United States Patent 7,943,754 (BIOINFORMATICALLY DETECTABLE GROUP OF NOVEL REGULATORY BACTERIAL AND BACTERIAL ASSOCIATED OLIGONUCLEOTIDES AND USES THEREOF) - sequence listing, part 50

SEQ ID NO: 1781029 - RNA, 19 nt, Salmonella enterica enterica serovar Typhi Ty2
cgcuuuuuuauuguuucua

SEQ ID NO: 1781030 - RNA, 21 nt, Salmonella enterica enterica serovar Typhi Ty2
cgcuuuuuuaacgauuucccc

SEQ ID NO: 1781031 - RNA, 14 nt, Salmonella enterica enterica serovar Typhi Ty2
cgcuuuuugcgcca

SEQ ID NO: 1781032 - RNA, 17 nt, Salmonella enterica enterica serovar Typhi Ty2
cgcuuuuugcuucgcca

SEQ ID NO: 1781033 - RNA, 13 nt, Salmonella enterica enterica serovar Typhi Ty2
cgcuggcgcugca

SEQ ID NO: 1781034 - RNA, 20 nt, Salmonella enterica enterica serovar Typhi Ty2
cgcuggcgcaaagaaggcau

SEQ ID NO: 1781035 - RNA, 23 nt, Salmonella enterica enterica serovar Typhi Ty2
cgcuggagccuguuccagcugcg

SEQ ID NO: 1781036 - RNA, 23 nt, Salmonella enterica enterica serovar Typhi Ty2
cgcuggaaguaugccucgcgcac

SEQ ID NO: 1781037 - RNA, 23 nt, Salmonella enterica enterica serovar Typhi Ty2
cgcuggacgucgucaccacggug

SEQ ID NO: 1781038 - RNA, 13 nt, Salmonella enterica enterica serovar Typhi Ty2
cgcuggacauuaa

SEQ ID NO: 1781039 - RNA, 23 nt, Salmonella enterica enterica serovar Typhi Ty2
cgcugcucauuuaugcgcugggc

SEQ ID NO: 1781040 - RNA, 15 nt, Salmonella enterica enterica serovar Typhi Ty2
cgcugcguggcgggc

SEQ ID NO: 1781041 - RNA, 17 nt, Salmonella enterica enterica serovar Typhi Ty2
cgcugcggucaggaaug

SEQ ID NO: 1781042 - RNA, 23 nt, Salmonella enterica enterica serovar Typhi Ty2
cgcugcgcuuaccgggccgacag

SEQ ID NO: 1781043 - RNA, 19 nt, Salmonella enterica enterica serovar Typhi Ty2
cgcugcgcuuaccgggccu

SEQ ID NO: 1781044 - RNA, 18 nt, Salmonella enterica enterica serovar Typhi Ty2
cgcugcgcuuaccgggcc

SEQ ID NO: 1781045 - RNA, 14 nt, Salmonella enterica enterica serovar Typhi Ty2
cgcugccgcccuuu

SEQ ID NO: 1781046 - RNA, 15 nt, Salmonella enterica enterica serovar Typhi Ty2
cgcugcgaagugaau

SEQ ID NO: 1781047 - RNA, 23 nt, Salmonella enterica enterica serovar Typhi Ty2
cgcugcgcauuagcaauaaucuc

SEQ ID NO: 1781048 - RNA, 22 nt, Salmonella enterica enterica serovar Typhi Ty2
cgcugagucagaaacggccugg

SEQ ID NO: 1781049 - RNA, 21 nt, Salmonella enterica enterica serovar Typhi Ty2
cgcugagucauccuuccccca

SEQ ID NO: 1781050 - RNA, 16 nt, Salmonella enterica enterica serovar Typhi Ty2
cgcugauagccacggc

SEQ ID NO: 1781051 - RNA, 22 nt, Salmonella enterica enterica serovar Typhi Ty2
cgcugaccgcgcuguaucacuu

SEQ ID NO: 1781052 - RNA, 17 nt, Salmonella enterica enterica serovar Typhi Ty2
cgcugaugcagcuugca

SEQ ID NO: 1781053 - RNA, 15 nt, Salmonella enterica enterica serovar Typhi Ty2
cgcugcccugacucg

SEQ ID NO: 1781054 - RNA, 16 nt, Salmonella enterica enterica serovar Typhi Ty2
cgcucaggcgcgcgcu

SEQ ID NO: 1781055 - RNA, 16 nt, Salmonella enterica enterica serovar Typhi Ty2
cgcucuaucgccgccc

SEQ ID NO: 1781056 - RNA, 19 nt, Salmonella enterica enterica serovar Typhi Ty2
cgcucuauauccugcccuu

SEQ ID NO: 1781057 - RNA, 18 nt, Salmonella enterica enterica serovar Typhi Ty2
cgcucuaucaccgcccgc

SEQ ID NO: 1781058 - RNA, 14 nt, Salmonella enterica enterica serovar Typhi Ty2
cgcucuaucgccug

SEQ ID NO: 1781059 - RNA, 12 nt, Salmonella enterica enterica serovar Typhi Ty2
cgcucuauucca

SEQ ID NO: 1781060 - RNA, 18 nt, Salmonella enterica enterica serovar Typhi Ty2
cgcucuaucgccgcccgc

SEQ ID NO: 1781061 - RNA, 22 nt, Salmonella enterica enterica serovar Typhi Ty2
cgcucucauagccgacccgcau

SEQ ID NO: 1781062 - RNA, 22 nt, Salmonella enterica enterica serovar Typhi Ty2
cgcucucgccgcgcuccaucau

SEQ ID NO: 1781063 - RNA, 13 nt, Salmonella enterica enterica serovar Typhi Ty2
cgcucugccuuuu

SEQ ID NO: 1781064 - RNA, 12 nt, Salmonella enterica enterica serovar Typhi Ty2
cgggcggcggcu

SEQ ID NO: 1781065 - RNA, 17 nt, Salmonella enterica enterica serovar Typhi Ty2
cgggcggcugucccaga

SEQ ID NO: 1781066 - RNA, 22 nt, Salmonella enterica enterica serovar Typhi Ty2
cgggcgucacccgccggcagca

SEQ ID NO: 1781067 - RNA, 19 nt, Salmonella enterica enterica serovar Typhi Ty2
cgggcguauagccaggcag

SEQ ID NO: 1781068 - RNA, 13 nt, Salmonella enterica enterica serovar Typhi Ty2
cgggcucggcgcu

SEQ ID NO: 1781069 - RNA, 23 nt, Salmonella enterica enterica serovar Typhi Ty2
cgggcguuucacauuccggcgcg

SEQ ID NO: 1781070 - RNA, 19 nt, Salmonella enterica enterica serovar Typhi Ty2
cgggcuaaaugcccacggc

SEQ ID NO: 1781071 - RNA, 17 nt, Salmonella enterica enterica serovar Typhi Ty2
cgggcguuugcgcgcgc

SEQ ID NO: 1781072 - RNA, 20 nt, Salmonella enterica enterica serovar Typhi Ty2
cggguauggcaaugcccccu

SEQ ID NO: 1781073 - RNA, 19 nt, Salmonella enterica enterica serovar Typhi Ty2
cggguauccauugccagau

SEQ ID NO: 1781074 - RNA, 15 nt, Salmonella enterica enterica serovar Typhi Ty2
cggguagagcuuuuc

SEQ ID NO: 1781075 - RNA, 17 nt, Salmonella enterica enterica serovar Typhi Ty2
cggguagaaauuccuuc

SEQ ID NO: 1781076 - RNA, 13 nt, Salmonella enterica enterica serovar Typhi Ty2
cgggcuucaggau

SEQ ID NO: 1781077 - RNA, 23 nt, Salmonella enterica enterica serovar Typhi Ty2
cgggcuuccaguacgcugacgaa

SEQ ID NO: 1781078 - RNA, 23 nt, Salmonella enterica enterica serovar Typhi Ty2
cggggaaaauauuagcggcggca

SEQ ID NO: 1781079 - RNA, 13 nt, Salmonella enterica enterica serovar Typhi Ty2
cggggcgcaaaau

SEQ ID NO: 1781080 - RNA, 19 nt, Salmonella enterica enterica serovar Typhi Ty2
cgggcaggucgucuucuug

SEQ ID NO: 1781081 - RNA, 12 nt, Salmonella enterica enterica serovar Typhi Ty2
cgggcagggcug

SEQ ID NO: 1781082 - RNA, 18 nt, Salmonella enterica enterica serovar Typhi Ty2
cgggcauacucuccucca

SEQ ID NO: 1781083 - RNA, 23 nt, Salmonella enterica enterica serovar Typhi Ty2
cgggaauaacgcgagaagaagaa

SEQ ID NO: 1781084 - RNA, 15 nt, Salmonella enterica enterica serovar Typhi Ty2
cgggaaguccuucuc

SEQ ID NO: 1781085 - RNA, 17 nt, Salmonella enterica enterica serovar Typhi Ty2
cggcuuuuugccgggcg

SEQ ID NO: 1781086 - RNA, 15 nt, Salmonella enterica enterica serovar Typhi Ty2
cgggcacgcugacca

SEQ ID NO: 1781087 - RNA, 23 nt, Salmonella enterica enterica serovar Typhi Ty2
cgggccuacaaaaucgcccaggc

SEQ ID NO: 1781088 - RNA, 16 nt, Salmonella enterica enterica serovar Typhi Ty2
cgggccgccgcagcag

SEQ ID NO: 1781089 - RNA, 21 nt, Salmonella enterica enterica serovar Typhi Ty2
cgggccgccgcagcagaugug

SEQ ID NO: 1781090 - RNA, 21 nt, Salmonella enterica enterica serovar Typhi Ty2
cgggccgccaucuccggcagc

SEQ ID NO: 1781091 - RNA, 16 nt, Salmonella enterica enterica serovar Typhi Ty2
cgggcgauaaaccagc

SEQ ID NO: 1781092 - RNA, 15 nt, Salmonella enterica enterica serovar Typhi Ty2
cgggcgauaaaccag

SEQ ID NO: 1781093 - RNA, 13 nt, Salmonella enterica enterica serovar Typhi Ty2
cgggccugccagg

SEQ ID NO: 1781094 - RNA, 17 nt, Salmonella enterica enterica serovar Typhi Ty2
cgggccugagcgcgcag

SEQ ID NO: 1781095 - RNA, 12 nt, Salmonella enterica enterica serovar Typhi Ty2
cgggccugugcc

SEQ ID NO: 1781096 - RNA, 15 nt, Salmonella enterica enterica serovar Typhi Ty2
cgggcgaccacccgc

SEQ ID NO: 1781097 - RNA, 17 nt, Salmonella enterica enterica serovar Typhi Ty2
cgggcgacacgcgcgcu

SEQ ID NO: 1781098 - RNA, 21 nt, Salmonella enterica enterica serovar Typhi Ty2
cggcuuauccggccugcacga

SEQ ID NO: 1781099 - RNA, 20 nt, Salmonella enterica enterica serovar Typhi Ty2
cggcuuacugcuucgcgccu

SEQ ID NO: 1781100 - RNA, 19 nt, Salmonella enterica enterica serovar Typhi Ty2
cggcuuaaugcccggcccg

SEQ ID NO: 1781101 - RNA, 18 nt, Salmonella enterica enterica serovar Typhi Ty2
cggcuucacgccauccag

SEQ ID NO: 1781102 - RNA, 16 nt, Salmonella enterica enterica serovar Typhi Ty2
cggcuucagcggcgca

SEQ ID NO: 1781103 - RNA, 16 nt, Salmonella enterica enterica serovar Typhi Ty2
cggcuuuccgcaccgc

SEQ ID NO: 1781104 - RNA, 13 nt, Salmonella enterica enterica serovar Typhi Ty2
cggcuguagccag

SEQ ID NO: 1781105 - RNA, 12 nt, Salmonella enterica enterica serovar Typhi Ty2
cggcuguauaca

SEQ ID NO: 1781106 - RNA, 19 nt, Salmonella enterica enterica serovar Typhi Ty2
cggcuguagccagccugaa

SEQ ID NO: 1781107 - RNA, 23 nt, Salmonella enterica enterica serovar Typhi Ty2
cggcuguaccuuaaccgggcgcu

SEQ ID NO: 1781108 - RNA, 14 nt, Salmonella enterica enterica serovar Typhi Ty2
cggcugguaagaga

SEQ ID NO: 1781109 - RNA, 16 nt, Salmonella enterica enterica serovar Typhi Ty2
cggcugcgccugcggg

SEQ ID NO: 1781110 - RNA, 19 nt, Salmonella enterica enterica serovar Typhi Ty2
cggcugcgccuuauccggc

SEQ ID NO: 1781111 - RNA, 23 nt, Salmonella enterica enterica serovar Typhi Ty2
cggcugccuuuuuuaauggcgcu

SEQ ID NO: 1781112 - RNA, 13 nt, Salmonella enterica enterica serovar Typhi Ty2
cggcucauccagc

SEQ ID NO: 1781113 - RNA, 13 nt, Salmonella enterica enterica serovar Typhi Ty2
cggcucagcaauc

SEQ ID NO: 1781114 - RNA, 17 nt, Salmonella enterica enterica serovar Typhi Ty2
cggcucgaacuguucug

SEQ ID NO: 1781115 - RNA, 16 nt, Salmonella enterica enterica serovar Typhi Ty2
cggcuagcgcaguuug

SEQ ID NO: 1781116 - RNA, 22 nt, Salmonella enterica enterica serovar Typhi Ty2
cggcuacugccagcgucgcuga

SEQ ID NO: 1781117 - RNA, 16 nt, Salmonella enterica enterica serovar Typhi Ty2
cggcuaccgaaggcgc

SEQ ID NO: 1781118 - RNA, 16 nt, Salmonella enterica enterica serovar Typhi Ty2
cggcuaacgccugauc

SEQ ID NO: 1781119 - RNA, 22 nt, Salmonella enterica enterica serovar Typhi Ty2
cggcucaccagcugacgcagca

SEQ ID NO: 1781120 - RNA, 14 nt, Salmonella enterica enterica serovar Typhi Ty2
cggcgugcgcugca

SEQ ID NO: 1781121 - RNA, 21 nt, Salmonella enterica enterica serovar Typhi Ty2
cggcguagccgccgagcgccg

SEQ ID NO: 1781122 - RNA, 22 nt, Salmonella enterica enterica serovar Typhi Ty2
cggcguguaaacagaugcucac

SEQ ID NO: 1781123 - RNA, 18 nt, Salmonella enterica enterica serovar Typhi Ty2
cggcguuuuuuccugcug

SEQ ID NO: 1781124 - RNA, 15 nt, Salmonella enterica enterica serovar Typhi Ty2
cggcguuccgcccag

SEQ ID NO: 1781125 - RNA, 20 nt, Salmonella enterica enterica serovar Typhi Ty2
cggcuaccccggcgcggcgc

SEQ ID NO: 1781126 - RNA, 20 nt, Salmonella enterica enterica serovar Typhi Ty2
cggcguuacccgucuggcgc

SEQ ID NO: 1781127 - RNA, 22 nt, Salmonella enterica enterica serovar Typhi Ty2
cggcguuauacgccugccuggu

SEQ ID NO: 1781128 - RNA, 13 nt, Salmonella enterica enterica serovar Typhi Ty2
cggcggucgccgc

SEQ ID NO: 1781129 - RNA, 14 nt, Salmonella enterica enterica serovar Typhi Ty2
cggcggucagccag

SEQ ID NO: 1781130 - RNA, 19 nt, Salmonella enterica enterica serovar Typhi Ty2
cggcguaagaucgcggggc

SEQ ID NO: 1781131 - RNA, 15 nt, Salmonella enterica enterica serovar Typhi Ty2
cggcguaacccagug

SEQ ID NO: 1781132 - RNA, 15 nt, Salmonella enterica enterica serovar Typhi Ty2
cggcguaaacgccuu

SEQ ID NO: 1781133 - RNA, 21 nt, Salmonella enterica enterica serovar Typhi Ty2
cggcggagacagaacaggaug

SEQ ID NO: 1781134 - RNA, 15 nt, Salmonella enterica enterica serovar Typhi Ty2
cggccuguuuuucug

SEQ ID NO: 1781135 - RNA, 17 nt, Salmonella enterica enterica serovar Typhi Ty2
cggcgcgcucuuuuucu

SEQ ID NO: 1781136 - RNA, 16 nt, Salmonella enterica enterica serovar Typhi Ty2
cggcgcgcugccgccc

SEQ ID NO: 1781137 - RNA, 13 nt, Salmonella enterica enterica serovar Typhi Ty2
cggcgcggaaggg

SEQ ID NO: 1781138 - RNA, 16 nt, Salmonella enterica enterica serovar Typhi Ty2
cggccuugccgccagc

SEQ ID NO: 1781139 - RNA, 19 nt, Salmonella enterica enterica serovar Typhi Ty2
cggcgcguuuuggcagaca

SEQ ID NO: 1781140 - RNA, 14 nt, Salmonella enterica enterica serovar Typhi Ty2
cggcgcucgccagc

SEQ ID NO: 1781141 - RNA, 19 nt, Salmonella enterica enterica serovar Typhi Ty2
cggcgcggauagucauaau

SEQ ID NO: 1781142 - RNA, 13 nt, Salmonella enterica enterica serovar Typhi Ty2
cggcgcggcauca

SEQ ID NO: 1781143 - RNA, 21 nt, Salmonella enterica enterica serovar Typhi Ty2
cgucacccgccggcagcagcu

SEQ ID NO: 1781144 - RNA, 19 nt, Salmonella enterica enterica serovar Typhi Ty2
cgucacccgccggcagcag

SEQ ID NO: 1781145 - RNA, 15 nt, Salmonella enterica enterica serovar Typhi Ty2
cgucaccgaauagcg

SEQ ID NO: 1781146 - RNA, 16 nt, Salmonella enterica enterica serovar Typhi Ty2
cgucacccgccggcag

SEQ ID NO: 1781147 - RNA, 22 nt, Salmonella enterica enterica serovar Typhi Ty2
cgucaccacgguguaccccgcc

SEQ ID NO: 1781148 - RNA, 17 nt, Salmonella enterica enterica serovar Typhi Ty2
cgucacccgccggcagc

SEQ ID NO: 1781149 - RNA, 15 nt, Salmonella enterica enterica serovar Typhi Ty2
cgucaccgggcugca

SEQ ID NO: 1781150 - RNA, 15 nt, Salmonella enterica enterica serovar Typhi Ty2
cgucaccgccgcgcu

SEQ ID NO: 1781151 - RNA, 17 nt, Salmonella enterica enterica serovar Typhi Ty2
cgucacgcaacaggccg

SEQ ID NO: 1781152 - RNA, 12 nt, Salmonella enterica enterica serovar Typhi Ty2
cgucacgaccgg

SEQ ID NO: 1781153 - RNA, 14 nt, Salmonella enterica enterica serovar Typhi Ty2
cgucacgaccggcg

SEQ ID NO: 1781154 - RNA, 13 nt, Salmonella enterica enterica serovar Typhi Ty2
cgucaaagaaaac

SEQ ID NO: 1781155 - RNA, 21 nt, Salmonella enterica enterica serovar Typhi Ty2
cgucaaauagagaaaauaaca

SEQ ID NO: 1781156 - RNA, 14 nt, Salmonella enterica enterica serovar Typhi Ty2
cgucaacgaccaga

SEQ ID NO: 1781157 - RNA, 19 nt, Salmonella enterica enterica serovar Typhi Ty2
cgucaaguagccaguuuuc

SEQ ID NO: 1781158 - RNA, 14 nt, Salmonella enterica enterica serovar Typhi Ty2
cgucaagaucgcgc

SEQ ID NO: 1781159 - RNA, 14 nt, Salmonella enterica enterica serovar Typhi Ty2
cgucacagaccccg

SEQ ID NO: 1781160 - RNA, 21 nt, Salmonella enterica enterica serovar Typhi Ty2
cgucacaauaucgagaugacc

SEQ ID NO: 1781161 - RNA, 20 nt, Salmonella enterica enterica serovar Typhi Ty2
cgucaccaccgcaggcagcg

SEQ ID NO: 1781162 - RNA, 23 nt, Salmonella enterica enterica serovar Typhi Ty2
cgucacaaaaacacccgcagccg

SEQ ID NO: 1781163 - RNA, 15 nt, Salmonella enterica enterica serovar Typhi Ty2
cgucaaugugaaucc

SEQ ID NO: 1781164 - RNA, 21 nt, Salmonella enterica enterica serovar Typhi Ty2
cgucaaucaggaaagagccgc

SEQ ID NO: 1781165 - RNA, 18 nt, Salmonella enterica enterica serovar Typhi Ty2
cgucaucgggcuguuauu

SEQ ID NO: 1781166 - RNA, 14 nt, Salmonella enterica enterica serovar Typhi Ty2
cgucauccugcagg

SEQ ID NO: 1781167 - RNA, 18 nt, Salmonella enterica enterica serovar Typhi Ty2
cgucaucgcgcgcaggcc

SEQ ID NO: 1781168 - RNA, 18 nt, Salmonella enterica enterica serovar Typhi Ty2
cgucauccggcaaucaga

SEQ ID NO: 1781169 - RNA, 12 nt, Salmonella enterica enterica serovar Typhi Ty2
cgucaucaugcu

SEQ ID NO: 1781170 - RNA, 13 nt, Salmonella enterica enterica serovar Typhi Ty2
cgucagucgcucu

SEQ ID NO: 1781171 - RNA, 20 nt, Salmonella enterica enterica serovar Typhi Ty2
cgucaguaaacuuucagacc

SEQ ID NO: 1781172 - RNA, 15 nt, Salmonella enterica enterica serovar Typhi Ty2
cgucaguaaaagccc

SEQ ID NO: 1781173 - RNA, 18 nt, Salmonella enterica enterica serovar Typhi Ty2
cgucauauagccgcgcag

SEQ ID NO: 1781174 - RNA, 23 nt, Salmonella enterica enterica serovar Typhi Ty2
cgucaucaggccauuaacgccgc

SEQ ID NO: 1781175 - RNA, 22 nt, Salmonella enterica enterica serovar Typhi Ty2
cgucauacccgcgcucuccggc

SEQ ID NO: 1781176 - RNA, 16 nt, Salmonella enterica enterica serovar Typhi Ty2
cgucauagccgcgcgu

SEQ ID NO: 1781177 - RNA, 19 nt, Salmonella enterica enterica serovar Typhi Ty2
cgucagacaggccugguua

SEQ ID NO: 1781178 - RNA, 15 nt, Salmonella enterica enterica serovar Typhi Ty2
cgucagcaacaccac

SEQ ID NO: 1781179 - RNA, 22 nt, Salmonella enterica enterica serovar Typhi Ty2
cgucagaugcguuuucugcauu

SEQ ID NO: 1781180 - RNA, 11 nt, Salmonella enterica enterica serovar Typhi Ty2
cgucagccaga

SEQ ID NO: 1781181 - RNA, 13 nt, Salmonella enterica enterica serovar Typhi Ty2
cgucagcauggua

SEQ ID NO: 1781182 - RNA, 23 nt, Salmonella enterica enterica serovar Typhi Ty2
cgucagccacuucuuccagcggc

SEQ ID NO: 1781183 - RNA, 21 nt, Salmonella enterica enterica serovar Typhi Ty2
cgucaggccgccgcaaaagcc

SEQ ID NO: 1781184 - RNA, 22 nt, Salmonella enterica enterica serovar Typhi Ty2
cgucaggcgaaguuccgggcuc

SEQ ID NO: 1781185 - RNA, 20 nt, Salmonella enterica enterica serovar Typhi Ty2
cgucaggcgaaguuccgggc

SEQ ID NO: 1781186 - RNA, 22 nt, Salmonella enterica enterica serovar Typhi Ty2
cgucaggcuguuguucuuuucu

SEQ ID NO: 1781187 - RNA, 15 nt, Salmonella enterica enterica serovar Typhi Ty2
cgucagcgccuccgc

SEQ ID NO: 1781188 - RNA, 19 nt, Salmonella enterica enterica serovar Typhi Ty2
cgucagcgcauaccggcca

SEQ ID NO: 1781189 - RNA, 17 nt, Salmonella enterica enterica serovar Typhi Ty2
cguauuucacuuuugcc

SEQ ID NO: 1781190 - RNA, 16 nt, Salmonella enterica enterica serovar Typhi Ty2
cgucaaacaguuccug

SEQ ID NO: 1781191 - RNA, 15 nt, Salmonella enterica enterica serovar Typhi Ty2
cgucaaacaguucag

SEQ ID NO: 1781192 - RNA, 14 nt, Salmonella enterica enterica serovar Typhi Ty2
cguauugagcugga

SEQ ID NO: 1781193 - RNA, 19 nt, Salmonella enterica enterica serovar Typhi Ty2
cguauuccacggaauacga

SEQ ID NO: 1781194 - RNA, 16 nt, Salmonella enterica enterica serovar Typhi Ty2
cguauucaccucccug

SEQ ID NO: 1781195 - RNA, 17 nt, Salmonella enterica enterica serovar Typhi Ty2
cguauucggaauaaugu

SEQ ID NO: 1781196 - RNA, 10 nt, Salmonella enterica enterica serovar Typhi Ty2
cguaucuucc

SEQ ID NO: 1781197 - RNA, 21 nt, Salmonella enterica enterica serovar Typhi Ty2
cguaugauuuucuuauuacaa

SEQ ID NO: 1781198 - RNA, 17 nt, Salmonella enterica enterica serovar Typhi Ty2
cguaucgcccagauggc

SEQ ID NO: 1781199 - RNA, 17 nt, Salmonella enterica enterica serovar Typhi Ty2
cguaucugucccagccu

SEQ ID NO: 1781200 - RNA, 20 nt, Salmonella enterica enterica serovar Typhi Ty2
cguauuaucaaaucuucauu

SEQ ID NO: 1781201 - RNA, 12 nt, Salmonella enterica enterica serovar Typhi Ty2
cguauuacaagu

SEQ ID NO: 1781202 - RNA, 13 nt, Salmonella enterica enterica serovar Typhi Ty2
cguauuagauaag

SEQ ID NO: 1781203 - RNA, 14 nt, Salmonella enterica enterica serovar Typhi Ty2
cguaugcagccagg

SEQ ID NO: 1781204 - RNA, 18 nt, Salmonella enterica enterica serovar Typhi Ty2
cguauaucgcgauaaacu

SEQ ID NO: 1781205 - RNA, 14 nt, Salmonella enterica enterica serovar Typhi Ty2
cguauaauuaagcu

SEQ ID NO: 1781206 - RNA, 15 nt, Salmonella enterica enterica serovar Typhi Ty2
cguauaauccagcuu

SEQ ID NO: 1781207 - RNA, 22 nt, Salmonella enterica enterica serovar Typhi Ty2
cguaguagucaggaucgcuggc

SEQ ID NO: 1781208 - RNA, 20 nt, Salmonella enterica enterica serovar Typhi Ty2
cguaguagguauccagcaga

SEQ ID NO: 1781209 - RNA, 15 nt, Salmonella enterica enterica serovar Typhi Ty2
cguaguggcauggca

SEQ ID NO: 1781210 - RNA, 14 nt, Salmonella enterica enterica serovar Typhi Ty2
cguaacguaaccug

SEQ ID NO: 1781211 - RNA, 16 nt, Salmonella enterica enterica serovar Typhi Ty2
cguaacgucguaaauu

SEQ ID NO: 1781212 - RNA, 15 nt, Salmonella enterica enterica serovar Typhi Ty2
cguaacucggcagcg

SEQ ID NO: 1781213 - RNA, 15 nt, Salmonella enterica enterica serovar Typhi Ty2
cguagaacgggccga

SEQ ID NO: 1781214 - RNA, 16 nt, Salmonella enterica enterica serovar Typhi Ty2
cguagaccgcccagga

SEQ ID NO: 1781215 - RNA, 18 nt, Salmonella enterica enterica serovar Typhi Ty2
cguagauuuucaucauau

SEQ ID NO: 1781216 - RNA, 24 nt, Salmonella enterica enterica serovar Typhi Ty2
cguagcaucucuucgacaucuuca

SEQ ID NO: 1781217 - RNA, 14 nt, Salmonella enterica enterica serovar Typhi Ty2
cguagccgcgcgcc

SEQ ID NO: 1781218 - RNA, 17 nt, Salmonella enterica enterica serovar Typhi Ty2
cguagccgccgagcgcc

SEQ ID NO: 1781219 - RNA, 16 nt, Salmonella enterica enterica serovar Typhi Ty2
cguagccgcagaacca

SEQ ID NO: 1781220 - RNA, 18 nt, Salmonella enterica enterica serovar Typhi Ty2
cguagccgcagaaccauu

SEQ ID NO: 1781221 - RNA, 19 nt, Salmonella enterica enterica serovar Typhi Ty2
cguagcccagcgccgcauc

SEQ ID NO: 1781222 - RNA, 13 nt, Salmonella enterica enterica serovar Typhi Ty2
cguaggcggcgga

SEQ ID NO: 1781223 - RNA, 13 nt, Salmonella enterica enterica serovar Typhi Ty2
cguagguaagaua

SEQ ID NO: 1781224 - RNA, 21 nt, Salmonella enterica enterica serovar Typhi Ty2
cguagccgcuuacucagccag

SEQ ID NO: 1781225 - RNA, 22 nt, Salmonella enterica enterica serovar Typhi Ty2
cguagccgcuuacucagccaga

SEQ ID NO: 1781226 - RNA, 18 nt, Salmonella enterica enterica serovar Typhi Ty2
cguagcgagaaggcuuug

SEQ ID NO: 1781227 - RNA, 21 nt, Salmonella enterica enterica serovar Typhi Ty2
cguagcuggucgccagcgccg

SEQ ID NO: 1781228 - RNA, 23 nt, Salmonella enterica enterica serovar Typhi Ty2
cggugaugaucaauaacgccggu

SEQ ID NO: 1781229 - RNA, 22 nt, Salmonella enterica enterica serovar Typhi Ty2
cggugaugcgccugucuccagc

SEQ ID NO: 1781230 - RNA, 19 nt, Salmonella enterica enterica serovar Typhi Ty2
cggugacggaaaccagcau

SEQ ID NO: 1781231 - RNA, 14 nt, Salmonella enterica enterica serovar Typhi Ty2
cggugaccugccuu

SEQ ID NO: 1781232 - RNA, 17 nt, Salmonella enterica enterica serovar Typhi Ty2
cggugagaaacgcgcca

SEQ ID NO: 1781233 - RNA, 22 nt, Salmonella enterica enterica serovar Typhi Ty2
cggucgagcuuuugcugcgcca

SEQ ID NO: 1781234 - RNA, 21 nt, Salmonella enterica enterica serovar Typhi Ty2
cggucgggauauaugcaaaac

SEQ ID NO: 1781235 - RNA, 13 nt, Salmonella enterica enterica serovar Typhi Ty2
cggucgcgcgcag

SEQ ID NO: 1781236 - RNA, 17 nt, Salmonella enterica enterica serovar Typhi Ty2
cggucgcggagaucauc

SEQ ID NO: 1781237 - RNA, 15 nt, Salmonella enterica enterica serovar Typhi Ty2
cggucccuggcuggu

SEQ ID NO: 1781238 - RNA, 21 nt, Salmonella enterica enterica serovar Typhi Ty2
cgguccguuuucgcccccagc

SEQ ID NO: 1781239 - RNA, 17 nt, Salmonella enterica enterica serovar Typhi Ty2
cggucauuaauccccgg

SEQ ID NO: 1781240 - RNA, 17 nt, Salmonella enterica enterica serovar Typhi Ty2
cggucauguuccaacaa

SEQ ID NO: 1781241 - RNA, 15 nt, Salmonella enterica enterica serovar Typhi Ty2
cggucagguagcaga

SEQ ID NO: 1781242 - RNA, 14 nt, Salmonella enterica enterica serovar Typhi Ty2
cggucagguagcag

SEQ ID NO: 1781243 - RNA, 22 nt, Salmonella enterica enterica serovar Typhi Ty2
cggucagggugaaucccgccau

SEQ ID NO: 1781244 - RNA, 22 nt, Salmonella enterica enterica serovar Typhi Ty2
cggucaggaagcggacuaccug

SEQ ID NO: 1781245 - RNA, 22 nt, Salmonella enterica enterica serovar Typhi Ty2
cggucaguguuuccauacauuu

SEQ ID NO: 1781246 - RNA, 20 nt, Salmonella enterica enterica serovar Typhi Ty2
cggucaacugaauuucaucc

SEQ ID NO: 1781247 - RNA, 20 nt, Salmonella enterica enterica serovar Typhi Ty2
cggucaacguuaacugcugc

SEQ ID NO: 1781248 - RNA, 16 nt, Salmonella enterica enterica serovar Typhi Ty2
cggucaacguuucccc

SEQ ID NO: 1781249 - RNA, 22 nt, Salmonella enterica enterica serovar Typhi Ty2
cgggucggacgagcgcgucagc

SEQ ID NO: 1781250 - RNA, 16 nt, Salmonella enterica enterica serovar Typhi Ty2
cgggucgcgcgccgca

SEQ ID NO: 1781251 - RNA, 15 nt, Salmonella enterica enterica serovar Typhi Ty2
cggucaauacaucac

SEQ ID NO: 1781252 - RNA, 18 nt, Salmonella enterica enterica serovar Typhi Ty2
cggugccaaauguauacu

SEQ ID NO: 1781253 - RNA, 19 nt, Salmonella enterica enterica serovar Typhi Ty2
cggugccauuccagccggu

SEQ ID NO: 1781254 - RNA, 14 nt, Salmonella enterica enterica serovar Typhi Ty2
cgguguccggcgca

SEQ ID NO: 1781255 - RNA, 14 nt, Salmonella enterica enterica serovar Typhi Ty2
cggugucagacacc

SEQ ID NO: 1781256 - RNA, 18 nt, Salmonella enterica enterica serovar Typhi Ty2
cgguggguagcggcaauu

SEQ ID NO: 1781257 - RNA, 14 nt, Salmonella enterica enterica serovar Typhi Ty2
cgguuauaauaaua

SEQ ID NO: 1781258 - RNA, 13 nt, Salmonella enterica enterica serovar Typhi Ty2
cgguuacuccuua

SEQ ID NO: 1781259 - RNA, 14 nt, Salmonella enterica enterica serovar Typhi Ty2
cguaaagcauggcu

SEQ ID NO: 1781260 - RNA, 19 nt, Salmonella enterica enterica serovar Typhi Ty2
cguaaaccccuucaccgcu

SEQ ID NO: 1781261 - RNA, 21 nt, Salmonella enterica enterica serovar Typhi Ty2
cguaaaccccuucaccgcuuu

SEQ ID NO: 1781262 - RNA, 12 nt, Salmonella enterica enterica serovar Typhi Ty2
cguaacccagug

SEQ ID NO: 1781263 - RNA, 12 nt, Salmonella enterica enterica serovar Typhi Ty2
cguaaagcuggc

SEQ ID NO: 1781264 - RNA, 14 nt, Salmonella enterica enterica serovar Typhi Ty2
cguaaccgcaaaug

SEQ ID NO: 1781265 - RNA, 17 nt, Salmonella enterica enterica serovar Typhi Ty2
cgguuuugcgccauccu

SEQ ID NO: 1781266 - RNA, 22 nt, Salmonella enterica enterica serovar Typhi Ty2
cgguuuuauccccuucaggaau

SEQ ID NO: 1781267 - RNA, 21 nt, Salmonella enterica enterica serovar Typhi Ty2
cgguuuuauuaacgugcugcc

SEQ ID NO: 1781268 - RNA, 14 nt, Salmonella enterica enterica serovar Typhi Ty2
cgguuuuccggguc

SEQ ID NO: 1781269 - RNA, 22 nt, Salmonella enterica enterica serovar Typhi Ty2
cgguuuuauaguagcgcgcgcu

SEQ ID NO: 1781270 - RNA, 20 nt, Salmonella enterica enterica serovar Typhi Ty2
cgguuugggcgcgaaacugc

SEQ ID NO: 1781271 - RNA, 11 nt, Salmonella enterica enterica serovar Typhi Ty2
cgguuuauccc

SEQ ID NO: 1781272 - RNA, 20 nt, Salmonella enterica enterica serovar Typhi Ty2
cgguuucaacuuccaccacc

SEQ ID NO: 1781273 - RNA, 21 nt, Salmonella enterica enterica serovar Typhi Ty2
cgguuucaacuuccaccaccu

SEQ ID NO: 1781274 - RNA, 20 nt, Salmonella enterica enterica serovar Typhi Ty2
cgguuuccggcauccagcgc

SEQ ID NO: 1781275 - RNA, 18 nt, Salmonella enterica enterica serovar Typhi Ty2
cgguuaucuggcgcaacc

SEQ ID NO: 1781276 - RNA, 17 nt, Salmonella enterica enterica serovar Typhi Ty2
cgguuauccuccggguc

SEQ ID NO: 1781277 - RNA, 15 nt, Salmonella enterica enterica serovar Typhi Ty2
cgguuggcuccagua

SEQ ID NO: 1781278 - RNA, 19 nt, Salmonella enterica enterica serovar Typhi Ty2
cccgccgggcgucacccgc

SEQ ID NO: 1781279 - RNA, 20 nt, Salmonella enterica enterica serovar Typhi Ty2
cccgccgggcgucacccgcc

SEQ ID NO: 1781280 - RNA, 16 nt, Salmonella enterica enterica serovar Typhi Ty2
cccgccugagcgcgca

SEQ ID NO: 1781281 - RNA, 14 nt, Salmonella enterica enterica serovar Typhi Ty2
cccgccuccgucac

SEQ ID NO: 1781282 - RNA, 15 nt, Salmonella enterica enterica serovar Typhi Ty2
cccgccgcgcggccc

SEQ ID NO: 1781283 - RNA, 16 nt, Salmonella enterica enterica serovar Typhi Ty2
cccgccgcgcggcccc

SEQ ID NO: 1781284 - RNA, 22 nt, Salmonella enterica enterica serovar Typhi Ty2
cccgccgcggcgguuauccucc

SEQ ID NO: 1781285 - RNA, 19 nt, Salmonella enterica enterica serovar Typhi Ty2
cccgccgcacacgccgugc

SEQ ID NO: 1781286 - RNA, 21 nt, Salmonella enterica enterica serovar Typhi Ty2
cccgccgcacacgccgugcac

SEQ ID NO: 1781287 - RNA, 15 nt, Salmonella enterica enterica serovar Typhi Ty2
cccgccgccaccaug

SEQ ID NO: 1781288 - RNA, 17 nt, Salmonella enterica enterica serovar Typhi Ty2
cccgccgccagcaccgc

SEQ ID NO: 1781289 - RNA, 12 nt, Salmonella enterica enterica serovar Typhi Ty2
cccgccgccauu

SEQ ID NO: 1781290 - RNA, 13 nt, Salmonella enterica enterica serovar Typhi Ty2
cccgcgcaggcgg

SEQ ID NO: 1781291 - RNA, 15 nt, Salmonella enterica enterica serovar Typhi Ty2
cccgcgcagcgccag

SEQ ID NO: 1781292 - RNA, 21 nt, Salmonella enterica enterica serovar Typhi Ty2
cccgcgauaaaaauccugcuc

SEQ ID NO: 1781293 - RNA, 12 nt, Salmonella enterica enterica serovar Typhi Ty2
cccgcgccagca

SEQ ID NO: 1781294 - RNA, 18 nt, Salmonella enterica enterica serovar Typhi Ty2
cccgcgauaaaaauccug

SEQ ID NO: 1781295 - RNA, 14 nt, Salmonella enterica enterica serovar Typhi Ty2
cccgccugcugcaa

SEQ ID NO: 1781296 - RNA, 12 nt, Salmonella enterica enterica serovar Typhi Ty2
cccgccugcugc

SEQ ID NO: 1781297 - RNA, 21 nt, Salmonella enterica enterica serovar Typhi Ty2
cccgccuugcggcgccaggac

SEQ ID NO: 1781298 - RNA, 18 nt, Salmonella enterica enterica serovar Typhi Ty2
cccgccgaaggcaacgcc

SEQ ID NO: 1781299 - RNA, 22 nt, Salmonella enterica enterica serovar Typhi Ty2
cccgccgaaggcaacgccgcca

SEQ ID NO: 1781300 - RNA, 15 nt, Salmonella enterica enterica serovar Typhi Ty2
cccgcccugcccgcc

SEQ ID NO: 1781301 - RNA, 16 nt, Salmonella enterica enterica serovar Typhi Ty2
cccgcccugcccgcca

SEQ ID NO: 1781302 - RNA, 12 nt, Salmonella enterica enterica serovar Typhi Ty2
cccgcccugccc

SEQ ID NO: 1781303 - RNA, 23 nt, Salmonella enterica enterica serovar Typhi Ty2
cccgcccacaggcugcggcacgc

SEQ ID NO: 1781304 - RNA, 15 nt, Salmonella enterica enterica serovar Typhi Ty2
cccgcccagcauuac

SEQ ID NO: 1781305 - RNA, 15 nt, Salmonella enterica enterica serovar Typhi Ty2
cccgccagcacagca

SEQ ID NO: 1781306 - RNA, 12 nt, Salmonella enterica enterica serovar Typhi Ty2
cccgccagcaca

SEQ ID NO: 1781307 - RNA, 13 nt, Salmonella enterica enterica serovar Typhi Ty2
cccgccaggguau

SEQ ID NO: 1781308 - RNA, 19 nt, Salmonella enterica enterica serovar Typhi Ty2
cccgccaucguccagccau

SEQ ID NO: 1781309 - RNA, 14 nt, Salmonella enterica enterica serovar Typhi Ty2
cccgcccacaggcu

SEQ ID NO: 1781310 - RNA, 17 nt, Salmonella enterica enterica serovar Typhi Ty2
cccgcaucgccgcggcg

SEQ ID NO: 1781311 - RNA, 17 nt, Salmonella enterica enterica serovar Typhi Ty2
cccgcaggccuggcugg

SEQ ID NO: 1781312 - RNA, 13 nt, Salmonella enterica enterica serovar Typhi Ty2
cccgcaggccugg

SEQ ID NO: 1781313 - RNA, 17 nt, Salmonella enterica enterica serovar Typhi Ty2
cccgcaugguaaacgca

SEQ ID NO: 1781314 - RNA, 16 nt, Salmonella enterica enterica serovar Typhi Ty2
cccgcauuuuaaacga

SEQ ID NO: 1781315 - RNA, 17 nt, Salmonella enterica enterica serovar Typhi Ty2
cccgcauuuaacaggac

SEQ ID NO: 1781316 - RNA, 13 nt, Salmonella enterica enterica serovar Typhi Ty2
cccgccagaugca

SEQ ID NO: 1781317 - RNA, 13 nt, Salmonella enterica enterica serovar Typhi Ty2
cccggcaggcugg

SEQ ID NO: 1781318 - RNA, 21 nt, Salmonella enterica enterica serovar Typhi Ty2
cccggcaauuaccgccagcgg

SEQ ID NO: 1781319 - RNA, 12 nt, Salmonella enterica enterica serovar Typhi Ty2
cccggccacagc

SEQ ID NO: 1781320 - RNA, 17 nt, Salmonella enterica enterica serovar Typhi Ty2
cccggccacagcgccag

SEQ ID NO: 1781321 - RNA, 18 nt, Salmonella enterica enterica serovar Typhi Ty2
cccggagggguuuucgcc

SEQ ID NO: 1781322 - RNA, 20 nt, Salmonella enterica enterica serovar Typhi Ty2
cccggaucgcuaauuuuuaa

SEQ ID NO: 1781323 - RNA, 19 nt, Salmonella enterica enterica serovar Typhi Ty2
cccggagcggugaaacugu

SEQ ID NO: 1781324 - RNA, 17 nt, Salmonella enterica enterica serovar Typhi Ty2
cccggacaaggcgcgcc

SEQ ID NO: 1781325 - RNA, 22 nt, Salmonella enterica enterica serovar Typhi Ty2
cccggacaucauccccggcagg

SEQ ID NO: 1781326 - RNA, 17 nt, Salmonella enterica enterica serovar Typhi Ty2
cccggacaucauccccg

SEQ ID NO: 1781327 - RNA, 14 nt, Salmonella enterica enterica serovar Typhi Ty2
cccgcuuuaccgaa

SEQ ID NO: 1781328 - RNA, 20 nt, Salmonella enterica enterica serovar Typhi Ty2
cccgcggucauugagccgcu

SEQ ID NO: 1781329 - RNA, 16 nt, Salmonella enterica enterica serovar Typhi Ty2
cccgcgcuuuccagcc

SEQ ID NO: 1781330 - RNA, 13 nt, Salmonella enterica enterica serovar Typhi Ty2
cccgcgcucuccg

SEQ ID NO: 1781331 - RNA, 20 nt, Salmonella enterica enterica serovar Typhi Ty2
cccgcugucgggagccucuu

SEQ ID NO: 1781332 - RNA, 12 nt, Salmonella enterica enterica serovar Typhi Ty2
cccgcuggcgcg

SEQ ID NO: 1781333 - RNA, 21 nt, Salmonella enterica enterica serovar Typhi Ty2
cccgcuggcgcggggaucggu

SEQ ID NO: 1781334 - RNA, 23 nt, Salmonella enterica enterica serovar Typhi Ty2
cccgcucuucaguaaccagggag

SEQ ID NO: 1781335 - RNA, 13 nt, Salmonella enterica enterica serovar Typhi Ty2
cccgcugacgaug

SEQ ID NO: 1781336 - RNA, 15 nt, Salmonella enterica enterica serovar Typhi Ty2
cccgcuaucaccgcc

SEQ ID NO: 1781337 - RNA, 15 nt, Salmonella enterica enterica serovar Typhi Ty2
cccguagugauagca

SEQ ID NO: 1781338 - RNA, 23 nt, Salmonella enterica enterica serovar Typhi Ty2
cccgguuuaugcgguucucccgg

SEQ ID NO: 1781339 - RNA, 23 nt, Salmonella enterica enterica serovar Typhi Ty2
cccgguuugggcgcgaaacugcu

SEQ ID NO: 1781340 - RNA, 22 nt, Salmonella enterica enterica serovar Typhi Ty2
cccgguucgccgcuucaaaaac

SEQ ID NO: 1781341 - RNA, 22 nt, Salmonella enterica enterica serovar Typhi Ty2
cccguggugggguucccgagcg

SEQ ID NO: 1781342 - RNA, 18 nt, Salmonella enterica enterica serovar Typhi Ty2
cccguggcgggaugcccc

SEQ ID NO: 1781343 - RNA, 14 nt, Salmonella enterica enterica serovar Typhi Ty2
cccgucucuuuauc

SEQ ID NO: 1781344 - RNA, 16 nt, Salmonella enterica enterica serovar Typhi Ty2
cccguuucagccccuu

SEQ ID NO: 1781345 - RNA, 20 nt, Salmonella enterica enterica serovar Typhi Ty2
cccguuucagccccuugcug

SEQ ID NO: 1781346 - RNA, 15 nt, Salmonella enterica enterica serovar Typhi Ty2
cccguugucuucacc

SEQ ID NO: 1781347 - RNA, 15 nt, Salmonella enterica enterica serovar Typhi Ty2
cccguucucgccgcg

SEQ ID NO: 1781348 - RNA, 15 nt, Salmonella enterica enterica serovar Typhi Ty2
cccguuuuuuccagc

SEQ ID NO: 1781349 - RNA, 19 nt, Salmonella enterica enterica serovar Typhi Ty2
cccuaaggcagcaagguac

SEQ ID NO: 1781350 - RNA, 16 nt, Salmonella enterica enterica serovar Typhi Ty2
cccuaaggucacgccg

SEQ ID NO: 1781351 - RNA, 15 nt, Salmonella enterica enterica serovar Typhi Ty2
cccuacugcuuagcu

SEQ ID NO: 1781352 - RNA, 14 nt, Salmonella enterica enterica serovar Typhi Ty2
cccucaacgcgccc

SEQ ID NO: 1781353 - RNA, 23 nt, Salmonella enterica enterica serovar Typhi Ty2
cccucaaguuauguuauccccac

SEQ ID NO: 1781354 - RNA, 21 nt, Salmonella enterica enterica serovar Typhi Ty2
cccucaacgcccugcucccac

SEQ ID NO: 1781355 - RNA, 18 nt, Salmonella enterica enterica serovar Typhi Ty2
cccucaauaucuuugccu

SEQ ID NO: 1781356 - RNA, 15 nt, Salmonella enterica enterica serovar Typhi Ty2
cccuccaguagcagc

SEQ ID NO: 1781357 - RNA, 12 nt, Salmonella enterica enterica serovar Typhi Ty2
cccuccagccau

SEQ ID NO: 1781358 - RNA, 22 nt, Salmonella enterica enterica serovar Typhi Ty2
cccuccgcggauuguuuuacuu

SEQ ID NO: 1781359 - RNA, 16 nt, Salmonella enterica enterica serovar Typhi Ty2
cccuccggccagcgcc

SEQ ID NO: 1781360 - RNA, 19 nt, Salmonella enterica enterica serovar Typhi Ty2
cccgguaagcgcagcgcca

SEQ ID NO: 1781361 - RNA, 24 nt, Salmonella enterica enterica serovar Typhi Ty2
cccggcuuuuuuauugccuaagau

SEQ ID NO: 1781362 - RNA, 16 nt, Salmonella enterica enterica serovar Typhi Ty2
cccggugagcgccgcg

SEQ ID NO: 1781363 - RNA, 17 nt, Salmonella enterica enterica serovar Typhi Ty2
cccggucugucgguaaa

SEQ ID NO: 1781364 - RNA, 21 nt, Salmonella enterica enterica serovar Typhi Ty2
cccgguggcgccacgccaccg

SEQ ID NO: 1781365 - RNA, 12 nt, Salmonella enterica enterica serovar Typhi Ty2
cccgguggcggc

SEQ ID NO: 1781366 - RNA, 19 nt, Salmonella enterica enterica serovar Typhi Ty2
cccggugucaaagcgccag

SEQ ID NO: 1781367 - RNA, 11 nt, Salmonella enterica enterica serovar Typhi Ty2
cccggugggca

SEQ ID NO: 1781368 - RNA, 19 nt, Salmonella enterica enterica serovar Typhi Ty2
cccggucaacgcgccgcca

SEQ ID NO: 1781369 - RNA, 17 nt, Salmonella enterica enterica serovar Typhi Ty2
cccgguagccacaccca

SEQ ID NO: 1781370 - RNA, 16 nt, Salmonella enterica enterica serovar Typhi Ty2
cccggucauccagcgg

SEQ ID NO: 1781371 - RNA, 14 nt, Salmonella enterica enterica serovar Typhi Ty2
cccggucgcgccag

SEQ ID NO: 1781372 - RNA, 22 nt, Salmonella enterica enterica serovar Typhi Ty2
cccggcgcacuuccucucccac

SEQ ID NO: 1781373 - RNA, 16 nt, Salmonella enterica enterica serovar Typhi Ty2
cccggcgccagcucaa

SEQ ID NO: 1781374 - RNA, 22 nt, Salmonella enterica enterica serovar Typhi Ty2
cccggccuucgaacagcucauu

SEQ ID NO: 1781375 - RNA, 21 nt, Salmonella enterica enterica serovar Typhi Ty2
cccggccguuaccguggcggc

SEQ ID NO: 1781376 - RNA, 21 nt, Salmonella enterica enterica serovar Typhi Ty2
cccggcuuaccggcuaucagc

SEQ ID NO: 1781377 - RNA, 21 nt, Salmonella enterica enterica serovar Typhi Ty2
cccggcggguauggcaaugcc

SEQ ID NO: 1781378 - RNA, 21 nt, Salmonella enterica enterica serovar Typhi Ty2
cccggcggcgcgaugccugcc

SEQ ID NO: 1781379 - RNA, 12 nt, Salmonella enterica enterica serovar Typhi Ty2
cccggcgcgcca

SEQ ID NO: 1781380 - RNA, 21 nt, Salmonella enterica enterica serovar Typhi Ty2
ccauugaugccugcccaucua

SEQ ID NO: 1781381 - RNA, 16 nt, Salmonella enterica enterica serovar Typhi Ty2
ccauugaugccugccc

SEQ ID NO: 1781382 - RNA, 14 nt, Salmonella enterica enterica serovar Typhi Ty2
ccaucuuuuuucac

SEQ ID NO: 1781383 - RNA, 15 nt, Salmonella enterica enterica serovar Typhi Ty2
ccauuuuauccucuu

SEQ ID NO: 1781384 - RNA, 23 nt, Salmonella enterica enterica serovar Typhi Ty2
ccauuuuccuauggacauuggcc

SEQ ID NO: 1781385 - RNA, 15 nt, Salmonella enterica enterica serovar Typhi Ty2
ccauuuuaaauacac

SEQ ID NO: 1781386 - RNA, 17 nt, Salmonella enterica enterica serovar Typhi Ty2
ccauuugccagauagcg

SEQ ID NO: 1781387 - RNA, 12 nt, Salmonella enterica enterica serovar Typhi Ty2
cccaaaagguag

SEQ ID NO: 1781388 - RNA, 13 nt, Salmonella enterica enterica serovar Typhi Ty2
cccaaaauaauuc

SEQ ID NO: 1781389 - RNA, 13 nt, Salmonella enterica enterica serovar Typhi Ty2
cccaccaccgcca

SEQ ID NO: 1781390 - RNA, 19 nt, Salmonella enterica enterica serovar Typhi Ty2
cccacagcuugccguagcg

SEQ ID NO: 1781391 - RNA, 13 nt, Salmonella enterica enterica serovar Typhi Ty2
cccaccagcgcca

SEQ ID NO: 1781392 - RNA, 17 nt, Salmonella enterica enterica serovar Typhi Ty2
cccaccgccaaccgccc

SEQ ID NO: 1781393 - RNA, 15 nt, Salmonella enterica enterica serovar Typhi Ty2
cccacgcuuuuuuau

SEQ ID NO: 1781394 - RNA, 15 nt, Salmonella enterica enterica serovar Typhi Ty2
cccacgcccgccauc

SEQ ID NO: 1781395 - RNA, 19 nt, Salmonella enterica enterica serovar Typhi Ty2
cccacgcccgccaucgccg

SEQ ID NO: 1781396 - RNA, 15 nt, Salmonella enterica enterica serovar Typhi Ty2
cccaccggcccacgc

SEQ ID NO: 1781397 - RNA, 20 nt, Salmonella enterica enterica serovar Typhi Ty2
cccaccgcuggauauguuuu

SEQ ID NO: 1781398 - RNA, 21 nt, Salmonella enterica enterica serovar Typhi Ty2
cccaaacugcucguaaagcau

SEQ ID NO: 1781399 - RNA, 19 nt, Salmonella enterica enterica serovar Typhi Ty2
cccaaacgucguaaaaccu

SEQ ID NO: 1781400 - RNA, 23 nt, Salmonella enterica enterica serovar Typhi Ty2
cccaaaggaaagguccggcccgc

SEQ ID NO: 1781401 - RNA, 20 nt, Salmonella enterica enterica serovar Typhi Ty2
cccaaaugaaaaaucggcaa

SEQ ID NO: 1781402 - RNA, 20 nt, Salmonella enterica enterica serovar Typhi Ty2
cccaaauuaauuuauugacg

SEQ ID NO: 1781403 - RNA, 15 nt, Salmonella enterica enterica serovar Typhi Ty2
cccaacaugguugcu

SEQ ID NO: 1781404 - RNA, 12 nt, Salmonella enterica enterica serovar Typhi Ty2
cccaaccagugg

SEQ ID NO: 1781405 - RNA, 12 nt, Salmonella enterica enterica serovar Typhi Ty2
cccaaccagccc

SEQ ID NO: 1781406 - RNA, 14 nt, Salmonella enterica enterica serovar Typhi Ty2
cccaaccagcccag

SEQ ID NO: 1781407 - RNA, 23 nt, Salmonella enterica enterica serovar Typhi Ty2
cccaaccgccagccauugaugca

SEQ ID NO: 1781408 - RNA, 21 nt, Salmonella enterica enterica serovar Typhi Ty2
cccaaccaguggcggggcaga

SEQ ID NO: 1781409 - RNA, 22 nt, Salmonella enterica enterica serovar Typhi Ty2
cccacacaucacaaucuccaga

SEQ ID NO: 1781410 - RNA, 12 nt, Salmonella enterica enterica serovar Typhi Ty2
cccacaccauac

SEQ ID NO: 1781411 - RNA, 17 nt, Salmonella enterica enterica serovar Typhi Ty2
cccacacggccaccaua

SEQ ID NO: 1781412 - RNA, 14 nt, Salmonella enterica enterica serovar Typhi Ty2
cccacaccacagcc

SEQ ID NO: 1781413 - RNA, 13 nt, Salmonella enterica enterica serovar Typhi Ty2
cccagcagcagaa

SEQ ID NO: 1781414 - RNA, 14 nt, Salmonella enterica enterica serovar Typhi Ty2
cccagcagcagaua

SEQ ID NO: 1781415 - RNA, 15 nt, Salmonella enterica enterica serovar Typhi Ty2
cccagcagcagccgg

SEQ ID NO: 1781416 - RNA, 22 nt, Salmonella enterica enterica serovar Typhi Ty2
cccagccuuccuggucugccag

SEQ ID NO: 1781417 - RNA, 21 nt, Salmonella enterica enterica serovar Typhi Ty2
cccagccgugaauggucacau

SEQ ID NO: 1781418 - RNA, 19 nt, Salmonella enterica enterica serovar Typhi Ty2
cccagcaccgaaacagcac

SEQ ID NO: 1781419 - RNA, 22 nt, Salmonella enterica enterica serovar Typhi Ty2
cccagcacuaacagcagcagca

SEQ ID NO: 1781420 - RNA, 13 nt, Salmonella enterica enterica serovar Typhi Ty2
cccagcaccaacg

SEQ ID NO: 1781421 - RNA, 12 nt, Salmonella enterica enterica serovar Typhi Ty2
cccacuauuuuu

SEQ ID NO: 1781422 - RNA, 17 nt, Salmonella enterica enterica serovar Typhi Ty2
cccagcgaucccaguug

SEQ ID NO: 1781423 - RNA, 14 nt, Salmonella enterica enterica serovar Typhi Ty2
cccagcgcccccag

SEQ ID NO: 1781424 - RNA, 17 nt, Salmonella enterica enterica serovar Typhi Ty2
cccagcgcccccagcaa

SEQ ID NO: 1781425 - RNA, 13 nt, Salmonella enterica enterica serovar Typhi Ty2
cccagcgccagcc

SEQ ID NO: 1781426 - RNA, 18 nt, Salmonella enterica enterica serovar Typhi Ty2
cccagcgccagccgcgcc

SEQ ID NO: 1781427 - RNA, 22 nt, Salmonella enterica enterica serovar Typhi Ty2
cccagcgcgaauuugccccaga

SEQ ID NO: 1781428 - RNA, 12 nt, Salmonella enterica enterica serovar Typhi Ty2
cccagcgcgccg

SEQ ID NO: 1781429 - RNA, 20 nt, Salmonella enterica enterica serovar Typhi Ty2
cccagcgcgccgcagcgccg

SEQ ID NO: 1781430 - RNA, 23 nt, Salmonella enterica enterica serovar Typhi Ty2
cccagcggaugucggucaucagg

SEQ ID NO: 1781431 - RNA, 20 nt, Salmonella enterica enterica serovar Typhi Ty2
cccaggcauaaaaaaagcgc

SEQ ID NO: 1781432 - RNA, 13 nt, Salmonella enterica enterica serovar Typhi Ty2
cccaggccaaaac

SEQ ID NO: 1781433 - RNA, 18 nt, Salmonella enterica enterica serovar Typhi Ty2
cccaggccaugcgccgcg

SEQ ID NO: 1781434 - RNA, 12 nt, Salmonella enterica enterica serovar Typhi Ty2
cccaggccgcca

SEQ ID NO: 1781435 - RNA, 18 nt, Salmonella enterica enterica serovar Typhi Ty2
cccaggccgccaccgccu

SEQ ID NO: 1781436 - RNA, 21 nt, Salmonella enterica enterica serovar Typhi Ty2
cccaggccgccaccgccucgc

SEQ ID NO: 1781437 - RNA, 20 nt, Salmonella enterica enterica serovar Typhi Ty2
cccaggggcauauauuauua

SEQ ID NO: 1781438 - RNA, 22 nt, Salmonella enterica enterica serovar Typhi Ty2
cccaggauaguacugaccagac

SEQ ID NO: 1781439 - RNA, 19 nt, Salmonella enterica enterica serovar Typhi Ty2
cccaggauaguacugacca

SEQ ID NO: 1781440 - RNA, 21 nt, Salmonella enterica enterica serovar Typhi Ty2
cccagcucaugauagggcagc

SEQ ID NO: 1781441 - RNA, 22 nt, Salmonella enterica enterica serovar Typhi Ty2
cccagcucaugauagggcagca

SEQ ID NO: 1781442 - RNA, 21 nt, Salmonella enterica enterica serovar Typhi Ty2
cccaggcaaaugauuaucucc

SEQ ID NO: 1781443 - RNA, 17 nt, Salmonella enterica enterica serovar Typhi Ty2
cccagcguaccacgccg

SEQ ID NO: 1781444 - RNA, 20 nt, Salmonella enterica enterica serovar Typhi Ty2
ccccagaccgauauuuugcu

SEQ ID NO: 1781445 - RNA, 19 nt, Salmonella enterica enterica serovar Typhi Ty2
ccccagaaucccgccuugc

SEQ ID NO: 1781446 - RNA, 20 nt, Salmonella enterica enterica serovar Typhi Ty2
ccccagaugccguagccaag

SEQ ID NO: 1781447 - RNA, 20 nt, Salmonella enterica enterica serovar Typhi Ty2
cccccagaaugccgcccauc

SEQ ID NO: 1781448 - RNA, 17 nt, Salmonella enterica enterica serovar Typhi Ty2
cccccauggccccaugu

SEQ ID NO: 1781449 - RNA, 21 nt, Salmonella enterica enterica serovar Typhi Ty2
cccccgcacagcacauagaag

SEQ ID NO: 1781450 - RNA, 13 nt, Salmonella enterica enterica serovar Typhi Ty2
ccccccuaccgga

SEQ ID NO: 1781451 - RNA, 19 nt, Salmonella enterica enterica serovar Typhi Ty2
ccccgaguaacaccgcggc

SEQ ID NO: 1781452 - RNA, 17 nt, Salmonella enterica enterica serovar Typhi Ty2
ccccgacggccucuuca

SEQ ID NO: 1781453 - RNA, 22 nt, Salmonella enterica enterica serovar Typhi Ty2
ccccgaugucgccacgccgccc

SEQ ID NO: 1781454 - RNA, 20 nt, Salmonella enterica enterica serovar Typhi Ty2
ccccgaugucgccacgccgc

SEQ ID NO: 1781455 - RNA, 15 nt, Salmonella enterica enterica serovar Typhi Ty2
ccccgccaccgccgc

SEQ ID NO: 1781456 - RNA, 20 nt, Salmonella enterica enterica serovar Typhi Ty2
ccccgccauaaugcacaaua

SEQ ID NO: 1781457 - RNA, 16 nt, Salmonella enterica enterica serovar Typhi Ty2
ccccgccaccgccgcu

SEQ ID NO: 1781458 - RNA, 18 nt, Salmonella enterica enterica serovar Typhi Ty2
ccccgccaucuucacgca

SEQ ID NO: 1781459 - RNA, 18 nt, Salmonella enterica enterica serovar Typhi Ty2
cccaugauggugaacaga

SEQ ID NO: 1781460 - RNA, 18 nt, Salmonella enterica enterica serovar Typhi Ty2
cccaugaugggcaagcgu

SEQ ID NO: 1781461 - RNA, 21 nt, Salmonella enterica enterica serovar Typhi Ty2
cccaugccgccugccgcgccg

SEQ ID NO: 1781462 - RNA, 13 nt, Salmonella enterica enterica serovar Typhi Ty2
cccaggguuuagc

SEQ ID NO: 1781463 - RNA, 20 nt, Salmonella enterica enterica serovar Typhi Ty2
cccaugcgggauggccgccg

SEQ ID NO: 1781464 - RNA, 21 nt, Salmonella enterica enterica serovar Typhi Ty2
cccaugcgggauggccgccga

SEQ ID NO: 1781465 - RNA, 13 nt, Salmonella enterica enterica serovar Typhi Ty2
cccaugcuuccag

SEQ ID NO: 1781466 - RNA, 17 nt, Salmonella enterica enterica serovar Typhi Ty2
cccauggaugcgccgcc

SEQ ID NO: 1781467 - RNA, 14 nt, Salmonella enterica enterica serovar Typhi Ty2
cccauuaaacuggc

SEQ ID NO: 1781468 - RNA, 16 nt, Salmonella enterica enterica serovar Typhi Ty2
cccauuccgccugccg

SEQ ID NO: 1781469 - RNA, 13 nt, Salmonella enterica enterica serovar Typhi Ty2
cccauuuuccgcu

SEQ ID NO: 1781470 - RNA, 13 nt, Salmonella enterica enterica serovar Typhi Ty2
cccauuauugauc

SEQ ID NO: 1781471 - RNA, 22 nt, Salmonella enterica enterica serovar Typhi Ty2
cccauuugcggguggugugcgu

SEQ ID NO: 1781472 - RNA, 13 nt, Salmonella enterica enterica serovar Typhi Ty2
ccccaccgccaga

SEQ ID NO: 1781473 - RNA, 12 nt, Salmonella enterica enterica serovar Typhi Ty2
ccccaccaggaa

SEQ ID NO: 1781474 - RNA, 19 nt, Salmonella enterica enterica serovar Typhi Ty2
ccccacacggccaccauau

SEQ ID NO: 1781475 - RNA, 13 nt, Salmonella enterica enterica serovar Typhi Ty2
ccccaaccgccag

SEQ ID NO: 1781476 - RNA, 15 nt, Salmonella enterica enterica serovar Typhi Ty2
ccccaaacgcucaua

SEQ ID NO: 1781477 - RNA, 14 nt, Salmonella enterica enterica serovar Typhi Ty2
ccccaaacugcucg

SEQ ID NO: 1781478 - RNA, 16 nt, Salmonella enterica enterica serovar Typhi Ty2
ccccaaugauccacag

SEQ ID NO: 1781479 - RNA, 17 nt, Salmonella enterica enterica serovar Typhi Ty2
ccccaaucuugcguacc

SEQ ID NO: 1781480 - RNA, 20 nt, Salmonella enterica enterica serovar Typhi Ty2
cccgcaaacuaauggcgcag

SEQ ID NO: 1781481 - RNA, 15 nt, Salmonella enterica enterica serovar Typhi Ty2
cccgauucgcaugaa

SEQ ID NO: 1781482 - RNA, 21 nt, Salmonella enterica enterica serovar Typhi Ty2
cccgaugucgccacgccgccc

SEQ ID NO: 1781483 - RNA, 21 nt, Salmonella enterica enterica serovar Typhi Ty2
cccgcaauguuuggauuucgu

SEQ ID NO: 1781484 - RNA, 19 nt, Salmonella enterica enterica serovar Typhi Ty2
cccgcaaacuggccacagc

SEQ ID NO: 1781485 - RNA, 19 nt, Salmonella enterica enterica serovar Typhi Ty2
cccgcacgcgacgcgccag

SEQ ID NO: 1781486 - RNA, 22 nt, Salmonella enterica enterica serovar Typhi Ty2
cccgauauaccacccgcuauga

SEQ ID NO: 1781487 - RNA, 14 nt, Salmonella enterica enterica serovar Typhi Ty2
cccgauacccgccc

SEQ ID NO: 1781488 - RNA, 16 nt, Salmonella enterica enterica serovar Typhi Ty2
cccgaguuuuaacacu

SEQ ID NO: 1781489 - RNA, 14 nt, Salmonella enterica enterica serovar Typhi Ty2
ccccugacgcgcgc

SEQ ID NO: 1781490 - RNA, 21 nt, Salmonella enterica enterica serovar Typhi Ty2
ccccugaugcguauccagcgc

SEQ ID NO: 1781491 - RNA, 21 nt, Salmonella enterica enterica serovar Typhi Ty2
ccccugaaauaacagacuccg

SEQ ID NO: 1781492 - RNA, 19 nt, Salmonella enterica enterica serovar Typhi Ty2
ccccugcgcggccugcgcc

SEQ ID NO: 1781493 - RNA, 20 nt, Salmonella enterica enterica serovar Typhi Ty2
ccccugcccgcgaucgagcg

SEQ ID NO: 1781494 - RNA, 14 nt, Salmonella enterica enterica serovar Typhi Ty2
ccccgcuggcgcgg

SEQ ID NO: 1781495 - RNA, 22 nt, Salmonella enterica enterica serovar Typhi Ty2
cccgacaggguuugccagcacc

SEQ ID NO: 1781496 - RNA, 13 nt, Salmonella enterica enterica serovar Typhi Ty2
cccgaccacgccc

SEQ ID NO: 1781497 - RNA, 18 nt, Salmonella enterica enterica serovar Typhi Ty2
ccccuuuuuugcuggcaa

SEQ ID NO: 1781498 - RNA, 21 nt, Salmonella enterica enterica serovar Typhi Ty2
cccgaaaagcguaacgccccc

SEQ ID NO: 1781499 - RNA, 20 nt, Salmonella enterica enterica serovar Typhi Ty2
ccccuuucgguucgccgcgc

SEQ ID NO: 1781500 - RNA, 18 nt, Salmonella enterica enterica serovar Typhi Ty2
ccccuuucgcaaucaugc

SEQ ID NO: 1781501 - RNA, 22 nt, Salmonella enterica enterica serovar Typhi Ty2
ccccuucuuuaucuucugcugc

SEQ ID NO: 1781502 - RNA, 12 nt, Salmonella enterica enterica serovar Typhi Ty2
ccccuuuuucaa

SEQ ID NO: 1781503 - RNA, 19 nt, Salmonella enterica enterica serovar Typhi Ty2
cccgacaaaaccguucuga

SEQ ID NO: 1781504 - RNA, 15 nt, Salmonella enterica enterica serovar Typhi Ty2
ccagcgucagccaga

SEQ ID NO: 1781505 - RNA, 20 nt, Salmonella enterica enterica serovar Typhi Ty2
ccagcgguaugcaccucuuu

SEQ ID NO: 1781506 - RNA, 18 nt, Salmonella enterica enterica serovar Typhi Ty2
ccagcgggcgcaguccag

SEQ ID NO: 1781507 - RNA, 23 nt, Salmonella enterica enterica serovar Typhi Ty2
ccagcggcguuuuuuccugcugg

SEQ ID NO: 1781508 - RNA, 16 nt, Salmonella enterica enterica serovar Typhi Ty2
ccagcguugaccagcc

SEQ ID NO: 1781509 - RNA, 13 nt, Salmonella enterica enterica serovar Typhi Ty2
ccagcuaaaaacg

SEQ ID NO: 1781510 - RNA, 18 nt, Salmonella enterica enterica serovar Typhi Ty2
ccagcuacuggccacgga

SEQ ID NO: 1781511 - RNA, 21 nt, Salmonella enterica enterica serovar Typhi Ty2
ccagcucaacgccuuugcaau

SEQ ID NO: 1781512 - RNA, 17 nt, Salmonella enterica enterica serovar Typhi Ty2
ccagcuauccaguuucu

SEQ ID NO: 1781513 - RNA, 15 nt, Salmonella enterica enterica serovar Typhi Ty2
ccagcuaaccuguuc

SEQ ID NO: 1781514 - RNA, 18 nt, Salmonella enterica enterica serovar Typhi Ty2
ccagcgccgccagaauca

SEQ ID NO: 1781515 - RNA, 12 nt, Salmonella enterica enterica serovar Typhi Ty2
ccagcgccgccg

SEQ ID NO: 1781516 - RNA, 13 nt, Salmonella enterica enterica serovar Typhi Ty2
ccagcgccgccgc

SEQ ID NO: 1781517 - RNA, 12 nt, Salmonella enterica enterica serovar Typhi Ty2
ccagcgccgcga

SEQ ID NO: 1781518 - RNA, 18 nt, Salmonella enterica enterica serovar Typhi Ty2
ccagcgccgcgacaagca

SEQ ID NO: 1781519 - RNA, 20 nt, Salmonella enterica enterica serovar Typhi Ty2
ccagcgccgcggccuccgga

SEQ ID NO: 1781520 - RNA, 13 nt, Salmonella enterica enterica serovar Typhi Ty2
ccagcgccgcgcg

SEQ ID NO: 1781521 - RNA, 12 nt, Salmonella enterica enterica serovar Typhi Ty2
ccagcgccgcgc

SEQ ID NO: 1781522 - RNA, 13 nt, Salmonella enterica enterica serovar Typhi Ty2
ccagcgccccugc

SEQ ID NO: 1781523 - RNA, 14 nt, Salmonella enterica enterica serovar Typhi Ty2
ccagcgcccgcuuc

SEQ ID NO: 1781524 - RNA, 13 nt, Salmonella enterica enterica serovar Typhi Ty2
ccagcgccagccg

SEQ ID NO: 1781525 - RNA, 14 nt, Salmonella enterica enterica serovar Typhi Ty2
ccagcgccagcgcc

SEQ ID NO: 1781526 - RNA, 14 nt, Salmonella enterica enterica serovar Typhi Ty2
ccagcgccagcucc

SEQ ID NO: 1781527 - RNA, 13 nt, Salmonella enterica enterica serovar Typhi Ty2
ccagcgcgccguc

SEQ ID NO: 1781528 - RNA, 14 nt, Salmonella enterica enterica serovar Typhi Ty2
ccagcgcgccgcca

SEQ ID NO: 1781529 - RNA, 19 nt, Salmonella enterica enterica serovar Typhi Ty2
ccagcgcgccgcagcgccg

SEQ ID NO: 1781530 - RNA, 18 nt, Salmonella enterica enterica serovar Typhi Ty2
ccagcgcgccgcagcgcc

SEQ ID NO: 1781531 - RNA, 16 nt, Salmonella enterica enterica serovar Typhi Ty2
ccagcgccuucuucac

SEQ ID NO: 1781532 - RNA, 16 nt, Salmonella enterica enterica serovar Typhi Ty2
ccagcgcgaauuugcc

SEQ ID NO: 1781533 - RNA, 24 nt, Salmonella enterica enterica serovar Typhi Ty2
ccagcgcgaauuugccccagauac

SEQ ID NO: 1781534 - RNA, 21 nt, Salmonella enterica enterica serovar Typhi Ty2
ccagcgccugcuguaaaauau

SEQ ID NO: 1781535 - RNA, 16 nt, Salmonella enterica enterica serovar Typhi Ty2
ccagcgcgugaaccgu

SEQ ID NO: 1781536 - RNA, 19 nt, Salmonella enterica enterica serovar Typhi Ty2
ccagcgcgggcgaggccuc

SEQ ID NO: 1781537 - RNA, 20 nt, Salmonella enterica enterica serovar Typhi Ty2
ccagcgcgguggcgcacagu

SEQ ID NO: 1781538 - RNA, 21 nt, Salmonella enterica enterica serovar Typhi Ty2
ccagcgcgccgccaacgccaa

SEQ ID NO: 1781539 - RNA, 23 nt, Salmonella enterica enterica serovar Typhi Ty2
ccaggaaguaaauuauuccuuga

SEQ ID NO: 1781540 - RNA, 16 nt, Salmonella enterica enterica serovar Typhi Ty2
ccaggccagcuccgcg

SEQ ID NO: 1781541 - RNA, 11 nt, Salmonella enterica enterica serovar Typhi Ty2
ccaggccagcg

SEQ ID NO: 1781542 - RNA, 21 nt, Salmonella enterica enterica serovar Typhi Ty2
ccaggccaaaaccacagugac

SEQ ID NO: 1781543 - RNA, 12 nt, Salmonella enterica enterica serovar Typhi Ty2
ccaggccaaaac

SEQ ID NO: 1781544 - RNA, 19 nt, Salmonella enterica enterica serovar Typhi Ty2
ccaggcauuuuauuaccug

SEQ ID NO: 1781545 - RNA, 13 nt, Salmonella enterica enterica serovar Typhi Ty2
ccaggcaaagccc

SEQ ID NO: 1781546 - RNA, 11 nt, Salmonella enterica enterica serovar Typhi Ty2
ccaggcauccg

SEQ ID NO: 1781547 - RNA, 16 nt, Salmonella enterica enterica serovar Typhi Ty2
ccaggcauaaaaaaag

SEQ ID NO: 1781548 - RNA, 13 nt, Salmonella enterica enterica serovar Typhi Ty2
ccaggcauagaaa

SEQ ID NO: 1781549 - RNA, 21 nt, Salmonella enterica enterica serovar Typhi Ty2
ccaggcauagaaaaagaacug

SEQ ID NO: 1781550 - RNA, 15 nt, Salmonella enterica enterica serovar Typhi Ty2
ccaggauggccagca

SEQ ID NO: 1781551 - RNA, 17 nt, Salmonella enterica enterica serovar Typhi Ty2
ccaggaugccaaccacc

SEQ ID NO: 1781552 - RNA, 14 nt, Salmonella enterica enterica serovar Typhi Ty2
ccaggcaaaccagc

SEQ ID NO: 1781553 - RNA, 18 nt, Salmonella enterica enterica serovar Typhi Ty2
ccaggcaaagccccaguc

SEQ ID NO: 1781554 - RNA, 21 nt, Salmonella enterica enterica serovar Typhi Ty2
ccagggugcaaagaaacguuc

SEQ ID NO: 1781555 - RNA, 12 nt, Salmonella enterica enterica serovar Typhi Ty2
ccaggccgccag

SEQ ID NO: 1781556 - RNA, 18 nt, Salmonella enterica enterica serovar Typhi Ty2
ccaggccgccaccgccuc

SEQ ID NO: 1781557 - RNA, 16 nt, Salmonella enterica enterica serovar Typhi Ty2
ccaggcggugaagacg

SEQ ID NO: 1781558 - RNA, 20 nt, Salmonella enterica enterica serovar Typhi Ty2
ccaggcggauaaaacagaaa

SEQ ID NO: 1781559 - RNA, 22 nt, Salmonella enterica enterica serovar Typhi Ty2
ccaggcuauaguggauggccca

SEQ ID NO: 1781560 - RNA, 14 nt, Salmonella enterica enterica serovar Typhi Ty2
ccaggcuauccagc

SEQ ID NO: 1781561 - RNA, 15 nt, Salmonella enterica enterica serovar Typhi Ty2
ccaggcguccaguug

SEQ ID NO: 1781562 - RNA, 23 nt, Salmonella enterica enterica serovar Typhi Ty2
ccagucccugaagaaaaggaaug

SEQ ID NO: 1781563 - RNA, 14 nt, Salmonella enterica enterica serovar Typhi Ty2
ccaguccccuuuuc

SEQ ID NO: 1781564 - RNA, 13 nt, Salmonella enterica enterica serovar Typhi Ty2
ccagucccagcac

SEQ ID NO: 1781565 - RNA, 17 nt, Salmonella enterica enterica serovar Typhi Ty2
ccaguccgguauaaaac

SEQ ID NO: 1781566 - RNA, 17 nt, Salmonella enterica enterica serovar Typhi Ty2
ccaguccugccaccagc

SEQ ID NO: 1781567 - RNA, 16 nt, Salmonella enterica enterica serovar Typhi Ty2
ccaguccuuccgccgg

SEQ ID NO: 1781568 - RNA, 18 nt, Salmonella enterica enterica serovar Typhi Ty2
ccaguccugucccugcca

SEQ ID NO: 1781569 - RNA, 21 nt, Salmonella enterica enterica serovar Typhi Ty2
ccagucgcucuaacugaugug

SEQ ID NO: 1781570 - RNA, 16 nt, Salmonella enterica enterica serovar Typhi Ty2
ccagucggcaaagacc

SEQ ID NO: 1781571 - RNA, 16 nt, Salmonella enterica enterica serovar Typhi Ty2
ccagucgggcgugccg

SEQ ID NO: 1781572 - RNA, 14 nt, Salmonella enterica enterica serovar Typhi Ty2
ccagucguaauuca

SEQ ID NO: 1781573 - RNA, 16 nt, Salmonella enterica enterica serovar Typhi Ty2
ccagugaauccaccac

SEQ ID NO: 1781574 - RNA, 23 nt, Salmonella enterica enterica serovar Typhi Ty2
ccagugaaaguugguguuucuca

SEQ ID NO: 1781575 - RNA, 13 nt, Salmonella enterica enterica serovar Typhi Ty2
ccagugaaauaaa

SEQ ID NO: 1781576 - RNA, 17 nt, Salmonella enterica enterica serovar Typhi Ty2
ccagucaucauaauuca

SEQ ID NO: 1781577 - RNA, 19 nt, Salmonella enterica enterica serovar Typhi Ty2
ccagucaggcgaucccggc

SEQ ID NO: 1781578 - RNA, 20 nt, Salmonella enterica enterica serovar Typhi Ty2
ccagucaggcgaucccggcc

SEQ ID NO: 1781579 - RNA, 22 nt, Salmonella enterica enterica serovar Typhi Ty2
ccagucagcaauuaacaaauaa

SEQ ID NO: 1781580 - RNA, 18 nt, Salmonella enterica enterica serovar Typhi Ty2
ccaguaguugaccugauc

SEQ ID NO: 1781581 - RNA, 21 nt, Salmonella enterica enterica serovar Typhi Ty2
ccagucaacgaggugaauaaa

SEQ ID NO: 1781582 - RNA, 19 nt, Salmonella enterica enterica serovar Typhi Ty2
ccaguucgccuucuucauc

SEQ ID NO: 1781583 - RNA, 23 nt, Salmonella enterica enterica serovar Typhi Ty2
ccaguucucaaucgccgcauggg

SEQ ID NO: 1781584 - RNA, 19 nt, Salmonella enterica enterica serovar Typhi Ty2
ccagugcagaaagugugau

SEQ ID NO: 1781585 - RNA, 21 nt, Salmonella enterica enterica serovar Typhi Ty2
ccagugccaccagccggagcc

SEQ ID NO: 1781586 - RNA, 23 nt, Salmonella enterica enterica serovar Typhi Ty2
ccagugccaccagccggagccgg

SEQ ID NO: 1781587 - RNA, 17 nt, Salmonella enterica enterica serovar Typhi Ty2
ccagugccaguuaagca

SEQ ID NO: 1781588 - RNA, 17 nt, Salmonella enterica enterica serovar Typhi Ty2
ccaguugcuuaccuugu

SEQ ID NO: 1781589 - RNA, 17 nt, Salmonella enterica enterica serovar Typhi Ty2
ccaguucuggcugcgcu

SEQ ID NO: 1781590 - RNA, 12 nt, Salmonella enterica enterica serovar Typhi Ty2
ccaguugcgcca

SEQ ID NO: 1781591 - RNA, 17 nt, Salmonella enterica enterica serovar Typhi Ty2
ccauaaagcgaauaauu

SEQ ID NO: 1781592 - RNA, 18 nt, Salmonella enterica enterica serovar Typhi Ty2
ccaguuucaaugcccagg

SEQ ID NO: 1781593 - RNA, 22 nt, Salmonella enterica enterica serovar Typhi Ty2
ccaguuguuuauuccauucauc

SEQ ID NO: 1781594 - RNA, 15 nt, Salmonella enterica enterica serovar Typhi Ty2
ccaguuucaaugccc

SEQ ID NO: 1781595 - RNA, 13 nt, Salmonella enterica enterica serovar Typhi Ty2
ccaucauaaagcc

SEQ ID NO: 1781596 - RNA, 13 nt, Salmonella enterica enterica serovar Typhi Ty2
ccaucagggaaaa

SEQ ID NO: 1781597 - RNA, 15 nt, Salmonella enterica enterica serovar Typhi Ty2
ccaucagggaaaaau

SEQ ID NO: 1781598 - RNA, 17 nt, Salmonella enterica enterica serovar Typhi Ty2
ccaucaugcccacaggc

SEQ ID NO: 1781599 - RNA, 22 nt, Salmonella enterica enterica serovar Typhi Ty2
ccaucauggcuuucagauuagc

SEQ ID NO: 1781600 - RNA, 15 nt, Salmonella enterica enterica serovar Typhi Ty2
ccaucaugcgccagg

SEQ ID NO: 1781601 - RNA, 13 nt, Salmonella enterica enterica serovar Typhi Ty2
ccaucauuaauau

SEQ ID NO: 1781602 - RNA, 20 nt, Salmonella enterica enterica serovar Typhi Ty2
ccaucauugacuucaacgca

SEQ ID NO: 1781603 - RNA, 13 nt, Salmonella enterica enterica serovar Typhi Ty2
ccaucccggcgua

SEQ ID NO: 1781604 - RNA, 15 nt, Salmonella enterica enterica serovar Typhi Ty2
ccaucccccugccgu

SEQ ID NO: 1781605 - RNA, 16 nt, Salmonella enterica enterica serovar Typhi Ty2
ccauccggcaaacuca

SEQ ID NO: 1781606 - RNA, 16 nt, Salmonella enterica enterica serovar Typhi Ty2
ccaucgacgaaauggu

SEQ ID NO: 1781607 - RNA, 17 nt, Salmonella enterica enterica serovar Typhi Ty2
ccaucggcaaacgccgc

SEQ ID NO: 1781608 - RNA, 21 nt, Salmonella enterica enterica serovar Typhi Ty2
ccaucggcacgucgucccagg

SEQ ID NO: 1781609 - RNA, 18 nt, Salmonella enterica enterica serovar Typhi Ty2
ccaucuuccucacagccu

SEQ ID NO: 1781610 - RNA, 15 nt, Salmonella enterica enterica serovar Typhi Ty2
ccaucguccagccau

SEQ ID NO: 1781611 - RNA, 14 nt, Salmonella enterica enterica serovar Typhi Ty2
ccaucguccagcca

SEQ ID NO: 1781612 - RNA, 23 nt, Salmonella enterica enterica serovar Typhi Ty2
ccaucgguucucugccaucaucc

SEQ ID NO: 1781613 - RNA, 14 nt, Salmonella enterica enterica serovar Typhi Ty2
ccaucagcacauga

SEQ ID NO: 1781614 - RNA, 21 nt, Salmonella enterica enterica serovar Typhi Ty2
ccaucagcaaaauaccggcag

SEQ ID NO: 1781615 - RNA, 15 nt, Salmonella enterica enterica serovar Typhi Ty2
ccaucagauucaaca

SEQ ID NO: 1781616 - RNA, 14 nt, Salmonella enterica enterica serovar Typhi Ty2
ccaucaggcaauau

SEQ ID NO: 1781617 - RNA, 21 nt, Salmonella enterica enterica serovar Typhi Ty2
ccaucaggcaucugaaaugcu

SEQ ID NO: 1781618 - RNA, 22 nt, Salmonella enterica enterica serovar Typhi Ty2
ccaucaggcaaucuuuaacgcu

SEQ ID NO: 1781619 - RNA, 16 nt, Salmonella enterica enterica serovar Typhi Ty2
ccaucaggcaaucuuu

SEQ ID NO: 1781620 - RNA, 23 nt, Salmonella enterica enterica serovar Typhi Ty2
ccaucacguuggggaauaaauau

SEQ ID NO: 1781621 - RNA, 16 nt, Salmonella enterica enterica serovar Typhi Ty2
ccaucaauccaacgaa

SEQ ID NO: 1781622 - RNA, 21 nt, Salmonella enterica enterica serovar Typhi Ty2
ccaucagaaugcuggucacgg

SEQ ID NO: 1781623 - RNA, 13 nt, Salmonella enterica enterica serovar Typhi Ty2
ccaucacuuccug

SEQ ID NO: 1781624 - RNA, 15 nt, Salmonella enterica enterica serovar Typhi Ty2
ccaucaaucaccuua

SEQ ID NO: 1781625 - RNA, 21 nt, Salmonella enterica enterica serovar Typhi Ty2
ccaucaauccaacgaaacuca

SEQ ID NO: 1781626 - RNA, 20 nt, Salmonella enterica enterica serovar Typhi Ty2
ccauacacugcauaaauauc

SEQ ID NO: 1781627 - RNA, 13 nt, Salmonella enterica enterica serovar Typhi Ty2
ccauaauuuuccc

SEQ ID NO: 1781628 - RNA, 17 nt, Salmonella enterica enterica serovar Typhi Ty2
ccauacaguggccagac

SEQ ID NO: 1781629 - RNA, 18 nt, Salmonella enterica enterica serovar Typhi Ty2
ccauacagcccauaccac

SEQ ID NO: 1781630 - RNA, 21 nt, Salmonella enterica enterica serovar Typhi Ty2
ccauacauugaguaaauaaau

SEQ ID NO: 1781631 - RNA, 17 nt, Salmonella enterica enterica serovar Typhi Ty2
ccauauuccagaaagga

SEQ ID NO: 1781632 - RNA, 14 nt, Salmonella enterica enterica serovar Typhi Ty2
ccauauuauucugc

SEQ ID NO: 1781633 - RNA, 19 nt, Salmonella enterica enterica serovar Typhi Ty2
ccaucaacuucucgcaggc

SEQ ID NO: 1781634 - RNA, 20 nt, Salmonella enterica enterica serovar Typhi Ty2
ccagauguuauaaacuucaa

SEQ ID NO: 1781635 - RNA, 19 nt, Salmonella enterica enterica serovar Typhi Ty2
ccagauguugauacagaaa

SEQ ID NO: 1781636 - RNA, 17 nt, Salmonella enterica enterica serovar Typhi Ty2
ccagauuacugcccuga

SEQ ID NO: 1781637 - RNA, 17 nt, Salmonella enterica enterica serovar Typhi Ty2
ccagauggcaagauuaa

SEQ ID NO: 1781638 - RNA, 21 nt, Salmonella enterica enterica serovar Typhi Ty2
ccagauggcuaugaagcugga

SEQ ID NO: 1781639 - RNA, 21 nt, Salmonella enterica enterica serovar Typhi Ty2
ccagauggcugcacccggaga

SEQ ID NO: 1781640 - RNA, 16 nt, Salmonella enterica enterica serovar Typhi Ty2
ccagaugcgccaguac

SEQ ID NO: 1781641 - RNA, 14 nt, Salmonella enterica enterica serovar Typhi Ty2
ccagaugcugggcg

SEQ ID NO: 1781642 - RNA, 14 nt, Salmonella enterica enterica serovar Typhi Ty2
ccagauucuuaguc

SEQ ID NO: 1781643 - RNA, 20 nt, Salmonella enterica enterica serovar Typhi Ty2
ccagauugucgcaaaccacc

SEQ ID NO: 1781644 - RNA, 14 nt, Salmonella enterica enterica serovar Typhi Ty2
ccagcaaaaucacc

SEQ ID NO: 1781645 - RNA, 11 nt, Salmonella enterica enterica serovar Typhi Ty2
ccagcaaaauc

SEQ ID NO: 1781646 - RNA, 19 nt, Salmonella enterica enterica serovar Typhi Ty2
ccagaauacgccgccgccc

SEQ ID NO: 1781647 - RNA, 14 nt, Salmonella enterica enterica serovar Typhi Ty2
ccagaaucaccucu

SEQ ID NO: 1781648 - RNA, 19 nt, Salmonella enterica enterica serovar Typhi Ty2
ccagaaucaccgacagcac

SEQ ID NO: 1781649 - RNA, 18 nt, Salmonella enterica enterica serovar Typhi Ty2
ccagaauacacuucucaa

SEQ ID NO: 1781650 - RNA, 16 nt, Salmonella enterica enterica serovar Typhi Ty2
ccagaauacaccgccu

SEQ ID NO: 1781651 - RNA, 16 nt, Salmonella enterica enterica serovar Typhi Ty2
ccagauaaaucagccc

SEQ ID NO: 1781652 - RNA, 22 nt, Salmonella enterica enterica serovar Typhi Ty2
ccagaaucaucgcuaucaugcu

SEQ ID NO: 1781653 - RNA, 19 nt, Salmonella enterica enterica serovar Typhi Ty2
ccagauagaaccacgcaaa

SEQ ID NO: 1781654 - RNA, 22 nt, Salmonella enterica enterica serovar Typhi Ty2
ccagauaaucgccgccagcuca

SEQ ID NO: 1781655 - RNA, 15 nt, Salmonella enterica enterica serovar Typhi Ty2
ccagauaucccgcca

SEQ ID NO: 1781656 - RNA, 22 nt, Salmonella enterica enterica serovar Typhi Ty2
ccagauaucgcguacaggaugu

SEQ ID NO: 1781657 - RNA, 16 nt, Salmonella enterica enterica serovar Typhi Ty2
ccagauaguggcugag

SEQ ID NO: 1781658 - RNA, 13 nt, Salmonella enterica enterica serovar Typhi Ty2
ccagauauggcaa

SEQ ID NO: 1781659 - RNA, 19 nt, Salmonella enterica enterica serovar Typhi Ty2
ccagcacagguacaggccg

SEQ ID NO: 1781660 - RNA, 24 nt, Salmonella enterica enterica serovar Typhi Ty2
ccagcacauuacaggcaucuucca

SEQ ID NO: 1781661 - RNA, 17 nt, Salmonella enterica enterica serovar Typhi Ty2
ccagcacagcccaguaa

SEQ ID NO: 1781662 - RNA, 19 nt, Salmonella enterica enterica serovar Typhi Ty2
ccagcaacagguaccccgc

SEQ ID NO: 1781663 - RNA, 16 nt, Salmonella enterica enterica serovar Typhi Ty2
ccagcaccaacgccgc

SEQ ID NO: 1781664 - RNA, 14 nt, Salmonella enterica enterica serovar Typhi Ty2
ccagcaacacagcc

SEQ ID NO: 1781665 - RNA, 23 nt, Salmonella enterica enterica serovar Typhi Ty2
ccagcacgcccauauccagcucg

SEQ ID NO: 1781666 - RNA, 21 nt, Salmonella enterica enterica serovar Typhi Ty2
ccagcaccucaucacccaguc

SEQ ID NO: 1781667 - RNA, 15 nt, Salmonella enterica enterica serovar Typhi Ty2
ccagcaccagcagug

SEQ ID NO: 1781668 - RNA, 12 nt, Salmonella enterica enterica serovar Typhi Ty2
ccagcaccagca

SEQ ID NO: 1781669 - RNA, 22 nt, Salmonella enterica enterica serovar Typhi Ty2
ccagcagauuagcgaagaaguc

SEQ ID NO: 1781670 - RNA, 20 nt, Salmonella enterica enterica serovar Typhi Ty2
ccagcagauuuuuauccguc

SEQ ID NO: 1781671 - RNA, 9 nt, Salmonella enterica enterica serovar Typhi Ty2
ccagcagca

SEQ ID NO: 1781672 - RNA, 15 nt, Salmonella enterica enterica serovar Typhi Ty2
ccagcagcacuuccg

SEQ ID NO: 1781673 - RNA, 15 nt, Salmonella enterica enterica serovar Typhi Ty2
ccagcagcauaaaac

SEQ ID NO: 1781674 - RNA, 23 nt, Salmonella enterica enterica serovar Typhi Ty2
ccagcagcauaaaaccgccgccc

SEQ ID NO: 1781675 - RNA, 17 nt, Salmonella enterica enterica serovar Typhi Ty2
ccagcagcagcaccggc

SEQ ID NO: 1781676 - RNA, 22 nt, Salmonella enterica enterica serovar Typhi Ty2
ccagcagcucgccgaccggcgc

SEQ ID NO: 1781677 - RNA, 22 nt, Salmonella enterica enterica serovar Typhi Ty2
ccagcgaugagcgccagcaaca

SEQ ID NO: 1781678 - RNA, 23 nt, Salmonella enterica enterica serovar Typhi Ty2
ccagcgauuuuuacgccauucau

SEQ ID NO: 1781679 - RNA, 17 nt, Salmonella enterica enterica serovar Typhi Ty2
ccagcgaugagcgccag

SEQ ID NO: 1781680 - RNA, 22 nt, Salmonella enterica enterica serovar Typhi Ty2
ccagcgcaaagggacacucaag

SEQ ID NO: 1781681 - RNA, 19 nt, Salmonella enterica enterica serovar Typhi Ty2
ccagcgagaugaaaaguca

SEQ ID NO: 1781682 - RNA, 22 nt, Salmonella enterica enterica serovar Typhi Ty2
ccagcgcauguuucgcuucaau

SEQ ID NO: 1781683 - RNA, 22 nt, Salmonella enterica enterica serovar Typhi Ty2
ccagcgcaagcagcgccccgcc

SEQ ID NO: 1781684 - RNA, 16 nt, Salmonella enterica enterica serovar Typhi Ty2
ccagcgacaucccaga

SEQ ID NO: 1781685 - RNA, 16 nt, Salmonella enterica enterica serovar Typhi Ty2
ccagccugucgggcca

SEQ ID NO: 1781686 - RNA, 13 nt, Salmonella enterica enterica serovar Typhi Ty2
ccagcgacaguag

SEQ ID NO: 1781687 - RNA, 21 nt, Salmonella enterica enterica serovar Typhi Ty2
ccagcgaacugauaaaagaga

SEQ ID NO: 1781688 - RNA, 13 nt, Salmonella enterica enterica serovar Typhi Ty2
ccagcgaauaaug

SEQ ID NO: 1781689 - RNA, 14 nt, Salmonella enterica enterica serovar Typhi Ty2
ccagcgaauaauga

SEQ ID NO: 1781690 - RNA, 14 nt, Salmonella enterica enterica serovar Typhi Ty2
ccagcgacggccag

SEQ ID NO: 1781691 - RNA, 15 nt, Salmonella enterica enterica serovar Typhi Ty2
ccagcgacgcccagu

SEQ ID NO: 1781692 - RNA, 21 nt, Salmonella enterica enterica serovar Typhi Ty2
ccagcgacggcguauucggca

SEQ ID NO: 1781693 - RNA, 22 nt, Salmonella enterica enterica serovar Typhi Ty2
ccagcgaaaaccagcgccgcca

SEQ ID NO: 1781694 - RNA, 15 nt, Salmonella enterica enterica serovar Typhi Ty2
ccagcgaaccgcggc

SEQ ID NO: 1781695 - RNA, 15 nt, Salmonella enterica enterica serovar Typhi Ty2
ccagcgaaaaccagc

SEQ ID NO: 1781696 - RNA, 15 nt, Salmonella enterica enterica serovar Typhi Ty2
ccagccucucccagc

SEQ ID NO: 1781697 - RNA, 19 nt, Salmonella enterica enterica serovar Typhi Ty2
ccagccugaacaucuucca

SEQ ID NO: 1781698 - RNA, 19 nt, Salmonella enterica enterica serovar Typhi Ty2
ccagccuaccugccgccau

SEQ ID NO: 1781699 - RNA, 17 nt, Salmonella enterica enterica serovar Typhi Ty2
ccagccgggcaggaaaa

SEQ ID NO: 1781700 - RNA, 21 nt, Salmonella enterica enterica serovar Typhi Ty2
ccagcaggucgcacuccucug

SEQ ID NO: 1781701 - RNA, 16 nt, Salmonella enterica enterica serovar Typhi Ty2
ccagcagguaucccaa

SEQ ID NO: 1781702 - RNA, 15 nt, Salmonella enterica enterica serovar Typhi Ty2
ccagcauauaaauac

SEQ ID NO: 1781703 - RNA, 14 nt, Salmonella enterica enterica serovar Typhi Ty2
ccagcaguugccuu

SEQ ID NO: 1781704 - RNA, 22 nt, Salmonella enterica enterica serovar Typhi Ty2
ccagcauaugcacacgcagcug

SEQ ID NO: 1781705 - RNA, 14 nt, Salmonella enterica enterica serovar Typhi Ty2
ccagcauaccgccc

SEQ ID NO: 1781706 - RNA, 19 nt, Salmonella enterica enterica serovar Typhi Ty2
ccagcccaauacgccagcc

SEQ ID NO: 1781707 - RNA, 18 nt, Salmonella enterica enterica serovar Typhi Ty2
ccagcccaugaaggagca

SEQ ID NO: 1781708 - RNA, 13 nt, Salmonella enterica enterica serovar Typhi Ty2
ccagccgcugccu

SEQ ID NO: 1781709 - RNA, 18 nt, Salmonella enterica enterica serovar Typhi Ty2
ccagccgaucaucacgaa

SEQ ID NO: 1781710 - RNA, 15 nt, Salmonella enterica enterica serovar Typhi Ty2
ccagccgaucuauuu

SEQ ID NO: 1781711 - RNA, 13 nt, Salmonella enterica enterica serovar Typhi Ty2
ccagccgccgccg

SEQ ID NO: 1781712 - RNA, 19 nt, Salmonella enterica enterica serovar Typhi Ty2
ccagccgcgccaucuccuc

SEQ ID NO: 1781713 - RNA, 18 nt, Salmonella enterica enterica serovar Typhi Ty2
ccagcccugcgaucauca

SEQ ID NO: 1781714 - RNA, 19 nt, Salmonella enterica enterica serovar Typhi Ty2
ccagcccucaacauugccg

SEQ ID NO: 1781715 - RNA, 21 nt, Salmonella enterica enterica serovar Typhi Ty2
ccagccgagcgguaagagcca

SEQ ID NO: 1781716 - RNA, 14 nt, Salmonella enterica enterica serovar Typhi Ty2
ccagccccaccguc

SEQ ID NO: 1781717 - RNA, 23 nt, Salmonella enterica enterica serovar Typhi Ty2
ccaccggaccuaauagccagccc

SEQ ID NO: 1781718 - RNA, 22 nt, Salmonella enterica enterica serovar Typhi Ty2
ccaccgcugauggcguggcgca

SEQ ID NO: 1781719 - RNA, 16 nt, Salmonella enterica enterica serovar Typhi Ty2
ccaccgcgcgcuuaau

SEQ ID NO: 1781720 - RNA, 17 nt, Salmonella enterica enterica serovar Typhi Ty2
ccaccgccgccaccaaa

SEQ ID NO: 1781721 - RNA, 16 nt, Salmonella enterica enterica serovar Typhi Ty2
ccaccgccagacgccc

SEQ ID NO: 1781722 - RNA, 15 nt, Salmonella enterica enterica serovar Typhi Ty2
ccacccgcuaugaag

SEQ ID NO: 1781723 - RNA, 22 nt, Salmonella enterica enterica serovar Typhi Ty2
cauuuuuuuguccgucauuuac

SEQ ID NO: 1781724 - RNA, 16 nt, Salmonella enterica enterica serovar Typhi Ty2
cauuuuuuuggcuucu

SEQ ID NO: 1781725 - RNA, 15 nt, Salmonella enterica enterica serovar Typhi Ty2
cauuuuuuucagccu

SEQ ID NO: 1781726 - RNA, 18 nt, Salmonella enterica enterica serovar Typhi Ty2
ccaccuguucgccuucgu

SEQ ID NO: 1781727 - RNA, 19 nt, Salmonella enterica enterica serovar Typhi Ty2
ccaccuguuucgccaggcc

SEQ ID NO: 1781728 - RNA, 17 nt, Salmonella enterica enterica serovar Typhi Ty2
ccacgacggccggaccu

SEQ ID NO: 1781729 - RNA, 24 nt, Salmonella enterica enterica serovar Typhi Ty2
ccaccgggcaacccggcuaaauga

SEQ ID NO: 1781730 - RNA, 16 nt, Salmonella enterica enterica serovar Typhi Ty2
ccaccgguauccgcau

SEQ ID NO: 1781731 - RNA, 20 nt, Salmonella enterica enterica serovar Typhi Ty2
ccaccggguuaaagcccuga

SEQ ID NO: 1781732 - RNA, 15 nt, Salmonella enterica enterica serovar Typhi Ty2
ccaccugaucgccaa

SEQ ID NO: 1781733 - RNA, 16 nt, Salmonella enterica enterica serovar Typhi Ty2
ccaccucguucaaaca

SEQ ID NO: 1781734 - RNA, 14 nt, Salmonella enterica enterica serovar Typhi Ty2
ccacgccgcaagga

SEQ ID NO: 1781735 - RNA, 14 nt, Salmonella enterica enterica serovar Typhi Ty2
ccacgccguccgga

SEQ ID NO: 1781736 - RNA, 16 nt, Salmonella enterica enterica serovar Typhi Ty2
ccacgagaaauccaca

SEQ ID NO: 1781737 - RNA, 14 nt, Salmonella enterica enterica serovar Typhi Ty2
ccacgcaaaccgcu

SEQ ID NO: 1781738 - RNA, 18 nt, Salmonella enterica enterica serovar Typhi Ty2
ccacgaccuacaccguau

SEQ ID NO: 1781739 - RNA, 18 nt, Salmonella enterica enterica serovar Typhi Ty2
ccacuggcccccuguucc

SEQ ID NO: 1781740 - RNA, 21 nt, Salmonella enterica enterica serovar Typhi Ty2
ccacuggcagcgccugacggc

SEQ ID NO: 1781741 - RNA, 13 nt, Salmonella enterica enterica serovar Typhi Ty2
ccacuggcccccu

SEQ ID NO: 1781742 - RNA, 12 nt, Salmonella enterica enterica serovar Typhi Ty2
ccacugcccgcc

SEQ ID NO: 1781743 - RNA, 22 nt, Salmonella enterica enterica serovar Typhi Ty2
ccacugauggaguuucaucagc

SEQ ID NO: 1781744 - RNA, 20 nt, Salmonella enterica enterica serovar Typhi Ty2
ccacugauaguccaucaccu

SEQ ID NO: 1781745 - RNA, 14 nt, Salmonella enterica enterica serovar Typhi Ty2
ccacugcacgccag

SEQ ID NO: 1781746 - RNA, 17 nt, Salmonella enterica enterica serovar Typhi Ty2
ccacuuacggacaaaau

SEQ ID NO: 1781747 - RNA, 14 nt, Salmonella enterica enterica serovar Typhi Ty2
ccacuuaggcagcc

SEQ ID NO: 1781748 - RNA, 19 nt, Salmonella enterica enterica serovar Typhi Ty2
ccacuggcuuuccugauca

SEQ ID NO: 1781749 - RNA, 15 nt, Salmonella enterica enterica serovar Typhi Ty2
ccacuggguuuccca

SEQ ID NO: 1781750 - RNA, 12 nt, Salmonella enterica enterica serovar Typhi Ty2
ccagaacagaag

SEQ ID NO: 1781751 - RNA, 19 nt, Salmonella enterica enterica serovar Typhi Ty2
ccagaaguagcagagaaaa

SEQ ID NO: 1781752 - RNA, 18 nt, Salmonella enterica enterica serovar Typhi Ty2
ccagaaggcgaacauaag

SEQ ID NO: 1781753 - RNA, 13 nt, Salmonella enterica enterica serovar Typhi Ty2
ccagaaggcaaaa

SEQ ID NO: 1781754 - RNA, 22 nt, Salmonella enterica enterica serovar Typhi Ty2
ccagaaggcaaaaugccagccc

SEQ ID NO: 1781755 - RNA, 20 nt, Salmonella enterica enterica serovar Typhi Ty2
ccacuucuuccagcggcaga

SEQ ID NO: 1781756 - RNA, 19 nt, Salmonella enterica enterica serovar Typhi Ty2
ccacuuccagcgcgccguc

SEQ ID NO: 1781757 - RNA, 14 nt, Salmonella enterica enterica serovar Typhi Ty2
ccacgcgccgccga

SEQ ID NO: 1781758 - RNA, 17 nt, Salmonella enterica enterica serovar Typhi Ty2
ccacgguucacggccaa

SEQ ID NO: 1781759 - RNA, 18 nt, Salmonella enterica enterica serovar Typhi Ty2
ccacgguucucaccgugg

SEQ ID NO: 1781760 - RNA, 17 nt, Salmonella enterica enterica serovar Typhi Ty2
ccacgcucgcuggugcc

SEQ ID NO: 1781761 - RNA, 18 nt, Salmonella enterica enterica serovar Typhi Ty2
ccacgguuaucuggcgca

SEQ ID NO: 1781762 - RNA, 18 nt, Salmonella enterica enterica serovar Typhi Ty2
ccacuacgcagcuccagc

SEQ ID NO: 1781763 - RNA, 15 nt, Salmonella enterica enterica serovar Typhi Ty2
ccacuacgcagcucc

SEQ ID NO: 1781764 - RNA, 16 nt, Salmonella enterica enterica serovar Typhi Ty2
ccacguagcugcggua

SEQ ID NO: 1781765 - RNA, 15 nt, Salmonella enterica enterica serovar Typhi Ty2
ccacucauccagcaa

SEQ ID NO: 1781766 - RNA, 16 nt, Salmonella enterica enterica serovar Typhi Ty2
ccacuccaucgccuga

SEQ ID NO: 1781767 - RNA, 18 nt, Salmonella enterica enterica serovar Typhi Ty2
ccacuccguguugcugcc

SEQ ID NO: 1781768 - RNA, 21 nt, Salmonella enterica enterica serovar Typhi Ty2
ccacuauaguugacgccccau

SEQ ID NO: 1781769 - RNA, 14 nt, Salmonella enterica enterica serovar Typhi Ty2
ccacucuuucagca

SEQ ID NO: 1781770 - RNA, 22 nt, Salmonella enterica enterica serovar Typhi Ty2
ccacuccuuacgguaaagcgua

SEQ ID NO: 1781771 - RNA, 20 nt, Salmonella enterica enterica serovar Typhi Ty2
ccacugagcuucaccgccag

SEQ ID NO: 1781772 - RNA, 15 nt, Salmonella enterica enterica serovar Typhi Ty2
ccuggcucaauccag

SEQ ID NO: 1781773 - RNA, 16 nt, Salmonella enterica enterica serovar Typhi Ty2
ccuggcuugccggcac

SEQ ID NO: 1781774 - RNA, 19 nt, Salmonella enterica enterica serovar Typhi Ty2
ccuggcuucaaccuccugc

SEQ ID NO: 1781775 - RNA, 20 nt, Salmonella enterica enterica serovar Typhi Ty2
ccuggcuucaaccuccugca

SEQ ID NO: 1781776 - RNA, 18 nt, Salmonella enterica enterica serovar Typhi Ty2
ccuggugagguuucagca

SEQ ID NO: 1781777 - RNA, 18 nt, Salmonella enterica enterica serovar Typhi Ty2
ccuggucuauucguucuc

SEQ ID NO: 1781778 - RNA, 13 nt, Salmonella enterica enterica serovar Typhi Ty2
ccugguuaacaau

SEQ ID NO: 1781779 - RNA, 20 nt, Salmonella enterica enterica serovar Typhi Ty2
ccuggucuauucguucucug

SEQ ID NO: 1781780 - RNA, 18 nt, Salmonella enterica enterica serovar Typhi Ty2
ccuggcgcuuuaaaccga

SEQ ID NO: 1781781 - RNA, 14 nt, Salmonella enterica enterica serovar Typhi Ty2
ccuggcgcagcgcg

SEQ ID NO: 1781782 - RNA, 13 nt, Salmonella enterica enterica serovar Typhi Ty2
ccuggccuccggc

SEQ ID NO: 1781783 - RNA, 22 nt, Salmonella enterica enterica serovar Typhi Ty2
ccuggaauagcgugggcagacc

SEQ ID NO: 1781784 - RNA, 22 nt, Salmonella enterica enterica serovar Typhi Ty2
ccuggaauuuuuccagcucaga

SEQ ID NO: 1781785 - RNA, 14 nt, Salmonella enterica enterica serovar Typhi Ty2
ccuggccaggcuuc

SEQ ID NO: 1781786 - RNA, 24 nt, Salmonella enterica enterica serovar Typhi Ty2
ccuggcccggcaguugcuggcgcu

SEQ ID NO: 1781787 - RNA, 17 nt, Salmonella enterica enterica serovar Typhi Ty2
ccuggcccugcaucagc

SEQ ID NO: 1781788 - RNA, 15 nt, Salmonella enterica enterica serovar Typhi Ty2
ccugcucccacagcu

SEQ ID NO: 1781789 - RNA, 11 nt, Salmonella enterica enterica serovar Typhi Ty2
ccugcucaugc

SEQ ID NO: 1781790 - RNA, 18 nt, Salmonella enterica enterica serovar Typhi Ty2
ccugccauagcaucacca

SEQ ID NO: 1781791 - RNA, 16 nt, Salmonella enterica enterica serovar Typhi Ty2
ccugccaggccggacu

SEQ ID NO: 1781792 - RNA, 13 nt, Salmonella enterica enterica serovar Typhi Ty2
ccugccagccgcu

SEQ ID NO: 1781793 - RNA, 22 nt, Salmonella enterica enterica serovar Typhi Ty2
ccugcuguugcggaauacacga

SEQ ID NO: 1781794 - RNA, 13 nt, Salmonella enterica enterica serovar Typhi Ty2
ccugcugugacau

SEQ ID NO: 1781795 - RNA, 21 nt, Salmonella enterica enterica serovar Typhi Ty2
ccugcuggucugaaucugcuc

SEQ ID NO: 1781796 - RNA, 16 nt, Salmonella enterica enterica serovar Typhi Ty2
ccugcuggcgcaugau

SEQ ID NO: 1781797 - RNA, 16 nt, Salmonella enterica enterica serovar Typhi Ty2
ccugcuggcaaaacgc

SEQ ID NO: 1781798 - RNA, 13 nt, Salmonella enterica enterica serovar Typhi Ty2
ccugcugcgccag

SEQ ID NO: 1781799 - RNA, 22 nt, Salmonella enterica enterica serovar Typhi Ty2
ccugcuucagacaacgccgccu

SEQ ID NO: 1781800 - RNA, 11 nt, Salmonella enterica enterica serovar Typhi Ty2
ccugcuucaga

SEQ ID NO: 1781801 - RNA, 18 nt, Salmonella enterica enterica serovar Typhi Ty2
ccugcuuuuucagcgagg

SEQ ID NO: 1781802 - RNA, 15 nt, Salmonella enterica enterica serovar Typhi Ty2
ccuggaaccaggcgc

SEQ ID NO: 1781803 - RNA, 18 nt, Salmonella enterica enterica serovar Typhi Ty2
ccuuaucgaccaggcgac

SEQ ID NO: 1781804 - RNA, 22 nt, Salmonella enterica enterica serovar Typhi Ty2
ccuuaucgagugucaauaagcc

SEQ ID NO: 1781805 - RNA, 18 nt, Salmonella enterica enterica serovar Typhi Ty2
ccuuaucgcagucagccu

SEQ ID NO: 1781806 - RNA, 17 nt, Salmonella enterica enterica serovar Typhi Ty2
ccuuauauuccgcgcau

SEQ ID NO: 1781807 - RNA, 23 nt, Salmonella enterica enterica serovar Typhi Ty2
ccuuauucgcuagcgugccauua

SEQ ID NO: 1781808 - RNA, 13 nt, Salmonella enterica enterica serovar Typhi Ty2
ccuuauuuuucag

SEQ ID NO: 1781809 - RNA, 19 nt, Salmonella enterica enterica serovar Typhi Ty2
ccuuaucaagccuacaccu

SEQ ID NO: 1781810 - RNA, 19 nt, Salmonella enterica enterica serovar Typhi Ty2
ccuuacuaagccaguucuc

SEQ ID NO: 1781811 - RNA, 13 nt, Salmonella enterica enterica serovar Typhi Ty2
ccuuacggcuccu

SEQ ID NO: 1781812 - RNA, 23 nt, Salmonella enterica enterica serovar Typhi Ty2
ccuuacgcacaugaucuucguug

SEQ ID NO: 1781813 - RNA, 17 nt, Salmonella enterica enterica serovar Typhi Ty2
ccuuacccggccugcgu

SEQ ID NO: 1781814 - RNA, 17 nt, Salmonella enterica enterica serovar Typhi Ty2
ccuuaccgucagccacu

SEQ ID NO: 1781815 - RNA, 15 nt, Salmonella enterica enterica serovar Typhi Ty2
ccuuaguaaaaccga

SEQ ID NO: 1781816 - RNA, 18 nt, Salmonella enterica enterica serovar Typhi Ty2
ccuuaggccgucagacau

SEQ ID NO: 1781817 - RNA, 20 nt, Salmonella enterica enterica serovar Typhi Ty2
ccuucagaaaauuauuuuca

SEQ ID NO: 1781818 - RNA, 15 nt, Salmonella enterica enterica serovar Typhi Ty2
ccuucacgccgccaa

SEQ ID NO: 1781819 - RNA, 16 nt, Salmonella enterica enterica serovar Typhi Ty2
ccuucacccccaucgc

SEQ ID NO: 1781820 - RNA, 18 nt, Salmonella enterica enterica serovar Typhi Ty2
ccuucacgcagugcgcga

SEQ ID NO: 1781821 - RNA, 14 nt, Salmonella enterica enterica serovar Typhi Ty2
ccuucagcgcgccc

SEQ ID NO: 1781822 - RNA, 22 nt, Salmonella enterica enterica serovar Typhi Ty2
ccuucagauucaaacugauaag

SEQ ID NO: 1781823 - RNA, 13 nt, Salmonella enterica enterica serovar Typhi Ty2
ccuucaggcauca

SEQ ID NO: 1781824 - RNA, 22 nt, Salmonella enterica enterica serovar Typhi Ty2
ccuucaaucacaaaauggcuga

SEQ ID NO: 1781825 - RNA, 22 nt, Salmonella enterica enterica serovar Typhi Ty2
ccuucaaucacgcccgcagcaa

SEQ ID NO: 1781826 - RNA, 21 nt, Salmonella enterica enterica serovar Typhi Ty2
ccuucaauuugaccugaccug

SEQ ID NO: 1781827 - RNA, 17 nt, Salmonella enterica enterica serovar Typhi Ty2
ccuucaaauauauugaa

SEQ ID NO: 1781828 - RNA, 14 nt, Salmonella enterica enterica serovar Typhi Ty2
ccuucaacccagca

SEQ ID NO: 1781829 - RNA, 23 nt, Salmonella enterica enterica serovar Typhi Ty2
ccuguugcgggccagcagccagg

SEQ ID NO: 1781830 - RNA, 13 nt, Salmonella enterica enterica serovar Typhi Ty2
ccuguuuauauuc

SEQ ID NO: 1781831 - RNA, 16 nt, Salmonella enterica enterica serovar Typhi Ty2
ccuguuuaucugaugc

SEQ ID NO: 1781832 - RNA, 22 nt, Salmonella enterica enterica serovar Typhi Ty2
ccuguuucgccaggccgcggcu

SEQ ID NO: 1781833 - RNA, 18 nt, Salmonella enterica enterica serovar Typhi Ty2
ccuguuucugcgccgcuu

SEQ ID NO: 1781834 - RNA, 24 nt, Salmonella enterica enterica serovar Typhi Ty2
ccuguuucuuaccacgccgcgacu

SEQ ID NO: 1781835 - RNA, 13 nt, Salmonella enterica enterica serovar Typhi Ty2
ccuuaaaaaggac

SEQ ID NO: 1781836 - RNA, 24 nt, Salmonella enterica enterica serovar Typhi Ty2
ccuuaauuugugauugcagauaau

SEQ ID NO: 1781837 - RNA, 18 nt, Salmonella enterica enterica serovar Typhi Ty2
ccuuacaggcgcaucaga

SEQ ID NO: 1781838 - RNA, 20 nt, Salmonella enterica enterica serovar Typhi Ty2
ccuuacaggcgcaucagaaa

SEQ ID NO: 1781839 - RNA, 18 nt, Salmonella enterica enterica serovar Typhi Ty2
ccugugcaaccagcucuu

SEQ ID NO: 1781840 - RNA, 14 nt, Salmonella enterica enterica serovar Typhi Ty2
ccuguuauucaggg

SEQ ID NO: 1781841 - RNA, 20 nt, Salmonella enterica enterica serovar Typhi Ty2
ccugugccauacuguuuauc

SEQ ID NO: 1781842 - RNA, 16 nt, Salmonella enterica enterica serovar Typhi Ty2
ccuguuauucaauucu

SEQ ID NO: 1781843 - RNA, 12 nt, Salmonella enterica enterica serovar Typhi Ty2
ccuguucaagug

SEQ ID NO: 1781844 - RNA, 21 nt, Salmonella enterica enterica serovar Typhi Ty2
ccuguucaaguggcaaucgac

SEQ ID NO: 1781845 - RNA, 19 nt, Salmonella enterica enterica serovar Typhi Ty2
ccuguucaagcaauaaugc

SEQ ID NO: 1781846 - RNA, 16 nt, Salmonella enterica enterica serovar Typhi Ty2
ccuguucaaaagccug

SEQ ID NO: 1781847 - RNA, 13 nt, Salmonella enterica enterica serovar Typhi Ty2
ccuguucaacaug

SEQ ID NO: 1781848 - RNA, 14 nt, Salmonella enterica enterica serovar Typhi Ty2
ccuguucgcuuauu

SEQ ID NO: 1781849 - RNA, 19 nt, Salmonella enterica enterica serovar Typhi Ty2
ccugguuuguccagggcau

SEQ ID NO: 1781850 - RNA, 15 nt, Salmonella enterica enterica serovar Typhi Ty2
ccugguugacccgca

SEQ ID NO: 1781851 - RNA, 14 nt, Salmonella enterica enterica serovar Typhi Ty2
ccuguaaaccgccu

SEQ ID NO: 1781852 - RNA, 17 nt, Salmonella enterica enterica serovar Typhi Ty2
ccuguaaaccgccucca

SEQ ID NO: 1781853 - RNA, 14 nt, Salmonella enterica enterica serovar Typhi Ty2
ccugucuccagcgc

SEQ ID NO: 1781854 - RNA, 23 nt, Salmonella enterica enterica serovar Typhi Ty2
ccugucugucaaaacccagccca

SEQ ID NO: 1781855 - RNA, 19 nt, Salmonella enterica enterica serovar Typhi Ty2
ccugucugucgcgggcgaa

SEQ ID NO: 1781856 - RNA, 17 nt, Salmonella enterica enterica serovar Typhi Ty2
ccugucugucaaaaccc

SEQ ID NO: 1781857 - RNA, 22 nt, Salmonella enterica enterica serovar Typhi Ty2
ccugucugucaaaacccagccc

SEQ ID NO: 1781858 - RNA, 17 nt, Salmonella enterica enterica serovar Typhi Ty2
ccugucugcgcaacgcu

SEQ ID NO: 1781859 - RNA, 16 nt, Salmonella enterica enterica serovar Typhi Ty2
ccugugaaguaaaaaa

SEQ ID NO: 1781860 - RNA, 15 nt, Salmonella enterica enterica serovar Typhi Ty2
ccugucuuaaagaaa

SEQ ID NO: 1781861 - RNA, 19 nt, Salmonella enterica enterica serovar Typhi Ty2
ccucauacagcccgcgcag

SEQ ID NO: 1781862 - RNA, 14 nt, Salmonella enterica enterica serovar Typhi Ty2
ccucauauuuguau

SEQ ID NO: 1781863 - RNA, 17 nt, Salmonella enterica enterica serovar Typhi Ty2
ccucagcaaaaucacgc

SEQ ID NO: 1781864 - RNA, 12 nt, Salmonella enterica enterica serovar Typhi Ty2
ccucagccaccc

SEQ ID NO: 1781865 - RNA, 18 nt, Salmonella enterica enterica serovar Typhi Ty2
ccucagucgcuuguaccg

SEQ ID NO: 1781866 - RNA, 19 nt, Salmonella enterica enterica serovar Typhi Ty2
ccucgcauccuccauccag

SEQ ID NO: 1781867 - RNA, 13 nt, Salmonella enterica enterica serovar Typhi Ty2
ccucgcauccucc

SEQ ID NO: 1781868 - RNA, 21 nt, Salmonella enterica enterica serovar Typhi Ty2
ccucgauggcauuguccuuua

SEQ ID NO: 1781869 - RNA, 17 nt, Salmonella enterica enterica serovar Typhi Ty2
ccucgcaaaacauggcu

SEQ ID NO: 1781870 - RNA, 16 nt, Salmonella enterica enterica serovar Typhi Ty2
ccucgccaaagcagcg

SEQ ID NO: 1781871 - RNA, 13 nt, Salmonella enterica enterica serovar Typhi Ty2
ccucuacauuuuc

SEQ ID NO: 1781872 - RNA, 13 nt, Salmonella enterica enterica serovar Typhi Ty2
ccucuaucuuuuc

SEQ ID NO: 1781873 - RNA, 18 nt, Salmonella enterica enterica serovar Typhi Ty2
ccucuaucuuuucaauca

SEQ ID NO: 1781874 - RNA, 22 nt, Salmonella enterica enterica serovar Typhi Ty2
ccucuauaguaaauugacgcuu

SEQ ID NO: 1781875 - RNA, 23 nt, Salmonella enterica enterica serovar Typhi Ty2
ccucugccguagcguacuuucaa

SEQ ID NO: 1781876 - RNA, 20 nt, Salmonella enterica enterica serovar Typhi Ty2
ccucugcaccagaacucccu

SEQ ID NO: 1781877 - RNA, 13 nt, Salmonella enterica enterica serovar Typhi Ty2
ccucuuaucaggc

SEQ ID NO: 1781878 - RNA, 21 nt, Salmonella enterica enterica serovar Typhi Ty2
ccucuggccgcgcuuuuuuaa

SEQ ID NO: 1781879 - RNA, 20 nt, Salmonella enterica enterica serovar Typhi Ty2
ccucggcaacauaccgggua

SEQ ID NO: 1781880 - RNA, 17 nt, Salmonella enterica enterica serovar Typhi Ty2
ccugcagggaauaagcg

SEQ ID NO: 1781881 - RNA, 12 nt, Salmonella enterica enterica serovar Typhi Ty2
ccugcagggaau

SEQ ID NO: 1781882 - RNA, 17 nt, Salmonella enterica enterica serovar Typhi Ty2
ccugcaggcgagugcua

SEQ ID NO: 1781883 - RNA, 16 nt, Salmonella enterica enterica serovar Typhi Ty2
ccugccacaggccaac

SEQ ID NO: 1781884 - RNA, 20 nt, Salmonella enterica enterica serovar Typhi Ty2
ccugcagggaauaagcgccc

SEQ ID NO: 1781885 - RNA, 22 nt, Salmonella enterica enterica serovar Typhi Ty2
ccugcagggaauaagcgcccau

SEQ ID NO: 1781886 - RNA, 20 nt, Salmonella enterica enterica serovar Typhi Ty2
ccugcaacgcuuuagugccg

SEQ ID NO: 1781887 - RNA, 22 nt, Salmonella enterica enterica serovar Typhi Ty2
ccugcaaagcaaaaaucaccac

SEQ ID NO: 1781888 - RNA, 13 nt, Salmonella enterica enterica serovar Typhi Ty2
ccugauuuaucac

SEQ ID NO: 1781889 - RNA, 14 nt, Salmonella enterica enterica serovar Typhi Ty2
ccugauuuaucacg

SEQ ID NO: 1781890 - RNA, 15 nt, Salmonella enterica enterica serovar Typhi Ty2
ccugauuuaucacgu

SEQ ID NO: 1781891 - RNA, 20 nt, Salmonella enterica enterica serovar Typhi Ty2
ccugauugauacgcgcccga

SEQ ID NO: 1781892 - RNA, 16 nt, Salmonella enterica enterica serovar Typhi Ty2
ccugauugaccagcau

SEQ ID NO: 1781893 - RNA, 14 nt, Salmonella enterica enterica serovar Typhi Ty2
ccugauucugcagc

SEQ ID NO: 1781894 - RNA, 18 nt, Salmonella enterica enterica serovar Typhi Ty2
ccugauucugcagcgagc

SEQ ID NO: 1781895 - RNA, 20 nt, Salmonella enterica enterica serovar Typhi Ty2
ccugcaaaccucucccccgc

SEQ ID NO: 1781896 - RNA, 21 nt, Salmonella enterica enterica serovar Typhi Ty2
ccugcaaacuauguacgccaa

SEQ ID NO: 1781897 - RNA, 14 nt, Salmonella enterica enterica serovar Typhi Ty2
ccugcaaaccucuc

SEQ ID NO: 1781898 - RNA, 23 nt, Salmonella enterica enterica serovar Typhi Ty2
ccugauauugcguaagcagcugc

SEQ ID NO: 1781899 - RNA, 19 nt, Salmonella enterica enterica serovar Typhi Ty2
ccugauccagcucuucuuc

SEQ ID NO: 1781900 - RNA, 19 nt, Salmonella enterica enterica serovar Typhi Ty2
ccugauccugcaacagcac

SEQ ID NO: 1781901 - RNA, 17 nt, Salmonella enterica enterica serovar Typhi Ty2
ccugaugacgcugcgcu

SEQ ID NO: 1781902 - RNA, 20 nt, Salmonella enterica enterica serovar Typhi Ty2
ccugaugacggcugguaagg

SEQ ID NO: 1781903 - RNA, 19 nt, Salmonella enterica enterica serovar Typhi Ty2
ccugaugagcgcagcgacu

SEQ ID NO: 1781904 - RNA, 12 nt, Salmonella enterica enterica serovar Typhi Ty2
ccugauggcgcg

SEQ ID NO: 1781905 - RNA, 17 nt, Salmonella enterica enterica serovar Typhi Ty2
ccugaugguuauuuuca

SEQ ID NO: 1781906 - RNA, 21 nt, Salmonella enterica enterica serovar Typhi Ty2
ccugauggucgcucuggucga

SEQ ID NO: 1781907 - RNA, 22 nt, Salmonella enterica enterica serovar Typhi Ty2
ccugauggcgcuacguuuaucu

SEQ ID NO: 1781908 - RNA, 19 nt, Salmonella enterica enterica serovar Typhi Ty2
ccugauucaccaacugcug

SEQ ID NO: 1781909 - RNA, 21 nt, Salmonella enterica enterica serovar Typhi Ty2
ccugauuaaguuuuuuuaaaa

SEQ ID NO: 1781910 - RNA, 20 nt, Salmonella enterica enterica serovar Typhi Ty2
ccugauaaccuauuuugcaa

SEQ ID NO: 1781911 - RNA, 19 nt, Salmonella enterica enterica serovar Typhi Ty2
ccugagucuugccuguccg

SEQ ID NO: 1781912 - RNA, 16 nt, Salmonella enterica enterica serovar Typhi Ty2
ccugauagcaaucauc

SEQ ID NO: 1781913 - RNA, 17 nt, Salmonella enterica enterica serovar Typhi Ty2
ccugacuuuuccauacu

SEQ ID NO: 1781914 - RNA, 21 nt, Salmonella enterica enterica serovar Typhi Ty2
ccugagcagacauauuuucuc

SEQ ID NO: 1781915 - RNA, 16 nt, Salmonella enterica enterica serovar Typhi Ty2
ccugagccgaaccccu

SEQ ID NO: 1781916 - RNA, 14 nt, Salmonella enterica enterica serovar Typhi Ty2
ccugagcccacagc

SEQ ID NO: 1781917 - RNA, 17 nt, Salmonella enterica enterica serovar Typhi Ty2
ccugagcgcgcagcugg

SEQ ID NO: 1781918 - RNA, 19 nt, Salmonella enterica enterica serovar Typhi Ty2
ccugagcgcgcagcugggc

SEQ ID NO: 1781919 - RNA, 18 nt, Salmonella enterica enterica serovar Typhi Ty2
ccugagcgcgaacuacac

SEQ ID NO: 1781920 - RNA, 13 nt, Salmonella enterica enterica serovar Typhi Ty2
ccugaccagcgac

SEQ ID NO: 1781921 - RNA, 19 nt, Salmonella enterica enterica serovar Typhi Ty2
ccugaccauggaguuucag

SEQ ID NO: 1781922 - RNA, 15 nt, Salmonella enterica enterica serovar Typhi Ty2
ccugacauagcucac

SEQ ID NO: 1781923 - RNA, 23 nt, Salmonella enterica enterica serovar Typhi Ty2
ccugaccauugauuuccgcgcaa

SEQ ID NO: 1781924 - RNA, 13 nt, Salmonella enterica enterica serovar Typhi Ty2
ccucuuccgccag

SEQ ID NO: 1781925 - RNA, 22 nt, Salmonella enterica enterica serovar Typhi Ty2
ccucuuccucgauaucuucaua

SEQ ID NO: 1781926 - RNA, 14 nt, Salmonella enterica enterica serovar Typhi Ty2
ccugacaauacugc

SEQ ID NO: 1781927 - RNA, 18 nt, Salmonella enterica enterica serovar Typhi Ty2
ccucuuccgccaggucgc

SEQ ID NO: 1781928 - RNA, 20 nt, Salmonella enterica enterica serovar Typhi Ty2
ccugacgcugagagaacugc

SEQ ID NO: 1781929 - RNA, 21 nt, Salmonella enterica enterica serovar Typhi Ty2
ccugacuauugcugagcugac

SEQ ID NO: 1781930 - RNA, 20 nt, Salmonella enterica enterica serovar Typhi Ty2
ccugacugcgcgccugcgcu

SEQ ID NO: 1781931 - RNA, 20 nt, Salmonella enterica enterica serovar Typhi Ty2
ccugacgccgcuguuuucac

SEQ ID NO: 1781932 - RNA, 18 nt, Salmonella enterica enterica serovar Typhi Ty2
ccugacgauaucgucacc

SEQ ID NO: 1781933 - RNA, 20 nt, Salmonella enterica enterica serovar Typhi Ty2
ccugaccgguaaauuucacu

SEQ ID NO: 1781934 - RNA, 13 nt, Salmonella enterica enterica serovar Typhi Ty2
ccguccccagcca

SEQ ID NO: 1781935 - RNA, 22 nt, Salmonella enterica enterica serovar Typhi Ty2
ccgucccuaagccggcaggcag

SEQ ID NO: 1781936 - RNA, 15 nt, Salmonella enterica enterica serovar Typhi Ty2
ccguccgccaggccc

SEQ ID NO: 1781937 - RNA, 14 nt, Salmonella enterica enterica serovar Typhi Ty2
ccgucccuuccgcc

SEQ ID NO: 1781938 - RNA, 20 nt, Salmonella enterica enterica serovar Typhi Ty2
ccgucccuuccgccaccagg

SEQ ID NO: 1781939 - RNA, 17 nt, Salmonella enterica enterica serovar Typhi Ty2
ccguccggcaaacccuu

SEQ ID NO: 1781940 - RNA, 13 nt, Salmonella enterica enterica serovar Typhi Ty2
ccgucccagcgga

SEQ ID NO: 1781941 - RNA, 18 nt, Salmonella enterica enterica serovar Typhi Ty2
ccguccagaccgucauga

SEQ ID NO: 1781942 - RNA, 23 nt, Salmonella enterica enterica serovar Typhi Ty2
ccgucaguuauaggucagguuua

SEQ ID NO: 1781943 - RNA, 16 nt, Salmonella enterica enterica serovar Typhi Ty2
ccgucauccagcagca

SEQ ID NO: 1781944 - RNA, 16 nt, Salmonella enterica enterica serovar Typhi Ty2
ccgucagucgccagaa

SEQ ID NO: 1781945 - RNA, 23 nt, Salmonella enterica enterica serovar Typhi Ty2
ccgucagucgccagaaggcaggc

SEQ ID NO: 1781946 - RNA, 18 nt, Salmonella enterica enterica serovar Typhi Ty2
ccgucaguaccagcgaga

SEQ ID NO: 1781947 - RNA, 16 nt, Salmonella enterica enterica serovar Typhi Ty2
ccgucaucgacuucaa

SEQ ID NO: 1781948 - RNA, 17 nt, Salmonella enterica enterica serovar Typhi Ty2
ccgucaucgacuucgaa

SEQ ID NO: 1781949 - RNA, 16 nt, Salmonella enterica enterica serovar Typhi Ty2
ccgucaugauguuugu

SEQ ID NO: 1781950 - RNA, 15 nt, Salmonella enterica enterica serovar Typhi Ty2
ccguccacauccagc

SEQ ID NO: 1781951 - RNA, 14 nt, Salmonella enterica enterica serovar Typhi Ty2
ccguccaccuggcc

SEQ ID NO: 1781952 - RNA, 18 nt, Salmonella enterica enterica serovar Typhi Ty2
ccguauuuuauuuuucaa

SEQ ID NO: 1781953 - RNA, 16 nt, Salmonella enterica enterica serovar Typhi Ty2
ccgucaacacgcagac

SEQ ID NO: 1781954 - RNA, 19 nt, Salmonella enterica enterica serovar Typhi Ty2
ccgucaaaacgcgcauccu

SEQ ID NO: 1781955 - RNA, 19 nt, Salmonella enterica enterica serovar Typhi Ty2
ccgucaaacaagccgccaa

SEQ ID NO: 1781956 - RNA, 20 nt, Salmonella enterica enterica serovar Typhi Ty2
ccgucaaugccuggcagacg

SEQ ID NO: 1781957 - RNA, 14 nt, Salmonella enterica enterica serovar Typhi Ty2
ccgucaccacgcgc

SEQ ID NO: 1781958 - RNA, 19 nt, Salmonella enterica enterica serovar Typhi Ty2
ccgucacgccgacgaccgg

SEQ ID NO: 1781959 - RNA, 21 nt, Salmonella enterica enterica serovar Typhi Ty2
ccguaccgcggcgcugcagau

SEQ ID NO: 1781960 - RNA, 19 nt, Salmonella enterica enterica serovar Typhi Ty2
ccguauccgccaccaugau

SEQ ID NO: 1781961 - RNA, 15 nt, Salmonella enterica enterica serovar Typhi Ty2
ccguauccgccacca

SEQ ID NO: 1781962 - RNA, 14 nt, Salmonella enterica enterica serovar Typhi Ty2
ccguauccagaccc

SEQ ID NO: 1781963 - RNA, 21 nt, Salmonella enterica enterica serovar Typhi Ty2
ccgguuccagcggccgcuccg

SEQ ID NO: 1781964 - RNA, 22 nt, Salmonella enterica enterica serovar Typhi Ty2
ccgguucggacgguaccugaag

SEQ ID NO: 1781965 - RNA, 17 nt, Salmonella enterica enterica serovar Typhi Ty2
ccgguucggcaucgccc

SEQ ID NO: 1781966 - RNA, 16 nt, Salmonella enterica enterica serovar Typhi Ty2
ccgguuauaccgccau

SEQ ID NO: 1781967 - RNA, 22 nt, Salmonella enterica enterica serovar Typhi Ty2
ccgguuagcucaacgcaucgcu

SEQ ID NO: 1781968 - RNA, 12 nt, Salmonella enterica enterica serovar Typhi Ty2
ccgguuuauccc

SEQ ID NO: 1781969 - RNA, 12 nt, Salmonella enterica enterica serovar Typhi Ty2
ccgguugcgcug

SEQ ID NO: 1781970 - RNA, 18 nt, Salmonella enterica enterica serovar Typhi Ty2
ccgguugaccggcccgcu

SEQ ID NO: 1781971 - RNA, 13 nt, Salmonella enterica enterica serovar Typhi Ty2
ccggugcgcccca

SEQ ID NO: 1781972 - RNA, 21 nt, Salmonella enterica enterica serovar Typhi Ty2
ccggugcgcaggccgcgccgc

SEQ ID NO: 1781973 - RNA, 16 nt, Salmonella enterica enterica serovar Typhi Ty2
ccgguggcgccacgcc

SEQ ID NO: 1781974 - RNA, 15 nt, Salmonella enterica enterica serovar Typhi Ty2
ccgguggcguggcgc

SEQ ID NO: 1781975 - RNA, 16 nt, Salmonella enterica enterica serovar Typhi Ty2
ccgguggcgcugcgcu

SEQ ID NO: 1781976 - RNA, 15 nt, Salmonella enterica enterica serovar Typhi Ty2
ccggugggcauauga

SEQ ID NO: 1781977 - RNA, 15 nt, Salmonella enterica enterica serovar Typhi Ty2
ccgguguaaaaaaug

SEQ ID NO: 1781978 - RNA, 19 nt, Salmonella enterica enterica serovar Typhi Ty2
ccgguagcuucagcggcgc

SEQ ID NO: 1781979 - RNA, 17 nt, Salmonella enterica enterica serovar Typhi Ty2
ccgguagcgagaagccg

SEQ ID NO: 1781980 - RNA, 13 nt, Salmonella enterica enterica serovar Typhi Ty2
ccggucauccagc

SEQ ID NO: 1781981 - RNA, 15 nt, Salmonella enterica enterica serovar Typhi Ty2
ccggucugcgcgccg

SEQ ID NO: 1781982 - RNA, 17 nt, Salmonella enterica enterica serovar Typhi Ty2
ccgguaagcgcagcgcc

SEQ ID NO: 1781983 - RNA, 20 nt, Salmonella enterica enterica serovar Typhi Ty2
ccgggugcaaauccaucuca

SEQ ID NO: 1781984 - RNA, 18 nt, Salmonella enterica enterica serovar Typhi Ty2
ccgggcgacacgcgcgcu

SEQ ID NO: 1781985 - RNA, 13 nt, Salmonella enterica enterica serovar Typhi Ty2
ccgggccgucagg

SEQ ID NO: 1781986 - RNA, 16 nt, Salmonella enterica enterica serovar Typhi Ty2
ccgggccgugacacau

SEQ ID NO: 1781987 - RNA, 16 nt, Salmonella enterica enterica serovar Typhi Ty2
ccgggccugagcgcgc

SEQ ID NO: 1781988 - RNA, 19 nt, Salmonella enterica enterica serovar Typhi Ty2
ccgggccugagcgcgcagc

SEQ ID NO: 1781989 - RNA, 14 nt, Salmonella enterica enterica serovar Typhi Ty2
ccggggcuggcggc

SEQ ID NO: 1781990 - RNA, 17 nt, Salmonella enterica enterica serovar Typhi Ty2
ccggggcuggcggcgau

SEQ ID NO: 1781991 - RNA, 16 nt, Salmonella enterica enterica serovar Typhi Ty2
ccgggcgcuuaccuaa

SEQ ID NO: 1781992 - RNA, 19 nt, Salmonella enterica enterica serovar Typhi Ty2
ccgggccgcuagcugcagc

SEQ ID NO: 1781993 - RNA, 14 nt, Salmonella enterica enterica serovar Typhi Ty2
ccgggauucaggga

SEQ ID NO: 1781994 - RNA, 18 nt, Salmonella enterica enterica serovar Typhi Ty2
ccucacugcguaaaaucg

SEQ ID NO: 1781995 - RNA, 12 nt, Salmonella enterica enterica serovar Typhi Ty2
ccucacuguuga

SEQ ID NO: 1781996 - RNA, 16 nt, Salmonella enterica enterica serovar Typhi Ty2
ccucaccguccgccag

SEQ ID NO: 1781997 - RNA, 22 nt, Salmonella enterica enterica serovar Typhi Ty2
ccucacgcuuaucgccaaacca

SEQ ID NO: 1781998 - RNA, 23 nt, Salmonella enterica enterica serovar Typhi Ty2
ccucacgcuuaucgccaaaccag

SEQ ID NO: 1781999 - RNA, 18 nt, Salmonella enterica enterica serovar Typhi Ty2
ccucacgcaaccagguca

SEQ ID NO: 1782000 - RNA, 15 nt, Salmonella enterica enterica serovar Typhi Ty2
ccucacguacuacgu

SEQ ID NO: 1782001 - RNA, 20 nt, Salmonella enterica enterica serovar Typhi Ty2
ccucaaugguuucacgcucu

SEQ ID NO: 1782002 - RNA, 16 nt, Salmonella enterica enterica serovar Typhi Ty2
ccucaauugccgccag

SEQ ID NO: 1782003 - RNA, 18 nt, Salmonella enterica enterica serovar Typhi Ty2
ccucaaguaaaaugcccu

SEQ ID NO: 1782004 - RNA, 23 nt, Salmonella enterica enterica serovar Typhi Ty2
ccuauuucaguacagccaaaaau

SEQ ID NO: 1782005 - RNA, 18 nt, Salmonella enterica enterica serovar Typhi Ty2
ccuauuuuaaauucccag

SEQ ID NO: 1782006 - RNA, 14 nt, Salmonella enterica enterica serovar Typhi Ty2
ccuauuaggcacua

SEQ ID NO: 1782007 - RNA, 14 nt, Salmonella enterica enterica serovar Typhi Ty2
ccucaaacaggcug

SEQ ID NO: 1782008 - RNA, 16 nt, Salmonella enterica enterica serovar Typhi Ty2
ccucaaacaggcuguc

SEQ ID NO: 1782009 - RNA, 19 nt, Salmonella enterica enterica serovar Typhi Ty2
ccucaaaauggaaaauaau

SEQ ID NO: 1782010 - RNA, 22 nt, Salmonella enterica enterica serovar Typhi Ty2
ccuauuuugcaaaacugaguug

SEQ ID NO: 1782011 - RNA, 14 nt, Salmonella enterica enterica serovar Typhi Ty2
ccuauuuugcaaaa

SEQ ID NO: 1782012 - RNA, 15 nt, Salmonella enterica enterica serovar Typhi Ty2
ccuauuuuacaaaau

SEQ ID NO: 1782013 - RNA, 19 nt, Salmonella enterica enterica serovar Typhi Ty2
ccuauuuuaaauucccagc

SEQ ID NO: 1782014 - RNA, 16 nt, Salmonella enterica enterica serovar Typhi Ty2
ccucaaaaccgggcag

SEQ ID NO: 1782015 - RNA, 17 nt, Salmonella enterica enterica serovar Typhi Ty2
ccucaacaucucuucgu

SEQ ID NO: 1782016 - RNA, 18 nt, Salmonella enterica enterica serovar Typhi Ty2
ccucaacauugccggcau

SEQ ID NO: 1782017 - RNA, 21 nt, Salmonella enterica enterica serovar Typhi Ty2
ccucaacgucgcucagaauag

SEQ ID NO: 1782018 - RNA, 18 nt, Salmonella enterica enterica serovar Typhi Ty2
ccuacucucgcaugggga

SEQ ID NO: 1782019 - RNA, 19 nt, Salmonella enterica enterica serovar Typhi Ty2
ccuacugcccuacgcuucu

SEQ ID NO: 1782020 - RNA, 18 nt, Salmonella enterica enterica serovar Typhi Ty2
ccuacacauugagcgaga

SEQ ID NO: 1782021 - RNA, 17 nt, Salmonella enterica enterica serovar Typhi Ty2
ccuacacaaaaucauuc

SEQ ID NO: 1782022 - RNA, 18 nt, Salmonella enterica enterica serovar Typhi Ty2
ccuacaaggcauucaggc

SEQ ID NO: 1782023 - RNA, 21 nt, Salmonella enterica enterica serovar Typhi Ty2
ccuagcgucccggcaauacug

SEQ ID NO: 1782024 - RNA, 14 nt, Salmonella enterica enterica serovar Typhi Ty2
ccuaggccagugcc

SEQ ID NO: 1782025 - RNA, 16 nt, Salmonella enterica enterica serovar Typhi Ty2
ccuauaagcugccucu

SEQ ID NO: 1782026 - RNA, 17 nt, Salmonella enterica enterica serovar Typhi Ty2
ccuauaagcugccucuu

SEQ ID NO: 1782027 - RNA, 22 nt, Salmonella enterica enterica serovar Typhi Ty2
ccuaucaggaucaaaaucgcgc

SEQ ID NO: 1782028 - RNA, 17 nt, Salmonella enterica enterica serovar Typhi Ty2
ccuauauuaguguuaua

SEQ ID NO: 1782029 - RNA, 21 nt, Salmonella enterica enterica serovar Typhi Ty2
ccgugcaaaaucacgcggcgc

SEQ ID NO: 1782030 - RNA, 23 nt, Salmonella enterica enterica serovar Typhi Ty2
ccgugaugcggacgcugacgcca

SEQ ID NO: 1782031 - RNA, 23 nt, Salmonella enterica enterica serovar Typhi Ty2
ccgugcaguuuugcuucaugcac

SEQ ID NO: 1782032 - RNA, 17 nt, Salmonella enterica enterica serovar Typhi Ty2
ccgucgccaucaccagg

SEQ ID NO: 1782033 - RNA, 15 nt, Salmonella enterica enterica serovar Typhi Ty2
ccguggcauucgcuu

SEQ ID NO: 1782034 - RNA, 22 nt, Salmonella enterica enterica serovar Typhi Ty2
ccguguuuuuuacaggcauccg

SEQ ID NO: 1782035 - RNA, 23 nt, Salmonella enterica enterica serovar Typhi Ty2
ccguuaaaccaaagguauugccu

SEQ ID NO: 1782036 - RNA, 23 nt, Salmonella enterica enterica serovar Typhi Ty2
ccguuaaacugcgcgauaucugc

SEQ ID NO: 1782037 - RNA, 14 nt, Salmonella enterica enterica serovar Typhi Ty2
ccguuacuuccccc

SEQ ID NO: 1782038 - RNA, 18 nt, Salmonella enterica enterica serovar Typhi Ty2
ccguuacgcagucagcac

SEQ ID NO: 1782039 - RNA, 13 nt, Salmonella enterica enterica serovar Typhi Ty2
ccguuacaaauag

SEQ ID NO: 1782040 - RNA, 13 nt, Salmonella enterica enterica serovar Typhi Ty2
ccguuaagcccug

SEQ ID NO: 1782041 - RNA, 21 nt, Salmonella enterica enterica serovar Typhi Ty2
ccguuaugcaguucaaaaggu

SEQ ID NO: 1782042 - RNA, 13 nt, Salmonella enterica enterica serovar Typhi Ty2
ccuaauaaaauaa

SEQ ID NO: 1782043 - RNA, 15 nt, Salmonella enterica enterica serovar Typhi Ty2
ccuaauaaaauaacu

SEQ ID NO: 1782044 - RNA, 21 nt, Salmonella enterica enterica serovar Typhi Ty2
ccuaaauccguuaagcccuga

SEQ ID NO: 1782045 - RNA, 16 nt, Salmonella enterica enterica serovar Typhi Ty2
ccguuguugcaccacc

SEQ ID NO: 1782046 - RNA, 16 nt, Salmonella enterica enterica serovar Typhi Ty2
ccguuuuggcagcgcc

SEQ ID NO: 1782047 - RNA, 16 nt, Salmonella enterica enterica serovar Typhi Ty2
ccguuguuuggcagga

SEQ ID NO: 1782048 - RNA, 16 nt, Salmonella enterica enterica serovar Typhi Ty2
ccguuuuuaauuugcu

SEQ ID NO: 1782049 - RNA, 23 nt, Salmonella enterica enterica serovar Typhi Ty2
ccuaaaccaaacaccagaucauu

SEQ ID NO: 1782050 - RNA, 17 nt, Salmonella enterica enterica serovar Typhi Ty2
ccguugaccagcugacg

SEQ ID NO: 1782051 - RNA, 20 nt, Salmonella enterica enterica serovar Typhi Ty2
ccguugucacaggcuuggca

SEQ ID NO: 1782052 - RNA, 21 nt, Salmonella enterica enterica serovar Typhi Ty2
ccguugucuucaccuugcugc

SEQ ID NO: 1782053 - RNA, 14 nt, Salmonella enterica enterica serovar Typhi Ty2
ccggcacacagaau

SEQ ID NO: 1782054 - RNA, 21 nt, Salmonella enterica enterica serovar Typhi Ty2
ccggcaauuaccgccagcggc

SEQ ID NO: 1782055 - RNA, 20 nt, Salmonella enterica enterica serovar Typhi Ty2
ccggcacaccggccauugcc

SEQ ID NO: 1782056 - RNA, 21 nt, Salmonella enterica enterica serovar Typhi Ty2
ccggcacauccagcgccugcu

SEQ ID NO: 1782057 - RNA, 21 nt, Salmonella enterica enterica serovar Typhi Ty2
ccggcacaccggccauugccg

SEQ ID NO: 1782058 - RNA, 16 nt, Salmonella enterica enterica serovar Typhi Ty2
ccggcacauccagcug

SEQ ID NO: 1782059 - RNA, 20 nt, Salmonella enterica enterica serovar Typhi Ty2
ccggcaaugauaucggccgg

SEQ ID NO: 1782060 - RNA, 14 nt, Salmonella enterica enterica serovar Typhi Ty2
ccggcaaacucagc

SEQ ID NO: 1782061 - RNA, 17 nt, Salmonella enterica enterica serovar Typhi Ty2
ccggcaaacucagcggc

SEQ ID NO: 1782062 - RNA, 23 nt, Salmonella enterica enterica serovar Typhi Ty2
ccggcaguccuugcagccagaac

SEQ ID NO: 1782063 - RNA, 12 nt, Salmonella enterica enterica serovar Typhi Ty2
ccggcaguccau

SEQ ID NO: 1782064 - RNA, 21 nt, Salmonella enterica enterica serovar Typhi Ty2
ccggcaucauucugcaggcgg

SEQ ID NO: 1782065 - RNA, 19 nt, Salmonella enterica enterica serovar Typhi Ty2
ccggcaucacaaaccagac

SEQ ID NO: 1782066 - RNA, 14 nt, Salmonella enterica enterica serovar Typhi Ty2
ccggcaucggcagc

SEQ ID NO: 1782067 - RNA, 20 nt, Salmonella enterica enterica serovar Typhi Ty2
ccggcccgcuaucaccgccc

SEQ ID NO: 1782068 - RNA, 21 nt, Salmonella enterica enterica serovar Typhi Ty2
ccggaccuaauagccagcccc

SEQ ID NO: 1782069 - RNA, 11 nt, Salmonella enterica enterica serovar Typhi Ty2
ccggaccuaau

SEQ ID NO: 1782070 - RNA, 13 nt, Salmonella enterica enterica serovar Typhi Ty2
ccgcuucuuccau

SEQ ID NO: 1782071 - RNA, 14 nt, Salmonella enterica enterica serovar Typhi Ty2
ccggacgcccgucc

SEQ ID NO: 1782072 - RNA, 18 nt, Salmonella enterica enterica serovar Typhi Ty2
ccggacgaucaauaaaau

SEQ ID NO: 1782073 - RNA, 15 nt, Salmonella enterica enterica serovar Typhi Ty2
ccggagguuuuucug

SEQ ID NO: 1782074 - RNA, 17 nt, Salmonella enterica enterica serovar Typhi Ty2
ccggagccggucggcgc

SEQ ID NO: 1782075 - RNA, 22 nt, Salmonella enterica enterica serovar Typhi Ty2
ccggaggauauuuauucccccu

SEQ ID NO: 1782076 - RNA, 13 nt, Salmonella enterica enterica serovar Typhi Ty2
ccggaucaucuuu

SEQ ID NO: 1782077 - RNA, 23 nt, Salmonella enterica enterica serovar Typhi Ty2
ccggaucaauaaacagcuccgca

SEQ ID NO: 1782078 - RNA, 17 nt, Salmonella enterica enterica serovar Typhi Ty2
ccggaucggucuggcgc

SEQ ID NO: 1782079 - RNA, 14 nt, Salmonella enterica enterica serovar Typhi Ty2
ccggaugcagucug

SEQ ID NO: 1782080 - RNA, 15 nt, Salmonella enterica enterica serovar Typhi Ty2
ccggauugcccgcgg

SEQ ID NO: 1782081 - RNA, 22 nt, Salmonella enterica enterica serovar Typhi Ty2
ccggauuaaggcguuugcgccg

SEQ ID NO: 1782082 - RNA, 14 nt, Salmonella enterica enterica serovar Typhi Ty2
ccggauuccagaau

SEQ ID NO: 1782083 - RNA, 23 nt, Salmonella enterica enterica serovar Typhi Ty2
ccggaugcgccucaucugcuuca

SEQ ID NO: 1782084 - RNA, 22 nt, Salmonella enterica enterica serovar Typhi Ty2
ccggaugcguguucagguuggc

SEQ ID NO: 1782085 - RNA, 14 nt, Salmonella enterica enterica serovar Typhi Ty2
ccggauggcggcgc

SEQ ID NO: 1782086 - RNA, 19 nt, Salmonella enterica enterica serovar Typhi Ty2
ccggauggcgcuaaugcuu

SEQ ID NO: 1782087 - RNA, 15 nt, Salmonella enterica enterica serovar Typhi Ty2
ccggcgcguaauucc

SEQ ID NO: 1782088 - RNA, 16 nt, Salmonella enterica enterica serovar Typhi Ty2
ccggcgcgggcgagau

SEQ ID NO: 1782089 - RNA, 12 nt, Salmonella enterica enterica serovar Typhi Ty2
ccggcgcggcgc

SEQ ID NO: 1782090 - RNA, 13 nt, Salmonella enterica enterica serovar Typhi Ty2
ccggcgcggcauc

SEQ ID NO: 1782091 - RNA, 19 nt, Salmonella enterica enterica serovar Typhi Ty2
ccggcgcguuuuggcagac

SEQ ID NO: 1782092 - RNA, 14 nt, Salmonella enterica enterica serovar Typhi Ty2
ccggcggaauagcu

SEQ ID NO: 1782093 - RNA, 20 nt, Salmonella enterica enterica serovar Typhi Ty2
ccggcgcugcgcggcgugca

SEQ ID NO: 1782094 - RNA, 22 nt, Salmonella enterica enterica serovar Typhi Ty2
ccggcgcuggacaaaccacagu

SEQ ID NO: 1782095 - RNA, 11 nt, Salmonella enterica enterica serovar Typhi Ty2
ccggcgcgcca

SEQ ID NO: 1782096 - RNA, 19 nt, Salmonella enterica enterica serovar Typhi Ty2
ccggcgccgaucaucccgc

SEQ ID NO: 1782097 - RNA, 19 nt, Salmonella enterica enterica serovar Typhi Ty2
ccggcgccagcucaacgcc

SEQ ID NO: 1782098 - RNA, 13 nt, Salmonella enterica enterica serovar Typhi Ty2
ccggcgauggugc

SEQ ID NO: 1782099 - RNA, 16 nt, Salmonella enterica enterica serovar Typhi Ty2
ccggcgauguuggcgc

SEQ ID NO: 1782100 - RNA, 14 nt, Salmonella enterica enterica serovar Typhi Ty2
ccggcgcauccagu

SEQ ID NO: 1782101 - RNA, 13 nt, Salmonella enterica enterica serovar Typhi Ty2
ccggccugcaaac

SEQ ID NO: 1782102 - RNA, 17 nt, Salmonella enterica enterica serovar Typhi Ty2
ccggcgaauagcgccag

SEQ ID NO: 1782103 - RNA, 18 nt, Salmonella enterica enterica serovar Typhi Ty2
ccggcgagugccugcugg

SEQ ID NO: 1782104 - RNA, 23 nt, Salmonella enterica enterica serovar Typhi Ty2
ccggcgauaacccgcgcauggcc

SEQ ID NO: 1782105 - RNA, 17 nt, Salmonella enterica enterica serovar Typhi Ty2
ccggcgauagcggccug

SEQ ID NO: 1782106 - RNA, 17 nt, Salmonella enterica enterica serovar Typhi Ty2
ccggcgaaagcggacac

SEQ ID NO: 1782107 - RNA, 13 nt, Salmonella enterica enterica serovar Typhi Ty2
ccggccuggcgca

SEQ ID NO: 1782108 - RNA, 16 nt, Salmonella enterica enterica serovar Typhi Ty2
ccgcgcgcgcggcauc

SEQ ID NO: 1782109 - RNA, 15 nt, Salmonella enterica enterica serovar Typhi Ty2
ccgcgcgcuuuccac

SEQ ID NO: 1782110 - RNA, 17 nt, Salmonella enterica enterica serovar Typhi Ty2
ccgcgccaaacguggcg

SEQ ID NO: 1782111 - RNA, 13 nt, Salmonella enterica enterica serovar Typhi Ty2
ccgcgccacccca

SEQ ID NO: 1782112 - RNA, 18 nt, Salmonella enterica enterica serovar Typhi Ty2
ccgcgcuagugccgccag

SEQ ID NO: 1782113 - RNA, 15 nt, Salmonella enterica enterica serovar Typhi Ty2
ccgcgcgucagcgug

SEQ ID NO: 1782114 - RNA, 22 nt, Salmonella enterica enterica serovar Typhi Ty2
ccgcgcuagugccgccaggcaa

SEQ ID NO: 1782115 - RNA, 19 nt, Salmonella enterica enterica serovar Typhi Ty2
ccgcggagaucgcucccgc

SEQ ID NO: 1782116 - RNA, 18 nt, Salmonella enterica enterica serovar Typhi Ty2
ccgcggagaucgcucccg

SEQ ID NO: 1782117 - RNA, 19 nt, Salmonella enterica enterica serovar Typhi Ty2
ccgcgcuuucuggcgcaga

SEQ ID NO: 1782118 - RNA, 14 nt, Salmonella enterica enterica serovar Typhi Ty2
ccgccgccggccug

SEQ ID NO: 1782119 - RNA, 13 nt, Salmonella enterica enterica serovar Typhi Ty2
ccgccgcgaaaac

SEQ ID NO: 1782120 - RNA, 14 nt, Salmonella enterica enterica serovar Typhi Ty2
ccgccgcccguccg

SEQ ID NO: 1782121 - RNA, 13 nt, Salmonella enterica enterica serovar Typhi Ty2
ccgccgcccagcg

SEQ ID NO: 1782122 - RNA, 18 nt, Salmonella enterica enterica serovar Typhi Ty2
ccgccugccgcgccgccg

SEQ ID NO: 1782123 - RNA, 18 nt, Salmonella enterica enterica serovar Typhi Ty2
ccgccugcgccagcgccg

SEQ ID NO: 1782124 - RNA, 12 nt, Salmonella enterica enterica serovar Typhi Ty2
ccgccugcugug

SEQ ID NO: 1782125 - RNA, 19 nt, Salmonella enterica enterica serovar Typhi Ty2
ccgccuuaagaauguccau

SEQ ID NO: 1782126 - RNA, 15 nt, Salmonella enterica enterica serovar Typhi Ty2
ccgccuuaccgcggu

SEQ ID NO: 1782127 - RNA, 16 nt, Salmonella enterica enterica serovar Typhi Ty2
ccgcgauacggauagc

SEQ ID NO: 1782128 - RNA, 20 nt, Salmonella enterica enterica serovar Typhi Ty2
ccgcugguugccuuccugau

SEQ ID NO: 1782129 - RNA, 23 nt, Salmonella enterica enterica serovar Typhi Ty2
ccgcuucggacuccugacgcuga

SEQ ID NO: 1782130 - RNA, 14 nt, Salmonella enterica enterica serovar Typhi Ty2
ccgcuucgcgggac

SEQ ID NO: 1782131 - RNA, 16 nt, Salmonella enterica enterica serovar Typhi Ty2
ccgcuucgcgcgccag

SEQ ID NO: 1782132 - RNA, 23 nt, Salmonella enterica enterica serovar Typhi Ty2
ccgcugcggaacaccagcgccgc

SEQ ID NO: 1782133 - RNA, 19 nt, Salmonella enterica enterica serovar Typhi Ty2
ccgcugcggucaggaauga

SEQ ID NO: 1782134 - RNA, 19 nt, Salmonella enterica enterica serovar Typhi Ty2
ccgcugcugccuuccaguu

SEQ ID NO: 1782135 - RNA, 19 nt, Salmonella enterica enterica serovar Typhi Ty2
ccgcucgcuuacgcggcgc

SEQ ID NO: 1782136 - RNA, 15 nt, Salmonella enterica enterica serovar Typhi Ty2
ccgcucgccauaucu

SEQ ID NO: 1782137 - RNA, 17 nt, Salmonella enterica enterica serovar Typhi Ty2
ccgcucgccgccucccc

SEQ ID NO: 1782138 - RNA, 18 nt, Salmonella enterica enterica serovar Typhi Ty2
ccgcucccgcauggacaa

SEQ ID NO: 1782139 - RNA, 24 nt, Salmonella enterica enterica serovar Typhi Ty2
ccgcugacgcugcccgccggacag

SEQ ID NO: 1782140 - RNA, 22 nt, Salmonella enterica enterica serovar Typhi Ty2
ccgcucggcauacaccgccagc

SEQ ID NO: 1782141 - RNA, 16 nt, Salmonella enterica enterica serovar Typhi Ty2
ccgcugcaacucccgc

SEQ ID NO: 1782142 - RNA, 19 nt, Salmonella enterica enterica serovar Typhi Ty2
ccgcugauguuuugcgccg

SEQ ID NO: 1782143 - RNA, 15 nt, Salmonella enterica enterica serovar Typhi Ty2
ccgcuaucgaccagc

SEQ ID NO: 1782144 - RNA, 22 nt, Salmonella enterica enterica serovar Typhi Ty2
ccgcucauuagggugcagugaa

SEQ ID NO: 1782145 - RNA, 21 nt, Salmonella enterica enterica serovar Typhi Ty2
ccgcuacccggcacaaugccc

SEQ ID NO: 1782146 - RNA, 19 nt, Salmonella enterica enterica serovar Typhi Ty2
ccgcuacguaauucaugca

SEQ ID NO: 1782147 - RNA, 14 nt, Salmonella enterica enterica serovar Typhi Ty2
ccgcuacuccgccc

SEQ ID NO: 1782148 - RNA, 14 nt, Salmonella enterica enterica serovar Typhi Ty2
ccgcuacaauccag

SEQ ID NO: 1782149 - RNA, 17 nt, Salmonella enterica enterica serovar Typhi Ty2
ccgcggcgaucuccuga

SEQ ID NO: 1782150 - RNA, 17 nt, Salmonella enterica enterica serovar Typhi Ty2
ccgauagcuaucacaca

SEQ ID NO: 1782151 - RNA, 17 nt, Salmonella enterica enterica serovar Typhi Ty2
ccgauacaggacugacu

SEQ ID NO: 1782152 - RNA, 23 nt, Salmonella enterica enterica serovar Typhi Ty2
ccgauacaggacugacugcuguc

SEQ ID NO: 1782153 - RNA, 22 nt, Salmonella enterica enterica serovar Typhi Ty2
ccgaucgagucacccugcaaca

SEQ ID NO: 1782154 - RNA, 14 nt, Salmonella enterica enterica serovar Typhi Ty2
ccgaguaacaccgc

SEQ ID NO: 1782155 - RNA, 15 nt, Salmonella enterica enterica serovar Typhi Ty2
ccgauaacgcggccc

SEQ ID NO: 1782156 - RNA, 19 nt, Salmonella enterica enterica serovar Typhi Ty2
ccgaggacgggacuugaac

SEQ ID NO: 1782157 - RNA, 20 nt, Salmonella enterica enterica serovar Typhi Ty2
ccgacugucgaaaccagcau

SEQ ID NO: 1782158 - RNA, 16 nt, Salmonella enterica enterica serovar Typhi Ty2
ccgacucugacgccgg

SEQ ID NO: 1782159 - RNA, 23 nt, Salmonella enterica enterica serovar Typhi Ty2
ccgagcaggacgcgcgcgaaaag

SEQ ID NO: 1782160 - RNA, 23 nt, Salmonella enterica enterica serovar Typhi Ty2
ccgacggccucuucacgcagcgc

SEQ ID NO: 1782161 - RNA, 22 nt, Salmonella enterica enterica serovar Typhi Ty2
ccgaccuggcggucggcuuugu

SEQ ID NO: 1782162 - RNA, 22 nt, Salmonella enterica enterica serovar Typhi Ty2
ccgacccauacucuuucccggc

SEQ ID NO: 1782163 - RNA, 15 nt, Salmonella enterica enterica serovar Typhi Ty2
ccgaccauuacccac

SEQ ID NO: 1782164 - RNA, 17 nt, Salmonella enterica enterica serovar Typhi Ty2
ccgacacaguaaaaaaa

SEQ ID NO: 1782165 - RNA, 16 nt, Salmonella enterica enterica serovar Typhi Ty2
ccgacacauucaggcu

SEQ ID NO: 1782166 - RNA, 20 nt, Salmonella enterica enterica serovar Typhi Ty2
ccgacaauauucgccgcgau

SEQ ID NO: 1782167 - RNA, 22 nt, Salmonella enterica enterica serovar Typhi Ty2
ccgacaauuuugauaagagaaa

SEQ ID NO: 1782168 - RNA, 18 nt, Salmonella enterica enterica serovar Typhi Ty2
ccgacaagccccccgcac

SEQ ID NO: 1782169 - RNA, 19 nt, Salmonella enterica enterica serovar Typhi Ty2
ccgacaauauucgccgcga

SEQ ID NO: 1782170 - RNA, 12 nt, Salmonella enterica enterica serovar Typhi Ty2
ccgaaucuugca

SEQ ID NO: 1782171 - RNA, 18 nt, Salmonella enterica enterica serovar Typhi Ty2
ccgaaugcguuuuuucac

SEQ ID NO: 1782172 - RNA, 18 nt, Salmonella enterica enterica serovar Typhi Ty2
ccgaccaauugcaggcag

SEQ ID NO: 1782173 - RNA, 15 nt, Salmonella enterica enterica serovar Typhi Ty2
ccgaccaccgcccug

SEQ ID NO: 1782174 - RNA, 22 nt, Salmonella enterica enterica serovar Typhi Ty2
ccgacaugguuaaccaccagcg

SEQ ID NO: 1782175 - RNA, 19 nt, Salmonella enterica enterica serovar Typhi Ty2
ccgaccaucgcgccgcugg

SEQ ID NO: 1782176 - RNA, 22 nt, Salmonella enterica enterica serovar Typhi Ty2
ccgaccauccagacaugcacau

SEQ ID NO: 1782177 - RNA, 16 nt, Salmonella enterica enterica serovar Typhi Ty2
ccgacaggguuugcca

SEQ ID NO: 1782178 - RNA, 13 nt, Salmonella enterica enterica serovar Typhi Ty2
ccgacagcggaaa

SEQ ID NO: 1782179 - RNA, 17 nt, Salmonella enterica enterica serovar Typhi Ty2
ccgacauagcugaacaa

SEQ ID NO: 1782180 - RNA, 18 nt, Salmonella enterica enterica serovar Typhi Ty2
cccuuuuuaaaaugaccg

SEQ ID NO: 1782181 - RNA, 11 nt, Salmonella enterica enterica serovar Typhi Ty2
cccuuuuucaa

SEQ ID NO: 1782182 - RNA, 13 nt, Salmonella enterica enterica serovar Typhi Ty2
cccuuuuucaauu

SEQ ID NO: 1782183 - RNA, 16 nt, Salmonella enterica enterica serovar Typhi Ty2
ccgaaagaaagacgcu

SEQ ID NO: 1782184 - RNA, 17 nt, Salmonella enterica enterica serovar Typhi Ty2
ccgaaagcgaccuucuc

SEQ ID NO: 1782185 - RNA, 16 nt, Salmonella enterica enterica serovar Typhi Ty2
ccgaaauccaccagcg

SEQ ID NO: 1782186 - RNA, 16 nt, Salmonella enterica enterica serovar Typhi Ty2
cccuuuacacguucca

SEQ ID NO: 1782187 - RNA, 19 nt, Salmonella enterica enterica serovar Typhi Ty2
cccuuucgguucgccgcgc

SEQ ID NO: 1782188 - RNA, 18 nt, Salmonella enterica enterica serovar Typhi Ty2
cccuuguuauccuaaauc

SEQ ID NO: 1782189 - RNA, 22 nt, Salmonella enterica enterica serovar Typhi Ty2
cccuuguacaggauauacuuca

SEQ ID NO: 1782190 - RNA, 13 nt, Salmonella enterica enterica serovar Typhi Ty2
cccucgccagcaa

SEQ ID NO: 1782191 - RNA, 15 nt, Salmonella enterica enterica serovar Typhi Ty2
ccgcaugugcggcgc

SEQ ID NO: 1782192 - RNA, 16 nt, Salmonella enterica enterica serovar Typhi Ty2
ccgcauuauaaauauc

SEQ ID NO: 1782193 - RNA, 17 nt, Salmonella enterica enterica serovar Typhi Ty2
ccgcauugagcaacccu

SEQ ID NO: 1782194 - RNA, 17 nt, Salmonella enterica enterica serovar Typhi Ty2
ccgcaucgcccgcuccc

SEQ ID NO: 1782195 - RNA, 19 nt, Salmonella enterica enterica serovar Typhi Ty2
ccgcaucgauacccugcug

SEQ ID NO: 1782196 - RNA, 14 nt, Salmonella enterica enterica serovar Typhi Ty2
ccgcaucaaugccc

SEQ ID NO: 1782197 - RNA, 18 nt, Salmonella enterica enterica serovar Typhi Ty2
ccgccaagcgcggacagc

SEQ ID NO: 1782198 - RNA, 16 nt, Salmonella enterica enterica serovar Typhi Ty2
ccgccaauaaccaccu

SEQ ID NO: 1782199 - RNA, 18 nt, Salmonella enterica enterica serovar Typhi Ty2
ccgccaacgccagcagcg

SEQ ID NO: 1782200 - RNA, 13 nt, Salmonella enterica enterica serovar Typhi Ty2
ccgccaacgccaa

SEQ ID NO: 1782201 - RNA, 23 nt, Salmonella enterica enterica serovar Typhi Ty2
ccgcauuuaacaggacgcuccau

SEQ ID NO: 1782202 - RNA, 24 nt, Salmonella enterica enterica serovar Typhi Ty2
ccgccaaacugcgcgccgcccugc

SEQ ID NO: 1782203 - RNA, 14 nt, Salmonella enterica enterica serovar Typhi Ty2
ccgccaaagcgccc

SEQ ID NO: 1782204 - RNA, 12 nt, Salmonella enterica enterica serovar Typhi Ty2
ccgccaccagca

SEQ ID NO: 1782205 - RNA, 14 nt, Salmonella enterica enterica serovar Typhi Ty2
ccgccaccacgccc

SEQ ID NO: 1782206 - RNA, 13 nt, Salmonella enterica enterica serovar Typhi Ty2
ccgccaccacaaa

SEQ ID NO: 1782207 - RNA, 14 nt, Salmonella enterica enterica serovar Typhi Ty2
ccgccaccacaaag

SEQ ID NO: 1782208 - RNA, 11 nt, Salmonella enterica enterica serovar Typhi Ty2
ccgccaccacg

SEQ ID NO: 1782209 - RNA, 23 nt, Salmonella enterica enterica serovar Typhi Ty2
ccgcacgcgaccagacacggugu

SEQ ID NO: 1782210 - RNA, 23 nt, Salmonella enterica enterica serovar Typhi Ty2
ccgcagcaaucagguauuuccug

SEQ ID NO: 1782211 - RNA, 10 nt, Salmonella enterica enterica serovar Typhi Ty2
ccgcagccgg

SEQ ID NO: 1782212 - RNA, 17 nt, Salmonella enterica enterica serovar Typhi Ty2
ccgauggacucccaggu

SEQ ID NO: 1782213 - RNA, 13 nt, Salmonella enterica enterica serovar Typhi Ty2
ccgcaaucuggcg

SEQ ID NO: 1782214 - RNA, 21 nt, Salmonella enterica enterica serovar Typhi Ty2
ccgcaccuggguauuccacug

SEQ ID NO: 1782215 - RNA, 18 nt, Salmonella enterica enterica serovar Typhi Ty2
ccgccagcgacauggcgg

SEQ ID NO: 1782216 - RNA, 13 nt, Salmonella enterica enterica serovar Typhi Ty2
ccgccagcgccgc

SEQ ID NO: 1782217 - RNA, 12 nt, Salmonella enterica enterica serovar Typhi Ty2
ccgccagcgccu

SEQ ID NO: 1782218 - RNA, 13 nt, Salmonella enterica enterica serovar Typhi Ty2
ccgccagcagagc

SEQ ID NO: 1782219 - RNA, 11 nt, Salmonella enterica enterica serovar Typhi Ty2
ccgccagcagu

SEQ ID NO: 1782220 - RNA, 14 nt, Salmonella enterica enterica serovar Typhi Ty2
ccgccagccccacc

SEQ ID NO: 1782221 - RNA, 17 nt, Salmonella enterica enterica serovar Typhi Ty2
ccgccagucacccugcc

SEQ ID NO: 1782222 - RNA, 21 nt, Salmonella enterica enterica serovar Typhi Ty2
ccgccaggucuuuaucuauca

SEQ ID NO: 1782223 - RNA, 13 nt, Salmonella enterica enterica serovar Typhi Ty2
ccgccagcggcgc

SEQ ID NO: 1782224 - RNA, 15 nt, Salmonella enterica enterica serovar Typhi Ty2
ccgccagcggcgcca

SEQ ID NO: 1782225 - RNA, 18 nt, Salmonella enterica enterica serovar Typhi Ty2
ccgccagcaccaggcucg

SEQ ID NO: 1782226 - RNA, 15 nt, Salmonella enterica enterica serovar Typhi Ty2
ccgccagcaaugccg

SEQ ID NO: 1782227 - RNA, 20 nt, Salmonella enterica enterica serovar Typhi Ty2
ccgccagauuauccaguccc

SEQ ID NO: 1782228 - RNA, 13 nt, Salmonella enterica enterica serovar Typhi Ty2
ccgccagacucag

SEQ ID NO: 1782229 - RNA, 16 nt, Salmonella enterica enterica serovar Typhi Ty2
ccgccagacucagcca

SEQ ID NO: 1782230 - RNA, 19 nt, Salmonella enterica enterica serovar Typhi Ty2
ccgccacgccgcuccacag

SEQ ID NO: 1782231 - RNA, 13 nt, Salmonella enterica enterica serovar Typhi Ty2
ccgccaccgccgc

SEQ ID NO: 1782232 - RNA, 15 nt, Salmonella enterica enterica serovar Typhi Ty2
ccgccaccgccucgc

SEQ ID NO: 1782233 - RNA, 23 nt, Salmonella enterica enterica serovar Typhi Ty2
ccgcccuucacaaccaucgucug

SEQ ID NO: 1782234 - RNA, 14 nt, Salmonella enterica enterica serovar Typhi Ty2
ccgcccggcgcgcu

SEQ ID NO: 1782235 - RNA, 16 nt, Salmonella enterica enterica serovar Typhi Ty2
ccgcccggacccgcuu

SEQ ID NO: 1782236 - RNA, 20 nt, Salmonella enterica enterica serovar Typhi Ty2
ccgccgaacagacggcggcu

SEQ ID NO: 1782237 - RNA, 20 nt, Salmonella enterica enterica serovar Typhi Ty2
ccgccgagcauuuccgcagc

SEQ ID NO: 1782238 - RNA, 15 nt, Salmonella enterica enterica serovar Typhi Ty2
ccgccauccggccug

SEQ ID NO: 1782239 - RNA, 19 nt, Salmonella enterica enterica serovar Typhi Ty2
ccgccauccggcacaguau

SEQ ID NO: 1782240 - RNA, 24 nt, Salmonella enterica enterica serovar Typhi Ty2
ccgccauauauuuacugaauaaau

SEQ ID NO: 1782241 - RNA, 16 nt, Salmonella enterica enterica serovar Typhi Ty2
ccgccauauauuuacu

SEQ ID NO: 1782242 - RNA, 15 nt, Salmonella enterica enterica serovar Typhi Ty2
ccgccaucacaccaa

SEQ ID NO: 1782243 - RNA, 11 nt, Salmonella enterica enterica serovar Typhi Ty2
ccgccaucaug

SEQ ID NO: 1782244 - RNA, 17 nt, Salmonella enterica enterica serovar Typhi Ty2
ccgccaguugcucaaca

SEQ ID NO: 1782245 - RNA, 21 nt, Salmonella enterica enterica serovar Typhi Ty2
ccgccaguuuguaaccaacaa

SEQ ID NO: 1782246 - RNA, 15 nt, Salmonella enterica enterica serovar Typhi Ty2
ccgccauaagaaugu

SEQ ID NO: 1782247 - RNA, 19 nt, Salmonella enterica enterica serovar Typhi Ty2
ccgccauacccggcuccca

SEQ ID NO: 1782248 - RNA, 23 nt, Salmonella enterica enterica serovar Typhi Ty2
ccgccaguaauuuuucucccagc

SEQ ID NO: 1782249 - RNA, 17 nt, Salmonella enterica enterica serovar Typhi Ty2
ccgcccaacagggcggc

SEQ ID NO: 1782250 - RNA, 14 nt, Salmonella enterica enterica serovar Typhi Ty2
ccgccaucgacagc

SEQ ID NO: 1782251 - RNA, 22 nt, Salmonella enterica enterica serovar Typhi Ty2
ccgcccagaaagaucagcagaa

SEQ ID NO: 1782252 - RNA, 12 nt, Salmonella enterica enterica serovar Typhi Ty2
ccgcccagaacg

SEQ ID NO: 1782253 - RNA, 15 nt, Salmonella enterica enterica serovar Typhi Ty2
cauccgguuuuaaau

SEQ ID NO: 1782254 - RNA, 18 nt, Salmonella enterica enterica serovar Typhi Ty2
cauccggguuaaaccagc

SEQ ID NO: 1782255 - RNA, 19 nt, Salmonella enterica enterica serovar Typhi Ty2
cauccggaugguuaagcag

SEQ ID NO: 1782256 - RNA, 19 nt, Salmonella enterica enterica serovar Typhi Ty2
cauccggcguugcgccgcc

SEQ ID NO: 1782257 - RNA, 20 nt, Salmonella enterica enterica serovar Typhi Ty2
cauccgggaguuucaugcca

SEQ ID NO: 1782258 - RNA, 13 nt, Salmonella enterica enterica serovar Typhi Ty2
cauccggacgcca

SEQ ID NO: 1782259 - RNA, 15 nt, Salmonella enterica enterica serovar Typhi Ty2
cauccggacgccagu

SEQ ID NO: 1782260 - RNA, 15 nt, Salmonella enterica enterica serovar Typhi Ty2
cauccgcucccgcuu

SEQ ID NO: 1782261 - RNA, 15 nt, Salmonella enterica enterica serovar Typhi Ty2
cauccgccagcgccu

SEQ ID NO: 1782262 - RNA, 19 nt, Salmonella enterica enterica serovar Typhi Ty2
cauccagacaugcacaugg

SEQ ID NO: 1782263 - RNA, 19 nt, Salmonella enterica enterica serovar Typhi Ty2
cauccgccagcgccucuuc

SEQ ID NO: 1782264 - RNA, 18 nt, Salmonella enterica enterica serovar Typhi Ty2
cauccgcccggcaucaag

SEQ ID NO: 1782265 - RNA, 16 nt, Salmonella enterica enterica serovar Typhi Ty2
cauccugauuuuacug

SEQ ID NO: 1782266 - RNA, 13 nt, Salmonella enterica enterica serovar Typhi Ty2
cauccucuccuga

SEQ ID NO: 1782267 - RNA, 19 nt, Salmonella enterica enterica serovar Typhi Ty2
cauccucuuggguuauuuc

SEQ ID NO: 1782268 - RNA, 21 nt, Salmonella enterica enterica serovar Typhi Ty2
cauccucuuggguuauuucga

SEQ ID NO: 1782269 - RNA, 20 nt, Salmonella enterica enterica serovar Typhi Ty2
cauccuccggcgacugaaug

SEQ ID NO: 1782270 - RNA, 21 nt, Salmonella enterica enterica serovar Typhi Ty2
cauccuccggcgacugaaugc

SEQ ID NO: 1782271 - RNA, 23 nt, Salmonella enterica enterica serovar Typhi Ty2
caucgaauaaagacacugcugcu

SEQ ID NO: 1782272 - RNA, 21 nt, Salmonella enterica enterica serovar Typhi Ty2
caucgacaagcuaauccccag

SEQ ID NO: 1782273 - RNA, 15 nt, Salmonella enterica enterica serovar Typhi Ty2
caucgacagacuuca

SEQ ID NO: 1782274 - RNA, 23 nt, Salmonella enterica enterica serovar Typhi Ty2
caucgacaagcuaauccccagcg

SEQ ID NO: 1782275 - RNA, 12 nt, Salmonella enterica enterica serovar Typhi Ty2
caucgcccaggu

SEQ ID NO: 1782276 - RNA, 15 nt, Salmonella enterica enterica serovar Typhi Ty2
caucgcccgcuccca

SEQ ID NO: 1782277 - RNA, 18 nt, Salmonella enterica enterica serovar Typhi Ty2
caucgauacccugcugau

SEQ ID NO: 1782278 - RNA, 13 nt, Salmonella enterica enterica serovar Typhi Ty2
caucgccagcuuc

SEQ ID NO: 1782279 - RNA, 12 nt, Salmonella enterica enterica serovar Typhi Ty2
caucgacgccag

SEQ ID NO: 1782280 - RNA, 13 nt, Salmonella enterica enterica serovar Typhi Ty2
caucgcgcagcag

SEQ ID NO: 1782281 - RNA, 16 nt, Salmonella enterica enterica serovar Typhi Ty2
caucgcgccgcuggcg

SEQ ID NO: 1782282 - RNA, 20 nt, Salmonella enterica enterica serovar Typhi Ty2
caucgcgaauuucaaucgcc

SEQ ID NO: 1782283 - RNA, 13 nt, Salmonella enterica enterica serovar Typhi Ty2
caucgccugauga

SEQ ID NO: 1782284 - RNA, 15 nt, Salmonella enterica enterica serovar Typhi Ty2
caucgcuaucaugcu

SEQ ID NO: 1782285 - RNA, 15 nt, Salmonella enterica enterica serovar Typhi Ty2
caucgcgguuuuccg

SEQ ID NO: 1782286 - RNA, 18 nt, Salmonella enterica enterica serovar Typhi Ty2
caucgcuaaccggcggcg

SEQ ID NO: 1782287 - RNA, 20 nt, Salmonella enterica enterica serovar Typhi Ty2
caucuucggcgggaucucca

SEQ ID NO: 1782288 - RNA, 15 nt, Salmonella enterica enterica serovar Typhi Ty2
caucuucuaccugga

SEQ ID NO: 1782289 - RNA, 14 nt, Salmonella enterica enterica serovar Typhi Ty2
caucuucgcccggc

SEQ ID NO: 1782290 - RNA, 14 nt, Salmonella enterica enterica serovar Typhi Ty2
caucuucuuuuucc

SEQ ID NO: 1782291 - RNA, 18 nt, Salmonella enterica enterica serovar Typhi Ty2
caucuugaaugauuuugu

SEQ ID NO: 1782292 - RNA, 17 nt, Salmonella enterica enterica serovar Typhi Ty2
caucuuuaaccgccugc

SEQ ID NO: 1782293 - RNA, 21 nt, Salmonella enterica enterica serovar Typhi Ty2
caucuuuaccaaugugcaaag

SEQ ID NO: 1782294 - RNA, 12 nt, Salmonella enterica enterica serovar Typhi Ty2
caucuugcguua

SEQ ID NO: 1782295 - RNA, 15 nt, Salmonella enterica enterica serovar Typhi Ty2
caucugggggaagau

SEQ ID NO: 1782296 - RNA, 17 nt, Salmonella enterica enterica serovar Typhi Ty2
caucugggcugagaaaa

SEQ ID NO: 1782297 - RNA, 23 nt, Salmonella enterica enterica serovar Typhi Ty2
caucugcuccggcguacgggcaa

SEQ ID NO: 1782298 - RNA, 17 nt, Salmonella enterica enterica serovar Typhi Ty2
caucuguggcaauuuuc

SEQ ID NO: 1782299 - RNA, 16 nt, Salmonella enterica enterica serovar Typhi Ty2
caucuuauauuuuggu

SEQ ID NO: 1782300 - RNA, 16 nt, Salmonella enterica enterica serovar Typhi Ty2
caucuucaccuuucca

SEQ ID NO: 1782301 - RNA, 17 nt, Salmonella enterica enterica serovar Typhi Ty2
caucuucacuucacaaa

SEQ ID NO: 1782302 - RNA, 23 nt, Salmonella enterica enterica serovar Typhi Ty2
caucuccucgcgcguuugcaaua

SEQ ID NO: 1782303 - RNA, 23 nt, Salmonella enterica enterica serovar Typhi Ty2
caucucgauaccgguaaucaaac

SEQ ID NO: 1782304 - RNA, 15 nt, Salmonella enterica enterica serovar Typhi Ty2
caucucuuucagaau

SEQ ID NO: 1782305 - RNA, 19 nt, Salmonella enterica enterica serovar Typhi Ty2
caucugaaaugcucaauca

SEQ ID NO: 1782306 - RNA, 14 nt, Salmonella enterica enterica serovar Typhi Ty2
caucugaccgugag

SEQ ID NO: 1782307 - RNA, 16 nt, Salmonella enterica enterica serovar Typhi Ty2
caucugccauuucugc

SEQ ID NO: 1782308 - RNA, 14 nt, Salmonella enterica enterica serovar Typhi Ty2
caucgguucucugc

SEQ ID NO: 1782309 - RNA, 18 nt, Salmonella enterica enterica serovar Typhi Ty2
caucgguguacggcguca

SEQ ID NO: 1782310 - RNA, 15 nt, Salmonella enterica enterica serovar Typhi Ty2
caucggucaguguuu

SEQ ID NO: 1782311 - RNA, 19 nt, Salmonella enterica enterica serovar Typhi Ty2
caucgggaacggcauacug

SEQ ID NO: 1782312 - RNA, 18 nt, Salmonella enterica enterica serovar Typhi Ty2
caucgggauuuacaaccg

SEQ ID NO: 1782313 - RNA, 18 nt, Salmonella enterica enterica serovar Typhi Ty2
caucgggucgcgcgccgc

SEQ ID NO: 1782314 - RNA, 20 nt, Salmonella enterica enterica serovar Typhi Ty2
caucucccaggccgccaccg

SEQ ID NO: 1782315 - RNA, 21 nt, Salmonella enterica enterica serovar Typhi Ty2
caucucccaggccgccaccgc

SEQ ID NO: 1782316 - RNA, 14 nt, Salmonella enterica enterica serovar Typhi Ty2
caucucccaggccg

SEQ ID NO: 1782317 - RNA, 12 nt, Salmonella enterica enterica serovar Typhi Ty2
caucuauuuaac

SEQ ID NO: 1782318 - RNA, 23 nt, Salmonella enterica enterica serovar Typhi Ty2
caucuauaauaccuccugucuau

SEQ ID NO: 1782319 - RNA, 13 nt, Salmonella enterica enterica serovar Typhi Ty2
caucuaucgccag

SEQ ID NO: 1782320 - RNA, 21 nt, Salmonella enterica enterica serovar Typhi Ty2
caucaccuccagcacgcgcug

SEQ ID NO: 1782321 - RNA, 16 nt, Salmonella enterica enterica serovar Typhi Ty2
caucaccuccagcacg

SEQ ID NO: 1782322 - RNA, 16 nt, Salmonella enterica enterica serovar Typhi Ty2
caucaccguuuuccag

SEQ ID NO: 1782323 - RNA, 17 nt, Salmonella enterica enterica serovar Typhi Ty2
caucacgcaacggugag

SEQ ID NO: 1782324 - RNA, 21 nt, Salmonella enterica enterica serovar Typhi Ty2
caucacgaucuggcaaaccau

SEQ ID NO: 1782325 - RNA, 16 nt, Salmonella enterica enterica serovar Typhi Ty2
caucagcgccagcccu

SEQ ID NO: 1782326 - RNA, 21 nt, Salmonella enterica enterica serovar Typhi Ty2
caucagccguuacuuccccca

SEQ ID NO: 1782327 - RNA, 23 nt, Salmonella enterica enterica serovar Typhi Ty2
caucagccagccgccaaaaauau

SEQ ID NO: 1782328 - RNA, 20 nt, Salmonella enterica enterica serovar Typhi Ty2
caucacggagcgguaguuca

SEQ ID NO: 1782329 - RNA, 15 nt, Salmonella enterica enterica serovar Typhi Ty2
caucagccagcagcu

SEQ ID NO: 1782330 - RNA, 16 nt, Salmonella enterica enterica serovar Typhi Ty2
caucagccagcagcuc

SEQ ID NO: 1782331 - RNA, 15 nt, Salmonella enterica enterica serovar Typhi Ty2
caucaguacaaacgc

SEQ ID NO: 1782332 - RNA, 18 nt, Salmonella enterica enterica serovar Typhi Ty2
caucaguaacacccgcgc

SEQ ID NO: 1782333 - RNA, 13 nt, Salmonella enterica enterica serovar Typhi Ty2
caucaguaacuga

SEQ ID NO: 1782334 - RNA, 13 nt, Salmonella enterica enterica serovar Typhi Ty2
caucagucucaaa

SEQ ID NO: 1782335 - RNA, 15 nt, Salmonella enterica enterica serovar Typhi Ty2
caucaguccuguuga

SEQ ID NO: 1782336 - RNA, 18 nt, Salmonella enterica enterica serovar Typhi Ty2
caucagcgccagcccugc

SEQ ID NO: 1782337 - RNA, 19 nt, Salmonella enterica enterica serovar Typhi Ty2
caucaggcauggcagcagg

SEQ ID NO: 1782338 - RNA, 13 nt, Salmonella enterica enterica serovar Typhi Ty2
caucaggcgugcc

SEQ ID NO: 1782339 - RNA, 15 nt, Salmonella enterica enterica serovar Typhi Ty2
caucaggccugcaaa

SEQ ID NO: 1782340 - RNA, 17 nt, Salmonella enterica enterica serovar Typhi Ty2
caucaggccugcaaacc

SEQ ID NO: 1782341 - RNA, 18 nt, Salmonella enterica enterica serovar Typhi Ty2
caucaggccugcaaaccu

SEQ ID NO: 1782342 - RNA, 17 nt, Salmonella enterica enterica serovar Typhi Ty2
caucagguggaagaaac

SEQ ID NO: 1782343 - RNA, 14 nt, Salmonella enterica enterica serovar Typhi Ty2
caucauucccauug

SEQ ID NO: 1782344 - RNA, 14 nt, Salmonella enterica enterica serovar Typhi Ty2
caucaugauauaau

SEQ ID NO: 1782345 - RNA, 13 nt, Salmonella enterica enterica serovar Typhi Ty2
caucaugauauaa

SEQ ID NO: 1782346 - RNA, 21 nt, Salmonella enterica enterica serovar Typhi Ty2
caucaugcaagagucccagaa

SEQ ID NO: 1782347 - RNA, 23 nt, Salmonella enterica enterica serovar Typhi Ty2
caucaugaugaucuucagcccgu

SEQ ID NO: 1782348 - RNA, 22 nt, Salmonella enterica enterica serovar Typhi Ty2
caucaugcaagagucccagaac

SEQ ID NO: 1782349 - RNA, 20 nt, Salmonella enterica enterica serovar Typhi Ty2
caucaugaaaaacaguaccg

SEQ ID NO: 1782350 - RNA, 21 nt, Salmonella enterica enterica serovar Typhi Ty2
caucaucuuguccucaucauu

SEQ ID NO: 1782351 - RNA, 13 nt, Salmonella enterica enterica serovar Typhi Ty2
caucaucuugucc

SEQ ID NO: 1782352 - RNA, 13 nt, Salmonella enterica enterica serovar Typhi Ty2
cauccacccuggc

SEQ ID NO: 1782353 - RNA, 23 nt, Salmonella enterica enterica serovar Typhi Ty2
cauccacauucguaacaugcugg

SEQ ID NO: 1782354 - RNA, 14 nt, Salmonella enterica enterica serovar Typhi Ty2
caucauaauccuua

SEQ ID NO: 1782355 - RNA, 14 nt, Salmonella enterica enterica serovar Typhi Ty2
caucauaauaauug

SEQ ID NO: 1782356 - RNA, 19 nt, Salmonella enterica enterica serovar Typhi Ty2
caucauaucccggcugaca

SEQ ID NO: 1782357 - RNA, 12 nt, Salmonella enterica enterica serovar Typhi Ty2
caucaucgccaa

SEQ ID NO: 1782358 - RNA, 22 nt, Salmonella enterica enterica serovar Typhi Ty2
caucaucgcuggugugcagcca

SEQ ID NO: 1782359 - RNA, 18 nt, Salmonella enterica enterica serovar Typhi Ty2
caucaucguuugcgcgca

SEQ ID NO: 1782360 - RNA, 19 nt, Salmonella enterica enterica serovar Typhi Ty2
caucaucggcacagccagu

SEQ ID NO: 1782361 - RNA, 14 nt, Salmonella enterica enterica serovar Typhi Ty2
caucaucucauaaa

SEQ ID NO: 1782362 - RNA, 19 nt, Salmonella enterica enterica serovar Typhi Ty2
caucaucaucggcacagcc

SEQ ID NO: 1782363 - RNA, 19 nt, Salmonella enterica enterica serovar Typhi Ty2
caucaucaggacucaauca

SEQ ID NO: 1782364 - RNA, 17 nt, Salmonella enterica enterica serovar Typhi Ty2
caucauccugcagggua

SEQ ID NO: 1782365 - RNA, 23 nt, Salmonella enterica enterica serovar Typhi Ty2
caucaacguaaauagagaaauca

SEQ ID NO: 1782366 - RNA, 21 nt, Salmonella enterica enterica serovar Typhi Ty2
caucaagcccacacaucacaa

SEQ ID NO: 1782367 - RNA, 17 nt, Salmonella enterica enterica serovar Typhi Ty2
caucaccgacggggcgu

SEQ ID NO: 1782368 - RNA, 18 nt, Salmonella enterica enterica serovar Typhi Ty2
cauauuuuucacacauaa

SEQ ID NO: 1782369 - RNA, 18 nt, Salmonella enterica enterica serovar Typhi Ty2
cauauuuuuccagcgccu

SEQ ID NO: 1782370 - RNA, 15 nt, Salmonella enterica enterica serovar Typhi Ty2
cauauuuuucacaca

SEQ ID NO: 1782371 - RNA, 14 nt, Salmonella enterica enterica serovar Typhi Ty2
cauauuauuauaua

SEQ ID NO: 1782372 - RNA, 19 nt, Salmonella enterica enterica serovar Typhi Ty2
cauauuuucaacggcauca

SEQ ID NO: 1782373 - RNA, 20 nt, Salmonella enterica enterica serovar Typhi Ty2
cauauuugcgugucaucaaa

SEQ ID NO: 1782374 - RNA, 19 nt, Salmonella enterica enterica serovar Typhi Ty2
caucaaacgcagcaaacgc

SEQ ID NO: 1782375 - RNA, 20 nt, Salmonella enterica enterica serovar Typhi Ty2
caucaaccaccaaaaagcca

SEQ ID NO: 1782376 - RNA, 14 nt, Salmonella enterica enterica serovar Typhi Ty2
caucaaacagcggc

SEQ ID NO: 1782377 - RNA, 18 nt, Salmonella enterica enterica serovar Typhi Ty2
caucaaaaucaucgccac

SEQ ID NO: 1782378 - RNA, 14 nt, Salmonella enterica enterica serovar Typhi Ty2
caucaaaaaaaaua

SEQ ID NO: 1782379 - RNA, 23 nt, Salmonella enterica enterica serovar Typhi Ty2
cauauacccugcggcgaaacaga

SEQ ID NO: 1782380 - RNA, 18 nt, Salmonella enterica enterica serovar Typhi Ty2
cauauagugcgugacaau

SEQ ID NO: 1782381 - RNA, 15 nt, Salmonella enterica enterica serovar Typhi Ty2
cauaucgcuaaacca

SEQ ID NO: 1782382 - RNA, 17 nt, Salmonella enterica enterica serovar Typhi Ty2
cauauaugcgacagaaa

SEQ ID NO: 1782383 - RNA, 23 nt, Salmonella enterica enterica serovar Typhi Ty2
cauaucaccgcugacugaacuca

SEQ ID NO: 1782384 - RNA, 13 nt, Salmonella enterica enterica serovar Typhi Ty2
cauauauuuacug

SEQ ID NO: 1782385 - RNA, 22 nt, Salmonella enterica enterica serovar Typhi Ty2
cauaucaaugaacuacggcccu

SEQ ID NO: 1782386 - RNA, 15 nt, Salmonella enterica enterica serovar Typhi Ty2
cauauaaggcccaua

SEQ ID NO: 1782387 - RNA, 20 nt, Salmonella enterica enterica serovar Typhi Ty2
cauauaauuaacauuuaaga

SEQ ID NO: 1782388 - RNA, 23 nt, Salmonella enterica enterica serovar Typhi Ty2
cauagaaaauauaugacaacacu

SEQ ID NO: 1782389 - RNA, 14 nt, Salmonella enterica enterica serovar Typhi Ty2
cauagaaaaagaac

SEQ ID NO: 1782390 - RNA, 18 nt, Salmonella enterica enterica serovar Typhi Ty2
cauauuaucgcgcugaau

SEQ ID NO: 1782391 - RNA, 15 nt, Salmonella enterica enterica serovar Typhi Ty2
cauauuacauagaaa

SEQ ID NO: 1782392 - RNA, 14 nt, Salmonella enterica enterica serovar Typhi Ty2
cauaugcgcggcga

SEQ ID NO: 1782393 - RNA, 13 nt, Salmonella enterica enterica serovar Typhi Ty2
cauaugcgcggcg

SEQ ID NO: 1782394 - RNA, 16 nt, Salmonella enterica enterica serovar Typhi Ty2
cauauggcauucgcag

SEQ ID NO: 1782395 - RNA, 17 nt, Salmonella enterica enterica serovar Typhi Ty2
cauaugggaagacauuc

SEQ ID NO: 1782396 - RNA, 14 nt, Salmonella enterica enterica serovar Typhi Ty2
cauaucuuccaggc

SEQ ID NO: 1782397 - RNA, 16 nt, Salmonella enterica enterica serovar Typhi Ty2
cauaucuggacgggcc

SEQ ID NO: 1782398 - RNA, 19 nt, Salmonella enterica enterica serovar Typhi Ty2
cauaucguacugcuuuaau

SEQ ID NO: 1782399 - RNA, 16 nt, Salmonella enterica enterica serovar Typhi Ty2
cauugcgcuauuacuc

SEQ ID NO: 1782400 - RNA, 14 nt, Salmonella enterica enterica serovar Typhi Ty2
cauugcuuucuuga

SEQ ID NO: 1782401 - RNA, 15 nt, Salmonella enterica enterica serovar Typhi Ty2
cauugcuguggaaaa

SEQ ID NO: 1782402 - RNA, 16 nt, Salmonella enterica enterica serovar Typhi Ty2
cauugcgcgccgacag

SEQ ID NO: 1782403 - RNA, 16 nt, Salmonella enterica enterica serovar Typhi Ty2
cauugcgccccagcac

SEQ ID NO: 1782404 - RNA, 22 nt, Salmonella enterica enterica serovar Typhi Ty2
cauugcgagaaaaaacucagga

SEQ ID NO: 1782405 - RNA, 14 nt, Salmonella enterica enterica serovar Typhi Ty2
cauugccguaaauu

SEQ ID NO: 1782406 - RNA, 19 nt, Salmonella enterica enterica serovar Typhi Ty2
cauugccguuaacugcugc

SEQ ID NO: 1782407 - RNA, 20 nt, Salmonella enterica enterica serovar Typhi Ty2
cauugccguuaacugcugcu

SEQ ID NO: 1782408 - RNA, 21 nt, Salmonella enterica enterica serovar Typhi Ty2
cauugauauagaguccagcca

SEQ ID NO: 1782409 - RNA, 20 nt, Salmonella enterica enterica serovar Typhi Ty2
cauugaugcaggcgccuggg

SEQ ID NO: 1782410 - RNA, 21 nt, Salmonella enterica enterica serovar Typhi Ty2
cauugaugaugaagcugcagg

SEQ ID NO: 1782411 - RNA, 16 nt, Salmonella enterica enterica serovar Typhi Ty2
cauugcagcauuacac

SEQ ID NO: 1782412 - RNA, 13 nt, Salmonella enterica enterica serovar Typhi Ty2
cauuggcaccacc

SEQ ID NO: 1782413 - RNA, 20 nt, Salmonella enterica enterica serovar Typhi Ty2
cauuggaagagacacgcuga

SEQ ID NO: 1782414 - RNA, 14 nt, Salmonella enterica enterica serovar Typhi Ty2
cauugucgggcaga

SEQ ID NO: 1782415 - RNA, 17 nt, Salmonella enterica enterica serovar Typhi Ty2
cauugucggcgcuaucu

SEQ ID NO: 1782416 - RNA, 19 nt, Salmonella enterica enterica serovar Typhi Ty2
cauugucggcgcuaucuau

SEQ ID NO: 1782417 - RNA, 23 nt, Salmonella enterica enterica serovar Typhi Ty2
cauuguccuuuaucugcccuuuc

SEQ ID NO: 1782418 - RNA, 19 nt, Salmonella enterica enterica serovar Typhi Ty2
cauuguuccugcuggcaaa

SEQ ID NO: 1782419 - RNA, 18 nt, Salmonella enterica enterica serovar Typhi Ty2
cauuguugggguuaucgc

SEQ ID NO: 1782420 - RNA, 20 nt, Salmonella enterica enterica serovar Typhi Ty2
cauuguuauguuuuuagaca

SEQ ID NO: 1782421 - RNA, 20 nt, Salmonella enterica enterica serovar Typhi Ty2
cauucguuuugcugauauga

SEQ ID NO: 1782422 - RNA, 20 nt, Salmonella enterica enterica serovar Typhi Ty2
cauucucuuucugcgccgca

SEQ ID NO: 1782423 - RNA, 23 nt, Salmonella enterica enterica serovar Typhi Ty2
cauucugauuuuacuaaugaauu

SEQ ID NO: 1782424 - RNA, 18 nt, Salmonella enterica enterica serovar Typhi Ty2
cauucugacggcccuuuu

SEQ ID NO: 1782425 - RNA, 20 nt, Salmonella enterica enterica serovar Typhi Ty2
cauucucuucuaccacgcug

SEQ ID NO: 1782426 - RNA, 14 nt, Salmonella enterica enterica serovar Typhi Ty2
cauuaugaugaguu

SEQ ID NO: 1782427 - RNA, 19 nt, Salmonella enterica enterica serovar Typhi Ty2
cauuaucgaugcguauuuc

SEQ ID NO: 1782428 - RNA, 12 nt, Salmonella enterica enterica serovar Typhi Ty2
cauucugucaga

SEQ ID NO: 1782429 - RNA, 19 nt, Salmonella enterica enterica serovar Typhi Ty2
cauucugcuuaccagaccg

SEQ ID NO: 1782430 - RNA, 20 nt, Salmonella enterica enterica serovar Typhi Ty2
cauucugggaggugaaggau

SEQ ID NO: 1782431 - RNA, 15 nt, Salmonella enterica enterica serovar Typhi Ty2
cauucugcugaugcu

SEQ ID NO: 1782432 - RNA, 18 nt, Salmonella enterica enterica serovar Typhi Ty2
cauugaggcuacccagac

SEQ ID NO: 1782433 - RNA, 19 nt, Salmonella enterica enterica serovar Typhi Ty2
cauugaggcuacccagaca

SEQ ID NO: 1782434 - RNA, 16 nt, Salmonella enterica enterica serovar Typhi Ty2
cauugaguaaauaaau

SEQ ID NO: 1782435 - RNA, 14 nt, Salmonella enterica enterica serovar Typhi Ty2
cauuucuucuucaa

SEQ ID NO: 1782436 - RNA, 16 nt, Salmonella enterica enterica serovar Typhi Ty2
cauuucuucuucaagc

SEQ ID NO: 1782437 - RNA, 20 nt, Salmonella enterica enterica serovar Typhi Ty2
cauuuaagauuuaaaacaag

SEQ ID NO: 1782438 - RNA, 21 nt, Salmonella enterica enterica serovar Typhi Ty2
cauuucuucaagcguuuccag

SEQ ID NO: 1782439 - RNA, 15 nt, Salmonella enterica enterica serovar Typhi Ty2
cauuuaccagugcua

SEQ ID NO: 1782440 - RNA, 20 nt, Salmonella enterica enterica serovar Typhi Ty2
cauuucugucugacgacccg

SEQ ID NO: 1782441 - RNA, 15 nt, Salmonella enterica enterica serovar Typhi Ty2
cauuuguacaaaaaa

SEQ ID NO: 1782442 - RNA, 16 nt, Salmonella enterica enterica serovar Typhi Ty2
cauuuguacaaaaaau

SEQ ID NO: 1782443 - RNA, 19 nt, Salmonella enterica enterica serovar Typhi Ty2
cauuuguagcggcaacagc

SEQ ID NO: 1782444 - RNA, 14 nt, Salmonella enterica enterica serovar Typhi Ty2
cauuuguacaaaaa

SEQ ID NO: 1782445 - RNA, 16 nt, Salmonella enterica enterica serovar Typhi Ty2
cauuugcgcauauucc

SEQ ID NO: 1782446 - RNA, 21 nt, Salmonella enterica enterica serovar Typhi Ty2
cauuugcggcgucugcaccgg

SEQ ID NO: 1782447 - RNA, 14 nt, Salmonella enterica enterica serovar Typhi Ty2
cauuugcagguuac

SEQ ID NO: 1782448 - RNA, 16 nt, Salmonella enterica enterica serovar Typhi Ty2
cauuugcuuucaucaa

SEQ ID NO: 1782449 - RNA, 16 nt, Salmonella enterica enterica serovar Typhi Ty2
cauuugcuguuuuauu

SEQ ID NO: 1782450 - RNA, 14 nt, Salmonella enterica enterica serovar Typhi Ty2
cauuuuaaauacac

SEQ ID NO: 1782451 - RNA, 17 nt, Salmonella enterica enterica serovar Typhi Ty2
cauuuuaccuuuaaacu

SEQ ID NO: 1782452 - RNA, 15 nt, Salmonella enterica enterica serovar Typhi Ty2
cauuuuauccucuuc

SEQ ID NO: 1782453 - RNA, 16 nt, Salmonella enterica enterica serovar Typhi Ty2
cauuuuauccaacagc

SEQ ID NO: 1782454 - RNA, 17 nt, Salmonella enterica enterica serovar Typhi Ty2
cauuuuauuuaaaaagg

SEQ ID NO: 1782455 - RNA, 15 nt, Salmonella enterica enterica serovar Typhi Ty2
cauuuuaucuuuugu

SEQ ID NO: 1782456 - RNA, 15 nt, Salmonella enterica enterica serovar Typhi Ty2
cauuuucuuauuuau

SEQ ID NO: 1782457 - RNA, 16 nt, Salmonella enterica enterica serovar Typhi Ty2
cauuuucuuucaucaa

SEQ ID NO: 1782458 - RNA, 19 nt, Salmonella enterica enterica serovar Typhi Ty2
cauuuuccggcgacgcuuu

SEQ ID NO: 1782459 - RNA, 22 nt, Salmonella enterica enterica serovar Typhi Ty2
cauuuuccgcugucuauccacu

SEQ ID NO: 1782460 - RNA, 15 nt, Salmonella enterica enterica serovar Typhi Ty2
cauuuuccgcugucu

SEQ ID NO: 1782461 - RNA, 13 nt, Salmonella enterica enterica serovar Typhi Ty2
cauuuuucccgau

SEQ ID NO: 1782462 - RNA, 18 nt, Salmonella enterica enterica serovar Typhi Ty2
cauuuuucgaucuucucc

SEQ ID NO: 1782463 - RNA, 13 nt, Salmonella enterica enterica serovar Typhi Ty2
cauuuuugccauu

SEQ ID NO: 1782464 - RNA, 16 nt, Salmonella enterica enterica serovar Typhi Ty2
cauuuucuuugcagcu

SEQ ID NO: 1782465 - RNA, 17 nt, Salmonella enterica enterica serovar Typhi Ty2
cauuuucuuucaucaaa

SEQ ID NO: 1782466 - RNA, 22 nt, Salmonella enterica enterica serovar Typhi Ty2
cauuuugcgguuuuaauuucca

SEQ ID NO: 1782467 - RNA, 18 nt, Salmonella enterica enterica serovar Typhi Ty2
cauuuuggggaaaauacc

SEQ ID NO: 1782468 - RNA, 23 nt, Salmonella enterica enterica serovar Typhi Ty2
cauuaauccccggcgaaagaaaa

SEQ ID NO: 1782469 - RNA, 17 nt, Salmonella enterica enterica serovar Typhi Ty2
cauuaauaucagcccca

SEQ ID NO: 1782470 - RNA, 19 nt, Salmonella enterica enterica serovar Typhi Ty2
cauuaauaugcgcaaucac

SEQ ID NO: 1782471 - RNA, 17 nt, Salmonella enterica enterica serovar Typhi Ty2
cauuaaucgccauugca

SEQ ID NO: 1782472 - RNA, 16 nt, Salmonella enterica enterica serovar Typhi Ty2
cauuaaucuauuuaau

SEQ ID NO: 1782473 - RNA, 16 nt, Salmonella enterica enterica serovar Typhi Ty2
cauuaauacacugcgu

SEQ ID NO: 1782474 - RNA, 14 nt, Salmonella enterica enterica serovar Typhi Ty2
cauuaacccggccc

SEQ ID NO: 1782475 - RNA, 17 nt, Salmonella enterica enterica serovar Typhi Ty2
cauuaacccggccccga

SEQ ID NO: 1782476 - RNA, 19 nt, Salmonella enterica enterica serovar Typhi Ty2
cauuaaaugcgcccagccc

SEQ ID NO: 1782477 - RNA, 12 nt, Salmonella enterica enterica serovar Typhi Ty2
cauuaacgccau

SEQ ID NO: 1782478 - RNA, 23 nt, Salmonella enterica enterica serovar Typhi Ty2
cauuaacgaggcgcuugcuaccc

SEQ ID NO: 1782479 - RNA, 22 nt, Salmonella enterica enterica serovar Typhi Ty2
cauuaagcccauaaagcacugg

SEQ ID NO: 1782480 - RNA, 22 nt, Salmonella enterica enterica serovar Typhi Ty2
cauuacaggcaucuuccagcgu

SEQ ID NO: 1782481 - RNA, 18 nt, Salmonella enterica enterica serovar Typhi Ty2
cauuacaauguacagaau

SEQ ID NO: 1782482 - RNA, 23 nt, Salmonella enterica enterica serovar Typhi Ty2
cauuaauggcgauaauagaaccg

SEQ ID NO: 1782483 - RNA, 20 nt, Salmonella enterica enterica serovar Typhi Ty2
cauuagcgcgauaaaaccac

SEQ ID NO: 1782484 - RNA, 23 nt, Salmonella enterica enterica serovar Typhi Ty2
cauuagacaguuuuuucguucca

SEQ ID NO: 1782485 - RNA, 21 nt, Salmonella enterica enterica serovar Typhi Ty2
cauuagaccggacguugaaaa

SEQ ID NO: 1782486 - RNA, 15 nt, Salmonella enterica enterica serovar Typhi Ty2
cauuaccgcuaacau

SEQ ID NO: 1782487 - RNA, 15 nt, Salmonella enterica enterica serovar Typhi Ty2
cauuacuguaaaccg

SEQ ID NO: 1782488 - RNA, 21 nt, Salmonella enterica enterica serovar Typhi Ty2
cauuaccgcccuguccuccau

SEQ ID NO: 1782489 - RNA, 18 nt, Salmonella enterica enterica serovar Typhi Ty2
caugguugaaaaaagccg

SEQ ID NO: 1782490 - RNA, 15 nt, Salmonella enterica enterica serovar Typhi Ty2
caugguugacuuaca

SEQ ID NO: 1782491 - RNA, 13 nt, Salmonella enterica enterica serovar Typhi Ty2
caugguugaaaaa

SEQ ID NO: 1782492 - RNA, 22 nt, Salmonella enterica enterica serovar Typhi Ty2
caugguuaaaaucacuaagacc

SEQ ID NO: 1782493 - RNA, 14 nt, Salmonella enterica enterica serovar Typhi Ty2
caugguguucagau

SEQ ID NO: 1782494 - RNA, 23 nt, Salmonella enterica enterica serovar Typhi Ty2
cauggucgccguccauuucaaug

SEQ ID NO: 1782495 - RNA, 14 nt, Salmonella enterica enterica serovar Typhi Ty2
caugugcagcaucc

SEQ ID NO: 1782496 - RNA, 17 nt, Salmonella enterica enterica serovar Typhi Ty2
cauguuccgccccgccu

SEQ ID NO: 1782497 - RNA, 13 nt, Salmonella enterica enterica serovar Typhi Ty2
cauuaaaaaaacg

SEQ ID NO: 1782498 - RNA, 15 nt, Salmonella enterica enterica serovar Typhi Ty2
cauuaaaaaaacaug

SEQ ID NO: 1782499 - RNA, 19 nt, Salmonella enterica enterica serovar Typhi Ty2
cauguuuuuuaauugugau

SEQ ID NO: 1782500 - RNA, 10 nt, Salmonella enterica enterica serovar Typhi Ty2
cauuaaaaaa

SEQ ID NO: 1782501 - RNA, 12 nt, Salmonella enterica enterica serovar Typhi Ty2
cauuaaaaaaac

SEQ ID NO: 1782502 - RNA, 15 nt, Salmonella enterica enterica serovar Typhi Ty2
cauguuuccccuucu

SEQ ID NO: 1782503 - RNA, 17 nt, Salmonella enterica enterica serovar Typhi Ty2
cauguuuccccuucugg

SEQ ID NO: 1782504 - RNA, 22 nt, Salmonella enterica enterica serovar Typhi Ty2
cauguugaucguaaaaugaaaa

SEQ ID NO: 1782505 - RNA, 23 nt, Salmonella enterica enterica serovar Typhi Ty2
cauguugaucguaaaaugaaaaa

SEQ ID NO: 1782506 - RNA, 17 nt, Salmonella enterica enterica serovar Typhi Ty2
cauguugccaugaucca

SEQ ID NO: 1782507 - RNA, 21 nt, Salmonella enterica enterica serovar Typhi Ty2
cauguugcggguuucugaaua

SEQ ID NO: 1782508 - RNA, 17 nt, Salmonella enterica enterica serovar Typhi Ty2
cauguugcguaaauaaa

SEQ ID NO: 1782509 - RNA, 18 nt, Salmonella enterica enterica serovar Typhi Ty2
cauguugcguaaauaaau

SEQ ID NO: 1782510 - RNA, 15 nt, Salmonella enterica enterica serovar Typhi Ty2
caugcaauuugaggu

SEQ ID NO: 1782511 - RNA, 20 nt, Salmonella enterica enterica serovar Typhi Ty2
caugcaccagucccagcccc

SEQ ID NO: 1782512 - RNA, 18 nt, Salmonella enterica enterica serovar Typhi Ty2
caugcccaguucaaucaa

SEQ ID NO: 1782513 - RNA, 12 nt, Salmonella enterica enterica serovar Typhi Ty2
caugcaaaaaag

SEQ ID NO: 1782514 - RNA, 16 nt, Salmonella enterica enterica serovar Typhi Ty2
caugcaacuucaccuc

SEQ ID NO: 1782515 - RNA, 21 nt, Salmonella enterica enterica serovar Typhi Ty2
caucuuugccaaacugcugga

SEQ ID NO: 1782516 - RNA, 16 nt, Salmonella enterica enterica serovar Typhi Ty2
caugaaaaauauaaaa

SEQ ID NO: 1782517 - RNA, 19 nt, Salmonella enterica enterica serovar Typhi Ty2
caugaaaaauauaaaaagc

SEQ ID NO: 1782518 - RNA, 20 nt, Salmonella enterica enterica serovar Typhi Ty2
caugcccggauggcgucuga

SEQ ID NO: 1782519 - RNA, 20 nt, Salmonella enterica enterica serovar Typhi Ty2
caugcccaguuuacccagcg

SEQ ID NO: 1782520 - RNA, 21 nt, Salmonella enterica enterica serovar Typhi Ty2
caugcccgucugggagccgcu

SEQ ID NO: 1782521 - RNA, 16 nt, Salmonella enterica enterica serovar Typhi Ty2
caugccugauggcgcu

SEQ ID NO: 1782522 - RNA, 22 nt, Salmonella enterica enterica serovar Typhi Ty2
caugcgcgucccggcagugcau

SEQ ID NO: 1782523 - RNA, 18 nt, Salmonella enterica enterica serovar Typhi Ty2
caugcgcagaaacugauc

SEQ ID NO: 1782524 - RNA, 18 nt, Salmonella enterica enterica serovar Typhi Ty2
caugcgaucgggcaaucc

SEQ ID NO: 1782525 - RNA, 21 nt, Salmonella enterica enterica serovar Typhi Ty2
cauggcaaaagacauccccgc

SEQ ID NO: 1782526 - RNA, 14 nt, Salmonella enterica enterica serovar Typhi Ty2
caugggaaauaacg

SEQ ID NO: 1782527 - RNA, 17 nt, Salmonella enterica enterica serovar Typhi Ty2
caugggaaauaacguua

SEQ ID NO: 1782528 - RNA, 22 nt, Salmonella enterica enterica serovar Typhi Ty2
caugggacgggucuccaucaga

SEQ ID NO: 1782529 - RNA, 20 nt, Salmonella enterica enterica serovar Typhi Ty2
caugggcgcggcgaacuggu

SEQ ID NO: 1782530 - RNA, 20 nt, Salmonella enterica enterica serovar Typhi Ty2
caugggcagcuugccgccaa

SEQ ID NO: 1782531 - RNA, 16 nt, Salmonella enterica enterica serovar Typhi Ty2
caugguagucaaauuc

SEQ ID NO: 1782532 - RNA, 19 nt, Salmonella enterica enterica serovar Typhi Ty2
cauggaacauccucuccug

SEQ ID NO: 1782533 - RNA, 17 nt, Salmonella enterica enterica serovar Typhi Ty2
caugcuugcuuugcggc

SEQ ID NO: 1782534 - RNA, 15 nt, Salmonella enterica enterica serovar Typhi Ty2
caugcgggagcuugg

SEQ ID NO: 1782535 - RNA, 22 nt, Salmonella enterica enterica serovar Typhi Ty2
caugcgggggaaucuuauuuuc

SEQ ID NO: 1782536 - RNA, 17 nt, Salmonella enterica enterica serovar Typhi Ty2
caugcgggauggccgcc

SEQ ID NO: 1782537 - RNA, 21 nt, Salmonella enterica enterica serovar Typhi Ty2
caugcuaaaacagauaacgaa

SEQ ID NO: 1782538 - RNA, 15 nt, Salmonella enterica enterica serovar Typhi Ty2
caugcguuagauaua

SEQ ID NO: 1782539 - RNA, 19 nt, Salmonella enterica enterica serovar Typhi Ty2
caugcggugcaugaauauc

SEQ ID NO: 1782540 - RNA, 18 nt, Salmonella enterica enterica serovar Typhi Ty2
caugcgucuucauuuucg

SEQ ID NO: 1782541 - RNA, 23 nt, Salmonella enterica enterica serovar Typhi Ty2
cauacugaagauaaacagcagcg

SEQ ID NO: 1782542 - RNA, 22 nt, Salmonella enterica enterica serovar Typhi Ty2
cauacugaaauuucuuuuccag

SEQ ID NO: 1782543 - RNA, 21 nt, Salmonella enterica enterica serovar Typhi Ty2
cauacucuuggagagcaucau

SEQ ID NO: 1782544 - RNA, 19 nt, Salmonella enterica enterica serovar Typhi Ty2
cauacugaccaacaacaga

SEQ ID NO: 1782545 - RNA, 14 nt, Salmonella enterica enterica serovar Typhi Ty2
cauacuguuuauca

SEQ ID NO: 1782546 - RNA, 19 nt, Salmonella enterica enterica serovar Typhi Ty2
cauacguuuuuauuaucug

SEQ ID NO: 1782547 - RNA, 13 nt, Salmonella enterica enterica serovar Typhi Ty2
cauacguuuuuau

SEQ ID NO: 1782548 - RNA, 17 nt, Salmonella enterica enterica serovar Typhi Ty2
cauacguuuaaagcgcu

SEQ ID NO: 1782549 - RNA, 16 nt, Salmonella enterica enterica serovar Typhi Ty2
cauacucacgaauaag

SEQ ID NO: 1782550 - RNA, 17 nt, Salmonella enterica enterica serovar Typhi Ty2
cauacucacgaauaaga

SEQ ID NO: 1782551 - RNA, 21 nt, Salmonella enterica enterica serovar Typhi Ty2
cauacucacauucauaaaaga

SEQ ID NO: 1782552 - RNA, 23 nt, Salmonella enterica enterica serovar Typhi Ty2
cauacucacauucauaaaagauc

SEQ ID NO: 1782553 - RNA, 19 nt, Salmonella enterica enterica serovar Typhi Ty2
cauaccuguaucaaaccaa

SEQ ID NO: 1782554 - RNA, 18 nt, Salmonella enterica enterica serovar Typhi Ty2
cauaccuguaucaaacca

SEQ ID NO: 1782555 - RNA, 20 nt, Salmonella enterica enterica serovar Typhi Ty2
cauaccuguuccucuuuccc

SEQ ID NO: 1782556 - RNA, 19 nt, Salmonella enterica enterica serovar Typhi Ty2
cauaccugcggccaugauc

SEQ ID NO: 1782557 - RNA, 16 nt, Salmonella enterica enterica serovar Typhi Ty2
cauaccuauaaaaaug

SEQ ID NO: 1782558 - RNA, 21 nt, Salmonella enterica enterica serovar Typhi Ty2
cauaccggugcgccccagcau

SEQ ID NO: 1782559 - RNA, 15 nt, Salmonella enterica enterica serovar Typhi Ty2
cauaccguuucaacu

SEQ ID NO: 1782560 - RNA, 17 nt, Salmonella enterica enterica serovar Typhi Ty2
cauaccgcuuaacagcg

SEQ ID NO: 1782561 - RNA, 15 nt, Salmonella enterica enterica serovar Typhi Ty2
cauaccgccaaucaa

SEQ ID NO: 1782562 - RNA, 17 nt, Salmonella enterica enterica serovar Typhi Ty2
cauacccaguagcagac

SEQ ID NO: 1782563 - RNA, 18 nt, Salmonella enterica enterica serovar Typhi Ty2
cauacggaugaaauacuc

SEQ ID NO: 1782564 - RNA, 20 nt, Salmonella enterica enterica serovar Typhi Ty2
cauacgggcaugaagaaaau

SEQ ID NO: 1782565 - RNA, 15 nt, Salmonella enterica enterica serovar Typhi Ty2
cauacggaugaaaua

SEQ ID NO: 1782566 - RNA, 15 nt, Salmonella enterica enterica serovar Typhi Ty2
cauacgcgcgccaca

SEQ ID NO: 1782567 - RNA, 18 nt, Salmonella enterica enterica serovar Typhi Ty2
cauacgccgccagccacu

SEQ ID NO: 1782568 - RNA, 12 nt, Salmonella enterica enterica serovar Typhi Ty2
cauacgccgcca

SEQ ID NO: 1782569 - RNA, 15 nt, Salmonella enterica enterica serovar Typhi Ty2
cauaccgaacagaaa

SEQ ID NO: 1782570 - RNA, 12 nt, Salmonella enterica enterica serovar Typhi Ty2
cauacccgcuua

SEQ ID NO: 1782571 - RNA, 19 nt, Salmonella enterica enterica serovar Typhi Ty2
cauacccuauuuacagagc

SEQ ID NO: 1782572 - RNA, 20 nt, Salmonella enterica enterica serovar Typhi Ty2
cauacauuuuuguaauaaaa

SEQ ID NO: 1782573 - RNA, 18 nt, Salmonella enterica enterica serovar Typhi Ty2
cauaccacgcagcggcau

SEQ ID NO: 1782574 - RNA, 15 nt, Salmonella enterica enterica serovar Typhi Ty2
cauacagcacuuccc

SEQ ID NO: 1782575 - RNA, 13 nt, Salmonella enterica enterica serovar Typhi Ty2
cauacagcccgcg

SEQ ID NO: 1782576 - RNA, 14 nt, Salmonella enterica enterica serovar Typhi Ty2
cauacacgcggcga

SEQ ID NO: 1782577 - RNA, 14 nt, Salmonella enterica enterica serovar Typhi Ty2
cauacacugcauaa

SEQ ID NO: 1782578 - RNA, 19 nt, Salmonella enterica enterica serovar Typhi Ty2
cauacagcgauaaccgccg

SEQ ID NO: 1782579 - RNA, 15 nt, Salmonella enterica enterica serovar Typhi Ty2
cauacagguuuuaau

SEQ ID NO: 1782580 - RNA, 19 nt, Salmonella enterica enterica serovar Typhi Ty2
cauacauccaucacuccuu

SEQ ID NO: 1782581 - RNA, 15 nt, Salmonella enterica enterica serovar Typhi Ty2
cauaacggcugucca

SEQ ID NO: 1782582 - RNA, 18 nt, Salmonella enterica enterica serovar Typhi Ty2
cauaacgugccaucuuug

SEQ ID NO: 1782583 - RNA, 17 nt, Salmonella enterica enterica serovar Typhi Ty2
cauaaucgcuuuuuccu

SEQ ID NO: 1782584 - RNA, 15 nt, Salmonella enterica enterica serovar Typhi Ty2
cauaaucgacagugg

SEQ ID NO: 1782585 - RNA, 15 nt, Salmonella enterica enterica serovar Typhi Ty2
cauaaucgauauaau

SEQ ID NO: 1782586 - RNA, 19 nt, Salmonella enterica enterica serovar Typhi Ty2
cauaaucgauauaauuuua

SEQ ID NO: 1782587 - RNA, 20 nt, Salmonella enterica enterica serovar Typhi Ty2
cauaaucggccaggauggcc

SEQ ID NO: 1782588 - RNA, 21 nt, Salmonella enterica enterica serovar Typhi Ty2
cauaaucggccaggauggccc

SEQ ID NO: 1782589 - RNA, 21 nt, Salmonella enterica enterica serovar Typhi Ty2
cauaaugauggggucacaggu

SEQ ID NO: 1782590 - RNA, 22 nt, Salmonella enterica enterica serovar Typhi Ty2
cauaaugauggggucacagguu

SEQ ID NO: 1782591 - RNA, 21 nt, Salmonella enterica enterica serovar Typhi Ty2
caguuguaguagccacagcgg

SEQ ID NO: 1782592 - RNA, 21 nt, Salmonella enterica enterica serovar Typhi Ty2
caguugguuguagcacagccc

SEQ ID NO: 1782593 - RNA, 14 nt, Salmonella enterica enterica serovar Typhi Ty2
caguugcuggagca

SEQ ID NO: 1782594 - RNA, 16 nt, Salmonella enterica enterica serovar Typhi Ty2
caguugcccauuuucc

SEQ ID NO: 1782595 - RNA, 20 nt, Salmonella enterica enterica serovar Typhi Ty2
caguugcgacuguucaucaa

SEQ ID NO: 1782596 - RNA, 12 nt, Salmonella enterica enterica serovar Typhi Ty2
caguugcagcgc

SEQ ID NO: 1782597 - RNA, 16 nt, Salmonella enterica enterica serovar Typhi Ty2
caguucuggcugcgcu

SEQ ID NO: 1782598 - RNA, 16 nt, Salmonella enterica enterica serovar Typhi Ty2
caguucucgcgccacc

SEQ ID NO: 1782599 - RNA, 16 nt, Salmonella enterica enterica serovar Typhi Ty2
caguugaccaaacagc

SEQ ID NO: 1782600 - RNA, 22 nt, Salmonella enterica enterica serovar Typhi Ty2
caguguuucccaacaaugccac

SEQ ID NO: 1782601 - RNA, 23 nt, Salmonella enterica enterica serovar Typhi Ty2
caguguugauugaaacucgccau

SEQ ID NO: 1782602 - RNA, 20 nt, Salmonella enterica enterica serovar Typhi Ty2
caguguuaaucucacgcuca

SEQ ID NO: 1782603 - RNA, 16 nt, Salmonella enterica enterica serovar Typhi Ty2
cauaaauacguaacac

SEQ ID NO: 1782604 - RNA, 19 nt, Salmonella enterica enterica serovar Typhi Ty2
cauaaaccccgauaaacca

SEQ ID NO: 1782605 - RNA, 19 nt, Salmonella enterica enterica serovar Typhi Ty2
cauaaaccgccgcuuugau

SEQ ID NO: 1782606 - RNA, 13 nt, Salmonella enterica enterica serovar Typhi Ty2
cauaaaaacguga

SEQ ID NO: 1782607 - RNA, 12 nt, Salmonella enterica enterica serovar Typhi Ty2
cauaaaaaagag

SEQ ID NO: 1782608 - RNA, 18 nt, Salmonella enterica enterica serovar Typhi Ty2
caguuuaaaucacagggg

SEQ ID NO: 1782609 - RNA, 23 nt, Salmonella enterica enterica serovar Typhi Ty2
cauaaauuggcucagaauuuaaa

SEQ ID NO: 1782610 - RNA, 14 nt, Salmonella enterica enterica serovar Typhi Ty2
cauaaauuggcuca

SEQ ID NO: 1782611 - RNA, 21 nt, Salmonella enterica enterica serovar Typhi Ty2
cauaaaugcgaugaacaucga

SEQ ID NO: 1782612 - RNA, 22 nt, Salmonella enterica enterica serovar Typhi Ty2
cauaaauauuggcggcaaagaa

SEQ ID NO: 1782613 - RNA, 21 nt, Salmonella enterica enterica serovar Typhi Ty2
cauaaaucauuacuuauauuu

SEQ ID NO: 1782614 - RNA, 19 nt, Salmonella enterica enterica serovar Typhi Ty2
cauaaaucauuacuuauau

SEQ ID NO: 1782615 - RNA, 21 nt, Salmonella enterica enterica serovar Typhi Ty2
cauaaauauuggcggcaaaga

SEQ ID NO: 1782616 - RNA, 22 nt, Salmonella enterica enterica serovar Typhi Ty2
cauaaccggcaaccaaagucca

SEQ ID NO: 1782617 - RNA, 22 nt, Salmonella enterica enterica serovar Typhi Ty2
cauaaccaaacgcgcauuuuau

SEQ ID NO: 1782618 - RNA, 16 nt, Salmonella enterica enterica serovar Typhi Ty2
caggugcggacugggc

SEQ ID NO: 1782619 - RNA, 17 nt, Salmonella enterica enterica serovar Typhi Ty2
caggugcugccacaucg

SEQ ID NO: 1782620 - RNA, 20 nt, Salmonella enterica enterica serovar Typhi Ty2
cagguggaucccccuggccc

SEQ ID NO: 1782621 - RNA, 22 nt, Salmonella enterica enterica serovar Typhi Ty2
caggguuccguucccaaugcuu

SEQ ID NO: 1782622 - RNA, 13 nt, Salmonella enterica enterica serovar Typhi Ty2
caggguucacugc

SEQ ID NO: 1782623 - RNA, 23 nt, Salmonella enterica enterica serovar Typhi Ty2
caggguuauuuccgcuggccggu

SEQ ID NO: 1782624 - RNA, 13 nt, Salmonella enterica enterica serovar Typhi Ty2
caggguuugccag

SEQ ID NO: 1782625 - RNA, 23 nt, Salmonella enterica enterica serovar Typhi Ty2
caggguuugcgcagacugcgcca

SEQ ID NO: 1782626 - RNA, 18 nt, Salmonella enterica enterica serovar Typhi Ty2
caggguuugccagcacca

SEQ ID NO: 1782627 - RNA, 20 nt, Salmonella enterica enterica serovar Typhi Ty2
cagguaaaccggucagguag

SEQ ID NO: 1782628 - RNA, 23 nt, Salmonella enterica enterica serovar Typhi Ty2
cagguaaaccggucagguagcag

SEQ ID NO: 1782629 - RNA, 18 nt, Salmonella enterica enterica serovar Typhi Ty2
cagguaaaccggucaggu

SEQ ID NO: 1782630 - RNA, 21 nt, Salmonella enterica enterica serovar Typhi Ty2
cagguugccgaugacucccag

SEQ ID NO: 1782631 - RNA, 16 nt, Salmonella enterica enterica serovar Typhi Ty2
cagguugcguccgccg

SEQ ID NO: 1782632 - RNA, 17 nt, Salmonella enterica enterica serovar Typhi Ty2
cagguugcguccgccgc

SEQ ID NO: 1782633 - RNA, 18 nt, Salmonella enterica enterica serovar Typhi Ty2
cagguugcguccgccgcu

SEQ ID NO: 1782634 - RNA, 18 nt, Salmonella enterica enterica serovar Typhi Ty2
cagguguuaaucauuuuc

SEQ ID NO: 1782635 - RNA, 20 nt, Salmonella enterica enterica serovar Typhi Ty2
caggugguacaucaaaucag

SEQ ID NO: 1782636 - RNA, 17 nt, Salmonella enterica enterica serovar Typhi Ty2
caguaaaagcccgccca

SEQ ID NO: 1782637 - RNA, 22 nt, Salmonella enterica enterica serovar Typhi Ty2
caguaaaagcccgcccagcauu

SEQ ID NO: 1782638 - RNA, 12 nt, Salmonella enterica enterica serovar Typhi Ty2
caguaaaagccc

SEQ ID NO: 1782639 - RNA, 21 nt, Salmonella enterica enterica serovar Typhi Ty2
cagguuuuuuuauaacauaaa

SEQ ID NO: 1782640 - RNA, 17 nt, Salmonella enterica enterica serovar Typhi Ty2
cagguuuuuaagcugcc

SEQ ID NO: 1782641 - RNA, 20 nt, Salmonella enterica enterica serovar Typhi Ty2
cagguuuuuaagcugcccac

SEQ ID NO: 1782642 - RNA, 16 nt, Salmonella enterica enterica serovar Typhi Ty2
caguacagccaaaaau

SEQ ID NO: 1782643 - RNA, 19 nt, Salmonella enterica enterica serovar Typhi Ty2
caguacagccaaaaauaac

SEQ ID NO: 1782644 - RNA, 12 nt, Salmonella enterica enterica serovar Typhi Ty2
caguacaggcau

SEQ ID NO: 1782645 - RNA, 14 nt, Salmonella enterica enterica serovar Typhi Ty2
caguaccagcgaga

SEQ ID NO: 1782646 - RNA, 21 nt, Salmonella enterica enterica serovar Typhi Ty2
caguaccgggccuccuuuccu

SEQ ID NO: 1782647 - RNA, 22 nt, Salmonella enterica enterica serovar Typhi Ty2
caguaaagauuuguuucaucgc

SEQ ID NO: 1782648 - RNA, 18 nt, Salmonella enterica enterica serovar Typhi Ty2
caguaacucaucgccagc

SEQ ID NO: 1782649 - RNA, 17 nt, Salmonella enterica enterica serovar Typhi Ty2
caguaacucaucgccag

SEQ ID NO: 1782650 - RNA, 13 nt, Salmonella enterica enterica serovar Typhi Ty2
caguaagaucacc

SEQ ID NO: 1782651 - RNA, 13 nt, Salmonella enterica enterica serovar Typhi Ty2
caguacagccaaa

SEQ ID NO: 1782652 - RNA, 17 nt, Salmonella enterica enterica serovar Typhi Ty2
caguacagacuggaugg

SEQ ID NO: 1782653 - RNA, 14 nt, Salmonella enterica enterica serovar Typhi Ty2
caguaacucaucgc

SEQ ID NO: 1782654 - RNA, 16 nt, Salmonella enterica enterica serovar Typhi Ty2
caguaauaauauaaag

SEQ ID NO: 1782655 - RNA, 22 nt, Salmonella enterica enterica serovar Typhi Ty2
caguaagcguaccauuccauuc

SEQ ID NO: 1782656 - RNA, 12 nt, Salmonella enterica enterica serovar Typhi Ty2
caguagauggcg

SEQ ID NO: 1782657 - RNA, 18 nt, Salmonella enterica enterica serovar Typhi Ty2
caguagcagacagccgau

SEQ ID NO: 1782658 - RNA, 15 nt, Salmonella enterica enterica serovar Typhi Ty2
caguagcagacagcc

SEQ ID NO: 1782659 - RNA, 23 nt, Salmonella enterica enterica serovar Typhi Ty2
cagucaacgaggugaauaaaucc

SEQ ID NO: 1782660 - RNA, 15 nt, Salmonella enterica enterica serovar Typhi Ty2
cagugaccagcauca

SEQ ID NO: 1782661 - RNA, 13 nt, Salmonella enterica enterica serovar Typhi Ty2
cagugacgccagu

SEQ ID NO: 1782662 - RNA, 15 nt, Salmonella enterica enterica serovar Typhi Ty2
cagugaaauccucua

SEQ ID NO: 1782663 - RNA, 21 nt, Salmonella enterica enterica serovar Typhi Ty2
cagugaaauuugucgauaaaa

SEQ ID NO: 1782664 - RNA, 18 nt, Salmonella enterica enterica serovar Typhi Ty2
cagugaaaccggcgcgcc

SEQ ID NO: 1782665 - RNA, 14 nt, Salmonella enterica enterica serovar Typhi Ty2
cagugaacacccug

SEQ ID NO: 1782666 - RNA, 17 nt, Salmonella enterica enterica serovar Typhi Ty2
cagugaacacccugccc

SEQ ID NO: 1782667 - RNA, 20 nt, Salmonella enterica enterica serovar Typhi Ty2
cagugcugagcacgcccggu

SEQ ID NO: 1782668 - RNA, 23 nt, Salmonella enterica enterica serovar Typhi Ty2
cagugcaguauugcaccaggaag

SEQ ID NO: 1782669 - RNA, 18 nt, Salmonella enterica enterica serovar Typhi Ty2
caguggagaggccaccag

SEQ ID NO: 1782670 - RNA, 17 nt, Salmonella enterica enterica serovar Typhi Ty2
caguggacgauaagcac

SEQ ID NO: 1782671 - RNA, 19 nt, Salmonella enterica enterica serovar Typhi Ty2
cagucagccuugaccgccu

SEQ ID NO: 1782672 - RNA, 14 nt, Salmonella enterica enterica serovar Typhi Ty2
cagucagccuugac

SEQ ID NO: 1782673 - RNA, 16 nt, Salmonella enterica enterica serovar Typhi Ty2
cagucagcgcgagcgu

SEQ ID NO: 1782674 - RNA, 18 nt, Salmonella enterica enterica serovar Typhi Ty2
cagucagcaauuaacaaa

SEQ ID NO: 1782675 - RNA, 17 nt, Salmonella enterica enterica serovar Typhi Ty2
cagucagcaauuaacaa

SEQ ID NO: 1782676 - RNA, 16 nt, Salmonella enterica enterica serovar Typhi Ty2
cagucgauguggccuu

SEQ ID NO: 1782677 - RNA, 17 nt, Salmonella enterica enterica serovar Typhi Ty2
cagucaugaaaucgauu

SEQ ID NO: 1782678 - RNA, 18 nt, Salmonella enterica enterica serovar Typhi Ty2
caguccugucccugccag

SEQ ID NO: 1782679 - RNA, 14 nt, Salmonella enterica enterica serovar Typhi Ty2
caguccuuccgccg

SEQ ID NO: 1782680 - RNA, 17 nt, Salmonella enterica enterica serovar Typhi Ty2
caguccucgcccacuuc

SEQ ID NO: 1782681 - RNA, 17 nt, Salmonella enterica enterica serovar Typhi Ty2
cagucguggcggauucu

SEQ ID NO: 1782682 - RNA, 15 nt, Salmonella enterica enterica serovar Typhi Ty2
cagucgucuggcgcu

SEQ ID NO: 1782683 - RNA, 19 nt, Salmonella enterica enterica serovar Typhi Ty2
cagucgggaucgccagauc

SEQ ID NO: 1782684 - RNA, 20 nt, Salmonella enterica enterica serovar Typhi Ty2
cagucgcgccgugcccagca

SEQ ID NO: 1782685 - RNA, 22 nt, Salmonella enterica enterica serovar Typhi Ty2
cagucuggguuagcuguaucca

SEQ ID NO: 1782686 - RNA, 21 nt, Salmonella enterica enterica serovar Typhi Ty2
cagucuggcggcagccgacag

SEQ ID NO: 1782687 - RNA, 16 nt, Salmonella enterica enterica serovar Typhi Ty2
cagucuaauuuauuaa

SEQ ID NO: 1782688 - RNA, 20 nt, Salmonella enterica enterica serovar Typhi Ty2
cagucuaauuuauuaacccu

SEQ ID NO: 1782689 - RNA, 20 nt, Salmonella enterica enterica serovar Typhi Ty2
cagucgucauggcguaaauc

SEQ ID NO: 1782690 - RNA, 17 nt, Salmonella enterica enterica serovar Typhi Ty2
caggauuuacugagcgc

SEQ ID NO: 1782691 - RNA, 17 nt, Salmonella enterica enterica serovar Typhi Ty2
caggauucgaaccugcg

SEQ ID NO: 1782692 - RNA, 23 nt, Salmonella enterica enterica serovar Typhi Ty2
caggcacuguggugugccugcgc

SEQ ID NO: 1782693 - RNA, 17 nt, Salmonella enterica enterica serovar Typhi Ty2
caggcacuguggugugc

SEQ ID NO: 1782694 - RNA, 21 nt, Salmonella enterica enterica serovar Typhi Ty2
caggcacugaauuuacgccgu

SEQ ID NO: 1782695 - RNA, 15 nt, Salmonella enterica enterica serovar Typhi Ty2
caggcacgugcauaa

SEQ ID NO: 1782696 - RNA, 22 nt, Salmonella enterica enterica serovar Typhi Ty2
caggauugcugugaaguaauuc

SEQ ID NO: 1782697 - RNA, 13 nt, Salmonella enterica enterica serovar Typhi Ty2
caggcagaaauaa

SEQ ID NO: 1782698 - RNA, 14 nt, Salmonella enterica enterica serovar Typhi Ty2
caggcacuugagaa

SEQ ID NO: 1782699 - RNA, 13 nt, Salmonella enterica enterica serovar Typhi Ty2
caggaucgguaaa

SEQ ID NO: 1782700 - RNA, 22 nt, Salmonella enterica enterica serovar Typhi Ty2
caggaucgguaaacgccccuuc

SEQ ID NO: 1782701 - RNA, 23 nt, Salmonella enterica enterica serovar Typhi Ty2
caggaucgguaaacgccccuucg

SEQ ID NO: 1782702 - RNA, 15 nt, Salmonella enterica enterica serovar Typhi Ty2
caggaucggaagcga

SEQ ID NO: 1782703 - RNA, 20 nt, Salmonella enterica enterica serovar Typhi Ty2
caggaucgggaucagcgcgc

SEQ ID NO: 1782704 - RNA, 17 nt, Salmonella enterica enterica serovar Typhi Ty2
caggaucuucaucccau

SEQ ID NO: 1782705 - RNA, 13 nt, Salmonella enterica enterica serovar Typhi Ty2
caggaucuucauc

SEQ ID NO: 1782706 - RNA, 14 nt, Salmonella enterica enterica serovar Typhi Ty2
caggaggccugaau

SEQ ID NO: 1782707 - RNA, 17 nt, Salmonella enterica enterica serovar Typhi Ty2
caggauaaaauccugca

SEQ ID NO: 1782708 - RNA, 19 nt, Salmonella enterica enterica serovar Typhi Ty2
caggauaaagaccggcaca

SEQ ID NO: 1782709 - RNA, 14 nt, Salmonella enterica enterica serovar Typhi Ty2
caggagacuauucg

SEQ ID NO: 1782710 - RNA, 18 nt, Salmonella enterica enterica serovar Typhi Ty2
caggagaucggcgcaggu

SEQ ID NO: 1782711 - RNA, 17 nt, Salmonella enterica enterica serovar Typhi Ty2
caggacgguggucaucu

SEQ ID NO: 1782712 - RNA, 20 nt, Salmonella enterica enterica serovar Typhi Ty2
caggaagaacacgccgccua

SEQ ID NO: 1782713 - RNA, 15 nt, Salmonella enterica enterica serovar Typhi Ty2
caggaaggcgugcag

SEQ ID NO: 1782714 - RNA, 19 nt, Salmonella enterica enterica serovar Typhi Ty2
caggaacugcggccagaca

SEQ ID NO: 1782715 - RNA, 14 nt, Salmonella enterica enterica serovar Typhi Ty2
caggaacugacuga

SEQ ID NO: 1782716 - RNA, 17 nt, Salmonella enterica enterica serovar Typhi Ty2
caggaacgcggcgccga

SEQ ID NO: 1782717 - RNA, 18 nt, Salmonella enterica enterica serovar Typhi Ty2
caggacgccagcgcggca

SEQ ID NO: 1782718 - RNA, 12 nt, Salmonella enterica enterica serovar Typhi Ty2
caggacgccagc

SEQ ID NO: 1782719 - RNA, 15 nt, Salmonella enterica enterica serovar Typhi Ty2
caggacgccagugaa

SEQ ID NO: 1782720 - RNA, 19 nt, Salmonella enterica enterica serovar Typhi Ty2
caggacgcacccuguucau

SEQ ID NO: 1782721 - RNA, 19 nt, Salmonella enterica enterica serovar Typhi Ty2
caggaccaaaacaguacug

SEQ ID NO: 1782722 - RNA, 21 nt, Salmonella enterica enterica serovar Typhi Ty2
caggaauaacaucguaaauca

SEQ ID NO: 1782723 - RNA, 23 nt, Salmonella enterica enterica serovar Typhi Ty2
caggaauaaccacugauggcugg

SEQ ID NO: 1782724 - RNA, 20 nt, Salmonella enterica enterica serovar Typhi Ty2
caggaauaacaucguaaauc

SEQ ID NO: 1782725 - RNA, 19 nt, Salmonella enterica enterica serovar Typhi Ty2
caggacagaugucccgccu

SEQ ID NO: 1782726 - RNA, 17 nt, Salmonella enterica enterica serovar Typhi Ty2
caggacaucaaaggcag

SEQ ID NO: 1782727 - RNA, 13 nt, Salmonella enterica enterica serovar Typhi Ty2
caggacaaccccu

SEQ ID NO: 1782728 - RNA, 19 nt, Salmonella enterica enterica serovar Typhi Ty2
caggaauuccaguccuuuc

SEQ ID NO: 1782729 - RNA, 22 nt, Salmonella enterica enterica serovar Typhi Ty2
cagcuggcgauauccgugccgc

SEQ ID NO: 1782730 - RNA, 18 nt, Salmonella enterica enterica serovar Typhi Ty2
cagcucggcaaagcccau

SEQ ID NO: 1782731 - RNA, 16 nt, Salmonella enterica enterica serovar Typhi Ty2
cagcuucugucagccu

SEQ ID NO: 1782732 - RNA, 17 nt, Salmonella enterica enterica serovar Typhi Ty2
cagcuucaucaccgcau

SEQ ID NO: 1782733 - RNA, 22 nt, Salmonella enterica enterica serovar Typhi Ty2
cagcuucaggcucaucagcgcc

SEQ ID NO: 1782734 - RNA, 21 nt, Salmonella enterica enterica serovar Typhi Ty2
cagcuguuuaagcgccuccac

SEQ ID NO: 1782735 - RNA, 14 nt, Salmonella enterica enterica serovar Typhi Ty2
cagcuuaccccugu

SEQ ID NO: 1782736 - RNA, 18 nt, Salmonella enterica enterica serovar Typhi Ty2
cagcuuaaucaccagcgc

SEQ ID NO: 1782737 - RNA, 17 nt, Salmonella enterica enterica serovar Typhi Ty2
cagcuuaucugaccaug

SEQ ID NO: 1782738 - RNA, 18 nt, Salmonella enterica enterica serovar Typhi Ty2
cagcuuauuccagucauu

SEQ ID NO: 1782739 - RNA, 13 nt, Salmonella enterica enterica serovar Typhi Ty2
cagcggcggcagu

SEQ ID NO: 1782740 - RNA, 19 nt, Salmonella enterica enterica serovar Typhi Ty2
cagcggcgccaucaccauc

SEQ ID NO: 1782741 - RNA, 21 nt, Salmonella enterica enterica serovar Typhi Ty2
cagcggcgauuuauagagcag

SEQ ID NO: 1782742 - RNA, 17 nt, Salmonella enterica enterica serovar Typhi Ty2
cagcggccauugaaguc

SEQ ID NO: 1782743 - RNA, 15 nt, Salmonella enterica enterica serovar Typhi Ty2
cagcuauccaguuuc

SEQ ID NO: 1782744 - RNA, 23 nt, Salmonella enterica enterica serovar Typhi Ty2
cagcggcguuggcgauuuccagc

SEQ ID NO: 1782745 - RNA, 22 nt, Salmonella enterica enterica serovar Typhi Ty2
cagcggcggcuugccuucaucc

SEQ ID NO: 1782746 - RNA, 19 nt, Salmonella enterica enterica serovar Typhi Ty2
cagcggcgguuauccgcca

SEQ ID NO: 1782747 - RNA, 19 nt, Salmonella enterica enterica serovar Typhi Ty2
cagcucaaccgcgcggcgu

SEQ ID NO: 1782748 - RNA, 20 nt, Salmonella enterica enterica serovar Typhi Ty2
cagcuccauccaccagcccc

SEQ ID NO: 1782749 - RNA, 14 nt, Salmonella enterica enterica serovar Typhi Ty2
cagggcgauuuccg

SEQ ID NO: 1782750 - RNA, 15 nt, Salmonella enterica enterica serovar Typhi Ty2
cagggcgaugccuca

SEQ ID NO: 1782751 - RNA, 23 nt, Salmonella enterica enterica serovar Typhi Ty2
cagggcgcggcgcaacuuuuucg

SEQ ID NO: 1782752 - RNA, 19 nt, Salmonella enterica enterica serovar Typhi Ty2
cagggaauaugauuuaaaa

SEQ ID NO: 1782753 - RNA, 17 nt, Salmonella enterica enterica serovar Typhi Ty2
cagggacuauaggcaau

SEQ ID NO: 1782754 - RNA, 17 nt, Salmonella enterica enterica serovar Typhi Ty2
caggcuccaaguauuga

SEQ ID NO: 1782755 - RNA, 17 nt, Salmonella enterica enterica serovar Typhi Ty2
caggcucaucagcgcca

SEQ ID NO: 1782756 - RNA, 16 nt, Salmonella enterica enterica serovar Typhi Ty2
cagggcaacggccagc

SEQ ID NO: 1782757 - RNA, 16 nt, Salmonella enterica enterica serovar Typhi Ty2
cagggcaucccguccc

SEQ ID NO: 1782758 - RNA, 20 nt, Salmonella enterica enterica serovar Typhi Ty2
cagggcaucccgucccacca

SEQ ID NO: 1782759 - RNA, 21 nt, Salmonella enterica enterica serovar Typhi Ty2
cagggcaugauuacagauauc

SEQ ID NO: 1782760 - RNA, 17 nt, Salmonella enterica enterica serovar Typhi Ty2
cagggcgugacgcgcca

SEQ ID NO: 1782761 - RNA, 19 nt, Salmonella enterica enterica serovar Typhi Ty2
cagggcugcuggccuucca

SEQ ID NO: 1782762 - RNA, 21 nt, Salmonella enterica enterica serovar Typhi Ty2
cagggcugcuggugcgccugu

SEQ ID NO: 1782763 - RNA, 16 nt, Salmonella enterica enterica serovar Typhi Ty2
cagggcggaagcagau

SEQ ID NO: 1782764 - RNA, 21 nt, Salmonella enterica enterica serovar Typhi Ty2
cagggcgggauccccugcucc

SEQ ID NO: 1782765 - RNA, 13 nt, Salmonella enterica enterica serovar Typhi Ty2
caggggauucugc

SEQ ID NO: 1782766 - RNA, 20 nt, Salmonella enterica enterica serovar Typhi Ty2
caggggaugauuuucaggca

SEQ ID NO: 1782767 - RNA, 15 nt, Salmonella enterica enterica serovar Typhi Ty2
cagggcuuuuuucuc

SEQ ID NO: 1782768 - RNA, 14 nt, Salmonella enterica enterica serovar Typhi Ty2
cagggcuuuauuuu

SEQ ID NO: 1782769 - RNA, 19 nt, Salmonella enterica enterica serovar Typhi Ty2
caggggcucuaaaaaggaa

SEQ ID NO: 1782770 - RNA, 19 nt, Salmonella enterica enterica serovar Typhi Ty2
caggggcuccugcgccgga

SEQ ID NO: 1782771 - RNA, 23 nt, Salmonella enterica enterica serovar Typhi Ty2
cagggucuuauuucuccugcgcc

SEQ ID NO: 1782772 - RNA, 16 nt, Salmonella enterica enterica serovar Typhi Ty2
cagggugaugguguca

SEQ ID NO: 1782773 - RNA, 12 nt, Salmonella enterica enterica serovar Typhi Ty2
caggguggcgcu

SEQ ID NO: 1782774 - RNA, 23 nt, Salmonella enterica enterica serovar Typhi Ty2
caggguaucauuaugggcagcac

SEQ ID NO: 1782775 - RNA, 14 nt, Salmonella enterica enterica serovar Typhi Ty2
cagggguguccaga

SEQ ID NO: 1782776 - RNA, 17 nt, Salmonella enterica enterica serovar Typhi Ty2
caggguaaucaccauua

SEQ ID NO: 1782777 - RNA, 16 nt, Salmonella enterica enterica serovar Typhi Ty2
cagggguuccggcaau

SEQ ID NO: 1782778 - RNA, 16 nt, Salmonella enterica enterica serovar Typhi Ty2
caggguaucuaacccg

SEQ ID NO: 1782779 - RNA, 21 nt, Salmonella enterica enterica serovar Typhi Ty2
caggguaucauuaugggcagc

SEQ ID NO: 1782780 - RNA, 22 nt, Salmonella enterica enterica serovar Typhi Ty2
caggguaucauuaugggcagca

SEQ ID NO: 1782781 - RNA, 16 nt, Salmonella enterica enterica serovar Typhi Ty2
caggccuaacacaugc

SEQ ID NO: 1782782 - RNA, 16 nt, Salmonella enterica enterica serovar Typhi Ty2
caggccuaccagccga

SEQ ID NO: 1782783 - RNA, 17 nt, Salmonella enterica enterica serovar Typhi Ty2
caggccuaccagccgag

SEQ ID NO: 1782784 - RNA, 13 nt, Salmonella enterica enterica serovar Typhi Ty2
caggcgcaggcau

SEQ ID NO: 1782785 - RNA, 18 nt, Salmonella enterica enterica serovar Typhi Ty2
caggccgucggcgccagc

SEQ ID NO: 1782786 - RNA, 16 nt, Salmonella enterica enterica serovar Typhi Ty2
caggcgcaucagaaaa

SEQ ID NO: 1782787 - RNA, 19 nt, Salmonella enterica enterica serovar Typhi Ty2
caggcgcuauucccaggca

SEQ ID NO: 1782788 - RNA, 22 nt, Salmonella enterica enterica serovar Typhi Ty2
caggcgcuaucuucaauacgaa

SEQ ID NO: 1782789 - RNA, 20 nt, Salmonella enterica enterica serovar Typhi Ty2
caggcgcgaauaaugcgucc

SEQ ID NO: 1782790 - RNA, 22 nt, Salmonella enterica enterica serovar Typhi Ty2
caggcgcgaaucgacaauccgc

SEQ ID NO: 1782791 - RNA, 19 nt, Salmonella enterica enterica serovar Typhi Ty2
caggcgcgaccucaucaaa

SEQ ID NO: 1782792 - RNA, 22 nt, Salmonella enterica enterica serovar Typhi Ty2
caggcgcgaccucaucaaacag

SEQ ID NO: 1782793 - RNA, 17 nt, Salmonella enterica enterica serovar Typhi Ty2
caggcguguggccaggg

SEQ ID NO: 1782794 - RNA, 18 nt, Salmonella enterica enterica serovar Typhi Ty2
caggcuaaauggcauagc

SEQ ID NO: 1782795 - RNA, 14 nt, Salmonella enterica enterica serovar Typhi Ty2
caggcgggugcgca

SEQ ID NO: 1782796 - RNA, 19 nt, Salmonella enterica enterica serovar Typhi Ty2
caggcggguagucccagga

SEQ ID NO: 1782797 - RNA, 22 nt, Salmonella enterica enterica serovar Typhi Ty2
caggcggguagucccaggauag

SEQ ID NO: 1782798 - RNA, 15 nt, Salmonella enterica enterica serovar Typhi Ty2
caggcggucagggug

SEQ ID NO: 1782799 - RNA, 22 nt, Salmonella enterica enterica serovar Typhi Ty2
caggcgggugcgcagccccagc

SEQ ID NO: 1782800 - RNA, 17 nt, Salmonella enterica enterica serovar Typhi Ty2
caggcgugauugagcag

SEQ ID NO: 1782801 - RNA, 19 nt, Salmonella enterica enterica serovar Typhi Ty2
caggcggcuuuuucaucau

SEQ ID NO: 1782802 - RNA, 16 nt, Salmonella enterica enterica serovar Typhi Ty2
caggcggcugcgcaug

SEQ ID NO: 1782803 - RNA, 17 nt, Salmonella enterica enterica serovar Typhi Ty2
caggccggauggcggcu

SEQ ID NO: 1782804 - RNA, 18 nt, Salmonella enterica enterica serovar Typhi Ty2
caggccgccgcaaaagcc

SEQ ID NO: 1782805 - RNA, 19 nt, Salmonella enterica enterica serovar Typhi Ty2
caggccgccgcaaaagccg

SEQ ID NO: 1782806 - RNA, 13 nt, Salmonella enterica enterica serovar Typhi Ty2
caggccgccgccu

SEQ ID NO: 1782807 - RNA, 18 nt, Salmonella enterica enterica serovar Typhi Ty2
caggccggauaaggcagc

SEQ ID NO: 1782808 - RNA, 15 nt, Salmonella enterica enterica serovar Typhi Ty2
caggccgccagcaac

SEQ ID NO: 1782809 - RNA, 17 nt, Salmonella enterica enterica serovar Typhi Ty2
caggcauaaaaaagagg

SEQ ID NO: 1782810 - RNA, 20 nt, Salmonella enterica enterica serovar Typhi Ty2
caggcagccggauuuuaaau

SEQ ID NO: 1782811 - RNA, 13 nt, Salmonella enterica enterica serovar Typhi Ty2
caggcagccacaa

SEQ ID NO: 1782812 - RNA, 15 nt, Salmonella enterica enterica serovar Typhi Ty2
caggcagccacaaug

SEQ ID NO: 1782813 - RNA, 21 nt, Salmonella enterica enterica serovar Typhi Ty2
caggcaggcccgcgcuuuaau

SEQ ID NO: 1782814 - RNA, 22 nt, Salmonella enterica enterica serovar Typhi Ty2
cacuuuacugaauaacagcacc

SEQ ID NO: 1782815 - RNA, 19 nt, Salmonella enterica enterica serovar Typhi Ty2
cacuuuacugaauaacagc

SEQ ID NO: 1782816 - RNA, 11 nt, Salmonella enterica enterica serovar Typhi Ty2
cacuuguucuu

SEQ ID NO: 1782817 - RNA, 20 nt, Salmonella enterica enterica serovar Typhi Ty2
cacuuuacugaauaacagca

SEQ ID NO: 1782818 - RNA, 19 nt, Salmonella enterica enterica serovar Typhi Ty2
cacuuuccagaccaagauc

SEQ ID NO: 1782819 - RNA, 21 nt, Salmonella enterica enterica serovar Typhi Ty2
cacuugccgaguggaaucagc

SEQ ID NO: 1782820 - RNA, 19 nt, Salmonella enterica enterica serovar Typhi Ty2
cagaaaaagggaaaagcca

SEQ ID NO: 1782821 - RNA, 13 nt, Salmonella enterica enterica serovar Typhi Ty2
cacuuuuuccucc

SEQ ID NO: 1782822 - RNA, 18 nt, Salmonella enterica enterica serovar Typhi Ty2
cacuuuuuauuuguuccu

SEQ ID NO: 1782823 - RNA, 21 nt, Salmonella enterica enterica serovar Typhi Ty2
cacuuuuuauuuguuccucuu

SEQ ID NO: 1782824 - RNA, 20 nt, Salmonella enterica enterica serovar Typhi Ty2
cacuuuugucggccuguucu

SEQ ID NO: 1782825 - RNA, 18 nt, Salmonella enterica enterica serovar Typhi Ty2
cagaaaaaccuccggcua

SEQ ID NO: 1782826 - RNA, 19 nt, Salmonella enterica enterica serovar Typhi Ty2
cagaaaaaaugcaccgccu

SEQ ID NO: 1782827 - RNA, 15 nt, Salmonella enterica enterica serovar Typhi Ty2
cacuuuuccagccaa

SEQ ID NO: 1782828 - RNA, 20 nt, Salmonella enterica enterica serovar Typhi Ty2
cacuuuucccgccagcugcg

SEQ ID NO: 1782829 - RNA, 12 nt, Salmonella enterica enterica serovar Typhi Ty2
cacuuucucggc

SEQ ID NO: 1782830 - RNA, 15 nt, Salmonella enterica enterica serovar Typhi Ty2
cacuuccgccaccac

SEQ ID NO: 1782831 - RNA, 22 nt, Salmonella enterica enterica serovar Typhi Ty2
cacuuccgguguccauguugcc

SEQ ID NO: 1782832 - RNA, 14 nt, Salmonella enterica enterica serovar Typhi Ty2
cacuucgauaaacg

SEQ ID NO: 1782833 - RNA, 22 nt, Salmonella enterica enterica serovar Typhi Ty2
cacuucgcgccauugaucauug

SEQ ID NO: 1782834 - RNA, 21 nt, Salmonella enterica enterica serovar Typhi Ty2
cacuucgcugauaccgcccuc

SEQ ID NO: 1782835 - RNA, 23 nt, Salmonella enterica enterica serovar Typhi Ty2
cacuucugaguucggcauggggu

SEQ ID NO: 1782836 - RNA, 22 nt, Salmonella enterica enterica serovar Typhi Ty2
cacuucugaguucggcaugggg

SEQ ID NO: 1782837 - RNA, 17 nt, Salmonella enterica enterica serovar Typhi Ty2
cacuucgcgcauugcga

SEQ ID NO: 1782838 - RNA, 13 nt, Salmonella enterica enterica serovar Typhi Ty2
cacuucugcggua

SEQ ID NO: 1782839 - RNA, 14 nt, Salmonella enterica enterica serovar Typhi Ty2
cacuugagaaauua

SEQ ID NO: 1782840 - RNA, 22 nt, Salmonella enterica enterica serovar Typhi Ty2
cacuucuuucacugucaugguu

SEQ ID NO: 1782841 - RNA, 16 nt, Salmonella enterica enterica serovar Typhi Ty2
cacuuacuuucuugcc

SEQ ID NO: 1782842 - RNA, 22 nt, Salmonella enterica enterica serovar Typhi Ty2
cacuuacuuucuugccacuggc

SEQ ID NO: 1782843 - RNA, 17 nt, Salmonella enterica enterica serovar Typhi Ty2
cacuuagcacaaagaau

SEQ ID NO: 1782844 - RNA, 15 nt, Salmonella enterica enterica serovar Typhi Ty2
cacuuaucccugccc

SEQ ID NO: 1782845 - RNA, 16 nt, Salmonella enterica enterica serovar Typhi Ty2
cacuuaucccugcccc

SEQ ID NO: 1782846 - RNA, 21 nt, Salmonella enterica enterica serovar Typhi Ty2
cacuucaauguuagcauuauu

SEQ ID NO: 1782847 - RNA, 19 nt, Salmonella enterica enterica serovar Typhi Ty2
cacuucaauguuagcauua

SEQ ID NO: 1782848 - RNA, 15 nt, Salmonella enterica enterica serovar Typhi Ty2
cacuuccccugccag

SEQ ID NO: 1782849 - RNA, 14 nt, Salmonella enterica enterica serovar Typhi Ty2
cacuucaucaucau

SEQ ID NO: 1782850 - RNA, 20 nt, Salmonella enterica enterica serovar Typhi Ty2
cacuggcguagucucccucc

SEQ ID NO: 1782851 - RNA, 14 nt, Salmonella enterica enterica serovar Typhi Ty2
cacuggcccccugu

SEQ ID NO: 1782852 - RNA, 19 nt, Salmonella enterica enterica serovar Typhi Ty2
cacuggccucccaguuccc

SEQ ID NO: 1782853 - RNA, 20 nt, Salmonella enterica enterica serovar Typhi Ty2
cacuggccucccaguucccc

SEQ ID NO: 1782854 - RNA, 23 nt, Salmonella enterica enterica serovar Typhi Ty2
cacugcucguuaaauccucccau

SEQ ID NO: 1782855 - RNA, 22 nt, Salmonella enterica enterica serovar Typhi Ty2
cacugcuguagcgucucaucaa

SEQ ID NO: 1782856 - RNA, 16 nt, Salmonella enterica enterica serovar Typhi Ty2
cacugcuguguccagg

SEQ ID NO: 1782857 - RNA, 20 nt, Salmonella enterica enterica serovar Typhi Ty2
cacuggaauucguuaccucg

SEQ ID NO: 1782858 - RNA, 21 nt, Salmonella enterica enterica serovar Typhi Ty2
cacuggagcgcauuuuacugc

SEQ ID NO: 1782859 - RNA, 17 nt, Salmonella enterica enterica serovar Typhi Ty2
cacuguggugugccugc

SEQ ID NO: 1782860 - RNA, 16 nt, Salmonella enterica enterica serovar Typhi Ty2
cacuguggugugccug

SEQ ID NO: 1782861 - RNA, 22 nt, Salmonella enterica enterica serovar Typhi Ty2
cacugucaaaaauaacaggcac

SEQ ID NO: 1782862 - RNA, 14 nt, Salmonella enterica enterica serovar Typhi Ty2
cacuguugcaucuu

SEQ ID NO: 1782863 - RNA, 17 nt, Salmonella enterica enterica serovar Typhi Ty2
cacuuacggacaaaaua

SEQ ID NO: 1782864 - RNA, 23 nt, Salmonella enterica enterica serovar Typhi Ty2
cacuuacggacaaaauauugccc

SEQ ID NO: 1782865 - RNA, 18 nt, Salmonella enterica enterica serovar Typhi Ty2
caaugucggccugauuuc

SEQ ID NO: 1782866 - RNA, 21 nt, Salmonella enterica enterica serovar Typhi Ty2
caauguuuuaccggcagcucu

SEQ ID NO: 1782867 - RNA, 17 nt, Salmonella enterica enterica serovar Typhi Ty2
caauguugagcaucgcu

SEQ ID NO: 1782868 - RNA, 14 nt, Salmonella enterica enterica serovar Typhi Ty2
cacugcacaucccg

SEQ ID NO: 1782869 - RNA, 19 nt, Salmonella enterica enterica serovar Typhi Ty2
cacugcaauuucugcugga

SEQ ID NO: 1782870 - RNA, 15 nt, Salmonella enterica enterica serovar Typhi Ty2
cacugaugccacacc

SEQ ID NO: 1782871 - RNA, 22 nt, Salmonella enterica enterica serovar Typhi Ty2
cacugcgagggauuuccuggca

SEQ ID NO: 1782872 - RNA, 15 nt, Salmonella enterica enterica serovar Typhi Ty2
cacugccgccacgcc

SEQ ID NO: 1782873 - RNA, 12 nt, Salmonella enterica enterica serovar Typhi Ty2
cacugccgccac

SEQ ID NO: 1782874 - RNA, 12 nt, Salmonella enterica enterica serovar Typhi Ty2
cacugccaccgc

SEQ ID NO: 1782875 - RNA, 20 nt, Salmonella enterica enterica serovar Typhi Ty2
cagaaauaaaauacuuccau

SEQ ID NO: 1782876 - RNA, 17 nt, Salmonella enterica enterica serovar Typhi Ty2
cagaaauauucaguacu

SEQ ID NO: 1782877 - RNA, 16 nt, Salmonella enterica enterica serovar Typhi Ty2
cagaaaucgccgggcu

SEQ ID NO: 1782878 - RNA, 10 nt, Salmonella enterica enterica serovar Typhi Ty2
cagaaaugac

SEQ ID NO: 1782879 - RNA, 21 nt, Salmonella enterica enterica serovar Typhi Ty2
cagaaauugaauuauaauaaa

SEQ ID NO: 1782880 - RNA, 18 nt, Salmonella enterica enterica serovar Typhi Ty2
cagaacaaacuuauccca

SEQ ID NO: 1782881 - RNA, 13 nt, Salmonella enterica enterica serovar Typhi Ty2
cagaaaggaugcc

SEQ ID NO: 1782882 - RNA, 17 nt, Salmonella enterica enterica serovar Typhi Ty2
cagaaagccauaaaacu

SEQ ID NO: 1782883 - RNA, 22 nt, Salmonella enterica enterica serovar Typhi Ty2
cagaaacaagaagcacgacaca

SEQ ID NO: 1782884 - RNA, 14 nt, Salmonella enterica enterica serovar Typhi Ty2
cagaaccacuugaa

SEQ ID NO: 1782885 - RNA, 19 nt, Salmonella enterica enterica serovar Typhi Ty2
cagaaccuguucaugccag

SEQ ID NO: 1782886 - RNA, 20 nt, Salmonella enterica enterica serovar Typhi Ty2
cagaaccuguucaugccaga

SEQ ID NO: 1782887 - RNA, 13 nt, Salmonella enterica enterica serovar Typhi Ty2
cagaacgagagga

SEQ ID NO: 1782888 - RNA, 20 nt, Salmonella enterica enterica serovar Typhi Ty2
cagaacucaucuucuuuuuc

SEQ ID NO: 1782889 - RNA, 16 nt, Salmonella enterica enterica serovar Typhi Ty2
cagaacguagcccauu

SEQ ID NO: 1782890 - RNA, 15 nt, Salmonella enterica enterica serovar Typhi Ty2
cagaacgggaaagcg

SEQ ID NO: 1782891 - RNA, 16 nt, Salmonella enterica enterica serovar Typhi Ty2
cagaagcacuucucca

SEQ ID NO: 1782892 - RNA, 12 nt, Salmonella enterica enterica serovar Typhi Ty2
cagaagagaaug

SEQ ID NO: 1782893 - RNA, 11 nt, Salmonella enterica enterica serovar Typhi Ty2
cagaagcuucg

SEQ ID NO: 1782894 - RNA, 19 nt, Salmonella enterica enterica serovar Typhi Ty2
cagaaggcuaacagcuggc

SEQ ID NO: 1782895 - RNA, 14 nt, Salmonella enterica enterica serovar Typhi Ty2
cagaaggcgaacau

SEQ ID NO: 1782896 - RNA, 17 nt, Salmonella enterica enterica serovar Typhi Ty2
cagaaggcuaacagcug

SEQ ID NO: 1782897 - RNA, 19 nt, Salmonella enterica enterica serovar Typhi Ty2
cagaaggccagugguaaaa

SEQ ID NO: 1782898 - RNA, 20 nt, Salmonella enterica enterica serovar Typhi Ty2
cagaaggcuaacagcuggcu

SEQ ID NO: 1782899 - RNA, 21 nt, Salmonella enterica enterica serovar Typhi Ty2
cagaaggcuaacagcuggcuu

SEQ ID NO: 1782900 - RNA, 15 nt, Salmonella enterica enterica serovar Typhi Ty2
cagaaugcccagcaa

SEQ ID NO: 1782901 - RNA, 16 nt, Salmonella enterica enterica serovar Typhi Ty2
cagaaugcccugcugu

SEQ ID NO: 1782902 - RNA, 20 nt, Salmonella enterica enterica serovar Typhi Ty2
cagaaugcccugcuguucca

SEQ ID NO: 1782903 - RNA, 21 nt, Salmonella enterica enterica serovar Typhi Ty2
cagaauuaacucaucacagcc

SEQ ID NO: 1782904 - RNA, 19 nt, Salmonella enterica enterica serovar Typhi Ty2
cagaauuaacucaucacag

SEQ ID NO: 1782905 - RNA, 21 nt, Salmonella enterica enterica serovar Typhi Ty2
cagaauuucgcccuguauaca

SEQ ID NO: 1782906 - RNA, 15 nt, Salmonella enterica enterica serovar Typhi Ty2
cagaauuuauuucug

SEQ ID NO: 1782907 - RNA, 16 nt, Salmonella enterica enterica serovar Typhi Ty2
cagaauuuauuucugc

SEQ ID NO: 1782908 - RNA, 16 nt, Salmonella enterica enterica serovar Typhi Ty2
cagaauugcgccaccu

SEQ ID NO: 1782909 - RNA, 20 nt, Salmonella enterica enterica serovar Typhi Ty2
cagaauucguacguuuuucc

SEQ ID NO: 1782910 - RNA, 18 nt, Salmonella enterica enterica serovar Typhi Ty2
cagacaauaaacgguccg

SEQ ID NO: 1782911 - RNA, 20 nt, Salmonella enterica enterica serovar Typhi Ty2
cagacaauuagcgacgcaua

SEQ ID NO: 1782912 - RNA, 16 nt, Salmonella enterica enterica serovar Typhi Ty2
cagacaagcacauaac

SEQ ID NO: 1782913 - RNA, 15 nt, Salmonella enterica enterica serovar Typhi Ty2
cagaauaucuuuuac

SEQ ID NO: 1782914 - RNA, 17 nt, Salmonella enterica enterica serovar Typhi Ty2
cagaauauuuuucucag

SEQ ID NO: 1782915 - RNA, 15 nt, Salmonella enterica enterica serovar Typhi Ty2
cagaaucaccucuuu

SEQ ID NO: 1782916 - RNA, 21 nt, Salmonella enterica enterica serovar Typhi Ty2
cagaaucaccucuuucuccac

SEQ ID NO: 1782917 - RNA, 18 nt, Salmonella enterica enterica serovar Typhi Ty2
cagaauaaugcuggcgga

SEQ ID NO: 1782918 - RNA, 13 nt, Salmonella enterica enterica serovar Typhi Ty2
cagaauaauguug

SEQ ID NO: 1782919 - RNA, 16 nt, Salmonella enterica enterica serovar Typhi Ty2
cagaauacacuucuca

SEQ ID NO: 1782920 - RNA, 17 nt, Salmonella enterica enterica serovar Typhi Ty2
cagaauacgaauauuca

SEQ ID NO: 1782921 - RNA, 18 nt, Salmonella enterica enterica serovar Typhi Ty2
cagaauacgaccucaaau

SEQ ID NO: 1782922 - RNA, 13 nt, Salmonella enterica enterica serovar Typhi Ty2
cagaaucaggcca

SEQ ID NO: 1782923 - RNA, 14 nt, Salmonella enterica enterica serovar Typhi Ty2
cagaaucagccgac

SEQ ID NO: 1782924 - RNA, 21 nt, Salmonella enterica enterica serovar Typhi Ty2
cagaauccgucagguuuuuug

SEQ ID NO: 1782925 - RNA, 19 nt, Salmonella enterica enterica serovar Typhi Ty2
cagaaucaucaugucguca

SEQ ID NO: 1782926 - RNA, 14 nt, Salmonella enterica enterica serovar Typhi Ty2
cagaaucgccagca

SEQ ID NO: 1782927 - RNA, 23 nt, Salmonella enterica enterica serovar Typhi Ty2
cagaaugauaaugccgcugauaa

SEQ ID NO: 1782928 - RNA, 17 nt, Salmonella enterica enterica serovar Typhi Ty2
cagaccgcugcggaaca

SEQ ID NO: 1782929 - RNA, 14 nt, Salmonella enterica enterica serovar Typhi Ty2
cagaccggauugcc

SEQ ID NO: 1782930 - RNA, 18 nt, Salmonella enterica enterica serovar Typhi Ty2
cagaccggagcgugcuuc

SEQ ID NO: 1782931 - RNA, 16 nt, Salmonella enterica enterica serovar Typhi Ty2
cagaccggcaaaaauu

SEQ ID NO: 1782932 - RNA, 14 nt, Salmonella enterica enterica serovar Typhi Ty2
cagaccggcagccu

SEQ ID NO: 1782933 - RNA, 17 nt, Salmonella enterica enterica serovar Typhi Ty2
cagaccgucaugacguc

SEQ ID NO: 1782934 - RNA, 18 nt, Salmonella enterica enterica serovar Typhi Ty2
cagacccgauagcgccgc

SEQ ID NO: 1782935 - RNA, 19 nt, Salmonella enterica enterica serovar Typhi Ty2
cagacccgcauacaggaag

SEQ ID NO: 1782936 - RNA, 21 nt, Salmonella enterica enterica serovar Typhi Ty2
cagacccgcauacaggaagcc

SEQ ID NO: 1782937 - RNA, 17 nt, Salmonella enterica enterica serovar Typhi Ty2
cagaccgacaagccccc

SEQ ID NO: 1782938 - RNA, 15 nt, Salmonella enterica enterica serovar Typhi Ty2
cagaccgacaaaacu

SEQ ID NO: 1782939 - RNA, 17 nt, Salmonella enterica enterica serovar Typhi Ty2
cagaccgaucucaugca

SEQ ID NO: 1782940 - RNA, 22 nt, Salmonella enterica enterica serovar Typhi Ty2
cagaccgaucucaugcaacugg

SEQ ID NO: 1782941 - RNA, 16 nt, Salmonella enterica enterica serovar Typhi Ty2
cagaccagucggacag

SEQ ID NO: 1782942 - RNA, 13 nt, Salmonella enterica enterica serovar Typhi Ty2
cagaccaccagcg

SEQ ID NO: 1782943 - RNA, 17 nt, Salmonella enterica enterica serovar Typhi Ty2
cagaccacgaaucagga

SEQ ID NO: 1782944 - RNA, 19 nt, Salmonella enterica enterica serovar Typhi Ty2
cagacacuggaaacagcca

SEQ ID NO: 1782945 - RNA, 12 nt, Salmonella enterica enterica serovar Typhi Ty2
cagacacuggaa

SEQ ID NO: 1782946 - RNA, 17 nt, Salmonella enterica enterica serovar Typhi Ty2
cagacagauaacaccag

SEQ ID NO: 1782947 - RNA, 19 nt, Salmonella enterica enterica serovar Typhi Ty2
cagacagccauauuuaugc

SEQ ID NO: 1782948 - RNA, 17 nt, Salmonella enterica enterica serovar Typhi Ty2
cagacagaucgguuuau

SEQ ID NO: 1782949 - RNA, 14 nt, Salmonella enterica enterica serovar Typhi Ty2
cagacaggacgcca

SEQ ID NO: 1782950 - RNA, 23 nt, Salmonella enterica enterica serovar Typhi Ty2
cagacaggccugguuaacaauau

SEQ ID NO: 1782951 - RNA, 13 nt, Salmonella enterica enterica serovar Typhi Ty2
cagacacugccac

SEQ ID NO: 1782952 - RNA, 22 nt, Salmonella enterica enterica serovar Typhi Ty2
cagacaguggccaucuuccagc

SEQ ID NO: 1782953 - RNA, 20 nt, Salmonella enterica enterica serovar Typhi Ty2
cagacagucuggauauaaac

SEQ ID NO: 1782954 - RNA, 16 nt, Salmonella enterica enterica serovar Typhi Ty2
cagacauggcaauggc

SEQ ID NO: 1782955 - RNA, 14 nt, Salmonella enterica enterica serovar Typhi Ty2
cagacaugcacaug

SEQ ID NO: 1782956 - RNA, 15 nt, Salmonella enterica enterica serovar Typhi Ty2
cagacaugcacaugg

SEQ ID NO: 1782957 - RNA, 17 nt, Salmonella enterica enterica serovar Typhi Ty2
cagacauauuuucucug

SEQ ID NO: 1782958 - RNA, 20 nt, Salmonella enterica enterica serovar Typhi Ty2
cagacaugaccgcacagcag

SEQ ID NO: 1782959 - RNA, 23 nt, Salmonella enterica enterica serovar Typhi Ty2
cagacaucggagauuucauccuc

SEQ ID NO: 1782960 - RNA, 20 nt, Salmonella enterica enterica serovar Typhi Ty2
cagacaugcagcacuuuuga

SEQ ID NO: 1782961 - RNA, 15 nt, Salmonella enterica enterica serovar Typhi Ty2
cagacaugcgccgga

SEQ ID NO: 1782962 - RNA, 18 nt, Salmonella enterica enterica serovar Typhi Ty2
cagaccaaagucaaacug

SEQ ID NO: 1782963 - RNA, 16 nt, Salmonella enterica enterica serovar Typhi Ty2
cagacugguauagccu

SEQ ID NO: 1782964 - RNA, 18 nt, Salmonella enterica enterica serovar Typhi Ty2
cagacuucaacgccgcac

SEQ ID NO: 1782965 - RNA, 16 nt, Salmonella enterica enterica serovar Typhi Ty2
cagacuucauuuucca

SEQ ID NO: 1782966 - RNA, 17 nt, Salmonella enterica enterica serovar Typhi Ty2
cagacuucauuuuccac

SEQ ID NO: 1782967 - RNA, 17 nt, Salmonella enterica enterica serovar Typhi Ty2
cagagauccacauuggu

SEQ ID NO: 1782968 - RNA, 22 nt, Salmonella enterica enterica serovar Typhi Ty2
cagagauucgccguucuguucu

SEQ ID NO: 1782969 - RNA, 15 nt, Salmonella enterica enterica serovar Typhi Ty2
cagagauaauuuucc

SEQ ID NO: 1782970 - RNA, 17 nt, Salmonella enterica enterica serovar Typhi Ty2
cagagauaauuuuccca

SEQ ID NO: 1782971 - RNA, 16 nt, Salmonella enterica enterica serovar Typhi Ty2
cagagagggaaaaaaa

SEQ ID NO: 1782972 - RNA, 21 nt, Salmonella enterica enterica serovar Typhi Ty2
cagagcaucuaccgcauacug

SEQ ID NO: 1782973 - RNA, 19 nt, Salmonella enterica enterica serovar Typhi Ty2
cagagccaaacacuucccc

SEQ ID NO: 1782974 - RNA, 21 nt, Salmonella enterica enterica serovar Typhi Ty2
cagagcagucguugcgccugu

SEQ ID NO: 1782975 - RNA, 21 nt, Salmonella enterica enterica serovar Typhi Ty2
cagacggcuccagcgccagcu

SEQ ID NO: 1782976 - RNA, 16 nt, Salmonella enterica enterica serovar Typhi Ty2
cagacggcgaaucaau

SEQ ID NO: 1782977 - RNA, 13 nt, Salmonella enterica enterica serovar Typhi Ty2
cagacggcugggc

SEQ ID NO: 1782978 - RNA, 18 nt, Salmonella enterica enterica serovar Typhi Ty2
cagacggcaagcaaccgu

SEQ ID NO: 1782979 - RNA, 21 nt, Salmonella enterica enterica serovar Typhi Ty2
cagacuaaccguucaucuauc

SEQ ID NO: 1782980 - RNA, 18 nt, Salmonella enterica enterica serovar Typhi Ty2
cagacuacggaaacugua

SEQ ID NO: 1782981 - RNA, 22 nt, Salmonella enterica enterica serovar Typhi Ty2
cagacuauccguccucuuuccc

SEQ ID NO: 1782982 - RNA, 17 nt, Salmonella enterica enterica serovar Typhi Ty2
cagacucgcucccuucc

SEQ ID NO: 1782983 - RNA, 15 nt, Salmonella enterica enterica serovar Typhi Ty2
cagacucagccaggu

SEQ ID NO: 1782984 - RNA, 14 nt, Salmonella enterica enterica serovar Typhi Ty2
cagacucagccagg

SEQ ID NO: 1782985 - RNA, 16 nt, Salmonella enterica enterica serovar Typhi Ty2
cagacgcgcagcaccg

SEQ ID NO: 1782986 - RNA, 13 nt, Salmonella enterica enterica serovar Typhi Ty2
cagacgcuccgca

SEQ ID NO: 1782987 - RNA, 18 nt, Salmonella enterica enterica serovar Typhi Ty2
cagaccuuuauaagguua

SEQ ID NO: 1782988 - RNA, 18 nt, Salmonella enterica enterica serovar Typhi Ty2
cagaccucugcaaacacc

SEQ ID NO: 1782989 - RNA, 13 nt, Salmonella enterica enterica serovar Typhi Ty2
cagaccucugcaa

SEQ ID NO: 1782990 - RNA, 14 nt, Salmonella enterica enterica serovar Typhi Ty2
cagacgaugaauuc

SEQ ID NO: 1782991 - RNA, 12 nt, Salmonella enterica enterica serovar Typhi Ty2
cagauagucauc

SEQ ID NO: 1782992 - RNA, 20 nt, Salmonella enterica enterica serovar Typhi Ty2
cagauaggcggcaaauaaag

SEQ ID NO: 1782993 - RNA, 15 nt, Salmonella enterica enterica serovar Typhi Ty2
cagauaugcgggcuc

SEQ ID NO: 1782994 - RNA, 23 nt, Salmonella enterica enterica serovar Typhi Ty2
cagauauuuucggcauacucuuu

SEQ ID NO: 1782995 - RNA, 16 nt, Salmonella enterica enterica serovar Typhi Ty2
cagaucaggucugaga

SEQ ID NO: 1782996 - RNA, 14 nt, Salmonella enterica enterica serovar Typhi Ty2
cagauccaaauggc

SEQ ID NO: 1782997 - RNA, 16 nt, Salmonella enterica enterica serovar Typhi Ty2
cagauccaucgccugc

SEQ ID NO: 1782998 - RNA, 21 nt, Salmonella enterica enterica serovar Typhi Ty2
cagauaagcucuccuggaugc

SEQ ID NO: 1782999 - RNA, 17 nt, Salmonella enterica enterica serovar Typhi Ty2
cagauaauuaauaaugg

SEQ ID NO: 1783000 - RNA, 19 nt, Salmonella enterica enterica serovar Typhi Ty2
cagauaaugccgcuggcgu

SEQ ID NO: 1783001 - RNA, 22 nt, Salmonella enterica enterica serovar Typhi Ty2
cagauaacgcaucagacuguua

SEQ ID NO: 1783002 - RNA, 13 nt, Salmonella enterica enterica serovar Typhi Ty2
cagauaacugagc

SEQ ID NO: 1783003 - RNA, 15 nt, Salmonella enterica enterica serovar Typhi Ty2
cagauagcguaaccg

SEQ ID NO: 1783004 - RNA, 19 nt, Salmonella enterica enterica serovar Typhi Ty2
cagauagcgcugcgccaga

SEQ ID NO: 1783005 - RNA, 13 nt, Salmonella enterica enterica serovar Typhi Ty2
cagauagcgcugc

SEQ ID NO: 1783006 - RNA, 13 nt, Salmonella enterica enterica serovar Typhi Ty2
cagauagcccgcc

SEQ ID NO: 1783007 - RNA, 20 nt, Salmonella enterica enterica serovar Typhi Ty2
cagauagcaaaaaagcgccu

SEQ ID NO: 1783008 - RNA, 15 nt, Salmonella enterica enterica serovar Typhi Ty2
cagauacauggcuau

SEQ ID NO: 1783009 - RNA, 20 nt, Salmonella enterica enterica serovar Typhi Ty2
cagauacugcgcguggcaaa

SEQ ID NO: 1783010 - RNA, 17 nt, Salmonella enterica enterica serovar Typhi Ty2
cagauacggcuccagca

SEQ ID NO: 1783011 - RNA, 21 nt, Salmonella enterica enterica serovar Typhi Ty2
cagaguaacccgauacccuga

SEQ ID NO: 1783012 - RNA, 17 nt, Salmonella enterica enterica serovar Typhi Ty2
cagaguccagcggcagc

SEQ ID NO: 1783013 - RNA, 20 nt, Salmonella enterica enterica serovar Typhi Ty2
cagaguccggcgccugaaua

SEQ ID NO: 1783014 - RNA, 12 nt, Salmonella enterica enterica serovar Typhi Ty2
cagauaaaccac

SEQ ID NO: 1783015 - RNA, 17 nt, Salmonella enterica enterica serovar Typhi Ty2
cagagucugaaaacuca

SEQ ID NO: 1783016 - RNA, 18 nt, Salmonella enterica enterica serovar Typhi Ty2
cagaguucuuuugaggcu

SEQ ID NO: 1783017 - RNA, 18 nt, Salmonella enterica enterica serovar Typhi Ty2
cagagcucgucaaaaauc

SEQ ID NO: 1783018 - RNA, 20 nt, Salmonella enterica enterica serovar Typhi Ty2
cagagcucgucaaaaaucac

SEQ ID NO: 1783019 - RNA, 17 nt, Salmonella enterica enterica serovar Typhi Ty2
cagagcucgucaaaaau

SEQ ID NO: 1783020 - RNA, 12 nt, Salmonella enterica enterica serovar Typhi Ty2
cagaggaaaacg

SEQ ID NO: 1783021 - RNA, 15 nt, Salmonella enterica enterica serovar Typhi Ty2
cagaggccugaaugc

SEQ ID NO: 1783022 - RNA, 22 nt, Salmonella enterica enterica serovar Typhi Ty2
cagagcggggaaacucuuuucc

SEQ ID NO: 1783023 - RNA, 16 nt, Salmonella enterica enterica serovar Typhi Ty2
cagagcggggaaacuc

SEQ ID NO: 1783024 - RNA, 17 nt, Salmonella enterica enterica serovar Typhi Ty2
cagagcguccacgccau

SEQ ID NO: 1783025 - RNA, 22 nt, Salmonella enterica enterica serovar Typhi Ty2
cagagcgcgcuggcaagcgcca

SEQ ID NO: 1783026 - RNA, 20 nt, Salmonella enterica enterica serovar Typhi Ty2
cagagcgccggcaaagccau

SEQ ID NO: 1783027 - RNA, 17 nt, Salmonella enterica enterica serovar Typhi Ty2
cagagcgcgcuggcaag

SEQ ID NO: 1783028 - RNA, 16 nt, Salmonella enterica enterica serovar Typhi Ty2
cagagcgauaaagaac

SEQ ID NO: 1783029 - RNA, 13 nt, Salmonella enterica enterica serovar Typhi Ty2
cagcaacgcgcca

SEQ ID NO: 1783030 - RNA, 19 nt, Salmonella enterica enterica serovar Typhi Ty2
cagcaacggaagcugacca

SEQ ID NO: 1783031 - RNA, 17 nt, Salmonella enterica enterica serovar Typhi Ty2
cagcaacggcugauggc

SEQ ID NO: 1783032 - RNA, 22 nt, Salmonella enterica enterica serovar Typhi Ty2
cagcaacgugaacugcgccugc

SEQ ID NO: 1783033 - RNA, 22 nt, Salmonella enterica enterica serovar Typhi Ty2
cagcaacugcugcgcgugcugu

SEQ ID NO: 1783034 - RNA, 18 nt, Salmonella enterica enterica serovar Typhi Ty2
cagcaacugcgcgcgggu

SEQ ID NO: 1783035 - RNA, 17 nt, Salmonella enterica enterica serovar Typhi Ty2
cagcaaggcugccgcca

SEQ ID NO: 1783036 - RNA, 15 nt, Salmonella enterica enterica serovar Typhi Ty2
cagcaauaaaaggaa

SEQ ID NO: 1783037 - RNA, 22 nt, Salmonella enterica enterica serovar Typhi Ty2
cagcaagaaguuccgcuuuucu

SEQ ID NO: 1783038 - RNA, 23 nt, Salmonella enterica enterica serovar Typhi Ty2
cagcaaacgccuuccggagacua

SEQ ID NO: 1783039 - RNA, 19 nt, Salmonella enterica enterica serovar Typhi Ty2
cagcaacacuuugcgcugc

SEQ ID NO: 1783040 - RNA, 16 nt, Salmonella enterica enterica serovar Typhi Ty2
cagcaacaguugcugg

SEQ ID NO: 1783041 - RNA, 20 nt, Salmonella enterica enterica serovar Typhi Ty2
cagcaacagugggcuaugaa

SEQ ID NO: 1783042 - RNA, 21 nt, Salmonella enterica enterica serovar Typhi Ty2
cagcaacagugggcuaugaag

SEQ ID NO: 1783043 - RNA, 17 nt, Salmonella enterica enterica serovar Typhi Ty2
cagcaaccccugagugc

SEQ ID NO: 1783044 - RNA, 13 nt, Salmonella enterica enterica serovar Typhi Ty2
cagcaacccugcc

SEQ ID NO: 1783045 - RNA, 13 nt, Salmonella enterica enterica serovar Typhi Ty2
cagcaccacgccc

SEQ ID NO: 1783046 - RNA, 17 nt, Salmonella enterica enterica serovar Typhi Ty2
cagcacaugauguuuua

SEQ ID NO: 1783047 - RNA, 17 nt, Salmonella enterica enterica serovar Typhi Ty2
cagcacauagccuaaug

SEQ ID NO: 1783048 - RNA, 12 nt, Salmonella enterica enterica serovar Typhi Ty2
cagcaaucaggu

SEQ ID NO: 1783049 - RNA, 20 nt, Salmonella enterica enterica serovar Typhi Ty2
cagcaaucacuuccgccucg

SEQ ID NO: 1783050 - RNA, 17 nt, Salmonella enterica enterica serovar Typhi Ty2
cagcaauaucagccauu

SEQ ID NO: 1783051 - RNA, 20 nt, Salmonella enterica enterica serovar Typhi Ty2
cagcaauaguggacacacaa

SEQ ID NO: 1783052 - RNA, 22 nt, Salmonella enterica enterica serovar Typhi Ty2
cagcaauaacaccggcggcgcc

SEQ ID NO: 1783053 - RNA, 13 nt, Salmonella enterica enterica serovar Typhi Ty2
cagcaauacccag

SEQ ID NO: 1783054 - RNA, 13 nt, Salmonella enterica enterica serovar Typhi Ty2
cagcaaugauaac

SEQ ID NO: 1783055 - RNA, 15 nt, Salmonella enterica enterica serovar Typhi Ty2
cagcaaugcccaaaa

SEQ ID NO: 1783056 - RNA, 21 nt, Salmonella enterica enterica serovar Typhi Ty2
cagcaauuggccaucuucguu

SEQ ID NO: 1783057 - RNA, 23 nt, Salmonella enterica enterica serovar Typhi Ty2
cagcaauuccgccaucucauucg

SEQ ID NO: 1783058 - RNA, 21 nt, Salmonella enterica enterica serovar Typhi Ty2
cagcacaauuccggcccaggc

SEQ ID NO: 1783059 - RNA, 21 nt, Salmonella enterica enterica serovar Typhi Ty2
cagcacaaucccggcgccgau

SEQ ID NO: 1783060 - RNA, 15 nt, Salmonella enterica enterica serovar Typhi Ty2
cagcacacuacacag

SEQ ID NO: 1783061 - RNA, 15 nt, Salmonella enterica enterica serovar Typhi Ty2
cagauuuuuaauguc

SEQ ID NO: 1783062 - RNA, 23 nt, Salmonella enterica enterica serovar Typhi Ty2
cagauuuuuaauguccagcagug

SEQ ID NO: 1783063 - RNA, 18 nt, Salmonella enterica enterica serovar Typhi Ty2
cagcaaaauaccggcagc

SEQ ID NO: 1783064 - RNA, 21 nt, Salmonella enterica enterica serovar Typhi Ty2
cagcaaaauggcaauugcgcc

SEQ ID NO: 1783065 - RNA, 15 nt, Salmonella enterica enterica serovar Typhi Ty2
cagcaaacauccccg

SEQ ID NO: 1783066 - RNA, 18 nt, Salmonella enterica enterica serovar Typhi Ty2
cagcaaaccgauaaucac

SEQ ID NO: 1783067 - RNA, 18 nt, Salmonella enterica enterica serovar Typhi Ty2
cagauuucgcagcagcau

SEQ ID NO: 1783068 - RNA, 15 nt, Salmonella enterica enterica serovar Typhi Ty2
cagauguugauacag

SEQ ID NO: 1783069 - RNA, 17 nt, Salmonella enterica enterica serovar Typhi Ty2
cagauguuauaaacuuc

SEQ ID NO: 1783070 - RNA, 14 nt, Salmonella enterica enterica serovar Typhi Ty2
cagauguugauaca

SEQ ID NO: 1783071 - RNA, 19 nt, Salmonella enterica enterica serovar Typhi Ty2
cagaugucgcggauaugca

SEQ ID NO: 1783072 - RNA, 20 nt, Salmonella enterica enterica serovar Typhi Ty2
cagauguaccagcggcagcu

SEQ ID NO: 1783073 - RNA, 20 nt, Salmonella enterica enterica serovar Typhi Ty2
cagauggugauagcgcgcca

SEQ ID NO: 1783074 - RNA, 18 nt, Salmonella enterica enterica serovar Typhi Ty2
cagaugguuggcgccgau

SEQ ID NO: 1783075 - RNA, 14 nt, Salmonella enterica enterica serovar Typhi Ty2
cagauuacuaugag

SEQ ID NO: 1783076 - RNA, 13 nt, Salmonella enterica enterica serovar Typhi Ty2
cagauucuucugc

SEQ ID NO: 1783077 - RNA, 18 nt, Salmonella enterica enterica serovar Typhi Ty2
cagauucuuaguccucag

SEQ ID NO: 1783078 - RNA, 19 nt, Salmonella enterica enterica serovar Typhi Ty2
cagaucggcagacaguuuc

SEQ ID NO: 1783079 - RNA, 15 nt, Salmonella enterica enterica serovar Typhi Ty2
cagaucgaaugaaaa

SEQ ID NO: 1783080 - RNA, 15 nt, Salmonella enterica enterica serovar Typhi Ty2
cagauccuuuuucug

SEQ ID NO: 1783081 - RNA, 14 nt, Salmonella enterica enterica serovar Typhi Ty2
cagaucuucaaucg

SEQ ID NO: 1783082 - RNA, 17 nt, Salmonella enterica enterica serovar Typhi Ty2
cagaucuuuuugcuccu

SEQ ID NO: 1783083 - RNA, 18 nt, Salmonella enterica enterica serovar Typhi Ty2
cagaucuugugaguaaua

SEQ ID NO: 1783084 - RNA, 16 nt, Salmonella enterica enterica serovar Typhi Ty2
cagaucugucgccaug

SEQ ID NO: 1783085 - RNA, 22 nt, Salmonella enterica enterica serovar Typhi Ty2
cagaucuuauaugagcgggccg

SEQ ID NO: 1783086 - RNA, 19 nt, Salmonella enterica enterica serovar Typhi Ty2
cagaucgguaaaagcguuu

SEQ ID NO: 1783087 - RNA, 15 nt, Salmonella enterica enterica serovar Typhi Ty2
cagaucgguuuaucc

SEQ ID NO: 1783088 - RNA, 18 nt, Salmonella enterica enterica serovar Typhi Ty2
cagaucguaugcgccugu

SEQ ID NO: 1783089 - RNA, 19 nt, Salmonella enterica enterica serovar Typhi Ty2
cagaugcccguaaagcucg

SEQ ID NO: 1783090 - RNA, 21 nt, Salmonella enterica enterica serovar Typhi Ty2
cagaugcagguucccgcccug

SEQ ID NO: 1783091 - RNA, 19 nt, Salmonella enterica enterica serovar Typhi Ty2
cagaugcagguucccgccc

SEQ ID NO: 1783092 - RNA, 14 nt, Salmonella enterica enterica serovar Typhi Ty2
cagaugcaaugcag

SEQ ID NO: 1783093 - RNA, 17 nt, Salmonella enterica enterica serovar Typhi Ty2
cagaugagcgguaaguc

SEQ ID NO: 1783094 - RNA, 17 nt, Salmonella enterica enterica serovar Typhi Ty2
cagaugcuuaaacugcg

SEQ ID NO: 1783095 - RNA, 15 nt, Salmonella enterica enterica serovar Typhi Ty2
cagaugcgcuucaag

SEQ ID NO: 1783096 - RNA, 21 nt, Salmonella enterica enterica serovar Typhi Ty2
cagaugcgccagauucaugau

SEQ ID NO: 1783097 - RNA, 17 nt, Salmonella enterica enterica serovar Typhi Ty2
cagccaacaacaggccg

SEQ ID NO: 1783098 - RNA, 16 nt, Salmonella enterica enterica serovar Typhi Ty2
cagccaacaaagaggc

SEQ ID NO: 1783099 - RNA, 21 nt, Salmonella enterica enterica serovar Typhi Ty2
cagcauuuuucacaguucuac

SEQ ID NO: 1783100 - RNA, 18 nt, Salmonella enterica enterica serovar Typhi Ty2
cagccaaauagcgccaga

SEQ ID NO: 1783101 - RNA, 23 nt, Salmonella enterica enterica serovar Typhi Ty2
cagccaaagcgagguaaaaagcg

SEQ ID NO: 1783102 - RNA, 19 nt, Salmonella enterica enterica serovar Typhi Ty2
cagccaaacuccucacugc

SEQ ID NO: 1783103 - RNA, 17 nt, Salmonella enterica enterica serovar Typhi Ty2
cagcauuugcuguuuua

SEQ ID NO: 1783104 - RNA, 21 nt, Salmonella enterica enterica serovar Typhi Ty2
cagccaaaaauaacgcccugc

SEQ ID NO: 1783105 - RNA, 22 nt, Salmonella enterica enterica serovar Typhi Ty2
cagccaaaaauaacgcccugcg

SEQ ID NO: 1783106 - RNA, 19 nt, Salmonella enterica enterica serovar Typhi Ty2
cagccaauuuaggcguggu

SEQ ID NO: 1783107 - RNA, 14 nt, Salmonella enterica enterica serovar Typhi Ty2
cagcauuacccccg

SEQ ID NO: 1783108 - RNA, 13 nt, Salmonella enterica enterica serovar Typhi Ty2
cagcauuuccagc

SEQ ID NO: 1783109 - RNA, 21 nt, Salmonella enterica enterica serovar Typhi Ty2
cagcauuggugagagaguugc

SEQ ID NO: 1783110 - RNA, 19 nt, Salmonella enterica enterica serovar Typhi Ty2
cagcauuucaaucgcgccc

SEQ ID NO: 1783111 - RNA, 14 nt, Salmonella enterica enterica serovar Typhi Ty2
cagcauagucgcuc

SEQ ID NO: 1783112 - RNA, 23 nt, Salmonella enterica enterica serovar Typhi Ty2
cagcauaauauucauaacgccga

SEQ ID NO: 1783113 - RNA, 19 nt, Salmonella enterica enterica serovar Typhi Ty2
cagcauaauaaagcagcgg

SEQ ID NO: 1783114 - RNA, 18 nt, Salmonella enterica enterica serovar Typhi Ty2
cagcaucaaccaccaaaa

SEQ ID NO: 1783115 - RNA, 16 nt, Salmonella enterica enterica serovar Typhi Ty2
cagcaucaccggcccc

SEQ ID NO: 1783116 - RNA, 20 nt, Salmonella enterica enterica serovar Typhi Ty2
cagcaucaucucccaggccg

SEQ ID NO: 1783117 - RNA, 13 nt, Salmonella enterica enterica serovar Typhi Ty2
cagcaucccgcug

SEQ ID NO: 1783118 - RNA, 19 nt, Salmonella enterica enterica serovar Typhi Ty2
cagcaucccgcuggcgcca

SEQ ID NO: 1783119 - RNA, 21 nt, Salmonella enterica enterica serovar Typhi Ty2
cagcaucaugggcucaucaaa

SEQ ID NO: 1783120 - RNA, 17 nt, Salmonella enterica enterica serovar Typhi Ty2
cagcaugaucauacugc

SEQ ID NO: 1783121 - RNA, 21 nt, Salmonella enterica enterica serovar Typhi Ty2
cagcaugaauaaccucccgcc

SEQ ID NO: 1783122 - RNA, 22 nt, Salmonella enterica enterica serovar Typhi Ty2
cagcaucugcauaauggcgacg

SEQ ID NO: 1783123 - RNA, 24 nt, Salmonella enterica enterica serovar Typhi Ty2
cagcaucugcggcuuucaucauuc

SEQ ID NO: 1783124 - RNA, 20 nt, Salmonella enterica enterica serovar Typhi Ty2
cagcaugaauaaccucccgc

SEQ ID NO: 1783125 - RNA, 16 nt, Salmonella enterica enterica serovar Typhi Ty2
cagcaucggcagcgcc

SEQ ID NO: 1783126 - RNA, 18 nt, Salmonella enterica enterica serovar Typhi Ty2
cagcaucgggaaucaucg

SEQ ID NO: 1783127 - RNA, 17 nt, Salmonella enterica enterica serovar Typhi Ty2
cagcaucgggaaucauc

SEQ ID NO: 1783128 - RNA, 14 nt, Salmonella enterica enterica serovar Typhi Ty2
cagcaucuccuggc

SEQ ID NO: 1783129 - RNA, 14 nt, Salmonella enterica enterica serovar Typhi Ty2
cagcaucgaccagg

SEQ ID NO: 1783130 - RNA, 19 nt, Salmonella enterica enterica serovar Typhi Ty2
cagcaucgccaucaacucc

SEQ ID NO: 1783131 - RNA, 18 nt, Salmonella enterica enterica serovar Typhi Ty2
cagccauaaucaguacug

SEQ ID NO: 1783132 - RNA, 23 nt, Salmonella enterica enterica serovar Typhi Ty2
cagccauaaucaguacugcgccc

SEQ ID NO: 1783133 - RNA, 22 nt, Salmonella enterica enterica serovar Typhi Ty2
cagccauaauggauuagguugc

SEQ ID NO: 1783134 - RNA, 16 nt, Salmonella enterica enterica serovar Typhi Ty2
cagccauagcgcgccg

SEQ ID NO: 1783135 - RNA, 16 nt, Salmonella enterica enterica serovar Typhi Ty2
cagccauauuuaugca

SEQ ID NO: 1783136 - RNA, 17 nt, Salmonella enterica enterica serovar Typhi Ty2
cagccaugccauauggc

SEQ ID NO: 1783137 - RNA, 15 nt, Salmonella enterica enterica serovar Typhi Ty2
cagccauccccauau

SEQ ID NO: 1783138 - RNA, 13 nt, Salmonella enterica enterica serovar Typhi Ty2
cagccauccgacg

SEQ ID NO: 1783139 - RNA, 13 nt, Salmonella enterica enterica serovar Typhi Ty2
cagccaugccagc

SEQ ID NO: 1783140 - RNA, 13 nt, Salmonella enterica enterica serovar Typhi Ty2
cagccauggcccu

SEQ ID NO: 1783141 - RNA, 14 nt, Salmonella enterica enterica serovar Typhi Ty2
cagccauucaccac

SEQ ID NO: 1783142 - RNA, 16 nt, Salmonella enterica enterica serovar Typhi Ty2
cagcccagguuaccaa

SEQ ID NO: 1783143 - RNA, 20 nt, Salmonella enterica enterica serovar Typhi Ty2
cagcccauaccacaacagaa

SEQ ID NO: 1783144 - RNA, 19 nt, Salmonella enterica enterica serovar Typhi Ty2
cagcccaucuuucgccagc

SEQ ID NO: 1783145 - RNA, 22 nt, Salmonella enterica enterica serovar Typhi Ty2
cagcccaucggucgcgcgcagg

SEQ ID NO: 1783146 - RNA, 20 nt, Salmonella enterica enterica serovar Typhi Ty2
cagcccaucggucgcgcgca

SEQ ID NO: 1783147 - RNA, 12 nt, Salmonella enterica enterica serovar Typhi Ty2
cagcccaugaag

SEQ ID NO: 1783148 - RNA, 16 nt, Salmonella enterica enterica serovar Typhi Ty2
cagccccagcaccaga

SEQ ID NO: 1783149 - RNA, 16 nt, Salmonella enterica enterica serovar Typhi Ty2
cagccccacauuggaa

SEQ ID NO: 1783150 - RNA, 20 nt, Salmonella enterica enterica serovar Typhi Ty2
cagccccugaaauaacagac

SEQ ID NO: 1783151 - RNA, 16 nt, Salmonella enterica enterica serovar Typhi Ty2
cagccccuucgcuguc

SEQ ID NO: 1783152 - RNA, 17 nt, Salmonella enterica enterica serovar Typhi Ty2
cagccccuucgcugucc

SEQ ID NO: 1783153 - RNA, 22 nt, Salmonella enterica enterica serovar Typhi Ty2
cagcccccaguuuuugaacaua

SEQ ID NO: 1783154 - RNA, 23 nt, Salmonella enterica enterica serovar Typhi Ty2
cagccagucgccaggcaagguua

SEQ ID NO: 1783155 - RNA, 14 nt, Salmonella enterica enterica serovar Typhi Ty2
cagccaggucugca

SEQ ID NO: 1783156 - RNA, 12 nt, Salmonella enterica enterica serovar Typhi Ty2
cagccaguccuc

SEQ ID NO: 1783157 - RNA, 21 nt, Salmonella enterica enterica serovar Typhi Ty2
cagccagguauuuagccacgc

SEQ ID NO: 1783158 - RNA, 17 nt, Salmonella enterica enterica serovar Typhi Ty2
cagccagcucaccagcc

SEQ ID NO: 1783159 - RNA, 19 nt, Salmonella enterica enterica serovar Typhi Ty2
cagccagccguugugcugg

SEQ ID NO: 1783160 - RNA, 23 nt, Salmonella enterica enterica serovar Typhi Ty2
cagccaggcgaucgcacagagau

SEQ ID NO: 1783161 - RNA, 11 nt, Salmonella enterica enterica serovar Typhi Ty2
cagccaggcca

SEQ ID NO: 1783162 - RNA, 17 nt, Salmonella enterica enterica serovar Typhi Ty2
cagccaggcaaaacagu

SEQ ID NO: 1783163 - RNA, 18 nt, Salmonella enterica enterica serovar Typhi Ty2
cagccaggcaaagcccca

SEQ ID NO: 1783164 - RNA, 15 nt, Salmonella enterica enterica serovar Typhi Ty2
cagccacuucuucca

SEQ ID NO: 1783165 - RNA, 16 nt, Salmonella enterica enterica serovar Typhi Ty2
cagccagaacucaucu

SEQ ID NO: 1783166 - RNA, 12 nt, Salmonella enterica enterica serovar Typhi Ty2
cagccacccacu

SEQ ID NO: 1783167 - RNA, 15 nt, Salmonella enterica enterica serovar Typhi Ty2
cagccagacgccagc

SEQ ID NO: 1783168 - RNA, 17 nt, Salmonella enterica enterica serovar Typhi Ty2
cagccagacggcgccca

SEQ ID NO: 1783169 - RNA, 16 nt, Salmonella enterica enterica serovar Typhi Ty2
cagccagacggcgccc

SEQ ID NO: 1783170 - RNA, 15 nt, Salmonella enterica enterica serovar Typhi Ty2
cagccagcauuucca

SEQ ID NO: 1783171 - RNA, 18 nt, Salmonella enterica enterica serovar Typhi Ty2
cagcaguggcucagucag

SEQ ID NO: 1783172 - RNA, 16 nt, Salmonella enterica enterica serovar Typhi Ty2
cagcagugggaaaauu

SEQ ID NO: 1783173 - RNA, 14 nt, Salmonella enterica enterica serovar Typhi Ty2
cagcaguucuacgc

SEQ ID NO: 1783174 - RNA, 18 nt, Salmonella enterica enterica serovar Typhi Ty2
cagcaguuuuucaaucuu

SEQ ID NO: 1783175 - RNA, 16 nt, Salmonella enterica enterica serovar Typhi Ty2
cagcagucucuacuac

SEQ ID NO: 1783176 - RNA, 20 nt, Salmonella enterica enterica serovar Typhi Ty2
cagcaggucgaccaccugcu

SEQ ID NO: 1783177 - RNA, 20 nt, Salmonella enterica enterica serovar Typhi Ty2
cagcaggucgcacuccucug

SEQ ID NO: 1783178 - RNA, 20 nt, Salmonella enterica enterica serovar Typhi Ty2
cagcagguuaaacagacaau

SEQ ID NO: 1783179 - RNA, 18 nt, Salmonella enterica enterica serovar Typhi Ty2
cagcaggcuuugcugcug

SEQ ID NO: 1783180 - RNA, 14 nt, Salmonella enterica enterica serovar Typhi Ty2
cagcagcuucagca

SEQ ID NO: 1783181 - RNA, 13 nt, Salmonella enterica enterica serovar Typhi Ty2
cagcagcgcggca

SEQ ID NO: 1783182 - RNA, 16 nt, Salmonella enterica enterica serovar Typhi Ty2
cagcagcgcuuucuuc

SEQ ID NO: 1783183 - RNA, 14 nt, Salmonella enterica enterica serovar Typhi Ty2
cagcagcagcaccg

SEQ ID NO: 1783184 - RNA, 15 nt, Salmonella enterica enterica serovar Typhi Ty2
cagcagcaccggcug

SEQ ID NO: 1783185 - RNA, 23 nt, Salmonella enterica enterica serovar Typhi Ty2
cagcagcaggcuggagagcaacg

SEQ ID NO: 1783186 - RNA, 12 nt, Salmonella enterica enterica serovar Typhi Ty2
cagcagccagaa

SEQ ID NO: 1783187 - RNA, 15 nt, Salmonella enterica enterica serovar Typhi Ty2
cagcagccaugccag

SEQ ID NO: 1783188 - RNA, 20 nt, Salmonella enterica enterica serovar Typhi Ty2
cagcagcgcccagccaaagc

SEQ ID NO: 1783189 - RNA, 19 nt, Salmonella enterica enterica serovar Typhi Ty2
cagcagcccgucuuuuucc

SEQ ID NO: 1783190 - RNA, 19 nt, Salmonella enterica enterica serovar Typhi Ty2
cagcacguagcuuauaaau

SEQ ID NO: 1783191 - RNA, 14 nt, Salmonella enterica enterica serovar Typhi Ty2
cagcacuaacagca

SEQ ID NO: 1783192 - RNA, 18 nt, Salmonella enterica enterica serovar Typhi Ty2
cagcacguuaccggcggu

SEQ ID NO: 1783193 - RNA, 19 nt, Salmonella enterica enterica serovar Typhi Ty2
cagcacgcgcugcgccgca

SEQ ID NO: 1783194 - RNA, 18 nt, Salmonella enterica enterica serovar Typhi Ty2
cagcacgccggaaagaau

SEQ ID NO: 1783195 - RNA, 19 nt, Salmonella enterica enterica serovar Typhi Ty2
cagcacgccgcccgccuga

SEQ ID NO: 1783196 - RNA, 14 nt, Salmonella enterica enterica serovar Typhi Ty2
cagcacgggccugu

SEQ ID NO: 1783197 - RNA, 17 nt, Salmonella enterica enterica serovar Typhi Ty2
cagcacgcuuacccagc

SEQ ID NO: 1783198 - RNA, 23 nt, Salmonella enterica enterica serovar Typhi Ty2
cagcagauagcccgccagcacca

SEQ ID NO: 1783199 - RNA, 19 nt, Salmonella enterica enterica serovar Typhi Ty2
cagcacuuccggaucgcua

SEQ ID NO: 1783200 - RNA, 17 nt, Salmonella enterica enterica serovar Typhi Ty2
cagcacuucgcugauac

SEQ ID NO: 1783201 - RNA, 20 nt, Salmonella enterica enterica serovar Typhi Ty2
cagcacccagcgaauuauga

SEQ ID NO: 1783202 - RNA, 21 nt, Salmonella enterica enterica serovar Typhi Ty2
cagcaccaguugcgucagcgu

SEQ ID NO: 1783203 - RNA, 17 nt, Salmonella enterica enterica serovar Typhi Ty2
cagcaccaucuuuuccg

SEQ ID NO: 1783204 - RNA, 12 nt, Salmonella enterica enterica serovar Typhi Ty2
cagcaccgccgc

SEQ ID NO: 1783205 - RNA, 14 nt, Salmonella enterica enterica serovar Typhi Ty2
cagcaccgccggga

SEQ ID NO: 1783206 - RNA, 14 nt, Salmonella enterica enterica serovar Typhi Ty2
cagcaccuccagcg

SEQ ID NO: 1783207 - RNA, 16 nt, Salmonella enterica enterica serovar Typhi Ty2
cagcaccugaauaaug

SEQ ID NO: 1783208 - RNA, 21 nt, Salmonella enterica enterica serovar Typhi Ty2
cagcaccucgcugcugcuuuu

SEQ ID NO: 1783209 - RNA, 16 nt, Salmonella enterica enterica serovar Typhi Ty2
cagcacgaugcauaug

SEQ ID NO: 1783210 - RNA, 13 nt, Salmonella enterica enterica serovar Typhi Ty2
cagcccgccagca

SEQ ID NO: 1783211 - RNA, 16 nt, Salmonella enterica enterica serovar Typhi Ty2
cagcccgaucaucucc

SEQ ID NO: 1783212 - RNA, 17 nt, Salmonella enterica enterica serovar Typhi Ty2
cagcccgauacccgccc

SEQ ID NO: 1783213 - RNA, 15 nt, Salmonella enterica enterica serovar Typhi Ty2
cagcccugugccgcu

SEQ ID NO: 1783214 - RNA, 13 nt, Salmonella enterica enterica serovar Typhi Ty2
cagcccugugccg

SEQ ID NO: 1783215 - RNA, 14 nt, Salmonella enterica enterica serovar Typhi Ty2
cagcccgucggcgu

SEQ ID NO: 1783216 - RNA, 19 nt, Salmonella enterica enterica serovar Typhi Ty2
cagcccguucucgccgcgu

SEQ ID NO: 1783217 - RNA, 21 nt, Salmonella enterica enterica serovar Typhi Ty2
cagcccguucugugcgccgcu

SEQ ID NO: 1783218 - RNA, 16 nt, Salmonella enterica enterica serovar Typhi Ty2
cagccgauaacucuuc

SEQ ID NO: 1783219 - RNA, 20 nt, Salmonella enterica enterica serovar Typhi Ty2
cagccgaucuauuucauaau

SEQ ID NO: 1783220 - RNA, 14 nt, Salmonella enterica enterica serovar Typhi Ty2
cagccgaucaggcc

SEQ ID NO: 1783221 - RNA, 24 nt, Salmonella enterica enterica serovar Typhi Ty2
cagccgaucaacgggguuagcguu

SEQ ID NO: 1783222 - RNA, 13 nt, Salmonella enterica enterica serovar Typhi Ty2
cagccgacgcauu

SEQ ID NO: 1783223 - RNA, 21 nt, Salmonella enterica enterica serovar Typhi Ty2
cagccgacgcauuucuccuga

SEQ ID NO: 1783224 - RNA, 16 nt, Salmonella enterica enterica serovar Typhi Ty2
cagcccuuugagaaaa

SEQ ID NO: 1783225 - RNA, 14 nt, Salmonella enterica enterica serovar Typhi Ty2
cagccgcauuuuuu

SEQ ID NO: 1783226 - RNA, 12 nt, Salmonella enterica enterica serovar Typhi Ty2
cagccgcaucuu

SEQ ID NO: 1783227 - RNA, 22 nt, Salmonella enterica enterica serovar Typhi Ty2
cagccgccaguuugguuaauuc

SEQ ID NO: 1783228 - RNA, 12 nt, Salmonella enterica enterica serovar Typhi Ty2
cagccgccaggc

SEQ ID NO: 1783229 - RNA, 15 nt, Salmonella enterica enterica serovar Typhi Ty2
cagccgccaucgcug

SEQ ID NO: 1783230 - RNA, 13 nt, Salmonella enterica enterica serovar Typhi Ty2
cagccgccauccg

SEQ ID NO: 1783231 - RNA, 19 nt, Salmonella enterica enterica serovar Typhi Ty2
cagccgccauuaauaccau

SEQ ID NO: 1783232 - RNA, 17 nt, Salmonella enterica enterica serovar Typhi Ty2
cagccgcgccaucuccu

SEQ ID NO: 1783233 - RNA, 21 nt, Salmonella enterica enterica serovar Typhi Ty2
cagccgcggcgcuuucgccac

SEQ ID NO: 1783234 - RNA, 21 nt, Salmonella enterica enterica serovar Typhi Ty2
cagccgcccgcgauaaaaauc

SEQ ID NO: 1783235 - RNA, 16 nt, Salmonella enterica enterica serovar Typhi Ty2
cagccgggcaggaaaa

SEQ ID NO: 1783236 - RNA, 15 nt, Salmonella enterica enterica serovar Typhi Ty2
cagccgggcaggaaa

SEQ ID NO: 1783237 - RNA, 20 nt, Salmonella enterica enterica serovar Typhi Ty2
cagccgcucugcuguuccuu

SEQ ID NO: 1783238 - RNA, 22 nt, Salmonella enterica enterica serovar Typhi Ty2
cagccgcuuuccgccgccgcca

SEQ ID NO: 1783239 - RNA, 23 nt, Salmonella enterica enterica serovar Typhi Ty2
cagccggaaaagcgcuggcuggc

SEQ ID NO: 1783240 - RNA, 13 nt, Salmonella enterica enterica serovar Typhi Ty2
cagcgaccuccgc

SEQ ID NO: 1783241 - RNA, 14 nt, Salmonella enterica enterica serovar Typhi Ty2
cagcgaccuccgcg

SEQ ID NO: 1783242 - RNA, 23 nt, Salmonella enterica enterica serovar Typhi Ty2
cagcgacgaugaaauaaacgacc

SEQ ID NO: 1783243 - RNA, 13 nt, Salmonella enterica enterica serovar Typhi Ty2
cagcgacgccaga

SEQ ID NO: 1783244 - RNA, 15 nt, Salmonella enterica enterica serovar Typhi Ty2
cagcgacgcauugag

SEQ ID NO: 1783245 - RNA, 15 nt, Salmonella enterica enterica serovar Typhi Ty2
cagcgacgcccagug

SEQ ID NO: 1783246 - RNA, 15 nt, Salmonella enterica enterica serovar Typhi Ty2
cagcgagaagucggc

SEQ ID NO: 1783247 - RNA, 14 nt, Salmonella enterica enterica serovar Typhi Ty2
cagcgacucauuca

SEQ ID NO: 1783248 - RNA, 22 nt, Salmonella enterica enterica serovar Typhi Ty2
cagcgaggugauaaucagcgcu

SEQ ID NO: 1783249 - RNA, 15 nt, Salmonella enterica enterica serovar Typhi Ty2
cagcgagauggcuuu

SEQ ID NO: 1783250 - RNA, 18 nt, Salmonella enterica enterica serovar Typhi Ty2
cagcgagcaggaauagcu

SEQ ID NO: 1783251 - RNA, 15 nt, Salmonella enterica enterica serovar Typhi Ty2
cagcgagacgcugga

SEQ ID NO: 1783252 - RNA, 23 nt, Salmonella enterica enterica serovar Typhi Ty2
cagcgacgccagauuaucggcca

SEQ ID NO: 1783253 - RNA, 15 nt, Salmonella enterica enterica serovar Typhi Ty2
cagcgaaccuuccau

SEQ ID NO: 1783254 - RNA, 21 nt, Salmonella enterica enterica serovar Typhi Ty2
cagcgaaaugacggccaccag

SEQ ID NO: 1783255 - RNA, 22 nt, Salmonella enterica enterica serovar Typhi Ty2
cagcgaaaugacggccaccagc

SEQ ID NO: 1783256 - RNA, 17 nt, Salmonella enterica enterica serovar Typhi Ty2
cagcgaaacgacgucga

SEQ ID NO: 1783257 - RNA, 23 nt, Salmonella enterica enterica serovar Typhi Ty2
cagcgaaacgacgucgacgccuu

SEQ ID NO: 1783258 - RNA, 23 nt, Salmonella enterica enterica serovar Typhi Ty2
cagcgaauccgugcguaaaauau

SEQ ID NO: 1783259 - RNA, 21 nt, Salmonella enterica enterica serovar Typhi Ty2
cagcgaauuccggccaucaga

SEQ ID NO: 1783260 - RNA, 14 nt, Salmonella enterica enterica serovar Typhi Ty2
cagcgaauaaugaa

SEQ ID NO: 1783261 - RNA, 17 nt, Salmonella enterica enterica serovar Typhi Ty2
cagcgaccacgccaccg

SEQ ID NO: 1783262 - RNA, 11 nt, Salmonella enterica enterica serovar Typhi Ty2
cagccuuauag

SEQ ID NO: 1783263 - RNA, 13 nt, Salmonella enterica enterica serovar Typhi Ty2
cagccuguuugga

SEQ ID NO: 1783264 - RNA, 11 nt, Salmonella enterica enterica serovar Typhi Ty2
cagccugugca

SEQ ID NO: 1783265 - RNA, 15 nt, Salmonella enterica enterica serovar Typhi Ty2
cagccugccgucuuu

SEQ ID NO: 1783266 - RNA, 13 nt, Salmonella enterica enterica serovar Typhi Ty2
cagccugcugguc

SEQ ID NO: 1783267 - RNA, 21 nt, Salmonella enterica enterica serovar Typhi Ty2
cagccugcuggucugaaucug

SEQ ID NO: 1783268 - RNA, 21 nt, Salmonella enterica enterica serovar Typhi Ty2
cagccguaccacccgggaaaa

SEQ ID NO: 1783269 - RNA, 23 nt, Salmonella enterica enterica serovar Typhi Ty2
cagccucgcgcauccgggccgcu

SEQ ID NO: 1783270 - RNA, 16 nt, Salmonella enterica enterica serovar Typhi Ty2
cagccguuucuugucu

SEQ ID NO: 1783271 - RNA, 17 nt, Salmonella enterica enterica serovar Typhi Ty2
cagccucaggccugccg

SEQ ID NO: 1783272 - RNA, 13 nt, Salmonella enterica enterica serovar Typhi Ty2
cagccuaucgcca

SEQ ID NO: 1783273 - RNA, 14 nt, Salmonella enterica enterica serovar Typhi Ty2
cagcgccgcgccga

SEQ ID NO: 1783274 - RNA, 14 nt, Salmonella enterica enterica serovar Typhi Ty2
cagcgcccgcuuca

SEQ ID NO: 1783275 - RNA, 22 nt, Salmonella enterica enterica serovar Typhi Ty2
cagcgccuccgcguagcccagc

SEQ ID NO: 1783276 - RNA, 19 nt, Salmonella enterica enterica serovar Typhi Ty2
cagcgccguagcggcaggg

SEQ ID NO: 1783277 - RNA, 16 nt, Salmonella enterica enterica serovar Typhi Ty2
cagcgccgcgggcugg

SEQ ID NO: 1783278 - RNA, 13 nt, Salmonella enterica enterica serovar Typhi Ty2
cagcgccggcagc

SEQ ID NO: 1783279 - RNA, 14 nt, Salmonella enterica enterica serovar Typhi Ty2
cagcgccggcagca

SEQ ID NO: 1783280 - RNA, 15 nt, Salmonella enterica enterica serovar Typhi Ty2
cagcgccggcagcag

SEQ ID NO: 1783281 - RNA, 21 nt, Salmonella enterica enterica serovar Typhi Ty2
cagcgccggaucgggcuucca

SEQ ID NO: 1783282 - RNA, 21 nt, Salmonella enterica enterica serovar Typhi Ty2
cagcgccagcugcgucauguc

SEQ ID NO: 1783283 - RNA, 14 nt, Salmonella enterica enterica serovar Typhi Ty2
cagcgccaggccau

SEQ ID NO: 1783284 - RNA, 15 nt, Salmonella enterica enterica serovar Typhi Ty2
cagcgccagcuccau

SEQ ID NO: 1783285 - RNA, 17 nt, Salmonella enterica enterica serovar Typhi Ty2
cagcgccagcggcggcu

SEQ ID NO: 1783286 - RNA, 14 nt, Salmonella enterica enterica serovar Typhi Ty2
cagcgccagccgcg

SEQ ID NO: 1783287 - RNA, 14 nt, Salmonella enterica enterica serovar Typhi Ty2
cagcgccagcccug

SEQ ID NO: 1783288 - RNA, 15 nt, Salmonella enterica enterica serovar Typhi Ty2
cagcgccagcccugc

SEQ ID NO: 1783289 - RNA, 16 nt, Salmonella enterica enterica serovar Typhi Ty2
cagcgccagcccugcg

SEQ ID NO: 1783290 - RNA, 13 nt, Salmonella enterica enterica serovar Typhi Ty2
cagcgccagccgc

SEQ ID NO: 1783291 - RNA, 13 nt, Salmonella enterica enterica serovar Typhi Ty2
cagcgccagcccu

SEQ ID NO: 1783292 - RNA, 14 nt, Salmonella enterica enterica serovar Typhi Ty2
cagcgccagcagca

SEQ ID NO: 1783293 - RNA, 23 nt, Salmonella enterica enterica serovar Typhi Ty2
cagcgccagaauagacgccaugu

SEQ ID NO: 1783294 - RNA, 14 nt, Salmonella enterica enterica serovar Typhi Ty2
cagcgccccgccgc

SEQ ID NO: 1783295 - RNA, 19 nt, Salmonella enterica enterica serovar Typhi Ty2
cagcgccauccggcaaaau

SEQ ID NO: 1783296 - RNA, 17 nt, Salmonella enterica enterica serovar Typhi Ty2
cagcgccaucaggcccc

SEQ ID NO: 1783297 - RNA, 22 nt, Salmonella enterica enterica serovar Typhi Ty2
cagcgccauccacggccccggg

SEQ ID NO: 1783298 - RNA, 18 nt, Salmonella enterica enterica serovar Typhi Ty2
cagcgccaguuuuucccg

SEQ ID NO: 1783299 - RNA, 22 nt, Salmonella enterica enterica serovar Typhi Ty2
cagcgccauauaaauuucaucc

SEQ ID NO: 1783300 - RNA, 15 nt, Salmonella enterica enterica serovar Typhi Ty2
cagcgcaguuuccau

SEQ ID NO: 1783301 - RNA, 16 nt, Salmonella enterica enterica serovar Typhi Ty2
cagcgcauaccggcca

SEQ ID NO: 1783302 - RNA, 11 nt, Salmonella enterica enterica serovar Typhi Ty2
cagcgccaccg

SEQ ID NO: 1783303 - RNA, 12 nt, Salmonella enterica enterica serovar Typhi Ty2
cagcgccaccgg

SEQ ID NO: 1783304 - RNA, 21 nt, Salmonella enterica enterica serovar Typhi Ty2
cagcgccaccacaaacgccgu

SEQ ID NO: 1783305 - RNA, 16 nt, Salmonella enterica enterica serovar Typhi Ty2
cagcgccaccacaaac

SEQ ID NO: 1783306 - RNA, 17 nt, Salmonella enterica enterica serovar Typhi Ty2
cagcgcauuuuucuuca

SEQ ID NO: 1783307 - RNA, 16 nt, Salmonella enterica enterica serovar Typhi Ty2
cagcgccaacgccacu

SEQ ID NO: 1783308 - RNA, 14 nt, Salmonella enterica enterica serovar Typhi Ty2
cagcgcauugccuu

SEQ ID NO: 1783309 - RNA, 21 nt, Salmonella enterica enterica serovar Typhi Ty2
cagcgauuuuuacgccauuca

SEQ ID NO: 1783310 - RNA, 16 nt, Salmonella enterica enterica serovar Typhi Ty2
cagcgauugcgccaga

SEQ ID NO: 1783311 - RNA, 20 nt, Salmonella enterica enterica serovar Typhi Ty2
cagcgcaaaguuuucuuccg

SEQ ID NO: 1783312 - RNA, 14 nt, Salmonella enterica enterica serovar Typhi Ty2
cagcgcaacgcgca

SEQ ID NO: 1783313 - RNA, 20 nt, Salmonella enterica enterica serovar Typhi Ty2
cagcgauuccgucaggaacg

SEQ ID NO: 1783314 - RNA, 13 nt, Salmonella enterica enterica serovar Typhi Ty2
cagcgauuauuuc

SEQ ID NO: 1783315 - RNA, 19 nt, Salmonella enterica enterica serovar Typhi Ty2
cagcgaucugucgccgcgu

SEQ ID NO: 1783316 - RNA, 18 nt, Salmonella enterica enterica serovar Typhi Ty2
cagcgaugagcgccagca

SEQ ID NO: 1783317 - RNA, 14 nt, Salmonella enterica enterica serovar Typhi Ty2
cagcgauauuucuc

SEQ ID NO: 1783318 - RNA, 19 nt, Salmonella enterica enterica serovar Typhi Ty2
cagcgauauuucuccgccc

SEQ ID NO: 1783319 - RNA, 16 nt, Salmonella enterica enterica serovar Typhi Ty2
cagcgauauuucuccg

SEQ ID NO: 1783320 - RNA, 12 nt, Salmonella enterica enterica serovar Typhi Ty2
cagcgcgccgcg

SEQ ID NO: 1783321 - RNA, 13 nt, Salmonella enterica enterica serovar Typhi Ty2
cagcgcgcguaac

SEQ ID NO: 1783322 - RNA, 19 nt, Salmonella enterica enterica serovar Typhi Ty2
cagcgcgcgcuuucaccgc

SEQ ID NO: 1783323 - RNA, 13 nt, Salmonella enterica enterica serovar Typhi Ty2
cagcgcggcagcc

SEQ ID NO: 1783324 - RNA, 14 nt, Salmonella enterica enterica serovar Typhi Ty2
cagcgcggcaagga

SEQ ID NO: 1783325 - RNA, 20 nt, Salmonella enterica enterica serovar Typhi Ty2
cagcgcguccaauagccccu

SEQ ID NO: 1783326 - RNA, 23 nt, Salmonella enterica enterica serovar Typhi Ty2
cagcgcggguucuuuccacaauc

SEQ ID NO: 1783327 - RNA, 20 nt, Salmonella enterica enterica serovar Typhi Ty2
cagcgcgggcgaggccucgu

SEQ ID NO: 1783328 - RNA, 14 nt, Salmonella enterica enterica serovar Typhi Ty2
cagcgcgaccugca

SEQ ID NO: 1783329 - RNA, 14 nt, Salmonella enterica enterica serovar Typhi Ty2
cagcgcgacauaga

SEQ ID NO: 1783330 - RNA, 14 nt, Salmonella enterica enterica serovar Typhi Ty2
cagcgccugaaugu

SEQ ID NO: 1783331 - RNA, 12 nt, Salmonella enterica enterica serovar Typhi Ty2
cagcgcgccgca

SEQ ID NO: 1783332 - RNA, 19 nt, Salmonella enterica enterica serovar Typhi Ty2
cagcgcgccaaaguuaauc

SEQ ID NO: 1783333 - RNA, 20 nt, Salmonella enterica enterica serovar Typhi Ty2
cagcgcgauacgcagcaccg

SEQ ID NO: 1783334 - RNA, 18 nt, Salmonella enterica enterica serovar Typhi Ty2
cagcggcagcucugccug

SEQ ID NO: 1783335 - RNA, 16 nt, Salmonella enterica enterica serovar Typhi Ty2
cagcggcagcucugcc

SEQ ID NO: 1783336 - RNA, 16 nt, Salmonella enterica enterica serovar Typhi Ty2
cagcggcagugaugaa

SEQ ID NO: 1783337 - RNA, 22 nt, Salmonella enterica enterica serovar Typhi Ty2
cagcggcccgcgcugaauagcg

SEQ ID NO: 1783338 - RNA, 18 nt, Salmonella enterica enterica serovar Typhi Ty2
cagcggagagacauuggu

SEQ ID NO: 1783339 - RNA, 15 nt, Salmonella enterica enterica serovar Typhi Ty2
cagcggaucgauaac

SEQ ID NO: 1783340 - RNA, 23 nt, Salmonella enterica enterica serovar Typhi Ty2
cagcggcaaaggcauggcaggua

SEQ ID NO: 1783341 - RNA, 13 nt, Salmonella enterica enterica serovar Typhi Ty2
cagcggaugcucu

SEQ ID NO: 1783342 - RNA, 15 nt, Salmonella enterica enterica serovar Typhi Ty2
cagcggaauucccac

SEQ ID NO: 1783343 - RNA, 19 nt, Salmonella enterica enterica serovar Typhi Ty2
cagcggaaaauauucagca

SEQ ID NO: 1783344 - RNA, 20 nt, Salmonella enterica enterica serovar Typhi Ty2
cagcggaaaauauucagcac

SEQ ID NO: 1783345 - RNA, 20 nt, Salmonella enterica enterica serovar Typhi Ty2
cagcggaaagugaaggccag

SEQ ID NO: 1783346 - RNA, 20 nt, Salmonella enterica enterica serovar Typhi Ty2
cagcgcuuucaccgcgucgu

SEQ ID NO: 1783347 - RNA, 15 nt, Salmonella enterica enterica serovar Typhi Ty2
cagcgcuuugccgcu

SEQ ID NO: 1783348 - RNA, 18 nt, Salmonella enterica enterica serovar Typhi Ty2
cagcgcuuugccgcugcu

SEQ ID NO: 1783349 - RNA, 23 nt, Salmonella enterica enterica serovar Typhi Ty2
cagcgcuuugccgcugcugccuu

SEQ ID NO: 1783350 - RNA, 23 nt, Salmonella enterica enterica serovar Typhi Ty2
cagcgcuucucuuuccaguuggc

SEQ ID NO: 1783351 - RNA, 22 nt, Salmonella enterica enterica serovar Typhi Ty2
cagcgcuaccagcgcggcgcca

SEQ ID NO: 1783352 - RNA, 20 nt, Salmonella enterica enterica serovar Typhi Ty2
cagcgcuaccagcgcggcgc

SEQ ID NO: 1783353 - RNA, 20 nt, Salmonella enterica enterica serovar Typhi Ty2
cagcgcuaucaggcacugaa

SEQ ID NO: 1783354 - RNA, 15 nt, Salmonella enterica enterica serovar Typhi Ty2
cagcgcuauccggcc

SEQ ID NO: 1783355 - RNA, 15 nt, Salmonella enterica enterica serovar Typhi Ty2
cagcgcgucggccgg

SEQ ID NO: 1783356 - RNA, 23 nt, Salmonella enterica enterica serovar Typhi Ty2
cagcgcugcuguaacagacgcag

SEQ ID NO: 1783357 - RNA, 18 nt, Salmonella enterica enterica serovar Typhi Ty2
cagcgcuccaccaaccag

SEQ ID NO: 1783358 - RNA, 17 nt, Salmonella enterica enterica serovar Typhi Ty2
cagcgcugaaucgcaau

SEQ ID NO: 1783359 - RNA, 20 nt, Salmonella enterica enterica serovar Typhi Ty2
caaccaucacugaacccaaa

SEQ ID NO: 1783360 - RNA, 18 nt, Salmonella enterica enterica serovar Typhi Ty2
caaccaucacugaaccca

SEQ ID NO: 1783361 - RNA, 21 nt, Salmonella enterica enterica serovar Typhi Ty2
caaccaguuaauuucuuucca

SEQ ID NO: 1783362 - RNA, 19 nt, Salmonella enterica enterica serovar Typhi Ty2
caaccaguuaauuucuuuc

SEQ ID NO: 1783363 - RNA, 22 nt, Salmonella enterica enterica serovar Typhi Ty2
caacccauauucgucuucaucu

SEQ ID NO: 1783364 - RNA, 19 nt, Salmonella enterica enterica serovar Typhi Ty2
caacccguaccuccagcga

SEQ ID NO: 1783365 - RNA, 20 nt, Salmonella enterica enterica serovar Typhi Ty2
caacccgcaagcauaaaaaa

SEQ ID NO: 1783366 - RNA, 20 nt, Salmonella enterica enterica serovar Typhi Ty2
caaccccagacggcggcgaa

SEQ ID NO: 1783367 - RNA, 14 nt, Salmonella enterica enterica serovar Typhi Ty2
caaccgggaucuuu

SEQ ID NO: 1783368 - RNA, 15 nt, Salmonella enterica enterica serovar Typhi Ty2
caaccgcucuccgca

SEQ ID NO: 1783369 - RNA, 17 nt, Salmonella enterica enterica serovar Typhi Ty2
caaccggguaaacgcca

SEQ ID NO: 1783370 - RNA, 16 nt, Salmonella enterica enterica serovar Typhi Ty2
caacccuuuggccacc

SEQ ID NO: 1783371 - RNA, 16 nt, Salmonella enterica enterica serovar Typhi Ty2
caaccgccugcguuug

SEQ ID NO: 1783372 - RNA, 14 nt, Salmonella enterica enterica serovar Typhi Ty2
caaccgccaauaau

SEQ ID NO: 1783373 - RNA, 23 nt, Salmonella enterica enterica serovar Typhi Ty2
caaccaccggauggaucaucggc

SEQ ID NO: 1783374 - RNA, 20 nt, Salmonella enterica enterica serovar Typhi Ty2
caaccacggauaagccagcc

SEQ ID NO: 1783375 - RNA, 13 nt, Salmonella enterica enterica serovar Typhi Ty2
caaccaccaaaaa

SEQ ID NO: 1783376 - RNA, 15 nt, Salmonella enterica enterica serovar Typhi Ty2
caaccaacccaaaaa

SEQ ID NO: 1783377 - RNA, 15 nt, Salmonella enterica enterica serovar Typhi Ty2
caaccaaaguccaac

SEQ ID NO: 1783378 - RNA, 13 nt, Salmonella enterica enterica serovar Typhi Ty2
caaccaggcaaac

SEQ ID NO: 1783379 - RNA, 14 nt, Salmonella enterica enterica serovar Typhi Ty2
caaccaggauucaa

SEQ ID NO: 1783380 - RNA, 21 nt, Salmonella enterica enterica serovar Typhi Ty2
caaccagcgaaaugacggcca

SEQ ID NO: 1783381 - RNA, 12 nt, Salmonella enterica enterica serovar Typhi Ty2
caaccagcaaug

SEQ ID NO: 1783382 - RNA, 13 nt, Salmonella enterica enterica serovar Typhi Ty2
caaccagaauaau

SEQ ID NO: 1783383 - RNA, 16 nt, Salmonella enterica enterica serovar Typhi Ty2
caaccagaauaauggg

SEQ ID NO: 1783384 - RNA, 22 nt, Salmonella enterica enterica serovar Typhi Ty2
caacaugccugauggcgcugcg

SEQ ID NO: 1783385 - RNA, 15 nt, Salmonella enterica enterica serovar Typhi Ty2
caacaugaccagcgc

SEQ ID NO: 1783386 - RNA, 17 nt, Salmonella enterica enterica serovar Typhi Ty2
caacagguaccccgcca

SEQ ID NO: 1783387 - RNA, 24 nt, Salmonella enterica enterica serovar Typhi Ty2
caacagggcggccuccuggcuuac

SEQ ID NO: 1783388 - RNA, 14 nt, Salmonella enterica enterica serovar Typhi Ty2
caacauugccggca

SEQ ID NO: 1783389 - RNA, 20 nt, Salmonella enterica enterica serovar Typhi Ty2
caacauugaggcuacccaga

SEQ ID NO: 1783390 - RNA, 18 nt, Salmonella enterica enterica serovar Typhi Ty2
caacauuaucaaaaguga

SEQ ID NO: 1783391 - RNA, 20 nt, Salmonella enterica enterica serovar Typhi Ty2
caacauuaucaaaagugauc

SEQ ID NO: 1783392 - RNA, 13 nt, Salmonella enterica enterica serovar Typhi Ty2
caacggcggauga

SEQ ID NO: 1783393 - RNA, 19 nt, Salmonella enterica enterica serovar Typhi Ty2
caacguauaaaauggcaaa

SEQ ID NO: 1783394 - RNA, 15 nt, Salmonella enterica enterica serovar Typhi Ty2
caacgucaagacgcu

SEQ ID NO: 1783395 - RNA, 14 nt, Salmonella enterica enterica serovar Typhi Ty2
caacgucagcaucu

SEQ ID NO: 1783396 - RNA, 20 nt, Salmonella enterica enterica serovar Typhi Ty2
caacgucgugccagugaugc

SEQ ID NO: 1783397 - RNA, 22 nt, Salmonella enterica enterica serovar Typhi Ty2
caacguccccguuugcaguccg

SEQ ID NO: 1783398 - RNA, 21 nt, Salmonella enterica enterica serovar Typhi Ty2
caacgucgacagacgcaucuu

SEQ ID NO: 1783399 - RNA, 17 nt, Salmonella enterica enterica serovar Typhi Ty2
caacgucaucaugaaaa

SEQ ID NO: 1783400 - RNA, 15 nt, Salmonella enterica enterica serovar Typhi Ty2
caacguccgcagccg

SEQ ID NO: 1783401 - RNA, 15 nt, Salmonella enterica enterica serovar Typhi Ty2
caacggcacacaggc

SEQ ID NO: 1783402 - RNA, 20 nt, Salmonella enterica enterica serovar Typhi Ty2
caacggccagcaaaaucacc

SEQ ID NO: 1783403 - RNA, 13 nt, Salmonella enterica enterica serovar Typhi Ty2
caacgcuccagca

SEQ ID NO: 1783404 - RNA, 17 nt, Salmonella enterica enterica serovar Typhi Ty2
caacgcucagaccgauc

SEQ ID NO: 1783405 - RNA, 19 nt, Salmonella enterica enterica serovar Typhi Ty2
caaccguuggggaaaauau

SEQ ID NO: 1783406 - RNA, 16 nt, Salmonella enterica enterica serovar Typhi Ty2
caaccgugagcgcgcc

SEQ ID NO: 1783407 - RNA, 16 nt, Salmonella enterica enterica serovar Typhi Ty2
caaccguuucuuuuuc

SEQ ID NO: 1783408 - RNA, 17 nt, Salmonella enterica enterica serovar Typhi Ty2
caaccugaaagaagcgc

SEQ ID NO: 1783409 - RNA, 15 nt, Salmonella enterica enterica serovar Typhi Ty2
caaccucuuuuuccg

SEQ ID NO: 1783410 - RNA, 18 nt, Salmonella enterica enterica serovar Typhi Ty2
caaccucggcuugcuuca

SEQ ID NO: 1783411 - RNA, 17 nt, Salmonella enterica enterica serovar Typhi Ty2
caaccucggcuugcuuc

SEQ ID NO: 1783412 - RNA, 17 nt, Salmonella enterica enterica serovar Typhi Ty2
caaccucacuguugaua

SEQ ID NO: 1783413 - RNA, 12 nt, Salmonella enterica enterica serovar Typhi Ty2
caacgccacugc

SEQ ID NO: 1783414 - RNA, 19 nt, Salmonella enterica enterica serovar Typhi Ty2
caacgccaucagcaaaaua

SEQ ID NO: 1783415 - RNA, 14 nt, Salmonella enterica enterica serovar Typhi Ty2
caacgccagcagcg

SEQ ID NO: 1783416 - RNA, 14 nt, Salmonella enterica enterica serovar Typhi Ty2
caacgccaacauag

SEQ ID NO: 1783417 - RNA, 12 nt, Salmonella enterica enterica serovar Typhi Ty2
caacgccaagcg

SEQ ID NO: 1783418 - RNA, 15 nt, Salmonella enterica enterica serovar Typhi Ty2
caacgccaagcgcgg

SEQ ID NO: 1783419 - RNA, 17 nt, Salmonella enterica enterica serovar Typhi Ty2
caacgcgugauccacag

SEQ ID NO: 1783420 - RNA, 17 nt, Salmonella enterica enterica serovar Typhi Ty2
caacgccaucagccgcg

SEQ ID NO: 1783421 - RNA, 15 nt, Salmonella enterica enterica serovar Typhi Ty2
caacugggcuugcau

SEQ ID NO: 1783422 - RNA, 22 nt, Salmonella enterica enterica serovar Typhi Ty2
caacuguucuucgguuucgaca

SEQ ID NO: 1783423 - RNA, 22 nt, Salmonella enterica enterica serovar Typhi Ty2
caacuguuuuaccaaaucaaua

SEQ ID NO: 1783424 - RNA, 20 nt, Salmonella enterica enterica serovar Typhi Ty2
caacugcugcgcgugcugua

SEQ ID NO: 1783425 - RNA, 16 nt, Salmonella enterica enterica serovar Typhi Ty2
caacugcgccugaaga

SEQ ID NO: 1783426 - RNA, 19 nt, Salmonella enterica enterica serovar Typhi Ty2
caacugauuaaucugccga

SEQ ID NO: 1783427 - RNA, 17 nt, Salmonella enterica enterica serovar Typhi Ty2
caacugauucaaaaggu

SEQ ID NO: 1783428 - RNA, 16 nt, Salmonella enterica enterica serovar Typhi Ty2
caacgugccagaaaca

SEQ ID NO: 1783429 - RNA, 15 nt, Salmonella enterica enterica serovar Typhi Ty2
caacgugcagauggu

SEQ ID NO: 1783430 - RNA, 22 nt, Salmonella enterica enterica serovar Typhi Ty2
caacuacucguaaucuaaaauu

SEQ ID NO: 1783431 - RNA, 18 nt, Salmonella enterica enterica serovar Typhi Ty2
caacaaugccacgccccu

SEQ ID NO: 1783432 - RNA, 21 nt, Salmonella enterica enterica serovar Typhi Ty2
caacaaugccacgccccuaag

SEQ ID NO: 1783433 - RNA, 16 nt, Salmonella enterica enterica serovar Typhi Ty2
caacacacguaacaac

SEQ ID NO: 1783434 - RNA, 14 nt, Salmonella enterica enterica serovar Typhi Ty2
caacacauaagcca

SEQ ID NO: 1783435 - RNA, 16 nt, Salmonella enterica enterica serovar Typhi Ty2
caacacauaagccacu

SEQ ID NO: 1783436 - RNA, 14 nt, Salmonella enterica enterica serovar Typhi Ty2
caacaccaccgcuc

SEQ ID NO: 1783437 - RNA, 17 nt, Salmonella enterica enterica serovar Typhi Ty2
caacacgccgaacaaca

SEQ ID NO: 1783438 - RNA, 17 nt, Salmonella enterica enterica serovar Typhi Ty2
caacacggcgcucagga

SEQ ID NO: 1783439 - RNA, 14 nt, Salmonella enterica enterica serovar Typhi Ty2
caacagcucgccau

SEQ ID NO: 1783440 - RNA, 17 nt, Salmonella enterica enterica serovar Typhi Ty2
caacagcucgccaugca

SEQ ID NO: 1783441 - RNA, 16 nt, Salmonella enterica enterica serovar Typhi Ty2
caaaugagaauagacu

SEQ ID NO: 1783442 - RNA, 18 nt, Salmonella enterica enterica serovar Typhi Ty2
caaaugauaauaugcuca

SEQ ID NO: 1783443 - RNA, 22 nt, Salmonella enterica enterica serovar Typhi Ty2
caaaugcgauaaccugcuguga

SEQ ID NO: 1783444 - RNA, 24 nt, Salmonella enterica enterica serovar Typhi Ty2
caaauuaucuguugauaaaacacu

SEQ ID NO: 1783445 - RNA, 17 nt, Salmonella enterica enterica serovar Typhi Ty2
caaauuaucuguugaua

SEQ ID NO: 1783446 - RNA, 17 nt, Salmonella enterica enterica serovar Typhi Ty2
caaaucaccacauggcc

SEQ ID NO: 1783447 - RNA, 16 nt, Salmonella enterica enterica serovar Typhi Ty2
caaaucaccacauggc

SEQ ID NO: 1783448 - RNA, 21 nt, Salmonella enterica enterica serovar Typhi Ty2
caaaucaggaaauaaucgagu

SEQ ID NO: 1783449 - RNA, 15 nt, Salmonella enterica enterica serovar Typhi Ty2
caaaucaggaaauaa

SEQ ID NO: 1783450 - RNA, 13 nt, Salmonella enterica enterica serovar Typhi Ty2
caaaucagcagga

SEQ ID NO: 1783451 - RNA, 23 nt, Salmonella enterica enterica serovar Typhi Ty2
caaaucgugugcgguauagauca

SEQ ID NO: 1783452 - RNA, 16 nt, Salmonella enterica enterica serovar Typhi Ty2
caaaucgcgguaaaaa

SEQ ID NO: 1783453 - RNA, 18 nt, Salmonella enterica enterica serovar Typhi Ty2
caaaucgcgguaaaaagc

SEQ ID NO: 1783454 - RNA, 20 nt, Salmonella enterica enterica serovar Typhi Ty2
caaaucgcccaucacaugua

SEQ ID NO: 1783455 - RNA, 15 nt, Salmonella enterica enterica serovar Typhi Ty2
caaaucgccaucagc

SEQ ID NO: 1783456 - RNA, 16 nt, Salmonella enterica enterica serovar Typhi Ty2
caaagcaaaaaucacc

SEQ ID NO: 1783457 - RNA, 19 nt, Salmonella enterica enterica serovar Typhi Ty2
caaagcaccauucuucaac

SEQ ID NO: 1783458 - RNA, 15 nt, Salmonella enterica enterica serovar Typhi Ty2
caaagacaccccagc

SEQ ID NO: 1783459 - RNA, 17 nt, Salmonella enterica enterica serovar Typhi Ty2
caaagacaccccagccu

SEQ ID NO: 1783460 - RNA, 16 nt, Salmonella enterica enterica serovar Typhi Ty2
caaagacaggugacca

SEQ ID NO: 1783461 - RNA, 19 nt, Salmonella enterica enterica serovar Typhi Ty2
caaagccgccauccggccu

SEQ ID NO: 1783462 - RNA, 17 nt, Salmonella enterica enterica serovar Typhi Ty2
caaagccugcuggaaag

SEQ ID NO: 1783463 - RNA, 15 nt, Salmonella enterica enterica serovar Typhi Ty2
caaagccccagucau

SEQ ID NO: 1783464 - RNA, 16 nt, Salmonella enterica enterica serovar Typhi Ty2
caaagcccaucagcgc

SEQ ID NO: 1783465 - RNA, 19 nt, Salmonella enterica enterica serovar Typhi Ty2
caaagccaggccgccagca

SEQ ID NO: 1783466 - RNA, 21 nt, Salmonella enterica enterica serovar Typhi Ty2
caaagccaggccgccagcaac

SEQ ID NO: 1783467 - RNA, 18 nt, Salmonella enterica enterica serovar Typhi Ty2
caaaaggcuggaacagau

SEQ ID NO: 1783468 - RNA, 13 nt, Salmonella enterica enterica serovar Typhi Ty2
caaacuuuuaaau

SEQ ID NO: 1783469 - RNA, 22 nt, Salmonella enterica enterica serovar Typhi Ty2
caaaagccggucguaaugagca

SEQ ID NO: 1783470 - RNA, 17 nt, Salmonella enterica enterica serovar Typhi Ty2
caaaagccuguuuacca

SEQ ID NO: 1783471 - RNA, 15 nt, Salmonella enterica enterica serovar Typhi Ty2
caaaaggcuggaaca

SEQ ID NO: 1783472 - RNA, 12 nt, Salmonella enterica enterica serovar Typhi Ty2
caaagaaaacca

SEQ ID NO: 1783473 - RNA, 17 nt, Salmonella enterica enterica serovar Typhi Ty2
caaagaagaauccaggg

SEQ ID NO: 1783474 - RNA, 14 nt, Salmonella enterica enterica serovar Typhi Ty2
caaauacagaugcu

SEQ ID NO: 1783475 - RNA, 16 nt, Salmonella enterica enterica serovar Typhi Ty2
caaagcgagguaaaaa

SEQ ID NO: 1783476 - RNA, 18 nt, Salmonella enterica enterica serovar Typhi Ty2
caaaguuaucccugcuga

SEQ ID NO: 1783477 - RNA, 16 nt, Salmonella enterica enterica serovar Typhi Ty2
caaaguugcaucaaga

SEQ ID NO: 1783478 - RNA, 21 nt, Salmonella enterica enterica serovar Typhi Ty2
caaagucuggccaccgauaaa

SEQ ID NO: 1783479 - RNA, 15 nt, Salmonella enterica enterica serovar Typhi Ty2
caaagucuuuuguau

SEQ ID NO: 1783480 - RNA, 12 nt, Salmonella enterica enterica serovar Typhi Ty2
caagggcuuucu

SEQ ID NO: 1783481 - RNA, 15 nt, Salmonella enterica enterica serovar Typhi Ty2
caaggcgacucaaaa

SEQ ID NO: 1783482 - RNA, 12 nt, Salmonella enterica enterica serovar Typhi Ty2
caaggcgcgcca

SEQ ID NO: 1783483 - RNA, 14 nt, Salmonella enterica enterica serovar Typhi Ty2
caaggucggcuccu

SEQ ID NO: 1783484 - RNA, 19 nt, Salmonella enterica enterica serovar Typhi Ty2
caagguggaaaaaagauaa

SEQ ID NO: 1783485 - RNA, 13 nt, Salmonella enterica enterica serovar Typhi Ty2
caagcggcggcca

SEQ ID NO: 1783486 - RNA, 13 nt, Salmonella enterica enterica serovar Typhi Ty2
caagcgucagcau

SEQ ID NO: 1783487 - RNA, 19 nt, Salmonella enterica enterica serovar Typhi Ty2
caaggaaugacacauuucu

SEQ ID NO: 1783488 - RNA, 18 nt, Salmonella enterica enterica serovar Typhi Ty2
caagccagguugcgcccg

SEQ ID NO: 1783489 - RNA, 17 nt, Salmonella enterica enterica serovar Typhi Ty2
caagccgccaacgccag

SEQ ID NO: 1783490 - RNA, 14 nt, Salmonella enterica enterica serovar Typhi Ty2
caagccgaucagcg

SEQ ID NO: 1783491 - RNA, 20 nt, Salmonella enterica enterica serovar Typhi Ty2
caagccgguaaucgcgcgca

SEQ ID NO: 1783492 - RNA, 17 nt, Salmonella enterica enterica serovar Typhi Ty2
caagcacugaaugcuga

SEQ ID NO: 1783493 - RNA, 15 nt, Salmonella enterica enterica serovar Typhi Ty2
caagcacugaaugcu

SEQ ID NO: 1783494 - RNA, 13 nt, Salmonella enterica enterica serovar Typhi Ty2
caagcaguucuga

SEQ ID NO: 1783495 - RNA, 20 nt, Salmonella enterica enterica serovar Typhi Ty2
caagcaguaucguguuauuu

SEQ ID NO: 1783496 - RNA, 15 nt, Salmonella enterica enterica serovar Typhi Ty2
caagcaguuccagca

SEQ ID NO: 1783497 - RNA, 14 nt, Salmonella enterica enterica serovar Typhi Ty2
caagcaguaugacc

SEQ ID NO: 1783498 - RNA, 18 nt, Salmonella enterica enterica serovar Typhi Ty2
caacuucaugaguaaaug

SEQ ID NO: 1783499 - RNA, 21 nt, Salmonella enterica enterica serovar Typhi Ty2
caacuuccaccaccuccugcu

SEQ ID NO: 1783500 - RNA, 16 nt, Salmonella enterica enterica serovar Typhi Ty2
caacuucaugaguaaa

SEQ ID NO: 1783501 - RNA, 22 nt, Salmonella enterica enterica serovar Typhi Ty2
caauacuggaccccagauaaua

SEQ ID NO: 1783502 - RNA, 20 nt, Salmonella enterica enterica serovar Typhi Ty2
caauacuccacaguucaaug

SEQ ID NO: 1783503 - RNA, 14 nt, Salmonella enterica enterica serovar Typhi Ty2
caauagcgcuaaac

SEQ ID NO: 1783504 - RNA, 16 nt, Salmonella enterica enterica serovar Typhi Ty2
caauagcgagaggcaa

SEQ ID NO: 1783505 - RNA, 22 nt, Salmonella enterica enterica serovar Typhi Ty2
caauaauuuuaccauucagcuu

SEQ ID NO: 1783506 - RNA, 19 nt, Salmonella enterica enterica serovar Typhi Ty2
caauacgaucggcuggaau

SEQ ID NO: 1783507 - RNA, 19 nt, Salmonella enterica enterica serovar Typhi Ty2
caauagcuucaaugaucca

SEQ ID NO: 1783508 - RNA, 23 nt, Salmonella enterica enterica serovar Typhi Ty2
caauagcgcgucguugccuuugc

SEQ ID NO: 1783509 - RNA, 14 nt, Salmonella enterica enterica serovar Typhi Ty2
caauaguauccaua

SEQ ID NO: 1783510 - RNA, 19 nt, Salmonella enterica enterica serovar Typhi Ty2
caauaguauccauaauuuu

SEQ ID NO: 1783511 - RNA, 22 nt, Salmonella enterica enterica serovar Typhi Ty2
caauaguauccauaauuuuccc

SEQ ID NO: 1783512 - RNA, 19 nt, Salmonella enterica enterica serovar Typhi Ty2
caauagguugaaagaggaa

SEQ ID NO: 1783513 - RNA, 16 nt, Salmonella enterica enterica serovar Typhi Ty2
caauaguggacacaca

SEQ ID NO: 1783514 - RNA, 19 nt, Salmonella enterica enterica serovar Typhi Ty2
caauauccucgcauccucc

SEQ ID NO: 1783515 - RNA, 21 nt, Salmonella enterica enterica serovar Typhi Ty2
caauaucgauagcauuuuuac

SEQ ID NO: 1783516 - RNA, 19 nt, Salmonella enterica enterica serovar Typhi Ty2
caauaucgcggcaaagaaa

SEQ ID NO: 1783517 - RNA, 20 nt, Salmonella enterica enterica serovar Typhi Ty2
caauauccgccccgcuggcu

SEQ ID NO: 1783518 - RNA, 12 nt, Salmonella enterica enterica serovar Typhi Ty2
caauauccuccg

SEQ ID NO: 1783519 - RNA, 18 nt, Salmonella enterica enterica serovar Typhi Ty2
caauauccucgcauccuc

SEQ ID NO: 1783520 - RNA, 18 nt, Salmonella enterica enterica serovar Typhi Ty2
caauaacaccacaacaca

SEQ ID NO: 1783521 - RNA, 15 nt, Salmonella enterica enterica serovar Typhi Ty2
caauaacagccagcg

SEQ ID NO: 1783522 - RNA, 23 nt, Salmonella enterica enterica serovar Typhi Ty2
caauaaguaaaaacgaaaaaccc

SEQ ID NO: 1783523 - RNA, 19 nt, Salmonella enterica enterica serovar Typhi Ty2
caauaagggcauguuucau

SEQ ID NO: 1783524 - RNA, 17 nt, Salmonella enterica enterica serovar Typhi Ty2
caauaagcgguaauaau

SEQ ID NO: 1783525 - RNA, 12 nt, Salmonella enterica enterica serovar Typhi Ty2
caauaaacuggc

SEQ ID NO: 1783526 - RNA, 16 nt, Salmonella enterica enterica serovar Typhi Ty2
caauaaacgccagguu

SEQ ID NO: 1783527 - RNA, 16 nt, Salmonella enterica enterica serovar Typhi Ty2
caauaaacauuuuuuu

SEQ ID NO: 1783528 - RNA, 16 nt, Salmonella enterica enterica serovar Typhi Ty2
caaguuuagaaaaaau

SEQ ID NO: 1783529 - RNA, 14 nt, Salmonella enterica enterica serovar Typhi Ty2
caaguuuagaaaaa

SEQ ID NO: 1783530 - RNA, 14 nt, Salmonella enterica enterica serovar Typhi Ty2
caaguuuagaaaau

SEQ ID NO: 1783531 - RNA, 21 nt, Salmonella enterica enterica serovar Typhi Ty2
caagguucgacucgagcaaua

SEQ ID NO: 1783532 - RNA, 22 nt, Salmonella enterica enterica serovar Typhi Ty2
caagguuauuaaaaagccagcg

SEQ ID NO: 1783533 - RNA, 14 nt, Salmonella enterica enterica serovar Typhi Ty2
caaguaguuguuau

SEQ ID NO: 1783534 - RNA, 23 nt, Salmonella enterica enterica serovar Typhi Ty2
caaguaguuguuauagcgcgccc

SEQ ID NO: 1783535 - RNA, 22 nt, Salmonella enterica enterica serovar Typhi Ty2
caauguaacaccuguaacguca

SEQ ID NO: 1783536 - RNA, 23 nt, Salmonella enterica enterica serovar Typhi Ty2
caauguaaaacgguaugaaacau

SEQ ID NO: 1783537 - RNA, 14 nt, Salmonella enterica enterica serovar Typhi Ty2
caaugucauauuug

SEQ ID NO: 1783538 - RNA, 17 nt, Salmonella enterica enterica serovar Typhi Ty2
caaugguugccuggugu

SEQ ID NO: 1783539 - RNA, 19 nt, Salmonella enterica enterica serovar Typhi Ty2
caaugguguuuuccagcgu

SEQ ID NO: 1783540 - RNA, 17 nt, Salmonella enterica enterica serovar Typhi Ty2
caauggcgcgucuuaaa

SEQ ID NO: 1783541 - RNA, 22 nt, Salmonella enterica enterica serovar Typhi Ty2
caauggcgcucggaugugcauu

SEQ ID NO: 1783542 - RNA, 19 nt, Salmonella enterica enterica serovar Typhi Ty2
caauggcgacgaucagcgc

SEQ ID NO: 1783543 - RNA, 20 nt, Salmonella enterica enterica serovar Typhi Ty2
caauggcgacgaucagcgcc

SEQ ID NO: 1783544 - RNA, 18 nt, Salmonella enterica enterica serovar Typhi Ty2
caauggccagaugaaacu

SEQ ID NO: 1783545 - RNA, 22 nt, Salmonella enterica enterica serovar Typhi Ty2
caaugccauauuuaccuuuucc

SEQ ID NO: 1783546 - RNA, 15 nt, Salmonella enterica enterica serovar Typhi Ty2
caaugcccacgccgu

SEQ ID NO: 1783547 - RNA, 23 nt, Salmonella enterica enterica serovar Typhi Ty2
caaugcccuuaaauccggccucc

SEQ ID NO: 1783548 - RNA, 22 nt, Salmonella enterica enterica serovar Typhi Ty2
caaugcccgguuuuuuaaugag

SEQ ID NO: 1783549 - RNA, 20 nt, Salmonella enterica enterica serovar Typhi Ty2
caaugccgcgggaaauacca

SEQ ID NO: 1783550 - RNA, 19 nt, Salmonella enterica enterica serovar Typhi Ty2
caaugccuaacccuuuucc

SEQ ID NO: 1783551 - RNA, 18 nt, Salmonella enterica enterica serovar Typhi Ty2
caaugccuaacccuuuuc

SEQ ID NO: 1783552 - RNA, 15 nt, Salmonella enterica enterica serovar Typhi Ty2
caaugcgaauaacau

SEQ ID NO: 1783553 - RNA, 18 nt, Salmonella enterica enterica serovar Typhi Ty2
caaugcgcguaauuugcg

SEQ ID NO: 1783554 - RNA, 14 nt, Salmonella enterica enterica serovar Typhi Ty2
caaugcggaaacca

SEQ ID NO: 1783555 - RNA, 21 nt, Salmonella enterica enterica serovar Typhi Ty2
caaugcgcuuuuuuugcccuu

SEQ ID NO: 1783556 - RNA, 14 nt, Salmonella enterica enterica serovar Typhi Ty2
caaugcuggcaggc

SEQ ID NO: 1783557 - RNA, 15 nt, Salmonella enterica enterica serovar Typhi Ty2
caaugcuuucaccag

SEQ ID NO: 1783558 - RNA, 13 nt, Salmonella enterica enterica serovar Typhi Ty2
caaugaacaguuu

SEQ ID NO: 1783559 - RNA, 19 nt, Salmonella enterica enterica serovar Typhi Ty2
caaugaacagcacguuacc

SEQ ID NO: 1783560 - RNA, 17 nt, Salmonella enterica enterica serovar Typhi Ty2
caaugaccauuaacgcc

SEQ ID NO: 1783561 - RNA, 18 nt, Salmonella enterica enterica serovar Typhi Ty2
caaucuguucguugcugu

SEQ ID NO: 1783562 - RNA, 14 nt, Salmonella enterica enterica serovar Typhi Ty2
caaugccaccacac

SEQ ID NO: 1783563 - RNA, 15 nt, Salmonella enterica enterica serovar Typhi Ty2
caaugccaccagcgc

SEQ ID NO: 1783564 - RNA, 18 nt, Salmonella enterica enterica serovar Typhi Ty2
caaugccaaaaaaacuaa

SEQ ID NO: 1783565 - RNA, 14 nt, Salmonella enterica enterica serovar Typhi Ty2
caaugcaacgccuu

SEQ ID NO: 1783566 - RNA, 16 nt, Salmonella enterica enterica serovar Typhi Ty2
caaugaucagacgcac

SEQ ID NO: 1783567 - RNA, 13 nt, Salmonella enterica enterica serovar Typhi Ty2
caaugaucagacg

SEQ ID NO: 1783568 - RNA, 17 nt, Salmonella enterica enterica serovar Typhi Ty2
caaugaugccuugcgaa

SEQ ID NO: 1783569 - RNA, 18 nt, Salmonella enterica enterica serovar Typhi Ty2
caauccgcgccgcaucuu

SEQ ID NO: 1783570 - RNA, 17 nt, Salmonella enterica enterica serovar Typhi Ty2
caauccauuuuaaauac

SEQ ID NO: 1783571 - RNA, 18 nt, Salmonella enterica enterica serovar Typhi Ty2
caauccauuuuaaauaca

SEQ ID NO: 1783572 - RNA, 18 nt, Salmonella enterica enterica serovar Typhi Ty2
caauccaacgaaacucag

SEQ ID NO: 1783573 - RNA, 21 nt, Salmonella enterica enterica serovar Typhi Ty2
caauccaacgaaacucagcgg

SEQ ID NO: 1783574 - RNA, 20 nt, Salmonella enterica enterica serovar Typhi Ty2
caaucauugugguuucccug

SEQ ID NO: 1783575 - RNA, 19 nt, Salmonella enterica enterica serovar Typhi Ty2
caauauugcugugcuauga

SEQ ID NO: 1783576 - RNA, 12 nt, Salmonella enterica enterica serovar Typhi Ty2
caauauuccugg

SEQ ID NO: 1783577 - RNA, 12 nt, Salmonella enterica enterica serovar Typhi Ty2
caauauuuuucc

SEQ ID NO: 1783578 - RNA, 21 nt, Salmonella enterica enterica serovar Typhi Ty2
caaucauaaacgccugacgau

SEQ ID NO: 1783579 - RNA, 13 nt, Salmonella enterica enterica serovar Typhi Ty2
caaucauaauaaa

SEQ ID NO: 1783580 - RNA, 21 nt, Salmonella enterica enterica serovar Typhi Ty2
caaucgucacuucaauuugcc

SEQ ID NO: 1783581 - RNA, 23 nt, Salmonella enterica enterica serovar Typhi Ty2
caaucggcgauaaaccaacagcc

SEQ ID NO: 1783582 - RNA, 20 nt, Salmonella enterica enterica serovar Typhi Ty2
caaucgcuuccagcgccggu

SEQ ID NO: 1783583 - RNA, 22 nt, Salmonella enterica enterica serovar Typhi Ty2
caauccugucgucaccagcagg

SEQ ID NO: 1783584 - RNA, 14 nt, Salmonella enterica enterica serovar Typhi Ty2
caaucgccagcccc

SEQ ID NO: 1783585 - RNA, 16 nt, Salmonella enterica enterica serovar Typhi Ty2
caaucgagaucagacu

SEQ ID NO: 1783586 - RNA, 14 nt, Salmonella enterica enterica serovar Typhi Ty2
caaucgagaagcca

SEQ ID NO: 1783587 - RNA, 13 nt, Salmonella enterica enterica serovar Typhi Ty2
caaucguucuugc

SEQ ID NO: 1783588 - RNA, 18 nt, Salmonella enterica enterica serovar Typhi Ty2
caaucuccagaccgcugc

SEQ ID NO: 1783589 - RNA, 14 nt, Salmonella enterica enterica serovar Typhi Ty2
caaucuggugacga

SEQ ID NO: 1783590 - RNA, 20 nt, Salmonella enterica enterica serovar Typhi Ty2
caaucucuggccaggcauug

SEQ ID NO: 1783591 - RNA, 14 nt, Salmonella enterica enterica serovar Typhi Ty2
caaucuccuccggc

SEQ ID NO: 1783592 - RNA, 22 nt, Salmonella enterica enterica serovar Typhi Ty2
caaucucgcaagauuccagaua

SEQ ID NO: 1783593 - RNA, 18 nt, Salmonella enterica enterica serovar Typhi Ty2
auuuuugcccagccuucu

SEQ ID NO: 1783594 - RNA, 14 nt, Salmonella enterica enterica serovar Typhi Ty2
auuuuugccauuau

SEQ ID NO: 1783595 - RNA, 17 nt, Salmonella enterica enterica serovar Typhi Ty2
auuuuugaucugcuuga

SEQ ID NO: 1783596 - RNA, 12 nt, Salmonella enterica enterica serovar Typhi Ty2
auuuuucagggu

SEQ ID NO: 1783597 - RNA, 13 nt, Salmonella enterica enterica serovar Typhi Ty2
auuuuuccagcau

SEQ ID NO: 1783598 - RNA, 16 nt, Salmonella enterica enterica serovar Typhi Ty2
auuuuucccaucaauc

SEQ ID NO: 1783599 - RNA, 17 nt, Salmonella enterica enterica serovar Typhi Ty2
auuuuuccagcucagaa

SEQ ID NO: 1783600 - RNA, 15 nt, Salmonella enterica enterica serovar Typhi Ty2
auuuuucccuggccg

SEQ ID NO: 1783601 - RNA, 20 nt, Salmonella enterica enterica serovar Typhi Ty2
auuuuuccggcgucaaaaau

SEQ ID NO: 1783602 - RNA, 18 nt, Salmonella enterica enterica serovar Typhi Ty2
auuuuucgccagguacau

SEQ ID NO: 1783603 - RNA, 16 nt, Salmonella enterica enterica serovar Typhi Ty2
auuuuucgaucuucuc

SEQ ID NO: 1783604 - RNA, 15 nt, Salmonella enterica enterica serovar Typhi Ty2
auuuuucgaucuucu

SEQ ID NO: 1783605 - RNA, 16 nt, Salmonella enterica enterica serovar Typhi Ty2
auuuuucgguuuucca

SEQ ID NO: 1783606 - RNA, 14 nt, Salmonella enterica enterica serovar Typhi Ty2
auuuuucugguaaa

SEQ ID NO: 1783607 - RNA, 21 nt, Salmonella enterica enterica serovar Typhi Ty2
auuuuuugacaacaaaaagau

SEQ ID NO: 1783608 - RNA, 13 nt, Salmonella enterica enterica serovar Typhi Ty2
caaaaaaaaccag

SEQ ID NO: 1783609 - RNA, 22 nt, Salmonella enterica enterica serovar Typhi Ty2
caaaaaaacuaauccucuucuc

SEQ ID NO: 1783610 - RNA, 18 nt, Salmonella enterica enterica serovar Typhi Ty2
caaaaaaggaaaaugacg

SEQ ID NO: 1783611 - RNA, 20 nt, Salmonella enterica enterica serovar Typhi Ty2
caaaaaguaguuccagcaua

SEQ ID NO: 1783612 - RNA, 18 nt, Salmonella enterica enterica serovar Typhi Ty2
caaaaauagcauuaagcu

SEQ ID NO: 1783613 - RNA, 20 nt, Salmonella enterica enterica serovar Typhi Ty2
caaaaauauggucgaaaaua

SEQ ID NO: 1783614 - RNA, 21 nt, Salmonella enterica enterica serovar Typhi Ty2
caaaaauauggucgaaaauau

SEQ ID NO: 1783615 - RNA, 20 nt, Salmonella enterica enterica serovar Typhi Ty2
caaaaaucgucaucagauag

SEQ ID NO: 1783616 - RNA, 18 nt, Salmonella enterica enterica serovar Typhi Ty2
caaaaagccuugcugaau

SEQ ID NO: 1783617 - RNA, 21 nt, Salmonella enterica enterica serovar Typhi Ty2
caaaaagcgcgccgaaaauau

SEQ ID NO: 1783618 - RNA, 15 nt, Salmonella enterica enterica serovar Typhi Ty2
caaaaagauauuaua

SEQ ID NO: 1783619 - RNA, 16 nt, Salmonella enterica enterica serovar Typhi Ty2
caaaaaaugugagcca

SEQ ID NO: 1783620 - RNA, 16 nt, Salmonella enterica enterica serovar Typhi Ty2
caaaaaaucagcaauc

SEQ ID NO: 1783621 - RNA, 10 nt, Salmonella enterica enterica serovar Typhi Ty2
caaaaacaag

SEQ ID NO: 1783622 - RNA, 15 nt, Salmonella enterica enterica serovar Typhi Ty2
caaaagccagauaaa

SEQ ID NO: 1783623 - RNA, 14 nt, Salmonella enterica enterica serovar Typhi Ty2
caaaagauugauuu

SEQ ID NO: 1783624 - RNA, 22 nt, Salmonella enterica enterica serovar Typhi Ty2
caaaagaggaaguugcucccgc

SEQ ID NO: 1783625 - RNA, 17 nt, Salmonella enterica enterica serovar Typhi Ty2
caaaagaggcuaauuau

SEQ ID NO: 1783626 - RNA, 23 nt, Salmonella enterica enterica serovar Typhi Ty2
caaaacucucaccgaccugccuu

SEQ ID NO: 1783627 - RNA, 21 nt, Salmonella enterica enterica serovar Typhi Ty2
caaaacugaguuguaggcuca

SEQ ID NO: 1783628 - RNA, 12 nt, Salmonella enterica enterica serovar Typhi Ty2
caaaacuauuuu

SEQ ID NO: 1783629 - RNA, 15 nt, Salmonella enterica enterica serovar Typhi Ty2
caaaacggucgguaa

SEQ ID NO: 1783630 - RNA, 21 nt, Salmonella enterica enterica serovar Typhi Ty2
caaaacgucgugaguggcggc

SEQ ID NO: 1783631 - RNA, 15 nt, Salmonella enterica enterica serovar Typhi Ty2
caaaaccacagugac

SEQ ID NO: 1783632 - RNA, 10 nt, Salmonella enterica enterica serovar Typhi Ty2
auuugauuua

SEQ ID NO: 1783633 - RNA, 16 nt, Salmonella enterica enterica serovar Typhi Ty2
auuugguaaauaacuu

SEQ ID NO: 1783634 - RNA, 16 nt, Salmonella enterica enterica serovar Typhi Ty2
auuuggcuuaaauaau

SEQ ID NO: 1783635 - RNA, 15 nt, Salmonella enterica enterica serovar Typhi Ty2
auuugcucaguucag

SEQ ID NO: 1783636 - RNA, 11 nt, Salmonella enterica enterica serovar Typhi Ty2
auuugcucagu

SEQ ID NO: 1783637 - RNA, 14 nt, Salmonella enterica enterica serovar Typhi Ty2
auuuguuaguccgc

SEQ ID NO: 1783638 - RNA, 22 nt, Salmonella enterica enterica serovar Typhi Ty2
auuugugagcuauacgguaaau

SEQ ID NO: 1783639 - RNA, 13 nt, Salmonella enterica enterica serovar Typhi Ty2
auuuggucggcgu

SEQ ID NO: 1783640 - RNA, 15 nt, Salmonella enterica enterica serovar Typhi Ty2
auuucucgccgccgg

SEQ ID NO: 1783641 - RNA, 13 nt, Salmonella enterica enterica serovar Typhi Ty2
auuucucgcccgc

SEQ ID NO: 1783642 - RNA, 21 nt, Salmonella enterica enterica serovar Typhi Ty2
auuucucgcucgcccaucacu

SEQ ID NO: 1783643 - RNA, 20 nt, Salmonella enterica enterica serovar Typhi Ty2
auuucuugagcggcaucacu

SEQ ID NO: 1783644 - RNA, 18 nt, Salmonella enterica enterica serovar Typhi Ty2
auuucaugcgcagcauga

SEQ ID NO: 1783645 - RNA, 16 nt, Salmonella enterica enterica serovar Typhi Ty2
auuucaucgccgccgc

SEQ ID NO: 1783646 - RNA, 15 nt, Salmonella enterica enterica serovar Typhi Ty2
auuucaucuaucugc

SEQ ID NO: 1783647 - RNA, 16 nt, Salmonella enterica enterica serovar Typhi Ty2
auuucuccugcgccag

SEQ ID NO: 1783648 - RNA, 13 nt, Salmonella enterica enterica serovar Typhi Ty2
auuucuccugcau

SEQ ID NO: 1783649 - RNA, 18 nt, Salmonella enterica enterica serovar Typhi Ty2
auuuucuuauuacaagaa

SEQ ID NO: 1783650 - RNA, 16 nt, Salmonella enterica enterica serovar Typhi Ty2
auuuucuguaauucuc

SEQ ID NO: 1783651 - RNA, 18 nt, Salmonella enterica enterica serovar Typhi Ty2
auuuucggcacaucaaua

SEQ ID NO: 1783652 - RNA, 14 nt, Salmonella enterica enterica serovar Typhi Ty2
auuuucaucauauc

SEQ ID NO: 1783653 - RNA, 23 nt, Salmonella enterica enterica serovar Typhi Ty2
auuuuccguuaauggaggcagug

SEQ ID NO: 1783654 - RNA, 16 nt, Salmonella enterica enterica serovar Typhi Ty2
auuuuccugaaaaaau

SEQ ID NO: 1783655 - RNA, 16 nt, Salmonella enterica enterica serovar Typhi Ty2
auuuugauaaaaacac

SEQ ID NO: 1783656 - RNA, 15 nt, Salmonella enterica enterica serovar Typhi Ty2
auuuugauaaaucag

SEQ ID NO: 1783657 - RNA, 22 nt, Salmonella enterica enterica serovar Typhi Ty2
auuuuguugcuccagcaucaca

SEQ ID NO: 1783658 - RNA, 22 nt, Salmonella enterica enterica serovar Typhi Ty2
auuuuacugcguaaucuuuuca

SEQ ID NO: 1783659 - RNA, 21 nt, Salmonella enterica enterica serovar Typhi Ty2
auuuuaaauuuccucuuguca

SEQ ID NO: 1783660 - RNA, 13 nt, Salmonella enterica enterica serovar Typhi Ty2
auuuuaacaucac

SEQ ID NO: 1783661 - RNA, 14 nt, Salmonella enterica enterica serovar Typhi Ty2
auuuuauuuaaaaa

SEQ ID NO: 1783662 - RNA, 22 nt, Salmonella enterica enterica serovar Typhi Ty2
auuuucagaggucaggauuuuc

SEQ ID NO: 1783663 - RNA, 14 nt, Salmonella enterica enterica serovar Typhi Ty2
auuuucaccuggau

SEQ ID NO: 1783664 - RNA, 20 nt, Salmonella enterica enterica serovar Typhi Ty2
auuuucagcuucagucauaa

SEQ ID NO: 1783665 - RNA, 21 nt, Salmonella enterica enterica serovar Typhi Ty2
auuuucaucaagccauugcgc

SEQ ID NO: 1783666 - RNA, 18 nt, Salmonella enterica enterica serovar Typhi Ty2
auuuucauacuauuuccu

SEQ ID NO: 1783667 - RNA, 19 nt, Salmonella enterica enterica serovar Typhi Ty2
auuuaacccugguuugcug

SEQ ID NO: 1783668 - RNA, 17 nt, Salmonella enterica enterica serovar Typhi Ty2
auuuaaauaucgguuca

SEQ ID NO: 1783669 - RNA, 19 nt, Salmonella enterica enterica serovar Typhi Ty2
auuguuuuacuuuuuuaaa

SEQ ID NO: 1783670 - RNA, 15 nt, Salmonella enterica enterica serovar Typhi Ty2
auuuaaauacuuuuu

SEQ ID NO: 1783671 - RNA, 15 nt, Salmonella enterica enterica serovar Typhi Ty2
auuguuuggugcuga

SEQ ID NO: 1783672 - RNA, 13 nt, Salmonella enterica enterica serovar Typhi Ty2
auuguuccagguu

SEQ ID NO: 1783673 - RNA, 14 nt, Salmonella enterica enterica serovar Typhi Ty2
auuguuccagguuu

SEQ ID NO: 1783674 - RNA, 13 nt, Salmonella enterica enterica serovar Typhi Ty2
auuguuaaaaaga

SEQ ID NO: 1783675 - RNA, 18 nt, Salmonella enterica enterica serovar Typhi Ty2
auuguuacugguuuuuuc

SEQ ID NO: 1783676 - RNA, 13 nt, Salmonella enterica enterica serovar Typhi Ty2
auuguugccccgc

SEQ ID NO: 1783677 - RNA, 20 nt, Salmonella enterica enterica serovar Typhi Ty2
auuguuuaacguuucaugga

SEQ ID NO: 1783678 - RNA, 14 nt, Salmonella enterica enterica serovar Typhi Ty2
auugucaaaaauag

SEQ ID NO: 1783679 - RNA, 12 nt, Salmonella enterica enterica serovar Typhi Ty2
auuguaaaaccg

SEQ ID NO: 1783680 - RNA, 23 nt, Salmonella enterica enterica serovar Typhi Ty2
auuguccuuuaucugcccuuucu

SEQ ID NO: 1783681 - RNA, 21 nt, Salmonella enterica enterica serovar Typhi Ty2
auugucaccuguaaccccagc

SEQ ID NO: 1783682 - RNA, 16 nt, Salmonella enterica enterica serovar Typhi Ty2
auugucagaaucacau

SEQ ID NO: 1783683 - RNA, 20 nt, Salmonella enterica enterica serovar Typhi Ty2
auugucaugcuaaaacagau

SEQ ID NO: 1783684 - RNA, 17 nt, Salmonella enterica enterica serovar Typhi Ty2
auugucuuaaauaugaa

SEQ ID NO: 1783685 - RNA, 18 nt, Salmonella enterica enterica serovar Typhi Ty2
auugugcacagguaaacg

SEQ ID NO: 1783686 - RNA, 15 nt, Salmonella enterica enterica serovar Typhi Ty2
auugugauuccaguu

SEQ ID NO: 1783687 - RNA, 13 nt, Salmonella enterica enterica serovar Typhi Ty2
auugugaaauucg

SEQ ID NO: 1783688 - RNA, 15 nt, Salmonella enterica enterica serovar Typhi Ty2
auugucuuauuauua

SEQ ID NO: 1783689 - RNA, 21 nt, Salmonella enterica enterica serovar Typhi Ty2
auuguggaucagacgccgcgc

SEQ ID NO: 1783690 - RNA, 13 nt, Salmonella enterica enterica serovar Typhi Ty2
auuuaauauauga

SEQ ID NO: 1783691 - RNA, 21 nt, Salmonella enterica enterica serovar Typhi Ty2
auuuaaugaaccgggagauaa

SEQ ID NO: 1783692 - RNA, 18 nt, Salmonella enterica enterica serovar Typhi Ty2
auuuaucgaucuccaucu

SEQ ID NO: 1783693 - RNA, 14 nt, Salmonella enterica enterica serovar Typhi Ty2
auuuauccacgccg

SEQ ID NO: 1783694 - RNA, 23 nt, Salmonella enterica enterica serovar Typhi Ty2
auuuauuuucugaacgcugcugu

SEQ ID NO: 1783695 - RNA, 22 nt, Salmonella enterica enterica serovar Typhi Ty2
auuuauuuuuaguaacuuacaa

SEQ ID NO: 1783696 - RNA, 22 nt, Salmonella enterica enterica serovar Typhi Ty2
auuucaaacguuucaagaugcc

SEQ ID NO: 1783697 - RNA, 17 nt, Salmonella enterica enterica serovar Typhi Ty2
auuucaauaaucccuuc

SEQ ID NO: 1783698 - RNA, 17 nt, Salmonella enterica enterica serovar Typhi Ty2
auuucaaucaucauauc

SEQ ID NO: 1783699 - RNA, 16 nt, Salmonella enterica enterica serovar Typhi Ty2
auuucagcauccuccg

SEQ ID NO: 1783700 - RNA, 20 nt, Salmonella enterica enterica serovar Typhi Ty2
auuucagcgcagaauuuauu

SEQ ID NO: 1783701 - RNA, 16 nt, Salmonella enterica enterica serovar Typhi Ty2
auuucaggaauacauu

SEQ ID NO: 1783702 - RNA, 13 nt, Salmonella enterica enterica serovar Typhi Ty2
auugcucacccau

SEQ ID NO: 1783703 - RNA, 20 nt, Salmonella enterica enterica serovar Typhi Ty2
auugcugugaaguaauucuu

SEQ ID NO: 1783704 - RNA, 15 nt, Salmonella enterica enterica serovar Typhi Ty2
auugcuguuaauuuc

SEQ ID NO: 1783705 - RNA, 21 nt, Salmonella enterica enterica serovar Typhi Ty2
auugcgaucuccuuuaaugaa

SEQ ID NO: 1783706 - RNA, 16 nt, Salmonella enterica enterica serovar Typhi Ty2
auugcgauaugcuguu

SEQ ID NO: 1783707 - RNA, 15 nt, Salmonella enterica enterica serovar Typhi Ty2
auugcgagaaaaaac

SEQ ID NO: 1783708 - RNA, 13 nt, Salmonella enterica enterica serovar Typhi Ty2
auugcgagaaaaa

SEQ ID NO: 1783709 - RNA, 17 nt, Salmonella enterica enterica serovar Typhi Ty2
auugcgaauaaaacugc

SEQ ID NO: 1783710 - RNA, 18 nt, Salmonella enterica enterica serovar Typhi Ty2
auugcgaauaaaacugcc

SEQ ID NO: 1783711 - RNA, 22 nt, Salmonella enterica enterica serovar Typhi Ty2
auugcgacaacuagaauuuuca

SEQ ID NO: 1783712 - RNA, 16 nt, Salmonella enterica enterica serovar Typhi Ty2
auugcgaauaaaacug

SEQ ID NO: 1783713 - RNA, 15 nt, Salmonella enterica enterica serovar Typhi Ty2
auugggcguaagaaa

SEQ ID NO: 1783714 - RNA, 20 nt, Salmonella enterica enterica serovar Typhi Ty2
auuggcaaaccccugcucgc

SEQ ID NO: 1783715 - RNA, 13 nt, Salmonella enterica enterica serovar Typhi Ty2
auugauuuuucug

SEQ ID NO: 1783716 - RNA, 18 nt, Salmonella enterica enterica serovar Typhi Ty2
auugaggcuacccagaca

SEQ ID NO: 1783717 - RNA, 19 nt, Salmonella enterica enterica serovar Typhi Ty2
auugccauguuaauaccag

SEQ ID NO: 1783718 - RNA, 13 nt, Salmonella enterica enterica serovar Typhi Ty2
auugcccaccggc

SEQ ID NO: 1783719 - RNA, 17 nt, Salmonella enterica enterica serovar Typhi Ty2
auugcccaucgcgccau

SEQ ID NO: 1783720 - RNA, 15 nt, Salmonella enterica enterica serovar Typhi Ty2
auugcccuuuuguuu

SEQ ID NO: 1783721 - RNA, 16 nt, Salmonella enterica enterica serovar Typhi Ty2
auugccuaaauaacuc

SEQ ID NO: 1783722 - RNA, 21 nt, Salmonella enterica enterica serovar Typhi Ty2
auugccguuguugucaauauc

SEQ ID NO: 1783723 - RNA, 19 nt, Salmonella enterica enterica serovar Typhi Ty2
auugccgaccgccagcaga

SEQ ID NO: 1783724 - RNA, 18 nt, Salmonella enterica enterica serovar Typhi Ty2
auugccgccagcuccugc

SEQ ID NO: 1783725 - RNA, 23 nt, Salmonella enterica enterica serovar Typhi Ty2
auugaagcgauauucgguaagcu

SEQ ID NO: 1783726 - RNA, 15 nt, Salmonella enterica enterica serovar Typhi Ty2
auugagacaaauaac

SEQ ID NO: 1783727 - RNA, 22 nt, Salmonella enterica enterica serovar Typhi Ty2
auugagacaugccgccagacca

SEQ ID NO: 1783728 - RNA, 21 nt, Salmonella enterica enterica serovar Typhi Ty2
auugagacaugccgccagacc

SEQ ID NO: 1783729 - RNA, 14 nt, Salmonella enterica enterica serovar Typhi Ty2
auugagacaugccg

SEQ ID NO: 1783730 - RNA, 16 nt, Salmonella enterica enterica serovar Typhi Ty2
auugaccgcuuuuucc

SEQ ID NO: 1783731 - RNA, 17 nt, Salmonella enterica enterica serovar Typhi Ty2
auugaccgcuuuuucca

SEQ ID NO: 1783732 - RNA, 22 nt, Salmonella enterica enterica serovar Typhi Ty2
auugaauaugguggucggcaau

SEQ ID NO: 1783733 - RNA, 18 nt, Salmonella enterica enterica serovar Typhi Ty2
auucuuaacccacaagaa

SEQ ID NO: 1783734 - RNA, 19 nt, Salmonella enterica enterica serovar Typhi Ty2
auucuuaacccacaagaaa

SEQ ID NO: 1783735 - RNA, 20 nt, Salmonella enterica enterica serovar Typhi Ty2
auucuuaacccacaagaaau

SEQ ID NO: 1783736 - RNA, 17 nt, Salmonella enterica enterica serovar Typhi Ty2
auucuguuugucuuuau

SEQ ID NO: 1783737 - RNA, 15 nt, Salmonella enterica enterica serovar Typhi Ty2
auucugucagaaauc

SEQ ID NO: 1783738 - RNA, 22 nt, Salmonella enterica enterica serovar Typhi Ty2
auucuguaucgcuuauuuucgu

SEQ ID NO: 1783739 - RNA, 16 nt, Salmonella enterica enterica serovar Typhi Ty2
auucuguaacucauag

SEQ ID NO: 1783740 - RNA, 21 nt, Salmonella enterica enterica serovar Typhi Ty2
auucuggaaucaauuucccuu

SEQ ID NO: 1783741 - RNA, 15 nt, Salmonella enterica enterica serovar Typhi Ty2
auucugcuuccagaa

SEQ ID NO: 1783742 - RNA, 13 nt, Salmonella enterica enterica serovar Typhi Ty2
auucugcugaugc

SEQ ID NO: 1783743 - RNA, 16 nt, Salmonella enterica enterica serovar Typhi Ty2
auucugcugaugcugg

SEQ ID NO: 1783744 - RNA, 20 nt, Salmonella enterica enterica serovar Typhi Ty2
auucagguuuugcugaucaa

SEQ ID NO: 1783745 - RNA, 17 nt, Salmonella enterica enterica serovar Typhi Ty2
auucagguuaauaacug

SEQ ID NO: 1783746 - RNA, 21 nt, Salmonella enterica enterica serovar Typhi Ty2
auucagguuauuugccucugg

SEQ ID NO: 1783747 - RNA, 16 nt, Salmonella enterica enterica serovar Typhi Ty2
auucaguaagagggug

SEQ ID NO: 1783748 - RNA, 12 nt, Salmonella enterica enterica serovar Typhi Ty2
auucagguaaua

SEQ ID NO: 1783749 - RNA, 21 nt, Salmonella enterica enterica serovar Typhi Ty2
auucagggcuuuauuuuacaa

SEQ ID NO: 1783750 - RNA, 17 nt, Salmonella enterica enterica serovar Typhi Ty2
auucaggccgccagcaa

SEQ ID NO: 1783751 - RNA, 19 nt, Salmonella enterica enterica serovar Typhi Ty2
augccgguuuuagcaauga

SEQ ID NO: 1783752 - RNA, 17 nt, Salmonella enterica enterica serovar Typhi Ty2
augccguagccaaguau

SEQ ID NO: 1783753 - RNA, 18 nt, Salmonella enterica enterica serovar Typhi Ty2
augccgccuuuaucgaca

SEQ ID NO: 1783754 - RNA, 21 nt, Salmonella enterica enterica serovar Typhi Ty2
augccgcuggccgaugucaau

SEQ ID NO: 1783755 - RNA, 13 nt, Salmonella enterica enterica serovar Typhi Ty2
augccgcugcugg

SEQ ID NO: 1783756 - RNA, 18 nt, Salmonella enterica enterica serovar Typhi Ty2
augccguuggcuuuggcu

SEQ ID NO: 1783757 - RNA, 14 nt, Salmonella enterica enterica serovar Typhi Ty2
augccucaccccau

SEQ ID NO: 1783758 - RNA, 22 nt, Salmonella enterica enterica serovar Typhi Ty2
augccucguuucccucauauuu

SEQ ID NO: 1783759 - RNA, 17 nt, Salmonella enterica enterica serovar Typhi Ty2
augccucuuacagggcg

SEQ ID NO: 1783760 - RNA, 20 nt, Salmonella enterica enterica serovar Typhi Ty2
augccugcgcauccucuuuc

SEQ ID NO: 1783761 - RNA, 21 nt, Salmonella enterica enterica serovar Typhi Ty2
augccuguguaucgcccugcc

SEQ ID NO: 1783762 - RNA, 17 nt, Salmonella enterica enterica serovar Typhi Ty2
augccuuccuguggaag

SEQ ID NO: 1783763 - RNA, 17 nt, Salmonella enterica enterica serovar Typhi Ty2
augcccggaugauuauc

SEQ ID NO: 1783764 - RNA, 17 nt, Salmonella enterica enterica serovar Typhi Ty2
augcccggggugaacaa

SEQ ID NO: 1783765 - RNA, 12 nt, Salmonella enterica enterica serovar Typhi Ty2
augccgaccaau

SEQ ID NO: 1783766 - RNA, 15 nt, Salmonella enterica enterica serovar Typhi Ty2
augccgccgcaacgc

SEQ ID NO: 1783767 - RNA, 20 nt, Salmonella enterica enterica serovar Typhi Ty2
augccgccauccgacacagc

SEQ ID NO: 1783768 - RNA, 21 nt, Salmonella enterica enterica serovar Typhi Ty2
augccgcacuccccagaauga

SEQ ID NO: 1783769 - RNA, 16 nt, Salmonella enterica enterica serovar Typhi Ty2
augccgcacaaaauuu

SEQ ID NO: 1783770 - RNA, 19 nt, Salmonella enterica enterica serovar Typhi Ty2
augccgcacuccccagaau

SEQ ID NO: 1783771 - RNA, 18 nt, Salmonella enterica enterica serovar Typhi Ty2
augccauguuucuuuuaa

SEQ ID NO: 1783772 - RNA, 20 nt, Salmonella enterica enterica serovar Typhi Ty2
augccaucucuuaauguaaa

SEQ ID NO: 1783773 - RNA, 21 nt, Salmonella enterica enterica serovar Typhi Ty2
augccaugcuggcucuugguu

SEQ ID NO: 1783774 - RNA, 21 nt, Salmonella enterica enterica serovar Typhi Ty2
augccauaguagaagugaagc

SEQ ID NO: 1783775 - RNA, 21 nt, Salmonella enterica enterica serovar Typhi Ty2
augcccaccugaaaaagggua

SEQ ID NO: 1783776 - RNA, 20 nt, Salmonella enterica enterica serovar Typhi Ty2
augcccaggcggcgggaaug

SEQ ID NO: 1783777 - RNA, 14 nt, Salmonella enterica enterica serovar Typhi Ty2
augcccauaaagaa

SEQ ID NO: 1783778 - RNA, 17 nt, Salmonella enterica enterica serovar Typhi Ty2
augcccccgcgcaggcg

SEQ ID NO: 1783779 - RNA, 17 nt, Salmonella enterica enterica serovar Typhi Ty2
augccccgacaucagau

SEQ ID NO: 1783780 - RNA, 14 nt, Salmonella enterica enterica serovar Typhi Ty2
augcaggccaagca

SEQ ID NO: 1783781 - RNA, 16 nt, Salmonella enterica enterica serovar Typhi Ty2
augcaggcauaaaaaa

SEQ ID NO: 1783782 - RNA, 18 nt, Salmonella enterica enterica serovar Typhi Ty2
augcaggcauaaaaaaga

SEQ ID NO: 1783783 - RNA, 15 nt, Salmonella enterica enterica serovar Typhi Ty2
augcagguucccgcc

SEQ ID NO: 1783784 - RNA, 13 nt, Salmonella enterica enterica serovar Typhi Ty2
augcagccaggcc

SEQ ID NO: 1783785 - RNA, 19 nt, Salmonella enterica enterica serovar Typhi Ty2
augcacaggcggcgguuca

SEQ ID NO: 1783786 - RNA, 14 nt, Salmonella enterica enterica serovar Typhi Ty2
augcaauuccgcuu

SEQ ID NO: 1783787 - RNA, 18 nt, Salmonella enterica enterica serovar Typhi Ty2
augcaauuccgcuuucuu

SEQ ID NO: 1783788 - RNA, 19 nt, Salmonella enterica enterica serovar Typhi Ty2
augcaaucaguuccaaucu

SEQ ID NO: 1783789 - RNA, 15 nt, Salmonella enterica enterica serovar Typhi Ty2
augccagcgauuauu

SEQ ID NO: 1783790 - RNA, 16 nt, Salmonella enterica enterica serovar Typhi Ty2
augccagaagcaaauu

SEQ ID NO: 1783791 - RNA, 20 nt, Salmonella enterica enterica serovar Typhi Ty2
augccacaacagaagcggcc

SEQ ID NO: 1783792 - RNA, 16 nt, Salmonella enterica enterica serovar Typhi Ty2
augccacggcugaggc

SEQ ID NO: 1783793 - RNA, 23 nt, Salmonella enterica enterica serovar Typhi Ty2
augccacugcccucaaguuaugu

SEQ ID NO: 1783794 - RNA, 16 nt, Salmonella enterica enterica serovar Typhi Ty2
augccacuauagauga

SEQ ID NO: 1783795 - RNA, 20 nt, Salmonella enterica enterica serovar Typhi Ty2
augccaaguaauaaagagaa

SEQ ID NO: 1783796 - RNA, 21 nt, Salmonella enterica enterica serovar Typhi Ty2
augccaaguaauaaagagaac

SEQ ID NO: 1783797 - RNA, 14 nt, Salmonella enterica enterica serovar Typhi Ty2
augccaaccaccgc

SEQ ID NO: 1783798 - RNA, 13 nt, Salmonella enterica enterica serovar Typhi Ty2
augcagugcugcu

SEQ ID NO: 1783799 - RNA, 23 nt, Salmonella enterica enterica serovar Typhi Ty2
augcaguucuucgccguuaucgg

SEQ ID NO: 1783800 - RNA, 13 nt, Salmonella enterica enterica serovar Typhi Ty2
augcauaaaaaaa

SEQ ID NO: 1783801 - RNA, 14 nt, Salmonella enterica enterica serovar Typhi Ty2
augcauaaaaaaac

SEQ ID NO: 1783802 - RNA, 17 nt, Salmonella enterica enterica serovar Typhi Ty2
augcaguucaucauccu

SEQ ID NO: 1783803 - RNA, 13 nt, Salmonella enterica enterica serovar Typhi Ty2
augaugaaaaaga

SEQ ID NO: 1783804 - RNA, 15 nt, Salmonella enterica enterica serovar Typhi Ty2
augaucuuuccuuuu

SEQ ID NO: 1783805 - RNA, 20 nt, Salmonella enterica enterica serovar Typhi Ty2
augauaaccgccgccaaacu

SEQ ID NO: 1783806 - RNA, 15 nt, Salmonella enterica enterica serovar Typhi Ty2
augaguuaacgacug

SEQ ID NO: 1783807 - RNA, 15 nt, Salmonella enterica enterica serovar Typhi Ty2
augaugaaaaagaau

SEQ ID NO: 1783808 - RNA, 14 nt, Salmonella enterica enterica serovar Typhi Ty2
augaugaauauuuu

SEQ ID NO: 1783809 - RNA, 19 nt, Salmonella enterica enterica serovar Typhi Ty2
augauggcgaacagcccca

SEQ ID NO: 1783810 - RNA, 19 nt, Salmonella enterica enterica serovar Typhi Ty2
augaugagauacgucauca

SEQ ID NO: 1783811 - RNA, 12 nt, Salmonella enterica enterica serovar Typhi Ty2
augcaaauguca

SEQ ID NO: 1783812 - RNA, 21 nt, Salmonella enterica enterica serovar Typhi Ty2
augcaaagaagggcaggggaa

SEQ ID NO: 1783813 - RNA, 14 nt, Salmonella enterica enterica serovar Typhi Ty2
augcaaccccugac

SEQ ID NO: 1783814 - RNA, 17 nt, Salmonella enterica enterica serovar Typhi Ty2
augcaagcagcauaaug

SEQ ID NO: 1783815 - RNA, 14 nt, Salmonella enterica enterica serovar Typhi Ty2
augcaacuggcaag

SEQ ID NO: 1783816 - RNA, 13 nt, Salmonella enterica enterica serovar Typhi Ty2
augauuuaaaaaa

SEQ ID NO: 1783817 - RNA, 17 nt, Salmonella enterica enterica serovar Typhi Ty2
augauguacaggugaaa

SEQ ID NO: 1783818 - RNA, 19 nt, Salmonella enterica enterica serovar Typhi Ty2
augauguucauccauauau

SEQ ID NO: 1783819 - RNA, 20 nt, Salmonella enterica enterica serovar Typhi Ty2
augauguucauccauauauc

SEQ ID NO: 1783820 - RNA, 24 nt, Salmonella enterica enterica serovar Typhi Ty2
augauugcuggcagaugaacauaa

SEQ ID NO: 1783821 - RNA, 14 nt, Salmonella enterica enterica serovar Typhi Ty2
augaauuauuuuuu

SEQ ID NO: 1783822 - RNA, 16 nt, Salmonella enterica enterica serovar Typhi Ty2
augaauuauuuuuuca

SEQ ID NO: 1783823 - RNA, 20 nt, Salmonella enterica enterica serovar Typhi Ty2
augaaugacaguucccugcu

SEQ ID NO: 1783824 - RNA, 14 nt, Salmonella enterica enterica serovar Typhi Ty2
augacauccagagg

SEQ ID NO: 1783825 - RNA, 19 nt, Salmonella enterica enterica serovar Typhi Ty2
augaccaccgcaucggcau

SEQ ID NO: 1783826 - RNA, 13 nt, Salmonella enterica enterica serovar Typhi Ty2
augaccagaacau

SEQ ID NO: 1783827 - RNA, 16 nt, Salmonella enterica enterica serovar Typhi Ty2
augaccagcgcccaca

SEQ ID NO: 1783828 - RNA, 14 nt, Salmonella enterica enterica serovar Typhi Ty2
augaauaucaaacc

SEQ ID NO: 1783829 - RNA, 14 nt, Salmonella enterica enterica serovar Typhi Ty2
augaaucaucagaa

SEQ ID NO: 1783830 - RNA, 21 nt, Salmonella enterica enterica serovar Typhi Ty2
augaaggguauauaaaucaaa

SEQ ID NO: 1783831 - RNA, 18 nt, Salmonella enterica enterica serovar Typhi Ty2
augaauaaaugaauuauu

SEQ ID NO: 1783832 - RNA, 15 nt, Salmonella enterica enterica serovar Typhi Ty2
augaauaaccucccg

SEQ ID NO: 1783833 - RNA, 22 nt, Salmonella enterica enterica serovar Typhi Ty2
augaauaaccucccgccggggc

SEQ ID NO: 1783834 - RNA, 13 nt, Salmonella enterica enterica serovar Typhi Ty2
augaauaauaaua

SEQ ID NO: 1783835 - RNA, 15 nt, Salmonella enterica enterica serovar Typhi Ty2
augaauaaucucugc

SEQ ID NO: 1783836 - RNA, 18 nt, Salmonella enterica enterica serovar Typhi Ty2
augagagacggagaaaaa

SEQ ID NO: 1783837 - RNA, 18 nt, Salmonella enterica enterica serovar Typhi Ty2
augagcaaacugcucauu

SEQ ID NO: 1783838 - RNA, 14 nt, Salmonella enterica enterica serovar Typhi Ty2
augaguaaaugaac

SEQ ID NO: 1783839 - RNA, 12 nt, Salmonella enterica enterica serovar Typhi Ty2
augaguaaaauu

SEQ ID NO: 1783840 - RNA, 17 nt, Salmonella enterica enterica serovar Typhi Ty2
augaccauuaacgccag

SEQ ID NO: 1783841 - RNA, 20 nt, Salmonella enterica enterica serovar Typhi Ty2
augaccaucaaauaauacgc

SEQ ID NO: 1783842 - RNA, 14 nt, Salmonella enterica enterica serovar Typhi Ty2
augacgaccucauc

SEQ ID NO: 1783843 - RNA, 12 nt, Salmonella enterica enterica serovar Typhi Ty2
augagaagaaaa

SEQ ID NO: 1783844 - RNA, 13 nt, Salmonella enterica enterica serovar Typhi Ty2
augagaagaaaaa

SEQ ID NO: 1783845 - RNA, 18 nt, Salmonella enterica enterica serovar Typhi Ty2
augagaaaaggaagaaua

SEQ ID NO: 1783846 - RNA, 20 nt, Salmonella enterica enterica serovar Typhi Ty2
augacugcgaauuuccugcc

SEQ ID NO: 1783847 - RNA, 14 nt, Salmonella enterica enterica serovar Typhi Ty2
augacugguuuuuc

SEQ ID NO: 1783848 - RNA, 14 nt, Salmonella enterica enterica serovar Typhi Ty2
augaagaaaauacu

SEQ ID NO: 1783849 - RNA, 22 nt, Salmonella enterica enterica serovar Typhi Ty2
augaacucuaugcaaaagaaaa

SEQ ID NO: 1783850 - RNA, 22 nt, Salmonella enterica enterica serovar Typhi Ty2
augaaaucgccuguuaauggua

SEQ ID NO: 1783851 - RNA, 22 nt, Salmonella enterica enterica serovar Typhi Ty2
augaaaucgucgccaacaccga

SEQ ID NO: 1783852 - RNA, 23 nt, Salmonella enterica enterica serovar Typhi Ty2
augaaggauacggaauggauaac

SEQ ID NO: 1783853 - RNA, 19 nt, Salmonella enterica enterica serovar Typhi Ty2
augaaggagagcauuuuuu

SEQ ID NO: 1783854 - RNA, 21 nt, Salmonella enterica enterica serovar Typhi Ty2
augaagccuuagcgggaggug

SEQ ID NO: 1783855 - RNA, 15 nt, Salmonella enterica enterica serovar Typhi Ty2
augaagauauucacu

SEQ ID NO: 1783856 - RNA, 23 nt, Salmonella enterica enterica serovar Typhi Ty2
augaagacguucuaucagguauc

SEQ ID NO: 1783857 - RNA, 17 nt, Salmonella enterica enterica serovar Typhi Ty2
aucuuuucaaucagguu

SEQ ID NO: 1783858 - RNA, 16 nt, Salmonella enterica enterica serovar Typhi Ty2
aucuuuuacgaaacaa

SEQ ID NO: 1783859 - RNA, 13 nt, Salmonella enterica enterica serovar Typhi Ty2
aucuuuccuuuuu

SEQ ID NO: 1783860 - RNA, 14 nt, Salmonella enterica enterica serovar Typhi Ty2
aucuuucuccuggu

SEQ ID NO: 1783861 - RNA, 23 nt, Salmonella enterica enterica serovar Typhi Ty2
aucuuucuccugguuuuuccauu

SEQ ID NO: 1783862 - RNA, 12 nt, Salmonella enterica enterica serovar Typhi Ty2
augaaagagaaa

SEQ ID NO: 1783863 - RNA, 14 nt, Salmonella enterica enterica serovar Typhi Ty2
augaaagaaaucac

SEQ ID NO: 1783864 - RNA, 19 nt, Salmonella enterica enterica serovar Typhi Ty2
aucuucuccauugaucacu

SEQ ID NO: 1783865 - RNA, 11 nt, Salmonella enterica enterica serovar Typhi Ty2
aucuucuuccg

SEQ ID NO: 1783866 - RNA, 22 nt, Salmonella enterica enterica serovar Typhi Ty2
aucugcuaccgccacuuugcuu

SEQ ID NO: 1783867 - RNA, 23 nt, Salmonella enterica enterica serovar Typhi Ty2
aucugcuaccgccacuuugcuuu

SEQ ID NO: 1783868 - RNA, 21 nt, Salmonella enterica enterica serovar Typhi Ty2
aucuuuaccagggaauaugau

SEQ ID NO: 1783869 - RNA, 14 nt, Salmonella enterica enterica serovar Typhi Ty2
aucuuuccggaacg

SEQ ID NO: 1783870 - RNA, 20 nt, Salmonella enterica enterica serovar Typhi Ty2
aucgccggcgucaucggcgc

SEQ ID NO: 1783871 - RNA, 23 nt, Salmonella enterica enterica serovar Typhi Ty2
aucgccggcgucaucggcgccag

SEQ ID NO: 1783872 - RNA, 24 nt, Salmonella enterica enterica serovar Typhi Ty2
aucgcccgguugcaauuccgccau

SEQ ID NO: 1783873 - RNA, 15 nt, Salmonella enterica enterica serovar Typhi Ty2
aucgcccaucacaug

SEQ ID NO: 1783874 - RNA, 22 nt, Salmonella enterica enterica serovar Typhi Ty2
aucgcccacgcaaaauggccug

SEQ ID NO: 1783875 - RNA, 13 nt, Salmonella enterica enterica serovar Typhi Ty2
aucgcauauugcg

SEQ ID NO: 1783876 - RNA, 23 nt, Salmonella enterica enterica serovar Typhi Ty2
aucgcauagacgcccugcaaagc

SEQ ID NO: 1783877 - RNA, 22 nt, Salmonella enterica enterica serovar Typhi Ty2
aucgcauugagcaggggcuccu

SEQ ID NO: 1783878 - RNA, 21 nt, Salmonella enterica enterica serovar Typhi Ty2
aucgcagauuccgaacucaug

SEQ ID NO: 1783879 - RNA, 21 nt, Salmonella enterica enterica serovar Typhi Ty2
aucgcacuggcgccugcgccu

SEQ ID NO: 1783880 - RNA, 16 nt, Salmonella enterica enterica serovar Typhi Ty2
aucgcaggaugcgcug

SEQ ID NO: 1783881 - RNA, 23 nt, Salmonella enterica enterica serovar Typhi Ty2
aucgcgggcaaucaaaugcgcau

SEQ ID NO: 1783882 - RNA, 21 nt, Salmonella enterica enterica serovar Typhi Ty2
aucgcggcgcugaguuucucc

SEQ ID NO: 1783883 - RNA, 14 nt, Salmonella enterica enterica serovar Typhi Ty2
aucgcgcuggcagu

SEQ ID NO: 1783884 - RNA, 21 nt, Salmonella enterica enterica serovar Typhi Ty2
aucgcgcgcagaguguaggcc

SEQ ID NO: 1783885 - RNA, 16 nt, Salmonella enterica enterica serovar Typhi Ty2
aucgcgcgcaaaugca

SEQ ID NO: 1783886 - RNA, 23 nt, Salmonella enterica enterica serovar Typhi Ty2
aucgcgcccgccaucaugcccac

SEQ ID NO: 1783887 - RNA, 22 nt, Salmonella enterica enterica serovar Typhi Ty2
aucgccguuaucgaggcgcugg

SEQ ID NO: 1783888 - RNA, 13 nt, Salmonella enterica enterica serovar Typhi Ty2
aucgccucaacca

SEQ ID NO: 1783889 - RNA, 18 nt, Salmonella enterica enterica serovar Typhi Ty2
aucgccuccagacuggcg

SEQ ID NO: 1783890 - RNA, 16 nt, Salmonella enterica enterica serovar Typhi Ty2
aucgcgcagacagugg

SEQ ID NO: 1783891 - RNA, 23 nt, Salmonella enterica enterica serovar Typhi Ty2
aucgcgagcacuuuuuccuccug

SEQ ID NO: 1783892 - RNA, 21 nt, Salmonella enterica enterica serovar Typhi Ty2
aucgagugucaauaagccaga

SEQ ID NO: 1783893 - RNA, 20 nt, Salmonella enterica enterica serovar Typhi Ty2
aucgauauaucgcgucauca

SEQ ID NO: 1783894 - RNA, 16 nt, Salmonella enterica enterica serovar Typhi Ty2
aucgauacuaaaacuu

SEQ ID NO: 1783895 - RNA, 13 nt, Salmonella enterica enterica serovar Typhi Ty2
aucgaaaaccggu

SEQ ID NO: 1783896 - RNA, 18 nt, Salmonella enterica enterica serovar Typhi Ty2
auccuuuuucugcgccag

SEQ ID NO: 1783897 - RNA, 14 nt, Salmonella enterica enterica serovar Typhi Ty2
aucgagagcgggug

SEQ ID NO: 1783898 - RNA, 23 nt, Salmonella enterica enterica serovar Typhi Ty2
aucgugccguccggcaucacaaa

SEQ ID NO: 1783899 - RNA, 20 nt, Salmonella enterica enterica serovar Typhi Ty2
aucgugcggcgaagcaucuu

SEQ ID NO: 1783900 - RNA, 16 nt, Salmonella enterica enterica serovar Typhi Ty2
aucgugccaugaccau

SEQ ID NO: 1783901 - RNA, 16 nt, Salmonella enterica enterica serovar Typhi Ty2
aucgugguuggcauau

SEQ ID NO: 1783902 - RNA, 23 nt, Salmonella enterica enterica serovar Typhi Ty2
aucgucgcgaucgcgccagccuu

SEQ ID NO: 1783903 - RNA, 16 nt, Salmonella enterica enterica serovar Typhi Ty2
aucguccggcgaaaac

SEQ ID NO: 1783904 - RNA, 17 nt, Salmonella enterica enterica serovar Typhi Ty2
aucguccucacaaacgg

SEQ ID NO: 1783905 - RNA, 13 nt, Salmonella enterica enterica serovar Typhi Ty2
aucguuauauaua

SEQ ID NO: 1783906 - RNA, 19 nt, Salmonella enterica enterica serovar Typhi Ty2
aucguuauccagcagccac

SEQ ID NO: 1783907 - RNA, 22 nt, Salmonella enterica enterica serovar Typhi Ty2
aucguucgcccuucaucuucca

SEQ ID NO: 1783908 - RNA, 14 nt, Salmonella enterica enterica serovar Typhi Ty2
aucguugccgccgu

SEQ ID NO: 1783909 - RNA, 17 nt, Salmonella enterica enterica serovar Typhi Ty2
aucuaaaauuauuuuua

SEQ ID NO: 1783910 - RNA, 21 nt, Salmonella enterica enterica serovar Typhi Ty2
aucgcuaaccaaaccagaugc

SEQ ID NO: 1783911 - RNA, 18 nt, Salmonella enterica enterica serovar Typhi Ty2
aucgcguuuuccagcauc

SEQ ID NO: 1783912 - RNA, 20 nt, Salmonella enterica enterica serovar Typhi Ty2
aucgcguuuuccagcauccu

SEQ ID NO: 1783913 - RNA, 19 nt, Salmonella enterica enterica serovar Typhi Ty2
aucgcguuguaaucgccug

SEQ ID NO: 1783914 - RNA, 15 nt, Salmonella enterica enterica serovar Typhi Ty2
aucgcggggcaacag

SEQ ID NO: 1783915 - RNA, 19 nt, Salmonella enterica enterica serovar Typhi Ty2
aucgcggucagcggcgcgc

SEQ ID NO: 1783916 - RNA, 17 nt, Salmonella enterica enterica serovar Typhi Ty2
aucggauuuacagggga

SEQ ID NO: 1783917 - RNA, 15 nt, Salmonella enterica enterica serovar Typhi Ty2
aucggauagaugaag

SEQ ID NO: 1783918 - RNA, 20 nt, Salmonella enterica enterica serovar Typhi Ty2
aucggccagauaguggcuga

SEQ ID NO: 1783919 - RNA, 18 nt, Salmonella enterica enterica serovar Typhi Ty2
aucggccagcgaaaacca

SEQ ID NO: 1783920 - RNA, 15 nt, Salmonella enterica enterica serovar Typhi Ty2
aucggcaagcaucug

SEQ ID NO: 1783921 - RNA, 11 nt, Salmonella enterica enterica serovar Typhi Ty2
aucggcaaaca

SEQ ID NO: 1783922 - RNA, 17 nt, Salmonella enterica enterica serovar Typhi Ty2
aucggcaaacgccgccu

SEQ ID NO: 1783923 - RNA, 19 nt, Salmonella enterica enterica serovar Typhi Ty2
aucggcaaacgccgccugg

SEQ ID NO: 1783924 - RNA, 23 nt, Salmonella enterica enterica serovar Typhi Ty2
aucgggugacgagggaaggggau

SEQ ID NO: 1783925 - RNA, 23 nt, Salmonella enterica enterica serovar Typhi Ty2
aucgguaggccggauaaggcauu

SEQ ID NO: 1783926 - RNA, 17 nt, Salmonella enterica enterica serovar Typhi Ty2
aucggguuuuccugaau

SEQ ID NO: 1783927 - RNA, 17 nt, Salmonella enterica enterica serovar Typhi Ty2
aucgggugauaaaauaa

SEQ ID NO: 1783928 - RNA, 19 nt, Salmonella enterica enterica serovar Typhi Ty2
aucggugauccagcaaucg

SEQ ID NO: 1783929 - RNA, 19 nt, Salmonella enterica enterica serovar Typhi Ty2
aucggguauguuuuagcag

SEQ ID NO: 1783930 - RNA, 15 nt, Salmonella enterica enterica serovar Typhi Ty2
aucgggcuuccagcg

SEQ ID NO: 1783931 - RNA, 20 nt, Salmonella enterica enterica serovar Typhi Ty2
aucggccauauccagccagu

SEQ ID NO: 1783932 - RNA, 17 nt, Salmonella enterica enterica serovar Typhi Ty2
aucggccugaccaugga

SEQ ID NO: 1783933 - RNA, 13 nt, Salmonella enterica enterica serovar Typhi Ty2
aucugccauuucu

SEQ ID NO: 1783934 - RNA, 20 nt, Salmonella enterica enterica serovar Typhi Ty2
aucugccagccgauuuuucg

SEQ ID NO: 1783935 - RNA, 14 nt, Salmonella enterica enterica serovar Typhi Ty2
aucugcccuuucuu

SEQ ID NO: 1783936 - RNA, 15 nt, Salmonella enterica enterica serovar Typhi Ty2
aucugcauaggcuuu

SEQ ID NO: 1783937 - RNA, 17 nt, Salmonella enterica enterica serovar Typhi Ty2
aucugcggucuccugaa

SEQ ID NO: 1783938 - RNA, 18 nt, Salmonella enterica enterica serovar Typhi Ty2
aucugcgucaguaccuga

SEQ ID NO: 1783939 - RNA, 22 nt, Salmonella enterica enterica serovar Typhi Ty2
aucugcgccggcugcgcugcca

SEQ ID NO: 1783940 - RNA, 21 nt, Salmonella enterica enterica serovar Typhi Ty2
aucugcgccgacauucccugc

SEQ ID NO: 1783941 - RNA, 21 nt, Salmonella enterica enterica serovar Typhi Ty2
aucugcgcaacauucugcuuc

SEQ ID NO: 1783942 - RNA, 19 nt, Salmonella enterica enterica serovar Typhi Ty2
aucugcgcaacauucugcu

SEQ ID NO: 1783943 - RNA, 15 nt, Salmonella enterica enterica serovar Typhi Ty2
aucugccgucaucga

SEQ ID NO: 1783944 - RNA, 17 nt, Salmonella enterica enterica serovar Typhi Ty2
aucugcccuuucuuaug

SEQ ID NO: 1783945 - RNA, 17 nt, Salmonella enterica enterica serovar Typhi Ty2
aucugauucaauuaaug

SEQ ID NO: 1783946 - RNA, 21 nt, Salmonella enterica enterica serovar Typhi Ty2
aucugcacaacauuccgcuuc

SEQ ID NO: 1783947 - RNA, 16 nt, Salmonella enterica enterica serovar Typhi Ty2
aucugauauaucuuca

SEQ ID NO: 1783948 - RNA, 19 nt, Salmonella enterica enterica serovar Typhi Ty2
aucugagcugguuucuccg

SEQ ID NO: 1783949 - RNA, 16 nt, Salmonella enterica enterica serovar Typhi Ty2
aucugaguaucgcuuu

SEQ ID NO: 1783950 - RNA, 13 nt, Salmonella enterica enterica serovar Typhi Ty2
aucugauaaaaug

SEQ ID NO: 1783951 - RNA, 19 nt, Salmonella enterica enterica serovar Typhi Ty2
aucugacagccaaacugcu

SEQ ID NO: 1783952 - RNA, 13 nt, Salmonella enterica enterica serovar Typhi Ty2
aucugaauaccuu

SEQ ID NO: 1783953 - RNA, 15 nt, Salmonella enterica enterica serovar Typhi Ty2
aucucuuucagaaua

SEQ ID NO: 1783954 - RNA, 17 nt, Salmonella enterica enterica serovar Typhi Ty2
aucucuugcauaauauc

SEQ ID NO: 1783955 - RNA, 22 nt, Salmonella enterica enterica serovar Typhi Ty2
aucucuugcauaauauccagga

SEQ ID NO: 1783956 - RNA, 22 nt, Salmonella enterica enterica serovar Typhi Ty2
aucucuuuuaauuuucuguaau

SEQ ID NO: 1783957 - RNA, 15 nt, Salmonella enterica enterica serovar Typhi Ty2
aucucuuuugcuuca

SEQ ID NO: 1783958 - RNA, 16 nt, Salmonella enterica enterica serovar Typhi Ty2
aucucugucgaccauc

SEQ ID NO: 1783959 - RNA, 14 nt, Salmonella enterica enterica serovar Typhi Ty2
aucucuccccccuc

SEQ ID NO: 1783960 - RNA, 12 nt, Salmonella enterica enterica serovar Typhi Ty2
aucucgccuggc

SEQ ID NO: 1783961 - RNA, 19 nt, Salmonella enterica enterica serovar Typhi Ty2
aucucgcgguugacgcugc

SEQ ID NO: 1783962 - RNA, 18 nt, Salmonella enterica enterica serovar Typhi Ty2
aucucuaucggcaaacca

SEQ ID NO: 1783963 - RNA, 21 nt, Salmonella enterica enterica serovar Typhi Ty2
aucuagcggaaccuguccuga

SEQ ID NO: 1783964 - RNA, 18 nt, Salmonella enterica enterica serovar Typhi Ty2
aucuacgguaucugcaua

SEQ ID NO: 1783965 - RNA, 19 nt, Salmonella enterica enterica serovar Typhi Ty2
aucuacgcuauuuccagaa

SEQ ID NO: 1783966 - RNA, 16 nt, Salmonella enterica enterica serovar Typhi Ty2
aucuauauauucuucu

SEQ ID NO: 1783967 - RNA, 20 nt, Salmonella enterica enterica serovar Typhi Ty2
aucuauuuagcguauaguac

SEQ ID NO: 1783968 - RNA, 17 nt, Salmonella enterica enterica serovar Typhi Ty2
aucucaauaccacgccg

SEQ ID NO: 1783969 - RNA, 15 nt, Salmonella enterica enterica serovar Typhi Ty2
aucucaagccccaug

SEQ ID NO: 1783970 - RNA, 12 nt, Salmonella enterica enterica serovar Typhi Ty2
aucuccugacau

SEQ ID NO: 1783971 - RNA, 22 nt, Salmonella enterica enterica serovar Typhi Ty2
aucuccuccucauucagcggcu

SEQ ID NO: 1783972 - RNA, 19 nt, Salmonella enterica enterica serovar Typhi Ty2
aucuccugacauagcucac

SEQ ID NO: 1783973 - RNA, 17 nt, Salmonella enterica enterica serovar Typhi Ty2
aucuccuguaaugaggc

SEQ ID NO: 1783974 - RNA, 22 nt, Salmonella enterica enterica serovar Typhi Ty2
aucucgcacaucaugaugaucu

SEQ ID NO: 1783975 - RNA, 16 nt, Salmonella enterica enterica serovar Typhi Ty2
aucuccggcagcgaau

SEQ ID NO: 1783976 - RNA, 16 nt, Salmonella enterica enterica serovar Typhi Ty2
aucuccggcaucucaa

SEQ ID NO: 1783977 - RNA, 13 nt, Salmonella enterica enterica serovar Typhi Ty2
aucuccaucucca

SEQ ID NO: 1783978 - RNA, 16 nt, Salmonella enterica enterica serovar Typhi Ty2
aucuccaguuguucac

SEQ ID NO: 1783979 - RNA, 23 nt, Salmonella enterica enterica serovar Typhi Ty2
aucucccaggccgccaccgccuc

SEQ ID NO: 1783980 - RNA, 14 nt, Salmonella enterica enterica serovar Typhi Ty2
aucucauugauggu

SEQ ID NO: 1783981 - RNA, 18 nt, Salmonella enterica enterica serovar Typhi Ty2
aucucauaaaugcugucg

SEQ ID NO: 1783982 - RNA, 18 nt, Salmonella enterica enterica serovar Typhi Ty2
aucucagauaauagcugc

SEQ ID NO: 1783983 - RNA, 13 nt, Salmonella enterica enterica serovar Typhi Ty2
aucucauaaaccg

SEQ ID NO: 1783984 - RNA, 21 nt, Salmonella enterica enterica serovar Typhi Ty2
augugcaaucacacuacacga

SEQ ID NO: 1783985 - RNA, 22 nt, Salmonella enterica enterica serovar Typhi Ty2
auguggacgccauaaaccagaa

SEQ ID NO: 1783986 - RNA, 17 nt, Salmonella enterica enterica serovar Typhi Ty2
auguggcggcccguggu

SEQ ID NO: 1783987 - RNA, 18 nt, Salmonella enterica enterica serovar Typhi Ty2
auguuaauaccagcgcca

SEQ ID NO: 1783988 - RNA, 22 nt, Salmonella enterica enterica serovar Typhi Ty2
auguuaaauacgccgccagcaa

SEQ ID NO: 1783989 - RNA, 17 nt, Salmonella enterica enterica serovar Typhi Ty2
auguguuucagcagccc

SEQ ID NO: 1783990 - RNA, 21 nt, Salmonella enterica enterica serovar Typhi Ty2
auguuaaaguuuuucauaucc

SEQ ID NO: 1783991 - RNA, 22 nt, Salmonella enterica enterica serovar Typhi Ty2
augugagcaucggcgauuaagu

SEQ ID NO: 1783992 - RNA, 17 nt, Salmonella enterica enterica serovar Typhi Ty2
augugauauggaaagug

SEQ ID NO: 1783993 - RNA, 18 nt, Salmonella enterica enterica serovar Typhi Ty2
augugauauggaaagugg

SEQ ID NO: 1783994 - RNA, 16 nt, Salmonella enterica enterica serovar Typhi Ty2
augugaucuauauauu

SEQ ID NO: 1783995 - RNA, 13 nt, Salmonella enterica enterica serovar Typhi Ty2
augugacaaucac

SEQ ID NO: 1783996 - RNA, 17 nt, Salmonella enterica enterica serovar Typhi Ty2
augugaaauacagccag

SEQ ID NO: 1783997 - RNA, 15 nt, Salmonella enterica enterica serovar Typhi Ty2
augucuuccuuuucu

SEQ ID NO: 1783998 - RNA, 13 nt, Salmonella enterica enterica serovar Typhi Ty2
auguaaaacaaga

SEQ ID NO: 1783999 - RNA, 19 nt, Salmonella enterica enterica serovar Typhi Ty2
auguaaaacgguaugaaac

SEQ ID NO: 1784000 - RNA, 14 nt, Salmonella enterica enterica serovar Typhi Ty2
auguaguaaauagg

SEQ ID NO: 1784001 - RNA, 24 nt, Salmonella enterica enterica serovar Typhi Ty2
auguaagcgucuauuacacgauca

SEQ ID NO: 1784002 - RNA, 17 nt, Salmonella enterica enterica serovar Typhi Ty2
augucauucaggucuau

SEQ ID NO: 1784003 - RNA, 21 nt, Salmonella enterica enterica serovar Typhi Ty2
augucauucaggucuauugcc

SEQ ID NO: 1784004 - RNA, 19 nt, Salmonella enterica enterica serovar Typhi Ty2
auguccaggcgacaugaca

SEQ ID NO: 1784005 - RNA, 17 nt, Salmonella enterica enterica serovar Typhi Ty2
augucaugacugguuuu

SEQ ID NO: 1784006 - RNA, 17 nt, Salmonella enterica enterica serovar Typhi Ty2
auguccgauagcauuau

SEQ ID NO: 1784007 - RNA, 17 nt, Salmonella enterica enterica serovar Typhi Ty2
augucccgauauugguc

SEQ ID NO: 1784008 - RNA, 20 nt, Salmonella enterica enterica serovar Typhi Ty2
auguccgccuaccagcacau

SEQ ID NO: 1784009 - RNA, 18 nt, Salmonella enterica enterica serovar Typhi Ty2
auguccaucagauucaac

SEQ ID NO: 1784010 - RNA, 16 nt, Salmonella enterica enterica serovar Typhi Ty2
augucccaguaauauc

SEQ ID NO: 1784011 - RNA, 19 nt, Salmonella enterica enterica serovar Typhi Ty2
augcgaucgggcaauccau

SEQ ID NO: 1784012 - RNA, 14 nt, Salmonella enterica enterica serovar Typhi Ty2
augcgaaaaguaaa

SEQ ID NO: 1784013 - RNA, 22 nt, Salmonella enterica enterica serovar Typhi Ty2
auggcauaugacgguauugcuu

SEQ ID NO: 1784014 - RNA, 22 nt, Salmonella enterica enterica serovar Typhi Ty2
auggccaauguacguaaaacca

SEQ ID NO: 1784015 - RNA, 15 nt, Salmonella enterica enterica serovar Typhi Ty2
auggcagauaaacca

SEQ ID NO: 1784016 - RNA, 18 nt, Salmonella enterica enterica serovar Typhi Ty2
auggcgcgaaaacagcug

SEQ ID NO: 1784017 - RNA, 18 nt, Salmonella enterica enterica serovar Typhi Ty2
auggcgcgccacuucuuu

SEQ ID NO: 1784018 - RNA, 12 nt, Salmonella enterica enterica serovar Typhi Ty2
auggccagcccc

SEQ ID NO: 1784019 - RNA, 20 nt, Salmonella enterica enterica serovar Typhi Ty2
auggccagcaccagcauuag

SEQ ID NO: 1784020 - RNA, 16 nt, Salmonella enterica enterica serovar Typhi Ty2
auggccagcaccagca

SEQ ID NO: 1784021 - RNA, 18 nt, Salmonella enterica enterica serovar Typhi Ty2
auggcgggccugugccug

SEQ ID NO: 1784022 - RNA, 17 nt, Salmonella enterica enterica serovar Typhi Ty2
auggcuaugaagcugga

SEQ ID NO: 1784023 - RNA, 21 nt, Salmonella enterica enterica serovar Typhi Ty2
auggcggcuuggcuguagaua

SEQ ID NO: 1784024 - RNA, 19 nt, Salmonella enterica enterica serovar Typhi Ty2
augggauaacgcagaagac

SEQ ID NO: 1784025 - RNA, 22 nt, Salmonella enterica enterica serovar Typhi Ty2
augggauaacgcagaagacaga

SEQ ID NO: 1784026 - RNA, 18 nt, Salmonella enterica enterica serovar Typhi Ty2
augggauagugccugccg

SEQ ID NO: 1784027 - RNA, 15 nt, Salmonella enterica enterica serovar Typhi Ty2
augggaaaucacagc

SEQ ID NO: 1784028 - RNA, 20 nt, Salmonella enterica enterica serovar Typhi Ty2
augggauagugccugccguc

SEQ ID NO: 1784029 - RNA, 22 nt, Salmonella enterica enterica serovar Typhi Ty2
augggcaggagaugaccugccc

SEQ ID NO: 1784030 - RNA, 23 nt, Salmonella enterica enterica serovar Typhi Ty2
augggcgaaaacggcgcaggcaa

SEQ ID NO: 1784031 - RNA, 18 nt, Salmonella enterica enterica serovar Typhi Ty2
augggccuacgccuggau

SEQ ID NO: 1784032 - RNA, 22 nt, Salmonella enterica enterica serovar Typhi Ty2
augggcgugcugacggagcugg

SEQ ID NO: 1784033 - RNA, 14 nt, Salmonella enterica enterica serovar Typhi Ty2
augguaaaauccuu

SEQ ID NO: 1784034 - RNA, 17 nt, Salmonella enterica enterica serovar Typhi Ty2
auggggaucgucugcaa

SEQ ID NO: 1784035 - RNA, 15 nt, Salmonella enterica enterica serovar Typhi Ty2
augggcuucuucacu

SEQ ID NO: 1784036 - RNA, 16 nt, Salmonella enterica enterica serovar Typhi Ty2
augguacucaacauca

SEQ ID NO: 1784037 - RNA, 20 nt, Salmonella enterica enterica serovar Typhi Ty2
augguacacauaugggaaga

SEQ ID NO: 1784038 - RNA, 19 nt, Salmonella enterica enterica serovar Typhi Ty2
auggucguauuuuggcgcu

SEQ ID NO: 1784039 - RNA, 15 nt, Salmonella enterica enterica serovar Typhi Ty2
auggucgguauuauc

SEQ ID NO: 1784040 - RNA, 21 nt, Salmonella enterica enterica serovar Typhi Ty2
auggucgcauggcuaaaagaa

SEQ ID NO: 1784041 - RNA, 20 nt, Salmonella enterica enterica serovar Typhi Ty2
auggucgaaaauaucggccu

SEQ ID NO: 1784042 - RNA, 17 nt, Salmonella enterica enterica serovar Typhi Ty2
augguuaagcagacgcu

SEQ ID NO: 1784043 - RNA, 13 nt, Salmonella enterica enterica serovar Typhi Ty2
auggucuuaaaug

SEQ ID NO: 1784044 - RNA, 23 nt, Salmonella enterica enterica serovar Typhi Ty2
auuaacgcagaauauuuuucuca

SEQ ID NO: 1784045 - RNA, 15 nt, Salmonella enterica enterica serovar Typhi Ty2
auuaacgcgaaaaua

SEQ ID NO: 1784046 - RNA, 13 nt, Salmonella enterica enterica serovar Typhi Ty2
auuaacucuuccg

SEQ ID NO: 1784047 - RNA, 12 nt, Salmonella enterica enterica serovar Typhi Ty2
auuaacucauca

SEQ ID NO: 1784048 - RNA, 23 nt, Salmonella enterica enterica serovar Typhi Ty2
auuaacuugacuuugcucuccuu

SEQ ID NO: 1784049 - RNA, 15 nt, Salmonella enterica enterica serovar Typhi Ty2
auuaagcaauccauu

SEQ ID NO: 1784050 - RNA, 13 nt, Salmonella enterica enterica serovar Typhi Ty2
auuaagcaggccg

SEQ ID NO: 1784051 - RNA, 11 nt, Salmonella enterica enterica serovar Typhi Ty2
auuaacaucag

SEQ ID NO: 1784052 - RNA, 23 nt, Salmonella enterica enterica serovar Typhi Ty2
auuaacaggcgccggggcagcaa

SEQ ID NO: 1784053 - RNA, 23 nt, Salmonella enterica enterica serovar Typhi Ty2
auuaacagcgcgaccaggaaacc

SEQ ID NO: 1784054 - RNA, 15 nt, Salmonella enterica enterica serovar Typhi Ty2
auuaacauuuaagaa

SEQ ID NO: 1784055 - RNA, 13 nt, Salmonella enterica enterica serovar Typhi Ty2
auuaacaaauaaa

SEQ ID NO: 1784056 - RNA, 13 nt, Salmonella enterica enterica serovar Typhi Ty2
auuaacaaaucau

SEQ ID NO: 1784057 - RNA, 16 nt, Salmonella enterica enterica serovar Typhi Ty2
auuaaaugcuugcuuu

SEQ ID NO: 1784058 - RNA, 20 nt, Salmonella enterica enterica serovar Typhi Ty2
auuaaauggaucgacaucuu

SEQ ID NO: 1784059 - RNA, 12 nt, Salmonella enterica enterica serovar Typhi Ty2
auuaacaaauaa

SEQ ID NO: 1784060 - RNA, 16 nt, Salmonella enterica enterica serovar Typhi Ty2
auuaaugauuugcuuu

SEQ ID NO: 1784061 - RNA, 15 nt, Salmonella enterica enterica serovar Typhi Ty2
auuaaugauuaaaau

SEQ ID NO: 1784062 - RNA, 18 nt, Salmonella enterica enterica serovar Typhi Ty2
auuaaugauuaaaauaaa

SEQ ID NO: 1784063 - RNA, 19 nt, Salmonella enterica enterica serovar Typhi Ty2
auuaaugcuccaauaaaua

SEQ ID NO: 1784064 - RNA, 21 nt, Salmonella enterica enterica serovar Typhi Ty2
auuaaugcuccaauaaauauu

SEQ ID NO: 1784065 - RNA, 18 nt, Salmonella enterica enterica serovar Typhi Ty2
auuaaugcuccaauaaau

SEQ ID NO: 1784066 - RNA, 14 nt, Salmonella enterica enterica serovar Typhi Ty2
auuaauccugcgcu

SEQ ID NO: 1784067 - RNA, 20 nt, Salmonella enterica enterica serovar Typhi Ty2
auuaaugaauaaaugaauua

SEQ ID NO: 1784068 - RNA, 18 nt, Salmonella enterica enterica serovar Typhi Ty2
auuaaucccaacccgacc

SEQ ID NO: 1784069 - RNA, 18 nt, Salmonella enterica enterica serovar Typhi Ty2
auuaauauuuaacacauu

SEQ ID NO: 1784070 - RNA, 18 nt, Salmonella enterica enterica serovar Typhi Ty2
auuaaguuuuuuuaaaaa

SEQ ID NO: 1784071 - RNA, 16 nt, Salmonella enterica enterica serovar Typhi Ty2
auuaaguuuuuuuaaa

SEQ ID NO: 1784072 - RNA, 12 nt, Salmonella enterica enterica serovar Typhi Ty2
auuaauaaaauc

SEQ ID NO: 1784073 - RNA, 16 nt, Salmonella enterica enterica serovar Typhi Ty2
auuaauacaucacuuu

SEQ ID NO: 1784074 - RNA, 17 nt, Salmonella enterica enterica serovar Typhi Ty2
auuaauaaacaaugcag

SEQ ID NO: 1784075 - RNA, 23 nt, Salmonella enterica enterica serovar Typhi Ty2
auuaaggcguuaucuugacauga

SEQ ID NO: 1784076 - RNA, 21 nt, Salmonella enterica enterica serovar Typhi Ty2
auuaagcugauauuuuacuuu

SEQ ID NO: 1784077 - RNA, 18 nt, Salmonella enterica enterica serovar Typhi Ty2
auuaagcgaauccagcgc

SEQ ID NO: 1784078 - RNA, 22 nt, Salmonella enterica enterica serovar Typhi Ty2
auuaagcggauuuuuucgcuuu

SEQ ID NO: 1784079 - RNA, 12 nt, Salmonella enterica enterica serovar Typhi Ty2
auuaaguuuuuu

SEQ ID NO: 1784080 - RNA, 15 nt, Salmonella enterica enterica serovar Typhi Ty2
auguuuuuucaucuc

SEQ ID NO: 1784081 - RNA, 12 nt, Salmonella enterica enterica serovar Typhi Ty2
auuaaaaauacc

SEQ ID NO: 1784082 - RNA, 15 nt, Salmonella enterica enterica serovar Typhi Ty2
auuaaaaauacccca

SEQ ID NO: 1784083 - RNA, 22 nt, Salmonella enterica enterica serovar Typhi Ty2
auuaaaaauaccccaggggcau

SEQ ID NO: 1784084 - RNA, 17 nt, Salmonella enterica enterica serovar Typhi Ty2
auuaaaagaccccauuu

SEQ ID NO: 1784085 - RNA, 22 nt, Salmonella enterica enterica serovar Typhi Ty2
auuaaauaaauaguaaauagaa

SEQ ID NO: 1784086 - RNA, 12 nt, Salmonella enterica enterica serovar Typhi Ty2
auuaaagccacg

SEQ ID NO: 1784087 - RNA, 16 nt, Salmonella enterica enterica serovar Typhi Ty2
auuaaacuuucaugaa

SEQ ID NO: 1784088 - RNA, 20 nt, Salmonella enterica enterica serovar Typhi Ty2
auuaaagauuagcguuuuua

SEQ ID NO: 1784089 - RNA, 21 nt, Salmonella enterica enterica serovar Typhi Ty2
auuaaagauuagcguuuuuau

SEQ ID NO: 1784090 - RNA, 20 nt, Salmonella enterica enterica serovar Typhi Ty2
auguuucgacaguuucuucu

SEQ ID NO: 1784091 - RNA, 20 nt, Salmonella enterica enterica serovar Typhi Ty2
auguuuguaggcuuccagaa

SEQ ID NO: 1784092 - RNA, 16 nt, Salmonella enterica enterica serovar Typhi Ty2
auguuuugucguucac

SEQ ID NO: 1784093 - RNA, 16 nt, Salmonella enterica enterica serovar Typhi Ty2
auguuugccacgccaa

SEQ ID NO: 1784094 - RNA, 15 nt, Salmonella enterica enterica serovar Typhi Ty2
auguuugcugauaag

SEQ ID NO: 1784095 - RNA, 22 nt, Salmonella enterica enterica serovar Typhi Ty2
auguuggauuauacauucgcuc

SEQ ID NO: 1784096 - RNA, 17 nt, Salmonella enterica enterica serovar Typhi Ty2
auguuggauuauacauu

SEQ ID NO: 1784097 - RNA, 13 nt, Salmonella enterica enterica serovar Typhi Ty2
auguugguuauag

SEQ ID NO: 1784098 - RNA, 17 nt, Salmonella enterica enterica serovar Typhi Ty2
auguuguuccagagugc

SEQ ID NO: 1784099 - RNA, 15 nt, Salmonella enterica enterica serovar Typhi Ty2
auguuguuccagagu

SEQ ID NO: 1784100 - RNA, 14 nt, Salmonella enterica enterica serovar Typhi Ty2
auguuguuugaaaa

SEQ ID NO: 1784101 - RNA, 13 nt, Salmonella enterica enterica serovar Typhi Ty2
auguugcugcauc

SEQ ID NO: 1784102 - RNA, 14 nt, Salmonella enterica enterica serovar Typhi Ty2
auguugcugcugcg

SEQ ID NO: 1784103 - RNA, 19 nt, Salmonella enterica enterica serovar Typhi Ty2
auguucaugaaccacgcca

SEQ ID NO: 1784104 - RNA, 13 nt, Salmonella enterica enterica serovar Typhi Ty2
auguuccacaauc

SEQ ID NO: 1784105 - RNA, 22 nt, Salmonella enterica enterica serovar Typhi Ty2
auguucaacgucagcuggaaug

SEQ ID NO: 1784106 - RNA, 20 nt, Salmonella enterica enterica serovar Typhi Ty2
auuaguucaaguuuagaaaa

SEQ ID NO: 1784107 - RNA, 14 nt, Salmonella enterica enterica serovar Typhi Ty2
auuagucagcaaca

SEQ ID NO: 1784108 - RNA, 15 nt, Salmonella enterica enterica serovar Typhi Ty2
auuagggugcaguga

SEQ ID NO: 1784109 - RNA, 13 nt, Salmonella enterica enterica serovar Typhi Ty2
auuaguaauauca

SEQ ID NO: 1784110 - RNA, 13 nt, Salmonella enterica enterica serovar Typhi Ty2
auuagcuuuuuac

SEQ ID NO: 1784111 - RNA, 16 nt, Salmonella enterica enterica serovar Typhi Ty2
auuauacauucgcuca

SEQ ID NO: 1784112 - RNA, 17 nt, Salmonella enterica enterica serovar Typhi Ty2
auuauauuuaaaauucc

SEQ ID NO: 1784113 - RNA, 15 nt, Salmonella enterica enterica serovar Typhi Ty2
auuauauuuaaaauu

SEQ ID NO: 1784114 - RNA, 18 nt, Salmonella enterica enterica serovar Typhi Ty2
auuauauagacuccguca

SEQ ID NO: 1784115 - RNA, 16 nt, Salmonella enterica enterica serovar Typhi Ty2
auuauauagucuuaau

SEQ ID NO: 1784116 - RNA, 16 nt, Salmonella enterica enterica serovar Typhi Ty2
auuacuuauauuuauu

SEQ ID NO: 1784117 - RNA, 15 nt, Salmonella enterica enterica serovar Typhi Ty2
auuacuucaggcugc

SEQ ID NO: 1784118 - RNA, 20 nt, Salmonella enterica enterica serovar Typhi Ty2
auuacugcgugcuggcggcc

SEQ ID NO: 1784119 - RNA, 12 nt, Salmonella enterica enterica serovar Typhi Ty2
auuacugauaaa

SEQ ID NO: 1784120 - RNA, 13 nt, Salmonella enterica enterica serovar Typhi Ty2
auuacugauaaag

SEQ ID NO: 1784121 - RNA, 14 nt, Salmonella enterica enterica serovar Typhi Ty2
auuacucuuuaugc

SEQ ID NO: 1784122 - RNA, 20 nt, Salmonella enterica enterica serovar Typhi Ty2
auuagaaacccauauuccug

SEQ ID NO: 1784123 - RNA, 14 nt, Salmonella enterica enterica serovar Typhi Ty2
auuagaaacccaua

SEQ ID NO: 1784124 - RNA, 15 nt, Salmonella enterica enterica serovar Typhi Ty2
auuacuuuccagcaa

SEQ ID NO: 1784125 - RNA, 21 nt, Salmonella enterica enterica serovar Typhi Ty2
auuagaggucagaauaacuca

SEQ ID NO: 1784126 - RNA, 16 nt, Salmonella enterica enterica serovar Typhi Ty2
auuagaggucagaaua

SEQ ID NO: 1784127 - RNA, 18 nt, Salmonella enterica enterica serovar Typhi Ty2
auuagaggcguaaguaaa

SEQ ID NO: 1784128 - RNA, 19 nt, Salmonella enterica enterica serovar Typhi Ty2
auuagcauccagcacgagc

SEQ ID NO: 1784129 - RNA, 21 nt, Salmonella enterica enterica serovar Typhi Ty2
auuagcaauugccauaaaaac

SEQ ID NO: 1784130 - RNA, 22 nt, Salmonella enterica enterica serovar Typhi Ty2
auuagcgacgcauacucuugga

SEQ ID NO: 1784131 - RNA, 18 nt, Salmonella enterica enterica serovar Typhi Ty2
auuacgacccacaaugag

SEQ ID NO: 1784132 - RNA, 22 nt, Salmonella enterica enterica serovar Typhi Ty2
auuacgacugcacccaucuuua

SEQ ID NO: 1784133 - RNA, 18 nt, Salmonella enterica enterica serovar Typhi Ty2
auuacgaaaaggucuuuc

SEQ ID NO: 1784134 - RNA, 16 nt, Salmonella enterica enterica serovar Typhi Ty2
auuaccugguauuauu

SEQ ID NO: 1784135 - RNA, 15 nt, Salmonella enterica enterica serovar Typhi Ty2
auuaccggacggucg

SEQ ID NO: 1784136 - RNA, 17 nt, Salmonella enterica enterica serovar Typhi Ty2
auuacguuuucccugag

SEQ ID NO: 1784137 - RNA, 22 nt, Salmonella enterica enterica serovar Typhi Ty2
auuacguguaguuauaaauuua

SEQ ID NO: 1784138 - RNA, 21 nt, Salmonella enterica enterica serovar Typhi Ty2
auuacuaucuucaaagccaca

SEQ ID NO: 1784139 - RNA, 16 nt, Salmonella enterica enterica serovar Typhi Ty2
auuacgcuauaaaguu

SEQ ID NO: 1784140 - RNA, 17 nt, Salmonella enterica enterica serovar Typhi Ty2
auuaauuuacugauaaa

SEQ ID NO: 1784141 - RNA, 15 nt, Salmonella enterica enterica serovar Typhi Ty2
auuaauuuucacgcu

SEQ ID NO: 1784142 - RNA, 21 nt, Salmonella enterica enterica serovar Typhi Ty2
auuaauucuuuuaacauaagu

SEQ ID NO: 1784143 - RNA, 19 nt, Salmonella enterica enterica serovar Typhi Ty2
auuaauucuuuuaacauaa

SEQ ID NO: 1784144 - RNA, 20 nt, Salmonella enterica enterica serovar Typhi Ty2
auuacagguguuaaucauuu

SEQ ID NO: 1784145 - RNA, 18 nt, Salmonella enterica enterica serovar Typhi Ty2
auuacagccgcgaugcua

SEQ ID NO: 1784146 - RNA, 16 nt, Salmonella enterica enterica serovar Typhi Ty2
auuacagcguguucau

SEQ ID NO: 1784147 - RNA, 18 nt, Salmonella enterica enterica serovar Typhi Ty2
auuacaucaauaaacauu

SEQ ID NO: 1784148 - RNA, 23 nt, Salmonella enterica enterica serovar Typhi Ty2
auuacaacguucggucauggaua

SEQ ID NO: 1784149 - RNA, 13 nt, Salmonella enterica enterica serovar Typhi Ty2
auuacaagaaagu

SEQ ID NO: 1784150 - RNA, 14 nt, Salmonella enterica enterica serovar Typhi Ty2
auuacaacaugucc

SEQ ID NO: 1784151 - RNA, 16 nt, Salmonella enterica enterica serovar Typhi Ty2
auuacaaguaauaaaa

SEQ ID NO: 1784152 - RNA, 21 nt, Salmonella enterica enterica serovar Typhi Ty2
auuacaaacaggcuuuauaca

SEQ ID NO: 1784153 - RNA, 16 nt, Salmonella enterica enterica serovar Typhi Ty2
auuacaaaaugugcaa

SEQ ID NO: 1784154 - RNA, 20 nt, Salmonella enterica enterica serovar Typhi Ty2
auuacaaaauaagucauauc

SEQ ID NO: 1784155 - RNA, 17 nt, Salmonella enterica enterica serovar Typhi Ty2
auucagauccgaggcgu

SEQ ID NO: 1784156 - RNA, 13 nt, Salmonella enterica enterica serovar Typhi Ty2
auucagagcgucc

SEQ ID NO: 1784157 - RNA, 23 nt, Salmonella enterica enterica serovar Typhi Ty2
auucagaccccugugauuuaugu

SEQ ID NO: 1784158 - RNA, 19 nt, Salmonella enterica enterica serovar Typhi Ty2
auucacuuuccgaaucagg

SEQ ID NO: 1784159 - RNA, 21 nt, Salmonella enterica enterica serovar Typhi Ty2
auucacuuucgacgacaacgc

SEQ ID NO: 1784160 - RNA, 14 nt, Salmonella enterica enterica serovar Typhi Ty2
auucaccaaauccu

SEQ ID NO: 1784161 - RNA, 22 nt, Salmonella enterica enterica serovar Typhi Ty2
auucacacgcucacccaguuuu

SEQ ID NO: 1784162 - RNA, 18 nt, Salmonella enterica enterica serovar Typhi Ty2
auucacaccuuuauauuu

SEQ ID NO: 1784163 - RNA, 18 nt, Salmonella enterica enterica serovar Typhi Ty2
auucacauauauuucugu

SEQ ID NO: 1784164 - RNA, 19 nt, Salmonella enterica enterica serovar Typhi Ty2
auucaccuggauuccucca

SEQ ID NO: 1784165 - RNA, 19 nt, Salmonella enterica enterica serovar Typhi Ty2
auucacccaauaaauaaua

SEQ ID NO: 1784166 - RNA, 15 nt, Salmonella enterica enterica serovar Typhi Ty2
auucaacgcaucaaa

SEQ ID NO: 1784167 - RNA, 22 nt, Salmonella enterica enterica serovar Typhi Ty2
auucaacagggguuccggcaau

SEQ ID NO: 1784168 - RNA, 23 nt, Salmonella enterica enterica serovar Typhi Ty2
auucaaccagccgaucagcgcca

SEQ ID NO: 1784169 - RNA, 22 nt, Salmonella enterica enterica serovar Typhi Ty2
auucaaccagccgaucagcgcc

SEQ ID NO: 1784170 - RNA, 19 nt, Salmonella enterica enterica serovar Typhi Ty2
auucaacacauuccauuuu

SEQ ID NO: 1784171 - RNA, 22 nt, Salmonella enterica enterica serovar Typhi Ty2
auucaacacauuccauuuuucg

SEQ ID NO: 1784172 - RNA, 23 nt, Salmonella enterica enterica serovar Typhi Ty2
auucaagcaacuguagaaugcua

SEQ ID NO: 1784173 - RNA, 11 nt, Salmonella enterica enterica serovar Typhi Ty2
auucaaucacu

SEQ ID NO: 1784174 - RNA, 17 nt, Salmonella enterica enterica serovar Typhi Ty2
auucaaucuggugacga

SEQ ID NO: 1784175 - RNA, 17 nt, Salmonella enterica enterica serovar Typhi Ty2
auuauuuuuaaauaacu

SEQ ID NO: 1784176 - RNA, 14 nt, Salmonella enterica enterica serovar Typhi Ty2
auuauuuuuaaaua

SEQ ID NO: 1784177 - RNA, 19 nt, Salmonella enterica enterica serovar Typhi Ty2
auuauuuuagugaaaaaau

SEQ ID NO: 1784178 - RNA, 17 nt, Salmonella enterica enterica serovar Typhi Ty2
auuauuuucuaaaaucu

SEQ ID NO: 1784179 - RNA, 18 nt, Salmonella enterica enterica serovar Typhi Ty2
auuauuuuuaaauaacuu

SEQ ID NO: 1784180 - RNA, 19 nt, Salmonella enterica enterica serovar Typhi Ty2
auuaugccgcacuccccag

SEQ ID NO: 1784181 - RNA, 16 nt, Salmonella enterica enterica serovar Typhi Ty2
auuaugcuggccugca

SEQ ID NO: 1784182 - RNA, 18 nt, Salmonella enterica enterica serovar Typhi Ty2
auuaugcgaaugcuggcu

SEQ ID NO: 1784183 - RNA, 13 nt, Salmonella enterica enterica serovar Typhi Ty2
auuauuacaauaa

SEQ ID NO: 1784184 - RNA, 16 nt, Salmonella enterica enterica serovar Typhi Ty2
auuauucaggccuccu

SEQ ID NO: 1784185 - RNA, 12 nt, Salmonella enterica enterica serovar Typhi Ty2
auuauuccccuc

SEQ ID NO: 1784186 - RNA, 14 nt, Salmonella enterica enterica serovar Typhi Ty2
auuauucugaauuc

SEQ ID NO: 1784187 - RNA, 13 nt, Salmonella enterica enterica serovar Typhi Ty2
auuauucugcuga

SEQ ID NO: 1784188 - RNA, 14 nt, Salmonella enterica enterica serovar Typhi Ty2
auuauugacauuca

SEQ ID NO: 1784189 - RNA, 22 nt, Salmonella enterica enterica serovar Typhi Ty2
auuauugcguugcuuuauaaaa

SEQ ID NO: 1784190 - RNA, 21 nt, Salmonella enterica enterica serovar Typhi Ty2
auuauuggcuuuguaaauauu

SEQ ID NO: 1784191 - RNA, 14 nt, Salmonella enterica enterica serovar Typhi Ty2
auuauugcacauaa

SEQ ID NO: 1784192 - RNA, 18 nt, Salmonella enterica enterica serovar Typhi Ty2
auuaucuuuauugaaaag

SEQ ID NO: 1784193 - RNA, 17 nt, Salmonella enterica enterica serovar Typhi Ty2
auuaucguuuacguuau

SEQ ID NO: 1784194 - RNA, 23 nt, Salmonella enterica enterica serovar Typhi Ty2
auuaucugccagccgauuuuucg

SEQ ID NO: 1784195 - RNA, 12 nt, Salmonella enterica enterica serovar Typhi Ty2
auuaucaccauu

SEQ ID NO: 1784196 - RNA, 14 nt, Salmonella enterica enterica serovar Typhi Ty2
auuaucaaaaguga

SEQ ID NO: 1784197 - RNA, 13 nt, Salmonella enterica enterica serovar Typhi Ty2
auuaucaggauga

SEQ ID NO: 1784198 - RNA, 16 nt, Salmonella enterica enterica serovar Typhi Ty2
auuaucgaacugaaau

SEQ ID NO: 1784199 - RNA, 12 nt, Salmonella enterica enterica serovar Typhi Ty2
auauaaaaauag

SEQ ID NO: 1784200 - RNA, 19 nt, Salmonella enterica enterica serovar Typhi Ty2
auauaaaaaacauauaauu

SEQ ID NO: 1784201 - RNA, 23 nt, Salmonella enterica enterica serovar Typhi Ty2
auauaauuuuauuauauuuaaaa

SEQ ID NO: 1784202 - RNA, 15 nt, Salmonella enterica enterica serovar Typhi Ty2
auaguuuuuccccau

SEQ ID NO: 1784203 - RNA, 17 nt, Salmonella enterica enterica serovar Typhi Ty2
auauaaaaaacauauaa

SEQ ID NO: 1784204 - RNA, 15 nt, Salmonella enterica enterica serovar Typhi Ty2
auaguuugccagaga

SEQ ID NO: 1784205 - RNA, 16 nt, Salmonella enterica enterica serovar Typhi Ty2
auaguuuuuaauucca

SEQ ID NO: 1784206 - RNA, 21 nt, Salmonella enterica enterica serovar Typhi Ty2
auagugcgugacaaucuccuc

SEQ ID NO: 1784207 - RNA, 18 nt, Salmonella enterica enterica serovar Typhi Ty2
auagugagcgacuucaaa

SEQ ID NO: 1784208 - RNA, 15 nt, Salmonella enterica enterica serovar Typhi Ty2
auaggcaauauccuc

SEQ ID NO: 1784209 - RNA, 12 nt, Salmonella enterica enterica serovar Typhi Ty2
auaggccaggcu

SEQ ID NO: 1784210 - RNA, 14 nt, Salmonella enterica enterica serovar Typhi Ty2
auaggcgaggaaaa

SEQ ID NO: 1784211 - RNA, 21 nt, Salmonella enterica enterica serovar Typhi Ty2
auagguucaauaugccaggca

SEQ ID NO: 1784212 - RNA, 14 nt, Salmonella enterica enterica serovar Typhi Ty2
auagguacggggca

SEQ ID NO: 1784213 - RNA, 15 nt, Salmonella enterica enterica serovar Typhi Ty2
auaggucguuccuca

SEQ ID NO: 1784214 - RNA, 18 nt, Salmonella enterica enterica serovar Typhi Ty2
auaguaaauagaaaauaa

SEQ ID NO: 1784215 - RNA, 17 nt, Salmonella enterica enterica serovar Typhi Ty2
auaguaacguaugcugg

SEQ ID NO: 1784216 - RNA, 23 nt, Salmonella enterica enterica serovar Typhi Ty2
auaguacccucugcaccagaacu

SEQ ID NO: 1784217 - RNA, 18 nt, Salmonella enterica enterica serovar Typhi Ty2
auaguacccucugcacca

SEQ ID NO: 1784218 - RNA, 22 nt, Salmonella enterica enterica serovar Typhi Ty2
auaguacgauagcaauuaauaa

SEQ ID NO: 1784219 - RNA, 22 nt, Salmonella enterica enterica serovar Typhi Ty2
auauacuucaccauaaaucauu

SEQ ID NO: 1784220 - RNA, 12 nt, Salmonella enterica enterica serovar Typhi Ty2
auauacugucuu

SEQ ID NO: 1784221 - RNA, 12 nt, Salmonella enterica enterica serovar Typhi Ty2
auauagacuccg

SEQ ID NO: 1784222 - RNA, 12 nt, Salmonella enterica enterica serovar Typhi Ty2
auauauuuuccg

SEQ ID NO: 1784223 - RNA, 21 nt, Salmonella enterica enterica serovar Typhi Ty2
auauauuucacuucaucauca

SEQ ID NO: 1784224 - RNA, 18 nt, Salmonella enterica enterica serovar Typhi Ty2
auauauuacgacugcacc

SEQ ID NO: 1784225 - RNA, 14 nt, Salmonella enterica enterica serovar Typhi Ty2
auaucagucugcaa

SEQ ID NO: 1784226 - RNA, 19 nt, Salmonella enterica enterica serovar Typhi Ty2
auaucaggcaaaaaucguc

SEQ ID NO: 1784227 - RNA, 15 nt, Salmonella enterica enterica serovar Typhi Ty2
auaucacgcgcgcga

SEQ ID NO: 1784228 - RNA, 18 nt, Salmonella enterica enterica serovar Typhi Ty2
auaucaccaucuuuuugc

SEQ ID NO: 1784229 - RNA, 12 nt, Salmonella enterica enterica serovar Typhi Ty2
auaucaacgacc

SEQ ID NO: 1784230 - RNA, 13 nt, Salmonella enterica enterica serovar Typhi Ty2
auaucaaucaccu

SEQ ID NO: 1784231 - RNA, 14 nt, Salmonella enterica enterica serovar Typhi Ty2
auaucaauucaaca

SEQ ID NO: 1784232 - RNA, 13 nt, Salmonella enterica enterica serovar Typhi Ty2
auaucgauaaaga

SEQ ID NO: 1784233 - RNA, 18 nt, Salmonella enterica enterica serovar Typhi Ty2
auaucgacggucaggcug

SEQ ID NO: 1784234 - RNA, 15 nt, Salmonella enterica enterica serovar Typhi Ty2
auaucgccugcggca

SEQ ID NO: 1784235 - RNA, 22 nt, Salmonella enterica enterica serovar Typhi Ty2
auaucgacauaaguaaauaaca

SEQ ID NO: 1784236 - RNA, 21 nt, Salmonella enterica enterica serovar Typhi Ty2
auauccaccagcccaucuuuc

SEQ ID NO: 1784237 - RNA, 22 nt, Salmonella enterica enterica serovar Typhi Ty2
auaucuuccaggcuauccaaca

SEQ ID NO: 1784238 - RNA, 18 nt, Salmonella enterica enterica serovar Typhi Ty2
auagcuguuccgcaacac

SEQ ID NO: 1784239 - RNA, 21 nt, Salmonella enterica enterica serovar Typhi Ty2
auagcgggcuuccuucuaccg

SEQ ID NO: 1784240 - RNA, 14 nt, Salmonella enterica enterica serovar Typhi Ty2
auagcuaaauaaaa

SEQ ID NO: 1784241 - RNA, 16 nt, Salmonella enterica enterica serovar Typhi Ty2
auagcuaaauaaaaau

SEQ ID NO: 1784242 - RNA, 16 nt, Salmonella enterica enterica serovar Typhi Ty2
auagcccuauucguga

SEQ ID NO: 1784243 - RNA, 18 nt, Salmonella enterica enterica serovar Typhi Ty2
auagcgcgucguugccuu

SEQ ID NO: 1784244 - RNA, 15 nt, Salmonella enterica enterica serovar Typhi Ty2
auagccgaaacuuau

SEQ ID NO: 1784245 - RNA, 14 nt, Salmonella enterica enterica serovar Typhi Ty2
auagcgcggaauau

SEQ ID NO: 1784246 - RNA, 23 nt, Salmonella enterica enterica serovar Typhi Ty2
auagcgcuaugcgcuccaggaug

SEQ ID NO: 1784247 - RNA, 16 nt, Salmonella enterica enterica serovar Typhi Ty2
auagcgcugaugcguu

SEQ ID NO: 1784248 - RNA, 15 nt, Salmonella enterica enterica serovar Typhi Ty2
auagcgcuuuccugc

SEQ ID NO: 1784249 - RNA, 21 nt, Salmonella enterica enterica serovar Typhi Ty2
auagcggcguuuauauaaaaa

SEQ ID NO: 1784250 - RNA, 13 nt, Salmonella enterica enterica serovar Typhi Ty2
auagccauuuaau

SEQ ID NO: 1784251 - RNA, 11 nt, Salmonella enterica enterica serovar Typhi Ty2
auagccaggca

SEQ ID NO: 1784252 - RNA, 19 nt, Salmonella enterica enterica serovar Typhi Ty2
auagccaguaauauaacca

SEQ ID NO: 1784253 - RNA, 22 nt, Salmonella enterica enterica serovar Typhi Ty2
auagccagccccagaaaauuaa

SEQ ID NO: 1784254 - RNA, 15 nt, Salmonella enterica enterica serovar Typhi Ty2
auagcagcaaauuua

SEQ ID NO: 1784255 - RNA, 16 nt, Salmonella enterica enterica serovar Typhi Ty2
auagcaggagauauag

SEQ ID NO: 1784256 - RNA, 14 nt, Salmonella enterica enterica serovar Typhi Ty2
auagagaaaucaac

SEQ ID NO: 1784257 - RNA, 15 nt, Salmonella enterica enterica serovar Typhi Ty2
auagaguaauacauc

SEQ ID NO: 1784258 - RNA, 19 nt, Salmonella enterica enterica serovar Typhi Ty2
auagcaaucauccugauuu

SEQ ID NO: 1784259 - RNA, 13 nt, Salmonella enterica enterica serovar Typhi Ty2
auagcaauuucag

SEQ ID NO: 1784260 - RNA, 13 nt, Salmonella enterica enterica serovar Typhi Ty2
auagcaauuaaua

SEQ ID NO: 1784261 - RNA, 14 nt, Salmonella enterica enterica serovar Typhi Ty2
auagcacacaaacg

SEQ ID NO: 1784262 - RNA, 15 nt, Salmonella enterica enterica serovar Typhi Ty2
auagaugauaaucau

SEQ ID NO: 1784263 - RNA, 15 nt, Salmonella enterica enterica serovar Typhi Ty2
auaccggcaucacgc

SEQ ID NO: 1784264 - RNA, 13 nt, Salmonella enterica enterica serovar Typhi Ty2
auaccucauuuca

SEQ ID NO: 1784265 - RNA, 13 nt, Salmonella enterica enterica serovar Typhi Ty2
auaccguaaauuu

SEQ ID NO: 1784266 - RNA, 16 nt, Salmonella enterica enterica serovar Typhi Ty2
auaccgguuauccaua

SEQ ID NO: 1784267 - RNA, 13 nt, Salmonella enterica enterica serovar Typhi Ty2
auacggggacaga

SEQ ID NO: 1784268 - RNA, 23 nt, Salmonella enterica enterica serovar Typhi Ty2
auacgggagagcguauccagcac

SEQ ID NO: 1784269 - RNA, 16 nt, Salmonella enterica enterica serovar Typhi Ty2
auacggcuuccacugc

SEQ ID NO: 1784270 - RNA, 22 nt, Salmonella enterica enterica serovar Typhi Ty2
auacggagaacggcacaauagc

SEQ ID NO: 1784271 - RNA, 15 nt, Salmonella enterica enterica serovar Typhi Ty2
auacgguaauaacuc

SEQ ID NO: 1784272 - RNA, 17 nt, Salmonella enterica enterica serovar Typhi Ty2
auacgguaaaucauuug

SEQ ID NO: 1784273 - RNA, 20 nt, Salmonella enterica enterica serovar Typhi Ty2
auacgucauaucauccagcc

SEQ ID NO: 1784274 - RNA, 13 nt, Salmonella enterica enterica serovar Typhi Ty2
auacgccagcaga

SEQ ID NO: 1784275 - RNA, 15 nt, Salmonella enterica enterica serovar Typhi Ty2
auacgaucgcgcaca

SEQ ID NO: 1784276 - RNA, 20 nt, Salmonella enterica enterica serovar Typhi Ty2
auaccuucuucacuaaaaac

SEQ ID NO: 1784277 - RNA, 21 nt, Salmonella enterica enterica serovar Typhi Ty2
auaccuucccgcgauaaaaac

SEQ ID NO: 1784278 - RNA, 21 nt, Salmonella enterica enterica serovar Typhi Ty2
auaccuuuaaccucuuuuuca

SEQ ID NO: 1784279 - RNA, 12 nt, Salmonella enterica enterica serovar Typhi Ty2
auacucaucaua

SEQ ID NO: 1784280 - RNA, 16 nt, Salmonella enterica enterica serovar Typhi Ty2
auacucaauauccugc

SEQ ID NO: 1784281 - RNA, 13 nt, Salmonella enterica enterica serovar Typhi Ty2
auacuccagcaga

SEQ ID NO: 1784282 - RNA, 18 nt, Salmonella enterica enterica serovar Typhi Ty2
auacucacgaauaagaau

SEQ ID NO: 1784283 - RNA, 22 nt, Salmonella enterica enterica serovar Typhi Ty2
auacgucgugacccacacauag

SEQ ID NO: 1784284 - RNA, 13 nt, Salmonella enterica enterica serovar Typhi Ty2
auacugucuugug

SEQ ID NO: 1784285 - RNA, 22 nt, Salmonella enterica enterica serovar Typhi Ty2
auacuggccgguuuuaaaaaua

SEQ ID NO: 1784286 - RNA, 17 nt, Salmonella enterica enterica serovar Typhi Ty2
auacuguacgcccagcc

SEQ ID NO: 1784287 - RNA, 21 nt, Salmonella enterica enterica serovar Typhi Ty2
auacugaccaacaacagauau

SEQ ID NO: 1784288 - RNA, 12 nt, Salmonella enterica enterica serovar Typhi Ty2
auacugaccaac

SEQ ID NO: 1784289 - RNA, 21 nt, Salmonella enterica enterica serovar Typhi Ty2
auacugaaccacggagagaca

SEQ ID NO: 1784290 - RNA, 12 nt, Salmonella enterica enterica serovar Typhi Ty2
auacucuucacg

SEQ ID NO: 1784291 - RNA, 11 nt, Salmonella enterica enterica serovar Typhi Ty2
auacugcaacg

SEQ ID NO: 1784292 - RNA, 20 nt, Salmonella enterica enterica serovar Typhi Ty2
auauuugugaccaacaucau

SEQ ID NO: 1784293 - RNA, 19 nt, Salmonella enterica enterica serovar Typhi Ty2
auauuugcgugucaucaaa

SEQ ID NO: 1784294 - RNA, 21 nt, Salmonella enterica enterica serovar Typhi Ty2
auauuuuauggaggauauaaa

SEQ ID NO: 1784295 - RNA, 11 nt, Salmonella enterica enterica serovar Typhi Ty2
auauuuuaugg

SEQ ID NO: 1784296 - RNA, 21 nt, Salmonella enterica enterica serovar Typhi Ty2
auauugccgaccgccagcaga

SEQ ID NO: 1784297 - RNA, 20 nt, Salmonella enterica enterica serovar Typhi Ty2
auauugccauaaauacaauu

SEQ ID NO: 1784298 - RNA, 20 nt, Salmonella enterica enterica serovar Typhi Ty2
auauugcauuuuaucuuuug

SEQ ID NO: 1784299 - RNA, 19 nt, Salmonella enterica enterica serovar Typhi Ty2
auauugcgacaacuagaau

SEQ ID NO: 1784300 - RNA, 15 nt, Salmonella enterica enterica serovar Typhi Ty2
auauugcgccgcagc

SEQ ID NO: 1784301 - RNA, 11 nt, Salmonella enterica enterica serovar Typhi Ty2
auauuguugaa

SEQ ID NO: 1784302 - RNA, 15 nt, Salmonella enterica enterica serovar Typhi Ty2
auauuguugaaauua

SEQ ID NO: 1784303 - RNA, 21 nt, Salmonella enterica enterica serovar Typhi Ty2
auauuguuuucuauuuucucc

SEQ ID NO: 1784304 - RNA, 23 nt, Salmonella enterica enterica serovar Typhi Ty2
auauuguguuuuuuaauauauuc

SEQ ID NO: 1784305 - RNA, 16 nt, Salmonella enterica enterica serovar Typhi Ty2
auauugucgcccugca

SEQ ID NO: 1784306 - RNA, 23 nt, Salmonella enterica enterica serovar Typhi Ty2
auauugugccucuuuuuucgcca

SEQ ID NO: 1784307 - RNA, 21 nt, Salmonella enterica enterica serovar Typhi Ty2
auauuuuguuuuaaauucaac

SEQ ID NO: 1784308 - RNA, 19 nt, Salmonella enterica enterica serovar Typhi Ty2
auauuuuguuuuaaauuca

SEQ ID NO: 1784309 - RNA, 11 nt, Salmonella enterica enterica serovar Typhi Ty2
auauuuugcug

SEQ ID NO: 1784310 - RNA, 16 nt, Salmonella enterica enterica serovar Typhi Ty2
aucaaaaaaaaccaga

SEQ ID NO: 1784311 - RNA, 12 nt, Salmonella enterica enterica serovar Typhi Ty2
auauugcauuuu

SEQ ID NO: 1784312 - RNA, 20 nt, Salmonella enterica enterica serovar Typhi Ty2
auauucuguuagcgcccucu

SEQ ID NO: 1784313 - RNA, 21 nt, Salmonella enterica enterica serovar Typhi Ty2
auauucugggcuuacuuucca

SEQ ID NO: 1784314 - RNA, 19 nt, Salmonella enterica enterica serovar Typhi Ty2
auauuauucugcugaaaaa

SEQ ID NO: 1784315 - RNA, 12 nt, Salmonella enterica enterica serovar Typhi Ty2
auaugaugcagg

SEQ ID NO: 1784316 - RNA, 21 nt, Salmonella enterica enterica serovar Typhi Ty2
auaugaucgaaaaugcgcaug

SEQ ID NO: 1784317 - RNA, 19 nt, Salmonella enterica enterica serovar Typhi Ty2
auaugaucugcacaacauu

SEQ ID NO: 1784318 - RNA, 19 nt, Salmonella enterica enterica serovar Typhi Ty2
auaugauagaaguuaugca

SEQ ID NO: 1784319 - RNA, 14 nt, Salmonella enterica enterica serovar Typhi Ty2
auauucaccuguaa

SEQ ID NO: 1784320 - RNA, 22 nt, Salmonella enterica enterica serovar Typhi Ty2
auauucacuauaugccugccaa

SEQ ID NO: 1784321 - RNA, 22 nt, Salmonella enterica enterica serovar Typhi Ty2
auauucaacgaaugccugcaua

SEQ ID NO: 1784322 - RNA, 19 nt, Salmonella enterica enterica serovar Typhi Ty2
aucaauuucauauuauuau

SEQ ID NO: 1784323 - RNA, 18 nt, Salmonella enterica enterica serovar Typhi Ty2
aucaauuucauauuauua

SEQ ID NO: 1784324 - RNA, 19 nt, Salmonella enterica enterica serovar Typhi Ty2
aucaauugugugcacugca

SEQ ID NO: 1784325 - RNA, 13 nt, Salmonella enterica enterica serovar Typhi Ty2
aucacacauaucg

SEQ ID NO: 1784326 - RNA, 19 nt, Salmonella enterica enterica serovar Typhi Ty2
aucacacauaucgccagcc

SEQ ID NO: 1784327 - RNA, 15 nt, Salmonella enterica enterica serovar Typhi Ty2
aucacagacagaugc

SEQ ID NO: 1784328 - RNA, 14 nt, Salmonella enterica enterica serovar Typhi Ty2
aucaauagauuauu

SEQ ID NO: 1784329 - RNA, 14 nt, Salmonella enterica enterica serovar Typhi Ty2
aucaauaaaauuau

SEQ ID NO: 1784330 - RNA, 21 nt, Salmonella enterica enterica serovar Typhi Ty2
aucaaugcccagcgcaaucac

SEQ ID NO: 1784331 - RNA, 15 nt, Salmonella enterica enterica serovar Typhi Ty2
aucaaucugcuuuuu

SEQ ID NO: 1784332 - RNA, 21 nt, Salmonella enterica enterica serovar Typhi Ty2
aucaaugggauagugccugcc

SEQ ID NO: 1784333 - RNA, 16 nt, Salmonella enterica enterica serovar Typhi Ty2
aucaaccaccuucacc

SEQ ID NO: 1784334 - RNA, 14 nt, Salmonella enterica enterica serovar Typhi Ty2
aucaaccaccuuca

SEQ ID NO: 1784335 - RNA, 19 nt, Salmonella enterica enterica serovar Typhi Ty2
aucaacauuauuaaaaugu

SEQ ID NO: 1784336 - RNA, 15 nt, Salmonella enterica enterica serovar Typhi Ty2
aucaacgaaaucaga

SEQ ID NO: 1784337 - RNA, 20 nt, Salmonella enterica enterica serovar Typhi Ty2
aucaaacugaaaaucaaaua

SEQ ID NO: 1784338 - RNA, 19 nt, Salmonella enterica enterica serovar Typhi Ty2
aucaaacuuuuaaauugaa

SEQ ID NO: 1784339 - RNA, 24 nt, Salmonella enterica enterica serovar Typhi Ty2
aucaaaccgauagcuaucacacau

SEQ ID NO: 1784340 - RNA, 18 nt, Salmonella enterica enterica serovar Typhi Ty2
aucaaaccaucccagguu

SEQ ID NO: 1784341 - RNA, 19 nt, Salmonella enterica enterica serovar Typhi Ty2
aucaaacaaaccaaacuga

SEQ ID NO: 1784342 - RNA, 20 nt, Salmonella enterica enterica serovar Typhi Ty2
aucaacgccgcgccaucagg

SEQ ID NO: 1784343 - RNA, 17 nt, Salmonella enterica enterica serovar Typhi Ty2
aucaacgccuccaggcu

SEQ ID NO: 1784344 - RNA, 13 nt, Salmonella enterica enterica serovar Typhi Ty2
aucaagcccagcu

SEQ ID NO: 1784345 - RNA, 14 nt, Salmonella enterica enterica serovar Typhi Ty2
aucaaguacagcuu

SEQ ID NO: 1784346 - RNA, 20 nt, Salmonella enterica enterica serovar Typhi Ty2
aucaagcuuugcguaaaaaa

SEQ ID NO: 1784347 - RNA, 16 nt, Salmonella enterica enterica serovar Typhi Ty2
aucacuuuugauaaug

SEQ ID NO: 1784348 - RNA, 23 nt, Salmonella enterica enterica serovar Typhi Ty2
aucacuuuuuauuuguuccucuu

SEQ ID NO: 1784349 - RNA, 19 nt, Salmonella enterica enterica serovar Typhi Ty2
aucagaaaaaagccaagca

SEQ ID NO: 1784350 - RNA, 19 nt, Salmonella enterica enterica serovar Typhi Ty2
aucagaaaaaccuccggcu

SEQ ID NO: 1784351 - RNA, 14 nt, Salmonella enterica enterica serovar Typhi Ty2
aucagaaaaaauua

SEQ ID NO: 1784352 - RNA, 18 nt, Salmonella enterica enterica serovar Typhi Ty2
aucagaaaaaccuccggc

SEQ ID NO: 1784353 - RNA, 12 nt, Salmonella enterica enterica serovar Typhi Ty2
aucagaagcuuc

SEQ ID NO: 1784354 - RNA, 15 nt, Salmonella enterica enterica serovar Typhi Ty2
aucagaagaagacaa

SEQ ID NO: 1784355 - RNA, 13 nt, Salmonella enterica enterica serovar Typhi Ty2
aucacuuucaguu

SEQ ID NO: 1784356 - RNA, 17 nt, Salmonella enterica enterica serovar Typhi Ty2
aucacuuucacccaugc

SEQ ID NO: 1784357 - RNA, 20 nt, Salmonella enterica enterica serovar Typhi Ty2
aucacuuccgccaccacgcc

SEQ ID NO: 1784358 - RNA, 12 nt, Salmonella enterica enterica serovar Typhi Ty2
aucacuuccugu

SEQ ID NO: 1784359 - RNA, 10 nt, Salmonella enterica enterica serovar Typhi Ty2
aucacuucca

SEQ ID NO: 1784360 - RNA, 14 nt, Salmonella enterica enterica serovar Typhi Ty2
aucacuuccgccac

SEQ ID NO: 1784361 - RNA, 21 nt, Salmonella enterica enterica serovar Typhi Ty2
aucacuuaucaaaccagcuuu

SEQ ID NO: 1784362 - RNA, 21 nt, Salmonella enterica enterica serovar Typhi Ty2
aucacuggagcgcauuuuacu

SEQ ID NO: 1784363 - RNA, 20 nt, Salmonella enterica enterica serovar Typhi Ty2
aucacuggagcgcauuuuac

SEQ ID NO: 1784364 - RNA, 16 nt, Salmonella enterica enterica serovar Typhi Ty2
aucagacgcacaaucg

SEQ ID NO: 1784365 - RNA, 18 nt, Salmonella enterica enterica serovar Typhi Ty2
aucagaccuguaaaaaaa

SEQ ID NO: 1784366 - RNA, 23 nt, Salmonella enterica enterica serovar Typhi Ty2
aucagacguuuauaccccaccau

SEQ ID NO: 1784367 - RNA, 13 nt, Salmonella enterica enterica serovar Typhi Ty2
aucagaccgacaa

SEQ ID NO: 1784368 - RNA, 17 nt, Salmonella enterica enterica serovar Typhi Ty2
aucagaauuucgcccug

SEQ ID NO: 1784369 - RNA, 23 nt, Salmonella enterica enterica serovar Typhi Ty2
aucagaauuucgcccuguauaca

SEQ ID NO: 1784370 - RNA, 15 nt, Salmonella enterica enterica serovar Typhi Ty2
aucagauuguugccg

SEQ ID NO: 1784371 - RNA, 18 nt, Salmonella enterica enterica serovar Typhi Ty2
aucagauauuccagcgac

SEQ ID NO: 1784372 - RNA, 18 nt, Salmonella enterica enterica serovar Typhi Ty2
aucagauaucccugcaaa

SEQ ID NO: 1784373 - RNA, 19 nt, Salmonella enterica enterica serovar Typhi Ty2
aucagauacggcuccagca

SEQ ID NO: 1784374 - RNA, 18 nt, Salmonella enterica enterica serovar Typhi Ty2
aucagagacaaauacaug

SEQ ID NO: 1784375 - RNA, 14 nt, Salmonella enterica enterica serovar Typhi Ty2
aucagagacaaaua

SEQ ID NO: 1784376 - RNA, 20 nt, Salmonella enterica enterica serovar Typhi Ty2
aucagcgcgcuccagaccac

SEQ ID NO: 1784377 - RNA, 14 nt, Salmonella enterica enterica serovar Typhi Ty2
aucagcgcgcucca

SEQ ID NO: 1784378 - RNA, 15 nt, Salmonella enterica enterica serovar Typhi Ty2
aucagcgcuaccagc

SEQ ID NO: 1784379 - RNA, 17 nt, Salmonella enterica enterica serovar Typhi Ty2
aucagcgcgcuccagac

SEQ ID NO: 1784380 - RNA, 14 nt, Salmonella enterica enterica serovar Typhi Ty2
aucagcgccagccc

SEQ ID NO: 1784381 - RNA, 18 nt, Salmonella enterica enterica serovar Typhi Ty2
aucagcgccaccacaaac

SEQ ID NO: 1784382 - RNA, 17 nt, Salmonella enterica enterica serovar Typhi Ty2
aucagccauuaaccaga

SEQ ID NO: 1784383 - RNA, 13 nt, Salmonella enterica enterica serovar Typhi Ty2
aucagcccgcaaa

SEQ ID NO: 1784384 - RNA, 18 nt, Salmonella enterica enterica serovar Typhi Ty2
aucagcccgcaaaggacc

SEQ ID NO: 1784385 - RNA, 18 nt, Salmonella enterica enterica serovar Typhi Ty2
aucagccguuacuucccc

SEQ ID NO: 1784386 - RNA, 14 nt, Salmonella enterica enterica serovar Typhi Ty2
aucagcgagacagc

SEQ ID NO: 1784387 - RNA, 14 nt, Salmonella enterica enterica serovar Typhi Ty2
aucagcgccaccac

SEQ ID NO: 1784388 - RNA, 15 nt, Salmonella enterica enterica serovar Typhi Ty2
aucagcgccaccaca

SEQ ID NO: 1784389 - RNA, 21 nt, Salmonella enterica enterica serovar Typhi Ty2
aucagccagccgccaaaaaua

SEQ ID NO: 1784390 - RNA, 22 nt, Salmonella enterica enterica serovar Typhi Ty2
aucagcaucuuaugcgcaaaaa

SEQ ID NO: 1784391 - RNA, 13 nt, Salmonella enterica enterica serovar Typhi Ty2
aucagcaucccac

SEQ ID NO: 1784392 - RNA, 16 nt, Salmonella enterica enterica serovar Typhi Ty2
aucagcaggauagcga

SEQ ID NO: 1784393 - RNA, 17 nt, Salmonella enterica enterica serovar Typhi Ty2
aucagcaguugcgacug

SEQ ID NO: 1784394 - RNA, 13 nt, Salmonella enterica enterica serovar Typhi Ty2
aucagcagaucca

SEQ ID NO: 1784395 - RNA, 18 nt, Salmonella enterica enterica serovar Typhi Ty2
aucagcacauucagcagc

SEQ ID NO: 1784396 - RNA, 12 nt, Salmonella enterica enterica serovar Typhi Ty2
aucagcaaaaua

SEQ ID NO: 1784397 - RNA, 20 nt, Salmonella enterica enterica serovar Typhi Ty2
aucagcaaacgaccuuucgc

SEQ ID NO: 1784398 - RNA, 14 nt, Salmonella enterica enterica serovar Typhi Ty2
aucagcaaaugaac

SEQ ID NO: 1784399 - RNA, 18 nt, Salmonella enterica enterica serovar Typhi Ty2
aucacaucgcgcagcagg

SEQ ID NO: 1784400 - RNA, 21 nt, Salmonella enterica enterica serovar Typhi Ty2
aucacaugcgggagcaaaaua

SEQ ID NO: 1784401 - RNA, 17 nt, Salmonella enterica enterica serovar Typhi Ty2
aucacauuaugcugggu

SEQ ID NO: 1784402 - RNA, 16 nt, Salmonella enterica enterica serovar Typhi Ty2
aucacagggggaacau

SEQ ID NO: 1784403 - RNA, 21 nt, Salmonella enterica enterica serovar Typhi Ty2
aucacagggggaacauuuaag

SEQ ID NO: 1784404 - RNA, 15 nt, Salmonella enterica enterica serovar Typhi Ty2
aucaccggcauuuca

SEQ ID NO: 1784405 - RNA, 17 nt, Salmonella enterica enterica serovar Typhi Ty2
aucaccggcauuucacc

SEQ ID NO: 1784406 - RNA, 16 nt, Salmonella enterica enterica serovar Typhi Ty2
aucaccguuuuccagg

SEQ ID NO: 1784407 - RNA, 19 nt, Salmonella enterica enterica serovar Typhi Ty2
aucaccucgcuucccugac

SEQ ID NO: 1784408 - RNA, 21 nt, Salmonella enterica enterica serovar Typhi Ty2
aucaccgcggcaaccagccca

SEQ ID NO: 1784409 - RNA, 22 nt, Salmonella enterica enterica serovar Typhi Ty2
aucaccagcgcaucucccugcc

SEQ ID NO: 1784410 - RNA, 20 nt, Salmonella enterica enterica serovar Typhi Ty2
aucacguuggggaauaaaua

SEQ ID NO: 1784411 - RNA, 17 nt, Salmonella enterica enterica serovar Typhi Ty2
aucacguuccuuuacuu

SEQ ID NO: 1784412 - RNA, 15 nt, Salmonella enterica enterica serovar Typhi Ty2
aucacguccugauag

SEQ ID NO: 1784413 - RNA, 14 nt, Salmonella enterica enterica serovar Typhi Ty2
aucacuaauuugcg

SEQ ID NO: 1784414 - RNA, 13 nt, Salmonella enterica enterica serovar Typhi Ty2
aucacugauauaa

SEQ ID NO: 1784415 - RNA, 17 nt, Salmonella enterica enterica serovar Typhi Ty2
aucacugauauaacccu

SEQ ID NO: 1784416 - RNA, 18 nt, Salmonella enterica enterica serovar Typhi Ty2
aucaccuucuuuggcuua

SEQ ID NO: 1784417 - RNA, 15 nt, Salmonella enterica enterica serovar Typhi Ty2
aucaccuggugcauu

SEQ ID NO: 1784418 - RNA, 15 nt, Salmonella enterica enterica serovar Typhi Ty2
aucacgguacgcauc

SEQ ID NO: 1784419 - RNA, 13 nt, Salmonella enterica enterica serovar Typhi Ty2
aucacgguaaacc

SEQ ID NO: 1784420 - RNA, 23 nt, Salmonella enterica enterica serovar Typhi Ty2
aucacgcccgcagcaauagaaua

SEQ ID NO: 1784421 - RNA, 18 nt, Salmonella enterica enterica serovar Typhi Ty2
aucacgccacgucaccau

SEQ ID NO: 1784422 - RNA, 17 nt, Salmonella enterica enterica serovar Typhi Ty2
aucacgcauaucccacu

SEQ ID NO: 1784423 - RNA, 21 nt, Salmonella enterica enterica serovar Typhi Ty2
aguuucuucggcuucaccgau

SEQ ID NO: 1784424 - RNA, 15 nt, Salmonella enterica enterica serovar Typhi Ty2
aguuugcaauccaga

SEQ ID NO: 1784425 - RNA, 14 nt, Salmonella enterica enterica serovar Typhi Ty2
aguuuccgguaaau

SEQ ID NO: 1784426 - RNA, 22 nt, Salmonella enterica enterica serovar Typhi Ty2
aguuucgacuuucauuucuuua

SEQ ID NO: 1784427 - RNA, 19 nt, Salmonella enterica enterica serovar Typhi Ty2
aguuucugcucgaccguca

SEQ ID NO: 1784428 - RNA, 16 nt, Salmonella enterica enterica serovar Typhi Ty2
aguuucucuucguuau

SEQ ID NO: 1784429 - RNA, 20 nt, Salmonella enterica enterica serovar Typhi Ty2
aguuuuaccguaaaaugcug

SEQ ID NO: 1784430 - RNA, 20 nt, Salmonella enterica enterica serovar Typhi Ty2
aguuuugcuucaugcacaaa

SEQ ID NO: 1784431 - RNA, 22 nt, Salmonella enterica enterica serovar Typhi Ty2
aguuuuuucuuacuaauaaaua

SEQ ID NO: 1784432 - RNA, 18 nt, Salmonella enterica enterica serovar Typhi Ty2
aguuuuuugaccauucca

SEQ ID NO: 1784433 - RNA, 14 nt, Salmonella enterica enterica serovar Typhi Ty2
aguucuucauuuau

SEQ ID NO: 1784434 - RNA, 18 nt, Salmonella enterica enterica serovar Typhi Ty2
aguugauucgcuaauaau

SEQ ID NO: 1784435 - RNA, 23 nt, Salmonella enterica enterica serovar Typhi Ty2
aguugcaagucaccaucaguagc

SEQ ID NO: 1784436 - RNA, 19 nt, Salmonella enterica enterica serovar Typhi Ty2
aguugcacccgaacaacaa

SEQ ID NO: 1784437 - RNA, 21 nt, Salmonella enterica enterica serovar Typhi Ty2
aguugcagauuacugagcagu

SEQ ID NO: 1784438 - RNA, 22 nt, Salmonella enterica enterica serovar Typhi Ty2
aguugcuuaccuuguucuucca

SEQ ID NO: 1784439 - RNA, 16 nt, Salmonella enterica enterica serovar Typhi Ty2
aguugcuggauucucu

SEQ ID NO: 1784440 - RNA, 17 nt, Salmonella enterica enterica serovar Typhi Ty2
aguuguucacgggaacg

SEQ ID NO: 1784441 - RNA, 14 nt, Salmonella enterica enterica serovar Typhi Ty2
aguuguuccagcag

SEQ ID NO: 1784442 - RNA, 18 nt, Salmonella enterica enterica serovar Typhi Ty2
aguuguuccgcgcugaug

SEQ ID NO: 1784443 - RNA, 19 nt, Salmonella enterica enterica serovar Typhi Ty2
aguuguuccgcgcugaugg

SEQ ID NO: 1784444 - RNA, 18 nt, Salmonella enterica enterica serovar Typhi Ty2
aguuguucuuucaccauu

SEQ ID NO: 1784445 - RNA, 15 nt, Salmonella enterica enterica serovar Typhi Ty2
aguuggcagggcuga

SEQ ID NO: 1784446 - RNA, 13 nt, Salmonella enterica enterica serovar Typhi Ty2
aguuguuucaaca

SEQ ID NO: 1784447 - RNA, 19 nt, Salmonella enterica enterica serovar Typhi Ty2
aguuacgcacgccagauaa

SEQ ID NO: 1784448 - RNA, 16 nt, Salmonella enterica enterica serovar Typhi Ty2
aguuagcuuuuuuaug

SEQ ID NO: 1784449 - RNA, 19 nt, Salmonella enterica enterica serovar Typhi Ty2
aguguuaacuuccucuuuc

SEQ ID NO: 1784450 - RNA, 21 nt, Salmonella enterica enterica serovar Typhi Ty2
aguguuggaugaaccauauca

SEQ ID NO: 1784451 - RNA, 20 nt, Salmonella enterica enterica serovar Typhi Ty2
aguguggaugucauaauugc

SEQ ID NO: 1784452 - RNA, 22 nt, Salmonella enterica enterica serovar Typhi Ty2
aguguggaaaacagcgccggca

SEQ ID NO: 1784453 - RNA, 17 nt, Salmonella enterica enterica serovar Typhi Ty2
aguguguaccagcagcg

SEQ ID NO: 1784454 - RNA, 16 nt, Salmonella enterica enterica serovar Typhi Ty2
aguguguaccagcagc

SEQ ID NO: 1784455 - RNA, 11 nt, Salmonella enterica enterica serovar Typhi Ty2
aguuccuccug

SEQ ID NO: 1784456 - RNA, 16 nt, Salmonella enterica enterica serovar Typhi Ty2
aguucccacagcuuca

SEQ ID NO: 1784457 - RNA, 24 nt, Salmonella enterica enterica serovar Typhi Ty2
aguuccugugcggaauagccuauc

SEQ ID NO: 1784458 - RNA, 14 nt, Salmonella enterica enterica serovar Typhi Ty2
aguggugggugaug

SEQ ID NO: 1784459 - RNA, 17 nt, Salmonella enterica enterica serovar Typhi Ty2
aguggugggugaugacg

SEQ ID NO: 1784460 - RNA, 15 nt, Salmonella enterica enterica serovar Typhi Ty2
agugguuccauucca

SEQ ID NO: 1784461 - RNA, 22 nt, Salmonella enterica enterica serovar Typhi Ty2
agugguucguccaucaguucuu

SEQ ID NO: 1784462 - RNA, 12 nt, Salmonella enterica enterica serovar Typhi Ty2
agugguggguga

SEQ ID NO: 1784463 - RNA, 21 nt, Salmonella enterica enterica serovar Typhi Ty2
aguguccacucgcucauuugc

SEQ ID NO: 1784464 - RNA, 17 nt, Salmonella enterica enterica serovar Typhi Ty2
agugucgccauaaauca

SEQ ID NO: 1784465 - RNA, 19 nt, Salmonella enterica enterica serovar Typhi Ty2
agugucgcccgcucaggga

SEQ ID NO: 1784466 - RNA, 22 nt, Salmonella enterica enterica serovar Typhi Ty2
aguguaaaaauuuuugaucugc

SEQ ID NO: 1784467 - RNA, 13 nt, Salmonella enterica enterica serovar Typhi Ty2
agugucaacugcg

SEQ ID NO: 1784468 - RNA, 22 nt, Salmonella enterica enterica serovar Typhi Ty2
agugacuucugcucgguaaaaa

SEQ ID NO: 1784469 - RNA, 19 nt, Salmonella enterica enterica serovar Typhi Ty2
agugacguuaucugucagc

SEQ ID NO: 1784470 - RNA, 23 nt, Salmonella enterica enterica serovar Typhi Ty2
agugacguuaucugucagccgca

SEQ ID NO: 1784471 - RNA, 20 nt, Salmonella enterica enterica serovar Typhi Ty2
agugacgguuuucacuggca

SEQ ID NO: 1784472 - RNA, 21 nt, Salmonella enterica enterica serovar Typhi Ty2
agugcagcggaugcucuuuac

SEQ ID NO: 1784473 - RNA, 18 nt, Salmonella enterica enterica serovar Typhi Ty2
agugcauguacaacuuca

SEQ ID NO: 1784474 - RNA, 15 nt, Salmonella enterica enterica serovar Typhi Ty2
agugcgcacucagaa

SEQ ID NO: 1784475 - RNA, 17 nt, Salmonella enterica enterica serovar Typhi Ty2
agugcgaaguagcugaa

SEQ ID NO: 1784476 - RNA, 14 nt, Salmonella enterica enterica serovar Typhi Ty2
agugcguuaacccg

SEQ ID NO: 1784477 - RNA, 14 nt, Salmonella enterica enterica serovar Typhi Ty2
aguggaaucagcca

SEQ ID NO: 1784478 - RNA, 20 nt, Salmonella enterica enterica serovar Typhi Ty2
agugcugaaaaucgucucuc

SEQ ID NO: 1784479 - RNA, 16 nt, Salmonella enterica enterica serovar Typhi Ty2
agucguuauccagauc

SEQ ID NO: 1784480 - RNA, 20 nt, Salmonella enterica enterica serovar Typhi Ty2
agucguuucuauuauugauc

SEQ ID NO: 1784481 - RNA, 12 nt, Salmonella enterica enterica serovar Typhi Ty2
agucgccaggca

SEQ ID NO: 1784482 - RNA, 19 nt, Salmonella enterica enterica serovar Typhi Ty2
agucgcauccaguggugaa

SEQ ID NO: 1784483 - RNA, 14 nt, Salmonella enterica enterica serovar Typhi Ty2
agucgccagaaggc

SEQ ID NO: 1784484 - RNA, 21 nt, Salmonella enterica enterica serovar Typhi Ty2
agucgccaugaguucaauaug

SEQ ID NO: 1784485 - RNA, 20 nt, Salmonella enterica enterica serovar Typhi Ty2
agucgcgcgcgccagucauc

SEQ ID NO: 1784486 - RNA, 15 nt, Salmonella enterica enterica serovar Typhi Ty2
agucguuauaauccu

SEQ ID NO: 1784487 - RNA, 22 nt, Salmonella enterica enterica serovar Typhi Ty2
aguccgcuuuucguccccuaua

SEQ ID NO: 1784488 - RNA, 18 nt, Salmonella enterica enterica serovar Typhi Ty2
aguaccgguuagcucaac

SEQ ID NO: 1784489 - RNA, 14 nt, Salmonella enterica enterica serovar Typhi Ty2
aguccggcgaaaaa

SEQ ID NO: 1784490 - RNA, 15 nt, Salmonella enterica enterica serovar Typhi Ty2
aguacccucugcacc

SEQ ID NO: 1784491 - RNA, 15 nt, Salmonella enterica enterica serovar Typhi Ty2
aguaccgaacagcca

SEQ ID NO: 1784492 - RNA, 13 nt, Salmonella enterica enterica serovar Typhi Ty2
aguacccucugca

SEQ ID NO: 1784493 - RNA, 21 nt, Salmonella enterica enterica serovar Typhi Ty2
aguaccgggcaggaaaagacu

SEQ ID NO: 1784494 - RNA, 20 nt, Salmonella enterica enterica serovar Typhi Ty2
aguccgucagaauaucuuuu

SEQ ID NO: 1784495 - RNA, 21 nt, Salmonella enterica enterica serovar Typhi Ty2
aguccguggagaguuuugccg

SEQ ID NO: 1784496 - RNA, 18 nt, Salmonella enterica enterica serovar Typhi Ty2
aguccuucaacccacuuu

SEQ ID NO: 1784497 - RNA, 17 nt, Salmonella enterica enterica serovar Typhi Ty2
aguccuucuucccccug

SEQ ID NO: 1784498 - RNA, 19 nt, Salmonella enterica enterica serovar Typhi Ty2
agucuuuuguuuuucucuu

SEQ ID NO: 1784499 - RNA, 16 nt, Salmonella enterica enterica serovar Typhi Ty2
agucuuuuguuuuucu

SEQ ID NO: 1784500 - RNA, 17 nt, Salmonella enterica enterica serovar Typhi Ty2
agucuuuuguuuuucuc

SEQ ID NO: 1784501 - RNA, 22 nt, Salmonella enterica enterica serovar Typhi Ty2
agugacaaacucacguucccca

SEQ ID NO: 1784502 - RNA, 13 nt, Salmonella enterica enterica serovar Typhi Ty2
agugacgccgcca

SEQ ID NO: 1784503 - RNA, 20 nt, Salmonella enterica enterica serovar Typhi Ty2
agugacccgccgccagcacc

SEQ ID NO: 1784504 - RNA, 20 nt, Salmonella enterica enterica serovar Typhi Ty2
agucuggccaccgauaaaaa

SEQ ID NO: 1784505 - RNA, 22 nt, Salmonella enterica enterica serovar Typhi Ty2
agucuuaauuugcuguuuuuug

SEQ ID NO: 1784506 - RNA, 17 nt, Salmonella enterica enterica serovar Typhi Ty2
agucugaccgucagccc

SEQ ID NO: 1784507 - RNA, 16 nt, Salmonella enterica enterica serovar Typhi Ty2
agucugaaaauaauug

SEQ ID NO: 1784508 - RNA, 17 nt, Salmonella enterica enterica serovar Typhi Ty2
agucugagcgcaaacau

SEQ ID NO: 1784509 - RNA, 15 nt, Salmonella enterica enterica serovar Typhi Ty2
agucuggauauaaac

SEQ ID NO: 1784510 - RNA, 18 nt, Salmonella enterica enterica serovar Typhi Ty2
agucuggauauaaaccgg

SEQ ID NO: 1784511 - RNA, 19 nt, Salmonella enterica enterica serovar Typhi Ty2
agucuggauauaaaccgga

SEQ ID NO: 1784512 - RNA, 22 nt, Salmonella enterica enterica serovar Typhi Ty2
auaaccggugccgaaaucauca

SEQ ID NO: 1784513 - RNA, 19 nt, Salmonella enterica enterica serovar Typhi Ty2
auaacguuacauuuuccau

SEQ ID NO: 1784514 - RNA, 17 nt, Salmonella enterica enterica serovar Typhi Ty2
auaacguuacauuuucc

SEQ ID NO: 1784515 - RNA, 19 nt, Salmonella enterica enterica serovar Typhi Ty2
auaaccucaaugauuuccg

SEQ ID NO: 1784516 - RNA, 23 nt, Salmonella enterica enterica serovar Typhi Ty2
auaaccucaacgucgcucagaau

SEQ ID NO: 1784517 - RNA, 22 nt, Salmonella enterica enterica serovar Typhi Ty2
auaacuauaauugcuuuuuucc

SEQ ID NO: 1784518 - RNA, 18 nt, Salmonella enterica enterica serovar Typhi Ty2
auaacucaauagcggugc

SEQ ID NO: 1784519 - RNA, 13 nt, Salmonella enterica enterica serovar Typhi Ty2
auaacguuuucag

SEQ ID NO: 1784520 - RNA, 20 nt, Salmonella enterica enterica serovar Typhi Ty2
auaacguuaccgcagcgaau

SEQ ID NO: 1784521 - RNA, 22 nt, Salmonella enterica enterica serovar Typhi Ty2
auaacuuuuuaagcucccgcca

SEQ ID NO: 1784522 - RNA, 20 nt, Salmonella enterica enterica serovar Typhi Ty2
auaacuuccuuugccuuucu

SEQ ID NO: 1784523 - RNA, 20 nt, Salmonella enterica enterica serovar Typhi Ty2
auaacuuuccugccuucuga

SEQ ID NO: 1784524 - RNA, 17 nt, Salmonella enterica enterica serovar Typhi Ty2
auaacucuuaauuauaa

SEQ ID NO: 1784525 - RNA, 12 nt, Salmonella enterica enterica serovar Typhi Ty2
auaacucuucau

SEQ ID NO: 1784526 - RNA, 19 nt, Salmonella enterica enterica serovar Typhi Ty2
auaacucgaauuguuaaaa

SEQ ID NO: 1784527 - RNA, 23 nt, Salmonella enterica enterica serovar Typhi Ty2
auaacccggauugucuuaaauau

SEQ ID NO: 1784528 - RNA, 13 nt, Salmonella enterica enterica serovar Typhi Ty2
auaacccgccugg

SEQ ID NO: 1784529 - RNA, 18 nt, Salmonella enterica enterica serovar Typhi Ty2
auaacauuucagucuaau

SEQ ID NO: 1784530 - RNA, 16 nt, Salmonella enterica enterica serovar Typhi Ty2
auaaaugaauuauuuu

SEQ ID NO: 1784531 - RNA, 16 nt, Salmonella enterica enterica serovar Typhi Ty2
auaaaaagccagggaa

SEQ ID NO: 1784532 - RNA, 15 nt, Salmonella enterica enterica serovar Typhi Ty2
auaaacacagcaaac

SEQ ID NO: 1784533 - RNA, 14 nt, Salmonella enterica enterica serovar Typhi Ty2
auaaacacagcaaa

SEQ ID NO: 1784534 - RNA, 21 nt, Salmonella enterica enterica serovar Typhi Ty2
auaaacaaaaaccugcucucg

SEQ ID NO: 1784535 - RNA, 14 nt, Salmonella enterica enterica serovar Typhi Ty2
auaaaaauagcugg

SEQ ID NO: 1784536 - RNA, 21 nt, Salmonella enterica enterica serovar Typhi Ty2
auaaacuucaauucagaaagu

SEQ ID NO: 1784537 - RNA, 19 nt, Salmonella enterica enterica serovar Typhi Ty2
auaaacuucaauucagaaa

SEQ ID NO: 1784538 - RNA, 12 nt, Salmonella enterica enterica serovar Typhi Ty2
auaaagauggca

SEQ ID NO: 1784539 - RNA, 21 nt, Salmonella enterica enterica serovar Typhi Ty2
auaaagauuggcaucugcaau

SEQ ID NO: 1784540 - RNA, 22 nt, Salmonella enterica enterica serovar Typhi Ty2
auaaagauuggcaucugcaauu

SEQ ID NO: 1784541 - RNA, 21 nt, Salmonella enterica enterica serovar Typhi Ty2
auaaacucuguguuaugaaug

SEQ ID NO: 1784542 - RNA, 21 nt, Salmonella enterica enterica serovar Typhi Ty2
auaaaucccggcgauuaauaa

SEQ ID NO: 1784543 - RNA, 23 nt, Salmonella enterica enterica serovar Typhi Ty2
auaaauauugcaacgaucccuaa

SEQ ID NO: 1784544 - RNA, 21 nt, Salmonella enterica enterica serovar Typhi Ty2
auaaauaacauuucagucuaa

SEQ ID NO: 1784545 - RNA, 18 nt, Salmonella enterica enterica serovar Typhi Ty2
auaaauauucaucaaaau

SEQ ID NO: 1784546 - RNA, 14 nt, Salmonella enterica enterica serovar Typhi Ty2
auaaauauccuccg

SEQ ID NO: 1784547 - RNA, 15 nt, Salmonella enterica enterica serovar Typhi Ty2
auaaagcuuucaucu

SEQ ID NO: 1784548 - RNA, 12 nt, Salmonella enterica enterica serovar Typhi Ty2
auaaagcagggc

SEQ ID NO: 1784549 - RNA, 17 nt, Salmonella enterica enterica serovar Typhi Ty2
auaaagcagcgacaaua

SEQ ID NO: 1784550 - RNA, 18 nt, Salmonella enterica enterica serovar Typhi Ty2
auaaagcccuguuauuca

SEQ ID NO: 1784551 - RNA, 16 nt, Salmonella enterica enterica serovar Typhi Ty2
auaaagcgaauaacau

SEQ ID NO: 1784552 - RNA, 21 nt, Salmonella enterica enterica serovar Typhi Ty2
auaaaggucacaucaucgcca

SEQ ID NO: 1784553 - RNA, 14 nt, Salmonella enterica enterica serovar Typhi Ty2
auaaaggucacauc

SEQ ID NO: 1784554 - RNA, 14 nt, Salmonella enterica enterica serovar Typhi Ty2
auaaaggggugcuu

SEQ ID NO: 1784555 - RNA, 20 nt, Salmonella enterica enterica serovar Typhi Ty2
auaaagggugcgcaaauugg

SEQ ID NO: 1784556 - RNA, 16 nt, Salmonella enterica enterica serovar Typhi Ty2
auaaaguagccaaugc

SEQ ID NO: 1784557 - RNA, 18 nt, Salmonella enterica enterica serovar Typhi Ty2
auaauauuaucauaaugu

SEQ ID NO: 1784558 - RNA, 16 nt, Salmonella enterica enterica serovar Typhi Ty2
auaauauuaucauaau

SEQ ID NO: 1784559 - RNA, 20 nt, Salmonella enterica enterica serovar Typhi Ty2
auaaucaauggccuugccag

SEQ ID NO: 1784560 - RNA, 16 nt, Salmonella enterica enterica serovar Typhi Ty2
auaauaugcucaacuu

SEQ ID NO: 1784561 - RNA, 13 nt, Salmonella enterica enterica serovar Typhi Ty2
auaauaugcucaa

SEQ ID NO: 1784562 - RNA, 15 nt, Salmonella enterica enterica serovar Typhi Ty2
auaauagaacccaaa

SEQ ID NO: 1784563 - RNA, 21 nt, Salmonella enterica enterica serovar Typhi Ty2
auaauagacaacaucccagaa

SEQ ID NO: 1784564 - RNA, 17 nt, Salmonella enterica enterica serovar Typhi Ty2
auaauagcugaaaagau

SEQ ID NO: 1784565 - RNA, 22 nt, Salmonella enterica enterica serovar Typhi Ty2
auaauaagcggccuauauuagu

SEQ ID NO: 1784566 - RNA, 21 nt, Salmonella enterica enterica serovar Typhi Ty2
auaauacaccgccauauauuu

SEQ ID NO: 1784567 - RNA, 20 nt, Salmonella enterica enterica serovar Typhi Ty2
auaauacacgguaaauucuu

SEQ ID NO: 1784568 - RNA, 20 nt, Salmonella enterica enterica serovar Typhi Ty2
auaauaauuaccacgcagcc

SEQ ID NO: 1784569 - RNA, 16 nt, Salmonella enterica enterica serovar Typhi Ty2
auaauuaagaccauac

SEQ ID NO: 1784570 - RNA, 23 nt, Salmonella enterica enterica serovar Typhi Ty2
auaauuaacauuuaagaaacaau

SEQ ID NO: 1784571 - RNA, 13 nt, Salmonella enterica enterica serovar Typhi Ty2
auaaugugcgcga

SEQ ID NO: 1784572 - RNA, 14 nt, Salmonella enterica enterica serovar Typhi Ty2
auaaugaauacaca

SEQ ID NO: 1784573 - RNA, 16 nt, Salmonella enterica enterica serovar Typhi Ty2
auaauggagaacccag

SEQ ID NO: 1784574 - RNA, 19 nt, Salmonella enterica enterica serovar Typhi Ty2
auaauggagaugaaaauaa

SEQ ID NO: 1784575 - RNA, 15 nt, Salmonella enterica enterica serovar Typhi Ty2
auaauggaacugccu

SEQ ID NO: 1784576 - RNA, 19 nt, Salmonella enterica enterica serovar Typhi Ty2
auaauggcgccgauaacac

SEQ ID NO: 1784577 - RNA, 14 nt, Salmonella enterica enterica serovar Typhi Ty2
auaaugcgccacca

SEQ ID NO: 1784578 - RNA, 16 nt, Salmonella enterica enterica serovar Typhi Ty2
auaaugcgccaccacu

SEQ ID NO: 1784579 - RNA, 16 nt, Salmonella enterica enterica serovar Typhi Ty2
auaaucgaccguaucc

SEQ ID NO: 1784580 - RNA, 19 nt, Salmonella enterica enterica serovar Typhi Ty2
auaaucagcgcuccgacaa

SEQ ID NO: 1784581 - RNA, 16 nt, Salmonella enterica enterica serovar Typhi Ty2
auaaucgcgagaaaau

SEQ ID NO: 1784582 - RNA, 20 nt, Salmonella enterica enterica serovar Typhi Ty2
auaaucgguagcacuuuaaa

SEQ ID NO: 1784583 - RNA, 15 nt, Salmonella enterica enterica serovar Typhi Ty2
auaaucguuuuaugc

SEQ ID NO: 1784584 - RNA, 20 nt, Salmonella enterica enterica serovar Typhi Ty2
auaaguuagcuuuuuuaugc

SEQ ID NO: 1784585 - RNA, 23 nt, Salmonella enterica enterica serovar Typhi Ty2
auaauaaaugccgucgcuuucau

SEQ ID NO: 1784586 - RNA, 14 nt, Salmonella enterica enterica serovar Typhi Ty2
auaaguuuuuucuu

SEQ ID NO: 1784587 - RNA, 16 nt, Salmonella enterica enterica serovar Typhi Ty2
auaagguucuggcauu

SEQ ID NO: 1784588 - RNA, 15 nt, Salmonella enterica enterica serovar Typhi Ty2
auaagggcucagcau

SEQ ID NO: 1784589 - RNA, 14 nt, Salmonella enterica enterica serovar Typhi Ty2
auaagggcucagca

SEQ ID NO: 1784590 - RNA, 23 nt, Salmonella enterica enterica serovar Typhi Ty2
auaaggcgcuugcgccaucaucc

SEQ ID NO: 1784591 - RNA, 16 nt, Salmonella enterica enterica serovar Typhi Ty2
auaaggcgauaccuaa

SEQ ID NO: 1784592 - RNA, 15 nt, Salmonella enterica enterica serovar Typhi Ty2
auaaggcagcaaugu

SEQ ID NO: 1784593 - RNA, 15 nt, Salmonella enterica enterica serovar Typhi Ty2
auaagagaaaauacc

SEQ ID NO: 1784594 - RNA, 13 nt, Salmonella enterica enterica serovar Typhi Ty2
auaagaaucagau

SEQ ID NO: 1784595 - RNA, 12 nt, Salmonella enterica enterica serovar Typhi Ty2
auaagcuuuaac

SEQ ID NO: 1784596 - RNA, 18 nt, Salmonella enterica enterica serovar Typhi Ty2
auaagcuuaggauaagaa

SEQ ID NO: 1784597 - RNA, 13 nt, Salmonella enterica enterica serovar Typhi Ty2
auaagcugaaugg

SEQ ID NO: 1784598 - RNA, 15 nt, Salmonella enterica enterica serovar Typhi Ty2
auaagcgcucaggca

SEQ ID NO: 1784599 - RNA, 22 nt, Salmonella enterica enterica serovar Typhi Ty2
auaagcguagcgccaucaggcu

SEQ ID NO: 1784600 - RNA, 15 nt, Salmonella enterica enterica serovar Typhi Ty2
auaagcgucugcaau

SEQ ID NO: 1784601 - RNA, 17 nt, Salmonella enterica enterica serovar Typhi Ty2
auaagcacaccauuuca

SEQ ID NO: 1784602 - RNA, 18 nt, Salmonella enterica enterica serovar Typhi Ty2
auaagcacaccauuucac

SEQ ID NO: 1784603 - RNA, 21 nt, Salmonella enterica enterica serovar Typhi Ty2
auaagcacaccauuucacaaa

SEQ ID NO: 1784604 - RNA, 11 nt, Salmonella enterica enterica serovar Typhi Ty2
auaagcagaac

SEQ ID NO: 1784605 - RNA, 20 nt, Salmonella enterica enterica serovar Typhi Ty2
auaagccugagcgcgaggca

SEQ ID NO: 1784606 - RNA, 18 nt, Salmonella enterica enterica serovar Typhi Ty2
auaagccgcguucugucg

SEQ ID NO: 1784607 - RNA, 20 nt, Salmonella enterica enterica serovar Typhi Ty2
aggcaaagcauaggccacga

SEQ ID NO: 1784608 - RNA, 16 nt, Salmonella enterica enterica serovar Typhi Ty2
aggcaaccugucagua

SEQ ID NO: 1784609 - RNA, 14 nt, Salmonella enterica enterica serovar Typhi Ty2
aggcaauauccucc

SEQ ID NO: 1784610 - RNA, 12 nt, Salmonella enterica enterica serovar Typhi Ty2
aggcaauauccu

SEQ ID NO: 1784611 - RNA, 18 nt, Salmonella enterica enterica serovar Typhi Ty2
aggcaauaugucuuaaac

SEQ ID NO: 1784612 - RNA, 16 nt, Salmonella enterica enterica serovar Typhi Ty2
aggcaauaaacaucag

SEQ ID NO: 1784613 - RNA, 19 nt, Salmonella enterica enterica serovar Typhi Ty2
aggcaauagaccagcggcc

SEQ ID NO: 1784614 - RNA, 15 nt, Salmonella enterica enterica serovar Typhi Ty2
aggcaaguucuuguu

SEQ ID NO: 1784615 - RNA, 23 nt, Salmonella enterica enterica serovar Typhi Ty2
aggcaauucuggcgcacauugcu

SEQ ID NO: 1784616 - RNA, 20 nt, Salmonella enterica enterica serovar Typhi Ty2
aggcacuuuccagaccaaga

SEQ ID NO: 1784617 - RNA, 14 nt, Salmonella enterica enterica serovar Typhi Ty2
aggcacuguggugu

SEQ ID NO: 1784618 - RNA, 22 nt, Salmonella enterica enterica serovar Typhi Ty2
aggcaccguuucuuugcugccg

SEQ ID NO: 1784619 - RNA, 13 nt, Salmonella enterica enterica serovar Typhi Ty2
aggauugcuguga

SEQ ID NO: 1784620 - RNA, 22 nt, Salmonella enterica enterica serovar Typhi Ty2
aggauucgacggccagcgcgcg

SEQ ID NO: 1784621 - RNA, 18 nt, Salmonella enterica enterica serovar Typhi Ty2
aggcaaaaauaggcuuuu

SEQ ID NO: 1784622 - RNA, 21 nt, Salmonella enterica enterica serovar Typhi Ty2
aggcaaaaaucgucaucagau

SEQ ID NO: 1784623 - RNA, 13 nt, Salmonella enterica enterica serovar Typhi Ty2
aggcaaaacgggc

SEQ ID NO: 1784624 - RNA, 20 nt, Salmonella enterica enterica serovar Typhi Ty2
aggcaaaacgggcggcggcu

SEQ ID NO: 1784625 - RNA, 15 nt, Salmonella enterica enterica serovar Typhi Ty2
aggcaaaaugccagc

SEQ ID NO: 1784626 - RNA, 20 nt, Salmonella enterica enterica serovar Typhi Ty2
aggcaaacgcggugaaggca

SEQ ID NO: 1784627 - RNA, 15 nt, Salmonella enterica enterica serovar Typhi Ty2
aggcaaaccagcacc

SEQ ID NO: 1784628 - RNA, 18 nt, Salmonella enterica enterica serovar Typhi Ty2
aggauuugucucaucuga

SEQ ID NO: 1784629 - RNA, 13 nt, Salmonella enterica enterica serovar Typhi Ty2
aggaugagcguuu

SEQ ID NO: 1784630 - RNA, 14 nt, Salmonella enterica enterica serovar Typhi Ty2
aggaugaacucuau

SEQ ID NO: 1784631 - RNA, 14 nt, Salmonella enterica enterica serovar Typhi Ty2
aggaucguaaugau

SEQ ID NO: 1784632 - RNA, 22 nt, Salmonella enterica enterica serovar Typhi Ty2
aggaucguaacaggucacgaca

SEQ ID NO: 1784633 - RNA, 22 nt, Salmonella enterica enterica serovar Typhi Ty2
aggaugccccaucucuuucaga

SEQ ID NO: 1784634 - RNA, 18 nt, Salmonella enterica enterica serovar Typhi Ty2
aggaugccacuguucaga

SEQ ID NO: 1784635 - RNA, 16 nt, Salmonella enterica enterica serovar Typhi Ty2
aggauguccaggcgac

SEQ ID NO: 1784636 - RNA, 22 nt, Salmonella enterica enterica serovar Typhi Ty2
aggccaacauagcggcaaggaa

SEQ ID NO: 1784637 - RNA, 12 nt, Salmonella enterica enterica serovar Typhi Ty2
aggccaaacccu

SEQ ID NO: 1784638 - RNA, 19 nt, Salmonella enterica enterica serovar Typhi Ty2
aggcauuuaugccgccauc

SEQ ID NO: 1784639 - RNA, 13 nt, Salmonella enterica enterica serovar Typhi Ty2
aggccaaaaccac

SEQ ID NO: 1784640 - RNA, 20 nt, Salmonella enterica enterica serovar Typhi Ty2
aggccaaaaccacagugacc

SEQ ID NO: 1784641 - RNA, 18 nt, Salmonella enterica enterica serovar Typhi Ty2
aggcauuucaaucgccac

SEQ ID NO: 1784642 - RNA, 15 nt, Salmonella enterica enterica serovar Typhi Ty2
aggcauggcagcagg

SEQ ID NO: 1784643 - RNA, 20 nt, Salmonella enterica enterica serovar Typhi Ty2
aggcaugccaaaccagacuc

SEQ ID NO: 1784644 - RNA, 16 nt, Salmonella enterica enterica serovar Typhi Ty2
aggcaugaugccacga

SEQ ID NO: 1784645 - RNA, 15 nt, Salmonella enterica enterica serovar Typhi Ty2
aggcauuaaaaaaac

SEQ ID NO: 1784646 - RNA, 15 nt, Salmonella enterica enterica serovar Typhi Ty2
aggcauggccuucaa

SEQ ID NO: 1784647 - RNA, 14 nt, Salmonella enterica enterica serovar Typhi Ty2
aggcauuggacgga

SEQ ID NO: 1784648 - RNA, 20 nt, Salmonella enterica enterica serovar Typhi Ty2
aggcauugauaaagcgcuca

SEQ ID NO: 1784649 - RNA, 17 nt, Salmonella enterica enterica serovar Typhi Ty2
aggcaggaaauccagca

SEQ ID NO: 1784650 - RNA, 23 nt, Salmonella enterica enterica serovar Typhi Ty2
aggcagccacaaugggggcauaa

SEQ ID NO: 1784651 - RNA, 19 nt, Salmonella enterica enterica serovar Typhi Ty2
aggcagcaccucaauauga

SEQ ID NO: 1784652 - RNA, 19 nt, Salmonella enterica enterica serovar Typhi Ty2
aggcagccggauuuuaaau

SEQ ID NO: 1784653 - RNA, 22 nt, Salmonella enterica enterica serovar Typhi Ty2
aggcagccggauuuuaaauugg

SEQ ID NO: 1784654 - RNA, 22 nt, Salmonella enterica enterica serovar Typhi Ty2
aggcaucgacgccagcggguga

SEQ ID NO: 1784655 - RNA, 23 nt, Salmonella enterica enterica serovar Typhi Ty2
aggcauccgugaccugcugacua

SEQ ID NO: 1784656 - RNA, 19 nt, Salmonella enterica enterica serovar Typhi Ty2
aggcauccgugaccugcug

SEQ ID NO: 1784657 - RNA, 14 nt, Salmonella enterica enterica serovar Typhi Ty2
aggcaucagauaaa

SEQ ID NO: 1784658 - RNA, 13 nt, Salmonella enterica enterica serovar Typhi Ty2
aggcauaaaaaaa

SEQ ID NO: 1784659 - RNA, 16 nt, Salmonella enterica enterica serovar Typhi Ty2
aggcauaaaaaagagg

SEQ ID NO: 1784660 - RNA, 14 nt, Salmonella enterica enterica serovar Typhi Ty2
aggcauagaaaaag

SEQ ID NO: 1784661 - RNA, 13 nt, Salmonella enterica enterica serovar Typhi Ty2
aggcccagccgcu

SEQ ID NO: 1784662 - RNA, 21 nt, Salmonella enterica enterica serovar Typhi Ty2
aggcccauuuucggcaucagc

SEQ ID NO: 1784663 - RNA, 23 nt, Salmonella enterica enterica serovar Typhi Ty2
aggcccauuuucggcaucagcag

SEQ ID NO: 1784664 - RNA, 23 nt, Salmonella enterica enterica serovar Typhi Ty2
aggccgacaaaugacgucagcaa

SEQ ID NO: 1784665 - RNA, 20 nt, Salmonella enterica enterica serovar Typhi Ty2
aggccagaaggcgaacauaa

SEQ ID NO: 1784666 - RNA, 13 nt, Salmonella enterica enterica serovar Typhi Ty2
aggccacuucaca

SEQ ID NO: 1784667 - RNA, 15 nt, Salmonella enterica enterica serovar Typhi Ty2
aggccacgcagcgca

SEQ ID NO: 1784668 - RNA, 23 nt, Salmonella enterica enterica serovar Typhi Ty2
aggccacgauauagucgcccauc

SEQ ID NO: 1784669 - RNA, 16 nt, Salmonella enterica enterica serovar Typhi Ty2
aggccagcgucaccuc

SEQ ID NO: 1784670 - RNA, 20 nt, Salmonella enterica enterica serovar Typhi Ty2
aggccauuaagcuucgugag

SEQ ID NO: 1784671 - RNA, 21 nt, Salmonella enterica enterica serovar Typhi Ty2
aggaauaagggugagagggga

SEQ ID NO: 1784672 - RNA, 22 nt, Salmonella enterica enterica serovar Typhi Ty2
aggaauaacaucguaaaucaaa

SEQ ID NO: 1784673 - RNA, 13 nt, Salmonella enterica enterica serovar Typhi Ty2
aggaauaacaucg

SEQ ID NO: 1784674 - RNA, 20 nt, Salmonella enterica enterica serovar Typhi Ty2
aggaaggcgguaagagagug

SEQ ID NO: 1784675 - RNA, 22 nt, Salmonella enterica enterica serovar Typhi Ty2
aggaagucagcuuccugcacgc

SEQ ID NO: 1784676 - RNA, 14 nt, Salmonella enterica enterica serovar Typhi Ty2
aggaagacuucguu

SEQ ID NO: 1784677 - RNA, 22 nt, Salmonella enterica enterica serovar Typhi Ty2
aggaagcccucggcgaacaggc

SEQ ID NO: 1784678 - RNA, 17 nt, Salmonella enterica enterica serovar Typhi Ty2
aggaaggaaacuuauuu

SEQ ID NO: 1784679 - RNA, 19 nt, Salmonella enterica enterica serovar Typhi Ty2
aggaagcugcgcagcacuu

SEQ ID NO: 1784680 - RNA, 14 nt, Salmonella enterica enterica serovar Typhi Ty2
aggaaugaaaacga

SEQ ID NO: 1784681 - RNA, 17 nt, Salmonella enterica enterica serovar Typhi Ty2
aggaaugcccagcucag

SEQ ID NO: 1784682 - RNA, 20 nt, Salmonella enterica enterica serovar Typhi Ty2
aggaaugcccagcucagcuu

SEQ ID NO: 1784683 - RNA, 17 nt, Salmonella enterica enterica serovar Typhi Ty2
aggaauuccaguccuuu

SEQ ID NO: 1784684 - RNA, 13 nt, Salmonella enterica enterica serovar Typhi Ty2
aggaauucuccac

SEQ ID NO: 1784685 - RNA, 13 nt, Salmonella enterica enterica serovar Typhi Ty2
aggaauuuuccca

SEQ ID NO: 1784686 - RNA, 21 nt, Salmonella enterica enterica serovar Typhi Ty2
aggaauuuucccauaaaagag

SEQ ID NO: 1784687 - RNA, 12 nt, Salmonella enterica enterica serovar Typhi Ty2
aggaaaggcaga

SEQ ID NO: 1784688 - RNA, 20 nt, Salmonella enterica enterica serovar Typhi Ty2
aggaaagauuacuucaggcu

SEQ ID NO: 1784689 - RNA, 15 nt, Salmonella enterica enterica serovar Typhi Ty2
agcuuuuuauuacuu

SEQ ID NO: 1784690 - RNA, 22 nt, Salmonella enterica enterica serovar Typhi Ty2
agcuuuugcgcguuccccaaca

SEQ ID NO: 1784691 - RNA, 22 nt, Salmonella enterica enterica serovar Typhi Ty2
aggaaaagaccauccgguuuua

SEQ ID NO: 1784692 - RNA, 14 nt, Salmonella enterica enterica serovar Typhi Ty2
aggaaaaaugagac

SEQ ID NO: 1784693 - RNA, 20 nt, Salmonella enterica enterica serovar Typhi Ty2
aggaacuguucagccagcaa

SEQ ID NO: 1784694 - RNA, 21 nt, Salmonella enterica enterica serovar Typhi Ty2
aggaaccgguagccaggcgcg

SEQ ID NO: 1784695 - RNA, 18 nt, Salmonella enterica enterica serovar Typhi Ty2
aggaacgcgcagaccguu

SEQ ID NO: 1784696 - RNA, 14 nt, Salmonella enterica enterica serovar Typhi Ty2
aggaacagauacug

SEQ ID NO: 1784697 - RNA, 13 nt, Salmonella enterica enterica serovar Typhi Ty2
aggaacagugaca

SEQ ID NO: 1784698 - RNA, 14 nt, Salmonella enterica enterica serovar Typhi Ty2
aggaacagugacaa

SEQ ID NO: 1784699 - RNA, 18 nt, Salmonella enterica enterica serovar Typhi Ty2
aggaacagugacaaacuc

SEQ ID NO: 1784700 - RNA, 18 nt, Salmonella enterica enterica serovar Typhi Ty2
aggaacaucgacccccac

SEQ ID NO: 1784701 - RNA, 17 nt, Salmonella enterica enterica serovar Typhi Ty2
aggaacaucagccagca

SEQ ID NO: 1784702 - RNA, 13 nt, Salmonella enterica enterica serovar Typhi Ty2
aggaaauucugac

SEQ ID NO: 1784703 - RNA, 14 nt, Salmonella enterica enterica serovar Typhi Ty2
aggaaauucugacg

SEQ ID NO: 1784704 - RNA, 19 nt, Salmonella enterica enterica serovar Typhi Ty2
aggaaauucagauccgagg

SEQ ID NO: 1784705 - RNA, 12 nt, Salmonella enterica enterica serovar Typhi Ty2
aggaaauccagc

SEQ ID NO: 1784706 - RNA, 14 nt, Salmonella enterica enterica serovar Typhi Ty2
aggaguaguuaaaa

SEQ ID NO: 1784707 - RNA, 21 nt, Salmonella enterica enterica serovar Typhi Ty2
aggaguccaaaacgaacaggc

SEQ ID NO: 1784708 - RNA, 15 nt, Salmonella enterica enterica serovar Typhi Ty2
aggauaaaaucgcca

SEQ ID NO: 1784709 - RNA, 13 nt, Salmonella enterica enterica serovar Typhi Ty2
aggagcggaagag

SEQ ID NO: 1784710 - RNA, 21 nt, Salmonella enterica enterica serovar Typhi Ty2
aggauauuuauuugguuucua

SEQ ID NO: 1784711 - RNA, 17 nt, Salmonella enterica enterica serovar Typhi Ty2
aggauauuuauuugcau

SEQ ID NO: 1784712 - RNA, 20 nt, Salmonella enterica enterica serovar Typhi Ty2
aggaucaaaaucgcgcccca

SEQ ID NO: 1784713 - RNA, 19 nt, Salmonella enterica enterica serovar Typhi Ty2
aggaucaucggccagauaa

SEQ ID NO: 1784714 - RNA, 13 nt, Salmonella enterica enterica serovar Typhi Ty2
aggauauaaaaaa

SEQ ID NO: 1784715 - RNA, 21 nt, Salmonella enterica enterica serovar Typhi Ty2
aggauagcuuuguauauguuu

SEQ ID NO: 1784716 - RNA, 19 nt, Salmonella enterica enterica serovar Typhi Ty2
aggauagcgaccagcguca

SEQ ID NO: 1784717 - RNA, 21 nt, Salmonella enterica enterica serovar Typhi Ty2
aggauagcgaccagcgucagc

SEQ ID NO: 1784718 - RNA, 15 nt, Salmonella enterica enterica serovar Typhi Ty2
aggauacagccgacu

SEQ ID NO: 1784719 - RNA, 22 nt, Salmonella enterica enterica serovar Typhi Ty2
aggagcauagauaacuauguga

SEQ ID NO: 1784720 - RNA, 19 nt, Salmonella enterica enterica serovar Typhi Ty2
aggagagucgauacgcuga

SEQ ID NO: 1784721 - RNA, 18 nt, Salmonella enterica enterica serovar Typhi Ty2
aggagagccagaagaaua

SEQ ID NO: 1784722 - RNA, 14 nt, Salmonella enterica enterica serovar Typhi Ty2
aggagacgccgccc

SEQ ID NO: 1784723 - RNA, 16 nt, Salmonella enterica enterica serovar Typhi Ty2
aggacucaaucacuua

SEQ ID NO: 1784724 - RNA, 21 nt, Salmonella enterica enterica serovar Typhi Ty2
aggacugacggaagagcucga

SEQ ID NO: 1784725 - RNA, 14 nt, Salmonella enterica enterica serovar Typhi Ty2
aggagaaaacgggu

SEQ ID NO: 1784726 - RNA, 14 nt, Salmonella enterica enterica serovar Typhi Ty2
aggacguucuucuc

SEQ ID NO: 1784727 - RNA, 14 nt, Salmonella enterica enterica serovar Typhi Ty2
aggacgccagugaa

SEQ ID NO: 1784728 - RNA, 22 nt, Salmonella enterica enterica serovar Typhi Ty2
agcuugccgccaauaggggcgg

SEQ ID NO: 1784729 - RNA, 22 nt, Salmonella enterica enterica serovar Typhi Ty2
agcuugcgauccauauaaucaa

SEQ ID NO: 1784730 - RNA, 18 nt, Salmonella enterica enterica serovar Typhi Ty2
agcuuucugaauuucacg

SEQ ID NO: 1784731 - RNA, 16 nt, Salmonella enterica enterica serovar Typhi Ty2
agcuuugccacuggcu

SEQ ID NO: 1784732 - RNA, 21 nt, Salmonella enterica enterica serovar Typhi Ty2
agcuucgccgcguaaucuucg

SEQ ID NO: 1784733 - RNA, 23 nt, Salmonella enterica enterica serovar Typhi Ty2
agcuuaucugaccaugccagcaa

SEQ ID NO: 1784734 - RNA, 18 nt, Salmonella enterica enterica serovar Typhi Ty2
agcuuaucgggccuacca

SEQ ID NO: 1784735 - RNA, 15 nt, Salmonella enterica enterica serovar Typhi Ty2
agcuuauuccaguca

SEQ ID NO: 1784736 - RNA, 14 nt, Salmonella enterica enterica serovar Typhi Ty2
agcuucaccgccag

SEQ ID NO: 1784737 - RNA, 12 nt, Salmonella enterica enterica serovar Typhi Ty2
agcuuccagcaa

SEQ ID NO: 1784738 - RNA, 14 nt, Salmonella enterica enterica serovar Typhi Ty2
agcuuccagcaaac

SEQ ID NO: 1784739 - RNA, 20 nt, Salmonella enterica enterica serovar Typhi Ty2
agcuucagcuggauagagua

SEQ ID NO: 1784740 - RNA, 20 nt, Salmonella enterica enterica serovar Typhi Ty2
agcuuaucgccaaagauaua

SEQ ID NO: 1784741 - RNA, 13 nt, Salmonella enterica enterica serovar Typhi Ty2
agcuuauccugcc

SEQ ID NO: 1784742 - RNA, 18 nt, Salmonella enterica enterica serovar Typhi Ty2
agcuuaggauucgccauu

SEQ ID NO: 1784743 - RNA, 15 nt, Salmonella enterica enterica serovar Typhi Ty2
agcuuacuuugcgcc

SEQ ID NO: 1784744 - RNA, 18 nt, Salmonella enterica enterica serovar Typhi Ty2
agcuuagaacucacgcuc

SEQ ID NO: 1784745 - RNA, 18 nt, Salmonella enterica enterica serovar Typhi Ty2
agcuuaaucaccagcgca

SEQ ID NO: 1784746 - RNA, 19 nt, Salmonella enterica enterica serovar Typhi Ty2
agcugggcgucaacgugaa

SEQ ID NO: 1784747 - RNA, 18 nt, Salmonella enterica enterica serovar Typhi Ty2
agcugguauaggccaggc

SEQ ID NO: 1784748 - RNA, 21 nt, Salmonella enterica enterica serovar Typhi Ty2
agcuggcuugccagcagauuu

SEQ ID NO: 1784749 - RNA, 14 nt, Salmonella enterica enterica serovar Typhi Ty2
agcugggccugcuc

SEQ ID NO: 1784750 - RNA, 18 nt, Salmonella enterica enterica serovar Typhi Ty2
agcuggaccgcagcuuau

SEQ ID NO: 1784751 - RNA, 22 nt, Salmonella enterica enterica serovar Typhi Ty2
agcuggcggucgggaacgcugu

SEQ ID NO: 1784752 - RNA, 14 nt, Salmonella enterica enterica serovar Typhi Ty2
agcugcgcgccgca

SEQ ID NO: 1784753 - RNA, 17 nt, Salmonella enterica enterica serovar Typhi Ty2
agcugcgaucaaguuuu

SEQ ID NO: 1784754 - RNA, 20 nt, Salmonella enterica enterica serovar Typhi Ty2
agcugguguaauugcgccag

SEQ ID NO: 1784755 - RNA, 21 nt, Salmonella enterica enterica serovar Typhi Ty2
agcugguggcgaguccugccg

SEQ ID NO: 1784756 - RNA, 22 nt, Salmonella enterica enterica serovar Typhi Ty2
agcuguacuuugccggggaggg

SEQ ID NO: 1784757 - RNA, 13 nt, Salmonella enterica enterica serovar Typhi Ty2
agcuguaacacug

SEQ ID NO: 1784758 - RNA, 12 nt, Salmonella enterica enterica serovar Typhi Ty2
agcugugagaau

SEQ ID NO: 1784759 - RNA, 17 nt, Salmonella enterica enterica serovar Typhi Ty2
agcugcaguuauuuuuu

SEQ ID NO: 1784760 - RNA, 18 nt, Salmonella enterica enterica serovar Typhi Ty2
agcugccacaccacaugc

SEQ ID NO: 1784761 - RNA, 22 nt, Salmonella enterica enterica serovar Typhi Ty2
agcugcauccgggguucgaauc

SEQ ID NO: 1784762 - RNA, 18 nt, Salmonella enterica enterica serovar Typhi Ty2
agcugccguuggcgagcc

SEQ ID NO: 1784763 - RNA, 18 nt, Salmonella enterica enterica serovar Typhi Ty2
agcugaaugcuucgccac

SEQ ID NO: 1784764 - RNA, 17 nt, Salmonella enterica enterica serovar Typhi Ty2
agcugaaaagauaaagu

SEQ ID NO: 1784765 - RNA, 15 nt, Salmonella enterica enterica serovar Typhi Ty2
agcucaguuuccagc

SEQ ID NO: 1784766 - RNA, 15 nt, Salmonella enterica enterica serovar Typhi Ty2
agcucuccuggaugc

SEQ ID NO: 1784767 - RNA, 14 nt, Salmonella enterica enterica serovar Typhi Ty2
agcucaggcgggga

SEQ ID NO: 1784768 - RNA, 18 nt, Salmonella enterica enterica serovar Typhi Ty2
agcucagaaauaaaacca

SEQ ID NO: 1784769 - RNA, 23 nt, Salmonella enterica enterica serovar Typhi Ty2
agcucagaaauaaaaccagggaa

SEQ ID NO: 1784770 - RNA, 15 nt, Salmonella enterica enterica serovar Typhi Ty2
agcucacgccaaaau

SEQ ID NO: 1784771 - RNA, 12 nt, Salmonella enterica enterica serovar Typhi Ty2
agcgcgauaaaa

SEQ ID NO: 1784772 - RNA, 18 nt, Salmonella enterica enterica serovar Typhi Ty2
agcgcgcccgccaccagc

SEQ ID NO: 1784773 - RNA, 17 nt, Salmonella enterica enterica serovar Typhi Ty2
agcgcgccauccugagu

SEQ ID NO: 1784774 - RNA, 21 nt, Salmonella enterica enterica serovar Typhi Ty2
agcgcgccaauggccgccccc

SEQ ID NO: 1784775 - RNA, 17 nt, Salmonella enterica enterica serovar Typhi Ty2
agcgcgcagcugggccu

SEQ ID NO: 1784776 - RNA, 13 nt, Salmonella enterica enterica serovar Typhi Ty2
agcgcgcgcgccu

SEQ ID NO: 1784777 - RNA, 19 nt, Salmonella enterica enterica serovar Typhi Ty2
agcgcgcgacaugcgucuu

SEQ ID NO: 1784778 - RNA, 18 nt, Salmonella enterica enterica serovar Typhi Ty2
agcgcgcgacccagcgca

SEQ ID NO: 1784779 - RNA, 23 nt, Salmonella enterica enterica serovar Typhi Ty2
agcgcgcgcuaauuuucagggug

SEQ ID NO: 1784780 - RNA, 23 nt, Salmonella enterica enterica serovar Typhi Ty2
agcgcggacagcagaauauugcu

SEQ ID NO: 1784781 - RNA, 16 nt, Salmonella enterica enterica serovar Typhi Ty2
agcgcgcuccagacca

SEQ ID NO: 1784782 - RNA, 15 nt, Salmonella enterica enterica serovar Typhi Ty2
agcgcgccgcccugu

SEQ ID NO: 1784783 - RNA, 16 nt, Salmonella enterica enterica serovar Typhi Ty2
agcgcugaugcaggca

SEQ ID NO: 1784784 - RNA, 14 nt, Salmonella enterica enterica serovar Typhi Ty2
agcgcugccgcaac

SEQ ID NO: 1784785 - RNA, 19 nt, Salmonella enterica enterica serovar Typhi Ty2
agcgcugagucauccuucc

SEQ ID NO: 1784786 - RNA, 20 nt, Salmonella enterica enterica serovar Typhi Ty2
agcgcuggcgccgcaaacca

SEQ ID NO: 1784787 - RNA, 23 nt, Salmonella enterica enterica serovar Typhi Ty2
agcgcggcgcccauuccgccugc

SEQ ID NO: 1784788 - RNA, 13 nt, Salmonella enterica enterica serovar Typhi Ty2
agcgcggcgccca

SEQ ID NO: 1784789 - RNA, 13 nt, Salmonella enterica enterica serovar Typhi Ty2
agcggccugucag

SEQ ID NO: 1784790 - RNA, 17 nt, Salmonella enterica enterica serovar Typhi Ty2
agcggcgccaucaccau

SEQ ID NO: 1784791 - RNA, 16 nt, Salmonella enterica enterica serovar Typhi Ty2
agcggcgcaggggcau

SEQ ID NO: 1784792 - RNA, 15 nt, Salmonella enterica enterica serovar Typhi Ty2
agcggcccgcgcuga

SEQ ID NO: 1784793 - RNA, 13 nt, Salmonella enterica enterica serovar Typhi Ty2
agcggccagggca

SEQ ID NO: 1784794 - RNA, 15 nt, Salmonella enterica enterica serovar Typhi Ty2
agcggaagaggcaua

SEQ ID NO: 1784795 - RNA, 18 nt, Salmonella enterica enterica serovar Typhi Ty2
agcggcucauccagcaac

SEQ ID NO: 1784796 - RNA, 19 nt, Salmonella enterica enterica serovar Typhi Ty2
agcggcucauccagcaaca

SEQ ID NO: 1784797 - RNA, 17 nt, Salmonella enterica enterica serovar Typhi Ty2
agcggcuaaucaccacc

SEQ ID NO: 1784798 - RNA, 18 nt, Salmonella enterica enterica serovar Typhi Ty2
agcggcugacacucaucc

SEQ ID NO: 1784799 - RNA, 22 nt, Salmonella enterica enterica serovar Typhi Ty2
agcggcugacacucauccagac

SEQ ID NO: 1784800 - RNA, 15 nt, Salmonella enterica enterica serovar Typhi Ty2
agcggcugcgccugu

SEQ ID NO: 1784801 - RNA, 14 nt, Salmonella enterica enterica serovar Typhi Ty2
agcggcggaaugcu

SEQ ID NO: 1784802 - RNA, 18 nt, Salmonella enterica enterica serovar Typhi Ty2
agcggcgccaucaccauc

SEQ ID NO: 1784803 - RNA, 17 nt, Salmonella enterica enterica serovar Typhi Ty2
agcggcguucaaaacgc

SEQ ID NO: 1784804 - RNA, 20 nt, Salmonella enterica enterica serovar Typhi Ty2
agcggcggucugcgccugcu

SEQ ID NO: 1784805 - RNA, 18 nt, Salmonella enterica enterica serovar Typhi Ty2
agcguacaggcggaugaa

SEQ ID NO: 1784806 - RNA, 15 nt, Salmonella enterica enterica serovar Typhi Ty2
agcguagccugcaug

SEQ ID NO: 1784807 - RNA, 20 nt, Salmonella enterica enterica serovar Typhi Ty2
agcguaccgucuggcgaggc

SEQ ID NO: 1784808 - RNA, 22 nt, Salmonella enterica enterica serovar Typhi Ty2
agcguaaugguggcaaccugac

SEQ ID NO: 1784809 - RNA, 19 nt, Salmonella enterica enterica serovar Typhi Ty2
agcguaauuccgcaaucug

SEQ ID NO: 1784810 - RNA, 15 nt, Salmonella enterica enterica serovar Typhi Ty2
agcggucuuucaaca

SEQ ID NO: 1784811 - RNA, 13 nt, Salmonella enterica enterica serovar Typhi Ty2
agcgggggccggc

SEQ ID NO: 1784812 - RNA, 20 nt, Salmonella enterica enterica serovar Typhi Ty2
agcgggcagcauugaccacc

SEQ ID NO: 1784813 - RNA, 19 nt, Salmonella enterica enterica serovar Typhi Ty2
agcgggcgcaguccagaug

SEQ ID NO: 1784814 - RNA, 15 nt, Salmonella enterica enterica serovar Typhi Ty2
agcgucuauagauga

SEQ ID NO: 1784815 - RNA, 22 nt, Salmonella enterica enterica serovar Typhi Ty2
agcgucgggccgcgcugcgccu

SEQ ID NO: 1784816 - RNA, 17 nt, Salmonella enterica enterica serovar Typhi Ty2
agcgucggugaagaaaa

SEQ ID NO: 1784817 - RNA, 20 nt, Salmonella enterica enterica serovar Typhi Ty2
agcgucgcugauugccgcca

SEQ ID NO: 1784818 - RNA, 18 nt, Salmonella enterica enterica serovar Typhi Ty2
agcguauaauuaagcugc

SEQ ID NO: 1784819 - RNA, 20 nt, Salmonella enterica enterica serovar Typhi Ty2
agcguauaauuaagcugcga

SEQ ID NO: 1784820 - RNA, 13 nt, Salmonella enterica enterica serovar Typhi Ty2
agcguaggguaga

SEQ ID NO: 1784821 - RNA, 13 nt, Salmonella enterica enterica serovar Typhi Ty2
agcguagcgccau

SEQ ID NO: 1784822 - RNA, 18 nt, Salmonella enterica enterica serovar Typhi Ty2
agcgugccgguaaagggc

SEQ ID NO: 1784823 - RNA, 22 nt, Salmonella enterica enterica serovar Typhi Ty2
agcgucuguuucaacgcaucca

SEQ ID NO: 1784824 - RNA, 23 nt, Salmonella enterica enterica serovar Typhi Ty2
agcgugcuguugcuaaauccaua

SEQ ID NO: 1784825 - RNA, 15 nt, Salmonella enterica enterica serovar Typhi Ty2
agcuaaucacccacu

SEQ ID NO: 1784826 - RNA, 18 nt, Salmonella enterica enterica serovar Typhi Ty2
agcuaauccccagcgcuc

SEQ ID NO: 1784827 - RNA, 16 nt, Salmonella enterica enterica serovar Typhi Ty2
agcuaauccccagcgc

SEQ ID NO: 1784828 - RNA, 18 nt, Salmonella enterica enterica serovar Typhi Ty2
agcuaaguuuguaaaaua

SEQ ID NO: 1784829 - RNA, 21 nt, Salmonella enterica enterica serovar Typhi Ty2
agcguucaugcuggucagcaa

SEQ ID NO: 1784830 - RNA, 23 nt, Salmonella enterica enterica serovar Typhi Ty2
agcguuacugcaacugcgcggca

SEQ ID NO: 1784831 - RNA, 20 nt, Salmonella enterica enterica serovar Typhi Ty2
agcguuacccagacagcaaa

SEQ ID NO: 1784832 - RNA, 17 nt, Salmonella enterica enterica serovar Typhi Ty2
agcgugucgcagauacg

SEQ ID NO: 1784833 - RNA, 17 nt, Salmonella enterica enterica serovar Typhi Ty2
agcucaaacguaaagca

SEQ ID NO: 1784834 - RNA, 17 nt, Salmonella enterica enterica serovar Typhi Ty2
agcucaccgagacugcc

SEQ ID NO: 1784835 - RNA, 18 nt, Salmonella enterica enterica serovar Typhi Ty2
agcucaagcccgcgucgu

SEQ ID NO: 1784836 - RNA, 19 nt, Salmonella enterica enterica serovar Typhi Ty2
agcucaacuauuaaagcac

SEQ ID NO: 1784837 - RNA, 18 nt, Salmonella enterica enterica serovar Typhi Ty2
agcuauccaguuucugac

SEQ ID NO: 1784838 - RNA, 19 nt, Salmonella enterica enterica serovar Typhi Ty2
agcuauccacgcagacgcc

SEQ ID NO: 1784839 - RNA, 19 nt, Salmonella enterica enterica serovar Typhi Ty2
agcuauucauuauuuuuaa

SEQ ID NO: 1784840 - RNA, 16 nt, Salmonella enterica enterica serovar Typhi Ty2
agcuauuccaaaauaa

SEQ ID NO: 1784841 - RNA, 14 nt, Salmonella enterica enterica serovar Typhi Ty2
aggcuuuugauuca

SEQ ID NO: 1784842 - RNA, 16 nt, Salmonella enterica enterica serovar Typhi Ty2
aggcuuuucaggcugu

SEQ ID NO: 1784843 - RNA, 14 nt, Salmonella enterica enterica serovar Typhi Ty2
agggaaaagccauu

SEQ ID NO: 1784844 - RNA, 17 nt, Salmonella enterica enterica serovar Typhi Ty2
agggaaaagccauugcc

SEQ ID NO: 1784845 - RNA, 13 nt, Salmonella enterica enterica serovar Typhi Ty2
agggaaaagaagu

SEQ ID NO: 1784846 - RNA, 13 nt, Salmonella enterica enterica serovar Typhi Ty2
agggaauaugauu

SEQ ID NO: 1784847 - RNA, 20 nt, Salmonella enterica enterica serovar Typhi Ty2
agggacacauuucuuuugau

SEQ ID NO: 1784848 - RNA, 16 nt, Salmonella enterica enterica serovar Typhi Ty2
agggacacucaaggcu

SEQ ID NO: 1784849 - RNA, 23 nt, Salmonella enterica enterica serovar Typhi Ty2
agggacuaucgaaagagcaaaua

SEQ ID NO: 1784850 - RNA, 13 nt, Salmonella enterica enterica serovar Typhi Ty2
agggaugacagaa

SEQ ID NO: 1784851 - RNA, 13 nt, Salmonella enterica enterica serovar Typhi Ty2
agggauuuugcuu

SEQ ID NO: 1784852 - RNA, 18 nt, Salmonella enterica enterica serovar Typhi Ty2
agggagguucgccucccu

SEQ ID NO: 1784853 - RNA, 17 nt, Salmonella enterica enterica serovar Typhi Ty2
agggagcugacugcaaa

SEQ ID NO: 1784854 - RNA, 19 nt, Salmonella enterica enterica serovar Typhi Ty2
agggaggugcucucccagc

SEQ ID NO: 1784855 - RNA, 21 nt, Salmonella enterica enterica serovar Typhi Ty2
agggaggugcucucccagcug

SEQ ID NO: 1784856 - RNA, 16 nt, Salmonella enterica enterica serovar Typhi Ty2
agggaucaucuucacu

SEQ ID NO: 1784857 - RNA, 16 nt, Salmonella enterica enterica serovar Typhi Ty2
agggaucaauguaaaa

SEQ ID NO: 1784858 - RNA, 22 nt, Salmonella enterica enterica serovar Typhi Ty2
agggauaagguugucaaaaaau

SEQ ID NO: 1784859 - RNA, 20 nt, Salmonella enterica enterica serovar Typhi Ty2
agggauaagaaagauaaaau

SEQ ID NO: 1784860 - RNA, 14 nt, Salmonella enterica enterica serovar Typhi Ty2
aggcuuugcugcug

SEQ ID NO: 1784861 - RNA, 13 nt, Salmonella enterica enterica serovar Typhi Ty2
aggcuugcaggau

SEQ ID NO: 1784862 - RNA, 19 nt, Salmonella enterica enterica serovar Typhi Ty2
aggcuugccgcgccagacg

SEQ ID NO: 1784863 - RNA, 20 nt, Salmonella enterica enterica serovar Typhi Ty2
aggcuucaucggauagauga

SEQ ID NO: 1784864 - RNA, 16 nt, Salmonella enterica enterica serovar Typhi Ty2
aggcuucaaccguuuc

SEQ ID NO: 1784865 - RNA, 14 nt, Salmonella enterica enterica serovar Typhi Ty2
aggcuuccggcagc

SEQ ID NO: 1784866 - RNA, 14 nt, Salmonella enterica enterica serovar Typhi Ty2
aggcuuccagauac

SEQ ID NO: 1784867 - RNA, 23 nt, Salmonella enterica enterica serovar Typhi Ty2
aggcugccgacaacgccuccugc

SEQ ID NO: 1784868 - RNA, 13 nt, Salmonella enterica enterica serovar Typhi Ty2
aggcugcggauga

SEQ ID NO: 1784869 - RNA, 15 nt, Salmonella enterica enterica serovar Typhi Ty2
aggcugcgcguuuuc

SEQ ID NO: 1784870 - RNA, 14 nt, Salmonella enterica enterica serovar Typhi Ty2
aggcuggagagcaa

SEQ ID NO: 1784871 - RNA, 11 nt, Salmonella enterica enterica serovar Typhi Ty2
aggcuggaaca

SEQ ID NO: 1784872 - RNA, 14 nt, Salmonella enterica enterica serovar Typhi Ty2
aggcugucugccau

SEQ ID NO: 1784873 - RNA, 17 nt, Salmonella enterica enterica serovar Typhi Ty2
aggcuguggcugucguu

SEQ ID NO: 1784874 - RNA, 20 nt, Salmonella enterica enterica serovar Typhi Ty2
aggcuggcgguaacaggcac

SEQ ID NO: 1784875 - RNA, 22 nt, Salmonella enterica enterica serovar Typhi Ty2
aggcuggguugauaccggagga

SEQ ID NO: 1784876 - RNA, 18 nt, Salmonella enterica enterica serovar Typhi Ty2
aggggccacaggcggcau

SEQ ID NO: 1784877 - RNA, 18 nt, Salmonella enterica enterica serovar Typhi Ty2
aggggcucuaaaaaggaa

SEQ ID NO: 1784878 - RNA, 17 nt, Salmonella enterica enterica serovar Typhi Ty2
agggguugaugccgacc

SEQ ID NO: 1784879 - RNA, 22 nt, Salmonella enterica enterica serovar Typhi Ty2
agggguuuucgccagcaacgcc

SEQ ID NO: 1784880 - RNA, 13 nt, Salmonella enterica enterica serovar Typhi Ty2
agggguauuuauc

SEQ ID NO: 1784881 - RNA, 18 nt, Salmonella enterica enterica serovar Typhi Ty2
aggguaacaucgcccgca

SEQ ID NO: 1784882 - RNA, 13 nt, Salmonella enterica enterica serovar Typhi Ty2
aggguauaugagc

SEQ ID NO: 1784883 - RNA, 13 nt, Salmonella enterica enterica serovar Typhi Ty2
aggguagaaaaag

SEQ ID NO: 1784884 - RNA, 14 nt, Salmonella enterica enterica serovar Typhi Ty2
aggguagaaaaagg

SEQ ID NO: 1784885 - RNA, 21 nt, Salmonella enterica enterica serovar Typhi Ty2
agggcggcgcgcugccgcccu

SEQ ID NO: 1784886 - RNA, 14 nt, Salmonella enterica enterica serovar Typhi Ty2
agggcgcggcuggu

SEQ ID NO: 1784887 - RNA, 13 nt, Salmonella enterica enterica serovar Typhi Ty2
agggcggcuggau

SEQ ID NO: 1784888 - RNA, 17 nt, Salmonella enterica enterica serovar Typhi Ty2
agggcgggcgauagaga

SEQ ID NO: 1784889 - RNA, 18 nt, Salmonella enterica enterica serovar Typhi Ty2
agggcgcggcgcaacuuu

SEQ ID NO: 1784890 - RNA, 18 nt, Salmonella enterica enterica serovar Typhi Ty2
agggcauuuuuuccagua

SEQ ID NO: 1784891 - RNA, 13 nt, Salmonella enterica enterica serovar Typhi Ty2
agggcaggggaaa

SEQ ID NO: 1784892 - RNA, 13 nt, Salmonella enterica enterica serovar Typhi Ty2
agggcaggcagug

SEQ ID NO: 1784893 - RNA, 15 nt, Salmonella enterica enterica serovar Typhi Ty2
agggcaggcagugaa

SEQ ID NO: 1784894 - RNA, 23 nt, Salmonella enterica enterica serovar Typhi Ty2
agggcaugauuacagauauccac

SEQ ID NO: 1784895 - RNA, 16 nt, Salmonella enterica enterica serovar Typhi Ty2
agggcaacaaacauaa

SEQ ID NO: 1784896 - RNA, 18 nt, Salmonella enterica enterica serovar Typhi Ty2
aggccgccaccgccucgc

SEQ ID NO: 1784897 - RNA, 15 nt, Salmonella enterica enterica serovar Typhi Ty2
aggccgccagcaaac

SEQ ID NO: 1784898 - RNA, 16 nt, Salmonella enterica enterica serovar Typhi Ty2
aggccgccgaggcuaa

SEQ ID NO: 1784899 - RNA, 18 nt, Salmonella enterica enterica serovar Typhi Ty2
aggccgccgcacaggcga

SEQ ID NO: 1784900 - RNA, 22 nt, Salmonella enterica enterica serovar Typhi Ty2
aggccgccgaggcuaagccaga

SEQ ID NO: 1784901 - RNA, 10 nt, Salmonella enterica enterica serovar Typhi Ty2
aggccgccgc

SEQ ID NO: 1784902 - RNA, 17 nt, Salmonella enterica enterica serovar Typhi Ty2
aggccgccgcacaggcg

SEQ ID NO: 1784903 - RNA, 21 nt, Salmonella enterica enterica serovar Typhi Ty2
aggccggcgaagauccgcuca

SEQ ID NO: 1784904 - RNA, 18 nt, Salmonella enterica enterica serovar Typhi Ty2
aggccggauaaggcgcuu

SEQ ID NO: 1784905 - RNA, 15 nt, Salmonella enterica enterica serovar Typhi Ty2
aggccggauaagccg

SEQ ID NO: 1784906 - RNA, 23 nt, Salmonella enterica enterica serovar Typhi Ty2
aggccggauaagcggcagcgcca

SEQ ID NO: 1784907 - RNA, 16 nt, Salmonella enterica enterica serovar Typhi Ty2
aggccgcuuaauaaua

SEQ ID NO: 1784908 - RNA, 20 nt, Salmonella enterica enterica serovar Typhi Ty2
aggccugauaagcacaggcc

SEQ ID NO: 1784909 - RNA, 13 nt, Salmonella enterica enterica serovar Typhi Ty2
aggccugauaagc

SEQ ID NO: 1784910 - RNA, 23 nt, Salmonella enterica enterica serovar Typhi Ty2
aggccugauaagacgcaucgcgu

SEQ ID NO: 1784911 - RNA, 21 nt, Salmonella enterica enterica serovar Typhi Ty2
aggccucgaccaguuuuuccg

SEQ ID NO: 1784912 - RNA, 16 nt, Salmonella enterica enterica serovar Typhi Ty2
aggccuaacacaugca

SEQ ID NO: 1784913 - RNA, 19 nt, Salmonella enterica enterica serovar Typhi Ty2
aggccguugugucccugga

SEQ ID NO: 1784914 - RNA, 20 nt, Salmonella enterica enterica serovar Typhi Ty2
aggccguucauucgccccag

SEQ ID NO: 1784915 - RNA, 14 nt, Salmonella enterica enterica serovar Typhi Ty2
aggccuacaagaau

SEQ ID NO: 1784916 - RNA, 16 nt, Salmonella enterica enterica serovar Typhi Ty2
aggccuacaaucgugu

SEQ ID NO: 1784917 - RNA, 22 nt, Salmonella enterica enterica serovar Typhi Ty2
aggccuacaaucgugugaugca

SEQ ID NO: 1784918 - RNA, 17 nt, Salmonella enterica enterica serovar Typhi Ty2
aggccuacauccggcuc

SEQ ID NO: 1784919 - RNA, 20 nt, Salmonella enterica enterica serovar Typhi Ty2
aggccguuauugucaugcua

SEQ ID NO: 1784920 - RNA, 21 nt, Salmonella enterica enterica serovar Typhi Ty2
aggccgguuguuuacacggca

SEQ ID NO: 1784921 - RNA, 22 nt, Salmonella enterica enterica serovar Typhi Ty2
aggccgggaaaucuucuacuuc

SEQ ID NO: 1784922 - RNA, 23 nt, Salmonella enterica enterica serovar Typhi Ty2
aggccggguaggacauagccgcc

SEQ ID NO: 1784923 - RNA, 15 nt, Salmonella enterica enterica serovar Typhi Ty2
aggcgauagccgucc

SEQ ID NO: 1784924 - RNA, 19 nt, Salmonella enterica enterica serovar Typhi Ty2
aggcgcagagugagcaggc

SEQ ID NO: 1784925 - RNA, 17 nt, Salmonella enterica enterica serovar Typhi Ty2
aggcgcaucagaaaaac

SEQ ID NO: 1784926 - RNA, 13 nt, Salmonella enterica enterica serovar Typhi Ty2
aggcgcagccgcc

SEQ ID NO: 1784927 - RNA, 23 nt, Salmonella enterica enterica serovar Typhi Ty2
aggcgccggggcagcaauaguug

SEQ ID NO: 1784928 - RNA, 14 nt, Salmonella enterica enterica serovar Typhi Ty2
aggccugauaagcg

SEQ ID NO: 1784929 - RNA, 22 nt, Salmonella enterica enterica serovar Typhi Ty2
aggccugauaagcgcagcgcca

SEQ ID NO: 1784930 - RNA, 18 nt, Salmonella enterica enterica serovar Typhi Ty2
aggccugcaaaccucucc

SEQ ID NO: 1784931 - RNA, 18 nt, Salmonella enterica enterica serovar Typhi Ty2
aggccugccggguuuaau

SEQ ID NO: 1784932 - RNA, 16 nt, Salmonella enterica enterica serovar Typhi Ty2
aggccugguuaacaau

SEQ ID NO: 1784933 - RNA, 18 nt, Salmonella enterica enterica serovar Typhi Ty2
aggccugguuaacaauau

SEQ ID NO: 1784934 - RNA, 12 nt, Salmonella enterica enterica serovar Typhi Ty2
aggccuggcugg

SEQ ID NO: 1784935 - RNA, 21 nt, Salmonella enterica enterica serovar Typhi Ty2
aggcgaacauaagagauggaa

SEQ ID NO: 1784936 - RNA, 21 nt, Salmonella enterica enterica serovar Typhi Ty2
aggcgaaacggcggaaccauu

SEQ ID NO: 1784937 - RNA, 14 nt, Salmonella enterica enterica serovar Typhi Ty2
aggcgacccauaac

SEQ ID NO: 1784938 - RNA, 13 nt, Salmonella enterica enterica serovar Typhi Ty2
aggcgaauagcgc

SEQ ID NO: 1784939 - RNA, 19 nt, Salmonella enterica enterica serovar Typhi Ty2
aggcgacuggcguccgcaa

SEQ ID NO: 1784940 - RNA, 21 nt, Salmonella enterica enterica serovar Typhi Ty2
aggcgagcacaccauaucuuu

SEQ ID NO: 1784941 - RNA, 15 nt, Salmonella enterica enterica serovar Typhi Ty2
aggcgcgcagcugcc

SEQ ID NO: 1784942 - RNA, 17 nt, Salmonella enterica enterica serovar Typhi Ty2
aggcgcggucuggccug

SEQ ID NO: 1784943 - RNA, 21 nt, Salmonella enterica enterica serovar Typhi Ty2
aggcgcguuuacuggcgacga

SEQ ID NO: 1784944 - RNA, 18 nt, Salmonella enterica enterica serovar Typhi Ty2
aggcgcuaauuaauucua

SEQ ID NO: 1784945 - RNA, 21 nt, Salmonella enterica enterica serovar Typhi Ty2
aggcgcuaugcuuaccaucug

SEQ ID NO: 1784946 - RNA, 20 nt, Salmonella enterica enterica serovar Typhi Ty2
aggcgcuauucccaggcaaa

SEQ ID NO: 1784947 - RNA, 13 nt, Salmonella enterica enterica serovar Typhi Ty2
aggcggcaaagau

SEQ ID NO: 1784948 - RNA, 23 nt, Salmonella enterica enterica serovar Typhi Ty2
aggcggaguuauacagugccagu

SEQ ID NO: 1784949 - RNA, 14 nt, Salmonella enterica enterica serovar Typhi Ty2
aggcggagccgcca

SEQ ID NO: 1784950 - RNA, 14 nt, Salmonella enterica enterica serovar Typhi Ty2
aggcguaaccgcca

SEQ ID NO: 1784951 - RNA, 18 nt, Salmonella enterica enterica serovar Typhi Ty2
aggcgucauagccgcgcg

SEQ ID NO: 1784952 - RNA, 18 nt, Salmonella enterica enterica serovar Typhi Ty2
aggcgggcuuuuuuugcc

SEQ ID NO: 1784953 - RNA, 23 nt, Salmonella enterica enterica serovar Typhi Ty2
aggcggcaugauagggcgccugu

SEQ ID NO: 1784954 - RNA, 20 nt, Salmonella enterica enterica serovar Typhi Ty2
aggcggauacagcggcgcgc

SEQ ID NO: 1784955 - RNA, 12 nt, Salmonella enterica enterica serovar Typhi Ty2
aggcggcgagcg

SEQ ID NO: 1784956 - RNA, 16 nt, Salmonella enterica enterica serovar Typhi Ty2
aggcggcuaccgccgu

SEQ ID NO: 1784957 - RNA, 18 nt, Salmonella enterica enterica serovar Typhi Ty2
aggcggcggcgggaaguu

SEQ ID NO: 1784958 - RNA, 13 nt, Salmonella enterica enterica serovar Typhi Ty2
aggcggcgccgcg

SEQ ID NO: 1784959 - RNA, 15 nt, Salmonella enterica enterica serovar Typhi Ty2
aggcgucccauguug

SEQ ID NO: 1784960 - RNA, 13 nt, Salmonella enterica enterica serovar Typhi Ty2
aggcguaugaaug

SEQ ID NO: 1784961 - RNA, 22 nt, Salmonella enterica enterica serovar Typhi Ty2
aggcguucccgaaaugggccaa

SEQ ID NO: 1784962 - RNA, 18 nt, Salmonella enterica enterica serovar Typhi Ty2
aggcguugaacauuucau

SEQ ID NO: 1784963 - RNA, 15 nt, Salmonella enterica enterica serovar Typhi Ty2
aggcguucaugccuu

SEQ ID NO: 1784964 - RNA, 20 nt, Salmonella enterica enterica serovar Typhi Ty2
aggcguugugcugcggcaug

SEQ ID NO: 1784965 - RNA, 18 nt, Salmonella enterica enterica serovar Typhi Ty2
aggcguuuacgcugcuau

SEQ ID NO: 1784966 - RNA, 22 nt, Salmonella enterica enterica serovar Typhi Ty2
aggcuacgguacugcccaccuu

SEQ ID NO: 1784967 - RNA, 22 nt, Salmonella enterica enterica serovar Typhi Ty2
aggcuccaaguauugauaccuu

SEQ ID NO: 1784968 - RNA, 20 nt, Salmonella enterica enterica serovar Typhi Ty2
aggcuccgagacucaaagaa

SEQ ID NO: 1784969 - RNA, 22 nt, Salmonella enterica enterica serovar Typhi Ty2
aggcuccgagacucaaagaaaa

SEQ ID NO: 1784970 - RNA, 21 nt, Salmonella enterica enterica serovar Typhi Ty2
aggcuccggcaccaaaccaua

SEQ ID NO: 1784971 - RNA, 16 nt, Salmonella enterica enterica serovar Typhi Ty2
aggcuccgcgcagggu

SEQ ID NO: 1784972 - RNA, 21 nt, Salmonella enterica enterica serovar Typhi Ty2
aggcucgcauucgcgagccuu

SEQ ID NO: 1784973 - RNA, 21 nt, Salmonella enterica enterica serovar Typhi Ty2
aggcugacgaagaacuuagga

SEQ ID NO: 1784974 - RNA, 21 nt, Salmonella enterica enterica serovar Typhi Ty2
aggcugagcguagaccgccca

SEQ ID NO: 1784975 - RNA, 19 nt, Salmonella enterica enterica serovar Typhi Ty2
aggcucuccgguugcugau

SEQ ID NO: 1784976 - RNA, 22 nt, Salmonella enterica enterica serovar Typhi Ty2
aggcugacaaagguugcgccaa

SEQ ID NO: 1784977 - RNA, 22 nt, Salmonella enterica enterica serovar Typhi Ty2
aguaaauugacgcuugacucug

SEQ ID NO: 1784978 - RNA, 15 nt, Salmonella enterica enterica serovar Typhi Ty2
aguaaauuuacucag

SEQ ID NO: 1784979 - RNA, 14 nt, Salmonella enterica enterica serovar Typhi Ty2
aguaacauaaugcc

SEQ ID NO: 1784980 - RNA, 19 nt, Salmonella enterica enterica serovar Typhi Ty2
aguaaccuauuuuacaaaa

SEQ ID NO: 1784981 - RNA, 19 nt, Salmonella enterica enterica serovar Typhi Ty2
aguaacgcacuuuuccagc

SEQ ID NO: 1784982 - RNA, 15 nt, Salmonella enterica enterica serovar Typhi Ty2
aguaaccccagggag

SEQ ID NO: 1784983 - RNA, 22 nt, Salmonella enterica enterica serovar Typhi Ty2
aguaacgcguccaacuggcuuu

SEQ ID NO: 1784984 - RNA, 18 nt, Salmonella enterica enterica serovar Typhi Ty2
aguaacugcaaaucuucg

SEQ ID NO: 1784985 - RNA, 15 nt, Salmonella enterica enterica serovar Typhi Ty2
aguaauaaaauaaua

SEQ ID NO: 1784986 - RNA, 18 nt, Salmonella enterica enterica serovar Typhi Ty2
aguaauaaaauaauaggu

SEQ ID NO: 1784987 - RNA, 14 nt, Salmonella enterica enterica serovar Typhi Ty2
aguaauaaucacau

SEQ ID NO: 1784988 - RNA, 21 nt, Salmonella enterica enterica serovar Typhi Ty2
aguaauauaaccaauuuaaaa

SEQ ID NO: 1784989 - RNA, 22 nt, Salmonella enterica enterica serovar Typhi Ty2
aguaccauugagcuuucuucca

SEQ ID NO: 1784990 - RNA, 18 nt, Salmonella enterica enterica serovar Typhi Ty2
aguacagggcgauuuccg

SEQ ID NO: 1784991 - RNA, 18 nt, Salmonella enterica enterica serovar Typhi Ty2
aguacagguuaugcaagu

SEQ ID NO: 1784992 - RNA, 15 nt, Salmonella enterica enterica serovar Typhi Ty2
aguacaaacaaauaa

SEQ ID NO: 1784993 - RNA, 14 nt, Salmonella enterica enterica serovar Typhi Ty2
aguaauuuuucucc

SEQ ID NO: 1784994 - RNA, 21 nt, Salmonella enterica enterica serovar Typhi Ty2
aguaauuuuucucccagcaga

SEQ ID NO: 1784995 - RNA, 13 nt, Salmonella enterica enterica serovar Typhi Ty2
aguaauuuuuccg

SEQ ID NO: 1784996 - RNA, 17 nt, Salmonella enterica enterica serovar Typhi Ty2
aguaauuuuuccgccuc

SEQ ID NO: 1784997 - RNA, 16 nt, Salmonella enterica enterica serovar Typhi Ty2
aguaauguccagauua

SEQ ID NO: 1784998 - RNA, 16 nt, Salmonella enterica enterica serovar Typhi Ty2
agguugcgcccggcgc

SEQ ID NO: 1784999 - RNA, 19 nt, Salmonella enterica enterica serovar Typhi Ty2
agguugccugauggcgcug

SEQ ID NO: 1785000 - RNA, 19 nt, Salmonella enterica enterica serovar Typhi Ty2
agguucauauugcgccgca

SEQ ID NO: 1785001 - RNA, 18 nt, Salmonella enterica enterica serovar Typhi Ty2
agguucaccaccacccag

SEQ ID NO: 1785002 - RNA, 15 nt, Salmonella enterica enterica serovar Typhi Ty2
agguucccgccgcca

SEQ ID NO: 1785003 - RNA, 14 nt, Salmonella enterica enterica serovar Typhi Ty2
agguuaauaacugc

SEQ ID NO: 1785004 - RNA, 16 nt, Salmonella enterica enterica serovar Typhi Ty2
agguuaauaacugcgc

SEQ ID NO: 1785005 - RNA, 14 nt, Salmonella enterica enterica serovar Typhi Ty2
agguuaagccucac

SEQ ID NO: 1785006 - RNA, 13 nt, Salmonella enterica enterica serovar Typhi Ty2
agguuaagugaca

SEQ ID NO: 1785007 - RNA, 19 nt, Salmonella enterica enterica serovar Typhi Ty2
agguuacucuuccaccauc

SEQ ID NO: 1785008 - RNA, 16 nt, Salmonella enterica enterica serovar Typhi Ty2
agguuacguucaucag

SEQ ID NO: 1785009 - RNA, 13 nt, Salmonella enterica enterica serovar Typhi Ty2
agguuagcagcca

SEQ ID NO: 1785010 - RNA, 16 nt, Salmonella enterica enterica serovar Typhi Ty2
agguuagguuaaauag

SEQ ID NO: 1785011 - RNA, 14 nt, Salmonella enterica enterica serovar Typhi Ty2
agguuaguaaugcc

SEQ ID NO: 1785012 - RNA, 16 nt, Salmonella enterica enterica serovar Typhi Ty2
agguuauucaggugga

SEQ ID NO: 1785013 - RNA, 21 nt, Salmonella enterica enterica serovar Typhi Ty2
agguguuacgugggucgagaa

SEQ ID NO: 1785014 - RNA, 17 nt, Salmonella enterica enterica serovar Typhi Ty2
agguguuuacgccgcca

SEQ ID NO: 1785015 - RNA, 22 nt, Salmonella enterica enterica serovar Typhi Ty2
agguguucagguaaaugaggac

SEQ ID NO: 1785016 - RNA, 17 nt, Salmonella enterica enterica serovar Typhi Ty2
agguguaucccuauucu

SEQ ID NO: 1785017 - RNA, 14 nt, Salmonella enterica enterica serovar Typhi Ty2
aguaaagauuuguu

SEQ ID NO: 1785018 - RNA, 17 nt, Salmonella enterica enterica serovar Typhi Ty2
aguaaagaaauuuugca

SEQ ID NO: 1785019 - RNA, 20 nt, Salmonella enterica enterica serovar Typhi Ty2
aguaaacuccucuuccgaca

SEQ ID NO: 1785020 - RNA, 17 nt, Salmonella enterica enterica serovar Typhi Ty2
aguaaacgcucaagcaa

SEQ ID NO: 1785021 - RNA, 15 nt, Salmonella enterica enterica serovar Typhi Ty2
aguaaaguuauucac

SEQ ID NO: 1785022 - RNA, 15 nt, Salmonella enterica enterica serovar Typhi Ty2
aguaaauagaaaaua

SEQ ID NO: 1785023 - RNA, 23 nt, Salmonella enterica enterica serovar Typhi Ty2
aguaaauagaaaauaauucuuaa

SEQ ID NO: 1785024 - RNA, 16 nt, Salmonella enterica enterica serovar Typhi Ty2
aguaaaaaaaccguau

SEQ ID NO: 1785025 - RNA, 15 nt, Salmonella enterica enterica serovar Typhi Ty2
aguaaacagaaucaa

SEQ ID NO: 1785026 - RNA, 16 nt, Salmonella enterica enterica serovar Typhi Ty2
agguuguuuuauuacc

SEQ ID NO: 1785027 - RNA, 23 nt, Salmonella enterica enterica serovar Typhi Ty2
agguuuucuaucgcuuuaaucag

SEQ ID NO: 1785028 - RNA, 21 nt, Salmonella enterica enterica serovar Typhi Ty2
agguuuucucauccagcuugc

SEQ ID NO: 1785029 - RNA, 16 nt, Salmonella enterica enterica serovar Typhi Ty2
agguuucuucaucaaa

SEQ ID NO: 1785030 - RNA, 20 nt, Salmonella enterica enterica serovar Typhi Ty2
agguuugaccagauaaucaa

SEQ ID NO: 1785031 - RNA, 14 nt, Salmonella enterica enterica serovar Typhi Ty2
agguaaauccgcca

SEQ ID NO: 1785032 - RNA, 19 nt, Salmonella enterica enterica serovar Typhi Ty2
agguaacgcgaaaaaagau

SEQ ID NO: 1785033 - RNA, 23 nt, Salmonella enterica enterica serovar Typhi Ty2
aggguuuucaauuccacaggcgc

SEQ ID NO: 1785034 - RNA, 22 nt, Salmonella enterica enterica serovar Typhi Ty2
aggguuuucaauuccacaggcg

SEQ ID NO: 1785035 - RNA, 13 nt, Salmonella enterica enterica serovar Typhi Ty2
aggguugccagag

SEQ ID NO: 1785036 - RNA, 21 nt, Salmonella enterica enterica serovar Typhi Ty2
aggguauaugagcgcaggcga

SEQ ID NO: 1785037 - RNA, 16 nt, Salmonella enterica enterica serovar Typhi Ty2
aggguagggauagcau

SEQ ID NO: 1785038 - RNA, 15 nt, Salmonella enterica enterica serovar Typhi Ty2
agggucaacaggcug

SEQ ID NO: 1785039 - RNA, 22 nt, Salmonella enterica enterica serovar Typhi Ty2
agggucgccgcgcccagcagca

SEQ ID NO: 1785040 - RNA, 15 nt, Salmonella enterica enterica serovar Typhi Ty2
agggugcaaagaaac

SEQ ID NO: 1785041 - RNA, 14 nt, Salmonella enterica enterica serovar Typhi Ty2
agggugagagggga

SEQ ID NO: 1785042 - RNA, 23 nt, Salmonella enterica enterica serovar Typhi Ty2
agggugggcgcacaggccuucau

SEQ ID NO: 1785043 - RNA, 14 nt, Salmonella enterica enterica serovar Typhi Ty2
agguauccagcaga

SEQ ID NO: 1785044 - RNA, 18 nt, Salmonella enterica enterica serovar Typhi Ty2
agguauccgccauauccc

SEQ ID NO: 1785045 - RNA, 16 nt, Salmonella enterica enterica serovar Typhi Ty2
agguauccuaaugcca

SEQ ID NO: 1785046 - RNA, 14 nt, Salmonella enterica enterica serovar Typhi Ty2
agguauccgccaua

SEQ ID NO: 1785047 - RNA, 17 nt, Salmonella enterica enterica serovar Typhi Ty2
agguauaggaaaaugau

SEQ ID NO: 1785048 - RNA, 14 nt, Salmonella enterica enterica serovar Typhi Ty2
agguauuuagccac

SEQ ID NO: 1785049 - RNA, 15 nt, Salmonella enterica enterica serovar Typhi Ty2
agguauugauuuuua

SEQ ID NO: 1785050 - RNA, 21 nt, Salmonella enterica enterica serovar Typhi Ty2
agguauugauuuuuaaaaugu

SEQ ID NO: 1785051 - RNA, 14 nt, Salmonella enterica enterica serovar Typhi Ty2
agguauuaaauaca

SEQ ID NO: 1785052 - RNA, 16 nt, Salmonella enterica enterica serovar Typhi Ty2
agguauguaguaaaua

SEQ ID NO: 1785053 - RNA, 16 nt, Salmonella enterica enterica serovar Typhi Ty2
agguauccuccugcca

SEQ ID NO: 1785054 - RNA, 16 nt, Salmonella enterica enterica serovar Typhi Ty2
aggucacaucaucgcc

SEQ ID NO: 1785055 - RNA, 15 nt, Salmonella enterica enterica serovar Typhi Ty2
aggucacaucaucgc

SEQ ID NO: 1785056 - RNA, 19 nt, Salmonella enterica enterica serovar Typhi Ty2
aggucacgccggaaaucac

SEQ ID NO: 1785057 - RNA, 20 nt, Salmonella enterica enterica serovar Typhi Ty2
aggucagauccuuuuucugc

SEQ ID NO: 1785058 - RNA, 23 nt, Salmonella enterica enterica serovar Typhi Ty2
agguauuucgaggggcaggaagg

SEQ ID NO: 1785059 - RNA, 21 nt, Salmonella enterica enterica serovar Typhi Ty2
aggucaaccacgagagcaccg

SEQ ID NO: 1785060 - RNA, 20 nt, Salmonella enterica enterica serovar Typhi Ty2
agguacgcguuucacaaccu

SEQ ID NO: 1785061 - RNA, 13 nt, Salmonella enterica enterica serovar Typhi Ty2
agguacauugcca

SEQ ID NO: 1785062 - RNA, 16 nt, Salmonella enterica enterica serovar Typhi Ty2
agguacagcuuagcug

SEQ ID NO: 1785063 - RNA, 17 nt, Salmonella enterica enterica serovar Typhi Ty2
agguagcagaccgguac

SEQ ID NO: 1785064 - RNA, 22 nt, Salmonella enterica enterica serovar Typhi Ty2
agguacggggcaucuauuuaac

SEQ ID NO: 1785065 - RNA, 17 nt, Salmonella enterica enterica serovar Typhi Ty2
agguaguccaaauaagg

SEQ ID NO: 1785066 - RNA, 19 nt, Salmonella enterica enterica serovar Typhi Ty2
agguagcccggcaggcugg

SEQ ID NO: 1785067 - RNA, 22 nt, Salmonella enterica enterica serovar Typhi Ty2
aggucgaaaacggccaauccug

SEQ ID NO: 1785068 - RNA, 16 nt, Salmonella enterica enterica serovar Typhi Ty2
aggucgccaaauuuag

SEQ ID NO: 1785069 - RNA, 18 nt, Salmonella enterica enterica serovar Typhi Ty2
aggucaucaccuccagca

SEQ ID NO: 1785070 - RNA, 15 nt, Salmonella enterica enterica serovar Typhi Ty2
aggucaugguaaaac

SEQ ID NO: 1785071 - RNA, 17 nt, Salmonella enterica enterica serovar Typhi Ty2
aggucauuauucaggcc

SEQ ID NO: 1785072 - RNA, 20 nt, Salmonella enterica enterica serovar Typhi Ty2
aggucgcuauccagcaguaa

SEQ ID NO: 1785073 - RNA, 21 nt, Salmonella enterica enterica serovar Typhi Ty2
aggucgcggucggccuuaacg

SEQ ID NO: 1785074 - RNA, 14 nt, Salmonella enterica enterica serovar Typhi Ty2
aggucggacguugc

SEQ ID NO: 1785075 - RNA, 22 nt, Salmonella enterica enterica serovar Typhi Ty2
aggucguuucccccgcaacaaa

SEQ ID NO: 1785076 - RNA, 22 nt, Salmonella enterica enterica serovar Typhi Ty2
aggucuuuaucuaucaccgccu

SEQ ID NO: 1785077 - RNA, 18 nt, Salmonella enterica enterica serovar Typhi Ty2
aggucuugccaacaaagg

SEQ ID NO: 1785078 - RNA, 20 nt, Salmonella enterica enterica serovar Typhi Ty2
aggucuugccaacaaagguu

SEQ ID NO: 1785079 - RNA, 14 nt, Salmonella enterica enterica serovar Typhi Ty2
aggucuugauggcg

SEQ ID NO: 1785080 - RNA, 13 nt, Salmonella enterica enterica serovar Typhi Ty2
aggugaauagcau

SEQ ID NO: 1785081 - RNA, 15 nt, Salmonella enterica enterica serovar Typhi Ty2
aggugagcucuuucu

SEQ ID NO: 1785082 - RNA, 13 nt, Salmonella enterica enterica serovar Typhi Ty2
aggugagcucuuu

SEQ ID NO: 1785083 - RNA, 14 nt, Salmonella enterica enterica serovar Typhi Ty2
aggugaucuguuca

SEQ ID NO: 1785084 - RNA, 15 nt, Salmonella enterica enterica serovar Typhi Ty2
agguggcaauauccu

SEQ ID NO: 1785085 - RNA, 16 nt, Salmonella enterica enterica serovar Typhi Ty2
aggugcuggugguggg

SEQ ID NO: 1785086 - RNA, 15 nt, Salmonella enterica enterica serovar Typhi Ty2
aggugcggcugggcg

SEQ ID NO: 1785087 - RNA, 17 nt, Salmonella enterica enterica serovar Typhi Ty2
agguggccgagaggcug

SEQ ID NO: 1785088 - RNA, 17 nt, Salmonella enterica enterica serovar Typhi Ty2
acgguccuggccaggcu

SEQ ID NO: 1785089 - RNA, 18 nt, Salmonella enterica enterica serovar Typhi Ty2
acggugagcugaaagccg

SEQ ID NO: 1785090 - RNA, 21 nt, Salmonella enterica enterica serovar Typhi Ty2
acguaacugcgguaaauaaug

SEQ ID NO: 1785091 - RNA, 22 nt, Salmonella enterica enterica serovar Typhi Ty2
acguaauaaccaccggcgcgcc

SEQ ID NO: 1785092 - RNA, 14 nt, Salmonella enterica enterica serovar Typhi Ty2
acguaacagacgca

SEQ ID NO: 1785093 - RNA, 16 nt, Salmonella enterica enterica serovar Typhi Ty2
acguaacgucguaaau

SEQ ID NO: 1785094 - RNA, 20 nt, Salmonella enterica enterica serovar Typhi Ty2
acguaaauuacuuaugauau

SEQ ID NO: 1785095 - RNA, 17 nt, Salmonella enterica enterica serovar Typhi Ty2
acguaaauuacuuauga

SEQ ID NO: 1785096 - RNA, 15 nt, Salmonella enterica enterica serovar Typhi Ty2
acguaaauauauaca

SEQ ID NO: 1785097 - RNA, 13 nt, Salmonella enterica enterica serovar Typhi Ty2
acguaaauaccca

SEQ ID NO: 1785098 - RNA, 22 nt, Salmonella enterica enterica serovar Typhi Ty2
acguaaagcuggccuucagguu

SEQ ID NO: 1785099 - RNA, 15 nt, Salmonella enterica enterica serovar Typhi Ty2
acguaaagacgacgu

SEQ ID NO: 1785100 - RNA, 13 nt, Salmonella enterica enterica serovar Typhi Ty2
acguaaagcuggc

SEQ ID NO: 1785101 - RNA, 17 nt, Salmonella enterica enterica serovar Typhi Ty2
acgguuaaaaacagcca

SEQ ID NO: 1785102 - RNA, 16 nt, Salmonella enterica enterica serovar Typhi Ty2
acggugugaucaccgc

SEQ ID NO: 1785103 - RNA, 15 nt, Salmonella enterica enterica serovar Typhi Ty2
acgguguggcccagc

SEQ ID NO: 1785104 - RNA, 22 nt, Salmonella enterica enterica serovar Typhi Ty2
acgguucauccagcagcagcac

SEQ ID NO: 1785105 - RNA, 13 nt, Salmonella enterica enterica serovar Typhi Ty2
acgguuucaacuu

SEQ ID NO: 1785106 - RNA, 19 nt, Salmonella enterica enterica serovar Typhi Ty2
acgguaaacgugccacagu

SEQ ID NO: 1785107 - RNA, 23 nt, Salmonella enterica enterica serovar Typhi Ty2
acgguaacgauacccaccagcgu

SEQ ID NO: 1785108 - RNA, 20 nt, Salmonella enterica enterica serovar Typhi Ty2
acgguaaccauuuccggauc

SEQ ID NO: 1785109 - RNA, 14 nt, Salmonella enterica enterica serovar Typhi Ty2
acgguaaaccucuu

SEQ ID NO: 1785110 - RNA, 19 nt, Salmonella enterica enterica serovar Typhi Ty2
acgguacuauuaccgcauc

SEQ ID NO: 1785111 - RNA, 23 nt, Salmonella enterica enterica serovar Typhi Ty2
acgguacaaaccccacccacuga

SEQ ID NO: 1785112 - RNA, 21 nt, Salmonella enterica enterica serovar Typhi Ty2
acgguauucguuaccagcauc

SEQ ID NO: 1785113 - RNA, 12 nt, Salmonella enterica enterica serovar Typhi Ty2
acgguauuucca

SEQ ID NO: 1785114 - RNA, 20 nt, Salmonella enterica enterica serovar Typhi Ty2
acggcggcauuaaagccgcc

SEQ ID NO: 1785115 - RNA, 17 nt, Salmonella enterica enterica serovar Typhi Ty2
acgggcccuggccgcaa

SEQ ID NO: 1785116 - RNA, 17 nt, Salmonella enterica enterica serovar Typhi Ty2
acgggccgccgcagcag

SEQ ID NO: 1785117 - RNA, 23 nt, Salmonella enterica enterica serovar Typhi Ty2
acggcgguaccauaccugcggcc

SEQ ID NO: 1785118 - RNA, 16 nt, Salmonella enterica enterica serovar Typhi Ty2
acgggcccuggccgca

SEQ ID NO: 1785119 - RNA, 21 nt, Salmonella enterica enterica serovar Typhi Ty2
acgggcgggguaguuaucacg

SEQ ID NO: 1785120 - RNA, 23 nt, Salmonella enterica enterica serovar Typhi Ty2
acgggcuuaaucaguucggcauc

SEQ ID NO: 1785121 - RNA, 13 nt, Salmonella enterica enterica serovar Typhi Ty2
acggggcgcagaa

SEQ ID NO: 1785122 - RNA, 22 nt, Salmonella enterica enterica serovar Typhi Ty2
acgcaaggaaauauuaauuaag

SEQ ID NO: 1785123 - RNA, 17 nt, Salmonella enterica enterica serovar Typhi Ty2
acgcaagagagcaacau

SEQ ID NO: 1785124 - RNA, 22 nt, Salmonella enterica enterica serovar Typhi Ty2
acgcugcuauccggcaacacgu

SEQ ID NO: 1785125 - RNA, 13 nt, Salmonella enterica enterica serovar Typhi Ty2
acgcacaaaccgc

SEQ ID NO: 1785126 - RNA, 20 nt, Salmonella enterica enterica serovar Typhi Ty2
acgcugcuccggcuuaaugc

SEQ ID NO: 1785127 - RNA, 13 nt, Salmonella enterica enterica serovar Typhi Ty2
acgcuggcacagg

SEQ ID NO: 1785128 - RNA, 14 nt, Salmonella enterica enterica serovar Typhi Ty2
acgcuggcacagga

SEQ ID NO: 1785129 - RNA, 17 nt, Salmonella enterica enterica serovar Typhi Ty2
acgcuggcacuggcagc

SEQ ID NO: 1785130 - RNA, 20 nt, Salmonella enterica enterica serovar Typhi Ty2
acgcuggcgcaaagaaggca

SEQ ID NO: 1785131 - RNA, 18 nt, Salmonella enterica enterica serovar Typhi Ty2
acgcuggugcgcgggaga

SEQ ID NO: 1785132 - RNA, 18 nt, Salmonella enterica enterica serovar Typhi Ty2
acgcuggugcugugccug

SEQ ID NO: 1785133 - RNA, 17 nt, Salmonella enterica enterica serovar Typhi Ty2
acgcugguuucggcauc

SEQ ID NO: 1785134 - RNA, 23 nt, Salmonella enterica enterica serovar Typhi Ty2
acgcugguuugugugcaggagca

SEQ ID NO: 1785135 - RNA, 18 nt, Salmonella enterica enterica serovar Typhi Ty2
acggaaccaaaugcccag

SEQ ID NO: 1785136 - RNA, 14 nt, Salmonella enterica enterica serovar Typhi Ty2
acggaacccagcaa

SEQ ID NO: 1785137 - RNA, 19 nt, Salmonella enterica enterica serovar Typhi Ty2
acggacauaaaggaaaugc

SEQ ID NO: 1785138 - RNA, 16 nt, Salmonella enterica enterica serovar Typhi Ty2
acggaaaccagauauc

SEQ ID NO: 1785139 - RNA, 17 nt, Salmonella enterica enterica serovar Typhi Ty2
acggaaaagcauugcuu

SEQ ID NO: 1785140 - RNA, 14 nt, Salmonella enterica enterica serovar Typhi Ty2
acggaaaccagcau

SEQ ID NO: 1785141 - RNA, 19 nt, Salmonella enterica enterica serovar Typhi Ty2
acggaacaaaacggaaugu

SEQ ID NO: 1785142 - RNA, 23 nt, Salmonella enterica enterica serovar Typhi Ty2
acggaacaacggcacacaggccg

SEQ ID NO: 1785143 - RNA, 23 nt, Salmonella enterica enterica serovar Typhi Ty2
acggaacaacggcauacaggccg

SEQ ID NO: 1785144 - RNA, 16 nt, Salmonella enterica enterica serovar Typhi Ty2
acgcuuuugcgcacug

SEQ ID NO: 1785145 - RNA, 19 nt, Salmonella enterica enterica serovar Typhi Ty2
acgcuuaucaguccccaca

SEQ ID NO: 1785146 - RNA, 22 nt, Salmonella enterica enterica serovar Typhi Ty2
acggcacaacggccagcaaaau

SEQ ID NO: 1785147 - RNA, 14 nt, Salmonella enterica enterica serovar Typhi Ty2
acggcacacaggcc

SEQ ID NO: 1785148 - RNA, 19 nt, Salmonella enterica enterica serovar Typhi Ty2
acggcaaguauacuuauug

SEQ ID NO: 1785149 - RNA, 13 nt, Salmonella enterica enterica serovar Typhi Ty2
acggauccagaac

SEQ ID NO: 1785150 - RNA, 15 nt, Salmonella enterica enterica serovar Typhi Ty2
acggauccagaacug

SEQ ID NO: 1785151 - RNA, 12 nt, Salmonella enterica enterica serovar Typhi Ty2
acggaucuucca

SEQ ID NO: 1785152 - RNA, 20 nt, Salmonella enterica enterica serovar Typhi Ty2
acggcaaaucgcgguaaaaa

SEQ ID NO: 1785153 - RNA, 16 nt, Salmonella enterica enterica serovar Typhi Ty2
acggcaacgggacggc

SEQ ID NO: 1785154 - RNA, 14 nt, Salmonella enterica enterica serovar Typhi Ty2
acggcaacugaaaa

SEQ ID NO: 1785155 - RNA, 22 nt, Salmonella enterica enterica serovar Typhi Ty2
acggcaacggcgacaagaauau

SEQ ID NO: 1785156 - RNA, 20 nt, Salmonella enterica enterica serovar Typhi Ty2
acggcgacggcuucacugcc

SEQ ID NO: 1785157 - RNA, 22 nt, Salmonella enterica enterica serovar Typhi Ty2
acggcgacgcccgccaucugcu

SEQ ID NO: 1785158 - RNA, 20 nt, Salmonella enterica enterica serovar Typhi Ty2
acggccugcaaacgaaucac

SEQ ID NO: 1785159 - RNA, 18 nt, Salmonella enterica enterica serovar Typhi Ty2
acggcccgugauauugac

SEQ ID NO: 1785160 - RNA, 21 nt, Salmonella enterica enterica serovar Typhi Ty2
acucaaaauaacgcuucaccu

SEQ ID NO: 1785161 - RNA, 23 nt, Salmonella enterica enterica serovar Typhi Ty2
acuauuuuuccggcgucaaaaau

SEQ ID NO: 1785162 - RNA, 13 nt, Salmonella enterica enterica serovar Typhi Ty2
acuauucuucccc

SEQ ID NO: 1785163 - RNA, 22 nt, Salmonella enterica enterica serovar Typhi Ty2
acuauucuuccccuucacucuu

SEQ ID NO: 1785164 - RNA, 18 nt, Salmonella enterica enterica serovar Typhi Ty2
acuauuucggcacugacu

SEQ ID NO: 1785165 - RNA, 20 nt, Salmonella enterica enterica serovar Typhi Ty2
acuauguugaugcuaaccuc

SEQ ID NO: 1785166 - RNA, 16 nt, Salmonella enterica enterica serovar Typhi Ty2
acuauccuggccugau

SEQ ID NO: 1785167 - RNA, 18 nt, Salmonella enterica enterica serovar Typhi Ty2
acuaucgaaagagcaaau

SEQ ID NO: 1785168 - RNA, 22 nt, Salmonella enterica enterica serovar Typhi Ty2
acuaucaguuuuggcaaucaca

SEQ ID NO: 1785169 - RNA, 16 nt, Salmonella enterica enterica serovar Typhi Ty2
acuaucaugauuucuu

SEQ ID NO: 1785170 - RNA, 20 nt, Salmonella enterica enterica serovar Typhi Ty2
acuauaaaaauaccggcauc

SEQ ID NO: 1785171 - RNA, 15 nt, Salmonella enterica enterica serovar Typhi Ty2
acuaauuauuuuuca

SEQ ID NO: 1785172 - RNA, 15 nt, Salmonella enterica enterica serovar Typhi Ty2
acuaccacuuucuug

SEQ ID NO: 1785173 - RNA, 17 nt, Salmonella enterica enterica serovar Typhi Ty2
acuacgccaaugaacuc

SEQ ID NO: 1785174 - RNA, 21 nt, Salmonella enterica enterica serovar Typhi Ty2
acuacggcaaacgcuggugcu

SEQ ID NO: 1785175 - RNA, 16 nt, Salmonella enterica enterica serovar Typhi Ty2
acuaccggcaccagca

SEQ ID NO: 1785176 - RNA, 18 nt, Salmonella enterica enterica serovar Typhi Ty2
acuaccagaaacaacacg

SEQ ID NO: 1785177 - RNA, 20 nt, Salmonella enterica enterica serovar Typhi Ty2
acuaccucuuauccggcugc

SEQ ID NO: 1785178 - RNA, 22 nt, Salmonella enterica enterica serovar Typhi Ty2
acuacuuuuacccuucagauau

SEQ ID NO: 1785179 - RNA, 14 nt, Salmonella enterica enterica serovar Typhi Ty2
acuagaauuuucac

SEQ ID NO: 1785180 - RNA, 23 nt, Salmonella enterica enterica serovar Typhi Ty2
acguuaucuucggucgagcuuuu

SEQ ID NO: 1785181 - RNA, 23 nt, Salmonella enterica enterica serovar Typhi Ty2
acguuaucgccgacaaacaguga

SEQ ID NO: 1785182 - RNA, 17 nt, Salmonella enterica enterica serovar Typhi Ty2
acguuucuuucaucaga

SEQ ID NO: 1785183 - RNA, 18 nt, Salmonella enterica enterica serovar Typhi Ty2
acguuugaccugcagcuc

SEQ ID NO: 1785184 - RNA, 18 nt, Salmonella enterica enterica serovar Typhi Ty2
acguuggggauaaccaga

SEQ ID NO: 1785185 - RNA, 17 nt, Salmonella enterica enterica serovar Typhi Ty2
acguugugauaaaucgu

SEQ ID NO: 1785186 - RNA, 15 nt, Salmonella enterica enterica serovar Typhi Ty2
acuaaaacgugcuga

SEQ ID NO: 1785187 - RNA, 16 nt, Salmonella enterica enterica serovar Typhi Ty2
acuaaaaauucaaaaa

SEQ ID NO: 1785188 - RNA, 23 nt, Salmonella enterica enterica serovar Typhi Ty2
acuaaaaauucaaaaaagcagua

SEQ ID NO: 1785189 - RNA, 19 nt, Salmonella enterica enterica serovar Typhi Ty2
acguuuuuccauucacaca

SEQ ID NO: 1785190 - RNA, 23 nt, Salmonella enterica enterica serovar Typhi Ty2
acguuuugggaaaaccaguugca

SEQ ID NO: 1785191 - RNA, 13 nt, Salmonella enterica enterica serovar Typhi Ty2
acguuuuccugcg

SEQ ID NO: 1785192 - RNA, 17 nt, Salmonella enterica enterica serovar Typhi Ty2
acguuacuugauggaaa

SEQ ID NO: 1785193 - RNA, 21 nt, Salmonella enterica enterica serovar Typhi Ty2
acgugcugaucccgcgcgccu

SEQ ID NO: 1785194 - RNA, 22 nt, Salmonella enterica enterica serovar Typhi Ty2
acgugcauuauuuuagugaaaa

SEQ ID NO: 1785195 - RNA, 13 nt, Salmonella enterica enterica serovar Typhi Ty2
acgucugaagaag

SEQ ID NO: 1785196 - RNA, 14 nt, Salmonella enterica enterica serovar Typhi Ty2
acgucguaaaaccu

SEQ ID NO: 1785197 - RNA, 20 nt, Salmonella enterica enterica serovar Typhi Ty2
acgucgcaagacgaaaaaug

SEQ ID NO: 1785198 - RNA, 17 nt, Salmonella enterica enterica serovar Typhi Ty2
acgucgcaagacgaaaa

SEQ ID NO: 1785199 - RNA, 18 nt, Salmonella enterica enterica serovar Typhi Ty2
acgucgccuggcauggug

SEQ ID NO: 1785200 - RNA, 16 nt, Salmonella enterica enterica serovar Typhi Ty2
acgucgcaagacgaaa

SEQ ID NO: 1785201 - RNA, 16 nt, Salmonella enterica enterica serovar Typhi Ty2
acgucccugccacagu

SEQ ID NO: 1785202 - RNA, 19 nt, Salmonella enterica enterica serovar Typhi Ty2
acguccauccggguaauuu

SEQ ID NO: 1785203 - RNA, 21 nt, Salmonella enterica enterica serovar Typhi Ty2
acguccauaccgguugcgcgc

SEQ ID NO: 1785204 - RNA, 14 nt, Salmonella enterica enterica serovar Typhi Ty2
acguaauauuaagc

SEQ ID NO: 1785205 - RNA, 12 nt, Salmonella enterica enterica serovar Typhi Ty2
acguaauaccug

SEQ ID NO: 1785206 - RNA, 13 nt, Salmonella enterica enterica serovar Typhi Ty2
acguaauaccuga

SEQ ID NO: 1785207 - RNA, 13 nt, Salmonella enterica enterica serovar Typhi Ty2
acguaaugugaaa

SEQ ID NO: 1785208 - RNA, 16 nt, Salmonella enterica enterica serovar Typhi Ty2
acguaaugugaaaaac

SEQ ID NO: 1785209 - RNA, 22 nt, Salmonella enterica enterica serovar Typhi Ty2
acguacagguugugcaucuccu

SEQ ID NO: 1785210 - RNA, 16 nt, Salmonella enterica enterica serovar Typhi Ty2
acuucagagcugaaaa

SEQ ID NO: 1785211 - RNA, 12 nt, Salmonella enterica enterica serovar Typhi Ty2
acuucagauacc

SEQ ID NO: 1785212 - RNA, 19 nt, Salmonella enterica enterica serovar Typhi Ty2
acuucagcauacaggucuu

SEQ ID NO: 1785213 - RNA, 23 nt, Salmonella enterica enterica serovar Typhi Ty2
acuucagcauacaggucuuuccg

SEQ ID NO: 1785214 - RNA, 20 nt, Salmonella enterica enterica serovar Typhi Ty2
acuuccauucggcgaaagaa

SEQ ID NO: 1785215 - RNA, 21 nt, Salmonella enterica enterica serovar Typhi Ty2
acuuccauucggcgaaagaag

SEQ ID NO: 1785216 - RNA, 20 nt, Salmonella enterica enterica serovar Typhi Ty2
acuuccgguauccguucauc

SEQ ID NO: 1785217 - RNA, 15 nt, Salmonella enterica enterica serovar Typhi Ty2
acuuccggaucgcua

SEQ ID NO: 1785218 - RNA, 14 nt, Salmonella enterica enterica serovar Typhi Ty2
acuuccgccucgcc

SEQ ID NO: 1785219 - RNA, 21 nt, Salmonella enterica enterica serovar Typhi Ty2
acuuccgguugaccgcauaau

SEQ ID NO: 1785220 - RNA, 13 nt, Salmonella enterica enterica serovar Typhi Ty2
acuuccccugcca

SEQ ID NO: 1785221 - RNA, 18 nt, Salmonella enterica enterica serovar Typhi Ty2
acuuccgcacgcgcgccc

SEQ ID NO: 1785222 - RNA, 20 nt, Salmonella enterica enterica serovar Typhi Ty2
acuucacaaacaauuucccc

SEQ ID NO: 1785223 - RNA, 13 nt, Salmonella enterica enterica serovar Typhi Ty2
acuucacaaacaa

SEQ ID NO: 1785224 - RNA, 16 nt, Salmonella enterica enterica serovar Typhi Ty2
acuucaccucagccaa

SEQ ID NO: 1785225 - RNA, 18 nt, Salmonella enterica enterica serovar Typhi Ty2
acuucaccauaaaucauu

SEQ ID NO: 1785226 - RNA, 12 nt, Salmonella enterica enterica serovar Typhi Ty2
acuucaaucacu

SEQ ID NO: 1785227 - RNA, 18 nt, Salmonella enterica enterica serovar Typhi Ty2
acuucaauauugaugcua

SEQ ID NO: 1785228 - RNA, 23 nt, Salmonella enterica enterica serovar Typhi Ty2
acuucaagguucgacucgagcaa

SEQ ID NO: 1785229 - RNA, 22 nt, Salmonella enterica enterica serovar Typhi Ty2
acuuaucggcguguuucaucuc

SEQ ID NO: 1785230 - RNA, 16 nt, Salmonella enterica enterica serovar Typhi Ty2
acuuauacugauaaac

SEQ ID NO: 1785231 - RNA, 13 nt, Salmonella enterica enterica serovar Typhi Ty2
acuuauacccuug

SEQ ID NO: 1785232 - RNA, 21 nt, Salmonella enterica enterica serovar Typhi Ty2
acuuauaaguacgccugaaaa

SEQ ID NO: 1785233 - RNA, 21 nt, Salmonella enterica enterica serovar Typhi Ty2
acugucuuaucaggccuacac

SEQ ID NO: 1785234 - RNA, 21 nt, Salmonella enterica enterica serovar Typhi Ty2
acuguucaucaaagaaaacca

SEQ ID NO: 1785235 - RNA, 17 nt, Salmonella enterica enterica serovar Typhi Ty2
acuguuagcgaaacugc

SEQ ID NO: 1785236 - RNA, 14 nt, Salmonella enterica enterica serovar Typhi Ty2
acuguucagcugac

SEQ ID NO: 1785237 - RNA, 13 nt, Salmonella enterica enterica serovar Typhi Ty2
acugucgcuggau

SEQ ID NO: 1785238 - RNA, 17 nt, Salmonella enterica enterica serovar Typhi Ty2
acugguuuguugcgucu

SEQ ID NO: 1785239 - RNA, 13 nt, Salmonella enterica enterica serovar Typhi Ty2
acuguuuuugcuu

SEQ ID NO: 1785240 - RNA, 15 nt, Salmonella enterica enterica serovar Typhi Ty2
acuuaaaauugaauu

SEQ ID NO: 1785241 - RNA, 14 nt, Salmonella enterica enterica serovar Typhi Ty2
acuuaauaucaaua

SEQ ID NO: 1785242 - RNA, 21 nt, Salmonella enterica enterica serovar Typhi Ty2
acuggaucaccugaaugcaaa

SEQ ID NO: 1785243 - RNA, 20 nt, Salmonella enterica enterica serovar Typhi Ty2
acuggaucaccugaaugcaa

SEQ ID NO: 1785244 - RNA, 15 nt, Salmonella enterica enterica serovar Typhi Ty2
acuggaauucguuac

SEQ ID NO: 1785245 - RNA, 23 nt, Salmonella enterica enterica serovar Typhi Ty2
acugcuguguccaggucaucacc

SEQ ID NO: 1785246 - RNA, 17 nt, Salmonella enterica enterica serovar Typhi Ty2
acugcugguaaauccaa

SEQ ID NO: 1785247 - RNA, 23 nt, Salmonella enterica enterica serovar Typhi Ty2
acugcuuaaauuuuuugccgcuc

SEQ ID NO: 1785248 - RNA, 22 nt, Salmonella enterica enterica serovar Typhi Ty2
acugcuggcgcgucacaacagc

SEQ ID NO: 1785249 - RNA, 18 nt, Salmonella enterica enterica serovar Typhi Ty2
acugcuuagcucaucagc

SEQ ID NO: 1785250 - RNA, 14 nt, Salmonella enterica enterica serovar Typhi Ty2
acugcuuugaucac

SEQ ID NO: 1785251 - RNA, 20 nt, Salmonella enterica enterica serovar Typhi Ty2
acugcuuuuccggcagcgca

SEQ ID NO: 1785252 - RNA, 21 nt, Salmonella enterica enterica serovar Typhi Ty2
acugcucguuaaauccuccca

SEQ ID NO: 1785253 - RNA, 22 nt, Salmonella enterica enterica serovar Typhi Ty2
acugcucuaccaacugagcuaa

SEQ ID NO: 1785254 - RNA, 13 nt, Salmonella enterica enterica serovar Typhi Ty2
acugcugcgcgug

SEQ ID NO: 1785255 - RNA, 18 nt, Salmonella enterica enterica serovar Typhi Ty2
acugcugacaaucagcac

SEQ ID NO: 1785256 - RNA, 12 nt, Salmonella enterica enterica serovar Typhi Ty2
acugcugacucu

SEQ ID NO: 1785257 - RNA, 16 nt, Salmonella enterica enterica serovar Typhi Ty2
acugcgugagugugga

SEQ ID NO: 1785258 - RNA, 22 nt, Salmonella enterica enterica serovar Typhi Ty2
acugcguuugaaauaccaggcg

SEQ ID NO: 1785259 - RNA, 16 nt, Salmonella enterica enterica serovar Typhi Ty2
acugguaaccuguucc

SEQ ID NO: 1785260 - RNA, 23 nt, Salmonella enterica enterica serovar Typhi Ty2
acugguaaccuguuccucacuga

SEQ ID NO: 1785261 - RNA, 13 nt, Salmonella enterica enterica serovar Typhi Ty2
acuggugguuuug

SEQ ID NO: 1785262 - RNA, 23 nt, Salmonella enterica enterica serovar Typhi Ty2
acugguggaauaaauauaagauc

SEQ ID NO: 1785263 - RNA, 20 nt, Salmonella enterica enterica serovar Typhi Ty2
acuggugcccgcaaaaccuu

SEQ ID NO: 1785264 - RNA, 20 nt, Salmonella enterica enterica serovar Typhi Ty2
acuggguaaggcgcuugccu

SEQ ID NO: 1785265 - RNA, 21 nt, Salmonella enterica enterica serovar Typhi Ty2
acuggcuuuccugaucaauca

SEQ ID NO: 1785266 - RNA, 17 nt, Salmonella enterica enterica serovar Typhi Ty2
acuggcuuuccugauca

SEQ ID NO: 1785267 - RNA, 22 nt, Salmonella enterica enterica serovar Typhi Ty2
acuggcugugcgugacccacag

SEQ ID NO: 1785268 - RNA, 22 nt, Salmonella enterica enterica serovar Typhi Ty2
acuggcggugcggucacaggca

SEQ ID NO: 1785269 - RNA, 15 nt, Salmonella enterica enterica serovar Typhi Ty2
acuggcgaccgccac

SEQ ID NO: 1785270 - RNA, 16 nt, Salmonella enterica enterica serovar Typhi Ty2
acuggcgaccggcagc

SEQ ID NO: 1785271 - RNA, 12 nt, Salmonella enterica enterica serovar Typhi Ty2
acuggccuccca

SEQ ID NO: 1785272 - RNA, 16 nt, Salmonella enterica enterica serovar Typhi Ty2
acuggccccgcauuuu

SEQ ID NO: 1785273 - RNA, 15 nt, Salmonella enterica enterica serovar Typhi Ty2
acuggcauugugagc

SEQ ID NO: 1785274 - RNA, 22 nt, Salmonella enterica enterica serovar Typhi Ty2
acuggcagccucguccugcaau

SEQ ID NO: 1785275 - RNA, 12 nt, Salmonella enterica enterica serovar Typhi Ty2
acuggauuaucg

SEQ ID NO: 1785276 - RNA, 14 nt, Salmonella enterica enterica serovar Typhi Ty2
acuggcaaauaaaa

SEQ ID NO: 1785277 - RNA, 22 nt, Salmonella enterica enterica serovar Typhi Ty2
acugcacuuccugcgucaggcu

SEQ ID NO: 1785278 - RNA, 14 nt, Salmonella enterica enterica serovar Typhi Ty2
acugccaaccauua

SEQ ID NO: 1785279 - RNA, 22 nt, Salmonella enterica enterica serovar Typhi Ty2
acugcacgccaggguaauacug

SEQ ID NO: 1785280 - RNA, 15 nt, Salmonella enterica enterica serovar Typhi Ty2
acugcccguggcgga

SEQ ID NO: 1785281 - RNA, 12 nt, Salmonella enterica enterica serovar Typhi Ty2
acugcccggcau

SEQ ID NO: 1785282 - RNA, 14 nt, Salmonella enterica enterica serovar Typhi Ty2
acugcccagccgcc

SEQ ID NO: 1785283 - RNA, 23 nt, Salmonella enterica enterica serovar Typhi Ty2
acugcccaaauaaaagccgccgu

SEQ ID NO: 1785284 - RNA, 14 nt, Salmonella enterica enterica serovar Typhi Ty2
acugcccaaauaaa

SEQ ID NO: 1785285 - RNA, 15 nt, Salmonella enterica enterica serovar Typhi Ty2
acugccagaccggcg

SEQ ID NO: 1785286 - RNA, 16 nt, Salmonella enterica enterica serovar Typhi Ty2
acugcgccauguucau

SEQ ID NO: 1785287 - RNA, 23 nt, Salmonella enterica enterica serovar Typhi Ty2
acugcgcgccgcccugcaucaug

SEQ ID NO: 1785288 - RNA, 20 nt, Salmonella enterica enterica serovar Typhi Ty2
acugcgcucuaucaccgccc

SEQ ID NO: 1785289 - RNA, 19 nt, Salmonella enterica enterica serovar Typhi Ty2
acugcggagguuucuuuuu

SEQ ID NO: 1785290 - RNA, 12 nt, Salmonella enterica enterica serovar Typhi Ty2
acugcgccugcu

SEQ ID NO: 1785291 - RNA, 18 nt, Salmonella enterica enterica serovar Typhi Ty2
acugccgccgucaucugc

SEQ ID NO: 1785292 - RNA, 21 nt, Salmonella enterica enterica serovar Typhi Ty2
acugccgcagccgcucagggu

SEQ ID NO: 1785293 - RNA, 15 nt, Salmonella enterica enterica serovar Typhi Ty2
acugccgcccaucgc

SEQ ID NO: 1785294 - RNA, 21 nt, Salmonella enterica enterica serovar Typhi Ty2
acugccgcccaucgccacagc

SEQ ID NO: 1785295 - RNA, 15 nt, Salmonella enterica enterica serovar Typhi Ty2
acugccgcagccgcu

SEQ ID NO: 1785296 - RNA, 13 nt, Salmonella enterica enterica serovar Typhi Ty2
acugcgaauuucc

SEQ ID NO: 1785297 - RNA, 22 nt, Salmonella enterica enterica serovar Typhi Ty2
acugcgaacgcaucaaagccac

SEQ ID NO: 1785298 - RNA, 15 nt, Salmonella enterica enterica serovar Typhi Ty2
acugauaguuuaaau

SEQ ID NO: 1785299 - RNA, 19 nt, Salmonella enterica enterica serovar Typhi Ty2
acugauaguccaucaccuc

SEQ ID NO: 1785300 - RNA, 18 nt, Salmonella enterica enterica serovar Typhi Ty2
acugauacagccaaauca

SEQ ID NO: 1785301 - RNA, 18 nt, Salmonella enterica enterica serovar Typhi Ty2
acugauaagggccuucau

SEQ ID NO: 1785302 - RNA, 22 nt, Salmonella enterica enterica serovar Typhi Ty2
acugagcuucaccgccagagca

SEQ ID NO: 1785303 - RNA, 16 nt, Salmonella enterica enterica serovar Typhi Ty2
acugagcuaacgaccc

SEQ ID NO: 1785304 - RNA, 23 nt, Salmonella enterica enterica serovar Typhi Ty2
acugagcgguuuuuuuguggccu

SEQ ID NO: 1785305 - RNA, 21 nt, Salmonella enterica enterica serovar Typhi Ty2
acugaguauuggcaagaauca

SEQ ID NO: 1785306 - RNA, 16 nt, Salmonella enterica enterica serovar Typhi Ty2
acucuuuuuucagaau

SEQ ID NO: 1785307 - RNA, 15 nt, Salmonella enterica enterica serovar Typhi Ty2
acugaaaaucaaaua

SEQ ID NO: 1785308 - RNA, 21 nt, Salmonella enterica enterica serovar Typhi Ty2
acugacuauccacagcgaauu

SEQ ID NO: 1785309 - RNA, 13 nt, Salmonella enterica enterica serovar Typhi Ty2
acugagacucagc

SEQ ID NO: 1785310 - RNA, 13 nt, Salmonella enterica enterica serovar Typhi Ty2
acugcaaauacca

SEQ ID NO: 1785311 - RNA, 21 nt, Salmonella enterica enterica serovar Typhi Ty2
acugauuucgccccacuggcc

SEQ ID NO: 1785312 - RNA, 17 nt, Salmonella enterica enterica serovar Typhi Ty2
acugauucaaaagguga

SEQ ID NO: 1785313 - RNA, 18 nt, Salmonella enterica enterica serovar Typhi Ty2
acugauuaauugcgacaa

SEQ ID NO: 1785314 - RNA, 15 nt, Salmonella enterica enterica serovar Typhi Ty2
acugauuaauugcga

SEQ ID NO: 1785315 - RNA, 21 nt, Salmonella enterica enterica serovar Typhi Ty2
acugauggcgcuaagccagcc

SEQ ID NO: 1785316 - RNA, 14 nt, Salmonella enterica enterica serovar Typhi Ty2
acugaugccagccg

SEQ ID NO: 1785317 - RNA, 21 nt, Salmonella enterica enterica serovar Typhi Ty2
acugauggaguuucaucagca

SEQ ID NO: 1785318 - RNA, 19 nt, Salmonella enterica enterica serovar Typhi Ty2
acugaucgauccacuuccc

SEQ ID NO: 1785319 - RNA, 20 nt, Salmonella enterica enterica serovar Typhi Ty2
acugaucgcuggugcccggu

SEQ ID NO: 1785320 - RNA, 19 nt, Salmonella enterica enterica serovar Typhi Ty2
acugaucaauuugccuuua

SEQ ID NO: 1785321 - RNA, 17 nt, Salmonella enterica enterica serovar Typhi Ty2
acucgcucccuuccccc

SEQ ID NO: 1785322 - RNA, 20 nt, Salmonella enterica enterica serovar Typhi Ty2
acucucggccuauaaaccac

SEQ ID NO: 1785323 - RNA, 17 nt, Salmonella enterica enterica serovar Typhi Ty2
acucuaugcaaaagaaa

SEQ ID NO: 1785324 - RNA, 14 nt, Salmonella enterica enterica serovar Typhi Ty2
acucuaugcaaaag

SEQ ID NO: 1785325 - RNA, 16 nt, Salmonella enterica enterica serovar Typhi Ty2
acucuaggcgcugcug

SEQ ID NO: 1785326 - RNA, 17 nt, Salmonella enterica enterica serovar Typhi Ty2
acucugaaaaaauuucg

SEQ ID NO: 1785327 - RNA, 23 nt, Salmonella enterica enterica serovar Typhi Ty2
acucuuuuuccgcgagagaaaaa

SEQ ID NO: 1785328 - RNA, 21 nt, Salmonella enterica enterica serovar Typhi Ty2
acucuuuuccccgacggccuc

SEQ ID NO: 1785329 - RNA, 15 nt, Salmonella enterica enterica serovar Typhi Ty2
acucuuaauuauaaa

SEQ ID NO: 1785330 - RNA, 18 nt, Salmonella enterica enterica serovar Typhi Ty2
acucuuaauuauaaagca

SEQ ID NO: 1785331 - RNA, 14 nt, Salmonella enterica enterica serovar Typhi Ty2
acucuuaauuauaa

SEQ ID NO: 1785332 - RNA, 15 nt, Salmonella enterica enterica serovar Typhi Ty2
acucuguuauauauu

SEQ ID NO: 1785333 - RNA, 15 nt, Salmonella enterica enterica serovar Typhi Ty2
acuccuaagagaaaa

SEQ ID NO: 1785334 - RNA, 16 nt, Salmonella enterica enterica serovar Typhi Ty2
acuccgucaaagaaaa

SEQ ID NO: 1785335 - RNA, 18 nt, Salmonella enterica enterica serovar Typhi Ty2
acuccuaagagaaaaccc

SEQ ID NO: 1785336 - RNA, 14 nt, Salmonella enterica enterica serovar Typhi Ty2
acuccgucaaagaa

SEQ ID NO: 1785337 - RNA, 22 nt, Salmonella enterica enterica serovar Typhi Ty2
acuccgccggcgcggaagggau

SEQ ID NO: 1785338 - RNA, 17 nt, Salmonella enterica enterica serovar Typhi Ty2
acucaagguagccacgc

SEQ ID NO: 1785339 - RNA, 12 nt, Salmonella enterica enterica serovar Typhi Ty2
acucaacaucau

SEQ ID NO: 1785340 - RNA, 15 nt, Salmonella enterica enterica serovar Typhi Ty2
acucaacaucauuaa

SEQ ID NO: 1785341 - RNA, 17 nt, Salmonella enterica enterica serovar Typhi Ty2
acucaagcgaauccaga

SEQ ID NO: 1785342 - RNA, 14 nt, Salmonella enterica enterica serovar Typhi Ty2
acuccugccugaca

SEQ ID NO: 1785343 - RNA, 15 nt, Salmonella enterica enterica serovar Typhi Ty2
acuccugcaacagaa

SEQ ID NO: 1785344 - RNA, 11 nt, Salmonella enterica enterica serovar Typhi Ty2
acuccugcaac

SEQ ID NO: 1785345 - RNA, 19 nt, Salmonella enterica enterica serovar Typhi Ty2
acucgaggaacuguucagc

SEQ ID NO: 1785346 - RNA, 13 nt, Salmonella enterica enterica serovar Typhi Ty2
acucgaauuauuu

SEQ ID NO: 1785347 - RNA, 17 nt, Salmonella enterica enterica serovar Typhi Ty2
acuccuuagauuaauca

SEQ ID NO: 1785348 - RNA, 15 nt, Salmonella enterica enterica serovar Typhi Ty2
acuccugggcaaaau

SEQ ID NO: 1785349 - RNA, 16 nt, Salmonella enterica enterica serovar Typhi Ty2
acuccuucuaauucca

SEQ ID NO: 1785350 - RNA, 18 nt, Salmonella enterica enterica serovar Typhi Ty2
agauuagccccagcgcca

SEQ ID NO: 1785351 - RNA, 21 nt, Salmonella enterica enterica serovar Typhi Ty2
agauuacuucaggcugccaac

SEQ ID NO: 1785352 - RNA, 19 nt, Salmonella enterica enterica serovar Typhi Ty2
agauuaucggccagcgcca

SEQ ID NO: 1785353 - RNA, 14 nt, Salmonella enterica enterica serovar Typhi Ty2
agauugauuuauuc

SEQ ID NO: 1785354 - RNA, 21 nt, Salmonella enterica enterica serovar Typhi Ty2
agauugauuuauucacuggca

SEQ ID NO: 1785355 - RNA, 23 nt, Salmonella enterica enterica serovar Typhi Ty2
agauucugcgguaaucugccagc

SEQ ID NO: 1785356 - RNA, 14 nt, Salmonella enterica enterica serovar Typhi Ty2
agauugaacgcugg

SEQ ID NO: 1785357 - RNA, 14 nt, Salmonella enterica enterica serovar Typhi Ty2
agauucuucugccu

SEQ ID NO: 1785358 - RNA, 18 nt, Salmonella enterica enterica serovar Typhi Ty2
agauugaaacgaaaacug

SEQ ID NO: 1785359 - RNA, 17 nt, Salmonella enterica enterica serovar Typhi Ty2
agauguuaaaguuuuuc

SEQ ID NO: 1785360 - RNA, 22 nt, Salmonella enterica enterica serovar Typhi Ty2
agauggucuguaccaccagaau

SEQ ID NO: 1785361 - RNA, 16 nt, Salmonella enterica enterica serovar Typhi Ty2
agauguugauacagaa

SEQ ID NO: 1785362 - RNA, 19 nt, Salmonella enterica enterica serovar Typhi Ty2
agauguucuaucuuucaga

SEQ ID NO: 1785363 - RNA, 17 nt, Salmonella enterica enterica serovar Typhi Ty2
agauuaagaccguauaa

SEQ ID NO: 1785364 - RNA, 16 nt, Salmonella enterica enterica serovar Typhi Ty2
agauuaacagcuucau

SEQ ID NO: 1785365 - RNA, 15 nt, Salmonella enterica enterica serovar Typhi Ty2
agauuaaucagcaga

SEQ ID NO: 1785366 - RNA, 20 nt, Salmonella enterica enterica serovar Typhi Ty2
agauuaauaauugagcgcaa

SEQ ID NO: 1785367 - RNA, 20 nt, Salmonella enterica enterica serovar Typhi Ty2
agauuacucucuugccagcg

SEQ ID NO: 1785368 - RNA, 15 nt, Salmonella enterica enterica serovar Typhi Ty2
agauggcguggccaa

SEQ ID NO: 1785369 - RNA, 21 nt, Salmonella enterica enterica serovar Typhi Ty2
agauggcuaugaagcuggagc

SEQ ID NO: 1785370 - RNA, 21 nt, Salmonella enterica enterica serovar Typhi Ty2
agauggcauugcccggcggca

SEQ ID NO: 1785371 - RNA, 16 nt, Salmonella enterica enterica serovar Typhi Ty2
agauggcaagauuaac

SEQ ID NO: 1785372 - RNA, 16 nt, Salmonella enterica enterica serovar Typhi Ty2
agaugcugucggaaaa

SEQ ID NO: 1785373 - RNA, 16 nt, Salmonella enterica enterica serovar Typhi Ty2
agauggaaaaaaagaa

SEQ ID NO: 1785374 - RNA, 14 nt, Salmonella enterica enterica serovar Typhi Ty2
agauggaaaaaaag

SEQ ID NO: 1785375 - RNA, 13 nt, Salmonella enterica enterica serovar Typhi Ty2
agauggaaaaaaa

SEQ ID NO: 1785376 - RNA, 19 nt, Salmonella enterica enterica serovar Typhi Ty2
agaugcucaggcaacacga

SEQ ID NO: 1785377 - RNA, 13 nt, Salmonella enterica enterica serovar Typhi Ty2
agaucccucaccu

SEQ ID NO: 1785378 - RNA, 18 nt, Salmonella enterica enterica serovar Typhi Ty2
agauccuggcgaaagcga

SEQ ID NO: 1785379 - RNA, 14 nt, Salmonella enterica enterica serovar Typhi Ty2
agauccaacacggc

SEQ ID NO: 1785380 - RNA, 18 nt, Salmonella enterica enterica serovar Typhi Ty2
agaucauuccugaauacc

SEQ ID NO: 1785381 - RNA, 17 nt, Salmonella enterica enterica serovar Typhi Ty2
agauccauaagaugaaa

SEQ ID NO: 1785382 - RNA, 19 nt, Salmonella enterica enterica serovar Typhi Ty2
agauccauaagaugaaaga

SEQ ID NO: 1785383 - RNA, 20 nt, Salmonella enterica enterica serovar Typhi Ty2
agauccauaagaugaaagau

SEQ ID NO: 1785384 - RNA, 21 nt, Salmonella enterica enterica serovar Typhi Ty2
agauccacugagcgcgccaug

SEQ ID NO: 1785385 - RNA, 19 nt, Salmonella enterica enterica serovar Typhi Ty2
agaucguuauccagcagcc

SEQ ID NO: 1785386 - RNA, 22 nt, Salmonella enterica enterica serovar Typhi Ty2
agaucgugcauccggacgccag

SEQ ID NO: 1785387 - RNA, 12 nt, Salmonella enterica enterica serovar Typhi Ty2
agaucgcugcaa

SEQ ID NO: 1785388 - RNA, 17 nt, Salmonella enterica enterica serovar Typhi Ty2
agaucggcauagcggga

SEQ ID NO: 1785389 - RNA, 20 nt, Salmonella enterica enterica serovar Typhi Ty2
agaucgcauaaaauuauaaa

SEQ ID NO: 1785390 - RNA, 18 nt, Salmonella enterica enterica serovar Typhi Ty2
agaucgcguacagcgcca

SEQ ID NO: 1785391 - RNA, 23 nt, Salmonella enterica enterica serovar Typhi Ty2
agaucgaaugaaaauguaucaga

SEQ ID NO: 1785392 - RNA, 19 nt, Salmonella enterica enterica serovar Typhi Ty2
agaucgacagcgcgcgcga

SEQ ID NO: 1785393 - RNA, 16 nt, Salmonella enterica enterica serovar Typhi Ty2
agaucgaccagcgcau

SEQ ID NO: 1785394 - RNA, 14 nt, Salmonella enterica enterica serovar Typhi Ty2
agauccuucauuca

SEQ ID NO: 1785395 - RNA, 15 nt, Salmonella enterica enterica serovar Typhi Ty2
agaucucuaucggca

SEQ ID NO: 1785396 - RNA, 18 nt, Salmonella enterica enterica serovar Typhi Ty2
agaucugucgccgauaau

SEQ ID NO: 1785397 - RNA, 21 nt, Salmonella enterica enterica serovar Typhi Ty2
agaucuuuauccugcacgaag

SEQ ID NO: 1785398 - RNA, 17 nt, Salmonella enterica enterica serovar Typhi Ty2
agaugcccgcagaucug

SEQ ID NO: 1785399 - RNA, 23 nt, Salmonella enterica enterica serovar Typhi Ty2
agaugcagcggcaguuccggcgu

SEQ ID NO: 1785400 - RNA, 15 nt, Salmonella enterica enterica serovar Typhi Ty2
agaugcaggccaagc

SEQ ID NO: 1785401 - RNA, 19 nt, Salmonella enterica enterica serovar Typhi Ty2
agaucaggccgauuucauu

SEQ ID NO: 1785402 - RNA, 18 nt, Salmonella enterica enterica serovar Typhi Ty2
agaucagacgaccaucca

SEQ ID NO: 1785403 - RNA, 14 nt, Salmonella enterica enterica serovar Typhi Ty2
agaucagcauggua

SEQ ID NO: 1785404 - RNA, 22 nt, Salmonella enterica enterica serovar Typhi Ty2
agauauuuuguuuuaaauucaa

SEQ ID NO: 1785405 - RNA, 21 nt, Salmonella enterica enterica serovar Typhi Ty2
agauauuuuguuuuaaauuca

SEQ ID NO: 1785406 - RNA, 20 nt, Salmonella enterica enterica serovar Typhi Ty2
agauauaggguggcuuucua

SEQ ID NO: 1785407 - RNA, 13 nt, Salmonella enterica enterica serovar Typhi Ty2
agauaguggcuga

SEQ ID NO: 1785408 - RNA, 17 nt, Salmonella enterica enterica serovar Typhi Ty2
agauagucaucaccauu

SEQ ID NO: 1785409 - RNA, 17 nt, Salmonella enterica enterica serovar Typhi Ty2
agauaucaccaucuuuu

SEQ ID NO: 1785410 - RNA, 16 nt, Salmonella enterica enterica serovar Typhi Ty2
agauauuauaaaauaa

SEQ ID NO: 1785411 - RNA, 15 nt, Salmonella enterica enterica serovar Typhi Ty2
agauauuaauaucga

SEQ ID NO: 1785412 - RNA, 12 nt, Salmonella enterica enterica serovar Typhi Ty2
agauauucccgg

SEQ ID NO: 1785413 - RNA, 20 nt, Salmonella enterica enterica serovar Typhi Ty2
agagugauccaccaccagca

SEQ ID NO: 1785414 - RNA, 18 nt, Salmonella enterica enterica serovar Typhi Ty2
agagugacgguuuucacu

SEQ ID NO: 1785415 - RNA, 15 nt, Salmonella enterica enterica serovar Typhi Ty2
agauaaaaaagcugc

SEQ ID NO: 1785416 - RNA, 23 nt, Salmonella enterica enterica serovar Typhi Ty2
agauaauuuucccaguucaucca

SEQ ID NO: 1785417 - RNA, 23 nt, Salmonella enterica enterica serovar Typhi Ty2
agauagcccgccagcaccagcag

SEQ ID NO: 1785418 - RNA, 23 nt, Salmonella enterica enterica serovar Typhi Ty2
agauagcgcugcgccagaucagg

SEQ ID NO: 1785419 - RNA, 17 nt, Salmonella enterica enterica serovar Typhi Ty2
agauagcuuccaugccg

SEQ ID NO: 1785420 - RNA, 22 nt, Salmonella enterica enterica serovar Typhi Ty2
agauagcugcuuaccauacuga

SEQ ID NO: 1785421 - RNA, 19 nt, Salmonella enterica enterica serovar Typhi Ty2
agauacugcgcguggcaaa

SEQ ID NO: 1785422 - RNA, 22 nt, Salmonella enterica enterica serovar Typhi Ty2
agauacuggaagugauccuuca

SEQ ID NO: 1785423 - RNA, 18 nt, Salmonella enterica enterica serovar Typhi Ty2
agagcaacgccaucagca

SEQ ID NO: 1785424 - RNA, 22 nt, Salmonella enterica enterica serovar Typhi Ty2
agagcaacgccaucagcaaaau

SEQ ID NO: 1785425 - RNA, 20 nt, Salmonella enterica enterica serovar Typhi Ty2
agagcaaauacuggaaaaaa

SEQ ID NO: 1785426 - RNA, 20 nt, Salmonella enterica enterica serovar Typhi Ty2
agagauucgccguucuguuc

SEQ ID NO: 1785427 - RNA, 17 nt, Salmonella enterica enterica serovar Typhi Ty2
agagaucgacagcgcgc

SEQ ID NO: 1785428 - RNA, 18 nt, Salmonella enterica enterica serovar Typhi Ty2
agagauggaacaucuuuu

SEQ ID NO: 1785429 - RNA, 15 nt, Salmonella enterica enterica serovar Typhi Ty2
agagagaaucggguc

SEQ ID NO: 1785430 - RNA, 16 nt, Salmonella enterica enterica serovar Typhi Ty2
agagagccuuacaggc

SEQ ID NO: 1785431 - RNA, 18 nt, Salmonella enterica enterica serovar Typhi Ty2
agagaguuccuccuggcu

SEQ ID NO: 1785432 - RNA, 12 nt, Salmonella enterica enterica serovar Typhi Ty2
agagagugagaa

SEQ ID NO: 1785433 - RNA, 12 nt, Salmonella enterica enterica serovar Typhi Ty2
agagaguuccuc

SEQ ID NO: 1785434 - RNA, 20 nt, Salmonella enterica enterica serovar Typhi Ty2
agacuauccagccagggauc

SEQ ID NO: 1785435 - RNA, 12 nt, Salmonella enterica enterica serovar Typhi Ty2
agagacugacaa

SEQ ID NO: 1785436 - RNA, 19 nt, Salmonella enterica enterica serovar Typhi Ty2
agagacuggcgacagccgc

SEQ ID NO: 1785437 - RNA, 16 nt, Salmonella enterica enterica serovar Typhi Ty2
agacuacggaaacugu

SEQ ID NO: 1785438 - RNA, 19 nt, Salmonella enterica enterica serovar Typhi Ty2
agacuacgcaaaaaaagcc

SEQ ID NO: 1785439 - RNA, 19 nt, Salmonella enterica enterica serovar Typhi Ty2
agacuacccaucacgcccu

SEQ ID NO: 1785440 - RNA, 22 nt, Salmonella enterica enterica serovar Typhi Ty2
agagucucgaaacgaaucucau

SEQ ID NO: 1785441 - RNA, 10 nt, Salmonella enterica enterica serovar Typhi Ty2
agagucgcca

SEQ ID NO: 1785442 - RNA, 18 nt, Salmonella enterica enterica serovar Typhi Ty2
agaguauaagcgccgcug

SEQ ID NO: 1785443 - RNA, 22 nt, Salmonella enterica enterica serovar Typhi Ty2
agaggucugcauucaggccucu

SEQ ID NO: 1785444 - RNA, 19 nt, Salmonella enterica enterica serovar Typhi Ty2
agagucaaggcauccagca

SEQ ID NO: 1785445 - RNA, 19 nt, Salmonella enterica enterica serovar Typhi Ty2
agagguauccugaaccagc

SEQ ID NO: 1785446 - RNA, 20 nt, Salmonella enterica enterica serovar Typhi Ty2
agaggguuggacaaaauuuu

SEQ ID NO: 1785447 - RNA, 17 nt, Salmonella enterica enterica serovar Typhi Ty2
agagcuugauaaauauc

SEQ ID NO: 1785448 - RNA, 23 nt, Salmonella enterica enterica serovar Typhi Ty2
agagcuuuuccuguucgcuuauu

SEQ ID NO: 1785449 - RNA, 15 nt, Salmonella enterica enterica serovar Typhi Ty2
agagccuuacaggcg

SEQ ID NO: 1785450 - RNA, 16 nt, Salmonella enterica enterica serovar Typhi Ty2
agagccuuacaggcgc

SEQ ID NO: 1785451 - RNA, 21 nt, Salmonella enterica enterica serovar Typhi Ty2
agagccuaucccauuagggcu

SEQ ID NO: 1785452 - RNA, 16 nt, Salmonella enterica enterica serovar Typhi Ty2
agagcgacguugucuu

SEQ ID NO: 1785453 - RNA, 15 nt, Salmonella enterica enterica serovar Typhi Ty2
agagcgcgcucugcc

SEQ ID NO: 1785454 - RNA, 23 nt, Salmonella enterica enterica serovar Typhi Ty2
agaaaaugcgcugggaaucgcga

SEQ ID NO: 1785455 - RNA, 20 nt, Salmonella enterica enterica serovar Typhi Ty2
agaaaauuaacgacaaaaau

SEQ ID NO: 1785456 - RNA, 22 nt, Salmonella enterica enterica serovar Typhi Ty2
agaaaaauuuaagccagaugua

SEQ ID NO: 1785457 - RNA, 19 nt, Salmonella enterica enterica serovar Typhi Ty2
agaaaccaucuugcguuau

SEQ ID NO: 1785458 - RNA, 16 nt, Salmonella enterica enterica serovar Typhi Ty2
agaaaccgcagaaaaa

SEQ ID NO: 1785459 - RNA, 17 nt, Salmonella enterica enterica serovar Typhi Ty2
agaaacugcuguagcac

SEQ ID NO: 1785460 - RNA, 17 nt, Salmonella enterica enterica serovar Typhi Ty2
agaaagcauuaaaucau

SEQ ID NO: 1785461 - RNA, 16 nt, Salmonella enterica enterica serovar Typhi Ty2
acuuuuuuaaauguuu

SEQ ID NO: 1785462 - RNA, 17 nt, Salmonella enterica enterica serovar Typhi Ty2
acuuuuuuaaauguuuu

SEQ ID NO: 1785463 - RNA, 22 nt, Salmonella enterica enterica serovar Typhi Ty2
acuuuuuggcuguugguaugca

SEQ ID NO: 1785464 - RNA, 20 nt, Salmonella enterica enterica serovar Typhi Ty2
acuuuuguagagauccagaa

SEQ ID NO: 1785465 - RNA, 16 nt, Salmonella enterica enterica serovar Typhi Ty2
acuuuucgccccggac

SEQ ID NO: 1785466 - RNA, 18 nt, Salmonella enterica enterica serovar Typhi Ty2
acuucgcgguuagaaagu

SEQ ID NO: 1785467 - RNA, 20 nt, Salmonella enterica enterica serovar Typhi Ty2
acuucgcgguugcgcccuuc

SEQ ID NO: 1785468 - RNA, 19 nt, Salmonella enterica enterica serovar Typhi Ty2
acuuccuggaugcuuaaaa

SEQ ID NO: 1785469 - RNA, 19 nt, Salmonella enterica enterica serovar Typhi Ty2
acuuccugcgucaggcugu

SEQ ID NO: 1785470 - RNA, 22 nt, Salmonella enterica enterica serovar Typhi Ty2
agaacguugacguuucagucac

SEQ ID NO: 1785471 - RNA, 21 nt, Salmonella enterica enterica serovar Typhi Ty2
agaacguugccgcaggcaacg

SEQ ID NO: 1785472 - RNA, 12 nt, Salmonella enterica enterica serovar Typhi Ty2
agaacguauuau

SEQ ID NO: 1785473 - RNA, 15 nt, Salmonella enterica enterica serovar Typhi Ty2
agaacguauuauuau

SEQ ID NO: 1785474 - RNA, 14 nt, Salmonella enterica enterica serovar Typhi Ty2
agaacucaggcaaa

SEQ ID NO: 1785475 - RNA, 16 nt, Salmonella enterica enterica serovar Typhi Ty2
agaacuggcgcgauga

SEQ ID NO: 1785476 - RNA, 22 nt, Salmonella enterica enterica serovar Typhi Ty2
agaacugcugcauccgcgcuuu

SEQ ID NO: 1785477 - RNA, 20 nt, Salmonella enterica enterica serovar Typhi Ty2
agaacgacgaauaagcugaa

SEQ ID NO: 1785478 - RNA, 23 nt, Salmonella enterica enterica serovar Typhi Ty2
agaaccuguucaugccagauuuu

SEQ ID NO: 1785479 - RNA, 13 nt, Salmonella enterica enterica serovar Typhi Ty2
agaacgaauuuac

SEQ ID NO: 1785480 - RNA, 14 nt, Salmonella enterica enterica serovar Typhi Ty2
agaacgagaggagg

SEQ ID NO: 1785481 - RNA, 22 nt, Salmonella enterica enterica serovar Typhi Ty2
agaacggauauccagaaucaca

SEQ ID NO: 1785482 - RNA, 21 nt, Salmonella enterica enterica serovar Typhi Ty2
agaacggcacaauagcgcuaa

SEQ ID NO: 1785483 - RNA, 21 nt, Salmonella enterica enterica serovar Typhi Ty2
agaacggaaguugcauauaag

SEQ ID NO: 1785484 - RNA, 19 nt, Salmonella enterica enterica serovar Typhi Ty2
agaacgcuugucuucggua

SEQ ID NO: 1785485 - RNA, 22 nt, Salmonella enterica enterica serovar Typhi Ty2
agaaccguugcgcccaucauca

SEQ ID NO: 1785486 - RNA, 23 nt, Salmonella enterica enterica serovar Typhi Ty2
agaaccguugcgcccaucaucau

SEQ ID NO: 1785487 - RNA, 23 nt, Salmonella enterica enterica serovar Typhi Ty2
agaaauuuaggucaaaaaagcga

SEQ ID NO: 1785488 - RNA, 23 nt, Salmonella enterica enterica serovar Typhi Ty2
agaaaguaggcgguuucaucgag

SEQ ID NO: 1785489 - RNA, 16 nt, Salmonella enterica enterica serovar Typhi Ty2
agaaauugaauuauaa

SEQ ID NO: 1785490 - RNA, 15 nt, Salmonella enterica enterica serovar Typhi Ty2
agaacauaaacagcg

SEQ ID NO: 1785491 - RNA, 16 nt, Salmonella enterica enterica serovar Typhi Ty2
agaacauuucccgaaa

SEQ ID NO: 1785492 - RNA, 22 nt, Salmonella enterica enterica serovar Typhi Ty2
agaaccaacgucaucaugaaaa

SEQ ID NO: 1785493 - RNA, 11 nt, Salmonella enterica enterica serovar Typhi Ty2
agacagaacag

SEQ ID NO: 1785494 - RNA, 18 nt, Salmonella enterica enterica serovar Typhi Ty2
agacagaacaggaugcuu

SEQ ID NO: 1785495 - RNA, 19 nt, Salmonella enterica enterica serovar Typhi Ty2
agacacuggaaacagccaa

SEQ ID NO: 1785496 - RNA, 20 nt, Salmonella enterica enterica serovar Typhi Ty2
agacagauaacaccagcgau

SEQ ID NO: 1785497 - RNA, 22 nt, Salmonella enterica enterica serovar Typhi Ty2
agacagagaaccugaacaauaa

SEQ ID NO: 1785498 - RNA, 22 nt, Salmonella enterica enterica serovar Typhi Ty2
agacaguguucccugcgcugga

SEQ ID NO: 1785499 - RNA, 18 nt, Salmonella enterica enterica serovar Typhi Ty2
agacagagaaaaucccca

SEQ ID NO: 1785500 - RNA, 15 nt, Salmonella enterica enterica serovar Typhi Ty2
agaccacgaaucagg

SEQ ID NO: 1785501 - RNA, 15 nt, Salmonella enterica enterica serovar Typhi Ty2
agaccaccagcgaca

SEQ ID NO: 1785502 - RNA, 18 nt, Salmonella enterica enterica serovar Typhi Ty2
agaccagaaucccacgga

SEQ ID NO: 1785503 - RNA, 23 nt, Salmonella enterica enterica serovar Typhi Ty2
agaccagaaucccacggagaaaa

SEQ ID NO: 1785504 - RNA, 18 nt, Salmonella enterica enterica serovar Typhi Ty2
agaauugcgccaccuuaa

SEQ ID NO: 1785505 - RNA, 18 nt, Salmonella enterica enterica serovar Typhi Ty2
agacaaccgggcaucacc

SEQ ID NO: 1785506 - RNA, 14 nt, Salmonella enterica enterica serovar Typhi Ty2
agaauuucaaucau

SEQ ID NO: 1785507 - RNA, 22 nt, Salmonella enterica enterica serovar Typhi Ty2
agacaauaccagggcgauuccc

SEQ ID NO: 1785508 - RNA, 15 nt, Salmonella enterica enterica serovar Typhi Ty2
agacgaugaauuccu

SEQ ID NO: 1785509 - RNA, 12 nt, Salmonella enterica enterica serovar Typhi Ty2
agacggcugggc

SEQ ID NO: 1785510 - RNA, 17 nt, Salmonella enterica enterica serovar Typhi Ty2
agacgucggcaccgaau

SEQ ID NO: 1785511 - RNA, 20 nt, Salmonella enterica enterica serovar Typhi Ty2
agacguuuaugccgccaucc

SEQ ID NO: 1785512 - RNA, 20 nt, Salmonella enterica enterica serovar Typhi Ty2
agacguuuacaccgccaucc

SEQ ID NO: 1785513 - RNA, 15 nt, Salmonella enterica enterica serovar Typhi Ty2
agacgucauaccugg

SEQ ID NO: 1785514 - RNA, 22 nt, Salmonella enterica enterica serovar Typhi Ty2
agacgaccauccaccagaaccu

SEQ ID NO: 1785515 - RNA, 14 nt, Salmonella enterica enterica serovar Typhi Ty2
agaccucugcaaac

SEQ ID NO: 1785516 - RNA, 18 nt, Salmonella enterica enterica serovar Typhi Ty2
agaccucugcuuugguuu

SEQ ID NO: 1785517 - RNA, 15 nt, Salmonella enterica enterica serovar Typhi Ty2
agaccauccaugaaa

SEQ ID NO: 1785518 - RNA, 18 nt, Salmonella enterica enterica serovar Typhi Ty2
agacccaguacaaacaaa

SEQ ID NO: 1785519 - RNA, 19 nt, Salmonella enterica enterica serovar Typhi Ty2
agacccaguacaaacaaau

SEQ ID NO: 1785520 - RNA, 13 nt, Salmonella enterica enterica serovar Typhi Ty2
agacccaauaugc

SEQ ID NO: 1785521 - RNA, 23 nt, Salmonella enterica enterica serovar Typhi Ty2
agacccacauauugcgcuucacu

SEQ ID NO: 1785522 - RNA, 18 nt, Salmonella enterica enterica serovar Typhi Ty2
agaauagccggauaaaau

SEQ ID NO: 1785523 - RNA, 17 nt, Salmonella enterica enterica serovar Typhi Ty2
agaauagccggauaaaa

SEQ ID NO: 1785524 - RNA, 16 nt, Salmonella enterica enterica serovar Typhi Ty2
agaauacuuccugcuc

SEQ ID NO: 1785525 - RNA, 21 nt, Salmonella enterica enterica serovar Typhi Ty2
agaauccggcgcucaucagac

SEQ ID NO: 1785526 - RNA, 20 nt, Salmonella enterica enterica serovar Typhi Ty2
agaaucgguagcuacucagg

SEQ ID NO: 1785527 - RNA, 17 nt, Salmonella enterica enterica serovar Typhi Ty2
agaaucgaucagcuuaa

SEQ ID NO: 1785528 - RNA, 21 nt, Salmonella enterica enterica serovar Typhi Ty2
agaaucgauguaguuguucuu

SEQ ID NO: 1785529 - RNA, 22 nt, Salmonella enterica enterica serovar Typhi Ty2
agaauggccagcacaauaacga

SEQ ID NO: 1785530 - RNA, 16 nt, Salmonella enterica enterica serovar Typhi Ty2
agaauggccagcacaa

SEQ ID NO: 1785531 - RNA, 13 nt, Salmonella enterica enterica serovar Typhi Ty2
agaauucgcaaug

SEQ ID NO: 1785532 - RNA, 13 nt, Salmonella enterica enterica serovar Typhi Ty2
agaauuauuucag

SEQ ID NO: 1785533 - RNA, 15 nt, Salmonella enterica enterica serovar Typhi Ty2
agaaucucugacagg

SEQ ID NO: 1785534 - RNA, 19 nt, Salmonella enterica enterica serovar Typhi Ty2
agaaucuguauaaaauauu

SEQ ID NO: 1785535 - RNA, 14 nt, Salmonella enterica enterica serovar Typhi Ty2
agaaucuguuucag

SEQ ID NO: 1785536 - RNA, 16 nt, Salmonella enterica enterica serovar Typhi Ty2
agaaggugaguuucgc

SEQ ID NO: 1785537 - RNA, 13 nt, Salmonella enterica enterica serovar Typhi Ty2
agaagcuuaccac

SEQ ID NO: 1785538 - RNA, 15 nt, Salmonella enterica enterica serovar Typhi Ty2
agaagcuuaccaccu

SEQ ID NO: 1785539 - RNA, 17 nt, Salmonella enterica enterica serovar Typhi Ty2
agaaguaaacagaauca

SEQ ID NO: 1785540 - RNA, 14 nt, Salmonella enterica enterica serovar Typhi Ty2
agaauacgaauauu

SEQ ID NO: 1785541 - RNA, 14 nt, Salmonella enterica enterica serovar Typhi Ty2
agaacuuaaauuaa

SEQ ID NO: 1785542 - RNA, 11 nt, Salmonella enterica enterica serovar Typhi Ty2
agaagcaaauu

SEQ ID NO: 1785543 - RNA, 15 nt, Salmonella enterica enterica serovar Typhi Ty2
agaagauuucuuaau

SEQ ID NO: 1785544 - RNA, 17 nt, Salmonella enterica enterica serovar Typhi Ty2
agaagaaucgccccauu

SEQ ID NO: 1785545 - RNA, 16 nt, Salmonella enterica enterica serovar Typhi Ty2
agaagacagaagcuga

SEQ ID NO: 1785546 - RNA, 20 nt, Salmonella enterica enterica serovar Typhi Ty2
agaagcacgacacaaaagca

SEQ ID NO: 1785547 - RNA, 23 nt, Salmonella enterica enterica serovar Typhi Ty2
acaggguuugccagcaccagcag

SEQ ID NO: 1785548 - RNA, 23 nt, Salmonella enterica enterica serovar Typhi Ty2
acagggcguuuuauaagccgauc

SEQ ID NO: 1785549 - RNA, 18 nt, Salmonella enterica enterica serovar Typhi Ty2
acagggcggcgcgcugcc

SEQ ID NO: 1785550 - RNA, 22 nt, Salmonella enterica enterica serovar Typhi Ty2
acaggcuuuucaggcuguggcu

SEQ ID NO: 1785551 - RNA, 18 nt, Salmonella enterica enterica serovar Typhi Ty2
acaggcggcuguugguuu

SEQ ID NO: 1785552 - RNA, 21 nt, Salmonella enterica enterica serovar Typhi Ty2
acaggcggaaaucaacaaucc

SEQ ID NO: 1785553 - RNA, 20 nt, Salmonella enterica enterica serovar Typhi Ty2
acaguagcaggggcuggaga

SEQ ID NO: 1785554 - RNA, 21 nt, Salmonella enterica enterica serovar Typhi Ty2
acaguagagggggaccucauc

SEQ ID NO: 1785555 - RNA, 14 nt, Salmonella enterica enterica serovar Typhi Ty2
acaguagcaggggc

SEQ ID NO: 1785556 - RNA, 16 nt, Salmonella enterica enterica serovar Typhi Ty2
acaguagagggggacc

SEQ ID NO: 1785557 - RNA, 15 nt, Salmonella enterica enterica serovar Typhi Ty2
acagguggaaagugc

SEQ ID NO: 1785558 - RNA, 18 nt, Salmonella enterica enterica serovar Typhi Ty2
acagguugcguaacgcca

SEQ ID NO: 1785559 - RNA, 16 nt, Salmonella enterica enterica serovar Typhi Ty2
acaguaaccccauaca

SEQ ID NO: 1785560 - RNA, 17 nt, Salmonella enterica enterica serovar Typhi Ty2
acaguaaaaaaacgccu

SEQ ID NO: 1785561 - RNA, 22 nt, Salmonella enterica enterica serovar Typhi Ty2
acagucaaacacgaccagcgac

SEQ ID NO: 1785562 - RNA, 14 nt, Salmonella enterica enterica serovar Typhi Ty2
acagugaguacgca

SEQ ID NO: 1785563 - RNA, 20 nt, Salmonella enterica enterica serovar Typhi Ty2
acagugauuuacuccaaaaa

SEQ ID NO: 1785564 - RNA, 18 nt, Salmonella enterica enterica serovar Typhi Ty2
acaguggaaaguaccaaa

SEQ ID NO: 1785565 - RNA, 16 nt, Salmonella enterica enterica serovar Typhi Ty2
acagugggcuaugaag

SEQ ID NO: 1785566 - RNA, 14 nt, Salmonella enterica enterica serovar Typhi Ty2
acaguuaccacaca

SEQ ID NO: 1785567 - RNA, 19 nt, Salmonella enterica enterica serovar Typhi Ty2
acaguucauuucaggcaaa

SEQ ID NO: 1785568 - RNA, 20 nt, Salmonella enterica enterica serovar Typhi Ty2
acauaaaaugguuauugcuu

SEQ ID NO: 1785569 - RNA, 15 nt, Salmonella enterica enterica serovar Typhi Ty2
acauaaauaaacagc

SEQ ID NO: 1785570 - RNA, 14 nt, Salmonella enterica enterica serovar Typhi Ty2
acauaauggagaac

SEQ ID NO: 1785571 - RNA, 17 nt, Salmonella enterica enterica serovar Typhi Ty2
acaucgccggagccgcc

SEQ ID NO: 1785572 - RNA, 16 nt, Salmonella enterica enterica serovar Typhi Ty2
acaucgccaccaccag

SEQ ID NO: 1785573 - RNA, 12 nt, Salmonella enterica enterica serovar Typhi Ty2
acaucuuccagg

SEQ ID NO: 1785574 - RNA, 23 nt, Salmonella enterica enterica serovar Typhi Ty2
acaucucaucggcuuuuuuguau

SEQ ID NO: 1785575 - RNA, 22 nt, Salmonella enterica enterica serovar Typhi Ty2
acaucugccgcuuugaggauca

SEQ ID NO: 1785576 - RNA, 22 nt, Salmonella enterica enterica serovar Typhi Ty2
acaugacguauucaccucccug

SEQ ID NO: 1785577 - RNA, 16 nt, Salmonella enterica enterica serovar Typhi Ty2
acaucuuccaugccuu

SEQ ID NO: 1785578 - RNA, 15 nt, Salmonella enterica enterica serovar Typhi Ty2
acaugaauaauaaua

SEQ ID NO: 1785579 - RNA, 17 nt, Salmonella enterica enterica serovar Typhi Ty2
acaugaauaauaauaca

SEQ ID NO: 1785580 - RNA, 16 nt, Salmonella enterica enterica serovar Typhi Ty2
acaugaccgcacagca

SEQ ID NO: 1785581 - RNA, 19 nt, Salmonella enterica enterica serovar Typhi Ty2
acaugaccgcacagcagac

SEQ ID NO: 1785582 - RNA, 19 nt, Salmonella enterica enterica serovar Typhi Ty2
acaugauaaguuucucuuc

SEQ ID NO: 1785583 - RNA, 13 nt, Salmonella enterica enterica serovar Typhi Ty2
acaucauuaucca

SEQ ID NO: 1785584 - RNA, 13 nt, Salmonella enterica enterica serovar Typhi Ty2
acauccacauagg

SEQ ID NO: 1785585 - RNA, 22 nt, Salmonella enterica enterica serovar Typhi Ty2
acaucaacaaagggcaccuggg

SEQ ID NO: 1785586 - RNA, 19 nt, Salmonella enterica enterica serovar Typhi Ty2
acaucacgcaaaugcagcg

SEQ ID NO: 1785587 - RNA, 18 nt, Salmonella enterica enterica serovar Typhi Ty2
acaucagccagcagcuca

SEQ ID NO: 1785588 - RNA, 15 nt, Salmonella enterica enterica serovar Typhi Ty2
acaucagcaaaugaa

SEQ ID NO: 1785589 - RNA, 13 nt, Salmonella enterica enterica serovar Typhi Ty2
acaucagauaaac

SEQ ID NO: 1785590 - RNA, 19 nt, Salmonella enterica enterica serovar Typhi Ty2
acaucagaaaaaagccaag

SEQ ID NO: 1785591 - RNA, 13 nt, Salmonella enterica enterica serovar Typhi Ty2
acauauuuuuguu

SEQ ID NO: 1785592 - RNA, 19 nt, Salmonella enterica enterica serovar Typhi Ty2
acauauuuuuguugaaaua

SEQ ID NO: 1785593 - RNA, 22 nt, Salmonella enterica enterica serovar Typhi Ty2
acauauuugcgugucaucaaaa

SEQ ID NO: 1785594 - RNA, 23 nt, Salmonella enterica enterica serovar Typhi Ty2
acauauuugcgugucaucaaaau

SEQ ID NO: 1785595 - RNA, 21 nt, Salmonella enterica enterica serovar Typhi Ty2
acauauuugcgugucaucaaa

SEQ ID NO: 1785596 - RNA, 22 nt, Salmonella enterica enterica serovar Typhi Ty2
acauauuuuucacacauaagca

SEQ ID NO: 1785597 - RNA, 12 nt, Salmonella enterica enterica serovar Typhi Ty2
acauauuuuuau

SEQ ID NO: 1785598 - RNA, 14 nt, Salmonella enterica enterica serovar Typhi Ty2
acauauuugcgugu

SEQ ID NO: 1785599 - RNA, 15 nt, Salmonella enterica enterica serovar Typhi Ty2
acauauuguuuucua

SEQ ID NO: 1785600 - RNA, 23 nt, Salmonella enterica enterica serovar Typhi Ty2
acauacaccggcgccagcucugc

SEQ ID NO: 1785601 - RNA, 17 nt, Salmonella enterica enterica serovar Typhi Ty2
acauacaaagagaaaau

SEQ ID NO: 1785602 - RNA, 16 nt, Salmonella enterica enterica serovar Typhi Ty2
acauauuccagaagcg

SEQ ID NO: 1785603 - RNA, 14 nt, Salmonella enterica enterica serovar Typhi Ty2
acauauuccagaag

SEQ ID NO: 1785604 - RNA, 15 nt, Salmonella enterica enterica serovar Typhi Ty2
acauauucaauaaua

SEQ ID NO: 1785605 - RNA, 14 nt, Salmonella enterica enterica serovar Typhi Ty2
acauauucaauaau

SEQ ID NO: 1785606 - RNA, 14 nt, Salmonella enterica enterica serovar Typhi Ty2
acacuuucaucagc

SEQ ID NO: 1785607 - RNA, 16 nt, Salmonella enterica enterica serovar Typhi Ty2
acacuuucgcccggcg

SEQ ID NO: 1785608 - RNA, 18 nt, Salmonella enterica enterica serovar Typhi Ty2
acacuucucaacauugac

SEQ ID NO: 1785609 - RNA, 22 nt, Salmonella enterica enterica serovar Typhi Ty2
acagacccaguacaaacaaaua

SEQ ID NO: 1785610 - RNA, 13 nt, Salmonella enterica enterica serovar Typhi Ty2
acagacaauacca

SEQ ID NO: 1785611 - RNA, 14 nt, Salmonella enterica enterica serovar Typhi Ty2
acagacaaggugga

SEQ ID NO: 1785612 - RNA, 20 nt, Salmonella enterica enterica serovar Typhi Ty2
acagacaucggagauuucau

SEQ ID NO: 1785613 - RNA, 16 nt, Salmonella enterica enterica serovar Typhi Ty2
acagaauuaacgcaga

SEQ ID NO: 1785614 - RNA, 18 nt, Salmonella enterica enterica serovar Typhi Ty2
acagaauuaacgcagaau

SEQ ID NO: 1785615 - RNA, 20 nt, Salmonella enterica enterica serovar Typhi Ty2
acagaaugcugaacagccgu

SEQ ID NO: 1785616 - RNA, 22 nt, Salmonella enterica enterica serovar Typhi Ty2
acacuggaaacagccaaucaua

SEQ ID NO: 1785617 - RNA, 15 nt, Salmonella enterica enterica serovar Typhi Ty2
acacugaagccuggu

SEQ ID NO: 1785618 - RNA, 14 nt, Salmonella enterica enterica serovar Typhi Ty2
acacugaaacuccg

SEQ ID NO: 1785619 - RNA, 23 nt, Salmonella enterica enterica serovar Typhi Ty2
acagcacuacggauggcccugcc

SEQ ID NO: 1785620 - RNA, 20 nt, Salmonella enterica enterica serovar Typhi Ty2
acagcacuaacgaggccacc

SEQ ID NO: 1785621 - RNA, 14 nt, Salmonella enterica enterica serovar Typhi Ty2
acagccacacugcu

SEQ ID NO: 1785622 - RNA, 21 nt, Salmonella enterica enterica serovar Typhi Ty2
acagagucgcuuaucugcugc

SEQ ID NO: 1785623 - RNA, 18 nt, Salmonella enterica enterica serovar Typhi Ty2
acagagucguuagcagaa

SEQ ID NO: 1785624 - RNA, 13 nt, Salmonella enterica enterica serovar Typhi Ty2
acagaggaaugaa

SEQ ID NO: 1785625 - RNA, 18 nt, Salmonella enterica enterica serovar Typhi Ty2
acagaggaaugaaaacga

SEQ ID NO: 1785626 - RNA, 16 nt, Salmonella enterica enterica serovar Typhi Ty2
acagcaaugcccaaaa

SEQ ID NO: 1785627 - RNA, 16 nt, Salmonella enterica enterica serovar Typhi Ty2
acagcaauaucagcca

SEQ ID NO: 1785628 - RNA, 18 nt, Salmonella enterica enterica serovar Typhi Ty2
acagcaauaucagccauu

SEQ ID NO: 1785629 - RNA, 15 nt, Salmonella enterica enterica serovar Typhi Ty2
acagcaaugagcagg

SEQ ID NO: 1785630 - RNA, 13 nt, Salmonella enterica enterica serovar Typhi Ty2
acagcacauagaa

SEQ ID NO: 1785631 - RNA, 11 nt, Salmonella enterica enterica serovar Typhi Ty2
acagcacauag

SEQ ID NO: 1785632 - RNA, 17 nt, Salmonella enterica enterica serovar Typhi Ty2
acagauuggucagcagc

SEQ ID NO: 1785633 - RNA, 12 nt, Salmonella enterica enterica serovar Typhi Ty2
acagauuaucag

SEQ ID NO: 1785634 - RNA, 17 nt, Salmonella enterica enterica serovar Typhi Ty2
acaggcgcaucagaaaa

SEQ ID NO: 1785635 - RNA, 15 nt, Salmonella enterica enterica serovar Typhi Ty2
acaggcgcaucagaa

SEQ ID NO: 1785636 - RNA, 18 nt, Salmonella enterica enterica serovar Typhi Ty2
acaggcgcggagacguga

SEQ ID NO: 1785637 - RNA, 20 nt, Salmonella enterica enterica serovar Typhi Ty2
acaggccgccauaagaaugu

SEQ ID NO: 1785638 - RNA, 13 nt, Salmonella enterica enterica serovar Typhi Ty2
acaggcauggccu

SEQ ID NO: 1785639 - RNA, 16 nt, Salmonella enterica enterica serovar Typhi Ty2
acaggcauggccuuca

SEQ ID NO: 1785640 - RNA, 20 nt, Salmonella enterica enterica serovar Typhi Ty2
acaggccaacauagcggcaa

SEQ ID NO: 1785641 - RNA, 20 nt, Salmonella enterica enterica serovar Typhi Ty2
acaggcaccagcguauaauu

SEQ ID NO: 1785642 - RNA, 14 nt, Salmonella enterica enterica serovar Typhi Ty2
acaggacagauguc

SEQ ID NO: 1785643 - RNA, 16 nt, Salmonella enterica enterica serovar Typhi Ty2
acaggaauaaccacug

SEQ ID NO: 1785644 - RNA, 15 nt, Salmonella enterica enterica serovar Typhi Ty2
acaggaauuccaguc

SEQ ID NO: 1785645 - RNA, 19 nt, Salmonella enterica enterica serovar Typhi Ty2
acaggaacaucguguccug

SEQ ID NO: 1785646 - RNA, 21 nt, Salmonella enterica enterica serovar Typhi Ty2
acagcucggcaaagcccauca

SEQ ID NO: 1785647 - RNA, 15 nt, Salmonella enterica enterica serovar Typhi Ty2
acagcucaccccuau

SEQ ID NO: 1785648 - RNA, 13 nt, Salmonella enterica enterica serovar Typhi Ty2
acagcucaccccu

SEQ ID NO: 1785649 - RNA, 19 nt, Salmonella enterica enterica serovar Typhi Ty2
acagcuuaaucaccagcgc

SEQ ID NO: 1785650 - RNA, 17 nt, Salmonella enterica enterica serovar Typhi Ty2
acagcuuagcuguaauu

SEQ ID NO: 1785651 - RNA, 16 nt, Salmonella enterica enterica serovar Typhi Ty2
acagcuuagcuguaau

SEQ ID NO: 1785652 - RNA, 22 nt, Salmonella enterica enterica serovar Typhi Ty2
acagcuucaugcgccgcgacaa

SEQ ID NO: 1785653 - RNA, 19 nt, Salmonella enterica enterica serovar Typhi Ty2
acagcuucgguccggcgcu

SEQ ID NO: 1785654 - RNA, 14 nt, Salmonella enterica enterica serovar Typhi Ty2
acagcuuuuacaac

SEQ ID NO: 1785655 - RNA, 13 nt, Salmonella enterica enterica serovar Typhi Ty2
acagcggagagac

SEQ ID NO: 1785656 - RNA, 20 nt, Salmonella enterica enterica serovar Typhi Ty2
acagcgcgccaauccaugcc

SEQ ID NO: 1785657 - RNA, 13 nt, Salmonella enterica enterica serovar Typhi Ty2
acagcgcgcgcga

SEQ ID NO: 1785658 - RNA, 13 nt, Salmonella enterica enterica serovar Typhi Ty2
acagcgccagaca

SEQ ID NO: 1785659 - RNA, 15 nt, Salmonella enterica enterica serovar Typhi Ty2
acagcgccagaauag

SEQ ID NO: 1785660 - RNA, 15 nt, Salmonella enterica enterica serovar Typhi Ty2
acagcgcaauaugca

SEQ ID NO: 1785661 - RNA, 20 nt, Salmonella enterica enterica serovar Typhi Ty2
acagcguacaauggcaggca

SEQ ID NO: 1785662 - RNA, 17 nt, Salmonella enterica enterica serovar Typhi Ty2
acagcguacaauggcag

SEQ ID NO: 1785663 - RNA, 15 nt, Salmonella enterica enterica serovar Typhi Ty2
acagcguacaauggc

SEQ ID NO: 1785664 - RNA, 14 nt, Salmonella enterica enterica serovar Typhi Ty2
acagcggcaggcgg

SEQ ID NO: 1785665 - RNA, 20 nt, Salmonella enterica enterica serovar Typhi Ty2
acagcggcucgaacuguucu

SEQ ID NO: 1785666 - RNA, 22 nt, Salmonella enterica enterica serovar Typhi Ty2
acagcguaguuuauucaucucc

SEQ ID NO: 1785667 - RNA, 12 nt, Salmonella enterica enterica serovar Typhi Ty2
acagcgugaaca

SEQ ID NO: 1785668 - RNA, 15 nt, Salmonella enterica enterica serovar Typhi Ty2
acagcguguucaugc

SEQ ID NO: 1785669 - RNA, 15 nt, Salmonella enterica enterica serovar Typhi Ty2
acagcgaccacgcca

SEQ ID NO: 1785670 - RNA, 13 nt, Salmonella enterica enterica serovar Typhi Ty2
acagcgacgccag

SEQ ID NO: 1785671 - RNA, 17 nt, Salmonella enterica enterica serovar Typhi Ty2
acagcgacacuccgcgc

SEQ ID NO: 1785672 - RNA, 23 nt, Salmonella enterica enterica serovar Typhi Ty2
acagcgaacaguguaaacgccag

SEQ ID NO: 1785673 - RNA, 21 nt, Salmonella enterica enterica serovar Typhi Ty2
acagccuaaaaaaccggccca

SEQ ID NO: 1785674 - RNA, 23 nt, Salmonella enterica enterica serovar Typhi Ty2
acagccgcuguuuuucaucauca

SEQ ID NO: 1785675 - RNA, 16 nt, Salmonella enterica enterica serovar Typhi Ty2
acagccgcauuuuuuc

SEQ ID NO: 1785676 - RNA, 16 nt, Salmonella enterica enterica serovar Typhi Ty2
acagcccuuucaggaa

SEQ ID NO: 1785677 - RNA, 21 nt, Salmonella enterica enterica serovar Typhi Ty2
accauuacgcccccucgcccu

SEQ ID NO: 1785678 - RNA, 16 nt, Salmonella enterica enterica serovar Typhi Ty2
accauuaucgcuccgg

SEQ ID NO: 1785679 - RNA, 19 nt, Salmonella enterica enterica serovar Typhi Ty2
accaucauuaauauaaucc

SEQ ID NO: 1785680 - RNA, 14 nt, Salmonella enterica enterica serovar Typhi Ty2
accaucaugcaaga

SEQ ID NO: 1785681 - RNA, 14 nt, Salmonella enterica enterica serovar Typhi Ty2
accaucaguucagg

SEQ ID NO: 1785682 - RNA, 14 nt, Salmonella enterica enterica serovar Typhi Ty2
accauugauaccaa

SEQ ID NO: 1785683 - RNA, 13 nt, Salmonella enterica enterica serovar Typhi Ty2
accauuccagguc

SEQ ID NO: 1785684 - RNA, 19 nt, Salmonella enterica enterica serovar Typhi Ty2
acccacaagaaaugcaggc

SEQ ID NO: 1785685 - RNA, 16 nt, Salmonella enterica enterica serovar Typhi Ty2
acccaccauaaaacca

SEQ ID NO: 1785686 - RNA, 13 nt, Salmonella enterica enterica serovar Typhi Ty2
acccaccagcagg

SEQ ID NO: 1785687 - RNA, 13 nt, Salmonella enterica enterica serovar Typhi Ty2
acccaccagcgcc

SEQ ID NO: 1785688 - RNA, 22 nt, Salmonella enterica enterica serovar Typhi Ty2
acccagaaucaguaacacaauc

SEQ ID NO: 1785689 - RNA, 15 nt, Salmonella enterica enterica serovar Typhi Ty2
acccacuucuuccag

SEQ ID NO: 1785690 - RNA, 16 nt, Salmonella enterica enterica serovar Typhi Ty2
acccaauugaauuuaa

SEQ ID NO: 1785691 - RNA, 13 nt, Salmonella enterica enterica serovar Typhi Ty2
acccaacaccaga

SEQ ID NO: 1785692 - RNA, 22 nt, Salmonella enterica enterica serovar Typhi Ty2
accauuguuguaagggcuggaa

SEQ ID NO: 1785693 - RNA, 15 nt, Salmonella enterica enterica serovar Typhi Ty2
acccaacgcaaugcg

SEQ ID NO: 1785694 - RNA, 14 nt, Salmonella enterica enterica serovar Typhi Ty2
acccagauaucagu

SEQ ID NO: 1785695 - RNA, 16 nt, Salmonella enterica enterica serovar Typhi Ty2
acccagauuaugggua

SEQ ID NO: 1785696 - RNA, 22 nt, Salmonella enterica enterica serovar Typhi Ty2
acccagcccaauacgccagccu

SEQ ID NO: 1785697 - RNA, 16 nt, Salmonella enterica enterica serovar Typhi Ty2
acccagcgaauuauga

SEQ ID NO: 1785698 - RNA, 13 nt, Salmonella enterica enterica serovar Typhi Ty2
acccagcagcaga

SEQ ID NO: 1785699 - RNA, 20 nt, Salmonella enterica enterica serovar Typhi Ty2
acccagccacaugauguugu

SEQ ID NO: 1785700 - RNA, 20 nt, Salmonella enterica enterica serovar Typhi Ty2
accccacgcuuuuuuauuuu

SEQ ID NO: 1785701 - RNA, 12 nt, Salmonella enterica enterica serovar Typhi Ty2
accccagcugcg

SEQ ID NO: 1785702 - RNA, 18 nt, Salmonella enterica enterica serovar Typhi Ty2
accccaggcauagaaaaa

SEQ ID NO: 1785703 - RNA, 11 nt, Salmonella enterica enterica serovar Typhi Ty2
accccaucccg

SEQ ID NO: 1785704 - RNA, 15 nt, Salmonella enterica enterica serovar Typhi Ty2
accccaucccggcaa

SEQ ID NO: 1785705 - RNA, 18 nt, Salmonella enterica enterica serovar Typhi Ty2
accccagggagacggcca

SEQ ID NO: 1785706 - RNA, 12 nt, Salmonella enterica enterica serovar Typhi Ty2
acccccagccau

SEQ ID NO: 1785707 - RNA, 17 nt, Salmonella enterica enterica serovar Typhi Ty2
acccccagcacauuaca

SEQ ID NO: 1785708 - RNA, 16 nt, Salmonella enterica enterica serovar Typhi Ty2
accaggucgccagcgg

SEQ ID NO: 1785709 - RNA, 22 nt, Salmonella enterica enterica serovar Typhi Ty2
accaggucguccguugccaccc

SEQ ID NO: 1785710 - RNA, 14 nt, Salmonella enterica enterica serovar Typhi Ty2
accaguaaccgcca

SEQ ID NO: 1785711 - RNA, 19 nt, Salmonella enterica enterica serovar Typhi Ty2
accagggauuuugcuuuuu

SEQ ID NO: 1785712 - RNA, 20 nt, Salmonella enterica enterica serovar Typhi Ty2
accagggaggacgcaagagc

SEQ ID NO: 1785713 - RNA, 15 nt, Salmonella enterica enterica serovar Typhi Ty2
accagcgacggccag

SEQ ID NO: 1785714 - RNA, 22 nt, Salmonella enterica enterica serovar Typhi Ty2
accagcgcaagcagcgccccgc

SEQ ID NO: 1785715 - RNA, 22 nt, Salmonella enterica enterica serovar Typhi Ty2
accagcgccgccagauaaagcg

SEQ ID NO: 1785716 - RNA, 15 nt, Salmonella enterica enterica serovar Typhi Ty2
accagcgccaggcca

SEQ ID NO: 1785717 - RNA, 17 nt, Salmonella enterica enterica serovar Typhi Ty2
accagcgcuucgccugc

SEQ ID NO: 1785718 - RNA, 15 nt, Salmonella enterica enterica serovar Typhi Ty2
accagcgcggcgcca

SEQ ID NO: 1785719 - RNA, 22 nt, Salmonella enterica enterica serovar Typhi Ty2
accauaccggugcgccccagca

SEQ ID NO: 1785720 - RNA, 21 nt, Salmonella enterica enterica serovar Typhi Ty2
accauaccgcuuaacagcgua

SEQ ID NO: 1785721 - RNA, 19 nt, Salmonella enterica enterica serovar Typhi Ty2
accauaaacaaaacaacaa

SEQ ID NO: 1785722 - RNA, 13 nt, Salmonella enterica enterica serovar Typhi Ty2
accaguuuuuccg

SEQ ID NO: 1785723 - RNA, 19 nt, Salmonella enterica enterica serovar Typhi Ty2
accauaaaugaaaccucaa

SEQ ID NO: 1785724 - RNA, 18 nt, Salmonella enterica enterica serovar Typhi Ty2
accauaaaugaaaugccc

SEQ ID NO: 1785725 - RNA, 17 nt, Salmonella enterica enterica serovar Typhi Ty2
accauaaacaaaacaac

SEQ ID NO: 1785726 - RNA, 22 nt, Salmonella enterica enterica serovar Typhi Ty2
accauaaacggcaccuggaagu

SEQ ID NO: 1785727 - RNA, 12 nt, Salmonella enterica enterica serovar Typhi Ty2
accauagcagcc

SEQ ID NO: 1785728 - RNA, 18 nt, Salmonella enterica enterica serovar Typhi Ty2
accauacugacuuaauaa

SEQ ID NO: 1785729 - RNA, 16 nt, Salmonella enterica enterica serovar Typhi Ty2
accauacugacuuaau

SEQ ID NO: 1785730 - RNA, 17 nt, Salmonella enterica enterica serovar Typhi Ty2
accauacugacuuaaua

SEQ ID NO: 1785731 - RNA, 21 nt, Salmonella enterica enterica serovar Typhi Ty2
accauaggccagcgucaccuc

SEQ ID NO: 1785732 - RNA, 23 nt, Salmonella enterica enterica serovar Typhi Ty2
accauauuauucugcugaaaaag

SEQ ID NO: 1785733 - RNA, 22 nt, Salmonella enterica enterica serovar Typhi Ty2
accaucagcgggcuaugcugaa

SEQ ID NO: 1785734 - RNA, 17 nt, Salmonella enterica enterica serovar Typhi Ty2
accagucgaccgcagac

SEQ ID NO: 1785735 - RNA, 15 nt, Salmonella enterica enterica serovar Typhi Ty2
accagucggcaaaga

SEQ ID NO: 1785736 - RNA, 22 nt, Salmonella enterica enterica serovar Typhi Ty2
accagugaacgucugcacggca

SEQ ID NO: 1785737 - RNA, 22 nt, Salmonella enterica enterica serovar Typhi Ty2
accaguccagugcgucacuuua

SEQ ID NO: 1785738 - RNA, 16 nt, Salmonella enterica enterica serovar Typhi Ty2
accaguacaucuucac

SEQ ID NO: 1785739 - RNA, 22 nt, Salmonella enterica enterica serovar Typhi Ty2
accagugcggcaaccaccagca

SEQ ID NO: 1785740 - RNA, 15 nt, Salmonella enterica enterica serovar Typhi Ty2
accaguggcggggca

SEQ ID NO: 1785741 - RNA, 14 nt, Salmonella enterica enterica serovar Typhi Ty2
accaguucacuccu

SEQ ID NO: 1785742 - RNA, 16 nt, Salmonella enterica enterica serovar Typhi Ty2
accaguuaauuucuuu

SEQ ID NO: 1785743 - RNA, 20 nt, Salmonella enterica enterica serovar Typhi Ty2
accacccagccagacgccag

SEQ ID NO: 1785744 - RNA, 12 nt, Salmonella enterica enterica serovar Typhi Ty2
accacccagcca

SEQ ID NO: 1785745 - RNA, 17 nt, Salmonella enterica enterica serovar Typhi Ty2
accaccccacaguaaug

SEQ ID NO: 1785746 - RNA, 17 nt, Salmonella enterica enterica serovar Typhi Ty2
accacccgggaaaaaug

SEQ ID NO: 1785747 - RNA, 23 nt, Salmonella enterica enterica serovar Typhi Ty2
accaccgaauuccgcuaaucuuu

SEQ ID NO: 1785748 - RNA, 20 nt, Salmonella enterica enterica serovar Typhi Ty2
accacuccggugcccauucc

SEQ ID NO: 1785749 - RNA, 18 nt, Salmonella enterica enterica serovar Typhi Ty2
accacugacacggaacaa

SEQ ID NO: 1785750 - RNA, 21 nt, Salmonella enterica enterica serovar Typhi Ty2
accacuccggcauaauaugca

SEQ ID NO: 1785751 - RNA, 21 nt, Salmonella enterica enterica serovar Typhi Ty2
accacgguguccggguucagc

SEQ ID NO: 1785752 - RNA, 19 nt, Salmonella enterica enterica serovar Typhi Ty2
accacgguguaccccgccu

SEQ ID NO: 1785753 - RNA, 15 nt, Salmonella enterica enterica serovar Typhi Ty2
accacgggguuggcc

SEQ ID NO: 1785754 - RNA, 21 nt, Salmonella enterica enterica serovar Typhi Ty2
accacgguauuaacaggcgcc

SEQ ID NO: 1785755 - RNA, 17 nt, Salmonella enterica enterica serovar Typhi Ty2
accacgggguuggcccu

SEQ ID NO: 1785756 - RNA, 15 nt, Salmonella enterica enterica serovar Typhi Ty2
accacggcuucagcg

SEQ ID NO: 1785757 - RNA, 14 nt, Salmonella enterica enterica serovar Typhi Ty2
accacggcuucagc

SEQ ID NO: 1785758 - RNA, 17 nt, Salmonella enterica enterica serovar Typhi Ty2
accacggccacagccau

SEQ ID NO: 1785759 - RNA, 20 nt, Salmonella enterica enterica serovar Typhi Ty2
accaccggcgcgccagcgca

SEQ ID NO: 1785760 - RNA, 16 nt, Salmonella enterica enterica serovar Typhi Ty2
accacgacgccggaga

SEQ ID NO: 1785761 - RNA, 19 nt, Salmonella enterica enterica serovar Typhi Ty2
accacggaaugaauguuag

SEQ ID NO: 1785762 - RNA, 22 nt, Salmonella enterica enterica serovar Typhi Ty2
accacgaucuugucacaauaac

SEQ ID NO: 1785763 - RNA, 22 nt, Salmonella enterica enterica serovar Typhi Ty2
accagaaucccacggagaaaag

SEQ ID NO: 1785764 - RNA, 17 nt, Salmonella enterica enterica serovar Typhi Ty2
accagaaucaccgacag

SEQ ID NO: 1785765 - RNA, 21 nt, Salmonella enterica enterica serovar Typhi Ty2
accagaccggcaucucaucuu

SEQ ID NO: 1785766 - RNA, 16 nt, Salmonella enterica enterica serovar Typhi Ty2
accagaccgacaagcc

SEQ ID NO: 1785767 - RNA, 16 nt, Salmonella enterica enterica serovar Typhi Ty2
accagaccaacccagc

SEQ ID NO: 1785768 - RNA, 21 nt, Salmonella enterica enterica serovar Typhi Ty2
accagacacggugugccgcca

SEQ ID NO: 1785769 - RNA, 21 nt, Salmonella enterica enterica serovar Typhi Ty2
accagacgcgaacguuugacc

SEQ ID NO: 1785770 - RNA, 16 nt, Salmonella enterica enterica serovar Typhi Ty2
accagagacauugccu

SEQ ID NO: 1785771 - RNA, 17 nt, Salmonella enterica enterica serovar Typhi Ty2
accagaauacacuucuc

SEQ ID NO: 1785772 - RNA, 16 nt, Salmonella enterica enterica serovar Typhi Ty2
accagaauaaugggga

SEQ ID NO: 1785773 - RNA, 22 nt, Salmonella enterica enterica serovar Typhi Ty2
accagaaaaccgacagcaauau

SEQ ID NO: 1785774 - RNA, 20 nt, Salmonella enterica enterica serovar Typhi Ty2
accagaucaacaugguguuu

SEQ ID NO: 1785775 - RNA, 19 nt, Salmonella enterica enterica serovar Typhi Ty2
accagccuaccugccgcca

SEQ ID NO: 1785776 - RNA, 16 nt, Salmonella enterica enterica serovar Typhi Ty2
accagccacugcgcca

SEQ ID NO: 1785777 - RNA, 16 nt, Salmonella enterica enterica serovar Typhi Ty2
accagcauaauauuca

SEQ ID NO: 1785778 - RNA, 15 nt, Salmonella enterica enterica serovar Typhi Ty2
accaacccagccugc

SEQ ID NO: 1785779 - RNA, 17 nt, Salmonella enterica enterica serovar Typhi Ty2
accaaccgccagucacc

SEQ ID NO: 1785780 - RNA, 20 nt, Salmonella enterica enterica serovar Typhi Ty2
accaaccaggcaaaccagca

SEQ ID NO: 1785781 - RNA, 18 nt, Salmonella enterica enterica serovar Typhi Ty2
accaacgaccaucaagca

SEQ ID NO: 1785782 - RNA, 17 nt, Salmonella enterica enterica serovar Typhi Ty2
accaacguuuuuccuug

SEQ ID NO: 1785783 - RNA, 15 nt, Salmonella enterica enterica serovar Typhi Ty2
accaacguuuuuccu

SEQ ID NO: 1785784 - RNA, 16 nt, Salmonella enterica enterica serovar Typhi Ty2
accaacgcauaaaaac

SEQ ID NO: 1785785 - RNA, 16 nt, Salmonella enterica enterica serovar Typhi Ty2
accaagucucaggagu

SEQ ID NO: 1785786 - RNA, 17 nt, Salmonella enterica enterica serovar Typhi Ty2
accaauuccaccaccuc

SEQ ID NO: 1785787 - RNA, 14 nt, Salmonella enterica enterica serovar Typhi Ty2
accacauuuucucg

SEQ ID NO: 1785788 - RNA, 16 nt, Salmonella enterica enterica serovar Typhi Ty2
accacaugaccagcgc

SEQ ID NO: 1785789 - RNA, 16 nt, Salmonella enterica enterica serovar Typhi Ty2
accaauaguauccaua

SEQ ID NO: 1785790 - RNA, 21 nt, Salmonella enterica enterica serovar Typhi Ty2
acauggcggucgccauauguu

SEQ ID NO: 1785791 - RNA, 22 nt, Salmonella enterica enterica serovar Typhi Ty2
acauggacaccggaagugaauu

SEQ ID NO: 1785792 - RNA, 22 nt, Salmonella enterica enterica serovar Typhi Ty2
acauggcgaaaaucggcaggcc

SEQ ID NO: 1785793 - RNA, 20 nt, Salmonella enterica enterica serovar Typhi Ty2
acaugucggcgaaaauccuu

SEQ ID NO: 1785794 - RNA, 20 nt, Salmonella enterica enterica serovar Typhi Ty2
acauguccuacacucaauac

SEQ ID NO: 1785795 - RNA, 12 nt, Salmonella enterica enterica serovar Typhi Ty2
acauguccagau

SEQ ID NO: 1785796 - RNA, 17 nt, Salmonella enterica enterica serovar Typhi Ty2
acauuuacgccagccag

SEQ ID NO: 1785797 - RNA, 19 nt, Salmonella enterica enterica serovar Typhi Ty2
acauuucagcgcagaauuu

SEQ ID NO: 1785798 - RNA, 17 nt, Salmonella enterica enterica serovar Typhi Ty2
acauuuaucuuccggca

SEQ ID NO: 1785799 - RNA, 15 nt, Salmonella enterica enterica serovar Typhi Ty2
acauuuuuuucuugc

SEQ ID NO: 1785800 - RNA, 17 nt, Salmonella enterica enterica serovar Typhi Ty2
accaaaaacgcccccag

SEQ ID NO: 1785801 - RNA, 13 nt, Salmonella enterica enterica serovar Typhi Ty2
accaaaacaguac

SEQ ID NO: 1785802 - RNA, 14 nt, Salmonella enterica enterica serovar Typhi Ty2
accaaagccaggcc

SEQ ID NO: 1785803 - RNA, 12 nt, Salmonella enterica enterica serovar Typhi Ty2
accaaagccagg

SEQ ID NO: 1785804 - RNA, 16 nt, Salmonella enterica enterica serovar Typhi Ty2
accaaagucaaacuga

SEQ ID NO: 1785805 - RNA, 18 nt, Salmonella enterica enterica serovar Typhi Ty2
acgauacgucauaucauc

SEQ ID NO: 1785806 - RNA, 20 nt, Salmonella enterica enterica serovar Typhi Ty2
acgauaauguugguaaauuu

SEQ ID NO: 1785807 - RNA, 19 nt, Salmonella enterica enterica serovar Typhi Ty2
acgauagcgccgguuucuc

SEQ ID NO: 1785808 - RNA, 21 nt, Salmonella enterica enterica serovar Typhi Ty2
acgauagcaauuaauaaacaa

SEQ ID NO: 1785809 - RNA, 16 nt, Salmonella enterica enterica serovar Typhi Ty2
acgauagacagcacca

SEQ ID NO: 1785810 - RNA, 13 nt, Salmonella enterica enterica serovar Typhi Ty2
acgauacccacca

SEQ ID NO: 1785811 - RNA, 16 nt, Salmonella enterica enterica serovar Typhi Ty2
acgauacucagcccca

SEQ ID NO: 1785812 - RNA, 16 nt, Salmonella enterica enterica serovar Typhi Ty2
acgauauaggguuuuc

SEQ ID NO: 1785813 - RNA, 13 nt, Salmonella enterica enterica serovar Typhi Ty2
acgauauaaaaac

SEQ ID NO: 1785814 - RNA, 20 nt, Salmonella enterica enterica serovar Typhi Ty2
acgauaguuugccagagaga

SEQ ID NO: 1785815 - RNA, 20 nt, Salmonella enterica enterica serovar Typhi Ty2
acgaucaauaaaauuaucca

SEQ ID NO: 1785816 - RNA, 14 nt, Salmonella enterica enterica serovar Typhi Ty2
acgaucauuucacu

SEQ ID NO: 1785817 - RNA, 15 nt, Salmonella enterica enterica serovar Typhi Ty2
acgauaaaccucacg

SEQ ID NO: 1785818 - RNA, 18 nt, Salmonella enterica enterica serovar Typhi Ty2
acgaguugcggcaacgug

SEQ ID NO: 1785819 - RNA, 14 nt, Salmonella enterica enterica serovar Typhi Ty2
acgauaaauuucac

SEQ ID NO: 1785820 - RNA, 12 nt, Salmonella enterica enterica serovar Typhi Ty2
acgauaaaaaaa

SEQ ID NO: 1785821 - RNA, 13 nt, Salmonella enterica enterica serovar Typhi Ty2
acgauaaaaaaag

SEQ ID NO: 1785822 - RNA, 19 nt, Salmonella enterica enterica serovar Typhi Ty2
acgagucggaucaugaaaa

SEQ ID NO: 1785823 - RNA, 17 nt, Salmonella enterica enterica serovar Typhi Ty2
acgagugcguucuucca

SEQ ID NO: 1785824 - RNA, 18 nt, Salmonella enterica enterica serovar Typhi Ty2
acgagugcguucuuccac

SEQ ID NO: 1785825 - RNA, 16 nt, Salmonella enterica enterica serovar Typhi Ty2
acgaugauguagccgc

SEQ ID NO: 1785826 - RNA, 17 nt, Salmonella enterica enterica serovar Typhi Ty2
acgauggcaaauaauac

SEQ ID NO: 1785827 - RNA, 17 nt, Salmonella enterica enterica serovar Typhi Ty2
acgauguucgucccugc

SEQ ID NO: 1785828 - RNA, 17 nt, Salmonella enterica enterica serovar Typhi Ty2
acgauguaaaaccuggc

SEQ ID NO: 1785829 - RNA, 21 nt, Salmonella enterica enterica serovar Typhi Ty2
acgauauccagcaccucauca

SEQ ID NO: 1785830 - RNA, 17 nt, Salmonella enterica enterica serovar Typhi Ty2
acgaucgcgcacaugcu

SEQ ID NO: 1785831 - RNA, 15 nt, Salmonella enterica enterica serovar Typhi Ty2
acgaugaugaaaaag

SEQ ID NO: 1785832 - RNA, 17 nt, Salmonella enterica enterica serovar Typhi Ty2
acgaugaugaaaaagaa

SEQ ID NO: 1785833 - RNA, 19 nt, Salmonella enterica enterica serovar Typhi Ty2
acgcaaagacaccccagcc

SEQ ID NO: 1785834 - RNA, 19 nt, Salmonella enterica enterica serovar Typhi Ty2
acgauuuugguagcgcuga

SEQ ID NO: 1785835 - RNA, 20 nt, Salmonella enterica enterica serovar Typhi Ty2
acgcaacgcuucugagaauu

SEQ ID NO: 1785836 - RNA, 19 nt, Salmonella enterica enterica serovar Typhi Ty2
acgcaacucacgccauucc

SEQ ID NO: 1785837 - RNA, 13 nt, Salmonella enterica enterica serovar Typhi Ty2
acgauuuccccug

SEQ ID NO: 1785838 - RNA, 15 nt, Salmonella enterica enterica serovar Typhi Ty2
acgauugaucucauc

SEQ ID NO: 1785839 - RNA, 13 nt, Salmonella enterica enterica serovar Typhi Ty2
acgaauagcgcgc

SEQ ID NO: 1785840 - RNA, 18 nt, Salmonella enterica enterica serovar Typhi Ty2
acgaauauucauuuccag

SEQ ID NO: 1785841 - RNA, 17 nt, Salmonella enterica enterica serovar Typhi Ty2
acgaaguuuaauucuuu

SEQ ID NO: 1785842 - RNA, 21 nt, Salmonella enterica enterica serovar Typhi Ty2
acgaaguuuaauucuuugagc

SEQ ID NO: 1785843 - RNA, 22 nt, Salmonella enterica enterica serovar Typhi Ty2
acgaaugccgauagucuccgcc

SEQ ID NO: 1785844 - RNA, 20 nt, Salmonella enterica enterica serovar Typhi Ty2
acgaaucuggucguaagaau

SEQ ID NO: 1785845 - RNA, 21 nt, Salmonella enterica enterica serovar Typhi Ty2
acgacagugcuauacaguaaa

SEQ ID NO: 1785846 - RNA, 13 nt, Salmonella enterica enterica serovar Typhi Ty2
acgacagaauaug

SEQ ID NO: 1785847 - RNA, 14 nt, Salmonella enterica enterica serovar Typhi Ty2
acgacagaauaugc

SEQ ID NO: 1785848 - RNA, 18 nt, Salmonella enterica enterica serovar Typhi Ty2
acgaauuuaaauagcaau

SEQ ID NO: 1785849 - RNA, 16 nt, Salmonella enterica enterica serovar Typhi Ty2
acgaauuuaaauagca

SEQ ID NO: 1785850 - RNA, 22 nt, Salmonella enterica enterica serovar Typhi Ty2
acgaaguccuucacaaacuucu

SEQ ID NO: 1785851 - RNA, 19 nt, Salmonella enterica enterica serovar Typhi Ty2
acgaagaucgcguacagcg

SEQ ID NO: 1785852 - RNA, 17 nt, Salmonella enterica enterica serovar Typhi Ty2
acgaagagaccugugua

SEQ ID NO: 1785853 - RNA, 22 nt, Salmonella enterica enterica serovar Typhi Ty2
acgaagaucgcguacagcgcca

SEQ ID NO: 1785854 - RNA, 14 nt, Salmonella enterica enterica serovar Typhi Ty2
acgaaccgagcggu

SEQ ID NO: 1785855 - RNA, 20 nt, Salmonella enterica enterica serovar Typhi Ty2
acgaacgcuggcacuuuccg

SEQ ID NO: 1785856 - RNA, 16 nt, Salmonella enterica enterica serovar Typhi Ty2
acgacuucguuaguga

SEQ ID NO: 1785857 - RNA, 18 nt, Salmonella enterica enterica serovar Typhi Ty2
acgagaacccacuuugcu

SEQ ID NO: 1785858 - RNA, 19 nt, Salmonella enterica enterica serovar Typhi Ty2
acgagaacccacuuugcuu

SEQ ID NO: 1785859 - RNA, 15 nt, Salmonella enterica enterica serovar Typhi Ty2
acgacgcuccagaau

SEQ ID NO: 1785860 - RNA, 13 nt, Salmonella enterica enterica serovar Typhi Ty2
acgaccaaacaag

SEQ ID NO: 1785861 - RNA, 23 nt, Salmonella enterica enterica serovar Typhi Ty2
acgaccacucuuuggacggcauc

SEQ ID NO: 1785862 - RNA, 18 nt, Salmonella enterica enterica serovar Typhi Ty2
acgaccccgccgagaauu

SEQ ID NO: 1785863 - RNA, 18 nt, Salmonella enterica enterica serovar Typhi Ty2
acgacgaauaagcugaau

SEQ ID NO: 1785864 - RNA, 20 nt, Salmonella enterica enterica serovar Typhi Ty2
acgaccuuucgccgucaccu

SEQ ID NO: 1785865 - RNA, 21 nt, Salmonella enterica enterica serovar Typhi Ty2
acgaaauggugugcauggugu

SEQ ID NO: 1785866 - RNA, 18 nt, Salmonella enterica enterica serovar Typhi Ty2
acgaacaacaucagacag

SEQ ID NO: 1785867 - RNA, 12 nt, Salmonella enterica enterica serovar Typhi Ty2
acgaaacucagc

SEQ ID NO: 1785868 - RNA, 23 nt, Salmonella enterica enterica serovar Typhi Ty2
acgaaagcggcgaauauagcuaa

SEQ ID NO: 1785869 - RNA, 21 nt, Salmonella enterica enterica serovar Typhi Ty2
acgaaaucagagacaaauaca

SEQ ID NO: 1785870 - RNA, 16 nt, Salmonella enterica enterica serovar Typhi Ty2
acgaaacagauuaaaa

SEQ ID NO: 1785871 - RNA, 13 nt, Salmonella enterica enterica serovar Typhi Ty2
acgaaaaaaaaga

SEQ ID NO: 1785872 - RNA, 20 nt, Salmonella enterica enterica serovar Typhi Ty2
accuuuuuuuccagcgucug

SEQ ID NO: 1785873 - RNA, 11 nt, Salmonella enterica enterica serovar Typhi Ty2
acgaaaaauaa

SEQ ID NO: 1785874 - RNA, 12 nt, Salmonella enterica enterica serovar Typhi Ty2
acgaaaaauaaa

SEQ ID NO: 1785875 - RNA, 13 nt, Salmonella enterica enterica serovar Typhi Ty2
acgaaaaauaaaa

SEQ ID NO: 1785876 - RNA, 14 nt, Salmonella enterica enterica serovar Typhi Ty2
acgaaaaauaaaaa

SEQ ID NO: 1785877 - RNA, 12 nt, Salmonella enterica enterica serovar Typhi Ty2
accuuuccaguc

SEQ ID NO: 1785878 - RNA, 20 nt, Salmonella enterica enterica serovar Typhi Ty2
accuuuaaccucuuuuucau

SEQ ID NO: 1785879 - RNA, 15 nt, Salmonella enterica enterica serovar Typhi Ty2
accuuuuacuucacg

SEQ ID NO: 1785880 - RNA, 21 nt, Salmonella enterica enterica serovar Typhi Ty2
accuuuucauuggucaguaag

SEQ ID NO: 1785881 - RNA, 21 nt, Salmonella enterica enterica serovar Typhi Ty2
accuuuggaggagagcgucau

SEQ ID NO: 1785882 - RNA, 22 nt, Salmonella enterica enterica serovar Typhi Ty2
accuugcccuggaauuuuucca

SEQ ID NO: 1785883 - RNA, 18 nt, Salmonella enterica enterica serovar Typhi Ty2
accuugauucccuuuugc

SEQ ID NO: 1785884 - RNA, 19 nt, Salmonella enterica enterica serovar Typhi Ty2
accuucuugcucaaaaagc

SEQ ID NO: 1785885 - RNA, 18 nt, Salmonella enterica enterica serovar Typhi Ty2
accuucacgccgccaaag

SEQ ID NO: 1785886 - RNA, 17 nt, Salmonella enterica enterica serovar Typhi Ty2
accuucacauuggcaaa

SEQ ID NO: 1785887 - RNA, 19 nt, Salmonella enterica enterica serovar Typhi Ty2
accuucacccccaucgccc

SEQ ID NO: 1785888 - RNA, 18 nt, Salmonella enterica enterica serovar Typhi Ty2
accuucacgcagugcgcg

SEQ ID NO: 1785889 - RNA, 15 nt, Salmonella enterica enterica serovar Typhi Ty2
accuucacgccgcca

SEQ ID NO: 1785890 - RNA, 15 nt, Salmonella enterica enterica serovar Typhi Ty2
accuucaccggauac

SEQ ID NO: 1785891 - RNA, 21 nt, Salmonella enterica enterica serovar Typhi Ty2
accuucaucucuuugcccguc

SEQ ID NO: 1785892 - RNA, 17 nt, Salmonella enterica enterica serovar Typhi Ty2
accuucggucccaucgc

SEQ ID NO: 1785893 - RNA, 13 nt, Salmonella enterica enterica serovar Typhi Ty2
accuucggccucc

SEQ ID NO: 1785894 - RNA, 22 nt, Salmonella enterica enterica serovar Typhi Ty2
accuucggccuccgcuuccugc

SEQ ID NO: 1785895 - RNA, 15 nt, Salmonella enterica enterica serovar Typhi Ty2
accuucgacgagguu

SEQ ID NO: 1785896 - RNA, 13 nt, Salmonella enterica enterica serovar Typhi Ty2
accuucugugaaa

SEQ ID NO: 1785897 - RNA, 14 nt, Salmonella enterica enterica serovar Typhi Ty2
accuucuucacuaa

SEQ ID NO: 1785898 - RNA, 21 nt, Salmonella enterica enterica serovar Typhi Ty2
accuucuucacuaaaaacagg

SEQ ID NO: 1785899 - RNA, 14 nt, Salmonella enterica enterica serovar Typhi Ty2
accuucuucgccaa

SEQ ID NO: 1785900 - RNA, 19 nt, Salmonella enterica enterica serovar Typhi Ty2
accugccguuuuccagccg

SEQ ID NO: 1785901 - RNA, 19 nt, Salmonella enterica enterica serovar Typhi Ty2
accugcgcaaucaugacag

SEQ ID NO: 1785902 - RNA, 18 nt, Salmonella enterica enterica serovar Typhi Ty2
accugccgaccucacugg

SEQ ID NO: 1785903 - RNA, 20 nt, Salmonella enterica enterica serovar Typhi Ty2
accugccaguccgcccgccu

SEQ ID NO: 1785904 - RNA, 20 nt, Salmonella enterica enterica serovar Typhi Ty2
accugcccuuucuucaaugg

SEQ ID NO: 1785905 - RNA, 18 nt, Salmonella enterica enterica serovar Typhi Ty2
accugccgaugaaagagc

SEQ ID NO: 1785906 - RNA, 15 nt, Salmonella enterica enterica serovar Typhi Ty2
accugcggcgcgccc

SEQ ID NO: 1785907 - RNA, 18 nt, Salmonella enterica enterica serovar Typhi Ty2
accugcggcaauggcuca

SEQ ID NO: 1785908 - RNA, 21 nt, Salmonella enterica enterica serovar Typhi Ty2
accugcaucccuuucuuuaca

SEQ ID NO: 1785909 - RNA, 12 nt, Salmonella enterica enterica serovar Typhi Ty2
accugccaggcu

SEQ ID NO: 1785910 - RNA, 19 nt, Salmonella enterica enterica serovar Typhi Ty2
accugccaguccgcccgcc

SEQ ID NO: 1785911 - RNA, 24 nt, Salmonella enterica enterica serovar Typhi Ty2
accugcagguuuaaaaccggccag

SEQ ID NO: 1785912 - RNA, 22 nt, Salmonella enterica enterica serovar Typhi Ty2
accugcacaucgccauuaaaag

SEQ ID NO: 1785913 - RNA, 11 nt, Salmonella enterica enterica serovar Typhi Ty2
accuggcuggc

SEQ ID NO: 1785914 - RNA, 15 nt, Salmonella enterica enterica serovar Typhi Ty2
accuggcggagcugc

SEQ ID NO: 1785915 - RNA, 18 nt, Salmonella enterica enterica serovar Typhi Ty2
accuggcccugcaucagc

SEQ ID NO: 1785916 - RNA, 20 nt, Salmonella enterica enterica serovar Typhi Ty2
accugcuccagauuacuaug

SEQ ID NO: 1785917 - RNA, 23 nt, Salmonella enterica enterica serovar Typhi Ty2
accugcuggcggcguaagcgggu

SEQ ID NO: 1785918 - RNA, 18 nt, Salmonella enterica enterica serovar Typhi Ty2
accuggaaccaggcgcga

SEQ ID NO: 1785919 - RNA, 18 nt, Salmonella enterica enterica serovar Typhi Ty2
accuggaaguuuugcugg

SEQ ID NO: 1785920 - RNA, 19 nt, Salmonella enterica enterica serovar Typhi Ty2
accuguaucugcugacacc

SEQ ID NO: 1785921 - RNA, 23 nt, Salmonella enterica enterica serovar Typhi Ty2
accuguaucugcugacacccucu

SEQ ID NO: 1785922 - RNA, 16 nt, Salmonella enterica enterica serovar Typhi Ty2
accuguaucaaaccaa

SEQ ID NO: 1785923 - RNA, 16 nt, Salmonella enterica enterica serovar Typhi Ty2
accugucuuugcgccg

SEQ ID NO: 1785924 - RNA, 18 nt, Salmonella enterica enterica serovar Typhi Ty2
accuuaagcgcgaaauuu

SEQ ID NO: 1785925 - RNA, 21 nt, Salmonella enterica enterica serovar Typhi Ty2
accuuaauuugugauugcaga

SEQ ID NO: 1785926 - RNA, 17 nt, Salmonella enterica enterica serovar Typhi Ty2
accuuaucgagaauacu

SEQ ID NO: 1785927 - RNA, 18 nt, Salmonella enterica enterica serovar Typhi Ty2
accucuucguucauccgu

SEQ ID NO: 1785928 - RNA, 13 nt, Salmonella enterica enterica serovar Typhi Ty2
accucugcaaaca

SEQ ID NO: 1785929 - RNA, 18 nt, Salmonella enterica enterica serovar Typhi Ty2
accucuauaacuugcaaa

SEQ ID NO: 1785930 - RNA, 23 nt, Salmonella enterica enterica serovar Typhi Ty2
accucgcuucccugacgcgcagc

SEQ ID NO: 1785931 - RNA, 13 nt, Salmonella enterica enterica serovar Typhi Ty2
accucuaaaugga

SEQ ID NO: 1785932 - RNA, 23 nt, Salmonella enterica enterica serovar Typhi Ty2
accugaaugcaaagaagggcagg

SEQ ID NO: 1785933 - RNA, 21 nt, Salmonella enterica enterica serovar Typhi Ty2
accugaaugcaaagaagggca

SEQ ID NO: 1785934 - RNA, 22 nt, Salmonella enterica enterica serovar Typhi Ty2
accugaagcccuuuagugaauu

SEQ ID NO: 1785935 - RNA, 20 nt, Salmonella enterica enterica serovar Typhi Ty2
accucuuuggcgcgaaccgu

SEQ ID NO: 1785936 - RNA, 14 nt, Salmonella enterica enterica serovar Typhi Ty2
accugaaaucagcc

SEQ ID NO: 1785937 - RNA, 10 nt, Salmonella enterica enterica serovar Typhi Ty2
accugauguc

SEQ ID NO: 1785938 - RNA, 13 nt, Salmonella enterica enterica serovar Typhi Ty2
accugaugugcuu

SEQ ID NO: 1785939 - RNA, 19 nt, Salmonella enterica enterica serovar Typhi Ty2
accugaugguuauuuucag

SEQ ID NO: 1785940 - RNA, 16 nt, Salmonella enterica enterica serovar Typhi Ty2
accucgccacauucaa

SEQ ID NO: 1785941 - RNA, 16 nt, Salmonella enterica enterica serovar Typhi Ty2
accucgcaauauucau

SEQ ID NO: 1785942 - RNA, 19 nt, Salmonella enterica enterica serovar Typhi Ty2
accuccggcuaugccggag

SEQ ID NO: 1785943 - RNA, 11 nt, Salmonella enterica enterica serovar Typhi Ty2
accuccgggug

SEQ ID NO: 1785944 - RNA, 18 nt, Salmonella enterica enterica serovar Typhi Ty2
accuccggcuaugccgga

SEQ ID NO: 1785945 - RNA, 14 nt, Salmonella enterica enterica serovar Typhi Ty2
accuccgcccggug

SEQ ID NO: 1785946 - RNA, 12 nt, Salmonella enterica enterica serovar Typhi Ty2
accuccgcccgg

SEQ ID NO: 1785947 - RNA, 14 nt, Salmonella enterica enterica serovar Typhi Ty2
accucagccaccca

SEQ ID NO: 1785948 - RNA, 20 nt, Salmonella enterica enterica serovar Typhi Ty2
accucagguaaauccgccag

SEQ ID NO: 1785949 - RNA, 17 nt, Salmonella enterica enterica serovar Typhi Ty2
accucaucaccuacccu

SEQ ID NO: 1785950 - RNA, 13 nt, Salmonella enterica enterica serovar Typhi Ty2
accucaucgcuac

SEQ ID NO: 1785951 - RNA, 23 nt, Salmonella enterica enterica serovar Typhi Ty2
accucauccagauguuauaaacu

SEQ ID NO: 1785952 - RNA, 19 nt, Salmonella enterica enterica serovar Typhi Ty2
accucaugccggcuggcaa

SEQ ID NO: 1785953 - RNA, 11 nt, Salmonella enterica enterica serovar Typhi Ty2
accucaauaug

SEQ ID NO: 1785954 - RNA, 16 nt, Salmonella enterica enterica serovar Typhi Ty2
accucaccguccgcca

SEQ ID NO: 1785955 - RNA, 19 nt, Salmonella enterica enterica serovar Typhi Ty2
accuauuucgauaccgacu

SEQ ID NO: 1785956 - RNA, 20 nt, Salmonella enterica enterica serovar Typhi Ty2
accuauuuuaaauucccagc

SEQ ID NO: 1785957 - RNA, 14 nt, Salmonella enterica enterica serovar Typhi Ty2
accuauugaaaaua

SEQ ID NO: 1785958 - RNA, 20 nt, Salmonella enterica enterica serovar Typhi Ty2
accguuuuuuuaugcagccg

SEQ ID NO: 1785959 - RNA, 17 nt, Salmonella enterica enterica serovar Typhi Ty2
accguucagaucgccaa

SEQ ID NO: 1785960 - RNA, 23 nt, Salmonella enterica enterica serovar Typhi Ty2
accguucuggcugccgucaaagu

SEQ ID NO: 1785961 - RNA, 16 nt, Salmonella enterica enterica serovar Typhi Ty2
accguuaggaaagcag

SEQ ID NO: 1785962 - RNA, 22 nt, Salmonella enterica enterica serovar Typhi Ty2
accgugugcagugacagaggaa

SEQ ID NO: 1785963 - RNA, 21 nt, Salmonella enterica enterica serovar Typhi Ty2
accguuaacguuuuacgcugc

SEQ ID NO: 1785964 - RNA, 18 nt, Salmonella enterica enterica serovar Typhi Ty2
accguugcgcccaucauc

SEQ ID NO: 1785965 - RNA, 19 nt, Salmonella enterica enterica serovar Typhi Ty2
accguugcgcccaucauca

SEQ ID NO: 1785966 - RNA, 17 nt, Salmonella enterica enterica serovar Typhi Ty2
accguuggaauaaauca

SEQ ID NO: 1785967 - RNA, 21 nt, Salmonella enterica enterica serovar Typhi Ty2
accuaauuaaauagggacuua

SEQ ID NO: 1785968 - RNA, 15 nt, Salmonella enterica enterica serovar Typhi Ty2
accuacagaaaauca

SEQ ID NO: 1785969 - RNA, 18 nt, Salmonella enterica enterica serovar Typhi Ty2
accuacuguggugugccu

SEQ ID NO: 1785970 - RNA, 19 nt, Salmonella enterica enterica serovar Typhi Ty2
accuacuguggugugccug

SEQ ID NO: 1785971 - RNA, 20 nt, Salmonella enterica enterica serovar Typhi Ty2
accuacuguggugugccugc

SEQ ID NO: 1785972 - RNA, 13 nt, Salmonella enterica enterica serovar Typhi Ty2
accuaccggcaua

SEQ ID NO: 1785973 - RNA, 14 nt, Salmonella enterica enterica serovar Typhi Ty2
accgucagauucug

SEQ ID NO: 1785974 - RNA, 14 nt, Salmonella enterica enterica serovar Typhi Ty2
accgucagcagcac

SEQ ID NO: 1785975 - RNA, 22 nt, Salmonella enterica enterica serovar Typhi Ty2
accgucagccccguacaagguc

SEQ ID NO: 1785976 - RNA, 16 nt, Salmonella enterica enterica serovar Typhi Ty2
accgucagcuccggua

SEQ ID NO: 1785977 - RNA, 15 nt, Salmonella enterica enterica serovar Typhi Ty2
accguccccagccag

SEQ ID NO: 1785978 - RNA, 18 nt, Salmonella enterica enterica serovar Typhi Ty2
accgucgagaaaccgcuc

SEQ ID NO: 1785979 - RNA, 15 nt, Salmonella enterica enterica serovar Typhi Ty2
accguccacauccag

SEQ ID NO: 1785980 - RNA, 15 nt, Salmonella enterica enterica serovar Typhi Ty2
accgucaaaacgcgc

SEQ ID NO: 1785981 - RNA, 18 nt, Salmonella enterica enterica serovar Typhi Ty2
accguauuaucaaaucuu

SEQ ID NO: 1785982 - RNA, 22 nt, Salmonella enterica enterica serovar Typhi Ty2
accgucaauaacgggcacgguc

SEQ ID NO: 1785983 - RNA, 21 nt, Salmonella enterica enterica serovar Typhi Ty2
accguaucgcccagcuuaugc

SEQ ID NO: 1785984 - RNA, 14 nt, Salmonella enterica enterica serovar Typhi Ty2
accguauccgccac

SEQ ID NO: 1785985 - RNA, 18 nt, Salmonella enterica enterica serovar Typhi Ty2
accguauccuuccagccc

SEQ ID NO: 1785986 - RNA, 19 nt, Salmonella enterica enterica serovar Typhi Ty2
accguauccagacccccgg

SEQ ID NO: 1785987 - RNA, 14 nt, Salmonella enterica enterica serovar Typhi Ty2
accgugauuuuuac

SEQ ID NO: 1785988 - RNA, 14 nt, Salmonella enterica enterica serovar Typhi Ty2
accgugcacgcugc

SEQ ID NO: 1785989 - RNA, 19 nt, Salmonella enterica enterica serovar Typhi Ty2
accguggcggcagugggcu

SEQ ID NO: 1785990 - RNA, 15 nt, Salmonella enterica enterica serovar Typhi Ty2
accguggccuccggc

SEQ ID NO: 1785991 - RNA, 14 nt, Salmonella enterica enterica serovar Typhi Ty2
accgugugcaguga

SEQ ID NO: 1785992 - RNA, 14 nt, Salmonella enterica enterica serovar Typhi Ty2
accgucggcacgca

SEQ ID NO: 1785993 - RNA, 18 nt, Salmonella enterica enterica serovar Typhi Ty2
accgucgcgcccuccucc

SEQ ID NO: 1785994 - RNA, 17 nt, Salmonella enterica enterica serovar Typhi Ty2
accgucgccgacaacgc

SEQ ID NO: 1785995 - RNA, 22 nt, Salmonella enterica enterica serovar Typhi Ty2
accgucuucaggucauucagga

SEQ ID NO: 1785996 - RNA, 14 nt, Salmonella enterica enterica serovar Typhi Ty2
accgugacugacca

SEQ ID NO: 1785997 - RNA, 13 nt, Salmonella enterica enterica serovar Typhi Ty2
accgugagcgcgc

SEQ ID NO: 1785998 - RNA, 22 nt, Salmonella enterica enterica serovar Typhi Ty2
accguaauaguuucgacuuuca

SEQ ID NO: 1785999 - RNA, 19 nt, Salmonella enterica enterica serovar Typhi Ty2
accguaaacgccugcacca

SEQ ID NO: 1786000 - RNA, 18 nt, Salmonella enterica enterica serovar Typhi Ty2
accguaaacgccugcacc

SEQ ID NO: 1786001 - RNA, 17 nt, Salmonella enterica enterica serovar Typhi Ty2
accguaaacgccugcac

SEQ ID NO: 1786002 - RNA, 19 nt, Salmonella enterica enterica serovar Typhi Ty2
accguaaaaugcuggugca

SEQ ID NO: 1786003 - RNA, 13 nt, Salmonella enterica enterica serovar Typhi Ty2
accgguuuuuccg

SEQ ID NO: 1786004 - RNA, 19 nt, Salmonella enterica enterica serovar Typhi Ty2
accggugcgccccagcaug

SEQ ID NO: 1786005 - RNA, 14 nt, Salmonella enterica enterica serovar Typhi Ty2
accggugcgcccca

SEQ ID NO: 1786006 - RNA, 15 nt, Salmonella enterica enterica serovar Typhi Ty2
accggucagaaaucc

SEQ ID NO: 1786007 - RNA, 18 nt, Salmonella enterica enterica serovar Typhi Ty2
accggucuggcucacuga

SEQ ID NO: 1786008 - RNA, 15 nt, Salmonella enterica enterica serovar Typhi Ty2
accgguacucuucca

SEQ ID NO: 1786009 - RNA, 17 nt, Salmonella enterica enterica serovar Typhi Ty2
accggggcgcgccgcua

SEQ ID NO: 1786010 - RNA, 19 nt, Salmonella enterica enterica serovar Typhi Ty2
accgguaacugucagauca

SEQ ID NO: 1786011 - RNA, 17 nt, Salmonella enterica enterica serovar Typhi Ty2
accgggucgcagaacau

SEQ ID NO: 1786012 - RNA, 18 nt, Salmonella enterica enterica serovar Typhi Ty2
accgggucgauaaacagc

SEQ ID NO: 1786013 - RNA, 15 nt, Salmonella enterica enterica serovar Typhi Ty2
accggguuaaagccc

SEQ ID NO: 1786014 - RNA, 23 nt, Salmonella enterica enterica serovar Typhi Ty2
accgggccugaugcgcguuuagc

SEQ ID NO: 1786015 - RNA, 22 nt, Salmonella enterica enterica serovar Typhi Ty2
accgggccuccuuuccugugcu

SEQ ID NO: 1786016 - RNA, 18 nt, Salmonella enterica enterica serovar Typhi Ty2
accgggcaggauacggcg

SEQ ID NO: 1786017 - RNA, 14 nt, Salmonella enterica enterica serovar Typhi Ty2
accgggcaaacauu

SEQ ID NO: 1786018 - RNA, 14 nt, Salmonella enterica enterica serovar Typhi Ty2
accgggcaggauac

SEQ ID NO: 1786019 - RNA, 21 nt, Salmonella enterica enterica serovar Typhi Ty2
accggcuguauacacuuucca

SEQ ID NO: 1786020 - RNA, 12 nt, Salmonella enterica enterica serovar Typhi Ty2
accggcccagcu

SEQ ID NO: 1786021 - RNA, 14 nt, Salmonella enterica enterica serovar Typhi Ty2
accggcccccggcc

SEQ ID NO: 1786022 - RNA, 15 nt, Salmonella enterica enterica serovar Typhi Ty2
accggccgcccggac

SEQ ID NO: 1786023 - RNA, 20 nt, Salmonella enterica enterica serovar Typhi Ty2
accggcgcgccuuccagcaa

SEQ ID NO: 1786024 - RNA, 17 nt, Salmonella enterica enterica serovar Typhi Ty2
accggcgauguuggcgc

SEQ ID NO: 1786025 - RNA, 16 nt, Salmonella enterica enterica serovar Typhi Ty2
accggcguaauugcgc

SEQ ID NO: 1786026 - RNA, 15 nt, Salmonella enterica enterica serovar Typhi Ty2
accggcgucaucauu

SEQ ID NO: 1786027 - RNA, 20 nt, Salmonella enterica enterica serovar Typhi Ty2
accggcguccccguucugac

SEQ ID NO: 1786028 - RNA, 22 nt, Salmonella enterica enterica serovar Typhi Ty2
accggcgguugagauuggcccg

SEQ ID NO: 1786029 - RNA, 22 nt, Salmonella enterica enterica serovar Typhi Ty2
accggcauuucaccgucaauaa

SEQ ID NO: 1786030 - RNA, 13 nt, Salmonella enterica enterica serovar Typhi Ty2
accggcauuucac

SEQ ID NO: 1786031 - RNA, 13 nt, Salmonella enterica enterica serovar Typhi Ty2
accggcagcguca

SEQ ID NO: 1786032 - RNA, 20 nt, Salmonella enterica enterica serovar Typhi Ty2
accggcagcgucagcccaag

SEQ ID NO: 1786033 - RNA, 21 nt, Salmonella enterica enterica serovar Typhi Ty2
accggcauacacgccgggcac

SEQ ID NO: 1786034 - RNA, 20 nt, Salmonella enterica enterica serovar Typhi Ty2
accggcaggugauggcggcu

SEQ ID NO: 1786035 - RNA, 16 nt, Salmonella enterica enterica serovar Typhi Ty2
accggcaucucaucuu

SEQ ID NO: 1786036 - RNA, 22 nt, Salmonella enterica enterica serovar Typhi Ty2
accggcaaauaccgucauaauc

SEQ ID NO: 1786037 - RNA, 22 nt, Salmonella enterica enterica serovar Typhi Ty2
accgcuucgaaguuuugaguuu

SEQ ID NO: 1786038 - RNA, 20 nt, Salmonella enterica enterica serovar Typhi Ty2
accggauuggucugauucag

SEQ ID NO: 1786039 - RNA, 15 nt, Salmonella enterica enterica serovar Typhi Ty2
accgcaugacaauau

SEQ ID NO: 1786040 - RNA, 16 nt, Salmonella enterica enterica serovar Typhi Ty2
accgcacaucacugcc

SEQ ID NO: 1786041 - RNA, 14 nt, Salmonella enterica enterica serovar Typhi Ty2
accgauuccugguu

SEQ ID NO: 1786042 - RNA, 21 nt, Salmonella enterica enterica serovar Typhi Ty2
accgccaauaaaaacugcuaa

SEQ ID NO: 1786043 - RNA, 16 nt, Salmonella enterica enterica serovar Typhi Ty2
accgccaauaauuuua

SEQ ID NO: 1786044 - RNA, 15 nt, Salmonella enterica enterica serovar Typhi Ty2
accgccaaccgcccg

SEQ ID NO: 1786045 - RNA, 13 nt, Salmonella enterica enterica serovar Typhi Ty2
accgcauuuucag

SEQ ID NO: 1786046 - RNA, 15 nt, Salmonella enterica enterica serovar Typhi Ty2
accgccauauauuua

SEQ ID NO: 1786047 - RNA, 18 nt, Salmonella enterica enterica serovar Typhi Ty2
accgccaucaaacgcagc

SEQ ID NO: 1786048 - RNA, 16 nt, Salmonella enterica enterica serovar Typhi Ty2
accgccauccggcauu

SEQ ID NO: 1786049 - RNA, 15 nt, Salmonella enterica enterica serovar Typhi Ty2
accgccagucccagc

SEQ ID NO: 1786050 - RNA, 15 nt, Salmonella enterica enterica serovar Typhi Ty2
accgccagucacccu

SEQ ID NO: 1786051 - RNA, 19 nt, Salmonella enterica enterica serovar Typhi Ty2
accgaugccgugaggcuga

SEQ ID NO: 1786052 - RNA, 16 nt, Salmonella enterica enterica serovar Typhi Ty2
accccgccaccgccgc

SEQ ID NO: 1786053 - RNA, 19 nt, Salmonella enterica enterica serovar Typhi Ty2
accccgccgucagacaggc

SEQ ID NO: 1786054 - RNA, 22 nt, Salmonella enterica enterica serovar Typhi Ty2
accgccuaacagcgccgcgccg

SEQ ID NO: 1786055 - RNA, 20 nt, Salmonella enterica enterica serovar Typhi Ty2
accgccuacacaaaaucauu

SEQ ID NO: 1786056 - RNA, 16 nt, Salmonella enterica enterica serovar Typhi Ty2
accgccguuagcgccu

SEQ ID NO: 1786057 - RNA, 19 nt, Salmonella enterica enterica serovar Typhi Ty2
accgcccauggaugcgccg

SEQ ID NO: 1786058 - RNA, 17 nt, Salmonella enterica enterica serovar Typhi Ty2
accgccuuccugcugcg

SEQ ID NO: 1786059 - RNA, 16 nt, Salmonella enterica enterica serovar Typhi Ty2
accgcgaacauuggaa

SEQ ID NO: 1786060 - RNA, 17 nt, Salmonella enterica enterica serovar Typhi Ty2
accgcugcggaacacca

SEQ ID NO: 1786061 - RNA, 22 nt, Salmonella enterica enterica serovar Typhi Ty2
accgcugggaugaccugaaauc

SEQ ID NO: 1786062 - RNA, 15 nt, Salmonella enterica enterica serovar Typhi Ty2
accgcuccgcgcauc

SEQ ID NO: 1786063 - RNA, 15 nt, Salmonella enterica enterica serovar Typhi Ty2
accgcgcuccuggaa

SEQ ID NO: 1786064 - RNA, 19 nt, Salmonella enterica enterica serovar Typhi Ty2
accgcgcggcguucugcgc

SEQ ID NO: 1786065 - RNA, 14 nt, Salmonella enterica enterica serovar Typhi Ty2
accgcgcggcguuc

SEQ ID NO: 1786066 - RNA, 14 nt, Salmonella enterica enterica serovar Typhi Ty2
aacccacuuugcuu

SEQ ID NO: 1786067 - RNA, 14 nt, Salmonella enterica enterica serovar Typhi Ty2
aacccaccagcagg

SEQ ID NO: 1786068 - RNA, 13 nt, Salmonella enterica enterica serovar Typhi Ty2
aacccaccagcgc

SEQ ID NO: 1786069 - RNA, 16 nt, Salmonella enterica enterica serovar Typhi Ty2
aacccacaagaaaugc

SEQ ID NO: 1786070 - RNA, 18 nt, Salmonella enterica enterica serovar Typhi Ty2
aacccagauaucagucug

SEQ ID NO: 1786071 - RNA, 15 nt, Salmonella enterica enterica serovar Typhi Ty2
aaccauuuccucugc

SEQ ID NO: 1786072 - RNA, 15 nt, Salmonella enterica enterica serovar Typhi Ty2
aaccauucaaauuca

SEQ ID NO: 1786073 - RNA, 18 nt, Salmonella enterica enterica serovar Typhi Ty2
aaccaugcgagaucggca

SEQ ID NO: 1786074 - RNA, 18 nt, Salmonella enterica enterica serovar Typhi Ty2
aaccagugaauacugcgc

SEQ ID NO: 1786075 - RNA, 16 nt, Salmonella enterica enterica serovar Typhi Ty2
aaccaguaacggcagu

SEQ ID NO: 1786076 - RNA, 22 nt, Salmonella enterica enterica serovar Typhi Ty2
aaccagaaaaccgacagcaaua

SEQ ID NO: 1786077 - RNA, 10 nt, Salmonella enterica enterica serovar Typhi Ty2
aaccacgcca

SEQ ID NO: 1786078 - RNA, 17 nt, Salmonella enterica enterica serovar Typhi Ty2
aaccacgccaaccaucg

SEQ ID NO: 1786079 - RNA, 20 nt, Salmonella enterica enterica serovar Typhi Ty2
aaccacgccauggccgcagc

SEQ ID NO: 1786080 - RNA, 13 nt, Salmonella enterica enterica serovar Typhi Ty2
aaccaccagcagu

SEQ ID NO: 1786081 - RNA, 20 nt, Salmonella enterica enterica serovar Typhi Ty2
aaccacaaguuuauccagca

SEQ ID NO: 1786082 - RNA, 14 nt, Salmonella enterica enterica serovar Typhi Ty2
aaccaccaaaaagc

SEQ ID NO: 1786083 - RNA, 17 nt, Salmonella enterica enterica serovar Typhi Ty2
aaccagcaaugagacaa

SEQ ID NO: 1786084 - RNA, 18 nt, Salmonella enterica enterica serovar Typhi Ty2
aaccagcccaugaaggag

SEQ ID NO: 1786085 - RNA, 21 nt, Salmonella enterica enterica serovar Typhi Ty2
aaccagcgcuucgccugccgg

SEQ ID NO: 1786086 - RNA, 23 nt, Salmonella enterica enterica serovar Typhi Ty2
aaccagcggcgacacaacggcac

SEQ ID NO: 1786087 - RNA, 15 nt, Salmonella enterica enterica serovar Typhi Ty2
aaccagcuuuucauu

SEQ ID NO: 1786088 - RNA, 15 nt, Salmonella enterica enterica serovar Typhi Ty2
aaccagcuauccagu

SEQ ID NO: 1786089 - RNA, 18 nt, Salmonella enterica enterica serovar Typhi Ty2
aaccaggcaaaccagcac

SEQ ID NO: 1786090 - RNA, 14 nt, Salmonella enterica enterica serovar Typhi Ty2
aaccaggcauuuua

SEQ ID NO: 1786091 - RNA, 20 nt, Salmonella enterica enterica serovar Typhi Ty2
aaccguaaacgccugcacca

SEQ ID NO: 1786092 - RNA, 22 nt, Salmonella enterica enterica serovar Typhi Ty2
aaccgguuugucauucgccuca

SEQ ID NO: 1786093 - RNA, 22 nt, Salmonella enterica enterica serovar Typhi Ty2
aaccggucucuuaaugccagcg

SEQ ID NO: 1786094 - RNA, 14 nt, Salmonella enterica enterica serovar Typhi Ty2
aaccguagcguugc

SEQ ID NO: 1786095 - RNA, 22 nt, Salmonella enterica enterica serovar Typhi Ty2
aaccguaucacuguaaaaggga

SEQ ID NO: 1786096 - RNA, 17 nt, Salmonella enterica enterica serovar Typhi Ty2
aaccguagauuuucauc

SEQ ID NO: 1786097 - RNA, 20 nt, Salmonella enterica enterica serovar Typhi Ty2
aaccggucagguagcagacc

SEQ ID NO: 1786098 - RNA, 19 nt, Salmonella enterica enterica serovar Typhi Ty2
aaccggucagguagcagac

SEQ ID NO: 1786099 - RNA, 19 nt, Salmonella enterica enterica serovar Typhi Ty2
aaccggaccagcacaaaaa

SEQ ID NO: 1786100 - RNA, 21 nt, Salmonella enterica enterica serovar Typhi Ty2
aaccggcacauccagcgccug

SEQ ID NO: 1786101 - RNA, 21 nt, Salmonella enterica enterica serovar Typhi Ty2
aaccggcgcgccuuccagcaa

SEQ ID NO: 1786102 - RNA, 17 nt, Salmonella enterica enterica serovar Typhi Ty2
aaccgcagaaaaagccc

SEQ ID NO: 1786103 - RNA, 14 nt, Salmonella enterica enterica serovar Typhi Ty2
aaccgcaaaugcca

SEQ ID NO: 1786104 - RNA, 15 nt, Salmonella enterica enterica serovar Typhi Ty2
aaccgcaaaugccau

SEQ ID NO: 1786105 - RNA, 13 nt, Salmonella enterica enterica serovar Typhi Ty2
aaccgccagcagu

SEQ ID NO: 1786106 - RNA, 19 nt, Salmonella enterica enterica serovar Typhi Ty2
aaccgcagaaaaagccccc

SEQ ID NO: 1786107 - RNA, 23 nt, Salmonella enterica enterica serovar Typhi Ty2
aaccgcuaaugaggaaaaagccg

SEQ ID NO: 1786108 - RNA, 18 nt, Salmonella enterica enterica serovar Typhi Ty2
aaccgcggucggcaggcg

SEQ ID NO: 1786109 - RNA, 16 nt, Salmonella enterica enterica serovar Typhi Ty2
aaccgcgccggaugac

SEQ ID NO: 1786110 - RNA, 22 nt, Salmonella enterica enterica serovar Typhi Ty2
aaccgcgcggcguucugcgcca

SEQ ID NO: 1786111 - RNA, 14 nt, Salmonella enterica enterica serovar Typhi Ty2
aaccgcgcguaaau

SEQ ID NO: 1786112 - RNA, 19 nt, Salmonella enterica enterica serovar Typhi Ty2
aaccgcgccaaagauaaga

SEQ ID NO: 1786113 - RNA, 19 nt, Salmonella enterica enterica serovar Typhi Ty2
aaccgaaagaagaaaccau

SEQ ID NO: 1786114 - RNA, 18 nt, Salmonella enterica enterica serovar Typhi Ty2
aaccgacuaucagaaaaa

SEQ ID NO: 1786115 - RNA, 16 nt, Salmonella enterica enterica serovar Typhi Ty2
aaccgacccaaaaaug

SEQ ID NO: 1786116 - RNA, 18 nt, Salmonella enterica enterica serovar Typhi Ty2
aaccgacgaaagauaaaa

SEQ ID NO: 1786117 - RNA, 20 nt, Salmonella enterica enterica serovar Typhi Ty2
aaccgacggugcucaugaca

SEQ ID NO: 1786118 - RNA, 15 nt, Salmonella enterica enterica serovar Typhi Ty2
aaccgauaaucacca

SEQ ID NO: 1786119 - RNA, 17 nt, Salmonella enterica enterica serovar Typhi Ty2
aaccgagcauccgcgca

SEQ ID NO: 1786120 - RNA, 23 nt, Salmonella enterica enterica serovar Typhi Ty2
aacccuuucauucgucaaauuca

SEQ ID NO: 1786121 - RNA, 21 nt, Salmonella enterica enterica serovar Typhi Ty2
aacccuucauaggugaacaug

SEQ ID NO: 1786122 - RNA, 15 nt, Salmonella enterica enterica serovar Typhi Ty2
aacccucaucgguca

SEQ ID NO: 1786123 - RNA, 20 nt, Salmonella enterica enterica serovar Typhi Ty2
aacccgaucgccauccugca

SEQ ID NO: 1786124 - RNA, 13 nt, Salmonella enterica enterica serovar Typhi Ty2
aaccccugcucgc

SEQ ID NO: 1786125 - RNA, 16 nt, Salmonella enterica enterica serovar Typhi Ty2
aaccccagcugcggca

SEQ ID NO: 1786126 - RNA, 22 nt, Salmonella enterica enterica serovar Typhi Ty2
aaccccaggucagcaguuuuuc

SEQ ID NO: 1786127 - RNA, 15 nt, Salmonella enterica enterica serovar Typhi Ty2
aaccccaucccggca

SEQ ID NO: 1786128 - RNA, 15 nt, Salmonella enterica enterica serovar Typhi Ty2
aaccccaaaucagca

SEQ ID NO: 1786129 - RNA, 19 nt, Salmonella enterica enterica serovar Typhi Ty2
aaccccacccacugauaaa

SEQ ID NO: 1786130 - RNA, 14 nt, Salmonella enterica enterica serovar Typhi Ty2
aacccggcauuucu

SEQ ID NO: 1786131 - RNA, 21 nt, Salmonella enterica enterica serovar Typhi Ty2
aacccguuaaauaccagcacc

SEQ ID NO: 1786132 - RNA, 17 nt, Salmonella enterica enterica serovar Typhi Ty2
aacccgccucaaacgcc

SEQ ID NO: 1786133 - RNA, 16 nt, Salmonella enterica enterica serovar Typhi Ty2
aacccgauucugccag

SEQ ID NO: 1786134 - RNA, 14 nt, Salmonella enterica enterica serovar Typhi Ty2
aacauccucuccug

SEQ ID NO: 1786135 - RNA, 15 nt, Salmonella enterica enterica serovar Typhi Ty2
aacaucguaaaucaa

SEQ ID NO: 1786136 - RNA, 16 nt, Salmonella enterica enterica serovar Typhi Ty2
aacaucguaaaucaaa

SEQ ID NO: 1786137 - RNA, 19 nt, Salmonella enterica enterica serovar Typhi Ty2
aacauuacaauguacagaa

SEQ ID NO: 1786138 - RNA, 20 nt, Salmonella enterica enterica serovar Typhi Ty2
aacauggguuugacccauuu

SEQ ID NO: 1786139 - RNA, 14 nt, Salmonella enterica enterica serovar Typhi Ty2
aacauggggagcag

SEQ ID NO: 1786140 - RNA, 14 nt, Salmonella enterica enterica serovar Typhi Ty2
aaccaaaugcccag

SEQ ID NO: 1786141 - RNA, 16 nt, Salmonella enterica enterica serovar Typhi Ty2
aaccaacgcauaaaaa

SEQ ID NO: 1786142 - RNA, 21 nt, Salmonella enterica enterica serovar Typhi Ty2
aacauuggaaaacuccagcag

SEQ ID NO: 1786143 - RNA, 17 nt, Salmonella enterica enterica serovar Typhi Ty2
aacauucaaaccuucaa

SEQ ID NO: 1786144 - RNA, 18 nt, Salmonella enterica enterica serovar Typhi Ty2
aacauuauuaaaaugucu

SEQ ID NO: 1786145 - RNA, 13 nt, Salmonella enterica enterica serovar Typhi Ty2
aacauucagguuc

SEQ ID NO: 1786146 - RNA, 23 nt, Salmonella enterica enterica serovar Typhi Ty2
aacauagcggcaaggaaaaccag

SEQ ID NO: 1786147 - RNA, 17 nt, Salmonella enterica enterica serovar Typhi Ty2
aacauagcuaaauaaaa

SEQ ID NO: 1786148 - RNA, 20 nt, Salmonella enterica enterica serovar Typhi Ty2
aacauauagcagcagucucu

SEQ ID NO: 1786149 - RNA, 23 nt, Salmonella enterica enterica serovar Typhi Ty2
aacauauuuuucacacauaagca

SEQ ID NO: 1786150 - RNA, 13 nt, Salmonella enterica enterica serovar Typhi Ty2
aacauauuuuuau

SEQ ID NO: 1786151 - RNA, 16 nt, Salmonella enterica enterica serovar Typhi Ty2
aacaucaccuuucauu

SEQ ID NO: 1786152 - RNA, 20 nt, Salmonella enterica enterica serovar Typhi Ty2
aacaucagcgcuaccagcgc

SEQ ID NO: 1786153 - RNA, 14 nt, Salmonella enterica enterica serovar Typhi Ty2
aacaucagcgcuac

SEQ ID NO: 1786154 - RNA, 23 nt, Salmonella enterica enterica serovar Typhi Ty2
aacaucagcccuaucgcugcgcu

SEQ ID NO: 1786155 - RNA, 16 nt, Salmonella enterica enterica serovar Typhi Ty2
aacaucagccagcagc

SEQ ID NO: 1786156 - RNA, 19 nt, Salmonella enterica enterica serovar Typhi Ty2
aacaucagaaaaaagccaa

SEQ ID NO: 1786157 - RNA, 16 nt, Salmonella enterica enterica serovar Typhi Ty2
aacaucccagaaaaug

SEQ ID NO: 1786158 - RNA, 18 nt, Salmonella enterica enterica serovar Typhi Ty2
aacaucauuauuccccuc

SEQ ID NO: 1786159 - RNA, 22 nt, Salmonella enterica enterica serovar Typhi Ty2
aacaucauucccguaucuucau

SEQ ID NO: 1786160 - RNA, 16 nt, Salmonella enterica enterica serovar Typhi Ty2
aacagugacaaacuca

SEQ ID NO: 1786161 - RNA, 22 nt, Salmonella enterica enterica serovar Typhi Ty2
aacagucgcgccgugcccagca

SEQ ID NO: 1786162 - RNA, 19 nt, Salmonella enterica enterica serovar Typhi Ty2
aacagugggcuaugaagag

SEQ ID NO: 1786163 - RNA, 17 nt, Salmonella enterica enterica serovar Typhi Ty2
aacaguguaaacgccag

SEQ ID NO: 1786164 - RNA, 22 nt, Salmonella enterica enterica serovar Typhi Ty2
aacaguucauuucaggcaaagg

SEQ ID NO: 1786165 - RNA, 13 nt, Salmonella enterica enterica serovar Typhi Ty2
aacaguucagaca

SEQ ID NO: 1786166 - RNA, 16 nt, Salmonella enterica enterica serovar Typhi Ty2
aacaguuuuuccuuuc

SEQ ID NO: 1786167 - RNA, 18 nt, Salmonella enterica enterica serovar Typhi Ty2
aacaggguuucucgggag

SEQ ID NO: 1786168 - RNA, 20 nt, Salmonella enterica enterica serovar Typhi Ty2
aacagggcggccuccuggcu

SEQ ID NO: 1786169 - RNA, 19 nt, Salmonella enterica enterica serovar Typhi Ty2
aacaguaccugauaaaauu

SEQ ID NO: 1786170 - RNA, 14 nt, Salmonella enterica enterica serovar Typhi Ty2
aacaguacuggucg

SEQ ID NO: 1786171 - RNA, 19 nt, Salmonella enterica enterica serovar Typhi Ty2
aacaggcgcaggcauuaaa

SEQ ID NO: 1786172 - RNA, 21 nt, Salmonella enterica enterica serovar Typhi Ty2
aacaggccugcggaaaaaguc

SEQ ID NO: 1786173 - RNA, 15 nt, Salmonella enterica enterica serovar Typhi Ty2
aacaggccugcggaa

SEQ ID NO: 1786174 - RNA, 22 nt, Salmonella enterica enterica serovar Typhi Ty2
aacaggcugucugccaugccuu

SEQ ID NO: 1786175 - RNA, 19 nt, Salmonella enterica enterica serovar Typhi Ty2
aacaggcuuuauacaguaa

SEQ ID NO: 1786176 - RNA, 23 nt, Salmonella enterica enterica serovar Typhi Ty2
aacaggcugcguaacgcgccgga

SEQ ID NO: 1786177 - RNA, 20 nt, Salmonella enterica enterica serovar Typhi Ty2
aacagcgucauccaguguua

SEQ ID NO: 1786178 - RNA, 22 nt, Salmonella enterica enterica serovar Typhi Ty2
aacagcgugaacacgccccaca

SEQ ID NO: 1786179 - RNA, 22 nt, Salmonella enterica enterica serovar Typhi Ty2
aacagcuuaccccuguccuuuc

SEQ ID NO: 1786180 - RNA, 14 nt, Salmonella enterica enterica serovar Typhi Ty2
aacagcuugaucau

SEQ ID NO: 1786181 - RNA, 21 nt, Salmonella enterica enterica serovar Typhi Ty2
aacagcgggguaaagccuuua

SEQ ID NO: 1786182 - RNA, 18 nt, Salmonella enterica enterica serovar Typhi Ty2
aacagcgcugguagcacc

SEQ ID NO: 1786183 - RNA, 12 nt, Salmonella enterica enterica serovar Typhi Ty2
aacagcgcucca

SEQ ID NO: 1786184 - RNA, 17 nt, Salmonella enterica enterica serovar Typhi Ty2
aacagcgccggcagcag

SEQ ID NO: 1786185 - RNA, 15 nt, Salmonella enterica enterica serovar Typhi Ty2
aacagcgccggcagc

SEQ ID NO: 1786186 - RNA, 16 nt, Salmonella enterica enterica serovar Typhi Ty2
aacagcgccaucagga

SEQ ID NO: 1786187 - RNA, 12 nt, Salmonella enterica enterica serovar Typhi Ty2
aacagcaggacc

SEQ ID NO: 1786188 - RNA, 12 nt, Salmonella enterica enterica serovar Typhi Ty2
aacagcagcagc

SEQ ID NO: 1786189 - RNA, 15 nt, Salmonella enterica enterica serovar Typhi Ty2
aacagcaccagcagg

SEQ ID NO: 1786190 - RNA, 20 nt, Salmonella enterica enterica serovar Typhi Ty2
aacagcaaaucgggaaaaug

SEQ ID NO: 1786191 - RNA, 16 nt, Salmonella enterica enterica serovar Typhi Ty2
aacagcaaacgccuuc

SEQ ID NO: 1786192 - RNA, 16 nt, Salmonella enterica enterica serovar Typhi Ty2
aacagcaaugcccaaa

SEQ ID NO: 1786193 - RNA, 12 nt, Salmonella enterica enterica serovar Typhi Ty2
aacagcaaugcc

SEQ ID NO: 1786194 - RNA, 12 nt, Salmonella enterica enterica serovar Typhi Ty2
aacagcaccagc

SEQ ID NO: 1786195 - RNA, 14 nt, Salmonella enterica enterica serovar Typhi Ty2
aacagcaccagcag

SEQ ID NO: 1786196 - RNA, 14 nt, Salmonella enterica enterica serovar Typhi Ty2
aacagccagcagcg

SEQ ID NO: 1786197 - RNA, 14 nt, Salmonella enterica enterica serovar Typhi Ty2
aacagccagaagcc

SEQ ID NO: 1786198 - RNA, 15 nt, Salmonella enterica enterica serovar Typhi Ty2
aacagccagaagccu

SEQ ID NO: 1786199 - RNA, 18 nt, Salmonella enterica enterica serovar Typhi Ty2
aacagccauuuuaaaaau

SEQ ID NO: 1786200 - RNA, 13 nt, Salmonella enterica enterica serovar Typhi Ty2
aacagccagaagc

SEQ ID NO: 1786201 - RNA, 18 nt, Salmonella enterica enterica serovar Typhi Ty2
aacacuauauguccuuua

SEQ ID NO: 1786202 - RNA, 14 nt, Salmonella enterica enterica serovar Typhi Ty2
aacacucuccacca

SEQ ID NO: 1786203 - RNA, 14 nt, Salmonella enterica enterica serovar Typhi Ty2
aacacuggcgcuca

SEQ ID NO: 1786204 - RNA, 16 nt, Salmonella enterica enterica serovar Typhi Ty2
aacacgccgcgcugga

SEQ ID NO: 1786205 - RNA, 16 nt, Salmonella enterica enterica serovar Typhi Ty2
aacacgacgcugccac

SEQ ID NO: 1786206 - RNA, 18 nt, Salmonella enterica enterica serovar Typhi Ty2
aacacgauggcaaauaau

SEQ ID NO: 1786207 - RNA, 19 nt, Salmonella enterica enterica serovar Typhi Ty2
aacagagagggaaaaaaau

SEQ ID NO: 1786208 - RNA, 18 nt, Salmonella enterica enterica serovar Typhi Ty2
aacagagagggaaaaaaa

SEQ ID NO: 1786209 - RNA, 17 nt, Salmonella enterica enterica serovar Typhi Ty2
aacagacgccuuucaga

SEQ ID NO: 1786210 - RNA, 13 nt, Salmonella enterica enterica serovar Typhi Ty2
aacagacuccguc

SEQ ID NO: 1786211 - RNA, 13 nt, Salmonella enterica enterica serovar Typhi Ty2
aacagaguaaccc

SEQ ID NO: 1786212 - RNA, 17 nt, Salmonella enterica enterica serovar Typhi Ty2
aacagaaaaaaugcacc

SEQ ID NO: 1786213 - RNA, 17 nt, Salmonella enterica enterica serovar Typhi Ty2
aacagaauuaacgcaga

SEQ ID NO: 1786214 - RNA, 18 nt, Salmonella enterica enterica serovar Typhi Ty2
aacagaagccugcguuau

SEQ ID NO: 1786215 - RNA, 17 nt, Salmonella enterica enterica serovar Typhi Ty2
aacagacaauaccaggg

SEQ ID NO: 1786216 - RNA, 19 nt, Salmonella enterica enterica serovar Typhi Ty2
aacaccagggauuuugcuu

SEQ ID NO: 1786217 - RNA, 12 nt, Salmonella enterica enterica serovar Typhi Ty2
aacaccagauca

SEQ ID NO: 1786218 - RNA, 13 nt, Salmonella enterica enterica serovar Typhi Ty2
aacaccagacuga

SEQ ID NO: 1786219 - RNA, 15 nt, Salmonella enterica enterica serovar Typhi Ty2
aacaccacaacacac

SEQ ID NO: 1786220 - RNA, 14 nt, Salmonella enterica enterica serovar Typhi Ty2
aacacagccagcac

SEQ ID NO: 1786221 - RNA, 15 nt, Salmonella enterica enterica serovar Typhi Ty2
aacaccggggcauuu

SEQ ID NO: 1786222 - RNA, 16 nt, Salmonella enterica enterica serovar Typhi Ty2
aacacccacaccaucg

SEQ ID NO: 1786223 - RNA, 20 nt, Salmonella enterica enterica serovar Typhi Ty2
aacaccuuuggggaaaggua

SEQ ID NO: 1786224 - RNA, 13 nt, Salmonella enterica enterica serovar Typhi Ty2
aacacgaauaugc

SEQ ID NO: 1786225 - RNA, 18 nt, Salmonella enterica enterica serovar Typhi Ty2
aacacgaccagcgacagu

SEQ ID NO: 1786226 - RNA, 16 nt, Salmonella enterica enterica serovar Typhi Ty2
aacaccuuauccggcc

SEQ ID NO: 1786227 - RNA, 20 nt, Salmonella enterica enterica serovar Typhi Ty2
aacaccucagccacccacug

SEQ ID NO: 1786228 - RNA, 12 nt, Salmonella enterica enterica serovar Typhi Ty2
aacaauauuaaa

SEQ ID NO: 1786229 - RNA, 23 nt, Salmonella enterica enterica serovar Typhi Ty2
aacaauaucgauagcauuuuuac

SEQ ID NO: 1786230 - RNA, 19 nt, Salmonella enterica enterica serovar Typhi Ty2
aacaaugccauuauugcau

SEQ ID NO: 1786231 - RNA, 19 nt, Salmonella enterica enterica serovar Typhi Ty2
aacacacgcuuagcuugcc

SEQ ID NO: 1786232 - RNA, 21 nt, Salmonella enterica enterica serovar Typhi Ty2
aacacaaacaauuuacgcagc

SEQ ID NO: 1786233 - RNA, 17 nt, Salmonella enterica enterica serovar Typhi Ty2
aacacaaacuggaccca

SEQ ID NO: 1786234 - RNA, 20 nt, Salmonella enterica enterica serovar Typhi Ty2
aacaauuacgccuacuggga

SEQ ID NO: 1786235 - RNA, 17 nt, Salmonella enterica enterica serovar Typhi Ty2
aacaaauaaauccauga

SEQ ID NO: 1786236 - RNA, 18 nt, Salmonella enterica enterica serovar Typhi Ty2
aacaaauaaauccaugag

SEQ ID NO: 1786237 - RNA, 20 nt, Salmonella enterica enterica serovar Typhi Ty2
aacaaagggcaccugggcaa

SEQ ID NO: 1786238 - RNA, 14 nt, Salmonella enterica enterica serovar Typhi Ty2
aacaaagggcaccu

SEQ ID NO: 1786239 - RNA, 14 nt, Salmonella enterica enterica serovar Typhi Ty2
aacaaaaccagcau

SEQ ID NO: 1786240 - RNA, 16 nt, Salmonella enterica enterica serovar Typhi Ty2
aacaaaacggaauguu

SEQ ID NO: 1786241 - RNA, 22 nt, Salmonella enterica enterica serovar Typhi Ty2
aacaaaaagauauuauaaaaua

SEQ ID NO: 1786242 - RNA, 15 nt, Salmonella enterica enterica serovar Typhi Ty2
aacaagcaaaccuau

SEQ ID NO: 1786243 - RNA, 23 nt, Salmonella enterica enterica serovar Typhi Ty2
aacaagccgccaacgccagcagc

SEQ ID NO: 1786244 - RNA, 14 nt, Salmonella enterica enterica serovar Typhi Ty2
aacaagcagauacc

SEQ ID NO: 1786245 - RNA, 20 nt, Salmonella enterica enterica serovar Typhi Ty2
aacaacuguuuuucacuaau

SEQ ID NO: 1786246 - RNA, 14 nt, Salmonella enterica enterica serovar Typhi Ty2
aacaacuguuuuuc

SEQ ID NO: 1786247 - RNA, 14 nt, Salmonella enterica enterica serovar Typhi Ty2
aacaacggcacaca

SEQ ID NO: 1786248 - RNA, 20 nt, Salmonella enterica enterica serovar Typhi Ty2
aaauuuauuuuuugcuggga

SEQ ID NO: 1786249 - RNA, 14 nt, Salmonella enterica enterica serovar Typhi Ty2
aaauuucuuuucca

SEQ ID NO: 1786250 - RNA, 14 nt, Salmonella enterica enterica serovar Typhi Ty2
aaauuucugaugug

SEQ ID NO: 1786251 - RNA, 12 nt, Salmonella enterica enterica serovar Typhi Ty2
aaauuuccucuu

SEQ ID NO: 1786252 - RNA, 21 nt, Salmonella enterica enterica serovar Typhi Ty2
aaauuucgaaacaggaaaaac

SEQ ID NO: 1786253 - RNA, 20 nt, Salmonella enterica enterica serovar Typhi Ty2
aaauuuccgcagccagaauc

SEQ ID NO: 1786254 - RNA, 18 nt, Salmonella enterica enterica serovar Typhi Ty2
aaauuguuuaaaaacagg

SEQ ID NO: 1786255 - RNA, 14 nt, Salmonella enterica enterica serovar Typhi Ty2
aaauuuaauauaug

SEQ ID NO: 1786256 - RNA, 13 nt, Salmonella enterica enterica serovar Typhi Ty2
aaauuuagcuauu

SEQ ID NO: 1786257 - RNA, 19 nt, Salmonella enterica enterica serovar Typhi Ty2
aaauuuagcuauuccaaaa

SEQ ID NO: 1786258 - RNA, 22 nt, Salmonella enterica enterica serovar Typhi Ty2
uuucaaaaccgaccccgcucag

SEQ ID NO: 1786259 - RNA, 15 nt, Salmonella enterica enterica serovar Typhi Ty2
aaauugaucacaaaa

SEQ ID NO: 1786260 - RNA, 16 nt, Salmonella enterica enterica serovar Typhi Ty2
uuucaaaaaagagaag

SEQ ID NO: 1786261 - RNA, 20 nt, Salmonella enterica enterica serovar Typhi Ty2
aaauugccgcgcccugcgga

SEQ ID NO: 1786262 - RNA, 16 nt, Salmonella enterica enterica serovar Typhi Ty2
aaauugccugauggcg

SEQ ID NO: 1786263 - RNA, 22 nt, Salmonella enterica enterica serovar Typhi Ty2
aaauuggguaguaauauuaaaa

SEQ ID NO: 1786264 - RNA, 13 nt, Salmonella enterica enterica serovar Typhi Ty2
aaauugcugaugu

SEQ ID NO: 1786265 - RNA, 17 nt, Salmonella enterica enterica serovar Typhi Ty2
aagaaagggagaauacc

SEQ ID NO: 1786266 - RNA, 19 nt, Salmonella enterica enterica serovar Typhi Ty2
aagaaagacgcugaaaagc

SEQ ID NO: 1786267 - RNA, 12 nt, Salmonella enterica enterica serovar Typhi Ty2
aagaaaccauua

SEQ ID NO: 1786268 - RNA, 22 nt, Salmonella enterica enterica serovar Typhi Ty2
aagaaacgccgcgcaaagcaau

SEQ ID NO: 1786269 - RNA, 20 nt, Salmonella enterica enterica serovar Typhi Ty2
aagaaaacuuucauuucacu

SEQ ID NO: 1786270 - RNA, 21 nt, Salmonella enterica enterica serovar Typhi Ty2
aagaaacaauccguuauuuca

SEQ ID NO: 1786271 - RNA, 17 nt, Salmonella enterica enterica serovar Typhi Ty2
aagaaaaaacuggugca

SEQ ID NO: 1786272 - RNA, 14 nt, Salmonella enterica enterica serovar Typhi Ty2
aagaaaaaagugau

SEQ ID NO: 1786273 - RNA, 22 nt, Salmonella enterica enterica serovar Typhi Ty2
aagaaaaaggagccuuacggcu

SEQ ID NO: 1786274 - RNA, 19 nt, Salmonella enterica enterica serovar Typhi Ty2
aagaacuuccccaucagga

SEQ ID NO: 1786275 - RNA, 20 nt, Salmonella enterica enterica serovar Typhi Ty2
aagaacuuaggauaauuccc

SEQ ID NO: 1786276 - RNA, 18 nt, Salmonella enterica enterica serovar Typhi Ty2
aagaagcacgacacaaaa

SEQ ID NO: 1786277 - RNA, 12 nt, Salmonella enterica enterica serovar Typhi Ty2
aagaagaggcga

SEQ ID NO: 1786278 - RNA, 16 nt, Salmonella enterica enterica serovar Typhi Ty2
aagaacgguuggaaua

SEQ ID NO: 1786279 - RNA, 16 nt, Salmonella enterica enterica serovar Typhi Ty2
aagaacguucaugcgu

SEQ ID NO: 1786280 - RNA, 20 nt, Salmonella enterica enterica serovar Typhi Ty2
aagaacgccgcaaacgccga

SEQ ID NO: 1786281 - RNA, 22 nt, Salmonella enterica enterica serovar Typhi Ty2
aagaaccgacugucgaaaccag

SEQ ID NO: 1786282 - RNA, 17 nt, Salmonella enterica enterica serovar Typhi Ty2
aagaaauugggcuucca

SEQ ID NO: 1786283 - RNA, 14 nt, Salmonella enterica enterica serovar Typhi Ty2
aagaacaugacggc

SEQ ID NO: 1786284 - RNA, 22 nt, Salmonella enterica enterica serovar Typhi Ty2
aagaacagggggcgcaucacug

SEQ ID NO: 1786285 - RNA, 22 nt, Salmonella enterica enterica serovar Typhi Ty2
aacuuguaaaaaugccugugcc

SEQ ID NO: 1786286 - RNA, 13 nt, Salmonella enterica enterica serovar Typhi Ty2
aacuuguaaaaau

SEQ ID NO: 1786287 - RNA, 23 nt, Salmonella enterica enterica serovar Typhi Ty2
aacuugccguuuuucucaucaag

SEQ ID NO: 1786288 - RNA, 20 nt, Salmonella enterica enterica serovar Typhi Ty2
aacuugacuuugcucuccuu

SEQ ID NO: 1786289 - RNA, 16 nt, Salmonella enterica enterica serovar Typhi Ty2
aacuuuuaauuuuuau

SEQ ID NO: 1786290 - RNA, 20 nt, Salmonella enterica enterica serovar Typhi Ty2
aacuuugcgccauuucaaua

SEQ ID NO: 1786291 - RNA, 18 nt, Salmonella enterica enterica serovar Typhi Ty2
aacuuuuggugcccaucg

SEQ ID NO: 1786292 - RNA, 11 nt, Salmonella enterica enterica serovar Typhi Ty2
aacuuuccaac

SEQ ID NO: 1786293 - RNA, 19 nt, Salmonella enterica enterica serovar Typhi Ty2
aacuuuccugccuucugaa

SEQ ID NO: 1786294 - RNA, 12 nt, Salmonella enterica enterica serovar Typhi Ty2
aacuuucauuuc

SEQ ID NO: 1786295 - RNA, 12 nt, Salmonella enterica enterica serovar Typhi Ty2
aacuuucagaau

SEQ ID NO: 1786296 - RNA, 18 nt, Salmonella enterica enterica serovar Typhi Ty2
aacuuauuuuauuuuuau

SEQ ID NO: 1786297 - RNA, 18 nt, Salmonella enterica enterica serovar Typhi Ty2
aacuucaauucagaaagu

SEQ ID NO: 1786298 - RNA, 20 nt, Salmonella enterica enterica serovar Typhi Ty2
aacuuacacuuaccugauua

SEQ ID NO: 1786299 - RNA, 18 nt, Salmonella enterica enterica serovar Typhi Ty2
aacuuacaagugucguga

SEQ ID NO: 1786300 - RNA, 23 nt, Salmonella enterica enterica serovar Typhi Ty2
aacuuaguguccacucgcucauu

SEQ ID NO: 1786301 - RNA, 20 nt, Salmonella enterica enterica serovar Typhi Ty2
aacuuccgguagguuaaaua

SEQ ID NO: 1786302 - RNA, 22 nt, Salmonella enterica enterica serovar Typhi Ty2
aacuuccaccaccuccugcugg

SEQ ID NO: 1786303 - RNA, 19 nt, Salmonella enterica enterica serovar Typhi Ty2
aacuucuccgccaucaguu

SEQ ID NO: 1786304 - RNA, 17 nt, Salmonella enterica enterica serovar Typhi Ty2
aacuucucgcaggccaa

SEQ ID NO: 1786305 - RNA, 14 nt, Salmonella enterica enterica serovar Typhi Ty2
aacugcuguagcac

SEQ ID NO: 1786306 - RNA, 12 nt, Salmonella enterica enterica serovar Typhi Ty2
aacuggaaaaag

SEQ ID NO: 1786307 - RNA, 13 nt, Salmonella enterica enterica serovar Typhi Ty2
aacuggaaaaaga

SEQ ID NO: 1786308 - RNA, 22 nt, Salmonella enterica enterica serovar Typhi Ty2
aacuggcacgccguuugccaua

SEQ ID NO: 1786309 - RNA, 16 nt, Salmonella enterica enterica serovar Typhi Ty2
aacuggcagcagugac

SEQ ID NO: 1786310 - RNA, 19 nt, Salmonella enterica enterica serovar Typhi Ty2
aacuggcgcaucuggucau

SEQ ID NO: 1786311 - RNA, 16 nt, Salmonella enterica enterica serovar Typhi Ty2
aacuggguaugcagug

SEQ ID NO: 1786312 - RNA, 13 nt, Salmonella enterica enterica serovar Typhi Ty2
aacuggugaaaca

SEQ ID NO: 1786313 - RNA, 17 nt, Salmonella enterica enterica serovar Typhi Ty2
aacuggugaaacagguu

SEQ ID NO: 1786314 - RNA, 16 nt, Salmonella enterica enterica serovar Typhi Ty2
aacuggcgccggaguc

SEQ ID NO: 1786315 - RNA, 16 nt, Salmonella enterica enterica serovar Typhi Ty2
aacugggcgauaaagu

SEQ ID NO: 1786316 - RNA, 14 nt, Salmonella enterica enterica serovar Typhi Ty2
aacugucgccgcua

SEQ ID NO: 1786317 - RNA, 23 nt, Salmonella enterica enterica serovar Typhi Ty2
aacugucguauuuauuuucugaa

SEQ ID NO: 1786318 - RNA, 15 nt, Salmonella enterica enterica serovar Typhi Ty2
aacuguauccguaau

SEQ ID NO: 1786319 - RNA, 19 nt, Salmonella enterica enterica serovar Typhi Ty2
aacuguagcaggauauuuu

SEQ ID NO: 1786320 - RNA, 18 nt, Salmonella enterica enterica serovar Typhi Ty2
aacuuaaauuaaugauua

SEQ ID NO: 1786321 - RNA, 17 nt, Salmonella enterica enterica serovar Typhi Ty2
aacuguuaggccggaca

SEQ ID NO: 1786322 - RNA, 13 nt, Salmonella enterica enterica serovar Typhi Ty2
aacuguuaucaua

SEQ ID NO: 1786323 - RNA, 15 nt, Salmonella enterica enterica serovar Typhi Ty2
aacuguucagccagc

SEQ ID NO: 1786324 - RNA, 14 nt, Salmonella enterica enterica serovar Typhi Ty2
aacuguuuacccac

SEQ ID NO: 1786325 - RNA, 22 nt, Salmonella enterica enterica serovar Typhi Ty2
aacugaauuucauccccggcgc

SEQ ID NO: 1786326 - RNA, 13 nt, Salmonella enterica enterica serovar Typhi Ty2
aacugaauuucau

SEQ ID NO: 1786327 - RNA, 13 nt, Salmonella enterica enterica serovar Typhi Ty2
aacugacaauuuc

SEQ ID NO: 1786328 - RNA, 14 nt, Salmonella enterica enterica serovar Typhi Ty2
aacugacgaccggg

SEQ ID NO: 1786329 - RNA, 21 nt, Salmonella enterica enterica serovar Typhi Ty2
aacucuuuuucagcaaauaca

SEQ ID NO: 1786330 - RNA, 15 nt, Salmonella enterica enterica serovar Typhi Ty2
aacugaaccaacagc

SEQ ID NO: 1786331 - RNA, 17 nt, Salmonella enterica enterica serovar Typhi Ty2
aacugagacucagcagc

SEQ ID NO: 1786332 - RNA, 20 nt, Salmonella enterica enterica serovar Typhi Ty2
aacugauauuacuaauaaaa

SEQ ID NO: 1786333 - RNA, 22 nt, Salmonella enterica enterica serovar Typhi Ty2
aacugauccugcguuaacgacc

SEQ ID NO: 1786334 - RNA, 18 nt, Salmonella enterica enterica serovar Typhi Ty2
aacugauucaaaagguga

SEQ ID NO: 1786335 - RNA, 22 nt, Salmonella enterica enterica serovar Typhi Ty2
aacugauuuguaggccugauaa

SEQ ID NO: 1786336 - RNA, 10 nt, Salmonella enterica enterica serovar Typhi Ty2
aacugcacca

SEQ ID NO: 1786337 - RNA, 11 nt, Salmonella enterica enterica serovar Typhi Ty2
aacugcugcuc

SEQ ID NO: 1786338 - RNA, 18 nt, Salmonella enterica enterica serovar Typhi Ty2
aacugcugcgcgugcugu

SEQ ID NO: 1786339 - RNA, 15 nt, Salmonella enterica enterica serovar Typhi Ty2
aacugcugccgcagc

SEQ ID NO: 1786340 - RNA, 11 nt, Salmonella enterica enterica serovar Typhi Ty2
aacugcggcua

SEQ ID NO: 1786341 - RNA, 14 nt, Salmonella enterica enterica serovar Typhi Ty2
aacugcggccagac

SEQ ID NO: 1786342 - RNA, 17 nt, Salmonella enterica enterica serovar Typhi Ty2
aacugcgcggcaaugag

SEQ ID NO: 1786343 - RNA, 19 nt, Salmonella enterica enterica serovar Typhi Ty2
aacugcgcgcccgccuccg

SEQ ID NO: 1786344 - RNA, 16 nt, Salmonella enterica enterica serovar Typhi Ty2
aacugcgccaaaucgg

SEQ ID NO: 1786345 - RNA, 17 nt, Salmonella enterica enterica serovar Typhi Ty2
aacugcgaaaucaccga

SEQ ID NO: 1786346 - RNA, 15 nt, Salmonella enterica enterica serovar Typhi Ty2
aacugcgccugaaga

SEQ ID NO: 1786347 - RNA, 21 nt, Salmonella enterica enterica serovar Typhi Ty2
aacucggcgggguuuuuuuau

SEQ ID NO: 1786348 - RNA, 20 nt, Salmonella enterica enterica serovar Typhi Ty2
aacucgccaugccaucggcc

SEQ ID NO: 1786349 - RNA, 21 nt, Salmonella enterica enterica serovar Typhi Ty2
aacuccuccgggaaaacauca

SEQ ID NO: 1786350 - RNA, 17 nt, Salmonella enterica enterica serovar Typhi Ty2
aacucccgcauauauug

SEQ ID NO: 1786351 - RNA, 21 nt, Salmonella enterica enterica serovar Typhi Ty2
aacuccggacguacccaggcg

SEQ ID NO: 1786352 - RNA, 17 nt, Salmonella enterica enterica serovar Typhi Ty2
aacuccagugcagaaag

SEQ ID NO: 1786353 - RNA, 20 nt, Salmonella enterica enterica serovar Typhi Ty2
aacucucaccgaccugccuu

SEQ ID NO: 1786354 - RNA, 23 nt, Salmonella enterica enterica serovar Typhi Ty2
aacucuaugcaaaagaaaaaacu

SEQ ID NO: 1786355 - RNA, 19 nt, Salmonella enterica enterica serovar Typhi Ty2
aacucugcgacgccaggcg

SEQ ID NO: 1786356 - RNA, 14 nt, Salmonella enterica enterica serovar Typhi Ty2
aacuauuaauucuu

SEQ ID NO: 1786357 - RNA, 19 nt, Salmonella enterica enterica serovar Typhi Ty2
aacuauuaauucuuuuaac

SEQ ID NO: 1786358 - RNA, 12 nt, Salmonella enterica enterica serovar Typhi Ty2
aacuaugugggc

SEQ ID NO: 1786359 - RNA, 17 nt, Salmonella enterica enterica serovar Typhi Ty2
aacuaugccagaauaca

SEQ ID NO: 1786360 - RNA, 21 nt, Salmonella enterica enterica serovar Typhi Ty2
aacuaugccagaauacaccgc

SEQ ID NO: 1786361 - RNA, 15 nt, Salmonella enterica enterica serovar Typhi Ty2
aacuaugcaaaacgu

SEQ ID NO: 1786362 - RNA, 14 nt, Salmonella enterica enterica serovar Typhi Ty2
aacucaucgccagc

SEQ ID NO: 1786363 - RNA, 17 nt, Salmonella enterica enterica serovar Typhi Ty2
aacucaucaugauauaa

SEQ ID NO: 1786364 - RNA, 23 nt, Salmonella enterica enterica serovar Typhi Ty2
aacucauccaccuuauccuggca

SEQ ID NO: 1786365 - RNA, 15 nt, Salmonella enterica enterica serovar Typhi Ty2
aacucaucaugauau

SEQ ID NO: 1786366 - RNA, 22 nt, Salmonella enterica enterica serovar Typhi Ty2
aacucaugccguagaacagcau

SEQ ID NO: 1786367 - RNA, 12 nt, Salmonella enterica enterica serovar Typhi Ty2
aacucaggaaau

SEQ ID NO: 1786368 - RNA, 21 nt, Salmonella enterica enterica serovar Typhi Ty2
aacuaauuguuuguagaaagu

SEQ ID NO: 1786369 - RNA, 13 nt, Salmonella enterica enterica serovar Typhi Ty2
aacuacucguaau

SEQ ID NO: 1786370 - RNA, 21 nt, Salmonella enterica enterica serovar Typhi Ty2
aacguaugugauuagcccacc

SEQ ID NO: 1786371 - RNA, 21 nt, Salmonella enterica enterica serovar Typhi Ty2
aacgucaguggaaaacagcau

SEQ ID NO: 1786372 - RNA, 18 nt, Salmonella enterica enterica serovar Typhi Ty2
aacgucaguggaaaacag

SEQ ID NO: 1786373 - RNA, 19 nt, Salmonella enterica enterica serovar Typhi Ty2
aacgucguaaaaccugcgu

SEQ ID NO: 1786374 - RNA, 16 nt, Salmonella enterica enterica serovar Typhi Ty2
aacgucguaaaaccug

SEQ ID NO: 1786375 - RNA, 12 nt, Salmonella enterica enterica serovar Typhi Ty2
aacgugcagaug

SEQ ID NO: 1786376 - RNA, 13 nt, Salmonella enterica enterica serovar Typhi Ty2
aacgugccacagu

SEQ ID NO: 1786377 - RNA, 22 nt, Salmonella enterica enterica serovar Typhi Ty2
aacguuacauuuuccaugccuu

SEQ ID NO: 1786378 - RNA, 12 nt, Salmonella enterica enterica serovar Typhi Ty2
aacguucaaaau

SEQ ID NO: 1786379 - RNA, 16 nt, Salmonella enterica enterica serovar Typhi Ty2
aacguucaaaaucaaa

SEQ ID NO: 1786380 - RNA, 22 nt, Salmonella enterica enterica serovar Typhi Ty2
aacguguuuucgauuucauuca

SEQ ID NO: 1786381 - RNA, 23 nt, Salmonella enterica enterica serovar Typhi Ty2
aacguguuacguuuaaaccaugc

SEQ ID NO: 1786382 - RNA, 21 nt, Salmonella enterica enterica serovar Typhi Ty2
aacguguccaguuuuuuacuu

SEQ ID NO: 1786383 - RNA, 21 nt, Salmonella enterica enterica serovar Typhi Ty2
aacgugcuggauggcagacaa

SEQ ID NO: 1786384 - RNA, 19 nt, Salmonella enterica enterica serovar Typhi Ty2
aacguuauuggcaggaugu

SEQ ID NO: 1786385 - RNA, 22 nt, Salmonella enterica enterica serovar Typhi Ty2
aacguuguccagcggccaugac

SEQ ID NO: 1786386 - RNA, 14 nt, Salmonella enterica enterica serovar Typhi Ty2
aacgguaacggaca

SEQ ID NO: 1786387 - RNA, 18 nt, Salmonella enterica enterica serovar Typhi Ty2
aacgguucauccagcagc

SEQ ID NO: 1786388 - RNA, 21 nt, Salmonella enterica enterica serovar Typhi Ty2
aacguaaauagagaaaucaac

SEQ ID NO: 1786389 - RNA, 14 nt, Salmonella enterica enterica serovar Typhi Ty2
aacguaaauaccca

SEQ ID NO: 1786390 - RNA, 19 nt, Salmonella enterica enterica serovar Typhi Ty2
aacguagcccauugucauc

SEQ ID NO: 1786391 - RNA, 15 nt, Salmonella enterica enterica serovar Typhi Ty2
aacguaccugagaga

SEQ ID NO: 1786392 - RNA, 13 nt, Salmonella enterica enterica serovar Typhi Ty2
aacggcccggcgu

SEQ ID NO: 1786393 - RNA, 18 nt, Salmonella enterica enterica serovar Typhi Ty2
aacggcgagcuuuaauga

SEQ ID NO: 1786394 - RNA, 19 nt, Salmonella enterica enterica serovar Typhi Ty2
aacggccagugaaauaaau

SEQ ID NO: 1786395 - RNA, 19 nt, Salmonella enterica enterica serovar Typhi Ty2
aacggcgugaaucccccug

SEQ ID NO: 1786396 - RNA, 19 nt, Salmonella enterica enterica serovar Typhi Ty2
aacggcgcguccagccagc

SEQ ID NO: 1786397 - RNA, 17 nt, Salmonella enterica enterica serovar Typhi Ty2
aacggcuuuccagcagc

SEQ ID NO: 1786398 - RNA, 21 nt, Salmonella enterica enterica serovar Typhi Ty2
aacggcuuuccagcagccaga

SEQ ID NO: 1786399 - RNA, 22 nt, Salmonella enterica enterica serovar Typhi Ty2
aacgggacggcggccagcauuu

SEQ ID NO: 1786400 - RNA, 19 nt, Salmonella enterica enterica serovar Typhi Ty2
aacgggcguugcucaaugg

SEQ ID NO: 1786401 - RNA, 14 nt, Salmonella enterica enterica serovar Typhi Ty2
aacgggccacugcu

SEQ ID NO: 1786402 - RNA, 15 nt, Salmonella enterica enterica serovar Typhi Ty2
aacgcgcucgccagc

SEQ ID NO: 1786403 - RNA, 17 nt, Salmonella enterica enterica serovar Typhi Ty2
aacgcgcucgccagcgc

SEQ ID NO: 1786404 - RNA, 20 nt, Salmonella enterica enterica serovar Typhi Ty2
aacgcgcauuuuauuuaaaa

SEQ ID NO: 1786405 - RNA, 14 nt, Salmonella enterica enterica serovar Typhi Ty2
aacgcgcaaaacuc

SEQ ID NO: 1786406 - RNA, 16 nt, Salmonella enterica enterica serovar Typhi Ty2
aacgcgccauccggca

SEQ ID NO: 1786407 - RNA, 19 nt, Salmonella enterica enterica serovar Typhi Ty2
aacgcgucuucaucagcca

SEQ ID NO: 1786408 - RNA, 22 nt, Salmonella enterica enterica serovar Typhi Ty2
aacgcgucuucaucagccagca

SEQ ID NO: 1786409 - RNA, 20 nt, Salmonella enterica enterica serovar Typhi Ty2
aacgcggcuuuaaguuuuuc

SEQ ID NO: 1786410 - RNA, 21 nt, Salmonella enterica enterica serovar Typhi Ty2
aacgcggcguagccgccgagc

SEQ ID NO: 1786411 - RNA, 12 nt, Salmonella enterica enterica serovar Typhi Ty2
aacgcggccugg

SEQ ID NO: 1786412 - RNA, 23 nt, Salmonella enterica enterica serovar Typhi Ty2
aacgcucuuaccgcuaaaauacc

SEQ ID NO: 1786413 - RNA, 22 nt, Salmonella enterica enterica serovar Typhi Ty2
aacgcucuuaccgcuaaaauac

SEQ ID NO: 1786414 - RNA, 16 nt, Salmonella enterica enterica serovar Typhi Ty2
aacgcugagucagaaa

SEQ ID NO: 1786415 - RNA, 13 nt, Salmonella enterica enterica serovar Typhi Ty2
aacgcugcaaagu

SEQ ID NO: 1786416 - RNA, 16 nt, Salmonella enterica enterica serovar Typhi Ty2
aacgcugcaaaguuau

SEQ ID NO: 1786417 - RNA, 13 nt, Salmonella enterica enterica serovar Typhi Ty2
aacgcuccagcag

SEQ ID NO: 1786418 - RNA, 15 nt, Salmonella enterica enterica serovar Typhi Ty2
aacgcuuaaucccuu

SEQ ID NO: 1786419 - RNA, 21 nt, Salmonella enterica enterica serovar Typhi Ty2
aacgcuucacaaccugaaaga

SEQ ID NO: 1786420 - RNA, 18 nt, Salmonella enterica enterica serovar Typhi Ty2
aacgcuggugcugugccu

SEQ ID NO: 1786421 - RNA, 23 nt, Salmonella enterica enterica serovar Typhi Ty2
aacgcuguugccgcugcuggcgu

SEQ ID NO: 1786422 - RNA, 17 nt, Salmonella enterica enterica serovar Typhi Ty2
aacgcuuuguacagaca

SEQ ID NO: 1786423 - RNA, 19 nt, Salmonella enterica enterica serovar Typhi Ty2
aacggaaaagcauugcuuc

SEQ ID NO: 1786424 - RNA, 22 nt, Salmonella enterica enterica serovar Typhi Ty2
aacggcaacaguaccugauaaa

SEQ ID NO: 1786425 - RNA, 13 nt, Salmonella enterica enterica serovar Typhi Ty2
aacggcagccagc

SEQ ID NO: 1786426 - RNA, 20 nt, Salmonella enterica enterica serovar Typhi Ty2
aacggaugcgccaucccaug

SEQ ID NO: 1786427 - RNA, 22 nt, Salmonella enterica enterica serovar Typhi Ty2
aacggaucaugguugaaaaaag

SEQ ID NO: 1786428 - RNA, 15 nt, Salmonella enterica enterica serovar Typhi Ty2
aacgccgaagccagc

SEQ ID NO: 1786429 - RNA, 22 nt, Salmonella enterica enterica serovar Typhi Ty2
aacgcccgccgcgaccagcagc

SEQ ID NO: 1786430 - RNA, 21 nt, Salmonella enterica enterica serovar Typhi Ty2
aacgcccggcgcgacaccuuc

SEQ ID NO: 1786431 - RNA, 20 nt, Salmonella enterica enterica serovar Typhi Ty2
aacgcccgauagcguaaaga

SEQ ID NO: 1786432 - RNA, 16 nt, Salmonella enterica enterica serovar Typhi Ty2
aacgccaagcgcggca

SEQ ID NO: 1786433 - RNA, 18 nt, Salmonella enterica enterica serovar Typhi Ty2
aacgccaaucacuuuacu

SEQ ID NO: 1786434 - RNA, 23 nt, Salmonella enterica enterica serovar Typhi Ty2
aacgccaaaguuuuuaaacaaca

SEQ ID NO: 1786435 - RNA, 21 nt, Salmonella enterica enterica serovar Typhi Ty2
aacgccaccgccaccugcccu

SEQ ID NO: 1786436 - RNA, 13 nt, Salmonella enterica enterica serovar Typhi Ty2
aacgcaucacaug

SEQ ID NO: 1786437 - RNA, 14 nt, Salmonella enterica enterica serovar Typhi Ty2
aacgcauccagcgc

SEQ ID NO: 1786438 - RNA, 16 nt, Salmonella enterica enterica serovar Typhi Ty2
aacgcauccagcguca

SEQ ID NO: 1786439 - RNA, 22 nt, Salmonella enterica enterica serovar Typhi Ty2
aacgcaucgcugcgcuuacaca

SEQ ID NO: 1786440 - RNA, 11 nt, Salmonella enterica enterica serovar Typhi Ty2
aacgcauucac

SEQ ID NO: 1786441 - RNA, 16 nt, Salmonella enterica enterica serovar Typhi Ty2
aacgccgcgcguaaau

SEQ ID NO: 1786442 - RNA, 16 nt, Salmonella enterica enterica serovar Typhi Ty2
aacgccgccugcgcca

SEQ ID NO: 1786443 - RNA, 18 nt, Salmonella enterica enterica serovar Typhi Ty2
aacgccguuaccagcauc

SEQ ID NO: 1786444 - RNA, 22 nt, Salmonella enterica enterica serovar Typhi Ty2
aacgccgucacaaagcccaccg

SEQ ID NO: 1786445 - RNA, 18 nt, Salmonella enterica enterica serovar Typhi Ty2
aacgccgguuccaacagc

SEQ ID NO: 1786446 - RNA, 15 nt, Salmonella enterica enterica serovar Typhi Ty2
aacgccgggccugcc

SEQ ID NO: 1786447 - RNA, 19 nt, Salmonella enterica enterica serovar Typhi Ty2
aacgcgagaagaagaauua

SEQ ID NO: 1786448 - RNA, 13 nt, Salmonella enterica enterica serovar Typhi Ty2
aacgcgaaaauac

SEQ ID NO: 1786449 - RNA, 15 nt, Salmonella enterica enterica serovar Typhi Ty2
aacgcgaaauaauca

SEQ ID NO: 1786450 - RNA, 14 nt, Salmonella enterica enterica serovar Typhi Ty2
aacgcgaccagcgc

SEQ ID NO: 1786451 - RNA, 13 nt, Salmonella enterica enterica serovar Typhi Ty2
aacgccuccaccg

SEQ ID NO: 1786452 - RNA, 23 nt, Salmonella enterica enterica serovar Typhi Ty2
aacgccuccauuuuggggaaaau

SEQ ID NO: 1786453 - RNA, 18 nt, Salmonella enterica enterica serovar Typhi Ty2
aacgccugaugcugcgca

SEQ ID NO: 1786454 - RNA, 12 nt, Salmonella enterica enterica serovar Typhi Ty2
aacgccuggcgc

SEQ ID NO: 1786455 - RNA, 21 nt, Salmonella enterica enterica serovar Typhi Ty2
aacgaguugcggcaacgugaa

SEQ ID NO: 1786456 - RNA, 18 nt, Salmonella enterica enterica serovar Typhi Ty2
aacgaucccuaauaaaau

SEQ ID NO: 1786457 - RNA, 17 nt, Salmonella enterica enterica serovar Typhi Ty2
aacgacgcauaaaaaau

SEQ ID NO: 1786458 - RNA, 20 nt, Salmonella enterica enterica serovar Typhi Ty2
aacgaugaugaaaaagaaug

SEQ ID NO: 1786459 - RNA, 17 nt, Salmonella enterica enterica serovar Typhi Ty2
aacgaugaugaaaaaga

SEQ ID NO: 1786460 - RNA, 15 nt, Salmonella enterica enterica serovar Typhi Ty2
aacgaugaccauaaa

SEQ ID NO: 1786461 - RNA, 18 nt, Salmonella enterica enterica serovar Typhi Ty2
aacgauucguaaauugac

SEQ ID NO: 1786462 - RNA, 18 nt, Salmonella enterica enterica serovar Typhi Ty2
aacgcacccgcgcaggcg

SEQ ID NO: 1786463 - RNA, 19 nt, Salmonella enterica enterica serovar Typhi Ty2
aacgcacguacggaaggua

SEQ ID NO: 1786464 - RNA, 16 nt, Salmonella enterica enterica serovar Typhi Ty2
aacgcacuuuuccagc

SEQ ID NO: 1786465 - RNA, 18 nt, Salmonella enterica enterica serovar Typhi Ty2
aacgcaucaaauaccuuu

SEQ ID NO: 1786466 - RNA, 15 nt, Salmonella enterica enterica serovar Typhi Ty2
aacgcauaaaaacgu

SEQ ID NO: 1786467 - RNA, 14 nt, Salmonella enterica enterica serovar Typhi Ty2
aacgcagcaucgcc

SEQ ID NO: 1786468 - RNA, 14 nt, Salmonella enterica enterica serovar Typhi Ty2
aaccgucaucagcc

SEQ ID NO: 1786469 - RNA, 17 nt, Salmonella enterica enterica serovar Typhi Ty2
aaccguggcaccccucu

SEQ ID NO: 1786470 - RNA, 16 nt, Salmonella enterica enterica serovar Typhi Ty2
aaccguuggggaaaau

SEQ ID NO: 1786471 - RNA, 21 nt, Salmonella enterica enterica serovar Typhi Ty2
aaccguucaucuaucgccagc

SEQ ID NO: 1786472 - RNA, 22 nt, Salmonella enterica enterica serovar Typhi Ty2
aaccguuuuaccuucugccgcg

SEQ ID NO: 1786473 - RNA, 17 nt, Salmonella enterica enterica serovar Typhi Ty2
aaccguuggggaaaaua

SEQ ID NO: 1786474 - RNA, 22 nt, Salmonella enterica enterica serovar Typhi Ty2
aaccuauugaaaauaaaugaua

SEQ ID NO: 1786475 - RNA, 15 nt, Salmonella enterica enterica serovar Typhi Ty2
aaccuauugaaaaua

SEQ ID NO: 1786476 - RNA, 12 nt, Salmonella enterica enterica serovar Typhi Ty2
aaccuaaaaacc

SEQ ID NO: 1786477 - RNA, 21 nt, Salmonella enterica enterica serovar Typhi Ty2
aaccuggcagaaaggugaaaa

SEQ ID NO: 1786478 - RNA, 13 nt, Salmonella enterica enterica serovar Typhi Ty2
aaccugcgaaaag

SEQ ID NO: 1786479 - RNA, 13 nt, Salmonella enterica enterica serovar Typhi Ty2
aaccugccacagg

SEQ ID NO: 1786480 - RNA, 13 nt, Salmonella enterica enterica serovar Typhi Ty2
aaccugagcgcga

SEQ ID NO: 1786481 - RNA, 21 nt, Salmonella enterica enterica serovar Typhi Ty2
aaccugagcgcgaacgcucca

SEQ ID NO: 1786482 - RNA, 15 nt, Salmonella enterica enterica serovar Typhi Ty2
aaccugagaauauua

SEQ ID NO: 1786483 - RNA, 14 nt, Salmonella enterica enterica serovar Typhi Ty2
aaccugagaauauu

SEQ ID NO: 1786484 - RNA, 20 nt, Salmonella enterica enterica serovar Typhi Ty2
aaccucggcuugcuucaucu

SEQ ID NO: 1786485 - RNA, 13 nt, Salmonella enterica enterica serovar Typhi Ty2
aaccucccgccgg

SEQ ID NO: 1786486 - RNA, 19 nt, Salmonella enterica enterica serovar Typhi Ty2
aaccucaucccggcuuaaa

SEQ ID NO: 1786487 - RNA, 22 nt, Salmonella enterica enterica serovar Typhi Ty2
aaccuccugcaaucguucuugc

SEQ ID NO: 1786488 - RNA, 20 nt, Salmonella enterica enterica serovar Typhi Ty2
aaccuccggcuaugccggag

SEQ ID NO: 1786489 - RNA, 14 nt, Salmonella enterica enterica serovar Typhi Ty2
aacgaccagauacu

SEQ ID NO: 1786490 - RNA, 17 nt, Salmonella enterica enterica serovar Typhi Ty2
aacgacaaaaauaccac

SEQ ID NO: 1786491 - RNA, 20 nt, Salmonella enterica enterica serovar Typhi Ty2
aacgaauuuaaauagcaauu

SEQ ID NO: 1786492 - RNA, 13 nt, Salmonella enterica enterica serovar Typhi Ty2
aacgaauuuaaau

SEQ ID NO: 1786493 - RNA, 19 nt, Salmonella enterica enterica serovar Typhi Ty2
aacgaaucaccucgcuucc

SEQ ID NO: 1786494 - RNA, 12 nt, Salmonella enterica enterica serovar Typhi Ty2
aacgaaacucag

SEQ ID NO: 1786495 - RNA, 20 nt, Salmonella enterica enterica serovar Typhi Ty2
aacgaaagcucaggcgggga

SEQ ID NO: 1786496 - RNA, 17 nt, Salmonella enterica enterica serovar Typhi Ty2
aaccuucaagaaucaau

SEQ ID NO: 1786497 - RNA, 14 nt, Salmonella enterica enterica serovar Typhi Ty2
aaccuuacggcuca

SEQ ID NO: 1786498 - RNA, 13 nt, Salmonella enterica enterica serovar Typhi Ty2
aaccuguccuuua

SEQ ID NO: 1786499 - RNA, 15 nt, Salmonella enterica enterica serovar Typhi Ty2
aaccuguaucugcug

SEQ ID NO: 1786500 - RNA, 13 nt, Salmonella enterica enterica serovar Typhi Ty2
aaccugucaguac

SEQ ID NO: 1786501 - RNA, 22 nt, Salmonella enterica enterica serovar Typhi Ty2
aaucauucuacaaguucaguag

SEQ ID NO: 1786502 - RNA, 20 nt, Salmonella enterica enterica serovar Typhi Ty2
aaucauucgggaugcauaaa

SEQ ID NO: 1786503 - RNA, 19 nt, Salmonella enterica enterica serovar Typhi Ty2
aaucauucgggaugcauaa

SEQ ID NO: 1786504 - RNA, 15 nt, Salmonella enterica enterica serovar Typhi Ty2
aaucauugcguucag

SEQ ID NO: 1786505 - RNA, 18 nt, Salmonella enterica enterica serovar Typhi Ty2
aaucauucgggaugcaua

SEQ ID NO: 1786506 - RNA, 16 nt, Salmonella enterica enterica serovar Typhi Ty2
aaucauuaauacacug

SEQ ID NO: 1786507 - RNA, 13 nt, Salmonella enterica enterica serovar Typhi Ty2
aaucaugucaaau

SEQ ID NO: 1786508 - RNA, 22 nt, Salmonella enterica enterica serovar Typhi Ty2
aaucaugaacguuaucggcaua

SEQ ID NO: 1786509 - RNA, 23 nt, Salmonella enterica enterica serovar Typhi Ty2
aaucaucgcgcugauauuuuuac

SEQ ID NO: 1786510 - RNA, 16 nt, Salmonella enterica enterica serovar Typhi Ty2
aaucauauaagaaaua

SEQ ID NO: 1786511 - RNA, 17 nt, Salmonella enterica enterica serovar Typhi Ty2
aaucaggcauccugccc

SEQ ID NO: 1786512 - RNA, 22 nt, Salmonella enterica enterica serovar Typhi Ty2
aaucaggcaucccguuuucguc

SEQ ID NO: 1786513 - RNA, 17 nt, Salmonella enterica enterica serovar Typhi Ty2
aauauguuccacaauca

SEQ ID NO: 1786514 - RNA, 15 nt, Salmonella enterica enterica serovar Typhi Ty2
aauaugguuauccag

SEQ ID NO: 1786515 - RNA, 13 nt, Salmonella enterica enterica serovar Typhi Ty2
aaucaggaaaaag

SEQ ID NO: 1786516 - RNA, 14 nt, Salmonella enterica enterica serovar Typhi Ty2
aauccaaauccgca

SEQ ID NO: 1786517 - RNA, 15 nt, Salmonella enterica enterica serovar Typhi Ty2
aaucauuuguacaaa

SEQ ID NO: 1786518 - RNA, 19 nt, Salmonella enterica enterica serovar Typhi Ty2
aaucauuuguacaaaaaau

SEQ ID NO: 1786519 - RNA, 12 nt, Salmonella enterica enterica serovar Typhi Ty2
aauccaccagcg

SEQ ID NO: 1786520 - RNA, 16 nt, Salmonella enterica enterica serovar Typhi Ty2
aauccacauuccagac

SEQ ID NO: 1786521 - RNA, 19 nt, Salmonella enterica enterica serovar Typhi Ty2
aauccacuccguguugcug

SEQ ID NO: 1786522 - RNA, 20 nt, Salmonella enterica enterica serovar Typhi Ty2
aauccagaggguaauuucuu

SEQ ID NO: 1786523 - RNA, 21 nt, Salmonella enterica enterica serovar Typhi Ty2
aauccagaauguuccugcaau

SEQ ID NO: 1786524 - RNA, 22 nt, Salmonella enterica enterica serovar Typhi Ty2
aauccagaauguuccugcaaua

SEQ ID NO: 1786525 - RNA, 15 nt, Salmonella enterica enterica serovar Typhi Ty2
aauccagcagaauaa

SEQ ID NO: 1786526 - RNA, 17 nt, Salmonella enterica enterica serovar Typhi Ty2
aauccaggaauuuuccc

SEQ ID NO: 1786527 - RNA, 14 nt, Salmonella enterica enterica serovar Typhi Ty2
aauccaggaauuuu

SEQ ID NO: 1786528 - RNA, 17 nt, Salmonella enterica enterica serovar Typhi Ty2
aauccagcuacuggcca

SEQ ID NO: 1786529 - RNA, 23 nt, Salmonella enterica enterica serovar Typhi Ty2
aauccaguaaugccauaauuuau

SEQ ID NO: 1786530 - RNA, 20 nt, Salmonella enterica enterica serovar Typhi Ty2
aaucgucguuccgccaggcg

SEQ ID NO: 1786531 - RNA, 23 nt, Salmonella enterica enterica serovar Typhi Ty2
aaucuaccauugauaccaauaaa

SEQ ID NO: 1786532 - RNA, 23 nt, Salmonella enterica enterica serovar Typhi Ty2
aaucgguaacaucaaguacagcu

SEQ ID NO: 1786533 - RNA, 18 nt, Salmonella enterica enterica serovar Typhi Ty2
aauccuuguccauguaaa

SEQ ID NO: 1786534 - RNA, 16 nt, Salmonella enterica enterica serovar Typhi Ty2
aauccuucuuccauuc

SEQ ID NO: 1786535 - RNA, 13 nt, Salmonella enterica enterica serovar Typhi Ty2
aauccuuccuuuc

SEQ ID NO: 1786536 - RNA, 15 nt, Salmonella enterica enterica serovar Typhi Ty2
aauccuuauuuaaua

SEQ ID NO: 1786537 - RNA, 16 nt, Salmonella enterica enterica serovar Typhi Ty2
aaucgccucaaccaac

SEQ ID NO: 1786538 - RNA, 17 nt, Salmonella enterica enterica serovar Typhi Ty2
aaucgccgugaucccaa

SEQ ID NO: 1786539 - RNA, 11 nt, Salmonella enterica enterica serovar Typhi Ty2
aaucgccgcuu

SEQ ID NO: 1786540 - RNA, 16 nt, Salmonella enterica enterica serovar Typhi Ty2
aaucgccgggcggcgc

SEQ ID NO: 1786541 - RNA, 18 nt, Salmonella enterica enterica serovar Typhi Ty2
aaucgcgauccagcccca

SEQ ID NO: 1786542 - RNA, 14 nt, Salmonella enterica enterica serovar Typhi Ty2
aaucgcuaaacaua

SEQ ID NO: 1786543 - RNA, 21 nt, Salmonella enterica enterica serovar Typhi Ty2
aaucgcucacccgauaaaauc

SEQ ID NO: 1786544 - RNA, 12 nt, Salmonella enterica enterica serovar Typhi Ty2
aauccugcaccc

SEQ ID NO: 1786545 - RNA, 23 nt, Salmonella enterica enterica serovar Typhi Ty2
aauccucauuaguucaaguuuag

SEQ ID NO: 1786546 - RNA, 21 nt, Salmonella enterica enterica serovar Typhi Ty2
aauccucuaccggaaaacagc

SEQ ID NO: 1786547 - RNA, 15 nt, Salmonella enterica enterica serovar Typhi Ty2
aauccugcacccgcc

SEQ ID NO: 1786548 - RNA, 18 nt, Salmonella enterica enterica serovar Typhi Ty2
aauccugcacuuccagcc

SEQ ID NO: 1786549 - RNA, 23 nt, Salmonella enterica enterica serovar Typhi Ty2
aauccugcuccaucguauagcga

SEQ ID NO: 1786550 - RNA, 16 nt, Salmonella enterica enterica serovar Typhi Ty2
aauccguuaagcccug

SEQ ID NO: 1786551 - RNA, 18 nt, Salmonella enterica enterica serovar Typhi Ty2
aauccgugcguaaaauau

SEQ ID NO: 1786552 - RNA, 21 nt, Salmonella enterica enterica serovar Typhi Ty2
aauccggcugccugccggauu

SEQ ID NO: 1786553 - RNA, 19 nt, Salmonella enterica enterica serovar Typhi Ty2
aauccgcuaacgaugucau

SEQ ID NO: 1786554 - RNA, 22 nt, Salmonella enterica enterica serovar Typhi Ty2
aaucccggcgauuaauaaaauc

SEQ ID NO: 1786555 - RNA, 21 nt, Salmonella enterica enterica serovar Typhi Ty2
aaucccgcaucacccgcauau

SEQ ID NO: 1786556 - RNA, 23 nt, Salmonella enterica enterica serovar Typhi Ty2
aaucccgaaucacuuacuaaggu

SEQ ID NO: 1786557 - RNA, 17 nt, Salmonella enterica enterica serovar Typhi Ty2
aaucccccugccacaac

SEQ ID NO: 1786558 - RNA, 15 nt, Salmonella enterica enterica serovar Typhi Ty2
aaucccauuagccac

SEQ ID NO: 1786559 - RNA, 19 nt, Salmonella enterica enterica serovar Typhi Ty2
aauccccagcgcuccacca

SEQ ID NO: 1786560 - RNA, 17 nt, Salmonella enterica enterica serovar Typhi Ty2
aauccgacgcuucaaag

SEQ ID NO: 1786561 - RNA, 19 nt, Salmonella enterica enterica serovar Typhi Ty2
aaucccuggcgaauaaaau

SEQ ID NO: 1786562 - RNA, 14 nt, Salmonella enterica enterica serovar Typhi Ty2
aaucuguuccagcg

SEQ ID NO: 1786563 - RNA, 22 nt, Salmonella enterica enterica serovar Typhi Ty2
aaucuguuccagcgagcaggaa

SEQ ID NO: 1786564 - RNA, 21 nt, Salmonella enterica enterica serovar Typhi Ty2
aaucuggugauaaagcagacc

SEQ ID NO: 1786565 - RNA, 12 nt, Salmonella enterica enterica serovar Typhi Ty2
aaugaaaucguc

SEQ ID NO: 1786566 - RNA, 12 nt, Salmonella enterica enterica serovar Typhi Ty2
aaugaugggguc

SEQ ID NO: 1786567 - RNA, 21 nt, Salmonella enterica enterica serovar Typhi Ty2
aaugaggacggcccgcugucu

SEQ ID NO: 1786568 - RNA, 12 nt, Salmonella enterica enterica serovar Typhi Ty2
aaugaucagacg

SEQ ID NO: 1786569 - RNA, 22 nt, Salmonella enterica enterica serovar Typhi Ty2
aaugaugacucauuaaaaaaac

SEQ ID NO: 1786570 - RNA, 21 nt, Salmonella enterica enterica serovar Typhi Ty2
aaugaugacucauuaaaaaaa

SEQ ID NO: 1786571 - RNA, 19 nt, Salmonella enterica enterica serovar Typhi Ty2
aaugaucguaugcagccag

SEQ ID NO: 1786572 - RNA, 15 nt, Salmonella enterica enterica serovar Typhi Ty2
aaugacggaccaaca

SEQ ID NO: 1786573 - RNA, 13 nt, Salmonella enterica enterica serovar Typhi Ty2
aaugacgcccugc

SEQ ID NO: 1786574 - RNA, 13 nt, Salmonella enterica enterica serovar Typhi Ty2
aaugaccucaaga

SEQ ID NO: 1786575 - RNA, 17 nt, Salmonella enterica enterica serovar Typhi Ty2
aaugagagacggagaaa

SEQ ID NO: 1786576 - RNA, 15 nt, Salmonella enterica enterica serovar Typhi Ty2
aaugagcaucuaccc

SEQ ID NO: 1786577 - RNA, 22 nt, Salmonella enterica enterica serovar Typhi Ty2
aaugaaucaucgguaaaugcuu

SEQ ID NO: 1786578 - RNA, 22 nt, Salmonella enterica enterica serovar Typhi Ty2
aaugaauuauuuuuucaugacu

SEQ ID NO: 1786579 - RNA, 16 nt, Salmonella enterica enterica serovar Typhi Ty2
aaugaccucaagaaua

SEQ ID NO: 1786580 - RNA, 15 nt, Salmonella enterica enterica serovar Typhi Ty2
aaugccgggcaaaaa

SEQ ID NO: 1786581 - RNA, 20 nt, Salmonella enterica enterica serovar Typhi Ty2
aaugccgcgggaaauaccaa

SEQ ID NO: 1786582 - RNA, 14 nt, Salmonella enterica enterica serovar Typhi Ty2
aaugccugaccaac

SEQ ID NO: 1786583 - RNA, 17 nt, Salmonella enterica enterica serovar Typhi Ty2
aaugcgcgaauaucuuu

SEQ ID NO: 1786584 - RNA, 17 nt, Salmonella enterica enterica serovar Typhi Ty2
aaugcgccgucaggcuu

SEQ ID NO: 1786585 - RNA, 18 nt, Salmonella enterica enterica serovar Typhi Ty2
aaugcgccccggcggcgu

SEQ ID NO: 1786586 - RNA, 21 nt, Salmonella enterica enterica serovar Typhi Ty2
aaugcgcaaaauucacaccaa

SEQ ID NO: 1786587 - RNA, 14 nt, Salmonella enterica enterica serovar Typhi Ty2
aaugcgauagguga

SEQ ID NO: 1786588 - RNA, 17 nt, Salmonella enterica enterica serovar Typhi Ty2
aaugccuuccuguggaa

SEQ ID NO: 1786589 - RNA, 13 nt, Salmonella enterica enterica serovar Typhi Ty2
aaugcgagcaaaa

SEQ ID NO: 1786590 - RNA, 16 nt, Salmonella enterica enterica serovar Typhi Ty2
aaugcaggcguuuuau

SEQ ID NO: 1786591 - RNA, 21 nt, Salmonella enterica enterica serovar Typhi Ty2
aaugcagcggaauucccacau

SEQ ID NO: 1786592 - RNA, 23 nt, Salmonella enterica enterica serovar Typhi Ty2
aaugccagaaaucgcucaugcgc

SEQ ID NO: 1786593 - RNA, 17 nt, Salmonella enterica enterica serovar Typhi Ty2
aaugccacuauagauga

SEQ ID NO: 1786594 - RNA, 16 nt, Salmonella enterica enterica serovar Typhi Ty2
aaugccaaaaaaacua

SEQ ID NO: 1786595 - RNA, 18 nt, Salmonella enterica enterica serovar Typhi Ty2
aaugcccucaacgcccug

SEQ ID NO: 1786596 - RNA, 13 nt, Salmonella enterica enterica serovar Typhi Ty2
aaugccacugccc

SEQ ID NO: 1786597 - RNA, 16 nt, Salmonella enterica enterica serovar Typhi Ty2
aauggcgcucuuuucc

SEQ ID NO: 1786598 - RNA, 20 nt, Salmonella enterica enterica serovar Typhi Ty2
aauggcggagaucuccagau

SEQ ID NO: 1786599 - RNA, 12 nt, Salmonella enterica enterica serovar Typhi Ty2
aaugguugcguu

SEQ ID NO: 1786600 - RNA, 15 nt, Salmonella enterica enterica serovar Typhi Ty2
aauguaaaacugacu

SEQ ID NO: 1786601 - RNA, 17 nt, Salmonella enterica enterica serovar Typhi Ty2
aauguaaaaaaauaaaa

SEQ ID NO: 1786602 - RNA, 12 nt, Salmonella enterica enterica serovar Typhi Ty2
aaugguuuugcc

SEQ ID NO: 1786603 - RNA, 15 nt, Salmonella enterica enterica serovar Typhi Ty2
aaugguuucccaggu

SEQ ID NO: 1786604 - RNA, 21 nt, Salmonella enterica enterica serovar Typhi Ty2
aauggcgacgacgcuguuuau

SEQ ID NO: 1786605 - RNA, 19 nt, Salmonella enterica enterica serovar Typhi Ty2
aauggcgcgaaaacagcug

SEQ ID NO: 1786606 - RNA, 14 nt, Salmonella enterica enterica serovar Typhi Ty2
aauggcgcgaaaac

SEQ ID NO: 1786607 - RNA, 22 nt, Salmonella enterica enterica serovar Typhi Ty2
aauggccgcagcgccauaaaaa

SEQ ID NO: 1786608 - RNA, 12 nt, Salmonella enterica enterica serovar Typhi Ty2
aauggccgcccc

SEQ ID NO: 1786609 - RNA, 13 nt, Salmonella enterica enterica serovar Typhi Ty2
aaugcuuuaaaug

SEQ ID NO: 1786610 - RNA, 15 nt, Salmonella enterica enterica serovar Typhi Ty2
aaugcuuucaauacu

SEQ ID NO: 1786611 - RNA, 10 nt, Salmonella enterica enterica serovar Typhi Ty2
aaugcuuucc

SEQ ID NO: 1786612 - RNA, 19 nt, Salmonella enterica enterica serovar Typhi Ty2
aauggaccagccaggcgau

SEQ ID NO: 1786613 - RNA, 14 nt, Salmonella enterica enterica serovar Typhi Ty2
aauggaacugccug

SEQ ID NO: 1786614 - RNA, 16 nt, Salmonella enterica enterica serovar Typhi Ty2
aaugcgucggcaccau

SEQ ID NO: 1786615 - RNA, 18 nt, Salmonella enterica enterica serovar Typhi Ty2
aaugcuuagucagccuua

SEQ ID NO: 1786616 - RNA, 15 nt, Salmonella enterica enterica serovar Typhi Ty2
aaugcgcuagcuggc

SEQ ID NO: 1786617 - RNA, 17 nt, Salmonella enterica enterica serovar Typhi Ty2
aaugcgcuuuuuuugcc

SEQ ID NO: 1786618 - RNA, 22 nt, Salmonella enterica enterica serovar Typhi Ty2
aaugcgcgcggcuaccggacug

SEQ ID NO: 1786619 - RNA, 19 nt, Salmonella enterica enterica serovar Typhi Ty2
aauucacccguuauucauu

SEQ ID NO: 1786620 - RNA, 21 nt, Salmonella enterica enterica serovar Typhi Ty2
aauucacccguuauucauuca

SEQ ID NO: 1786621 - RNA, 18 nt, Salmonella enterica enterica serovar Typhi Ty2
aauucacccguuauucau

SEQ ID NO: 1786622 - RNA, 15 nt, Salmonella enterica enterica serovar Typhi Ty2
aauucaccgcaugac

SEQ ID NO: 1786623 - RNA, 18 nt, Salmonella enterica enterica serovar Typhi Ty2
aauucacguuccauuuca

SEQ ID NO: 1786624 - RNA, 21 nt, Salmonella enterica enterica serovar Typhi Ty2
aauucagaaaguuacuuucca

SEQ ID NO: 1786625 - RNA, 15 nt, Salmonella enterica enterica serovar Typhi Ty2
aauucauaacaccaa

SEQ ID NO: 1786626 - RNA, 14 nt, Salmonella enterica enterica serovar Typhi Ty2
aauuccaauauuua

SEQ ID NO: 1786627 - RNA, 15 nt, Salmonella enterica enterica serovar Typhi Ty2
aauuccaccaccucg

SEQ ID NO: 1786628 - RNA, 19 nt, Salmonella enterica enterica serovar Typhi Ty2
aauuccauuagcauucccu

SEQ ID NO: 1786629 - RNA, 17 nt, Salmonella enterica enterica serovar Typhi Ty2
aauuccgcaucauucau

SEQ ID NO: 1786630 - RNA, 16 nt, Salmonella enterica enterica serovar Typhi Ty2
aauuccgcaucauuca

SEQ ID NO: 1786631 - RNA, 17 nt, Salmonella enterica enterica serovar Typhi Ty2
aauuccggcgaaaaacc

SEQ ID NO: 1786632 - RNA, 16 nt, Salmonella enterica enterica serovar Typhi Ty2
aauuccggagccugug

SEQ ID NO: 1786633 - RNA, 19 nt, Salmonella enterica enterica serovar Typhi Ty2
aauuccggcacaaccuggc

SEQ ID NO: 1786634 - RNA, 19 nt, Salmonella enterica enterica serovar Typhi Ty2
aauuccgcaggagagccag

SEQ ID NO: 1786635 - RNA, 15 nt, Salmonella enterica enterica serovar Typhi Ty2
aauucuaugccaggc

SEQ ID NO: 1786636 - RNA, 16 nt, Salmonella enterica enterica serovar Typhi Ty2
aauucuaugccaggcg

SEQ ID NO: 1786637 - RNA, 21 nt, Salmonella enterica enterica serovar Typhi Ty2
aauucucagaaacaacacaaa

SEQ ID NO: 1786638 - RNA, 19 nt, Salmonella enterica enterica serovar Typhi Ty2
aauucugcgcgucaucgcu

SEQ ID NO: 1786639 - RNA, 19 nt, Salmonella enterica enterica serovar Typhi Ty2
aauucugaucgauaaaagu

SEQ ID NO: 1786640 - RNA, 14 nt, Salmonella enterica enterica serovar Typhi Ty2
aauucguccacacg

SEQ ID NO: 1786641 - RNA, 17 nt, Salmonella enterica enterica serovar Typhi Ty2
aauucguuaccugcgca

SEQ ID NO: 1786642 - RNA, 18 nt, Salmonella enterica enterica serovar Typhi Ty2
aauuccuucaauuuuacu

SEQ ID NO: 1786643 - RNA, 16 nt, Salmonella enterica enterica serovar Typhi Ty2
aauuacgccauaaaaa

SEQ ID NO: 1786644 - RNA, 18 nt, Salmonella enterica enterica serovar Typhi Ty2
aauuacuaucuucaaagc

SEQ ID NO: 1786645 - RNA, 20 nt, Salmonella enterica enterica serovar Typhi Ty2
aauguaauucaccaaauccu

SEQ ID NO: 1786646 - RNA, 12 nt, Salmonella enterica enterica serovar Typhi Ty2
aauguagcccca

SEQ ID NO: 1786647 - RNA, 14 nt, Salmonella enterica enterica serovar Typhi Ty2
aauguacgccuaaa

SEQ ID NO: 1786648 - RNA, 13 nt, Salmonella enterica enterica serovar Typhi Ty2
aauuaaccgauaa

SEQ ID NO: 1786649 - RNA, 17 nt, Salmonella enterica enterica serovar Typhi Ty2
aauuaacauuuaagaaa

SEQ ID NO: 1786650 - RNA, 21 nt, Salmonella enterica enterica serovar Typhi Ty2
aauuaacauuuaagaaacaau

SEQ ID NO: 1786651 - RNA, 14 nt, Salmonella enterica enterica serovar Typhi Ty2
aauuauuacagaca

SEQ ID NO: 1786652 - RNA, 14 nt, Salmonella enterica enterica serovar Typhi Ty2
aauuauuaccaaug

SEQ ID NO: 1786653 - RNA, 17 nt, Salmonella enterica enterica serovar Typhi Ty2
aauuaugaccaauguua

SEQ ID NO: 1786654 - RNA, 22 nt, Salmonella enterica enterica serovar Typhi Ty2
aauuaucuguugauaaaacacu

SEQ ID NO: 1786655 - RNA, 16 nt, Salmonella enterica enterica serovar Typhi Ty2
aauuaugaccaauguu

SEQ ID NO: 1786656 - RNA, 17 nt, Salmonella enterica enterica serovar Typhi Ty2
aauuauguauuucucgc

SEQ ID NO: 1786657 - RNA, 23 nt, Salmonella enterica enterica serovar Typhi Ty2
aauuaucuguugauaaaacacuc

SEQ ID NO: 1786658 - RNA, 20 nt, Salmonella enterica enterica serovar Typhi Ty2
aauuauuuuuacuuaaaauu

SEQ ID NO: 1786659 - RNA, 19 nt, Salmonella enterica enterica serovar Typhi Ty2
aauuauuuuucaaaugauc

SEQ ID NO: 1786660 - RNA, 16 nt, Salmonella enterica enterica serovar Typhi Ty2
aauuauuaucaauuuc

SEQ ID NO: 1786661 - RNA, 18 nt, Salmonella enterica enterica serovar Typhi Ty2
aauuauuccuuaucacau

SEQ ID NO: 1786662 - RNA, 12 nt, Salmonella enterica enterica serovar Typhi Ty2
aauucaaucacu

SEQ ID NO: 1786663 - RNA, 13 nt, Salmonella enterica enterica serovar Typhi Ty2
aauugucagaauc

SEQ ID NO: 1786664 - RNA, 13 nt, Salmonella enterica enterica serovar Typhi Ty2
aauugguagacgc

SEQ ID NO: 1786665 - RNA, 18 nt, Salmonella enterica enterica serovar Typhi Ty2
aauugucuuuuuaaccau

SEQ ID NO: 1786666 - RNA, 12 nt, Salmonella enterica enterica serovar Typhi Ty2
aauuuaaacgga

SEQ ID NO: 1786667 - RNA, 13 nt, Salmonella enterica enterica serovar Typhi Ty2
aauuuaaacaugu

SEQ ID NO: 1786668 - RNA, 22 nt, Salmonella enterica enterica serovar Typhi Ty2
aauuuaucaacaaauuccggca

SEQ ID NO: 1786669 - RNA, 22 nt, Salmonella enterica enterica serovar Typhi Ty2
aauuuagcuauuccaaaauaau

SEQ ID NO: 1786670 - RNA, 20 nt, Salmonella enterica enterica serovar Typhi Ty2
aauuuaugguuccugaaaua

SEQ ID NO: 1786671 - RNA, 22 nt, Salmonella enterica enterica serovar Typhi Ty2
aauuuaugauuuuaacaucacc

SEQ ID NO: 1786672 - RNA, 16 nt, Salmonella enterica enterica serovar Typhi Ty2
aauuuauuaacccuuc

SEQ ID NO: 1786673 - RNA, 20 nt, Salmonella enterica enterica serovar Typhi Ty2
aauuuauuacgaaguuuaau

SEQ ID NO: 1786674 - RNA, 14 nt, Salmonella enterica enterica serovar Typhi Ty2
aauuuauccaguaa

SEQ ID NO: 1786675 - RNA, 14 nt, Salmonella enterica enterica serovar Typhi Ty2
aauuuaucagacaa

SEQ ID NO: 1786676 - RNA, 16 nt, Salmonella enterica enterica serovar Typhi Ty2
aauuucacgcagcacg

SEQ ID NO: 1786677 - RNA, 13 nt, Salmonella enterica enterica serovar Typhi Ty2
aauuuauuucugc

SEQ ID NO: 1786678 - RNA, 18 nt, Salmonella enterica enterica serovar Typhi Ty2
aauugauaauaaccgucu

SEQ ID NO: 1786679 - RNA, 12 nt, Salmonella enterica enterica serovar Typhi Ty2
aauugaggccgu

SEQ ID NO: 1786680 - RNA, 18 nt, Salmonella enterica enterica serovar Typhi Ty2
aauugaagaguuugauca

SEQ ID NO: 1786681 - RNA, 23 nt, Salmonella enterica enterica serovar Typhi Ty2
aauugaaauacucuuugaacagc

SEQ ID NO: 1786682 - RNA, 23 nt, Salmonella enterica enterica serovar Typhi Ty2
aauugaccguccccagccagaga

SEQ ID NO: 1786683 - RNA, 14 nt, Salmonella enterica enterica serovar Typhi Ty2
aauugacgcugccu

SEQ ID NO: 1786684 - RNA, 20 nt, Salmonella enterica enterica serovar Typhi Ty2
aauugacgcuugacucugug

SEQ ID NO: 1786685 - RNA, 17 nt, Salmonella enterica enterica serovar Typhi Ty2
aauugaauuauaauaaa

SEQ ID NO: 1786686 - RNA, 21 nt, Salmonella enterica enterica serovar Typhi Ty2
aauucuguaccaggacgcacc

SEQ ID NO: 1786687 - RNA, 23 nt, Salmonella enterica enterica serovar Typhi Ty2
aauucugucucaauaaaaugucu

SEQ ID NO: 1786688 - RNA, 19 nt, Salmonella enterica enterica serovar Typhi Ty2
aauucuuaacccacaagaa

SEQ ID NO: 1786689 - RNA, 18 nt, Salmonella enterica enterica serovar Typhi Ty2
aauucuucugugauuauc

SEQ ID NO: 1786690 - RNA, 15 nt, Salmonella enterica enterica serovar Typhi Ty2
aauugauucugugau

SEQ ID NO: 1786691 - RNA, 18 nt, Salmonella enterica enterica serovar Typhi Ty2
aauugcagggugcagcaa

SEQ ID NO: 1786692 - RNA, 20 nt, Salmonella enterica enterica serovar Typhi Ty2
aauugcagggugcagcaaau

SEQ ID NO: 1786693 - RNA, 22 nt, Salmonella enterica enterica serovar Typhi Ty2
aauugccacgaacgauauaaaa

SEQ ID NO: 1786694 - RNA, 11 nt, Salmonella enterica enterica serovar Typhi Ty2
aauugcgcauc

SEQ ID NO: 1786695 - RNA, 20 nt, Salmonella enterica enterica serovar Typhi Ty2
aauugcgguagaugaaaauu

SEQ ID NO: 1786696 - RNA, 22 nt, Salmonella enterica enterica serovar Typhi Ty2
aauugcugauccuguaaaaaau

SEQ ID NO: 1786697 - RNA, 16 nt, Salmonella enterica enterica serovar Typhi Ty2
aauuggaguuaucauu

SEQ ID NO: 1786698 - RNA, 17 nt, Salmonella enterica enterica serovar Typhi Ty2
aagggaggugcucuccc

SEQ ID NO: 1786699 - RNA, 20 nt, Salmonella enterica enterica serovar Typhi Ty2
aagggauaagaaagauaaaa

SEQ ID NO: 1786700 - RNA, 14 nt, Salmonella enterica enterica serovar Typhi Ty2
aagggaccgcgaag

SEQ ID NO: 1786701 - RNA, 14 nt, Salmonella enterica enterica serovar Typhi Ty2
aagggcaccugggc

SEQ ID NO: 1786702 - RNA, 14 nt, Salmonella enterica enterica serovar Typhi Ty2
aagggcgcugccag

SEQ ID NO: 1786703 - RNA, 22 nt, Salmonella enterica enterica serovar Typhi Ty2
aaggggcaggcgucaaaacagg

SEQ ID NO: 1786704 - RNA, 23 nt, Salmonella enterica enterica serovar Typhi Ty2
aaggaugaacucuaugcaaaaga

SEQ ID NO: 1786705 - RNA, 20 nt, Salmonella enterica enterica serovar Typhi Ty2
aaggauuauuggcaucauaa

SEQ ID NO: 1786706 - RNA, 19 nt, Salmonella enterica enterica serovar Typhi Ty2
aaggcuaccgggcaaacau

SEQ ID NO: 1786707 - RNA, 20 nt, Salmonella enterica enterica serovar Typhi Ty2
aaggcuaccgggcaaacauu

SEQ ID NO: 1786708 - RNA, 22 nt, Salmonella enterica enterica serovar Typhi Ty2
aagggaaaagccauugccgcga

SEQ ID NO: 1786709 - RNA, 21 nt, Salmonella enterica enterica serovar Typhi Ty2
aagggaaaagccauugccgcg

SEQ ID NO: 1786710 - RNA, 23 nt, Salmonella enterica enterica serovar Typhi Ty2
aaggcuaccgcugggaugaccug

SEQ ID NO: 1786711 - RNA, 22 nt, Salmonella enterica enterica serovar Typhi Ty2
aaggcguaugaaugaaacaguc

SEQ ID NO: 1786712 - RNA, 15 nt, Salmonella enterica enterica serovar Typhi Ty2
aaguaaaaugcccug

SEQ ID NO: 1786713 - RNA, 13 nt, Salmonella enterica enterica serovar Typhi Ty2
aagguccagggaa

SEQ ID NO: 1786714 - RNA, 16 nt, Salmonella enterica enterica serovar Typhi Ty2
aagggugcccgccugg

SEQ ID NO: 1786715 - RNA, 15 nt, Salmonella enterica enterica serovar Typhi Ty2
aagguauugauuuuu

SEQ ID NO: 1786716 - RNA, 21 nt, Salmonella enterica enterica serovar Typhi Ty2
aaguaauucuucgaaugucuc

SEQ ID NO: 1786717 - RNA, 20 nt, Salmonella enterica enterica serovar Typhi Ty2
aaguacgccugaaaacagaa

SEQ ID NO: 1786718 - RNA, 12 nt, Salmonella enterica enterica serovar Typhi Ty2
aaguauaaagcu

SEQ ID NO: 1786719 - RNA, 17 nt, Salmonella enterica enterica serovar Typhi Ty2
aaguauaguggcgacaa

SEQ ID NO: 1786720 - RNA, 18 nt, Salmonella enterica enterica serovar Typhi Ty2
aaguauucgaugguguua

SEQ ID NO: 1786721 - RNA, 14 nt, Salmonella enterica enterica serovar Typhi Ty2
aaguagaucaccag

SEQ ID NO: 1786722 - RNA, 15 nt, Salmonella enterica enterica serovar Typhi Ty2
aaguagcugaaaauc

SEQ ID NO: 1786723 - RNA, 20 nt, Salmonella enterica enterica serovar Typhi Ty2
aagucgcaauauaaauauca

SEQ ID NO: 1786724 - RNA, 23 nt, Salmonella enterica enterica serovar Typhi Ty2
aaguccuucuccuucgccaaaau

SEQ ID NO: 1786725 - RNA, 13 nt, Salmonella enterica enterica serovar Typhi Ty2
aaguccuucuccu

SEQ ID NO: 1786726 - RNA, 17 nt, Salmonella enterica enterica serovar Typhi Ty2
aaguccuucuucccccu

SEQ ID NO: 1786727 - RNA, 19 nt, Salmonella enterica enterica serovar Typhi Ty2
aagucaucuguucaacuuu

SEQ ID NO: 1786728 - RNA, 18 nt, Salmonella enterica enterica serovar Typhi Ty2
aagucaucugccaguuau

SEQ ID NO: 1786729 - RNA, 18 nt, Salmonella enterica enterica serovar Typhi Ty2
aagucauaccuguuccuc

SEQ ID NO: 1786730 - RNA, 15 nt, Salmonella enterica enterica serovar Typhi Ty2
aagucaucaauugcu

SEQ ID NO: 1786731 - RNA, 12 nt, Salmonella enterica enterica serovar Typhi Ty2
aagucaaacuga

SEQ ID NO: 1786732 - RNA, 18 nt, Salmonella enterica enterica serovar Typhi Ty2
aaguuaucccugcugagu

SEQ ID NO: 1786733 - RNA, 12 nt, Salmonella enterica enterica serovar Typhi Ty2
aaguuaugcauc

SEQ ID NO: 1786734 - RNA, 15 nt, Salmonella enterica enterica serovar Typhi Ty2
aaguucaaacucauu

SEQ ID NO: 1786735 - RNA, 18 nt, Salmonella enterica enterica serovar Typhi Ty2
aagugguuaacagcgcag

SEQ ID NO: 1786736 - RNA, 18 nt, Salmonella enterica enterica serovar Typhi Ty2
aagucugagcgcaaacau

SEQ ID NO: 1786737 - RNA, 21 nt, Salmonella enterica enterica serovar Typhi Ty2
aagucugugagaaaagcgaaa

SEQ ID NO: 1786738 - RNA, 18 nt, Salmonella enterica enterica serovar Typhi Ty2
aagugcgaaauuuaauau

SEQ ID NO: 1786739 - RNA, 17 nt, Salmonella enterica enterica serovar Typhi Ty2
aagcuucgucaggcggc

SEQ ID NO: 1786740 - RNA, 19 nt, Salmonella enterica enterica serovar Typhi Ty2
aagcuguaacacugccgaa

SEQ ID NO: 1786741 - RNA, 22 nt, Salmonella enterica enterica serovar Typhi Ty2
aagcugguggcgaguccugccg

SEQ ID NO: 1786742 - RNA, 17 nt, Salmonella enterica enterica serovar Typhi Ty2
aagcuggagccacaucg

SEQ ID NO: 1786743 - RNA, 18 nt, Salmonella enterica enterica serovar Typhi Ty2
aagcugggcguuacuggc

SEQ ID NO: 1786744 - RNA, 17 nt, Salmonella enterica enterica serovar Typhi Ty2
aagcugguaauccucuu

SEQ ID NO: 1786745 - RNA, 21 nt, Salmonella enterica enterica serovar Typhi Ty2
aagcugggaaacuuaucagua

SEQ ID NO: 1786746 - RNA, 22 nt, Salmonella enterica enterica serovar Typhi Ty2
aaggaaacuuauuucaacuuau

SEQ ID NO: 1786747 - RNA, 11 nt, Salmonella enterica enterica serovar Typhi Ty2
aaggaaauuca

SEQ ID NO: 1786748 - RNA, 13 nt, Salmonella enterica enterica serovar Typhi Ty2
aaggaaauauuaa

SEQ ID NO: 1786749 - RNA, 14 nt, Salmonella enterica enterica serovar Typhi Ty2
aagcguuuccagag

SEQ ID NO: 1786750 - RNA, 16 nt, Salmonella enterica enterica serovar Typhi Ty2
aagcguuguaacaaac

SEQ ID NO: 1786751 - RNA, 21 nt, Salmonella enterica enterica serovar Typhi Ty2
aagcguuacggaaaaaauacu

SEQ ID NO: 1786752 - RNA, 23 nt, Salmonella enterica enterica serovar Typhi Ty2
aagcguaacagcgcuaucaggaa

SEQ ID NO: 1786753 - RNA, 15 nt, Salmonella enterica enterica serovar Typhi Ty2
aagcguaacagcgcu

SEQ ID NO: 1786754 - RNA, 18 nt, Salmonella enterica enterica serovar Typhi Ty2
aagcgguguaaaagccag

SEQ ID NO: 1786755 - RNA, 12 nt, Salmonella enterica enterica serovar Typhi Ty2
aagcguaagcgu

SEQ ID NO: 1786756 - RNA, 20 nt, Salmonella enterica enterica serovar Typhi Ty2
aagcguacaugaauaauaau

SEQ ID NO: 1786757 - RNA, 20 nt, Salmonella enterica enterica serovar Typhi Ty2
aagcguuacggaaaaaauac

SEQ ID NO: 1786758 - RNA, 21 nt, Salmonella enterica enterica serovar Typhi Ty2
aagcucauuucccaauaguuu

SEQ ID NO: 1786759 - RNA, 22 nt, Salmonella enterica enterica serovar Typhi Ty2
aagcucauuucccaauaguuua

SEQ ID NO: 1786760 - RNA, 13 nt, Salmonella enterica enterica serovar Typhi Ty2
aagcucauuuccc

SEQ ID NO: 1786761 - RNA, 13 nt, Salmonella enterica enterica serovar Typhi Ty2
aagcucagcggca

SEQ ID NO: 1786762 - RNA, 23 nt, Salmonella enterica enterica serovar Typhi Ty2
aagcgccagauaugaucgaaaau

SEQ ID NO: 1786763 - RNA, 15 nt, Salmonella enterica enterica serovar Typhi Ty2
aagcgcccguagcuc

SEQ ID NO: 1786764 - RNA, 18 nt, Salmonella enterica enterica serovar Typhi Ty2
aagcgcccaggccgggcg

SEQ ID NO: 1786765 - RNA, 23 nt, Salmonella enterica enterica serovar Typhi Ty2
aagcgccggaugaggacauaaac

SEQ ID NO: 1786766 - RNA, 18 nt, Salmonella enterica enterica serovar Typhi Ty2
aagcgccuguucaacaug

SEQ ID NO: 1786767 - RNA, 19 nt, Salmonella enterica enterica serovar Typhi Ty2
aagcgcgcccaccgaugac

SEQ ID NO: 1786768 - RNA, 12 nt, Salmonella enterica enterica serovar Typhi Ty2
aagcgcgggcug

SEQ ID NO: 1786769 - RNA, 20 nt, Salmonella enterica enterica serovar Typhi Ty2
aagcgcgguaaauuucuuga

SEQ ID NO: 1786770 - RNA, 13 nt, Salmonella enterica enterica serovar Typhi Ty2
aagcgguaaaucg

SEQ ID NO: 1786771 - RNA, 15 nt, Salmonella enterica enterica serovar Typhi Ty2
aagccccccgcacag

SEQ ID NO: 1786772 - RNA, 12 nt, Salmonella enterica enterica serovar Typhi Ty2
aagcccauggca

SEQ ID NO: 1786773 - RNA, 16 nt, Salmonella enterica enterica serovar Typhi Ty2
aagcccggccacagcg

SEQ ID NO: 1786774 - RNA, 22 nt, Salmonella enterica enterica serovar Typhi Ty2
aagcccggauuaacaagcagau

SEQ ID NO: 1786775 - RNA, 18 nt, Salmonella enterica enterica serovar Typhi Ty2
aagccgccaacgccagca

SEQ ID NO: 1786776 - RNA, 18 nt, Salmonella enterica enterica serovar Typhi Ty2
aagccgcauuacaaacag

SEQ ID NO: 1786777 - RNA, 22 nt, Salmonella enterica enterica serovar Typhi Ty2
aagccgacccgcaucagaccuc

SEQ ID NO: 1786778 - RNA, 18 nt, Salmonella enterica enterica serovar Typhi Ty2
aagccgaaaccacagcgg

SEQ ID NO: 1786779 - RNA, 19 nt, Salmonella enterica enterica serovar Typhi Ty2
aagcccuuucuuuuuuugu

SEQ ID NO: 1786780 - RNA, 18 nt, Salmonella enterica enterica serovar Typhi Ty2
aagcccaacuacacucuu

SEQ ID NO: 1786781 - RNA, 20 nt, Salmonella enterica enterica serovar Typhi Ty2
aagccagguugcgcccggcg

SEQ ID NO: 1786782 - RNA, 14 nt, Salmonella enterica enterica serovar Typhi Ty2
aagccagggaaaug

SEQ ID NO: 1786783 - RNA, 23 nt, Salmonella enterica enterica serovar Typhi Ty2
aagccaucuucgguaauacaauc

SEQ ID NO: 1786784 - RNA, 19 nt, Salmonella enterica enterica serovar Typhi Ty2
aagccauccaucuccggca

SEQ ID NO: 1786785 - RNA, 20 nt, Salmonella enterica enterica serovar Typhi Ty2
aagaagucugugagaaaagc

SEQ ID NO: 1786786 - RNA, 19 nt, Salmonella enterica enterica serovar Typhi Ty2
aagaaguaaacagaaucaa

SEQ ID NO: 1786787 - RNA, 17 nt, Salmonella enterica enterica serovar Typhi Ty2
aagaagguuaauauaca

SEQ ID NO: 1786788 - RNA, 20 nt, Salmonella enterica enterica serovar Typhi Ty2
aagccaggcaccauccggua

SEQ ID NO: 1786789 - RNA, 22 nt, Salmonella enterica enterica serovar Typhi Ty2
aagccagccaaauagcgccaga

SEQ ID NO: 1786790 - RNA, 20 nt, Salmonella enterica enterica serovar Typhi Ty2
aagccagcacggcuucacgu

SEQ ID NO: 1786791 - RNA, 21 nt, Salmonella enterica enterica serovar Typhi Ty2
aagccacuugaaguaugaaag

SEQ ID NO: 1786792 - RNA, 18 nt, Salmonella enterica enterica serovar Typhi Ty2
aagcgauacgucagcggu

SEQ ID NO: 1786793 - RNA, 17 nt, Salmonella enterica enterica serovar Typhi Ty2
aagcgcaaaauagcagc

SEQ ID NO: 1786794 - RNA, 21 nt, Salmonella enterica enterica serovar Typhi Ty2
aagcgcaaacggaucuuccac

SEQ ID NO: 1786795 - RNA, 17 nt, Salmonella enterica enterica serovar Typhi Ty2
aagcgcaaacuuccaca

SEQ ID NO: 1786796 - RNA, 20 nt, Salmonella enterica enterica serovar Typhi Ty2
aagcgaauaauuaacccaca

SEQ ID NO: 1786797 - RNA, 22 nt, Salmonella enterica enterica serovar Typhi Ty2
aagcgaagcgucauccggcaau

SEQ ID NO: 1786798 - RNA, 13 nt, Salmonella enterica enterica serovar Typhi Ty2
aagcgaccuucuc

SEQ ID NO: 1786799 - RNA, 23 nt, Salmonella enterica enterica serovar Typhi Ty2
aagcgaauacuccugcaacagaa

SEQ ID NO: 1786800 - RNA, 12 nt, Salmonella enterica enterica serovar Typhi Ty2
aagccuuucugu

SEQ ID NO: 1786801 - RNA, 16 nt, Salmonella enterica enterica serovar Typhi Ty2
aagccuugcugaauca

SEQ ID NO: 1786802 - RNA, 14 nt, Salmonella enterica enterica serovar Typhi Ty2
aagcgaaaauaaac

SEQ ID NO: 1786803 - RNA, 19 nt, Salmonella enterica enterica serovar Typhi Ty2
aagccgcgucgcaccugcu

SEQ ID NO: 1786804 - RNA, 16 nt, Salmonella enterica enterica serovar Typhi Ty2
aagccuacaccuuacu

SEQ ID NO: 1786805 - RNA, 22 nt, Salmonella enterica enterica serovar Typhi Ty2
aagccucuuccgccugauaaaa

SEQ ID NO: 1786806 - RNA, 14 nt, Salmonella enterica enterica serovar Typhi Ty2
aagccuggucaccu

SEQ ID NO: 1786807 - RNA, 22 nt, Salmonella enterica enterica serovar Typhi Ty2
aagccugauggcgcuucgcuua

SEQ ID NO: 1786808 - RNA, 20 nt, Salmonella enterica enterica serovar Typhi Ty2
aagccguauuuuauuuuuca

SEQ ID NO: 1786809 - RNA, 22 nt, Salmonella enterica enterica serovar Typhi Ty2
aagccguauuuuauuuuucaau

SEQ ID NO: 1786810 - RNA, 16 nt, Salmonella enterica enterica serovar Typhi Ty2
aauauacuuaucggcg

SEQ ID NO: 1786811 - RNA, 18 nt, Salmonella enterica enterica serovar Typhi Ty2
aauaguguggaugucaua

SEQ ID NO: 1786812 - RNA, 14 nt, Salmonella enterica enterica serovar Typhi Ty2
aauauaauuauuau

SEQ ID NO: 1786813 - RNA, 19 nt, Salmonella enterica enterica serovar Typhi Ty2
aauauaauccuuguccaug

SEQ ID NO: 1786814 - RNA, 13 nt, Salmonella enterica enterica serovar Typhi Ty2
aauagccagcccc

SEQ ID NO: 1786815 - RNA, 22 nt, Salmonella enterica enterica serovar Typhi Ty2
aauagccccucaauuauguauu

SEQ ID NO: 1786816 - RNA, 13 nt, Salmonella enterica enterica serovar Typhi Ty2
aauagccugggca

SEQ ID NO: 1786817 - RNA, 20 nt, Salmonella enterica enterica serovar Typhi Ty2
aauagcgcuggcgccgcaaa

SEQ ID NO: 1786818 - RNA, 11 nt, Salmonella enterica enterica serovar Typhi Ty2
aauagcgcugc

SEQ ID NO: 1786819 - RNA, 13 nt, Salmonella enterica enterica serovar Typhi Ty2
aauagcggcacag

SEQ ID NO: 1786820 - RNA, 13 nt, Salmonella enterica enterica serovar Typhi Ty2
aauaggauggcgc

SEQ ID NO: 1786821 - RNA, 14 nt, Salmonella enterica enterica serovar Typhi Ty2
aauagcgccagaca

SEQ ID NO: 1786822 - RNA, 22 nt, Salmonella enterica enterica serovar Typhi Ty2
aauagcgcuacauccgccagcc

SEQ ID NO: 1786823 - RNA, 21 nt, Salmonella enterica enterica serovar Typhi Ty2
aauagcgcugaggcgcuggcu

SEQ ID NO: 1786824 - RNA, 16 nt, Salmonella enterica enterica serovar Typhi Ty2
aauaguggugcgcauc

SEQ ID NO: 1786825 - RNA, 22 nt, Salmonella enterica enterica serovar Typhi Ty2
aauagugcggccaaauugcucg

SEQ ID NO: 1786826 - RNA, 16 nt, Salmonella enterica enterica serovar Typhi Ty2
aauagugacuucugcu

SEQ ID NO: 1786827 - RNA, 21 nt, Salmonella enterica enterica serovar Typhi Ty2
aauaggcgaggaaaacauucg

SEQ ID NO: 1786828 - RNA, 17 nt, Salmonella enterica enterica serovar Typhi Ty2
aauaggcgaggaaaaca

SEQ ID NO: 1786829 - RNA, 22 nt, Salmonella enterica enterica serovar Typhi Ty2
aauaggccaggcucgccagacc

SEQ ID NO: 1786830 - RNA, 22 nt, Salmonella enterica enterica serovar Typhi Ty2
aauaggccggagaaaagaccag

SEQ ID NO: 1786831 - RNA, 22 nt, Salmonella enterica enterica serovar Typhi Ty2
aauaucucccguuuguauaaau

SEQ ID NO: 1786832 - RNA, 22 nt, Salmonella enterica enterica serovar Typhi Ty2
aauaucucuauugcuuauuaga

SEQ ID NO: 1786833 - RNA, 15 nt, Salmonella enterica enterica serovar Typhi Ty2
aauauccgcugcggu

SEQ ID NO: 1786834 - RNA, 19 nt, Salmonella enterica enterica serovar Typhi Ty2
aauauccgguacaccaacu

SEQ ID NO: 1786835 - RNA, 14 nt, Salmonella enterica enterica serovar Typhi Ty2
aauaucccgaugac

SEQ ID NO: 1786836 - RNA, 15 nt, Salmonella enterica enterica serovar Typhi Ty2
aauaugccagauauu

SEQ ID NO: 1786837 - RNA, 16 nt, Salmonella enterica enterica serovar Typhi Ty2
aauaugccagauauuu

SEQ ID NO: 1786838 - RNA, 21 nt, Salmonella enterica enterica serovar Typhi Ty2
aauaucuguuucauggagauc

SEQ ID NO: 1786839 - RNA, 15 nt, Salmonella enterica enterica serovar Typhi Ty2
aauaugccugcacua

SEQ ID NO: 1786840 - RNA, 18 nt, Salmonella enterica enterica serovar Typhi Ty2
aauaugccaggcuuccug

SEQ ID NO: 1786841 - RNA, 13 nt, Salmonella enterica enterica serovar Typhi Ty2
aauaugccaggca

SEQ ID NO: 1786842 - RNA, 20 nt, Salmonella enterica enterica serovar Typhi Ty2
aauauggcugcgauaaugaa

SEQ ID NO: 1786843 - RNA, 21 nt, Salmonella enterica enterica serovar Typhi Ty2
aauaugcucaacuuccagagc

SEQ ID NO: 1786844 - RNA, 14 nt, Salmonella enterica enterica serovar Typhi Ty2
aauaugcuggcuua

SEQ ID NO: 1786845 - RNA, 17 nt, Salmonella enterica enterica serovar Typhi Ty2
aauauaucaggcugagc

SEQ ID NO: 1786846 - RNA, 23 nt, Salmonella enterica enterica serovar Typhi Ty2
aauauaucuguuccacagaucua

SEQ ID NO: 1786847 - RNA, 11 nt, Salmonella enterica enterica serovar Typhi Ty2
aauauccauuu

SEQ ID NO: 1786848 - RNA, 23 nt, Salmonella enterica enterica serovar Typhi Ty2
aauauccccaucccagaccauuc

SEQ ID NO: 1786849 - RNA, 16 nt, Salmonella enterica enterica serovar Typhi Ty2
aauaucaugaauaauc

SEQ ID NO: 1786850 - RNA, 18 nt, Salmonella enterica enterica serovar Typhi Ty2
aauaucauuaauuauacu

SEQ ID NO: 1786851 - RNA, 20 nt, Salmonella enterica enterica serovar Typhi Ty2
aauaccacaaauuuugauaa

SEQ ID NO: 1786852 - RNA, 22 nt, Salmonella enterica enterica serovar Typhi Ty2
aauaccaaagugguuccaggcg

SEQ ID NO: 1786853 - RNA, 16 nt, Salmonella enterica enterica serovar Typhi Ty2
aauaccgaaauccgcu

SEQ ID NO: 1786854 - RNA, 19 nt, Salmonella enterica enterica serovar Typhi Ty2
aauacccgacucuuuuuuc

SEQ ID NO: 1786855 - RNA, 22 nt, Salmonella enterica enterica serovar Typhi Ty2
aauacccgacucuuuuuucaga

SEQ ID NO: 1786856 - RNA, 15 nt, Salmonella enterica enterica serovar Typhi Ty2
aauaccacaucagac

SEQ ID NO: 1786857 - RNA, 20 nt, Salmonella enterica enterica serovar Typhi Ty2
aauaccaccugccaaagcug

SEQ ID NO: 1786858 - RNA, 15 nt, Salmonella enterica enterica serovar Typhi Ty2
aauaauuucuucuuu

SEQ ID NO: 1786859 - RNA, 16 nt, Salmonella enterica enterica serovar Typhi Ty2
aauaauuuuagaaaua

SEQ ID NO: 1786860 - RNA, 17 nt, Salmonella enterica enterica serovar Typhi Ty2
aauaauuuuagaaauag

SEQ ID NO: 1786861 - RNA, 20 nt, Salmonella enterica enterica serovar Typhi Ty2
aauacgccagccgucaugau

SEQ ID NO: 1786862 - RNA, 23 nt, Salmonella enterica enterica serovar Typhi Ty2
aauacgcggcacguuuuccaggu

SEQ ID NO: 1786863 - RNA, 18 nt, Salmonella enterica enterica serovar Typhi Ty2
aauacgcaagccgaacuc

SEQ ID NO: 1786864 - RNA, 19 nt, Salmonella enterica enterica serovar Typhi Ty2
aauaccuuaguaaaaccga

SEQ ID NO: 1786865 - RNA, 15 nt, Salmonella enterica enterica serovar Typhi Ty2
aauaccuggaauauc

SEQ ID NO: 1786866 - RNA, 19 nt, Salmonella enterica enterica serovar Typhi Ty2
aauacgauguacauaggca

SEQ ID NO: 1786867 - RNA, 19 nt, Salmonella enterica enterica serovar Typhi Ty2
aauaccuaacucuuccgca

SEQ ID NO: 1786868 - RNA, 18 nt, Salmonella enterica enterica serovar Typhi Ty2
aauaccucaaaugcugaa

SEQ ID NO: 1786869 - RNA, 17 nt, Salmonella enterica enterica serovar Typhi Ty2
aauaccguaagaccaga

SEQ ID NO: 1786870 - RNA, 20 nt, Salmonella enterica enterica serovar Typhi Ty2
aauaccgguuauccauauga

SEQ ID NO: 1786871 - RNA, 11 nt, Salmonella enterica enterica serovar Typhi Ty2
aauaccgccca

SEQ ID NO: 1786872 - RNA, 16 nt, Salmonella enterica enterica serovar Typhi Ty2
aauaccggauaugcau

SEQ ID NO: 1786873 - RNA, 15 nt, Salmonella enterica enterica serovar Typhi Ty2
aauagaacccaaagc

SEQ ID NO: 1786874 - RNA, 20 nt, Salmonella enterica enterica serovar Typhi Ty2
aauagagugcgauuugacau

SEQ ID NO: 1786875 - RNA, 13 nt, Salmonella enterica enterica serovar Typhi Ty2
aauacuuuuuuag

SEQ ID NO: 1786876 - RNA, 14 nt, Salmonella enterica enterica serovar Typhi Ty2
aauacugaucaauu

SEQ ID NO: 1786877 - RNA, 23 nt, Salmonella enterica enterica serovar Typhi Ty2
aauacgggagagcguauccagca

SEQ ID NO: 1786878 - RNA, 15 nt, Salmonella enterica enterica serovar Typhi Ty2
aauacuguaagccuc

SEQ ID NO: 1786879 - RNA, 16 nt, Salmonella enterica enterica serovar Typhi Ty2
aauacuggaaaaaacg

SEQ ID NO: 1786880 - RNA, 23 nt, Salmonella enterica enterica serovar Typhi Ty2
aauacugcacgccgcguuuuagc

SEQ ID NO: 1786881 - RNA, 20 nt, Salmonella enterica enterica serovar Typhi Ty2
aauagaugcgucgcauccuu

SEQ ID NO: 1786882 - RNA, 15 nt, Salmonella enterica enterica serovar Typhi Ty2
aauagcagcguuuug

SEQ ID NO: 1786883 - RNA, 18 nt, Salmonella enterica enterica serovar Typhi Ty2
aauagcaauuauauugcg

SEQ ID NO: 1786884 - RNA, 18 nt, Salmonella enterica enterica serovar Typhi Ty2
aauagcacaucagccaac

SEQ ID NO: 1786885 - RNA, 12 nt, Salmonella enterica enterica serovar Typhi Ty2
aauagccagaca

SEQ ID NO: 1786886 - RNA, 15 nt, Salmonella enterica enterica serovar Typhi Ty2
aauagccagccccag

SEQ ID NO: 1786887 - RNA, 16 nt, Salmonella enterica enterica serovar Typhi Ty2
aauagccagccccaga

SEQ ID NO: 1786888 - RNA, 20 nt, Salmonella enterica enterica serovar Typhi Ty2
aauagccagaaugccagcgc

SEQ ID NO: 1786889 - RNA, 22 nt, Salmonella enterica enterica serovar Typhi Ty2
aauaacaucguaaaucaaauga

SEQ ID NO: 1786890 - RNA, 23 nt, Salmonella enterica enterica serovar Typhi Ty2
aauaacagacuccgucucuuuau

SEQ ID NO: 1786891 - RNA, 20 nt, Salmonella enterica enterica serovar Typhi Ty2
aauaacgaugaugaaaaaga

SEQ ID NO: 1786892 - RNA, 15 nt, Salmonella enterica enterica serovar Typhi Ty2
aauaacgaugaugaa

SEQ ID NO: 1786893 - RNA, 21 nt, Salmonella enterica enterica serovar Typhi Ty2
aauaacgaucuggucgccaag

SEQ ID NO: 1786894 - RNA, 23 nt, Salmonella enterica enterica serovar Typhi Ty2
aauaacuuuuaauuuuuauguca

SEQ ID NO: 1786895 - RNA, 16 nt, Salmonella enterica enterica serovar Typhi Ty2
aauaacuauaauugcu

SEQ ID NO: 1786896 - RNA, 17 nt, Salmonella enterica enterica serovar Typhi Ty2
aauaacuauaauugcuu

SEQ ID NO: 1786897 - RNA, 15 nt, Salmonella enterica enterica serovar Typhi Ty2
aauaacgugucagga

SEQ ID NO: 1786898 - RNA, 21 nt, Salmonella enterica enterica serovar Typhi Ty2
aauaacgggcacggucugcug

SEQ ID NO: 1786899 - RNA, 17 nt, Salmonella enterica enterica serovar Typhi Ty2
aauaacugacagacuca

SEQ ID NO: 1786900 - RNA, 15 nt, Salmonella enterica enterica serovar Typhi Ty2
aauaacugacagacu

SEQ ID NO: 1786901 - RNA, 13 nt, Salmonella enterica enterica serovar Typhi Ty2
aauaacaaaugaa

SEQ ID NO: 1786902 - RNA, 17 nt, Salmonella enterica enterica serovar Typhi Ty2
aauaaaugauauuuaaa

SEQ ID NO: 1786903 - RNA, 22 nt, Salmonella enterica enterica serovar Typhi Ty2
aauaaaucacaacguaaucauc

SEQ ID NO: 1786904 - RNA, 23 nt, Salmonella enterica enterica serovar Typhi Ty2
aauaaauugaauucgcuaauaaa

SEQ ID NO: 1786905 - RNA, 20 nt, Salmonella enterica enterica serovar Typhi Ty2
aauaaauccaugagaagaaa

SEQ ID NO: 1786906 - RNA, 14 nt, Salmonella enterica enterica serovar Typhi Ty2
aauaaauauucauc

SEQ ID NO: 1786907 - RNA, 19 nt, Salmonella enterica enterica serovar Typhi Ty2
aauaaauaguaaauagaaa

SEQ ID NO: 1786908 - RNA, 14 nt, Salmonella enterica enterica serovar Typhi Ty2
aauaaauaccaaca

SEQ ID NO: 1786909 - RNA, 20 nt, Salmonella enterica enterica serovar Typhi Ty2
aauaaagugcugaacaauaa

SEQ ID NO: 1786910 - RNA, 23 nt, Salmonella enterica enterica serovar Typhi Ty2
aaguugcucggcaauuucuuugu

SEQ ID NO: 1786911 - RNA, 19 nt, Salmonella enterica enterica serovar Typhi Ty2
aauaaagugcugaacaaua

SEQ ID NO: 1786912 - RNA, 15 nt, Salmonella enterica enterica serovar Typhi Ty2
aaguugaucauccuu

SEQ ID NO: 1786913 - RNA, 13 nt, Salmonella enterica enterica serovar Typhi Ty2
aauaauauuauug

SEQ ID NO: 1786914 - RNA, 20 nt, Salmonella enterica enterica serovar Typhi Ty2
aauaauaugccccgacauca

SEQ ID NO: 1786915 - RNA, 11 nt, Salmonella enterica enterica serovar Typhi Ty2
aauaaucacug

SEQ ID NO: 1786916 - RNA, 23 nt, Salmonella enterica enterica serovar Typhi Ty2
aauaagcgccgaguagcugagcg

SEQ ID NO: 1786917 - RNA, 12 nt, Salmonella enterica enterica serovar Typhi Ty2
aauaaggcuggc

SEQ ID NO: 1786918 - RNA, 23 nt, Salmonella enterica enterica serovar Typhi Ty2
aauaagcuccgggacauccggau

SEQ ID NO: 1786919 - RNA, 17 nt, Salmonella enterica enterica serovar Typhi Ty2
aauaagguggcuaaccc

SEQ ID NO: 1786920 - RNA, 15 nt, Salmonella enterica enterica serovar Typhi Ty2
aauaaugaccagcgc

SEQ ID NO: 1786921 - RNA, 18 nt, Salmonella enterica enterica serovar Typhi Ty2
aauaauggcgcgaaaaca

SEQ ID NO: 1786922 - RNA, 17 nt, Salmonella enterica enterica serovar Typhi Ty2
aauaaucccuucuuuua

SEQ ID NO: 1786923 - RNA, 15 nt, Salmonella enterica enterica serovar Typhi Ty2
aauaaucgaaauaaa

SEQ ID NO: 1786924 - RNA, 13 nt, Salmonella enterica enterica serovar Typhi Ty2
aauaaucgccggg

SEQ ID NO: 1786925 - RNA, 20 nt, Salmonella enterica enterica serovar Typhi Ty2
aauaaucgcgagaaaauaga

SEQ ID NO: 1786926 - RNA, 14 nt, Salmonella enterica enterica serovar Typhi Ty2
aauaauguaaaaaa

SEQ ID NO: 1786927 - RNA, 22 nt, Salmonella enterica enterica serovar Typhi Ty2
aauaauggcgcgaaaacagcug

SEQ ID NO: 1786928 - RNA, 18 nt, Salmonella enterica enterica serovar Typhi Ty2
aauaauguaaaaaaauaa

SEQ ID NO: 1786929 - RNA, 16 nt, Salmonella enterica enterica serovar Typhi Ty2
aauaauguaaaaaaau

SEQ ID NO: 1786930 - RNA, 15 nt, Salmonella enterica enterica serovar Typhi Ty2
aauaauuaacccaca

SEQ ID NO: 1786931 - RNA, 15 nt, Salmonella enterica enterica serovar Typhi Ty2
aauaauugagcgcaa

SEQ ID NO: 1786932 - RNA, 20 nt, Salmonella enterica enterica serovar Typhi Ty2
uuggugauuaacagcgccau

SEQ ID NO: 1786933 - RNA, 12 nt, Salmonella enterica enterica serovar Typhi Ty2
uuggugaguggc

SEQ ID NO: 1786934 - RNA, 22 nt, Salmonella enterica enterica serovar Typhi Ty2
uugguguaacagcaacaucuau

SEQ ID NO: 1786935 - RNA, 19 nt, Salmonella enterica enterica serovar Typhi Ty2
uugguuagggaucaucuuc

SEQ ID NO: 1786936 - RNA, 19 nt, Salmonella enterica enterica serovar Typhi Ty2
uugguauucaacgccaucu

SEQ ID NO: 1786937 - RNA, 23 nt, Salmonella enterica enterica serovar Typhi Ty2
uugggcgcgaaacugcugccgca

SEQ ID NO: 1786938 - RNA, 19 nt, Salmonella enterica enterica serovar Typhi Ty2
uugggcgcgacgccugggc

SEQ ID NO: 1786939 - RNA, 20 nt, Salmonella enterica enterica serovar Typhi Ty2
uuggggaaccuggcagaaag

SEQ ID NO: 1786940 - RNA, 22 nt, Salmonella enterica enterica serovar Typhi Ty2
uuggccagcguggaugaacuca

SEQ ID NO: 1786941 - RNA, 20 nt, Salmonella enterica enterica serovar Typhi Ty2
uuggccggcuucuccaccau

SEQ ID NO: 1786942 - RNA, 15 nt, Salmonella enterica enterica serovar Typhi Ty2
uuggccagcauggcg

SEQ ID NO: 1786943 - RNA, 14 nt, Salmonella enterica enterica serovar Typhi Ty2
uuggcaucugucau

SEQ ID NO: 1786944 - RNA, 14 nt, Salmonella enterica enterica serovar Typhi Ty2
uuggcgcuggguac

SEQ ID NO: 1786945 - RNA, 14 nt, Salmonella enterica enterica serovar Typhi Ty2
uuggcgauuuccag

SEQ ID NO: 1786946 - RNA, 18 nt, Salmonella enterica enterica serovar Typhi Ty2
uuggcgacgaacacggcg

SEQ ID NO: 1786947 - RNA, 18 nt, Salmonella enterica enterica serovar Typhi Ty2
uugggaauuagcgaauca

SEQ ID NO: 1786948 - RNA, 13 nt, Salmonella enterica enterica serovar Typhi Ty2
uuggcguauuaug

SEQ ID NO: 1786949 - RNA, 14 nt, Salmonella enterica enterica serovar Typhi Ty2
uuggcgugacggcg

SEQ ID NO: 1786950 - RNA, 16 nt, Salmonella enterica enterica serovar Typhi Ty2
uuggcgcgaaccguaa

SEQ ID NO: 1786951 - RNA, 18 nt, Salmonella enterica enterica serovar Typhi Ty2
uuggcguaaaucaggcca

SEQ ID NO: 1786952 - RNA, 21 nt, Salmonella enterica enterica serovar Typhi Ty2
uugcuggagcaggugcggcug

SEQ ID NO: 1786953 - RNA, 14 nt, Salmonella enterica enterica serovar Typhi Ty2
uugcuggauucucu

SEQ ID NO: 1786954 - RNA, 17 nt, Salmonella enterica enterica serovar Typhi Ty2
uugcugguagacaaaca

SEQ ID NO: 1786955 - RNA, 21 nt, Salmonella enterica enterica serovar Typhi Ty2
uugcugcugcggaucgucucu

SEQ ID NO: 1786956 - RNA, 15 nt, Salmonella enterica enterica serovar Typhi Ty2
uugcugcuauauaac

SEQ ID NO: 1786957 - RNA, 17 nt, Salmonella enterica enterica serovar Typhi Ty2
uugcuauagcccacgca

SEQ ID NO: 1786958 - RNA, 22 nt, Salmonella enterica enterica serovar Typhi Ty2
uugcguaucguaagccaccgcc

SEQ ID NO: 1786959 - RNA, 20 nt, Salmonella enterica enterica serovar Typhi Ty2
uugcuguuagaaucucugac

SEQ ID NO: 1786960 - RNA, 22 nt, Salmonella enterica enterica serovar Typhi Ty2
uugcuucuguccuuucugcugc

SEQ ID NO: 1786961 - RNA, 23 nt, Salmonella enterica enterica serovar Typhi Ty2
uugcuucgcucucgugccaguaa

SEQ ID NO: 1786962 - RNA, 12 nt, Salmonella enterica enterica serovar Typhi Ty2
uuggcaaauccg

SEQ ID NO: 1786963 - RNA, 17 nt, Salmonella enterica enterica serovar Typhi Ty2
uuggcaacgucuugcca

SEQ ID NO: 1786964 - RNA, 16 nt, Salmonella enterica enterica serovar Typhi Ty2
uuggcaaaccccugcu

SEQ ID NO: 1786965 - RNA, 15 nt, Salmonella enterica enterica serovar Typhi Ty2
uuggcaaaaaaggcc

SEQ ID NO: 1786966 - RNA, 17 nt, Salmonella enterica enterica serovar Typhi Ty2
uuggcaaucagcggcaa

SEQ ID NO: 1786967 - RNA, 13 nt, Salmonella enterica enterica serovar Typhi Ty2
uuggcaccaccag

SEQ ID NO: 1786968 - RNA, 22 nt, Salmonella enterica enterica serovar Typhi Ty2
uuggcagccccugaaauaacag

SEQ ID NO: 1786969 - RNA, 22 nt, Salmonella enterica enterica serovar Typhi Ty2
uuggcagcccggcguugaaauc

SEQ ID NO: 1786970 - RNA, 21 nt, Salmonella enterica enterica serovar Typhi Ty2
uuggcagccccugaaauaaca

SEQ ID NO: 1786971 - RNA, 22 nt, Salmonella enterica enterica serovar Typhi Ty2
uuggaaaaccccaucccggcaa

SEQ ID NO: 1786972 - RNA, 21 nt, Salmonella enterica enterica serovar Typhi Ty2
uuggaaacuaugcaaaacgua

SEQ ID NO: 1786973 - RNA, 15 nt, Salmonella enterica enterica serovar Typhi Ty2
uugccagugaaaaaa

SEQ ID NO: 1786974 - RNA, 22 nt, Salmonella enterica enterica serovar Typhi Ty2
uugccaucggauauauuuuacc

SEQ ID NO: 1786975 - RNA, 19 nt, Salmonella enterica enterica serovar Typhi Ty2
uugccaugaugagcgccau

SEQ ID NO: 1786976 - RNA, 20 nt, Salmonella enterica enterica serovar Typhi Ty2
uugccauucgccagcccgau

SEQ ID NO: 1786977 - RNA, 15 nt, Salmonella enterica enterica serovar Typhi Ty2
uugccgugaaaacga

SEQ ID NO: 1786978 - RNA, 21 nt, Salmonella enterica enterica serovar Typhi Ty2
uugcgacaagcucauuuccca

SEQ ID NO: 1786979 - RNA, 19 nt, Salmonella enterica enterica serovar Typhi Ty2
uugcgacuguucaucaaag

SEQ ID NO: 1786980 - RNA, 15 nt, Salmonella enterica enterica serovar Typhi Ty2
uugcgauaauacacg

SEQ ID NO: 1786981 - RNA, 13 nt, Salmonella enterica enterica serovar Typhi Ty2
uugcgagaaaaaa

SEQ ID NO: 1786982 - RNA, 20 nt, Salmonella enterica enterica serovar Typhi Ty2
uugcgcgguuaacagccgcu

SEQ ID NO: 1786983 - RNA, 20 nt, Salmonella enterica enterica serovar Typhi Ty2
uugcgauuuguccgcugcug

SEQ ID NO: 1786984 - RNA, 21 nt, Salmonella enterica enterica serovar Typhi Ty2
uugcggcggggauaaucagca

SEQ ID NO: 1786985 - RNA, 23 nt, Salmonella enterica enterica serovar Typhi Ty2
uugcgcucaccuuuuuauuuacu

SEQ ID NO: 1786986 - RNA, 15 nt, Salmonella enterica enterica serovar Typhi Ty2
uugcggcacacagcc

SEQ ID NO: 1786987 - RNA, 13 nt, Salmonella enterica enterica serovar Typhi Ty2
uugcauacauaaa

SEQ ID NO: 1786988 - RNA, 13 nt, Salmonella enterica enterica serovar Typhi Ty2
uugcauaaauaau

SEQ ID NO: 1786989 - RNA, 17 nt, Salmonella enterica enterica serovar Typhi Ty2
uugcauccguagcuuca

SEQ ID NO: 1786990 - RNA, 14 nt, Salmonella enterica enterica serovar Typhi Ty2
uugcaugaccaucc

SEQ ID NO: 1786991 - RNA, 23 nt, Salmonella enterica enterica serovar Typhi Ty2
uugccacuggcuuuccugaucaa

SEQ ID NO: 1786992 - RNA, 13 nt, Salmonella enterica enterica serovar Typhi Ty2
uugccacuggccu

SEQ ID NO: 1786993 - RNA, 20 nt, Salmonella enterica enterica serovar Typhi Ty2
uugccacuacgcagcuccag

SEQ ID NO: 1786994 - RNA, 19 nt, Salmonella enterica enterica serovar Typhi Ty2
uugccagagccccaaugcu

SEQ ID NO: 1786995 - RNA, 21 nt, Salmonella enterica enterica serovar Typhi Ty2
uugcagguaacgacuacuucc

SEQ ID NO: 1786996 - RNA, 20 nt, Salmonella enterica enterica serovar Typhi Ty2
uugcagggugcagcaaauaa

SEQ ID NO: 1786997 - RNA, 19 nt, Salmonella enterica enterica serovar Typhi Ty2
uugcaggaaaaacuguccc

SEQ ID NO: 1786998 - RNA, 13 nt, Salmonella enterica enterica serovar Typhi Ty2
uugcaggaggcgc

SEQ ID NO: 1786999 - RNA, 15 nt, Salmonella enterica enterica serovar Typhi Ty2
uugcagcuccuuuua

SEQ ID NO: 1787000 - RNA, 15 nt, Salmonella enterica enterica serovar Typhi Ty2
uugcagcgguaaaca

SEQ ID NO: 1787001 - RNA, 20 nt, Salmonella enterica enterica serovar Typhi Ty2
uugcagccacguugcgcgcg

SEQ ID NO: 1787002 - RNA, 14 nt, Salmonella enterica enterica serovar Typhi Ty2
uugcagccagaacu

SEQ ID NO: 1787003 - RNA, 12 nt, Salmonella enterica enterica serovar Typhi Ty2
uugauuuuauga

SEQ ID NO: 1787004 - RNA, 17 nt, Salmonella enterica enterica serovar Typhi Ty2
uugcacuuuugccaggc

SEQ ID NO: 1787005 - RNA, 22 nt, Salmonella enterica enterica serovar Typhi Ty2
uugcagcagcgagauggcuuuu

SEQ ID NO: 1787006 - RNA, 14 nt, Salmonella enterica enterica serovar Typhi Ty2
uugcagauccgcga

SEQ ID NO: 1787007 - RNA, 12 nt, Salmonella enterica enterica serovar Typhi Ty2
uugauggccagc

SEQ ID NO: 1787008 - RNA, 17 nt, Salmonella enterica enterica serovar Typhi Ty2
uugauuaaucgucaucc

SEQ ID NO: 1787009 - RNA, 17 nt, Salmonella enterica enterica serovar Typhi Ty2
uugauuucauugcugca

SEQ ID NO: 1787010 - RNA, 15 nt, Salmonella enterica enterica serovar Typhi Ty2
uugauuuguuuuuua

SEQ ID NO: 1787011 - RNA, 17 nt, Salmonella enterica enterica serovar Typhi Ty2
uugaucggguuuuccug

SEQ ID NO: 1787012 - RNA, 13 nt, Salmonella enterica enterica serovar Typhi Ty2
uugaucguccauc

SEQ ID NO: 1787013 - RNA, 22 nt, Salmonella enterica enterica serovar Typhi Ty2
uugaucgcgcagcaaaucagcu

SEQ ID NO: 1787014 - RNA, 12 nt, Salmonella enterica enterica serovar Typhi Ty2
uugaucugcuug

SEQ ID NO: 1787015 - RNA, 17 nt, Salmonella enterica enterica serovar Typhi Ty2
uugaugcuaaccucuau

SEQ ID NO: 1787016 - RNA, 18 nt, Salmonella enterica enterica serovar Typhi Ty2
uugauagggugaaugcgu

SEQ ID NO: 1787017 - RNA, 17 nt, Salmonella enterica enterica serovar Typhi Ty2
uugauaccaucaauguu

SEQ ID NO: 1787018 - RNA, 18 nt, Salmonella enterica enterica serovar Typhi Ty2
uugauaccuauuuaauaa

SEQ ID NO: 1787019 - RNA, 18 nt, Salmonella enterica enterica serovar Typhi Ty2
uugauaccuuuaaccucu

SEQ ID NO: 1787020 - RNA, 17 nt, Salmonella enterica enterica serovar Typhi Ty2
uugaguuccgcuucgua

SEQ ID NO: 1787021 - RNA, 21 nt, Salmonella enterica enterica serovar Typhi Ty2
uugauaagcggguugcacauu

SEQ ID NO: 1787022 - RNA, 16 nt, Salmonella enterica enterica serovar Typhi Ty2
uugagucgcauccagu

SEQ ID NO: 1787023 - RNA, 16 nt, Salmonella enterica enterica serovar Typhi Ty2
uugaggaaauucugac

SEQ ID NO: 1787024 - RNA, 18 nt, Salmonella enterica enterica serovar Typhi Ty2
uugagcgcaaaacgcugc

SEQ ID NO: 1787025 - RNA, 23 nt, Salmonella enterica enterica serovar Typhi Ty2
uugagcgagucagacaccagccc

SEQ ID NO: 1787026 - RNA, 13 nt, Salmonella enterica enterica serovar Typhi Ty2
uugagccauucca

SEQ ID NO: 1787027 - RNA, 19 nt, Salmonella enterica enterica serovar Typhi Ty2
uuuauaacuaaacucaucu

SEQ ID NO: 1787028 - RNA, 14 nt, Salmonella enterica enterica serovar Typhi Ty2
uuuagccagcagcg

SEQ ID NO: 1787029 - RNA, 19 nt, Salmonella enterica enterica serovar Typhi Ty2
uuuagcauaacguuuccuu

SEQ ID NO: 1787030 - RNA, 14 nt, Salmonella enterica enterica serovar Typhi Ty2
uuuaucaaaaagac

SEQ ID NO: 1787031 - RNA, 18 nt, Salmonella enterica enterica serovar Typhi Ty2
uuuaucaggccuacaaga

SEQ ID NO: 1787032 - RNA, 23 nt, Salmonella enterica enterica serovar Typhi Ty2
uuuauccggauggaacgcaucca

SEQ ID NO: 1787033 - RNA, 12 nt, Salmonella enterica enterica serovar Typhi Ty2
uuuauccagcac

SEQ ID NO: 1787034 - RNA, 16 nt, Salmonella enterica enterica serovar Typhi Ty2
uuuaugggaaaauucc

SEQ ID NO: 1787035 - RNA, 19 nt, Salmonella enterica enterica serovar Typhi Ty2
uuuaugccggcuaauaguu

SEQ ID NO: 1787036 - RNA, 22 nt, Salmonella enterica enterica serovar Typhi Ty2
uuuaugacuggggcguuuuuua

SEQ ID NO: 1787037 - RNA, 21 nt, Salmonella enterica enterica serovar Typhi Ty2
uuuaucugcgugaugcaucag

SEQ ID NO: 1787038 - RNA, 18 nt, Salmonella enterica enterica serovar Typhi Ty2
uuuauugaugacauuaau

SEQ ID NO: 1787039 - RNA, 12 nt, Salmonella enterica enterica serovar Typhi Ty2
uuuauugccgcu

SEQ ID NO: 1787040 - RNA, 22 nt, Salmonella enterica enterica serovar Typhi Ty2
uuuauuacgcgcucucauaagc

SEQ ID NO: 1787041 - RNA, 12 nt, Salmonella enterica enterica serovar Typhi Ty2
uuuauuuuucaa

SEQ ID NO: 1787042 - RNA, 17 nt, Salmonella enterica enterica serovar Typhi Ty2
uuuaccuguuuaucuga

SEQ ID NO: 1787043 - RNA, 16 nt, Salmonella enterica enterica serovar Typhi Ty2
uuuacgcuuguuguaa

SEQ ID NO: 1787044 - RNA, 16 nt, Salmonella enterica enterica serovar Typhi Ty2
uuuaccucacggugac

SEQ ID NO: 1787045 - RNA, 22 nt, Salmonella enterica enterica serovar Typhi Ty2
uuuaccggugcagaccucugca

SEQ ID NO: 1787046 - RNA, 16 nt, Salmonella enterica enterica serovar Typhi Ty2
uuuacuucuucaggcu

SEQ ID NO: 1787047 - RNA, 12 nt, Salmonella enterica enterica serovar Typhi Ty2
uuuagaaaauau

SEQ ID NO: 1787048 - RNA, 16 nt, Salmonella enterica enterica serovar Typhi Ty2
uuuagaaccaauagua

SEQ ID NO: 1787049 - RNA, 16 nt, Salmonella enterica enterica serovar Typhi Ty2
uuuacgguuggccauu

SEQ ID NO: 1787050 - RNA, 20 nt, Salmonella enterica enterica serovar Typhi Ty2
uuuaauauaugaaccaagau

SEQ ID NO: 1787051 - RNA, 18 nt, Salmonella enterica enterica serovar Typhi Ty2
uuuaaugcuuuccagcca

SEQ ID NO: 1787052 - RNA, 20 nt, Salmonella enterica enterica serovar Typhi Ty2
uuuaaugcccgguauuuuuu

SEQ ID NO: 1787053 - RNA, 23 nt, Salmonella enterica enterica serovar Typhi Ty2
uuuaaggaauaacgcgcuuuuuu

SEQ ID NO: 1787054 - RNA, 19 nt, Salmonella enterica enterica serovar Typhi Ty2
uuuaaggcggcaaagauaa

SEQ ID NO: 1787055 - RNA, 18 nt, Salmonella enterica enterica serovar Typhi Ty2
uuuaagccgauugaauaa

SEQ ID NO: 1787056 - RNA, 18 nt, Salmonella enterica enterica serovar Typhi Ty2
uuuaagucaucuguucaa

SEQ ID NO: 1787057 - RNA, 13 nt, Salmonella enterica enterica serovar Typhi Ty2
uuuaauaaagaaa

SEQ ID NO: 1787058 - RNA, 16 nt, Salmonella enterica enterica serovar Typhi Ty2
uuuaagcauccaggaa

SEQ ID NO: 1787059 - RNA, 17 nt, Salmonella enterica enterica serovar Typhi Ty2
uuguccagcggccauga

SEQ ID NO: 1787060 - RNA, 17 nt, Salmonella enterica enterica serovar Typhi Ty2
uuguccauaaaaugaug

SEQ ID NO: 1787061 - RNA, 13 nt, Salmonella enterica enterica serovar Typhi Ty2
uugucccgccuug

SEQ ID NO: 1787062 - RNA, 15 nt, Salmonella enterica enterica serovar Typhi Ty2
uugucaucagucuca

SEQ ID NO: 1787063 - RNA, 16 nt, Salmonella enterica enterica serovar Typhi Ty2
uugucaucagaucaug

SEQ ID NO: 1787064 - RNA, 17 nt, Salmonella enterica enterica serovar Typhi Ty2
uugucaucagucucaaa

SEQ ID NO: 1787065 - RNA, 17 nt, Salmonella enterica enterica serovar Typhi Ty2
uugucauccugcucauc

SEQ ID NO: 1787066 - RNA, 18 nt, Salmonella enterica enterica serovar Typhi Ty2
uuguccuuuaucugcccu

SEQ ID NO: 1787067 - RNA, 14 nt, Salmonella enterica enterica serovar Typhi Ty2
uugucgccaauaau

SEQ ID NO: 1787068 - RNA, 22 nt, Salmonella enterica enterica serovar Typhi Ty2
uuguccggcguuuuagcgccau

SEQ ID NO: 1787069 - RNA, 15 nt, Salmonella enterica enterica serovar Typhi Ty2
uugucaaaaauagca

SEQ ID NO: 1787070 - RNA, 15 nt, Salmonella enterica enterica serovar Typhi Ty2
uugucagcauaaagc

SEQ ID NO: 1787071 - RNA, 16 nt, Salmonella enterica enterica serovar Typhi Ty2
uugucaggcagaaaua

SEQ ID NO: 1787072 - RNA, 23 nt, Salmonella enterica enterica serovar Typhi Ty2
uugucagcugaacagucccacca

SEQ ID NO: 1787073 - RNA, 17 nt, Salmonella enterica enterica serovar Typhi Ty2
uugucagucugguacuc

SEQ ID NO: 1787074 - RNA, 16 nt, Salmonella enterica enterica serovar Typhi Ty2
uuguacagcaauaaaa

SEQ ID NO: 1787075 - RNA, 20 nt, Salmonella enterica enterica serovar Typhi Ty2
uuguacagcaauaaaaggaa

SEQ ID NO: 1787076 - RNA, 18 nt, Salmonella enterica enterica serovar Typhi Ty2
uuguacggcggcauuaaa

SEQ ID NO: 1787077 - RNA, 16 nt, Salmonella enterica enterica serovar Typhi Ty2
uuguaggccugauagc

SEQ ID NO: 1787078 - RNA, 17 nt, Salmonella enterica enterica serovar Typhi Ty2
uuguaggcuuccagaag

SEQ ID NO: 1787079 - RNA, 15 nt, Salmonella enterica enterica serovar Typhi Ty2
uuguaggcaggaauu

SEQ ID NO: 1787080 - RNA, 21 nt, Salmonella enterica enterica serovar Typhi Ty2
uuguagcugcgccagcgugcu

SEQ ID NO: 1787081 - RNA, 18 nt, Salmonella enterica enterica serovar Typhi Ty2
uuguagcugcgccugaaa

SEQ ID NO: 1787082 - RNA, 18 nt, Salmonella enterica enterica serovar Typhi Ty2
uuguagcggcaacagcac

SEQ ID NO: 1787083 - RNA, 16 nt, Salmonella enterica enterica serovar Typhi Ty2
uuguaaagaaauuuaa

SEQ ID NO: 1787084 - RNA, 18 nt, Salmonella enterica enterica serovar Typhi Ty2
uugguuuaaacucugcaa

SEQ ID NO: 1787085 - RNA, 20 nt, Salmonella enterica enterica serovar Typhi Ty2
uugguuucgccuaagcccac

SEQ ID NO: 1787086 - RNA, 20 nt, Salmonella enterica enterica serovar Typhi Ty2
uuguuuuaaauucaaccagu

SEQ ID NO: 1787087 - RNA, 18 nt, Salmonella enterica enterica serovar Typhi Ty2
uuguucgucuuuugaaua

SEQ ID NO: 1787088 - RNA, 15 nt, Salmonella enterica enterica serovar Typhi Ty2
uuguucgcuucuucu

SEQ ID NO: 1787089 - RNA, 14 nt, Salmonella enterica enterica serovar Typhi Ty2
uuguucuaaacguu

SEQ ID NO: 1787090 - RNA, 17 nt, Salmonella enterica enterica serovar Typhi Ty2
uugugucaaaaaguugu

SEQ ID NO: 1787091 - RNA, 13 nt, Salmonella enterica enterica serovar Typhi Ty2
uuguucauaucga

SEQ ID NO: 1787092 - RNA, 15 nt, Salmonella enterica enterica serovar Typhi Ty2
uuguucagugccauc

SEQ ID NO: 1787093 - RNA, 15 nt, Salmonella enterica enterica serovar Typhi Ty2
uuguucaugcaauuc

SEQ ID NO: 1787094 - RNA, 13 nt, Salmonella enterica enterica serovar Typhi Ty2
uugucgggcagaa

SEQ ID NO: 1787095 - RNA, 17 nt, Salmonella enterica enterica serovar Typhi Ty2
uugucucaaaaaauauc

SEQ ID NO: 1787096 - RNA, 22 nt, Salmonella enterica enterica serovar Typhi Ty2
uugucugaugacucucggccua

SEQ ID NO: 1787097 - RNA, 16 nt, Salmonella enterica enterica serovar Typhi Ty2
uugugagaaaagcaga

SEQ ID NO: 1787098 - RNA, 15 nt, Salmonella enterica enterica serovar Typhi Ty2
uugucuuuuccagua

SEQ ID NO: 1787099 - RNA, 21 nt, Salmonella enterica enterica serovar Typhi Ty2
uugugcccgcgaucgcuucca

SEQ ID NO: 1787100 - RNA, 23 nt, Salmonella enterica enterica serovar Typhi Ty2
uugugccgacaucgcucccggca

SEQ ID NO: 1787101 - RNA, 14 nt, Salmonella enterica enterica serovar Typhi Ty2
uugugaguaauaau

SEQ ID NO: 1787102 - RNA, 13 nt, Salmonella enterica enterica serovar Typhi Ty2
uugugauuccagu

SEQ ID NO: 1787103 - RNA, 14 nt, Salmonella enterica enterica serovar Typhi Ty2
uucuacuacagaaa

SEQ ID NO: 1787104 - RNA, 18 nt, Salmonella enterica enterica serovar Typhi Ty2
uucuacucgggccagcuc

SEQ ID NO: 1787105 - RNA, 20 nt, Salmonella enterica enterica serovar Typhi Ty2
uucuaaacguucaucuuccc

SEQ ID NO: 1787106 - RNA, 19 nt, Salmonella enterica enterica serovar Typhi Ty2
uucuacucuucacccuucu

SEQ ID NO: 1787107 - RNA, 13 nt, Salmonella enterica enterica serovar Typhi Ty2
uucuacugguuaa

SEQ ID NO: 1787108 - RNA, 11 nt, Salmonella enterica enterica serovar Typhi Ty2
uucguuuuccg

SEQ ID NO: 1787109 - RNA, 21 nt, Salmonella enterica enterica serovar Typhi Ty2
uucuaaaaguaagcuauguuu

SEQ ID NO: 1787110 - RNA, 20 nt, Salmonella enterica enterica serovar Typhi Ty2
uucuaucguuauauauacuu

SEQ ID NO: 1787111 - RNA, 16 nt, Salmonella enterica enterica serovar Typhi Ty2
uucuaucguuauauau

SEQ ID NO: 1787112 - RNA, 16 nt, Salmonella enterica enterica serovar Typhi Ty2
uucuaucuuucagacc

SEQ ID NO: 1787113 - RNA, 22 nt, Salmonella enterica enterica serovar Typhi Ty2
uucuggcgaugugcccgaguga

SEQ ID NO: 1787114 - RNA, 15 nt, Salmonella enterica enterica serovar Typhi Ty2
uucuggcgcagauac

SEQ ID NO: 1787115 - RNA, 20 nt, Salmonella enterica enterica serovar Typhi Ty2
uucuggcgcagauacgcguc

SEQ ID NO: 1787116 - RNA, 16 nt, Salmonella enterica enterica serovar Typhi Ty2
uucuggccauuucauc

SEQ ID NO: 1787117 - RNA, 22 nt, Salmonella enterica enterica serovar Typhi Ty2
uucuggacgggcuaucaauaug

SEQ ID NO: 1787118 - RNA, 15 nt, Salmonella enterica enterica serovar Typhi Ty2
uucugcuuccagaau

SEQ ID NO: 1787119 - RNA, 19 nt, Salmonella enterica enterica serovar Typhi Ty2
uucugcgguaaucugccag

SEQ ID NO: 1787120 - RNA, 14 nt, Salmonella enterica enterica serovar Typhi Ty2
uucugcucaaugau

SEQ ID NO: 1787121 - RNA, 16 nt, Salmonella enterica enterica serovar Typhi Ty2
uucugcucgguaaaaa

SEQ ID NO: 1787122 - RNA, 20 nt, Salmonella enterica enterica serovar Typhi Ty2
uucugacagaauauaggaga

SEQ ID NO: 1787123 - RNA, 19 nt, Salmonella enterica enterica serovar Typhi Ty2
uucugaagcguaacagcgc

SEQ ID NO: 1787124 - RNA, 19 nt, Salmonella enterica enterica serovar Typhi Ty2
uucuccugcgcuugcggcc

SEQ ID NO: 1787125 - RNA, 22 nt, Salmonella enterica enterica serovar Typhi Ty2
uucuccugcgccagccggauac

SEQ ID NO: 1787126 - RNA, 15 nt, Salmonella enterica enterica serovar Typhi Ty2
uucuccggcagucca

SEQ ID NO: 1787127 - RNA, 20 nt, Salmonella enterica enterica serovar Typhi Ty2
uucuccauggucagacgcuc

SEQ ID NO: 1787128 - RNA, 23 nt, Salmonella enterica enterica serovar Typhi Ty2
uucuucaucaaagaaauacccuu

SEQ ID NO: 1787129 - RNA, 12 nt, Salmonella enterica enterica serovar Typhi Ty2
uucuuauuuauu

SEQ ID NO: 1787130 - RNA, 12 nt, Salmonella enterica enterica serovar Typhi Ty2
uucuucaaugaa

SEQ ID NO: 1787131 - RNA, 12 nt, Salmonella enterica enterica serovar Typhi Ty2
uucuuccucucg

SEQ ID NO: 1787132 - RNA, 14 nt, Salmonella enterica enterica serovar Typhi Ty2
uucuuccauuccca

SEQ ID NO: 1787133 - RNA, 17 nt, Salmonella enterica enterica serovar Typhi Ty2
uucuuccgucagcgaau

SEQ ID NO: 1787134 - RNA, 15 nt, Salmonella enterica enterica serovar Typhi Ty2
uucuucugccuuuuu

SEQ ID NO: 1787135 - RNA, 13 nt, Salmonella enterica enterica serovar Typhi Ty2
uucuucucuucuu

SEQ ID NO: 1787136 - RNA, 22 nt, Salmonella enterica enterica serovar Typhi Ty2
uucuuagcgccagcagaaaacc

SEQ ID NO: 1787137 - RNA, 15 nt, Salmonella enterica enterica serovar Typhi Ty2
uucuuacuaauaaau

SEQ ID NO: 1787138 - RNA, 20 nt, Salmonella enterica enterica serovar Typhi Ty2
uucuuacuaauaaauauuca

SEQ ID NO: 1787139 - RNA, 14 nt, Salmonella enterica enterica serovar Typhi Ty2
uucuuaauuccuca

SEQ ID NO: 1787140 - RNA, 22 nt, Salmonella enterica enterica serovar Typhi Ty2
uucuuaauacccauuucuucuu

SEQ ID NO: 1787141 - RNA, 14 nt, Salmonella enterica enterica serovar Typhi Ty2
uucuggcucggccu

SEQ ID NO: 1787142 - RNA, 17 nt, Salmonella enterica enterica serovar Typhi Ty2
uucuguaggcugugcaa

SEQ ID NO: 1787143 - RNA, 17 nt, Salmonella enterica enterica serovar Typhi Ty2
uucuguaauacgcugua

SEQ ID NO: 1787144 - RNA, 14 nt, Salmonella enterica enterica serovar Typhi Ty2
uucugucagccuug

SEQ ID NO: 1787145 - RNA, 14 nt, Salmonella enterica enterica serovar Typhi Ty2
uucggcagaaaaag

SEQ ID NO: 1787146 - RNA, 16 nt, Salmonella enterica enterica serovar Typhi Ty2
uucggcaauggccaga

SEQ ID NO: 1787147 - RNA, 11 nt, Salmonella enterica enterica serovar Typhi Ty2
uucggcagacu

SEQ ID NO: 1787148 - RNA, 15 nt, Salmonella enterica enterica serovar Typhi Ty2
uucggauucaauauu

SEQ ID NO: 1787149 - RNA, 17 nt, Salmonella enterica enterica serovar Typhi Ty2
uucggcgauuuccagcg

SEQ ID NO: 1787150 - RNA, 20 nt, Salmonella enterica enterica serovar Typhi Ty2
uucggcgauuuccagcgccg

SEQ ID NO: 1787151 - RNA, 13 nt, Salmonella enterica enterica serovar Typhi Ty2
uucgucuucaucu

SEQ ID NO: 1787152 - RNA, 15 nt, Salmonella enterica enterica serovar Typhi Ty2
uucgucuucaucuuc

SEQ ID NO: 1787153 - RNA, 14 nt, Salmonella enterica enterica serovar Typhi Ty2
uucguucucugaau

SEQ ID NO: 1787154 - RNA, 20 nt, Salmonella enterica enterica serovar Typhi Ty2
uucgguauuuaucaaaaaga

SEQ ID NO: 1787155 - RNA, 18 nt, Salmonella enterica enterica serovar Typhi Ty2
uucguccggcugccacuc

SEQ ID NO: 1787156 - RNA, 20 nt, Salmonella enterica enterica serovar Typhi Ty2
uucgggcgcaugucagugac

SEQ ID NO: 1787157 - RNA, 17 nt, Salmonella enterica enterica serovar Typhi Ty2
uucgggcacuccggcuc

SEQ ID NO: 1787158 - RNA, 18 nt, Salmonella enterica enterica serovar Typhi Ty2
uucgauaaccaccagcgg

SEQ ID NO: 1787159 - RNA, 17 nt, Salmonella enterica enterica serovar Typhi Ty2
uucgauaugaccaguac

SEQ ID NO: 1787160 - RNA, 23 nt, Salmonella enterica enterica serovar Typhi Ty2
uucgaugaugagaugcaggccaa

SEQ ID NO: 1787161 - RNA, 14 nt, Salmonella enterica enterica serovar Typhi Ty2
uucgaugaaaaaga

SEQ ID NO: 1787162 - RNA, 15 nt, Salmonella enterica enterica serovar Typhi Ty2
uucgaugaaaaagag

SEQ ID NO: 1787163 - RNA, 14 nt, Salmonella enterica enterica serovar Typhi Ty2
uucgaugcgcucau

SEQ ID NO: 1787164 - RNA, 23 nt, Salmonella enterica enterica serovar Typhi Ty2
uucgauaaacucaaucaggcuau

SEQ ID NO: 1787165 - RNA, 13 nt, Salmonella enterica enterica serovar Typhi Ty2
uucgacuguuguu

SEQ ID NO: 1787166 - RNA, 21 nt, Salmonella enterica enterica serovar Typhi Ty2
uucgcaaccuaaccaaacaga

SEQ ID NO: 1787167 - RNA, 17 nt, Salmonella enterica enterica serovar Typhi Ty2
uucgccacgcucacuuu

SEQ ID NO: 1787168 - RNA, 13 nt, Salmonella enterica enterica serovar Typhi Ty2
uucgcccacgccc

SEQ ID NO: 1787169 - RNA, 22 nt, Salmonella enterica enterica serovar Typhi Ty2
uucgccauucccgcgacgucaa

SEQ ID NO: 1787170 - RNA, 14 nt, Salmonella enterica enterica serovar Typhi Ty2
uucgcccagucauc

SEQ ID NO: 1787171 - RNA, 22 nt, Salmonella enterica enterica serovar Typhi Ty2
uucgcgcuaaaugacaaauaga

SEQ ID NO: 1787172 - RNA, 13 nt, Salmonella enterica enterica serovar Typhi Ty2
uucgcgcaguuca

SEQ ID NO: 1787173 - RNA, 20 nt, Salmonella enterica enterica serovar Typhi Ty2
uuccccgaucagaaaaccuu

SEQ ID NO: 1787174 - RNA, 12 nt, Salmonella enterica enterica serovar Typhi Ty2
uuccccguggcc

SEQ ID NO: 1787175 - RNA, 16 nt, Salmonella enterica enterica serovar Typhi Ty2
uuccccugaugcguau

SEQ ID NO: 1787176 - RNA, 17 nt, Salmonella enterica enterica serovar Typhi Ty2
uucccccauccgcgccg

SEQ ID NO: 1787177 - RNA, 20 nt, Salmonella enterica enterica serovar Typhi Ty2
uucccccacuucugacagaa

SEQ ID NO: 1787178 - RNA, 22 nt, Salmonella enterica enterica serovar Typhi Ty2
uuccaauauuuauuuaauguuu

SEQ ID NO: 1787179 - RNA, 23 nt, Salmonella enterica enterica serovar Typhi Ty2
uuccaauauuuauuuaauguuuc

SEQ ID NO: 1787180 - RNA, 15 nt, Salmonella enterica enterica serovar Typhi Ty2
uucccucauauuugu

SEQ ID NO: 1787181 - RNA, 18 nt, Salmonella enterica enterica serovar Typhi Ty2
uucccggcaauuaccgcc

SEQ ID NO: 1787182 - RNA, 17 nt, Salmonella enterica enterica serovar Typhi Ty2
uucccgcuauccaucau

SEQ ID NO: 1787183 - RNA, 22 nt, Salmonella enterica enterica serovar Typhi Ty2
uuccccuguaacugcaccuuuu

SEQ ID NO: 1787184 - RNA, 19 nt, Salmonella enterica enterica serovar Typhi Ty2
uucccggcaugccauaauc

SEQ ID NO: 1787185 - RNA, 17 nt, Salmonella enterica enterica serovar Typhi Ty2
uucccgcugguugccuu

SEQ ID NO: 1787186 - RNA, 21 nt, Salmonella enterica enterica serovar Typhi Ty2
uucccggcuaaccuguaucug

SEQ ID NO: 1787187 - RNA, 14 nt, Salmonella enterica enterica serovar Typhi Ty2
uuccgccagauaca

SEQ ID NO: 1787188 - RNA, 13 nt, Salmonella enterica enterica serovar Typhi Ty2
uuccgccccgccu

SEQ ID NO: 1787189 - RNA, 19 nt, Salmonella enterica enterica serovar Typhi Ty2
uuccgcgagagaaaaaaau

SEQ ID NO: 1787190 - RNA, 19 nt, Salmonella enterica enterica serovar Typhi Ty2
uuccgccgcgguauucaua

SEQ ID NO: 1787191 - RNA, 21 nt, Salmonella enterica enterica serovar Typhi Ty2
uuccgggcgcaccaguucccc

SEQ ID NO: 1787192 - RNA, 17 nt, Salmonella enterica enterica serovar Typhi Ty2
uuccgggcgcaccaguu

SEQ ID NO: 1787193 - RNA, 11 nt, Salmonella enterica enterica serovar Typhi Ty2
uucccuggccg

SEQ ID NO: 1787194 - RNA, 16 nt, Salmonella enterica enterica serovar Typhi Ty2
uucccuuccagcgacg

SEQ ID NO: 1787195 - RNA, 14 nt, Salmonella enterica enterica serovar Typhi Ty2
uuccgccagacuca

SEQ ID NO: 1787196 - RNA, 18 nt, Salmonella enterica enterica serovar Typhi Ty2
uucgaacgccgacaucac

SEQ ID NO: 1787197 - RNA, 23 nt, Salmonella enterica enterica serovar Typhi Ty2
uuccuuauuaaagccccuuccuc

SEQ ID NO: 1787198 - RNA, 22 nt, Salmonella enterica enterica serovar Typhi Ty2
uucgacaagaagauuucuuaau

SEQ ID NO: 1787199 - RNA, 20 nt, Salmonella enterica enterica serovar Typhi Ty2
uucgacaaacagcuauccau

SEQ ID NO: 1787200 - RNA, 15 nt, Salmonella enterica enterica serovar Typhi Ty2
uucgacaguuucuuc

SEQ ID NO: 1787201 - RNA, 14 nt, Salmonella enterica enterica serovar Typhi Ty2
uuccguccaccugg

SEQ ID NO: 1787202 - RNA, 14 nt, Salmonella enterica enterica serovar Typhi Ty2
uuccgucaugguga

SEQ ID NO: 1787203 - RNA, 18 nt, Salmonella enterica enterica serovar Typhi Ty2
uuccguuaauggaggcag

SEQ ID NO: 1787204 - RNA, 17 nt, Salmonella enterica enterica serovar Typhi Ty2
uuccugaguuuaugagg

SEQ ID NO: 1787205 - RNA, 22 nt, Salmonella enterica enterica serovar Typhi Ty2
uuccugagcagacauauuuuca

SEQ ID NO: 1787206 - RNA, 12 nt, Salmonella enterica enterica serovar Typhi Ty2
uuccuuaucagc

SEQ ID NO: 1787207 - RNA, 14 nt, Salmonella enterica enterica serovar Typhi Ty2
uuccugaaaaaauu

SEQ ID NO: 1787208 - RNA, 15 nt, Salmonella enterica enterica serovar Typhi Ty2
uucauuucaggcaaa

SEQ ID NO: 1787209 - RNA, 15 nt, Salmonella enterica enterica serovar Typhi Ty2
uucauuucaauguaa

SEQ ID NO: 1787210 - RNA, 18 nt, Salmonella enterica enterica serovar Typhi Ty2
uucauugucucuguuuuu

SEQ ID NO: 1787211 - RNA, 21 nt, Salmonella enterica enterica serovar Typhi Ty2
uucauucacccaauaaauaau

SEQ ID NO: 1787212 - RNA, 12 nt, Salmonella enterica enterica serovar Typhi Ty2
uucauucagacc

SEQ ID NO: 1787213 - RNA, 13 nt, Salmonella enterica enterica serovar Typhi Ty2
uucauucugucag

SEQ ID NO: 1787214 - RNA, 22 nt, Salmonella enterica enterica serovar Typhi Ty2
uucauuuguuccucgaaacgcu

SEQ ID NO: 1787215 - RNA, 15 nt, Salmonella enterica enterica serovar Typhi Ty2
uucaugcuucucaaa

SEQ ID NO: 1787216 - RNA, 16 nt, Salmonella enterica enterica serovar Typhi Ty2
uucaugcuguauaaac

SEQ ID NO: 1787217 - RNA, 21 nt, Salmonella enterica enterica serovar Typhi Ty2
uucauggucaucgcaaauucu

SEQ ID NO: 1787218 - RNA, 19 nt, Salmonella enterica enterica serovar Typhi Ty2
uucaugguaaaauccuuuu

SEQ ID NO: 1787219 - RNA, 12 nt, Salmonella enterica enterica serovar Typhi Ty2
uucaugcauuaa

SEQ ID NO: 1787220 - RNA, 17 nt, Salmonella enterica enterica serovar Typhi Ty2
uucaugcagcccgcacu

SEQ ID NO: 1787221 - RNA, 22 nt, Salmonella enterica enterica serovar Typhi Ty2
uucaugcacaaaacccgcagcc

SEQ ID NO: 1787222 - RNA, 18 nt, Salmonella enterica enterica serovar Typhi Ty2
uucaugcacgaugguauc

SEQ ID NO: 1787223 - RNA, 16 nt, Salmonella enterica enterica serovar Typhi Ty2
uucaugcacaaaaccc

SEQ ID NO: 1787224 - RNA, 21 nt, Salmonella enterica enterica serovar Typhi Ty2
uucaugcaauuccgcuuucuu

SEQ ID NO: 1787225 - RNA, 15 nt, Salmonella enterica enterica serovar Typhi Ty2
uucauguaaaugacg

SEQ ID NO: 1787226 - RNA, 18 nt, Salmonella enterica enterica serovar Typhi Ty2
uucaugaucuuuccuuuu

SEQ ID NO: 1787227 - RNA, 16 nt, Salmonella enterica enterica serovar Typhi Ty2
uucaugaucuuuccuu

SEQ ID NO: 1787228 - RNA, 15 nt, Salmonella enterica enterica serovar Typhi Ty2
uucaucuuccgggac

SEQ ID NO: 1787229 - RNA, 22 nt, Salmonella enterica enterica serovar Typhi Ty2
uucaucuucaccuuuccaguca

SEQ ID NO: 1787230 - RNA, 14 nt, Salmonella enterica enterica serovar Typhi Ty2
uucaucuucaguaa

SEQ ID NO: 1787231 - RNA, 12 nt, Salmonella enterica enterica serovar Typhi Ty2
uucaucuucuuu

SEQ ID NO: 1787232 - RNA, 18 nt, Salmonella enterica enterica serovar Typhi Ty2
uucaucuuuuaaaaucag

SEQ ID NO: 1787233 - RNA, 20 nt, Salmonella enterica enterica serovar Typhi Ty2
uucaucuguggcaauuuuca

SEQ ID NO: 1787234 - RNA, 14 nt, Salmonella enterica enterica serovar Typhi Ty2
uucaucucaucaau

SEQ ID NO: 1787235 - RNA, 17 nt, Salmonella enterica enterica serovar Typhi Ty2
uucaucuccgauaaaua

SEQ ID NO: 1787236 - RNA, 19 nt, Salmonella enterica enterica serovar Typhi Ty2
uucaucgguaauauuaagg

SEQ ID NO: 1787237 - RNA, 15 nt, Salmonella enterica enterica serovar Typhi Ty2
uucaucggcucgacu

SEQ ID NO: 1787238 - RNA, 12 nt, Salmonella enterica enterica serovar Typhi Ty2
uucaucgcuuuu

SEQ ID NO: 1787239 - RNA, 13 nt, Salmonella enterica enterica serovar Typhi Ty2
uucauaaaagauc

SEQ ID NO: 1787240 - RNA, 20 nt, Salmonella enterica enterica serovar Typhi Ty2
uucaguuaaauaaacaaaaa

SEQ ID NO: 1787241 - RNA, 23 nt, Salmonella enterica enterica serovar Typhi Ty2
uucaguggucaggcgaccaauau

SEQ ID NO: 1787242 - RNA, 18 nt, Salmonella enterica enterica serovar Typhi Ty2
uucagugccauccauauu

SEQ ID NO: 1787243 - RNA, 21 nt, Salmonella enterica enterica serovar Typhi Ty2
uucaguugcccauuuuccucc

SEQ ID NO: 1787244 - RNA, 20 nt, Salmonella enterica enterica serovar Typhi Ty2
uucaguugcccauuuuccuc

SEQ ID NO: 1787245 - RNA, 16 nt, Salmonella enterica enterica serovar Typhi Ty2
uucaguucggagauca

SEQ ID NO: 1787246 - RNA, 21 nt, Salmonella enterica enterica serovar Typhi Ty2
uucaguucgacuuaacgauaa

SEQ ID NO: 1787247 - RNA, 21 nt, Salmonella enterica enterica serovar Typhi Ty2
uucauaaagugccagggcgga

SEQ ID NO: 1787248 - RNA, 12 nt, Salmonella enterica enterica serovar Typhi Ty2
uucauaaauacg

SEQ ID NO: 1787249 - RNA, 21 nt, Salmonella enterica enterica serovar Typhi Ty2
uucauaauaagcgcucaggca

SEQ ID NO: 1787250 - RNA, 22 nt, Salmonella enterica enterica serovar Typhi Ty2
uucauaacgaccuuuacugaca

SEQ ID NO: 1787251 - RNA, 23 nt, Salmonella enterica enterica serovar Typhi Ty2
uucagugccugauagcgcugugc

SEQ ID NO: 1787252 - RNA, 19 nt, Salmonella enterica enterica serovar Typhi Ty2
uucagucauaauccuuccu

SEQ ID NO: 1787253 - RNA, 15 nt, Salmonella enterica enterica serovar Typhi Ty2
uucagguauugguau

SEQ ID NO: 1787254 - RNA, 16 nt, Salmonella enterica enterica serovar Typhi Ty2
uucagcguugcagcca

SEQ ID NO: 1787255 - RNA, 23 nt, Salmonella enterica enterica serovar Typhi Ty2
uucagcguaccgaagaacauaaa

SEQ ID NO: 1787256 - RNA, 23 nt, Salmonella enterica enterica serovar Typhi Ty2
uucagcggcuugucauccugcuc

SEQ ID NO: 1787257 - RNA, 16 nt, Salmonella enterica enterica serovar Typhi Ty2
uucagccuuuucauau

SEQ ID NO: 1787258 - RNA, 21 nt, Salmonella enterica enterica serovar Typhi Ty2
uucauauagucauaauacuca

SEQ ID NO: 1787259 - RNA, 17 nt, Salmonella enterica enterica serovar Typhi Ty2
uucauaggugaacauga

SEQ ID NO: 1787260 - RNA, 17 nt, Salmonella enterica enterica serovar Typhi Ty2
uucauagagaagucuga

SEQ ID NO: 1787261 - RNA, 15 nt, Salmonella enterica enterica serovar Typhi Ty2
uucauagaaccacuu

SEQ ID NO: 1787262 - RNA, 21 nt, Salmonella enterica enterica serovar Typhi Ty2
uucauaccggauauggcaaaa

SEQ ID NO: 1787263 - RNA, 20 nt, Salmonella enterica enterica serovar Typhi Ty2
uucauaugcgccaacugcau

SEQ ID NO: 1787264 - RNA, 16 nt, Salmonella enterica enterica serovar Typhi Ty2
uucaucaaagaaauac

SEQ ID NO: 1787265 - RNA, 13 nt, Salmonella enterica enterica serovar Typhi Ty2
uucauccaugcca

SEQ ID NO: 1787266 - RNA, 19 nt, Salmonella enterica enterica serovar Typhi Ty2
uucaucccacucaaucauu

SEQ ID NO: 1787267 - RNA, 20 nt, Salmonella enterica enterica serovar Typhi Ty2
uucaucgccgauuccugcug

SEQ ID NO: 1787268 - RNA, 17 nt, Salmonella enterica enterica serovar Typhi Ty2
uucaucaguaacugacg

SEQ ID NO: 1787269 - RNA, 16 nt, Salmonella enterica enterica serovar Typhi Ty2
uucaucauaucuuccc

SEQ ID NO: 1787270 - RNA, 13 nt, Salmonella enterica enterica serovar Typhi Ty2
uucaucaggcuga

SEQ ID NO: 1787271 - RNA, 16 nt, Salmonella enterica enterica serovar Typhi Ty2
uucaucaggccugcaa

SEQ ID NO: 1787272 - RNA, 18 nt, Salmonella enterica enterica serovar Typhi Ty2
uucacgccauugccagga

SEQ ID NO: 1787273 - RNA, 19 nt, Salmonella enterica enterica serovar Typhi Ty2
uucacgccauugccaggac

SEQ ID NO: 1787274 - RNA, 16 nt, Salmonella enterica enterica serovar Typhi Ty2
uucaccaaauccucac

SEQ ID NO: 1787275 - RNA, 21 nt, Salmonella enterica enterica serovar Typhi Ty2
uucacgcucgaguucuucacg

SEQ ID NO: 1787276 - RNA, 19 nt, Salmonella enterica enterica serovar Typhi Ty2
uucacgcucacgcagauau

SEQ ID NO: 1787277 - RNA, 20 nt, Salmonella enterica enterica serovar Typhi Ty2
uucacgccgccauccggcaa

SEQ ID NO: 1787278 - RNA, 18 nt, Salmonella enterica enterica serovar Typhi Ty2
uucacuccuaagagaaaa

SEQ ID NO: 1787279 - RNA, 20 nt, Salmonella enterica enterica serovar Typhi Ty2
uucacgccgugaauuucugc

SEQ ID NO: 1787280 - RNA, 19 nt, Salmonella enterica enterica serovar Typhi Ty2
uucagaaauguauucuccc

SEQ ID NO: 1787281 - RNA, 24 nt, Salmonella enterica enterica serovar Typhi Ty2
uucacugucaugguuauuuugucc

SEQ ID NO: 1787282 - RNA, 15 nt, Salmonella enterica enterica serovar Typhi Ty2
uucacuuauaaauaa

SEQ ID NO: 1787283 - RNA, 21 nt, Salmonella enterica enterica serovar Typhi Ty2
uucacuguagcugauaagcua

SEQ ID NO: 1787284 - RNA, 20 nt, Salmonella enterica enterica serovar Typhi Ty2
uucagagcgucuuuuauccc

SEQ ID NO: 1787285 - RNA, 16 nt, Salmonella enterica enterica serovar Typhi Ty2
uucagauaauucuaaa

SEQ ID NO: 1787286 - RNA, 14 nt, Salmonella enterica enterica serovar Typhi Ty2
uucagauaucccau

SEQ ID NO: 1787287 - RNA, 18 nt, Salmonella enterica enterica serovar Typhi Ty2
uucagauggccaaugaug

SEQ ID NO: 1787288 - RNA, 14 nt, Salmonella enterica enterica serovar Typhi Ty2
uucagaugcagcgg

SEQ ID NO: 1787289 - RNA, 17 nt, Salmonella enterica enterica serovar Typhi Ty2
uucagccugugcaacca

SEQ ID NO: 1787290 - RNA, 21 nt, Salmonella enterica enterica serovar Typhi Ty2
uucaauuugugagauaaaaaa

SEQ ID NO: 1787291 - RNA, 14 nt, Salmonella enterica enterica serovar Typhi Ty2
uucacaaccugaaa

SEQ ID NO: 1787292 - RNA, 19 nt, Salmonella enterica enterica serovar Typhi Ty2
uucaauuagcgccuccccu

SEQ ID NO: 1787293 - RNA, 14 nt, Salmonella enterica enterica serovar Typhi Ty2
uucaaugcacgcca

SEQ ID NO: 1787294 - RNA, 18 nt, Salmonella enterica enterica serovar Typhi Ty2
uucaaugcauacugccgg

SEQ ID NO: 1787295 - RNA, 16 nt, Salmonella enterica enterica serovar Typhi Ty2
uucaaugccaugcugg

SEQ ID NO: 1787296 - RNA, 17 nt, Salmonella enterica enterica serovar Typhi Ty2
uucaaucgccaguuuuu

SEQ ID NO: 1787297 - RNA, 23 nt, Salmonella enterica enterica serovar Typhi Ty2
uuauucgccuuucacgcguucaa

SEQ ID NO: 1787298 - RNA, 19 nt, Salmonella enterica enterica serovar Typhi Ty2
uuauucggaaugaugugcu

SEQ ID NO: 1787299 - RNA, 20 nt, Salmonella enterica enterica serovar Typhi Ty2
uuauucggucagauaaauaa

SEQ ID NO: 1787300 - RNA, 22 nt, Salmonella enterica enterica serovar Typhi Ty2
uuauugcuguaggcacuuucca

SEQ ID NO: 1787301 - RNA, 15 nt, Salmonella enterica enterica serovar Typhi Ty2
uuauugcguugcuuu

SEQ ID NO: 1787302 - RNA, 13 nt, Salmonella enterica enterica serovar Typhi Ty2
uuauuuaauucuu

SEQ ID NO: 1787303 - RNA, 15 nt, Salmonella enterica enterica serovar Typhi Ty2
uuauuuaauugcuau

SEQ ID NO: 1787304 - RNA, 16 nt, Salmonella enterica enterica serovar Typhi Ty2
uuauuucaagcaauac

SEQ ID NO: 1787305 - RNA, 10 nt, Salmonella enterica enterica serovar Typhi Ty2
uuauuucuau

SEQ ID NO: 1787306 - RNA, 21 nt, Salmonella enterica enterica serovar Typhi Ty2
uuauuccuuuuuaggcuauaa

SEQ ID NO: 1787307 - RNA, 20 nt, Salmonella enterica enterica serovar Typhi Ty2
uuauucacgcuauguuugcu

SEQ ID NO: 1787308 - RNA, 11 nt, Salmonella enterica enterica serovar Typhi Ty2
uuaggcguggu

SEQ ID NO: 1787309 - RNA, 15 nt, Salmonella enterica enterica serovar Typhi Ty2
uuaggcguaauuauu

SEQ ID NO: 1787310 - RNA, 17 nt, Salmonella enterica enterica serovar Typhi Ty2
uuaggcacuaccaccuc

SEQ ID NO: 1787311 - RNA, 19 nt, Salmonella enterica enterica serovar Typhi Ty2
uucaacagcucgccaugca

SEQ ID NO: 1787312 - RNA, 14 nt, Salmonella enterica enterica serovar Typhi Ty2
uucaacaaacucag

SEQ ID NO: 1787313 - RNA, 19 nt, Salmonella enterica enterica serovar Typhi Ty2
uucaaauuucugaugugau

SEQ ID NO: 1787314 - RNA, 15 nt, Salmonella enterica enterica serovar Typhi Ty2
uuauuuucacgccau

SEQ ID NO: 1787315 - RNA, 13 nt, Salmonella enterica enterica serovar Typhi Ty2
uuauuuucauacu

SEQ ID NO: 1787316 - RNA, 21 nt, Salmonella enterica enterica serovar Typhi Ty2
uuauuuuccugaaaaaauucc

SEQ ID NO: 1787317 - RNA, 21 nt, Salmonella enterica enterica serovar Typhi Ty2
uuauuuuagugaaaaaauauc

SEQ ID NO: 1787318 - RNA, 11 nt, Salmonella enterica enterica serovar Typhi Ty2
uuauuuuaaau

SEQ ID NO: 1787319 - RNA, 21 nt, Salmonella enterica enterica serovar Typhi Ty2
uggcaaucauaccgucagauu

SEQ ID NO: 1787320 - RNA, 13 nt, Salmonella enterica enterica serovar Typhi Ty2
uggcaacagccau

SEQ ID NO: 1787321 - RNA, 22 nt, Salmonella enterica enterica serovar Typhi Ty2
uggcaacauagcaucguuaccg

SEQ ID NO: 1787322 - RNA, 22 nt, Salmonella enterica enterica serovar Typhi Ty2
uggcaaucaaauccagcucagu

SEQ ID NO: 1787323 - RNA, 16 nt, Salmonella enterica enterica serovar Typhi Ty2
uggcacagggcaauaa

SEQ ID NO: 1787324 - RNA, 23 nt, Salmonella enterica enterica serovar Typhi Ty2
ugcguuaacccgcuuacaauuua

SEQ ID NO: 1787325 - RNA, 15 nt, Salmonella enterica enterica serovar Typhi Ty2
ugcguugcuauggca

SEQ ID NO: 1787326 - RNA, 21 nt, Salmonella enterica enterica serovar Typhi Ty2
ugcguucuuccacuucagcag

SEQ ID NO: 1787327 - RNA, 22 nt, Salmonella enterica enterica serovar Typhi Ty2
uggauuuauggcacaucaggca

SEQ ID NO: 1787328 - RNA, 20 nt, Salmonella enterica enterica serovar Typhi Ty2
uggcaaaaucguuaaccagc

SEQ ID NO: 1787329 - RNA, 20 nt, Salmonella enterica enterica serovar Typhi Ty2
uggccgcaaauuccaacaua

SEQ ID NO: 1787330 - RNA, 20 nt, Salmonella enterica enterica serovar Typhi Ty2
uggccaugccuaaaccgaca

SEQ ID NO: 1787331 - RNA, 23 nt, Salmonella enterica enterica serovar Typhi Ty2
uggccgauauugccuucacccag

SEQ ID NO: 1787332 - RNA, 14 nt, Salmonella enterica enterica serovar Typhi Ty2
uggccaucuuccag

SEQ ID NO: 1787333 - RNA, 17 nt, Salmonella enterica enterica serovar Typhi Ty2
uggccauauuuuuucag

SEQ ID NO: 1787334 - RNA, 21 nt, Salmonella enterica enterica serovar Typhi Ty2
uggccauauuuuuucaggaag

SEQ ID NO: 1787335 - RNA, 19 nt, Salmonella enterica enterica serovar Typhi Ty2
uggccaggaauaaagguca

SEQ ID NO: 1787336 - RNA, 21 nt, Salmonella enterica enterica serovar Typhi Ty2
uggccagggcaggcagugaac

SEQ ID NO: 1787337 - RNA, 16 nt, Salmonella enterica enterica serovar Typhi Ty2
uggccaaucagcgggu

SEQ ID NO: 1787338 - RNA, 21 nt, Salmonella enterica enterica serovar Typhi Ty2
uggccaaucagcggguauugc

SEQ ID NO: 1787339 - RNA, 13 nt, Salmonella enterica enterica serovar Typhi Ty2
uggccacaucguu

SEQ ID NO: 1787340 - RNA, 17 nt, Salmonella enterica enterica serovar Typhi Ty2
uggccacaucguuaccc

SEQ ID NO: 1787341 - RNA, 23 nt, Salmonella enterica enterica serovar Typhi Ty2
uggcagccucguccugcaauuug

SEQ ID NO: 1787342 - RNA, 23 nt, Salmonella enterica enterica serovar Typhi Ty2
uggcagcgccugacggcgcuguc

SEQ ID NO: 1787343 - RNA, 19 nt, Salmonella enterica enterica serovar Typhi Ty2
uggcagcggcaguaaauuu

SEQ ID NO: 1787344 - RNA, 12 nt, Salmonella enterica enterica serovar Typhi Ty2
uggccucauccg

SEQ ID NO: 1787345 - RNA, 14 nt, Salmonella enterica enterica serovar Typhi Ty2
uggccguggugaag

SEQ ID NO: 1787346 - RNA, 20 nt, Salmonella enterica enterica serovar Typhi Ty2
uggcgaacagccccaccgcc

SEQ ID NO: 1787347 - RNA, 19 nt, Salmonella enterica enterica serovar Typhi Ty2
uggccgcgugcucgcggcg

SEQ ID NO: 1787348 - RNA, 17 nt, Salmonella enterica enterica serovar Typhi Ty2
uggccgcugaccacggc

SEQ ID NO: 1787349 - RNA, 17 nt, Salmonella enterica enterica serovar Typhi Ty2
uggccgcuauccucgcc

SEQ ID NO: 1787350 - RNA, 17 nt, Salmonella enterica enterica serovar Typhi Ty2
uggcgauauccgugccg

SEQ ID NO: 1787351 - RNA, 22 nt, Salmonella enterica enterica serovar Typhi Ty2
uggcgaggcuuuguccuuugcu

SEQ ID NO: 1787352 - RNA, 23 nt, Salmonella enterica enterica serovar Typhi Ty2
uggcgaauccgggaaauggcaau

SEQ ID NO: 1787353 - RNA, 21 nt, Salmonella enterica enterica serovar Typhi Ty2
uggcgaugcuaucgguagugu

SEQ ID NO: 1787354 - RNA, 16 nt, Salmonella enterica enterica serovar Typhi Ty2
uggcgaucagcgccac

SEQ ID NO: 1787355 - RNA, 20 nt, Salmonella enterica enterica serovar Typhi Ty2
uggcgaucagcgccaccaca

SEQ ID NO: 1787356 - RNA, 16 nt, Salmonella enterica enterica serovar Typhi Ty2
uggcgaucacaauuac

SEQ ID NO: 1787357 - RNA, 18 nt, Salmonella enterica enterica serovar Typhi Ty2
uggcggagaucuccagau

SEQ ID NO: 1787358 - RNA, 15 nt, Salmonella enterica enterica serovar Typhi Ty2
uggcggcauaauaug

SEQ ID NO: 1787359 - RNA, 13 nt, Salmonella enterica enterica serovar Typhi Ty2
uggcgcuuuucca

SEQ ID NO: 1787360 - RNA, 17 nt, Salmonella enterica enterica serovar Typhi Ty2
uggcgcugucgcuuacc

SEQ ID NO: 1787361 - RNA, 15 nt, Salmonella enterica enterica serovar Typhi Ty2
uggcggugacgucaa

SEQ ID NO: 1787362 - RNA, 22 nt, Salmonella enterica enterica serovar Typhi Ty2
uggcggcaaggcgacucaaaac

SEQ ID NO: 1787363 - RNA, 15 nt, Salmonella enterica enterica serovar Typhi Ty2
ugguagacccggcau

SEQ ID NO: 1787364 - RNA, 22 nt, Salmonella enterica enterica serovar Typhi Ty2
ugguagagaucgacaaaccacu

SEQ ID NO: 1787365 - RNA, 19 nt, Salmonella enterica enterica serovar Typhi Ty2
ugguagacaaacagcgcgc

SEQ ID NO: 1787366 - RNA, 15 nt, Salmonella enterica enterica serovar Typhi Ty2
ugguagacaggcugg

SEQ ID NO: 1787367 - RNA, 16 nt, Salmonella enterica enterica serovar Typhi Ty2
ugguacuuuucaucca

SEQ ID NO: 1787368 - RNA, 15 nt, Salmonella enterica enterica serovar Typhi Ty2
ugguagcccucgcaa

SEQ ID NO: 1787369 - RNA, 14 nt, Salmonella enterica enterica serovar Typhi Ty2
ugguacguccaucc

SEQ ID NO: 1787370 - RNA, 15 nt, Salmonella enterica enterica serovar Typhi Ty2
ugguauucauuacag

SEQ ID NO: 1787371 - RNA, 17 nt, Salmonella enterica enterica serovar Typhi Ty2
ugguauaggccaggcua

SEQ ID NO: 1787372 - RNA, 21 nt, Salmonella enterica enterica serovar Typhi Ty2
ugguagucguuauaauccuga

SEQ ID NO: 1787373 - RNA, 16 nt, Salmonella enterica enterica serovar Typhi Ty2
ugguaguaagucagcu

SEQ ID NO: 1787374 - RNA, 14 nt, Salmonella enterica enterica serovar Typhi Ty2
ugguauaaaucccg

SEQ ID NO: 1787375 - RNA, 15 nt, Salmonella enterica enterica serovar Typhi Ty2
ugguaaaacgcuggc

SEQ ID NO: 1787376 - RNA, 23 nt, Salmonella enterica enterica serovar Typhi Ty2
ugguaaaauuauugugagaaaag

SEQ ID NO: 1787377 - RNA, 21 nt, Salmonella enterica enterica serovar Typhi Ty2
ugguaaggcaaauaugcuguc

SEQ ID NO: 1787378 - RNA, 22 nt, Salmonella enterica enterica serovar Typhi Ty2
ugguaaccuguuccucacugag

SEQ ID NO: 1787379 - RNA, 23 nt, Salmonella enterica enterica serovar Typhi Ty2
uggucggcgaccagcagcgcggc

SEQ ID NO: 1787380 - RNA, 19 nt, Salmonella enterica enterica serovar Typhi Ty2
uggucggacgggcccuggc

SEQ ID NO: 1787381 - RNA, 21 nt, Salmonella enterica enterica serovar Typhi Ty2
uggucggacgggcccuggccg

SEQ ID NO: 1787382 - RNA, 14 nt, Salmonella enterica enterica serovar Typhi Ty2
uggucgaaaauauc

SEQ ID NO: 1787383 - RNA, 14 nt, Salmonella enterica enterica serovar Typhi Ty2
uggucaucgaaggc

SEQ ID NO: 1787384 - RNA, 16 nt, Salmonella enterica enterica serovar Typhi Ty2
uggucauucccgucuc

SEQ ID NO: 1787385 - RNA, 12 nt, Salmonella enterica enterica serovar Typhi Ty2
uggucagcgcgc

SEQ ID NO: 1787386 - RNA, 12 nt, Salmonella enterica enterica serovar Typhi Ty2
uggucagcagcc

SEQ ID NO: 1787387 - RNA, 12 nt, Salmonella enterica enterica serovar Typhi Ty2
uggucaucgcgg

SEQ ID NO: 1787388 - RNA, 15 nt, Salmonella enterica enterica serovar Typhi Ty2
uggucaccaugacgc

SEQ ID NO: 1787389 - RNA, 23 nt, Salmonella enterica enterica serovar Typhi Ty2
uggucaccaugacgcagggcaau

SEQ ID NO: 1787390 - RNA, 18 nt, Salmonella enterica enterica serovar Typhi Ty2
uggcuuuuaagguuaauu

SEQ ID NO: 1787391 - RNA, 16 nt, Salmonella enterica enterica serovar Typhi Ty2
uggcuuucuacuacaa

SEQ ID NO: 1787392 - RNA, 21 nt, Salmonella enterica enterica serovar Typhi Ty2
uggcuuuccugaucaaucaac

SEQ ID NO: 1787393 - RNA, 20 nt, Salmonella enterica enterica serovar Typhi Ty2
ugggaucgacucauccagca

SEQ ID NO: 1787394 - RNA, 15 nt, Salmonella enterica enterica serovar Typhi Ty2
ugggauugcaaaaaa

SEQ ID NO: 1787395 - RNA, 18 nt, Salmonella enterica enterica serovar Typhi Ty2
uggcuucuucaacauugu

SEQ ID NO: 1787396 - RNA, 18 nt, Salmonella enterica enterica serovar Typhi Ty2
uggcuuccguccccagcc

SEQ ID NO: 1787397 - RNA, 16 nt, Salmonella enterica enterica serovar Typhi Ty2
uggcuuccguccccag

SEQ ID NO: 1787398 - RNA, 23 nt, Salmonella enterica enterica serovar Typhi Ty2
uggcuuaccguaugcaaaaggca

SEQ ID NO: 1787399 - RNA, 16 nt, Salmonella enterica enterica serovar Typhi Ty2
uggcuuaccugcucug

SEQ ID NO: 1787400 - RNA, 17 nt, Salmonella enterica enterica serovar Typhi Ty2
uggcuuaccuucggccu

SEQ ID NO: 1787401 - RNA, 14 nt, Salmonella enterica enterica serovar Typhi Ty2
ugggcggcaccagc

SEQ ID NO: 1787402 - RNA, 17 nt, Salmonella enterica enterica serovar Typhi Ty2
ugggcgcacagcgccau

SEQ ID NO: 1787403 - RNA, 12 nt, Salmonella enterica enterica serovar Typhi Ty2
ugggcagaaacg

SEQ ID NO: 1787404 - RNA, 21 nt, Salmonella enterica enterica serovar Typhi Ty2
uggggacgcgcaaacgcuggc

SEQ ID NO: 1787405 - RNA, 17 nt, Salmonella enterica enterica serovar Typhi Ty2
ugggcucaucaaacagc

SEQ ID NO: 1787406 - RNA, 19 nt, Salmonella enterica enterica serovar Typhi Ty2
uggggcaagcucagcggca

SEQ ID NO: 1787407 - RNA, 16 nt, Salmonella enterica enterica serovar Typhi Ty2
uggggauuaagcgagc

SEQ ID NO: 1787408 - RNA, 22 nt, Salmonella enterica enterica serovar Typhi Ty2
uguggggggaacggcagacagc

SEQ ID NO: 1787409 - RNA, 18 nt, Salmonella enterica enterica serovar Typhi Ty2
ugugguugugguaaucaa

SEQ ID NO: 1787410 - RNA, 20 nt, Salmonella enterica enterica serovar Typhi Ty2
uguggucgcggcucaccagc

SEQ ID NO: 1787411 - RNA, 21 nt, Salmonella enterica enterica serovar Typhi Ty2
uguguauauauugcauuuuau

SEQ ID NO: 1787412 - RNA, 13 nt, Salmonella enterica enterica serovar Typhi Ty2
ugugguuuaaaac

SEQ ID NO: 1787413 - RNA, 13 nt, Salmonella enterica enterica serovar Typhi Ty2
uguguacaaccau

SEQ ID NO: 1787414 - RNA, 22 nt, Salmonella enterica enterica serovar Typhi Ty2
uguguaccagcagcgccagcga

SEQ ID NO: 1787415 - RNA, 22 nt, Salmonella enterica enterica serovar Typhi Ty2
uguguagagauucugcaggcca

SEQ ID NO: 1787416 - RNA, 21 nt, Salmonella enterica enterica serovar Typhi Ty2
uguggccagggcaggcaguga

SEQ ID NO: 1787417 - RNA, 16 nt, Salmonella enterica enterica serovar Typhi Ty2
uguggcgcggccugga

SEQ ID NO: 1787418 - RNA, 17 nt, Salmonella enterica enterica serovar Typhi Ty2
uguggccugcucuacuc

SEQ ID NO: 1787419 - RNA, 15 nt, Salmonella enterica enterica serovar Typhi Ty2
ugugcuuccagcucc

SEQ ID NO: 1787420 - RNA, 12 nt, Salmonella enterica enterica serovar Typhi Ty2
ugugcuuccagc

SEQ ID NO: 1787421 - RNA, 20 nt, Salmonella enterica enterica serovar Typhi Ty2
ugugcgucgcguucgcauau

SEQ ID NO: 1787422 - RNA, 21 nt, Salmonella enterica enterica serovar Typhi Ty2
ugugcgugacccacaguuuca

SEQ ID NO: 1787423 - RNA, 19 nt, Salmonella enterica enterica serovar Typhi Ty2
ugugcguauugagcgcagu

SEQ ID NO: 1787424 - RNA, 14 nt, Salmonella enterica enterica serovar Typhi Ty2
ugugucaccacggg

SEQ ID NO: 1787425 - RNA, 18 nt, Salmonella enterica enterica serovar Typhi Ty2
uguguggagguuucuuca

SEQ ID NO: 1787426 - RNA, 15 nt, Salmonella enterica enterica serovar Typhi Ty2
ugugucguccaggcc

SEQ ID NO: 1787427 - RNA, 24 nt, Salmonella enterica enterica serovar Typhi Ty2
uguguugcucaaaaaagaguaaag

SEQ ID NO: 1787428 - RNA, 14 nt, Salmonella enterica enterica serovar Typhi Ty2
uguguuuuuuaaua

SEQ ID NO: 1787429 - RNA, 23 nt, Salmonella enterica enterica serovar Typhi Ty2
uguuaauccagagcggauaaaua

SEQ ID NO: 1787430 - RNA, 16 nt, Salmonella enterica enterica serovar Typhi Ty2
uguuaaugguaccaau

SEQ ID NO: 1787431 - RNA, 15 nt, Salmonella enterica enterica serovar Typhi Ty2
uguuaauaagcagaa

SEQ ID NO: 1787432 - RNA, 22 nt, Salmonella enterica enterica serovar Typhi Ty2
uguuagacauuccauuggccag

SEQ ID NO: 1787433 - RNA, 17 nt, Salmonella enterica enterica serovar Typhi Ty2
uguuacucaauaaaagu

SEQ ID NO: 1787434 - RNA, 12 nt, Salmonella enterica enterica serovar Typhi Ty2
uguuaccaaugc

SEQ ID NO: 1787435 - RNA, 12 nt, Salmonella enterica enterica serovar Typhi Ty2
uguuacccagcc

SEQ ID NO: 1787436 - RNA, 20 nt, Salmonella enterica enterica serovar Typhi Ty2
ugugagauaaaaaagcugcg

SEQ ID NO: 1787437 - RNA, 15 nt, Salmonella enterica enterica serovar Typhi Ty2
ugugaguaaagagau

SEQ ID NO: 1787438 - RNA, 23 nt, Salmonella enterica enterica serovar Typhi Ty2
ugugagccauaacaacuauuuuu

SEQ ID NO: 1787439 - RNA, 17 nt, Salmonella enterica enterica serovar Typhi Ty2
ugugacaaucacucucu

SEQ ID NO: 1787440 - RNA, 14 nt, Salmonella enterica enterica serovar Typhi Ty2
ugugaccccggccu

SEQ ID NO: 1787441 - RNA, 14 nt, Salmonella enterica enterica serovar Typhi Ty2
ugugacggcauguc

SEQ ID NO: 1787442 - RNA, 16 nt, Salmonella enterica enterica serovar Typhi Ty2
ugugaccaacaucauu

SEQ ID NO: 1787443 - RNA, 13 nt, Salmonella enterica enterica serovar Typhi Ty2
ugucuuaaauaug

SEQ ID NO: 1787444 - RNA, 15 nt, Salmonella enterica enterica serovar Typhi Ty2
ugucuuaaagaaaaa

SEQ ID NO: 1787445 - RNA, 23 nt, Salmonella enterica enterica serovar Typhi Ty2
ugucugccucggguggcaucuga

SEQ ID NO: 1787446 - RNA, 15 nt, Salmonella enterica enterica serovar Typhi Ty2
ugucuuauccggccu

SEQ ID NO: 1787447 - RNA, 23 nt, Salmonella enterica enterica serovar Typhi Ty2
ugugcgacaacaaugaaacgguu

SEQ ID NO: 1787448 - RNA, 18 nt, Salmonella enterica enterica serovar Typhi Ty2
ugugcauaucuggcgagg

SEQ ID NO: 1787449 - RNA, 19 nt, Salmonella enterica enterica serovar Typhi Ty2
ugugcagugacagaggaau

SEQ ID NO: 1787450 - RNA, 12 nt, Salmonella enterica enterica serovar Typhi Ty2
ugucgccaauaa

SEQ ID NO: 1787451 - RNA, 20 nt, Salmonella enterica enterica serovar Typhi Ty2
uguccaguuuuugcauuaua

SEQ ID NO: 1787452 - RNA, 17 nt, Salmonella enterica enterica serovar Typhi Ty2
uguccaguuuuuuacuu

SEQ ID NO: 1787453 - RNA, 22 nt, Salmonella enterica enterica serovar Typhi Ty2
uguccaggucaucaccuccagc

SEQ ID NO: 1787454 - RNA, 14 nt, Salmonella enterica enterica serovar Typhi Ty2
uguccagcggccau

SEQ ID NO: 1787455 - RNA, 16 nt, Salmonella enterica enterica serovar Typhi Ty2
uguccagcagugucug

SEQ ID NO: 1787456 - RNA, 19 nt, Salmonella enterica enterica serovar Typhi Ty2
ugucauucgccucaaaacc

SEQ ID NO: 1787457 - RNA, 14 nt, Salmonella enterica enterica serovar Typhi Ty2
uguccaaacuggcu

SEQ ID NO: 1787458 - RNA, 18 nt, Salmonella enterica enterica serovar Typhi Ty2
ugucgcuggauagcacca

SEQ ID NO: 1787459 - RNA, 19 nt, Salmonella enterica enterica serovar Typhi Ty2
ugucgggcaaaaugcgucg

SEQ ID NO: 1787460 - RNA, 17 nt, Salmonella enterica enterica serovar Typhi Ty2
ugucgcggcggcaaaag

SEQ ID NO: 1787461 - RNA, 16 nt, Salmonella enterica enterica serovar Typhi Ty2
ugucgcggauaugcag

SEQ ID NO: 1787462 - RNA, 22 nt, Salmonella enterica enterica serovar Typhi Ty2
ugucgggccaaucggagugaau

SEQ ID NO: 1787463 - RNA, 12 nt, Salmonella enterica enterica serovar Typhi Ty2
ugucggucugau

SEQ ID NO: 1787464 - RNA, 21 nt, Salmonella enterica enterica serovar Typhi Ty2
ugucuauuuauugaagaugua

SEQ ID NO: 1787465 - RNA, 16 nt, Salmonella enterica enterica serovar Typhi Ty2
ugucuauaggccugau

SEQ ID NO: 1787466 - RNA, 23 nt, Salmonella enterica enterica serovar Typhi Ty2
ugucuauaggccugauaaacgua

SEQ ID NO: 1787467 - RNA, 13 nt, Salmonella enterica enterica serovar Typhi Ty2
ugucguauuuauu

SEQ ID NO: 1787468 - RNA, 16 nt, Salmonella enterica enterica serovar Typhi Ty2
ugucaugcuaaaacag

SEQ ID NO: 1787469 - RNA, 17 nt, Salmonella enterica enterica serovar Typhi Ty2
ugucaugcuaaaacaga

SEQ ID NO: 1787470 - RNA, 20 nt, Salmonella enterica enterica serovar Typhi Ty2
ugucaugcuaaaacagauaa

SEQ ID NO: 1787471 - RNA, 23 nt, Salmonella enterica enterica serovar Typhi Ty2
ugucauagucggcgccaaaguua

SEQ ID NO: 1787472 - RNA, 14 nt, Salmonella enterica enterica serovar Typhi Ty2
ugucaucagaucau

SEQ ID NO: 1787473 - RNA, 12 nt, Salmonella enterica enterica serovar Typhi Ty2
ugucauccugcu

SEQ ID NO: 1787474 - RNA, 19 nt, Salmonella enterica enterica serovar Typhi Ty2
ugucaucaguaugagcgaa

SEQ ID NO: 1787475 - RNA, 21 nt, Salmonella enterica enterica serovar Typhi Ty2
ugucauccugcgcacagcaua

SEQ ID NO: 1787476 - RNA, 16 nt, Salmonella enterica enterica serovar Typhi Ty2
ugucaguggacgauaa

SEQ ID NO: 1787477 - RNA, 22 nt, Salmonella enterica enterica serovar Typhi Ty2
ugucauagucggcgccaaaguu

SEQ ID NO: 1787478 - RNA, 18 nt, Salmonella enterica enterica serovar Typhi Ty2
ugucagauccuucauuca

SEQ ID NO: 1787479 - RNA, 15 nt, Salmonella enterica enterica serovar Typhi Ty2
ugucagacaugauaa

SEQ ID NO: 1787480 - RNA, 21 nt, Salmonella enterica enterica serovar Typhi Ty2
ugucaguaucgguacgcgcgu

SEQ ID NO: 1787481 - RNA, 22 nt, Salmonella enterica enterica serovar Typhi Ty2
uguauuaaaggaucgauuaagg

SEQ ID NO: 1787482 - RNA, 13 nt, Salmonella enterica enterica serovar Typhi Ty2
uguauuaaaggau

SEQ ID NO: 1787483 - RNA, 15 nt, Salmonella enterica enterica serovar Typhi Ty2
ugucaaauucaagcc

SEQ ID NO: 1787484 - RNA, 17 nt, Salmonella enterica enterica serovar Typhi Ty2
ugucaacgugugccagg

SEQ ID NO: 1787485 - RNA, 14 nt, Salmonella enterica enterica serovar Typhi Ty2
ugucacgcaggggg

SEQ ID NO: 1787486 - RNA, 17 nt, Salmonella enterica enterica serovar Typhi Ty2
ugucaacuuaaacguuc

SEQ ID NO: 1787487 - RNA, 17 nt, Salmonella enterica enterica serovar Typhi Ty2
uguauaccaaaaauaau

SEQ ID NO: 1787488 - RNA, 18 nt, Salmonella enterica enterica serovar Typhi Ty2
uguauaccaaaaauaauu

SEQ ID NO: 1787489 - RNA, 20 nt, Salmonella enterica enterica serovar Typhi Ty2
uguauagcaacuuaauaaua

SEQ ID NO: 1787490 - RNA, 12 nt, Salmonella enterica enterica serovar Typhi Ty2
uguauaauuauu

SEQ ID NO: 1787491 - RNA, 14 nt, Salmonella enterica enterica serovar Typhi Ty2
uguauaaaauauuu

SEQ ID NO: 1787492 - RNA, 12 nt, Salmonella enterica enterica serovar Typhi Ty2
uguaguuuuuug

SEQ ID NO: 1787493 - RNA, 12 nt, Salmonella enterica enterica serovar Typhi Ty2
uguagugguugu

SEQ ID NO: 1787494 - RNA, 12 nt, Salmonella enterica enterica serovar Typhi Ty2
uguaguuaucgc

SEQ ID NO: 1787495 - RNA, 17 nt, Salmonella enterica enterica serovar Typhi Ty2
uguaggguacagcgcga

SEQ ID NO: 1787496 - RNA, 18 nt, Salmonella enterica enterica serovar Typhi Ty2
uguagcucauaacucgcu

SEQ ID NO: 1787497 - RNA, 23 nt, Salmonella enterica enterica serovar Typhi Ty2
uguagcugucccagugucaacug

SEQ ID NO: 1787498 - RNA, 13 nt, Salmonella enterica enterica serovar Typhi Ty2
uguagcgcuuugg

SEQ ID NO: 1787499 - RNA, 15 nt, Salmonella enterica enterica serovar Typhi Ty2
uguaggcuuccagaa

SEQ ID NO: 1787500 - RNA, 21 nt, Salmonella enterica enterica serovar Typhi Ty2
uguaaaacgguaugaaacaua

SEQ ID NO: 1787501 - RNA, 13 nt, Salmonella enterica enterica serovar Typhi Ty2
uguaaaaaugccu

SEQ ID NO: 1787502 - RNA, 20 nt, Salmonella enterica enterica serovar Typhi Ty2
uguaaaauccggcaggcagc

SEQ ID NO: 1787503 - RNA, 11 nt, Salmonella enterica enterica serovar Typhi Ty2
uguaaaaaaau

SEQ ID NO: 1787504 - RNA, 20 nt, Salmonella enterica enterica serovar Typhi Ty2
uguaacaaugccucgauggc

SEQ ID NO: 1787505 - RNA, 21 nt, Salmonella enterica enterica serovar Typhi Ty2
uguaaaccaggcauuuuauua

SEQ ID NO: 1787506 - RNA, 18 nt, Salmonella enterica enterica serovar Typhi Ty2
ugguuuaaacucugcaaa

SEQ ID NO: 1787507 - RNA, 18 nt, Salmonella enterica enterica serovar Typhi Ty2
uggugaaaaaucauuauc

SEQ ID NO: 1787508 - RNA, 18 nt, Salmonella enterica enterica serovar Typhi Ty2
uggugaaacguguuuauc

SEQ ID NO: 1787509 - RNA, 19 nt, Salmonella enterica enterica serovar Typhi Ty2
uggucggcguaacccagug

SEQ ID NO: 1787510 - RNA, 23 nt, Salmonella enterica enterica serovar Typhi Ty2
uggucuuaaugcugcgguugagc

SEQ ID NO: 1787511 - RNA, 21 nt, Salmonella enterica enterica serovar Typhi Ty2
uggucuguagauagcuaucca

SEQ ID NO: 1787512 - RNA, 16 nt, Salmonella enterica enterica serovar Typhi Ty2
ugguuucccugccuca

SEQ ID NO: 1787513 - RNA, 13 nt, Salmonella enterica enterica serovar Typhi Ty2
ugguuucccugcc

SEQ ID NO: 1787514 - RNA, 19 nt, Salmonella enterica enterica serovar Typhi Ty2
ugguuucggcaugccacug

SEQ ID NO: 1787515 - RNA, 20 nt, Salmonella enterica enterica serovar Typhi Ty2
ugguuucaugcaucauugaa

SEQ ID NO: 1787516 - RNA, 21 nt, Salmonella enterica enterica serovar Typhi Ty2
ugguuuaucgccgauugaggg

SEQ ID NO: 1787517 - RNA, 19 nt, Salmonella enterica enterica serovar Typhi Ty2
uguaaugaaagaaaucacc

SEQ ID NO: 1787518 - RNA, 13 nt, Salmonella enterica enterica serovar Typhi Ty2
uguaaccaacaaa

SEQ ID NO: 1787519 - RNA, 15 nt, Salmonella enterica enterica serovar Typhi Ty2
uguaacccgccgcca

SEQ ID NO: 1787520 - RNA, 16 nt, Salmonella enterica enterica serovar Typhi Ty2
uguaaccaaagcacca

SEQ ID NO: 1787521 - RNA, 22 nt, Salmonella enterica enterica serovar Typhi Ty2
uguaacgaguugcggcaacgug

SEQ ID NO: 1787522 - RNA, 22 nt, Salmonella enterica enterica serovar Typhi Ty2
uguacaaccaucacugaaccca

SEQ ID NO: 1787523 - RNA, 16 nt, Salmonella enterica enterica serovar Typhi Ty2
uguacuugcgccgcca

SEQ ID NO: 1787524 - RNA, 20 nt, Salmonella enterica enterica serovar Typhi Ty2
uguaccugauccagcucuuc

SEQ ID NO: 1787525 - RNA, 19 nt, Salmonella enterica enterica serovar Typhi Ty2
uguuuaguacgcaaggaaa

SEQ ID NO: 1787526 - RNA, 16 nt, Salmonella enterica enterica serovar Typhi Ty2
uguuuagacacauuga

SEQ ID NO: 1787527 - RNA, 16 nt, Salmonella enterica enterica serovar Typhi Ty2
uguuuaauacgcuguc

SEQ ID NO: 1787528 - RNA, 17 nt, Salmonella enterica enterica serovar Typhi Ty2
uguuuaaugcuuucaau

SEQ ID NO: 1787529 - RNA, 20 nt, Salmonella enterica enterica serovar Typhi Ty2
uguuguucuuuucuuucagc

SEQ ID NO: 1787530 - RNA, 21 nt, Salmonella enterica enterica serovar Typhi Ty2
uguuguucuuuucuuucagcu

SEQ ID NO: 1787531 - RNA, 15 nt, Salmonella enterica enterica serovar Typhi Ty2
uguuuaaaaucaacg

SEQ ID NO: 1787532 - RNA, 22 nt, Salmonella enterica enterica serovar Typhi Ty2
uguuggugaguggccugucugg

SEQ ID NO: 1787533 - RNA, 23 nt, Salmonella enterica enterica serovar Typhi Ty2
uguuggaaaugcguggcauuaac

SEQ ID NO: 1787534 - RNA, 17 nt, Salmonella enterica enterica serovar Typhi Ty2
uguuguaaagaaauuua

SEQ ID NO: 1787535 - RNA, 22 nt, Salmonella enterica enterica serovar Typhi Ty2
uguuguaagggcuggaaaauca

SEQ ID NO: 1787536 - RNA, 22 nt, Salmonella enterica enterica serovar Typhi Ty2
uguuguacagcaauaaaaggaa

SEQ ID NO: 1787537 - RNA, 14 nt, Salmonella enterica enterica serovar Typhi Ty2
uguuguacagcaau

SEQ ID NO: 1787538 - RNA, 20 nt, Salmonella enterica enterica serovar Typhi Ty2
uguuguguuuagcccucugg

SEQ ID NO: 1787539 - RNA, 13 nt, Salmonella enterica enterica serovar Typhi Ty2
uguugauacagaa

SEQ ID NO: 1787540 - RNA, 23 nt, Salmonella enterica enterica serovar Typhi Ty2
uguugauauggugcgcuuuuggc

SEQ ID NO: 1787541 - RNA, 22 nt, Salmonella enterica enterica serovar Typhi Ty2
uguugaugauggcuccuguugg

SEQ ID NO: 1787542 - RNA, 15 nt, Salmonella enterica enterica serovar Typhi Ty2
uguugauuaagcacg

SEQ ID NO: 1787543 - RNA, 14 nt, Salmonella enterica enterica serovar Typhi Ty2
uguugcaaauauuc

SEQ ID NO: 1787544 - RNA, 13 nt, Salmonella enterica enterica serovar Typhi Ty2
uguugccaugauc

SEQ ID NO: 1787545 - RNA, 22 nt, Salmonella enterica enterica serovar Typhi Ty2
uguugcgggccagcagccaggc

SEQ ID NO: 1787546 - RNA, 20 nt, Salmonella enterica enterica serovar Typhi Ty2
uguugcgccauggcuucucc

SEQ ID NO: 1787547 - RNA, 16 nt, Salmonella enterica enterica serovar Typhi Ty2
uguugcgcaagcacug

SEQ ID NO: 1787548 - RNA, 17 nt, Salmonella enterica enterica serovar Typhi Ty2
uguugaaagccccggcu

SEQ ID NO: 1787549 - RNA, 14 nt, Salmonella enterica enterica serovar Typhi Ty2
uguugagacgguga

SEQ ID NO: 1787550 - RNA, 14 nt, Salmonella enterica enterica serovar Typhi Ty2
uguugacugcgcuc

SEQ ID NO: 1787551 - RNA, 19 nt, Salmonella enterica enterica serovar Typhi Ty2
uguucuguccauguuuuau

SEQ ID NO: 1787552 - RNA, 19 nt, Salmonella enterica enterica serovar Typhi Ty2
uguucucgaggacagugaa

SEQ ID NO: 1787553 - RNA, 20 nt, Salmonella enterica enterica serovar Typhi Ty2
uguucgcuuauuccuccgcc

SEQ ID NO: 1787554 - RNA, 22 nt, Salmonella enterica enterica serovar Typhi Ty2
uguuccuggacguggguuucaa

SEQ ID NO: 1787555 - RNA, 13 nt, Salmonella enterica enterica serovar Typhi Ty2
uguucucccugcu

SEQ ID NO: 1787556 - RNA, 14 nt, Salmonella enterica enterica serovar Typhi Ty2
uguuccucuuuccc

SEQ ID NO: 1787557 - RNA, 17 nt, Salmonella enterica enterica serovar Typhi Ty2
uguuccugcuggcaaaa

SEQ ID NO: 1787558 - RNA, 14 nt, Salmonella enterica enterica serovar Typhi Ty2
uguuccugagcaga

SEQ ID NO: 1787559 - RNA, 18 nt, Salmonella enterica enterica serovar Typhi Ty2
uguuccggaugcgggccg

SEQ ID NO: 1787560 - RNA, 16 nt, Salmonella enterica enterica serovar Typhi Ty2
uguuccagggcuucca

SEQ ID NO: 1787561 - RNA, 23 nt, Salmonella enterica enterica serovar Typhi Ty2
uguucauaucgaagaccuggccg

SEQ ID NO: 1787562 - RNA, 14 nt, Salmonella enterica enterica serovar Typhi Ty2
uguuccaccugcgg

SEQ ID NO: 1787563 - RNA, 18 nt, Salmonella enterica enterica serovar Typhi Ty2
uguuauuuucaaaaacaa

SEQ ID NO: 1787564 - RNA, 14 nt, Salmonella enterica enterica serovar Typhi Ty2
uguucaagcaauaa

SEQ ID NO: 1787565 - RNA, 16 nt, Salmonella enterica enterica serovar Typhi Ty2
uguucaauauuccugg

SEQ ID NO: 1787566 - RNA, 13 nt, Salmonella enterica enterica serovar Typhi Ty2
uguucaauauucc

SEQ ID NO: 1787567 - RNA, 16 nt, Salmonella enterica enterica serovar Typhi Ty2
uguucacaucgcucag

SEQ ID NO: 1787568 - RNA, 13 nt, Salmonella enterica enterica serovar Typhi Ty2
uguucacaauugu

SEQ ID NO: 1787569 - RNA, 20 nt, Salmonella enterica enterica serovar Typhi Ty2
uguucacguaccaggcagcg

SEQ ID NO: 1787570 - RNA, 18 nt, Salmonella enterica enterica serovar Typhi Ty2
uguucagauggccaauga

SEQ ID NO: 1787571 - RNA, 18 nt, Salmonella enterica enterica serovar Typhi Ty2
uguucauaaagugccagg

SEQ ID NO: 1787572 - RNA, 14 nt, Salmonella enterica enterica serovar Typhi Ty2
uguucauaaagugc

SEQ ID NO: 1787573 - RNA, 15 nt, Salmonella enterica enterica serovar Typhi Ty2
uguuaguguccuuac

SEQ ID NO: 1787574 - RNA, 15 nt, Salmonella enterica enterica serovar Typhi Ty2
uguuaguuucuauua

SEQ ID NO: 1787575 - RNA, 16 nt, Salmonella enterica enterica serovar Typhi Ty2
uguuagcaaaaaugcc

SEQ ID NO: 1787576 - RNA, 18 nt, Salmonella enterica enterica serovar Typhi Ty2
uguuauauauuuuucagc

SEQ ID NO: 1787577 - RNA, 17 nt, Salmonella enterica enterica serovar Typhi Ty2
uguuaucuacaguguaa

SEQ ID NO: 1787578 - RNA, 21 nt, Salmonella enterica enterica serovar Typhi Ty2
uguuauuuacaaggaaagucu

SEQ ID NO: 1787579 - RNA, 22 nt, Salmonella enterica enterica serovar Typhi Ty2
uguuuuuuguugauuuuaugau

SEQ ID NO: 1787580 - RNA, 16 nt, Salmonella enterica enterica serovar Typhi Ty2
uguuuuuuguaggccg

SEQ ID NO: 1787581 - RNA, 11 nt, Salmonella enterica enterica serovar Typhi Ty2
uuaaaaaaacg

SEQ ID NO: 1787582 - RNA, 18 nt, Salmonella enterica enterica serovar Typhi Ty2
uuaaaaaaggcagaagaa

SEQ ID NO: 1787583 - RNA, 21 nt, Salmonella enterica enterica serovar Typhi Ty2
uuaaaaaaggccgcuuaauaa

SEQ ID NO: 1787584 - RNA, 13 nt, Salmonella enterica enterica serovar Typhi Ty2
uuaaaaacagcca

SEQ ID NO: 1787585 - RNA, 13 nt, Salmonella enterica enterica serovar Typhi Ty2
uuaaaaacaucau

SEQ ID NO: 1787586 - RNA, 18 nt, Salmonella enterica enterica serovar Typhi Ty2
uuaaaaaccaggcaaaaa

SEQ ID NO: 1787587 - RNA, 15 nt, Salmonella enterica enterica serovar Typhi Ty2
uuaaaaaauccugca

SEQ ID NO: 1787588 - RNA, 14 nt, Salmonella enterica enterica serovar Typhi Ty2
uuaaaaagcugcau

SEQ ID NO: 1787589 - RNA, 13 nt, Salmonella enterica enterica serovar Typhi Ty2
uuaaaaagcugca

SEQ ID NO: 1787590 - RNA, 17 nt, Salmonella enterica enterica serovar Typhi Ty2
uuaaaaagcugcauaau

SEQ ID NO: 1787591 - RNA, 13 nt, Salmonella enterica enterica serovar Typhi Ty2
uuaaaccacaccu

SEQ ID NO: 1787592 - RNA, 14 nt, Salmonella enterica enterica serovar Typhi Ty2
uuaaacaguauuua

SEQ ID NO: 1787593 - RNA, 21 nt, Salmonella enterica enterica serovar Typhi Ty2
uuaaaaugcggggacuggaug

SEQ ID NO: 1787594 - RNA, 11 nt, Salmonella enterica enterica serovar Typhi Ty2
uuaaaaugacc

SEQ ID NO: 1787595 - RNA, 18 nt, Salmonella enterica enterica serovar Typhi Ty2
uuaaacaacgccauaaua

SEQ ID NO: 1787596 - RNA, 19 nt, Salmonella enterica enterica serovar Typhi Ty2
uuaaacgccggauuccaga

SEQ ID NO: 1787597 - RNA, 22 nt, Salmonella enterica enterica serovar Typhi Ty2
uuaaacuggccccgcauuuuac

SEQ ID NO: 1787598 - RNA, 13 nt, Salmonella enterica enterica serovar Typhi Ty2
uguuuggugcuga

SEQ ID NO: 1787599 - RNA, 19 nt, Salmonella enterica enterica serovar Typhi Ty2
uguuuuaccaaaucaauag

SEQ ID NO: 1787600 - RNA, 18 nt, Salmonella enterica enterica serovar Typhi Ty2
uguuuuacuuuuuuaaau

SEQ ID NO: 1787601 - RNA, 21 nt, Salmonella enterica enterica serovar Typhi Ty2
uguuuuacuuuuuuaaauguu

SEQ ID NO: 1787602 - RNA, 14 nt, Salmonella enterica enterica serovar Typhi Ty2
uguuuuaccuguuu

SEQ ID NO: 1787603 - RNA, 20 nt, Salmonella enterica enterica serovar Typhi Ty2
uguuuuagcagaguaugcug

SEQ ID NO: 1787604 - RNA, 19 nt, Salmonella enterica enterica serovar Typhi Ty2
uguuuucauauguuugaua

SEQ ID NO: 1787605 - RNA, 15 nt, Salmonella enterica enterica serovar Typhi Ty2
uguuuuuauacaucc

SEQ ID NO: 1787606 - RNA, 15 nt, Salmonella enterica enterica serovar Typhi Ty2
uguuuuugaaaaugu

SEQ ID NO: 1787607 - RNA, 12 nt, Salmonella enterica enterica serovar Typhi Ty2
uguuuuucucuu

SEQ ID NO: 1787608 - RNA, 12 nt, Salmonella enterica enterica serovar Typhi Ty2
uguuuuugcuuu

SEQ ID NO: 1787609 - RNA, 16 nt, Salmonella enterica enterica serovar Typhi Ty2
uguuuuugcuuuaaua

SEQ ID NO: 1787610 - RNA, 23 nt, Salmonella enterica enterica serovar Typhi Ty2
uguuuuuucaucuccgauaaaua

SEQ ID NO: 1787611 - RNA, 21 nt, Salmonella enterica enterica serovar Typhi Ty2
uguuuucgagccuugccgcaa

SEQ ID NO: 1787612 - RNA, 17 nt, Salmonella enterica enterica serovar Typhi Ty2
uguuuucgagccuugcc

SEQ ID NO: 1787613 - RNA, 20 nt, Salmonella enterica enterica serovar Typhi Ty2
uguuuucccagaauccgcgc

SEQ ID NO: 1787614 - RNA, 13 nt, Salmonella enterica enterica serovar Typhi Ty2
uguuuuuaaaaga

SEQ ID NO: 1787615 - RNA, 22 nt, Salmonella enterica enterica serovar Typhi Ty2
uguuuaucagaccuguaaaaaa

SEQ ID NO: 1787616 - RNA, 18 nt, Salmonella enterica enterica serovar Typhi Ty2
uguuucagcaccucuuug

SEQ ID NO: 1787617 - RNA, 12 nt, Salmonella enterica enterica serovar Typhi Ty2
uguuucagcagc

SEQ ID NO: 1787618 - RNA, 21 nt, Salmonella enterica enterica serovar Typhi Ty2
uguuucgaccgccugcaucac

SEQ ID NO: 1787619 - RNA, 14 nt, Salmonella enterica enterica serovar Typhi Ty2
uguuucccaacaau

SEQ ID NO: 1787620 - RNA, 23 nt, Salmonella enterica enterica serovar Typhi Ty2
uguuuccauacauuuuuguaaua

SEQ ID NO: 1787621 - RNA, 17 nt, Salmonella enterica enterica serovar Typhi Ty2
uguuucggauaauucug

SEQ ID NO: 1787622 - RNA, 15 nt, Salmonella enterica enterica serovar Typhi Ty2
uguuucggauaauuc

SEQ ID NO: 1787623 - RNA, 16 nt, Salmonella enterica enterica serovar Typhi Ty2
uguuucggauaauucu

SEQ ID NO: 1787624 - RNA, 23 nt, Salmonella enterica enterica serovar Typhi Ty2
uguuucuuuuaaggcggcaaaga

SEQ ID NO: 1787625 - RNA, 17 nt, Salmonella enterica enterica serovar Typhi Ty2
uguuucucuuccgccag

SEQ ID NO: 1787626 - RNA, 10 nt, Salmonella enterica enterica serovar Typhi Ty2
uguuucugcg

SEQ ID NO: 1787627 - RNA, 16 nt, Salmonella enterica enterica serovar Typhi Ty2
uguuugcccagcucau

SEQ ID NO: 1787628 - RNA, 20 nt, Salmonella enterica enterica serovar Typhi Ty2
uguuugcugagaauuuccag

SEQ ID NO: 1787629 - RNA, 22 nt, Salmonella enterica enterica serovar Typhi Ty2
uguuugcccaccguaauaguuu

SEQ ID NO: 1787630 - RNA, 21 nt, Salmonella enterica enterica serovar Typhi Ty2
uguuugcccaccguaauaguu

SEQ ID NO: 1787631 - RNA, 17 nt, Salmonella enterica enterica serovar Typhi Ty2
uguuugagaaaaacauc

SEQ ID NO: 1787632 - RNA, 17 nt, Salmonella enterica enterica serovar Typhi Ty2
uuacaccccacuauuca

SEQ ID NO: 1787633 - RNA, 16 nt, Salmonella enterica enterica serovar Typhi Ty2
uuacacgaucauuuca

SEQ ID NO: 1787634 - RNA, 15 nt, Salmonella enterica enterica serovar Typhi Ty2
uuacacguuccaugg

SEQ ID NO: 1787635 - RNA, 14 nt, Salmonella enterica enterica serovar Typhi Ty2
uuacacguuccaug

SEQ ID NO: 1787636 - RNA, 22 nt, Salmonella enterica enterica serovar Typhi Ty2
uuacaccucgccacauucaauu

SEQ ID NO: 1787637 - RNA, 19 nt, Salmonella enterica enterica serovar Typhi Ty2
uuacacugauaccccagcg

SEQ ID NO: 1787638 - RNA, 12 nt, Salmonella enterica enterica serovar Typhi Ty2
uuacacugaagc

SEQ ID NO: 1787639 - RNA, 19 nt, Salmonella enterica enterica serovar Typhi Ty2
uuacacuuagcacaaagaa

SEQ ID NO: 1787640 - RNA, 23 nt, Salmonella enterica enterica serovar Typhi Ty2
uuacaaccgcaccggaucaauau

SEQ ID NO: 1787641 - RNA, 22 nt, Salmonella enterica enterica serovar Typhi Ty2
uuaaucccuugcuggcgacggc

SEQ ID NO: 1787642 - RNA, 14 nt, Salmonella enterica enterica serovar Typhi Ty2
uuaaucccaacccg

SEQ ID NO: 1787643 - RNA, 18 nt, Salmonella enterica enterica serovar Typhi Ty2
uuaaugacuuuuuauaua

SEQ ID NO: 1787644 - RNA, 15 nt, Salmonella enterica enterica serovar Typhi Ty2
uuaaugaccugccgc

SEQ ID NO: 1787645 - RNA, 19 nt, Salmonella enterica enterica serovar Typhi Ty2
uuaaugacuuuuuauauaa

SEQ ID NO: 1787646 - RNA, 13 nt, Salmonella enterica enterica serovar Typhi Ty2
uuacaucagauaa

SEQ ID NO: 1787647 - RNA, 19 nt, Salmonella enterica enterica serovar Typhi Ty2
uuaccacuuugcgcuccug

SEQ ID NO: 1787648 - RNA, 14 nt, Salmonella enterica enterica serovar Typhi Ty2
uuaccagaaccacu

SEQ ID NO: 1787649 - RNA, 15 nt, Salmonella enterica enterica serovar Typhi Ty2
uuacaucaauaaaca

SEQ ID NO: 1787650 - RNA, 18 nt, Salmonella enterica enterica serovar Typhi Ty2
uuaccacgguaacgccuu

SEQ ID NO: 1787651 - RNA, 17 nt, Salmonella enterica enterica serovar Typhi Ty2
uuacauagaaaauauau

SEQ ID NO: 1787652 - RNA, 15 nt, Salmonella enterica enterica serovar Typhi Ty2
uuaccauccauuaaa

SEQ ID NO: 1787653 - RNA, 15 nt, Salmonella enterica enterica serovar Typhi Ty2
uuaccggugcagacc

SEQ ID NO: 1787654 - RNA, 13 nt, Salmonella enterica enterica serovar Typhi Ty2
uuaccguaaaaug

SEQ ID NO: 1787655 - RNA, 21 nt, Salmonella enterica enterica serovar Typhi Ty2
uuaccguaaaaugcuggugca

SEQ ID NO: 1787656 - RNA, 20 nt, Salmonella enterica enterica serovar Typhi Ty2
uuacccauacaguacagacu

SEQ ID NO: 1787657 - RNA, 21 nt, Salmonella enterica enterica serovar Typhi Ty2
uuacgauacguuuaaaaugaa

SEQ ID NO: 1787658 - RNA, 21 nt, Salmonella enterica enterica serovar Typhi Ty2
uuacgacgauaaggccaauau

SEQ ID NO: 1787659 - RNA, 22 nt, Salmonella enterica enterica serovar Typhi Ty2
uuacgaccgcagaaacagauag

SEQ ID NO: 1787660 - RNA, 22 nt, Salmonella enterica enterica serovar Typhi Ty2
uuacgacgggucagauucagca

SEQ ID NO: 1787661 - RNA, 15 nt, Salmonella enterica enterica serovar Typhi Ty2
uuaccuucugccgcg

SEQ ID NO: 1787662 - RNA, 19 nt, Salmonella enterica enterica serovar Typhi Ty2
uuaccuacgcgauaaaaaa

SEQ ID NO: 1787663 - RNA, 13 nt, Salmonella enterica enterica serovar Typhi Ty2
uuaccuaccaguu

SEQ ID NO: 1787664 - RNA, 22 nt, Salmonella enterica enterica serovar Typhi Ty2
uuaccugcgcaaucaugacaga

SEQ ID NO: 1787665 - RNA, 17 nt, Salmonella enterica enterica serovar Typhi Ty2
uuaccuuguucuuccau

SEQ ID NO: 1787666 - RNA, 23 nt, Salmonella enterica enterica serovar Typhi Ty2
uuagcgcuaauuccuguccauug

SEQ ID NO: 1787667 - RNA, 17 nt, Salmonella enterica enterica serovar Typhi Ty2
uuagcgguacucuuuuu

SEQ ID NO: 1787668 - RNA, 21 nt, Salmonella enterica enterica serovar Typhi Ty2
uuagcaacacagacuuugcac

SEQ ID NO: 1787669 - RNA, 12 nt, Salmonella enterica enterica serovar Typhi Ty2
uuagaaaaagaa

SEQ ID NO: 1787670 - RNA, 22 nt, Salmonella enterica enterica serovar Typhi Ty2
uuagaauagaaucaauuucucu

SEQ ID NO: 1787671 - RNA, 16 nt, Salmonella enterica enterica serovar Typhi Ty2
uuagaaaauacugcua

SEQ ID NO: 1787672 - RNA, 20 nt, Salmonella enterica enterica serovar Typhi Ty2
uuagaaaauauauuggccuu

SEQ ID NO: 1787673 - RNA, 13 nt, Salmonella enterica enterica serovar Typhi Ty2
uuagaaaaagaaa

SEQ ID NO: 1787674 - RNA, 17 nt, Salmonella enterica enterica serovar Typhi Ty2
uuacuuuuuuaaauguu

SEQ ID NO: 1787675 - RNA, 13 nt, Salmonella enterica enterica serovar Typhi Ty2
uuacuuuuuuaaa

SEQ ID NO: 1787676 - RNA, 20 nt, Salmonella enterica enterica serovar Typhi Ty2
uuagaaaaaauuaaaaauac

SEQ ID NO: 1787677 - RNA, 13 nt, Salmonella enterica enterica serovar Typhi Ty2
uuagaaucucuga

SEQ ID NO: 1787678 - RNA, 15 nt, Salmonella enterica enterica serovar Typhi Ty2
uuacucucauguuca

SEQ ID NO: 1787679 - RNA, 13 nt, Salmonella enterica enterica serovar Typhi Ty2
uuacucucuuucu

SEQ ID NO: 1787680 - RNA, 13 nt, Salmonella enterica enterica serovar Typhi Ty2
uuacuaucuucaa

SEQ ID NO: 1787681 - RNA, 15 nt, Salmonella enterica enterica serovar Typhi Ty2
uuacucuuccugcug

SEQ ID NO: 1787682 - RNA, 19 nt, Salmonella enterica enterica serovar Typhi Ty2
uuacugucgcccgcaacca

SEQ ID NO: 1787683 - RNA, 12 nt, Salmonella enterica enterica serovar Typhi Ty2
uuacucuuccac

SEQ ID NO: 1787684 - RNA, 12 nt, Salmonella enterica enterica serovar Typhi Ty2
uuacugaauaaa

SEQ ID NO: 1787685 - RNA, 12 nt, Salmonella enterica enterica serovar Typhi Ty2
uuacuucaggcu

SEQ ID NO: 1787686 - RNA, 15 nt, Salmonella enterica enterica serovar Typhi Ty2
uuacuucacguaauc

SEQ ID NO: 1787687 - RNA, 16 nt, Salmonella enterica enterica serovar Typhi Ty2
uuacuguuuuaucagg

SEQ ID NO: 1787688 - RNA, 19 nt, Salmonella enterica enterica serovar Typhi Ty2
uuacgaucguuugcccauu

SEQ ID NO: 1787689 - RNA, 20 nt, Salmonella enterica enterica serovar Typhi Ty2
uuacgcacgccagauaaauc

SEQ ID NO: 1787690 - RNA, 18 nt, Salmonella enterica enterica serovar Typhi Ty2
uuacgcagcaagaacaga

SEQ ID NO: 1787691 - RNA, 13 nt, Salmonella enterica enterica serovar Typhi Ty2
uuacgcaggcuug

SEQ ID NO: 1787692 - RNA, 19 nt, Salmonella enterica enterica serovar Typhi Ty2
uuacgcguuacgcccugug

SEQ ID NO: 1787693 - RNA, 11 nt, Salmonella enterica enterica serovar Typhi Ty2
uuacgcugccg

SEQ ID NO: 1787694 - RNA, 14 nt, Salmonella enterica enterica serovar Typhi Ty2
uuacggacugcggc

SEQ ID NO: 1787695 - RNA, 22 nt, Salmonella enterica enterica serovar Typhi Ty2
uuacggaaaaaauacugauaaa

SEQ ID NO: 1787696 - RNA, 19 nt, Salmonella enterica enterica serovar Typhi Ty2
uuacgcugguuugugugca

SEQ ID NO: 1787697 - RNA, 12 nt, Salmonella enterica enterica serovar Typhi Ty2
uuacguaacugc

SEQ ID NO: 1787698 - RNA, 19 nt, Salmonella enterica enterica serovar Typhi Ty2
uuaagcaacguuuccgcua

SEQ ID NO: 1787699 - RNA, 16 nt, Salmonella enterica enterica serovar Typhi Ty2
uuaagcaccgcuuugg

SEQ ID NO: 1787700 - RNA, 21 nt, Salmonella enterica enterica serovar Typhi Ty2
uuaagcauuaccccguggugg

SEQ ID NO: 1787701 - RNA, 23 nt, Salmonella enterica enterica serovar Typhi Ty2
uuaagcaacugauuaaucugccg

SEQ ID NO: 1787702 - RNA, 12 nt, Salmonella enterica enterica serovar Typhi Ty2
uuaagaaaguag

SEQ ID NO: 1787703 - RNA, 21 nt, Salmonella enterica enterica serovar Typhi Ty2
uuaagaacgguuggaauaauu

SEQ ID NO: 1787704 - RNA, 16 nt, Salmonella enterica enterica serovar Typhi Ty2
uuaacggcaaaaacgu

SEQ ID NO: 1787705 - RNA, 22 nt, Salmonella enterica enterica serovar Typhi Ty2
uuaacgcgaauccgccauagcc

SEQ ID NO: 1787706 - RNA, 22 nt, Salmonella enterica enterica serovar Typhi Ty2
uuaacgcgaaauaaucagguga

SEQ ID NO: 1787707 - RNA, 16 nt, Salmonella enterica enterica serovar Typhi Ty2
uuaacgauaauguugg

SEQ ID NO: 1787708 - RNA, 15 nt, Salmonella enterica enterica serovar Typhi Ty2
uuaacgacaaaaaua

SEQ ID NO: 1787709 - RNA, 16 nt, Salmonella enterica enterica serovar Typhi Ty2
uuaacgauuuccccug

SEQ ID NO: 1787710 - RNA, 16 nt, Salmonella enterica enterica serovar Typhi Ty2
uuaacagauaauuaau

SEQ ID NO: 1787711 - RNA, 12 nt, Salmonella enterica enterica serovar Typhi Ty2
uuaacagaauug

SEQ ID NO: 1787712 - RNA, 19 nt, Salmonella enterica enterica serovar Typhi Ty2
uuaacagagagggaaaaaa

SEQ ID NO: 1787713 - RNA, 16 nt, Salmonella enterica enterica serovar Typhi Ty2
uuaacaucaccuuuca

SEQ ID NO: 1787714 - RNA, 15 nt, Salmonella enterica enterica serovar Typhi Ty2
uuaacacccggauau

SEQ ID NO: 1787715 - RNA, 16 nt, Salmonella enterica enterica serovar Typhi Ty2
uuaacaucagaaaaaa

SEQ ID NO: 1787716 - RNA, 14 nt, Salmonella enterica enterica serovar Typhi Ty2
uuaauacccauagu

SEQ ID NO: 1787717 - RNA, 21 nt, Salmonella enterica enterica serovar Typhi Ty2
uuaauaccagcgccaaucacu

SEQ ID NO: 1787718 - RNA, 18 nt, Salmonella enterica enterica serovar Typhi Ty2
uuaauacaucagaaaaca

SEQ ID NO: 1787719 - RNA, 11 nt, Salmonella enterica enterica serovar Typhi Ty2
uuaauacacga

SEQ ID NO: 1787720 - RNA, 21 nt, Salmonella enterica enterica serovar Typhi Ty2
uuaauauaugaaccaagauaa

SEQ ID NO: 1787721 - RNA, 17 nt, Salmonella enterica enterica serovar Typhi Ty2
uuaauacacgauaaacc

SEQ ID NO: 1787722 - RNA, 15 nt, Salmonella enterica enterica serovar Typhi Ty2
uuaauacaucagaaa

SEQ ID NO: 1787723 - RNA, 17 nt, Salmonella enterica enterica serovar Typhi Ty2
uuaaggcggcaaagaua

SEQ ID NO: 1787724 - RNA, 22 nt, Salmonella enterica enterica serovar Typhi Ty2
uuaagccccucgcuaaugcccg

SEQ ID NO: 1787725 - RNA, 15 nt, Salmonella enterica enterica serovar Typhi Ty2
uuaaggauugccgcc

SEQ ID NO: 1787726 - RNA, 21 nt, Salmonella enterica enterica serovar Typhi Ty2
uuaaguuuuacugaugccagc

SEQ ID NO: 1787727 - RNA, 13 nt, Salmonella enterica enterica serovar Typhi Ty2
uuaauaaaaucua

SEQ ID NO: 1787728 - RNA, 23 nt, Salmonella enterica enterica serovar Typhi Ty2
uuaauaaugugccgguaagaaga

SEQ ID NO: 1787729 - RNA, 16 nt, Salmonella enterica enterica serovar Typhi Ty2
uuaaaucagauaacaa

SEQ ID NO: 1787730 - RNA, 17 nt, Salmonella enterica enterica serovar Typhi Ty2
uuaaaucgcgcaaauau

SEQ ID NO: 1787731 - RNA, 18 nt, Salmonella enterica enterica serovar Typhi Ty2
uuaaaucgcgcaaauauu

SEQ ID NO: 1787732 - RNA, 17 nt, Salmonella enterica enterica serovar Typhi Ty2
uuaaaucgcuaagcaga

SEQ ID NO: 1787733 - RNA, 16 nt, Salmonella enterica enterica serovar Typhi Ty2
uuaaaucaucauaauc

SEQ ID NO: 1787734 - RNA, 18 nt, Salmonella enterica enterica serovar Typhi Ty2
uuaaauaacuuuuaauuu

SEQ ID NO: 1787735 - RNA, 13 nt, Salmonella enterica enterica serovar Typhi Ty2
uuaaagccuucau

SEQ ID NO: 1787736 - RNA, 23 nt, Salmonella enterica enterica serovar Typhi Ty2
uuaaagccgaccaucgcgccgcu

SEQ ID NO: 1787737 - RNA, 15 nt, Salmonella enterica enterica serovar Typhi Ty2
uuaaagcacaagaac

SEQ ID NO: 1787738 - RNA, 19 nt, Salmonella enterica enterica serovar Typhi Ty2
uuaaaguacuucacaauca

SEQ ID NO: 1787739 - RNA, 23 nt, Salmonella enterica enterica serovar Typhi Ty2
uuaaauaaauaguaaauagaaaa

SEQ ID NO: 1787740 - RNA, 14 nt, Salmonella enterica enterica serovar Typhi Ty2
uuaaauaaacaaaa

SEQ ID NO: 1787741 - RNA, 20 nt, Salmonella enterica enterica serovar Typhi Ty2
uuaaaugccuguuuauauuc

SEQ ID NO: 1787742 - RNA, 17 nt, Salmonella enterica enterica serovar Typhi Ty2
uuaaauuguuauaccgc

SEQ ID NO: 1787743 - RNA, 23 nt, Salmonella enterica enterica serovar Typhi Ty2
uuaaauguuuuuucaucuccgau

SEQ ID NO: 1787744 - RNA, 19 nt, Salmonella enterica enterica serovar Typhi Ty2
uuaaauuaaugauuaaaau

SEQ ID NO: 1787745 - RNA, 21 nt, Salmonella enterica enterica serovar Typhi Ty2
uuaaauuaaugauuaaaauaa

SEQ ID NO: 1787746 - RNA, 22 nt, Salmonella enterica enterica serovar Typhi Ty2
uuaaauucccagcguacaucuu

SEQ ID NO: 1787747 - RNA, 13 nt, Salmonella enterica enterica serovar Typhi Ty2
ucuauauccugcc

SEQ ID NO: 1787748 - RNA, 19 nt, Salmonella enterica enterica serovar Typhi Ty2
aaaugcauugauaggcugc

SEQ ID NO: 1787749 - RNA, 13 nt, Salmonella enterica enterica serovar Typhi Ty2
ucuaucaccgccu

SEQ ID NO: 1787750 - RNA, 14 nt, Salmonella enterica enterica serovar Typhi Ty2
ucuaucgccagcgc

SEQ ID NO: 1787751 - RNA, 15 nt, Salmonella enterica enterica serovar Typhi Ty2
ucuaucgcuccuccc

SEQ ID NO: 1787752 - RNA, 14 nt, Salmonella enterica enterica serovar Typhi Ty2
ucuaucgccuggag

SEQ ID NO: 1787753 - RNA, 16 nt, Salmonella enterica enterica serovar Typhi Ty2
ucuaucgccuggagcu

SEQ ID NO: 1787754 - RNA, 19 nt, Salmonella enterica enterica serovar Typhi Ty2
aaaugaugacucauuaaaa

SEQ ID NO: 1787755 - RNA, 12 nt, Salmonella enterica enterica serovar Typhi Ty2
aaaugaucguuu

SEQ ID NO: 1787756 - RNA, 13 nt, Salmonella enterica enterica serovar Typhi Ty2
aaaugaucacuuc

SEQ ID NO: 1787757 - RNA, 15 nt, Salmonella enterica enterica serovar Typhi Ty2
aaaugaucacuuccg

SEQ ID NO: 1787758 - RNA, 12 nt, Salmonella enterica enterica serovar Typhi Ty2
aaaugauauuua

SEQ ID NO: 1787759 - RNA, 10 nt, Salmonella enterica enterica serovar Typhi Ty2
aaaugauaag

SEQ ID NO: 1787760 - RNA, 13 nt, Salmonella enterica enterica serovar Typhi Ty2
ucuaggcgcugcu

SEQ ID NO: 1787761 - RNA, 18 nt, Salmonella enterica enterica serovar Typhi Ty2
ucuaggcgcugcuggcag

SEQ ID NO: 1787762 - RNA, 22 nt, Salmonella enterica enterica serovar Typhi Ty2
ucucauaaaacauuccugacau

SEQ ID NO: 1787763 - RNA, 16 nt, Salmonella enterica enterica serovar Typhi Ty2
ucucagguucgaaucc

SEQ ID NO: 1787764 - RNA, 19 nt, Salmonella enterica enterica serovar Typhi Ty2
ucucauccagcuugccguc

SEQ ID NO: 1787765 - RNA, 12 nt, Salmonella enterica enterica serovar Typhi Ty2
ucucaucaaaaa

SEQ ID NO: 1787766 - RNA, 15 nt, Salmonella enterica enterica serovar Typhi Ty2
ucucaucgacgauaa

SEQ ID NO: 1787767 - RNA, 22 nt, Salmonella enterica enterica serovar Typhi Ty2
ucucaucugcaaaauauauaau

SEQ ID NO: 1787768 - RNA, 21 nt, Salmonella enterica enterica serovar Typhi Ty2
ucucagauggaaaaaaagaau

SEQ ID NO: 1787769 - RNA, 18 nt, Salmonella enterica enterica serovar Typhi Ty2
ucucagauggaaaaaaag

SEQ ID NO: 1787770 - RNA, 14 nt, Salmonella enterica enterica serovar Typhi Ty2
ucucagauaauagc

SEQ ID NO: 1787771 - RNA, 17 nt, Salmonella enterica enterica serovar Typhi Ty2
ucucacagaaucaucag

SEQ ID NO: 1787772 - RNA, 19 nt, Salmonella enterica enterica serovar Typhi Ty2
aaaugcccauaaagaaaua

SEQ ID NO: 1787773 - RNA, 20 nt, Salmonella enterica enterica serovar Typhi Ty2
aaaugcccauaaagaaauau

SEQ ID NO: 1787774 - RNA, 18 nt, Salmonella enterica enterica serovar Typhi Ty2
aaaugcgacaucucaggc

SEQ ID NO: 1787775 - RNA, 18 nt, Salmonella enterica enterica serovar Typhi Ty2
ucucacccguuuucuccu

SEQ ID NO: 1787776 - RNA, 17 nt, Salmonella enterica enterica serovar Typhi Ty2
aaaugcgcaaagcauaa

SEQ ID NO: 1787777 - RNA, 11 nt, Salmonella enterica enterica serovar Typhi Ty2
aaaugcgcaug

SEQ ID NO: 1787778 - RNA, 16 nt, Salmonella enterica enterica serovar Typhi Ty2
aaaugcgaugaacauc

SEQ ID NO: 1787779 - RNA, 17 nt, Salmonella enterica enterica serovar Typhi Ty2
aaaugcggguccugauc

SEQ ID NO: 1787780 - RNA, 16 nt, Salmonella enterica enterica serovar Typhi Ty2
ucuauuaaaucagaua

SEQ ID NO: 1787781 - RNA, 16 nt, Salmonella enterica enterica serovar Typhi Ty2
ucuauugccuaaauaa

SEQ ID NO: 1787782 - RNA, 18 nt, Salmonella enterica enterica serovar Typhi Ty2
ucuauugccuaaauaacu

SEQ ID NO: 1787783 - RNA, 15 nt, Salmonella enterica enterica serovar Typhi Ty2
ucuauuucauaauaa

SEQ ID NO: 1787784 - RNA, 16 nt, Salmonella enterica enterica serovar Typhi Ty2
ucucaaaggccugcau

SEQ ID NO: 1787785 - RNA, 17 nt, Salmonella enterica enterica serovar Typhi Ty2
ucucaaacacuucuaaa

SEQ ID NO: 1787786 - RNA, 15 nt, Salmonella enterica enterica serovar Typhi Ty2
ucucaaacacuucua

SEQ ID NO: 1787787 - RNA, 16 nt, Salmonella enterica enterica serovar Typhi Ty2
ucucaauaaaaugucu

SEQ ID NO: 1787788 - RNA, 21 nt, Salmonella enterica enterica serovar Typhi Ty2
ucuacauuuucguaaaauaua

SEQ ID NO: 1787789 - RNA, 12 nt, Salmonella enterica enterica serovar Typhi Ty2
aaaugagaacac

SEQ ID NO: 1787790 - RNA, 16 nt, Salmonella enterica enterica serovar Typhi Ty2
ucuacugguuaaggau

SEQ ID NO: 1787791 - RNA, 20 nt, Salmonella enterica enterica serovar Typhi Ty2
ucuacuuuccugaagguaga

SEQ ID NO: 1787792 - RNA, 15 nt, Salmonella enterica enterica serovar Typhi Ty2
ucuacuuuccugaag

SEQ ID NO: 1787793 - RNA, 16 nt, Salmonella enterica enterica serovar Typhi Ty2
ucuacggccacaaaac

SEQ ID NO: 1787794 - RNA, 14 nt, Salmonella enterica enterica serovar Typhi Ty2
ucuacggaucccuu

SEQ ID NO: 1787795 - RNA, 16 nt, Salmonella enterica enterica serovar Typhi Ty2
ucuacuaacuggcaau

SEQ ID NO: 1787796 - RNA, 14 nt, Salmonella enterica enterica serovar Typhi Ty2
ucuacuacaacugu

SEQ ID NO: 1787797 - RNA, 19 nt, Salmonella enterica enterica serovar Typhi Ty2
ucuacgcugccauccucau

SEQ ID NO: 1787798 - RNA, 18 nt, Salmonella enterica enterica serovar Typhi Ty2
ucuaccuggaaccaggcg

SEQ ID NO: 1787799 - RNA, 20 nt, Salmonella enterica enterica serovar Typhi Ty2
ucuaccaacugagcuaacga

SEQ ID NO: 1787800 - RNA, 19 nt, Salmonella enterica enterica serovar Typhi Ty2
ucuaccauugauaccaaua

SEQ ID NO: 1787801 - RNA, 16 nt, Salmonella enterica enterica serovar Typhi Ty2
aaaugacgccggguaa

SEQ ID NO: 1787802 - RNA, 23 nt, Salmonella enterica enterica serovar Typhi Ty2
ucuaacgcaacggaaggaaauaa

SEQ ID NO: 1787803 - RNA, 21 nt, Salmonella enterica enterica serovar Typhi Ty2
ucuaacgcaacggaaggaaau

SEQ ID NO: 1787804 - RNA, 13 nt, Salmonella enterica enterica serovar Typhi Ty2
aaaucuucauuuc

SEQ ID NO: 1787805 - RNA, 23 nt, Salmonella enterica enterica serovar Typhi Ty2
aaaucuucuacuucaauuuucca

SEQ ID NO: 1787806 - RNA, 21 nt, Salmonella enterica enterica serovar Typhi Ty2
aaaugaaaaacgguauuucca

SEQ ID NO: 1787807 - RNA, 17 nt, Salmonella enterica enterica serovar Typhi Ty2
aaaucuuuuucgcugua

SEQ ID NO: 1787808 - RNA, 14 nt, Salmonella enterica enterica serovar Typhi Ty2
aaaugaaaaagaua

SEQ ID NO: 1787809 - RNA, 22 nt, Salmonella enterica enterica serovar Typhi Ty2
aaaugaaaugcccauaaagaaa

SEQ ID NO: 1787810 - RNA, 18 nt, Salmonella enterica enterica serovar Typhi Ty2
aaaugaaaugcccauaaa

SEQ ID NO: 1787811 - RNA, 23 nt, Salmonella enterica enterica serovar Typhi Ty2
ucuaaaucuacccaauugaauuu

SEQ ID NO: 1787812 - RNA, 20 nt, Salmonella enterica enterica serovar Typhi Ty2
ucuaaaugggcaggagauga

SEQ ID NO: 1787813 - RNA, 15 nt, Salmonella enterica enterica serovar Typhi Ty2
ucuaacauaaugaau

SEQ ID NO: 1787814 - RNA, 17 nt, Salmonella enterica enterica serovar Typhi Ty2
ucguuuuuguuuaaaaa

SEQ ID NO: 1787815 - RNA, 17 nt, Salmonella enterica enterica serovar Typhi Ty2
ucguuuuugucuccuca

SEQ ID NO: 1787816 - RNA, 17 nt, Salmonella enterica enterica serovar Typhi Ty2
ucguuugcaguuccgca

SEQ ID NO: 1787817 - RNA, 12 nt, Salmonella enterica enterica serovar Typhi Ty2
ucuaaaaaggaa

SEQ ID NO: 1787818 - RNA, 11 nt, Salmonella enterica enterica serovar Typhi Ty2
ucuaaaaagga

SEQ ID NO: 1787819 - RNA, 12 nt, Salmonella enterica enterica serovar Typhi Ty2
ucuggugcagca

SEQ ID NO: 1787820 - RNA, 15 nt, Salmonella enterica enterica serovar Typhi Ty2
ucuggcacagggcaa

SEQ ID NO: 1787821 - RNA, 22 nt, Salmonella enterica enterica serovar Typhi Ty2
ucuggaugcguucaaagaucuc

SEQ ID NO: 1787822 - RNA, 17 nt, Salmonella enterica enterica serovar Typhi Ty2
ucuggauuacaaaaaua

SEQ ID NO: 1787823 - RNA, 13 nt, Salmonella enterica enterica serovar Typhi Ty2
ucuggcucccgca

SEQ ID NO: 1787824 - RNA, 20 nt, Salmonella enterica enterica serovar Typhi Ty2
ucugcuuaugaucgcccagc

SEQ ID NO: 1787825 - RNA, 14 nt, Salmonella enterica enterica serovar Typhi Ty2
ucugcuuccagaau

SEQ ID NO: 1787826 - RNA, 18 nt, Salmonella enterica enterica serovar Typhi Ty2
ucugcuugagcaggcaga

SEQ ID NO: 1787827 - RNA, 18 nt, Salmonella enterica enterica serovar Typhi Ty2
ucugcuuguucuuuucaa

SEQ ID NO: 1787828 - RNA, 15 nt, Salmonella enterica enterica serovar Typhi Ty2
ucuguguugaauaaa

SEQ ID NO: 1787829 - RNA, 14 nt, Salmonella enterica enterica serovar Typhi Ty2
ucugucugacgacc

SEQ ID NO: 1787830 - RNA, 19 nt, Salmonella enterica enterica serovar Typhi Ty2
ucuguccgaugagaaguag

SEQ ID NO: 1787831 - RNA, 22 nt, Salmonella enterica enterica serovar Typhi Ty2
ucugguuguuucgguuuccguu

SEQ ID NO: 1787832 - RNA, 13 nt, Salmonella enterica enterica serovar Typhi Ty2
ucuguaggccgga

SEQ ID NO: 1787833 - RNA, 13 nt, Salmonella enterica enterica serovar Typhi Ty2
ucuguauaaaaua

SEQ ID NO: 1787834 - RNA, 15 nt, Salmonella enterica enterica serovar Typhi Ty2
ucuguaauuauaaau

SEQ ID NO: 1787835 - RNA, 17 nt, Salmonella enterica enterica serovar Typhi Ty2
ucuuccacuucagcagc

SEQ ID NO: 1787836 - RNA, 18 nt, Salmonella enterica enterica serovar Typhi Ty2
ucuuccacgccgucgaug

SEQ ID NO: 1787837 - RNA, 20 nt, Salmonella enterica enterica serovar Typhi Ty2
ucuuccaaccgugucugcug

SEQ ID NO: 1787838 - RNA, 22 nt, Salmonella enterica enterica serovar Typhi Ty2
ucuucaccuuuccagucaacga

SEQ ID NO: 1787839 - RNA, 22 nt, Salmonella enterica enterica serovar Typhi Ty2
ucuucacgcagucguuccagac

SEQ ID NO: 1787840 - RNA, 23 nt, Salmonella enterica enterica serovar Typhi Ty2
ucuucacgccgugaauuucugcu

SEQ ID NO: 1787841 - RNA, 15 nt, Salmonella enterica enterica serovar Typhi Ty2
ucuucacuaaaaaca

SEQ ID NO: 1787842 - RNA, 18 nt, Salmonella enterica enterica serovar Typhi Ty2
ucuucggcaaaauauuca

SEQ ID NO: 1787843 - RNA, 11 nt, Salmonella enterica enterica serovar Typhi Ty2
ucuuccucaca

SEQ ID NO: 1787844 - RNA, 14 nt, Salmonella enterica enterica serovar Typhi Ty2
ucuuccgucaaaaa

SEQ ID NO: 1787845 - RNA, 18 nt, Salmonella enterica enterica serovar Typhi Ty2
ucuuccggcauaaaaagc

SEQ ID NO: 1787846 - RNA, 18 nt, Salmonella enterica enterica serovar Typhi Ty2
ucuuccauugcuuuuuug

SEQ ID NO: 1787847 - RNA, 14 nt, Salmonella enterica enterica serovar Typhi Ty2
ucuuccaucagcca

SEQ ID NO: 1787848 - RNA, 19 nt, Salmonella enterica enterica serovar Typhi Ty2
ucuuccagcgucuccagac

SEQ ID NO: 1787849 - RNA, 15 nt, Salmonella enterica enterica serovar Typhi Ty2
ucuguucaacuuuuc

SEQ ID NO: 1787850 - RNA, 22 nt, Salmonella enterica enterica serovar Typhi Ty2
ucugugucguccaggccugaua

SEQ ID NO: 1787851 - RNA, 22 nt, Salmonella enterica enterica serovar Typhi Ty2
ucuguuaaaaaauuuauaacgu

SEQ ID NO: 1787852 - RNA, 22 nt, Salmonella enterica enterica serovar Typhi Ty2
ucuguuucaguucggagaucag

SEQ ID NO: 1787853 - RNA, 23 nt, Salmonella enterica enterica serovar Typhi Ty2
ucuuaccgcuaaaauacccgacc

SEQ ID NO: 1787854 - RNA, 21 nt, Salmonella enterica enterica serovar Typhi Ty2
ucuuaccaggucuuaccuauu

SEQ ID NO: 1787855 - RNA, 16 nt, Salmonella enterica enterica serovar Typhi Ty2
ucuuacagggcgaugc

SEQ ID NO: 1787856 - RNA, 14 nt, Salmonella enterica enterica serovar Typhi Ty2
ucuuaguaacauaa

SEQ ID NO: 1787857 - RNA, 23 nt, Salmonella enterica enterica serovar Typhi Ty2
ucuuacuaauaaauauucaucaa

SEQ ID NO: 1787858 - RNA, 16 nt, Salmonella enterica enterica serovar Typhi Ty2
ucuuacgagaggcuuu

SEQ ID NO: 1787859 - RNA, 16 nt, Salmonella enterica enterica serovar Typhi Ty2
ucuuacggauaaaaac

SEQ ID NO: 1787860 - RNA, 13 nt, Salmonella enterica enterica serovar Typhi Ty2
ucuucaacgugca

SEQ ID NO: 1787861 - RNA, 16 nt, Salmonella enterica enterica serovar Typhi Ty2
ucuuaucgugcgcgua

SEQ ID NO: 1787862 - RNA, 17 nt, Salmonella enterica enterica serovar Typhi Ty2
ucuuauccggccuaccu

SEQ ID NO: 1787863 - RNA, 15 nt, Salmonella enterica enterica serovar Typhi Ty2
ucugaguauguuagg

SEQ ID NO: 1787864 - RNA, 24 nt, Salmonella enterica enterica serovar Typhi Ty2
ucugauaacgcaggcgauagcccc

SEQ ID NO: 1787865 - RNA, 22 nt, Salmonella enterica enterica serovar Typhi Ty2
ucugcaaugguaaaacgcuggc

SEQ ID NO: 1787866 - RNA, 20 nt, Salmonella enterica enterica serovar Typhi Ty2
ucugcacaacauuccgcuuc

SEQ ID NO: 1787867 - RNA, 13 nt, Salmonella enterica enterica serovar Typhi Ty2
ucugaaacgcuuc

SEQ ID NO: 1787868 - RNA, 14 nt, Salmonella enterica enterica serovar Typhi Ty2
ucugaaaagaguag

SEQ ID NO: 1787869 - RNA, 14 nt, Salmonella enterica enterica serovar Typhi Ty2
ucucuuuagcgcua

SEQ ID NO: 1787870 - RNA, 15 nt, Salmonella enterica enterica serovar Typhi Ty2
ucucuugugcuucca

SEQ ID NO: 1787871 - RNA, 20 nt, Salmonella enterica enterica serovar Typhi Ty2
ucucuugugcuuccagcucc

SEQ ID NO: 1787872 - RNA, 19 nt, Salmonella enterica enterica serovar Typhi Ty2
ucugaaaaggggauaacaa

SEQ ID NO: 1787873 - RNA, 14 nt, Salmonella enterica enterica serovar Typhi Ty2
ucucuuucaccagc

SEQ ID NO: 1787874 - RNA, 23 nt, Salmonella enterica enterica serovar Typhi Ty2
ucugaaaguaagcuauuccugua

SEQ ID NO: 1787875 - RNA, 22 nt, Salmonella enterica enterica serovar Typhi Ty2
ucugaaaguaagcuauuccugu

SEQ ID NO: 1787876 - RNA, 17 nt, Salmonella enterica enterica serovar Typhi Ty2
ucugacaggucggcguu

SEQ ID NO: 1787877 - RNA, 13 nt, Salmonella enterica enterica serovar Typhi Ty2
ucugacagccaaa

SEQ ID NO: 1787878 - RNA, 11 nt, Salmonella enterica enterica serovar Typhi Ty2
ucugaccaguu

SEQ ID NO: 1787879 - RNA, 16 nt, Salmonella enterica enterica serovar Typhi Ty2
ucugagcgcaaacauc

SEQ ID NO: 1787880 - RNA, 20 nt, Salmonella enterica enterica serovar Typhi Ty2
ucucuugcagacagcgccug

SEQ ID NO: 1787881 - RNA, 13 nt, Salmonella enterica enterica serovar Typhi Ty2
ucucuucuaucug

SEQ ID NO: 1787882 - RNA, 17 nt, Salmonella enterica enterica serovar Typhi Ty2
aaauggagcgagcuggu

SEQ ID NO: 1787883 - RNA, 21 nt, Salmonella enterica enterica serovar Typhi Ty2
ucucuucguguaacgcauaca

SEQ ID NO: 1787884 - RNA, 15 nt, Salmonella enterica enterica serovar Typhi Ty2
ucucugagaucaaac

SEQ ID NO: 1787885 - RNA, 15 nt, Salmonella enterica enterica serovar Typhi Ty2
ucucugccaucaucc

SEQ ID NO: 1787886 - RNA, 20 nt, Salmonella enterica enterica serovar Typhi Ty2
ucucuggcgcgggcuucacg

SEQ ID NO: 1787887 - RNA, 17 nt, Salmonella enterica enterica serovar Typhi Ty2
ucucucccaggcauccu

SEQ ID NO: 1787888 - RNA, 20 nt, Salmonella enterica enterica serovar Typhi Ty2
ucucucucguucccgccugc

SEQ ID NO: 1787889 - RNA, 12 nt, Salmonella enterica enterica serovar Typhi Ty2
ucucuauugauu

SEQ ID NO: 1787890 - RNA, 21 nt, Salmonella enterica enterica serovar Typhi Ty2
ucuccuguaaugaggcaaauc

SEQ ID NO: 1787891 - RNA, 21 nt, Salmonella enterica enterica serovar Typhi Ty2
ucuccugcgauagcugcugac

SEQ ID NO: 1787892 - RNA, 20 nt, Salmonella enterica enterica serovar Typhi Ty2
ucuccugaagccagugcccg

SEQ ID NO: 1787893 - RNA, 15 nt, Salmonella enterica enterica serovar Typhi Ty2
ucuccugcgccagcc

SEQ ID NO: 1787894 - RNA, 17 nt, Salmonella enterica enterica serovar Typhi Ty2
ucuccugaacgcccggc

SEQ ID NO: 1787895 - RNA, 18 nt, Salmonella enterica enterica serovar Typhi Ty2
ucuccugaagccagugcc

SEQ ID NO: 1787896 - RNA, 17 nt, Salmonella enterica enterica serovar Typhi Ty2
ucuccucuucaguaagc

SEQ ID NO: 1787897 - RNA, 19 nt, Salmonella enterica enterica serovar Typhi Ty2
ucuccgggaaaaacguguc

SEQ ID NO: 1787898 - RNA, 21 nt, Salmonella enterica enterica serovar Typhi Ty2
ucuccggcacauucaccacgc

SEQ ID NO: 1787899 - RNA, 19 nt, Salmonella enterica enterica serovar Typhi Ty2
ucuccggcagcgaauguau

SEQ ID NO: 1787900 - RNA, 13 nt, Salmonella enterica enterica serovar Typhi Ty2
ucucgcacaucau

SEQ ID NO: 1787901 - RNA, 14 nt, Salmonella enterica enterica serovar Typhi Ty2
ucucgcucuuccag

SEQ ID NO: 1787902 - RNA, 20 nt, Salmonella enterica enterica serovar Typhi Ty2
ucucccguuuguauaaauua

SEQ ID NO: 1787903 - RNA, 13 nt, Salmonella enterica enterica serovar Typhi Ty2
ucucccuggcagu

SEQ ID NO: 1787904 - RNA, 15 nt, Salmonella enterica enterica serovar Typhi Ty2
ucuccgccgccuggc

SEQ ID NO: 1787905 - RNA, 14 nt, Salmonella enterica enterica serovar Typhi Ty2
ucucccaucaauaa

SEQ ID NO: 1787906 - RNA, 15 nt, Salmonella enterica enterica serovar Typhi Ty2
ucucccaaaugaaaa

SEQ ID NO: 1787907 - RNA, 20 nt, Salmonella enterica enterica serovar Typhi Ty2
ucuccaucgggcucggcgcu

SEQ ID NO: 1787908 - RNA, 19 nt, Salmonella enterica enterica serovar Typhi Ty2
ucucauuuucuuuacgcua

SEQ ID NO: 1787909 - RNA, 18 nt, Salmonella enterica enterica serovar Typhi Ty2
ucucauuguguacaucca

SEQ ID NO: 1787910 - RNA, 15 nt, Salmonella enterica enterica serovar Typhi Ty2
ucucauugaucaguu

SEQ ID NO: 1787911 - RNA, 19 nt, Salmonella enterica enterica serovar Typhi Ty2
ucuccagaucgcauaaaau

SEQ ID NO: 1787912 - RNA, 13 nt, Salmonella enterica enterica serovar Typhi Ty2
ucguuucuacaau

SEQ ID NO: 1787913 - RNA, 15 nt, Salmonella enterica enterica serovar Typhi Ty2
ucguuugcaguuccg

SEQ ID NO: 1787914 - RNA, 21 nt, Salmonella enterica enterica serovar Typhi Ty2
ucguuggcgccaaaaccgcuc

SEQ ID NO: 1787915 - RNA, 21 nt, Salmonella enterica enterica serovar Typhi Ty2
ucguuggcauggucagcauaa

SEQ ID NO: 1787916 - RNA, 14 nt, Salmonella enterica enterica serovar Typhi Ty2
ucguugccauuggu

SEQ ID NO: 1787917 - RNA, 15 nt, Salmonella enterica enterica serovar Typhi Ty2
ucguugccagcggcc

SEQ ID NO: 1787918 - RNA, 17 nt, Salmonella enterica enterica serovar Typhi Ty2
ucguugacuucaaucac

SEQ ID NO: 1787919 - RNA, 16 nt, Salmonella enterica enterica serovar Typhi Ty2
ucguucccgccugcug

SEQ ID NO: 1787920 - RNA, 17 nt, Salmonella enterica enterica serovar Typhi Ty2
ucguucccguuuauguu

SEQ ID NO: 1787921 - RNA, 17 nt, Salmonella enterica enterica serovar Typhi Ty2
ucguuccgguucuuccc

SEQ ID NO: 1787922 - RNA, 20 nt, Salmonella enterica enterica serovar Typhi Ty2
ucguuauuuccgagaucgcc

SEQ ID NO: 1787923 - RNA, 16 nt, Salmonella enterica enterica serovar Typhi Ty2
ucguuaaccagcggcg

SEQ ID NO: 1787924 - RNA, 22 nt, Salmonella enterica enterica serovar Typhi Ty2
ucguuaaucucaaacuuggcca

SEQ ID NO: 1787925 - RNA, 16 nt, Salmonella enterica enterica serovar Typhi Ty2
ucguuagcaaauugcu

SEQ ID NO: 1787926 - RNA, 23 nt, Salmonella enterica enterica serovar Typhi Ty2
ucguuagugauacgcggcugaug

SEQ ID NO: 1787927 - RNA, 11 nt, Salmonella enterica enterica serovar Typhi Ty2
ucguuaucauu

SEQ ID NO: 1787928 - RNA, 16 nt, Salmonella enterica enterica serovar Typhi Ty2
ucguggcgcuguucuu

SEQ ID NO: 1787929 - RNA, 19 nt, Salmonella enterica enterica serovar Typhi Ty2
ucguguuauuuucaaaaac

SEQ ID NO: 1787930 - RNA, 20 nt, Salmonella enterica enterica serovar Typhi Ty2
ucguguggcggaaugaccug

SEQ ID NO: 1787931 - RNA, 16 nt, Salmonella enterica enterica serovar Typhi Ty2
ucguggguucgaaucc

SEQ ID NO: 1787932 - RNA, 15 nt, Salmonella enterica enterica serovar Typhi Ty2
ucgugcagcgccgcc

SEQ ID NO: 1787933 - RNA, 23 nt, Salmonella enterica enterica serovar Typhi Ty2
ucgugcaucaggaaauccuggau

SEQ ID NO: 1787934 - RNA, 23 nt, Salmonella enterica enterica serovar Typhi Ty2
ucgugcauccggacgccagugcg

SEQ ID NO: 1787935 - RNA, 14 nt, Salmonella enterica enterica serovar Typhi Ty2
ucgugcgccccagg

SEQ ID NO: 1787936 - RNA, 19 nt, Salmonella enterica enterica serovar Typhi Ty2
ucgugccagugaugcgcgg

SEQ ID NO: 1787937 - RNA, 13 nt, Salmonella enterica enterica serovar Typhi Ty2
ucgugaggaaaaa

SEQ ID NO: 1787938 - RNA, 17 nt, Salmonella enterica enterica serovar Typhi Ty2
ucgugaggauaauccau

SEQ ID NO: 1787939 - RNA, 12 nt, Salmonella enterica enterica serovar Typhi Ty2
ucgugacccgcc

SEQ ID NO: 1787940 - RNA, 23 nt, Salmonella enterica enterica serovar Typhi Ty2
ucgugacaucaagcccacacauc

SEQ ID NO: 1787941 - RNA, 16 nt, Salmonella enterica enterica serovar Typhi Ty2
ucgucugacgcuugca

SEQ ID NO: 1787942 - RNA, 22 nt, Salmonella enterica enterica serovar Typhi Ty2
ucgucuguuauuugugauuuuc

SEQ ID NO: 1787943 - RNA, 15 nt, Salmonella enterica enterica serovar Typhi Ty2
ucguagccgcgcgcc

SEQ ID NO: 1787944 - RNA, 21 nt, Salmonella enterica enterica serovar Typhi Ty2
ucguauccccagucuuccugc

SEQ ID NO: 1787945 - RNA, 13 nt, Salmonella enterica enterica serovar Typhi Ty2
ucguauccccagu

SEQ ID NO: 1787946 - RNA, 15 nt, Salmonella enterica enterica serovar Typhi Ty2
ucguauuuauuuucu

SEQ ID NO: 1787947 - RNA, 13 nt, Salmonella enterica enterica serovar Typhi Ty2
ucgucacagaccc

SEQ ID NO: 1787948 - RNA, 19 nt, Salmonella enterica enterica serovar Typhi Ty2
ucgucaccugauagcgggu

SEQ ID NO: 1787949 - RNA, 12 nt, Salmonella enterica enterica serovar Typhi Ty2
ucgucaccagca

SEQ ID NO: 1787950 - RNA, 21 nt, Salmonella enterica enterica serovar Typhi Ty2
ucgucaaacaguucagacacc

SEQ ID NO: 1787951 - RNA, 17 nt, Salmonella enterica enterica serovar Typhi Ty2
ucguaaaucaaaugaga

SEQ ID NO: 1787952 - RNA, 22 nt, Salmonella enterica enterica serovar Typhi Ty2
ucguaagccgcauuacaaacag

SEQ ID NO: 1787953 - RNA, 16 nt, Salmonella enterica enterica serovar Typhi Ty2
ucguaaucuaaaauua

SEQ ID NO: 1787954 - RNA, 18 nt, Salmonella enterica enterica serovar Typhi Ty2
ucguaaugagcacuuucc

SEQ ID NO: 1787955 - RNA, 15 nt, Salmonella enterica enterica serovar Typhi Ty2
ucguagacucaggcg

SEQ ID NO: 1787956 - RNA, 14 nt, Salmonella enterica enterica serovar Typhi Ty2
ucguagaacaccac

SEQ ID NO: 1787957 - RNA, 16 nt, Salmonella enterica enterica serovar Typhi Ty2
ucguacauguccagau

SEQ ID NO: 1787958 - RNA, 21 nt, Salmonella enterica enterica serovar Typhi Ty2
ucguacacgcgcccgccgcca

SEQ ID NO: 1787959 - RNA, 14 nt, Salmonella enterica enterica serovar Typhi Ty2
ucguacguuuuucc

SEQ ID NO: 1787960 - RNA, 23 nt, Salmonella enterica enterica serovar Typhi Ty2
ucgucgccaccaugcugguuggg

SEQ ID NO: 1787961 - RNA, 18 nt, Salmonella enterica enterica serovar Typhi Ty2
ucgucgccaaucagcagc

SEQ ID NO: 1787962 - RNA, 12 nt, Salmonella enterica enterica serovar Typhi Ty2
ucguccggugau

SEQ ID NO: 1787963 - RNA, 23 nt, Salmonella enterica enterica serovar Typhi Ty2
ucgucauagugagcgacuucaaa

SEQ ID NO: 1787964 - RNA, 21 nt, Salmonella enterica enterica serovar Typhi Ty2
ucgucauagcguugauaugcu

SEQ ID NO: 1787965 - RNA, 12 nt, Salmonella enterica enterica serovar Typhi Ty2
ucgucaguucca

SEQ ID NO: 1787966 - RNA, 15 nt, Salmonella enterica enterica serovar Typhi Ty2
ucgucauuaaugccu

SEQ ID NO: 1787967 - RNA, 21 nt, Salmonella enterica enterica serovar Typhi Ty2
ucgucagaugcguuuucugca

SEQ ID NO: 1787968 - RNA, 21 nt, Salmonella enterica enterica serovar Typhi Ty2
ucgucaggccgccgcaaaagc

SEQ ID NO: 1787969 - RNA, 21 nt, Salmonella enterica enterica serovar Typhi Ty2
ucgucagacggacaucagagg

SEQ ID NO: 1787970 - RNA, 19 nt, Salmonella enterica enterica serovar Typhi Ty2
ucgucaccggaucgcugag

SEQ ID NO: 1787971 - RNA, 15 nt, Salmonella enterica enterica serovar Typhi Ty2
ucguccaguaaaauc

SEQ ID NO: 1787972 - RNA, 13 nt, Salmonella enterica enterica serovar Typhi Ty2
ucggcgcgcuggc

SEQ ID NO: 1787973 - RNA, 14 nt, Salmonella enterica enterica serovar Typhi Ty2
ucggcgccggcguc

SEQ ID NO: 1787974 - RNA, 17 nt, Salmonella enterica enterica serovar Typhi Ty2
ucggcgugaauaaaaua

SEQ ID NO: 1787975 - RNA, 20 nt, Salmonella enterica enterica serovar Typhi Ty2
ucggcgucaacguuuuucag

SEQ ID NO: 1787976 - RNA, 13 nt, Salmonella enterica enterica serovar Typhi Ty2
ucggcgucuggag

SEQ ID NO: 1787977 - RNA, 19 nt, Salmonella enterica enterica serovar Typhi Ty2
ucggcguaacccagugcaa

SEQ ID NO: 1787978 - RNA, 21 nt, Salmonella enterica enterica serovar Typhi Ty2
ucggcuuuuuuuuaugccucu

SEQ ID NO: 1787979 - RNA, 14 nt, Salmonella enterica enterica serovar Typhi Ty2
ucggcuuucaccuu

SEQ ID NO: 1787980 - RNA, 19 nt, Salmonella enterica enterica serovar Typhi Ty2
ucgggagcagugauuaugc

SEQ ID NO: 1787981 - RNA, 12 nt, Salmonella enterica enterica serovar Typhi Ty2
ucggcuggcagc

SEQ ID NO: 1787982 - RNA, 18 nt, Salmonella enterica enterica serovar Typhi Ty2
ucggcuccaauauuucag

SEQ ID NO: 1787983 - RNA, 17 nt, Salmonella enterica enterica serovar Typhi Ty2
ucggccagcaagcggcg

SEQ ID NO: 1787984 - RNA, 14 nt, Salmonella enterica enterica serovar Typhi Ty2
ucggccauuuuuuu

SEQ ID NO: 1787985 - RNA, 18 nt, Salmonella enterica enterica serovar Typhi Ty2
ucggcgauugucaucauu

SEQ ID NO: 1787986 - RNA, 17 nt, Salmonella enterica enterica serovar Typhi Ty2
ucggcgccagccacaag

SEQ ID NO: 1787987 - RNA, 23 nt, Salmonella enterica enterica serovar Typhi Ty2
ucggccugaccauggaguuucag

SEQ ID NO: 1787988 - RNA, 14 nt, Salmonella enterica enterica serovar Typhi Ty2
ucggugauccagca

SEQ ID NO: 1787989 - RNA, 13 nt, Salmonella enterica enterica serovar Typhi Ty2
ucggugcccggcu

SEQ ID NO: 1787990 - RNA, 23 nt, Salmonella enterica enterica serovar Typhi Ty2
ucggugcgguuacguccggcauu

SEQ ID NO: 1787991 - RNA, 16 nt, Salmonella enterica enterica serovar Typhi Ty2
ucggucaacauuccgu

SEQ ID NO: 1787992 - RNA, 17 nt, Salmonella enterica enterica serovar Typhi Ty2
ucggucgagcuuuugcu

SEQ ID NO: 1787993 - RNA, 20 nt, Salmonella enterica enterica serovar Typhi Ty2
ucguaaacacgacgccgccg

SEQ ID NO: 1787994 - RNA, 16 nt, Salmonella enterica enterica serovar Typhi Ty2
ucgguuuguaagugcc

SEQ ID NO: 1787995 - RNA, 21 nt, Salmonella enterica enterica serovar Typhi Ty2
ucgguuuauccccgcuggcgc

SEQ ID NO: 1787996 - RNA, 15 nt, Salmonella enterica enterica serovar Typhi Ty2
ucgguggauaaauuu

SEQ ID NO: 1787997 - RNA, 18 nt, Salmonella enterica enterica serovar Typhi Ty2
ucgguggaaaccgcagaa

SEQ ID NO: 1787998 - RNA, 22 nt, Salmonella enterica enterica serovar Typhi Ty2
ucggugguuuuaacccccagca

SEQ ID NO: 1787999 - RNA, 23 nt, Salmonella enterica enterica serovar Typhi Ty2
ucgguguucacaauuguggucgu

SEQ ID NO: 1788000 - RNA, 21 nt, Salmonella enterica enterica serovar Typhi Ty2
ucgguuauucggucagauaaa

SEQ ID NO: 1788001 - RNA, 23 nt, Salmonella enterica enterica serovar Typhi Ty2
ucgguacuucacaauaagaaauu

SEQ ID NO: 1788002 - RNA, 15 nt, Salmonella enterica enterica serovar Typhi Ty2
ucgguacuccccuuu

SEQ ID NO: 1788003 - RNA, 22 nt, Salmonella enterica enterica serovar Typhi Ty2
ucgguauaugaaucaucagaau

SEQ ID NO: 1788004 - RNA, 16 nt, Salmonella enterica enterica serovar Typhi Ty2
ucgguaugccuuccag

SEQ ID NO: 1788005 - RNA, 13 nt, Salmonella enterica enterica serovar Typhi Ty2
ucggguuuuccug

SEQ ID NO: 1788006 - RNA, 21 nt, Salmonella enterica enterica serovar Typhi Ty2
ucggguucacuuuaccaggca

SEQ ID NO: 1788007 - RNA, 14 nt, Salmonella enterica enterica serovar Typhi Ty2
ucgguaaagaaacc

SEQ ID NO: 1788008 - RNA, 17 nt, Salmonella enterica enterica serovar Typhi Ty2
ucggguaaagguuugcu

SEQ ID NO: 1788009 - RNA, 22 nt, Salmonella enterica enterica serovar Typhi Ty2
ucggguaaggcguagccgccac

SEQ ID NO: 1788010 - RNA, 23 nt, Salmonella enterica enterica serovar Typhi Ty2
ucgggugagacgcagccucucuu

SEQ ID NO: 1788011 - RNA, 17 nt, Salmonella enterica enterica serovar Typhi Ty2
ucgggucgaauuccagu

SEQ ID NO: 1788012 - RNA, 20 nt, Salmonella enterica enterica serovar Typhi Ty2
ucgggaugcauaaaaaaacg

SEQ ID NO: 1788013 - RNA, 18 nt, Salmonella enterica enterica serovar Typhi Ty2
ucggggauucgccagcgu

SEQ ID NO: 1788014 - RNA, 19 nt, Salmonella enterica enterica serovar Typhi Ty2
ucggauaaggcguuuacgc

SEQ ID NO: 1788015 - RNA, 14 nt, Salmonella enterica enterica serovar Typhi Ty2
ucggauguacugua

SEQ ID NO: 1788016 - RNA, 17 nt, Salmonella enterica enterica serovar Typhi Ty2
ucggcaaacagcuucau

SEQ ID NO: 1788017 - RNA, 20 nt, Salmonella enterica enterica serovar Typhi Ty2
ucggcaaacgccgccuggau

SEQ ID NO: 1788018 - RNA, 14 nt, Salmonella enterica enterica serovar Typhi Ty2
ucggcaaagucuuu

SEQ ID NO: 1788019 - RNA, 16 nt, Salmonella enterica enterica serovar Typhi Ty2
ucggcaaauucuuuuc

SEQ ID NO: 1788020 - RNA, 14 nt, Salmonella enterica enterica serovar Typhi Ty2
ucggcaauuucuuu

SEQ ID NO: 1788021 - RNA, 15 nt, Salmonella enterica enterica serovar Typhi Ty2
ucggcaccauuccca

SEQ ID NO: 1788022 - RNA, 13 nt, Salmonella enterica enterica serovar Typhi Ty2
ucggcagcgccag

SEQ ID NO: 1788023 - RNA, 11 nt, Salmonella enterica enterica serovar Typhi Ty2
ucggcaggccg

SEQ ID NO: 1788024 - RNA, 18 nt, Salmonella enterica enterica serovar Typhi Ty2
ucggcaucuguagcggcg

SEQ ID NO: 1788025 - RNA, 16 nt, Salmonella enterica enterica serovar Typhi Ty2
ucggcaugccacuggg

SEQ ID NO: 1788026 - RNA, 15 nt, Salmonella enterica enterica serovar Typhi Ty2
ucggccaaccgccac

SEQ ID NO: 1788027 - RNA, 20 nt, Salmonella enterica enterica serovar Typhi Ty2
ucggagguuuucucauccag

SEQ ID NO: 1788028 - RNA, 16 nt, Salmonella enterica enterica serovar Typhi Ty2
ucggagguucgaaucc

SEQ ID NO: 1788029 - RNA, 19 nt, Salmonella enterica enterica serovar Typhi Ty2
ucggaaacuauccuggccu

SEQ ID NO: 1788030 - RNA, 19 nt, Salmonella enterica enterica serovar Typhi Ty2
ucggaaaucuguuccagcg

SEQ ID NO: 1788031 - RNA, 21 nt, Salmonella enterica enterica serovar Typhi Ty2
ucggaagacugcuccggcaag

SEQ ID NO: 1788032 - RNA, 19 nt, Salmonella enterica enterica serovar Typhi Ty2
ucggaagacuggcgcagca

SEQ ID NO: 1788033 - RNA, 21 nt, Salmonella enterica enterica serovar Typhi Ty2
ucggacacgacguggacgcug

SEQ ID NO: 1788034 - RNA, 20 nt, Salmonella enterica enterica serovar Typhi Ty2
ucggaaugacaaacgccacc

SEQ ID NO: 1788035 - RNA, 14 nt, Salmonella enterica enterica serovar Typhi Ty2
ucgcuguccgggua

SEQ ID NO: 1788036 - RNA, 20 nt, Salmonella enterica enterica serovar Typhi Ty2
ucgcuuaaacauauacugcu

SEQ ID NO: 1788037 - RNA, 16 nt, Salmonella enterica enterica serovar Typhi Ty2
ucgcuuacgcggcgcg

SEQ ID NO: 1788038 - RNA, 18 nt, Salmonella enterica enterica serovar Typhi Ty2
ucgcuuccuuuauugguu

SEQ ID NO: 1788039 - RNA, 14 nt, Salmonella enterica enterica serovar Typhi Ty2
ucgcuuccagcgcc

SEQ ID NO: 1788040 - RNA, 23 nt, Salmonella enterica enterica serovar Typhi Ty2
ucgcuuguugacgacuuuugcaa

SEQ ID NO: 1788041 - RNA, 17 nt, Salmonella enterica enterica serovar Typhi Ty2
ucgcuuuacccgggcca

SEQ ID NO: 1788042 - RNA, 15 nt, Salmonella enterica enterica serovar Typhi Ty2
ucgcuuuuacucuuc

SEQ ID NO: 1788043 - RNA, 16 nt, Salmonella enterica enterica serovar Typhi Ty2
ucgcgccuccccugcc

SEQ ID NO: 1788044 - RNA, 15 nt, Salmonella enterica enterica serovar Typhi Ty2
ucgcgccuccccugc

SEQ ID NO: 1788045 - RNA, 19 nt, Salmonella enterica enterica serovar Typhi Ty2
ucgcgccgugcccagcauc

SEQ ID NO: 1788046 - RNA, 20 nt, Salmonella enterica enterica serovar Typhi Ty2
ucgcgcgcaaaugcaauuca

SEQ ID NO: 1788047 - RNA, 22 nt, Salmonella enterica enterica serovar Typhi Ty2
ucgcgcggcgguucauccugcg

SEQ ID NO: 1788048 - RNA, 20 nt, Salmonella enterica enterica serovar Typhi Ty2
ucgcgcggcgguucauccug

SEQ ID NO: 1788049 - RNA, 14 nt, Salmonella enterica enterica serovar Typhi Ty2
ucgcgcuauaucag

SEQ ID NO: 1788050 - RNA, 16 nt, Salmonella enterica enterica serovar Typhi Ty2
ucgcgcguccacggcg

SEQ ID NO: 1788051 - RNA, 17 nt, Salmonella enterica enterica serovar Typhi Ty2
ucgcggaauuucaggaa

SEQ ID NO: 1788052 - RNA, 18 nt, Salmonella enterica enterica serovar Typhi Ty2
ucgcggaauuucaggaag

SEQ ID NO: 1788053 - RNA, 20 nt, Salmonella enterica enterica serovar Typhi Ty2
ucgcgcugauauuuuuacug

SEQ ID NO: 1788054 - RNA, 17 nt, Salmonella enterica enterica serovar Typhi Ty2
ucgcgcucuuccgccag

SEQ ID NO: 1788055 - RNA, 19 nt, Salmonella enterica enterica serovar Typhi Ty2
ucgcgcuguauaaucccgc

SEQ ID NO: 1788056 - RNA, 15 nt, Salmonella enterica enterica serovar Typhi Ty2
ucgcgguaaaaagcu

SEQ ID NO: 1788057 - RNA, 19 nt, Salmonella enterica enterica serovar Typhi Ty2
ucgcgguuuacuucuucag

SEQ ID NO: 1788058 - RNA, 17 nt, Salmonella enterica enterica serovar Typhi Ty2
ucgcggugaucccaggc

SEQ ID NO: 1788059 - RNA, 16 nt, Salmonella enterica enterica serovar Typhi Ty2
ucgcggugaucccagg

SEQ ID NO: 1788060 - RNA, 13 nt, Salmonella enterica enterica serovar Typhi Ty2
ucgcgguuagaaa

SEQ ID NO: 1788061 - RNA, 19 nt, Salmonella enterica enterica serovar Typhi Ty2
ucgcgucgccaucaggcag

SEQ ID NO: 1788062 - RNA, 13 nt, Salmonella enterica enterica serovar Typhi Ty2
ucgcuauccagca

SEQ ID NO: 1788063 - RNA, 14 nt, Salmonella enterica enterica serovar Typhi Ty2
ucgcuauccagcag

SEQ ID NO: 1788064 - RNA, 18 nt, Salmonella enterica enterica serovar Typhi Ty2
ucgcguuuuucgaaaauu

SEQ ID NO: 1788065 - RNA, 16 nt, Salmonella enterica enterica serovar Typhi Ty2
ucgcuaccuuuuuuca

SEQ ID NO: 1788066 - RNA, 20 nt, Salmonella enterica enterica serovar Typhi Ty2
ucgcuaccuucuucccauau

SEQ ID NO: 1788067 - RNA, 19 nt, Salmonella enterica enterica serovar Typhi Ty2
ucgcuaccuuuuuucagua

SEQ ID NO: 1788068 - RNA, 14 nt, Salmonella enterica enterica serovar Typhi Ty2
ucgcuaauuuuuaa

SEQ ID NO: 1788069 - RNA, 18 nt, Salmonella enterica enterica serovar Typhi Ty2
ucgcucaggacagguucc

SEQ ID NO: 1788070 - RNA, 16 nt, Salmonella enterica enterica serovar Typhi Ty2
ucgcucaucucaagcc

SEQ ID NO: 1788071 - RNA, 16 nt, Salmonella enterica enterica serovar Typhi Ty2
ucgcucgcgccacgca

SEQ ID NO: 1788072 - RNA, 17 nt, Salmonella enterica enterica serovar Typhi Ty2
ucgcuggugugcagcca

SEQ ID NO: 1788073 - RNA, 17 nt, Salmonella enterica enterica serovar Typhi Ty2
ucgcuggccguuaugca

SEQ ID NO: 1788074 - RNA, 23 nt, Salmonella enterica enterica serovar Typhi Ty2
ucgcuggccauauuuuuucagga

SEQ ID NO: 1788075 - RNA, 17 nt, Salmonella enterica enterica serovar Typhi Ty2
ucgcugaauaaugccuu

SEQ ID NO: 1788076 - RNA, 15 nt, Salmonella enterica enterica serovar Typhi Ty2
ucgcucuaucgccug

SEQ ID NO: 1788077 - RNA, 17 nt, Salmonella enterica enterica serovar Typhi Ty2
ucgcucucuuucaccag

SEQ ID NO: 1788078 - RNA, 17 nt, Salmonella enterica enterica serovar Typhi Ty2
ucgcugacauugcuacg

SEQ ID NO: 1788079 - RNA, 19 nt, Salmonella enterica enterica serovar Typhi Ty2
ucgccagccugaacaucuu

SEQ ID NO: 1788080 - RNA, 18 nt, Salmonella enterica enterica serovar Typhi Ty2
ucgccagcccgaucaucu

SEQ ID NO: 1788081 - RNA, 11 nt, Salmonella enterica enterica serovar Typhi Ty2
ucgccagcaac

SEQ ID NO: 1788082 - RNA, 15 nt, Salmonella enterica enterica serovar Typhi Ty2
ucgccagcagcgcga

SEQ ID NO: 1788083 - RNA, 20 nt, Salmonella enterica enterica serovar Typhi Ty2
ucgccagcggaucgcgucca

SEQ ID NO: 1788084 - RNA, 10 nt, Salmonella enterica enterica serovar Typhi Ty2
ucgccaggcc

SEQ ID NO: 1788085 - RNA, 15 nt, Salmonella enterica enterica serovar Typhi Ty2
ucgccaguaagggga

SEQ ID NO: 1788086 - RNA, 16 nt, Salmonella enterica enterica serovar Typhi Ty2
ucgccauacaucgcgu

SEQ ID NO: 1788087 - RNA, 16 nt, Salmonella enterica enterica serovar Typhi Ty2
ucgccauaaagcugua

SEQ ID NO: 1788088 - RNA, 22 nt, Salmonella enterica enterica serovar Typhi Ty2
ucgccauccggcaaugauuaga

SEQ ID NO: 1788089 - RNA, 20 nt, Salmonella enterica enterica serovar Typhi Ty2
ucgccaucgauagcagcgcu

SEQ ID NO: 1788090 - RNA, 12 nt, Salmonella enterica enterica serovar Typhi Ty2
ucgccauaucuu

SEQ ID NO: 1788091 - RNA, 18 nt, Salmonella enterica enterica serovar Typhi Ty2
ucgccauauccaagcccc

SEQ ID NO: 1788092 - RNA, 21 nt, Salmonella enterica enterica serovar Typhi Ty2
ucgccaccgcauuuucagcuu

SEQ ID NO: 1788093 - RNA, 17 nt, Salmonella enterica enterica serovar Typhi Ty2
ucgccaccaugcugguu

SEQ ID NO: 1788094 - RNA, 16 nt, Salmonella enterica enterica serovar Typhi Ty2
ucgccaccacauucag

SEQ ID NO: 1788095 - RNA, 22 nt, Salmonella enterica enterica serovar Typhi Ty2
ucgccaacaccgauccgaagaa

SEQ ID NO: 1788096 - RNA, 17 nt, Salmonella enterica enterica serovar Typhi Ty2
ucgccaagaucgccaag

SEQ ID NO: 1788097 - RNA, 17 nt, Salmonella enterica enterica serovar Typhi Ty2
ucgccaaagcagugaau

SEQ ID NO: 1788098 - RNA, 19 nt, Salmonella enterica enterica serovar Typhi Ty2
ucgccccggcgagugccug

SEQ ID NO: 1788099 - RNA, 14 nt, Salmonella enterica enterica serovar Typhi Ty2
ucgcccguuuuacc

SEQ ID NO: 1788100 - RNA, 20 nt, Salmonella enterica enterica serovar Typhi Ty2
ucgcccucgccagcaacagg

SEQ ID NO: 1788101 - RNA, 20 nt, Salmonella enterica enterica serovar Typhi Ty2
ucgcccgcguuguccccuca

SEQ ID NO: 1788102 - RNA, 14 nt, Salmonella enterica enterica serovar Typhi Ty2
ucgcccggaaaugg

SEQ ID NO: 1788103 - RNA, 19 nt, Salmonella enterica enterica serovar Typhi Ty2
ucgcccagcacuaacagca

SEQ ID NO: 1788104 - RNA, 22 nt, Salmonella enterica enterica serovar Typhi Ty2
ucgcccacgcccagagcgcggc

SEQ ID NO: 1788105 - RNA, 18 nt, Salmonella enterica enterica serovar Typhi Ty2
ucgccauuccaagaauga

SEQ ID NO: 1788106 - RNA, 22 nt, Salmonella enterica enterica serovar Typhi Ty2
ucgcccaaauaguccagcagcc

SEQ ID NO: 1788107 - RNA, 18 nt, Salmonella enterica enterica serovar Typhi Ty2
ucgccgccaucggcgcgu

SEQ ID NO: 1788108 - RNA, 13 nt, Salmonella enterica enterica serovar Typhi Ty2
ucgccgccgcgag

SEQ ID NO: 1788109 - RNA, 17 nt, Salmonella enterica enterica serovar Typhi Ty2
ucgccgccgcgagcagc

SEQ ID NO: 1788110 - RNA, 18 nt, Salmonella enterica enterica serovar Typhi Ty2
ucgcccugcgccagacgc

SEQ ID NO: 1788111 - RNA, 14 nt, Salmonella enterica enterica serovar Typhi Ty2
ucgcccugcaauuc

SEQ ID NO: 1788112 - RNA, 15 nt, Salmonella enterica enterica serovar Typhi Ty2
ucgcccuuuucgcaa

SEQ ID NO: 1788113 - RNA, 18 nt, Salmonella enterica enterica serovar Typhi Ty2
ucgcccuucaucuuccag

SEQ ID NO: 1788114 - RNA, 19 nt, Salmonella enterica enterica serovar Typhi Ty2
ucgccgacaugcuccugca

SEQ ID NO: 1788115 - RNA, 19 nt, Salmonella enterica enterica serovar Typhi Ty2
ucgccgucguucagccagc

SEQ ID NO: 1788116 - RNA, 17 nt, Salmonella enterica enterica serovar Typhi Ty2
ucgccguguaagagcug

SEQ ID NO: 1788117 - RNA, 23 nt, Salmonella enterica enterica serovar Typhi Ty2
ucgccgguagcuucagcggcgcg

SEQ ID NO: 1788118 - RNA, 23 nt, Salmonella enterica enterica serovar Typhi Ty2
ucgccugcgcucauauacccugc

SEQ ID NO: 1788119 - RNA, 20 nt, Salmonella enterica enterica serovar Typhi Ty2
ucgccugccagcgcucugca

SEQ ID NO: 1788120 - RNA, 22 nt, Salmonella enterica enterica serovar Typhi Ty2
ucgccugauucaccaacugcug

SEQ ID NO: 1788121 - RNA, 16 nt, Salmonella enterica enterica serovar Typhi Ty2
ucgccugaugaccgcc

SEQ ID NO: 1788122 - RNA, 20 nt, Salmonella enterica enterica serovar Typhi Ty2
ucgccugaaugcacugcuga

SEQ ID NO: 1788123 - RNA, 16 nt, Salmonella enterica enterica serovar Typhi Ty2
ucgccuauuuucucuu

SEQ ID NO: 1788124 - RNA, 18 nt, Salmonella enterica enterica serovar Typhi Ty2
ucgccucccugccuaaag

SEQ ID NO: 1788125 - RNA, 14 nt, Salmonella enterica enterica serovar Typhi Ty2
ucgccuaaaugacc

SEQ ID NO: 1788126 - RNA, 14 nt, Salmonella enterica enterica serovar Typhi Ty2
ucgccucccugccu

SEQ ID NO: 1788127 - RNA, 18 nt, Salmonella enterica enterica serovar Typhi Ty2
ucgccggggaaaauauua

SEQ ID NO: 1788128 - RNA, 21 nt, Salmonella enterica enterica serovar Typhi Ty2
ucgccggagccgccuggccug

SEQ ID NO: 1788129 - RNA, 23 nt, Salmonella enterica enterica serovar Typhi Ty2
ucgccggcagacgauagcgggug

SEQ ID NO: 1788130 - RNA, 18 nt, Salmonella enterica enterica serovar Typhi Ty2
ucgccgcgcgaagaggau

SEQ ID NO: 1788131 - RNA, 19 nt, Salmonella enterica enterica serovar Typhi Ty2
ucgccgcggcgcuggccuu

SEQ ID NO: 1788132 - RNA, 18 nt, Salmonella enterica enterica serovar Typhi Ty2
ucgccgcugccgcuauug

SEQ ID NO: 1788133 - RNA, 19 nt, Salmonella enterica enterica serovar Typhi Ty2
ucgccgcuuucugagccgc

SEQ ID NO: 1788134 - RNA, 20 nt, Salmonella enterica enterica serovar Typhi Ty2
ucgcgcagauagagcgccug

SEQ ID NO: 1788135 - RNA, 22 nt, Salmonella enterica enterica serovar Typhi Ty2
ucgcgcacgcgccgaaugcguu

SEQ ID NO: 1788136 - RNA, 15 nt, Salmonella enterica enterica serovar Typhi Ty2
ucgcgcauccgggcc

SEQ ID NO: 1788137 - RNA, 16 nt, Salmonella enterica enterica serovar Typhi Ty2
ucgcgcauccgggccg

SEQ ID NO: 1788138 - RNA, 21 nt, Salmonella enterica enterica serovar Typhi Ty2
ucgcgccagcgacaucccaga

SEQ ID NO: 1788139 - RNA, 24 nt, Salmonella enterica enterica serovar Typhi Ty2
ucgcgcccaaugcuuagucagccu

SEQ ID NO: 1788140 - RNA, 12 nt, Salmonella enterica enterica serovar Typhi Ty2
ucgcgccgccaa

SEQ ID NO: 1788141 - RNA, 13 nt, Salmonella enterica enterica serovar Typhi Ty2
ucgcgaauuucaa

SEQ ID NO: 1788142 - RNA, 17 nt, Salmonella enterica enterica serovar Typhi Ty2
ucgcgaaucgcuucacg

SEQ ID NO: 1788143 - RNA, 21 nt, Salmonella enterica enterica serovar Typhi Ty2
ucgcgacggaccggcagcguc

SEQ ID NO: 1788144 - RNA, 17 nt, Salmonella enterica enterica serovar Typhi Ty2
ucgcgaucacagacaga

SEQ ID NO: 1788145 - RNA, 12 nt, Salmonella enterica enterica serovar Typhi Ty2
ucgcgaugaugu

SEQ ID NO: 1788146 - RNA, 15 nt, Salmonella enterica enterica serovar Typhi Ty2
ucgcgauucgggccg

SEQ ID NO: 1788147 - RNA, 19 nt, Salmonella enterica enterica serovar Typhi Ty2
ucgcgauacugccgcccau

SEQ ID NO: 1788148 - RNA, 18 nt, Salmonella enterica enterica serovar Typhi Ty2
ucgcgagcacuuuuuccu

SEQ ID NO: 1788149 - RNA, 16 nt, Salmonella enterica enterica serovar Typhi Ty2
ucgcgacugauaccca

SEQ ID NO: 1788150 - RNA, 16 nt, Salmonella enterica enterica serovar Typhi Ty2
ucgccuuacccggccu

SEQ ID NO: 1788151 - RNA, 13 nt, Salmonella enterica enterica serovar Typhi Ty2
ucgccuucauccg

SEQ ID NO: 1788152 - RNA, 16 nt, Salmonella enterica enterica serovar Typhi Ty2
ucgccuuauccggccu

SEQ ID NO: 1788153 - RNA, 17 nt, Salmonella enterica enterica serovar Typhi Ty2
ucgccuucauccgcaua

SEQ ID NO: 1788154 - RNA, 22 nt, Salmonella enterica enterica serovar Typhi Ty2
ucgccuggauaauggcuaugcc

SEQ ID NO: 1788155 - RNA, 18 nt, Salmonella enterica enterica serovar Typhi Ty2
ucgccugcgucgccccaa

SEQ ID NO: 1788156 - RNA, 19 nt, Salmonella enterica enterica serovar Typhi Ty2
ugaagaaaauacugauuaa

SEQ ID NO: 1788157 - RNA, 19 nt, Salmonella enterica enterica serovar Typhi Ty2
ugaacuuuuugcaggagcu

SEQ ID NO: 1788158 - RNA, 14 nt, Salmonella enterica enterica serovar Typhi Ty2
ugaacgccaaauac

SEQ ID NO: 1788159 - RNA, 16 nt, Salmonella enterica enterica serovar Typhi Ty2
ugaaccauaucaaaca

SEQ ID NO: 1788160 - RNA, 19 nt, Salmonella enterica enterica serovar Typhi Ty2
ugaaggcgcuaugcuuacc

SEQ ID NO: 1788161 - RNA, 18 nt, Salmonella enterica enterica serovar Typhi Ty2
ugaaggcgcuccccugcu

SEQ ID NO: 1788162 - RNA, 15 nt, Salmonella enterica enterica serovar Typhi Ty2
ugaagcgcaguguua

SEQ ID NO: 1788163 - RNA, 14 nt, Salmonella enterica enterica serovar Typhi Ty2
ugaagcgcaguguu

SEQ ID NO: 1788164 - RNA, 17 nt, Salmonella enterica enterica serovar Typhi Ty2
ugaagccuggugcccaa

SEQ ID NO: 1788165 - RNA, 22 nt, Salmonella enterica enterica serovar Typhi Ty2
ugaagcgauuuauccaccgcca

SEQ ID NO: 1788166 - RNA, 21 nt, Salmonella enterica enterica serovar Typhi Ty2
ugaagauggucuguaccacca

SEQ ID NO: 1788167 - RNA, 18 nt, Salmonella enterica enterica serovar Typhi Ty2
ugaauauggccagucccc

SEQ ID NO: 1788168 - RNA, 17 nt, Salmonella enterica enterica serovar Typhi Ty2
ugaauauucggcuccag

SEQ ID NO: 1788169 - RNA, 20 nt, Salmonella enterica enterica serovar Typhi Ty2
ugaauaugaucugcacaaca

SEQ ID NO: 1788170 - RNA, 22 nt, Salmonella enterica enterica serovar Typhi Ty2
ugaauaucgagcggcaguagca

SEQ ID NO: 1788171 - RNA, 14 nt, Salmonella enterica enterica serovar Typhi Ty2
ugaauagcgcugcg

SEQ ID NO: 1788172 - RNA, 12 nt, Salmonella enterica enterica serovar Typhi Ty2
ugaauagccagc

SEQ ID NO: 1788173 - RNA, 15 nt, Salmonella enterica enterica serovar Typhi Ty2
ugaauagccagcccc

SEQ ID NO: 1788174 - RNA, 12 nt, Salmonella enterica enterica serovar Typhi Ty2
ugaauacacaaa

SEQ ID NO: 1788175 - RNA, 18 nt, Salmonella enterica enterica serovar Typhi Ty2
ugaauaccaagucucagg

SEQ ID NO: 1788176 - RNA, 14 nt, Salmonella enterica enterica serovar Typhi Ty2
ugaaguguuccuga

SEQ ID NO: 1788177 - RNA, 18 nt, Salmonella enterica enterica serovar Typhi Ty2
ugaaguguuccugagcca

SEQ ID NO: 1788178 - RNA, 15 nt, Salmonella enterica enterica serovar Typhi Ty2
ugaaguuauccagcg

SEQ ID NO: 1788179 - RNA, 14 nt, Salmonella enterica enterica serovar Typhi Ty2
ugaauaaugaccag

SEQ ID NO: 1788180 - RNA, 17 nt, Salmonella enterica enterica serovar Typhi Ty2
ugaauaaugguaaauuu

SEQ ID NO: 1788181 - RNA, 15 nt, Salmonella enterica enterica serovar Typhi Ty2
ugaauaauaauacac

SEQ ID NO: 1788182 - RNA, 18 nt, Salmonella enterica enterica serovar Typhi Ty2
ugaauaauuucuucuuua

SEQ ID NO: 1788183 - RNA, 15 nt, Salmonella enterica enterica serovar Typhi Ty2
ugaauaccaaagccc

SEQ ID NO: 1788184 - RNA, 21 nt, Salmonella enterica enterica serovar Typhi Ty2
ugaacaaaggcagccaacaaa

SEQ ID NO: 1788185 - RNA, 12 nt, Salmonella enterica enterica serovar Typhi Ty2
ugaacaccagca

SEQ ID NO: 1788186 - RNA, 15 nt, Salmonella enterica enterica serovar Typhi Ty2
ugaacauuuuuucag

SEQ ID NO: 1788187 - RNA, 20 nt, Salmonella enterica enterica serovar Typhi Ty2
ugaaccagcaucccacgaau

SEQ ID NO: 1788188 - RNA, 21 nt, Salmonella enterica enterica serovar Typhi Ty2
ugaaccagcggcaccagcacg

SEQ ID NO: 1788189 - RNA, 13 nt, Salmonella enterica enterica serovar Typhi Ty2
ugaacauuuuuuc

SEQ ID NO: 1788190 - RNA, 22 nt, Salmonella enterica enterica serovar Typhi Ty2
ugaacagcaaacgccuuccgga

SEQ ID NO: 1788191 - RNA, 23 nt, Salmonella enterica enterica serovar Typhi Ty2
ugaacauaugaaggauacggaau

SEQ ID NO: 1788192 - RNA, 17 nt, Salmonella enterica enterica serovar Typhi Ty2
ugaaauuucuuuuccag

SEQ ID NO: 1788193 - RNA, 21 nt, Salmonella enterica enterica serovar Typhi Ty2
ugaaauugaucacaaaaucau

SEQ ID NO: 1788194 - RNA, 18 nt, Salmonella enterica enterica serovar Typhi Ty2
ugaaauucuaugccaggc

SEQ ID NO: 1788195 - RNA, 19 nt, Salmonella enterica enterica serovar Typhi Ty2
ugaaauucuaugccaggcg

SEQ ID NO: 1788196 - RNA, 22 nt, Salmonella enterica enterica serovar Typhi Ty2
ugaaauuauuccuuaucacauu

SEQ ID NO: 1788197 - RNA, 18 nt, Salmonella enterica enterica serovar Typhi Ty2
ugaaauuaaucaggcauc

SEQ ID NO: 1788198 - RNA, 12 nt, Salmonella enterica enterica serovar Typhi Ty2
ugaaaggguggg

SEQ ID NO: 1788199 - RNA, 15 nt, Salmonella enterica enterica serovar Typhi Ty2
ugaaagaaaucaccg

SEQ ID NO: 1788200 - RNA, 21 nt, Salmonella enterica enterica serovar Typhi Ty2
ugaaagucuucccgcaaacug

SEQ ID NO: 1788201 - RNA, 15 nt, Salmonella enterica enterica serovar Typhi Ty2
ucuucggcuucaccg

SEQ ID NO: 1788202 - RNA, 18 nt, Salmonella enterica enterica serovar Typhi Ty2
ucuucggucgagcuuuug

SEQ ID NO: 1788203 - RNA, 14 nt, Salmonella enterica enterica serovar Typhi Ty2
ucuucgucgucauc

SEQ ID NO: 1788204 - RNA, 14 nt, Salmonella enterica enterica serovar Typhi Ty2
ugaaaccccaaauc

SEQ ID NO: 1788205 - RNA, 20 nt, Salmonella enterica enterica serovar Typhi Ty2
ucuucguguaacgcauacau

SEQ ID NO: 1788206 - RNA, 23 nt, Salmonella enterica enterica serovar Typhi Ty2
ugaaaccggcgcgccuuccagca

SEQ ID NO: 1788207 - RNA, 22 nt, Salmonella enterica enterica serovar Typhi Ty2
ugacaucaagcccacacaucac

SEQ ID NO: 1788208 - RNA, 17 nt, Salmonella enterica enterica serovar Typhi Ty2
ugaccaucaaauaauac

SEQ ID NO: 1788209 - RNA, 17 nt, Salmonella enterica enterica serovar Typhi Ty2
ugaccauccgcagguua

SEQ ID NO: 1788210 - RNA, 17 nt, Salmonella enterica enterica serovar Typhi Ty2
ugaccauauaugaaauc

SEQ ID NO: 1788211 - RNA, 18 nt, Salmonella enterica enterica serovar Typhi Ty2
ugaccauauaugaaaucg

SEQ ID NO: 1788212 - RNA, 22 nt, Salmonella enterica enterica serovar Typhi Ty2
ugaccaguaagggcagccgaga

SEQ ID NO: 1788213 - RNA, 17 nt, Salmonella enterica enterica serovar Typhi Ty2
ugaccagggcaaauuau

SEQ ID NO: 1788214 - RNA, 18 nt, Salmonella enterica enterica serovar Typhi Ty2
ugaccagcgcccacacca

SEQ ID NO: 1788215 - RNA, 21 nt, Salmonella enterica enterica serovar Typhi Ty2
ugaccagcugacgacgccagc

SEQ ID NO: 1788216 - RNA, 15 nt, Salmonella enterica enterica serovar Typhi Ty2
ugaccugcccauccu

SEQ ID NO: 1788217 - RNA, 17 nt, Salmonella enterica enterica serovar Typhi Ty2
ugaccuuaauccagcag

SEQ ID NO: 1788218 - RNA, 11 nt, Salmonella enterica enterica serovar Typhi Ty2
ugaccugaaua

SEQ ID NO: 1788219 - RNA, 12 nt, Salmonella enterica enterica serovar Typhi Ty2
ugaccucgccua

SEQ ID NO: 1788220 - RNA, 17 nt, Salmonella enterica enterica serovar Typhi Ty2
ugaccgccgucauagca

SEQ ID NO: 1788221 - RNA, 23 nt, Salmonella enterica enterica serovar Typhi Ty2
ugaccgccgucauagcaggagau

SEQ ID NO: 1788222 - RNA, 21 nt, Salmonella enterica enterica serovar Typhi Ty2
ugacacuauauugcgaauaaa

SEQ ID NO: 1788223 - RNA, 13 nt, Salmonella enterica enterica serovar Typhi Ty2
ugacacucaucca

SEQ ID NO: 1788224 - RNA, 14 nt, Salmonella enterica enterica serovar Typhi Ty2
ugacacccucugcg

SEQ ID NO: 1788225 - RNA, 11 nt, Salmonella enterica enterica serovar Typhi Ty2
ugacacagcgu

SEQ ID NO: 1788226 - RNA, 19 nt, Salmonella enterica enterica serovar Typhi Ty2
ugacagcaucgauuccgcc

SEQ ID NO: 1788227 - RNA, 19 nt, Salmonella enterica enterica serovar Typhi Ty2
ugacagccaaacugcugua

SEQ ID NO: 1788228 - RNA, 22 nt, Salmonella enterica enterica serovar Typhi Ty2
ugacaaauuguuuaaaaacagg

SEQ ID NO: 1788229 - RNA, 14 nt, Salmonella enterica enterica serovar Typhi Ty2
ugacaacaaaaaga

SEQ ID NO: 1788230 - RNA, 17 nt, Salmonella enterica enterica serovar Typhi Ty2
ugacaacacucacaaaa

SEQ ID NO: 1788231 - RNA, 23 nt, Salmonella enterica enterica serovar Typhi Ty2
ugacaacacucacaaaacuauuu

SEQ ID NO: 1788232 - RNA, 16 nt, Salmonella enterica enterica serovar Typhi Ty2
ugacaaaaauuaaaac

SEQ ID NO: 1788233 - RNA, 14 nt, Salmonella enterica enterica serovar Typhi Ty2
ugacaaucacucuc

SEQ ID NO: 1788234 - RNA, 20 nt, Salmonella enterica enterica serovar Typhi Ty2
ugacaauauugccauaaaua

SEQ ID NO: 1788235 - RNA, 16 nt, Salmonella enterica enterica serovar Typhi Ty2
ugacaauauugccaua

SEQ ID NO: 1788236 - RNA, 17 nt, Salmonella enterica enterica serovar Typhi Ty2
ugacaacuauugcugcc

SEQ ID NO: 1788237 - RNA, 21 nt, Salmonella enterica enterica serovar Typhi Ty2
ugacaaucuccuccggcuuca

SEQ ID NO: 1788238 - RNA, 21 nt, Salmonella enterica enterica serovar Typhi Ty2
ugaaucccgccaucguccagc

SEQ ID NO: 1788239 - RNA, 21 nt, Salmonella enterica enterica serovar Typhi Ty2
ugaauccccagaauuucuuug

SEQ ID NO: 1788240 - RNA, 21 nt, Salmonella enterica enterica serovar Typhi Ty2
ugaaucgccgucagugagccc

SEQ ID NO: 1788241 - RNA, 15 nt, Salmonella enterica enterica serovar Typhi Ty2
ugaaucaagcuuugc

SEQ ID NO: 1788242 - RNA, 16 nt, Salmonella enterica enterica serovar Typhi Ty2
ugaaucaagcuuugcg

SEQ ID NO: 1788243 - RNA, 16 nt, Salmonella enterica enterica serovar Typhi Ty2
ugaauccaggccagau

SEQ ID NO: 1788244 - RNA, 13 nt, Salmonella enterica enterica serovar Typhi Ty2
ugaaucagcaucu

SEQ ID NO: 1788245 - RNA, 22 nt, Salmonella enterica enterica serovar Typhi Ty2
ugaaucuggucggugauauauu

SEQ ID NO: 1788246 - RNA, 24 nt, Salmonella enterica enterica serovar Typhi Ty2
ugaaucuggucggugauauauuca

SEQ ID NO: 1788247 - RNA, 18 nt, Salmonella enterica enterica serovar Typhi Ty2
ugaaugagucggaccauc

SEQ ID NO: 1788248 - RNA, 13 nt, Salmonella enterica enterica serovar Typhi Ty2
ugaaugcaaagaa

SEQ ID NO: 1788249 - RNA, 19 nt, Salmonella enterica enterica serovar Typhi Ty2
ugaaugccccagcgcugcu

SEQ ID NO: 1788250 - RNA, 17 nt, Salmonella enterica enterica serovar Typhi Ty2
ugaaugcccuuuuccag

SEQ ID NO: 1788251 - RNA, 18 nt, Salmonella enterica enterica serovar Typhi Ty2
ugaauggcggagaucucc

SEQ ID NO: 1788252 - RNA, 20 nt, Salmonella enterica enterica serovar Typhi Ty2
ugaauggcggagaucuccag

SEQ ID NO: 1788253 - RNA, 11 nt, Salmonella enterica enterica serovar Typhi Ty2
ugaauguuuug

SEQ ID NO: 1788254 - RNA, 22 nt, Salmonella enterica enterica serovar Typhi Ty2
ugaauuacagcucauaaacgcg

SEQ ID NO: 1788255 - RNA, 15 nt, Salmonella enterica enterica serovar Typhi Ty2
ugaauucaccgcaug

SEQ ID NO: 1788256 - RNA, 17 nt, Salmonella enterica enterica serovar Typhi Ty2
ugaauuauuuuuucaug

SEQ ID NO: 1788257 - RNA, 14 nt, Salmonella enterica enterica serovar Typhi Ty2
ugaauucguuaccu

SEQ ID NO: 1788258 - RNA, 15 nt, Salmonella enterica enterica serovar Typhi Ty2
ugaauuuaaauacuu

SEQ ID NO: 1788259 - RNA, 17 nt, Salmonella enterica enterica serovar Typhi Ty2
ugaauugcgguuuaucc

SEQ ID NO: 1788260 - RNA, 22 nt, Salmonella enterica enterica serovar Typhi Ty2
ugaauugcgguuuauccccgcu

SEQ ID NO: 1788261 - RNA, 14 nt, Salmonella enterica enterica serovar Typhi Ty2
ugaauuucugcugc

SEQ ID NO: 1788262 - RNA, 15 nt, Salmonella enterica enterica serovar Typhi Ty2
ugauguacaggugaa

SEQ ID NO: 1788263 - RNA, 21 nt, Salmonella enterica enterica serovar Typhi Ty2
ugaugguuucggcaugccacu

SEQ ID NO: 1788264 - RNA, 17 nt, Salmonella enterica enterica serovar Typhi Ty2
ugaugugucuauuuauu

SEQ ID NO: 1788265 - RNA, 13 nt, Salmonella enterica enterica serovar Typhi Ty2
ugaugugauggug

SEQ ID NO: 1788266 - RNA, 20 nt, Salmonella enterica enterica serovar Typhi Ty2
ugaugugauuuuugacccgc

SEQ ID NO: 1788267 - RNA, 19 nt, Salmonella enterica enterica serovar Typhi Ty2
ugauuaaguuuuuuuaaaa

SEQ ID NO: 1788268 - RNA, 18 nt, Salmonella enterica enterica serovar Typhi Ty2
ugauguuuuuaaaagaag

SEQ ID NO: 1788269 - RNA, 15 nt, Salmonella enterica enterica serovar Typhi Ty2
ugauuacaaagggca

SEQ ID NO: 1788270 - RNA, 21 nt, Salmonella enterica enterica serovar Typhi Ty2
ugauuacggaacaaaacggaa

SEQ ID NO: 1788271 - RNA, 20 nt, Salmonella enterica enterica serovar Typhi Ty2
ugauuacggaacaaaacgga

SEQ ID NO: 1788272 - RNA, 19 nt, Salmonella enterica enterica serovar Typhi Ty2
ugauuaucacccacaggag

SEQ ID NO: 1788273 - RNA, 21 nt, Salmonella enterica enterica serovar Typhi Ty2
ugauuaucacccacaggagcc

SEQ ID NO: 1788274 - RNA, 15 nt, Salmonella enterica enterica serovar Typhi Ty2
ugauuauuacaauaa

SEQ ID NO: 1788275 - RNA, 22 nt, Salmonella enterica enterica serovar Typhi Ty2
ugauuacguuuucccugagcgc

SEQ ID NO: 1788276 - RNA, 20 nt, Salmonella enterica enterica serovar Typhi Ty2
ugauuagaaacccauauucc

SEQ ID NO: 1788277 - RNA, 21 nt, Salmonella enterica enterica serovar Typhi Ty2
ugauucguuuaaguaagguaa

SEQ ID NO: 1788278 - RNA, 21 nt, Salmonella enterica enterica serovar Typhi Ty2
ugauucguuuuuacacugaag

SEQ ID NO: 1788279 - RNA, 19 nt, Salmonella enterica enterica serovar Typhi Ty2
ugauucauucccauacugc

SEQ ID NO: 1788280 - RNA, 11 nt, Salmonella enterica enterica serovar Typhi Ty2
ugauuuauuca

SEQ ID NO: 1788281 - RNA, 18 nt, Salmonella enterica enterica serovar Typhi Ty2
ugauuucgccccacuggc

SEQ ID NO: 1788282 - RNA, 19 nt, Salmonella enterica enterica serovar Typhi Ty2
ugauuucgacgauaaaaaa

SEQ ID NO: 1788283 - RNA, 15 nt, Salmonella enterica enterica serovar Typhi Ty2
ugauugcgacaggcu

SEQ ID NO: 1788284 - RNA, 16 nt, Salmonella enterica enterica serovar Typhi Ty2
ugauugcgacaggcug

SEQ ID NO: 1788285 - RNA, 22 nt, Salmonella enterica enterica serovar Typhi Ty2
ugauugcgacaggcugccgaca

SEQ ID NO: 1788286 - RNA, 21 nt, Salmonella enterica enterica serovar Typhi Ty2
ugauugccggagauuuaucuu

SEQ ID NO: 1788287 - RNA, 17 nt, Salmonella enterica enterica serovar Typhi Ty2
ugauugccggaugacgc

SEQ ID NO: 1788288 - RNA, 16 nt, Salmonella enterica enterica serovar Typhi Ty2
ugaugcaucagaacaa

SEQ ID NO: 1788289 - RNA, 22 nt, Salmonella enterica enterica serovar Typhi Ty2
ugaugccccagaacaacgggaa

SEQ ID NO: 1788290 - RNA, 13 nt, Salmonella enterica enterica serovar Typhi Ty2
ugauggccuuugu

SEQ ID NO: 1788291 - RNA, 20 nt, Salmonella enterica enterica serovar Typhi Ty2
ugauggcgcgacgcuuauca

SEQ ID NO: 1788292 - RNA, 16 nt, Salmonella enterica enterica serovar Typhi Ty2
ugauggcgcuacgcca

SEQ ID NO: 1788293 - RNA, 20 nt, Salmonella enterica enterica serovar Typhi Ty2
ugauggcgcuacgcuuauca

SEQ ID NO: 1788294 - RNA, 10 nt, Salmonella enterica enterica serovar Typhi Ty2
ugauggcuuu

SEQ ID NO: 1788295 - RNA, 17 nt, Salmonella enterica enterica serovar Typhi Ty2
ugauggcgaacagcccc

SEQ ID NO: 1788296 - RNA, 14 nt, Salmonella enterica enterica serovar Typhi Ty2
ugauggccuggcgg

SEQ ID NO: 1788297 - RNA, 15 nt, Salmonella enterica enterica serovar Typhi Ty2
ugaugcugcgcaucc

SEQ ID NO: 1788298 - RNA, 20 nt, Salmonella enterica enterica serovar Typhi Ty2
ugauauuucuuagcacccac

SEQ ID NO: 1788299 - RNA, 23 nt, Salmonella enterica enterica serovar Typhi Ty2
ugauauugcguaagcagcugcuu

SEQ ID NO: 1788300 - RNA, 22 nt, Salmonella enterica enterica serovar Typhi Ty2
ugauauugcguaagcagcugcu

SEQ ID NO: 1788301 - RNA, 17 nt, Salmonella enterica enterica serovar Typhi Ty2
ugauaccacaucaauag

SEQ ID NO: 1788302 - RNA, 21 nt, Salmonella enterica enterica serovar Typhi Ty2
ugauauuagaaagcugcacca

SEQ ID NO: 1788303 - RNA, 17 nt, Salmonella enterica enterica serovar Typhi Ty2
ugaucaccgcccuggcg

SEQ ID NO: 1788304 - RNA, 14 nt, Salmonella enterica enterica serovar Typhi Ty2
ugaucaauuugccu

SEQ ID NO: 1788305 - RNA, 23 nt, Salmonella enterica enterica serovar Typhi Ty2
ugaucgugccaugaccauucaca

SEQ ID NO: 1788306 - RNA, 18 nt, Salmonella enterica enterica serovar Typhi Ty2
ugaucgugauaggccaga

SEQ ID NO: 1788307 - RNA, 13 nt, Salmonella enterica enterica serovar Typhi Ty2
ugaucgugcccac

SEQ ID NO: 1788308 - RNA, 12 nt, Salmonella enterica enterica serovar Typhi Ty2
ugaucccaccag

SEQ ID NO: 1788309 - RNA, 13 nt, Salmonella enterica enterica serovar Typhi Ty2
ugaucccccagaa

SEQ ID NO: 1788310 - RNA, 12 nt, Salmonella enterica enterica serovar Typhi Ty2
ugaucggcuggc

SEQ ID NO: 1788311 - RNA, 18 nt, Salmonella enterica enterica serovar Typhi Ty2
ugaucggguuuuccugaa

SEQ ID NO: 1788312 - RNA, 21 nt, Salmonella enterica enterica serovar Typhi Ty2
ugaucacuuuugggccgcgua

SEQ ID NO: 1788313 - RNA, 23 nt, Salmonella enterica enterica serovar Typhi Ty2
ugaucacgguacgcaucaccagg

SEQ ID NO: 1788314 - RNA, 12 nt, Salmonella enterica enterica serovar Typhi Ty2
ugaucccaaugu

SEQ ID NO: 1788315 - RNA, 20 nt, Salmonella enterica enterica serovar Typhi Ty2
ugauaaagcuuucaucuuua

SEQ ID NO: 1788316 - RNA, 16 nt, Salmonella enterica enterica serovar Typhi Ty2
ugaguuugucauccag

SEQ ID NO: 1788317 - RNA, 13 nt, Salmonella enterica enterica serovar Typhi Ty2
ugauaaagcgcuc

SEQ ID NO: 1788318 - RNA, 18 nt, Salmonella enterica enterica serovar Typhi Ty2
ugaguuugucauccagac

SEQ ID NO: 1788319 - RNA, 19 nt, Salmonella enterica enterica serovar Typhi Ty2
ugaguccauaccguuucaa

SEQ ID NO: 1788320 - RNA, 23 nt, Salmonella enterica enterica serovar Typhi Ty2
ugagucagaaacggccuggcccg

SEQ ID NO: 1788321 - RNA, 23 nt, Salmonella enterica enterica serovar Typhi Ty2
ugauaaucaauggccuugccagc

SEQ ID NO: 1788322 - RNA, 15 nt, Salmonella enterica enterica serovar Typhi Ty2
ugauaaccgccgcca

SEQ ID NO: 1788323 - RNA, 19 nt, Salmonella enterica enterica serovar Typhi Ty2
ugauaaccuauuuugcaaa

SEQ ID NO: 1788324 - RNA, 16 nt, Salmonella enterica enterica serovar Typhi Ty2
ugauacaggaauaacc

SEQ ID NO: 1788325 - RNA, 22 nt, Salmonella enterica enterica serovar Typhi Ty2
ugauaauguuggauuauacauu

SEQ ID NO: 1788326 - RNA, 14 nt, Salmonella enterica enterica serovar Typhi Ty2
ugauacagcagcac

SEQ ID NO: 1788327 - RNA, 23 nt, Salmonella enterica enterica serovar Typhi Ty2
ugauacagccaaaucagcaggac

SEQ ID NO: 1788328 - RNA, 22 nt, Salmonella enterica enterica serovar Typhi Ty2
ugaguaacguuaauacaucaug

SEQ ID NO: 1788329 - RNA, 13 nt, Salmonella enterica enterica serovar Typhi Ty2
ugaguaacguuaa

SEQ ID NO: 1788330 - RNA, 19 nt, Salmonella enterica enterica serovar Typhi Ty2
ugaguaaagagaucaauuu

SEQ ID NO: 1788331 - RNA, 21 nt, Salmonella enterica enterica serovar Typhi Ty2
ugaguauaaaacucgccgcga

SEQ ID NO: 1788332 - RNA, 20 nt, Salmonella enterica enterica serovar Typhi Ty2
ugagguugagauccugaucc

SEQ ID NO: 1788333 - RNA, 15 nt, Salmonella enterica enterica serovar Typhi Ty2
ugagguuucagcacc

SEQ ID NO: 1788334 - RNA, 18 nt, Salmonella enterica enterica serovar Typhi Ty2
ugaguaaacgcucaagca

SEQ ID NO: 1788335 - RNA, 18 nt, Salmonella enterica enterica serovar Typhi Ty2
ugagcgcagugaccagca

SEQ ID NO: 1788336 - RNA, 17 nt, Salmonella enterica enterica serovar Typhi Ty2
ugagcgcagugaccagc

SEQ ID NO: 1788337 - RNA, 20 nt, Salmonella enterica enterica serovar Typhi Ty2
ugagcgccgcgccuaccagc

SEQ ID NO: 1788338 - RNA, 13 nt, Salmonella enterica enterica serovar Typhi Ty2
ugagcgcaaugcu

SEQ ID NO: 1788339 - RNA, 19 nt, Salmonella enterica enterica serovar Typhi Ty2
ugacugguuuguugcgucu

SEQ ID NO: 1788340 - RNA, 13 nt, Salmonella enterica enterica serovar Typhi Ty2
ugacugcugucau

SEQ ID NO: 1788341 - RNA, 19 nt, Salmonella enterica enterica serovar Typhi Ty2
ugacugcaaaucugccguc

SEQ ID NO: 1788342 - RNA, 14 nt, Salmonella enterica enterica serovar Typhi Ty2
ugagaauggcggga

SEQ ID NO: 1788343 - RNA, 18 nt, Salmonella enterica enterica serovar Typhi Ty2
ugagaauuuccaguucaa

SEQ ID NO: 1788344 - RNA, 18 nt, Salmonella enterica enterica serovar Typhi Ty2
ugagaaaagcgaaaauaa

SEQ ID NO: 1788345 - RNA, 14 nt, Salmonella enterica enterica serovar Typhi Ty2
ugagaaaagcagag

SEQ ID NO: 1788346 - RNA, 20 nt, Salmonella enterica enterica serovar Typhi Ty2
ugagaaaaggaagaauaaau

SEQ ID NO: 1788347 - RNA, 15 nt, Salmonella enterica enterica serovar Typhi Ty2
ugagaaaaggaagaa

SEQ ID NO: 1788348 - RNA, 14 nt, Salmonella enterica enterica serovar Typhi Ty2
ugagaaaaauuuaa

SEQ ID NO: 1788349 - RNA, 23 nt, Salmonella enterica enterica serovar Typhi Ty2
ugagaaaaggaagaauaaauaac

SEQ ID NO: 1788350 - RNA, 16 nt, Salmonella enterica enterica serovar Typhi Ty2
ugacuuugcucuccuu

SEQ ID NO: 1788351 - RNA, 20 nt, Salmonella enterica enterica serovar Typhi Ty2
ugagcagaucagcacgcgcc

SEQ ID NO: 1788352 - RNA, 21 nt, Salmonella enterica enterica serovar Typhi Ty2
ugagaugcaggccaagcagcg

SEQ ID NO: 1788353 - RNA, 19 nt, Salmonella enterica enterica serovar Typhi Ty2
ugagccacgguaguuucaa

SEQ ID NO: 1788354 - RNA, 14 nt, Salmonella enterica enterica serovar Typhi Ty2
ugagcauugcgcuc

SEQ ID NO: 1788355 - RNA, 14 nt, Salmonella enterica enterica serovar Typhi Ty2
ugagcccuccucca

SEQ ID NO: 1788356 - RNA, 20 nt, Salmonella enterica enterica serovar Typhi Ty2
ugagccgaaauccaccagcg

SEQ ID NO: 1788357 - RNA, 19 nt, Salmonella enterica enterica serovar Typhi Ty2
ugagcgaauccccgggaac

SEQ ID NO: 1788358 - RNA, 16 nt, Salmonella enterica enterica serovar Typhi Ty2
ugagcgagaauuuuau

SEQ ID NO: 1788359 - RNA, 20 nt, Salmonella enterica enterica serovar Typhi Ty2
ugcgcguaaauuucacuuau

SEQ ID NO: 1788360 - RNA, 20 nt, Salmonella enterica enterica serovar Typhi Ty2
ugcgcgggcguauagccagg

SEQ ID NO: 1788361 - RNA, 14 nt, Salmonella enterica enterica serovar Typhi Ty2
ugcgcgucccucuc

SEQ ID NO: 1788362 - RNA, 20 nt, Salmonella enterica enterica serovar Typhi Ty2
ugcgcgucccucuccagggc

SEQ ID NO: 1788363 - RNA, 21 nt, Salmonella enterica enterica serovar Typhi Ty2
ugcgcgugcgguuuuccugau

SEQ ID NO: 1788364 - RNA, 17 nt, Salmonella enterica enterica serovar Typhi Ty2
ugcgcguuuuccaccag

SEQ ID NO: 1788365 - RNA, 17 nt, Salmonella enterica enterica serovar Typhi Ty2
ugcgcguuuagcgccag

SEQ ID NO: 1788366 - RNA, 16 nt, Salmonella enterica enterica serovar Typhi Ty2
ugcgcguucugcucca

SEQ ID NO: 1788367 - RNA, 17 nt, Salmonella enterica enterica serovar Typhi Ty2
ugcgcguucugcuccag

SEQ ID NO: 1788368 - RNA, 12 nt, Salmonella enterica enterica serovar Typhi Ty2
ugcgcgcuauuc

SEQ ID NO: 1788369 - RNA, 17 nt, Salmonella enterica enterica serovar Typhi Ty2
ugcgcggcgaaaaagcc

SEQ ID NO: 1788370 - RNA, 17 nt, Salmonella enterica enterica serovar Typhi Ty2
ugcgcgcgaugcugcuc

SEQ ID NO: 1788371 - RNA, 18 nt, Salmonella enterica enterica serovar Typhi Ty2
ugcgcgcgaugcugcucc

SEQ ID NO: 1788372 - RNA, 16 nt, Salmonella enterica enterica serovar Typhi Ty2
ugcgcgccgacaggcu

SEQ ID NO: 1788373 - RNA, 23 nt, Salmonella enterica enterica serovar Typhi Ty2
ugcgcuaagcguuacggaaaaaa

SEQ ID NO: 1788374 - RNA, 12 nt, Salmonella enterica enterica serovar Typhi Ty2
ugcgcuaagcgu

SEQ ID NO: 1788375 - RNA, 14 nt, Salmonella enterica enterica serovar Typhi Ty2
ugcgcucaggguca

SEQ ID NO: 1788376 - RNA, 15 nt, Salmonella enterica enterica serovar Typhi Ty2
ugcgcuauuacucuu

SEQ ID NO: 1788377 - RNA, 14 nt, Salmonella enterica enterica serovar Typhi Ty2
ugcgcuccggcgcu

SEQ ID NO: 1788378 - RNA, 22 nt, Salmonella enterica enterica serovar Typhi Ty2
ugcgcugaauagcgcugcggcu

SEQ ID NO: 1788379 - RNA, 14 nt, Salmonella enterica enterica serovar Typhi Ty2
ugcgcugcaaaaag

SEQ ID NO: 1788380 - RNA, 19 nt, Salmonella enterica enterica serovar Typhi Ty2
ugcggagaagacgccgccg

SEQ ID NO: 1788381 - RNA, 18 nt, Salmonella enterica enterica serovar Typhi Ty2
ugcggacaggcgaaauaa

SEQ ID NO: 1788382 - RNA, 20 nt, Salmonella enterica enterica serovar Typhi Ty2
ugcggacgcagcucauaccc

SEQ ID NO: 1788383 - RNA, 15 nt, Salmonella enterica enterica serovar Typhi Ty2
ugcgcuggaacugau

SEQ ID NO: 1788384 - RNA, 15 nt, Salmonella enterica enterica serovar Typhi Ty2
ugcgcugcgcgcgau

SEQ ID NO: 1788385 - RNA, 17 nt, Salmonella enterica enterica serovar Typhi Ty2
ugcgcugcggccagacc

SEQ ID NO: 1788386 - RNA, 15 nt, Salmonella enterica enterica serovar Typhi Ty2
ugcggaugcgccauc

SEQ ID NO: 1788387 - RNA, 22 nt, Salmonella enterica enterica serovar Typhi Ty2
ugcgggccguaaaguucccagc

SEQ ID NO: 1788388 - RNA, 12 nt, Salmonella enterica enterica serovar Typhi Ty2
ugcggggaacac

SEQ ID NO: 1788389 - RNA, 18 nt, Salmonella enterica enterica serovar Typhi Ty2
ugcggggaacacuaaaac

SEQ ID NO: 1788390 - RNA, 19 nt, Salmonella enterica enterica serovar Typhi Ty2
ugcggggagcgaaaaggcc

SEQ ID NO: 1788391 - RNA, 18 nt, Salmonella enterica enterica serovar Typhi Ty2
ugcgggcaugggaaauaa

SEQ ID NO: 1788392 - RNA, 21 nt, Salmonella enterica enterica serovar Typhi Ty2
ugcggccagacaauacuuaaa

SEQ ID NO: 1788393 - RNA, 15 nt, Salmonella enterica enterica serovar Typhi Ty2
ugcgguaaauaaugc

SEQ ID NO: 1788394 - RNA, 17 nt, Salmonella enterica enterica serovar Typhi Ty2
ugcgguagcuccagaca

SEQ ID NO: 1788395 - RNA, 20 nt, Salmonella enterica enterica serovar Typhi Ty2
ugcggguguccguuccugcc

SEQ ID NO: 1788396 - RNA, 19 nt, Salmonella enterica enterica serovar Typhi Ty2
ugcguaaugagcgucgcca

SEQ ID NO: 1788397 - RNA, 21 nt, Salmonella enterica enterica serovar Typhi Ty2
ugcguaauacggagcaaaaaa

SEQ ID NO: 1788398 - RNA, 17 nt, Salmonella enterica enterica serovar Typhi Ty2
ugcggucaaaagcugca

SEQ ID NO: 1788399 - RNA, 22 nt, Salmonella enterica enterica serovar Typhi Ty2
ugcguaccgcuaucgccaaacu

SEQ ID NO: 1788400 - RNA, 13 nt, Salmonella enterica enterica serovar Typhi Ty2
ugcguauuuccac

SEQ ID NO: 1788401 - RNA, 15 nt, Salmonella enterica enterica serovar Typhi Ty2
ugcguaucgcccacc

SEQ ID NO: 1788402 - RNA, 12 nt, Salmonella enterica enterica serovar Typhi Ty2
ugcgccuuccag

SEQ ID NO: 1788403 - RNA, 22 nt, Salmonella enterica enterica serovar Typhi Ty2
ugcgccuguuagggcgcggcug

SEQ ID NO: 1788404 - RNA, 21 nt, Salmonella enterica enterica serovar Typhi Ty2
ugcgccuguuagggcgcggcu

SEQ ID NO: 1788405 - RNA, 18 nt, Salmonella enterica enterica serovar Typhi Ty2
ugcgccugugguuuaaaa

SEQ ID NO: 1788406 - RNA, 15 nt, Salmonella enterica enterica serovar Typhi Ty2
ugcgccuuaucaagc

SEQ ID NO: 1788407 - RNA, 13 nt, Salmonella enterica enterica serovar Typhi Ty2
ugcgccuuccagu

SEQ ID NO: 1788408 - RNA, 14 nt, Salmonella enterica enterica serovar Typhi Ty2
ugcgcgauguucau

SEQ ID NO: 1788409 - RNA, 19 nt, Salmonella enterica enterica serovar Typhi Ty2
ugcgcgacgacgccagcca

SEQ ID NO: 1788410 - RNA, 17 nt, Salmonella enterica enterica serovar Typhi Ty2
ugcgcgacgacgccagc

SEQ ID NO: 1788411 - RNA, 17 nt, Salmonella enterica enterica serovar Typhi Ty2
aaaugggcuggaaauau

SEQ ID NO: 1788412 - RNA, 16 nt, Salmonella enterica enterica serovar Typhi Ty2
aaauggguaucgccuu

SEQ ID NO: 1788413 - RNA, 21 nt, Salmonella enterica enterica serovar Typhi Ty2
ugcgccgugaaauauccuccg

SEQ ID NO: 1788414 - RNA, 15 nt, Salmonella enterica enterica serovar Typhi Ty2
ugcgccgugccuggc

SEQ ID NO: 1788415 - RNA, 19 nt, Salmonella enterica enterica serovar Typhi Ty2
ugcgccgucaggcuugccg

SEQ ID NO: 1788416 - RNA, 21 nt, Salmonella enterica enterica serovar Typhi Ty2
ugcgccgucaggcuugccgcg

SEQ ID NO: 1788417 - RNA, 14 nt, Salmonella enterica enterica serovar Typhi Ty2
ugcgccgugccugg

SEQ ID NO: 1788418 - RNA, 23 nt, Salmonella enterica enterica serovar Typhi Ty2
ugcgccugggugggcggaaaacu

SEQ ID NO: 1788419 - RNA, 21 nt, Salmonella enterica enterica serovar Typhi Ty2
aaauggcaaguaaaauagccc

SEQ ID NO: 1788420 - RNA, 21 nt, Salmonella enterica enterica serovar Typhi Ty2
ugcgccccggcggcguacagc

SEQ ID NO: 1788421 - RNA, 14 nt, Salmonella enterica enterica serovar Typhi Ty2
aaauggauacuggu

SEQ ID NO: 1788422 - RNA, 14 nt, Salmonella enterica enterica serovar Typhi Ty2
ugcgcccacaauga

SEQ ID NO: 1788423 - RNA, 21 nt, Salmonella enterica enterica serovar Typhi Ty2
ugcgcccagcccggaaauaaa

SEQ ID NO: 1788424 - RNA, 14 nt, Salmonella enterica enterica serovar Typhi Ty2
ugcgccauuuccag

SEQ ID NO: 1788425 - RNA, 21 nt, Salmonella enterica enterica serovar Typhi Ty2
ugcgcauccgcggcgcuuugc

SEQ ID NO: 1788426 - RNA, 16 nt, Salmonella enterica enterica serovar Typhi Ty2
ugcgcaucaccguuac

SEQ ID NO: 1788427 - RNA, 21 nt, Salmonella enterica enterica serovar Typhi Ty2
ugcgcagguaaaaccagauac

SEQ ID NO: 1788428 - RNA, 16 nt, Salmonella enterica enterica serovar Typhi Ty2
ugcgcaggccgcgccg

SEQ ID NO: 1788429 - RNA, 18 nt, Salmonella enterica enterica serovar Typhi Ty2
ugcgcaggccgcgccgcu

SEQ ID NO: 1788430 - RNA, 21 nt, Salmonella enterica enterica serovar Typhi Ty2
ugcgacaucagccagccgcca

SEQ ID NO: 1788431 - RNA, 15 nt, Salmonella enterica enterica serovar Typhi Ty2
ugcgacaucagccag

SEQ ID NO: 1788432 - RNA, 15 nt, Salmonella enterica enterica serovar Typhi Ty2
ugcgaccacuccggc

SEQ ID NO: 1788433 - RNA, 13 nt, Salmonella enterica enterica serovar Typhi Ty2
ugcgacgccagau

SEQ ID NO: 1788434 - RNA, 14 nt, Salmonella enterica enterica serovar Typhi Ty2
ugcgacgccaggcg

SEQ ID NO: 1788435 - RNA, 20 nt, Salmonella enterica enterica serovar Typhi Ty2
ugcgacgccaggcgccacga

SEQ ID NO: 1788436 - RNA, 18 nt, Salmonella enterica enterica serovar Typhi Ty2
ugcgacugaaaaucaaaa

SEQ ID NO: 1788437 - RNA, 21 nt, Salmonella enterica enterica serovar Typhi Ty2
ugcgacucggugccgcugcug

SEQ ID NO: 1788438 - RNA, 22 nt, Salmonella enterica enterica serovar Typhi Ty2
ugccuggcaacaugaccagcgc

SEQ ID NO: 1788439 - RNA, 15 nt, Salmonella enterica enterica serovar Typhi Ty2
ugccuggcucauucu

SEQ ID NO: 1788440 - RNA, 17 nt, Salmonella enterica enterica serovar Typhi Ty2
ugccucccguuucagug

SEQ ID NO: 1788441 - RNA, 15 nt, Salmonella enterica enterica serovar Typhi Ty2
ugccugcgccauguu

SEQ ID NO: 1788442 - RNA, 15 nt, Salmonella enterica enterica serovar Typhi Ty2
ugccugcuucagaca

SEQ ID NO: 1788443 - RNA, 14 nt, Salmonella enterica enterica serovar Typhi Ty2
ugccugcuccgcca

SEQ ID NO: 1788444 - RNA, 18 nt, Salmonella enterica enterica serovar Typhi Ty2
ugcgagcaguucagcagc

SEQ ID NO: 1788445 - RNA, 15 nt, Salmonella enterica enterica serovar Typhi Ty2
ugcgcaaccuccgcg

SEQ ID NO: 1788446 - RNA, 12 nt, Salmonella enterica enterica serovar Typhi Ty2
ugcgagaccauc

SEQ ID NO: 1788447 - RNA, 18 nt, Salmonella enterica enterica serovar Typhi Ty2
ugcgcagcguuuccagac

SEQ ID NO: 1788448 - RNA, 20 nt, Salmonella enterica enterica serovar Typhi Ty2
ugcgcagccccagcgccagc

SEQ ID NO: 1788449 - RNA, 22 nt, Salmonella enterica enterica serovar Typhi Ty2
ugcgcaacguuucuuucaucag

SEQ ID NO: 1788450 - RNA, 18 nt, Salmonella enterica enterica serovar Typhi Ty2
ugcgcaacguuucuuuca

SEQ ID NO: 1788451 - RNA, 14 nt, Salmonella enterica enterica serovar Typhi Ty2
ugcgcaagaaacau

SEQ ID NO: 1788452 - RNA, 21 nt, Salmonella enterica enterica serovar Typhi Ty2
ugcgcaagcacugaaugcuga

SEQ ID NO: 1788453 - RNA, 23 nt, Salmonella enterica enterica serovar Typhi Ty2
ugcccuuuuugcauucgcuccuc

SEQ ID NO: 1788454 - RNA, 14 nt, Salmonella enterica enterica serovar Typhi Ty2
ugcccuuuuccaga

SEQ ID NO: 1788455 - RNA, 20 nt, Salmonella enterica enterica serovar Typhi Ty2
ugccgacaaagagcucccca

SEQ ID NO: 1788456 - RNA, 17 nt, Salmonella enterica enterica serovar Typhi Ty2
ugccgacagaacugauu

SEQ ID NO: 1788457 - RNA, 20 nt, Salmonella enterica enterica serovar Typhi Ty2
ugccgauaauaaacgcgcca

SEQ ID NO: 1788458 - RNA, 21 nt, Salmonella enterica enterica serovar Typhi Ty2
ugccgauaauaaacgcgccaa

SEQ ID NO: 1788459 - RNA, 14 nt, Salmonella enterica enterica serovar Typhi Ty2
ugccgagcaacaga

SEQ ID NO: 1788460 - RNA, 21 nt, Salmonella enterica enterica serovar Typhi Ty2
ugccgagcaacagaaaccaua

SEQ ID NO: 1788461 - RNA, 18 nt, Salmonella enterica enterica serovar Typhi Ty2
ugccgaccgccagcagag

SEQ ID NO: 1788462 - RNA, 17 nt, Salmonella enterica enterica serovar Typhi Ty2
ugcccuggaauuuuucc

SEQ ID NO: 1788463 - RNA, 23 nt, Salmonella enterica enterica serovar Typhi Ty2
ugcccugcuugucgaucaucaga

SEQ ID NO: 1788464 - RNA, 21 nt, Salmonella enterica enterica serovar Typhi Ty2
ugcccuuaucuggaugaggac

SEQ ID NO: 1788465 - RNA, 18 nt, Salmonella enterica enterica serovar Typhi Ty2
ugcccuuaaauccggccu

SEQ ID NO: 1788466 - RNA, 22 nt, Salmonella enterica enterica serovar Typhi Ty2
ugcccuucgacaaucagcacca

SEQ ID NO: 1788467 - RNA, 19 nt, Salmonella enterica enterica serovar Typhi Ty2
ugcccugcuggcgcaugau

SEQ ID NO: 1788468 - RNA, 15 nt, Salmonella enterica enterica serovar Typhi Ty2
ugcccucggaaaacu

SEQ ID NO: 1788469 - RNA, 14 nt, Salmonella enterica enterica serovar Typhi Ty2
ugccgcacucccca

SEQ ID NO: 1788470 - RNA, 21 nt, Salmonella enterica enterica serovar Typhi Ty2
ugccgcagccgcucaggguaa

SEQ ID NO: 1788471 - RNA, 19 nt, Salmonella enterica enterica serovar Typhi Ty2
ugccgcagccacauuguau

SEQ ID NO: 1788472 - RNA, 12 nt, Salmonella enterica enterica serovar Typhi Ty2
ugccgcaggcaa

SEQ ID NO: 1788473 - RNA, 23 nt, Salmonella enterica enterica serovar Typhi Ty2
ugccgauuuaccucucaccagua

SEQ ID NO: 1788474 - RNA, 20 nt, Salmonella enterica enterica serovar Typhi Ty2
ugccgcaaacgccugcuccg

SEQ ID NO: 1788475 - RNA, 16 nt, Salmonella enterica enterica serovar Typhi Ty2
ugccgauggcuauuac

SEQ ID NO: 1788476 - RNA, 16 nt, Salmonella enterica enterica serovar Typhi Ty2
ugccgaugccgccgca

SEQ ID NO: 1788477 - RNA, 21 nt, Salmonella enterica enterica serovar Typhi Ty2
ugccgaucaccagcgcaucuc

SEQ ID NO: 1788478 - RNA, 18 nt, Salmonella enterica enterica serovar Typhi Ty2
ugccgaucaccagcgcau

SEQ ID NO: 1788479 - RNA, 21 nt, Salmonella enterica enterica serovar Typhi Ty2
ugccgcccugaaagccgaccc

SEQ ID NO: 1788480 - RNA, 21 nt, Salmonella enterica enterica serovar Typhi Ty2
ugccgcccguuuuuuccagcg

SEQ ID NO: 1788481 - RNA, 19 nt, Salmonella enterica enterica serovar Typhi Ty2
ugccgccgcgaugcaucuu

SEQ ID NO: 1788482 - RNA, 21 nt, Salmonella enterica enterica serovar Typhi Ty2
ugccgccgacaaccagcgaaa

SEQ ID NO: 1788483 - RNA, 20 nt, Salmonella enterica enterica serovar Typhi Ty2
ugccgcccagggaaagauca

SEQ ID NO: 1788484 - RNA, 21 nt, Salmonella enterica enterica serovar Typhi Ty2
ugccgccaguuguucaacaua

SEQ ID NO: 1788485 - RNA, 21 nt, Salmonella enterica enterica serovar Typhi Ty2
ugccgccauaacgccggcgcu

SEQ ID NO: 1788486 - RNA, 23 nt, Salmonella enterica enterica serovar Typhi Ty2
ugccgccaucagcgucagcagag

SEQ ID NO: 1788487 - RNA, 20 nt, Salmonella enterica enterica serovar Typhi Ty2
ugccgccauuauucugaauu

SEQ ID NO: 1788488 - RNA, 20 nt, Salmonella enterica enterica serovar Typhi Ty2
ugccgccauucgcuuccgcc

SEQ ID NO: 1788489 - RNA, 18 nt, Salmonella enterica enterica serovar Typhi Ty2
ugccgccacgccgcucca

SEQ ID NO: 1788490 - RNA, 22 nt, Salmonella enterica enterica serovar Typhi Ty2
ugccgccacgccgcuccacagc

SEQ ID NO: 1788491 - RNA, 15 nt, Salmonella enterica enterica serovar Typhi Ty2
ugccgccagcaguug

SEQ ID NO: 1788492 - RNA, 19 nt, Salmonella enterica enterica serovar Typhi Ty2
ugccgcaucuucgcccggc

SEQ ID NO: 1788493 - RNA, 17 nt, Salmonella enterica enterica serovar Typhi Ty2
ugccggcuuuccgcacc

SEQ ID NO: 1788494 - RNA, 13 nt, Salmonella enterica enterica serovar Typhi Ty2
ugccgggaaaacg

SEQ ID NO: 1788495 - RNA, 20 nt, Salmonella enterica enterica serovar Typhi Ty2
ugccgggcaaaaaacggaac

SEQ ID NO: 1788496 - RNA, 16 nt, Salmonella enterica enterica serovar Typhi Ty2
ugccgggaaaacggcc

SEQ ID NO: 1788497 - RNA, 18 nt, Salmonella enterica enterica serovar Typhi Ty2
ugccgucaauuuuaagaa

SEQ ID NO: 1788498 - RNA, 14 nt, Salmonella enterica enterica serovar Typhi Ty2
ugccguaggcaacg

SEQ ID NO: 1788499 - RNA, 18 nt, Salmonella enterica enterica serovar Typhi Ty2
ugccguaggcgacgccaa

SEQ ID NO: 1788500 - RNA, 18 nt, Salmonella enterica enterica serovar Typhi Ty2
ugccgugcauguccagac

SEQ ID NO: 1788501 - RNA, 18 nt, Salmonella enterica enterica serovar Typhi Ty2
ugccguccggcaucacaa

SEQ ID NO: 1788502 - RNA, 20 nt, Salmonella enterica enterica serovar Typhi Ty2
ugccgugaauauucagaucg

SEQ ID NO: 1788503 - RNA, 12 nt, Salmonella enterica enterica serovar Typhi Ty2
ugccuaaagaaa

SEQ ID NO: 1788504 - RNA, 20 nt, Salmonella enterica enterica serovar Typhi Ty2
ugccuaagauggcgccuugc

SEQ ID NO: 1788505 - RNA, 17 nt, Salmonella enterica enterica serovar Typhi Ty2
ugccuauucaccagacu

SEQ ID NO: 1788506 - RNA, 19 nt, Salmonella enterica enterica serovar Typhi Ty2
ugccucaacaaguccuucu

SEQ ID NO: 1788507 - RNA, 18 nt, Salmonella enterica enterica serovar Typhi Ty2
ugccguuuuucucaucaa

SEQ ID NO: 1788508 - RNA, 17 nt, Salmonella enterica enterica serovar Typhi Ty2
ugccguuuuccagccgu

SEQ ID NO: 1788509 - RNA, 12 nt, Salmonella enterica enterica serovar Typhi Ty2
ugccguuuucaa

SEQ ID NO: 1788510 - RNA, 14 nt, Salmonella enterica enterica serovar Typhi Ty2
ugccguuggcgcga

SEQ ID NO: 1788511 - RNA, 17 nt, Salmonella enterica enterica serovar Typhi Ty2
ugccguuaacugcugcu

SEQ ID NO: 1788512 - RNA, 14 nt, Salmonella enterica enterica serovar Typhi Ty2
ugccguuaacugcu

SEQ ID NO: 1788513 - RNA, 22 nt, Salmonella enterica enterica serovar Typhi Ty2
ugccgugcgccgacaucgccac

SEQ ID NO: 1788514 - RNA, 16 nt, Salmonella enterica enterica serovar Typhi Ty2
ugccgcguuacucggc

SEQ ID NO: 1788515 - RNA, 23 nt, Salmonella enterica enterica serovar Typhi Ty2
ugccgcgcuggugggacuguuca

SEQ ID NO: 1788516 - RNA, 22 nt, Salmonella enterica enterica serovar Typhi Ty2
ugccgcuggugcuacgggcgcu

SEQ ID NO: 1788517 - RNA, 16 nt, Salmonella enterica enterica serovar Typhi Ty2
ugccggaacucagcua

SEQ ID NO: 1788518 - RNA, 19 nt, Salmonella enterica enterica serovar Typhi Ty2
ugccggaagcggacgggcg

SEQ ID NO: 1788519 - RNA, 23 nt, Salmonella enterica enterica serovar Typhi Ty2
ugccggaaagacggcagcgccau

SEQ ID NO: 1788520 - RNA, 14 nt, Salmonella enterica enterica serovar Typhi Ty2
ugccggacgcggcu

SEQ ID NO: 1788521 - RNA, 18 nt, Salmonella enterica enterica serovar Typhi Ty2
ugccgcgccugccauagc

SEQ ID NO: 1788522 - RNA, 17 nt, Salmonella enterica enterica serovar Typhi Ty2
ugccgcgcccagcgccg

SEQ ID NO: 1788523 - RNA, 19 nt, Salmonella enterica enterica serovar Typhi Ty2
ugccgccggaccaucuucc

SEQ ID NO: 1788524 - RNA, 16 nt, Salmonella enterica enterica serovar Typhi Ty2
ugccgccgucgcggcu

SEQ ID NO: 1788525 - RNA, 23 nt, Salmonella enterica enterica serovar Typhi Ty2
ugccgccgucaucugcgccgaca

SEQ ID NO: 1788526 - RNA, 14 nt, Salmonella enterica enterica serovar Typhi Ty2
ugcccagccuucuc

SEQ ID NO: 1788527 - RNA, 16 nt, Salmonella enterica enterica serovar Typhi Ty2
ugcccagcucagcuuu

SEQ ID NO: 1788528 - RNA, 20 nt, Salmonella enterica enterica serovar Typhi Ty2
ugcccaccugaaaaagggua

SEQ ID NO: 1788529 - RNA, 20 nt, Salmonella enterica enterica serovar Typhi Ty2
ugcccaccggcccacgcagu

SEQ ID NO: 1788530 - RNA, 15 nt, Salmonella enterica enterica serovar Typhi Ty2
ugcccacccgggccg

SEQ ID NO: 1788531 - RNA, 23 nt, Salmonella enterica enterica serovar Typhi Ty2
ugcccccaucacuuuacccacau

SEQ ID NO: 1788532 - RNA, 15 nt, Salmonella enterica enterica serovar Typhi Ty2
ugccccauuguucuu

SEQ ID NO: 1788533 - RNA, 21 nt, Salmonella enterica enterica serovar Typhi Ty2
ugccccacgauacgccccugc

SEQ ID NO: 1788534 - RNA, 19 nt, Salmonella enterica enterica serovar Typhi Ty2
ugcccauuuccugcauuaa

SEQ ID NO: 1788535 - RNA, 13 nt, Salmonella enterica enterica serovar Typhi Ty2
ugcccauuccgcc

SEQ ID NO: 1788536 - RNA, 18 nt, Salmonella enterica enterica serovar Typhi Ty2
ugcccauucuucgucguc

SEQ ID NO: 1788537 - RNA, 23 nt, Salmonella enterica enterica serovar Typhi Ty2
ugcccaguuuacccagcgaaugc

SEQ ID NO: 1788538 - RNA, 19 nt, Salmonella enterica enterica serovar Typhi Ty2
ugcccaucgcgccaugauu

SEQ ID NO: 1788539 - RNA, 20 nt, Salmonella enterica enterica serovar Typhi Ty2
ugcccgcaaucucuggccag

SEQ ID NO: 1788540 - RNA, 21 nt, Salmonella enterica enterica serovar Typhi Ty2
ugcccgaugagcuugcacuau

SEQ ID NO: 1788541 - RNA, 15 nt, Salmonella enterica enterica serovar Typhi Ty2
ugcccgauggcgcua

SEQ ID NO: 1788542 - RNA, 14 nt, Salmonella enterica enterica serovar Typhi Ty2
ugcccgccagcggg

SEQ ID NO: 1788543 - RNA, 13 nt, Salmonella enterica enterica serovar Typhi Ty2
ugcccgccagcgg

SEQ ID NO: 1788544 - RNA, 15 nt, Salmonella enterica enterica serovar Typhi Ty2
ugcccgccgccggcc

SEQ ID NO: 1788545 - RNA, 12 nt, Salmonella enterica enterica serovar Typhi Ty2
ugccccucuucc

SEQ ID NO: 1788546 - RNA, 14 nt, Salmonella enterica enterica serovar Typhi Ty2
ugccccugaccgaa

SEQ ID NO: 1788547 - RNA, 15 nt, Salmonella enterica enterica serovar Typhi Ty2
ugccccucccugaau

SEQ ID NO: 1788548 - RNA, 17 nt, Salmonella enterica enterica serovar Typhi Ty2
ugcccgucggacucauc

SEQ ID NO: 1788549 - RNA, 19 nt, Salmonella enterica enterica serovar Typhi Ty2
ugcccgguggcgcugcgcu

SEQ ID NO: 1788550 - RNA, 21 nt, Salmonella enterica enterica serovar Typhi Ty2
ugcccgguuaaggggcaggcg

SEQ ID NO: 1788551 - RNA, 17 nt, Salmonella enterica enterica serovar Typhi Ty2
ugcccggggugaacaaa

SEQ ID NO: 1788552 - RNA, 19 nt, Salmonella enterica enterica serovar Typhi Ty2
ugcccggcgcggcaucauc

SEQ ID NO: 1788553 - RNA, 23 nt, Salmonella enterica enterica serovar Typhi Ty2
ugcccggcgcguuuuggcagaca

SEQ ID NO: 1788554 - RNA, 21 nt, Salmonella enterica enterica serovar Typhi Ty2
ugcccgcucgcuuacgcggcg

SEQ ID NO: 1788555 - RNA, 21 nt, Salmonella enterica enterica serovar Typhi Ty2
ugcccggcaugucgccagcca

SEQ ID NO: 1788556 - RNA, 19 nt, Salmonella enterica enterica serovar Typhi Ty2
ugccagcguaagucugaua

SEQ ID NO: 1788557 - RNA, 14 nt, Salmonella enterica enterica serovar Typhi Ty2
ugccagcggccagg

SEQ ID NO: 1788558 - RNA, 18 nt, Salmonella enterica enterica serovar Typhi Ty2
ugccagcggccagggcgu

SEQ ID NO: 1788559 - RNA, 14 nt, Salmonella enterica enterica serovar Typhi Ty2
ugccagcgccguca

SEQ ID NO: 1788560 - RNA, 15 nt, Salmonella enterica enterica serovar Typhi Ty2
ugccagcgcucugca

SEQ ID NO: 1788561 - RNA, 19 nt, Salmonella enterica enterica serovar Typhi Ty2
ugccagcgcccuauccagc

SEQ ID NO: 1788562 - RNA, 16 nt, Salmonella enterica enterica serovar Typhi Ty2
ugccagccauagccca

SEQ ID NO: 1788563 - RNA, 14 nt, Salmonella enterica enterica serovar Typhi Ty2
ugccagcauuaacc

SEQ ID NO: 1788564 - RNA, 11 nt, Salmonella enterica enterica serovar Typhi Ty2
ugccaggcauu

SEQ ID NO: 1788565 - RNA, 18 nt, Salmonella enterica enterica serovar Typhi Ty2
ugccaggaagucagcuuc

SEQ ID NO: 1788566 - RNA, 23 nt, Salmonella enterica enterica serovar Typhi Ty2
ugccagcgucgcugauugccgcc

SEQ ID NO: 1788567 - RNA, 19 nt, Salmonella enterica enterica serovar Typhi Ty2
ugccagcgucgcugauugc

SEQ ID NO: 1788568 - RNA, 17 nt, Salmonella enterica enterica serovar Typhi Ty2
ugccagcucguuauuuc

SEQ ID NO: 1788569 - RNA, 19 nt, Salmonella enterica enterica serovar Typhi Ty2
ugccagcucguuauuuccg

SEQ ID NO: 1788570 - RNA, 20 nt, Salmonella enterica enterica serovar Typhi Ty2
ugccagcuuaaaucgcggcg

SEQ ID NO: 1788571 - RNA, 11 nt, Salmonella enterica enterica serovar Typhi Ty2
ugccagggugc

SEQ ID NO: 1788572 - RNA, 14 nt, Salmonella enterica enterica serovar Typhi Ty2
ugccagguuauuuc

SEQ ID NO: 1788573 - RNA, 14 nt, Salmonella enterica enterica serovar Typhi Ty2
ugccaggguucaac

SEQ ID NO: 1788574 - RNA, 23 nt, Salmonella enterica enterica serovar Typhi Ty2
ugccaguagcggaauaucuuccc

SEQ ID NO: 1788575 - RNA, 17 nt, Salmonella enterica enterica serovar Typhi Ty2
ugccaguaccgccgccg

SEQ ID NO: 1788576 - RNA, 19 nt, Salmonella enterica enterica serovar Typhi Ty2
ugccaguaacguucuucga

SEQ ID NO: 1788577 - RNA, 23 nt, Salmonella enterica enterica serovar Typhi Ty2
ugccagucaauaagcuugcuuuc

SEQ ID NO: 1788578 - RNA, 13 nt, Salmonella enterica enterica serovar Typhi Ty2
ugccagugaaaaa

SEQ ID NO: 1788579 - RNA, 17 nt, Salmonella enterica enterica serovar Typhi Ty2
ugccaguucauuccgcc

SEQ ID NO: 1788580 - RNA, 19 nt, Salmonella enterica enterica serovar Typhi Ty2
ugccauaaucgauauaauu

SEQ ID NO: 1788581 - RNA, 21 nt, Salmonella enterica enterica serovar Typhi Ty2
ugccauauuguucaguuucaa

SEQ ID NO: 1788582 - RNA, 17 nt, Salmonella enterica enterica serovar Typhi Ty2
ugccauacuguuuauca

SEQ ID NO: 1788583 - RNA, 13 nt, Salmonella enterica enterica serovar Typhi Ty2
ugccauauucaac

SEQ ID NO: 1788584 - RNA, 21 nt, Salmonella enterica enterica serovar Typhi Ty2
ugccauauuuuuccagcgccu

SEQ ID NO: 1788585 - RNA, 22 nt, Salmonella enterica enterica serovar Typhi Ty2
ugccaucauuaauuuacugaua

SEQ ID NO: 1788586 - RNA, 13 nt, Salmonella enterica enterica serovar Typhi Ty2
ugccaucauccag

SEQ ID NO: 1788587 - RNA, 19 nt, Salmonella enterica enterica serovar Typhi Ty2
ugccaucaucaguaacacc

SEQ ID NO: 1788588 - RNA, 16 nt, Salmonella enterica enterica serovar Typhi Ty2
ugccaucaucaguaac

SEQ ID NO: 1788589 - RNA, 18 nt, Salmonella enterica enterica serovar Typhi Ty2
ugccaucgaccgauuggg

SEQ ID NO: 1788590 - RNA, 12 nt, Salmonella enterica enterica serovar Typhi Ty2
ugccaucaucag

SEQ ID NO: 1788591 - RNA, 14 nt, Salmonella enterica enterica serovar Typhi Ty2
ugccaucggccagc

SEQ ID NO: 1788592 - RNA, 17 nt, Salmonella enterica enterica serovar Typhi Ty2
ugccaucgcuucuacag

SEQ ID NO: 1788593 - RNA, 16 nt, Salmonella enterica enterica serovar Typhi Ty2
ugccaucccauguuga

SEQ ID NO: 1788594 - RNA, 15 nt, Salmonella enterica enterica serovar Typhi Ty2
ugccauguuaauacc

SEQ ID NO: 1788595 - RNA, 11 nt, Salmonella enterica enterica serovar Typhi Ty2
ugccaugcugg

SEQ ID NO: 1788596 - RNA, 23 nt, Salmonella enterica enterica serovar Typhi Ty2
ugccauuaucaccauucccagcg

SEQ ID NO: 1788597 - RNA, 15 nt, Salmonella enterica enterica serovar Typhi Ty2
ugcccaaccugcgca

SEQ ID NO: 1788598 - RNA, 14 nt, Salmonella enterica enterica serovar Typhi Ty2
ugccacacccugag

SEQ ID NO: 1788599 - RNA, 15 nt, Salmonella enterica enterica serovar Typhi Ty2
ugccacagccucagc

SEQ ID NO: 1788600 - RNA, 13 nt, Salmonella enterica enterica serovar Typhi Ty2
ugccacaggccaa

SEQ ID NO: 1788601 - RNA, 16 nt, Salmonella enterica enterica serovar Typhi Ty2
ugccacuauagaugau

SEQ ID NO: 1788602 - RNA, 19 nt, Salmonella enterica enterica serovar Typhi Ty2
ugccacuauagaugaugga

SEQ ID NO: 1788603 - RNA, 12 nt, Salmonella enterica enterica serovar Typhi Ty2
ugccacuggccu

SEQ ID NO: 1788604 - RNA, 12 nt, Salmonella enterica enterica serovar Typhi Ty2
ugccacuguucg

SEQ ID NO: 1788605 - RNA, 16 nt, Salmonella enterica enterica serovar Typhi Ty2
ugccagcaccagcagu

SEQ ID NO: 1788606 - RNA, 14 nt, Salmonella enterica enterica serovar Typhi Ty2
ugccagcaccagca

SEQ ID NO: 1788607 - RNA, 18 nt, Salmonella enterica enterica serovar Typhi Ty2
ugccaaauguauacuccc

SEQ ID NO: 1788608 - RNA, 16 nt, Salmonella enterica enterica serovar Typhi Ty2
ugccaaguaauaaaga

SEQ ID NO: 1788609 - RNA, 21 nt, Salmonella enterica enterica serovar Typhi Ty2
ugccaagcguaguacguucca

SEQ ID NO: 1788610 - RNA, 19 nt, Salmonella enterica enterica serovar Typhi Ty2
ugcaggcgggugcgcagcc

SEQ ID NO: 1788611 - RNA, 15 nt, Salmonella enterica enterica serovar Typhi Ty2
ugcaggcgccugggu

SEQ ID NO: 1788612 - RNA, 22 nt, Salmonella enterica enterica serovar Typhi Ty2
ugcaggccggauaaggcagcaa

SEQ ID NO: 1788613 - RNA, 21 nt, Salmonella enterica enterica serovar Typhi Ty2
ugcaucaaacuucguuacuua

SEQ ID NO: 1788614 - RNA, 15 nt, Salmonella enterica enterica serovar Typhi Ty2
ugcauauuauucaug

SEQ ID NO: 1788615 - RNA, 16 nt, Salmonella enterica enterica serovar Typhi Ty2
ugcauauaacuuucaa

SEQ ID NO: 1788616 - RNA, 22 nt, Salmonella enterica enterica serovar Typhi Ty2
ugcauauacguugcggcgcguu

SEQ ID NO: 1788617 - RNA, 15 nt, Salmonella enterica enterica serovar Typhi Ty2
ugcagguaacgacua

SEQ ID NO: 1788618 - RNA, 17 nt, Salmonella enterica enterica serovar Typhi Ty2
ugcauguaguaagccau

SEQ ID NO: 1788619 - RNA, 15 nt, Salmonella enterica enterica serovar Typhi Ty2
ugcaugggcagcuug

SEQ ID NO: 1788620 - RNA, 14 nt, Salmonella enterica enterica serovar Typhi Ty2
ugcaugguagucgu

SEQ ID NO: 1788621 - RNA, 23 nt, Salmonella enterica enterica serovar Typhi Ty2
ugcaugguagucguuauaauccu

SEQ ID NO: 1788622 - RNA, 18 nt, Salmonella enterica enterica serovar Typhi Ty2
ugcaugcgcuggacuggg

SEQ ID NO: 1788623 - RNA, 17 nt, Salmonella enterica enterica serovar Typhi Ty2
ugcauggcagauaaacc

SEQ ID NO: 1788624 - RNA, 14 nt, Salmonella enterica enterica serovar Typhi Ty2
ugcaugaauaucaa

SEQ ID NO: 1788625 - RNA, 20 nt, Salmonella enterica enterica serovar Typhi Ty2
ugcaucuugaaugauuuugu

SEQ ID NO: 1788626 - RNA, 18 nt, Salmonella enterica enterica serovar Typhi Ty2
ugcauccgcgcuuucugg

SEQ ID NO: 1788627 - RNA, 12 nt, Salmonella enterica enterica serovar Typhi Ty2
ugcagcagccag

SEQ ID NO: 1788628 - RNA, 18 nt, Salmonella enterica enterica serovar Typhi Ty2
ugcagacugcacuuccug

SEQ ID NO: 1788629 - RNA, 15 nt, Salmonella enterica enterica serovar Typhi Ty2
ugcagcgaccuggga

SEQ ID NO: 1788630 - RNA, 18 nt, Salmonella enterica enterica serovar Typhi Ty2
ugcagcaggacgcgcacu

SEQ ID NO: 1788631 - RNA, 16 nt, Salmonella enterica enterica serovar Typhi Ty2
ugcaggaaguuuucug

SEQ ID NO: 1788632 - RNA, 20 nt, Salmonella enterica enterica serovar Typhi Ty2
ugcaggacagacagacguug

SEQ ID NO: 1788633 - RNA, 16 nt, Salmonella enterica enterica serovar Typhi Ty2
ugcagcgcuguccaga

SEQ ID NO: 1788634 - RNA, 13 nt, Salmonella enterica enterica serovar Typhi Ty2
ugcagcgccgccu

SEQ ID NO: 1788635 - RNA, 17 nt, Salmonella enterica enterica serovar Typhi Ty2
ugcaggauucgaaccug

SEQ ID NO: 1788636 - RNA, 13 nt, Salmonella enterica enterica serovar Typhi Ty2
ugcaggaggcgcg

SEQ ID NO: 1788637 - RNA, 14 nt, Salmonella enterica enterica serovar Typhi Ty2
ugcaggccggauaa

SEQ ID NO: 1788638 - RNA, 20 nt, Salmonella enterica enterica serovar Typhi Ty2
ugcacgccugcuucacguau

SEQ ID NO: 1788639 - RNA, 16 nt, Salmonella enterica enterica serovar Typhi Ty2
ugcacgcgcggcgcca

SEQ ID NO: 1788640 - RNA, 20 nt, Salmonella enterica enterica serovar Typhi Ty2
ugcacgccaggguaauacug

SEQ ID NO: 1788641 - RNA, 15 nt, Salmonella enterica enterica serovar Typhi Ty2
ugcacgccaggguaa

SEQ ID NO: 1788642 - RNA, 20 nt, Salmonella enterica enterica serovar Typhi Ty2
ugcacgcacgacagugcuau

SEQ ID NO: 1788643 - RNA, 16 nt, Salmonella enterica enterica serovar Typhi Ty2
ugcacgguugaagcga

SEQ ID NO: 1788644 - RNA, 17 nt, Salmonella enterica enterica serovar Typhi Ty2
ugauuuguuuuuuauau

SEQ ID NO: 1788645 - RNA, 17 nt, Salmonella enterica enterica serovar Typhi Ty2
ugcacgaaauguagagc

SEQ ID NO: 1788646 - RNA, 16 nt, Salmonella enterica enterica serovar Typhi Ty2
uccagcaaugauuuua

SEQ ID NO: 1788647 - RNA, 16 nt, Salmonella enterica enterica serovar Typhi Ty2
uccagcacauccucaa

SEQ ID NO: 1788648 - RNA, 17 nt, Salmonella enterica enterica serovar Typhi Ty2
uccagcaauaacaccgg

SEQ ID NO: 1788649 - RNA, 14 nt, Salmonella enterica enterica serovar Typhi Ty2
uccagcaacagaag

SEQ ID NO: 1788650 - RNA, 20 nt, Salmonella enterica enterica serovar Typhi Ty2
uccagcaaaccuuccgccag

SEQ ID NO: 1788651 - RNA, 12 nt, Salmonella enterica enterica serovar Typhi Ty2
uccagcacggca

SEQ ID NO: 1788652 - RNA, 14 nt, Salmonella enterica enterica serovar Typhi Ty2
uccagcagauuagc

SEQ ID NO: 1788653 - RNA, 13 nt, Salmonella enterica enterica serovar Typhi Ty2
uccagcagcacuu

SEQ ID NO: 1788654 - RNA, 14 nt, Salmonella enterica enterica serovar Typhi Ty2
uccagcacggccuu

SEQ ID NO: 1788655 - RNA, 17 nt, Salmonella enterica enterica serovar Typhi Ty2
uccagcacgguaaaccu

SEQ ID NO: 1788656 - RNA, 11 nt, Salmonella enterica enterica serovar Typhi Ty2
uccagcagcca

SEQ ID NO: 1788657 - RNA, 20 nt, Salmonella enterica enterica serovar Typhi Ty2
uccagcacggcauaagccuc

SEQ ID NO: 1788658 - RNA, 20 nt, Salmonella enterica enterica serovar Typhi Ty2
uccagcagcagagccggaac

SEQ ID NO: 1788659 - RNA, 22 nt, Salmonella enterica enterica serovar Typhi Ty2
uccagcagcagcaccggcuguu

SEQ ID NO: 1788660 - RNA, 13 nt, Salmonella enterica enterica serovar Typhi Ty2
uccagcagcgcau

SEQ ID NO: 1788661 - RNA, 16 nt, Salmonella enterica enterica serovar Typhi Ty2
uccagcgaaccuucca

SEQ ID NO: 1788662 - RNA, 17 nt, Salmonella enterica enterica serovar Typhi Ty2
uccagcgaaccuuccau

SEQ ID NO: 1788663 - RNA, 16 nt, Salmonella enterica enterica serovar Typhi Ty2
uccagcucauuuuuac

SEQ ID NO: 1788664 - RNA, 15 nt, Salmonella enterica enterica serovar Typhi Ty2
uccagcucagggucc

SEQ ID NO: 1788665 - RNA, 18 nt, Salmonella enterica enterica serovar Typhi Ty2
uccagcucagggucccca

SEQ ID NO: 1788666 - RNA, 14 nt, Salmonella enterica enterica serovar Typhi Ty2
uccagcucaguuuc

SEQ ID NO: 1788667 - RNA, 14 nt, Salmonella enterica enterica serovar Typhi Ty2
uccagcuccaucca

SEQ ID NO: 1788668 - RNA, 20 nt, Salmonella enterica enterica serovar Typhi Ty2
uccagcucgcgauaggccuc

SEQ ID NO: 1788669 - RNA, 14 nt, Salmonella enterica enterica serovar Typhi Ty2
uccagcguuucucu

SEQ ID NO: 1788670 - RNA, 14 nt, Salmonella enterica enterica serovar Typhi Ty2
uccagcuacuggcc

SEQ ID NO: 1788671 - RNA, 16 nt, Salmonella enterica enterica serovar Typhi Ty2
uccagcuacuggccac

SEQ ID NO: 1788672 - RNA, 23 nt, Salmonella enterica enterica serovar Typhi Ty2
uccagccccagcgccagcugcgu

SEQ ID NO: 1788673 - RNA, 13 nt, Salmonella enterica enterica serovar Typhi Ty2
uccagccagggau

SEQ ID NO: 1788674 - RNA, 22 nt, Salmonella enterica enterica serovar Typhi Ty2
uccagccgcccuucuccgguaa

SEQ ID NO: 1788675 - RNA, 23 nt, Salmonella enterica enterica serovar Typhi Ty2
uccagccgcccgcgauaaaaauc

SEQ ID NO: 1788676 - RNA, 17 nt, Salmonella enterica enterica serovar Typhi Ty2
uccagccgguguuaacc

SEQ ID NO: 1788677 - RNA, 19 nt, Salmonella enterica enterica serovar Typhi Ty2
uccauaaauaacauuucag

SEQ ID NO: 1788678 - RNA, 12 nt, Salmonella enterica enterica serovar Typhi Ty2
uccauaaaauga

SEQ ID NO: 1788679 - RNA, 13 nt, Salmonella enterica enterica serovar Typhi Ty2
uccauacauccau

SEQ ID NO: 1788680 - RNA, 19 nt, Salmonella enterica enterica serovar Typhi Ty2
uccaguacuuucuuuugau

SEQ ID NO: 1788681 - RNA, 14 nt, Salmonella enterica enterica serovar Typhi Ty2
uccaguaauuucag

SEQ ID NO: 1788682 - RNA, 14 nt, Salmonella enterica enterica serovar Typhi Ty2
uccagucagcguua

SEQ ID NO: 1788683 - RNA, 23 nt, Salmonella enterica enterica serovar Typhi Ty2
uccagcugguauaggccaggcua

SEQ ID NO: 1788684 - RNA, 19 nt, Salmonella enterica enterica serovar Typhi Ty2
uccagcugcgacagcgaac

SEQ ID NO: 1788685 - RNA, 19 nt, Salmonella enterica enterica serovar Typhi Ty2
uccagcuguuuaagcgccu

SEQ ID NO: 1788686 - RNA, 16 nt, Salmonella enterica enterica serovar Typhi Ty2
uccagguaacauacaa

SEQ ID NO: 1788687 - RNA, 24 nt, Salmonella enterica enterica serovar Typhi Ty2
uccaggcucgauaaucaucacgcu

SEQ ID NO: 1788688 - RNA, 22 nt, Salmonella enterica enterica serovar Typhi Ty2
uccaggaaguaaauuauuccuu

SEQ ID NO: 1788689 - RNA, 19 nt, Salmonella enterica enterica serovar Typhi Ty2
uccagggaaaccauguuga

SEQ ID NO: 1788690 - RNA, 20 nt, Salmonella enterica enterica serovar Typhi Ty2
uccagggauugauggccagc

SEQ ID NO: 1788691 - RNA, 14 nt, Salmonella enterica enterica serovar Typhi Ty2
uccaaauaaggacu

SEQ ID NO: 1788692 - RNA, 19 nt, Salmonella enterica enterica serovar Typhi Ty2
uccacauucguaacaugcu

SEQ ID NO: 1788693 - RNA, 16 nt, Salmonella enterica enterica serovar Typhi Ty2
uccaccaaccaggcaa

SEQ ID NO: 1788694 - RNA, 21 nt, Salmonella enterica enterica serovar Typhi Ty2
uccacauccagcgccagcgcc

SEQ ID NO: 1788695 - RNA, 15 nt, Salmonella enterica enterica serovar Typhi Ty2
uccacauaaaguagc

SEQ ID NO: 1788696 - RNA, 20 nt, Salmonella enterica enterica serovar Typhi Ty2
uccacagguuaucgccgccc

SEQ ID NO: 1788697 - RNA, 12 nt, Salmonella enterica enterica serovar Typhi Ty2
uccaccgccaga

SEQ ID NO: 1788698 - RNA, 19 nt, Salmonella enterica enterica serovar Typhi Ty2
uccaccgccagacgcccca

SEQ ID NO: 1788699 - RNA, 13 nt, Salmonella enterica enterica serovar Typhi Ty2
uccaccagcccau

SEQ ID NO: 1788700 - RNA, 22 nt, Salmonella enterica enterica serovar Typhi Ty2
uccagauuacuaugaggauuau

SEQ ID NO: 1788701 - RNA, 20 nt, Salmonella enterica enterica serovar Typhi Ty2
uccagaugcgccagauucau

SEQ ID NO: 1788702 - RNA, 14 nt, Salmonella enterica enterica serovar Typhi Ty2
uccagaucuucaga

SEQ ID NO: 1788703 - RNA, 15 nt, Salmonella enterica enterica serovar Typhi Ty2
uccagaggcguugcc

SEQ ID NO: 1788704 - RNA, 15 nt, Salmonella enterica enterica serovar Typhi Ty2
uccagaguacauucu

SEQ ID NO: 1788705 - RNA, 14 nt, Salmonella enterica enterica serovar Typhi Ty2
uccagaccaccagc

SEQ ID NO: 1788706 - RNA, 16 nt, Salmonella enterica enterica serovar Typhi Ty2
uccagacagccgacgg

SEQ ID NO: 1788707 - RNA, 16 nt, Salmonella enterica enterica serovar Typhi Ty2
uccagacaauccgcgg

SEQ ID NO: 1788708 - RNA, 20 nt, Salmonella enterica enterica serovar Typhi Ty2
uccacugagcuucaccgcca

SEQ ID NO: 1788709 - RNA, 17 nt, Salmonella enterica enterica serovar Typhi Ty2
uccagaauacgaauauu

SEQ ID NO: 1788710 - RNA, 16 nt, Salmonella enterica enterica serovar Typhi Ty2
uccacugagcgcgcca

SEQ ID NO: 1788711 - RNA, 19 nt, Salmonella enterica enterica serovar Typhi Ty2
uccaccuucucuuuaugcg

SEQ ID NO: 1788712 - RNA, 12 nt, Salmonella enterica enterica serovar Typhi Ty2
uccaccuggccc

SEQ ID NO: 1788713 - RNA, 14 nt, Salmonella enterica enterica serovar Typhi Ty2
ucaucuuuuaaaau

SEQ ID NO: 1788714 - RNA, 17 nt, Salmonella enterica enterica serovar Typhi Ty2
ucaucuuguccucauca

SEQ ID NO: 1788715 - RNA, 20 nt, Salmonella enterica enterica serovar Typhi Ty2
ucaucuucggcgggaucucc

SEQ ID NO: 1788716 - RNA, 17 nt, Salmonella enterica enterica serovar Typhi Ty2
ucaucuucacuucacaa

SEQ ID NO: 1788717 - RNA, 22 nt, Salmonella enterica enterica serovar Typhi Ty2
ucaucuucccgcagauauccgc

SEQ ID NO: 1788718 - RNA, 15 nt, Salmonella enterica enterica serovar Typhi Ty2
ucaucuuccaguacc

SEQ ID NO: 1788719 - RNA, 11 nt, Salmonella enterica enterica serovar Typhi Ty2
ucaucugcuuc

SEQ ID NO: 1788720 - RNA, 20 nt, Salmonella enterica enterica serovar Typhi Ty2
ucaucgucauuaaugccuaa

SEQ ID NO: 1788721 - RNA, 15 nt, Salmonella enterica enterica serovar Typhi Ty2
ucaucgucagcuccu

SEQ ID NO: 1788722 - RNA, 18 nt, Salmonella enterica enterica serovar Typhi Ty2
ucaucgguguucacaauu

SEQ ID NO: 1788723 - RNA, 14 nt, Salmonella enterica enterica serovar Typhi Ty2
ucaucguaccaaua

SEQ ID NO: 1788724 - RNA, 18 nt, Salmonella enterica enterica serovar Typhi Ty2
ucaucggucaguuugccc

SEQ ID NO: 1788725 - RNA, 17 nt, Salmonella enterica enterica serovar Typhi Ty2
ucaucuccgauaaauaa

SEQ ID NO: 1788726 - RNA, 19 nt, Salmonella enterica enterica serovar Typhi Ty2
ucaucuccgauaaauaaga

SEQ ID NO: 1788727 - RNA, 16 nt, Salmonella enterica enterica serovar Typhi Ty2
ucaucucaagccccau

SEQ ID NO: 1788728 - RNA, 13 nt, Salmonella enterica enterica serovar Typhi Ty2
ucaucugacugcg

SEQ ID NO: 1788729 - RNA, 14 nt, Salmonella enterica enterica serovar Typhi Ty2
ucaucuaucugcuu

SEQ ID NO: 1788730 - RNA, 17 nt, Salmonella enterica enterica serovar Typhi Ty2
ucaugaccgaaaucuuc

SEQ ID NO: 1788731 - RNA, 19 nt, Salmonella enterica enterica serovar Typhi Ty2
ucaugacaucgcccugggu

SEQ ID NO: 1788732 - RNA, 14 nt, Salmonella enterica enterica serovar Typhi Ty2
ucaugacgcgauau

SEQ ID NO: 1788733 - RNA, 18 nt, Salmonella enterica enterica serovar Typhi Ty2
ucaugacugguuuuucgc

SEQ ID NO: 1788734 - RNA, 21 nt, Salmonella enterica enterica serovar Typhi Ty2
ucaugacuuuuuucaaccuca

SEQ ID NO: 1788735 - RNA, 20 nt, Salmonella enterica enterica serovar Typhi Ty2
ucaugacauagcauaauaau

SEQ ID NO: 1788736 - RNA, 23 nt, Salmonella enterica enterica serovar Typhi Ty2
ucaugaucuuuccuuuuucaggc

SEQ ID NO: 1788737 - RNA, 13 nt, Salmonella enterica enterica serovar Typhi Ty2
ucaugauguuugu

SEQ ID NO: 1788738 - RNA, 23 nt, Salmonella enterica enterica serovar Typhi Ty2
ucaugagucgcgcgcgccaguca

SEQ ID NO: 1788739 - RNA, 15 nt, Salmonella enterica enterica serovar Typhi Ty2
ucaugcaagacaucu

SEQ ID NO: 1788740 - RNA, 17 nt, Salmonella enterica enterica serovar Typhi Ty2
ucaugcaauaaucacug

SEQ ID NO: 1788741 - RNA, 18 nt, Salmonella enterica enterica serovar Typhi Ty2
ucaugcauuaaugggcga

SEQ ID NO: 1788742 - RNA, 22 nt, Salmonella enterica enterica serovar Typhi Ty2
ucaugccggcuggcaauuugau

SEQ ID NO: 1788743 - RNA, 18 nt, Salmonella enterica enterica serovar Typhi Ty2
ucauggcauagccaaaga

SEQ ID NO: 1788744 - RNA, 23 nt, Salmonella enterica enterica serovar Typhi Ty2
ucauggagacgaucuauguggug

SEQ ID NO: 1788745 - RNA, 20 nt, Salmonella enterica enterica serovar Typhi Ty2
ucauggacagauuuccacga

SEQ ID NO: 1788746 - RNA, 18 nt, Salmonella enterica enterica serovar Typhi Ty2
ucauggacagauuuccac

SEQ ID NO: 1788747 - RNA, 14 nt, Salmonella enterica enterica serovar Typhi Ty2
ucaugcuaaaacag

SEQ ID NO: 1788748 - RNA, 13 nt, Salmonella enterica enterica serovar Typhi Ty2
ucaugcuaaaagc

SEQ ID NO: 1788749 - RNA, 15 nt, Salmonella enterica enterica serovar Typhi Ty2
ucaugcgggagcuug

SEQ ID NO: 1788750 - RNA, 15 nt, Salmonella enterica enterica serovar Typhi Ty2
ucaugcugcaccgca

SEQ ID NO: 1788751 - RNA, 16 nt, Salmonella enterica enterica serovar Typhi Ty2
ucaugcuggucagcaa

SEQ ID NO: 1788752 - RNA, 17 nt, Salmonella enterica enterica serovar Typhi Ty2
ucauuauuuuuaaauaa

SEQ ID NO: 1788753 - RNA, 16 nt, Salmonella enterica enterica serovar Typhi Ty2
ucauucacauuauuca

SEQ ID NO: 1788754 - RNA, 19 nt, Salmonella enterica enterica serovar Typhi Ty2
ucauucacccaauaaauaa

SEQ ID NO: 1788755 - RNA, 21 nt, Salmonella enterica enterica serovar Typhi Ty2
ucauucgggaugcauaaaaaa

SEQ ID NO: 1788756 - RNA, 20 nt, Salmonella enterica enterica serovar Typhi Ty2
ucauucgggucaaugccguc

SEQ ID NO: 1788757 - RNA, 20 nt, Salmonella enterica enterica serovar Typhi Ty2
ucauucgguuaggaauagca

SEQ ID NO: 1788758 - RNA, 14 nt, Salmonella enterica enterica serovar Typhi Ty2
ucauucgggaugca

SEQ ID NO: 1788759 - RNA, 22 nt, Salmonella enterica enterica serovar Typhi Ty2
ucauuaccuacgcgauaaaaaa

SEQ ID NO: 1788760 - RNA, 19 nt, Salmonella enterica enterica serovar Typhi Ty2
ucauuacgaaguuuaauuc

SEQ ID NO: 1788761 - RNA, 14 nt, Salmonella enterica enterica serovar Typhi Ty2
ucauuauucaggcc

SEQ ID NO: 1788762 - RNA, 20 nt, Salmonella enterica enterica serovar Typhi Ty2
ucauuaagcccauaaagcac

SEQ ID NO: 1788763 - RNA, 22 nt, Salmonella enterica enterica serovar Typhi Ty2
ucauuaacgacaacuucuaauu

SEQ ID NO: 1788764 - RNA, 13 nt, Salmonella enterica enterica serovar Typhi Ty2
ucauuaauauaau

SEQ ID NO: 1788765 - RNA, 13 nt, Salmonella enterica enterica serovar Typhi Ty2
ucaugguugaaaa

SEQ ID NO: 1788766 - RNA, 21 nt, Salmonella enterica enterica serovar Typhi Ty2
ucauggcuuuuacccuucaug

SEQ ID NO: 1788767 - RNA, 16 nt, Salmonella enterica enterica serovar Typhi Ty2
ucaugggcucaucaaa

SEQ ID NO: 1788768 - RNA, 19 nt, Salmonella enterica enterica serovar Typhi Ty2
ucaugguagucaaauucca

SEQ ID NO: 1788769 - RNA, 20 nt, Salmonella enterica enterica serovar Typhi Ty2
ucauggguagccguuuaaaa

SEQ ID NO: 1788770 - RNA, 18 nt, Salmonella enterica enterica serovar Typhi Ty2
ucaugguacucaacauca

SEQ ID NO: 1788771 - RNA, 17 nt, Salmonella enterica enterica serovar Typhi Ty2
ucaugguagucaaauuc

SEQ ID NO: 1788772 - RNA, 20 nt, Salmonella enterica enterica serovar Typhi Ty2
uccaaaacgaacaggccgcc

SEQ ID NO: 1788773 - RNA, 13 nt, Salmonella enterica enterica serovar Typhi Ty2
uccaaaauaauaa

SEQ ID NO: 1788774 - RNA, 24 nt, Salmonella enterica enterica serovar Typhi Ty2
ucauuuuacugcguaaucuuuuca

SEQ ID NO: 1788775 - RNA, 13 nt, Salmonella enterica enterica serovar Typhi Ty2
ucauuuguuccuc

SEQ ID NO: 1788776 - RNA, 15 nt, Salmonella enterica enterica serovar Typhi Ty2
ucauucugauuuuac

SEQ ID NO: 1788777 - RNA, 19 nt, Salmonella enterica enterica serovar Typhi Ty2
ucauugcgcuaaaauccac

SEQ ID NO: 1788778 - RNA, 17 nt, Salmonella enterica enterica serovar Typhi Ty2
ucauugcgcuaaaaucc

SEQ ID NO: 1788779 - RNA, 18 nt, Salmonella enterica enterica serovar Typhi Ty2
ucauugcgcuaaaaucca

SEQ ID NO: 1788780 - RNA, 20 nt, Salmonella enterica enterica serovar Typhi Ty2
ucauuggaagagacacgcug

SEQ ID NO: 1788781 - RNA, 16 nt, Salmonella enterica enterica serovar Typhi Ty2
ucauuggggacgcgca

SEQ ID NO: 1788782 - RNA, 15 nt, Salmonella enterica enterica serovar Typhi Ty2
ucauuucgaucuguu

SEQ ID NO: 1788783 - RNA, 14 nt, Salmonella enterica enterica serovar Typhi Ty2
ucauuucaggcaaa

SEQ ID NO: 1788784 - RNA, 22 nt, Salmonella enterica enterica serovar Typhi Ty2
ucauuuaccagugcuaaaauua

SEQ ID NO: 1788785 - RNA, 14 nt, Salmonella enterica enterica serovar Typhi Ty2
ucauuguaaaaccg

SEQ ID NO: 1788786 - RNA, 14 nt, Salmonella enterica enterica serovar Typhi Ty2
ucagccuuuucaua

SEQ ID NO: 1788787 - RNA, 20 nt, Salmonella enterica enterica serovar Typhi Ty2
ucagcgaccgucguguuacc

SEQ ID NO: 1788788 - RNA, 21 nt, Salmonella enterica enterica serovar Typhi Ty2
ucagccugugcaaccagcucu

SEQ ID NO: 1788789 - RNA, 12 nt, Salmonella enterica enterica serovar Typhi Ty2
ucagccugugca

SEQ ID NO: 1788790 - RNA, 22 nt, Salmonella enterica enterica serovar Typhi Ty2
ucagccugaaagauuauuuuau

SEQ ID NO: 1788791 - RNA, 21 nt, Salmonella enterica enterica serovar Typhi Ty2
ucagccauuaaccagauuacc

SEQ ID NO: 1788792 - RNA, 18 nt, Salmonella enterica enterica serovar Typhi Ty2
ucagccgcgcauagcugg

SEQ ID NO: 1788793 - RNA, 16 nt, Salmonella enterica enterica serovar Typhi Ty2
ucagccacuucuucca

SEQ ID NO: 1788794 - RNA, 12 nt, Salmonella enterica enterica serovar Typhi Ty2
ucacuuauaaau

SEQ ID NO: 1788795 - RNA, 14 nt, Salmonella enterica enterica serovar Typhi Ty2
ucagccagaacgaa

SEQ ID NO: 1788796 - RNA, 24 nt, Salmonella enterica enterica serovar Typhi Ty2
ucacuuaucaaaccagcuuuucau

SEQ ID NO: 1788797 - RNA, 14 nt, Salmonella enterica enterica serovar Typhi Ty2
ucacuuaucccugc

SEQ ID NO: 1788798 - RNA, 21 nt, Salmonella enterica enterica serovar Typhi Ty2
ucacugaacccaaacagauaa

SEQ ID NO: 1788799 - RNA, 15 nt, Salmonella enterica enterica serovar Typhi Ty2
ucacugaaccugccu

SEQ ID NO: 1788800 - RNA, 16 nt, Salmonella enterica enterica serovar Typhi Ty2
ucacugaaccugccuu

SEQ ID NO: 1788801 - RNA, 17 nt, Salmonella enterica enterica serovar Typhi Ty2
ucacuguuaucgccauu

SEQ ID NO: 1788802 - RNA, 23 nt, Salmonella enterica enterica serovar Typhi Ty2
ucaggaacgcggcgccgaagcag

SEQ ID NO: 1788803 - RNA, 14 nt, Salmonella enterica enterica serovar Typhi Ty2
ucaggaaccacauc

SEQ ID NO: 1788804 - RNA, 18 nt, Salmonella enterica enterica serovar Typhi Ty2
ucaggaaccacauccacc

SEQ ID NO: 1788805 - RNA, 21 nt, Salmonella enterica enterica serovar Typhi Ty2
ucaggaaaaagggaauaauac

SEQ ID NO: 1788806 - RNA, 17 nt, Salmonella enterica enterica serovar Typhi Ty2
ucaggaaugccacgauc

SEQ ID NO: 1788807 - RNA, 18 nt, Salmonella enterica enterica serovar Typhi Ty2
ucaggaagcccugaaacu

SEQ ID NO: 1788808 - RNA, 23 nt, Salmonella enterica enterica serovar Typhi Ty2
ucaggaauaacaucguaaaucaa

SEQ ID NO: 1788809 - RNA, 19 nt, Salmonella enterica enterica serovar Typhi Ty2
ucagcuucugucagccuug

SEQ ID NO: 1788810 - RNA, 17 nt, Salmonella enterica enterica serovar Typhi Ty2
ucagcgcgcuccagacc

SEQ ID NO: 1788811 - RNA, 19 nt, Salmonella enterica enterica serovar Typhi Ty2
ucagcgcggcagccggaac

SEQ ID NO: 1788812 - RNA, 18 nt, Salmonella enterica enterica serovar Typhi Ty2
ucagcgcgccgcgcagca

SEQ ID NO: 1788813 - RNA, 13 nt, Salmonella enterica enterica serovar Typhi Ty2
ucagcgugccggu

SEQ ID NO: 1788814 - RNA, 18 nt, Salmonella enterica enterica serovar Typhi Ty2
ucagcuauuagcguuuuu

SEQ ID NO: 1788815 - RNA, 23 nt, Salmonella enterica enterica serovar Typhi Ty2
ucaggugauugcccuccagccau

SEQ ID NO: 1788816 - RNA, 13 nt, Salmonella enterica enterica serovar Typhi Ty2
ucagguggaagaa

SEQ ID NO: 1788817 - RNA, 19 nt, Salmonella enterica enterica serovar Typhi Ty2
ucaggguuuucuaccgcag

SEQ ID NO: 1788818 - RNA, 14 nt, Salmonella enterica enterica serovar Typhi Ty2
ucaggguugucuca

SEQ ID NO: 1788819 - RNA, 15 nt, Salmonella enterica enterica serovar Typhi Ty2
ucagguuuuuuucau

SEQ ID NO: 1788820 - RNA, 16 nt, Salmonella enterica enterica serovar Typhi Ty2
ucaguaauaauauaaa

SEQ ID NO: 1788821 - RNA, 20 nt, Salmonella enterica enterica serovar Typhi Ty2
ucaguaauguccagauuacg

SEQ ID NO: 1788822 - RNA, 15 nt, Salmonella enterica enterica serovar Typhi Ty2
ucaguaaccagggag

SEQ ID NO: 1788823 - RNA, 18 nt, Salmonella enterica enterica serovar Typhi Ty2
ucagggguccccacggga

SEQ ID NO: 1788824 - RNA, 20 nt, Salmonella enterica enterica serovar Typhi Ty2
ucagggucuuauuucuccug

SEQ ID NO: 1788825 - RNA, 22 nt, Salmonella enterica enterica serovar Typhi Ty2
ucagggcgcggcgcaacuuuuu

SEQ ID NO: 1788826 - RNA, 21 nt, Salmonella enterica enterica serovar Typhi Ty2
ucagggcuuacucccugguga

SEQ ID NO: 1788827 - RNA, 23 nt, Salmonella enterica enterica serovar Typhi Ty2
ucaggcaauaaacaucagccauu

SEQ ID NO: 1788828 - RNA, 20 nt, Salmonella enterica enterica serovar Typhi Ty2
ucaggcaauaaacaucagcc

SEQ ID NO: 1788829 - RNA, 22 nt, Salmonella enterica enterica serovar Typhi Ty2
ucaggcaauaaaaaaggcagag

SEQ ID NO: 1788830 - RNA, 14 nt, Salmonella enterica enterica serovar Typhi Ty2
ucagggcaaggcgg

SEQ ID NO: 1788831 - RNA, 23 nt, Salmonella enterica enterica serovar Typhi Ty2
ucaggcaaaaaucgucaucagau

SEQ ID NO: 1788832 - RNA, 14 nt, Salmonella enterica enterica serovar Typhi Ty2
ucaguucagaaacg

SEQ ID NO: 1788833 - RNA, 21 nt, Salmonella enterica enterica serovar Typhi Ty2
ucaguccuuccgcuuuaagcg

SEQ ID NO: 1788834 - RNA, 22 nt, Salmonella enterica enterica serovar Typhi Ty2
ucaguuaacgcguaaucuucca

SEQ ID NO: 1788835 - RNA, 22 nt, Salmonella enterica enterica serovar Typhi Ty2
ucauaaaacccguuaaauacca

SEQ ID NO: 1788836 - RNA, 22 nt, Salmonella enterica enterica serovar Typhi Ty2
ucauaaaggcuuuaaagcaggc

SEQ ID NO: 1788837 - RNA, 21 nt, Salmonella enterica enterica serovar Typhi Ty2
ucauaaccgcagucuccggua

SEQ ID NO: 1788838 - RNA, 14 nt, Salmonella enterica enterica serovar Typhi Ty2
ucaucaggcgugcc

SEQ ID NO: 1788839 - RNA, 19 nt, Salmonella enterica enterica serovar Typhi Ty2
ucaucaggcaauaaacauc

SEQ ID NO: 1788840 - RNA, 21 nt, Salmonella enterica enterica serovar Typhi Ty2
ucaucaggccugcaaaccucu

SEQ ID NO: 1788841 - RNA, 15 nt, Salmonella enterica enterica serovar Typhi Ty2
ucaucaggccugcaa

SEQ ID NO: 1788842 - RNA, 16 nt, Salmonella enterica enterica serovar Typhi Ty2
ucaucaguaacacccg

SEQ ID NO: 1788843 - RNA, 14 nt, Salmonella enterica enterica serovar Typhi Ty2
ucaucaguaacuga

SEQ ID NO: 1788844 - RNA, 14 nt, Salmonella enterica enterica serovar Typhi Ty2
ucaucauaauucag

SEQ ID NO: 1788845 - RNA, 13 nt, Salmonella enterica enterica serovar Typhi Ty2
ucaucauaaucaa

SEQ ID NO: 1788846 - RNA, 18 nt, Salmonella enterica enterica serovar Typhi Ty2
ucaucagaucaugaggau

SEQ ID NO: 1788847 - RNA, 17 nt, Salmonella enterica enterica serovar Typhi Ty2
ucaucagaccgagaccc

SEQ ID NO: 1788848 - RNA, 18 nt, Salmonella enterica enterica serovar Typhi Ty2
ucaucagacccgcauaca

SEQ ID NO: 1788849 - RNA, 15 nt, Salmonella enterica enterica serovar Typhi Ty2
ucaucagaagaagac

SEQ ID NO: 1788850 - RNA, 19 nt, Salmonella enterica enterica serovar Typhi Ty2
ucaucagcacaaaauccca

SEQ ID NO: 1788851 - RNA, 19 nt, Salmonella enterica enterica serovar Typhi Ty2
ucaucauggacagauuucc

SEQ ID NO: 1788852 - RNA, 22 nt, Salmonella enterica enterica serovar Typhi Ty2
ucaucauugaggcgcgaaaaau

SEQ ID NO: 1788853 - RNA, 22 nt, Salmonella enterica enterica serovar Typhi Ty2
ucaucaugcugcugauccuguu

SEQ ID NO: 1788854 - RNA, 14 nt, Salmonella enterica enterica serovar Typhi Ty2
ucauccagaaaaug

SEQ ID NO: 1788855 - RNA, 19 nt, Salmonella enterica enterica serovar Typhi Ty2
ucaucauugcgccaagacc

SEQ ID NO: 1788856 - RNA, 16 nt, Salmonella enterica enterica serovar Typhi Ty2
ucauccagcaaaauaa

SEQ ID NO: 1788857 - RNA, 15 nt, Salmonella enterica enterica serovar Typhi Ty2
ucauccaccuuaucc

SEQ ID NO: 1788858 - RNA, 11 nt, Salmonella enterica enterica serovar Typhi Ty2
ucauccagcaa

SEQ ID NO: 1788859 - RNA, 24 nt, Salmonella enterica enterica serovar Typhi Ty2
ucauccagcgaaccuuccaucgca

SEQ ID NO: 1788860 - RNA, 13 nt, Salmonella enterica enterica serovar Typhi Ty2
ucauccagcagca

SEQ ID NO: 1788861 - RNA, 16 nt, Salmonella enterica enterica serovar Typhi Ty2
ucauccgaccacggcc

SEQ ID NO: 1788862 - RNA, 23 nt, Salmonella enterica enterica serovar Typhi Ty2
ucauccgaccacggccacagcca

SEQ ID NO: 1788863 - RNA, 16 nt, Salmonella enterica enterica serovar Typhi Ty2
ucaucgaacgccgccu

SEQ ID NO: 1788864 - RNA, 17 nt, Salmonella enterica enterica serovar Typhi Ty2
ucauccgggcauaaaaa

SEQ ID NO: 1788865 - RNA, 17 nt, Salmonella enterica enterica serovar Typhi Ty2
ucaucccgcugugaucc

SEQ ID NO: 1788866 - RNA, 21 nt, Salmonella enterica enterica serovar Typhi Ty2
ucaucccgcccagcaacacag

SEQ ID NO: 1788867 - RNA, 23 nt, Salmonella enterica enterica serovar Typhi Ty2
ucaucccgguuucccgcgugaac

SEQ ID NO: 1788868 - RNA, 23 nt, Salmonella enterica enterica serovar Typhi Ty2
ucaucccgguuugggcgcgaaac

SEQ ID NO: 1788869 - RNA, 22 nt, Salmonella enterica enterica serovar Typhi Ty2
ucaucccggcuuaaauuuuuaa

SEQ ID NO: 1788870 - RNA, 17 nt, Salmonella enterica enterica serovar Typhi Ty2
ucaucccacgucgccuu

SEQ ID NO: 1788871 - RNA, 20 nt, Salmonella enterica enterica serovar Typhi Ty2
ucauccagucagcaauuaac

SEQ ID NO: 1788872 - RNA, 17 nt, Salmonella enterica enterica serovar Typhi Ty2
ucaucgcaaauucugua

SEQ ID NO: 1788873 - RNA, 16 nt, Salmonella enterica enterica serovar Typhi Ty2
ucaucgcuggugugca

SEQ ID NO: 1788874 - RNA, 22 nt, Salmonella enterica enterica serovar Typhi Ty2
ucauauuugcuggcuugcucag

SEQ ID NO: 1788875 - RNA, 23 nt, Salmonella enterica enterica serovar Typhi Ty2
ucauauuugugaccaacaucauu

SEQ ID NO: 1788876 - RNA, 13 nt, Salmonella enterica enterica serovar Typhi Ty2
ucaucaaaaaggc

SEQ ID NO: 1788877 - RNA, 20 nt, Salmonella enterica enterica serovar Typhi Ty2
ucauauuacauagaaaauau

SEQ ID NO: 1788878 - RNA, 19 nt, Salmonella enterica enterica serovar Typhi Ty2
ucauauuacauagaaaaua

SEQ ID NO: 1788879 - RNA, 13 nt, Salmonella enterica enterica serovar Typhi Ty2
ucauauuccagcc

SEQ ID NO: 1788880 - RNA, 19 nt, Salmonella enterica enterica serovar Typhi Ty2
ucauauggaagcuguuaau

SEQ ID NO: 1788881 - RNA, 15 nt, Salmonella enterica enterica serovar Typhi Ty2
ucaucaaacgauacc

SEQ ID NO: 1788882 - RNA, 13 nt, Salmonella enterica enterica serovar Typhi Ty2
ucaucaaaaugca

SEQ ID NO: 1788883 - RNA, 21 nt, Salmonella enterica enterica serovar Typhi Ty2
ucaucaauggauuuauggcac

SEQ ID NO: 1788884 - RNA, 20 nt, Salmonella enterica enterica serovar Typhi Ty2
ucaucacaucgcgcagcagg

SEQ ID NO: 1788885 - RNA, 13 nt, Salmonella enterica enterica serovar Typhi Ty2
ucauauaagaaau

SEQ ID NO: 1788886 - RNA, 14 nt, Salmonella enterica enterica serovar Typhi Ty2
ucauagugcgcgcg

SEQ ID NO: 1788887 - RNA, 20 nt, Salmonella enterica enterica serovar Typhi Ty2
ucauaggacugaucccacuu

SEQ ID NO: 1788888 - RNA, 14 nt, Salmonella enterica enterica serovar Typhi Ty2
ucauacuauuuccu

SEQ ID NO: 1788889 - RNA, 22 nt, Salmonella enterica enterica serovar Typhi Ty2
ucauacgcuuucugaauuuccu

SEQ ID NO: 1788890 - RNA, 21 nt, Salmonella enterica enterica serovar Typhi Ty2
ucauacauuugaauaauucug

SEQ ID NO: 1788891 - RNA, 13 nt, Salmonella enterica enterica serovar Typhi Ty2
ucauacccuucca

SEQ ID NO: 1788892 - RNA, 15 nt, Salmonella enterica enterica serovar Typhi Ty2
ucauaauucagcuca

SEQ ID NO: 1788893 - RNA, 16 nt, Salmonella enterica enterica serovar Typhi Ty2
ucauaaugaauacgcu

SEQ ID NO: 1788894 - RNA, 16 nt, Salmonella enterica enterica serovar Typhi Ty2
ucauaaucgcgauacu

SEQ ID NO: 1788895 - RNA, 23 nt, Salmonella enterica enterica serovar Typhi Ty2
ucauaaucgcgauacugccgccc

SEQ ID NO: 1788896 - RNA, 13 nt, Salmonella enterica enterica serovar Typhi Ty2
ucacuauuugugc

SEQ ID NO: 1788897 - RNA, 17 nt, Salmonella enterica enterica serovar Typhi Ty2
ucacuccuaagagaaaa

SEQ ID NO: 1788898 - RNA, 15 nt, Salmonella enterica enterica serovar Typhi Ty2
ucacguagcggcgcg

SEQ ID NO: 1788899 - RNA, 15 nt, Salmonella enterica enterica serovar Typhi Ty2
ucacgguuucaacuu

SEQ ID NO: 1788900 - RNA, 14 nt, Salmonella enterica enterica serovar Typhi Ty2
ucacuaccgccauc

SEQ ID NO: 1788901 - RNA, 12 nt, Salmonella enterica enterica serovar Typhi Ty2
ucacgcuggaua

SEQ ID NO: 1788902 - RNA, 20 nt, Salmonella enterica enterica serovar Typhi Ty2
ucacgcucacgcagauauuc

SEQ ID NO: 1788903 - RNA, 21 nt, Salmonella enterica enterica serovar Typhi Ty2
ucacgcuggugcgcgggagau

SEQ ID NO: 1788904 - RNA, 18 nt, Salmonella enterica enterica serovar Typhi Ty2
ucacgguauucguuacca

SEQ ID NO: 1788905 - RNA, 23 nt, Salmonella enterica enterica serovar Typhi Ty2
ucacgguauucguuaccagcauc

SEQ ID NO: 1788906 - RNA, 22 nt, Salmonella enterica enterica serovar Typhi Ty2
ucacgguacgcaucaccaggca

SEQ ID NO: 1788907 - RNA, 18 nt, Salmonella enterica enterica serovar Typhi Ty2
ucacgcagugcgcgaccg

SEQ ID NO: 1788908 - RNA, 16 nt, Salmonella enterica enterica serovar Typhi Ty2
ucacgcgccagcacca

SEQ ID NO: 1788909 - RNA, 18 nt, Salmonella enterica enterica serovar Typhi Ty2
ucaccuucugcgcaggag

SEQ ID NO: 1788910 - RNA, 19 nt, Salmonella enterica enterica serovar Typhi Ty2
ucaccuggcugguggccuu

SEQ ID NO: 1788911 - RNA, 16 nt, Salmonella enterica enterica serovar Typhi Ty2
ucaccuggaugcugcc

SEQ ID NO: 1788912 - RNA, 21 nt, Salmonella enterica enterica serovar Typhi Ty2
ucaccguuuaaaaacaucauu

SEQ ID NO: 1788913 - RNA, 18 nt, Salmonella enterica enterica serovar Typhi Ty2
ucaccucacuccagaccu

SEQ ID NO: 1788914 - RNA, 21 nt, Salmonella enterica enterica serovar Typhi Ty2
ucaccucuucgcuguuaaccu

SEQ ID NO: 1788915 - RNA, 20 nt, Salmonella enterica enterica serovar Typhi Ty2
ucaccucuuucuccacaucg

SEQ ID NO: 1788916 - RNA, 19 nt, Salmonella enterica enterica serovar Typhi Ty2
ucaccucuaccggggcgcu

SEQ ID NO: 1788917 - RNA, 12 nt, Salmonella enterica enterica serovar Typhi Ty2
ucaccuccagca

SEQ ID NO: 1788918 - RNA, 13 nt, Salmonella enterica enterica serovar Typhi Ty2
ucaccucccugca

SEQ ID NO: 1788919 - RNA, 15 nt, Salmonella enterica enterica serovar Typhi Ty2
ucaccuuucauuuua

SEQ ID NO: 1788920 - RNA, 22 nt, Salmonella enterica enterica serovar Typhi Ty2
ucaccuugcccuggaauuuuuc

SEQ ID NO: 1788921 - RNA, 13 nt, Salmonella enterica enterica serovar Typhi Ty2
ucaccuugcugcg

SEQ ID NO: 1788922 - RNA, 19 nt, Salmonella enterica enterica serovar Typhi Ty2
ucaccuuguaccuccugau

SEQ ID NO: 1788923 - RNA, 18 nt, Salmonella enterica enterica serovar Typhi Ty2
ucacgauacuguugcagu

SEQ ID NO: 1788924 - RNA, 17 nt, Salmonella enterica enterica serovar Typhi Ty2
ucacgaccaaccaacag

SEQ ID NO: 1788925 - RNA, 19 nt, Salmonella enterica enterica serovar Typhi Ty2
ucaccggauacccagccac

SEQ ID NO: 1788926 - RNA, 20 nt, Salmonella enterica enterica serovar Typhi Ty2
ucaccgccgcccguccgcua

SEQ ID NO: 1788927 - RNA, 18 nt, Salmonella enterica enterica serovar Typhi Ty2
ucaccguaauauaaucua

SEQ ID NO: 1788928 - RNA, 19 nt, Salmonella enterica enterica serovar Typhi Ty2
ucaccguuuaaaaacauca

SEQ ID NO: 1788929 - RNA, 17 nt, Salmonella enterica enterica serovar Typhi Ty2
ucaccguggcaucauca

SEQ ID NO: 1788930 - RNA, 18 nt, Salmonella enterica enterica serovar Typhi Ty2
ucaccguccgccaggccc

SEQ ID NO: 1788931 - RNA, 20 nt, Salmonella enterica enterica serovar Typhi Ty2
ucaccgucacugaaccugcc

SEQ ID NO: 1788932 - RNA, 14 nt, Salmonella enterica enterica serovar Typhi Ty2
ucaccgccaguccc

SEQ ID NO: 1788933 - RNA, 13 nt, Salmonella enterica enterica serovar Typhi Ty2
ucaccgccagagc

SEQ ID NO: 1788934 - RNA, 19 nt, Salmonella enterica enterica serovar Typhi Ty2
ucaccgcaaauucgucgcc

SEQ ID NO: 1788935 - RNA, 20 nt, Salmonella enterica enterica serovar Typhi Ty2
ucaccccaacaaauagcaca

SEQ ID NO: 1788936 - RNA, 22 nt, Salmonella enterica enterica serovar Typhi Ty2
ucacccaugccgcgacgaaguc

SEQ ID NO: 1788937 - RNA, 22 nt, Salmonella enterica enterica serovar Typhi Ty2
ucacccagaugcgaaucuucau

SEQ ID NO: 1788938 - RNA, 24 nt, Salmonella enterica enterica serovar Typhi Ty2
ucacccagucgcagccacccuggc

SEQ ID NO: 1788939 - RNA, 19 nt, Salmonella enterica enterica serovar Typhi Ty2
ucacccgccggcagcagcu

SEQ ID NO: 1788940 - RNA, 21 nt, Salmonella enterica enterica serovar Typhi Ty2
ucacccgaaucacugacggaa

SEQ ID NO: 1788941 - RNA, 17 nt, Salmonella enterica enterica serovar Typhi Ty2
ucaccacuucaaacggu

SEQ ID NO: 1788942 - RNA, 22 nt, Salmonella enterica enterica serovar Typhi Ty2
ucacccagaauacggccuucuu

SEQ ID NO: 1788943 - RNA, 14 nt, Salmonella enterica enterica serovar Typhi Ty2
ucacccacaucagc

SEQ ID NO: 1788944 - RNA, 15 nt, Salmonella enterica enterica serovar Typhi Ty2
ucaccauuaacauca

SEQ ID NO: 1788945 - RNA, 19 nt, Salmonella enterica enterica serovar Typhi Ty2
ucaccagcgcauugacgau

SEQ ID NO: 1788946 - RNA, 21 nt, Salmonella enterica enterica serovar Typhi Ty2
ucacauuggcaaaccccugcu

SEQ ID NO: 1788947 - RNA, 15 nt, Salmonella enterica enterica serovar Typhi Ty2
ucaccaaaaggcaga

SEQ ID NO: 1788948 - RNA, 14 nt, Salmonella enterica enterica serovar Typhi Ty2
ucaccaacugcuga

SEQ ID NO: 1788949 - RNA, 19 nt, Salmonella enterica enterica serovar Typhi Ty2
ucacaccaacgcuggcccg

SEQ ID NO: 1788950 - RNA, 19 nt, Salmonella enterica enterica serovar Typhi Ty2
ucacacauaagcacaccau

SEQ ID NO: 1788951 - RNA, 15 nt, Salmonella enterica enterica serovar Typhi Ty2
ucacaagcuguuucu

SEQ ID NO: 1788952 - RNA, 17 nt, Salmonella enterica enterica serovar Typhi Ty2
ucacaaucgcgccugcc

SEQ ID NO: 1788953 - RNA, 17 nt, Salmonella enterica enterica serovar Typhi Ty2
ucacaaucguucucagg

SEQ ID NO: 1788954 - RNA, 17 nt, Salmonella enterica enterica serovar Typhi Ty2
ucacaauaucgagauga

SEQ ID NO: 1788955 - RNA, 11 nt, Salmonella enterica enterica serovar Typhi Ty2
ucaauuuccag

SEQ ID NO: 1788956 - RNA, 12 nt, Salmonella enterica enterica serovar Typhi Ty2
ucaauuuccagu

SEQ ID NO: 1788957 - RNA, 13 nt, Salmonella enterica enterica serovar Typhi Ty2
ucaauuauguauu

SEQ ID NO: 1788958 - RNA, 16 nt, Salmonella enterica enterica serovar Typhi Ty2
ucaauuuuacagccuc

SEQ ID NO: 1788959 - RNA, 13 nt, Salmonella enterica enterica serovar Typhi Ty2
ucaauuuuucgcc

SEQ ID NO: 1788960 - RNA, 18 nt, Salmonella enterica enterica serovar Typhi Ty2
ucacaaccuccacgccca

SEQ ID NO: 1788961 - RNA, 13 nt, Salmonella enterica enterica serovar Typhi Ty2
ucacaaccuccac

SEQ ID NO: 1788962 - RNA, 23 nt, Salmonella enterica enterica serovar Typhi Ty2
ucaaugccgucggcaauuaacau

SEQ ID NO: 1788963 - RNA, 22 nt, Salmonella enterica enterica serovar Typhi Ty2
ucaaguuauguuauccccacuu

SEQ ID NO: 1788964 - RNA, 22 nt, Salmonella enterica enterica serovar Typhi Ty2
ucaauauuccuggcgccaccca

SEQ ID NO: 1788965 - RNA, 14 nt, Salmonella enterica enterica serovar Typhi Ty2
ucaagucccccccc

SEQ ID NO: 1788966 - RNA, 19 nt, Salmonella enterica enterica serovar Typhi Ty2
ucaaucaacuccauaauuu

SEQ ID NO: 1788967 - RNA, 21 nt, Salmonella enterica enterica serovar Typhi Ty2
ucaagcuggacgguaaccauu

SEQ ID NO: 1788968 - RNA, 20 nt, Salmonella enterica enterica serovar Typhi Ty2
ucaagcugauugauuuugua

SEQ ID NO: 1788969 - RNA, 14 nt, Salmonella enterica enterica serovar Typhi Ty2
ucaagcuugccgcu

SEQ ID NO: 1788970 - RNA, 13 nt, Salmonella enterica enterica serovar Typhi Ty2
ucaaggcaauaga

SEQ ID NO: 1788971 - RNA, 21 nt, Salmonella enterica enterica serovar Typhi Ty2
ucaagcuuugcguaaaaaaca

SEQ ID NO: 1788972 - RNA, 16 nt, Salmonella enterica enterica serovar Typhi Ty2
ucaagcggcaccacau

SEQ ID NO: 1788973 - RNA, 21 nt, Salmonella enterica enterica serovar Typhi Ty2
ucaagcgguagcguuauccag

SEQ ID NO: 1788974 - RNA, 12 nt, Salmonella enterica enterica serovar Typhi Ty2
ucaagcgauacg

SEQ ID NO: 1788975 - RNA, 18 nt, Salmonella enterica enterica serovar Typhi Ty2
ucaagccguuuuggcagc

SEQ ID NO: 1788976 - RNA, 14 nt, Salmonella enterica enterica serovar Typhi Ty2
ucaagcccagcuca

SEQ ID NO: 1788977 - RNA, 22 nt, Salmonella enterica enterica serovar Typhi Ty2
ucaagcccauguucaugaacca

SEQ ID NO: 1788978 - RNA, 16 nt, Salmonella enterica enterica serovar Typhi Ty2
ucaagcaguuccagca

SEQ ID NO: 1788979 - RNA, 17 nt, Salmonella enterica enterica serovar Typhi Ty2
ucaagaugauagccauu

SEQ ID NO: 1788980 - RNA, 17 nt, Salmonella enterica enterica serovar Typhi Ty2
ucaagcaacuguagaau

SEQ ID NO: 1788981 - RNA, 19 nt, Salmonella enterica enterica serovar Typhi Ty2
ucaacgguucgacggagau

SEQ ID NO: 1788982 - RNA, 13 nt, Salmonella enterica enterica serovar Typhi Ty2
ucaacguaaauag

SEQ ID NO: 1788983 - RNA, 23 nt, Salmonella enterica enterica serovar Typhi Ty2
ucaaauccagcucaguuuccagc

SEQ ID NO: 1788984 - RNA, 15 nt, Salmonella enterica enterica serovar Typhi Ty2
ucaacggucaaaaua

SEQ ID NO: 1788985 - RNA, 15 nt, Salmonella enterica enterica serovar Typhi Ty2
ucaacgugcaucucc

SEQ ID NO: 1788986 - RNA, 19 nt, Salmonella enterica enterica serovar Typhi Ty2
ucaacguuccuucaggaga

SEQ ID NO: 1788987 - RNA, 21 nt, Salmonella enterica enterica serovar Typhi Ty2
ucaacugcucuaccaacugag

SEQ ID NO: 1788988 - RNA, 20 nt, Salmonella enterica enterica serovar Typhi Ty2
ucaacugcucuaccaacuga

SEQ ID NO: 1788989 - RNA, 17 nt, Salmonella enterica enterica serovar Typhi Ty2
ucaacucuuucaggcga

SEQ ID NO: 1788990 - RNA, 23 nt, Salmonella enterica enterica serovar Typhi Ty2
ucaacugggcgagggaggcaauc

SEQ ID NO: 1788991 - RNA, 21 nt, Salmonella enterica enterica serovar Typhi Ty2
ucaacuggaugacugaauuau

SEQ ID NO: 1788992 - RNA, 20 nt, Salmonella enterica enterica serovar Typhi Ty2
ucaacuuauccauuagcgcc

SEQ ID NO: 1788993 - RNA, 16 nt, Salmonella enterica enterica serovar Typhi Ty2
ucaacugucgaucggu

SEQ ID NO: 1788994 - RNA, 15 nt, Salmonella enterica enterica serovar Typhi Ty2
ucaagagaugcagac

SEQ ID NO: 1788995 - RNA, 14 nt, Salmonella enterica enterica serovar Typhi Ty2
ucaagauaaaaaga

SEQ ID NO: 1788996 - RNA, 18 nt, Salmonella enterica enterica serovar Typhi Ty2
uauucagaauaugccagg

SEQ ID NO: 1788997 - RNA, 18 nt, Salmonella enterica enterica serovar Typhi Ty2
uauucagcaguucauucg

SEQ ID NO: 1788998 - RNA, 15 nt, Salmonella enterica enterica serovar Typhi Ty2
uauucaggccuccug

SEQ ID NO: 1788999 - RNA, 23 nt, Salmonella enterica enterica serovar Typhi Ty2
uauucaccucccugcaacagcac

SEQ ID NO: 1789000 - RNA, 21 nt, Salmonella enterica enterica serovar Typhi Ty2
uauucacacgcucacccaguu

SEQ ID NO: 1789001 - RNA, 23 nt, Salmonella enterica enterica serovar Typhi Ty2
uauucauuacagguguuaaucau

SEQ ID NO: 1789002 - RNA, 19 nt, Salmonella enterica enterica serovar Typhi Ty2
uauucauucacccaauaaa

SEQ ID NO: 1789003 - RNA, 22 nt, Salmonella enterica enterica serovar Typhi Ty2
uauucauucacccaauaaauaa

SEQ ID NO: 1789004 - RNA, 17 nt, Salmonella enterica enterica serovar Typhi Ty2
uauucaucaucuugucc

SEQ ID NO: 1789005 - RNA, 20 nt, Salmonella enterica enterica serovar Typhi Ty2
uauuccagucgcuccaccac

SEQ ID NO: 1789006 - RNA, 19 nt, Salmonella enterica enterica serovar Typhi Ty2
uauuccagggcauuuuuuc

SEQ ID NO: 1789007 - RNA, 17 nt, Salmonella enterica enterica serovar Typhi Ty2
uauuccagaaaggaugc

SEQ ID NO: 1789008 - RNA, 16 nt, Salmonella enterica enterica serovar Typhi Ty2
uauucauuuccagcac

SEQ ID NO: 1789009 - RNA, 15 nt, Salmonella enterica enterica serovar Typhi Ty2
uauuccaaaauaaua

SEQ ID NO: 1789010 - RNA, 16 nt, Salmonella enterica enterica serovar Typhi Ty2
uauuccaaaauaauaa

SEQ ID NO: 1789011 - RNA, 16 nt, Salmonella enterica enterica serovar Typhi Ty2
uauuccucuuccucga

SEQ ID NO: 1789012 - RNA, 14 nt, Salmonella enterica enterica serovar Typhi Ty2
uauuccuuaucaca

SEQ ID NO: 1789013 - RNA, 20 nt, Salmonella enterica enterica serovar Typhi Ty2
uauucucaaccagccgauca

SEQ ID NO: 1789014 - RNA, 14 nt, Salmonella enterica enterica serovar Typhi Ty2
uauucggauuggcc

SEQ ID NO: 1789015 - RNA, 13 nt, Salmonella enterica enterica serovar Typhi Ty2
uauucgcuuguuu

SEQ ID NO: 1789016 - RNA, 19 nt, Salmonella enterica enterica serovar Typhi Ty2
uauuauuagaggucagaau

SEQ ID NO: 1789017 - RNA, 19 nt, Salmonella enterica enterica serovar Typhi Ty2
uauuauuacgcaucauaua

SEQ ID NO: 1789018 - RNA, 14 nt, Salmonella enterica enterica serovar Typhi Ty2
uauuauauuuaaaa

SEQ ID NO: 1789019 - RNA, 16 nt, Salmonella enterica enterica serovar Typhi Ty2
uauuagcguuuuuacc

SEQ ID NO: 1789020 - RNA, 15 nt, Salmonella enterica enterica serovar Typhi Ty2
uauuagccaaagcgg

SEQ ID NO: 1789021 - RNA, 14 nt, Salmonella enterica enterica serovar Typhi Ty2
uauuacuuuccagc

SEQ ID NO: 1789022 - RNA, 20 nt, Salmonella enterica enterica serovar Typhi Ty2
uauuagaauucccuauguaa

SEQ ID NO: 1789023 - RNA, 20 nt, Salmonella enterica enterica serovar Typhi Ty2
uaucccuuccucauuuuugc

SEQ ID NO: 1789024 - RNA, 23 nt, Salmonella enterica enterica serovar Typhi Ty2
uaucccaaacgucguaaaaccug

SEQ ID NO: 1789025 - RNA, 16 nt, Salmonella enterica enterica serovar Typhi Ty2
uauccgacgcaacuca

SEQ ID NO: 1789026 - RNA, 14 nt, Salmonella enterica enterica serovar Typhi Ty2
uauccgcauucuaa

SEQ ID NO: 1789027 - RNA, 15 nt, Salmonella enterica enterica serovar Typhi Ty2
uauccgcauucuaaa

SEQ ID NO: 1789028 - RNA, 15 nt, Salmonella enterica enterica serovar Typhi Ty2
uauuaccuccugcau

SEQ ID NO: 1789029 - RNA, 20 nt, Salmonella enterica enterica serovar Typhi Ty2
uauccgcgaguguaaagauu

SEQ ID NO: 1789030 - RNA, 18 nt, Salmonella enterica enterica serovar Typhi Ty2
uauccgcuauuaccagua

SEQ ID NO: 1789031 - RNA, 22 nt, Salmonella enterica enterica serovar Typhi Ty2
uauuacgcaagaucacauacaa

SEQ ID NO: 1789032 - RNA, 16 nt, Salmonella enterica enterica serovar Typhi Ty2
uauuacugauaaaguu

SEQ ID NO: 1789033 - RNA, 17 nt, Salmonella enterica enterica serovar Typhi Ty2
uauugacgcuuucuucc

SEQ ID NO: 1789034 - RNA, 22 nt, Salmonella enterica enterica serovar Typhi Ty2
uauugacacuaacgcucuucuc

SEQ ID NO: 1789035 - RNA, 13 nt, Salmonella enterica enterica serovar Typhi Ty2
uauugagaauaaa

SEQ ID NO: 1789036 - RNA, 16 nt, Salmonella enterica enterica serovar Typhi Ty2
uauugaauaguuacca

SEQ ID NO: 1789037 - RNA, 23 nt, Salmonella enterica enterica serovar Typhi Ty2
uauugaagugcgaaauuuaauau

SEQ ID NO: 1789038 - RNA, 20 nt, Salmonella enterica enterica serovar Typhi Ty2
uauugccacaauaucaucgu

SEQ ID NO: 1789039 - RNA, 16 nt, Salmonella enterica enterica serovar Typhi Ty2
uauugccauaaauaca

SEQ ID NO: 1789040 - RNA, 12 nt, Salmonella enterica enterica serovar Typhi Ty2
uauugagauaau

SEQ ID NO: 1789041 - RNA, 19 nt, Salmonella enterica enterica serovar Typhi Ty2
uauugucgcccugcaauuc

SEQ ID NO: 1789042 - RNA, 14 nt, Salmonella enterica enterica serovar Typhi Ty2
uauugugagaaaag

SEQ ID NO: 1789043 - RNA, 20 nt, Salmonella enterica enterica serovar Typhi Ty2
uauugugaaccauggcaaca

SEQ ID NO: 1789044 - RNA, 13 nt, Salmonella enterica enterica serovar Typhi Ty2
uauugugucacca

SEQ ID NO: 1789045 - RNA, 14 nt, Salmonella enterica enterica serovar Typhi Ty2
uauuuaaaauucca

SEQ ID NO: 1789046 - RNA, 13 nt, Salmonella enterica enterica serovar Typhi Ty2
uauuuaaaauucc

SEQ ID NO: 1789047 - RNA, 17 nt, Salmonella enterica enterica serovar Typhi Ty2
uauugucgcccugcaau

SEQ ID NO: 1789048 - RNA, 17 nt, Salmonella enterica enterica serovar Typhi Ty2
uauugcggaucagcaaa

SEQ ID NO: 1789049 - RNA, 19 nt, Salmonella enterica enterica serovar Typhi Ty2
uauugccuaagauggcgcc

SEQ ID NO: 1789050 - RNA, 15 nt, Salmonella enterica enterica serovar Typhi Ty2
uauuuaccuuuuccu

SEQ ID NO: 1789051 - RNA, 23 nt, Salmonella enterica enterica serovar Typhi Ty2
uauuuauuugguuucuagucgcc

SEQ ID NO: 1789052 - RNA, 21 nt, Salmonella enterica enterica serovar Typhi Ty2
ucaaaaaaucgaccaacgcac

SEQ ID NO: 1789053 - RNA, 16 nt, Salmonella enterica enterica serovar Typhi Ty2
ucaaaaaaucagcaau

SEQ ID NO: 1789054 - RNA, 19 nt, Salmonella enterica enterica serovar Typhi Ty2
ucaaaaaauaucucucccu

SEQ ID NO: 1789055 - RNA, 14 nt, Salmonella enterica enterica serovar Typhi Ty2
ucaaaaaauaucuc

SEQ ID NO: 1789056 - RNA, 14 nt, Salmonella enterica enterica serovar Typhi Ty2
ucaaaaaaucagca

SEQ ID NO: 1789057 - RNA, 23 nt, Salmonella enterica enterica serovar Typhi Ty2
ucaaaacccagcccaauacgcca

SEQ ID NO: 1789058 - RNA, 15 nt, Salmonella enterica enterica serovar Typhi Ty2
ucaaaacaggucugu

SEQ ID NO: 1789059 - RNA, 16 nt, Salmonella enterica enterica serovar Typhi Ty2
ucaaaaggugagaaaa

SEQ ID NO: 1789060 - RNA, 14 nt, Salmonella enterica enterica serovar Typhi Ty2
ucaaaacgacauaa

SEQ ID NO: 1789061 - RNA, 18 nt, Salmonella enterica enterica serovar Typhi Ty2
ucaaaaccgaccccgcuc

SEQ ID NO: 1789062 - RNA, 11 nt, Salmonella enterica enterica serovar Typhi Ty2
ucaaaaaagag

SEQ ID NO: 1789063 - RNA, 22 nt, Salmonella enterica enterica serovar Typhi Ty2
ucaaaaaagcgacgcugucaau

SEQ ID NO: 1789064 - RNA, 21 nt, Salmonella enterica enterica serovar Typhi Ty2
ucaaaaaaaauagccauugcu

SEQ ID NO: 1789065 - RNA, 15 nt, Salmonella enterica enterica serovar Typhi Ty2
ucaaaaaaaaccaga

SEQ ID NO: 1789066 - RNA, 14 nt, Salmonella enterica enterica serovar Typhi Ty2
ucaaaaaaaaccag

SEQ ID NO: 1789067 - RNA, 16 nt, Salmonella enterica enterica serovar Typhi Ty2
uauuuuucucagccag

SEQ ID NO: 1789068 - RNA, 22 nt, Salmonella enterica enterica serovar Typhi Ty2
ucaaaggcgcugaacgcauaca

SEQ ID NO: 1789069 - RNA, 22 nt, Salmonella enterica enterica serovar Typhi Ty2
ucaaaggccugcaucaacaggc

SEQ ID NO: 1789070 - RNA, 15 nt, Salmonella enterica enterica serovar Typhi Ty2
ucaaacccuuccgca

SEQ ID NO: 1789071 - RNA, 20 nt, Salmonella enterica enterica serovar Typhi Ty2
ucaaacccuuccagacagcu

SEQ ID NO: 1789072 - RNA, 14 nt, Salmonella enterica enterica serovar Typhi Ty2
ucaaacgcgccgcu

SEQ ID NO: 1789073 - RNA, 20 nt, Salmonella enterica enterica serovar Typhi Ty2
ucaaacuuuuauaaauauag

SEQ ID NO: 1789074 - RNA, 13 nt, Salmonella enterica enterica serovar Typhi Ty2
ucaaacuuuuaua

SEQ ID NO: 1789075 - RNA, 22 nt, Salmonella enterica enterica serovar Typhi Ty2
ucaaagaacagggggcgcauca

SEQ ID NO: 1789076 - RNA, 21 nt, Salmonella enterica enterica serovar Typhi Ty2
ucaaagaagcggaaaccccag

SEQ ID NO: 1789077 - RNA, 18 nt, Salmonella enterica enterica serovar Typhi Ty2
uauuuuccguuagccaau

SEQ ID NO: 1789078 - RNA, 12 nt, Salmonella enterica enterica serovar Typhi Ty2
uauuuuuaaaua

SEQ ID NO: 1789079 - RNA, 16 nt, Salmonella enterica enterica serovar Typhi Ty2
uauuuucaaaaacaag

SEQ ID NO: 1789080 - RNA, 15 nt, Salmonella enterica enterica serovar Typhi Ty2
uauuuuaaauuccca

SEQ ID NO: 1789081 - RNA, 22 nt, Salmonella enterica enterica serovar Typhi Ty2
uauuuguuuaccgcgauagaaa

SEQ ID NO: 1789082 - RNA, 14 nt, Salmonella enterica enterica serovar Typhi Ty2
uauuuguuccggca

SEQ ID NO: 1789083 - RNA, 15 nt, Salmonella enterica enterica serovar Typhi Ty2
uauuuguuccggcaa

SEQ ID NO: 1789084 - RNA, 15 nt, Salmonella enterica enterica serovar Typhi Ty2
uauuuguguauuuuu

SEQ ID NO: 1789085 - RNA, 13 nt, Salmonella enterica enterica serovar Typhi Ty2
uauuugcauuuuc

SEQ ID NO: 1789086 - RNA, 22 nt, Salmonella enterica enterica serovar Typhi Ty2
uauuucgacaagaagauuucuu

SEQ ID NO: 1789087 - RNA, 15 nt, Salmonella enterica enterica serovar Typhi Ty2
uauuuccucagaaag

SEQ ID NO: 1789088 - RNA, 17 nt, Salmonella enterica enterica serovar Typhi Ty2
uauuuccauuuuucaga

SEQ ID NO: 1789089 - RNA, 15 nt, Salmonella enterica enterica serovar Typhi Ty2
uauuuccagaaauca

SEQ ID NO: 1789090 - RNA, 21 nt, Salmonella enterica enterica serovar Typhi Ty2
uauuucuaucagguaacauau

SEQ ID NO: 1789091 - RNA, 14 nt, Salmonella enterica enterica serovar Typhi Ty2
uauuucugaaaaac

SEQ ID NO: 1789092 - RNA, 18 nt, Salmonella enterica enterica serovar Typhi Ty2
uauuucucuugcagacag

SEQ ID NO: 1789093 - RNA, 19 nt, Salmonella enterica enterica serovar Typhi Ty2
uauuucugugagugcgcca

SEQ ID NO: 1789094 - RNA, 22 nt, Salmonella enterica enterica serovar Typhi Ty2
uauuucuuagcacccaccauca

SEQ ID NO: 1789095 - RNA, 20 nt, Salmonella enterica enterica serovar Typhi Ty2
uacaccugacggcagccacg

SEQ ID NO: 1789096 - RNA, 14 nt, Salmonella enterica enterica serovar Typhi Ty2
uacaccgccauaua

SEQ ID NO: 1789097 - RNA, 22 nt, Salmonella enterica enterica serovar Typhi Ty2
uacaccgccuagcgucccggca

SEQ ID NO: 1789098 - RNA, 18 nt, Salmonella enterica enterica serovar Typhi Ty2
uacaccguaaagcaccau

SEQ ID NO: 1789099 - RNA, 18 nt, Salmonella enterica enterica serovar Typhi Ty2
uacaccccuucuggagaa

SEQ ID NO: 1789100 - RNA, 15 nt, Salmonella enterica enterica serovar Typhi Ty2
uacacucugcgcgcg

SEQ ID NO: 1789101 - RNA, 21 nt, Salmonella enterica enterica serovar Typhi Ty2
uacacugaagccuggugccca

SEQ ID NO: 1789102 - RNA, 16 nt, Salmonella enterica enterica serovar Typhi Ty2
uacacugauaccccag

SEQ ID NO: 1789103 - RNA, 20 nt, Salmonella enterica enterica serovar Typhi Ty2
uacacgauaaaccucacgca

SEQ ID NO: 1789104 - RNA, 17 nt, Salmonella enterica enterica serovar Typhi Ty2
uacacgccuuccuccag

SEQ ID NO: 1789105 - RNA, 18 nt, Salmonella enterica enterica serovar Typhi Ty2
uacacgcgaauagccaga

SEQ ID NO: 1789106 - RNA, 12 nt, Salmonella enterica enterica serovar Typhi Ty2
uacagacaucau

SEQ ID NO: 1789107 - RNA, 21 nt, Salmonella enterica enterica serovar Typhi Ty2
uacagaauccggcgcucauca

SEQ ID NO: 1789108 - RNA, 17 nt, Salmonella enterica enterica serovar Typhi Ty2
uacacuucagccagacg

SEQ ID NO: 1789109 - RNA, 21 nt, Salmonella enterica enterica serovar Typhi Ty2
uacaacguucggucauggaua

SEQ ID NO: 1789110 - RNA, 22 nt, Salmonella enterica enterica serovar Typhi Ty2
uacaauaagggcauguuucaug

SEQ ID NO: 1789111 - RNA, 21 nt, Salmonella enterica enterica serovar Typhi Ty2
uacaaccguggcguuuucauu

SEQ ID NO: 1789112 - RNA, 17 nt, Salmonella enterica enterica serovar Typhi Ty2
uaauuuuagaaauagaa

SEQ ID NO: 1789113 - RNA, 18 nt, Salmonella enterica enterica serovar Typhi Ty2
uaauuuuacuuucauucc

SEQ ID NO: 1789114 - RNA, 17 nt, Salmonella enterica enterica serovar Typhi Ty2
uaauuuuacuuucauuc

SEQ ID NO: 1789115 - RNA, 21 nt, Salmonella enterica enterica serovar Typhi Ty2
uacaauuauugcguugcuuua

SEQ ID NO: 1789116 - RNA, 22 nt, Salmonella enterica enterica serovar Typhi Ty2
uacacaaagacgaauaaggaau

SEQ ID NO: 1789117 - RNA, 15 nt, Salmonella enterica enterica serovar Typhi Ty2
uacacacucggugca

SEQ ID NO: 1789118 - RNA, 17 nt, Salmonella enterica enterica serovar Typhi Ty2
uacaccaacuaccaaca

SEQ ID NO: 1789119 - RNA, 16 nt, Salmonella enterica enterica serovar Typhi Ty2
uacacaucaggaaugc

SEQ ID NO: 1789120 - RNA, 18 nt, Salmonella enterica enterica serovar Typhi Ty2
uacaguuaccacacaugc

SEQ ID NO: 1789121 - RNA, 13 nt, Salmonella enterica enterica serovar Typhi Ty2
uacaguuaccaca

SEQ ID NO: 1789122 - RNA, 16 nt, Salmonella enterica enterica serovar Typhi Ty2
uacaguuugucaucag

SEQ ID NO: 1789123 - RNA, 13 nt, Salmonella enterica enterica serovar Typhi Ty2
uacaggcaucuuc

SEQ ID NO: 1789124 - RNA, 17 nt, Salmonella enterica enterica serovar Typhi Ty2
uacaggcaucuuccagc

SEQ ID NO: 1789125 - RNA, 16 nt, Salmonella enterica enterica serovar Typhi Ty2
uacaggcggaaaucaa

SEQ ID NO: 1789126 - RNA, 15 nt, Salmonella enterica enterica serovar Typhi Ty2
uacaggcggaaauca

SEQ ID NO: 1789127 - RNA, 14 nt, Salmonella enterica enterica serovar Typhi Ty2
uacaggcgcagggc

SEQ ID NO: 1789128 - RNA, 17 nt, Salmonella enterica enterica serovar Typhi Ty2
uacaggcgcaucagaaa

SEQ ID NO: 1789129 - RNA, 19 nt, Salmonella enterica enterica serovar Typhi Ty2
uacaggcgcaucagaaaaa

SEQ ID NO: 1789130 - RNA, 20 nt, Salmonella enterica enterica serovar Typhi Ty2
uacaggcgcaucagaaaaac

SEQ ID NO: 1789131 - RNA, 22 nt, Salmonella enterica enterica serovar Typhi Ty2
uacaggcgcaucagaaaaaccu

SEQ ID NO: 1789132 - RNA, 18 nt, Salmonella enterica enterica serovar Typhi Ty2
uacaggaauuccaguccu

SEQ ID NO: 1789133 - RNA, 21 nt, Salmonella enterica enterica serovar Typhi Ty2
uacaggauauacuucaucagg

SEQ ID NO: 1789134 - RNA, 19 nt, Salmonella enterica enterica serovar Typhi Ty2
uacagcgucgacagccccc

SEQ ID NO: 1789135 - RNA, 15 nt, Salmonella enterica enterica serovar Typhi Ty2
uacagcacuucccgc

SEQ ID NO: 1789136 - RNA, 13 nt, Salmonella enterica enterica serovar Typhi Ty2
uacagaugcugua

SEQ ID NO: 1789137 - RNA, 18 nt, Salmonella enterica enterica serovar Typhi Ty2
uacagccugcgugaaucc

SEQ ID NO: 1789138 - RNA, 16 nt, Salmonella enterica enterica serovar Typhi Ty2
uacagccgcgaugcua

SEQ ID NO: 1789139 - RNA, 21 nt, Salmonella enterica enterica serovar Typhi Ty2
uacagccgacuauuccgcaaa

SEQ ID NO: 1789140 - RNA, 14 nt, Salmonella enterica enterica serovar Typhi Ty2
uacagccaaaaaua

SEQ ID NO: 1789141 - RNA, 19 nt, Salmonella enterica enterica serovar Typhi Ty2
uacagcacgacguagccca

SEQ ID NO: 1789142 - RNA, 17 nt, Salmonella enterica enterica serovar Typhi Ty2
uacagccaaaucagcag

SEQ ID NO: 1789143 - RNA, 13 nt, Salmonella enterica enterica serovar Typhi Ty2
uacagccaccaug

SEQ ID NO: 1789144 - RNA, 22 nt, Salmonella enterica enterica serovar Typhi Ty2
uacauaggcaauauccuccggc

SEQ ID NO: 1789145 - RNA, 22 nt, Salmonella enterica enterica serovar Typhi Ty2
uacauaguucuggcuuugcgcc

SEQ ID NO: 1789146 - RNA, 15 nt, Salmonella enterica enterica serovar Typhi Ty2
uacauaucuauauuu

SEQ ID NO: 1789147 - RNA, 18 nt, Salmonella enterica enterica serovar Typhi Ty2
uacaucuuccauuuuggu

SEQ ID NO: 1789148 - RNA, 12 nt, Salmonella enterica enterica serovar Typhi Ty2
uacauauuguuu

SEQ ID NO: 1789149 - RNA, 15 nt, Salmonella enterica enterica serovar Typhi Ty2
uacaugaauaauaau

SEQ ID NO: 1789150 - RNA, 16 nt, Salmonella enterica enterica serovar Typhi Ty2
uacaugaggauuuuga

SEQ ID NO: 1789151 - RNA, 16 nt, Salmonella enterica enterica serovar Typhi Ty2
uacaugcccgucuggg

SEQ ID NO: 1789152 - RNA, 17 nt, Salmonella enterica enterica serovar Typhi Ty2
uacaugccguuaauaau

SEQ ID NO: 1789153 - RNA, 20 nt, Salmonella enterica enterica serovar Typhi Ty2
uacauugggucguaauauuc

SEQ ID NO: 1789154 - RNA, 22 nt, Salmonella enterica enterica serovar Typhi Ty2
uacauuucacccuauaagcugc

SEQ ID NO: 1789155 - RNA, 19 nt, Salmonella enterica enterica serovar Typhi Ty2
uacauuuuuacaguuacca

SEQ ID NO: 1789156 - RNA, 21 nt, Salmonella enterica enterica serovar Typhi Ty2
uacauuuuuacaguuaccaca

SEQ ID NO: 1789157 - RNA, 15 nt, Salmonella enterica enterica serovar Typhi Ty2
uacauuuuccaugcc

SEQ ID NO: 1789158 - RNA, 22 nt, Salmonella enterica enterica serovar Typhi Ty2
uacauuuucguaaaauauauau

SEQ ID NO: 1789159 - RNA, 22 nt, Salmonella enterica enterica serovar Typhi Ty2
uacauuuuguauucgcagggcu

SEQ ID NO: 1789160 - RNA, 14 nt, Salmonella enterica enterica serovar Typhi Ty2
uaccaaacagcaga

SEQ ID NO: 1789161 - RNA, 14 nt, Salmonella enterica enterica serovar Typhi Ty2
uacauuuuuuucuu

SEQ ID NO: 1789162 - RNA, 17 nt, Salmonella enterica enterica serovar Typhi Ty2
uaccaauacccagcgcc

SEQ ID NO: 1789163 - RNA, 19 nt, Salmonella enterica enterica serovar Typhi Ty2
uaacgaggccaccaucacu

SEQ ID NO: 1789164 - RNA, 12 nt, Salmonella enterica enterica serovar Typhi Ty2
uaacgauaaaau

SEQ ID NO: 1789165 - RNA, 20 nt, Salmonella enterica enterica serovar Typhi Ty2
uaacgauacccaccagcgug

SEQ ID NO: 1789166 - RNA, 18 nt, Salmonella enterica enterica serovar Typhi Ty2
uaacgaugauuauuguua

SEQ ID NO: 1789167 - RNA, 16 nt, Salmonella enterica enterica serovar Typhi Ty2
uaacgaugaugaaaaa

SEQ ID NO: 1789168 - RNA, 15 nt, Salmonella enterica enterica serovar Typhi Ty2
uaacgaugaugaaaa

SEQ ID NO: 1789169 - RNA, 20 nt, Salmonella enterica enterica serovar Typhi Ty2
uaaucgcgauuuuuuuccgc

SEQ ID NO: 1789170 - RNA, 15 nt, Salmonella enterica enterica serovar Typhi Ty2
uaaucgccugccagc

SEQ ID NO: 1789171 - RNA, 15 nt, Salmonella enterica enterica serovar Typhi Ty2
uaauccuuauuuaau

SEQ ID NO: 1789172 - RNA, 20 nt, Salmonella enterica enterica serovar Typhi Ty2
uaauccuuguccauguaaac

SEQ ID NO: 1789173 - RNA, 18 nt, Salmonella enterica enterica serovar Typhi Ty2
uaaucuaaaauuauuuuu

SEQ ID NO: 1789174 - RNA, 15 nt, Salmonella enterica enterica serovar Typhi Ty2
uaaucuaaaauuauu

SEQ ID NO: 1789175 - RNA, 14 nt, Salmonella enterica enterica serovar Typhi Ty2
uaaucuaaaauuau

SEQ ID NO: 1789176 - RNA, 18 nt, Salmonella enterica enterica serovar Typhi Ty2
uaaucugaauaccuugau

SEQ ID NO: 1789177 - RNA, 21 nt, Salmonella enterica enterica serovar Typhi Ty2
uaaucugugauugaauucacc

SEQ ID NO: 1789178 - RNA, 15 nt, Salmonella enterica enterica serovar Typhi Ty2
uaaucugccagcuua

SEQ ID NO: 1789179 - RNA, 14 nt, Salmonella enterica enterica serovar Typhi Ty2
uaaucuuuucauau

SEQ ID NO: 1789180 - RNA, 15 nt, Salmonella enterica enterica serovar Typhi Ty2
uaaugacauccagag

SEQ ID NO: 1789181 - RNA, 16 nt, Salmonella enterica enterica serovar Typhi Ty2
uaaugacauagugcaa

SEQ ID NO: 1789182 - RNA, 15 nt, Salmonella enterica enterica serovar Typhi Ty2
uaaugaauuuaauau

SEQ ID NO: 1789183 - RNA, 13 nt, Salmonella enterica enterica serovar Typhi Ty2
uaaugaauuuaau

SEQ ID NO: 1789184 - RNA, 19 nt, Salmonella enterica enterica serovar Typhi Ty2
uaaugaagacguugaauau

SEQ ID NO: 1789185 - RNA, 16 nt, Salmonella enterica enterica serovar Typhi Ty2
uaaugaagcauaaaaa

SEQ ID NO: 1789186 - RNA, 19 nt, Salmonella enterica enterica serovar Typhi Ty2
uaaugaagcauaaaaagac

SEQ ID NO: 1789187 - RNA, 14 nt, Salmonella enterica enterica serovar Typhi Ty2
uaaugaacagcaaa

SEQ ID NO: 1789188 - RNA, 15 nt, Salmonella enterica enterica serovar Typhi Ty2
uaaugcuuuaaaugc

SEQ ID NO: 1789189 - RNA, 17 nt, Salmonella enterica enterica serovar Typhi Ty2
uaaugcuuuaaaugccu

SEQ ID NO: 1789190 - RNA, 16 nt, Salmonella enterica enterica serovar Typhi Ty2
uaaugcuuuccagcca

SEQ ID NO: 1789191 - RNA, 11 nt, Salmonella enterica enterica serovar Typhi Ty2
uaaugcuuuug

SEQ ID NO: 1789192 - RNA, 15 nt, Salmonella enterica enterica serovar Typhi Ty2
uaaugcauggcagau

SEQ ID NO: 1789193 - RNA, 16 nt, Salmonella enterica enterica serovar Typhi Ty2
uaaugacuaauuauua

SEQ ID NO: 1789194 - RNA, 17 nt, Salmonella enterica enterica serovar Typhi Ty2
uaaugacuaauuauuau

SEQ ID NO: 1789195 - RNA, 16 nt, Salmonella enterica enterica serovar Typhi Ty2
uaauuagcauccagca

SEQ ID NO: 1789196 - RNA, 12 nt, Salmonella enterica enterica serovar Typhi Ty2
uaauuaaaugcu

SEQ ID NO: 1789197 - RNA, 19 nt, Salmonella enterica enterica serovar Typhi Ty2
uaauuaacgccgcgaggau

SEQ ID NO: 1789198 - RNA, 20 nt, Salmonella enterica enterica serovar Typhi Ty2
uaauggugguugcaucaucg

SEQ ID NO: 1789199 - RNA, 16 nt, Salmonella enterica enterica serovar Typhi Ty2
uaaugguggcaaccug

SEQ ID NO: 1789200 - RNA, 18 nt, Salmonella enterica enterica serovar Typhi Ty2
uaauguaaaaaaauaaaa

SEQ ID NO: 1789201 - RNA, 16 nt, Salmonella enterica enterica serovar Typhi Ty2
uaauguaaaacaagag

SEQ ID NO: 1789202 - RNA, 18 nt, Salmonella enterica enterica serovar Typhi Ty2
uaauguaaaacaagagaa

SEQ ID NO: 1789203 - RNA, 22 nt, Salmonella enterica enterica serovar Typhi Ty2
uaauggcgaagcccgccuccac

SEQ ID NO: 1789204 - RNA, 18 nt, Salmonella enterica enterica serovar Typhi Ty2
uaauggcgcgaaaacagc

SEQ ID NO: 1789205 - RNA, 17 nt, Salmonella enterica enterica serovar Typhi Ty2
uaauggcgcgaaaacag

SEQ ID NO: 1789206 - RNA, 22 nt, Salmonella enterica enterica serovar Typhi Ty2
uaauucauggccaucaacuucu

SEQ ID NO: 1789207 - RNA, 20 nt, Salmonella enterica enterica serovar Typhi Ty2
uaauucucacagaaucauca

SEQ ID NO: 1789208 - RNA, 16 nt, Salmonella enterica enterica serovar Typhi Ty2
uaauucuaaaaguaag

SEQ ID NO: 1789209 - RNA, 21 nt, Salmonella enterica enterica serovar Typhi Ty2
uaauuauaaagcauaaauaca

SEQ ID NO: 1789210 - RNA, 15 nt, Salmonella enterica enterica serovar Typhi Ty2
uaauuuauagccauu

SEQ ID NO: 1789211 - RNA, 23 nt, Salmonella enterica enterica serovar Typhi Ty2
uaauuuccagugccaguuaagca

SEQ ID NO: 1789212 - RNA, 20 nt, Salmonella enterica enterica serovar Typhi Ty2
uaauugcugacgcgcuuuuu

SEQ ID NO: 1789213 - RNA, 16 nt, Salmonella enterica enterica serovar Typhi Ty2
uaauugcugaagauaa

SEQ ID NO: 1789214 - RNA, 15 nt, Salmonella enterica enterica serovar Typhi Ty2
uaauuguguaaucuu

SEQ ID NO: 1789215 - RNA, 14 nt, Salmonella enterica enterica serovar Typhi Ty2
uacuccguuuuaau

SEQ ID NO: 1789216 - RNA, 17 nt, Salmonella enterica enterica serovar Typhi Ty2
uacuccguuuuaaucuu

SEQ ID NO: 1789217 - RNA, 16 nt, Salmonella enterica enterica serovar Typhi Ty2
uacuccugcaacagaa

SEQ ID NO: 1789218 - RNA, 21 nt, Salmonella enterica enterica serovar Typhi Ty2
uacuggugcccgcaaaaccuu

SEQ ID NO: 1789219 - RNA, 22 nt, Salmonella enterica enterica serovar Typhi Ty2
uacuggcuaucuuuaugucagu

SEQ ID NO: 1789220 - RNA, 14 nt, Salmonella enterica enterica serovar Typhi Ty2
uacuuucuacaaau

SEQ ID NO: 1789221 - RNA, 16 nt, Salmonella enterica enterica serovar Typhi Ty2
uacuuucccccagauu

SEQ ID NO: 1789222 - RNA, 11 nt, Salmonella enterica enterica serovar Typhi Ty2
uacuuuccuga

SEQ ID NO: 1789223 - RNA, 13 nt, Salmonella enterica enterica serovar Typhi Ty2
uacuuuccagcaa

SEQ ID NO: 1789224 - RNA, 21 nt, Salmonella enterica enterica serovar Typhi Ty2
uacuucgauggccucaucaug

SEQ ID NO: 1789225 - RNA, 19 nt, Salmonella enterica enterica serovar Typhi Ty2
uacuucguagacucaggcg

SEQ ID NO: 1789226 - RNA, 14 nt, Salmonella enterica enterica serovar Typhi Ty2
uacuuuguacugua

SEQ ID NO: 1789227 - RNA, 18 nt, Salmonella enterica enterica serovar Typhi Ty2
uacuuuuuuaaauguuuu

SEQ ID NO: 1789228 - RNA, 13 nt, Salmonella enterica enterica serovar Typhi Ty2
uacuuuuuuaaau

SEQ ID NO: 1789229 - RNA, 23 nt, Salmonella enterica enterica serovar Typhi Ty2
uacuuuuuuaaauguuuuuucau

SEQ ID NO: 1789230 - RNA, 14 nt, Salmonella enterica enterica serovar Typhi Ty2
uagaaaaaauuaaa

SEQ ID NO: 1789231 - RNA, 22 nt, Salmonella enterica enterica serovar Typhi Ty2
uagaaaauaauucauauuagcu

SEQ ID NO: 1789232 - RNA, 14 nt, Salmonella enterica enterica serovar Typhi Ty2
uagaaaauauauug

SEQ ID NO: 1789233 - RNA, 23 nt, Salmonella enterica enterica serovar Typhi Ty2
uagaaacucuuuaaagcgcugcg

SEQ ID NO: 1789234 - RNA, 23 nt, Salmonella enterica enterica serovar Typhi Ty2
uagaaagucuuuuguuuuucucu

SEQ ID NO: 1789235 - RNA, 22 nt, Salmonella enterica enterica serovar Typhi Ty2
uagaaagucuuuuguuuuucuc

SEQ ID NO: 1789236 - RNA, 12 nt, Salmonella enterica enterica serovar Typhi Ty2
uagagaaaucaa

SEQ ID NO: 1789237 - RNA, 13 nt, Salmonella enterica enterica serovar Typhi Ty2
uagagaaaauaac

SEQ ID NO: 1789238 - RNA, 16 nt, Salmonella enterica enterica serovar Typhi Ty2
uagacuucacuuuccc

SEQ ID NO: 1789239 - RNA, 15 nt, Salmonella enterica enterica serovar Typhi Ty2
uagagaacagcauca

SEQ ID NO: 1789240 - RNA, 21 nt, Salmonella enterica enterica serovar Typhi Ty2
uagacuggcgccgucacguuc

SEQ ID NO: 1789241 - RNA, 22 nt, Salmonella enterica enterica serovar Typhi Ty2
uagacgacaucuuuuccugaag

SEQ ID NO: 1789242 - RNA, 15 nt, Salmonella enterica enterica serovar Typhi Ty2
uagacgaugcaggcc

SEQ ID NO: 1789243 - RNA, 17 nt, Salmonella enterica enterica serovar Typhi Ty2
uagacgccggucaugcc

SEQ ID NO: 1789244 - RNA, 22 nt, Salmonella enterica enterica serovar Typhi Ty2
uagaccugcuccaugacguuca

SEQ ID NO: 1789245 - RNA, 18 nt, Salmonella enterica enterica serovar Typhi Ty2
uagacaacaucccagaaa

SEQ ID NO: 1789246 - RNA, 21 nt, Salmonella enterica enterica serovar Typhi Ty2
uagacaauugcugcguaacug

SEQ ID NO: 1789247 - RNA, 17 nt, Salmonella enterica enterica serovar Typhi Ty2
uagaccugaaaucagcc

SEQ ID NO: 1789248 - RNA, 15 nt, Salmonella enterica enterica serovar Typhi Ty2
uagaccugaaaucag

SEQ ID NO: 1789249 - RNA, 21 nt, Salmonella enterica enterica serovar Typhi Ty2
uagaccacgccaucaacagcg

SEQ ID NO: 1789250 - RNA, 19 nt, Salmonella enterica enterica serovar Typhi Ty2
uagaagcucaugugcagca

SEQ ID NO: 1789251 - RNA, 20 nt, Salmonella enterica enterica serovar Typhi Ty2
uagaagcucaugugcagcau

SEQ ID NO: 1789252 - RNA, 14 nt, Salmonella enterica enterica serovar Typhi Ty2
uagaaccacuuauu

SEQ ID NO: 1789253 - RNA, 14 nt, Salmonella enterica enterica serovar Typhi Ty2
uagaacccaaagcc

SEQ ID NO: 1789254 - RNA, 23 nt, Salmonella enterica enterica serovar Typhi Ty2
uagaaucaauuucucuuuuauua

SEQ ID NO: 1789255 - RNA, 18 nt, Salmonella enterica enterica serovar Typhi Ty2
uagaaucccaccaauugc

SEQ ID NO: 1789256 - RNA, 13 nt, Salmonella enterica enterica serovar Typhi Ty2
uagaaucuauuau

SEQ ID NO: 1789257 - RNA, 18 nt, Salmonella enterica enterica serovar Typhi Ty2
uagaaucugguuguuucg

SEQ ID NO: 1789258 - RNA, 17 nt, Salmonella enterica enterica serovar Typhi Ty2
uagaauuaucugaaagu

SEQ ID NO: 1789259 - RNA, 16 nt, Salmonella enterica enterica serovar Typhi Ty2
uagaauacuuccugcu

SEQ ID NO: 1789260 - RNA, 16 nt, Salmonella enterica enterica serovar Typhi Ty2
uagaauagaaucaauu

SEQ ID NO: 1789261 - RNA, 16 nt, Salmonella enterica enterica serovar Typhi Ty2
uagaauaggaaauaau

SEQ ID NO: 1789262 - RNA, 13 nt, Salmonella enterica enterica serovar Typhi Ty2
uacgguuuauccc

SEQ ID NO: 1789263 - RNA, 21 nt, Salmonella enterica enterica serovar Typhi Ty2
uacgguccguuuucgccccca

SEQ ID NO: 1789264 - RNA, 14 nt, Salmonella enterica enterica serovar Typhi Ty2
uacgguacugccca

SEQ ID NO: 1789265 - RNA, 11 nt, Salmonella enterica enterica serovar Typhi Ty2
uacggcaggcc

SEQ ID NO: 1789266 - RNA, 22 nt, Salmonella enterica enterica serovar Typhi Ty2
uacggcaaacacaaucacgccc

SEQ ID NO: 1789267 - RNA, 20 nt, Salmonella enterica enterica serovar Typhi Ty2
uacggccacaaaacaggauu

SEQ ID NO: 1789268 - RNA, 14 nt, Salmonella enterica enterica serovar Typhi Ty2
uacggcaucggaac

SEQ ID NO: 1789269 - RNA, 20 nt, Salmonella enterica enterica serovar Typhi Ty2
uacggauggcccugccgggg

SEQ ID NO: 1789270 - RNA, 21 nt, Salmonella enterica enterica serovar Typhi Ty2
uacggaguuggaaccaaacac

SEQ ID NO: 1789271 - RNA, 18 nt, Salmonella enterica enterica serovar Typhi Ty2
uacgauagcaauuaauaa

SEQ ID NO: 1789272 - RNA, 17 nt, Salmonella enterica enterica serovar Typhi Ty2
uacgauagcaauuaaua

SEQ ID NO: 1789273 - RNA, 20 nt, Salmonella enterica enterica serovar Typhi Ty2
uacgcugaagauuuuuauuc

SEQ ID NO: 1789274 - RNA, 16 nt, Salmonella enterica enterica serovar Typhi Ty2
uacgaugcagcaccag

SEQ ID NO: 1789275 - RNA, 23 nt, Salmonella enterica enterica serovar Typhi Ty2
uacgaucgucuggcgagaacacg

SEQ ID NO: 1789276 - RNA, 23 nt, Salmonella enterica enterica serovar Typhi Ty2
uacgauucagguuuugcugauca

SEQ ID NO: 1789277 - RNA, 15 nt, Salmonella enterica enterica serovar Typhi Ty2
uacggaaaaaauacu

SEQ ID NO: 1789278 - RNA, 13 nt, Salmonella enterica enterica serovar Typhi Ty2
uacguuccagcag

SEQ ID NO: 1789279 - RNA, 16 nt, Salmonella enterica enterica serovar Typhi Ty2
uacguuuauucuuuuc

SEQ ID NO: 1789280 - RNA, 13 nt, Salmonella enterica enterica serovar Typhi Ty2
uacguuuuuauua

SEQ ID NO: 1789281 - RNA, 24 nt, Salmonella enterica enterica serovar Typhi Ty2
uacucaccaguccggcagaaagca

SEQ ID NO: 1789282 - RNA, 20 nt, Salmonella enterica enterica serovar Typhi Ty2
uacucagcacauucagagcg

SEQ ID NO: 1789283 - RNA, 19 nt, Salmonella enterica enterica serovar Typhi Ty2
uacucacgacuuucaccag

SEQ ID NO: 1789284 - RNA, 14 nt, Salmonella enterica enterica serovar Typhi Ty2
uacucaacaucauu

SEQ ID NO: 1789285 - RNA, 11 nt, Salmonella enterica enterica serovar Typhi Ty2
uacuauuuccu

SEQ ID NO: 1789286 - RNA, 12 nt, Salmonella enterica enterica serovar Typhi Ty2
uacuccagccca

SEQ ID NO: 1789287 - RNA, 21 nt, Salmonella enterica enterica serovar Typhi Ty2
uacuccauucccagcucuuuc

SEQ ID NO: 1789288 - RNA, 21 nt, Salmonella enterica enterica serovar Typhi Ty2
uacuccagcccaucagucccc

SEQ ID NO: 1789289 - RNA, 20 nt, Salmonella enterica enterica serovar Typhi Ty2
uacucagcgacguaaucuau

SEQ ID NO: 1789290 - RNA, 14 nt, Salmonella enterica enterica serovar Typhi Ty2
uacucagggcaaaa

SEQ ID NO: 1789291 - RNA, 22 nt, Salmonella enterica enterica serovar Typhi Ty2
uaccuuuuccucgucauaucug

SEQ ID NO: 1789292 - RNA, 23 nt, Salmonella enterica enterica serovar Typhi Ty2
uaccuuuuccggcggcaguccca

SEQ ID NO: 1789293 - RNA, 12 nt, Salmonella enterica enterica serovar Typhi Ty2
uaccuuuuccuc

SEQ ID NO: 1789294 - RNA, 21 nt, Salmonella enterica enterica serovar Typhi Ty2
uaccuucgcguuuaucaccaa

SEQ ID NO: 1789295 - RNA, 19 nt, Salmonella enterica enterica serovar Typhi Ty2
uaccuucccgcgauaaaaa

SEQ ID NO: 1789296 - RNA, 16 nt, Salmonella enterica enterica serovar Typhi Ty2
uaccuuguucuuccau

SEQ ID NO: 1789297 - RNA, 19 nt, Salmonella enterica enterica serovar Typhi Ty2
uaccuuuaaacuguuucca

SEQ ID NO: 1789298 - RNA, 14 nt, Salmonella enterica enterica serovar Typhi Ty2
uaccuuguucuucc

SEQ ID NO: 1789299 - RNA, 16 nt, Salmonella enterica enterica serovar Typhi Ty2
uaccuucuauuuuucc

SEQ ID NO: 1789300 - RNA, 17 nt, Salmonella enterica enterica serovar Typhi Ty2
uaccucgcgcuuauccg

SEQ ID NO: 1789301 - RNA, 16 nt, Salmonella enterica enterica serovar Typhi Ty2
uaccugaagccauccu

SEQ ID NO: 1789302 - RNA, 22 nt, Salmonella enterica enterica serovar Typhi Ty2
uaccugccagggugcaaagaaa

SEQ ID NO: 1789303 - RNA, 22 nt, Salmonella enterica enterica serovar Typhi Ty2
uaccugcacuuuaagcggcagc

SEQ ID NO: 1789304 - RNA, 18 nt, Salmonella enterica enterica serovar Typhi Ty2
uaccugaugagcaggcca

SEQ ID NO: 1789305 - RNA, 18 nt, Salmonella enterica enterica serovar Typhi Ty2
uaccugaugucauucuuu

SEQ ID NO: 1789306 - RNA, 19 nt, Salmonella enterica enterica serovar Typhi Ty2
uaccugauccagcucuucu

SEQ ID NO: 1789307 - RNA, 14 nt, Salmonella enterica enterica serovar Typhi Ty2
uaccugauaaaauu

SEQ ID NO: 1789308 - RNA, 13 nt, Salmonella enterica enterica serovar Typhi Ty2
uaccuguauuaug

SEQ ID NO: 1789309 - RNA, 22 nt, Salmonella enterica enterica serovar Typhi Ty2
uaccuguauuuucguuugcauu

SEQ ID NO: 1789310 - RNA, 18 nt, Salmonella enterica enterica serovar Typhi Ty2
uaccugcgcaaucaugac

SEQ ID NO: 1789311 - RNA, 22 nt, Salmonella enterica enterica serovar Typhi Ty2
uaccuuacggacugcggccugc

SEQ ID NO: 1789312 - RNA, 17 nt, Salmonella enterica enterica serovar Typhi Ty2
uaccuguaucaaaccaa

SEQ ID NO: 1789313 - RNA, 21 nt, Salmonella enterica enterica serovar Typhi Ty2
uaccucaaaaaccaguugcca

SEQ ID NO: 1789314 - RNA, 16 nt, Salmonella enterica enterica serovar Typhi Ty2
uaccgggcuaaaccac

SEQ ID NO: 1789315 - RNA, 19 nt, Salmonella enterica enterica serovar Typhi Ty2
uaccgggccuauauuucug

SEQ ID NO: 1789316 - RNA, 18 nt, Salmonella enterica enterica serovar Typhi Ty2
uaccggcgcucagccaga

SEQ ID NO: 1789317 - RNA, 16 nt, Salmonella enterica enterica serovar Typhi Ty2
uaccggcgaagucgcc

SEQ ID NO: 1789318 - RNA, 23 nt, Salmonella enterica enterica serovar Typhi Ty2
uaccgccgagcauuuccgcagcc

SEQ ID NO: 1789319 - RNA, 16 nt, Salmonella enterica enterica serovar Typhi Ty2
uaccgcuaaaauaccc

SEQ ID NO: 1789320 - RNA, 22 nt, Salmonella enterica enterica serovar Typhi Ty2
uaccgcgcaguucaauauucac

SEQ ID NO: 1789321 - RNA, 22 nt, Salmonella enterica enterica serovar Typhi Ty2
uaccgccgcuuuucaggggucc

SEQ ID NO: 1789322 - RNA, 15 nt, Salmonella enterica enterica serovar Typhi Ty2
uaccaaugccaaaaa

SEQ ID NO: 1789323 - RNA, 18 nt, Salmonella enterica enterica serovar Typhi Ty2
uaccaauuccaccaccuc

SEQ ID NO: 1789324 - RNA, 22 nt, Salmonella enterica enterica serovar Typhi Ty2
uaccacgccguagcugcgcgcc

SEQ ID NO: 1789325 - RNA, 16 nt, Salmonella enterica enterica serovar Typhi Ty2
uaccaccugccaaagc

SEQ ID NO: 1789326 - RNA, 15 nt, Salmonella enterica enterica serovar Typhi Ty2
uagauaacaccgcau

SEQ ID NO: 1789327 - RNA, 16 nt, Salmonella enterica enterica serovar Typhi Ty2
uagauaacuauaugcc

SEQ ID NO: 1789328 - RNA, 18 nt, Salmonella enterica enterica serovar Typhi Ty2
uagauaaguccuaacacc

SEQ ID NO: 1789329 - RNA, 16 nt, Salmonella enterica enterica serovar Typhi Ty2
uagauaccuacuuuau

SEQ ID NO: 1789330 - RNA, 23 nt, Salmonella enterica enterica serovar Typhi Ty2
uagauaccuacuuuauuuuucgc

SEQ ID NO: 1789331 - RNA, 17 nt, Salmonella enterica enterica serovar Typhi Ty2
uagagugcuucugcaaa

SEQ ID NO: 1789332 - RNA, 21 nt, Salmonella enterica enterica serovar Typhi Ty2
uagagugauccaccaccagca

SEQ ID NO: 1789333 - RNA, 16 nt, Salmonella enterica enterica serovar Typhi Ty2
uagagguguuauggca

SEQ ID NO: 1789334 - RNA, 20 nt, Salmonella enterica enterica serovar Typhi Ty2
uagagcaggucaaagacgaa

SEQ ID NO: 1789335 - RNA, 19 nt, Salmonella enterica enterica serovar Typhi Ty2
uagauucuaacauaaugaa

SEQ ID NO: 1789336 - RNA, 22 nt, Salmonella enterica enterica serovar Typhi Ty2
uagauggcguaucgcuugauac

SEQ ID NO: 1789337 - RNA, 13 nt, Salmonella enterica enterica serovar Typhi Ty2
uagauauuaauau

SEQ ID NO: 1789338 - RNA, 17 nt, Salmonella enterica enterica serovar Typhi Ty2
uagauauagcuuuucaa

SEQ ID NO: 1789339 - RNA, 13 nt, Salmonella enterica enterica serovar Typhi Ty2
uagcaauuauauu

SEQ ID NO: 1789340 - RNA, 14 nt, Salmonella enterica enterica serovar Typhi Ty2
uagcacaaagaauu

SEQ ID NO: 1789341 - RNA, 13 nt, Salmonella enterica enterica serovar Typhi Ty2
uagcacaaagaau

SEQ ID NO: 1789342 - RNA, 23 nt, Salmonella enterica enterica serovar Typhi Ty2
uagcaccucgcaauauucaugcc

SEQ ID NO: 1789343 - RNA, 22 nt, Salmonella enterica enterica serovar Typhi Ty2
uagcaacccacuuucggaaaaa

SEQ ID NO: 1789344 - RNA, 18 nt, Salmonella enterica enterica serovar Typhi Ty2
uagcaauuaauaaacaau

SEQ ID NO: 1789345 - RNA, 14 nt, Salmonella enterica enterica serovar Typhi Ty2
uagcaauuaauaaa

SEQ ID NO: 1789346 - RNA, 13 nt, Salmonella enterica enterica serovar Typhi Ty2
uagcaaaaaugcc

SEQ ID NO: 1789347 - RNA, 14 nt, Salmonella enterica enterica serovar Typhi Ty2
uagcaaaaaugccg

SEQ ID NO: 1789348 - RNA, 20 nt, Salmonella enterica enterica serovar Typhi Ty2
uagcaacacagacuuugcac

SEQ ID NO: 1789349 - RNA, 21 nt, Salmonella enterica enterica serovar Typhi Ty2
uagcaaagcguacaugaauaa

SEQ ID NO: 1789350 - RNA, 17 nt, Salmonella enterica enterica serovar Typhi Ty2
uagcauaacguuuccuu

SEQ ID NO: 1789351 - RNA, 19 nt, Salmonella enterica enterica serovar Typhi Ty2
uagcauaacguuuccuuau

SEQ ID NO: 1789352 - RNA, 21 nt, Salmonella enterica enterica serovar Typhi Ty2
uagcauaaaugcgaugaacau

SEQ ID NO: 1789353 - RNA, 14 nt, Salmonella enterica enterica serovar Typhi Ty2
uagcaguggagagg

SEQ ID NO: 1789354 - RNA, 19 nt, Salmonella enterica enterica serovar Typhi Ty2
uagcagcauaaacaucagc

SEQ ID NO: 1789355 - RNA, 14 nt, Salmonella enterica enterica serovar Typhi Ty2
uagcauccagaccc

SEQ ID NO: 1789356 - RNA, 17 nt, Salmonella enterica enterica serovar Typhi Ty2
uagcaucaggacauggu

SEQ ID NO: 1789357 - RNA, 20 nt, Salmonella enterica enterica serovar Typhi Ty2
uagcauuaagcugauauuuu

SEQ ID NO: 1789358 - RNA, 19 nt, Salmonella enterica enterica serovar Typhi Ty2
uagccaaagauuagcccca

SEQ ID NO: 1789359 - RNA, 16 nt, Salmonella enterica enterica serovar Typhi Ty2
uagcauuuuuacucag

SEQ ID NO: 1789360 - RNA, 20 nt, Salmonella enterica enterica serovar Typhi Ty2
uagccaaagcgguaauuaau

SEQ ID NO: 1789361 - RNA, 17 nt, Salmonella enterica enterica serovar Typhi Ty2
uagccaauaacgucugg

SEQ ID NO: 1789362 - RNA, 12 nt, Salmonella enterica enterica serovar Typhi Ty2
uaggauaaaauc

SEQ ID NO: 1789363 - RNA, 18 nt, Salmonella enterica enterica serovar Typhi Ty2
uaggaagacgagaagcga

SEQ ID NO: 1789364 - RNA, 14 nt, Salmonella enterica enterica serovar Typhi Ty2
uagcuucugucugc

SEQ ID NO: 1789365 - RNA, 17 nt, Salmonella enterica enterica serovar Typhi Ty2
uagcuuuuccgcuggaa

SEQ ID NO: 1789366 - RNA, 13 nt, Salmonella enterica enterica serovar Typhi Ty2
uagcuuuuuuaug

SEQ ID NO: 1789367 - RNA, 21 nt, Salmonella enterica enterica serovar Typhi Ty2
uagcuuuuuacucucuuucug

SEQ ID NO: 1789368 - RNA, 14 nt, Salmonella enterica enterica serovar Typhi Ty2
uagcuucagcggcg

SEQ ID NO: 1789369 - RNA, 17 nt, Salmonella enterica enterica serovar Typhi Ty2
uagcugcguuuccagcc

SEQ ID NO: 1789370 - RNA, 15 nt, Salmonella enterica enterica serovar Typhi Ty2
uagcuuaaaaaaucc

SEQ ID NO: 1789371 - RNA, 13 nt, Salmonella enterica enterica serovar Typhi Ty2
uagcuaauggcuu

SEQ ID NO: 1789372 - RNA, 17 nt, Salmonella enterica enterica serovar Typhi Ty2
uagcuccagacaggacg

SEQ ID NO: 1789373 - RNA, 22 nt, Salmonella enterica enterica serovar Typhi Ty2
uagcucaguugguagagcccug

SEQ ID NO: 1789374 - RNA, 23 nt, Salmonella enterica enterica serovar Typhi Ty2
uagcucagcuggauagagcgcug

SEQ ID NO: 1789375 - RNA, 15 nt, Salmonella enterica enterica serovar Typhi Ty2
uagcuaaauaaaaau

SEQ ID NO: 1789376 - RNA, 12 nt, Salmonella enterica enterica serovar Typhi Ty2
uagcuaaugcaa

SEQ ID NO: 1789377 - RNA, 16 nt, Salmonella enterica enterica serovar Typhi Ty2
uagcguucuuuccagu

SEQ ID NO: 1789378 - RNA, 13 nt, Salmonella enterica enterica serovar Typhi Ty2
uagcguugauaug

SEQ ID NO: 1789379 - RNA, 19 nt, Salmonella enterica enterica serovar Typhi Ty2
uagcguuuaaaaagcugca

SEQ ID NO: 1789380 - RNA, 13 nt, Salmonella enterica enterica serovar Typhi Ty2
uagcguuuuccag

SEQ ID NO: 1789381 - RNA, 12 nt, Salmonella enterica enterica serovar Typhi Ty2
uagcgugccauu

SEQ ID NO: 1789382 - RNA, 16 nt, Salmonella enterica enterica serovar Typhi Ty2
uagccgccccccguca

SEQ ID NO: 1789383 - RNA, 16 nt, Salmonella enterica enterica serovar Typhi Ty2
uagccgcugcccugac

SEQ ID NO: 1789384 - RNA, 21 nt, Salmonella enterica enterica serovar Typhi Ty2
uagccgcgcgccgccucuuca

SEQ ID NO: 1789385 - RNA, 19 nt, Salmonella enterica enterica serovar Typhi Ty2
uagccgcgcgucagcgugu

SEQ ID NO: 1789386 - RNA, 18 nt, Salmonella enterica enterica serovar Typhi Ty2
uagccguucaugcacucg

SEQ ID NO: 1789387 - RNA, 15 nt, Salmonella enterica enterica serovar Typhi Ty2
uagccguucaugcac

SEQ ID NO: 1789388 - RNA, 21 nt, Salmonella enterica enterica serovar Typhi Ty2
uagccuaaugacggacgcaga

SEQ ID NO: 1789389 - RNA, 14 nt, Salmonella enterica enterica serovar Typhi Ty2
uagccggauaaaau

SEQ ID NO: 1789390 - RNA, 18 nt, Salmonella enterica enterica serovar Typhi Ty2
uagccgguaacuuucccg

SEQ ID NO: 1789391 - RNA, 20 nt, Salmonella enterica enterica serovar Typhi Ty2
uagccggugccgcaaucggu

SEQ ID NO: 1789392 - RNA, 18 nt, Salmonella enterica enterica serovar Typhi Ty2
uagccauucauuaaaauu

SEQ ID NO: 1789393 - RNA, 20 nt, Salmonella enterica enterica serovar Typhi Ty2
uagccaguaccgaaaucauc

SEQ ID NO: 1789394 - RNA, 12 nt, Salmonella enterica enterica serovar Typhi Ty2
uagccagcauca

SEQ ID NO: 1789395 - RNA, 20 nt, Salmonella enterica enterica serovar Typhi Ty2
uagccagccugaacgggugg

SEQ ID NO: 1789396 - RNA, 21 nt, Salmonella enterica enterica serovar Typhi Ty2
uagcccauauaacguuuucag

SEQ ID NO: 1789397 - RNA, 16 nt, Salmonella enterica enterica serovar Typhi Ty2
uagcccggcaggcugg

SEQ ID NO: 1789398 - RNA, 20 nt, Salmonella enterica enterica serovar Typhi Ty2
uagccuuuuucuuucagacc

SEQ ID NO: 1789399 - RNA, 15 nt, Salmonella enterica enterica serovar Typhi Ty2
uagccuuuuucuuuc

SEQ ID NO: 1789400 - RNA, 15 nt, Salmonella enterica enterica serovar Typhi Ty2
uagcgaaacaguugg

SEQ ID NO: 1789401 - RNA, 23 nt, Salmonella enterica enterica serovar Typhi Ty2
uagccuuuauugaugacauuaau

SEQ ID NO: 1789402 - RNA, 15 nt, Salmonella enterica enterica serovar Typhi Ty2
uagcgccagacagau

SEQ ID NO: 1789403 - RNA, 22 nt, Salmonella enterica enterica serovar Typhi Ty2
uagcgccagacagauaacacca

SEQ ID NO: 1789404 - RNA, 16 nt, Salmonella enterica enterica serovar Typhi Ty2
uagcgccagcagcaua

SEQ ID NO: 1789405 - RNA, 14 nt, Salmonella enterica enterica serovar Typhi Ty2
uagcgccagcagca

SEQ ID NO: 1789406 - RNA, 22 nt, Salmonella enterica enterica serovar Typhi Ty2
uagcgagaagccgauggaagua

SEQ ID NO: 1789407 - RNA, 14 nt, Salmonella enterica enterica serovar Typhi Ty2
uagcgacugauaag

SEQ ID NO: 1789408 - RNA, 17 nt, Salmonella enterica enterica serovar Typhi Ty2
uagcgcaaaagcgcgcc

SEQ ID NO: 1789409 - RNA, 22 nt, Salmonella enterica enterica serovar Typhi Ty2
uagcgccuccccuaaucgagga

SEQ ID NO: 1789410 - RNA, 12 nt, Salmonella enterica enterica serovar Typhi Ty2
uagcgcgcugcu

SEQ ID NO: 1789411 - RNA, 12 nt, Salmonella enterica enterica serovar Typhi Ty2
uagcgccugcuc

SEQ ID NO: 1789412 - RNA, 23 nt, Salmonella enterica enterica serovar Typhi Ty2
uagcgcgacgccaaaccugccac

SEQ ID NO: 1789413 - RNA, 16 nt, Salmonella enterica enterica serovar Typhi Ty2
uagcggcugcggcgca

SEQ ID NO: 1789414 - RNA, 14 nt, Salmonella enterica enterica serovar Typhi Ty2
uagcggccagaugg

SEQ ID NO: 1789415 - RNA, 12 nt, Salmonella enterica enterica serovar Typhi Ty2
uagcggcaggga

SEQ ID NO: 1789416 - RNA, 21 nt, Salmonella enterica enterica serovar Typhi Ty2
uagcggcagccaugcuauuca

SEQ ID NO: 1789417 - RNA, 14 nt, Salmonella enterica enterica serovar Typhi Ty2
uagcgcuuuccugc

SEQ ID NO: 1789418 - RNA, 16 nt, Salmonella enterica enterica serovar Typhi Ty2
uagcgggcaaugccac

SEQ ID NO: 1789419 - RNA, 18 nt, Salmonella enterica enterica serovar Typhi Ty2
uagcgggcaaugccacca

SEQ ID NO: 1789420 - RNA, 20 nt, Salmonella enterica enterica serovar Typhi Ty2
uagcggcuaaucaccaccuc

SEQ ID NO: 1789421 - RNA, 15 nt, Salmonella enterica enterica serovar Typhi Ty2
uauaacuuucaauau

SEQ ID NO: 1789422 - RNA, 17 nt, Salmonella enterica enterica serovar Typhi Ty2
uauacaguaaaacgcca

SEQ ID NO: 1789423 - RNA, 19 nt, Salmonella enterica enterica serovar Typhi Ty2
uauaacucuuaauuauaaa

SEQ ID NO: 1789424 - RNA, 18 nt, Salmonella enterica enterica serovar Typhi Ty2
uauaacucuuaauuauaa

SEQ ID NO: 1789425 - RNA, 22 nt, Salmonella enterica enterica serovar Typhi Ty2
uauacauacauaccacgcagcg

SEQ ID NO: 1789426 - RNA, 18 nt, Salmonella enterica enterica serovar Typhi Ty2
uauacauauuguuuucua

SEQ ID NO: 1789427 - RNA, 13 nt, Salmonella enterica enterica serovar Typhi Ty2
uauacauucauuu

SEQ ID NO: 1789428 - RNA, 16 nt, Salmonella enterica enterica serovar Typhi Ty2
uauacauucauuuuau

SEQ ID NO: 1789429 - RNA, 21 nt, Salmonella enterica enterica serovar Typhi Ty2
uauaccaugcugccauuuuau

SEQ ID NO: 1789430 - RNA, 13 nt, Salmonella enterica enterica serovar Typhi Ty2
uauacuucaucag

SEQ ID NO: 1789431 - RNA, 15 nt, Salmonella enterica enterica serovar Typhi Ty2
uauacuuauugaucc

SEQ ID NO: 1789432 - RNA, 11 nt, Salmonella enterica enterica serovar Typhi Ty2
uauacugucuu

SEQ ID NO: 1789433 - RNA, 13 nt, Salmonella enterica enterica serovar Typhi Ty2
uauacugauaaac

SEQ ID NO: 1789434 - RNA, 15 nt, Salmonella enterica enterica serovar Typhi Ty2
uauagccaggcagau

SEQ ID NO: 1789435 - RNA, 15 nt, Salmonella enterica enterica serovar Typhi Ty2
uauagccauuuuuug

SEQ ID NO: 1789436 - RNA, 21 nt, Salmonella enterica enterica serovar Typhi Ty2
uauagcccagaaucaccccaa

SEQ ID NO: 1789437 - RNA, 18 nt, Salmonella enterica enterica serovar Typhi Ty2
uauagccuuuauugauga

SEQ ID NO: 1789438 - RNA, 12 nt, Salmonella enterica enterica serovar Typhi Ty2
uauagaugaugg

SEQ ID NO: 1789439 - RNA, 14 nt, Salmonella enterica enterica serovar Typhi Ty2
uauagcaaacccuc

SEQ ID NO: 1789440 - RNA, 19 nt, Salmonella enterica enterica serovar Typhi Ty2
uauagagcgccauauugcu

SEQ ID NO: 1789441 - RNA, 15 nt, Salmonella enterica enterica serovar Typhi Ty2
uauagaucagacgac

SEQ ID NO: 1789442 - RNA, 21 nt, Salmonella enterica enterica serovar Typhi Ty2
uauagacgccggucaugccau

SEQ ID NO: 1789443 - RNA, 23 nt, Salmonella enterica enterica serovar Typhi Ty2
uauauacuucaccauaaaucauu

SEQ ID NO: 1789444 - RNA, 15 nt, Salmonella enterica enterica serovar Typhi Ty2
uauauauuuucucaa

SEQ ID NO: 1789445 - RNA, 20 nt, Salmonella enterica enterica serovar Typhi Ty2
uauaguggaacgucaggccg

SEQ ID NO: 1789446 - RNA, 15 nt, Salmonella enterica enterica serovar Typhi Ty2
uauauucaugauagu

SEQ ID NO: 1789447 - RNA, 15 nt, Salmonella enterica enterica serovar Typhi Ty2
uauauucuucuuaga

SEQ ID NO: 1789448 - RNA, 16 nt, Salmonella enterica enterica serovar Typhi Ty2
uauauuccccuuaugg

SEQ ID NO: 1789449 - RNA, 22 nt, Salmonella enterica enterica serovar Typhi Ty2
uauauucuucuuagaauagaau

SEQ ID NO: 1789450 - RNA, 13 nt, Salmonella enterica enterica serovar Typhi Ty2
uaucaaaaagacu

SEQ ID NO: 1789451 - RNA, 13 nt, Salmonella enterica enterica serovar Typhi Ty2
uauauuuuucccu

SEQ ID NO: 1789452 - RNA, 18 nt, Salmonella enterica enterica serovar Typhi Ty2
uaucaaaucuucauuuca

SEQ ID NO: 1789453 - RNA, 20 nt, Salmonella enterica enterica serovar Typhi Ty2
uaucaauaaugcgcugcaca

SEQ ID NO: 1789454 - RNA, 22 nt, Salmonella enterica enterica serovar Typhi Ty2
uaucaaacugaaaaucaaauaa

SEQ ID NO: 1789455 - RNA, 20 nt, Salmonella enterica enterica serovar Typhi Ty2
uaucaaaccagcuuuucauu

SEQ ID NO: 1789456 - RNA, 17 nt, Salmonella enterica enterica serovar Typhi Ty2
uaucaauaguuaauuaa

SEQ ID NO: 1789457 - RNA, 20 nt, Salmonella enterica enterica serovar Typhi Ty2
uaucaugugaucuauauauu

SEQ ID NO: 1789458 - RNA, 17 nt, Salmonella enterica enterica serovar Typhi Ty2
uaucaggccuaccaguc

SEQ ID NO: 1789459 - RNA, 21 nt, Salmonella enterica enterica serovar Typhi Ty2
uaucacugguuauaugaauaa

SEQ ID NO: 1789460 - RNA, 18 nt, Salmonella enterica enterica serovar Typhi Ty2
uaucaggccgacaaauga

SEQ ID NO: 1789461 - RNA, 14 nt, Salmonella enterica enterica serovar Typhi Ty2
uaucacugguuaua

SEQ ID NO: 1789462 - RNA, 23 nt, Salmonella enterica enterica serovar Typhi Ty2
uaucaggguuauuuccgcuggcc

SEQ ID NO: 1789463 - RNA, 23 nt, Salmonella enterica enterica serovar Typhi Ty2
uaucaggcugagcgacgguuuua

SEQ ID NO: 1789464 - RNA, 17 nt, Salmonella enterica enterica serovar Typhi Ty2
uaucaggccuacaaggc

SEQ ID NO: 1789465 - RNA, 14 nt, Salmonella enterica enterica serovar Typhi Ty2
uaucaggccuacac

SEQ ID NO: 1789466 - RNA, 15 nt, Salmonella enterica enterica serovar Typhi Ty2
uauccauacaagcgu

SEQ ID NO: 1789467 - RNA, 14 nt, Salmonella enterica enterica serovar Typhi Ty2
uauccaguugcgcc

SEQ ID NO: 1789468 - RNA, 13 nt, Salmonella enterica enterica serovar Typhi Ty2
uauccaguuucug

SEQ ID NO: 1789469 - RNA, 15 nt, Salmonella enterica enterica serovar Typhi Ty2
uauccaccgccagac

SEQ ID NO: 1789470 - RNA, 23 nt, Salmonella enterica enterica serovar Typhi Ty2
uaguuuccgccgcgguauucaua

SEQ ID NO: 1789471 - RNA, 14 nt, Salmonella enterica enterica serovar Typhi Ty2
uaguuucaccuucu

SEQ ID NO: 1789472 - RNA, 18 nt, Salmonella enterica enterica serovar Typhi Ty2
uauaaaaaacauauaauu

SEQ ID NO: 1789473 - RNA, 22 nt, Salmonella enterica enterica serovar Typhi Ty2
uauaaaaaccgacgaaagauaa

SEQ ID NO: 1789474 - RNA, 20 nt, Salmonella enterica enterica serovar Typhi Ty2
uauaaaaaaugguuuuauuu

SEQ ID NO: 1789475 - RNA, 19 nt, Salmonella enterica enterica serovar Typhi Ty2
uauaacgaugauuauuguu

SEQ ID NO: 1789476 - RNA, 12 nt, Salmonella enterica enterica serovar Typhi Ty2
uauaaaaaccga

SEQ ID NO: 1789477 - RNA, 15 nt, Salmonella enterica enterica serovar Typhi Ty2
uagugcgauaugugg

SEQ ID NO: 1789478 - RNA, 22 nt, Salmonella enterica enterica serovar Typhi Ty2
uagugcaggaaggcgugcagcg

SEQ ID NO: 1789479 - RNA, 21 nt, Salmonella enterica enterica serovar Typhi Ty2
uagucccuccgcuuccacucu

SEQ ID NO: 1789480 - RNA, 11 nt, Salmonella enterica enterica serovar Typhi Ty2
uaguccagcag

SEQ ID NO: 1789481 - RNA, 16 nt, Salmonella enterica enterica serovar Typhi Ty2
uagucauugacagcaa

SEQ ID NO: 1789482 - RNA, 13 nt, Salmonella enterica enterica serovar Typhi Ty2
uagucaaauugaa

SEQ ID NO: 1789483 - RNA, 11 nt, Salmonella enterica enterica serovar Typhi Ty2
uaguuaaaaaa

SEQ ID NO: 1789484 - RNA, 20 nt, Salmonella enterica enterica serovar Typhi Ty2
uaguucaaguuuagaaaaaa

SEQ ID NO: 1789485 - RNA, 18 nt, Salmonella enterica enterica serovar Typhi Ty2
uaguucaaguuuagaaaa

SEQ ID NO: 1789486 - RNA, 23 nt, Salmonella enterica enterica serovar Typhi Ty2
uaguucagcgcagagugaccagc

SEQ ID NO: 1789487 - RNA, 18 nt, Salmonella enterica enterica serovar Typhi Ty2
uaguuaaaggugguguua

SEQ ID NO: 1789488 - RNA, 21 nt, Salmonella enterica enterica serovar Typhi Ty2
uagguaagauauuuuguuuua

SEQ ID NO: 1789489 - RNA, 12 nt, Salmonella enterica enterica serovar Typhi Ty2
uaggucagcgau

SEQ ID NO: 1789490 - RNA, 22 nt, Salmonella enterica enterica serovar Typhi Ty2
uagguacggggcaucuauuuaa

SEQ ID NO: 1789491 - RNA, 15 nt, Salmonella enterica enterica serovar Typhi Ty2
uaguacugaccagac

SEQ ID NO: 1789492 - RNA, 22 nt, Salmonella enterica enterica serovar Typhi Ty2
uaguaucgcucuauauccugcc

SEQ ID NO: 1789493 - RNA, 20 nt, Salmonella enterica enterica serovar Typhi Ty2
uaguauggagcaggaaaaga

SEQ ID NO: 1789494 - RNA, 22 nt, Salmonella enterica enterica serovar Typhi Ty2
uaguauccccggcaaccuuaaa

SEQ ID NO: 1789495 - RNA, 13 nt, Salmonella enterica enterica serovar Typhi Ty2
uaguagcuaauga

SEQ ID NO: 1789496 - RNA, 16 nt, Salmonella enterica enterica serovar Typhi Ty2
uagggccgggcagugc

SEQ ID NO: 1789497 - RNA, 18 nt, Salmonella enterica enterica serovar Typhi Ty2
uaggcuauaaaaaucauc

SEQ ID NO: 1789498 - RNA, 19 nt, Salmonella enterica enterica serovar Typhi Ty2
uaggcguugaacauuucau

SEQ ID NO: 1789499 - RNA, 20 nt, Salmonella enterica enterica serovar Typhi Ty2
uaggccagccgacgcucuuc

SEQ ID NO: 1789500 - RNA, 21 nt, Salmonella enterica enterica serovar Typhi Ty2
uaggccagacgaaguuuugcg

SEQ ID NO: 1789501 - RNA, 15 nt, Salmonella enterica enterica serovar Typhi Ty2
uaggcacuuuccaga

SEQ ID NO: 1789502 - RNA, 15 nt, Salmonella enterica enterica serovar Typhi Ty2
uaggcaggaaaucca

SEQ ID NO: 1789503 - RNA, 20 nt, Salmonella enterica enterica serovar Typhi Ty2
uaggccggauaagcggcagc

SEQ ID NO: 1789504 - RNA, 18 nt, Salmonella enterica enterica serovar Typhi Ty2
uaggccggauaagcaacg

SEQ ID NO: 1789505 - RNA, 13 nt, Salmonella enterica enterica serovar Typhi Ty2
uaggccugauaag

SEQ ID NO: 1789506 - RNA, 18 nt, Salmonella enterica enterica serovar Typhi Ty2
uaggccugauaagcguag

SEQ ID NO: 1789507 - RNA, 23 nt, Salmonella enterica enterica serovar Typhi Ty2
uaggccggcgaagauccgcucac

SEQ ID NO: 1789508 - RNA, 21 nt, Salmonella enterica enterica serovar Typhi Ty2
uaaaucugccgucaucgacuu

SEQ ID NO: 1789509 - RNA, 22 nt, Salmonella enterica enterica serovar Typhi Ty2
uaaaucugccgucaucgacuuc

SEQ ID NO: 1789510 - RNA, 20 nt, Salmonella enterica enterica serovar Typhi Ty2
uaaaucaauagauuauucgu

SEQ ID NO: 1789511 - RNA, 13 nt, Salmonella enterica enterica serovar Typhi Ty2
uaaaugucaggau

SEQ ID NO: 1789512 - RNA, 14 nt, Salmonella enterica enterica serovar Typhi Ty2
uaaaugaauuauuu

SEQ ID NO: 1789513 - RNA, 14 nt, Salmonella enterica enterica serovar Typhi Ty2
uaaaugaacuuaca

SEQ ID NO: 1789514 - RNA, 20 nt, Salmonella enterica enterica serovar Typhi Ty2
uaaaugaauuauuuuuucau

SEQ ID NO: 1789515 - RNA, 17 nt, Salmonella enterica enterica serovar Typhi Ty2
uaaaugccacuauagau

SEQ ID NO: 1789516 - RNA, 15 nt, Salmonella enterica enterica serovar Typhi Ty2
uaacaaaucauuucc

SEQ ID NO: 1789517 - RNA, 21 nt, Salmonella enterica enterica serovar Typhi Ty2
uaacaaccgggaucuuuuuca

SEQ ID NO: 1789518 - RNA, 18 nt, Salmonella enterica enterica serovar Typhi Ty2
uaacaaccagaauaaugg

SEQ ID NO: 1789519 - RNA, 17 nt, Salmonella enterica enterica serovar Typhi Ty2
uaacaaccagaauaaug

SEQ ID NO: 1789520 - RNA, 16 nt, Salmonella enterica enterica serovar Typhi Ty2
uaacaacauugaggcu

SEQ ID NO: 1789521 - RNA, 19 nt, Salmonella enterica enterica serovar Typhi Ty2
uaaauuuguuuaucauccu

SEQ ID NO: 1789522 - RNA, 17 nt, Salmonella enterica enterica serovar Typhi Ty2
uaaauuuauuuuuugcu

SEQ ID NO: 1789523 - RNA, 13 nt, Salmonella enterica enterica serovar Typhi Ty2
uaaauuuacucag

SEQ ID NO: 1789524 - RNA, 13 nt, Salmonella enterica enterica serovar Typhi Ty2
uaacagccagcgg

SEQ ID NO: 1789525 - RNA, 20 nt, Salmonella enterica enterica serovar Typhi Ty2
uaacaauccccgucacagcg

SEQ ID NO: 1789526 - RNA, 21 nt, Salmonella enterica enterica serovar Typhi Ty2
uaacaauauuaaauaaauagu

SEQ ID NO: 1789527 - RNA, 20 nt, Salmonella enterica enterica serovar Typhi Ty2
uaacaauccuaccguaacgu

SEQ ID NO: 1789528 - RNA, 19 nt, Salmonella enterica enterica serovar Typhi Ty2
uaacagcgcgaccaggaaa

SEQ ID NO: 1789529 - RNA, 20 nt, Salmonella enterica enterica serovar Typhi Ty2
uaacagcgcggucgaacaaa

SEQ ID NO: 1789530 - RNA, 16 nt, Salmonella enterica enterica serovar Typhi Ty2
uaacagcgcgaccagc

SEQ ID NO: 1789531 - RNA, 19 nt, Salmonella enterica enterica serovar Typhi Ty2
uaacagcgcuaucaggaag

SEQ ID NO: 1789532 - RNA, 21 nt, Salmonella enterica enterica serovar Typhi Ty2
uaacagcgcugguagcaccga

SEQ ID NO: 1789533 - RNA, 18 nt, Salmonella enterica enterica serovar Typhi Ty2
uaacagcuugaucaucag

SEQ ID NO: 1789534 - RNA, 17 nt, Salmonella enterica enterica serovar Typhi Ty2
uaacagcuggcuugcca

SEQ ID NO: 1789535 - RNA, 17 nt, Salmonella enterica enterica serovar Typhi Ty2
uaacauauagcagcagu

SEQ ID NO: 1789536 - RNA, 18 nt, Salmonella enterica enterica serovar Typhi Ty2
uaacauaucgacauaagu

SEQ ID NO: 1789537 - RNA, 18 nt, Salmonella enterica enterica serovar Typhi Ty2
uaacaucaaguacagcuu

SEQ ID NO: 1789538 - RNA, 23 nt, Salmonella enterica enterica serovar Typhi Ty2
uaacauaaauaguauuaguugau

SEQ ID NO: 1789539 - RNA, 14 nt, Salmonella enterica enterica serovar Typhi Ty2
uaacauacaaaaag

SEQ ID NO: 1789540 - RNA, 17 nt, Salmonella enterica enterica serovar Typhi Ty2
uaaccgcagcgcggccu

SEQ ID NO: 1789541 - RNA, 19 nt, Salmonella enterica enterica serovar Typhi Ty2
uaaccgauaacgcggcccg

SEQ ID NO: 1789542 - RNA, 15 nt, Salmonella enterica enterica serovar Typhi Ty2
uaaccgcccgcggcg

SEQ ID NO: 1789543 - RNA, 17 nt, Salmonella enterica enterica serovar Typhi Ty2
uaaccgcgaucgaugug

SEQ ID NO: 1789544 - RNA, 16 nt, Salmonella enterica enterica serovar Typhi Ty2
uaacccacaagaaaug

SEQ ID NO: 1789545 - RNA, 19 nt, Salmonella enterica enterica serovar Typhi Ty2
uaaccuguuccucacugag

SEQ ID NO: 1789546 - RNA, 13 nt, Salmonella enterica enterica serovar Typhi Ty2
uaaccucuuuuuc

SEQ ID NO: 1789547 - RNA, 18 nt, Salmonella enterica enterica serovar Typhi Ty2
uaaccucuauaguaaauu

SEQ ID NO: 1789548 - RNA, 15 nt, Salmonella enterica enterica serovar Typhi Ty2
uaaccuuucaccuua

SEQ ID NO: 1789549 - RNA, 20 nt, Salmonella enterica enterica serovar Typhi Ty2
uaacgaaccaucauuaauau

SEQ ID NO: 1789550 - RNA, 19 nt, Salmonella enterica enterica serovar Typhi Ty2
uaaacuaaguaaggaggaa

SEQ ID NO: 1789551 - RNA, 17 nt, Salmonella enterica enterica serovar Typhi Ty2
uaaacguuccugccagc

SEQ ID NO: 1789552 - RNA, 14 nt, Salmonella enterica enterica serovar Typhi Ty2
uaaacgucaugcug

SEQ ID NO: 1789553 - RNA, 21 nt, Salmonella enterica enterica serovar Typhi Ty2
uaaagaacggccucccaaacu

SEQ ID NO: 1789554 - RNA, 19 nt, Salmonella enterica enterica serovar Typhi Ty2
uaaacccccuggccggaaa

SEQ ID NO: 1789555 - RNA, 16 nt, Salmonella enterica enterica serovar Typhi Ty2
uaaaccauuucuccug

SEQ ID NO: 1789556 - RNA, 19 nt, Salmonella enterica enterica serovar Typhi Ty2
uaaacccgauucugccagu

SEQ ID NO: 1789557 - RNA, 12 nt, Salmonella enterica enterica serovar Typhi Ty2
uaaacgggcugc

SEQ ID NO: 1789558 - RNA, 13 nt, Salmonella enterica enterica serovar Typhi Ty2
uaaaauugaauua

SEQ ID NO: 1789559 - RNA, 16 nt, Salmonella enterica enterica serovar Typhi Ty2
uaaaauuauauucuaa

SEQ ID NO: 1789560 - RNA, 13 nt, Salmonella enterica enterica serovar Typhi Ty2
uaaaauuauaaac

SEQ ID NO: 1789561 - RNA, 21 nt, Salmonella enterica enterica serovar Typhi Ty2
uaaaauuauuuuuacuuaaaa

SEQ ID NO: 1789562 - RNA, 22 nt, Salmonella enterica enterica serovar Typhi Ty2
uaaaauuauuuuuacuuaaaau

SEQ ID NO: 1789563 - RNA, 18 nt, Salmonella enterica enterica serovar Typhi Ty2
uaaaauuccaauauuuau

SEQ ID NO: 1789564 - RNA, 14 nt, Salmonella enterica enterica serovar Typhi Ty2
uaaacaaugcaggu

SEQ ID NO: 1789565 - RNA, 15 nt, Salmonella enterica enterica serovar Typhi Ty2
uaaacaaaacaacaa

SEQ ID NO: 1789566 - RNA, 20 nt, Salmonella enterica enterica serovar Typhi Ty2
uaaacaauuugcccagcgcu

SEQ ID NO: 1789567 - RNA, 20 nt, Salmonella enterica enterica serovar Typhi Ty2
uaaacacgauggcaaauaau

SEQ ID NO: 1789568 - RNA, 15 nt, Salmonella enterica enterica serovar Typhi Ty2
uaaauaccuuauuca

SEQ ID NO: 1789569 - RNA, 17 nt, Salmonella enterica enterica serovar Typhi Ty2
uaaauacgccgccagca

SEQ ID NO: 1789570 - RNA, 13 nt, Salmonella enterica enterica serovar Typhi Ty2
uaaauagaaaaua

SEQ ID NO: 1789571 - RNA, 14 nt, Salmonella enterica enterica serovar Typhi Ty2
uaaauagaaaauaa

SEQ ID NO: 1789572 - RNA, 15 nt, Salmonella enterica enterica serovar Typhi Ty2
uaaauagaaaauaau

SEQ ID NO: 1789573 - RNA, 13 nt, Salmonella enterica enterica serovar Typhi Ty2
uaaauagcaggca

SEQ ID NO: 1789574 - RNA, 16 nt, Salmonella enterica enterica serovar Typhi Ty2
uaaauagagaaaucaa

SEQ ID NO: 1789575 - RNA, 16 nt, Salmonella enterica enterica serovar Typhi Ty2
uaaauauucaucaaaa

SEQ ID NO: 1789576 - RNA, 17 nt, Salmonella enterica enterica serovar Typhi Ty2
uaaauauucaucaaaau

SEQ ID NO: 1789577 - RNA, 12 nt, Salmonella enterica enterica serovar Typhi Ty2
uaaauauucauc

SEQ ID NO: 1789578 - RNA, 19 nt, Salmonella enterica enterica serovar Typhi Ty2
uaaauaggcgccgccgaca

SEQ ID NO: 1789579 - RNA, 14 nt, Salmonella enterica enterica serovar Typhi Ty2
uaaauaggcggcau

SEQ ID NO: 1789580 - RNA, 16 nt, Salmonella enterica enterica serovar Typhi Ty2
uaaauaggcgccgccg

SEQ ID NO: 1789581 - RNA, 19 nt, Salmonella enterica enterica serovar Typhi Ty2
uaaauacaauucaacucac

SEQ ID NO: 1789582 - RNA, 22 nt, Salmonella enterica enterica serovar Typhi Ty2
uaaauacccaggccaucagaau

SEQ ID NO: 1789583 - RNA, 18 nt, Salmonella enterica enterica serovar Typhi Ty2
uaaauaccgcaauaaaca

SEQ ID NO: 1789584 - RNA, 15 nt, Salmonella enterica enterica serovar Typhi Ty2
uaaauaccaggcacu

SEQ ID NO: 1789585 - RNA, 22 nt, Salmonella enterica enterica serovar Typhi Ty2
uaaauaaauaguaaauagaaaa

SEQ ID NO: 1789586 - RNA, 17 nt, Salmonella enterica enterica serovar Typhi Ty2
uaaagguuuucacgcua

SEQ ID NO: 1789587 - RNA, 18 nt, Salmonella enterica enterica serovar Typhi Ty2
uaaagcagaccaccccac

SEQ ID NO: 1789588 - RNA, 19 nt, Salmonella enterica enterica serovar Typhi Ty2
uaaagcagugcaguauugc

SEQ ID NO: 1789589 - RNA, 15 nt, Salmonella enterica enterica serovar Typhi Ty2
uaaagauuguuucgg

SEQ ID NO: 1789590 - RNA, 18 nt, Salmonella enterica enterica serovar Typhi Ty2
uaaagccuucaugcuucu

SEQ ID NO: 1789591 - RNA, 15 nt, Salmonella enterica enterica serovar Typhi Ty2
uaaagccuucaugcu

SEQ ID NO: 1789592 - RNA, 22 nt, Salmonella enterica enterica serovar Typhi Ty2
uaaagcgcgggccugccuguuu

SEQ ID NO: 1789593 - RNA, 15 nt, Salmonella enterica enterica serovar Typhi Ty2
uaaagcgcaaaauag

SEQ ID NO: 1789594 - RNA, 23 nt, Salmonella enterica enterica serovar Typhi Ty2
uaaaggacaggugcgcugugguc

SEQ ID NO: 1789595 - RNA, 23 nt, Salmonella enterica enterica serovar Typhi Ty2
uaaaauauccaugcuuucaauaa

SEQ ID NO: 1789596 - RNA, 23 nt, Salmonella enterica enterica serovar Typhi Ty2
uaaaaucacuaagaccagcauca

SEQ ID NO: 1789597 - RNA, 14 nt, Salmonella enterica enterica serovar Typhi Ty2
uaaaaucaacgcuc

SEQ ID NO: 1789598 - RNA, 12 nt, Salmonella enterica enterica serovar Typhi Ty2
uaaaauccugca

SEQ ID NO: 1789599 - RNA, 20 nt, Salmonella enterica enterica serovar Typhi Ty2
uaaaauccugguaacggcac

SEQ ID NO: 1789600 - RNA, 17 nt, Salmonella enterica enterica serovar Typhi Ty2
uaaaauccuuuuucaug

SEQ ID NO: 1789601 - RNA, 19 nt, Salmonella enterica enterica serovar Typhi Ty2
uaaaauccuuuuucaugca

SEQ ID NO: 1789602 - RNA, 20 nt, Salmonella enterica enterica serovar Typhi Ty2
uaaaaucggggucuuccagc

SEQ ID NO: 1789603 - RNA, 23 nt, Salmonella enterica enterica serovar Typhi Ty2
uaaaaucuaagagccugucccac

SEQ ID NO: 1789604 - RNA, 18 nt, Salmonella enterica enterica serovar Typhi Ty2
uaaaaugcccgucucauu

SEQ ID NO: 1789605 - RNA, 20 nt, Salmonella enterica enterica serovar Typhi Ty2
uaaaauaaacacuaaaucau

SEQ ID NO: 1789606 - RNA, 23 nt, Salmonella enterica enterica serovar Typhi Ty2
uaaaauaaacacuaaaucauaau

SEQ ID NO: 1789607 - RNA, 14 nt, Salmonella enterica enterica serovar Typhi Ty2
uaaaauaaacacua

SEQ ID NO: 1789608 - RNA, 13 nt, Salmonella enterica enterica serovar Typhi Ty2
uaaaauaaacacu

SEQ ID NO: 1789609 - RNA, 22 nt, Salmonella enterica enterica serovar Typhi Ty2
uaaaacgcauacugagcaucca

SEQ ID NO: 1789610 - RNA, 16 nt, Salmonella enterica enterica serovar Typhi Ty2
uaaaacgacucaucag

SEQ ID NO: 1789611 - RNA, 12 nt, Salmonella enterica enterica serovar Typhi Ty2
uaaaaccuggca

SEQ ID NO: 1789612 - RNA, 22 nt, Salmonella enterica enterica serovar Typhi Ty2
uaaaacguuauuggcaggaugu

SEQ ID NO: 1789613 - RNA, 17 nt, Salmonella enterica enterica serovar Typhi Ty2
uaaaacuggcuaucgcc

SEQ ID NO: 1789614 - RNA, 15 nt, Salmonella enterica enterica serovar Typhi Ty2
uaaaagaaaaccgua

SEQ ID NO: 1789615 - RNA, 21 nt, Salmonella enterica enterica serovar Typhi Ty2
uaaaacuucccgcgcagugca

SEQ ID NO: 1789616 - RNA, 22 nt, Salmonella enterica enterica serovar Typhi Ty2
uaaaagcccuuaucgccccagc

SEQ ID NO: 1789617 - RNA, 22 nt, Salmonella enterica enterica serovar Typhi Ty2
uaaaagagagcgccaaaaagaa

SEQ ID NO: 1789618 - RNA, 22 nt, Salmonella enterica enterica serovar Typhi Ty2
uaaaacaaaaaaacggccucaa

SEQ ID NO: 1789619 - RNA, 20 nt, Salmonella enterica enterica serovar Typhi Ty2
uaaaaauucaaaaaagcagu

SEQ ID NO: 1789620 - RNA, 18 nt, Salmonella enterica enterica serovar Typhi Ty2
uaaaaaugaggugaaaca

SEQ ID NO: 1789621 - RNA, 17 nt, Salmonella enterica enterica serovar Typhi Ty2
uaaaaauauuucagcag

SEQ ID NO: 1789622 - RNA, 18 nt, Salmonella enterica enterica serovar Typhi Ty2
guuuucgucccagcgcac

SEQ ID NO: 1789623 - RNA, 19 nt, Salmonella enterica enterica serovar Typhi Ty2
guuuucgucccagcgcacc

SEQ ID NO: 1789624 - RNA, 16 nt, Salmonella enterica enterica serovar Typhi Ty2
guuuucucauccagcu

SEQ ID NO: 1789625 - RNA, 15 nt, Salmonella enterica enterica serovar Typhi Ty2
guuuucaucgguggc

SEQ ID NO: 1789626 - RNA, 12 nt, Salmonella enterica enterica serovar Typhi Ty2
guuuuccagcuc

SEQ ID NO: 1789627 - RNA, 17 nt, Salmonella enterica enterica serovar Typhi Ty2
aaaucagugauggauuu

SEQ ID NO: 1789628 - RNA, 16 nt, Salmonella enterica enterica serovar Typhi Ty2
aaaucauccugcggca

SEQ ID NO: 1789629 - RNA, 15 nt, Salmonella enterica enterica serovar Typhi Ty2
aaaucaugccagaau

SEQ ID NO: 1789630 - RNA, 16 nt, Salmonella enterica enterica serovar Typhi Ty2
aaaucaucgccacgau

SEQ ID NO: 1789631 - RNA, 21 nt, Salmonella enterica enterica serovar Typhi Ty2
aaaucaucgcgcugauauuuu

SEQ ID NO: 1789632 - RNA, 17 nt, Salmonella enterica enterica serovar Typhi Ty2
guuuucauuagccgcca

SEQ ID NO: 1789633 - RNA, 11 nt, Salmonella enterica enterica serovar Typhi Ty2
guuuuaucaug

SEQ ID NO: 1789634 - RNA, 20 nt, Salmonella enterica enterica serovar Typhi Ty2
aaauccagcagaauaacauc

SEQ ID NO: 1789635 - RNA, 19 nt, Salmonella enterica enterica serovar Typhi Ty2
aaauccagggaaaccaugu

SEQ ID NO: 1789636 - RNA, 19 nt, Salmonella enterica enterica serovar Typhi Ty2
guuugccccauuguucuuu

SEQ ID NO: 1789637 - RNA, 21 nt, Salmonella enterica enterica serovar Typhi Ty2
guuuggcaaucaaauccagcu

SEQ ID NO: 1789638 - RNA, 22 nt, Salmonella enterica enterica serovar Typhi Ty2
guuuggcaaucaaauccagcuc

SEQ ID NO: 1789639 - RNA, 14 nt, Salmonella enterica enterica serovar Typhi Ty2
guuucuuucaucag

SEQ ID NO: 1789640 - RNA, 20 nt, Salmonella enterica enterica serovar Typhi Ty2
aaaucaggccaagcaacauu

SEQ ID NO: 1789641 - RNA, 14 nt, Salmonella enterica enterica serovar Typhi Ty2
aaaucaggaaaaag

SEQ ID NO: 1789642 - RNA, 19 nt, Salmonella enterica enterica serovar Typhi Ty2
guuuuaaucuuuuauaugu

SEQ ID NO: 1789643 - RNA, 13 nt, Salmonella enterica enterica serovar Typhi Ty2
guuuuaauuccug

SEQ ID NO: 1789644 - RNA, 14 nt, Salmonella enterica enterica serovar Typhi Ty2
guuuguaaaauaca

SEQ ID NO: 1789645 - RNA, 15 nt, Salmonella enterica enterica serovar Typhi Ty2
guuuguaggccggau

SEQ ID NO: 1789646 - RNA, 17 nt, Salmonella enterica enterica serovar Typhi Ty2
guuuggccugcugcggu

SEQ ID NO: 1789647 - RNA, 14 nt, Salmonella enterica enterica serovar Typhi Ty2
guuuguaaaaauag

SEQ ID NO: 1789648 - RNA, 13 nt, Salmonella enterica enterica serovar Typhi Ty2
guuuuugaaccau

SEQ ID NO: 1789649 - RNA, 18 nt, Salmonella enterica enterica serovar Typhi Ty2
guuuuugcgccauugccg

SEQ ID NO: 1789650 - RNA, 22 nt, Salmonella enterica enterica serovar Typhi Ty2
guuuuuggaaacuaugcaaaac

SEQ ID NO: 1789651 - RNA, 17 nt, Salmonella enterica enterica serovar Typhi Ty2
guuuuucgaaaauuucg

SEQ ID NO: 1789652 - RNA, 18 nt, Salmonella enterica enterica serovar Typhi Ty2
guuuuuacacugaagccu

SEQ ID NO: 1789653 - RNA, 19 nt, Salmonella enterica enterica serovar Typhi Ty2
guuuuuccuuucugcgcca

SEQ ID NO: 1789654 - RNA, 19 nt, Salmonella enterica enterica serovar Typhi Ty2
guuuuuccgugaaugccaa

SEQ ID NO: 1789655 - RNA, 18 nt, Salmonella enterica enterica serovar Typhi Ty2
guuuuuccuuucugcgcc

SEQ ID NO: 1789656 - RNA, 16 nt, Salmonella enterica enterica serovar Typhi Ty2
guuuuucgaaaauuuc

SEQ ID NO: 1789657 - RNA, 14 nt, Salmonella enterica enterica serovar Typhi Ty2
guuuuuucguucca

SEQ ID NO: 1789658 - RNA, 22 nt, Salmonella enterica enterica serovar Typhi Ty2
guuuuuuaaccguucuuccugg

SEQ ID NO: 1789659 - RNA, 15 nt, Salmonella enterica enterica serovar Typhi Ty2
guuuuuuaauauaag

SEQ ID NO: 1789660 - RNA, 21 nt, Salmonella enterica enterica serovar Typhi Ty2
guuuuuuaaugagaaauuuua

SEQ ID NO: 1789661 - RNA, 22 nt, Salmonella enterica enterica serovar Typhi Ty2
uaaaaaaggccgcuuaauaaua

SEQ ID NO: 1789662 - RNA, 11 nt, Salmonella enterica enterica serovar Typhi Ty2
uaaaaaaggca

SEQ ID NO: 1789663 - RNA, 21 nt, Salmonella enterica enterica serovar Typhi Ty2
uaaaaaaggccgcuuaauaau

SEQ ID NO: 1789664 - RNA, 13 nt, Salmonella enterica enterica serovar Typhi Ty2
uaaaaaagcugcg

SEQ ID NO: 1789665 - RNA, 18 nt, Salmonella enterica enterica serovar Typhi Ty2
uaaaaaacaccugucugu

SEQ ID NO: 1789666 - RNA, 21 nt, Salmonella enterica enterica serovar Typhi Ty2
uaaaaaaaccucuaccuacac

SEQ ID NO: 1789667 - RNA, 12 nt, Salmonella enterica enterica serovar Typhi Ty2
uaaaaaaauaaa

SEQ ID NO: 1789668 - RNA, 16 nt, Salmonella enterica enterica serovar Typhi Ty2
uaaaaaaauaaaaaag

SEQ ID NO: 1789669 - RNA, 20 nt, Salmonella enterica enterica serovar Typhi Ty2
uaaaaaccagaauuuccaga

SEQ ID NO: 1789670 - RNA, 15 nt, Salmonella enterica enterica serovar Typhi Ty2
uaaaaacccaccagc

SEQ ID NO: 1789671 - RNA, 18 nt, Salmonella enterica enterica serovar Typhi Ty2
uaaaaacccuuucauucg

SEQ ID NO: 1789672 - RNA, 12 nt, Salmonella enterica enterica serovar Typhi Ty2
uaaaaaaugaga

SEQ ID NO: 1789673 - RNA, 20 nt, Salmonella enterica enterica serovar Typhi Ty2
uaaaaacaauaaauaacgug

SEQ ID NO: 1789674 - RNA, 22 nt, Salmonella enterica enterica serovar Typhi Ty2
uaaaaagcacaucagcaaauga

SEQ ID NO: 1789675 - RNA, 21 nt, Salmonella enterica enterica serovar Typhi Ty2
uaaaaaggugagcgcaaugcu

SEQ ID NO: 1789676 - RNA, 11 nt, Salmonella enterica enterica serovar Typhi Ty2
uaaaaaggaca

SEQ ID NO: 1789677 - RNA, 17 nt, Salmonella enterica enterica serovar Typhi Ty2
uaaaaagcgucaguaaa

SEQ ID NO: 1789678 - RNA, 19 nt, Salmonella enterica enterica serovar Typhi Ty2
uaaaaagcgucaguaaaag

SEQ ID NO: 1789679 - RNA, 22 nt, Salmonella enterica enterica serovar Typhi Ty2
guugugcagaaucauuaauaca

SEQ ID NO: 1789680 - RNA, 15 nt, Salmonella enterica enterica serovar Typhi Ty2
guugucucaaaaaau

SEQ ID NO: 1789681 - RNA, 14 nt, Salmonella enterica enterica serovar Typhi Ty2
guugucuucaucua

SEQ ID NO: 1789682 - RNA, 22 nt, Salmonella enterica enterica serovar Typhi Ty2
guuguacggaugggguaucgcc

SEQ ID NO: 1789683 - RNA, 15 nt, Salmonella enterica enterica serovar Typhi Ty2
guuguagcacagccc

SEQ ID NO: 1789684 - RNA, 15 nt, Salmonella enterica enterica serovar Typhi Ty2
guuguaguuaucgcc

SEQ ID NO: 1789685 - RNA, 18 nt, Salmonella enterica enterica serovar Typhi Ty2
guuggggauaaccagaaa

SEQ ID NO: 1789686 - RNA, 23 nt, Salmonella enterica enterica serovar Typhi Ty2
guugggcuuccgucggcuggaag

SEQ ID NO: 1789687 - RNA, 19 nt, Salmonella enterica enterica serovar Typhi Ty2
guuggcauggucagcauaa

SEQ ID NO: 1789688 - RNA, 23 nt, Salmonella enterica enterica serovar Typhi Ty2
guugccgcccguuuuuuccagcg

SEQ ID NO: 1789689 - RNA, 17 nt, Salmonella enterica enterica serovar Typhi Ty2
guugccgaugacuccca

SEQ ID NO: 1789690 - RNA, 20 nt, Salmonella enterica enterica serovar Typhi Ty2
guuggaugaaccauaucaaa

SEQ ID NO: 1789691 - RNA, 19 nt, Salmonella enterica enterica serovar Typhi Ty2
guuggcaacgucuugccau

SEQ ID NO: 1789692 - RNA, 19 nt, Salmonella enterica enterica serovar Typhi Ty2
guugccaggguucaaccug

SEQ ID NO: 1789693 - RNA, 21 nt, Salmonella enterica enterica serovar Typhi Ty2
guugccaggguucaaccugau

SEQ ID NO: 1789694 - RNA, 20 nt, Salmonella enterica enterica serovar Typhi Ty2
guugcccauuuuccucccau

SEQ ID NO: 1789695 - RNA, 18 nt, Salmonella enterica enterica serovar Typhi Ty2
guuuauucaucuccucuu

SEQ ID NO: 1789696 - RNA, 20 nt, Salmonella enterica enterica serovar Typhi Ty2
guuuauugagauaauuuaug

SEQ ID NO: 1789697 - RNA, 19 nt, Salmonella enterica enterica serovar Typhi Ty2
guuuaauucuuugagcauc

SEQ ID NO: 1789698 - RNA, 18 nt, Salmonella enterica enterica serovar Typhi Ty2
guuuacccaggaagagua

SEQ ID NO: 1789699 - RNA, 21 nt, Salmonella enterica enterica serovar Typhi Ty2
guuuaccggugcagaccucug

SEQ ID NO: 1789700 - RNA, 16 nt, Salmonella enterica enterica serovar Typhi Ty2
guuuaccugcaaaaac

SEQ ID NO: 1789701 - RNA, 22 nt, Salmonella enterica enterica serovar Typhi Ty2
guuuagacagacagcguaaaua

SEQ ID NO: 1789702 - RNA, 21 nt, Salmonella enterica enterica serovar Typhi Ty2
guuguucuuuuuauggcgggg

SEQ ID NO: 1789703 - RNA, 12 nt, Salmonella enterica enterica serovar Typhi Ty2
guuguucugggu

SEQ ID NO: 1789704 - RNA, 16 nt, Salmonella enterica enterica serovar Typhi Ty2
guugugguuaaacaca

SEQ ID NO: 1789705 - RNA, 15 nt, Salmonella enterica enterica serovar Typhi Ty2
guuguuaauuugauu

SEQ ID NO: 1789706 - RNA, 20 nt, Salmonella enterica enterica serovar Typhi Ty2
guuuaaaucgcuaagcagaa

SEQ ID NO: 1789707 - RNA, 13 nt, Salmonella enterica enterica serovar Typhi Ty2
guuuaaagcgcuc

SEQ ID NO: 1789708 - RNA, 20 nt, Salmonella enterica enterica serovar Typhi Ty2
guuuaaacucccggcuaaac

SEQ ID NO: 1789709 - RNA, 17 nt, Salmonella enterica enterica serovar Typhi Ty2
guugacuuacaaaaaau

SEQ ID NO: 1789710 - RNA, 15 nt, Salmonella enterica enterica serovar Typhi Ty2
guugacugccaggua

SEQ ID NO: 1789711 - RNA, 14 nt, Salmonella enterica enterica serovar Typhi Ty2
guugagauuggccc

SEQ ID NO: 1789712 - RNA, 23 nt, Salmonella enterica enterica serovar Typhi Ty2
guugaccaguccgcacgccugca

SEQ ID NO: 1789713 - RNA, 12 nt, Salmonella enterica enterica serovar Typhi Ty2
guugaccacauc

SEQ ID NO: 1789714 - RNA, 19 nt, Salmonella enterica enterica serovar Typhi Ty2
guugaccugaucggccagc

SEQ ID NO: 1789715 - RNA, 14 nt, Salmonella enterica enterica serovar Typhi Ty2
guugaacauuucau

SEQ ID NO: 1789716 - RNA, 19 nt, Salmonella enterica enterica serovar Typhi Ty2
guugcaguuuuaccguaaa

SEQ ID NO: 1789717 - RNA, 13 nt, Salmonella enterica enterica serovar Typhi Ty2
guugauggagguu

SEQ ID NO: 1789718 - RNA, 17 nt, Salmonella enterica enterica serovar Typhi Ty2
guugaucguaaaaugaa

SEQ ID NO: 1789719 - RNA, 18 nt, Salmonella enterica enterica serovar Typhi Ty2
guugaucugguucacaga

SEQ ID NO: 1789720 - RNA, 16 nt, Salmonella enterica enterica serovar Typhi Ty2
guugaucggccagcaa

SEQ ID NO: 1789721 - RNA, 15 nt, Salmonella enterica enterica serovar Typhi Ty2
guucuugccgccauc

SEQ ID NO: 1789722 - RNA, 13 nt, Salmonella enterica enterica serovar Typhi Ty2
guucuuucaccau

SEQ ID NO: 1789723 - RNA, 20 nt, Salmonella enterica enterica serovar Typhi Ty2
guugaaaaaacgggcccgcg

SEQ ID NO: 1789724 - RNA, 22 nt, Salmonella enterica enterica serovar Typhi Ty2
guucguucaacguaaagcuggc

SEQ ID NO: 1789725 - RNA, 22 nt, Salmonella enterica enterica serovar Typhi Ty2
guucugcauaucgccuugcugc

SEQ ID NO: 1789726 - RNA, 19 nt, Salmonella enterica enterica serovar Typhi Ty2
guucugagcggauucgacu

SEQ ID NO: 1789727 - RNA, 15 nt, Salmonella enterica enterica serovar Typhi Ty2
guucuggcugcgcuu

SEQ ID NO: 1789728 - RNA, 22 nt, Salmonella enterica enterica serovar Typhi Ty2
guucugcugauaauacugccgc

SEQ ID NO: 1789729 - RNA, 20 nt, Salmonella enterica enterica serovar Typhi Ty2
guucugcgucgcgcauggca

SEQ ID NO: 1789730 - RNA, 17 nt, Salmonella enterica enterica serovar Typhi Ty2
guucuguaggcugugca

SEQ ID NO: 1789731 - RNA, 21 nt, Salmonella enterica enterica serovar Typhi Ty2
guucacuaacgcggcaucaag

SEQ ID NO: 1789732 - RNA, 16 nt, Salmonella enterica enterica serovar Typhi Ty2
guucacuccuaagaga

SEQ ID NO: 1789733 - RNA, 15 nt, Salmonella enterica enterica serovar Typhi Ty2
guucacagauugcug

SEQ ID NO: 1789734 - RNA, 19 nt, Salmonella enterica enterica serovar Typhi Ty2
guucagaaauguauucucc

SEQ ID NO: 1789735 - RNA, 23 nt, Salmonella enterica enterica serovar Typhi Ty2
guucaauagagcgcagcaaaacg

SEQ ID NO: 1789736 - RNA, 22 nt, Salmonella enterica enterica serovar Typhi Ty2
guucaauaugccaggcauuuuc

SEQ ID NO: 1789737 - RNA, 14 nt, Salmonella enterica enterica serovar Typhi Ty2
guucaagucucgcc

SEQ ID NO: 1789738 - RNA, 16 nt, Salmonella enterica enterica serovar Typhi Ty2
guucaaaucgaugcca

SEQ ID NO: 1789739 - RNA, 20 nt, Salmonella enterica enterica serovar Typhi Ty2
guucaaccugcgcugacggc

SEQ ID NO: 1789740 - RNA, 11 nt, Salmonella enterica enterica serovar Typhi Ty2
guucagguuuu

SEQ ID NO: 1789741 - RNA, 13 nt, Salmonella enterica enterica serovar Typhi Ty2
guucagguuuuuu

SEQ ID NO: 1789742 - RNA, 16 nt, Salmonella enterica enterica serovar Typhi Ty2
guucaguaugaucaug

SEQ ID NO: 1789743 - RNA, 20 nt, Salmonella enterica enterica serovar Typhi Ty2
guucaguuaaauaaacaaaa

SEQ ID NO: 1789744 - RNA, 12 nt, Salmonella enterica enterica serovar Typhi Ty2
guucaguuuuuc

SEQ ID NO: 1789745 - RNA, 16 nt, Salmonella enterica enterica serovar Typhi Ty2
guucauaagucaucca

SEQ ID NO: 1789746 - RNA, 16 nt, Salmonella enterica enterica serovar Typhi Ty2
guucauuaacaucugu

SEQ ID NO: 1789747 - RNA, 16 nt, Salmonella enterica enterica serovar Typhi Ty2
guucaugcuggucagc

SEQ ID NO: 1789748 - RNA, 14 nt, Salmonella enterica enterica serovar Typhi Ty2
guucauggcaaaag

SEQ ID NO: 1789749 - RNA, 20 nt, Salmonella enterica enterica serovar Typhi Ty2
guucauucccgccaauaacc

SEQ ID NO: 1789750 - RNA, 15 nt, Salmonella enterica enterica serovar Typhi Ty2
guuccagaaugguua

SEQ ID NO: 1789751 - RNA, 17 nt, Salmonella enterica enterica serovar Typhi Ty2
guuccagccgccaggca

SEQ ID NO: 1789752 - RNA, 12 nt, Salmonella enterica enterica serovar Typhi Ty2
guuccagcagcu

SEQ ID NO: 1789753 - RNA, 16 nt, Salmonella enterica enterica serovar Typhi Ty2
guuccaguaaggucca

SEQ ID NO: 1789754 - RNA, 13 nt, Salmonella enterica enterica serovar Typhi Ty2
guuccaggcgcgc

SEQ ID NO: 1789755 - RNA, 23 nt, Salmonella enterica enterica serovar Typhi Ty2
guucccagcgggaacaucacgga

SEQ ID NO: 1789756 - RNA, 20 nt, Salmonella enterica enterica serovar Typhi Ty2
guucccgagcggccaaaggg

SEQ ID NO: 1789757 - RNA, 14 nt, Salmonella enterica enterica serovar Typhi Ty2
guucccuacgccca

SEQ ID NO: 1789758 - RNA, 17 nt, Salmonella enterica enterica serovar Typhi Ty2
guucguacccgcaggcc

SEQ ID NO: 1789759 - RNA, 17 nt, Salmonella enterica enterica serovar Typhi Ty2
guucggauaaacgcugc

SEQ ID NO: 1789760 - RNA, 16 nt, Salmonella enterica enterica serovar Typhi Ty2
guucgauacuauaacg

SEQ ID NO: 1789761 - RNA, 16 nt, Salmonella enterica enterica serovar Typhi Ty2
guuccugagcagacau

SEQ ID NO: 1789762 - RNA, 14 nt, Salmonella enterica enterica serovar Typhi Ty2
guguuucagcagcc

SEQ ID NO: 1789763 - RNA, 12 nt, Salmonella enterica enterica serovar Typhi Ty2
guuaaauaccag

SEQ ID NO: 1789764 - RNA, 15 nt, Salmonella enterica enterica serovar Typhi Ty2
guguuugucggcucc

SEQ ID NO: 1789765 - RNA, 13 nt, Salmonella enterica enterica serovar Typhi Ty2
guguuugccagac

SEQ ID NO: 1789766 - RNA, 18 nt, Salmonella enterica enterica serovar Typhi Ty2
guguuuucgauuucauuc

SEQ ID NO: 1789767 - RNA, 20 nt, Salmonella enterica enterica serovar Typhi Ty2
guuaauauacauucauuuua

SEQ ID NO: 1789768 - RNA, 21 nt, Salmonella enterica enterica serovar Typhi Ty2
guuaauccagagcggauaaau

SEQ ID NO: 1789769 - RNA, 12 nt, Salmonella enterica enterica serovar Typhi Ty2
guuaauuuuccc

SEQ ID NO: 1789770 - RNA, 14 nt, Salmonella enterica enterica serovar Typhi Ty2
guuacagacgcugc

SEQ ID NO: 1789771 - RNA, 13 nt, Salmonella enterica enterica serovar Typhi Ty2
guuaccagcauca

SEQ ID NO: 1789772 - RNA, 20 nt, Salmonella enterica enterica serovar Typhi Ty2
guuaccaaugccaaaaaaac

SEQ ID NO: 1789773 - RNA, 21 nt, Salmonella enterica enterica serovar Typhi Ty2
guuacgcacgccagauaaauc

SEQ ID NO: 1789774 - RNA, 14 nt, Salmonella enterica enterica serovar Typhi Ty2
guuagauauuaaua

SEQ ID NO: 1789775 - RNA, 14 nt, Salmonella enterica enterica serovar Typhi Ty2
guuagcaacacaga

SEQ ID NO: 1789776 - RNA, 16 nt, Salmonella enterica enterica serovar Typhi Ty2
guuacgcgcugcaaau

SEQ ID NO: 1789777 - RNA, 16 nt, Salmonella enterica enterica serovar Typhi Ty2
guuacggaaaaaauac

SEQ ID NO: 1789778 - RNA, 14 nt, Salmonella enterica enterica serovar Typhi Ty2
guuacggaaaaaau

SEQ ID NO: 1789779 - RNA, 22 nt, Salmonella enterica enterica serovar Typhi Ty2
guuauaaccgaugcagccugga

SEQ ID NO: 1789780 - RNA, 18 nt, Salmonella enterica enterica serovar Typhi Ty2
guuauaaauccccgccgc

SEQ ID NO: 1789781 - RNA, 21 nt, Salmonella enterica enterica serovar Typhi Ty2
guuauaaauccccgccgccau

SEQ ID NO: 1789782 - RNA, 12 nt, Salmonella enterica enterica serovar Typhi Ty2
guuagccccuua

SEQ ID NO: 1789783 - RNA, 16 nt, Salmonella enterica enterica serovar Typhi Ty2
guuagcgucaguaaac

SEQ ID NO: 1789784 - RNA, 13 nt, Salmonella enterica enterica serovar Typhi Ty2
guuagcucuuuca

SEQ ID NO: 1789785 - RNA, 17 nt, Salmonella enterica enterica serovar Typhi Ty2
guuaguuucuauuaaau

SEQ ID NO: 1789786 - RNA, 23 nt, Salmonella enterica enterica serovar Typhi Ty2
guuauucgcccaaaugcacugca

SEQ ID NO: 1789787 - RNA, 14 nt, Salmonella enterica enterica serovar Typhi Ty2
guuauucgaugcgg

SEQ ID NO: 1789788 - RNA, 15 nt, Salmonella enterica enterica serovar Typhi Ty2
guuauucagcaggag

SEQ ID NO: 1789789 - RNA, 17 nt, Salmonella enterica enterica serovar Typhi Ty2
guuaucguagugccaca

SEQ ID NO: 1789790 - RNA, 18 nt, Salmonella enterica enterica serovar Typhi Ty2
guuaucgaggcgcuggcg

SEQ ID NO: 1789791 - RNA, 19 nt, Salmonella enterica enterica serovar Typhi Ty2
guuauccgccggagggcga

SEQ ID NO: 1789792 - RNA, 19 nt, Salmonella enterica enterica serovar Typhi Ty2
guuauccagcaaccaggua

SEQ ID NO: 1789793 - RNA, 14 nt, Salmonella enterica enterica serovar Typhi Ty2
guuauacagugcca

SEQ ID NO: 1789794 - RNA, 19 nt, Salmonella enterica enterica serovar Typhi Ty2
guggccgauauugccuuca

SEQ ID NO: 1789795 - RNA, 22 nt, Salmonella enterica enterica serovar Typhi Ty2
guggccgagaguccagcgccag

SEQ ID NO: 1789796 - RNA, 23 nt, Salmonella enterica enterica serovar Typhi Ty2
guggccgauauggccguuuucau

SEQ ID NO: 1789797 - RNA, 22 nt, Salmonella enterica enterica serovar Typhi Ty2
guggacaucgccauuccaagaa

SEQ ID NO: 1789798 - RNA, 14 nt, Salmonella enterica enterica serovar Typhi Ty2
guggcggcaaaaaa

SEQ ID NO: 1789799 - RNA, 23 nt, Salmonella enterica enterica serovar Typhi Ty2
guggcgcuuuccggcgcuuccug

SEQ ID NO: 1789800 - RNA, 21 nt, Salmonella enterica enterica serovar Typhi Ty2
guggcgcuguucuugcugcug

SEQ ID NO: 1789801 - RNA, 17 nt, Salmonella enterica enterica serovar Typhi Ty2
gugggcgugucgccggg

SEQ ID NO: 1789802 - RNA, 17 nt, Salmonella enterica enterica serovar Typhi Ty2
guggcuguguucauccc

SEQ ID NO: 1789803 - RNA, 18 nt, Salmonella enterica enterica serovar Typhi Ty2
guggcuuaccguaugcaa

SEQ ID NO: 1789804 - RNA, 19 nt, Salmonella enterica enterica serovar Typhi Ty2
guggucgucagccgugagc

SEQ ID NO: 1789805 - RNA, 14 nt, Salmonella enterica enterica serovar Typhi Ty2
guggucgcggcuca

SEQ ID NO: 1789806 - RNA, 22 nt, Salmonella enterica enterica serovar Typhi Ty2
guggucgacauauucaugguuc

SEQ ID NO: 1789807 - RNA, 14 nt, Salmonella enterica enterica serovar Typhi Ty2
guguaaaaauuuuu

SEQ ID NO: 1789808 - RNA, 20 nt, Salmonella enterica enterica serovar Typhi Ty2
gugguggauauccagcauaa

SEQ ID NO: 1789809 - RNA, 21 nt, Salmonella enterica enterica serovar Typhi Ty2
guguaauaaccguggcggcag

SEQ ID NO: 1789810 - RNA, 19 nt, Salmonella enterica enterica serovar Typhi Ty2
guguaauaaccguggcggc

SEQ ID NO: 1789811 - RNA, 12 nt, Salmonella enterica enterica serovar Typhi Ty2
guguaacagcaa

SEQ ID NO: 1789812 - RNA, 23 nt, Salmonella enterica enterica serovar Typhi Ty2
guguaaccaccugggugagcguc

SEQ ID NO: 1789813 - RNA, 16 nt, Salmonella enterica enterica serovar Typhi Ty2
guguaaaagccagcaa

SEQ ID NO: 1789814 - RNA, 15 nt, Salmonella enterica enterica serovar Typhi Ty2
guguaauguuuucug

SEQ ID NO: 1789815 - RNA, 14 nt, Salmonella enterica enterica serovar Typhi Ty2
guguccgccugcug

SEQ ID NO: 1789816 - RNA, 13 nt, Salmonella enterica enterica serovar Typhi Ty2
gugucccgcugug

SEQ ID NO: 1789817 - RNA, 20 nt, Salmonella enterica enterica serovar Typhi Ty2
guguauauauugcauuuuau

SEQ ID NO: 1789818 - RNA, 16 nt, Salmonella enterica enterica serovar Typhi Ty2
guguauauauugcauu

SEQ ID NO: 1789819 - RNA, 20 nt, Salmonella enterica enterica serovar Typhi Ty2
gugcuacgggcgcugucgcc

SEQ ID NO: 1789820 - RNA, 13 nt, Salmonella enterica enterica serovar Typhi Ty2
gugcuacugcugg

SEQ ID NO: 1789821 - RNA, 24 nt, Salmonella enterica enterica serovar Typhi Ty2
gugcgugacccacaguuucauauc

SEQ ID NO: 1789822 - RNA, 18 nt, Salmonella enterica enterica serovar Typhi Ty2
gugcucauuugcggcguc

SEQ ID NO: 1789823 - RNA, 18 nt, Salmonella enterica enterica serovar Typhi Ty2
gugcucgauauauuuucc

SEQ ID NO: 1789824 - RNA, 20 nt, Salmonella enterica enterica serovar Typhi Ty2
gugcucgaaauccucacggu

SEQ ID NO: 1789825 - RNA, 17 nt, Salmonella enterica enterica serovar Typhi Ty2
gugcugcgcaaauacgu

SEQ ID NO: 1789826 - RNA, 19 nt, Salmonella enterica enterica serovar Typhi Ty2
gugcugccacaucgccagc

SEQ ID NO: 1789827 - RNA, 22 nt, Salmonella enterica enterica serovar Typhi Ty2
guggaaugccccagguuauaga

SEQ ID NO: 1789828 - RNA, 23 nt, Salmonella enterica enterica serovar Typhi Ty2
guggacaaucaggcugcggauga

SEQ ID NO: 1789829 - RNA, 15 nt, Salmonella enterica enterica serovar Typhi Ty2
guggaaucagccagg

SEQ ID NO: 1789830 - RNA, 16 nt, Salmonella enterica enterica serovar Typhi Ty2
gugcuugagcugcggu

SEQ ID NO: 1789831 - RNA, 19 nt, Salmonella enterica enterica serovar Typhi Ty2
gugcuugagcugcgguggu

SEQ ID NO: 1789832 - RNA, 14 nt, Salmonella enterica enterica serovar Typhi Ty2
gugcuuccagcucc

SEQ ID NO: 1789833 - RNA, 15 nt, Salmonella enterica enterica serovar Typhi Ty2
gugcuuccagcucca

SEQ ID NO: 1789834 - RNA, 13 nt, Salmonella enterica enterica serovar Typhi Ty2
gugcgagaaaaag

SEQ ID NO: 1789835 - RNA, 18 nt, Salmonella enterica enterica serovar Typhi Ty2
gugcgcagccccagcgcc

SEQ ID NO: 1789836 - RNA, 17 nt, Salmonella enterica enterica serovar Typhi Ty2
gugcgccguccugcaag

SEQ ID NO: 1789837 - RNA, 13 nt, Salmonella enterica enterica serovar Typhi Ty2
gugcgccugcugc

SEQ ID NO: 1789838 - RNA, 13 nt, Salmonella enterica enterica serovar Typhi Ty2
gugcgccccaggu

SEQ ID NO: 1789839 - RNA, 13 nt, Salmonella enterica enterica serovar Typhi Ty2
gugcgcgcgggcg

SEQ ID NO: 1789840 - RNA, 15 nt, Salmonella enterica enterica serovar Typhi Ty2
gugcgcggcgaaaaa

SEQ ID NO: 1789841 - RNA, 15 nt, Salmonella enterica enterica serovar Typhi Ty2
gugcgguuuuccuga

SEQ ID NO: 1789842 - RNA, 13 nt, Salmonella enterica enterica serovar Typhi Ty2
gugcguaaaauau

SEQ ID NO: 1789843 - RNA, 15 nt, Salmonella enterica enterica serovar Typhi Ty2
gugcggggaacacua

SEQ ID NO: 1789844 - RNA, 18 nt, Salmonella enterica enterica serovar Typhi Ty2
gugcggcgcacugccuga

SEQ ID NO: 1789845 - RNA, 20 nt, Salmonella enterica enterica serovar Typhi Ty2
gugcggccuaaaucgcugcu

SEQ ID NO: 1789846 - RNA, 19 nt, Salmonella enterica enterica serovar Typhi Ty2
gugcggcugggcgaggcca

SEQ ID NO: 1789847 - RNA, 15 nt, Salmonella enterica enterica serovar Typhi Ty2
gugcgcuguggucgu

SEQ ID NO: 1789848 - RNA, 21 nt, Salmonella enterica enterica serovar Typhi Ty2
gucucacccguuuucuccuuc

SEQ ID NO: 1789849 - RNA, 14 nt, Salmonella enterica enterica serovar Typhi Ty2
gucucaaaaaauau

SEQ ID NO: 1789850 - RNA, 21 nt, Salmonella enterica enterica serovar Typhi Ty2
gugauagcaggcacuguggug

SEQ ID NO: 1789851 - RNA, 14 nt, Salmonella enterica enterica serovar Typhi Ty2
gugauagcgcgcca

SEQ ID NO: 1789852 - RNA, 12 nt, Salmonella enterica enterica serovar Typhi Ty2
gugauauagcaa

SEQ ID NO: 1789853 - RNA, 11 nt, Salmonella enterica enterica serovar Typhi Ty2
gucuauuuauu

SEQ ID NO: 1789854 - RNA, 14 nt, Salmonella enterica enterica serovar Typhi Ty2
gucuaugguacaca

SEQ ID NO: 1789855 - RNA, 13 nt, Salmonella enterica enterica serovar Typhi Ty2
gugauggugcagc

SEQ ID NO: 1789856 - RNA, 12 nt, Salmonella enterica enterica serovar Typhi Ty2
gugauuacaaaa

SEQ ID NO: 1789857 - RNA, 12 nt, Salmonella enterica enterica serovar Typhi Ty2
gugaugugcugg

SEQ ID NO: 1789858 - RNA, 13 nt, Salmonella enterica enterica serovar Typhi Ty2
gugaugugcuggc

SEQ ID NO: 1789859 - RNA, 15 nt, Salmonella enterica enterica serovar Typhi Ty2
gugauuacaaaaugu

SEQ ID NO: 1789860 - RNA, 19 nt, Salmonella enterica enterica serovar Typhi Ty2
gugaugcgggacugcugcu

SEQ ID NO: 1789861 - RNA, 20 nt, Salmonella enterica enterica serovar Typhi Ty2
gugaugccagccauagccca

SEQ ID NO: 1789862 - RNA, 18 nt, Salmonella enterica enterica serovar Typhi Ty2
gugaugagcucaaauaug

SEQ ID NO: 1789863 - RNA, 15 nt, Salmonella enterica enterica serovar Typhi Ty2
gugaugacuaaauca

SEQ ID NO: 1789864 - RNA, 16 nt, Salmonella enterica enterica serovar Typhi Ty2
gugaugacuaaaucag

SEQ ID NO: 1789865 - RNA, 13 nt, Salmonella enterica enterica serovar Typhi Ty2
gugcagugaacca

SEQ ID NO: 1789866 - RNA, 17 nt, Salmonella enterica enterica serovar Typhi Ty2
gugcagugacagaggaa

SEQ ID NO: 1789867 - RNA, 22 nt, Salmonella enterica enterica serovar Typhi Ty2
gugcauaaagauuggcaucugc

SEQ ID NO: 1789868 - RNA, 20 nt, Salmonella enterica enterica serovar Typhi Ty2
gugcauuauuuuagugaaaa

SEQ ID NO: 1789869 - RNA, 20 nt, Salmonella enterica enterica serovar Typhi Ty2
aaauauagccauuuaaugau

SEQ ID NO: 1789870 - RNA, 15 nt, Salmonella enterica enterica serovar Typhi Ty2
gugcauuccaggugu

SEQ ID NO: 1789871 - RNA, 22 nt, Salmonella enterica enterica serovar Typhi Ty2
gugcaugggauacgccagcaga

SEQ ID NO: 1789872 - RNA, 14 nt, Salmonella enterica enterica serovar Typhi Ty2
gugcaucuccucgc

SEQ ID NO: 1789873 - RNA, 22 nt, Salmonella enterica enterica serovar Typhi Ty2
gugcauguaaauaaggcugcgc

SEQ ID NO: 1789874 - RNA, 13 nt, Salmonella enterica enterica serovar Typhi Ty2
gugcaucuccucg

SEQ ID NO: 1789875 - RNA, 16 nt, Salmonella enterica enterica serovar Typhi Ty2
gugcagcaagcggcug

SEQ ID NO: 1789876 - RNA, 17 nt, Salmonella enterica enterica serovar Typhi Ty2
gugcaccguaucggcag

SEQ ID NO: 1789877 - RNA, 19 nt, Salmonella enterica enterica serovar Typhi Ty2
gugcccgcgaucgcuucca

SEQ ID NO: 1789878 - RNA, 12 nt, Salmonella enterica enterica serovar Typhi Ty2
gugcccaucggc

SEQ ID NO: 1789879 - RNA, 23 nt, Salmonella enterica enterica serovar Typhi Ty2
gugccgaagucaaaggccaguaa

SEQ ID NO: 1789880 - RNA, 15 nt, Salmonella enterica enterica serovar Typhi Ty2
gugccgacgccagcc

SEQ ID NO: 1789881 - RNA, 20 nt, Salmonella enterica enterica serovar Typhi Ty2
gugccgacgccagccauuaa

SEQ ID NO: 1789882 - RNA, 13 nt, Salmonella enterica enterica serovar Typhi Ty2
gugccaugaguaa

SEQ ID NO: 1789883 - RNA, 12 nt, Salmonella enterica enterica serovar Typhi Ty2
gugccaguaauc

SEQ ID NO: 1789884 - RNA, 20 nt, Salmonella enterica enterica serovar Typhi Ty2
gugccaguaacucaucgcca

SEQ ID NO: 1789885 - RNA, 17 nt, Salmonella enterica enterica serovar Typhi Ty2
gugccacuccgccagua

SEQ ID NO: 1789886 - RNA, 21 nt, Salmonella enterica enterica serovar Typhi Ty2
gugccaauggcgauaaaaaua

SEQ ID NO: 1789887 - RNA, 12 nt, Salmonella enterica enterica serovar Typhi Ty2
gugccaccagcc

SEQ ID NO: 1789888 - RNA, 12 nt, Salmonella enterica enterica serovar Typhi Ty2
gugccgcuggug

SEQ ID NO: 1789889 - RNA, 12 nt, Salmonella enterica enterica serovar Typhi Ty2
gugccgguggga

SEQ ID NO: 1789890 - RNA, 23 nt, Salmonella enterica enterica serovar Typhi Ty2
gugccgugagcgcguaggccaga

SEQ ID NO: 1789891 - RNA, 18 nt, Salmonella enterica enterica serovar Typhi Ty2
gugccugcuccgccaggg

SEQ ID NO: 1789892 - RNA, 17 nt, Salmonella enterica enterica serovar Typhi Ty2
gugccugccuguggcug

SEQ ID NO: 1789893 - RNA, 15 nt, Salmonella enterica enterica serovar Typhi Ty2
gugccugacagcaau

SEQ ID NO: 1789894 - RNA, 21 nt, Salmonella enterica enterica serovar Typhi Ty2
gugcgacaucgacaaaauagu

SEQ ID NO: 1789895 - RNA, 14 nt, Salmonella enterica enterica serovar Typhi Ty2
gugccuggauaaau

SEQ ID NO: 1789896 - RNA, 14 nt, Salmonella enterica enterica serovar Typhi Ty2
gugccuuccgcaau

SEQ ID NO: 1789897 - RNA, 16 nt, Salmonella enterica enterica serovar Typhi Ty2
guccacgcgagcugcc

SEQ ID NO: 1789898 - RNA, 22 nt, Salmonella enterica enterica serovar Typhi Ty2
guccagauugagacaaauaacu

SEQ ID NO: 1789899 - RNA, 13 nt, Salmonella enterica enterica serovar Typhi Ty2
guccacuuucugu

SEQ ID NO: 1789900 - RNA, 22 nt, Salmonella enterica enterica serovar Typhi Ty2
guccagaggaucuggacgccaa

SEQ ID NO: 1789901 - RNA, 14 nt, Salmonella enterica enterica serovar Typhi Ty2
gucauugacagcaa

SEQ ID NO: 1789902 - RNA, 18 nt, Salmonella enterica enterica serovar Typhi Ty2
gucaugcuggcgaugagu

SEQ ID NO: 1789903 - RNA, 17 nt, Salmonella enterica enterica serovar Typhi Ty2
gucauugcgcgcaugca

SEQ ID NO: 1789904 - RNA, 16 nt, Salmonella enterica enterica serovar Typhi Ty2
gucauagcaggagaua

SEQ ID NO: 1789905 - RNA, 19 nt, Salmonella enterica enterica serovar Typhi Ty2
gucauagucggcgccaaag

SEQ ID NO: 1789906 - RNA, 22 nt, Salmonella enterica enterica serovar Typhi Ty2
gucauaaauacacgaggccacg

SEQ ID NO: 1789907 - RNA, 18 nt, Salmonella enterica enterica serovar Typhi Ty2
gucaugauguuugucuuu

SEQ ID NO: 1789908 - RNA, 23 nt, Salmonella enterica enterica serovar Typhi Ty2
gucaugauguuugucuuuuccag

SEQ ID NO: 1789909 - RNA, 17 nt, Salmonella enterica enterica serovar Typhi Ty2
gucaugcuaaaacagau

SEQ ID NO: 1789910 - RNA, 13 nt, Salmonella enterica enterica serovar Typhi Ty2
gucauggcaaacg

SEQ ID NO: 1789911 - RNA, 16 nt, Salmonella enterica enterica serovar Typhi Ty2
guccauuuuuuaucug

SEQ ID NO: 1789912 - RNA, 19 nt, Salmonella enterica enterica serovar Typhi Ty2
guccauuuuuuaucugaca

SEQ ID NO: 1789913 - RNA, 18 nt, Salmonella enterica enterica serovar Typhi Ty2
guccauuuauugcaggua

SEQ ID NO: 1789914 - RNA, 16 nt, Salmonella enterica enterica serovar Typhi Ty2
guccaguucguucugc

SEQ ID NO: 1789915 - RNA, 20 nt, Salmonella enterica enterica serovar Typhi Ty2
guccagcagacucauggaca

SEQ ID NO: 1789916 - RNA, 15 nt, Salmonella enterica enterica serovar Typhi Ty2
guccagggcaugauu

SEQ ID NO: 1789917 - RNA, 17 nt, Salmonella enterica enterica serovar Typhi Ty2
guccccggcgacgugaa

SEQ ID NO: 1789918 - RNA, 20 nt, Salmonella enterica enterica serovar Typhi Ty2
gucccggcgucauacugcca

SEQ ID NO: 1789919 - RNA, 18 nt, Salmonella enterica enterica serovar Typhi Ty2
guccccauaucccgcgcc

SEQ ID NO: 1789920 - RNA, 14 nt, Salmonella enterica enterica serovar Typhi Ty2
guccgacagcaaga

SEQ ID NO: 1789921 - RNA, 14 nt, Salmonella enterica enterica serovar Typhi Ty2
guccgacauuagcg

SEQ ID NO: 1789922 - RNA, 21 nt, Salmonella enterica enterica serovar Typhi Ty2
gucccuuucccuuccagcgac

SEQ ID NO: 1789923 - RNA, 18 nt, Salmonella enterica enterica serovar Typhi Ty2
gucccuccgcuuccacuc

SEQ ID NO: 1789924 - RNA, 14 nt, Salmonella enterica enterica serovar Typhi Ty2
gucccugaagaaaa

SEQ ID NO: 1789925 - RNA, 18 nt, Salmonella enterica enterica serovar Typhi Ty2
gucagcgucuauagauga

SEQ ID NO: 1789926 - RNA, 21 nt, Salmonella enterica enterica serovar Typhi Ty2
gucagcgcuugccgcagcgca

SEQ ID NO: 1789927 - RNA, 16 nt, Salmonella enterica enterica serovar Typhi Ty2
gucagcgcggcuucca

SEQ ID NO: 1789928 - RNA, 22 nt, Salmonella enterica enterica serovar Typhi Ty2
gucagauccuuuuucugcgcca

SEQ ID NO: 1789929 - RNA, 13 nt, Salmonella enterica enterica serovar Typhi Ty2
gucagauccuuuu

SEQ ID NO: 1789930 - RNA, 15 nt, Salmonella enterica enterica serovar Typhi Ty2
gucagcaauuaacaa

SEQ ID NO: 1789931 - RNA, 17 nt, Salmonella enterica enterica serovar Typhi Ty2
gucagaugcguuuucug

SEQ ID NO: 1789932 - RNA, 19 nt, Salmonella enterica enterica serovar Typhi Ty2
gucagaugcguuuucugca

SEQ ID NO: 1789933 - RNA, 14 nt, Salmonella enterica enterica serovar Typhi Ty2
gucaggauuuucgc

SEQ ID NO: 1789934 - RNA, 12 nt, Salmonella enterica enterica serovar Typhi Ty2
gucaggcaacag

SEQ ID NO: 1789935 - RNA, 22 nt, Salmonella enterica enterica serovar Typhi Ty2
gucaggaugggcuucuucacua

SEQ ID NO: 1789936 - RNA, 13 nt, Salmonella enterica enterica serovar Typhi Ty2
gucaggaugcuga

SEQ ID NO: 1789937 - RNA, 13 nt, Salmonella enterica enterica serovar Typhi Ty2
gucagguuuuuug

SEQ ID NO: 1789938 - RNA, 18 nt, Salmonella enterica enterica serovar Typhi Ty2
gucaguaccagcgagaua

SEQ ID NO: 1789939 - RNA, 18 nt, Salmonella enterica enterica serovar Typhi Ty2
gucaguacgucgcauacu

SEQ ID NO: 1789940 - RNA, 22 nt, Salmonella enterica enterica serovar Typhi Ty2
gucaggaagcggacuaccugcc

SEQ ID NO: 1789941 - RNA, 12 nt, Salmonella enterica enterica serovar Typhi Ty2
gucaguuccaua

SEQ ID NO: 1789942 - RNA, 14 nt, Salmonella enterica enterica serovar Typhi Ty2
gucaguucgccacg

SEQ ID NO: 1789943 - RNA, 22 nt, Salmonella enterica enterica serovar Typhi Ty2
gucagucgcucuaucgccugga

SEQ ID NO: 1789944 - RNA, 14 nt, Salmonella enterica enterica serovar Typhi Ty2
gucaguccaccugu

SEQ ID NO: 1789945 - RNA, 15 nt, Salmonella enterica enterica serovar Typhi Ty2
gucaccguauugcca

SEQ ID NO: 1789946 - RNA, 20 nt, Salmonella enterica enterica serovar Typhi Ty2
gucacauggcgaaaaucacu

SEQ ID NO: 1789947 - RNA, 12 nt, Salmonella enterica enterica serovar Typhi Ty2
gucacauccaga

SEQ ID NO: 1789948 - RNA, 14 nt, Salmonella enterica enterica serovar Typhi Ty2
gucacauccagaca

SEQ ID NO: 1789949 - RNA, 16 nt, Salmonella enterica enterica serovar Typhi Ty2
gucacuucaaccuuua

SEQ ID NO: 1789950 - RNA, 19 nt, Salmonella enterica enterica serovar Typhi Ty2
gucacuuacuuucuugcca

SEQ ID NO: 1789951 - RNA, 18 nt, Salmonella enterica enterica serovar Typhi Ty2
gucaccucuuucgccgcu

SEQ ID NO: 1789952 - RNA, 19 nt, Salmonella enterica enterica serovar Typhi Ty2
gucacgauaaccaggucac

SEQ ID NO: 1789953 - RNA, 16 nt, Salmonella enterica enterica serovar Typhi Ty2
gucaauacaucacgca

SEQ ID NO: 1789954 - RNA, 23 nt, Salmonella enterica enterica serovar Typhi Ty2
gucaacgcacuguaacgcacugg

SEQ ID NO: 1789955 - RNA, 18 nt, Salmonella enterica enterica serovar Typhi Ty2
gucacaaagcccaccgcg

SEQ ID NO: 1789956 - RNA, 12 nt, Salmonella enterica enterica serovar Typhi Ty2
gucacaacagcc

SEQ ID NO: 1789957 - RNA, 17 nt, Salmonella enterica enterica serovar Typhi Ty2
gucacaauacuuccgcu

SEQ ID NO: 1789958 - RNA, 20 nt, Salmonella enterica enterica serovar Typhi Ty2
gucacagguucgaaucccgu

SEQ ID NO: 1789959 - RNA, 13 nt, Salmonella enterica enterica serovar Typhi Ty2
gucguccccugga

SEQ ID NO: 1789960 - RNA, 13 nt, Salmonella enterica enterica serovar Typhi Ty2
gucguccacucuu

SEQ ID NO: 1789961 - RNA, 20 nt, Salmonella enterica enterica serovar Typhi Ty2
gucuacccgguguaaaaaau

SEQ ID NO: 1789962 - RNA, 20 nt, Salmonella enterica enterica serovar Typhi Ty2
gucuaauugacggccaccau

SEQ ID NO: 1789963 - RNA, 12 nt, Salmonella enterica enterica serovar Typhi Ty2
gucggcgccauc

SEQ ID NO: 1789964 - RNA, 19 nt, Salmonella enterica enterica serovar Typhi Ty2
gucggcgccaucaugcagc

SEQ ID NO: 1789965 - RNA, 15 nt, Salmonella enterica enterica serovar Typhi Ty2
gucggguucgcgcgc

SEQ ID NO: 1789966 - RNA, 23 nt, Salmonella enterica enterica serovar Typhi Ty2
gucggguucgcgcgccgcuuccg

SEQ ID NO: 1789967 - RNA, 18 nt, Salmonella enterica enterica serovar Typhi Ty2
gucguauucuugcuaccg

SEQ ID NO: 1789968 - RNA, 17 nt, Salmonella enterica enterica serovar Typhi Ty2
gucgccccaaucgccag

SEQ ID NO: 1789969 - RNA, 12 nt, Salmonella enterica enterica serovar Typhi Ty2
gucgccaggcaa

SEQ ID NO: 1789970 - RNA, 16 nt, Salmonella enterica enterica serovar Typhi Ty2
gucgcgcgccgccugc

SEQ ID NO: 1789971 - RNA, 20 nt, Salmonella enterica enterica serovar Typhi Ty2
gucgcgcauggcagggcgau

SEQ ID NO: 1789972 - RNA, 18 nt, Salmonella enterica enterica serovar Typhi Ty2
gucgcgguugucggcgcg

SEQ ID NO: 1789973 - RNA, 17 nt, Salmonella enterica enterica serovar Typhi Ty2
gucggccaggugccgag

SEQ ID NO: 1789974 - RNA, 21 nt, Salmonella enterica enterica serovar Typhi Ty2
gucgcuaaaacccaccaccuc

SEQ ID NO: 1789975 - RNA, 16 nt, Salmonella enterica enterica serovar Typhi Ty2
gucgcuauggugcggg

SEQ ID NO: 1789976 - RNA, 14 nt, Salmonella enterica enterica serovar Typhi Ty2
gucggagccaauaa

SEQ ID NO: 1789977 - RNA, 14 nt, Salmonella enterica enterica serovar Typhi Ty2
guccgguguccauc

SEQ ID NO: 1789978 - RNA, 20 nt, Salmonella enterica enterica serovar Typhi Ty2
guccguuaccccuuuuucaa

SEQ ID NO: 1789979 - RNA, 21 nt, Salmonella enterica enterica serovar Typhi Ty2
guccgccuaccagcacaugau

SEQ ID NO: 1789980 - RNA, 19 nt, Salmonella enterica enterica serovar Typhi Ty2
guccucuuucccuuuuuaa

SEQ ID NO: 1789981 - RNA, 16 nt, Salmonella enterica enterica serovar Typhi Ty2
guccugucccugccag

SEQ ID NO: 1789982 - RNA, 17 nt, Salmonella enterica enterica serovar Typhi Ty2
guccuucacaaacuucu

SEQ ID NO: 1789983 - RNA, 14 nt, Salmonella enterica enterica serovar Typhi Ty2
gucgaacgguaaca

SEQ ID NO: 1789984 - RNA, 22 nt, Salmonella enterica enterica serovar Typhi Ty2
gucgaacugaauagucggcugc

SEQ ID NO: 1789985 - RNA, 13 nt, Salmonella enterica enterica serovar Typhi Ty2
gucgaacaugcgg

SEQ ID NO: 1789986 - RNA, 19 nt, Salmonella enterica enterica serovar Typhi Ty2
gucgagaaaccgcucgccg

SEQ ID NO: 1789987 - RNA, 23 nt, Salmonella enterica enterica serovar Typhi Ty2
gucgaagagcacuuugguaaaac

SEQ ID NO: 1789988 - RNA, 19 nt, Salmonella enterica enterica serovar Typhi Ty2
gucgaauuccgccugcugu

SEQ ID NO: 1789989 - RNA, 16 nt, Salmonella enterica enterica serovar Typhi Ty2
gucgccaagcugugga

SEQ ID NO: 1789990 - RNA, 18 nt, Salmonella enterica enterica serovar Typhi Ty2
gucgccaagcuguggaaa

SEQ ID NO: 1789991 - RNA, 15 nt, Salmonella enterica enterica serovar Typhi Ty2
gucgaugauuuucaa

SEQ ID NO: 1789992 - RNA, 11 nt, Salmonella enterica enterica serovar Typhi Ty2
gucaaaaauaa

SEQ ID NO: 1789993 - RNA, 20 nt, Salmonella enterica enterica serovar Typhi Ty2
gucaaaaccaaacagcgaca

SEQ ID NO: 1789994 - RNA, 14 nt, Salmonella enterica enterica serovar Typhi Ty2
gucaaaacuuauuu

SEQ ID NO: 1789995 - RNA, 16 nt, Salmonella enterica enterica serovar Typhi Ty2
gucaaccaugaucacu

SEQ ID NO: 1789996 - RNA, 13 nt, Salmonella enterica enterica serovar Typhi Ty2
gucaacaucaucc

SEQ ID NO: 1789997 - RNA, 18 nt, Salmonella enterica enterica serovar Typhi Ty2
gucaacaaugcuuucacc

SEQ ID NO: 1789998 - RNA, 17 nt, Salmonella enterica enterica serovar Typhi Ty2
gucaaauagagaaaaua

SEQ ID NO: 1789999 - RNA, 16 nt, Salmonella enterica enterica serovar Typhi Ty2
gucaaacuuuuauaaa

SEQ ID NO: 1790000 - RNA, 17 nt, Salmonella enterica enterica serovar Typhi Ty2
guauuucacuuuugccg

SEQ ID NO: 1790001 - RNA, 23 nt, Salmonella enterica enterica serovar Typhi Ty2
guauuucgacuuucuucggauua

SEQ ID NO: 1790002 - RNA, 17 nt, Salmonella enterica enterica serovar Typhi Ty2
guauuucugaaaaaccg

SEQ ID NO: 1790003 - RNA, 16 nt, Salmonella enterica enterica serovar Typhi Ty2
guauuuuauuuuucaa

SEQ ID NO: 1790004 - RNA, 11 nt, Salmonella enterica enterica serovar Typhi Ty2
guauuuuauuu

SEQ ID NO: 1790005 - RNA, 13 nt, Salmonella enterica enterica serovar Typhi Ty2
guauuggcaagaa

SEQ ID NO: 1790006 - RNA, 12 nt, Salmonella enterica enterica serovar Typhi Ty2
guauugauuuuu

SEQ ID NO: 1790007 - RNA, 22 nt, Salmonella enterica enterica serovar Typhi Ty2
guauugcuuucaauuuccgcac

SEQ ID NO: 1790008 - RNA, 22 nt, Salmonella enterica enterica serovar Typhi Ty2
guauucauaugcucuccuggca

SEQ ID NO: 1790009 - RNA, 15 nt, Salmonella enterica enterica serovar Typhi Ty2
guauucauaccuuua

SEQ ID NO: 1790010 - RNA, 20 nt, Salmonella enterica enterica serovar Typhi Ty2
guauuccagucgcuccacca

SEQ ID NO: 1790011 - RNA, 23 nt, Salmonella enterica enterica serovar Typhi Ty2
guauucaacgccaucuuccucac

SEQ ID NO: 1790012 - RNA, 14 nt, Salmonella enterica enterica serovar Typhi Ty2
guauucuuacccac

SEQ ID NO: 1790013 - RNA, 21 nt, Salmonella enterica enterica serovar Typhi Ty2
guauucugcgccagccagcuc

SEQ ID NO: 1790014 - RNA, 16 nt, Salmonella enterica enterica serovar Typhi Ty2
guauucggcuuaccca

SEQ ID NO: 1790015 - RNA, 21 nt, Salmonella enterica enterica serovar Typhi Ty2
guauuacaaguaauaaaauaa

SEQ ID NO: 1790016 - RNA, 22 nt, Salmonella enterica enterica serovar Typhi Ty2
guauuacaaguaauaaaauaau

SEQ ID NO: 1790017 - RNA, 22 nt, Salmonella enterica enterica serovar Typhi Ty2
guauuaccuugcuuaucagaua

SEQ ID NO: 1790018 - RNA, 22 nt, Salmonella enterica enterica serovar Typhi Ty2
guauguuaggguagaaaaaggu

SEQ ID NO: 1790019 - RNA, 19 nt, Salmonella enterica enterica serovar Typhi Ty2
guauguuaggguagaaaaa

SEQ ID NO: 1790020 - RNA, 18 nt, Salmonella enterica enterica serovar Typhi Ty2
guauuaacagcuucuucu

SEQ ID NO: 1790021 - RNA, 17 nt, Salmonella enterica enterica serovar Typhi Ty2
guaugcagccaggccau

SEQ ID NO: 1790022 - RNA, 15 nt, Salmonella enterica enterica serovar Typhi Ty2
guaugcagccaggcc

SEQ ID NO: 1790023 - RNA, 14 nt, Salmonella enterica enterica serovar Typhi Ty2
guaugcagccaggc

SEQ ID NO: 1790024 - RNA, 19 nt, Salmonella enterica enterica serovar Typhi Ty2
guaugccgcacaaaauuuu

SEQ ID NO: 1790025 - RNA, 21 nt, Salmonella enterica enterica serovar Typhi Ty2
guaucaucgcuuaacggccca

SEQ ID NO: 1790026 - RNA, 15 nt, Salmonella enterica enterica serovar Typhi Ty2
guaucaucagauccu

SEQ ID NO: 1790027 - RNA, 18 nt, Salmonella enterica enterica serovar Typhi Ty2
guaucaaacccuuccaga

SEQ ID NO: 1790028 - RNA, 14 nt, Salmonella enterica enterica serovar Typhi Ty2
guauccauugccag

SEQ ID NO: 1790029 - RNA, 16 nt, Salmonella enterica enterica serovar Typhi Ty2
guauccauaauuuucc

SEQ ID NO: 1790030 - RNA, 15 nt, Salmonella enterica enterica serovar Typhi Ty2
guauccagcaacagu

SEQ ID NO: 1790031 - RNA, 16 nt, Salmonella enterica enterica serovar Typhi Ty2
guauccagcaacagug

SEQ ID NO: 1790032 - RNA, 17 nt, Salmonella enterica enterica serovar Typhi Ty2
guaucccgccagcggcg

SEQ ID NO: 1790033 - RNA, 13 nt, Salmonella enterica enterica serovar Typhi Ty2
guaucccgccagc

SEQ ID NO: 1790034 - RNA, 16 nt, Salmonella enterica enterica serovar Typhi Ty2
guaucccgccagcggc

SEQ ID NO: 1790035 - RNA, 19 nt, Salmonella enterica enterica serovar Typhi Ty2
guauccccagucuuccugc

SEQ ID NO: 1790036 - RNA, 15 nt, Salmonella enterica enterica serovar Typhi Ty2
guauccguacuuucu

SEQ ID NO: 1790037 - RNA, 12 nt, Salmonella enterica enterica serovar Typhi Ty2
guauccgccaua

SEQ ID NO: 1790038 - RNA, 19 nt, Salmonella enterica enterica serovar Typhi Ty2
guauccuaaugccacggcu

SEQ ID NO: 1790039 - RNA, 22 nt, Salmonella enterica enterica serovar Typhi Ty2
guaucuucgccguauucuuacc

SEQ ID NO: 1790040 - RNA, 22 nt, Salmonella enterica enterica serovar Typhi Ty2
guaucuucgccguguucuuacc

SEQ ID NO: 1790041 - RNA, 19 nt, Salmonella enterica enterica serovar Typhi Ty2
guaucugucccagccuucc

SEQ ID NO: 1790042 - RNA, 13 nt, Salmonella enterica enterica serovar Typhi Ty2
guauagccaggca

SEQ ID NO: 1790043 - RNA, 14 nt, Salmonella enterica enterica serovar Typhi Ty2
guauagccaggcag

SEQ ID NO: 1790044 - RNA, 13 nt, Salmonella enterica enterica serovar Typhi Ty2
guauaggaaaaug

SEQ ID NO: 1790045 - RNA, 14 nt, Salmonella enterica enterica serovar Typhi Ty2
guauaggccaggcu

SEQ ID NO: 1790046 - RNA, 19 nt, Salmonella enterica enterica serovar Typhi Ty2
guauagaauacuuccugcu

SEQ ID NO: 1790047 - RNA, 15 nt, Salmonella enterica enterica serovar Typhi Ty2
guaguuauaaauuua

SEQ ID NO: 1790048 - RNA, 14 nt, Salmonella enterica enterica serovar Typhi Ty2
guaguuuauucauc

SEQ ID NO: 1790049 - RNA, 16 nt, Salmonella enterica enterica serovar Typhi Ty2
guauaaaauggcaaag

SEQ ID NO: 1790050 - RNA, 23 nt, Salmonella enterica enterica serovar Typhi Ty2
guauacauacauaccacgcagcg

SEQ ID NO: 1790051 - RNA, 20 nt, Salmonella enterica enterica serovar Typhi Ty2
guagcguuauccagucagag

SEQ ID NO: 1790052 - RNA, 20 nt, Salmonella enterica enterica serovar Typhi Ty2
guagcuauaaucacaggggu

SEQ ID NO: 1790053 - RNA, 23 nt, Salmonella enterica enterica serovar Typhi Ty2
guagcguuucacgcgcgccugcc

SEQ ID NO: 1790054 - RNA, 14 nt, Salmonella enterica enterica serovar Typhi Ty2
guagcuccagaccu

SEQ ID NO: 1790055 - RNA, 16 nt, Salmonella enterica enterica serovar Typhi Ty2
guagcucauaacucgc

SEQ ID NO: 1790056 - RNA, 14 nt, Salmonella enterica enterica serovar Typhi Ty2
guagcuucugucug

SEQ ID NO: 1790057 - RNA, 14 nt, Salmonella enterica enterica serovar Typhi Ty2
guagcggcagggau

SEQ ID NO: 1790058 - RNA, 20 nt, Salmonella enterica enterica serovar Typhi Ty2
guagcggaaccagccaugcc

SEQ ID NO: 1790059 - RNA, 16 nt, Salmonella enterica enterica serovar Typhi Ty2
guagcgggggccggcu

SEQ ID NO: 1790060 - RNA, 13 nt, Salmonella enterica enterica serovar Typhi Ty2
guagcgcgcgcua

SEQ ID NO: 1790061 - RNA, 22 nt, Salmonella enterica enterica serovar Typhi Ty2
guaggccggauaagcggcagcg

SEQ ID NO: 1790062 - RNA, 21 nt, Salmonella enterica enterica serovar Typhi Ty2
guaggcucuccgguugcugau

SEQ ID NO: 1790063 - RNA, 13 nt, Salmonella enterica enterica serovar Typhi Ty2
guaggcuucaacc

SEQ ID NO: 1790064 - RNA, 18 nt, Salmonella enterica enterica serovar Typhi Ty2
guagggcugccaucaggc

SEQ ID NO: 1790065 - RNA, 15 nt, Salmonella enterica enterica serovar Typhi Ty2
guaggguacagcgcg

SEQ ID NO: 1790066 - RNA, 16 nt, Salmonella enterica enterica serovar Typhi Ty2
guagguauccagcaga

SEQ ID NO: 1790067 - RNA, 13 nt, Salmonella enterica enterica serovar Typhi Ty2
guaguaaauagga

SEQ ID NO: 1790068 - RNA, 15 nt, Salmonella enterica enterica serovar Typhi Ty2
guaguaauauuaaaa

SEQ ID NO: 1790069 - RNA, 20 nt, Salmonella enterica enterica serovar Typhi Ty2
guaggucgcgaauagcuuuu

SEQ ID NO: 1790070 - RNA, 15 nt, Salmonella enterica enterica serovar Typhi Ty2
guaguuaaaaaaggu

SEQ ID NO: 1790071 - RNA, 23 nt, Salmonella enterica enterica serovar Typhi Ty2
guagccagccaaacaauaucccg

SEQ ID NO: 1790072 - RNA, 12 nt, Salmonella enterica enterica serovar Typhi Ty2
guagccacagcg

SEQ ID NO: 1790073 - RNA, 17 nt, Salmonella enterica enterica serovar Typhi Ty2
guagcaguggagaggcc

SEQ ID NO: 1790074 - RNA, 18 nt, Salmonella enterica enterica serovar Typhi Ty2
guagcagcgaugacagca

SEQ ID NO: 1790075 - RNA, 20 nt, Salmonella enterica enterica serovar Typhi Ty2
guagcagcgaugacagcagg

SEQ ID NO: 1790076 - RNA, 15 nt, Salmonella enterica enterica serovar Typhi Ty2
guagcagcgaugaca

SEQ ID NO: 1790077 - RNA, 13 nt, Salmonella enterica enterica serovar Typhi Ty2
guagcagcgauga

SEQ ID NO: 1790078 - RNA, 13 nt, Salmonella enterica enterica serovar Typhi Ty2
guagaucauuuac

SEQ ID NO: 1790079 - RNA, 12 nt, Salmonella enterica enterica serovar Typhi Ty2
guagaucaccag

SEQ ID NO: 1790080 - RNA, 16 nt, Salmonella enterica enterica serovar Typhi Ty2
guagaucacgccagcg

SEQ ID NO: 1790081 - RNA, 14 nt, Salmonella enterica enterica serovar Typhi Ty2
guagagaacagcau

SEQ ID NO: 1790082 - RNA, 19 nt, Salmonella enterica enterica serovar Typhi Ty2
guagagcgcggucagguuc

SEQ ID NO: 1790083 - RNA, 19 nt, Salmonella enterica enterica serovar Typhi Ty2
guagagcaucgcggcauca

SEQ ID NO: 1790084 - RNA, 16 nt, Salmonella enterica enterica serovar Typhi Ty2
guagacucaggcgcau

SEQ ID NO: 1790085 - RNA, 13 nt, Salmonella enterica enterica serovar Typhi Ty2
guagacucaggcg

SEQ ID NO: 1790086 - RNA, 21 nt, Salmonella enterica enterica serovar Typhi Ty2
guagacuggguaagcgcagcg

SEQ ID NO: 1790087 - RNA, 16 nt, Salmonella enterica enterica serovar Typhi Ty2
guagacaaacagcgcg

SEQ ID NO: 1790088 - RNA, 15 nt, Salmonella enterica enterica serovar Typhi Ty2
guacuuuuaaaucau

SEQ ID NO: 1790089 - RNA, 13 nt, Salmonella enterica enterica serovar Typhi Ty2
guacuuucaaaua

SEQ ID NO: 1790090 - RNA, 16 nt, Salmonella enterica enterica serovar Typhi Ty2
guacuuucaaauagcu

SEQ ID NO: 1790091 - RNA, 17 nt, Salmonella enterica enterica serovar Typhi Ty2
guacuuuugcuuccagu

SEQ ID NO: 1790092 - RNA, 15 nt, Salmonella enterica enterica serovar Typhi Ty2
guacgucgcauacuu

SEQ ID NO: 1790093 - RNA, 22 nt, Salmonella enterica enterica serovar Typhi Ty2
guacucggcuacgaaccgagcg

SEQ ID NO: 1790094 - RNA, 14 nt, Salmonella enterica enterica serovar Typhi Ty2
guacugcuggcgcg

SEQ ID NO: 1790095 - RNA, 15 nt, Salmonella enterica enterica serovar Typhi Ty2
guaaaaugcuggugc

SEQ ID NO: 1790096 - RNA, 17 nt, Salmonella enterica enterica serovar Typhi Ty2
guaaaauccggcaggca

SEQ ID NO: 1790097 - RNA, 21 nt, Salmonella enterica enterica serovar Typhi Ty2
guaaaauccggcaggcagccg

SEQ ID NO: 1790098 - RNA, 17 nt, Salmonella enterica enterica serovar Typhi Ty2
guaaaauccuuuuucau

SEQ ID NO: 1790099 - RNA, 15 nt, Salmonella enterica enterica serovar Typhi Ty2
guaaaaucaacagca

SEQ ID NO: 1790100 - RNA, 16 nt, Salmonella enterica enterica serovar Typhi Ty2
guaaaaucaacagcaa

SEQ ID NO: 1790101 - RNA, 21 nt, Salmonella enterica enterica serovar Typhi Ty2
guaaacccgauucugccaguu

SEQ ID NO: 1790102 - RNA, 16 nt, Salmonella enterica enterica serovar Typhi Ty2
guaaacgccugcacca

SEQ ID NO: 1790103 - RNA, 17 nt, Salmonella enterica enterica serovar Typhi Ty2
guaaaccggucucuuaa

SEQ ID NO: 1790104 - RNA, 18 nt, Salmonella enterica enterica serovar Typhi Ty2
guaaagaccgggcgcggu

SEQ ID NO: 1790105 - RNA, 22 nt, Salmonella enterica enterica serovar Typhi Ty2
guaaagacaccguucuggcugc

SEQ ID NO: 1790106 - RNA, 19 nt, Salmonella enterica enterica serovar Typhi Ty2
guaaagaaauuuaaagaua

SEQ ID NO: 1790107 - RNA, 23 nt, Salmonella enterica enterica serovar Typhi Ty2
guaaagauuaauaauugagcgca

SEQ ID NO: 1790108 - RNA, 14 nt, Salmonella enterica enterica serovar Typhi Ty2
guaaagcauggcug

SEQ ID NO: 1790109 - RNA, 17 nt, Salmonella enterica enterica serovar Typhi Ty2
guaaauuccuuguuuua

SEQ ID NO: 1790110 - RNA, 20 nt, Salmonella enterica enterica serovar Typhi Ty2
guaaaugccacuauagauga

SEQ ID NO: 1790111 - RNA, 19 nt, Salmonella enterica enterica serovar Typhi Ty2
guaaaucauuuguacaaaa

SEQ ID NO: 1790112 - RNA, 16 nt, Salmonella enterica enterica serovar Typhi Ty2
guaaauccaauagacu

SEQ ID NO: 1790113 - RNA, 17 nt, Salmonella enterica enterica serovar Typhi Ty2
guaaauagagaaaucaa

SEQ ID NO: 1790114 - RNA, 15 nt, Salmonella enterica enterica serovar Typhi Ty2
guaaauagaaaauaa

SEQ ID NO: 1790115 - RNA, 16 nt, Salmonella enterica enterica serovar Typhi Ty2
guaaaguuauucacgu

SEQ ID NO: 1790116 - RNA, 13 nt, Salmonella enterica enterica serovar Typhi Ty2
guaacagcaggac

SEQ ID NO: 1790117 - RNA, 16 nt, Salmonella enterica enterica serovar Typhi Ty2
guaacaggcaccagcg

SEQ ID NO: 1790118 - RNA, 22 nt, Salmonella enterica enterica serovar Typhi Ty2
guaacagacgcaucuuuuuccc

SEQ ID NO: 1790119 - RNA, 22 nt, Salmonella enterica enterica serovar Typhi Ty2
guaacaccuguaacgucacauu

SEQ ID NO: 1790120 - RNA, 13 nt, Salmonella enterica enterica serovar Typhi Ty2
guaacaaccagaa

SEQ ID NO: 1790121 - RNA, 13 nt, Salmonella enterica enterica serovar Typhi Ty2
guaaauuuauggu

SEQ ID NO: 1790122 - RNA, 22 nt, Salmonella enterica enterica serovar Typhi Ty2
guaaccaaagcaccauucuuca

SEQ ID NO: 1790123 - RNA, 20 nt, Salmonella enterica enterica serovar Typhi Ty2
guaacauccuggguuugcug

SEQ ID NO: 1790124 - RNA, 17 nt, Salmonella enterica enterica serovar Typhi Ty2
guaacauacaaaaagua

SEQ ID NO: 1790125 - RNA, 14 nt, Salmonella enterica enterica serovar Typhi Ty2
guaauaguuucgac

SEQ ID NO: 1790126 - RNA, 22 nt, Salmonella enterica enterica serovar Typhi Ty2
guaauaugugcgccacgcagcg

SEQ ID NO: 1790127 - RNA, 22 nt, Salmonella enterica enterica serovar Typhi Ty2
guaauacgcgucugucgaaacu

SEQ ID NO: 1790128 - RNA, 19 nt, Salmonella enterica enterica serovar Typhi Ty2
guaauacggagcaaaaaau

SEQ ID NO: 1790129 - RNA, 21 nt, Salmonella enterica enterica serovar Typhi Ty2
guaauaaggcggguugcugau

SEQ ID NO: 1790130 - RNA, 23 nt, Salmonella enterica enterica serovar Typhi Ty2
guaauaacaaaaaacauauaucu

SEQ ID NO: 1790131 - RNA, 15 nt, Salmonella enterica enterica serovar Typhi Ty2
guaauacaggguuug

SEQ ID NO: 1790132 - RNA, 18 nt, Salmonella enterica enterica serovar Typhi Ty2
guaauacggagcaaaaaa

SEQ ID NO: 1790133 - RNA, 20 nt, Salmonella enterica enterica serovar Typhi Ty2
guaaggcauuaauauccagu

SEQ ID NO: 1790134 - RNA, 23 nt, Salmonella enterica enterica serovar Typhi Ty2
guaagcccauggcaggcagcaca

SEQ ID NO: 1790135 - RNA, 16 nt, Salmonella enterica enterica serovar Typhi Ty2
guaagcuauuacaaaa

SEQ ID NO: 1790136 - RNA, 15 nt, Salmonella enterica enterica serovar Typhi Ty2
guaagcgcagcgcca

SEQ ID NO: 1790137 - RNA, 16 nt, Salmonella enterica enterica serovar Typhi Ty2
guaagcgccaagcggc

SEQ ID NO: 1790138 - RNA, 19 nt, Salmonella enterica enterica serovar Typhi Ty2
guaagucgccgcagcucca

SEQ ID NO: 1790139 - RNA, 21 nt, Salmonella enterica enterica serovar Typhi Ty2
guaagucgaccaguccuuccg

SEQ ID NO: 1790140 - RNA, 11 nt, Salmonella enterica enterica serovar Typhi Ty2
guaacuuacaa

SEQ ID NO: 1790141 - RNA, 23 nt, Salmonella enterica enterica serovar Typhi Ty2
guaacugcaccuuuuuuuccagc

SEQ ID NO: 1790142 - RNA, 18 nt, Salmonella enterica enterica serovar Typhi Ty2
guaacugcgguaaauaau

SEQ ID NO: 1790143 - RNA, 17 nt, Salmonella enterica enterica serovar Typhi Ty2
guaacguuguccagcag

SEQ ID NO: 1790144 - RNA, 15 nt, Salmonella enterica enterica serovar Typhi Ty2
guaacucaucgccag

SEQ ID NO: 1790145 - RNA, 23 nt, Salmonella enterica enterica serovar Typhi Ty2
guaagagcguuacccagacagca

SEQ ID NO: 1790146 - RNA, 17 nt, Salmonella enterica enterica serovar Typhi Ty2
guaagagcguuacccag

SEQ ID NO: 1790147 - RNA, 15 nt, Salmonella enterica enterica serovar Typhi Ty2
guaagagagccuuac

SEQ ID NO: 1790148 - RNA, 22 nt, Salmonella enterica enterica serovar Typhi Ty2
guaagaauuauuaccaaugagc

SEQ ID NO: 1790149 - RNA, 19 nt, Salmonella enterica enterica serovar Typhi Ty2
guaagaucccagggcggcg

SEQ ID NO: 1790150 - RNA, 16 nt, Salmonella enterica enterica serovar Typhi Ty2
guaagaggcauaaaaa

SEQ ID NO: 1790151 - RNA, 18 nt, Salmonella enterica enterica serovar Typhi Ty2
guaacucaauaucgacag

SEQ ID NO: 1790152 - RNA, 17 nt, Salmonella enterica enterica serovar Typhi Ty2
guaacguaaauacccag

SEQ ID NO: 1790153 - RNA, 15 nt, Salmonella enterica enterica serovar Typhi Ty2
guaacgcauaagcgc

SEQ ID NO: 1790154 - RNA, 23 nt, Salmonella enterica enterica serovar Typhi Ty2
guaacgccaaaguuuuuaaacaa

SEQ ID NO: 1790155 - RNA, 17 nt, Salmonella enterica enterica serovar Typhi Ty2
guaacggacauaaagga

SEQ ID NO: 1790156 - RNA, 14 nt, Salmonella enterica enterica serovar Typhi Ty2
guaacgcacuuuuc

SEQ ID NO: 1790157 - RNA, 16 nt, Salmonella enterica enterica serovar Typhi Ty2
guaacgauaaaaugca

SEQ ID NO: 1790158 - RNA, 14 nt, Salmonella enterica enterica serovar Typhi Ty2
guaaccgccacagc

SEQ ID NO: 1790159 - RNA, 17 nt, Salmonella enterica enterica serovar Typhi Ty2
guaacccgauacccuga

SEQ ID NO: 1790160 - RNA, 18 nt, Salmonella enterica enterica serovar Typhi Ty2
guaaccuauuuuacaaaa

SEQ ID NO: 1790161 - RNA, 23 nt, Salmonella enterica enterica serovar Typhi Ty2
guaaccccauacaguaguuuuca

SEQ ID NO: 1790162 - RNA, 18 nt, Salmonella enterica enterica serovar Typhi Ty2
guaaccgcaaaugccauc

SEQ ID NO: 1790163 - RNA, 18 nt, Salmonella enterica enterica serovar Typhi Ty2
guaauucucccaaauuuu

SEQ ID NO: 1790164 - RNA, 21 nt, Salmonella enterica enterica serovar Typhi Ty2
guaauguuuucugccagcaga

SEQ ID NO: 1790165 - RNA, 23 nt, Salmonella enterica enterica serovar Typhi Ty2
guaauucaugcuguauaaacuca

SEQ ID NO: 1790166 - RNA, 14 nt, Salmonella enterica enterica serovar Typhi Ty2
guaauucucccaaa

SEQ ID NO: 1790167 - RNA, 22 nt, Salmonella enterica enterica serovar Typhi Ty2
guaauucucacagaaucaucag

SEQ ID NO: 1790168 - RNA, 14 nt, Salmonella enterica enterica serovar Typhi Ty2
guaauuuuucuccc

SEQ ID NO: 1790169 - RNA, 13 nt, Salmonella enterica enterica serovar Typhi Ty2
guacaaaaaaugu

SEQ ID NO: 1790170 - RNA, 19 nt, Salmonella enterica enterica serovar Typhi Ty2
guaauuugaacauauccgc

SEQ ID NO: 1790171 - RNA, 11 nt, Salmonella enterica enterica serovar Typhi Ty2
guaauuuucac

SEQ ID NO: 1790172 - RNA, 20 nt, Salmonella enterica enterica serovar Typhi Ty2
guacaaacaaauaaauccau

SEQ ID NO: 1790173 - RNA, 13 nt, Salmonella enterica enterica serovar Typhi Ty2
guacaaacaaaua

SEQ ID NO: 1790174 - RNA, 21 nt, Salmonella enterica enterica serovar Typhi Ty2
guacaaacaaauaaauccaug

SEQ ID NO: 1790175 - RNA, 21 nt, Salmonella enterica enterica serovar Typhi Ty2
guacaaaccccacccacugau

SEQ ID NO: 1790176 - RNA, 17 nt, Salmonella enterica enterica serovar Typhi Ty2
guacaccuuaucugugg

SEQ ID NO: 1790177 - RNA, 19 nt, Salmonella enterica enterica serovar Typhi Ty2
guacaccugcaacuccugg

SEQ ID NO: 1790178 - RNA, 13 nt, Salmonella enterica enterica serovar Typhi Ty2
guacaccugcagg

SEQ ID NO: 1790179 - RNA, 17 nt, Salmonella enterica enterica serovar Typhi Ty2
guacacacgcgcugacc

SEQ ID NO: 1790180 - RNA, 18 nt, Salmonella enterica enterica serovar Typhi Ty2
guacaagagccgccgcca

SEQ ID NO: 1790181 - RNA, 20 nt, Salmonella enterica enterica serovar Typhi Ty2
guaaugaucagaacucacau

SEQ ID NO: 1790182 - RNA, 15 nt, Salmonella enterica enterica serovar Typhi Ty2
guaaucugacagaua

SEQ ID NO: 1790183 - RNA, 16 nt, Salmonella enterica enterica serovar Typhi Ty2
guaaugaacaccagca

SEQ ID NO: 1790184 - RNA, 14 nt, Salmonella enterica enterica serovar Typhi Ty2
guaaucuauucagc

SEQ ID NO: 1790185 - RNA, 18 nt, Salmonella enterica enterica serovar Typhi Ty2
guaaugcgccaggcagca

SEQ ID NO: 1790186 - RNA, 17 nt, Salmonella enterica enterica serovar Typhi Ty2
guaauggccuacacacu

SEQ ID NO: 1790187 - RNA, 12 nt, Salmonella enterica enterica serovar Typhi Ty2
guaauggucagc

SEQ ID NO: 1790188 - RNA, 21 nt, Salmonella enterica enterica serovar Typhi Ty2
guaauggcgggaaaagguuuc

SEQ ID NO: 1790189 - RNA, 20 nt, Salmonella enterica enterica serovar Typhi Ty2
guaaucggccuguuggccuu

SEQ ID NO: 1790190 - RNA, 22 nt, Salmonella enterica enterica serovar Typhi Ty2
aaauagaacagcuggugcggca

SEQ ID NO: 1790191 - RNA, 21 nt, Salmonella enterica enterica serovar Typhi Ty2
aaauagacgagcgaaaaacug

SEQ ID NO: 1790192 - RNA, 13 nt, Salmonella enterica enterica serovar Typhi Ty2
guacaugaauaau

SEQ ID NO: 1790193 - RNA, 19 nt, Salmonella enterica enterica serovar Typhi Ty2
guacaugaauaauaauaca

SEQ ID NO: 1790194 - RNA, 17 nt, Salmonella enterica enterica serovar Typhi Ty2
guacaugccauccggcg

SEQ ID NO: 1790195 - RNA, 16 nt, Salmonella enterica enterica serovar Typhi Ty2
guacaucgcgcugacc

SEQ ID NO: 1790196 - RNA, 23 nt, Salmonella enterica enterica serovar Typhi Ty2
guacagcuuaaucaccagcgcau

SEQ ID NO: 1790197 - RNA, 16 nt, Salmonella enterica enterica serovar Typhi Ty2
guacaggccgccgccu

SEQ ID NO: 1790198 - RNA, 22 nt, Salmonella enterica enterica serovar Typhi Ty2
guacacguauaaacgccgccgc

SEQ ID NO: 1790199 - RNA, 20 nt, Salmonella enterica enterica serovar Typhi Ty2
guacacuucagccagacgcu

SEQ ID NO: 1790200 - RNA, 17 nt, Salmonella enterica enterica serovar Typhi Ty2
guacagcaauaaaagga

SEQ ID NO: 1790201 - RNA, 20 nt, Salmonella enterica enterica serovar Typhi Ty2
guaccaccacgcccuucacg

SEQ ID NO: 1790202 - RNA, 20 nt, Salmonella enterica enterica serovar Typhi Ty2
guaccaccagaaucgccagc

SEQ ID NO: 1790203 - RNA, 16 nt, Salmonella enterica enterica serovar Typhi Ty2
guaccaauacccagcg

SEQ ID NO: 1790204 - RNA, 14 nt, Salmonella enterica enterica serovar Typhi Ty2
guaccaauacccag

SEQ ID NO: 1790205 - RNA, 20 nt, Salmonella enterica enterica serovar Typhi Ty2
guacauguccagaucuucac

SEQ ID NO: 1790206 - RNA, 23 nt, Salmonella enterica enterica serovar Typhi Ty2
guaccauaccggugcgccccagc

SEQ ID NO: 1790207 - RNA, 18 nt, Salmonella enterica enterica serovar Typhi Ty2
guaccacccgggaaaaau

SEQ ID NO: 1790208 - RNA, 18 nt, Salmonella enterica enterica serovar Typhi Ty2
guaccacgccgcacacag

SEQ ID NO: 1790209 - RNA, 15 nt, Salmonella enterica enterica serovar Typhi Ty2
guaccagcagcgcca

SEQ ID NO: 1790210 - RNA, 12 nt, Salmonella enterica enterica serovar Typhi Ty2
guaccagcagcg

SEQ ID NO: 1790211 - RNA, 18 nt, Salmonella enterica enterica serovar Typhi Ty2
guaccagaaugcccugcu

SEQ ID NO: 1790212 - RNA, 18 nt, Salmonella enterica enterica serovar Typhi Ty2
guaccucuugcuggguua

SEQ ID NO: 1790213 - RNA, 15 nt, Salmonella enterica enterica serovar Typhi Ty2
guaccggauuuagcg

SEQ ID NO: 1790214 - RNA, 18 nt, Salmonella enterica enterica serovar Typhi Ty2
guaccgcuugggccaccu

SEQ ID NO: 1790215 - RNA, 19 nt, Salmonella enterica enterica serovar Typhi Ty2
guaccgcuaucgccaaacu

SEQ ID NO: 1790216 - RNA, 15 nt, Salmonella enterica enterica serovar Typhi Ty2
guaccgcguccugac

SEQ ID NO: 1790217 - RNA, 13 nt, Salmonella enterica enterica serovar Typhi Ty2
guaccgaaagcga

SEQ ID NO: 1790218 - RNA, 17 nt, Salmonella enterica enterica serovar Typhi Ty2
guacccgcaggccuggc

SEQ ID NO: 1790219 - RNA, 21 nt, Salmonella enterica enterica serovar Typhi Ty2
guaccauugagcuuucuucca

SEQ ID NO: 1790220 - RNA, 13 nt, Salmonella enterica enterica serovar Typhi Ty2
guaccauugucaa

SEQ ID NO: 1790221 - RNA, 16 nt, Salmonella enterica enterica serovar Typhi Ty2
guacgccaaguacgcc

SEQ ID NO: 1790222 - RNA, 14 nt, Salmonella enterica enterica serovar Typhi Ty2
guacgcaggaggga

SEQ ID NO: 1790223 - RNA, 22 nt, Salmonella enterica enterica serovar Typhi Ty2
guaccuuucucuuucccaggcc

SEQ ID NO: 1790224 - RNA, 20 nt, Salmonella enterica enterica serovar Typhi Ty2
guacgcgcaaccgcaucacg

SEQ ID NO: 1790225 - RNA, 22 nt, Salmonella enterica enterica serovar Typhi Ty2
guacgcgcgucguauaugccaa

SEQ ID NO: 1790226 - RNA, 18 nt, Salmonella enterica enterica serovar Typhi Ty2
guacgcuuuggcaggccu

SEQ ID NO: 1790227 - RNA, 20 nt, Salmonella enterica enterica serovar Typhi Ty2
guacgcgucugaaugacgcc

SEQ ID NO: 1790228 - RNA, 18 nt, Salmonella enterica enterica serovar Typhi Ty2
guacggguauuccagggc

SEQ ID NO: 1790229 - RNA, 17 nt, Salmonella enterica enterica serovar Typhi Ty2
guacggggcaucuauuu

SEQ ID NO: 1790230 - RNA, 14 nt, Salmonella enterica enterica serovar Typhi Ty2
guacggauauuggc

SEQ ID NO: 1790231 - RNA, 14 nt, Salmonella enterica enterica serovar Typhi Ty2
ggugcucaauaaaa

SEQ ID NO: 1790232 - RNA, 22 nt, Salmonella enterica enterica serovar Typhi Ty2
ggugcguccgguagagaacgaa

SEQ ID NO: 1790233 - RNA, 17 nt, Salmonella enterica enterica serovar Typhi Ty2
ggugcucucccagcuga

SEQ ID NO: 1790234 - RNA, 16 nt, Salmonella enterica enterica serovar Typhi Ty2
ggugcgccccagcaug

SEQ ID NO: 1790235 - RNA, 21 nt, Salmonella enterica enterica serovar Typhi Ty2
ggugcgccccagcaugagcca

SEQ ID NO: 1790236 - RNA, 22 nt, Salmonella enterica enterica serovar Typhi Ty2
gguggggauaucuucgauaaga

SEQ ID NO: 1790237 - RNA, 11 nt, Salmonella enterica enterica serovar Typhi Ty2
gguggccggag

SEQ ID NO: 1790238 - RNA, 17 nt, Salmonella enterica enterica serovar Typhi Ty2
gguggcgccacgccacc

SEQ ID NO: 1790239 - RNA, 19 nt, Salmonella enterica enterica serovar Typhi Ty2
gguggcggaaaugcgcggu

SEQ ID NO: 1790240 - RNA, 15 nt, Salmonella enterica enterica serovar Typhi Ty2
gguggaaagugcuga

SEQ ID NO: 1790241 - RNA, 23 nt, Salmonella enterica enterica serovar Typhi Ty2
ggcuccgagacucaaagaaaaca

SEQ ID NO: 1790242 - RNA, 13 nt, Salmonella enterica enterica serovar Typhi Ty2
ggcucauauuauc

SEQ ID NO: 1790243 - RNA, 13 nt, Salmonella enterica enterica serovar Typhi Ty2
ggcucaucaaaca

SEQ ID NO: 1790244 - RNA, 16 nt, Salmonella enterica enterica serovar Typhi Ty2
ggugaauaccaaagcc

SEQ ID NO: 1790245 - RNA, 22 nt, Salmonella enterica enterica serovar Typhi Ty2
ggugacaguccgggccgugaca

SEQ ID NO: 1790246 - RNA, 22 nt, Salmonella enterica enterica serovar Typhi Ty2
ggugagcuccagcccgccgccc

SEQ ID NO: 1790247 - RNA, 19 nt, Salmonella enterica enterica serovar Typhi Ty2
ggugagcuccagcccgccg

SEQ ID NO: 1790248 - RNA, 21 nt, Salmonella enterica enterica serovar Typhi Ty2
ggugagcucauccagcguuuc

SEQ ID NO: 1790249 - RNA, 16 nt, Salmonella enterica enterica serovar Typhi Ty2
ggugacggaaaccagc

SEQ ID NO: 1790250 - RNA, 19 nt, Salmonella enterica enterica serovar Typhi Ty2
ggugacgccaugcaaaaaa

SEQ ID NO: 1790251 - RNA, 20 nt, Salmonella enterica enterica serovar Typhi Ty2
ggugcagaccucugcaaaca

SEQ ID NO: 1790252 - RNA, 15 nt, Salmonella enterica enterica serovar Typhi Ty2
ggugcagaccucugc

SEQ ID NO: 1790253 - RNA, 17 nt, Salmonella enterica enterica serovar Typhi Ty2
ggugcagcccgucggcg

SEQ ID NO: 1790254 - RNA, 23 nt, Salmonella enterica enterica serovar Typhi Ty2
ggugcauuuuuaucaucugcaug

SEQ ID NO: 1790255 - RNA, 17 nt, Salmonella enterica enterica serovar Typhi Ty2
ggugccaaauguauacu

SEQ ID NO: 1790256 - RNA, 22 nt, Salmonella enterica enterica serovar Typhi Ty2
ggugauauuuuagccaucccgg

SEQ ID NO: 1790257 - RNA, 22 nt, Salmonella enterica enterica serovar Typhi Ty2
ggugaguaauaacaaaaaacau

SEQ ID NO: 1790258 - RNA, 23 nt, Salmonella enterica enterica serovar Typhi Ty2
ggugaucuggccaauuuuucaca

SEQ ID NO: 1790259 - RNA, 15 nt, Salmonella enterica enterica serovar Typhi Ty2
ggugcaaaacguuug

SEQ ID NO: 1790260 - RNA, 18 nt, Salmonella enterica enterica serovar Typhi Ty2
ggugcaagcaccuuaucc

SEQ ID NO: 1790261 - RNA, 15 nt, Salmonella enterica enterica serovar Typhi Ty2
ggugauggacgacga

SEQ ID NO: 1790262 - RNA, 18 nt, Salmonella enterica enterica serovar Typhi Ty2
gguuucgauagcaggcac

SEQ ID NO: 1790263 - RNA, 19 nt, Salmonella enterica enterica serovar Typhi Ty2
gguuucccugccucaacau

SEQ ID NO: 1790264 - RNA, 14 nt, Salmonella enterica enterica serovar Typhi Ty2
gguuucuucgcugg

SEQ ID NO: 1790265 - RNA, 11 nt, Salmonella enterica enterica serovar Typhi Ty2
gguuucuuuuu

SEQ ID NO: 1790266 - RNA, 22 nt, Salmonella enterica enterica serovar Typhi Ty2
gguuucaauauagccguggcug

SEQ ID NO: 1790267 - RNA, 18 nt, Salmonella enterica enterica serovar Typhi Ty2
gguuucaccauuaagcaa

SEQ ID NO: 1790268 - RNA, 18 nt, Salmonella enterica enterica serovar Typhi Ty2
gguuuucauccacccugg

SEQ ID NO: 1790269 - RNA, 14 nt, Salmonella enterica enterica serovar Typhi Ty2
gguuugcagcagag

SEQ ID NO: 1790270 - RNA, 17 nt, Salmonella enterica enterica serovar Typhi Ty2
gguuuggacuaccggua

SEQ ID NO: 1790271 - RNA, 17 nt, Salmonella enterica enterica serovar Typhi Ty2
gguuugccagcaccagc

SEQ ID NO: 1790272 - RNA, 12 nt, Salmonella enterica enterica serovar Typhi Ty2
guaaaaagcuga

SEQ ID NO: 1790273 - RNA, 13 nt, Salmonella enterica enterica serovar Typhi Ty2
guaaaaccggcac

SEQ ID NO: 1790274 - RNA, 16 nt, Salmonella enterica enterica serovar Typhi Ty2
guaaaaccgacuauca

SEQ ID NO: 1790275 - RNA, 13 nt, Salmonella enterica enterica serovar Typhi Ty2
guaaaaccagaua

SEQ ID NO: 1790276 - RNA, 16 nt, Salmonella enterica enterica serovar Typhi Ty2
guaaaaacccuuucau

SEQ ID NO: 1790277 - RNA, 21 nt, Salmonella enterica enterica serovar Typhi Ty2
gguuuuuuuguaucugcgcag

SEQ ID NO: 1790278 - RNA, 15 nt, Salmonella enterica enterica serovar Typhi Ty2
gguuuuuuuacucug

SEQ ID NO: 1790279 - RNA, 22 nt, Salmonella enterica enterica serovar Typhi Ty2
guaaaaaaaccguaucacugua

SEQ ID NO: 1790280 - RNA, 19 nt, Salmonella enterica enterica serovar Typhi Ty2
gguuuuuuuauaacauaaa

SEQ ID NO: 1790281 - RNA, 14 nt, Salmonella enterica enterica serovar Typhi Ty2
gguucugccagaac

SEQ ID NO: 1790282 - RNA, 13 nt, Salmonella enterica enterica serovar Typhi Ty2
gguucugccagaa

SEQ ID NO: 1790283 - RNA, 18 nt, Salmonella enterica enterica serovar Typhi Ty2
gguucucugccaucaucc

SEQ ID NO: 1790284 - RNA, 12 nt, Salmonella enterica enterica serovar Typhi Ty2
gguugacgcugc

SEQ ID NO: 1790285 - RNA, 15 nt, Salmonella enterica enterica serovar Typhi Ty2
gguugcccgcaggcu

SEQ ID NO: 1790286 - RNA, 18 nt, Salmonella enterica enterica serovar Typhi Ty2
gguugccagaggcagcac

SEQ ID NO: 1790287 - RNA, 14 nt, Salmonella enterica enterica serovar Typhi Ty2
gguugccgcaaaug

SEQ ID NO: 1790288 - RNA, 15 nt, Salmonella enterica enterica serovar Typhi Ty2
gguugucucaaaaaa

SEQ ID NO: 1790289 - RNA, 14 nt, Salmonella enterica enterica serovar Typhi Ty2
gguugugccaguaa

SEQ ID NO: 1790290 - RNA, 20 nt, Salmonella enterica enterica serovar Typhi Ty2
gguuggaauaauuuucgcaa

SEQ ID NO: 1790291 - RNA, 17 nt, Salmonella enterica enterica serovar Typhi Ty2
gguugcuucuguccuuu

SEQ ID NO: 1790292 - RNA, 15 nt, Salmonella enterica enterica serovar Typhi Ty2
ggugggugaugacgg

SEQ ID NO: 1790293 - RNA, 21 nt, Salmonella enterica enterica serovar Typhi Ty2
gguggucacgccauuaucgaa

SEQ ID NO: 1790294 - RNA, 20 nt, Salmonella enterica enterica serovar Typhi Ty2
gguguaaaccaggcauuuua

SEQ ID NO: 1790295 - RNA, 16 nt, Salmonella enterica enterica serovar Typhi Ty2
gguguagcucauaacu

SEQ ID NO: 1790296 - RNA, 12 nt, Salmonella enterica enterica serovar Typhi Ty2
gguguccagaug

SEQ ID NO: 1790297 - RNA, 21 nt, Salmonella enterica enterica serovar Typhi Ty2
gguuaaacacauccggcggcg

SEQ ID NO: 1790298 - RNA, 17 nt, Salmonella enterica enterica serovar Typhi Ty2
gguuaaauagcaggcaa

SEQ ID NO: 1790299 - RNA, 18 nt, Salmonella enterica enterica serovar Typhi Ty2
gguguuuacgccgccauc

SEQ ID NO: 1790300 - RNA, 15 nt, Salmonella enterica enterica serovar Typhi Ty2
ggugugccugcgcuu

SEQ ID NO: 1790301 - RNA, 19 nt, Salmonella enterica enterica serovar Typhi Ty2
gguucaaccgaaagaagaa

SEQ ID NO: 1790302 - RNA, 16 nt, Salmonella enterica enterica serovar Typhi Ty2
gguucaccaccaccca

SEQ ID NO: 1790303 - RNA, 21 nt, Salmonella enterica enterica serovar Typhi Ty2
gguucaccaccacccagugcc

SEQ ID NO: 1790304 - RNA, 22 nt, Salmonella enterica enterica serovar Typhi Ty2
gguuauucggucagauaaauaa

SEQ ID NO: 1790305 - RNA, 15 nt, Salmonella enterica enterica serovar Typhi Ty2
gguuacaacccgacc

SEQ ID NO: 1790306 - RNA, 20 nt, Salmonella enterica enterica serovar Typhi Ty2
gguuacaacugcgaggucac

SEQ ID NO: 1790307 - RNA, 14 nt, Salmonella enterica enterica serovar Typhi Ty2
gguuauaauaauaa

SEQ ID NO: 1790308 - RNA, 23 nt, Salmonella enterica enterica serovar Typhi Ty2
gguucccgagcggccaaagggag

SEQ ID NO: 1790309 - RNA, 18 nt, Salmonella enterica enterica serovar Typhi Ty2
gguucccugcgccaggcc

SEQ ID NO: 1790310 - RNA, 22 nt, Salmonella enterica enterica serovar Typhi Ty2
gguuccguucccaaugcuuucg

SEQ ID NO: 1790311 - RNA, 15 nt, Salmonella enterica enterica serovar Typhi Ty2
gguucaucgccacau

SEQ ID NO: 1790312 - RNA, 13 nt, Salmonella enterica enterica serovar Typhi Ty2
gguucucccggca

SEQ ID NO: 1790313 - RNA, 22 nt, Salmonella enterica enterica serovar Typhi Ty2
gguucguacccgcaggccuggc

SEQ ID NO: 1790314 - RNA, 17 nt, Salmonella enterica enterica serovar Typhi Ty2
gguucgccucccucacc

SEQ ID NO: 1790315 - RNA, 21 nt, Salmonella enterica enterica serovar Typhi Ty2
gguucgaacgacagaauaugc

SEQ ID NO: 1790316 - RNA, 20 nt, Salmonella enterica enterica serovar Typhi Ty2
gccgggcggcuguguccgcc

SEQ ID NO: 1790317 - RNA, 20 nt, Salmonella enterica enterica serovar Typhi Ty2
gccgggcgucacccgccggc

SEQ ID NO: 1790318 - RNA, 15 nt, Salmonella enterica enterica serovar Typhi Ty2
gccgggcugaccgcu

SEQ ID NO: 1790319 - RNA, 21 nt, Salmonella enterica enterica serovar Typhi Ty2
gccgggcuauccggcuguucg

SEQ ID NO: 1790320 - RNA, 18 nt, Salmonella enterica enterica serovar Typhi Ty2
gccgggcauaaacuaauc

SEQ ID NO: 1790321 - RNA, 12 nt, Salmonella enterica enterica serovar Typhi Ty2
gccgggcauaug

SEQ ID NO: 1790322 - RNA, 17 nt, Salmonella enterica enterica serovar Typhi Ty2
gccgggccugagcgcgc

SEQ ID NO: 1790323 - RNA, 22 nt, Salmonella enterica enterica serovar Typhi Ty2
gccggggcucccacucuuccag

SEQ ID NO: 1790324 - RNA, 13 nt, Salmonella enterica enterica serovar Typhi Ty2
gccggggcgcugg

SEQ ID NO: 1790325 - RNA, 18 nt, Salmonella enterica enterica serovar Typhi Ty2
gccgguagcuucagcggc

SEQ ID NO: 1790326 - RNA, 19 nt, Salmonella enterica enterica serovar Typhi Ty2
gccgguacuggagaccggc

SEQ ID NO: 1790327 - RNA, 21 nt, Salmonella enterica enterica serovar Typhi Ty2
gccgguaaucgaucccgccgc

SEQ ID NO: 1790328 - RNA, 13 nt, Salmonella enterica enterica serovar Typhi Ty2
gccgguaagaaga

SEQ ID NO: 1790329 - RNA, 21 nt, Salmonella enterica enterica serovar Typhi Ty2
gccgguacgcagcaggcagac

SEQ ID NO: 1790330 - RNA, 15 nt, Salmonella enterica enterica serovar Typhi Ty2
gccgguacgcagcag

SEQ ID NO: 1790331 - RNA, 16 nt, Salmonella enterica enterica serovar Typhi Ty2
gccggguggcgcugug

SEQ ID NO: 1790332 - RNA, 14 nt, Salmonella enterica enterica serovar Typhi Ty2
gccggguuuaaugc

SEQ ID NO: 1790333 - RNA, 13 nt, Salmonella enterica enterica serovar Typhi Ty2
gccgguauccagc

SEQ ID NO: 1790334 - RNA, 17 nt, Salmonella enterica enterica serovar Typhi Ty2
gccggugccauuccagc

SEQ ID NO: 1790335 - RNA, 18 nt, Salmonella enterica enterica serovar Typhi Ty2
gccggugaucccaccagc

SEQ ID NO: 1790336 - RNA, 16 nt, Salmonella enterica enterica serovar Typhi Ty2
gccggucggcgcguca

SEQ ID NO: 1790337 - RNA, 15 nt, Salmonella enterica enterica serovar Typhi Ty2
gccgucguacucacc

SEQ ID NO: 1790338 - RNA, 20 nt, Salmonella enterica enterica serovar Typhi Ty2
gccgucgaugauggcggcua

SEQ ID NO: 1790339 - RNA, 22 nt, Salmonella enterica enterica serovar Typhi Ty2
gccgucauggcaaacgaaccca

SEQ ID NO: 1790340 - RNA, 20 nt, Salmonella enterica enterica serovar Typhi Ty2
gccguaacgaacgcggauca

SEQ ID NO: 1790341 - RNA, 17 nt, Salmonella enterica enterica serovar Typhi Ty2
gccguaaauugagugga

SEQ ID NO: 1790342 - RNA, 21 nt, Salmonella enterica enterica serovar Typhi Ty2
gccgguuuauccccgcuggcg

SEQ ID NO: 1790343 - RNA, 23 nt, Salmonella enterica enterica serovar Typhi Ty2
gccgguuuauccccgcuggcgcg

SEQ ID NO: 1790344 - RNA, 18 nt, Salmonella enterica enterica serovar Typhi Ty2
gccgguuauaccgccauc

SEQ ID NO: 1790345 - RNA, 13 nt, Salmonella enterica enterica serovar Typhi Ty2
gccguaggagaua

SEQ ID NO: 1790346 - RNA, 12 nt, Salmonella enterica enterica serovar Typhi Ty2
gccguagcguuu

SEQ ID NO: 1790347 - RNA, 22 nt, Salmonella enterica enterica serovar Typhi Ty2
gccguaaggcguaccgccgcga

SEQ ID NO: 1790348 - RNA, 13 nt, Salmonella enterica enterica serovar Typhi Ty2
gccuaaaaaugag

SEQ ID NO: 1790349 - RNA, 13 nt, Salmonella enterica enterica serovar Typhi Ty2
gccuaaagaaaaa

SEQ ID NO: 1790350 - RNA, 14 nt, Salmonella enterica enterica serovar Typhi Ty2
gccuaaagaaaaac

SEQ ID NO: 1790351 - RNA, 12 nt, Salmonella enterica enterica serovar Typhi Ty2
gccuaaagaaaa

SEQ ID NO: 1790352 - RNA, 14 nt, Salmonella enterica enterica serovar Typhi Ty2
gccuaaauuuaacu

SEQ ID NO: 1790353 - RNA, 18 nt, Salmonella enterica enterica serovar Typhi Ty2
gccuaagcccaccaucag

SEQ ID NO: 1790354 - RNA, 14 nt, Salmonella enterica enterica serovar Typhi Ty2
gccuacauccggcu

SEQ ID NO: 1790355 - RNA, 15 nt, Salmonella enterica enterica serovar Typhi Ty2
gccuaacgccagcau

SEQ ID NO: 1790356 - RNA, 12 nt, Salmonella enterica enterica serovar Typhi Ty2
gccuaagcccac

SEQ ID NO: 1790357 - RNA, 13 nt, Salmonella enterica enterica serovar Typhi Ty2
gccuaccgccaua

SEQ ID NO: 1790358 - RNA, 15 nt, Salmonella enterica enterica serovar Typhi Ty2
gccuacccgcgugcg

SEQ ID NO: 1790359 - RNA, 17 nt, Salmonella enterica enterica serovar Typhi Ty2
gccuaccaguuguuguc

SEQ ID NO: 1790360 - RNA, 15 nt, Salmonella enterica enterica serovar Typhi Ty2
gccuaccagucgacu

SEQ ID NO: 1790361 - RNA, 19 nt, Salmonella enterica enterica serovar Typhi Ty2
gccuaccagcgcuauccag

SEQ ID NO: 1790362 - RNA, 12 nt, Salmonella enterica enterica serovar Typhi Ty2
gccguggcuggc

SEQ ID NO: 1790363 - RNA, 21 nt, Salmonella enterica enterica serovar Typhi Ty2
gccguggcggugacuuccuga

SEQ ID NO: 1790364 - RNA, 18 nt, Salmonella enterica enterica serovar Typhi Ty2
gccgugccuggcgcuggg

SEQ ID NO: 1790365 - RNA, 21 nt, Salmonella enterica enterica serovar Typhi Ty2
gccgucguugcugucgcgcaa

SEQ ID NO: 1790366 - RNA, 18 nt, Salmonella enterica enterica serovar Typhi Ty2
gccgucucuuucauggaa

SEQ ID NO: 1790367 - RNA, 12 nt, Salmonella enterica enterica serovar Typhi Ty2
gccgugauucau

SEQ ID NO: 1790368 - RNA, 21 nt, Salmonella enterica enterica serovar Typhi Ty2
gccgugcccagcaucccgcug

SEQ ID NO: 1790369 - RNA, 16 nt, Salmonella enterica enterica serovar Typhi Ty2
gccggcaggcagcgcc

SEQ ID NO: 1790370 - RNA, 22 nt, Salmonella enterica enterica serovar Typhi Ty2
gccggcagacgauagcggguga

SEQ ID NO: 1790371 - RNA, 12 nt, Salmonella enterica enterica serovar Typhi Ty2
gccggcagcagc

SEQ ID NO: 1790372 - RNA, 15 nt, Salmonella enterica enterica serovar Typhi Ty2
gccggauggcggcug

SEQ ID NO: 1790373 - RNA, 14 nt, Salmonella enterica enterica serovar Typhi Ty2
gccggauggcggcg

SEQ ID NO: 1790374 - RNA, 13 nt, Salmonella enterica enterica serovar Typhi Ty2
gccggauggcgcu

SEQ ID NO: 1790375 - RNA, 22 nt, Salmonella enterica enterica serovar Typhi Ty2
gccggaugugagcgcauccggc

SEQ ID NO: 1790376 - RNA, 17 nt, Salmonella enterica enterica serovar Typhi Ty2
gccggauggcggcugcg

SEQ ID NO: 1790377 - RNA, 18 nt, Salmonella enterica enterica serovar Typhi Ty2
gccggcaacacccgccga

SEQ ID NO: 1790378 - RNA, 21 nt, Salmonella enterica enterica serovar Typhi Ty2
gccggaggaggacucuccgag

SEQ ID NO: 1790379 - RNA, 17 nt, Salmonella enterica enterica serovar Typhi Ty2
gccggaggauauuuauu

SEQ ID NO: 1790380 - RNA, 15 nt, Salmonella enterica enterica serovar Typhi Ty2
gccggauaagacgcg

SEQ ID NO: 1790381 - RNA, 22 nt, Salmonella enterica enterica serovar Typhi Ty2
gccggauaagacgcgcagcggc

SEQ ID NO: 1790382 - RNA, 15 nt, Salmonella enterica enterica serovar Typhi Ty2
gccggauaagacgcu

SEQ ID NO: 1790383 - RNA, 13 nt, Salmonella enterica enterica serovar Typhi Ty2
gccggacuccagc

SEQ ID NO: 1790384 - RNA, 17 nt, Salmonella enterica enterica serovar Typhi Ty2
gccggaucgggcuucca

SEQ ID NO: 1790385 - RNA, 16 nt, Salmonella enterica enterica serovar Typhi Ty2
gccggauaagguguuu

SEQ ID NO: 1790386 - RNA, 17 nt, Salmonella enterica enterica serovar Typhi Ty2
gccggauaaggcgcagc

SEQ ID NO: 1790387 - RNA, 13 nt, Salmonella enterica enterica serovar Typhi Ty2
gccggacagcagc

SEQ ID NO: 1790388 - RNA, 22 nt, Salmonella enterica enterica serovar Typhi Ty2
gccggaaucgcgauccagcccc

SEQ ID NO: 1790389 - RNA, 18 nt, Salmonella enterica enterica serovar Typhi Ty2
gccggcgaccaugccagc

SEQ ID NO: 1790390 - RNA, 16 nt, Salmonella enterica enterica serovar Typhi Ty2
gccggcgaccaugcca

SEQ ID NO: 1790391 - RNA, 18 nt, Salmonella enterica enterica serovar Typhi Ty2
gccggcuuaccagcgggc

SEQ ID NO: 1790392 - RNA, 15 nt, Salmonella enterica enterica serovar Typhi Ty2
gccuggcauuuuacu

SEQ ID NO: 1790393 - RNA, 15 nt, Salmonella enterica enterica serovar Typhi Ty2
gccuggcauggugca

SEQ ID NO: 1790394 - RNA, 19 nt, Salmonella enterica enterica serovar Typhi Ty2
gccuggcauggugcagccg

SEQ ID NO: 1790395 - RNA, 16 nt, Salmonella enterica enterica serovar Typhi Ty2
gccuggcaacaugacc

SEQ ID NO: 1790396 - RNA, 20 nt, Salmonella enterica enterica serovar Typhi Ty2
gccuguaaggucucagcgac

SEQ ID NO: 1790397 - RNA, 21 nt, Salmonella enterica enterica serovar Typhi Ty2
gccuguaaggucucagcgacc

SEQ ID NO: 1790398 - RNA, 17 nt, Salmonella enterica enterica serovar Typhi Ty2
gccuguaauggcgcucu

SEQ ID NO: 1790399 - RNA, 22 nt, Salmonella enterica enterica serovar Typhi Ty2
gccuguaauggcgcucuuuucc

SEQ ID NO: 1790400 - RNA, 18 nt, Salmonella enterica enterica serovar Typhi Ty2
gccuguaaacguuccugc

SEQ ID NO: 1790401 - RNA, 19 nt, Salmonella enterica enterica serovar Typhi Ty2
gccuguaaaacaacccccg

SEQ ID NO: 1790402 - RNA, 22 nt, Salmonella enterica enterica serovar Typhi Ty2
gccuggugcccaaccugcgcag

SEQ ID NO: 1790403 - RNA, 15 nt, Salmonella enterica enterica serovar Typhi Ty2
gccugugcaaccagc

SEQ ID NO: 1790404 - RNA, 21 nt, Salmonella enterica enterica serovar Typhi Ty2
gccugugacguuaacgcagca

SEQ ID NO: 1790405 - RNA, 19 nt, Salmonella enterica enterica serovar Typhi Ty2
gccugugaucggagaaaua

SEQ ID NO: 1790406 - RNA, 21 nt, Salmonella enterica enterica serovar Typhi Ty2
gccuguacuugcgccgccauc

SEQ ID NO: 1790407 - RNA, 19 nt, Salmonella enterica enterica serovar Typhi Ty2
gccuguaccgggcagacau

SEQ ID NO: 1790408 - RNA, 15 nt, Salmonella enterica enterica serovar Typhi Ty2
gccuguuagggcgcg

SEQ ID NO: 1790409 - RNA, 12 nt, Salmonella enterica enterica serovar Typhi Ty2
gccuuacaggcg

SEQ ID NO: 1790410 - RNA, 18 nt, Salmonella enterica enterica serovar Typhi Ty2
gccuuacaggcgcaucag

SEQ ID NO: 1790411 - RNA, 13 nt, Salmonella enterica enterica serovar Typhi Ty2
gccuuacccgacc

SEQ ID NO: 1790412 - RNA, 21 nt, Salmonella enterica enterica serovar Typhi Ty2
gccugugcuuucgccaccagc

SEQ ID NO: 1790413 - RNA, 13 nt, Salmonella enterica enterica serovar Typhi Ty2
gccuuccaggcgg

SEQ ID NO: 1790414 - RNA, 14 nt, Salmonella enterica enterica serovar Typhi Ty2
gccuuauccggccu

SEQ ID NO: 1790415 - RNA, 22 nt, Salmonella enterica enterica serovar Typhi Ty2
gccuuauaagaaccaucuacca

SEQ ID NO: 1790416 - RNA, 13 nt, Salmonella enterica enterica serovar Typhi Ty2
gccuuauccggcg

SEQ ID NO: 1790417 - RNA, 13 nt, Salmonella enterica enterica serovar Typhi Ty2
gccuucagguuuu

SEQ ID NO: 1790418 - RNA, 15 nt, Salmonella enterica enterica serovar Typhi Ty2
gcgaaaacagcuggc

SEQ ID NO: 1790419 - RNA, 22 nt, Salmonella enterica enterica serovar Typhi Ty2
gccuuuuuuauacuccagcaga

SEQ ID NO: 1790420 - RNA, 12 nt, Salmonella enterica enterica serovar Typhi Ty2
gcgaaaaccagc

SEQ ID NO: 1790421 - RNA, 22 nt, Salmonella enterica enterica serovar Typhi Ty2
gcgaaaauaccccagcgcgccg

SEQ ID NO: 1790422 - RNA, 20 nt, Salmonella enterica enterica serovar Typhi Ty2
gccuugugucacauuuucuu

SEQ ID NO: 1790423 - RNA, 21 nt, Salmonella enterica enterica serovar Typhi Ty2
gccuuuacugaaucucagaua

SEQ ID NO: 1790424 - RNA, 18 nt, Salmonella enterica enterica serovar Typhi Ty2
gccuuuaugcaguuccgu

SEQ ID NO: 1790425 - RNA, 13 nt, Salmonella enterica enterica serovar Typhi Ty2
gccuuuauccagc

SEQ ID NO: 1790426 - RNA, 17 nt, Salmonella enterica enterica serovar Typhi Ty2
gccuugcggcgccagga

SEQ ID NO: 1790427 - RNA, 21 nt, Salmonella enterica enterica serovar Typhi Ty2
gccuugcuggccuguucaagu

SEQ ID NO: 1790428 - RNA, 14 nt, Salmonella enterica enterica serovar Typhi Ty2
gccuucuccccuuc

SEQ ID NO: 1790429 - RNA, 17 nt, Salmonella enterica enterica serovar Typhi Ty2
gccuuccuccaguaauu

SEQ ID NO: 1790430 - RNA, 14 nt, Salmonella enterica enterica serovar Typhi Ty2
gccuuccuggucug

SEQ ID NO: 1790431 - RNA, 21 nt, Salmonella enterica enterica serovar Typhi Ty2
gccuuccucgucggcaagaau

SEQ ID NO: 1790432 - RNA, 20 nt, Salmonella enterica enterica serovar Typhi Ty2
gccuuccguccacaucgcga

SEQ ID NO: 1790433 - RNA, 22 nt, Salmonella enterica enterica serovar Typhi Ty2
gccuuccuguggaaggcauuau

SEQ ID NO: 1790434 - RNA, 22 nt, Salmonella enterica enterica serovar Typhi Ty2
gccuucccgauaaccgcguuca

SEQ ID NO: 1790435 - RNA, 23 nt, Salmonella enterica enterica serovar Typhi Ty2
gccugcgccuauuguuccaaugu

SEQ ID NO: 1790436 - RNA, 19 nt, Salmonella enterica enterica serovar Typhi Ty2
gccugcgccuauuguucca

SEQ ID NO: 1790437 - RNA, 20 nt, Salmonella enterica enterica serovar Typhi Ty2
gccugcgguaaucgccgcga

SEQ ID NO: 1790438 - RNA, 15 nt, Salmonella enterica enterica serovar Typhi Ty2
gccugcucaucaggu

SEQ ID NO: 1790439 - RNA, 15 nt, Salmonella enterica enterica serovar Typhi Ty2
gccugcuccgccagg

SEQ ID NO: 1790440 - RNA, 16 nt, Salmonella enterica enterica serovar Typhi Ty2
gccugcgaucuguguc

SEQ ID NO: 1790441 - RNA, 18 nt, Salmonella enterica enterica serovar Typhi Ty2
gccugcgaaugcaggccg

SEQ ID NO: 1790442 - RNA, 13 nt, Salmonella enterica enterica serovar Typhi Ty2
gccugccauagca

SEQ ID NO: 1790443 - RNA, 19 nt, Salmonella enterica enterica serovar Typhi Ty2
gccugcaucaccucagaau

SEQ ID NO: 1790444 - RNA, 22 nt, Salmonella enterica enterica serovar Typhi Ty2
gccugcauaaaggaguaacaga

SEQ ID NO: 1790445 - RNA, 12 nt, Salmonella enterica enterica serovar Typhi Ty2
gccugcagaccc

SEQ ID NO: 1790446 - RNA, 13 nt, Salmonella enterica enterica serovar Typhi Ty2
gccugcagaccca

SEQ ID NO: 1790447 - RNA, 18 nt, Salmonella enterica enterica serovar Typhi Ty2
gccugauagcacagcgcu

SEQ ID NO: 1790448 - RNA, 18 nt, Salmonella enterica enterica serovar Typhi Ty2
gccugaucgcgcagacag

SEQ ID NO: 1790449 - RNA, 16 nt, Salmonella enterica enterica serovar Typhi Ty2
gccugaucuuucuggu

SEQ ID NO: 1790450 - RNA, 12 nt, Salmonella enterica enterica serovar Typhi Ty2
gccugaucuuuc

SEQ ID NO: 1790451 - RNA, 16 nt, Salmonella enterica enterica serovar Typhi Ty2
gccugaugagcgcagc

SEQ ID NO: 1790452 - RNA, 20 nt, Salmonella enterica enterica serovar Typhi Ty2
gccugaugagcgcagcgacu

SEQ ID NO: 1790453 - RNA, 13 nt, Salmonella enterica enterica serovar Typhi Ty2
gccugaugcgccg

SEQ ID NO: 1790454 - RNA, 19 nt, Salmonella enterica enterica serovar Typhi Ty2
gccugaugcgccgccuugg

SEQ ID NO: 1790455 - RNA, 14 nt, Salmonella enterica enterica serovar Typhi Ty2
gccugauucauucc

SEQ ID NO: 1790456 - RNA, 23 nt, Salmonella enterica enterica serovar Typhi Ty2
gccugaugcugcgcauccgcggc

SEQ ID NO: 1790457 - RNA, 20 nt, Salmonella enterica enterica serovar Typhi Ty2
gccugcaaaccucucccccg

SEQ ID NO: 1790458 - RNA, 13 nt, Salmonella enterica enterica serovar Typhi Ty2
gccugauuucuga

SEQ ID NO: 1790459 - RNA, 12 nt, Salmonella enterica enterica serovar Typhi Ty2
gccugagcgcga

SEQ ID NO: 1790460 - RNA, 16 nt, Salmonella enterica enterica serovar Typhi Ty2
gccugauaagcacagg

SEQ ID NO: 1790461 - RNA, 20 nt, Salmonella enterica enterica serovar Typhi Ty2
gccugauaaauaugucggcc

SEQ ID NO: 1790462 - RNA, 16 nt, Salmonella enterica enterica serovar Typhi Ty2
gccugauaaaacgcag

SEQ ID NO: 1790463 - RNA, 18 nt, Salmonella enterica enterica serovar Typhi Ty2
gccugacggcgcugucac

SEQ ID NO: 1790464 - RNA, 18 nt, Salmonella enterica enterica serovar Typhi Ty2
gccugacgaauagcgcgc

SEQ ID NO: 1790465 - RNA, 22 nt, Salmonella enterica enterica serovar Typhi Ty2
gccucaacaaguccuucuuccc

SEQ ID NO: 1790466 - RNA, 21 nt, Salmonella enterica enterica serovar Typhi Ty2
gccucaaccaacggcgcuggc

SEQ ID NO: 1790467 - RNA, 20 nt, Salmonella enterica enterica serovar Typhi Ty2
gccucuuggaugauuuucuu

SEQ ID NO: 1790468 - RNA, 19 nt, Salmonella enterica enterica serovar Typhi Ty2
gccuaccggaauacacaau

SEQ ID NO: 1790469 - RNA, 17 nt, Salmonella enterica enterica serovar Typhi Ty2
gccuaccugccgccaua

SEQ ID NO: 1790470 - RNA, 24 nt, Salmonella enterica enterica serovar Typhi Ty2
gccuacggaaagcuguuguugcuc

SEQ ID NO: 1790471 - RNA, 17 nt, Salmonella enterica enterica serovar Typhi Ty2
gccugaagcgcaguguu

SEQ ID NO: 1790472 - RNA, 14 nt, Salmonella enterica enterica serovar Typhi Ty2
gccugaaccggugg

SEQ ID NO: 1790473 - RNA, 18 nt, Salmonella enterica enterica serovar Typhi Ty2
gccugaaugcacugcuga

SEQ ID NO: 1790474 - RNA, 17 nt, Salmonella enterica enterica serovar Typhi Ty2
gccugacagcaaugagc

SEQ ID NO: 1790475 - RNA, 20 nt, Salmonella enterica enterica serovar Typhi Ty2
gccugacgaaagucauccag

SEQ ID NO: 1790476 - RNA, 22 nt, Salmonella enterica enterica serovar Typhi Ty2
gccucaauugccgccagcuccu

SEQ ID NO: 1790477 - RNA, 19 nt, Salmonella enterica enterica serovar Typhi Ty2
gccucuuuuuucgccacgc

SEQ ID NO: 1790478 - RNA, 19 nt, Salmonella enterica enterica serovar Typhi Ty2
gcgauaaucaacucuccuu

SEQ ID NO: 1790479 - RNA, 20 nt, Salmonella enterica enterica serovar Typhi Ty2
gcgauaaggucgcuauccag

SEQ ID NO: 1790480 - RNA, 20 nt, Salmonella enterica enterica serovar Typhi Ty2
gcgauagagaguuccuccug

SEQ ID NO: 1790481 - RNA, 20 nt, Salmonella enterica enterica serovar Typhi Ty2
gcgauaccgugacugaccaa

SEQ ID NO: 1790482 - RNA, 21 nt, Salmonella enterica enterica serovar Typhi Ty2
gcgaggugguucauaauaccu

SEQ ID NO: 1790483 - RNA, 20 nt, Salmonella enterica enterica serovar Typhi Ty2
gcgaguccgcuuuucguccc

SEQ ID NO: 1790484 - RNA, 17 nt, Salmonella enterica enterica serovar Typhi Ty2
gcgagucagacaccagc

SEQ ID NO: 1790485 - RNA, 19 nt, Salmonella enterica enterica serovar Typhi Ty2
gcgagcgcauacgcugucc

SEQ ID NO: 1790486 - RNA, 14 nt, Salmonella enterica enterica serovar Typhi Ty2
gcgagcgauagaga

SEQ ID NO: 1790487 - RNA, 13 nt, Salmonella enterica enterica serovar Typhi Ty2
gcgaggcgcgcuc

SEQ ID NO: 1790488 - RNA, 15 nt, Salmonella enterica enterica serovar Typhi Ty2
gcgagggauuuccug

SEQ ID NO: 1790489 - RNA, 20 nt, Salmonella enterica enterica serovar Typhi Ty2
gcgacgguccuggccaggcu

SEQ ID NO: 1790490 - RNA, 16 nt, Salmonella enterica enterica serovar Typhi Ty2
gcgacgguccuggcca

SEQ ID NO: 1790491 - RNA, 15 nt, Salmonella enterica enterica serovar Typhi Ty2
gcgacggaccggcag

SEQ ID NO: 1790492 - RNA, 22 nt, Salmonella enterica enterica serovar Typhi Ty2
gcgacgauaggcauacacaucu

SEQ ID NO: 1790493 - RNA, 20 nt, Salmonella enterica enterica serovar Typhi Ty2
gcgacgauaaaucgguucau

SEQ ID NO: 1790494 - RNA, 18 nt, Salmonella enterica enterica serovar Typhi Ty2
gcgacgauaaaucgguuc

SEQ ID NO: 1790495 - RNA, 17 nt, Salmonella enterica enterica serovar Typhi Ty2
gcgacgccaaaccugcc

SEQ ID NO: 1790496 - RNA, 14 nt, Salmonella enterica enterica serovar Typhi Ty2
gcgacgccgccauc

SEQ ID NO: 1790497 - RNA, 20 nt, Salmonella enterica enterica serovar Typhi Ty2
gcgacuuuccgccaccagau

SEQ ID NO: 1790498 - RNA, 18 nt, Salmonella enterica enterica serovar Typhi Ty2
gcgacuuuuuucacccag

SEQ ID NO: 1790499 - RNA, 20 nt, Salmonella enterica enterica serovar Typhi Ty2
gcgagcaaaacccggugcgg

SEQ ID NO: 1790500 - RNA, 20 nt, Salmonella enterica enterica serovar Typhi Ty2
gcgagcacuuuuuccuccug

SEQ ID NO: 1790501 - RNA, 16 nt, Salmonella enterica enterica serovar Typhi Ty2
gcgacuuggaaaguug

SEQ ID NO: 1790502 - RNA, 16 nt, Salmonella enterica enterica serovar Typhi Ty2
gcgacuucgcuuccug

SEQ ID NO: 1790503 - RNA, 20 nt, Salmonella enterica enterica serovar Typhi Ty2
gcgacucuguauuuaauacc

SEQ ID NO: 1790504 - RNA, 17 nt, Salmonella enterica enterica serovar Typhi Ty2
gcgaccgcuucgcuggc

SEQ ID NO: 1790505 - RNA, 23 nt, Salmonella enterica enterica serovar Typhi Ty2
gcgaccggcucgcuguucgccag

SEQ ID NO: 1790506 - RNA, 19 nt, Salmonella enterica enterica serovar Typhi Ty2
gcgacgacuucacccgcgg

SEQ ID NO: 1790507 - RNA, 22 nt, Salmonella enterica enterica serovar Typhi Ty2
gcgacgacuucacccgcgggcg

SEQ ID NO: 1790508 - RNA, 18 nt, Salmonella enterica enterica serovar Typhi Ty2
gcgacgacgccagccagc

SEQ ID NO: 1790509 - RNA, 14 nt, Salmonella enterica enterica serovar Typhi Ty2
gcgaccacccgcga

SEQ ID NO: 1790510 - RNA, 21 nt, Salmonella enterica enterica serovar Typhi Ty2
gcgacauuuuuguuaauauuc

SEQ ID NO: 1790511 - RNA, 16 nt, Salmonella enterica enterica serovar Typhi Ty2
gcgaccagcagcauca

SEQ ID NO: 1790512 - RNA, 15 nt, Salmonella enterica enterica serovar Typhi Ty2
gcgaccagcgcgcca

SEQ ID NO: 1790513 - RNA, 13 nt, Salmonella enterica enterica serovar Typhi Ty2
gcgaccagcgcgc

SEQ ID NO: 1790514 - RNA, 20 nt, Salmonella enterica enterica serovar Typhi Ty2
gcgaccaguucaccggcggc

SEQ ID NO: 1790515 - RNA, 23 nt, Salmonella enterica enterica serovar Typhi Ty2
gcgaauccgugcguaaaauauac

SEQ ID NO: 1790516 - RNA, 15 nt, Salmonella enterica enterica serovar Typhi Ty2
gcgaaucuaccagau

SEQ ID NO: 1790517 - RNA, 20 nt, Salmonella enterica enterica serovar Typhi Ty2
gcgaaucucgugaucgccaa

SEQ ID NO: 1790518 - RNA, 14 nt, Salmonella enterica enterica serovar Typhi Ty2
gcgaaugcgcgcca

SEQ ID NO: 1790519 - RNA, 16 nt, Salmonella enterica enterica serovar Typhi Ty2
gcgaauuuccugccag

SEQ ID NO: 1790520 - RNA, 22 nt, Salmonella enterica enterica serovar Typhi Ty2
gcgaauuuuauuaagcaggccg

SEQ ID NO: 1790521 - RNA, 15 nt, Salmonella enterica enterica serovar Typhi Ty2
gcgacaaacagcgcc

SEQ ID NO: 1790522 - RNA, 18 nt, Salmonella enterica enterica serovar Typhi Ty2
gcgaauugcgaguaaccu

SEQ ID NO: 1790523 - RNA, 23 nt, Salmonella enterica enterica serovar Typhi Ty2
gcgaauuuauaagccugagcgcg

SEQ ID NO: 1790524 - RNA, 18 nt, Salmonella enterica enterica serovar Typhi Ty2
gcgaauuucaaucgccag

SEQ ID NO: 1790525 - RNA, 15 nt, Salmonella enterica enterica serovar Typhi Ty2
gcgaauagccagaca

SEQ ID NO: 1790526 - RNA, 18 nt, Salmonella enterica enterica serovar Typhi Ty2
gcgaaucacauccgccag

SEQ ID NO: 1790527 - RNA, 23 nt, Salmonella enterica enterica serovar Typhi Ty2
gcgaaaaucgguaacaucaagua

SEQ ID NO: 1790528 - RNA, 14 nt, Salmonella enterica enterica serovar Typhi Ty2
gcgaauaccuuccc

SEQ ID NO: 1790529 - RNA, 20 nt, Salmonella enterica enterica serovar Typhi Ty2
gcgaaaccgcuacccggcac

SEQ ID NO: 1790530 - RNA, 14 nt, Salmonella enterica enterica serovar Typhi Ty2
gcgaauaaucgccg

SEQ ID NO: 1790531 - RNA, 22 nt, Salmonella enterica enterica serovar Typhi Ty2
gcgacaccagcgucgcaugggu

SEQ ID NO: 1790532 - RNA, 10 nt, Salmonella enterica enterica serovar Typhi Ty2
gcgacaagaa

SEQ ID NO: 1790533 - RNA, 21 nt, Salmonella enterica enterica serovar Typhi Ty2
gcgacagucgcagagcccagc

SEQ ID NO: 1790534 - RNA, 14 nt, Salmonella enterica enterica serovar Typhi Ty2
gcgacaucagccag

SEQ ID NO: 1790535 - RNA, 16 nt, Salmonella enterica enterica serovar Typhi Ty2
gcgacaucagccagcc

SEQ ID NO: 1790536 - RNA, 21 nt, Salmonella enterica enterica serovar Typhi Ty2
gcgacagagaaugcgccgccc

SEQ ID NO: 1790537 - RNA, 17 nt, Salmonella enterica enterica serovar Typhi Ty2
gccgccugaugcuggca

SEQ ID NO: 1790538 - RNA, 14 nt, Salmonella enterica enterica serovar Typhi Ty2
gccgccugaugcug

SEQ ID NO: 1790539 - RNA, 15 nt, Salmonella enterica enterica serovar Typhi Ty2
gccgccugcgccaac

SEQ ID NO: 1790540 - RNA, 23 nt, Salmonella enterica enterica serovar Typhi Ty2
gccgccuccggggaagcgcgcgc

SEQ ID NO: 1790541 - RNA, 20 nt, Salmonella enterica enterica serovar Typhi Ty2
gccgcgagaacuuccgccac

SEQ ID NO: 1790542 - RNA, 18 nt, Salmonella enterica enterica serovar Typhi Ty2
gccgcgccuaccagcgcu

SEQ ID NO: 1790543 - RNA, 13 nt, Salmonella enterica enterica serovar Typhi Ty2
gccgcgcgccgcc

SEQ ID NO: 1790544 - RNA, 15 nt, Salmonella enterica enterica serovar Typhi Ty2
gccgcgcgccgccuc

SEQ ID NO: 1790545 - RNA, 18 nt, Salmonella enterica enterica serovar Typhi Ty2
gccgcgcgccgccucuuc

SEQ ID NO: 1790546 - RNA, 23 nt, Salmonella enterica enterica serovar Typhi Ty2
gccgccauuuuauccaggccagc

SEQ ID NO: 1790547 - RNA, 20 nt, Salmonella enterica enterica serovar Typhi Ty2
gccgccauuuuauccaggcc

SEQ ID NO: 1790548 - RNA, 18 nt, Salmonella enterica enterica serovar Typhi Ty2
gccgcccaaccagcccag

SEQ ID NO: 1790549 - RNA, 16 nt, Salmonella enterica enterica serovar Typhi Ty2
gccgcccaggccaugc

SEQ ID NO: 1790550 - RNA, 11 nt, Salmonella enterica enterica serovar Typhi Ty2
gccgcccugcg

SEQ ID NO: 1790551 - RNA, 13 nt, Salmonella enterica enterica serovar Typhi Ty2
gccgccccccguc

SEQ ID NO: 1790552 - RNA, 16 nt, Salmonella enterica enterica serovar Typhi Ty2
gccgccgacaaccagc

SEQ ID NO: 1790553 - RNA, 17 nt, Salmonella enterica enterica serovar Typhi Ty2
aaagcuauucacaccuu

SEQ ID NO: 1790554 - RNA, 12 nt, Salmonella enterica enterica serovar Typhi Ty2
gccgccgagcgc

SEQ ID NO: 1790555 - RNA, 17 nt, Salmonella enterica enterica serovar Typhi Ty2
gccgcagcuccaugucu

SEQ ID NO: 1790556 - RNA, 18 nt, Salmonella enterica enterica serovar Typhi Ty2
gccgcaaugaccacaaau

SEQ ID NO: 1790557 - RNA, 20 nt, Salmonella enterica enterica serovar Typhi Ty2
gccgcaauaguuaauguuga

SEQ ID NO: 1790558 - RNA, 18 nt, Salmonella enterica enterica serovar Typhi Ty2
gccgcaauuccugacugc

SEQ ID NO: 1790559 - RNA, 20 nt, Salmonella enterica enterica serovar Typhi Ty2
gccgcagugaagaauggcgc

SEQ ID NO: 1790560 - RNA, 12 nt, Salmonella enterica enterica serovar Typhi Ty2
gccgcaggccau

SEQ ID NO: 1790561 - RNA, 19 nt, Salmonella enterica enterica serovar Typhi Ty2
gccgccaaacugcgcgccg

SEQ ID NO: 1790562 - RNA, 23 nt, Salmonella enterica enterica serovar Typhi Ty2
gccgccaaacugcgcgccgcccu

SEQ ID NO: 1790563 - RNA, 20 nt, Salmonella enterica enterica serovar Typhi Ty2
gccgccaaacugcgcgccgc

SEQ ID NO: 1790564 - RNA, 18 nt, Salmonella enterica enterica serovar Typhi Ty2
gccgccaacgccagcagc

SEQ ID NO: 1790565 - RNA, 14 nt, Salmonella enterica enterica serovar Typhi Ty2
gccgccaaagcgcc

SEQ ID NO: 1790566 - RNA, 17 nt, Salmonella enterica enterica serovar Typhi Ty2
gccgccaauaggggcgg

SEQ ID NO: 1790567 - RNA, 17 nt, Salmonella enterica enterica serovar Typhi Ty2
gccgccaccacaaagcg

SEQ ID NO: 1790568 - RNA, 19 nt, Salmonella enterica enterica serovar Typhi Ty2
gccgccacauugcgcgccg

SEQ ID NO: 1790569 - RNA, 12 nt, Salmonella enterica enterica serovar Typhi Ty2
gccgccagcgac

SEQ ID NO: 1790570 - RNA, 23 nt, Salmonella enterica enterica serovar Typhi Ty2
gccgccaucuuuacccugagccu

SEQ ID NO: 1790571 - RNA, 14 nt, Salmonella enterica enterica serovar Typhi Ty2
gccgccauuaauac

SEQ ID NO: 1790572 - RNA, 23 nt, Salmonella enterica enterica serovar Typhi Ty2
gccgccauucgcuuccgccggga

SEQ ID NO: 1790573 - RNA, 16 nt, Salmonella enterica enterica serovar Typhi Ty2
gccgccauuaauacca

SEQ ID NO: 1790574 - RNA, 21 nt, Salmonella enterica enterica serovar Typhi Ty2
gccgccauucgcuuccgccgg

SEQ ID NO: 1790575 - RNA, 13 nt, Salmonella enterica enterica serovar Typhi Ty2
gccgccauccggc

SEQ ID NO: 1790576 - RNA, 20 nt, Salmonella enterica enterica serovar Typhi Ty2
gccgccauccggcacaguau

SEQ ID NO: 1790577 - RNA, 20 nt, Salmonella enterica enterica serovar Typhi Ty2
gccgccaguugcucaacauu

SEQ ID NO: 1790578 - RNA, 20 nt, Salmonella enterica enterica serovar Typhi Ty2
gccgccauaacgccggcgcu

SEQ ID NO: 1790579 - RNA, 16 nt, Salmonella enterica enterica serovar Typhi Ty2
gccgacgccacccagc

SEQ ID NO: 1790580 - RNA, 15 nt, Salmonella enterica enterica serovar Typhi Ty2
gccgacgccacccag

SEQ ID NO: 1790581 - RNA, 21 nt, Salmonella enterica enterica serovar Typhi Ty2
gccgaguagcugagcgucagg

SEQ ID NO: 1790582 - RNA, 13 nt, Salmonella enterica enterica serovar Typhi Ty2
gccgauggcgcuc

SEQ ID NO: 1790583 - RNA, 16 nt, Salmonella enterica enterica serovar Typhi Ty2
gccgaucaggccgcag

SEQ ID NO: 1790584 - RNA, 17 nt, Salmonella enterica enterica serovar Typhi Ty2
gccgaucaggccgcaga

SEQ ID NO: 1790585 - RNA, 14 nt, Salmonella enterica enterica serovar Typhi Ty2
gccgaugccgccga

SEQ ID NO: 1790586 - RNA, 19 nt, Salmonella enterica enterica serovar Typhi Ty2
aaagcgucaguaaaagccc

SEQ ID NO: 1790587 - RNA, 15 nt, Salmonella enterica enterica serovar Typhi Ty2
aaagcguuucaucau

SEQ ID NO: 1790588 - RNA, 19 nt, Salmonella enterica enterica serovar Typhi Ty2
gccgacauagcugaacaau

SEQ ID NO: 1790589 - RNA, 21 nt, Salmonella enterica enterica serovar Typhi Ty2
gccgacaggcagguugccgau

SEQ ID NO: 1790590 - RNA, 18 nt, Salmonella enterica enterica serovar Typhi Ty2
gccgacaucgccaccgca

SEQ ID NO: 1790591 - RNA, 19 nt, Salmonella enterica enterica serovar Typhi Ty2
gccgacaugguuaaccacc

SEQ ID NO: 1790592 - RNA, 16 nt, Salmonella enterica enterica serovar Typhi Ty2
gccgaccaaugacgcu

SEQ ID NO: 1790593 - RNA, 23 nt, Salmonella enterica enterica serovar Typhi Ty2
gcccucuaagcgcucaaauaaug

SEQ ID NO: 1790594 - RNA, 16 nt, Salmonella enterica enterica serovar Typhi Ty2
gcccugaagggcggcu

SEQ ID NO: 1790595 - RNA, 19 nt, Salmonella enterica enterica serovar Typhi Ty2
gcccugaagggcggcugga

SEQ ID NO: 1790596 - RNA, 17 nt, Salmonella enterica enterica serovar Typhi Ty2
gcccucuuuaucaaaca

SEQ ID NO: 1790597 - RNA, 16 nt, Salmonella enterica enterica serovar Typhi Ty2
gcccugagcccacagc

SEQ ID NO: 1790598 - RNA, 21 nt, Salmonella enterica enterica serovar Typhi Ty2
gcccugcaucaugcgcagaaa

SEQ ID NO: 1790599 - RNA, 18 nt, Salmonella enterica enterica serovar Typhi Ty2
gcccuuuuccagaaaacc

SEQ ID NO: 1790600 - RNA, 16 nt, Salmonella enterica enterica serovar Typhi Ty2
gcccuuuuguuuuugc

SEQ ID NO: 1790601 - RNA, 22 nt, Salmonella enterica enterica serovar Typhi Ty2
gcccuuuuugcauucgcuccuc

SEQ ID NO: 1790602 - RNA, 11 nt, Salmonella enterica enterica serovar Typhi Ty2
gcccuuuuguu

SEQ ID NO: 1790603 - RNA, 22 nt, Salmonella enterica enterica serovar Typhi Ty2
gcccuucgucaggaggccugaa

SEQ ID NO: 1790604 - RNA, 19 nt, Salmonella enterica enterica serovar Typhi Ty2
gcccuggcucaauccaggu

SEQ ID NO: 1790605 - RNA, 17 nt, Salmonella enterica enterica serovar Typhi Ty2
gcccuggcgggaaacag

SEQ ID NO: 1790606 - RNA, 19 nt, Salmonella enterica enterica serovar Typhi Ty2
gcccuuaaauccggccucc

SEQ ID NO: 1790607 - RNA, 17 nt, Salmonella enterica enterica serovar Typhi Ty2
gcccguucucgccgcgu

SEQ ID NO: 1790608 - RNA, 19 nt, Salmonella enterica enterica serovar Typhi Ty2
gcccguuuuuuccagcgcc

SEQ ID NO: 1790609 - RNA, 17 nt, Salmonella enterica enterica serovar Typhi Ty2
gcccguugucacaggcu

SEQ ID NO: 1790610 - RNA, 14 nt, Salmonella enterica enterica serovar Typhi Ty2
gcccgugacgccag

SEQ ID NO: 1790611 - RNA, 20 nt, Salmonella enterica enterica serovar Typhi Ty2
gcccgucugggagccgcugc

SEQ ID NO: 1790612 - RNA, 21 nt, Salmonella enterica enterica serovar Typhi Ty2
gcccgucugggagccgcugcu

SEQ ID NO: 1790613 - RNA, 15 nt, Salmonella enterica enterica serovar Typhi Ty2
gcccucgcaaagcug

SEQ ID NO: 1790614 - RNA, 14 nt, Salmonella enterica enterica serovar Typhi Ty2
gcccucgccagcaa

SEQ ID NO: 1790615 - RNA, 17 nt, Salmonella enterica enterica serovar Typhi Ty2
gcccuacgcuucucucc

SEQ ID NO: 1790616 - RNA, 17 nt, Salmonella enterica enterica serovar Typhi Ty2
gcccuauaacagcgcug

SEQ ID NO: 1790617 - RNA, 18 nt, Salmonella enterica enterica serovar Typhi Ty2
gcccgguaagcgcagcgc

SEQ ID NO: 1790618 - RNA, 15 nt, Salmonella enterica enterica serovar Typhi Ty2
gcccgcccacaggcu

SEQ ID NO: 1790619 - RNA, 12 nt, Salmonella enterica enterica serovar Typhi Ty2
gcccgccagcac

SEQ ID NO: 1790620 - RNA, 14 nt, Salmonella enterica enterica serovar Typhi Ty2
gcccgccagcacca

SEQ ID NO: 1790621 - RNA, 23 nt, Salmonella enterica enterica serovar Typhi Ty2
gcccgccaccagcacagcccagu

SEQ ID NO: 1790622 - RNA, 14 nt, Salmonella enterica enterica serovar Typhi Ty2
gcccgguggcgcug

SEQ ID NO: 1790623 - RNA, 15 nt, Salmonella enterica enterica serovar Typhi Ty2
gcccggugauggugc

SEQ ID NO: 1790624 - RNA, 19 nt, Salmonella enterica enterica serovar Typhi Ty2
gcccggugauggugcagcc

SEQ ID NO: 1790625 - RNA, 23 nt, Salmonella enterica enterica serovar Typhi Ty2
gcccggugauggugcagccccgg

SEQ ID NO: 1790626 - RNA, 14 nt, Salmonella enterica enterica serovar Typhi Ty2
gcccgguauuuuuu

SEQ ID NO: 1790627 - RNA, 19 nt, Salmonella enterica enterica serovar Typhi Ty2
gcccguaaacaggcugccc

SEQ ID NO: 1790628 - RNA, 18 nt, Salmonella enterica enterica serovar Typhi Ty2
gcccguaaacaggcugcc

SEQ ID NO: 1790629 - RNA, 19 nt, Salmonella enterica enterica serovar Typhi Ty2
gcccguaaacgggcugccc

SEQ ID NO: 1790630 - RNA, 14 nt, Salmonella enterica enterica serovar Typhi Ty2
gcccguaaacaggc

SEQ ID NO: 1790631 - RNA, 17 nt, Salmonella enterica enterica serovar Typhi Ty2
gcccguagcgacgccau

SEQ ID NO: 1790632 - RNA, 15 nt, Salmonella enterica enterica serovar Typhi Ty2
gcccguaucacugau

SEQ ID NO: 1790633 - RNA, 14 nt, Salmonella enterica enterica serovar Typhi Ty2
gccaugcauaugaa

SEQ ID NO: 1790634 - RNA, 13 nt, Salmonella enterica enterica serovar Typhi Ty2
gccauggccgcag

SEQ ID NO: 1790635 - RNA, 15 nt, Salmonella enterica enterica serovar Typhi Ty2
gccauggccgcagcc

SEQ ID NO: 1790636 - RNA, 14 nt, Salmonella enterica enterica serovar Typhi Ty2
gccaucgucacgca

SEQ ID NO: 1790637 - RNA, 15 nt, Salmonella enterica enterica serovar Typhi Ty2
gccaucguccagcca

SEQ ID NO: 1790638 - RNA, 18 nt, Salmonella enterica enterica serovar Typhi Ty2
gccaugaucgccgccauc

SEQ ID NO: 1790639 - RNA, 15 nt, Salmonella enterica enterica serovar Typhi Ty2
gccauucgcuuccgc

SEQ ID NO: 1790640 - RNA, 13 nt, Salmonella enterica enterica serovar Typhi Ty2
gccauugaagucc

SEQ ID NO: 1790641 - RNA, 14 nt, Salmonella enterica enterica serovar Typhi Ty2
gccauuucugcuca

SEQ ID NO: 1790642 - RNA, 13 nt, Salmonella enterica enterica serovar Typhi Ty2
gccauuuccagcc

SEQ ID NO: 1790643 - RNA, 16 nt, Salmonella enterica enterica serovar Typhi Ty2
gccauucacgcugggu

SEQ ID NO: 1790644 - RNA, 14 nt, Salmonella enterica enterica serovar Typhi Ty2
gccauucauuaaaa

SEQ ID NO: 1790645 - RNA, 23 nt, Salmonella enterica enterica serovar Typhi Ty2
gccauucauuaaaauugaacgga

SEQ ID NO: 1790646 - RNA, 18 nt, Salmonella enterica enterica serovar Typhi Ty2
gccauuccgcuucuucca

SEQ ID NO: 1790647 - RNA, 17 nt, Salmonella enterica enterica serovar Typhi Ty2
gccauuccgcagaagcc

SEQ ID NO: 1790648 - RNA, 13 nt, Salmonella enterica enterica serovar Typhi Ty2
gccauuccaagaa

SEQ ID NO: 1790649 - RNA, 14 nt, Salmonella enterica enterica serovar Typhi Ty2
gccauuccagccgg

SEQ ID NO: 1790650 - RNA, 22 nt, Salmonella enterica enterica serovar Typhi Ty2
gccauuugcauccguagcuuca

SEQ ID NO: 1790651 - RNA, 19 nt, Salmonella enterica enterica serovar Typhi Ty2
gccauuuuauccaggccag

SEQ ID NO: 1790652 - RNA, 22 nt, Salmonella enterica enterica serovar Typhi Ty2
gcccaaaauagcguccagccgc

SEQ ID NO: 1790653 - RNA, 21 nt, Salmonella enterica enterica serovar Typhi Ty2
gccaguuguccgcuggucagc

SEQ ID NO: 1790654 - RNA, 20 nt, Salmonella enterica enterica serovar Typhi Ty2
gccaguuguccgcuggucag

SEQ ID NO: 1790655 - RNA, 12 nt, Salmonella enterica enterica serovar Typhi Ty2
gccaguuucucu

SEQ ID NO: 1790656 - RNA, 21 nt, Salmonella enterica enterica serovar Typhi Ty2
gccaguuucucgucauaguga

SEQ ID NO: 1790657 - RNA, 20 nt, Salmonella enterica enterica serovar Typhi Ty2
gccaguuuccugacccgcuc

SEQ ID NO: 1790658 - RNA, 17 nt, Salmonella enterica enterica serovar Typhi Ty2
gccaguuuagggaucau

SEQ ID NO: 1790659 - RNA, 18 nt, Salmonella enterica enterica serovar Typhi Ty2
gccauaaagcuguaccug

SEQ ID NO: 1790660 - RNA, 21 nt, Salmonella enterica enterica serovar Typhi Ty2
gccauaaaccccgauaaacca

SEQ ID NO: 1790661 - RNA, 14 nt, Salmonella enterica enterica serovar Typhi Ty2
gccaguuuuccgcc

SEQ ID NO: 1790662 - RNA, 19 nt, Salmonella enterica enterica serovar Typhi Ty2
gccauaaaaacaauaaaua

SEQ ID NO: 1790663 - RNA, 13 nt, Salmonella enterica enterica serovar Typhi Ty2
gccauagcgggca

SEQ ID NO: 1790664 - RNA, 17 nt, Salmonella enterica enterica serovar Typhi Ty2
gccauacuuacugcugu

SEQ ID NO: 1790665 - RNA, 18 nt, Salmonella enterica enterica serovar Typhi Ty2
gccauagacuuuggcgca

SEQ ID NO: 1790666 - RNA, 19 nt, Salmonella enterica enterica serovar Typhi Ty2
gccauaaucgcuuuuuccu

SEQ ID NO: 1790667 - RNA, 17 nt, Salmonella enterica enterica serovar Typhi Ty2
gccauaauggauuaggu

SEQ ID NO: 1790668 - RNA, 18 nt, Salmonella enterica enterica serovar Typhi Ty2
gccauaacaacuauuuuu

SEQ ID NO: 1790669 - RNA, 14 nt, Salmonella enterica enterica serovar Typhi Ty2
gccauaauacuuaa

SEQ ID NO: 1790670 - RNA, 23 nt, Salmonella enterica enterica serovar Typhi Ty2
gccauaaucaguacugcgcccgc

SEQ ID NO: 1790671 - RNA, 14 nt, Salmonella enterica enterica serovar Typhi Ty2
gccauacacgcggc

SEQ ID NO: 1790672 - RNA, 21 nt, Salmonella enterica enterica serovar Typhi Ty2
gccaucaugcccacaggcagg

SEQ ID NO: 1790673 - RNA, 17 nt, Salmonella enterica enterica serovar Typhi Ty2
gccaucagcaaaauacc

SEQ ID NO: 1790674 - RNA, 19 nt, Salmonella enterica enterica serovar Typhi Ty2
gccauccacggccccgggc

SEQ ID NO: 1790675 - RNA, 23 nt, Salmonella enterica enterica serovar Typhi Ty2
gccaucagacucucaaugcccau

SEQ ID NO: 1790676 - RNA, 18 nt, Salmonella enterica enterica serovar Typhi Ty2
gccauaguagaagugaag

SEQ ID NO: 1790677 - RNA, 14 nt, Salmonella enterica enterica serovar Typhi Ty2
gccaucgcggcgca

SEQ ID NO: 1790678 - RNA, 16 nt, Salmonella enterica enterica serovar Typhi Ty2
gccauccggcaauuaa

SEQ ID NO: 1790679 - RNA, 11 nt, Salmonella enterica enterica serovar Typhi Ty2
gccauccggcc

SEQ ID NO: 1790680 - RNA, 19 nt, Salmonella enterica enterica serovar Typhi Ty2
gccaucccgcugaucgccg

SEQ ID NO: 1790681 - RNA, 18 nt, Salmonella enterica enterica serovar Typhi Ty2
gccagguugcgcccggcg

SEQ ID NO: 1790682 - RNA, 23 nt, Salmonella enterica enterica serovar Typhi Ty2
gccagguuauuucgcgcaguuag

SEQ ID NO: 1790683 - RNA, 20 nt, Salmonella enterica enterica serovar Typhi Ty2
gccaggucucauagcgcccc

SEQ ID NO: 1790684 - RNA, 18 nt, Salmonella enterica enterica serovar Typhi Ty2
gccaggucucauagcgcc

SEQ ID NO: 1790685 - RNA, 17 nt, Salmonella enterica enterica serovar Typhi Ty2
gccagguauacagacaa

SEQ ID NO: 1790686 - RNA, 21 nt, Salmonella enterica enterica serovar Typhi Ty2
gccagggcgggauccccugcu

SEQ ID NO: 1790687 - RNA, 22 nt, Salmonella enterica enterica serovar Typhi Ty2
gccagggcggcaaaaucuuuuu

SEQ ID NO: 1790688 - RNA, 19 nt, Salmonella enterica enterica serovar Typhi Ty2
gccaggggaugauuuucag

SEQ ID NO: 1790689 - RNA, 18 nt, Salmonella enterica enterica serovar Typhi Ty2
gccacuuccagcgcgccg

SEQ ID NO: 1790690 - RNA, 21 nt, Salmonella enterica enterica serovar Typhi Ty2
gccacuuccagcgcgccguca

SEQ ID NO: 1790691 - RNA, 16 nt, Salmonella enterica enterica serovar Typhi Ty2
gccacuuccagcgcgc

SEQ ID NO: 1790692 - RNA, 18 nt, Salmonella enterica enterica serovar Typhi Ty2
gccacuucacuggcggca

SEQ ID NO: 1790693 - RNA, 14 nt, Salmonella enterica enterica serovar Typhi Ty2
gccaggcuuccugc

SEQ ID NO: 1790694 - RNA, 18 nt, Salmonella enterica enterica serovar Typhi Ty2
gccagucuuccauuacaa

SEQ ID NO: 1790695 - RNA, 22 nt, Salmonella enterica enterica serovar Typhi Ty2
gccagucuuugcaggaggcgcg

SEQ ID NO: 1790696 - RNA, 18 nt, Salmonella enterica enterica serovar Typhi Ty2
gccagucuuugcaggagg

SEQ ID NO: 1790697 - RNA, 21 nt, Salmonella enterica enterica serovar Typhi Ty2
gccagugcgauaccggccgcc

SEQ ID NO: 1790698 - RNA, 22 nt, Salmonella enterica enterica serovar Typhi Ty2
gccagugcgauaccggccgccc

SEQ ID NO: 1790699 - RNA, 18 nt, Salmonella enterica enterica serovar Typhi Ty2
gccaguugcgcaggguau

SEQ ID NO: 1790700 - RNA, 14 nt, Salmonella enterica enterica serovar Typhi Ty2
gccaguucgccggc

SEQ ID NO: 1790701 - RNA, 16 nt, Salmonella enterica enterica serovar Typhi Ty2
gccaguucacgccgcc

SEQ ID NO: 1790702 - RNA, 19 nt, Salmonella enterica enterica serovar Typhi Ty2
gccaguucauucgccacca

SEQ ID NO: 1790703 - RNA, 19 nt, Salmonella enterica enterica serovar Typhi Ty2
gccaguucauuccgcccug

SEQ ID NO: 1790704 - RNA, 21 nt, Salmonella enterica enterica serovar Typhi Ty2
gccaguuaagcaacugauuaa

SEQ ID NO: 1790705 - RNA, 18 nt, Salmonella enterica enterica serovar Typhi Ty2
gccaguaucgcgccgcca

SEQ ID NO: 1790706 - RNA, 17 nt, Salmonella enterica enterica serovar Typhi Ty2
gccaguagcucgccgcu

SEQ ID NO: 1790707 - RNA, 22 nt, Salmonella enterica enterica serovar Typhi Ty2
gccaguagcggaauaucuuccc

SEQ ID NO: 1790708 - RNA, 17 nt, Salmonella enterica enterica serovar Typhi Ty2
gccaguaccgccgccgg

SEQ ID NO: 1790709 - RNA, 15 nt, Salmonella enterica enterica serovar Typhi Ty2
gccaguaaucggcgc

SEQ ID NO: 1790710 - RNA, 18 nt, Salmonella enterica enterica serovar Typhi Ty2
gccaguacagcacgccgg

SEQ ID NO: 1790711 - RNA, 14 nt, Salmonella enterica enterica serovar Typhi Ty2
gccaguccgcccgc

SEQ ID NO: 1790712 - RNA, 17 nt, Salmonella enterica enterica serovar Typhi Ty2
gccagucgccaggcaag

SEQ ID NO: 1790713 - RNA, 16 nt, Salmonella enterica enterica serovar Typhi Ty2
gccagucgccaggcaa

SEQ ID NO: 1790714 - RNA, 16 nt, Salmonella enterica enterica serovar Typhi Ty2
gccaguccugccacca

SEQ ID NO: 1790715 - RNA, 19 nt, Salmonella enterica enterica serovar Typhi Ty2
gccaguccugccaccagcg

SEQ ID NO: 1790716 - RNA, 18 nt, Salmonella enterica enterica serovar Typhi Ty2
gccccagauacgcacggu

SEQ ID NO: 1790717 - RNA, 13 nt, Salmonella enterica enterica serovar Typhi Ty2
gccccagacgccc

SEQ ID NO: 1790718 - RNA, 17 nt, Salmonella enterica enterica serovar Typhi Ty2
gccccacuggcccccug

SEQ ID NO: 1790719 - RNA, 14 nt, Salmonella enterica enterica serovar Typhi Ty2
gccccaccgccaga

SEQ ID NO: 1790720 - RNA, 20 nt, Salmonella enterica enterica serovar Typhi Ty2
gccccacgauacgccccugc

SEQ ID NO: 1790721 - RNA, 16 nt, Salmonella enterica enterica serovar Typhi Ty2
gcccauuuuccuccca

SEQ ID NO: 1790722 - RNA, 13 nt, Salmonella enterica enterica serovar Typhi Ty2
gccccaauaccac

SEQ ID NO: 1790723 - RNA, 13 nt, Salmonella enterica enterica serovar Typhi Ty2
gccccaacgcgcu

SEQ ID NO: 1790724 - RNA, 13 nt, Salmonella enterica enterica serovar Typhi Ty2
gcccagugcccga

SEQ ID NO: 1790725 - RNA, 22 nt, Salmonella enterica enterica serovar Typhi Ty2
gcccaggcggguagucccagga

SEQ ID NO: 1790726 - RNA, 15 nt, Salmonella enterica enterica serovar Typhi Ty2
gcccaguaccagcac

SEQ ID NO: 1790727 - RNA, 14 nt, Salmonella enterica enterica serovar Typhi Ty2
gcccaggcggcggg

SEQ ID NO: 1790728 - RNA, 22 nt, Salmonella enterica enterica serovar Typhi Ty2
gcccaggccugaugagcgcagc

SEQ ID NO: 1790729 - RNA, 21 nt, Salmonella enterica enterica serovar Typhi Ty2
gcccaugauggugaacagaau

SEQ ID NO: 1790730 - RNA, 20 nt, Salmonella enterica enterica serovar Typhi Ty2
gcccaugcaaccagugcgug

SEQ ID NO: 1790731 - RNA, 19 nt, Salmonella enterica enterica serovar Typhi Ty2
gcccaugauggugaacaga

SEQ ID NO: 1790732 - RNA, 15 nt, Salmonella enterica enterica serovar Typhi Ty2
gcccaucugacgugc

SEQ ID NO: 1790733 - RNA, 13 nt, Salmonella enterica enterica serovar Typhi Ty2
gcccagcgccgga

SEQ ID NO: 1790734 - RNA, 23 nt, Salmonella enterica enterica serovar Typhi Ty2
gcccagcgcgauacgcagcaccg

SEQ ID NO: 1790735 - RNA, 15 nt, Salmonella enterica enterica serovar Typhi Ty2
gcccagcgcgguggc

SEQ ID NO: 1790736 - RNA, 13 nt, Salmonella enterica enterica serovar Typhi Ty2
gcccagcgcggcc

SEQ ID NO: 1790737 - RNA, 15 nt, Salmonella enterica enterica serovar Typhi Ty2
gcccagcgcggccca

SEQ ID NO: 1790738 - RNA, 18 nt, Salmonella enterica enterica serovar Typhi Ty2
gcccaggccaugcgccgc

SEQ ID NO: 1790739 - RNA, 16 nt, Salmonella enterica enterica serovar Typhi Ty2
gcccagccugccugcc

SEQ ID NO: 1790740 - RNA, 14 nt, Salmonella enterica enterica serovar Typhi Ty2
gcccagcgccgaga

SEQ ID NO: 1790741 - RNA, 20 nt, Salmonella enterica enterica serovar Typhi Ty2
gcccagcacuaacagcagca

SEQ ID NO: 1790742 - RNA, 21 nt, Salmonella enterica enterica serovar Typhi Ty2
gcccagcacggcaagcgcggc

SEQ ID NO: 1790743 - RNA, 10 nt, Salmonella enterica enterica serovar Typhi Ty2
gcccagcagc

SEQ ID NO: 1790744 - RNA, 22 nt, Salmonella enterica enterica serovar Typhi Ty2
gcccagauaacgcaucagacug

SEQ ID NO: 1790745 - RNA, 15 nt, Salmonella enterica enterica serovar Typhi Ty2
gcccaagcugacgga

SEQ ID NO: 1790746 - RNA, 17 nt, Salmonella enterica enterica serovar Typhi Ty2
gcccccauacgcgcgcc

SEQ ID NO: 1790747 - RNA, 23 nt, Salmonella enterica enterica serovar Typhi Ty2
gccccaggcuauccagcucaccg

SEQ ID NO: 1790748 - RNA, 19 nt, Salmonella enterica enterica serovar Typhi Ty2
gccccagcaccaacgccgc

SEQ ID NO: 1790749 - RNA, 11 nt, Salmonella enterica enterica serovar Typhi Ty2
gccccagcccu

SEQ ID NO: 1790750 - RNA, 17 nt, Salmonella enterica enterica serovar Typhi Ty2
gccccagcgccagccgc

SEQ ID NO: 1790751 - RNA, 12 nt, Salmonella enterica enterica serovar Typhi Ty2
gccccagcgcca

SEQ ID NO: 1790752 - RNA, 11 nt, Salmonella enterica enterica serovar Typhi Ty2
gccccagcgcc

SEQ ID NO: 1790753 - RNA, 14 nt, Salmonella enterica enterica serovar Typhi Ty2
gccccagcgccagc

SEQ ID NO: 1790754 - RNA, 15 nt, Salmonella enterica enterica serovar Typhi Ty2
gcccccaugccgccu

SEQ ID NO: 1790755 - RNA, 19 nt, Salmonella enterica enterica serovar Typhi Ty2
gcccccaugccgccugccg

SEQ ID NO: 1790756 - RNA, 15 nt, Salmonella enterica enterica serovar Typhi Ty2
gccccccgcacagca

SEQ ID NO: 1790757 - RNA, 22 nt, Salmonella enterica enterica serovar Typhi Ty2
gccccccgguagccacacccau

SEQ ID NO: 1790758 - RNA, 19 nt, Salmonella enterica enterica serovar Typhi Ty2
gcccccgauucaaucuggu

SEQ ID NO: 1790759 - RNA, 17 nt, Salmonella enterica enterica serovar Typhi Ty2
gccccgacaaaacgggc

SEQ ID NO: 1790760 - RNA, 22 nt, Salmonella enterica enterica serovar Typhi Ty2
gcccgcaaaggaccaacaccag

SEQ ID NO: 1790761 - RNA, 18 nt, Salmonella enterica enterica serovar Typhi Ty2
gcccgaccacgcccagcu

SEQ ID NO: 1790762 - RNA, 20 nt, Salmonella enterica enterica serovar Typhi Ty2
gcccgauggcgcugcgcgca

SEQ ID NO: 1790763 - RNA, 16 nt, Salmonella enterica enterica serovar Typhi Ty2
gccccuaaggcagcaa

SEQ ID NO: 1790764 - RNA, 19 nt, Salmonella enterica enterica serovar Typhi Ty2
gccccugaaauaacagacu

SEQ ID NO: 1790765 - RNA, 18 nt, Salmonella enterica enterica serovar Typhi Ty2
gccccucuugcagcaaga

SEQ ID NO: 1790766 - RNA, 23 nt, Salmonella enterica enterica serovar Typhi Ty2
gccccugcuggcgaaccaccagc

SEQ ID NO: 1790767 - RNA, 21 nt, Salmonella enterica enterica serovar Typhi Ty2
gccccugagcaaucaguucuc

SEQ ID NO: 1790768 - RNA, 23 nt, Salmonella enterica enterica serovar Typhi Ty2
gcccgacaggguuugccagcacc

SEQ ID NO: 1790769 - RNA, 13 nt, Salmonella enterica enterica serovar Typhi Ty2
gccaccgccagcc

SEQ ID NO: 1790770 - RNA, 15 nt, Salmonella enterica enterica serovar Typhi Ty2
gccaccgcccagaga

SEQ ID NO: 1790771 - RNA, 16 nt, Salmonella enterica enterica serovar Typhi Ty2
gccaccgcauuuucag

SEQ ID NO: 1790772 - RNA, 17 nt, Salmonella enterica enterica serovar Typhi Ty2
gccaccggcacauccag

SEQ ID NO: 1790773 - RNA, 15 nt, Salmonella enterica enterica serovar Typhi Ty2
gccaccgggcauggc

SEQ ID NO: 1790774 - RNA, 21 nt, Salmonella enterica enterica serovar Typhi Ty2
gccaccggguuaaagcccuga

SEQ ID NO: 1790775 - RNA, 22 nt, Salmonella enterica enterica serovar Typhi Ty2
gccaccgguauuaaagcgcggg

SEQ ID NO: 1790776 - RNA, 20 nt, Salmonella enterica enterica serovar Typhi Ty2
gccaccuguuucgccaggcc

SEQ ID NO: 1790777 - RNA, 13 nt, Salmonella enterica enterica serovar Typhi Ty2
gccacccggcuuu

SEQ ID NO: 1790778 - RNA, 14 nt, Salmonella enterica enterica serovar Typhi Ty2
gccacccgacaagg

SEQ ID NO: 1790779 - RNA, 17 nt, Salmonella enterica enterica serovar Typhi Ty2
gccacccacuucgccgg

SEQ ID NO: 1790780 - RNA, 21 nt, Salmonella enterica enterica serovar Typhi Ty2
gccaccaugauuaccugaagc

SEQ ID NO: 1790781 - RNA, 20 nt, Salmonella enterica enterica serovar Typhi Ty2
gccacagcgguauaucugua

SEQ ID NO: 1790782 - RNA, 16 nt, Salmonella enterica enterica serovar Typhi Ty2
gccacacucucuccag

SEQ ID NO: 1790783 - RNA, 22 nt, Salmonella enterica enterica serovar Typhi Ty2
gccacuauuucggcacugacuc

SEQ ID NO: 1790784 - RNA, 15 nt, Salmonella enterica enterica serovar Typhi Ty2
gccacuccuuacggu

SEQ ID NO: 1790785 - RNA, 16 nt, Salmonella enterica enterica serovar Typhi Ty2
gccacguuuuccugcg

SEQ ID NO: 1790786 - RNA, 12 nt, Salmonella enterica enterica serovar Typhi Ty2
gccacucuccag

SEQ ID NO: 1790787 - RNA, 18 nt, Salmonella enterica enterica serovar Typhi Ty2
gccacucuggcgacgcca

SEQ ID NO: 1790788 - RNA, 19 nt, Salmonella enterica enterica serovar Typhi Ty2
gccacucuggcgacgccaa

SEQ ID NO: 1790789 - RNA, 15 nt, Salmonella enterica enterica serovar Typhi Ty2
gccacugcuggccca

SEQ ID NO: 1790790 - RNA, 13 nt, Salmonella enterica enterica serovar Typhi Ty2
gccacugcgccau

SEQ ID NO: 1790791 - RNA, 15 nt, Salmonella enterica enterica serovar Typhi Ty2
gccacgguuggccca

SEQ ID NO: 1790792 - RNA, 17 nt, Salmonella enterica enterica serovar Typhi Ty2
gccacgguuggcccagc

SEQ ID NO: 1790793 - RNA, 24 nt, Salmonella enterica enterica serovar Typhi Ty2
gccacggcuuucacgccauuggca

SEQ ID NO: 1790794 - RNA, 19 nt, Salmonella enterica enterica serovar Typhi Ty2
gccaagcggcaucucgcca

SEQ ID NO: 1790795 - RNA, 17 nt, Salmonella enterica enterica serovar Typhi Ty2
gccaagcgcggacagca

SEQ ID NO: 1790796 - RNA, 16 nt, Salmonella enterica enterica serovar Typhi Ty2
gccaagcugcagaauc

SEQ ID NO: 1790797 - RNA, 17 nt, Salmonella enterica enterica serovar Typhi Ty2
gccaaucaacgccgcca

SEQ ID NO: 1790798 - RNA, 18 nt, Salmonella enterica enterica serovar Typhi Ty2
gccaauauugacguuaaa

SEQ ID NO: 1790799 - RNA, 13 nt, Salmonella enterica enterica serovar Typhi Ty2
gccaaucacugcg

SEQ ID NO: 1790800 - RNA, 24 nt, Salmonella enterica enterica serovar Typhi Ty2
gccaauacgggagagcguauccag

SEQ ID NO: 1790801 - RNA, 17 nt, Salmonella enterica enterica serovar Typhi Ty2
gccaauaauuuuagaaa

SEQ ID NO: 1790802 - RNA, 17 nt, Salmonella enterica enterica serovar Typhi Ty2
gccaauaacgccuggug

SEQ ID NO: 1790803 - RNA, 18 nt, Salmonella enterica enterica serovar Typhi Ty2
gccaauaaucaaaugauu

SEQ ID NO: 1790804 - RNA, 14 nt, Salmonella enterica enterica serovar Typhi Ty2
gccacaacagaagc

SEQ ID NO: 1790805 - RNA, 18 nt, Salmonella enterica enterica serovar Typhi Ty2
gccacaacagaagcggcc

SEQ ID NO: 1790806 - RNA, 15 nt, Salmonella enterica enterica serovar Typhi Ty2
gccaauuccgccaua

SEQ ID NO: 1790807 - RNA, 18 nt, Salmonella enterica enterica serovar Typhi Ty2
gccaaugccggacgccac

SEQ ID NO: 1790808 - RNA, 19 nt, Salmonella enterica enterica serovar Typhi Ty2
gccaaugccggacgccacc

SEQ ID NO: 1790809 - RNA, 20 nt, Salmonella enterica enterica serovar Typhi Ty2
gccaaugcgaaaauacuccc

SEQ ID NO: 1790810 - RNA, 12 nt, Salmonella enterica enterica serovar Typhi Ty2
gccaauccugca

SEQ ID NO: 1790811 - RNA, 14 nt, Salmonella enterica enterica serovar Typhi Ty2
gccaaucgccgccg

SEQ ID NO: 1790812 - RNA, 15 nt, Salmonella enterica enterica serovar Typhi Ty2
gccaaugaaauaauu

SEQ ID NO: 1790813 - RNA, 20 nt, Salmonella enterica enterica serovar Typhi Ty2
gccaagaccgccuaacagcg

SEQ ID NO: 1790814 - RNA, 19 nt, Salmonella enterica enterica serovar Typhi Ty2
gccaagaccgccuaacagc

SEQ ID NO: 1790815 - RNA, 17 nt, Salmonella enterica enterica serovar Typhi Ty2
gccaagcagcgccacgc

SEQ ID NO: 1790816 - RNA, 15 nt, Salmonella enterica enterica serovar Typhi Ty2
gccaagcaacacggc

SEQ ID NO: 1790817 - RNA, 17 nt, Salmonella enterica enterica serovar Typhi Ty2
gccaacguccgccguca

SEQ ID NO: 1790818 - RNA, 16 nt, Salmonella enterica enterica serovar Typhi Ty2
gccaacgauacagcac

SEQ ID NO: 1790819 - RNA, 18 nt, Salmonella enterica enterica serovar Typhi Ty2
gccaacgagaauaagacc

SEQ ID NO: 1790820 - RNA, 21 nt, Salmonella enterica enterica serovar Typhi Ty2
gccaacgauacagcacggcag

SEQ ID NO: 1790821 - RNA, 19 nt, Salmonella enterica enterica serovar Typhi Ty2
gccaaccgugagcgcgccg

SEQ ID NO: 1790822 - RNA, 22 nt, Salmonella enterica enterica serovar Typhi Ty2
gccaacgaccggcgcagcgccc

SEQ ID NO: 1790823 - RNA, 21 nt, Salmonella enterica enterica serovar Typhi Ty2
gccaaccagcgcuuugcggcu

SEQ ID NO: 1790824 - RNA, 13 nt, Salmonella enterica enterica serovar Typhi Ty2
gccaaccagaccg

SEQ ID NO: 1790825 - RNA, 19 nt, Salmonella enterica enterica serovar Typhi Ty2
gccaacauagccacaggcu

SEQ ID NO: 1790826 - RNA, 17 nt, Salmonella enterica enterica serovar Typhi Ty2
gccaaaccugccacagg

SEQ ID NO: 1790827 - RNA, 20 nt, Salmonella enterica enterica serovar Typhi Ty2
gccaacaacaggccgccgag

SEQ ID NO: 1790828 - RNA, 21 nt, Salmonella enterica enterica serovar Typhi Ty2
gccaaauuuucaaccacggau

SEQ ID NO: 1790829 - RNA, 17 nt, Salmonella enterica enterica serovar Typhi Ty2
gccaaaagaggcagcaa

SEQ ID NO: 1790830 - RNA, 22 nt, Salmonella enterica enterica serovar Typhi Ty2
gccaaaacccaccagcagggca

SEQ ID NO: 1790831 - RNA, 18 nt, Salmonella enterica enterica serovar Typhi Ty2
gccaaaacggucgguaau

SEQ ID NO: 1790832 - RNA, 18 nt, Salmonella enterica enterica serovar Typhi Ty2
gcaucaaugcccagcgca

SEQ ID NO: 1790833 - RNA, 18 nt, Salmonella enterica enterica serovar Typhi Ty2
gcaucacaucaaagcccc

SEQ ID NO: 1790834 - RNA, 15 nt, Salmonella enterica enterica serovar Typhi Ty2
gcaucacggcagcac

SEQ ID NO: 1790835 - RNA, 17 nt, Salmonella enterica enterica serovar Typhi Ty2
gcauauagugcgugaca

SEQ ID NO: 1790836 - RNA, 22 nt, Salmonella enterica enterica serovar Typhi Ty2
gcaguagcgcuuugacaucggg

SEQ ID NO: 1790837 - RNA, 12 nt, Salmonella enterica enterica serovar Typhi Ty2
gcaguagccaug

SEQ ID NO: 1790838 - RNA, 21 nt, Salmonella enterica enterica serovar Typhi Ty2
gcaguagccacgguaacagcu

SEQ ID NO: 1790839 - RNA, 15 nt, Salmonella enterica enterica serovar Typhi Ty2
gcauacagcuuuuac

SEQ ID NO: 1790840 - RNA, 23 nt, Salmonella enterica enterica serovar Typhi Ty2
gcauacauucuguuuucgagccu

SEQ ID NO: 1790841 - RNA, 22 nt, Salmonella enterica enterica serovar Typhi Ty2
gcauacacgccgggcacgcuga

SEQ ID NO: 1790842 - RNA, 18 nt, Salmonella enterica enterica serovar Typhi Ty2
gcauacacaucuucuaca

SEQ ID NO: 1790843 - RNA, 18 nt, Salmonella enterica enterica serovar Typhi Ty2
gcauacucuuggagagca

SEQ ID NO: 1790844 - RNA, 21 nt, Salmonella enterica enterica serovar Typhi Ty2
gcauacucauuaccggcugcc

SEQ ID NO: 1790845 - RNA, 14 nt, Salmonella enterica enterica serovar Typhi Ty2
gcauacgccccggu

SEQ ID NO: 1790846 - RNA, 18 nt, Salmonella enterica enterica serovar Typhi Ty2
gcauaccaaguuuggcaa

SEQ ID NO: 1790847 - RNA, 13 nt, Salmonella enterica enterica serovar Typhi Ty2
gcauaccuucaca

SEQ ID NO: 1790848 - RNA, 13 nt, Salmonella enterica enterica serovar Typhi Ty2
gcauaccgcccaa

SEQ ID NO: 1790849 - RNA, 17 nt, Salmonella enterica enterica serovar Typhi Ty2
gcauaccgcccagaacg

SEQ ID NO: 1790850 - RNA, 14 nt, Salmonella enterica enterica serovar Typhi Ty2
gcauccccugcagg

SEQ ID NO: 1790851 - RNA, 18 nt, Salmonella enterica enterica serovar Typhi Ty2
gcauccgcaagacacgcu

SEQ ID NO: 1790852 - RNA, 16 nt, Salmonella enterica enterica serovar Typhi Ty2
gcauccggccagcgac

SEQ ID NO: 1790853 - RNA, 15 nt, Salmonella enterica enterica serovar Typhi Ty2
gcaucagacgguggc

SEQ ID NO: 1790854 - RNA, 16 nt, Salmonella enterica enterica serovar Typhi Ty2
gcaucagacuacuuuu

SEQ ID NO: 1790855 - RNA, 17 nt, Salmonella enterica enterica serovar Typhi Ty2
gcauccggcccgugcca

SEQ ID NO: 1790856 - RNA, 15 nt, Salmonella enterica enterica serovar Typhi Ty2
gcaucgccgcccagu

SEQ ID NO: 1790857 - RNA, 19 nt, Salmonella enterica enterica serovar Typhi Ty2
gcaucgccgcggcgcuggc

SEQ ID NO: 1790858 - RNA, 22 nt, Salmonella enterica enterica serovar Typhi Ty2
gcaucgccgguagcuucagcgg

SEQ ID NO: 1790859 - RNA, 23 nt, Salmonella enterica enterica serovar Typhi Ty2
gcaucgcguuauugaccaucgcc

SEQ ID NO: 1790860 - RNA, 15 nt, Salmonella enterica enterica serovar Typhi Ty2
gcaucgcuccccaac

SEQ ID NO: 1790861 - RNA, 21 nt, Salmonella enterica enterica serovar Typhi Ty2
gcaucgcugcgcuuacacacc

SEQ ID NO: 1790862 - RNA, 13 nt, Salmonella enterica enterica serovar Typhi Ty2
gcaucggcaucaa

SEQ ID NO: 1790863 - RNA, 20 nt, Salmonella enterica enterica serovar Typhi Ty2
gcauucuuugcuuuguaaag

SEQ ID NO: 1790864 - RNA, 23 nt, Salmonella enterica enterica serovar Typhi Ty2
gcauucuuugcuuuguaaagcgc

SEQ ID NO: 1790865 - RNA, 18 nt, Salmonella enterica enterica serovar Typhi Ty2
gcauugggauggauaaau

SEQ ID NO: 1790866 - RNA, 17 nt, Salmonella enterica enterica serovar Typhi Ty2
gcauugggauggauaaa

SEQ ID NO: 1790867 - RNA, 15 nt, Salmonella enterica enterica serovar Typhi Ty2
gcauuuuuucuucag

SEQ ID NO: 1790868 - RNA, 13 nt, Salmonella enterica enterica serovar Typhi Ty2
gccaaaaccacag

SEQ ID NO: 1790869 - RNA, 15 nt, Salmonella enterica enterica serovar Typhi Ty2
gccaaaaaaucgcug

SEQ ID NO: 1790870 - RNA, 16 nt, Salmonella enterica enterica serovar Typhi Ty2
gcauuuuggccgggau

SEQ ID NO: 1790871 - RNA, 19 nt, Salmonella enterica enterica serovar Typhi Ty2
gcauuguuaauccagagcg

SEQ ID NO: 1790872 - RNA, 15 nt, Salmonella enterica enterica serovar Typhi Ty2
gcauuaacaaaucau

SEQ ID NO: 1790873 - RNA, 19 nt, Salmonella enterica enterica serovar Typhi Ty2
gcauuagcaugggcuaaag

SEQ ID NO: 1790874 - RNA, 18 nt, Salmonella enterica enterica serovar Typhi Ty2
gcaugucguauccccagu

SEQ ID NO: 1790875 - RNA, 17 nt, Salmonella enterica enterica serovar Typhi Ty2
gcauguuaugaauaguu

SEQ ID NO: 1790876 - RNA, 18 nt, Salmonella enterica enterica serovar Typhi Ty2
gcauuaugggcgugcuga

SEQ ID NO: 1790877 - RNA, 14 nt, Salmonella enterica enterica serovar Typhi Ty2
gcauuaggcuuuuc

SEQ ID NO: 1790878 - RNA, 11 nt, Salmonella enterica enterica serovar Typhi Ty2
gcauuauaaau

SEQ ID NO: 1790879 - RNA, 17 nt, Salmonella enterica enterica serovar Typhi Ty2
gcauuagcgccaccgag

SEQ ID NO: 1790880 - RNA, 14 nt, Salmonella enterica enterica serovar Typhi Ty2
gcauucagccagcu

SEQ ID NO: 1790881 - RNA, 12 nt, Salmonella enterica enterica serovar Typhi Ty2
gcauucacgcca

SEQ ID NO: 1790882 - RNA, 14 nt, Salmonella enterica enterica serovar Typhi Ty2
gcauucacgccacc

SEQ ID NO: 1790883 - RNA, 17 nt, Salmonella enterica enterica serovar Typhi Ty2
gcauucucgccgugacu

SEQ ID NO: 1790884 - RNA, 13 nt, Salmonella enterica enterica serovar Typhi Ty2
gcaucuuuugccg

SEQ ID NO: 1790885 - RNA, 17 nt, Salmonella enterica enterica serovar Typhi Ty2
gcaucguaagccgcauu

SEQ ID NO: 1790886 - RNA, 22 nt, Salmonella enterica enterica serovar Typhi Ty2
gcaucguacgggcaaaaucuuc

SEQ ID NO: 1790887 - RNA, 14 nt, Salmonella enterica enterica serovar Typhi Ty2
gcaucguagucagg

SEQ ID NO: 1790888 - RNA, 14 nt, Salmonella enterica enterica serovar Typhi Ty2
gcaugaccauccac

SEQ ID NO: 1790889 - RNA, 14 nt, Salmonella enterica enterica serovar Typhi Ty2
gcaugaauuucucg

SEQ ID NO: 1790890 - RNA, 13 nt, Salmonella enterica enterica serovar Typhi Ty2
gcaugaauaucaa

SEQ ID NO: 1790891 - RNA, 18 nt, Salmonella enterica enterica serovar Typhi Ty2
gcauggucagcauaauau

SEQ ID NO: 1790892 - RNA, 17 nt, Salmonella enterica enterica serovar Typhi Ty2
gcauggguaaagcccau

SEQ ID NO: 1790893 - RNA, 14 nt, Salmonella enterica enterica serovar Typhi Ty2
gcauggggagaccc

SEQ ID NO: 1790894 - RNA, 16 nt, Salmonella enterica enterica serovar Typhi Ty2
gcauggcguugcugca

SEQ ID NO: 1790895 - RNA, 21 nt, Salmonella enterica enterica serovar Typhi Ty2
gcaugggauacgccagcagac

SEQ ID NO: 1790896 - RNA, 19 nt, Salmonella enterica enterica serovar Typhi Ty2
gcaugggcagcuugccgcc

SEQ ID NO: 1790897 - RNA, 17 nt, Salmonella enterica enterica serovar Typhi Ty2
gcauggcggucagcuuu

SEQ ID NO: 1790898 - RNA, 12 nt, Salmonella enterica enterica serovar Typhi Ty2
gcaugcgcugga

SEQ ID NO: 1790899 - RNA, 22 nt, Salmonella enterica enterica serovar Typhi Ty2
gcaugccccucgacaggaguau

SEQ ID NO: 1790900 - RNA, 21 nt, Salmonella enterica enterica serovar Typhi Ty2
gcaugaucauacugccgccgu

SEQ ID NO: 1790901 - RNA, 13 nt, Salmonella enterica enterica serovar Typhi Ty2
gcaugagccagcc

SEQ ID NO: 1790902 - RNA, 14 nt, Salmonella enterica enterica serovar Typhi Ty2
gcaugagcacgcgg

SEQ ID NO: 1790903 - RNA, 16 nt, Salmonella enterica enterica serovar Typhi Ty2
gcaggugguacaucaa

SEQ ID NO: 1790904 - RNA, 12 nt, Salmonella enterica enterica serovar Typhi Ty2
gcagguggccca

SEQ ID NO: 1790905 - RNA, 18 nt, Salmonella enterica enterica serovar Typhi Ty2
gcagguugagucugcucg

SEQ ID NO: 1790906 - RNA, 17 nt, Salmonella enterica enterica serovar Typhi Ty2
gcaguacacgcaucggg

SEQ ID NO: 1790907 - RNA, 17 nt, Salmonella enterica enterica serovar Typhi Ty2
gcaggugauggcggcuu

SEQ ID NO: 1790908 - RNA, 19 nt, Salmonella enterica enterica serovar Typhi Ty2
gcaggugcggcugggcgag

SEQ ID NO: 1790909 - RNA, 14 nt, Salmonella enterica enterica serovar Typhi Ty2
gcaggucggcccga

SEQ ID NO: 1790910 - RNA, 18 nt, Salmonella enterica enterica serovar Typhi Ty2
gcaggguuugaccucauc

SEQ ID NO: 1790911 - RNA, 18 nt, Salmonella enterica enterica serovar Typhi Ty2
gcagguaguccaaauaag

SEQ ID NO: 1790912 - RNA, 22 nt, Salmonella enterica enterica serovar Typhi Ty2
gcaggcgucauagccgcgcguc

SEQ ID NO: 1790913 - RNA, 18 nt, Salmonella enterica enterica serovar Typhi Ty2
gcaggcuuugcugcugcg

SEQ ID NO: 1790914 - RNA, 18 nt, Salmonella enterica enterica serovar Typhi Ty2
gcagggacgcugcugacg

SEQ ID NO: 1790915 - RNA, 16 nt, Salmonella enterica enterica serovar Typhi Ty2
gcaggcuuugcugcug

SEQ ID NO: 1790916 - RNA, 14 nt, Salmonella enterica enterica serovar Typhi Ty2
gcagggauccugua

SEQ ID NO: 1790917 - RNA, 21 nt, Salmonella enterica enterica serovar Typhi Ty2
gcagggaucauguugagcuua

SEQ ID NO: 1790918 - RNA, 21 nt, Salmonella enterica enterica serovar Typhi Ty2
gcagggauauacaaauauccc

SEQ ID NO: 1790919 - RNA, 17 nt, Salmonella enterica enterica serovar Typhi Ty2
gcagggacuuauuaaaa

SEQ ID NO: 1790920 - RNA, 13 nt, Salmonella enterica enterica serovar Typhi Ty2
gcaggcauggcca

SEQ ID NO: 1790921 - RNA, 17 nt, Salmonella enterica enterica serovar Typhi Ty2
gcaggccaaacagcggc

SEQ ID NO: 1790922 - RNA, 19 nt, Salmonella enterica enterica serovar Typhi Ty2
gcaggcgggugcgcagccc

SEQ ID NO: 1790923 - RNA, 20 nt, Salmonella enterica enterica serovar Typhi Ty2
gcaggcgggugcgcagcccc

SEQ ID NO: 1790924 - RNA, 22 nt, Salmonella enterica enterica serovar Typhi Ty2
gcaggcgucaaaacaggucugu

SEQ ID NO: 1790925 - RNA, 23 nt, Salmonella enterica enterica serovar Typhi Ty2
gcaggcgcggcaaugccgcgcuu

SEQ ID NO: 1790926 - RNA, 21 nt, Salmonella enterica enterica serovar Typhi Ty2
gcaggcaaaacgggcggcggc

SEQ ID NO: 1790927 - RNA, 22 nt, Salmonella enterica enterica serovar Typhi Ty2
gcagcuccuuuuaauaaagaaa

SEQ ID NO: 1790928 - RNA, 15 nt, Salmonella enterica enterica serovar Typhi Ty2
gcagcgucggcuuca

SEQ ID NO: 1790929 - RNA, 19 nt, Salmonella enterica enterica serovar Typhi Ty2
gcagcgugccuucaaauau

SEQ ID NO: 1790930 - RNA, 11 nt, Salmonella enterica enterica serovar Typhi Ty2
gcagcggcggu

SEQ ID NO: 1790931 - RNA, 13 nt, Salmonella enterica enterica serovar Typhi Ty2
gcagcggcaguga

SEQ ID NO: 1790932 - RNA, 15 nt, Salmonella enterica enterica serovar Typhi Ty2
gcagcgcggcacaca

SEQ ID NO: 1790933 - RNA, 20 nt, Salmonella enterica enterica serovar Typhi Ty2
gcagcgcgcgacccagcgca

SEQ ID NO: 1790934 - RNA, 15 nt, Salmonella enterica enterica serovar Typhi Ty2
gcagcgcgauggcgu

SEQ ID NO: 1790935 - RNA, 17 nt, Salmonella enterica enterica serovar Typhi Ty2
gcagcgcgacauagagc

SEQ ID NO: 1790936 - RNA, 18 nt, Salmonella enterica enterica serovar Typhi Ty2
gcagcgccaucaggcccc

SEQ ID NO: 1790937 - RNA, 13 nt, Salmonella enterica enterica serovar Typhi Ty2
gcagcgccaucca

SEQ ID NO: 1790938 - RNA, 15 nt, Salmonella enterica enterica serovar Typhi Ty2
gcagcgccccgccgc

SEQ ID NO: 1790939 - RNA, 15 nt, Salmonella enterica enterica serovar Typhi Ty2
gcagcgccagugacg

SEQ ID NO: 1790940 - RNA, 21 nt, Salmonella enterica enterica serovar Typhi Ty2
gcagcgccaccgggcaacaca

SEQ ID NO: 1790941 - RNA, 13 nt, Salmonella enterica enterica serovar Typhi Ty2
gcagcgccgccug

SEQ ID NO: 1790942 - RNA, 17 nt, Salmonella enterica enterica serovar Typhi Ty2
gcagcgccccgccgcgc

SEQ ID NO: 1790943 - RNA, 13 nt, Salmonella enterica enterica serovar Typhi Ty2
gcagcgcccagca

SEQ ID NO: 1790944 - RNA, 19 nt, Salmonella enterica enterica serovar Typhi Ty2
gcagccgguauccagcgcg

SEQ ID NO: 1790945 - RNA, 18 nt, Salmonella enterica enterica serovar Typhi Ty2
gcagcgaaagcugccuuu

SEQ ID NO: 1790946 - RNA, 16 nt, Salmonella enterica enterica serovar Typhi Ty2
gcagcgagcaccgauc

SEQ ID NO: 1790947 - RNA, 15 nt, Salmonella enterica enterica serovar Typhi Ty2
gcagcgauagacugu

SEQ ID NO: 1790948 - RNA, 16 nt, Salmonella enterica enterica serovar Typhi Ty2
gcagcgcaccugcccc

SEQ ID NO: 1790949 - RNA, 14 nt, Salmonella enterica enterica serovar Typhi Ty2
gcagcaacccugcc

SEQ ID NO: 1790950 - RNA, 15 nt, Salmonella enterica enterica serovar Typhi Ty2
gcagcaacccugccg

SEQ ID NO: 1790951 - RNA, 12 nt, Salmonella enterica enterica serovar Typhi Ty2
gcagcaaauaau

SEQ ID NO: 1790952 - RNA, 14 nt, Salmonella enterica enterica serovar Typhi Ty2
gcagcaagaacaga

SEQ ID NO: 1790953 - RNA, 15 nt, Salmonella enterica enterica serovar Typhi Ty2
gcagcaagaacagag

SEQ ID NO: 1790954 - RNA, 16 nt, Salmonella enterica enterica serovar Typhi Ty2
gcagcaagcggcuguc

SEQ ID NO: 1790955 - RNA, 17 nt, Salmonella enterica enterica serovar Typhi Ty2
gcagcaacgucucgaca

SEQ ID NO: 1790956 - RNA, 22 nt, Salmonella enterica enterica serovar Typhi Ty2
gcagcaauaguugucagaccuu

SEQ ID NO: 1790957 - RNA, 23 nt, Salmonella enterica enterica serovar Typhi Ty2
gcagcaaucagguauuuccugcu

SEQ ID NO: 1790958 - RNA, 20 nt, Salmonella enterica enterica serovar Typhi Ty2
gcagcaaugugcgccagaau

SEQ ID NO: 1790959 - RNA, 17 nt, Salmonella enterica enterica serovar Typhi Ty2
gcagcacaugcaauuug

SEQ ID NO: 1790960 - RNA, 18 nt, Salmonella enterica enterica serovar Typhi Ty2
gcagcaccgguuuuuccg

SEQ ID NO: 1790961 - RNA, 21 nt, Salmonella enterica enterica serovar Typhi Ty2
gcagcaccucgguauguccug

SEQ ID NO: 1790962 - RNA, 15 nt, Salmonella enterica enterica serovar Typhi Ty2
gcagcaccgccgcga

SEQ ID NO: 1790963 - RNA, 18 nt, Salmonella enterica enterica serovar Typhi Ty2
gcagcaccucaauaugaa

SEQ ID NO: 1790964 - RNA, 20 nt, Salmonella enterica enterica serovar Typhi Ty2
gcagcaccucaauaugaaau

SEQ ID NO: 1790965 - RNA, 18 nt, Salmonella enterica enterica serovar Typhi Ty2
gcagcagaaucaggcaca

SEQ ID NO: 1790966 - RNA, 20 nt, Salmonella enterica enterica serovar Typhi Ty2
gcagccaacaacaggccgcc

SEQ ID NO: 1790967 - RNA, 19 nt, Salmonella enterica enterica serovar Typhi Ty2
gcagccaacaacaggccgc

SEQ ID NO: 1790968 - RNA, 16 nt, Salmonella enterica enterica serovar Typhi Ty2
gcagccaacaacaggc

SEQ ID NO: 1790969 - RNA, 14 nt, Salmonella enterica enterica serovar Typhi Ty2
gcagccaacaacag

SEQ ID NO: 1790970 - RNA, 17 nt, Salmonella enterica enterica serovar Typhi Ty2
gcagccaacgccgccau

SEQ ID NO: 1790971 - RNA, 13 nt, Salmonella enterica enterica serovar Typhi Ty2
gcagccacucccg

SEQ ID NO: 1790972 - RNA, 23 nt, Salmonella enterica enterica serovar Typhi Ty2
gcagccagaaaaagggaaaagcc

SEQ ID NO: 1790973 - RNA, 17 nt, Salmonella enterica enterica serovar Typhi Ty2
gcagccaggcaaagccc

SEQ ID NO: 1790974 - RNA, 13 nt, Salmonella enterica enterica serovar Typhi Ty2
gcagccaggccau

SEQ ID NO: 1790975 - RNA, 17 nt, Salmonella enterica enterica serovar Typhi Ty2
gcagccauagcgcgccg

SEQ ID NO: 1790976 - RNA, 15 nt, Salmonella enterica enterica serovar Typhi Ty2
gcagcaguucuucgc

SEQ ID NO: 1790977 - RNA, 18 nt, Salmonella enterica enterica serovar Typhi Ty2
gcagcaguuccccgccgc

SEQ ID NO: 1790978 - RNA, 13 nt, Salmonella enterica enterica serovar Typhi Ty2
gcagcaucgccau

SEQ ID NO: 1790979 - RNA, 15 nt, Salmonella enterica enterica serovar Typhi Ty2
gcagaaaggugaaaa

SEQ ID NO: 1790980 - RNA, 18 nt, Salmonella enterica enterica serovar Typhi Ty2
gcagaacaaacagaccgc

SEQ ID NO: 1790981 - RNA, 15 nt, Salmonella enterica enterica serovar Typhi Ty2
gcagaacggcgacgg

SEQ ID NO: 1790982 - RNA, 22 nt, Salmonella enterica enterica serovar Typhi Ty2
gcagaacaaacagaccgccaug

SEQ ID NO: 1790983 - RNA, 18 nt, Salmonella enterica enterica serovar Typhi Ty2
gcagaauuaacucaucac

SEQ ID NO: 1790984 - RNA, 19 nt, Salmonella enterica enterica serovar Typhi Ty2
gcagaauuaacucaucaca

SEQ ID NO: 1790985 - RNA, 23 nt, Salmonella enterica enterica serovar Typhi Ty2
gcagaauuaacucaucacagcca

SEQ ID NO: 1790986 - RNA, 16 nt, Salmonella enterica enterica serovar Typhi Ty2
gcagaauuuauuucug

SEQ ID NO: 1790987 - RNA, 15 nt, Salmonella enterica enterica serovar Typhi Ty2
gcagacacugccacc

SEQ ID NO: 1790988 - RNA, 18 nt, Salmonella enterica enterica serovar Typhi Ty2
gcagacaauuuccgccgc

SEQ ID NO: 1790989 - RNA, 20 nt, Salmonella enterica enterica serovar Typhi Ty2
gcagaauauuuuucucagcc

SEQ ID NO: 1790990 - RNA, 21 nt, Salmonella enterica enterica serovar Typhi Ty2
gcagaauauuuuucucagcca

SEQ ID NO: 1790991 - RNA, 18 nt, Salmonella enterica enterica serovar Typhi Ty2
gcagacuuucugacaggu

SEQ ID NO: 1790992 - RNA, 15 nt, Salmonella enterica enterica serovar Typhi Ty2
gcagacuuucugaca

SEQ ID NO: 1790993 - RNA, 21 nt, Salmonella enterica enterica serovar Typhi Ty2
gcagacugguaaccuguuccu

SEQ ID NO: 1790994 - RNA, 18 nt, Salmonella enterica enterica serovar Typhi Ty2
gcagacuuuaaccauucc

SEQ ID NO: 1790995 - RNA, 18 nt, Salmonella enterica enterica serovar Typhi Ty2
gcagacucauggacaaaa

SEQ ID NO: 1790996 - RNA, 14 nt, Salmonella enterica enterica serovar Typhi Ty2
gcagacgccugccg

SEQ ID NO: 1790997 - RNA, 17 nt, Salmonella enterica enterica serovar Typhi Ty2
gcagaccggaugauggc

SEQ ID NO: 1790998 - RNA, 19 nt, Salmonella enterica enterica serovar Typhi Ty2
gcagaccggcagccugccg

SEQ ID NO: 1790999 - RNA, 22 nt, Salmonella enterica enterica serovar Typhi Ty2
gcagacaugaccgcacagcaga

SEQ ID NO: 1791000 - RNA, 17 nt, Salmonella enterica enterica serovar Typhi Ty2
gcagaucugucgccaug

SEQ ID NO: 1791001 - RNA, 19 nt, Salmonella enterica enterica serovar Typhi Ty2
gcagaucggccuguuuuuc

SEQ ID NO: 1791002 - RNA, 15 nt, Salmonella enterica enterica serovar Typhi Ty2
gcagaucguauccag

SEQ ID NO: 1791003 - RNA, 16 nt, Salmonella enterica enterica serovar Typhi Ty2
gcagauccaucgccug

SEQ ID NO: 1791004 - RNA, 20 nt, Salmonella enterica enterica serovar Typhi Ty2
gcagauccgcgauaucaauc

SEQ ID NO: 1791005 - RNA, 23 nt, Salmonella enterica enterica serovar Typhi Ty2
gcagauccuuaacgucaaagcua

SEQ ID NO: 1791006 - RNA, 21 nt, Salmonella enterica enterica serovar Typhi Ty2
gcagaucaagcgggggcgccu

SEQ ID NO: 1791007 - RNA, 17 nt, Salmonella enterica enterica serovar Typhi Ty2
gcagaugguauaaauca

SEQ ID NO: 1791008 - RNA, 13 nt, Salmonella enterica enterica serovar Typhi Ty2
gcagauugaggcu

SEQ ID NO: 1791009 - RNA, 20 nt, Salmonella enterica enterica serovar Typhi Ty2
gcagaugaacggcaagaccu

SEQ ID NO: 1791010 - RNA, 17 nt, Salmonella enterica enterica serovar Typhi Ty2
gcagaugcucaggcaac

SEQ ID NO: 1791011 - RNA, 22 nt, Salmonella enterica enterica serovar Typhi Ty2
gcagaugcccgcagaucugucg

SEQ ID NO: 1791012 - RNA, 22 nt, Salmonella enterica enterica serovar Typhi Ty2
gcagaguaugcugcuaaagcac

SEQ ID NO: 1791013 - RNA, 20 nt, Salmonella enterica enterica serovar Typhi Ty2
gcagagcgcgcucugccuuu

SEQ ID NO: 1791014 - RNA, 14 nt, Salmonella enterica enterica serovar Typhi Ty2
gcagagccggaacc

SEQ ID NO: 1791015 - RNA, 19 nt, Salmonella enterica enterica serovar Typhi Ty2
gcagagucgcagcggcggu

SEQ ID NO: 1791016 - RNA, 14 nt, Salmonella enterica enterica serovar Typhi Ty2
gcagauaacaggca

SEQ ID NO: 1791017 - RNA, 23 nt, Salmonella enterica enterica serovar Typhi Ty2
gcagauaguucguuugcgcgagg

SEQ ID NO: 1791018 - RNA, 18 nt, Salmonella enterica enterica serovar Typhi Ty2
gcagauaaccgucggcgc

SEQ ID NO: 1791019 - RNA, 15 nt, Salmonella enterica enterica serovar Typhi Ty2
gcagauacugguaaa

SEQ ID NO: 1791020 - RNA, 13 nt, Salmonella enterica enterica serovar Typhi Ty2
gcagauaccagcc

SEQ ID NO: 1791021 - RNA, 18 nt, Salmonella enterica enterica serovar Typhi Ty2
gcacuguaacgcacuggu

SEQ ID NO: 1791022 - RNA, 12 nt, Salmonella enterica enterica serovar Typhi Ty2
gcacugcaccug

SEQ ID NO: 1791023 - RNA, 14 nt, Salmonella enterica enterica serovar Typhi Ty2
gcacugcaccuggu

SEQ ID NO: 1791024 - RNA, 15 nt, Salmonella enterica enterica serovar Typhi Ty2
gcacugcaccugguc

SEQ ID NO: 1791025 - RNA, 13 nt, Salmonella enterica enterica serovar Typhi Ty2
gcacuuuaaacca

SEQ ID NO: 1791026 - RNA, 17 nt, Salmonella enterica enterica serovar Typhi Ty2
gcacuuccucucccacu

SEQ ID NO: 1791027 - RNA, 12 nt, Salmonella enterica enterica serovar Typhi Ty2
gcagaaaaccgg

SEQ ID NO: 1791028 - RNA, 20 nt, Salmonella enterica enterica serovar Typhi Ty2
gcagaaaaagcccccaucac

SEQ ID NO: 1791029 - RNA, 16 nt, Salmonella enterica enterica serovar Typhi Ty2
gcacuuuugccaggcg

SEQ ID NO: 1791030 - RNA, 16 nt, Salmonella enterica enterica serovar Typhi Ty2
gcacuuucauugccgu

SEQ ID NO: 1791031 - RNA, 24 nt, Salmonella enterica enterica serovar Typhi Ty2
gcacuacgguccaguugcccucuu

SEQ ID NO: 1791032 - RNA, 18 nt, Salmonella enterica enterica serovar Typhi Ty2
gcacuacggcaaacacaa

SEQ ID NO: 1791033 - RNA, 14 nt, Salmonella enterica enterica serovar Typhi Ty2
gcacuaccaccuca

SEQ ID NO: 1791034 - RNA, 15 nt, Salmonella enterica enterica serovar Typhi Ty2
gcacgucgcgcucgc

SEQ ID NO: 1791035 - RNA, 20 nt, Salmonella enterica enterica serovar Typhi Ty2
gcacgucauuacgguauuua

SEQ ID NO: 1791036 - RNA, 17 nt, Salmonella enterica enterica serovar Typhi Ty2
gcacucagaaaauuauu

SEQ ID NO: 1791037 - RNA, 15 nt, Salmonella enterica enterica serovar Typhi Ty2
gcacucagaaaauua

SEQ ID NO: 1791038 - RNA, 13 nt, Salmonella enterica enterica serovar Typhi Ty2
gcacucaccucuu

SEQ ID NO: 1791039 - RNA, 18 nt, Salmonella enterica enterica serovar Typhi Ty2
gcacuccccggcuugcgg

SEQ ID NO: 1791040 - RNA, 19 nt, Salmonella enterica enterica serovar Typhi Ty2
gcacugcaauuucugcugg

SEQ ID NO: 1791041 - RNA, 14 nt, Salmonella enterica enterica serovar Typhi Ty2
gcacugacuuacag

SEQ ID NO: 1791042 - RNA, 19 nt, Salmonella enterica enterica serovar Typhi Ty2
gcacucuauucaugcauua

SEQ ID NO: 1791043 - RNA, 12 nt, Salmonella enterica enterica serovar Typhi Ty2
gcacgcugcgca

SEQ ID NO: 1791044 - RNA, 15 nt, Salmonella enterica enterica serovar Typhi Ty2
gcacgcuggcaucaa

SEQ ID NO: 1791045 - RNA, 18 nt, Salmonella enterica enterica serovar Typhi Ty2
gcacgcuggcaucaauau

SEQ ID NO: 1791046 - RNA, 13 nt, Salmonella enterica enterica serovar Typhi Ty2
gcacgcuguuucu

SEQ ID NO: 1791047 - RNA, 16 nt, Salmonella enterica enterica serovar Typhi Ty2
gcacgcgauuugcagc

SEQ ID NO: 1791048 - RNA, 22 nt, Salmonella enterica enterica serovar Typhi Ty2
gcacgcuaaagcgcuggcggcg

SEQ ID NO: 1791049 - RNA, 16 nt, Salmonella enterica enterica serovar Typhi Ty2
gcacgccugcauaaag

SEQ ID NO: 1791050 - RNA, 21 nt, Salmonella enterica enterica serovar Typhi Ty2
gcacgcgcagcaucucaucca

SEQ ID NO: 1791051 - RNA, 17 nt, Salmonella enterica enterica serovar Typhi Ty2
gcacgacacaaaagcau

SEQ ID NO: 1791052 - RNA, 13 nt, Salmonella enterica enterica serovar Typhi Ty2
gcacgaaaaauaa

SEQ ID NO: 1791053 - RNA, 14 nt, Salmonella enterica enterica serovar Typhi Ty2
gcacgaaaaauaaa

SEQ ID NO: 1791054 - RNA, 12 nt, Salmonella enterica enterica serovar Typhi Ty2
gcacgaaaaaua

SEQ ID NO: 1791055 - RNA, 13 nt, Salmonella enterica enterica serovar Typhi Ty2
gcacgaaauguag

SEQ ID NO: 1791056 - RNA, 20 nt, Salmonella enterica enterica serovar Typhi Ty2
gcaccuucaacagcucgcca

SEQ ID NO: 1791057 - RNA, 15 nt, Salmonella enterica enterica serovar Typhi Ty2
gcaccuucaacagcu

SEQ ID NO: 1791058 - RNA, 14 nt, Salmonella enterica enterica serovar Typhi Ty2
gcaccuucucuccu

SEQ ID NO: 1791059 - RNA, 20 nt, Salmonella enterica enterica serovar Typhi Ty2
gcaccuguuucugcuggccu

SEQ ID NO: 1791060 - RNA, 21 nt, Salmonella enterica enterica serovar Typhi Ty2
gcaccuuaaccgucugcucag

SEQ ID NO: 1791061 - RNA, 18 nt, Salmonella enterica enterica serovar Typhi Ty2
gcacgauauccagcaccu

SEQ ID NO: 1791062 - RNA, 21 nt, Salmonella enterica enterica serovar Typhi Ty2
gcacgaugcauaugcacagcg

SEQ ID NO: 1791063 - RNA, 14 nt, Salmonella enterica enterica serovar Typhi Ty2
gcacgccaggguaa

SEQ ID NO: 1791064 - RNA, 12 nt, Salmonella enterica enterica serovar Typhi Ty2
gcacgccagggu

SEQ ID NO: 1791065 - RNA, 15 nt, Salmonella enterica enterica serovar Typhi Ty2
gcacgccggccccgc

SEQ ID NO: 1791066 - RNA, 17 nt, Salmonella enterica enterica serovar Typhi Ty2
gcacccaucuuuaccaa

SEQ ID NO: 1791067 - RNA, 16 nt, Salmonella enterica enterica serovar Typhi Ty2
gcacccggagagaaac

SEQ ID NO: 1791068 - RNA, 15 nt, Salmonella enterica enterica serovar Typhi Ty2
gcacccggagagaaa

SEQ ID NO: 1791069 - RNA, 17 nt, Salmonella enterica enterica serovar Typhi Ty2
gcaccauguggcgcggc

SEQ ID NO: 1791070 - RNA, 18 nt, Salmonella enterica enterica serovar Typhi Ty2
gcaccauguggcgcggcc

SEQ ID NO: 1791071 - RNA, 20 nt, Salmonella enterica enterica serovar Typhi Ty2
gcaccaguucacuccuaaga

SEQ ID NO: 1791072 - RNA, 23 nt, Salmonella enterica enterica serovar Typhi Ty2
gcaccaguucacuccuaagagaa

SEQ ID NO: 1791073 - RNA, 16 nt, Salmonella enterica enterica serovar Typhi Ty2
gcaccaguucacuccu

SEQ ID NO: 1791074 - RNA, 15 nt, Salmonella enterica enterica serovar Typhi Ty2
gcaccaguuccccau

SEQ ID NO: 1791075 - RNA, 20 nt, Salmonella enterica enterica serovar Typhi Ty2
gcaccaguuccccauacuga

SEQ ID NO: 1791076 - RNA, 19 nt, Salmonella enterica enterica serovar Typhi Ty2
gcaccacgaccagacuggu

SEQ ID NO: 1791077 - RNA, 14 nt, Salmonella enterica enterica serovar Typhi Ty2
gcaccaccugguua

SEQ ID NO: 1791078 - RNA, 17 nt, Salmonella enterica enterica serovar Typhi Ty2
gcaccacgcaaaccgcu

SEQ ID NO: 1791079 - RNA, 19 nt, Salmonella enterica enterica serovar Typhi Ty2
gcaccaccaggaacgccau

SEQ ID NO: 1791080 - RNA, 15 nt, Salmonella enterica enterica serovar Typhi Ty2
gcaccaacgccgcuu

SEQ ID NO: 1791081 - RNA, 19 nt, Salmonella enterica enterica serovar Typhi Ty2
gcaccaacgauaaauuuuc

SEQ ID NO: 1791082 - RNA, 13 nt, Salmonella enterica enterica serovar Typhi Ty2
gcaccagccagga

SEQ ID NO: 1791083 - RNA, 23 nt, Salmonella enterica enterica serovar Typhi Ty2
gcaccagccaggcgaucgcacag

SEQ ID NO: 1791084 - RNA, 17 nt, Salmonella enterica enterica serovar Typhi Ty2
gcaccagcaggugguac

SEQ ID NO: 1791085 - RNA, 16 nt, Salmonella enterica enterica serovar Typhi Ty2
gcaccagcaacacauc

SEQ ID NO: 1791086 - RNA, 19 nt, Salmonella enterica enterica serovar Typhi Ty2
gcaccacuuuguuuuuguc

SEQ ID NO: 1791087 - RNA, 21 nt, Salmonella enterica enterica serovar Typhi Ty2
gcaccagaacucccuguuccu

SEQ ID NO: 1791088 - RNA, 16 nt, Salmonella enterica enterica serovar Typhi Ty2
gcaccucgcaauauuc

SEQ ID NO: 1791089 - RNA, 18 nt, Salmonella enterica enterica serovar Typhi Ty2
gcaccucaauaugaaauu

SEQ ID NO: 1791090 - RNA, 12 nt, Salmonella enterica enterica serovar Typhi Ty2
gcaccuggaagu

SEQ ID NO: 1791091 - RNA, 18 nt, Salmonella enterica enterica serovar Typhi Ty2
gcaccuggagcgccuccc

SEQ ID NO: 1791092 - RNA, 21 nt, Salmonella enterica enterica serovar Typhi Ty2
gcaccugauagugaucgccaa

SEQ ID NO: 1791093 - RNA, 19 nt, Salmonella enterica enterica serovar Typhi Ty2
gcaccguaucggcagucac

SEQ ID NO: 1791094 - RNA, 13 nt, Salmonella enterica enterica serovar Typhi Ty2
gcaccgaauguuc

SEQ ID NO: 1791095 - RNA, 18 nt, Salmonella enterica enterica serovar Typhi Ty2
gcacccuucgcuauccau

SEQ ID NO: 1791096 - RNA, 20 nt, Salmonella enterica enterica serovar Typhi Ty2
gcaccgcuaaaaaacaggcg

SEQ ID NO: 1791097 - RNA, 16 nt, Salmonella enterica enterica serovar Typhi Ty2
gcaccgccagcgccgc

SEQ ID NO: 1791098 - RNA, 20 nt, Salmonella enterica enterica serovar Typhi Ty2
gcaccgccaaacgcggucag

SEQ ID NO: 1791099 - RNA, 15 nt, Salmonella enterica enterica serovar Typhi Ty2
gcacaccauuucaca

SEQ ID NO: 1791100 - RNA, 18 nt, Salmonella enterica enterica serovar Typhi Ty2
gcacacgccaaaaucgcc

SEQ ID NO: 1791101 - RNA, 18 nt, Salmonella enterica enterica serovar Typhi Ty2
gcacacucauuuugccgu

SEQ ID NO: 1791102 - RNA, 13 nt, Salmonella enterica enterica serovar Typhi Ty2
gcacagaagcgcc

SEQ ID NO: 1791103 - RNA, 18 nt, Salmonella enterica enterica serovar Typhi Ty2
gcacaagaaacauguugu

SEQ ID NO: 1791104 - RNA, 15 nt, Salmonella enterica enterica serovar Typhi Ty2
gcacaacccaaaggc

SEQ ID NO: 1791105 - RNA, 18 nt, Salmonella enterica enterica serovar Typhi Ty2
gcacaacgaguccccuca

SEQ ID NO: 1791106 - RNA, 16 nt, Salmonella enterica enterica serovar Typhi Ty2
gcacaaaccgcgcggu

SEQ ID NO: 1791107 - RNA, 13 nt, Salmonella enterica enterica serovar Typhi Ty2
gcacaacaggggg

SEQ ID NO: 1791108 - RNA, 17 nt, Salmonella enterica enterica serovar Typhi Ty2
gcacaauaccaauaaga

SEQ ID NO: 1791109 - RNA, 22 nt, Salmonella enterica enterica serovar Typhi Ty2
gcacaauaccgagaauguguuc

SEQ ID NO: 1791110 - RNA, 14 nt, Salmonella enterica enterica serovar Typhi Ty2
gcacaauaccaaua

SEQ ID NO: 1791111 - RNA, 21 nt, Salmonella enterica enterica serovar Typhi Ty2
gcacauaggcaaacaccucag

SEQ ID NO: 1791112 - RNA, 17 nt, Salmonella enterica enterica serovar Typhi Ty2
gcacaucgccauuaaaa

SEQ ID NO: 1791113 - RNA, 18 nt, Salmonella enterica enterica serovar Typhi Ty2
gcacaucgccauuaaaag

SEQ ID NO: 1791114 - RNA, 14 nt, Salmonella enterica enterica serovar Typhi Ty2
gcacaugggcagga

SEQ ID NO: 1791115 - RNA, 14 nt, Salmonella enterica enterica serovar Typhi Ty2
gcacauucagagcg

SEQ ID NO: 1791116 - RNA, 18 nt, Salmonella enterica enterica serovar Typhi Ty2
gcacauucagguggcuga

SEQ ID NO: 1791117 - RNA, 17 nt, Salmonella enterica enterica serovar Typhi Ty2
gcacauuguugcaggga

SEQ ID NO: 1791118 - RNA, 18 nt, Salmonella enterica enterica serovar Typhi Ty2
gcacauuuacgccagcca

SEQ ID NO: 1791119 - RNA, 15 nt, Salmonella enterica enterica serovar Typhi Ty2
gcacagccaguaaga

SEQ ID NO: 1791120 - RNA, 15 nt, Salmonella enterica enterica serovar Typhi Ty2
gcacagccccagcac

SEQ ID NO: 1791121 - RNA, 19 nt, Salmonella enterica enterica serovar Typhi Ty2
gcacagccccagcaccaac

SEQ ID NO: 1791122 - RNA, 14 nt, Salmonella enterica enterica serovar Typhi Ty2
gcacagcauaccgu

SEQ ID NO: 1791123 - RNA, 20 nt, Salmonella enterica enterica serovar Typhi Ty2
gcacagcccuaccgccacca

SEQ ID NO: 1791124 - RNA, 17 nt, Salmonella enterica enterica serovar Typhi Ty2
gcacagcgcuaucaggc

SEQ ID NO: 1791125 - RNA, 19 nt, Salmonella enterica enterica serovar Typhi Ty2
gcacagcgcuaucaggcac

SEQ ID NO: 1791126 - RNA, 16 nt, Salmonella enterica enterica serovar Typhi Ty2
gcacaguauuaccgcu

SEQ ID NO: 1791127 - RNA, 14 nt, Salmonella enterica enterica serovar Typhi Ty2
gcacauaacgugcc

SEQ ID NO: 1791128 - RNA, 15 nt, Salmonella enterica enterica serovar Typhi Ty2
gcacagguacaggcc

SEQ ID NO: 1791129 - RNA, 16 nt, Salmonella enterica enterica serovar Typhi Ty2
gcacaggccuucauga

SEQ ID NO: 1791130 - RNA, 20 nt, Salmonella enterica enterica serovar Typhi Ty2
gcacaaaaaguaguuccagc

SEQ ID NO: 1791131 - RNA, 17 nt, Salmonella enterica enterica serovar Typhi Ty2
gcacaaaaaaaccgcuc

SEQ ID NO: 1791132 - RNA, 21 nt, Salmonella enterica enterica serovar Typhi Ty2
gcaauuucucgcucgcccauc

SEQ ID NO: 1791133 - RNA, 23 nt, Salmonella enterica enterica serovar Typhi Ty2
gcaauuugguuagggaucaucuu

SEQ ID NO: 1791134 - RNA, 23 nt, Salmonella enterica enterica serovar Typhi Ty2
gcaauuccgcuuucuucccggca

SEQ ID NO: 1791135 - RNA, 15 nt, Salmonella enterica enterica serovar Typhi Ty2
gcaauuccugacugc

SEQ ID NO: 1791136 - RNA, 19 nt, Salmonella enterica enterica serovar Typhi Ty2
gcaauucaaacugacugau

SEQ ID NO: 1791137 - RNA, 18 nt, Salmonella enterica enterica serovar Typhi Ty2
gcaauugguaauuaaagg

SEQ ID NO: 1791138 - RNA, 21 nt, Salmonella enterica enterica serovar Typhi Ty2
gcaauugguaauuaaaggcag

SEQ ID NO: 1791139 - RNA, 22 nt, Salmonella enterica enterica serovar Typhi Ty2
gcaauuuaucgugccggauggc

SEQ ID NO: 1791140 - RNA, 20 nt, Salmonella enterica enterica serovar Typhi Ty2
gcaauguggacaaucaggcu

SEQ ID NO: 1791141 - RNA, 18 nt, Salmonella enterica enterica serovar Typhi Ty2
gcaauguucaauaucaaa

SEQ ID NO: 1791142 - RNA, 20 nt, Salmonella enterica enterica serovar Typhi Ty2
gcaauguucaauaucaaauu

SEQ ID NO: 1791143 - RNA, 17 nt, Salmonella enterica enterica serovar Typhi Ty2
gcaaugucugccucggg

SEQ ID NO: 1791144 - RNA, 21 nt, Salmonella enterica enterica serovar Typhi Ty2
gcaauuauauugcguaaaaac

SEQ ID NO: 1791145 - RNA, 16 nt, Salmonella enterica enterica serovar Typhi Ty2
gcaauuaacaaauaaa

SEQ ID NO: 1791146 - RNA, 15 nt, Salmonella enterica enterica serovar Typhi Ty2
gcaauuaaauuagaa

SEQ ID NO: 1791147 - RNA, 23 nt, Salmonella enterica enterica serovar Typhi Ty2
gcaauuaauaaacaaugcaggua

SEQ ID NO: 1791148 - RNA, 20 nt, Salmonella enterica enterica serovar Typhi Ty2
gcaaugcgcuuuuuuugccc

SEQ ID NO: 1791149 - RNA, 18 nt, Salmonella enterica enterica serovar Typhi Ty2
gcaaugcccgguuuuuua

SEQ ID NO: 1791150 - RNA, 16 nt, Salmonella enterica enterica serovar Typhi Ty2
gcaaugcgaauaacau

SEQ ID NO: 1791151 - RNA, 12 nt, Salmonella enterica enterica serovar Typhi Ty2
gcaaucucuuua

SEQ ID NO: 1791152 - RNA, 14 nt, Salmonella enterica enterica serovar Typhi Ty2
gcaaucgagaucag

SEQ ID NO: 1791153 - RNA, 15 nt, Salmonella enterica enterica serovar Typhi Ty2
gcaaucggcuuugac

SEQ ID NO: 1791154 - RNA, 20 nt, Salmonella enterica enterica serovar Typhi Ty2
gcaaucgccugcaacgcuuu

SEQ ID NO: 1791155 - RNA, 15 nt, Salmonella enterica enterica serovar Typhi Ty2
gcaaugccccgccgc

SEQ ID NO: 1791156 - RNA, 21 nt, Salmonella enterica enterica serovar Typhi Ty2
gcaaugccauauuuaccuuuu

SEQ ID NO: 1791157 - RNA, 15 nt, Salmonella enterica enterica serovar Typhi Ty2
gcaaucuuugccgca

SEQ ID NO: 1791158 - RNA, 14 nt, Salmonella enterica enterica serovar Typhi Ty2
gcaaucaugacaga

SEQ ID NO: 1791159 - RNA, 12 nt, Salmonella enterica enterica serovar Typhi Ty2
gcaaucacuuca

SEQ ID NO: 1791160 - RNA, 18 nt, Salmonella enterica enterica serovar Typhi Ty2
gcaauauugccgcacggu

SEQ ID NO: 1791161 - RNA, 17 nt, Salmonella enterica enterica serovar Typhi Ty2
gcaauauuguuaaccag

SEQ ID NO: 1791162 - RNA, 14 nt, Salmonella enterica enterica serovar Typhi Ty2
gcaaucacacuaca

SEQ ID NO: 1791163 - RNA, 19 nt, Salmonella enterica enterica serovar Typhi Ty2
gcaagccgaacucuuccac

SEQ ID NO: 1791164 - RNA, 14 nt, Salmonella enterica enterica serovar Typhi Ty2
gcaagcgaagcgcc

SEQ ID NO: 1791165 - RNA, 17 nt, Salmonella enterica enterica serovar Typhi Ty2
gcaagcgcuaagcaaca

SEQ ID NO: 1791166 - RNA, 17 nt, Salmonella enterica enterica serovar Typhi Ty2
gcaagacgaaaaaugaa

SEQ ID NO: 1791167 - RNA, 15 nt, Salmonella enterica enterica serovar Typhi Ty2
gcaagacgaaaaaug

SEQ ID NO: 1791168 - RNA, 16 nt, Salmonella enterica enterica serovar Typhi Ty2
gcaagaggugacucac

SEQ ID NO: 1791169 - RNA, 15 nt, Salmonella enterica enterica serovar Typhi Ty2
gcaagcagcauaaug

SEQ ID NO: 1791170 - RNA, 20 nt, Salmonella enterica enterica serovar Typhi Ty2
gcaaggaacaguagaggggg

SEQ ID NO: 1791171 - RNA, 21 nt, Salmonella enterica enterica serovar Typhi Ty2
gcaaggagacgcccgucacca

SEQ ID NO: 1791172 - RNA, 22 nt, Salmonella enterica enterica serovar Typhi Ty2
gcaauaacaccggcggcgccau

SEQ ID NO: 1791173 - RNA, 19 nt, Salmonella enterica enterica serovar Typhi Ty2
gcaaguucuuguuucaucg

SEQ ID NO: 1791174 - RNA, 19 nt, Salmonella enterica enterica serovar Typhi Ty2
gcaauaaaaauaucauuaa

SEQ ID NO: 1791175 - RNA, 14 nt, Salmonella enterica enterica serovar Typhi Ty2
gcaaguauacuuau

SEQ ID NO: 1791176 - RNA, 13 nt, Salmonella enterica enterica serovar Typhi Ty2
gcaaguaugaaaa

SEQ ID NO: 1791177 - RNA, 17 nt, Salmonella enterica enterica serovar Typhi Ty2
gcaauagccaauaacgu

SEQ ID NO: 1791178 - RNA, 13 nt, Salmonella enterica enterica serovar Typhi Ty2
gcaauauccuccg

SEQ ID NO: 1791179 - RNA, 16 nt, Salmonella enterica enterica serovar Typhi Ty2
gcaauaucgaugccag

SEQ ID NO: 1791180 - RNA, 14 nt, Salmonella enterica enterica serovar Typhi Ty2
gcaauaugcggcgc

SEQ ID NO: 1791181 - RNA, 19 nt, Salmonella enterica enterica serovar Typhi Ty2
gcaauaugucuuaaacagc

SEQ ID NO: 1791182 - RNA, 20 nt, Salmonella enterica enterica serovar Typhi Ty2
gcaauauuacaaagcaguaa

SEQ ID NO: 1791183 - RNA, 19 nt, Salmonella enterica enterica serovar Typhi Ty2
gcaauauguuuaaagaaga

SEQ ID NO: 1791184 - RNA, 14 nt, Salmonella enterica enterica serovar Typhi Ty2
gcaauauugccgca

SEQ ID NO: 1791185 - RNA, 15 nt, Salmonella enterica enterica serovar Typhi Ty2
gcaauagaguaauga

SEQ ID NO: 1791186 - RNA, 22 nt, Salmonella enterica enterica serovar Typhi Ty2
gcaauagaauaggaaauaauua

SEQ ID NO: 1791187 - RNA, 14 nt, Salmonella enterica enterica serovar Typhi Ty2
gaucaauuuugcuc

SEQ ID NO: 1791188 - RNA, 17 nt, Salmonella enterica enterica serovar Typhi Ty2
gcaacgacgucuuucuu

SEQ ID NO: 1791189 - RNA, 19 nt, Salmonella enterica enterica serovar Typhi Ty2
gcaacgaucccuaauaaaa

SEQ ID NO: 1791190 - RNA, 21 nt, Salmonella enterica enterica serovar Typhi Ty2
gcaacgugaacugcgccugca

SEQ ID NO: 1791191 - RNA, 14 nt, Salmonella enterica enterica serovar Typhi Ty2
gcaacgugaacugc

SEQ ID NO: 1791192 - RNA, 12 nt, Salmonella enterica enterica serovar Typhi Ty2
gcaacgucagua

SEQ ID NO: 1791193 - RNA, 17 nt, Salmonella enterica enterica serovar Typhi Ty2
gcaacggccagcgcagg

SEQ ID NO: 1791194 - RNA, 19 nt, Salmonella enterica enterica serovar Typhi Ty2
gcaacggcgaggugcuggu

SEQ ID NO: 1791195 - RNA, 19 nt, Salmonella enterica enterica serovar Typhi Ty2
gcaacggcauuccgcuggu

SEQ ID NO: 1791196 - RNA, 16 nt, Salmonella enterica enterica serovar Typhi Ty2
gcaacgggacggcggc

SEQ ID NO: 1791197 - RNA, 16 nt, Salmonella enterica enterica serovar Typhi Ty2
gcaacgggcaaugcca

SEQ ID NO: 1791198 - RNA, 20 nt, Salmonella enterica enterica serovar Typhi Ty2
gcaacggugagaccauugca

SEQ ID NO: 1791199 - RNA, 12 nt, Salmonella enterica enterica serovar Typhi Ty2
gcaacgccgccg

SEQ ID NO: 1791200 - RNA, 13 nt, Salmonella enterica enterica serovar Typhi Ty2
gcaacgccgccga

SEQ ID NO: 1791201 - RNA, 18 nt, Salmonella enterica enterica serovar Typhi Ty2
gcaacgccguacuccagc

SEQ ID NO: 1791202 - RNA, 20 nt, Salmonella enterica enterica serovar Typhi Ty2
gcaacgcuucugagaauuug

SEQ ID NO: 1791203 - RNA, 14 nt, Salmonella enterica enterica serovar Typhi Ty2
gcaacgcgcaucaa

SEQ ID NO: 1791204 - RNA, 11 nt, Salmonella enterica enterica serovar Typhi Ty2
gcaacugcgcc

SEQ ID NO: 1791205 - RNA, 17 nt, Salmonella enterica enterica serovar Typhi Ty2
gcaacugauuaaucugc

SEQ ID NO: 1791206 - RNA, 22 nt, Salmonella enterica enterica serovar Typhi Ty2
aaagcgcgagggauuaucuuua

SEQ ID NO: 1791207 - RNA, 18 nt, Salmonella enterica enterica serovar Typhi Ty2
gcaacguuuguaacagca

SEQ ID NO: 1791208 - RNA, 15 nt, Salmonella enterica enterica serovar Typhi Ty2
gcaacguuuccgcua

SEQ ID NO: 1791209 - RNA, 21 nt, Salmonella enterica enterica serovar Typhi Ty2
gcaacguuucuuucaucagau

SEQ ID NO: 1791210 - RNA, 17 nt, Salmonella enterica enterica serovar Typhi Ty2
gcaacucacgccauucc

SEQ ID NO: 1791211 - RNA, 14 nt, Salmonella enterica enterica serovar Typhi Ty2
gcaacucgcacuga

SEQ ID NO: 1791212 - RNA, 19 nt, Salmonella enterica enterica serovar Typhi Ty2
gcaacucucccacuuugcu

SEQ ID NO: 1791213 - RNA, 21 nt, Salmonella enterica enterica serovar Typhi Ty2
gcaacuguuuuaccaaaucaa

SEQ ID NO: 1791214 - RNA, 14 nt, Salmonella enterica enterica serovar Typhi Ty2
gcaacuguuuuacc

SEQ ID NO: 1791215 - RNA, 17 nt, Salmonella enterica enterica serovar Typhi Ty2
gcaacugcugcgcgugc

SEQ ID NO: 1791216 - RNA, 15 nt, Salmonella enterica enterica serovar Typhi Ty2
gcaacuggcaauagc

SEQ ID NO: 1791217 - RNA, 23 nt, Salmonella enterica enterica serovar Typhi Ty2
aaagcgcgcugauacuuauuacg

SEQ ID NO: 1791218 - RNA, 21 nt, Salmonella enterica enterica serovar Typhi Ty2
aaagcgcgccgaaaauauaca

SEQ ID NO: 1791219 - RNA, 22 nt, Salmonella enterica enterica serovar Typhi Ty2
aaagcggcgaauauagcuaaug

SEQ ID NO: 1791220 - RNA, 15 nt, Salmonella enterica enterica serovar Typhi Ty2
aaagcggccuuuuuu

SEQ ID NO: 1791221 - RNA, 13 nt, Salmonella enterica enterica serovar Typhi Ty2
aaagcggcgaaua

SEQ ID NO: 1791222 - RNA, 20 nt, Salmonella enterica enterica serovar Typhi Ty2
gcaagaauuauuucaggaau

SEQ ID NO: 1791223 - RNA, 19 nt, Salmonella enterica enterica serovar Typhi Ty2
gcaagaaucacgccgauga

SEQ ID NO: 1791224 - RNA, 13 nt, Salmonella enterica enterica serovar Typhi Ty2
gcaagaaguuccg

SEQ ID NO: 1791225 - RNA, 17 nt, Salmonella enterica enterica serovar Typhi Ty2
gcaagaaccgcuuuucc

SEQ ID NO: 1791226 - RNA, 17 nt, Salmonella enterica enterica serovar Typhi Ty2
gcaacuucaccucaguc

SEQ ID NO: 1791227 - RNA, 19 nt, Salmonella enterica enterica serovar Typhi Ty2
gcaacuucagaauccaggu

SEQ ID NO: 1791228 - RNA, 14 nt, Salmonella enterica enterica serovar Typhi Ty2
gcaagaaacaucau

SEQ ID NO: 1791229 - RNA, 18 nt, Salmonella enterica enterica serovar Typhi Ty2
gcgcuagugccgccaggc

SEQ ID NO: 1791230 - RNA, 16 nt, Salmonella enterica enterica serovar Typhi Ty2
gcgcuaucgguaucau

SEQ ID NO: 1791231 - RNA, 17 nt, Salmonella enterica enterica serovar Typhi Ty2
gcgcuagcuggcagggg

SEQ ID NO: 1791232 - RNA, 15 nt, Salmonella enterica enterica serovar Typhi Ty2
gcgcucaauagccag

SEQ ID NO: 1791233 - RNA, 13 nt, Salmonella enterica enterica serovar Typhi Ty2
gcgcucaagcgaa

SEQ ID NO: 1791234 - RNA, 17 nt, Salmonella enterica enterica serovar Typhi Ty2
gcgcuauucccaggcaa

SEQ ID NO: 1791235 - RNA, 18 nt, Salmonella enterica enterica serovar Typhi Ty2
gcgcuauuuucaugguau

SEQ ID NO: 1791236 - RNA, 13 nt, Salmonella enterica enterica serovar Typhi Ty2
gcgcuaucuucaa

SEQ ID NO: 1791237 - RNA, 19 nt, Salmonella enterica enterica serovar Typhi Ty2
gcgcuccagaccaccagcg

SEQ ID NO: 1791238 - RNA, 16 nt, Salmonella enterica enterica serovar Typhi Ty2
gcgcucauaaccgcga

SEQ ID NO: 1791239 - RNA, 11 nt, Salmonella enterica enterica serovar Typhi Ty2
gcgcucaggca

SEQ ID NO: 1791240 - RNA, 16 nt, Salmonella enterica enterica serovar Typhi Ty2
gcgcucaggaucgccg

SEQ ID NO: 1791241 - RNA, 15 nt, Salmonella enterica enterica serovar Typhi Ty2
gcgcucacgcggcgc

SEQ ID NO: 1791242 - RNA, 14 nt, Salmonella enterica enterica serovar Typhi Ty2
gcgcguucugcucc

SEQ ID NO: 1791243 - RNA, 19 nt, Salmonella enterica enterica serovar Typhi Ty2
gcgcguuuagcgccagcag

SEQ ID NO: 1791244 - RNA, 17 nt, Salmonella enterica enterica serovar Typhi Ty2
gcgcguuccccaacagc

SEQ ID NO: 1791245 - RNA, 14 nt, Salmonella enterica enterica serovar Typhi Ty2
gcgcguucauccac

SEQ ID NO: 1791246 - RNA, 17 nt, Salmonella enterica enterica serovar Typhi Ty2
gcgcuaaaugcauagcc

SEQ ID NO: 1791247 - RNA, 17 nt, Salmonella enterica enterica serovar Typhi Ty2
gcgcguuuaaucgagcc

SEQ ID NO: 1791248 - RNA, 14 nt, Salmonella enterica enterica serovar Typhi Ty2
gcgcuaagccagcc

SEQ ID NO: 1791249 - RNA, 22 nt, Salmonella enterica enterica serovar Typhi Ty2
gcgcuaagcgcccguagcucag

SEQ ID NO: 1791250 - RNA, 13 nt, Salmonella enterica enterica serovar Typhi Ty2
gcgcgucgccuga

SEQ ID NO: 1791251 - RNA, 17 nt, Salmonella enterica enterica serovar Typhi Ty2
gcgcguccuuauaaugc

SEQ ID NO: 1791252 - RNA, 13 nt, Salmonella enterica enterica serovar Typhi Ty2
gcgcgugcggcgg

SEQ ID NO: 1791253 - RNA, 14 nt, Salmonella enterica enterica serovar Typhi Ty2
gcgcgugucgggaa

SEQ ID NO: 1791254 - RNA, 13 nt, Salmonella enterica enterica serovar Typhi Ty2
gcgcguggcaaau

SEQ ID NO: 1791255 - RNA, 15 nt, Salmonella enterica enterica serovar Typhi Ty2
gcgcggggaacacau

SEQ ID NO: 1791256 - RNA, 17 nt, Salmonella enterica enterica serovar Typhi Ty2
gcgcggcguacacuuca

SEQ ID NO: 1791257 - RNA, 19 nt, Salmonella enterica enterica serovar Typhi Ty2
gcgcggcuaccggacugcu

SEQ ID NO: 1791258 - RNA, 21 nt, Salmonella enterica enterica serovar Typhi Ty2
gcgcgggauaucgcuggucgg

SEQ ID NO: 1791259 - RNA, 18 nt, Salmonella enterica enterica serovar Typhi Ty2
gcgcggucgcuucgccuu

SEQ ID NO: 1791260 - RNA, 20 nt, Salmonella enterica enterica serovar Typhi Ty2
gcgcgguauuucgccgccgc

SEQ ID NO: 1791261 - RNA, 16 nt, Salmonella enterica enterica serovar Typhi Ty2
gcgcguccuuauaaug

SEQ ID NO: 1791262 - RNA, 17 nt, Salmonella enterica enterica serovar Typhi Ty2
gcgcguccucacacuga

SEQ ID NO: 1791263 - RNA, 16 nt, Salmonella enterica enterica serovar Typhi Ty2
gcgcguccacggcggg

SEQ ID NO: 1791264 - RNA, 22 nt, Salmonella enterica enterica serovar Typhi Ty2
gcgcgucacaauaucgagauga

SEQ ID NO: 1791265 - RNA, 15 nt, Salmonella enterica enterica serovar Typhi Ty2
gcgcguaaauaccuu

SEQ ID NO: 1791266 - RNA, 21 nt, Salmonella enterica enterica serovar Typhi Ty2
gcgauccaggucuuccgccgg

SEQ ID NO: 1791267 - RNA, 22 nt, Salmonella enterica enterica serovar Typhi Ty2
gcgauccagccccagcgccagc

SEQ ID NO: 1791268 - RNA, 22 nt, Salmonella enterica enterica serovar Typhi Ty2
gcgaucagcucuucgcucugaa

SEQ ID NO: 1791269 - RNA, 22 nt, Salmonella enterica enterica serovar Typhi Ty2
gcgauccacaaucgucgugccu

SEQ ID NO: 1791270 - RNA, 19 nt, Salmonella enterica enterica serovar Typhi Ty2
gcgcgaaucgacaauccgc

SEQ ID NO: 1791271 - RNA, 21 nt, Salmonella enterica enterica serovar Typhi Ty2
gcgcgaagaggaugaaaagua

SEQ ID NO: 1791272 - RNA, 23 nt, Salmonella enterica enterica serovar Typhi Ty2
gcgaucgacuaauuuuaggaaga

SEQ ID NO: 1791273 - RNA, 22 nt, Salmonella enterica enterica serovar Typhi Ty2
gcgcgcacaacgugcaaaacag

SEQ ID NO: 1791274 - RNA, 17 nt, Salmonella enterica enterica serovar Typhi Ty2
gcgcgcacacaauagca

SEQ ID NO: 1791275 - RNA, 15 nt, Salmonella enterica enterica serovar Typhi Ty2
gcgcgcacgcgggcc

SEQ ID NO: 1791276 - RNA, 15 nt, Salmonella enterica enterica serovar Typhi Ty2
gcgcgacaauauuca

SEQ ID NO: 1791277 - RNA, 18 nt, Salmonella enterica enterica serovar Typhi Ty2
gcgcgaauuugccccaga

SEQ ID NO: 1791278 - RNA, 17 nt, Salmonella enterica enterica serovar Typhi Ty2
gcgcgcgaaaagaaacu

SEQ ID NO: 1791279 - RNA, 13 nt, Salmonella enterica enterica serovar Typhi Ty2
gcgcgcgggcgau

SEQ ID NO: 1791280 - RNA, 20 nt, Salmonella enterica enterica serovar Typhi Ty2
gcgcgccuucgaaccgggua

SEQ ID NO: 1791281 - RNA, 13 nt, Salmonella enterica enterica serovar Typhi Ty2
gcgcgccaugaga

SEQ ID NO: 1791282 - RNA, 15 nt, Salmonella enterica enterica serovar Typhi Ty2
gcgcgccguaaacaa

SEQ ID NO: 1791283 - RNA, 23 nt, Salmonella enterica enterica serovar Typhi Ty2
gcgcgccgaaaauauacaccuga

SEQ ID NO: 1791284 - RNA, 19 nt, Salmonella enterica enterica serovar Typhi Ty2
gcgcggcccauucaacggg

SEQ ID NO: 1791285 - RNA, 14 nt, Salmonella enterica enterica serovar Typhi Ty2
gcgcggccccauca

SEQ ID NO: 1791286 - RNA, 16 nt, Salmonella enterica enterica serovar Typhi Ty2
gcgcggccccaucagc

SEQ ID NO: 1791287 - RNA, 22 nt, Salmonella enterica enterica serovar Typhi Ty2
gcgcggcggacaacgcuccagc

SEQ ID NO: 1791288 - RNA, 14 nt, Salmonella enterica enterica serovar Typhi Ty2
gcgcggaucgccau

SEQ ID NO: 1791289 - RNA, 22 nt, Salmonella enterica enterica serovar Typhi Ty2
gcgcggaacuuuaucaccagcg

SEQ ID NO: 1791290 - RNA, 12 nt, Salmonella enterica enterica serovar Typhi Ty2
gcgcgcuccaga

SEQ ID NO: 1791291 - RNA, 17 nt, Salmonella enterica enterica serovar Typhi Ty2
gcgcugaguuucucccg

SEQ ID NO: 1791292 - RNA, 14 nt, Salmonella enterica enterica serovar Typhi Ty2
gcgcugaaguccgc

SEQ ID NO: 1791293 - RNA, 19 nt, Salmonella enterica enterica serovar Typhi Ty2
gcgcuucgcuugcccggcc

SEQ ID NO: 1791294 - RNA, 12 nt, Salmonella enterica enterica serovar Typhi Ty2
gcgcuuccugca

SEQ ID NO: 1791295 - RNA, 15 nt, Salmonella enterica enterica serovar Typhi Ty2
gcgcuugcauugcuc

SEQ ID NO: 1791296 - RNA, 22 nt, Salmonella enterica enterica serovar Typhi Ty2
gcgcuugccuuuacuguugccu

SEQ ID NO: 1791297 - RNA, 16 nt, Salmonella enterica enterica serovar Typhi Ty2
gcggaauuucaggaag

SEQ ID NO: 1791298 - RNA, 14 nt, Salmonella enterica enterica serovar Typhi Ty2
gcgcuuuugccgcg

SEQ ID NO: 1791299 - RNA, 19 nt, Salmonella enterica enterica serovar Typhi Ty2
gcggaauggcgggcgcagg

SEQ ID NO: 1791300 - RNA, 20 nt, Salmonella enterica enterica serovar Typhi Ty2
gcggaaugaccugagcgugc

SEQ ID NO: 1791301 - RNA, 16 nt, Salmonella enterica enterica serovar Typhi Ty2
gcgcuuuagggcuucc

SEQ ID NO: 1791302 - RNA, 20 nt, Salmonella enterica enterica serovar Typhi Ty2
gcgcuuuuagccaguuggca

SEQ ID NO: 1791303 - RNA, 20 nt, Salmonella enterica enterica serovar Typhi Ty2
gcgcuuuggguuaaugccag

SEQ ID NO: 1791304 - RNA, 17 nt, Salmonella enterica enterica serovar Typhi Ty2
gcgcuuucaaucgucag

SEQ ID NO: 1791305 - RNA, 14 nt, Salmonella enterica enterica serovar Typhi Ty2
gcggacugggcuga

SEQ ID NO: 1791306 - RNA, 16 nt, Salmonella enterica enterica serovar Typhi Ty2
gcggacacccgcagcc

SEQ ID NO: 1791307 - RNA, 14 nt, Salmonella enterica enterica serovar Typhi Ty2
gcggacaugguaau

SEQ ID NO: 1791308 - RNA, 23 nt, Salmonella enterica enterica serovar Typhi Ty2
gcggaguaaacugugugagcgcc

SEQ ID NO: 1791309 - RNA, 18 nt, Salmonella enterica enterica serovar Typhi Ty2
gcggauaaccgacgccgg

SEQ ID NO: 1791310 - RNA, 18 nt, Salmonella enterica enterica serovar Typhi Ty2
gcggaguuauacagugcc

SEQ ID NO: 1791311 - RNA, 16 nt, Salmonella enterica enterica serovar Typhi Ty2
gcggagccucuuccug

SEQ ID NO: 1791312 - RNA, 20 nt, Salmonella enterica enterica serovar Typhi Ty2
gcggagauacccuuaugaua

SEQ ID NO: 1791313 - RNA, 17 nt, Salmonella enterica enterica serovar Typhi Ty2
gcggagaucgcucccgc

SEQ ID NO: 1791314 - RNA, 19 nt, Salmonella enterica enterica serovar Typhi Ty2
gcggauaagcccggcggag

SEQ ID NO: 1791315 - RNA, 21 nt, Salmonella enterica enterica serovar Typhi Ty2
gcggauaagauagcaggcgau

SEQ ID NO: 1791316 - RNA, 18 nt, Salmonella enterica enterica serovar Typhi Ty2
gcggauacagcggcgcgc

SEQ ID NO: 1791317 - RNA, 19 nt, Salmonella enterica enterica serovar Typhi Ty2
gcggauacagcggcgcgcc

SEQ ID NO: 1791318 - RNA, 23 nt, Salmonella enterica enterica serovar Typhi Ty2
gcggaucaaacuccgcgcuggca

SEQ ID NO: 1791319 - RNA, 22 nt, Salmonella enterica enterica serovar Typhi Ty2
gcggaucaaacuccgcgcuggc

SEQ ID NO: 1791320 - RNA, 22 nt, Salmonella enterica enterica serovar Typhi Ty2
gcggaugcgccauccaccaggc

SEQ ID NO: 1791321 - RNA, 16 nt, Salmonella enterica enterica serovar Typhi Ty2
gcggcaaugccgccgu

SEQ ID NO: 1791322 - RNA, 17 nt, Salmonella enterica enterica serovar Typhi Ty2
gcggcaauggccgcagc

SEQ ID NO: 1791323 - RNA, 20 nt, Salmonella enterica enterica serovar Typhi Ty2
gcggcacagauacgaggugg

SEQ ID NO: 1791324 - RNA, 24 nt, Salmonella enterica enterica serovar Typhi Ty2
gcggcagaauuaacucaucacagc

SEQ ID NO: 1791325 - RNA, 20 nt, Salmonella enterica enterica serovar Typhi Ty2
gcggccaugaucgccgccau

SEQ ID NO: 1791326 - RNA, 16 nt, Salmonella enterica enterica serovar Typhi Ty2
gcggccgcuccgggcc

SEQ ID NO: 1791327 - RNA, 22 nt, Salmonella enterica enterica serovar Typhi Ty2
gcggcaguacgagcauccagau

SEQ ID NO: 1791328 - RNA, 21 nt, Salmonella enterica enterica serovar Typhi Ty2
gcggcaguacgagcauccaga

SEQ ID NO: 1791329 - RNA, 18 nt, Salmonella enterica enterica serovar Typhi Ty2
gcggcagugggcuaugcu

SEQ ID NO: 1791330 - RNA, 20 nt, Salmonella enterica enterica serovar Typhi Ty2
gcggcauacuuucgcgcggc

SEQ ID NO: 1791331 - RNA, 20 nt, Salmonella enterica enterica serovar Typhi Ty2
gcggcaguucaggcucgcaa

SEQ ID NO: 1791332 - RNA, 19 nt, Salmonella enterica enterica serovar Typhi Ty2
gcggcagcgccauccggca

SEQ ID NO: 1791333 - RNA, 21 nt, Salmonella enterica enterica serovar Typhi Ty2
gcggccuuuauccagcggcgc

SEQ ID NO: 1791334 - RNA, 20 nt, Salmonella enterica enterica serovar Typhi Ty2
gcggcgaaauauuaucgcca

SEQ ID NO: 1791335 - RNA, 21 nt, Salmonella enterica enterica serovar Typhi Ty2
gcggcgaucagacgcugguug

SEQ ID NO: 1791336 - RNA, 21 nt, Salmonella enterica enterica serovar Typhi Ty2
gcggcgauuuauagagcagca

SEQ ID NO: 1791337 - RNA, 14 nt, Salmonella enterica enterica serovar Typhi Ty2
gcggcgacaccagc

SEQ ID NO: 1791338 - RNA, 15 nt, Salmonella enterica enterica serovar Typhi Ty2
gcggcgacaucgcca

SEQ ID NO: 1791339 - RNA, 18 nt, Salmonella enterica enterica serovar Typhi Ty2
gcggcgaagcaucuuucc

SEQ ID NO: 1791340 - RNA, 21 nt, Salmonella enterica enterica serovar Typhi Ty2
gcguacugcccguggcggagg

SEQ ID NO: 1791341 - RNA, 22 nt, Salmonella enterica enterica serovar Typhi Ty2
gcguaccggccacaauugccag

SEQ ID NO: 1791342 - RNA, 21 nt, Salmonella enterica enterica serovar Typhi Ty2
gcguaccgcuaucgccaaacu

SEQ ID NO: 1791343 - RNA, 15 nt, Salmonella enterica enterica serovar Typhi Ty2
gcguaccacgccgca

SEQ ID NO: 1791344 - RNA, 23 nt, Salmonella enterica enterica serovar Typhi Ty2
gcguacauugccggauggcggcg

SEQ ID NO: 1791345 - RNA, 18 nt, Salmonella enterica enterica serovar Typhi Ty2
gcguacaauggcaggcau

SEQ ID NO: 1791346 - RNA, 21 nt, Salmonella enterica enterica serovar Typhi Ty2
gcguaaugcgccaggcagcac

SEQ ID NO: 1791347 - RNA, 21 nt, Salmonella enterica enterica serovar Typhi Ty2
gcguaaugguggcaaccugac

SEQ ID NO: 1791348 - RNA, 16 nt, Salmonella enterica enterica serovar Typhi Ty2
gcguaaugagcgucgc

SEQ ID NO: 1791349 - RNA, 22 nt, Salmonella enterica enterica serovar Typhi Ty2
gcguaauaugaauauccgccgc

SEQ ID NO: 1791350 - RNA, 14 nt, Salmonella enterica enterica serovar Typhi Ty2
gcguaaagauuguu

SEQ ID NO: 1791351 - RNA, 16 nt, Salmonella enterica enterica serovar Typhi Ty2
gcguaaacaggcgcgg

SEQ ID NO: 1791352 - RNA, 20 nt, Salmonella enterica enterica serovar Typhi Ty2
gcguaaaaaguuucaguggu

SEQ ID NO: 1791353 - RNA, 14 nt, Salmonella enterica enterica serovar Typhi Ty2
gcguaaaaauuuuc

SEQ ID NO: 1791354 - RNA, 22 nt, Salmonella enterica enterica serovar Typhi Ty2
gcguaaaagcgauaaagacagg

SEQ ID NO: 1791355 - RNA, 20 nt, Salmonella enterica enterica serovar Typhi Ty2
gcgguuuauccccgcuggcg

SEQ ID NO: 1791356 - RNA, 20 nt, Salmonella enterica enterica serovar Typhi Ty2
gcgguugacgcugcuuuuuu

SEQ ID NO: 1791357 - RNA, 14 nt, Salmonella enterica enterica serovar Typhi Ty2
gcgguucucccggc

SEQ ID NO: 1791358 - RNA, 23 nt, Salmonella enterica enterica serovar Typhi Ty2
gcgguuacagucuuuggaguaga

SEQ ID NO: 1791359 - RNA, 15 nt, Salmonella enterica enterica serovar Typhi Ty2
gcgguggcgcacagu

SEQ ID NO: 1791360 - RNA, 14 nt, Salmonella enterica enterica serovar Typhi Ty2
gcggugaagcagaa

SEQ ID NO: 1791361 - RNA, 19 nt, Salmonella enterica enterica serovar Typhi Ty2
gcggucgccugccgcaugu

SEQ ID NO: 1791362 - RNA, 14 nt, Salmonella enterica enterica serovar Typhi Ty2
gcggucgccgcaug

SEQ ID NO: 1791363 - RNA, 16 nt, Salmonella enterica enterica serovar Typhi Ty2
gcggucgcugauaauc

SEQ ID NO: 1791364 - RNA, 16 nt, Salmonella enterica enterica serovar Typhi Ty2
gcggucggcaggcggu

SEQ ID NO: 1791365 - RNA, 15 nt, Salmonella enterica enterica serovar Typhi Ty2
gcggugaaacuguuu

SEQ ID NO: 1791366 - RNA, 12 nt, Salmonella enterica enterica serovar Typhi Ty2
gcggucuucacu

SEQ ID NO: 1791367 - RNA, 22 nt, Salmonella enterica enterica serovar Typhi Ty2
gcggucguauuuaccgcuggcg

SEQ ID NO: 1791368 - RNA, 23 nt, Salmonella enterica enterica serovar Typhi Ty2
gcggucgauuuugccuucaauuc

SEQ ID NO: 1791369 - RNA, 22 nt, Salmonella enterica enterica serovar Typhi Ty2
gcggggcaacagauacggcgcg

SEQ ID NO: 1791370 - RNA, 23 nt, Salmonella enterica enterica serovar Typhi Ty2
gcggguaaacucacccaggcgau

SEQ ID NO: 1791371 - RNA, 13 nt, Salmonella enterica enterica serovar Typhi Ty2
gcggguaaacaga

SEQ ID NO: 1791372 - RNA, 19 nt, Salmonella enterica enterica serovar Typhi Ty2
gcggguaaacucacccagg

SEQ ID NO: 1791373 - RNA, 12 nt, Salmonella enterica enterica serovar Typhi Ty2
gcggucaggaau

SEQ ID NO: 1791374 - RNA, 13 nt, Salmonella enterica enterica serovar Typhi Ty2
gcggucagcuuuu

SEQ ID NO: 1791375 - RNA, 14 nt, Salmonella enterica enterica serovar Typhi Ty2
gcggucagcggcgc

SEQ ID NO: 1791376 - RNA, 18 nt, Salmonella enterica enterica serovar Typhi Ty2
gcggguucccccacucuu

SEQ ID NO: 1791377 - RNA, 21 nt, Salmonella enterica enterica serovar Typhi Ty2
gcggcugguaagagagccuua

SEQ ID NO: 1791378 - RNA, 15 nt, Salmonella enterica enterica serovar Typhi Ty2
gcggcuucagcgaca

SEQ ID NO: 1791379 - RNA, 14 nt, Salmonella enterica enterica serovar Typhi Ty2
gcggcuuacccuga

SEQ ID NO: 1791380 - RNA, 16 nt, Salmonella enterica enterica serovar Typhi Ty2
gcggcuguguccgcca

SEQ ID NO: 1791381 - RNA, 20 nt, Salmonella enterica enterica serovar Typhi Ty2
gcgggauaacgcaacaacag

SEQ ID NO: 1791382 - RNA, 20 nt, Salmonella enterica enterica serovar Typhi Ty2
gcgggauaucccacucuuca

SEQ ID NO: 1791383 - RNA, 22 nt, Salmonella enterica enterica serovar Typhi Ty2
gcgggauaucgcuggucggcug

SEQ ID NO: 1791384 - RNA, 18 nt, Salmonella enterica enterica serovar Typhi Ty2
gcgggauggccgccgagc

SEQ ID NO: 1791385 - RNA, 19 nt, Salmonella enterica enterica serovar Typhi Ty2
gcgggaugcguaauccggc

SEQ ID NO: 1791386 - RNA, 23 nt, Salmonella enterica enterica serovar Typhi Ty2
gcgggcaaaagggccauggcugg

SEQ ID NO: 1791387 - RNA, 21 nt, Salmonella enterica enterica serovar Typhi Ty2
gcgggcauauucuggcgacgg

SEQ ID NO: 1791388 - RNA, 18 nt, Salmonella enterica enterica serovar Typhi Ty2
gcgggcagccuucaaguu

SEQ ID NO: 1791389 - RNA, 23 nt, Salmonella enterica enterica serovar Typhi Ty2
gcgucgggggcgacaaacagcgc

SEQ ID NO: 1791390 - RNA, 14 nt, Salmonella enterica enterica serovar Typhi Ty2
gcgucgcgcauggc

SEQ ID NO: 1791391 - RNA, 22 nt, Salmonella enterica enterica serovar Typhi Ty2
gcgucgccuguccggccuguaa

SEQ ID NO: 1791392 - RNA, 22 nt, Salmonella enterica enterica serovar Typhi Ty2
gcgucgcgcuuucaaucgucag

SEQ ID NO: 1791393 - RNA, 15 nt, Salmonella enterica enterica serovar Typhi Ty2
gcgucuggagcgugc

SEQ ID NO: 1791394 - RNA, 17 nt, Salmonella enterica enterica serovar Typhi Ty2
gcgucugcgcgcuggug

SEQ ID NO: 1791395 - RNA, 18 nt, Salmonella enterica enterica serovar Typhi Ty2
gcgucucaucaaaaaggc

SEQ ID NO: 1791396 - RNA, 16 nt, Salmonella enterica enterica serovar Typhi Ty2
gcgucucauccggcag

SEQ ID NO: 1791397 - RNA, 14 nt, Salmonella enterica enterica serovar Typhi Ty2
gcgucucagcaggc

SEQ ID NO: 1791398 - RNA, 19 nt, Salmonella enterica enterica serovar Typhi Ty2
gcgucuauagaugauaauc

SEQ ID NO: 1791399 - RNA, 15 nt, Salmonella enterica enterica serovar Typhi Ty2
gcgucucaagcuuuu

SEQ ID NO: 1791400 - RNA, 22 nt, Salmonella enterica enterica serovar Typhi Ty2
gcgucucacuuuucgggugaga

SEQ ID NO: 1791401 - RNA, 18 nt, Salmonella enterica enterica serovar Typhi Ty2
gcgucugccccaaacgcu

SEQ ID NO: 1791402 - RNA, 13 nt, Salmonella enterica enterica serovar Typhi Ty2
gcgucugaguuaa

SEQ ID NO: 1791403 - RNA, 18 nt, Salmonella enterica enterica serovar Typhi Ty2
gcgucugagcaucccggu

SEQ ID NO: 1791404 - RNA, 21 nt, Salmonella enterica enterica serovar Typhi Ty2
gcgugcagaucaagcgggggc

SEQ ID NO: 1791405 - RNA, 17 nt, Salmonella enterica enterica serovar Typhi Ty2
gcgugagcgcauccggc

SEQ ID NO: 1791406 - RNA, 20 nt, Salmonella enterica enterica serovar Typhi Ty2
gcgugacgccaagcagcggc

SEQ ID NO: 1791407 - RNA, 19 nt, Salmonella enterica enterica serovar Typhi Ty2
gcgucuucaucagccagca

SEQ ID NO: 1791408 - RNA, 14 nt, Salmonella enterica enterica serovar Typhi Ty2
gcgugaauaaaaua

SEQ ID NO: 1791409 - RNA, 16 nt, Salmonella enterica enterica serovar Typhi Ty2
gcgugcgccauccggc

SEQ ID NO: 1791410 - RNA, 18 nt, Salmonella enterica enterica serovar Typhi Ty2
gcgugccuucaaauauau

SEQ ID NO: 1791411 - RNA, 18 nt, Salmonella enterica enterica serovar Typhi Ty2
gcgugcgaauuucggcaa

SEQ ID NO: 1791412 - RNA, 15 nt, Salmonella enterica enterica serovar Typhi Ty2
gcgugcuggcggccg

SEQ ID NO: 1791413 - RNA, 21 nt, Salmonella enterica enterica serovar Typhi Ty2
gcguggcaucuuaucaggccu

SEQ ID NO: 1791414 - RNA, 20 nt, Salmonella enterica enterica serovar Typhi Ty2
gcgucagcgcuugccgcagc

SEQ ID NO: 1791415 - RNA, 20 nt, Salmonella enterica enterica serovar Typhi Ty2
gcgucagcguguaaucgccg

SEQ ID NO: 1791416 - RNA, 18 nt, Salmonella enterica enterica serovar Typhi Ty2
gcgucaggaacgcggcgc

SEQ ID NO: 1791417 - RNA, 17 nt, Salmonella enterica enterica serovar Typhi Ty2
gcgucagcacgccgccc

SEQ ID NO: 1791418 - RNA, 15 nt, Salmonella enterica enterica serovar Typhi Ty2
gcgucagcauggugu

SEQ ID NO: 1791419 - RNA, 13 nt, Salmonella enterica enterica serovar Typhi Ty2
gcgucagccggca

SEQ ID NO: 1791420 - RNA, 13 nt, Salmonella enterica enterica serovar Typhi Ty2
gcgucagcgcggc

SEQ ID NO: 1791421 - RNA, 18 nt, Salmonella enterica enterica serovar Typhi Ty2
gcgucauagccgcgcguc

SEQ ID NO: 1791422 - RNA, 19 nt, Salmonella enterica enterica serovar Typhi Ty2
gcgucauaguuuuccagcc

SEQ ID NO: 1791423 - RNA, 20 nt, Salmonella enterica enterica serovar Typhi Ty2
gcgucaucauugcgccaaga

SEQ ID NO: 1791424 - RNA, 20 nt, Salmonella enterica enterica serovar Typhi Ty2
gcgucaucggcgcgcuggcg

SEQ ID NO: 1791425 - RNA, 22 nt, Salmonella enterica enterica serovar Typhi Ty2
gcgucauccaguguuaagaaga

SEQ ID NO: 1791426 - RNA, 22 nt, Salmonella enterica enterica serovar Typhi Ty2
gcgucaucgacauuaacaaugc

SEQ ID NO: 1791427 - RNA, 18 nt, Salmonella enterica enterica serovar Typhi Ty2
gcgucacgcgcaaagcug

SEQ ID NO: 1791428 - RNA, 21 nt, Salmonella enterica enterica serovar Typhi Ty2
gcgucacccgccggcagcagc

SEQ ID NO: 1791429 - RNA, 22 nt, Salmonella enterica enterica serovar Typhi Ty2
gcgucacccgccggcagcagcu

SEQ ID NO: 1791430 - RNA, 13 nt, Salmonella enterica enterica serovar Typhi Ty2
gcgucacaacagc

SEQ ID NO: 1791431 - RNA, 19 nt, Salmonella enterica enterica serovar Typhi Ty2
gcgucaaauagagaaaaua

SEQ ID NO: 1791432 - RNA, 15 nt, Salmonella enterica enterica serovar Typhi Ty2
gcgucaaagcacaug

SEQ ID NO: 1791433 - RNA, 20 nt, Salmonella enterica enterica serovar Typhi Ty2
gcgucaaaaucccggcuggg

SEQ ID NO: 1791434 - RNA, 15 nt, Salmonella enterica enterica serovar Typhi Ty2
gcguagcgcgcggau

SEQ ID NO: 1791435 - RNA, 16 nt, Salmonella enterica enterica serovar Typhi Ty2
gcguagguaagauauu

SEQ ID NO: 1791436 - RNA, 16 nt, Salmonella enterica enterica serovar Typhi Ty2
gcgucgaaugacgcgc

SEQ ID NO: 1791437 - RNA, 14 nt, Salmonella enterica enterica serovar Typhi Ty2
gcgucgccagcaac

SEQ ID NO: 1791438 - RNA, 16 nt, Salmonella enterica enterica serovar Typhi Ty2
gcgucgccauaaagcu

SEQ ID NO: 1791439 - RNA, 18 nt, Salmonella enterica enterica serovar Typhi Ty2
gcguccaacuggcuuuca

SEQ ID NO: 1791440 - RNA, 22 nt, Salmonella enterica enterica serovar Typhi Ty2
gcguccaacuggcuuucaucca

SEQ ID NO: 1791441 - RNA, 23 nt, Salmonella enterica enterica serovar Typhi Ty2
gcguccacuuucucggcuuucca

SEQ ID NO: 1791442 - RNA, 15 nt, Salmonella enterica enterica serovar Typhi Ty2
gcguccagaggaucu

SEQ ID NO: 1791443 - RNA, 22 nt, Salmonella enterica enterica serovar Typhi Ty2
gcguccaguacuuucuuuugau

SEQ ID NO: 1791444 - RNA, 14 nt, Salmonella enterica enterica serovar Typhi Ty2
gcgucccucuccag

SEQ ID NO: 1791445 - RNA, 20 nt, Salmonella enterica enterica serovar Typhi Ty2
gcgucccucuccagggcaac

SEQ ID NO: 1791446 - RNA, 17 nt, Salmonella enterica enterica serovar Typhi Ty2
gcgucccggcagugcau

SEQ ID NO: 1791447 - RNA, 15 nt, Salmonella enterica enterica serovar Typhi Ty2
gcguccccguucuga

SEQ ID NO: 1791448 - RNA, 12 nt, Salmonella enterica enterica serovar Typhi Ty2
gcgucccggcaa

SEQ ID NO: 1791449 - RNA, 18 nt, Salmonella enterica enterica serovar Typhi Ty2
gcgucccagcgggcugua

SEQ ID NO: 1791450 - RNA, 12 nt, Salmonella enterica enterica serovar Typhi Ty2
gcuggcgcgcua

SEQ ID NO: 1791451 - RNA, 13 nt, Salmonella enterica enterica serovar Typhi Ty2
gcuggcgccgcaa

SEQ ID NO: 1791452 - RNA, 15 nt, Salmonella enterica enterica serovar Typhi Ty2
gcuggcgcaugaucu

SEQ ID NO: 1791453 - RNA, 14 nt, Salmonella enterica enterica serovar Typhi Ty2
gcuggcggccccuc

SEQ ID NO: 1791454 - RNA, 17 nt, Salmonella enterica enterica serovar Typhi Ty2
gcuggcgcggggaucgg

SEQ ID NO: 1791455 - RNA, 18 nt, Salmonella enterica enterica serovar Typhi Ty2
gcuggcgcugacgacacu

SEQ ID NO: 1791456 - RNA, 15 nt, Salmonella enterica enterica serovar Typhi Ty2
gcuggccgucaugga

SEQ ID NO: 1791457 - RNA, 22 nt, Salmonella enterica enterica serovar Typhi Ty2
gcuggcgcacauuuacgccagc

SEQ ID NO: 1791458 - RNA, 15 nt, Salmonella enterica enterica serovar Typhi Ty2
gcuggcgacggcggu

SEQ ID NO: 1791459 - RNA, 14 nt, Salmonella enterica enterica serovar Typhi Ty2
gcuggcaggcgcga

SEQ ID NO: 1791460 - RNA, 17 nt, Salmonella enterica enterica serovar Typhi Ty2
gcuggcauuacgcuggc

SEQ ID NO: 1791461 - RNA, 16 nt, Salmonella enterica enterica serovar Typhi Ty2
gcuggcauaaccgcag

SEQ ID NO: 1791462 - RNA, 22 nt, Salmonella enterica enterica serovar Typhi Ty2
gcuggauaccgcgccagcgaug

SEQ ID NO: 1791463 - RNA, 14 nt, Salmonella enterica enterica serovar Typhi Ty2
gcuggcagcggcug

SEQ ID NO: 1791464 - RNA, 19 nt, Salmonella enterica enterica serovar Typhi Ty2
gcuggacauguuccgcccc

SEQ ID NO: 1791465 - RNA, 23 nt, Salmonella enterica enterica serovar Typhi Ty2
gcuggacauguuccgccccgccu

SEQ ID NO: 1791466 - RNA, 14 nt, Salmonella enterica enterica serovar Typhi Ty2
gcuggagccacauc

SEQ ID NO: 1791467 - RNA, 22 nt, Salmonella enterica enterica serovar Typhi Ty2
gcugcugaccuuaauccagcag

SEQ ID NO: 1791468 - RNA, 23 nt, Salmonella enterica enterica serovar Typhi Ty2
gcugcugaccuuaauccagcagu

SEQ ID NO: 1791469 - RNA, 22 nt, Salmonella enterica enterica serovar Typhi Ty2
gcugcuguuaaccuugcgccuc

SEQ ID NO: 1791470 - RNA, 21 nt, Salmonella enterica enterica serovar Typhi Ty2
gcugcuguuuuugaaaaugug

SEQ ID NO: 1791471 - RNA, 21 nt, Salmonella enterica enterica serovar Typhi Ty2
gcugcuucacguuuuccaggu

SEQ ID NO: 1791472 - RNA, 21 nt, Salmonella enterica enterica serovar Typhi Ty2
gcugcuuagcaguagugagcc

SEQ ID NO: 1791473 - RNA, 18 nt, Salmonella enterica enterica serovar Typhi Ty2
gcugcggcaaacuggcga

SEQ ID NO: 1791474 - RNA, 23 nt, Salmonella enterica enterica serovar Typhi Ty2
gcugcggcguuccccaauguuca

SEQ ID NO: 1791475 - RNA, 13 nt, Salmonella enterica enterica serovar Typhi Ty2
gcugcggcgugga

SEQ ID NO: 1791476 - RNA, 18 nt, Salmonella enterica enterica serovar Typhi Ty2
gcugcgucagcgcuugcc

SEQ ID NO: 1791477 - RNA, 22 nt, Salmonella enterica enterica serovar Typhi Ty2
gcugggcuuuauccugaccgcu

SEQ ID NO: 1791478 - RNA, 14 nt, Salmonella enterica enterica serovar Typhi Ty2
gcugggcgaggcca

SEQ ID NO: 1791479 - RNA, 15 nt, Salmonella enterica enterica serovar Typhi Ty2
gcugggccugcuccg

SEQ ID NO: 1791480 - RNA, 19 nt, Salmonella enterica enterica serovar Typhi Ty2
aaagcuguugugucccggc

SEQ ID NO: 1791481 - RNA, 18 nt, Salmonella enterica enterica serovar Typhi Ty2
gcuggguuucgguauaaa

SEQ ID NO: 1791482 - RNA, 17 nt, Salmonella enterica enterica serovar Typhi Ty2
gcugggugagcgggcug

SEQ ID NO: 1791483 - RNA, 20 nt, Salmonella enterica enterica serovar Typhi Ty2
gcuggguugauaccggagga

SEQ ID NO: 1791484 - RNA, 22 nt, Salmonella enterica enterica serovar Typhi Ty2
gcuggcgugacguguggcgcug

SEQ ID NO: 1791485 - RNA, 19 nt, Salmonella enterica enterica serovar Typhi Ty2
gcuggcgucgccaaagcag

SEQ ID NO: 1791486 - RNA, 20 nt, Salmonella enterica enterica serovar Typhi Ty2
gcuggcgucccgggucagga

SEQ ID NO: 1791487 - RNA, 19 nt, Salmonella enterica enterica serovar Typhi Ty2
gcuggcgguuuuugugggu

SEQ ID NO: 1791488 - RNA, 19 nt, Salmonella enterica enterica serovar Typhi Ty2
gcuggcgggguucgggcag

SEQ ID NO: 1791489 - RNA, 10 nt, Salmonella enterica enterica serovar Typhi Ty2
gcuggcuggc

SEQ ID NO: 1791490 - RNA, 19 nt, Salmonella enterica enterica serovar Typhi Ty2
gcuggcguuaucguccguc

SEQ ID NO: 1791491 - RNA, 15 nt, Salmonella enterica enterica serovar Typhi Ty2
gcuggcguugagcgu

SEQ ID NO: 1791492 - RNA, 21 nt, Salmonella enterica enterica serovar Typhi Ty2
gcuggcugccguuaaucuggc

SEQ ID NO: 1791493 - RNA, 17 nt, Salmonella enterica enterica serovar Typhi Ty2
gcugggaugaccugaaa

SEQ ID NO: 1791494 - RNA, 16 nt, Salmonella enterica enterica serovar Typhi Ty2
gcugguuggcgcgcuu

SEQ ID NO: 1791495 - RNA, 23 nt, Salmonella enterica enterica serovar Typhi Ty2
gcuguaaauguuguuccagagug

SEQ ID NO: 1791496 - RNA, 18 nt, Salmonella enterica enterica serovar Typhi Ty2
gcuguaaaucgcgcccga

SEQ ID NO: 1791497 - RNA, 18 nt, Salmonella enterica enterica serovar Typhi Ty2
gcuguccuuaaccagcuc

SEQ ID NO: 1791498 - RNA, 20 nt, Salmonella enterica enterica serovar Typhi Ty2
gcugucgacaauaaauugcg

SEQ ID NO: 1791499 - RNA, 23 nt, Salmonella enterica enterica serovar Typhi Ty2
gcugugacggcaacugaaaacag

SEQ ID NO: 1791500 - RNA, 22 nt, Salmonella enterica enterica serovar Typhi Ty2
gcugugagaaggugguggguaa

SEQ ID NO: 1791501 - RNA, 20 nt, Salmonella enterica enterica serovar Typhi Ty2
gcugucggucggcuuuuguu

SEQ ID NO: 1791502 - RNA, 15 nt, Salmonella enterica enterica serovar Typhi Ty2
gcugcccgccgccgg

SEQ ID NO: 1791503 - RNA, 15 nt, Salmonella enterica enterica serovar Typhi Ty2
gcugccccagacgcc

SEQ ID NO: 1791504 - RNA, 21 nt, Salmonella enterica enterica serovar Typhi Ty2
gcugcaucuuacugaccggcc

SEQ ID NO: 1791505 - RNA, 12 nt, Salmonella enterica enterica serovar Typhi Ty2
gcugccaucagg

SEQ ID NO: 1791506 - RNA, 20 nt, Salmonella enterica enterica serovar Typhi Ty2
gcugcacccggagagaaaca

SEQ ID NO: 1791507 - RNA, 17 nt, Salmonella enterica enterica serovar Typhi Ty2
gcugaugauuggccucc

SEQ ID NO: 1791508 - RNA, 13 nt, Salmonella enterica enterica serovar Typhi Ty2
gcugaugacgcgc

SEQ ID NO: 1791509 - RNA, 21 nt, Salmonella enterica enterica serovar Typhi Ty2
gcugaugccagauggcaagau

SEQ ID NO: 1791510 - RNA, 16 nt, Salmonella enterica enterica serovar Typhi Ty2
gcugacgcgaucgccg

SEQ ID NO: 1791511 - RNA, 17 nt, Salmonella enterica enterica serovar Typhi Ty2
gcugacggagcuggcac

SEQ ID NO: 1791512 - RNA, 22 nt, Salmonella enterica enterica serovar Typhi Ty2
gcugaaacagaauaaacggcag

SEQ ID NO: 1791513 - RNA, 22 nt, Salmonella enterica enterica serovar Typhi Ty2
gcugacaucgcgauuguuggug

SEQ ID NO: 1791514 - RNA, 23 nt, Salmonella enterica enterica serovar Typhi Ty2
gcugacaucguguauaccaaaaa

SEQ ID NO: 1791515 - RNA, 15 nt, Salmonella enterica enterica serovar Typhi Ty2
gcucuuuuuuuugcu

SEQ ID NO: 1791516 - RNA, 22 nt, Salmonella enterica enterica serovar Typhi Ty2
gcucuuuaaugauguccagaau

SEQ ID NO: 1791517 - RNA, 16 nt, Salmonella enterica enterica serovar Typhi Ty2
gcucuuuacauaaugu

SEQ ID NO: 1791518 - RNA, 14 nt, Salmonella enterica enterica serovar Typhi Ty2
gcugaguuucuccc

SEQ ID NO: 1791519 - RNA, 19 nt, Salmonella enterica enterica serovar Typhi Ty2
gcugaguuuagccagcagc

SEQ ID NO: 1791520 - RNA, 20 nt, Salmonella enterica enterica serovar Typhi Ty2
gcugauaagcuaguaaagaa

SEQ ID NO: 1791521 - RNA, 13 nt, Salmonella enterica enterica serovar Typhi Ty2
gcugauaauacug

SEQ ID NO: 1791522 - RNA, 21 nt, Salmonella enterica enterica serovar Typhi Ty2
gcugagucagaaacggccugg

SEQ ID NO: 1791523 - RNA, 17 nt, Salmonella enterica enterica serovar Typhi Ty2
gcugagucauccuuccc

SEQ ID NO: 1791524 - RNA, 17 nt, Salmonella enterica enterica serovar Typhi Ty2
gcugaggcuuugagcgu

SEQ ID NO: 1791525 - RNA, 14 nt, Salmonella enterica enterica serovar Typhi Ty2
gcugaggaucaccc

SEQ ID NO: 1791526 - RNA, 17 nt, Salmonella enterica enterica serovar Typhi Ty2
gcugagcgucaggcgca

SEQ ID NO: 1791527 - RNA, 17 nt, Salmonella enterica enterica serovar Typhi Ty2
gcugacugguuuguugc

SEQ ID NO: 1791528 - RNA, 17 nt, Salmonella enterica enterica serovar Typhi Ty2
gcugacguagauucuga

SEQ ID NO: 1791529 - RNA, 12 nt, Salmonella enterica enterica serovar Typhi Ty2
gcugacugccgu

SEQ ID NO: 1791530 - RNA, 15 nt, Salmonella enterica enterica serovar Typhi Ty2
gcucuguggggggaa

SEQ ID NO: 1791531 - RNA, 17 nt, Salmonella enterica enterica serovar Typhi Ty2
gcucuucuucgcucucg

SEQ ID NO: 1791532 - RNA, 21 nt, Salmonella enterica enterica serovar Typhi Ty2
gcucucuucgugacccgccag

SEQ ID NO: 1791533 - RNA, 19 nt, Salmonella enterica enterica serovar Typhi Ty2
gcucucccagcugagcuaa

SEQ ID NO: 1791534 - RNA, 18 nt, Salmonella enterica enterica serovar Typhi Ty2
gcucuccggcacauucac

SEQ ID NO: 1791535 - RNA, 15 nt, Salmonella enterica enterica serovar Typhi Ty2
gcucucccgccacug

SEQ ID NO: 1791536 - RNA, 23 nt, Salmonella enterica enterica serovar Typhi Ty2
gcucucccgccacugaauuacug

SEQ ID NO: 1791537 - RNA, 13 nt, Salmonella enterica enterica serovar Typhi Ty2
gcucucccagcug

SEQ ID NO: 1791538 - RNA, 14 nt, Salmonella enterica enterica serovar Typhi Ty2
gcucucccagcuga

SEQ ID NO: 1791539 - RNA, 16 nt, Salmonella enterica enterica serovar Typhi Ty2
gcucucccagcugagc

SEQ ID NO: 1791540 - RNA, 16 nt, Salmonella enterica enterica serovar Typhi Ty2
gcucucuuuucuuacu

SEQ ID NO: 1791541 - RNA, 19 nt, Salmonella enterica enterica serovar Typhi Ty2
gcucugaaucucuucccag

SEQ ID NO: 1791542 - RNA, 19 nt, Salmonella enterica enterica serovar Typhi Ty2
gcucugccaguagcugcuc

SEQ ID NO: 1791543 - RNA, 11 nt, Salmonella enterica enterica serovar Typhi Ty2
gcucugcuguu

SEQ ID NO: 1791544 - RNA, 15 nt, Salmonella enterica enterica serovar Typhi Ty2
gcucugcuguuccuu

SEQ ID NO: 1791545 - RNA, 17 nt, Salmonella enterica enterica serovar Typhi Ty2
gcucugcuguuccuuca

SEQ ID NO: 1791546 - RNA, 15 nt, Salmonella enterica enterica serovar Typhi Ty2
gcucggcgucauccc

SEQ ID NO: 1791547 - RNA, 21 nt, Salmonella enterica enterica serovar Typhi Ty2
gcucguagcguuuaaagacca

SEQ ID NO: 1791548 - RNA, 14 nt, Salmonella enterica enterica serovar Typhi Ty2
gcucuaaaaaggaa

SEQ ID NO: 1791549 - RNA, 18 nt, Salmonella enterica enterica serovar Typhi Ty2
gcucguuaaauccuccca

SEQ ID NO: 1791550 - RNA, 11 nt, Salmonella enterica enterica serovar Typhi Ty2
gcucgcggcgg

SEQ ID NO: 1791551 - RNA, 20 nt, Salmonella enterica enterica serovar Typhi Ty2
gcucccgcauggacaaggau

SEQ ID NO: 1791552 - RNA, 16 nt, Salmonella enterica enterica serovar Typhi Ty2
gcucggaugugcauug

SEQ ID NO: 1791553 - RNA, 15 nt, Salmonella enterica enterica serovar Typhi Ty2
gcucggcaauuucuu

SEQ ID NO: 1791554 - RNA, 20 nt, Salmonella enterica enterica serovar Typhi Ty2
gcucgcuuuuacucuuccug

SEQ ID NO: 1791555 - RNA, 13 nt, Salmonella enterica enterica serovar Typhi Ty2
gcuagcuucaggu

SEQ ID NO: 1791556 - RNA, 16 nt, Salmonella enterica enterica serovar Typhi Ty2
gcuaggaacagugaca

SEQ ID NO: 1791557 - RNA, 18 nt, Salmonella enterica enterica serovar Typhi Ty2
gcuauccacgcagacgcc

SEQ ID NO: 1791558 - RNA, 23 nt, Salmonella enterica enterica serovar Typhi Ty2
gcuaucccgaugcucagggcauc

SEQ ID NO: 1791559 - RNA, 22 nt, Salmonella enterica enterica serovar Typhi Ty2
gcuaucaacgccuccaggcuac

SEQ ID NO: 1791560 - RNA, 20 nt, Salmonella enterica enterica serovar Typhi Ty2
gcuaucaggaagaacacgcc

SEQ ID NO: 1791561 - RNA, 16 nt, Salmonella enterica enterica serovar Typhi Ty2
gcuauccggcaucaca

SEQ ID NO: 1791562 - RNA, 21 nt, Salmonella enterica enterica serovar Typhi Ty2
gcuaucgggcguuaaaaguac

SEQ ID NO: 1791563 - RNA, 23 nt, Salmonella enterica enterica serovar Typhi Ty2
gcuaucggaaacuauccuggccu

SEQ ID NO: 1791564 - RNA, 19 nt, Salmonella enterica enterica serovar Typhi Ty2
gcuaucgcuuuaacgcugc

SEQ ID NO: 1791565 - RNA, 21 nt, Salmonella enterica enterica serovar Typhi Ty2
gcuaucgcgccggacagcagc

SEQ ID NO: 1791566 - RNA, 22 nt, Salmonella enterica enterica serovar Typhi Ty2
gcuauaguggauggcccacugu

SEQ ID NO: 1791567 - RNA, 18 nt, Salmonella enterica enterica serovar Typhi Ty2
gcuauagaaugcaagcag

SEQ ID NO: 1791568 - RNA, 19 nt, Salmonella enterica enterica serovar Typhi Ty2
gcuauaaucacagggguca

SEQ ID NO: 1791569 - RNA, 14 nt, Salmonella enterica enterica serovar Typhi Ty2
gcuauacgcggcgu

SEQ ID NO: 1791570 - RNA, 15 nt, Salmonella enterica enterica serovar Typhi Ty2
gcuauauuuauaaaa

SEQ ID NO: 1791571 - RNA, 14 nt, Salmonella enterica enterica serovar Typhi Ty2
gcuauaaaguuccc

SEQ ID NO: 1791572 - RNA, 23 nt, Salmonella enterica enterica serovar Typhi Ty2
gcuauaaaguucccaugcuucca

SEQ ID NO: 1791573 - RNA, 15 nt, Salmonella enterica enterica serovar Typhi Ty2
gcucaagcgaaaaaa

SEQ ID NO: 1791574 - RNA, 15 nt, Salmonella enterica enterica serovar Typhi Ty2
gcucaacuuccagag

SEQ ID NO: 1791575 - RNA, 20 nt, Salmonella enterica enterica serovar Typhi Ty2
gcucaacgcccucaaguaaa

SEQ ID NO: 1791576 - RNA, 22 nt, Salmonella enterica enterica serovar Typhi Ty2
gcucaaccgcgcggcguucugc

SEQ ID NO: 1791577 - RNA, 16 nt, Salmonella enterica enterica serovar Typhi Ty2
gcucaaccgcgcggcg

SEQ ID NO: 1791578 - RNA, 13 nt, Salmonella enterica enterica serovar Typhi Ty2
gcucaaauaugau

SEQ ID NO: 1791579 - RNA, 22 nt, Salmonella enterica enterica serovar Typhi Ty2
gcucaaaaaagaguaaaguuau

SEQ ID NO: 1791580 - RNA, 20 nt, Salmonella enterica enterica serovar Typhi Ty2
gcuauuuuuugcuggcggca

SEQ ID NO: 1791581 - RNA, 15 nt, Salmonella enterica enterica serovar Typhi Ty2
gcuauuuccagaaau

SEQ ID NO: 1791582 - RNA, 15 nt, Salmonella enterica enterica serovar Typhi Ty2
gcuauuucaguggcu

SEQ ID NO: 1791583 - RNA, 16 nt, Salmonella enterica enterica serovar Typhi Ty2
gcuauucugcuguucc

SEQ ID NO: 1791584 - RNA, 19 nt, Salmonella enterica enterica serovar Typhi Ty2
gcuauuccucgaucgccug

SEQ ID NO: 1791585 - RNA, 12 nt, Salmonella enterica enterica serovar Typhi Ty2
gcuauuagccaa

SEQ ID NO: 1791586 - RNA, 14 nt, Salmonella enterica enterica serovar Typhi Ty2
gcuauuaccaguaa

SEQ ID NO: 1791587 - RNA, 16 nt, Salmonella enterica enterica serovar Typhi Ty2
gcuaucugacagccaa

SEQ ID NO: 1791588 - RNA, 21 nt, Salmonella enterica enterica serovar Typhi Ty2
gcuaugauggccgacuggcac

SEQ ID NO: 1791589 - RNA, 11 nt, Salmonella enterica enterica serovar Typhi Ty2
gcuaugaagac

SEQ ID NO: 1791590 - RNA, 22 nt, Salmonella enterica enterica serovar Typhi Ty2
gcuaugaagaccugcuucaggu

SEQ ID NO: 1791591 - RNA, 17 nt, Salmonella enterica enterica serovar Typhi Ty2
gcuaugaagcuggagcc

SEQ ID NO: 1791592 - RNA, 14 nt, Salmonella enterica enterica serovar Typhi Ty2
gcuauggcaacaaa

SEQ ID NO: 1791593 - RNA, 17 nt, Salmonella enterica enterica serovar Typhi Ty2
gcuauggcaacaaagcc

SEQ ID NO: 1791594 - RNA, 17 nt, Salmonella enterica enterica serovar Typhi Ty2
gcuaugggaagggugac

SEQ ID NO: 1791595 - RNA, 20 nt, Salmonella enterica enterica serovar Typhi Ty2
gcuaugcuuaccaucuggcc

SEQ ID NO: 1791596 - RNA, 13 nt, Salmonella enterica enterica serovar Typhi Ty2
gcuaugcgccagu

SEQ ID NO: 1791597 - RNA, 16 nt, Salmonella enterica enterica serovar Typhi Ty2
gcuaugcgcuccagga

SEQ ID NO: 1791598 - RNA, 16 nt, Salmonella enterica enterica serovar Typhi Ty2
gcucagggcauccgcc

SEQ ID NO: 1791599 - RNA, 23 nt, Salmonella enterica enterica serovar Typhi Ty2
gcucaugugcagcauccagcuca

SEQ ID NO: 1791600 - RNA, 15 nt, Salmonella enterica enterica serovar Typhi Ty2
gcucauuugcggcgu

SEQ ID NO: 1791601 - RNA, 23 nt, Salmonella enterica enterica serovar Typhi Ty2
gcucaugcgaucgggcaauccau

SEQ ID NO: 1791602 - RNA, 16 nt, Salmonella enterica enterica serovar Typhi Ty2
gcucaugcgcggcggg

SEQ ID NO: 1791603 - RNA, 15 nt, Salmonella enterica enterica serovar Typhi Ty2
gcucaugcgccuggc

SEQ ID NO: 1791604 - RNA, 22 nt, Salmonella enterica enterica serovar Typhi Ty2
gcucaugcgcgucccggcagug

SEQ ID NO: 1791605 - RNA, 20 nt, Salmonella enterica enterica serovar Typhi Ty2
gcucaugugcagcauccagc

SEQ ID NO: 1791606 - RNA, 18 nt, Salmonella enterica enterica serovar Typhi Ty2
gcucauuaacgacaacuu

SEQ ID NO: 1791607 - RNA, 23 nt, Salmonella enterica enterica serovar Typhi Ty2
gcuccagggcugcuggccuucca

SEQ ID NO: 1791608 - RNA, 21 nt, Salmonella enterica enterica serovar Typhi Ty2
gcucccagauuaaaucauccu

SEQ ID NO: 1791609 - RNA, 16 nt, Salmonella enterica enterica serovar Typhi Ty2
gcucccacucuuccag

SEQ ID NO: 1791610 - RNA, 13 nt, Salmonella enterica enterica serovar Typhi Ty2
gcuccccaacagg

SEQ ID NO: 1791611 - RNA, 18 nt, Salmonella enterica enterica serovar Typhi Ty2
gcuccccguuccaccgcc

SEQ ID NO: 1791612 - RNA, 21 nt, Salmonella enterica enterica serovar Typhi Ty2
gcuccagaagcacuucuccac

SEQ ID NO: 1791613 - RNA, 17 nt, Salmonella enterica enterica serovar Typhi Ty2
gcuccagacaggacgcc

SEQ ID NO: 1791614 - RNA, 19 nt, Salmonella enterica enterica serovar Typhi Ty2
gcuccagaccaccagcgac

SEQ ID NO: 1791615 - RNA, 20 nt, Salmonella enterica enterica serovar Typhi Ty2
gcuccagaccaccagcgaca

SEQ ID NO: 1791616 - RNA, 16 nt, Salmonella enterica enterica serovar Typhi Ty2
gcucaccggucccgga

SEQ ID NO: 1791617 - RNA, 20 nt, Salmonella enterica enterica serovar Typhi Ty2
gcucaccgagacugcccggc

SEQ ID NO: 1791618 - RNA, 22 nt, Salmonella enterica enterica serovar Typhi Ty2
gcucaccgagacugcccggcau

SEQ ID NO: 1791619 - RNA, 13 nt, Salmonella enterica enterica serovar Typhi Ty2
gcucacgcuggug

SEQ ID NO: 1791620 - RNA, 23 nt, Salmonella enterica enterica serovar Typhi Ty2
gcucacccaguuuuuuucugcca

SEQ ID NO: 1791621 - RNA, 19 nt, Salmonella enterica enterica serovar Typhi Ty2
gcucaauuauacgcuggug

SEQ ID NO: 1791622 - RNA, 19 nt, Salmonella enterica enterica serovar Typhi Ty2
gcucaauaccuuaguaaaa

SEQ ID NO: 1791623 - RNA, 20 nt, Salmonella enterica enterica serovar Typhi Ty2
gcucaauaccuuaguaaaac

SEQ ID NO: 1791624 - RNA, 13 nt, Salmonella enterica enterica serovar Typhi Ty2
gcucagcgcggca

SEQ ID NO: 1791625 - RNA, 19 nt, Salmonella enterica enterica serovar Typhi Ty2
gcucaggcgcgaauaaugc

SEQ ID NO: 1791626 - RNA, 20 nt, Salmonella enterica enterica serovar Typhi Ty2
gcucagcuggauagagcgcu

SEQ ID NO: 1791627 - RNA, 18 nt, Salmonella enterica enterica serovar Typhi Ty2
gcucacuuuucuuuccug

SEQ ID NO: 1791628 - RNA, 22 nt, Salmonella enterica enterica serovar Typhi Ty2
gcguucggaagacugcuccggc

SEQ ID NO: 1791629 - RNA, 17 nt, Salmonella enterica enterica serovar Typhi Ty2
gcguucggguuuuccug

SEQ ID NO: 1791630 - RNA, 20 nt, Salmonella enterica enterica serovar Typhi Ty2
gcguucgcgcaauucuucua

SEQ ID NO: 1791631 - RNA, 19 nt, Salmonella enterica enterica serovar Typhi Ty2
gcguuccaucacuuccugu

SEQ ID NO: 1791632 - RNA, 16 nt, Salmonella enterica enterica serovar Typhi Ty2
gcguuaucuguaauug

SEQ ID NO: 1791633 - RNA, 20 nt, Salmonella enterica enterica serovar Typhi Ty2
gcguuacuggcgaccggcag

SEQ ID NO: 1791634 - RNA, 18 nt, Salmonella enterica enterica serovar Typhi Ty2
gcguucauccaccgcccg

SEQ ID NO: 1791635 - RNA, 15 nt, Salmonella enterica enterica serovar Typhi Ty2
gcguucacgccgcca

SEQ ID NO: 1791636 - RNA, 18 nt, Salmonella enterica enterica serovar Typhi Ty2
gcguguugaaauccucua

SEQ ID NO: 1791637 - RNA, 23 nt, Salmonella enterica enterica serovar Typhi Ty2
gcguguuguacagcaauaaaagg

SEQ ID NO: 1791638 - RNA, 18 nt, Salmonella enterica enterica serovar Typhi Ty2
gcgugguuuccggcagcu

SEQ ID NO: 1791639 - RNA, 20 nt, Salmonella enterica enterica serovar Typhi Ty2
gcguggcugcaggacuuacc

SEQ ID NO: 1791640 - RNA, 20 nt, Salmonella enterica enterica serovar Typhi Ty2
gcguuuaauuccaucggcau

SEQ ID NO: 1791641 - RNA, 17 nt, Salmonella enterica enterica serovar Typhi Ty2
gcguuucacaucgccag

SEQ ID NO: 1791642 - RNA, 21 nt, Salmonella enterica enterica serovar Typhi Ty2
gcguuguuuuuucagaauuag

SEQ ID NO: 1791643 - RNA, 15 nt, Salmonella enterica enterica serovar Typhi Ty2
gcguuugcgccgcca

SEQ ID NO: 1791644 - RNA, 13 nt, Salmonella enterica enterica serovar Typhi Ty2
gcguuucguaaug

SEQ ID NO: 1791645 - RNA, 18 nt, Salmonella enterica enterica serovar Typhi Ty2
gcguuucacaucgccagu

SEQ ID NO: 1791646 - RNA, 13 nt, Salmonella enterica enterica serovar Typhi Ty2
gcguuuuccagcu

SEQ ID NO: 1791647 - RNA, 16 nt, Salmonella enterica enterica serovar Typhi Ty2
gcguuuuccagcaucc

SEQ ID NO: 1791648 - RNA, 18 nt, Salmonella enterica enterica serovar Typhi Ty2
gcguuuuacguacccgcu

SEQ ID NO: 1791649 - RNA, 22 nt, Salmonella enterica enterica serovar Typhi Ty2
gcguuugucuucuuaguaacau

SEQ ID NO: 1791650 - RNA, 18 nt, Salmonella enterica enterica serovar Typhi Ty2
gcguuuuuucaucggcag

SEQ ID NO: 1791651 - RNA, 19 nt, Salmonella enterica enterica serovar Typhi Ty2
gcguucugcgccauuucca

SEQ ID NO: 1791652 - RNA, 13 nt, Salmonella enterica enterica serovar Typhi Ty2
gcguucuuccacu

SEQ ID NO: 1791653 - RNA, 12 nt, Salmonella enterica enterica serovar Typhi Ty2
gcguugcagcca

SEQ ID NO: 1791654 - RNA, 18 nt, Salmonella enterica enterica serovar Typhi Ty2
gcguuguacggauggggu

SEQ ID NO: 1791655 - RNA, 19 nt, Salmonella enterica enterica serovar Typhi Ty2
gcguugguuaaggcggcug

SEQ ID NO: 1791656 - RNA, 18 nt, Salmonella enterica enterica serovar Typhi Ty2
gcguugccguaggcaacg

SEQ ID NO: 1791657 - RNA, 19 nt, Salmonella enterica enterica serovar Typhi Ty2
gcuacacgcguaaacuucc

SEQ ID NO: 1791658 - RNA, 19 nt, Salmonella enterica enterica serovar Typhi Ty2
gcuacacgcgaauagccag

SEQ ID NO: 1791659 - RNA, 21 nt, Salmonella enterica enterica serovar Typhi Ty2
gcuaccagcgcggcgccagua

SEQ ID NO: 1791660 - RNA, 14 nt, Salmonella enterica enterica serovar Typhi Ty2
gcuaccagcgcggc

SEQ ID NO: 1791661 - RNA, 17 nt, Salmonella enterica enterica serovar Typhi Ty2
gcuaccaggcaaagcuc

SEQ ID NO: 1791662 - RNA, 23 nt, Salmonella enterica enterica serovar Typhi Ty2
gcuaccagcgcggcgccaguacu

SEQ ID NO: 1791663 - RNA, 19 nt, Salmonella enterica enterica serovar Typhi Ty2
gcuacccgcugacgcugcc

SEQ ID NO: 1791664 - RNA, 20 nt, Salmonella enterica enterica serovar Typhi Ty2
gcuaauguacgccuaaaaau

SEQ ID NO: 1791665 - RNA, 17 nt, Salmonella enterica enterica serovar Typhi Ty2
gcuaauuuucagggugg

SEQ ID NO: 1791666 - RNA, 16 nt, Salmonella enterica enterica serovar Typhi Ty2
gcuaauuggcuuaccu

SEQ ID NO: 1791667 - RNA, 23 nt, Salmonella enterica enterica serovar Typhi Ty2
gcuacgcuuaucgggccuacgag

SEQ ID NO: 1791668 - RNA, 18 nt, Salmonella enterica enterica serovar Typhi Ty2
gcuacgccuuauccggcc

SEQ ID NO: 1791669 - RNA, 12 nt, Salmonella enterica enterica serovar Typhi Ty2
gcuacgggccgc

SEQ ID NO: 1791670 - RNA, 20 nt, Salmonella enterica enterica serovar Typhi Ty2
gcuacggaguucgccgccgg

SEQ ID NO: 1791671 - RNA, 13 nt, Salmonella enterica enterica serovar Typhi Ty2
gcuacugcaucug

SEQ ID NO: 1791672 - RNA, 16 nt, Salmonella enterica enterica serovar Typhi Ty2
gcuaccgggcaaacau

SEQ ID NO: 1791673 - RNA, 16 nt, Salmonella enterica enterica serovar Typhi Ty2
gcuaccguccaaauca

SEQ ID NO: 1791674 - RNA, 19 nt, Salmonella enterica enterica serovar Typhi Ty2
gcuaccgccacuuugcuuu

SEQ ID NO: 1791675 - RNA, 21 nt, Salmonella enterica enterica serovar Typhi Ty2
gcuacgccaucaggcauggca

SEQ ID NO: 1791676 - RNA, 14 nt, Salmonella enterica enterica serovar Typhi Ty2
gcuacgcagcggcg

SEQ ID NO: 1791677 - RNA, 14 nt, Salmonella enterica enterica serovar Typhi Ty2
gcuaaugauuaucu

SEQ ID NO: 1791678 - RNA, 16 nt, Salmonella enterica enterica serovar Typhi Ty2
gcuaauggcuuauugg

SEQ ID NO: 1791679 - RNA, 18 nt, Salmonella enterica enterica serovar Typhi Ty2
gcuaaucccgcucgccag

SEQ ID NO: 1791680 - RNA, 17 nt, Salmonella enterica enterica serovar Typhi Ty2
gcuaagcaacaguucac

SEQ ID NO: 1791681 - RNA, 20 nt, Salmonella enterica enterica serovar Typhi Ty2
gcuaagcgcccguagcucag

SEQ ID NO: 1791682 - RNA, 22 nt, Salmonella enterica enterica serovar Typhi Ty2
gcuaagcguuacggaaaaaaua

SEQ ID NO: 1791683 - RNA, 23 nt, Salmonella enterica enterica serovar Typhi Ty2
gcuaagcguuacggaaaaaauac

SEQ ID NO: 1791684 - RNA, 20 nt, Salmonella enterica enterica serovar Typhi Ty2
gcuaacuuauugaaaccuaa

SEQ ID NO: 1791685 - RNA, 16 nt, Salmonella enterica enterica serovar Typhi Ty2
gcuaaccuguaucugc

SEQ ID NO: 1791686 - RNA, 15 nt, Salmonella enterica enterica serovar Typhi Ty2
gcuaaaucagugaug

SEQ ID NO: 1791687 - RNA, 19 nt, Salmonella enterica enterica serovar Typhi Ty2
gcuaaaucacgcaggucau

SEQ ID NO: 1791688 - RNA, 15 nt, Salmonella enterica enterica serovar Typhi Ty2
gcuaaauaaaaauaa

SEQ ID NO: 1791689 - RNA, 13 nt, Salmonella enterica enterica serovar Typhi Ty2
gcuaacagugaaa

SEQ ID NO: 1791690 - RNA, 15 nt, Salmonella enterica enterica serovar Typhi Ty2
gcuaaaacagauaac

SEQ ID NO: 1791691 - RNA, 18 nt, Salmonella enterica enterica serovar Typhi Ty2
gcuaaaacccaccaccuc

SEQ ID NO: 1791692 - RNA, 18 nt, Salmonella enterica enterica serovar Typhi Ty2
gcuaaaccaaacuuaucu

SEQ ID NO: 1791693 - RNA, 19 nt, Salmonella enterica enterica serovar Typhi Ty2
gcuaaagcgacuuauccgg

SEQ ID NO: 1791694 - RNA, 17 nt, Salmonella enterica enterica serovar Typhi Ty2
gcuaaagcgcuggcggc

SEQ ID NO: 1791695 - RNA, 12 nt, Salmonella enterica enterica serovar Typhi Ty2
gcuuuucaggcu

SEQ ID NO: 1791696 - RNA, 17 nt, Salmonella enterica enterica serovar Typhi Ty2
gcuuuucaugaaacucg

SEQ ID NO: 1791697 - RNA, 20 nt, Salmonella enterica enterica serovar Typhi Ty2
gcuuuuauguuacccagccu

SEQ ID NO: 1791698 - RNA, 18 nt, Salmonella enterica enterica serovar Typhi Ty2
gcuuuuccuguucuggcu

SEQ ID NO: 1791699 - RNA, 13 nt, Salmonella enterica enterica serovar Typhi Ty2
gcuuuuucaucau

SEQ ID NO: 1791700 - RNA, 18 nt, Salmonella enterica enterica serovar Typhi Ty2
gcuuuuuacucucuuucu

SEQ ID NO: 1791701 - RNA, 21 nt, Salmonella enterica enterica serovar Typhi Ty2
ggaaaacagcgccggcagcag

SEQ ID NO: 1791702 - RNA, 16 nt, Salmonella enterica enterica serovar Typhi Ty2
ggaaaaccccaucccg

SEQ ID NO: 1791703 - RNA, 13 nt, Salmonella enterica enterica serovar Typhi Ty2
ggaaaacgcgcug

SEQ ID NO: 1791704 - RNA, 13 nt, Salmonella enterica enterica serovar Typhi Ty2
ggaaaaauaagag

SEQ ID NO: 1791705 - RNA, 13 nt, Salmonella enterica enterica serovar Typhi Ty2
ggaaaaaaagaau

SEQ ID NO: 1791706 - RNA, 13 nt, Salmonella enterica enterica serovar Typhi Ty2
ggaaaacagcgcc

SEQ ID NO: 1791707 - RNA, 17 nt, Salmonella enterica enterica serovar Typhi Ty2
ggaaaaaagcagcaucc

SEQ ID NO: 1791708 - RNA, 23 nt, Salmonella enterica enterica serovar Typhi Ty2
ggaaaaaagcgcccagcgccgga

SEQ ID NO: 1791709 - RNA, 17 nt, Salmonella enterica enterica serovar Typhi Ty2
gcuuuuuuauuguuucu

SEQ ID NO: 1791710 - RNA, 15 nt, Salmonella enterica enterica serovar Typhi Ty2
gcuuuuuucaccuuu

SEQ ID NO: 1791711 - RNA, 15 nt, Salmonella enterica enterica serovar Typhi Ty2
gcuuuuuucucugcu

SEQ ID NO: 1791712 - RNA, 18 nt, Salmonella enterica enterica serovar Typhi Ty2
gcugugcgagaccaucaa

SEQ ID NO: 1791713 - RNA, 13 nt, Salmonella enterica enterica serovar Typhi Ty2
gcugugccugccu

SEQ ID NO: 1791714 - RNA, 14 nt, Salmonella enterica enterica serovar Typhi Ty2
gcugugccugccug

SEQ ID NO: 1791715 - RNA, 15 nt, Salmonella enterica enterica serovar Typhi Ty2
gcugugcauaaauaa

SEQ ID NO: 1791716 - RNA, 16 nt, Salmonella enterica enterica serovar Typhi Ty2
gcuguggccaggcacg

SEQ ID NO: 1791717 - RNA, 15 nt, Salmonella enterica enterica serovar Typhi Ty2
gcuguggaaacugug

SEQ ID NO: 1791718 - RNA, 13 nt, Salmonella enterica enterica serovar Typhi Ty2
gcuuucuucuuca

SEQ ID NO: 1791719 - RNA, 14 nt, Salmonella enterica enterica serovar Typhi Ty2
gcuuucuucguuag

SEQ ID NO: 1791720 - RNA, 10 nt, Salmonella enterica enterica serovar Typhi Ty2
gcuuucuucu

SEQ ID NO: 1791721 - RNA, 23 nt, Salmonella enterica enterica serovar Typhi Ty2
gcuuucuuucuccagcguacugc

SEQ ID NO: 1791722 - RNA, 20 nt, Salmonella enterica enterica serovar Typhi Ty2
gcuuucugaauuucacgcuu

SEQ ID NO: 1791723 - RNA, 15 nt, Salmonella enterica enterica serovar Typhi Ty2
gcuuucugagccgcc

SEQ ID NO: 1791724 - RNA, 12 nt, Salmonella enterica enterica serovar Typhi Ty2
gcuuucucaccc

SEQ ID NO: 1791725 - RNA, 17 nt, Salmonella enterica enterica serovar Typhi Ty2
gcuuugcguaaaaaaca

SEQ ID NO: 1791726 - RNA, 17 nt, Salmonella enterica enterica serovar Typhi Ty2
gcuuugcaagcaugaua

SEQ ID NO: 1791727 - RNA, 19 nt, Salmonella enterica enterica serovar Typhi Ty2
gcuuugauauagggcuuga

SEQ ID NO: 1791728 - RNA, 22 nt, Salmonella enterica enterica serovar Typhi Ty2
gcuuugaacagcgucauccagu

SEQ ID NO: 1791729 - RNA, 19 nt, Salmonella enterica enterica serovar Typhi Ty2
gcuuuguuuccacugagcu

SEQ ID NO: 1791730 - RNA, 18 nt, Salmonella enterica enterica serovar Typhi Ty2
gcuuuguuuuccagauuc

SEQ ID NO: 1791731 - RNA, 17 nt, Salmonella enterica enterica serovar Typhi Ty2
gcuuuuaaaacuucccg

SEQ ID NO: 1791732 - RNA, 14 nt, Salmonella enterica enterica serovar Typhi Ty2
gcuuuggcaggccu

SEQ ID NO: 1791733 - RNA, 14 nt, Salmonella enterica enterica serovar Typhi Ty2
ggaacccaggcacc

SEQ ID NO: 1791734 - RNA, 22 nt, Salmonella enterica enterica serovar Typhi Ty2
ggaaauucugacgcagcuucug

SEQ ID NO: 1791735 - RNA, 18 nt, Salmonella enterica enterica serovar Typhi Ty2
ggaacuguucagccagca

SEQ ID NO: 1791736 - RNA, 23 nt, Salmonella enterica enterica serovar Typhi Ty2
ggaagaaacgcuuaaagcguucc

SEQ ID NO: 1791737 - RNA, 20 nt, Salmonella enterica enterica serovar Typhi Ty2
ggaagauaagaaaaaacugg

SEQ ID NO: 1791738 - RNA, 15 nt, Salmonella enterica enterica serovar Typhi Ty2
ggaagacguuuacac

SEQ ID NO: 1791739 - RNA, 17 nt, Salmonella enterica enterica serovar Typhi Ty2
ggaagacugcuccggca

SEQ ID NO: 1791740 - RNA, 15 nt, Salmonella enterica enterica serovar Typhi Ty2
ggaagaccguuuaaa

SEQ ID NO: 1791741 - RNA, 16 nt, Salmonella enterica enterica serovar Typhi Ty2
ggaaggaagggcgcug

SEQ ID NO: 1791742 - RNA, 17 nt, Salmonella enterica enterica serovar Typhi Ty2
ggaaggcuaccgcuggg

SEQ ID NO: 1791743 - RNA, 14 nt, Salmonella enterica enterica serovar Typhi Ty2
ggaauaucaauuca

SEQ ID NO: 1791744 - RNA, 15 nt, Salmonella enterica enterica serovar Typhi Ty2
ggaauaugauuuaaa

SEQ ID NO: 1791745 - RNA, 22 nt, Salmonella enterica enterica serovar Typhi Ty2
ggaaucaauuucccuucaauca

SEQ ID NO: 1791746 - RNA, 17 nt, Salmonella enterica enterica serovar Typhi Ty2
ggaaauuaaacugccuu

SEQ ID NO: 1791747 - RNA, 19 nt, Salmonella enterica enterica serovar Typhi Ty2
ggaaaugccgggcaaaaaa

SEQ ID NO: 1791748 - RNA, 22 nt, Salmonella enterica enterica serovar Typhi Ty2
ggaaaucuguuccagcgagcag

SEQ ID NO: 1791749 - RNA, 13 nt, Salmonella enterica enterica serovar Typhi Ty2
ggaaauagagcag

SEQ ID NO: 1791750 - RNA, 15 nt, Salmonella enterica enterica serovar Typhi Ty2
ggaaauaauuaaucc

SEQ ID NO: 1791751 - RNA, 17 nt, Salmonella enterica enterica serovar Typhi Ty2
ggaaagugaaggccaga

SEQ ID NO: 1791752 - RNA, 13 nt, Salmonella enterica enterica serovar Typhi Ty2
ggaaaggcagaga

SEQ ID NO: 1791753 - RNA, 22 nt, Salmonella enterica enterica serovar Typhi Ty2
ggaaaguaccaaaacagaaaag

SEQ ID NO: 1791754 - RNA, 17 nt, Salmonella enterica enterica serovar Typhi Ty2
ggaaacuaugcaaaacg

SEQ ID NO: 1791755 - RNA, 15 nt, Salmonella enterica enterica serovar Typhi Ty2
ggaaacucuuuuccc

SEQ ID NO: 1791756 - RNA, 23 nt, Salmonella enterica enterica serovar Typhi Ty2
ggaaacugugcgacaaccugcgc

SEQ ID NO: 1791757 - RNA, 24 nt, Salmonella enterica enterica serovar Typhi Ty2
ggaaagaaacgccgcgcaaagcaa

SEQ ID NO: 1791758 - RNA, 21 nt, Salmonella enterica enterica serovar Typhi Ty2
ggaaaccgucguuacccuccu

SEQ ID NO: 1791759 - RNA, 21 nt, Salmonella enterica enterica serovar Typhi Ty2
ggaaaacuggaagaagaaagg

SEQ ID NO: 1791760 - RNA, 14 nt, Salmonella enterica enterica serovar Typhi Ty2
ggaaaacuccagca

SEQ ID NO: 1791761 - RNA, 13 nt, Salmonella enterica enterica serovar Typhi Ty2
ggaaaauaauaau

SEQ ID NO: 1791762 - RNA, 22 nt, Salmonella enterica enterica serovar Typhi Ty2
ggaaaaugaugacucauuaaaa

SEQ ID NO: 1791763 - RNA, 19 nt, Salmonella enterica enterica serovar Typhi Ty2
ggauagugccugccgucgc

SEQ ID NO: 1791764 - RNA, 16 nt, Salmonella enterica enterica serovar Typhi Ty2
ggaguggcgaaauugg

SEQ ID NO: 1791765 - RNA, 13 nt, Salmonella enterica enterica serovar Typhi Ty2
ggagugcgcggcg

SEQ ID NO: 1791766 - RNA, 19 nt, Salmonella enterica enterica serovar Typhi Ty2
ggaguccagcaacugcgcg

SEQ ID NO: 1791767 - RNA, 22 nt, Salmonella enterica enterica serovar Typhi Ty2
ggaguauuuaccuacuguggug

SEQ ID NO: 1791768 - RNA, 14 nt, Salmonella enterica enterica serovar Typhi Ty2
ggagguucaccacc

SEQ ID NO: 1791769 - RNA, 19 nt, Salmonella enterica enterica serovar Typhi Ty2
ggagguauccuccugccag

SEQ ID NO: 1791770 - RNA, 16 nt, Salmonella enterica enterica serovar Typhi Ty2
ggauauacuucaucag

SEQ ID NO: 1791771 - RNA, 22 nt, Salmonella enterica enterica serovar Typhi Ty2
ggaucaccugaaugcaaagaag

SEQ ID NO: 1791772 - RNA, 20 nt, Salmonella enterica enterica serovar Typhi Ty2
ggaucagcagauccaucgcc

SEQ ID NO: 1791773 - RNA, 13 nt, Salmonella enterica enterica serovar Typhi Ty2
ggagaguuuugcc

SEQ ID NO: 1791774 - RNA, 23 nt, Salmonella enterica enterica serovar Typhi Ty2
ggagaguuuugccgucacagaga

SEQ ID NO: 1791775 - RNA, 19 nt, Salmonella enterica enterica serovar Typhi Ty2
ggagauauggcggggaggu

SEQ ID NO: 1791776 - RNA, 13 nt, Salmonella enterica enterica serovar Typhi Ty2
ggagaucagcaug

SEQ ID NO: 1791777 - RNA, 14 nt, Salmonella enterica enterica serovar Typhi Ty2
ggagcgcuucgcuu

SEQ ID NO: 1791778 - RNA, 22 nt, Salmonella enterica enterica serovar Typhi Ty2
ggagcgaagaauucgcaaugug

SEQ ID NO: 1791779 - RNA, 22 nt, Salmonella enterica enterica serovar Typhi Ty2
ggagcgugcucauuugcggcgu

SEQ ID NO: 1791780 - RNA, 19 nt, Salmonella enterica enterica serovar Typhi Ty2
ggagcugacugcaaaucug

SEQ ID NO: 1791781 - RNA, 22 nt, Salmonella enterica enterica serovar Typhi Ty2
ggaggaacagcgccgucacccg

SEQ ID NO: 1791782 - RNA, 16 nt, Salmonella enterica enterica serovar Typhi Ty2
ggagaagacgccgccg

SEQ ID NO: 1791783 - RNA, 22 nt, Salmonella enterica enterica serovar Typhi Ty2
ggagaacgguucauccagcagc

SEQ ID NO: 1791784 - RNA, 18 nt, Salmonella enterica enterica serovar Typhi Ty2
ggacuccugacgcugaga

SEQ ID NO: 1791785 - RNA, 16 nt, Salmonella enterica enterica serovar Typhi Ty2
ggacucgccuuucucc

SEQ ID NO: 1791786 - RNA, 14 nt, Salmonella enterica enterica serovar Typhi Ty2
ggacuccaggcaac

SEQ ID NO: 1791787 - RNA, 14 nt, Salmonella enterica enterica serovar Typhi Ty2
ggacuauaggcaau

SEQ ID NO: 1791788 - RNA, 17 nt, Salmonella enterica enterica serovar Typhi Ty2
ggacuauaggcaaugau

SEQ ID NO: 1791789 - RNA, 21 nt, Salmonella enterica enterica serovar Typhi Ty2
ggacucaccguuacaaauagc

SEQ ID NO: 1791790 - RNA, 18 nt, Salmonella enterica enterica serovar Typhi Ty2
ggacgcaccagccaggcg

SEQ ID NO: 1791791 - RNA, 13 nt, Salmonella enterica enterica serovar Typhi Ty2
ggacgcacccugu

SEQ ID NO: 1791792 - RNA, 21 nt, Salmonella enterica enterica serovar Typhi Ty2
ggacgccagucuuugcaggag

SEQ ID NO: 1791793 - RNA, 15 nt, Salmonella enterica enterica serovar Typhi Ty2
ggacggcggccagca

SEQ ID NO: 1791794 - RNA, 19 nt, Salmonella enterica enterica serovar Typhi Ty2
ggacgggauacggcgagac

SEQ ID NO: 1791795 - RNA, 21 nt, Salmonella enterica enterica serovar Typhi Ty2
ggacguggguuucaauauagc

SEQ ID NO: 1791796 - RNA, 13 nt, Salmonella enterica enterica serovar Typhi Ty2
ggaaucagccagg

SEQ ID NO: 1791797 - RNA, 14 nt, Salmonella enterica enterica serovar Typhi Ty2
ggaaucgcgaucca

SEQ ID NO: 1791798 - RNA, 15 nt, Salmonella enterica enterica serovar Typhi Ty2
ggaaucgucacagac

SEQ ID NO: 1791799 - RNA, 23 nt, Salmonella enterica enterica serovar Typhi Ty2
ggaaugaauguuagcgucugcgg

SEQ ID NO: 1791800 - RNA, 14 nt, Salmonella enterica enterica serovar Typhi Ty2
ggacaucaaaggca

SEQ ID NO: 1791801 - RNA, 17 nt, Salmonella enterica enterica serovar Typhi Ty2
ggacauaaacgccucau

SEQ ID NO: 1791802 - RNA, 13 nt, Salmonella enterica enterica serovar Typhi Ty2
ggacauaaacgcc

SEQ ID NO: 1791803 - RNA, 11 nt, Salmonella enterica enterica serovar Typhi Ty2
ggacaucaucc

SEQ ID NO: 1791804 - RNA, 17 nt, Salmonella enterica enterica serovar Typhi Ty2
ggacauauuccagaagc

SEQ ID NO: 1791805 - RNA, 12 nt, Salmonella enterica enterica serovar Typhi Ty2
ggaccagcacaa

SEQ ID NO: 1791806 - RNA, 14 nt, Salmonella enterica enterica serovar Typhi Ty2
aaaggggagggcaa

SEQ ID NO: 1791807 - RNA, 21 nt, Salmonella enterica enterica serovar Typhi Ty2
aaaggggagggcaacaaacau

SEQ ID NO: 1791808 - RNA, 18 nt, Salmonella enterica enterica serovar Typhi Ty2
ggcaaccugucaguacgu

SEQ ID NO: 1791809 - RNA, 18 nt, Salmonella enterica enterica serovar Typhi Ty2
ggcaacgacccgaagggc

SEQ ID NO: 1791810 - RNA, 20 nt, Salmonella enterica enterica serovar Typhi Ty2
ggcaaauccuccauaaauaa

SEQ ID NO: 1791811 - RNA, 16 nt, Salmonella enterica enterica serovar Typhi Ty2
ggcaacggcgacaaga

SEQ ID NO: 1791812 - RNA, 23 nt, Salmonella enterica enterica serovar Typhi Ty2
ggcaacgggacggcggccagcau

SEQ ID NO: 1791813 - RNA, 19 nt, Salmonella enterica enterica serovar Typhi Ty2
ggcaacguaagccaguucu

SEQ ID NO: 1791814 - RNA, 20 nt, Salmonella enterica enterica serovar Typhi Ty2
ggcaacgccagagcgucuca

SEQ ID NO: 1791815 - RNA, 23 nt, Salmonella enterica enterica serovar Typhi Ty2
ggcaacgccguacuccagcccau

SEQ ID NO: 1791816 - RNA, 17 nt, Salmonella enterica enterica serovar Typhi Ty2
ggcaaagccccagucau

SEQ ID NO: 1791817 - RNA, 11 nt, Salmonella enterica enterica serovar Typhi Ty2
ggcaaauagcg

SEQ ID NO: 1791818 - RNA, 17 nt, Salmonella enterica enterica serovar Typhi Ty2
ggcaaacggcgccagcu

SEQ ID NO: 1791819 - RNA, 11 nt, Salmonella enterica enterica serovar Typhi Ty2
ggcaaagguug

SEQ ID NO: 1791820 - RNA, 11 nt, Salmonella enterica enterica serovar Typhi Ty2
ggcaaagaccg

SEQ ID NO: 1791821 - RNA, 20 nt, Salmonella enterica enterica serovar Typhi Ty2
ggauuuaaaccgccccgacu

SEQ ID NO: 1791822 - RNA, 14 nt, Salmonella enterica enterica serovar Typhi Ty2
ggauuggucugauu

SEQ ID NO: 1791823 - RNA, 15 nt, Salmonella enterica enterica serovar Typhi Ty2
ggauuguuuuuuagc

SEQ ID NO: 1791824 - RNA, 21 nt, Salmonella enterica enterica serovar Typhi Ty2
ggauuggauaaaucggucauu

SEQ ID NO: 1791825 - RNA, 18 nt, Salmonella enterica enterica serovar Typhi Ty2
ggcaaaccauguacccuc

SEQ ID NO: 1791826 - RNA, 14 nt, Salmonella enterica enterica serovar Typhi Ty2
ggcaaacauagccu

SEQ ID NO: 1791827 - RNA, 23 nt, Salmonella enterica enterica serovar Typhi Ty2
ggcaaaccugcgguuaauacauc

SEQ ID NO: 1791828 - RNA, 15 nt, Salmonella enterica enterica serovar Typhi Ty2
ggcaauauguuuaaa

SEQ ID NO: 1791829 - RNA, 13 nt, Salmonella enterica enterica serovar Typhi Ty2
ggcaauauguuua

SEQ ID NO: 1791830 - RNA, 14 nt, Salmonella enterica enterica serovar Typhi Ty2
ggcaauaucaugaa

SEQ ID NO: 1791831 - RNA, 16 nt, Salmonella enterica enterica serovar Typhi Ty2
ggcaauauuaauguca

SEQ ID NO: 1791832 - RNA, 18 nt, Salmonella enterica enterica serovar Typhi Ty2
ggcaauccauuaauggcg

SEQ ID NO: 1791833 - RNA, 22 nt, Salmonella enterica enterica serovar Typhi Ty2
ggcaaucauaccgucagauucu

SEQ ID NO: 1791834 - RNA, 13 nt, Salmonella enterica enterica serovar Typhi Ty2
ggcaauuaacauu

SEQ ID NO: 1791835 - RNA, 23 nt, Salmonella enterica enterica serovar Typhi Ty2
ggcaauucaaucacuugaagccu

SEQ ID NO: 1791836 - RNA, 12 nt, Salmonella enterica enterica serovar Typhi Ty2
ggcaaugccacc

SEQ ID NO: 1791837 - RNA, 17 nt, Salmonella enterica enterica serovar Typhi Ty2
ggcaaucgccugcaacg

SEQ ID NO: 1791838 - RNA, 21 nt, Salmonella enterica enterica serovar Typhi Ty2
ggcacauauuccggcgcuggc

SEQ ID NO: 1791839 - RNA, 19 nt, Salmonella enterica enterica serovar Typhi Ty2
ggcaccacgaccagacugg

SEQ ID NO: 1791840 - RNA, 14 nt, Salmonella enterica enterica serovar Typhi Ty2
ggcacaaccuggcu

SEQ ID NO: 1791841 - RNA, 22 nt, Salmonella enterica enterica serovar Typhi Ty2
ggcaauuugacuacaaagcugg

SEQ ID NO: 1791842 - RNA, 15 nt, Salmonella enterica enterica serovar Typhi Ty2
ggcagcggcaagaca

SEQ ID NO: 1791843 - RNA, 22 nt, Salmonella enterica enterica serovar Typhi Ty2
aaaguacuucacaaucagcgca

SEQ ID NO: 1791844 - RNA, 19 nt, Salmonella enterica enterica serovar Typhi Ty2
ggcagcgcgaacaggcugg

SEQ ID NO: 1791845 - RNA, 19 nt, Salmonella enterica enterica serovar Typhi Ty2
ggcagcgccugacggcgcu

SEQ ID NO: 1791846 - RNA, 22 nt, Salmonella enterica enterica serovar Typhi Ty2
ggcacucaccucuuccgccagg

SEQ ID NO: 1791847 - RNA, 20 nt, Salmonella enterica enterica serovar Typhi Ty2
ggcacugacucuuccgggcg

SEQ ID NO: 1791848 - RNA, 23 nt, Salmonella enterica enterica serovar Typhi Ty2
ggcacugcgcuuauccggccuac

SEQ ID NO: 1791849 - RNA, 18 nt, Salmonella enterica enterica serovar Typhi Ty2
ggcagcacccggcccggc

SEQ ID NO: 1791850 - RNA, 19 nt, Salmonella enterica enterica serovar Typhi Ty2
ggcagcacaaucagcgcgg

SEQ ID NO: 1791851 - RNA, 23 nt, Salmonella enterica enterica serovar Typhi Ty2
ggcacuuuccgguuuccauggca

SEQ ID NO: 1791852 - RNA, 20 nt, Salmonella enterica enterica serovar Typhi Ty2
ggcagcaauacgcccgcccg

SEQ ID NO: 1791853 - RNA, 16 nt, Salmonella enterica enterica serovar Typhi Ty2
ggcagcaauacgcccg

SEQ ID NO: 1791854 - RNA, 21 nt, Salmonella enterica enterica serovar Typhi Ty2
ggcagaaaaaguagaaaaggu

SEQ ID NO: 1791855 - RNA, 15 nt, Salmonella enterica enterica serovar Typhi Ty2
ggcaccgguuuuuga

SEQ ID NO: 1791856 - RNA, 19 nt, Salmonella enterica enterica serovar Typhi Ty2
ggcaccucguccagauggg

SEQ ID NO: 1791857 - RNA, 19 nt, Salmonella enterica enterica serovar Typhi Ty2
ggcauaaaaaagaggaaug

SEQ ID NO: 1791858 - RNA, 16 nt, Salmonella enterica enterica serovar Typhi Ty2
ggcauaaacacagcaa

SEQ ID NO: 1791859 - RNA, 19 nt, Salmonella enterica enterica serovar Typhi Ty2
ggcauaaacacagcaaaca

SEQ ID NO: 1791860 - RNA, 14 nt, Salmonella enterica enterica serovar Typhi Ty2
ggcauacacgccgg

SEQ ID NO: 1791861 - RNA, 15 nt, Salmonella enterica enterica serovar Typhi Ty2
ggcauagacauccag

SEQ ID NO: 1791862 - RNA, 16 nt, Salmonella enterica enterica serovar Typhi Ty2
ggcaucgccgcccagu

SEQ ID NO: 1791863 - RNA, 18 nt, Salmonella enterica enterica serovar Typhi Ty2
ggcaucgcccguuuuacc

SEQ ID NO: 1791864 - RNA, 21 nt, Salmonella enterica enterica serovar Typhi Ty2
ggcaucugcaauucggcggca

SEQ ID NO: 1791865 - RNA, 18 nt, Salmonella enterica enterica serovar Typhi Ty2
ggcauccggcccgugcca

SEQ ID NO: 1791866 - RNA, 20 nt, Salmonella enterica enterica serovar Typhi Ty2
ggcagcgucggcuucaucac

SEQ ID NO: 1791867 - RNA, 14 nt, Salmonella enterica enterica serovar Typhi Ty2
ggcagcguccgcca

SEQ ID NO: 1791868 - RNA, 21 nt, Salmonella enterica enterica serovar Typhi Ty2
ggcagucgcuacaaccagcgc

SEQ ID NO: 1791869 - RNA, 23 nt, Salmonella enterica enterica serovar Typhi Ty2
ggcagucgcuacaaccagcgcgg

SEQ ID NO: 1791870 - RNA, 24 nt, Salmonella enterica enterica serovar Typhi Ty2
ggcagugaguaacguuaauacauc

SEQ ID NO: 1791871 - RNA, 22 nt, Salmonella enterica enterica serovar Typhi Ty2
ggcaguucagucgggaucgcca

SEQ ID NO: 1791872 - RNA, 15 nt, Salmonella enterica enterica serovar Typhi Ty2
ggcaguguuucccaa

SEQ ID NO: 1791873 - RNA, 12 nt, Salmonella enterica enterica serovar Typhi Ty2
ggcaguucccua

SEQ ID NO: 1791874 - RNA, 18 nt, Salmonella enterica enterica serovar Typhi Ty2
ggcaguuuauccggcgcc

SEQ ID NO: 1791875 - RNA, 13 nt, Salmonella enterica enterica serovar Typhi Ty2
ggcauaaaaaaag

SEQ ID NO: 1791876 - RNA, 23 nt, Salmonella enterica enterica serovar Typhi Ty2
ggccacauugaaugccgaauggc

SEQ ID NO: 1791877 - RNA, 14 nt, Salmonella enterica enterica serovar Typhi Ty2
ggccacagcgccag

SEQ ID NO: 1791878 - RNA, 18 nt, Salmonella enterica enterica serovar Typhi Ty2
ggccacagcgccagacac

SEQ ID NO: 1791879 - RNA, 15 nt, Salmonella enterica enterica serovar Typhi Ty2
ggccaaccgccacaa

SEQ ID NO: 1791880 - RNA, 22 nt, Salmonella enterica enterica serovar Typhi Ty2
ggccaacgcgcccucugagcug

SEQ ID NO: 1791881 - RNA, 19 nt, Salmonella enterica enterica serovar Typhi Ty2
ggccacaauugccagcagg

SEQ ID NO: 1791882 - RNA, 19 nt, Salmonella enterica enterica serovar Typhi Ty2
ggccaaaaccacagugacc

SEQ ID NO: 1791883 - RNA, 15 nt, Salmonella enterica enterica serovar Typhi Ty2
ggcauuaacaaauca

SEQ ID NO: 1791884 - RNA, 17 nt, Salmonella enterica enterica serovar Typhi Ty2
ggcauuucugucugacg

SEQ ID NO: 1791885 - RNA, 15 nt, Salmonella enterica enterica serovar Typhi Ty2
ggccaaacagcggcu

SEQ ID NO: 1791886 - RNA, 14 nt, Salmonella enterica enterica serovar Typhi Ty2
ggccaaauaaccca

SEQ ID NO: 1791887 - RNA, 19 nt, Salmonella enterica enterica serovar Typhi Ty2
ggcaugacuuuaccgguuu

SEQ ID NO: 1791888 - RNA, 20 nt, Salmonella enterica enterica serovar Typhi Ty2
ggccagcgaaaaccagcgcc

SEQ ID NO: 1791889 - RNA, 19 nt, Salmonella enterica enterica serovar Typhi Ty2
ggccagcgaaaaccagcgc

SEQ ID NO: 1791890 - RNA, 21 nt, Salmonella enterica enterica serovar Typhi Ty2
ggccagccgacgcucuuccuc

SEQ ID NO: 1791891 - RNA, 22 nt, Salmonella enterica enterica serovar Typhi Ty2
ggccaccgaagaauuuaucaau

SEQ ID NO: 1791892 - RNA, 22 nt, Salmonella enterica enterica serovar Typhi Ty2
ggccaccgauaaaaagcaaaga

SEQ ID NO: 1791893 - RNA, 18 nt, Salmonella enterica enterica serovar Typhi Ty2
ggccacggagugcgcggc

SEQ ID NO: 1791894 - RNA, 21 nt, Salmonella enterica enterica serovar Typhi Ty2
ggccaggcacguuaaacaccu

SEQ ID NO: 1791895 - RNA, 16 nt, Salmonella enterica enterica serovar Typhi Ty2
ggccaggcauugauaa

SEQ ID NO: 1791896 - RNA, 20 nt, Salmonella enterica enterica serovar Typhi Ty2
ggccagcguggaugaacuca

SEQ ID NO: 1791897 - RNA, 19 nt, Salmonella enterica enterica serovar Typhi Ty2
ggccaguagcgggggccgg

SEQ ID NO: 1791898 - RNA, 14 nt, Salmonella enterica enterica serovar Typhi Ty2
ggccagugccaagc

SEQ ID NO: 1791899 - RNA, 16 nt, Salmonella enterica enterica serovar Typhi Ty2
ggccagugccaagcaa

SEQ ID NO: 1791900 - RNA, 22 nt, Salmonella enterica enterica serovar Typhi Ty2
ggccaucgccgcagagaauaac

SEQ ID NO: 1791901 - RNA, 21 nt, Salmonella enterica enterica serovar Typhi Ty2
ggccaucgacgaaauggugug

SEQ ID NO: 1791902 - RNA, 19 nt, Salmonella enterica enterica serovar Typhi Ty2
ggccauuaagcuucgugag

SEQ ID NO: 1791903 - RNA, 17 nt, Salmonella enterica enterica serovar Typhi Ty2
ggccauugaagucccuu

SEQ ID NO: 1791904 - RNA, 17 nt, Salmonella enterica enterica serovar Typhi Ty2
ggcgucagcauggugug

SEQ ID NO: 1791905 - RNA, 22 nt, Salmonella enterica enterica serovar Typhi Ty2
ggcgucagcaugguguguuccc

SEQ ID NO: 1791906 - RNA, 21 nt, Salmonella enterica enterica serovar Typhi Ty2
ggcgucaucggcgccagccug

SEQ ID NO: 1791907 - RNA, 20 nt, Salmonella enterica enterica serovar Typhi Ty2
ggcgucacccgccggcagca

SEQ ID NO: 1791908 - RNA, 15 nt, Salmonella enterica enterica serovar Typhi Ty2
ggcguaauggcggga

SEQ ID NO: 1791909 - RNA, 21 nt, Salmonella enterica enterica serovar Typhi Ty2
ggcguaaaugugcgccagccu

SEQ ID NO: 1791910 - RNA, 16 nt, Salmonella enterica enterica serovar Typhi Ty2
ggcguaagaucgcggg

SEQ ID NO: 1791911 - RNA, 18 nt, Salmonella enterica enterica serovar Typhi Ty2
ggcggugauuuaaggcug

SEQ ID NO: 1791912 - RNA, 14 nt, Salmonella enterica enterica serovar Typhi Ty2
ggcggcuuggcugu

SEQ ID NO: 1791913 - RNA, 12 nt, Salmonella enterica enterica serovar Typhi Ty2
ggcggcgcagcg

SEQ ID NO: 1791914 - RNA, 14 nt, Salmonella enterica enterica serovar Typhi Ty2
ggcggcguaaacac

SEQ ID NO: 1791915 - RNA, 14 nt, Salmonella enterica enterica serovar Typhi Ty2
ggcggcgugcgccc

SEQ ID NO: 1791916 - RNA, 15 nt, Salmonella enterica enterica serovar Typhi Ty2
ggcgcuuacgggcga

SEQ ID NO: 1791917 - RNA, 17 nt, Salmonella enterica enterica serovar Typhi Ty2
ggcgcuuaccuaaguca

SEQ ID NO: 1791918 - RNA, 17 nt, Salmonella enterica enterica serovar Typhi Ty2
ggcgcuuccugcagugg

SEQ ID NO: 1791919 - RNA, 14 nt, Salmonella enterica enterica serovar Typhi Ty2
ggcgcuuccugcag

SEQ ID NO: 1791920 - RNA, 13 nt, Salmonella enterica enterica serovar Typhi Ty2
ggcgcuguucuug

SEQ ID NO: 1791921 - RNA, 17 nt, Salmonella enterica enterica serovar Typhi Ty2
ggcgcugucgccgcgca

SEQ ID NO: 1791922 - RNA, 18 nt, Salmonella enterica enterica serovar Typhi Ty2
ggcgcugucgccgcgcac

SEQ ID NO: 1791923 - RNA, 20 nt, Salmonella enterica enterica serovar Typhi Ty2
ggcgcuggcagggacgcugc

SEQ ID NO: 1791924 - RNA, 18 nt, Salmonella enterica enterica serovar Typhi Ty2
ggcgcuggcuugaccgcu

SEQ ID NO: 1791925 - RNA, 18 nt, Salmonella enterica enterica serovar Typhi Ty2
ggcggaaaugcggguccu

SEQ ID NO: 1791926 - RNA, 23 nt, Salmonella enterica enterica serovar Typhi Ty2
ggcgcuuuacaugacgcucuccg

SEQ ID NO: 1791927 - RNA, 18 nt, Salmonella enterica enterica serovar Typhi Ty2
ggcggcccgcauugaacg

SEQ ID NO: 1791928 - RNA, 18 nt, Salmonella enterica enterica serovar Typhi Ty2
ggcggcccacucauccag

SEQ ID NO: 1791929 - RNA, 18 nt, Salmonella enterica enterica serovar Typhi Ty2
ggcucagcauagcgcuga

SEQ ID NO: 1791930 - RNA, 12 nt, Salmonella enterica enterica serovar Typhi Ty2
ggcucaaauugg

SEQ ID NO: 1791931 - RNA, 19 nt, Salmonella enterica enterica serovar Typhi Ty2
ggcuaugaagagaaacaua

SEQ ID NO: 1791932 - RNA, 12 nt, Salmonella enterica enterica serovar Typhi Ty2
ggcucaccagcc

SEQ ID NO: 1791933 - RNA, 13 nt, Salmonella enterica enterica serovar Typhi Ty2
ggcuauagcucag

SEQ ID NO: 1791934 - RNA, 13 nt, Salmonella enterica enterica serovar Typhi Ty2
ggcuauuuuauuc

SEQ ID NO: 1791935 - RNA, 21 nt, Salmonella enterica enterica serovar Typhi Ty2
ggcuauuuuuugcuggcggca

SEQ ID NO: 1791936 - RNA, 16 nt, Salmonella enterica enterica serovar Typhi Ty2
ggcucaaacggccugc

SEQ ID NO: 1791937 - RNA, 22 nt, Salmonella enterica enterica serovar Typhi Ty2
ggcucaaacggccugcgcugga

SEQ ID NO: 1791938 - RNA, 17 nt, Salmonella enterica enterica serovar Typhi Ty2
ggcuaagccaaaaauaa

SEQ ID NO: 1791939 - RNA, 18 nt, Salmonella enterica enterica serovar Typhi Ty2
ggcguuucaacaaacuca

SEQ ID NO: 1791940 - RNA, 19 nt, Salmonella enterica enterica serovar Typhi Ty2
ggcguucugcgccauuucc

SEQ ID NO: 1791941 - RNA, 13 nt, Salmonella enterica enterica serovar Typhi Ty2
ggcguuccgcaca

SEQ ID NO: 1791942 - RNA, 20 nt, Salmonella enterica enterica serovar Typhi Ty2
ggcguuguaagguuaagccu

SEQ ID NO: 1791943 - RNA, 16 nt, Salmonella enterica enterica serovar Typhi Ty2
ggcgucuuaaugcucu

SEQ ID NO: 1791944 - RNA, 19 nt, Salmonella enterica enterica serovar Typhi Ty2
ggcgugacaccgguuugcg

SEQ ID NO: 1791945 - RNA, 13 nt, Salmonella enterica enterica serovar Typhi Ty2
ggcguguggcugu

SEQ ID NO: 1791946 - RNA, 22 nt, Salmonella enterica enterica serovar Typhi Ty2
ggcguuaaucaccggcgcgggc

SEQ ID NO: 1791947 - RNA, 17 nt, Salmonella enterica enterica serovar Typhi Ty2
ggcguuacagacgcugc

SEQ ID NO: 1791948 - RNA, 19 nt, Salmonella enterica enterica serovar Typhi Ty2
ggcguuaccggcaggcugg

SEQ ID NO: 1791949 - RNA, 18 nt, Salmonella enterica enterica serovar Typhi Ty2
ggcguuacccgucuggcg

SEQ ID NO: 1791950 - RNA, 22 nt, Salmonella enterica enterica serovar Typhi Ty2
ggcgugguggauauccagcaua

SEQ ID NO: 1791951 - RNA, 13 nt, Salmonella enterica enterica serovar Typhi Ty2
ggcguggugucuc

SEQ ID NO: 1791952 - RNA, 19 nt, Salmonella enterica enterica serovar Typhi Ty2
ggcgugauaaaacauucca

SEQ ID NO: 1791953 - RNA, 15 nt, Salmonella enterica enterica serovar Typhi Ty2
ggcgauggcucgccc

SEQ ID NO: 1791954 - RNA, 15 nt, Salmonella enterica enterica serovar Typhi Ty2
ggcgcaauaacgaua

SEQ ID NO: 1791955 - RNA, 18 nt, Salmonella enterica enterica serovar Typhi Ty2
ggcgcacaauaccgagaa

SEQ ID NO: 1791956 - RNA, 16 nt, Salmonella enterica enterica serovar Typhi Ty2
ggcgaggggcaggcgu

SEQ ID NO: 1791957 - RNA, 17 nt, Salmonella enterica enterica serovar Typhi Ty2
ggcgaguucucgcucuu

SEQ ID NO: 1791958 - RNA, 23 nt, Salmonella enterica enterica serovar Typhi Ty2
ggcgauaaaccaacagccgccug

SEQ ID NO: 1791959 - RNA, 17 nt, Salmonella enterica enterica serovar Typhi Ty2
ggcgaucagcgccacca

SEQ ID NO: 1791960 - RNA, 16 nt, Salmonella enterica enterica serovar Typhi Ty2
ggcgauaacccgcgca

SEQ ID NO: 1791961 - RNA, 18 nt, Salmonella enterica enterica serovar Typhi Ty2
ggcgaauuuacgggcgcg

SEQ ID NO: 1791962 - RNA, 15 nt, Salmonella enterica enterica serovar Typhi Ty2
ggcgacaagaauaug

SEQ ID NO: 1791963 - RNA, 22 nt, Salmonella enterica enterica serovar Typhi Ty2
ggcgcccauuucguuaaugcug

SEQ ID NO: 1791964 - RNA, 22 nt, Salmonella enterica enterica serovar Typhi Ty2
ggcgccaucgccuccagacugg

SEQ ID NO: 1791965 - RNA, 18 nt, Salmonella enterica enterica serovar Typhi Ty2
ggcgccauuggcucggcg

SEQ ID NO: 1791966 - RNA, 19 nt, Salmonella enterica enterica serovar Typhi Ty2
ggcgcauucucugucgccg

SEQ ID NO: 1791967 - RNA, 21 nt, Salmonella enterica enterica serovar Typhi Ty2
ggcgcauuuucggcagcgcga

SEQ ID NO: 1791968 - RNA, 16 nt, Salmonella enterica enterica serovar Typhi Ty2
ggcgccaaucaccgcc

SEQ ID NO: 1791969 - RNA, 23 nt, Salmonella enterica enterica serovar Typhi Ty2
ggcgcaucagaaaaaccuccggc

SEQ ID NO: 1791970 - RNA, 14 nt, Salmonella enterica enterica serovar Typhi Ty2
ggcgcaucagaaaa

SEQ ID NO: 1791971 - RNA, 15 nt, Salmonella enterica enterica serovar Typhi Ty2
ggcgcaucagaaaaa

SEQ ID NO: 1791972 - RNA, 22 nt, Salmonella enterica enterica serovar Typhi Ty2
ggcgcaguuuacgcagcgccuu

SEQ ID NO: 1791973 - RNA, 19 nt, Salmonella enterica enterica serovar Typhi Ty2
ggcgcauaaugacguccag

SEQ ID NO: 1791974 - RNA, 15 nt, Salmonella enterica enterica serovar Typhi Ty2
ggcgcauaucgcccu

SEQ ID NO: 1791975 - RNA, 14 nt, Salmonella enterica enterica serovar Typhi Ty2
ggcgcaguggcggg

SEQ ID NO: 1791976 - RNA, 13 nt, Salmonella enterica enterica serovar Typhi Ty2
aaauaccgcacau

SEQ ID NO: 1791977 - RNA, 15 nt, Salmonella enterica enterica serovar Typhi Ty2
aaauacccucaguuc

SEQ ID NO: 1791978 - RNA, 22 nt, Salmonella enterica enterica serovar Typhi Ty2
ggcgcagcgaaacugcgcgccg

SEQ ID NO: 1791979 - RNA, 17 nt, Salmonella enterica enterica serovar Typhi Ty2
ggcgcagcauacgcugc

SEQ ID NO: 1791980 - RNA, 14 nt, Salmonella enterica enterica serovar Typhi Ty2
ggcgcagagugagc

SEQ ID NO: 1791981 - RNA, 19 nt, Salmonella enterica enterica serovar Typhi Ty2
ggcgcacuuccucucccac

SEQ ID NO: 1791982 - RNA, 16 nt, Salmonella enterica enterica serovar Typhi Ty2
ggcgcgauauccacca

SEQ ID NO: 1791983 - RNA, 15 nt, Salmonella enterica enterica serovar Typhi Ty2
ggcgccgaucauccc

SEQ ID NO: 1791984 - RNA, 12 nt, Salmonella enterica enterica serovar Typhi Ty2
ggcgccggcgcg

SEQ ID NO: 1791985 - RNA, 23 nt, Salmonella enterica enterica serovar Typhi Ty2
ggcgccggauggcggcugcgccu

SEQ ID NO: 1791986 - RNA, 19 nt, Salmonella enterica enterica serovar Typhi Ty2
ggcgccggagucgacggcg

SEQ ID NO: 1791987 - RNA, 15 nt, Salmonella enterica enterica serovar Typhi Ty2
ggcgcucaaucagaa

SEQ ID NO: 1791988 - RNA, 18 nt, Salmonella enterica enterica serovar Typhi Ty2
ggcgcuaagccagccaaa

SEQ ID NO: 1791989 - RNA, 22 nt, Salmonella enterica enterica serovar Typhi Ty2
ggcgcguuuacuggcgacgacc

SEQ ID NO: 1791990 - RNA, 20 nt, Salmonella enterica enterica serovar Typhi Ty2
ggcgcgguauuucgccgccg

SEQ ID NO: 1791991 - RNA, 21 nt, Salmonella enterica enterica serovar Typhi Ty2
ggcgcugaacgcauacaggcu

SEQ ID NO: 1791992 - RNA, 13 nt, Salmonella enterica enterica serovar Typhi Ty2
ggcgcgcgcgcca

SEQ ID NO: 1791993 - RNA, 14 nt, Salmonella enterica enterica serovar Typhi Ty2
aaauacugauuaau

SEQ ID NO: 1791994 - RNA, 22 nt, Salmonella enterica enterica serovar Typhi Ty2
aaauacuggccgguuuuaaaaa

SEQ ID NO: 1791995 - RNA, 19 nt, Salmonella enterica enterica serovar Typhi Ty2
ggccuucugcuaucaggau

SEQ ID NO: 1791996 - RNA, 15 nt, Salmonella enterica enterica serovar Typhi Ty2
ggccuucaaucagca

SEQ ID NO: 1791997 - RNA, 17 nt, Salmonella enterica enterica serovar Typhi Ty2
ggcgaacguuggcuggg

SEQ ID NO: 1791998 - RNA, 16 nt, Salmonella enterica enterica serovar Typhi Ty2
ggcgaacucggucagg

SEQ ID NO: 1791999 - RNA, 15 nt, Salmonella enterica enterica serovar Typhi Ty2
ggcgaauaaaauuca

SEQ ID NO: 1792000 - RNA, 22 nt, Salmonella enterica enterica serovar Typhi Ty2
aaauaaauaguaaauagaaaau

SEQ ID NO: 1792001 - RNA, 16 nt, Salmonella enterica enterica serovar Typhi Ty2
aaauaaauccaugaga

SEQ ID NO: 1792002 - RNA, 18 nt, Salmonella enterica enterica serovar Typhi Ty2
aaauaaaugauauuuaaa

SEQ ID NO: 1792003 - RNA, 19 nt, Salmonella enterica enterica serovar Typhi Ty2
aaauaaaugauauuuaaaa

SEQ ID NO: 1792004 - RNA, 20 nt, Salmonella enterica enterica serovar Typhi Ty2
aaauaaauauguuauuuaca

SEQ ID NO: 1792005 - RNA, 18 nt, Salmonella enterica enterica serovar Typhi Ty2
aaauaaaguguuaucaug

SEQ ID NO: 1792006 - RNA, 22 nt, Salmonella enterica enterica serovar Typhi Ty2
ggccugucacguaaaauuagac

SEQ ID NO: 1792007 - RNA, 22 nt, Salmonella enterica enterica serovar Typhi Ty2
ggccugugacguuaacgcagca

SEQ ID NO: 1792008 - RNA, 23 nt, Salmonella enterica enterica serovar Typhi Ty2
ggccugucccuucgcccggcgcg

SEQ ID NO: 1792009 - RNA, 17 nt, Salmonella enterica enterica serovar Typhi Ty2
ggccuguuucuuaccac

SEQ ID NO: 1792010 - RNA, 22 nt, Salmonella enterica enterica serovar Typhi Ty2
ggccugcagagcggcaaauuca

SEQ ID NO: 1792011 - RNA, 14 nt, Salmonella enterica enterica serovar Typhi Ty2
ggccugcaucaaca

SEQ ID NO: 1792012 - RNA, 18 nt, Salmonella enterica enterica serovar Typhi Ty2
ggccugauaagcgcagcg

SEQ ID NO: 1792013 - RNA, 16 nt, Salmonella enterica enterica serovar Typhi Ty2
ggccugauagcacagc

SEQ ID NO: 1792014 - RNA, 16 nt, Salmonella enterica enterica serovar Typhi Ty2
ggccugcagagcggca

SEQ ID NO: 1792015 - RNA, 15 nt, Salmonella enterica enterica serovar Typhi Ty2
ggccugccguccuga

SEQ ID NO: 1792016 - RNA, 17 nt, Salmonella enterica enterica serovar Typhi Ty2
ggccugccggguuuaau

SEQ ID NO: 1792017 - RNA, 12 nt, Salmonella enterica enterica serovar Typhi Ty2
ggccuggagauc

SEQ ID NO: 1792018 - RNA, 16 nt, Salmonella enterica enterica serovar Typhi Ty2
ggccuggagaucagca

SEQ ID NO: 1792019 - RNA, 13 nt, Salmonella enterica enterica serovar Typhi Ty2
aaauaaacaccau

SEQ ID NO: 1792020 - RNA, 22 nt, Salmonella enterica enterica serovar Typhi Ty2
aaauaaacacuaaaucauaauu

SEQ ID NO: 1792021 - RNA, 12 nt, Salmonella enterica enterica serovar Typhi Ty2
aaauaaaauuau

SEQ ID NO: 1792022 - RNA, 16 nt, Salmonella enterica enterica serovar Typhi Ty2
aaauaaaauacuucca

SEQ ID NO: 1792023 - RNA, 22 nt, Salmonella enterica enterica serovar Typhi Ty2
aaauaaaauacgcucaauauac

SEQ ID NO: 1792024 - RNA, 17 nt, Salmonella enterica enterica serovar Typhi Ty2
aaauaaaaggggccugc

SEQ ID NO: 1792025 - RNA, 14 nt, Salmonella enterica enterica serovar Typhi Ty2
aaauaaaaauuccc

SEQ ID NO: 1792026 - RNA, 13 nt, Salmonella enterica enterica serovar Typhi Ty2
aaauaaaaauucc

SEQ ID NO: 1792027 - RNA, 17 nt, Salmonella enterica enterica serovar Typhi Ty2
ggccuggcugagaaaaa

SEQ ID NO: 1792028 - RNA, 19 nt, Salmonella enterica enterica serovar Typhi Ty2
ggccugcuuaaacaguauu

SEQ ID NO: 1792029 - RNA, 22 nt, Salmonella enterica enterica serovar Typhi Ty2
ggccugaaugcagaccucugcu

SEQ ID NO: 1792030 - RNA, 22 nt, Salmonella enterica enterica serovar Typhi Ty2
ggccugaccauggaguuucagu

SEQ ID NO: 1792031 - RNA, 17 nt, Salmonella enterica enterica serovar Typhi Ty2
ggccucuucacgcagcg

SEQ ID NO: 1792032 - RNA, 13 nt, Salmonella enterica enterica serovar Typhi Ty2
ggccuccggcggg

SEQ ID NO: 1792033 - RNA, 14 nt, Salmonella enterica enterica serovar Typhi Ty2
ggccuccggcgggu

SEQ ID NO: 1792034 - RNA, 12 nt, Salmonella enterica enterica serovar Typhi Ty2
ggccuccugacg

SEQ ID NO: 1792035 - RNA, 18 nt, Salmonella enterica enterica serovar Typhi Ty2
ggccuccugacgaagggc

SEQ ID NO: 1792036 - RNA, 18 nt, Salmonella enterica enterica serovar Typhi Ty2
ggccuacagaacugcacg

SEQ ID NO: 1792037 - RNA, 18 nt, Salmonella enterica enterica serovar Typhi Ty2
ggccuacaaggcauucag

SEQ ID NO: 1792038 - RNA, 16 nt, Salmonella enterica enterica serovar Typhi Ty2
ggccuacauucauuaa

SEQ ID NO: 1792039 - RNA, 15 nt, Salmonella enterica enterica serovar Typhi Ty2
ggccuauagacaccu

SEQ ID NO: 1792040 - RNA, 21 nt, Salmonella enterica enterica serovar Typhi Ty2
ggccuaucuguucgcaggacu

SEQ ID NO: 1792041 - RNA, 15 nt, Salmonella enterica enterica serovar Typhi Ty2
ggccguuuucaugca

SEQ ID NO: 1792042 - RNA, 23 nt, Salmonella enterica enterica serovar Typhi Ty2
ggccguuggcuuuaugcacgccg

SEQ ID NO: 1792043 - RNA, 15 nt, Salmonella enterica enterica serovar Typhi Ty2
ggccguuaaaccaaa

SEQ ID NO: 1792044 - RNA, 17 nt, Salmonella enterica enterica serovar Typhi Ty2
ggccgguuggcuccagu

SEQ ID NO: 1792045 - RNA, 21 nt, Salmonella enterica enterica serovar Typhi Ty2
ggccgucccacgcgccgccga

SEQ ID NO: 1792046 - RNA, 22 nt, Salmonella enterica enterica serovar Typhi Ty2
ggccgucacuuuaucacuccuu

SEQ ID NO: 1792047 - RNA, 21 nt, Salmonella enterica enterica serovar Typhi Ty2
ggccgucagacauauacucuu

SEQ ID NO: 1792048 - RNA, 19 nt, Salmonella enterica enterica serovar Typhi Ty2
ggccgucaaaccggcgguc

SEQ ID NO: 1792049 - RNA, 18 nt, Salmonella enterica enterica serovar Typhi Ty2
aaaguguguaccagcagc

SEQ ID NO: 1792050 - RNA, 14 nt, Salmonella enterica enterica serovar Typhi Ty2
aaaguuaaucagcg

SEQ ID NO: 1792051 - RNA, 12 nt, Salmonella enterica enterica serovar Typhi Ty2
ggccgccagcgc

SEQ ID NO: 1792052 - RNA, 22 nt, Salmonella enterica enterica serovar Typhi Ty2
ggccgccagcgugacccagaca

SEQ ID NO: 1792053 - RNA, 13 nt, Salmonella enterica enterica serovar Typhi Ty2
ggccgccagcaac

SEQ ID NO: 1792054 - RNA, 12 nt, Salmonella enterica enterica serovar Typhi Ty2
aaaguuauuaca

SEQ ID NO: 1792055 - RNA, 19 nt, Salmonella enterica enterica serovar Typhi Ty2
aaaguuagccccuuaucaa

SEQ ID NO: 1792056 - RNA, 16 nt, Salmonella enterica enterica serovar Typhi Ty2
aaaguuauuuuuucuu

SEQ ID NO: 1792057 - RNA, 17 nt, Salmonella enterica enterica serovar Typhi Ty2
ggccgcccggacccgcu

SEQ ID NO: 1792058 - RNA, 13 nt, Salmonella enterica enterica serovar Typhi Ty2
ggccgccgagcug

SEQ ID NO: 1792059 - RNA, 16 nt, Salmonella enterica enterica serovar Typhi Ty2
ggccgccgcacaggcg

SEQ ID NO: 1792060 - RNA, 18 nt, Salmonella enterica enterica serovar Typhi Ty2
ggccgcaaccgccaauaa

SEQ ID NO: 1792061 - RNA, 20 nt, Salmonella enterica enterica serovar Typhi Ty2
ggccgcaaacagcacgcccu

SEQ ID NO: 1792062 - RNA, 16 nt, Salmonella enterica enterica serovar Typhi Ty2
ggccgauuucauucag

SEQ ID NO: 1792063 - RNA, 13 nt, Salmonella enterica enterica serovar Typhi Ty2
ggccgcagcgcca

SEQ ID NO: 1792064 - RNA, 13 nt, Salmonella enterica enterica serovar Typhi Ty2
ggcccaaacgaug

SEQ ID NO: 1792065 - RNA, 22 nt, Salmonella enterica enterica serovar Typhi Ty2
aaagugccagggcggaagcaga

SEQ ID NO: 1792066 - RNA, 21 nt, Salmonella enterica enterica serovar Typhi Ty2
ggccgauauugcggccuuccu

SEQ ID NO: 1792067 - RNA, 19 nt, Salmonella enterica enterica serovar Typhi Ty2
ggccgauauugcggccuuc

SEQ ID NO: 1792068 - RNA, 14 nt, Salmonella enterica enterica serovar Typhi Ty2
ggccgcucgccugc

SEQ ID NO: 1792069 - RNA, 12 nt, Salmonella enterica enterica serovar Typhi Ty2
ggccgcucgccu

SEQ ID NO: 1792070 - RNA, 16 nt, Salmonella enterica enterica serovar Typhi Ty2
ggccgcuauccucgcc

SEQ ID NO: 1792071 - RNA, 14 nt, Salmonella enterica enterica serovar Typhi Ty2
ggccgcggcuguaa

SEQ ID NO: 1792072 - RNA, 16 nt, Salmonella enterica enterica serovar Typhi Ty2
aaaguuuauuugaaua

SEQ ID NO: 1792073 - RNA, 12 nt, Salmonella enterica enterica serovar Typhi Ty2
aaaguuucagga

SEQ ID NO: 1792074 - RNA, 15 nt, Salmonella enterica enterica serovar Typhi Ty2
aaaguugcaucaaga

SEQ ID NO: 1792075 - RNA, 18 nt, Salmonella enterica enterica serovar Typhi Ty2
ggccggauaaggcgcuug

SEQ ID NO: 1792076 - RNA, 18 nt, Salmonella enterica enterica serovar Typhi Ty2
ggccggauaagcgcagcg

SEQ ID NO: 1792077 - RNA, 19 nt, Salmonella enterica enterica serovar Typhi Ty2
ggccggauaagcggcagcg

SEQ ID NO: 1792078 - RNA, 19 nt, Salmonella enterica enterica serovar Typhi Ty2
ggccggcaccagccaggaa

SEQ ID NO: 1792079 - RNA, 21 nt, Salmonella enterica enterica serovar Typhi Ty2
ggccgcuuugcgaacagcgca

SEQ ID NO: 1792080 - RNA, 17 nt, Salmonella enterica enterica serovar Typhi Ty2
ggccggcuucuccacca

SEQ ID NO: 1792081 - RNA, 23 nt, Salmonella enterica enterica serovar Typhi Ty2
ggccgggccugagcgcgcagcug

SEQ ID NO: 1792082 - RNA, 13 nt, Salmonella enterica enterica serovar Typhi Ty2
gagcgaaggggcg

SEQ ID NO: 1792083 - RNA, 20 nt, Salmonella enterica enterica serovar Typhi Ty2
gagcgaacaguacggucagg

SEQ ID NO: 1792084 - RNA, 16 nt, Salmonella enterica enterica serovar Typhi Ty2
gagcgaauguauaauc

SEQ ID NO: 1792085 - RNA, 12 nt, Salmonella enterica enterica serovar Typhi Ty2
gagcugcugcuu

SEQ ID NO: 1792086 - RNA, 13 nt, Salmonella enterica enterica serovar Typhi Ty2
gaggacagugaaa

SEQ ID NO: 1792087 - RNA, 15 nt, Salmonella enterica enterica serovar Typhi Ty2
gaggacauuaaaguc

SEQ ID NO: 1792088 - RNA, 15 nt, Salmonella enterica enterica serovar Typhi Ty2
gaggaugccugcgca

SEQ ID NO: 1792089 - RNA, 21 nt, Salmonella enterica enterica serovar Typhi Ty2
gaggaugaaaaguauggcggu

SEQ ID NO: 1792090 - RNA, 22 nt, Salmonella enterica enterica serovar Typhi Ty2
gaggauauuuauuugcauugua

SEQ ID NO: 1792091 - RNA, 15 nt, Salmonella enterica enterica serovar Typhi Ty2
gagggaaauagccua

SEQ ID NO: 1792092 - RNA, 21 nt, Salmonella enterica enterica serovar Typhi Ty2
gaggcaggggcucuaaaaagg

SEQ ID NO: 1792093 - RNA, 12 nt, Salmonella enterica enterica serovar Typhi Ty2
gaggcagugaaa

SEQ ID NO: 1792094 - RNA, 23 nt, Salmonella enterica enterica serovar Typhi Ty2
gaggcaggggcucuaaaaaggaa

SEQ ID NO: 1792095 - RNA, 12 nt, Salmonella enterica enterica serovar Typhi Ty2
gaggcagcagga

SEQ ID NO: 1792096 - RNA, 15 nt, Salmonella enterica enterica serovar Typhi Ty2
gaggcguaucccagu

SEQ ID NO: 1792097 - RNA, 13 nt, Salmonella enterica enterica serovar Typhi Ty2
gaggcauaaaaaa

SEQ ID NO: 1792098 - RNA, 22 nt, Salmonella enterica enterica serovar Typhi Ty2
gaggcguugcuccagcagcgcc

SEQ ID NO: 1792099 - RNA, 14 nt, Salmonella enterica enterica serovar Typhi Ty2
gaggcuaagccaga

SEQ ID NO: 1792100 - RNA, 20 nt, Salmonella enterica enterica serovar Typhi Ty2
gaggcuaauuaucugccagc

SEQ ID NO: 1792101 - RNA, 15 nt, Salmonella enterica enterica serovar Typhi Ty2
gaggugcucucccag

SEQ ID NO: 1792102 - RNA, 12 nt, Salmonella enterica enterica serovar Typhi Ty2
gaggugauaauc

SEQ ID NO: 1792103 - RNA, 17 nt, Salmonella enterica enterica serovar Typhi Ty2
gagggcgaacuggcggu

SEQ ID NO: 1792104 - RNA, 14 nt, Salmonella enterica enterica serovar Typhi Ty2
gauaaagcgaauaa

SEQ ID NO: 1792105 - RNA, 20 nt, Salmonella enterica enterica serovar Typhi Ty2
gauaaagcgaccgaucauca

SEQ ID NO: 1792106 - RNA, 19 nt, Salmonella enterica enterica serovar Typhi Ty2
gauaaagcugaguaaggac

SEQ ID NO: 1792107 - RNA, 16 nt, Salmonella enterica enterica serovar Typhi Ty2
gauaaaaagacagaua

SEQ ID NO: 1792108 - RNA, 18 nt, Salmonella enterica enterica serovar Typhi Ty2
gauaaagguacuuucccc

SEQ ID NO: 1792109 - RNA, 15 nt, Salmonella enterica enterica serovar Typhi Ty2
gauaaauucaaugag

SEQ ID NO: 1792110 - RNA, 20 nt, Salmonella enterica enterica serovar Typhi Ty2
gauaacaccagcgauccaga

SEQ ID NO: 1792111 - RNA, 22 nt, Salmonella enterica enterica serovar Typhi Ty2
gaguggaugacaucgcaaugcc

SEQ ID NO: 1792112 - RNA, 13 nt, Salmonella enterica enterica serovar Typhi Ty2
gaguggaaucagc

SEQ ID NO: 1792113 - RNA, 17 nt, Salmonella enterica enterica serovar Typhi Ty2
gaguuaaugccaucauc

SEQ ID NO: 1792114 - RNA, 18 nt, Salmonella enterica enterica serovar Typhi Ty2
gaguuaaugccaucauca

SEQ ID NO: 1792115 - RNA, 15 nt, Salmonella enterica enterica serovar Typhi Ty2
gagugcguucuucca

SEQ ID NO: 1792116 - RNA, 23 nt, Salmonella enterica enterica serovar Typhi Ty2
gaguuggcauucgaauccuccug

SEQ ID NO: 1792117 - RNA, 16 nt, Salmonella enterica enterica serovar Typhi Ty2
gaguaguuaaaaaagg

SEQ ID NO: 1792118 - RNA, 20 nt, Salmonella enterica enterica serovar Typhi Ty2
gaguauagcggcguuuauau

SEQ ID NO: 1792119 - RNA, 20 nt, Salmonella enterica enterica serovar Typhi Ty2
gaguaaaaccggcacaucca

SEQ ID NO: 1792120 - RNA, 19 nt, Salmonella enterica enterica serovar Typhi Ty2
gaguagcugagcgucaggc

SEQ ID NO: 1792121 - RNA, 19 nt, Salmonella enterica enterica serovar Typhi Ty2
gagguucgccucccucacc

SEQ ID NO: 1792122 - RNA, 18 nt, Salmonella enterica enterica serovar Typhi Ty2
gagguuucagcaccucca

SEQ ID NO: 1792123 - RNA, 13 nt, Salmonella enterica enterica serovar Typhi Ty2
gagguuucuucau

SEQ ID NO: 1792124 - RNA, 16 nt, Salmonella enterica enterica serovar Typhi Ty2
gagguuucuucaucaa

SEQ ID NO: 1792125 - RNA, 18 nt, Salmonella enterica enterica serovar Typhi Ty2
gagguucccgccgccauu

SEQ ID NO: 1792126 - RNA, 23 nt, Salmonella enterica enterica serovar Typhi Ty2
gagucguuauccagaucuucaga

SEQ ID NO: 1792127 - RNA, 15 nt, Salmonella enterica enterica serovar Typhi Ty2
gaguccagcggcagc

SEQ ID NO: 1792128 - RNA, 20 nt, Salmonella enterica enterica serovar Typhi Ty2
gaguccauauccguacauaa

SEQ ID NO: 1792129 - RNA, 19 nt, Salmonella enterica enterica serovar Typhi Ty2
gaguccccucaaacaggcu

SEQ ID NO: 1792130 - RNA, 14 nt, Salmonella enterica enterica serovar Typhi Ty2
gagucuacaucaag

SEQ ID NO: 1792131 - RNA, 22 nt, Salmonella enterica enterica serovar Typhi Ty2
gauauccgcgcucaacacauaa

SEQ ID NO: 1792132 - RNA, 18 nt, Salmonella enterica enterica serovar Typhi Ty2
gauauccgcgcucaacac

SEQ ID NO: 1792133 - RNA, 22 nt, Salmonella enterica enterica serovar Typhi Ty2
gauaucagggcuuuuuucucgc

SEQ ID NO: 1792134 - RNA, 13 nt, Salmonella enterica enterica serovar Typhi Ty2
gauauucaucgcc

SEQ ID NO: 1792135 - RNA, 15 nt, Salmonella enterica enterica serovar Typhi Ty2
gauauuccauacagu

SEQ ID NO: 1792136 - RNA, 18 nt, Salmonella enterica enterica serovar Typhi Ty2
gauauucccguuccagcu

SEQ ID NO: 1792137 - RNA, 15 nt, Salmonella enterica enterica serovar Typhi Ty2
gauauucgccugucu

SEQ ID NO: 1792138 - RNA, 22 nt, Salmonella enterica enterica serovar Typhi Ty2
gauauuguguuuaccucauaua

SEQ ID NO: 1792139 - RNA, 19 nt, Salmonella enterica enterica serovar Typhi Ty2
gauauuucgccuaucaugc

SEQ ID NO: 1792140 - RNA, 14 nt, Salmonella enterica enterica serovar Typhi Ty2
gauauuuugcugca

SEQ ID NO: 1792141 - RNA, 16 nt, Salmonella enterica enterica serovar Typhi Ty2
gaucaauugcgguggc

SEQ ID NO: 1792142 - RNA, 13 nt, Salmonella enterica enterica serovar Typhi Ty2
gaucaaucacgcc

SEQ ID NO: 1792143 - RNA, 11 nt, Salmonella enterica enterica serovar Typhi Ty2
gauagccuuau

SEQ ID NO: 1792144 - RNA, 15 nt, Salmonella enterica enterica serovar Typhi Ty2
gauagcgucaacgcu

SEQ ID NO: 1792145 - RNA, 22 nt, Salmonella enterica enterica serovar Typhi Ty2
gauagcgccgguuucuccagcc

SEQ ID NO: 1792146 - RNA, 16 nt, Salmonella enterica enterica serovar Typhi Ty2
gauagcgagcaagacu

SEQ ID NO: 1792147 - RNA, 18 nt, Salmonella enterica enterica serovar Typhi Ty2
gauagcgcagcacgguaa

SEQ ID NO: 1792148 - RNA, 20 nt, Salmonella enterica enterica serovar Typhi Ty2
gauaguuuaaauccagcgcg

SEQ ID NO: 1792149 - RNA, 22 nt, Salmonella enterica enterica serovar Typhi Ty2
gauagcuaucacacauaucgcc

SEQ ID NO: 1792150 - RNA, 15 nt, Salmonella enterica enterica serovar Typhi Ty2
gauagcguuuuccag

SEQ ID NO: 1792151 - RNA, 12 nt, Salmonella enterica enterica serovar Typhi Ty2
gauauaaaaugg

SEQ ID NO: 1792152 - RNA, 16 nt, Salmonella enterica enterica serovar Typhi Ty2
gauaguuugccagaga

SEQ ID NO: 1792153 - RNA, 16 nt, Salmonella enterica enterica serovar Typhi Ty2
gauauaacccaguuca

SEQ ID NO: 1792154 - RNA, 17 nt, Salmonella enterica enterica serovar Typhi Ty2
gauauaacccucauccc

SEQ ID NO: 1792155 - RNA, 15 nt, Salmonella enterica enterica serovar Typhi Ty2
gauaucaaugcgaaa

SEQ ID NO: 1792156 - RNA, 20 nt, Salmonella enterica enterica serovar Typhi Ty2
gauauaauuuuauuauauuu

SEQ ID NO: 1792157 - RNA, 17 nt, Salmonella enterica enterica serovar Typhi Ty2
gauauauggcgggaaau

SEQ ID NO: 1792158 - RNA, 20 nt, Salmonella enterica enterica serovar Typhi Ty2
gauagccauacgauucaggu

SEQ ID NO: 1792159 - RNA, 12 nt, Salmonella enterica enterica serovar Typhi Ty2
gauagcauuuuu

SEQ ID NO: 1792160 - RNA, 16 nt, Salmonella enterica enterica serovar Typhi Ty2
gauagcaauuaauaaa

SEQ ID NO: 1792161 - RNA, 18 nt, Salmonella enterica enterica serovar Typhi Ty2
gauacucagccccaggcc

SEQ ID NO: 1792162 - RNA, 22 nt, Salmonella enterica enterica serovar Typhi Ty2
gauacgggaucgauaauugcuc

SEQ ID NO: 1792163 - RNA, 21 nt, Salmonella enterica enterica serovar Typhi Ty2
gauaccguaauaaguaucagc

SEQ ID NO: 1792164 - RNA, 21 nt, Salmonella enterica enterica serovar Typhi Ty2
gauaccggcgcagcaucugcg

SEQ ID NO: 1792165 - RNA, 14 nt, Salmonella enterica enterica serovar Typhi Ty2
gauacguuccagca

SEQ ID NO: 1792166 - RNA, 20 nt, Salmonella enterica enterica serovar Typhi Ty2
gauacgucauaucauccagc

SEQ ID NO: 1792167 - RNA, 17 nt, Salmonella enterica enterica serovar Typhi Ty2
gauacguuuaaaaugaa

SEQ ID NO: 1792168 - RNA, 14 nt, Salmonella enterica enterica serovar Typhi Ty2
gauaaucagcagcg

SEQ ID NO: 1792169 - RNA, 22 nt, Salmonella enterica enterica serovar Typhi Ty2
gauaaucaauggccuugccagc

SEQ ID NO: 1792170 - RNA, 13 nt, Salmonella enterica enterica serovar Typhi Ty2
gauaaucaccagc

SEQ ID NO: 1792171 - RNA, 20 nt, Salmonella enterica enterica serovar Typhi Ty2
gauaaugaagcauaaaaaga

SEQ ID NO: 1792172 - RNA, 21 nt, Salmonella enterica enterica serovar Typhi Ty2
gauaaucgguagcacuuuaaa

SEQ ID NO: 1792173 - RNA, 23 nt, Salmonella enterica enterica serovar Typhi Ty2
gauaauucccccaguaguugacc

SEQ ID NO: 1792174 - RNA, 13 nt, Salmonella enterica enterica serovar Typhi Ty2
gauaauucugacu

SEQ ID NO: 1792175 - RNA, 15 nt, Salmonella enterica enterica serovar Typhi Ty2
gauaauucccccagu

SEQ ID NO: 1792176 - RNA, 15 nt, Salmonella enterica enterica serovar Typhi Ty2
gauaaugacauccag

SEQ ID NO: 1792177 - RNA, 11 nt, Salmonella enterica enterica serovar Typhi Ty2
gauaauaauga

SEQ ID NO: 1792178 - RNA, 16 nt, Salmonella enterica enterica serovar Typhi Ty2
gauaauaagacgccag

SEQ ID NO: 1792179 - RNA, 22 nt, Salmonella enterica enterica serovar Typhi Ty2
gauaagguguuuacgccgccau

SEQ ID NO: 1792180 - RNA, 16 nt, Salmonella enterica enterica serovar Typhi Ty2
gauaauagaaccgaau

SEQ ID NO: 1792181 - RNA, 17 nt, Salmonella enterica enterica serovar Typhi Ty2
gauaauacauugccgca

SEQ ID NO: 1792182 - RNA, 17 nt, Salmonella enterica enterica serovar Typhi Ty2
gauaauaccucaaaugc

SEQ ID NO: 1792183 - RNA, 16 nt, Salmonella enterica enterica serovar Typhi Ty2
gauaaguccuaacacc

SEQ ID NO: 1792184 - RNA, 23 nt, Salmonella enterica enterica serovar Typhi Ty2
gauaagucccggaccgauugacu

SEQ ID NO: 1792185 - RNA, 23 nt, Salmonella enterica enterica serovar Typhi Ty2
gauaaggccacgccgccauccgg

SEQ ID NO: 1792186 - RNA, 13 nt, Salmonella enterica enterica serovar Typhi Ty2
gauaaggcagcaa

SEQ ID NO: 1792187 - RNA, 19 nt, Salmonella enterica enterica serovar Typhi Ty2
gauaaggucgcuauccagc

SEQ ID NO: 1792188 - RNA, 22 nt, Salmonella enterica enterica serovar Typhi Ty2
gauaagguaacgcgaaaaaaga

SEQ ID NO: 1792189 - RNA, 16 nt, Salmonella enterica enterica serovar Typhi Ty2
gauaaggcgugagcca

SEQ ID NO: 1792190 - RNA, 13 nt, Salmonella enterica enterica serovar Typhi Ty2
gauacauuuuuug

SEQ ID NO: 1792191 - RNA, 18 nt, Salmonella enterica enterica serovar Typhi Ty2
gauacauggcuauuccac

SEQ ID NO: 1792192 - RNA, 18 nt, Salmonella enterica enterica serovar Typhi Ty2
gauacagaaaaccggcaa

SEQ ID NO: 1792193 - RNA, 15 nt, Salmonella enterica enterica serovar Typhi Ty2
gauacagaaaaccgg

SEQ ID NO: 1792194 - RNA, 15 nt, Salmonella enterica enterica serovar Typhi Ty2
gauacagccaaauca

SEQ ID NO: 1792195 - RNA, 21 nt, Salmonella enterica enterica serovar Typhi Ty2
gauacaggacugacugcuguc

SEQ ID NO: 1792196 - RNA, 17 nt, Salmonella enterica enterica serovar Typhi Ty2
gauacaggacugacugc

SEQ ID NO: 1792197 - RNA, 18 nt, Salmonella enterica enterica serovar Typhi Ty2
gauacacgccuuccucca

SEQ ID NO: 1792198 - RNA, 19 nt, Salmonella enterica enterica serovar Typhi Ty2
gauacccagcgucccggcg

SEQ ID NO: 1792199 - RNA, 17 nt, Salmonella enterica enterica serovar Typhi Ty2
gauacccgcccagauca

SEQ ID NO: 1792200 - RNA, 21 nt, Salmonella enterica enterica serovar Typhi Ty2
gauaccccagcgaucccaguu

SEQ ID NO: 1792201 - RNA, 14 nt, Salmonella enterica enterica serovar Typhi Ty2
gauaccgcgccagc

SEQ ID NO: 1792202 - RNA, 23 nt, Salmonella enterica enterica serovar Typhi Ty2
aaagcagugaauccccagaauuu

SEQ ID NO: 1792203 - RNA, 17 nt, Salmonella enterica enterica serovar Typhi Ty2
gauaauuuuucagacgu

SEQ ID NO: 1792204 - RNA, 23 nt, Salmonella enterica enterica serovar Typhi Ty2
aaagcauggcuggcgguuuuugu

SEQ ID NO: 1792205 - RNA, 15 nt, Salmonella enterica enterica serovar Typhi Ty2
aaagcauuaaaucau

SEQ ID NO: 1792206 - RNA, 18 nt, Salmonella enterica enterica serovar Typhi Ty2
gauacaagguauccgcca

SEQ ID NO: 1792207 - RNA, 20 nt, Salmonella enterica enterica serovar Typhi Ty2
gagcaucaucugccauuucu

SEQ ID NO: 1792208 - RNA, 14 nt, Salmonella enterica enterica serovar Typhi Ty2
aaagcagcugcugg

SEQ ID NO: 1792209 - RNA, 13 nt, Salmonella enterica enterica serovar Typhi Ty2
aaagcagcugcug

SEQ ID NO: 1792210 - RNA, 23 nt, Salmonella enterica enterica serovar Typhi Ty2
gagcauaucgacggucaggcugu

SEQ ID NO: 1792211 - RNA, 19 nt, Salmonella enterica enterica serovar Typhi Ty2
gagccauuaaugcaggcag

SEQ ID NO: 1792212 - RNA, 22 nt, Salmonella enterica enterica serovar Typhi Ty2
gagccauaacaacuauuuuucc

SEQ ID NO: 1792213 - RNA, 17 nt, Salmonella enterica enterica serovar Typhi Ty2
gagccuguuccagcugc

SEQ ID NO: 1792214 - RNA, 13 nt, Salmonella enterica enterica serovar Typhi Ty2
gagccgcugcuca

SEQ ID NO: 1792215 - RNA, 18 nt, Salmonella enterica enterica serovar Typhi Ty2
gagcagguuacucuucca

SEQ ID NO: 1792216 - RNA, 20 nt, Salmonella enterica enterica serovar Typhi Ty2
gagcagucguugcgccuguu

SEQ ID NO: 1792217 - RNA, 18 nt, Salmonella enterica enterica serovar Typhi Ty2
gagcagugauuuuaucuc

SEQ ID NO: 1792218 - RNA, 17 nt, Salmonella enterica enterica serovar Typhi Ty2
gagcagaacaaguucuu

SEQ ID NO: 1792219 - RNA, 21 nt, Salmonella enterica enterica serovar Typhi Ty2
gagcagacuguaaaucugccg

SEQ ID NO: 1792220 - RNA, 16 nt, Salmonella enterica enterica serovar Typhi Ty2
gagcacugcccaggac

SEQ ID NO: 1792221 - RNA, 22 nt, Salmonella enterica enterica serovar Typhi Ty2
gagcacuuuuuccuccugcgga

SEQ ID NO: 1792222 - RNA, 13 nt, Salmonella enterica enterica serovar Typhi Ty2
gagcacugcccag

SEQ ID NO: 1792223 - RNA, 19 nt, Salmonella enterica enterica serovar Typhi Ty2
gagcacaccauaucuuuca

SEQ ID NO: 1792224 - RNA, 15 nt, Salmonella enterica enterica serovar Typhi Ty2
gagcaccacgcgggc

SEQ ID NO: 1792225 - RNA, 15 nt, Salmonella enterica enterica serovar Typhi Ty2
gagagcgucaugaaa

SEQ ID NO: 1792226 - RNA, 18 nt, Salmonella enterica enterica serovar Typhi Ty2
gagagcguauccagcacc

SEQ ID NO: 1792227 - RNA, 16 nt, Salmonella enterica enterica serovar Typhi Ty2
gagagcgggccguggc

SEQ ID NO: 1792228 - RNA, 19 nt, Salmonella enterica enterica serovar Typhi Ty2
gagagcguauccagcaccu

SEQ ID NO: 1792229 - RNA, 13 nt, Salmonella enterica enterica serovar Typhi Ty2
gagauagcgaggc

SEQ ID NO: 1792230 - RNA, 18 nt, Salmonella enterica enterica serovar Typhi Ty2
gagaucaucggaacggau

SEQ ID NO: 1792231 - RNA, 14 nt, Salmonella enterica enterica serovar Typhi Ty2
gagauccauaagau

SEQ ID NO: 1792232 - RNA, 12 nt, Salmonella enterica enterica serovar Typhi Ty2
gagagaaaaaaa

SEQ ID NO: 1792233 - RNA, 18 nt, Salmonella enterica enterica serovar Typhi Ty2
gagagaaaaaaauccagu

SEQ ID NO: 1792234 - RNA, 18 nt, Salmonella enterica enterica serovar Typhi Ty2
gagagcaucaucugccau

SEQ ID NO: 1792235 - RNA, 23 nt, Salmonella enterica enterica serovar Typhi Ty2
gagagccuuacaggcgcaucaga

SEQ ID NO: 1792236 - RNA, 17 nt, Salmonella enterica enterica serovar Typhi Ty2
gagagccuuacaggcgc

SEQ ID NO: 1792237 - RNA, 13 nt, Salmonella enterica enterica serovar Typhi Ty2
gagagcaacuggc

SEQ ID NO: 1792238 - RNA, 15 nt, Salmonella enterica enterica serovar Typhi Ty2
gagagcagcgccagc

SEQ ID NO: 1792239 - RNA, 13 nt, Salmonella enterica enterica serovar Typhi Ty2
gagagcaucaucu

SEQ ID NO: 1792240 - RNA, 19 nt, Salmonella enterica enterica serovar Typhi Ty2
gagaaucaccuggcagccg

SEQ ID NO: 1792241 - RNA, 18 nt, Salmonella enterica enterica serovar Typhi Ty2
gagaauaacgaugaugaa

SEQ ID NO: 1792242 - RNA, 15 nt, Salmonella enterica enterica serovar Typhi Ty2
gagaauccuuccagu

SEQ ID NO: 1792243 - RNA, 15 nt, Salmonella enterica enterica serovar Typhi Ty2
gagaauggaugugaa

SEQ ID NO: 1792244 - RNA, 21 nt, Salmonella enterica enterica serovar Typhi Ty2
gagaacguugccgcaggcaac

SEQ ID NO: 1792245 - RNA, 21 nt, Salmonella enterica enterica serovar Typhi Ty2
gagaagccgauggaaguacug

SEQ ID NO: 1792246 - RNA, 21 nt, Salmonella enterica enterica serovar Typhi Ty2
gagacauugguuucaugcauc

SEQ ID NO: 1792247 - RNA, 16 nt, Salmonella enterica enterica serovar Typhi Ty2
gagacagagaaccuga

SEQ ID NO: 1792248 - RNA, 16 nt, Salmonella enterica enterica serovar Typhi Ty2
gagacauugccuucca

SEQ ID NO: 1792249 - RNA, 16 nt, Salmonella enterica enterica serovar Typhi Ty2
gagacaugccgccaga

SEQ ID NO: 1792250 - RNA, 17 nt, Salmonella enterica enterica serovar Typhi Ty2
gagacaugccgccagac

SEQ ID NO: 1792251 - RNA, 16 nt, Salmonella enterica enterica serovar Typhi Ty2
aaagcaaucgccagcg

SEQ ID NO: 1792252 - RNA, 17 nt, Salmonella enterica enterica serovar Typhi Ty2
aaagcaaucgccagcgc

SEQ ID NO: 1792253 - RNA, 23 nt, Salmonella enterica enterica serovar Typhi Ty2
gagaaagcguugccguaggcaac

SEQ ID NO: 1792254 - RNA, 17 nt, Salmonella enterica enterica serovar Typhi Ty2
gagaaagugguggguga

SEQ ID NO: 1792255 - RNA, 17 nt, Salmonella enterica enterica serovar Typhi Ty2
gacuuuuugaaaucacg

SEQ ID NO: 1792256 - RNA, 19 nt, Salmonella enterica enterica serovar Typhi Ty2
gacuuuuagucgucaugau

SEQ ID NO: 1792257 - RNA, 19 nt, Salmonella enterica enterica serovar Typhi Ty2
gagaaaauaccgcacauca

SEQ ID NO: 1792258 - RNA, 21 nt, Salmonella enterica enterica serovar Typhi Ty2
gagaaaauaacaauauuaaau

SEQ ID NO: 1792259 - RNA, 19 nt, Salmonella enterica enterica serovar Typhi Ty2
gagaaaagggcgcaccaaa

SEQ ID NO: 1792260 - RNA, 22 nt, Salmonella enterica enterica serovar Typhi Ty2
gagaaaaacgaccaggaucaga

SEQ ID NO: 1792261 - RNA, 15 nt, Salmonella enterica enterica serovar Typhi Ty2
gagaaaauagaggaa

SEQ ID NO: 1792262 - RNA, 13 nt, Salmonella enterica enterica serovar Typhi Ty2
gagaaacauacug

SEQ ID NO: 1792263 - RNA, 11 nt, Salmonella enterica enterica serovar Typhi Ty2
gacuucaccuc

SEQ ID NO: 1792264 - RNA, 14 nt, Salmonella enterica enterica serovar Typhi Ty2
gacuucaccucagc

SEQ ID NO: 1792265 - RNA, 18 nt, Salmonella enterica enterica serovar Typhi Ty2
gacuucaacgcaggcgaa

SEQ ID NO: 1792266 - RNA, 14 nt, Salmonella enterica enterica serovar Typhi Ty2
gacuucauuuucca

SEQ ID NO: 1792267 - RNA, 23 nt, Salmonella enterica enterica serovar Typhi Ty2
gacuucauuuuccacaauaccgu

SEQ ID NO: 1792268 - RNA, 20 nt, Salmonella enterica enterica serovar Typhi Ty2
gacuuccgcacgcgcgcccu

SEQ ID NO: 1792269 - RNA, 19 nt, Salmonella enterica enterica serovar Typhi Ty2
gacuuauuugcucaguuca

SEQ ID NO: 1792270 - RNA, 19 nt, Salmonella enterica enterica serovar Typhi Ty2
gacuuacggaaaaaugucg

SEQ ID NO: 1792271 - RNA, 17 nt, Salmonella enterica enterica serovar Typhi Ty2
gacuuacggaaaaaugu

SEQ ID NO: 1792272 - RNA, 22 nt, Salmonella enterica enterica serovar Typhi Ty2
gacuuaggaaugcccagcucag

SEQ ID NO: 1792273 - RNA, 13 nt, Salmonella enterica enterica serovar Typhi Ty2
gacuuauuaaaaa

SEQ ID NO: 1792274 - RNA, 17 nt, Salmonella enterica enterica serovar Typhi Ty2
gacuguucagcugacaa

SEQ ID NO: 1792275 - RNA, 16 nt, Salmonella enterica enterica serovar Typhi Ty2
gacuguucacauccag

SEQ ID NO: 1792276 - RNA, 12 nt, Salmonella enterica enterica serovar Typhi Ty2
gacuguugaaag

SEQ ID NO: 1792277 - RNA, 16 nt, Salmonella enterica enterica serovar Typhi Ty2
gacuguucagcugaca

SEQ ID NO: 1792278 - RNA, 22 nt, Salmonella enterica enterica serovar Typhi Ty2
gacuuuaaacuuauccgccauc

SEQ ID NO: 1792279 - RNA, 22 nt, Salmonella enterica enterica serovar Typhi Ty2
gacuuuaucuuuaccagggaau

SEQ ID NO: 1792280 - RNA, 21 nt, Salmonella enterica enterica serovar Typhi Ty2
gacuuugcccuuuuugcauuc

SEQ ID NO: 1792281 - RNA, 16 nt, Salmonella enterica enterica serovar Typhi Ty2
gacuuugaccagcauc

SEQ ID NO: 1792282 - RNA, 11 nt, Salmonella enterica enterica serovar Typhi Ty2
gacuucuucag

SEQ ID NO: 1792283 - RNA, 12 nt, Salmonella enterica enterica serovar Typhi Ty2
gacuucucccuc

SEQ ID NO: 1792284 - RNA, 13 nt, Salmonella enterica enterica serovar Typhi Ty2
gacuucucccucu

SEQ ID NO: 1792285 - RNA, 18 nt, Salmonella enterica enterica serovar Typhi Ty2
gacuugucggcaaucuca

SEQ ID NO: 1792286 - RNA, 23 nt, Salmonella enterica enterica serovar Typhi Ty2
gacucgcuggacauuaagcguaa

SEQ ID NO: 1792287 - RNA, 18 nt, Salmonella enterica enterica serovar Typhi Ty2
gacucucaaugcccaucu

SEQ ID NO: 1792288 - RNA, 19 nt, Salmonella enterica enterica serovar Typhi Ty2
gacuccucaaccgacgcga

SEQ ID NO: 1792289 - RNA, 19 nt, Salmonella enterica enterica serovar Typhi Ty2
gacucugaagcgggaaagc

SEQ ID NO: 1792290 - RNA, 23 nt, Salmonella enterica enterica serovar Typhi Ty2
gacucugaagcgggaaagcguaa

SEQ ID NO: 1792291 - RNA, 18 nt, Salmonella enterica enterica serovar Typhi Ty2
gacucugaagcgggaaag

SEQ ID NO: 1792292 - RNA, 15 nt, Salmonella enterica enterica serovar Typhi Ty2
gacucugacgccggu

SEQ ID NO: 1792293 - RNA, 18 nt, Salmonella enterica enterica serovar Typhi Ty2
gacugaaaaucaaaaaca

SEQ ID NO: 1792294 - RNA, 19 nt, Salmonella enterica enterica serovar Typhi Ty2
gacugaaaaucaaaaacau

SEQ ID NO: 1792295 - RNA, 17 nt, Salmonella enterica enterica serovar Typhi Ty2
gacucuuuuuucagaau

SEQ ID NO: 1792296 - RNA, 22 nt, Salmonella enterica enterica serovar Typhi Ty2
gacuaaaaagcgcguccccggu

SEQ ID NO: 1792297 - RNA, 13 nt, Salmonella enterica enterica serovar Typhi Ty2
gacuccggcagca

SEQ ID NO: 1792298 - RNA, 23 nt, Salmonella enterica enterica serovar Typhi Ty2
gacuccccacaaucccgccagac

SEQ ID NO: 1792299 - RNA, 20 nt, Salmonella enterica enterica serovar Typhi Ty2
gacugccguauaauccagcu

SEQ ID NO: 1792300 - RNA, 19 nt, Salmonella enterica enterica serovar Typhi Ty2
gacugccguauaauccagc

SEQ ID NO: 1792301 - RNA, 14 nt, Salmonella enterica enterica serovar Typhi Ty2
gacugccgcagacc

SEQ ID NO: 1792302 - RNA, 14 nt, Salmonella enterica enterica serovar Typhi Ty2
gacugccagguaau

SEQ ID NO: 1792303 - RNA, 15 nt, Salmonella enterica enterica serovar Typhi Ty2
gacugcacuuccugc

SEQ ID NO: 1792304 - RNA, 16 nt, Salmonella enterica enterica serovar Typhi Ty2
gacugcacuuccugcg

SEQ ID NO: 1792305 - RNA, 16 nt, Salmonella enterica enterica serovar Typhi Ty2
gacugaugcuggcgcc

SEQ ID NO: 1792306 - RNA, 16 nt, Salmonella enterica enterica serovar Typhi Ty2
gacugcaaaucugccg

SEQ ID NO: 1792307 - RNA, 19 nt, Salmonella enterica enterica serovar Typhi Ty2
gacugaucccacuuaggca

SEQ ID NO: 1792308 - RNA, 13 nt, Salmonella enterica enterica serovar Typhi Ty2
gacugaucccacu

SEQ ID NO: 1792309 - RNA, 24 nt, Salmonella enterica enterica serovar Typhi Ty2
gacugauaccgcguuugcgcaaca

SEQ ID NO: 1792310 - RNA, 14 nt, Salmonella enterica enterica serovar Typhi Ty2
gacugauacccagc

SEQ ID NO: 1792311 - RNA, 17 nt, Salmonella enterica enterica serovar Typhi Ty2
gacugaccagacagauu

SEQ ID NO: 1792312 - RNA, 14 nt, Salmonella enterica enterica serovar Typhi Ty2
gacugacaaugacg

SEQ ID NO: 1792313 - RNA, 19 nt, Salmonella enterica enterica serovar Typhi Ty2
gacugucgaaaccagcaua

SEQ ID NO: 1792314 - RNA, 16 nt, Salmonella enterica enterica serovar Typhi Ty2
gacugucgaaaccagc

SEQ ID NO: 1792315 - RNA, 15 nt, Salmonella enterica enterica serovar Typhi Ty2
gacuguucacaucca

SEQ ID NO: 1792316 - RNA, 22 nt, Salmonella enterica enterica serovar Typhi Ty2
gacugucugaaggcguaugaau

SEQ ID NO: 1792317 - RNA, 21 nt, Salmonella enterica enterica serovar Typhi Ty2
gacuggcuaaacaauuugccc

SEQ ID NO: 1792318 - RNA, 18 nt, Salmonella enterica enterica serovar Typhi Ty2
gacuguaaaucugccguc

SEQ ID NO: 1792319 - RNA, 22 nt, Salmonella enterica enterica serovar Typhi Ty2
gacugguuuuucgccgaccauc

SEQ ID NO: 1792320 - RNA, 20 nt, Salmonella enterica enterica serovar Typhi Ty2
gacugguggcgagauaagcc

SEQ ID NO: 1792321 - RNA, 19 nt, Salmonella enterica enterica serovar Typhi Ty2
gacugggucgauguaguug

SEQ ID NO: 1792322 - RNA, 16 nt, Salmonella enterica enterica serovar Typhi Ty2
gacugcggggagcgaa

SEQ ID NO: 1792323 - RNA, 21 nt, Salmonella enterica enterica serovar Typhi Ty2
gacuggcgccgucacguucgg

SEQ ID NO: 1792324 - RNA, 23 nt, Salmonella enterica enterica serovar Typhi Ty2
gacuggcaccacgaccagacugg

SEQ ID NO: 1792325 - RNA, 22 nt, Salmonella enterica enterica serovar Typhi Ty2
gaccgauagagacugccgccgu

SEQ ID NO: 1792326 - RNA, 16 nt, Salmonella enterica enterica serovar Typhi Ty2
gaccgaucucaugcaa

SEQ ID NO: 1792327 - RNA, 14 nt, Salmonella enterica enterica serovar Typhi Ty2
gaccgauaaauacc

SEQ ID NO: 1792328 - RNA, 23 nt, Salmonella enterica enterica serovar Typhi Ty2
gaccgagucuacaucaagagaaa

SEQ ID NO: 1792329 - RNA, 17 nt, Salmonella enterica enterica serovar Typhi Ty2
gaccgagugucgcccgc

SEQ ID NO: 1792330 - RNA, 13 nt, Salmonella enterica enterica serovar Typhi Ty2
gaccgcaaaccga

SEQ ID NO: 1792331 - RNA, 23 nt, Salmonella enterica enterica serovar Typhi Ty2
gaccgcaaaccgaauucguccac

SEQ ID NO: 1792332 - RNA, 20 nt, Salmonella enterica enterica serovar Typhi Ty2
gaccgcagaccggaugaugg

SEQ ID NO: 1792333 - RNA, 19 nt, Salmonella enterica enterica serovar Typhi Ty2
gaccgguaagcccauggca

SEQ ID NO: 1792334 - RNA, 19 nt, Salmonella enterica enterica serovar Typhi Ty2
gaccgguccaccgggggcg

SEQ ID NO: 1792335 - RNA, 21 nt, Salmonella enterica enterica serovar Typhi Ty2
gaccggugaugugcuggcgga

SEQ ID NO: 1792336 - RNA, 13 nt, Salmonella enterica enterica serovar Typhi Ty2
gaccucaauccgu

SEQ ID NO: 1792337 - RNA, 21 nt, Salmonella enterica enterica serovar Typhi Ty2
gaccucauccaucagcgcggg

SEQ ID NO: 1792338 - RNA, 14 nt, Salmonella enterica enterica serovar Typhi Ty2
gaccuacaggccga

SEQ ID NO: 1792339 - RNA, 17 nt, Salmonella enterica enterica serovar Typhi Ty2
gaccuaaaguaaaggaa

SEQ ID NO: 1792340 - RNA, 13 nt, Salmonella enterica enterica serovar Typhi Ty2
gaccuaaauaagc

SEQ ID NO: 1792341 - RNA, 15 nt, Salmonella enterica enterica serovar Typhi Ty2
gaccuaauagccagc

SEQ ID NO: 1792342 - RNA, 12 nt, Salmonella enterica enterica serovar Typhi Ty2
gaccucaagaau

SEQ ID NO: 1792343 - RNA, 15 nt, Salmonella enterica enterica serovar Typhi Ty2
gaccguuucaaagaa

SEQ ID NO: 1792344 - RNA, 17 nt, Salmonella enterica enterica serovar Typhi Ty2
gaccgucgugccugcgg

SEQ ID NO: 1792345 - RNA, 16 nt, Salmonella enterica enterica serovar Typhi Ty2
gaccgucgcgcccucc

SEQ ID NO: 1792346 - RNA, 16 nt, Salmonella enterica enterica serovar Typhi Ty2
gacgaaucuggauagu

SEQ ID NO: 1792347 - RNA, 19 nt, Salmonella enterica enterica serovar Typhi Ty2
gacgaaguccuucacaaac

SEQ ID NO: 1792348 - RNA, 17 nt, Salmonella enterica enterica serovar Typhi Ty2
gacgacaucuuuuccug

SEQ ID NO: 1792349 - RNA, 17 nt, Salmonella enterica enterica serovar Typhi Ty2
gaccuucaucucuuugc

SEQ ID NO: 1792350 - RNA, 14 nt, Salmonella enterica enterica serovar Typhi Ty2
gaccuuaauccagc

SEQ ID NO: 1792351 - RNA, 16 nt, Salmonella enterica enterica serovar Typhi Ty2
gacgauucguaccauc

SEQ ID NO: 1792352 - RNA, 13 nt, Salmonella enterica enterica serovar Typhi Ty2
gacgaugauaaua

SEQ ID NO: 1792353 - RNA, 18 nt, Salmonella enterica enterica serovar Typhi Ty2
gacgaugaugagauacgu

SEQ ID NO: 1792354 - RNA, 21 nt, Salmonella enterica enterica serovar Typhi Ty2
gacgagcgcgucagcgccucc

SEQ ID NO: 1792355 - RNA, 15 nt, Salmonella enterica enterica serovar Typhi Ty2
gacgcucuuccucaa

SEQ ID NO: 1792356 - RNA, 12 nt, Salmonella enterica enterica serovar Typhi Ty2
gacgcugccaca

SEQ ID NO: 1792357 - RNA, 16 nt, Salmonella enterica enterica serovar Typhi Ty2
gacgcugcaacucucc

SEQ ID NO: 1792358 - RNA, 19 nt, Salmonella enterica enterica serovar Typhi Ty2
gacgcugcgcuuauccggc

SEQ ID NO: 1792359 - RNA, 12 nt, Salmonella enterica enterica serovar Typhi Ty2
gacgcugguugu

SEQ ID NO: 1792360 - RNA, 16 nt, Salmonella enterica enterica serovar Typhi Ty2
gacgcugcgccuggau

SEQ ID NO: 1792361 - RNA, 13 nt, Salmonella enterica enterica serovar Typhi Ty2
gacgcuauuuuuc

SEQ ID NO: 1792362 - RNA, 14 nt, Salmonella enterica enterica serovar Typhi Ty2
gacgcuauuuuuca

SEQ ID NO: 1792363 - RNA, 20 nt, Salmonella enterica enterica serovar Typhi Ty2
gacgcucgacguccagcgcg

SEQ ID NO: 1792364 - RNA, 19 nt, Salmonella enterica enterica serovar Typhi Ty2
gacgcguguugccggacca

SEQ ID NO: 1792365 - RNA, 15 nt, Salmonella enterica enterica serovar Typhi Ty2
gacgcgguacccacc

SEQ ID NO: 1792366 - RNA, 23 nt, Salmonella enterica enterica serovar Typhi Ty2
gacgcgucauaaugcccagcgcc

SEQ ID NO: 1792367 - RNA, 13 nt, Salmonella enterica enterica serovar Typhi Ty2
gacgcgcagcacc

SEQ ID NO: 1792368 - RNA, 19 nt, Salmonella enterica enterica serovar Typhi Ty2
gacgcgcucaccuccgcca

SEQ ID NO: 1792369 - RNA, 17 nt, Salmonella enterica enterica serovar Typhi Ty2
gacgcgccacuuccagc

SEQ ID NO: 1792370 - RNA, 20 nt, Salmonella enterica enterica serovar Typhi Ty2
gacgcgccacuuccagcgcg

SEQ ID NO: 1792371 - RNA, 17 nt, Salmonella enterica enterica serovar Typhi Ty2
gacgcgggccgcauugc

SEQ ID NO: 1792372 - RNA, 16 nt, Salmonella enterica enterica serovar Typhi Ty2
gacgcgcuccagcaac

SEQ ID NO: 1792373 - RNA, 22 nt, Salmonella enterica enterica serovar Typhi Ty2
gacgcggaacuggugaaacagg

SEQ ID NO: 1792374 - RNA, 14 nt, Salmonella enterica enterica serovar Typhi Ty2
gacgcgaagcggcg

SEQ ID NO: 1792375 - RNA, 20 nt, Salmonella enterica enterica serovar Typhi Ty2
gacgcaauagaguaaugaca

SEQ ID NO: 1792376 - RNA, 12 nt, Salmonella enterica enterica serovar Typhi Ty2
gacgcaccagcc

SEQ ID NO: 1792377 - RNA, 22 nt, Salmonella enterica enterica serovar Typhi Ty2
gacgggaucgaaccgccgaccc

SEQ ID NO: 1792378 - RNA, 14 nt, Salmonella enterica enterica serovar Typhi Ty2
gacgggauuaaaug

SEQ ID NO: 1792379 - RNA, 22 nt, Salmonella enterica enterica serovar Typhi Ty2
gacgggcaagguuaugcagcau

SEQ ID NO: 1792380 - RNA, 21 nt, Salmonella enterica enterica serovar Typhi Ty2
gacgggauuaaaugacgcccu

SEQ ID NO: 1792381 - RNA, 20 nt, Salmonella enterica enterica serovar Typhi Ty2
gacgggcggcgacagagaau

SEQ ID NO: 1792382 - RNA, 21 nt, Salmonella enterica enterica serovar Typhi Ty2
gacgggcguccggcuuaggca

SEQ ID NO: 1792383 - RNA, 20 nt, Salmonella enterica enterica serovar Typhi Ty2
gacgggaaaucucccuggca

SEQ ID NO: 1792384 - RNA, 21 nt, Salmonella enterica enterica serovar Typhi Ty2
gacgggaaaucucccuggcag

SEQ ID NO: 1792385 - RNA, 23 nt, Salmonella enterica enterica serovar Typhi Ty2
gacgggacgaauuuccagcgggc

SEQ ID NO: 1792386 - RNA, 15 nt, Salmonella enterica enterica serovar Typhi Ty2
gacggcuucacugcc

SEQ ID NO: 1792387 - RNA, 23 nt, Salmonella enterica enterica serovar Typhi Ty2
gacggcagucgcuacaaccagcg

SEQ ID NO: 1792388 - RNA, 15 nt, Salmonella enterica enterica serovar Typhi Ty2
gacggcaaaaagcau

SEQ ID NO: 1792389 - RNA, 24 nt, Salmonella enterica enterica serovar Typhi Ty2
gacggcaacggcgacaagaauaug

SEQ ID NO: 1792390 - RNA, 22 nt, Salmonella enterica enterica serovar Typhi Ty2
gacggcaauagaacgucgcgcg

SEQ ID NO: 1792391 - RNA, 16 nt, Salmonella enterica enterica serovar Typhi Ty2
gacggauucuuccucu

SEQ ID NO: 1792392 - RNA, 14 nt, Salmonella enterica enterica serovar Typhi Ty2
gacggcagccacgc

SEQ ID NO: 1792393 - RNA, 20 nt, Salmonella enterica enterica serovar Typhi Ty2
gacggcagcgccauccggca

SEQ ID NO: 1792394 - RNA, 19 nt, Salmonella enterica enterica serovar Typhi Ty2
gacgucgguaaucacauca

SEQ ID NO: 1792395 - RNA, 15 nt, Salmonella enterica enterica serovar Typhi Ty2
gacgucgucaccacg

SEQ ID NO: 1792396 - RNA, 14 nt, Salmonella enterica enterica serovar Typhi Ty2
gacgugaccgguug

SEQ ID NO: 1792397 - RNA, 11 nt, Salmonella enterica enterica serovar Typhi Ty2
gacguccagac

SEQ ID NO: 1792398 - RNA, 18 nt, Salmonella enterica enterica serovar Typhi Ty2
gacguaaacgucggccuu

SEQ ID NO: 1792399 - RNA, 23 nt, Salmonella enterica enterica serovar Typhi Ty2
gacguaacgguguuucaucuuca

SEQ ID NO: 1792400 - RNA, 21 nt, Salmonella enterica enterica serovar Typhi Ty2
gacaucgcucccggcaccagg

SEQ ID NO: 1792401 - RNA, 17 nt, Salmonella enterica enterica serovar Typhi Ty2
gacaucgcucccggcac

SEQ ID NO: 1792402 - RNA, 13 nt, Salmonella enterica enterica serovar Typhi Ty2
gacaucggcacgc

SEQ ID NO: 1792403 - RNA, 22 nt, Salmonella enterica enterica serovar Typhi Ty2
gacaucacguucgcgcauaccu

SEQ ID NO: 1792404 - RNA, 15 nt, Salmonella enterica enterica serovar Typhi Ty2
gacauaguacccucu

SEQ ID NO: 1792405 - RNA, 19 nt, Salmonella enterica enterica serovar Typhi Ty2
gacauaguacccucugcac

SEQ ID NO: 1792406 - RNA, 17 nt, Salmonella enterica enterica serovar Typhi Ty2
gacauagcauaauaaug

SEQ ID NO: 1792407 - RNA, 19 nt, Salmonella enterica enterica serovar Typhi Ty2
gacauuaacaaugccuuau

SEQ ID NO: 1792408 - RNA, 15 nt, Salmonella enterica enterica serovar Typhi Ty2
gacauuaaagucgcg

SEQ ID NO: 1792409 - RNA, 12 nt, Salmonella enterica enterica serovar Typhi Ty2
gacauuacccau

SEQ ID NO: 1792410 - RNA, 17 nt, Salmonella enterica enterica serovar Typhi Ty2
gacaucucaucggcuuu

SEQ ID NO: 1792411 - RNA, 23 nt, Salmonella enterica enterica serovar Typhi Ty2
gacaucgucacaauaugguuauc

SEQ ID NO: 1792412 - RNA, 16 nt, Salmonella enterica enterica serovar Typhi Ty2
gacaucguguauacca

SEQ ID NO: 1792413 - RNA, 15 nt, Salmonella enterica enterica serovar Typhi Ty2
gacaucucaggcaag

SEQ ID NO: 1792414 - RNA, 18 nt, Salmonella enterica enterica serovar Typhi Ty2
gacauaaacgccucaucc

SEQ ID NO: 1792415 - RNA, 15 nt, Salmonella enterica enterica serovar Typhi Ty2
gacauaaucaugaac

SEQ ID NO: 1792416 - RNA, 16 nt, Salmonella enterica enterica serovar Typhi Ty2
gacauaagugcaggcu

SEQ ID NO: 1792417 - RNA, 13 nt, Salmonella enterica enterica serovar Typhi Ty2
gacauacaggaau

SEQ ID NO: 1792418 - RNA, 22 nt, Salmonella enterica enterica serovar Typhi Ty2
gacauaaaacaguacgccgagg

SEQ ID NO: 1792419 - RNA, 22 nt, Salmonella enterica enterica serovar Typhi Ty2
gacagcgcgcaaaaaccggagc

SEQ ID NO: 1792420 - RNA, 16 nt, Salmonella enterica enterica serovar Typhi Ty2
gacagcguaaugcgcc

SEQ ID NO: 1792421 - RNA, 22 nt, Salmonella enterica enterica serovar Typhi Ty2
gacagcggauuacgcgccugcc

SEQ ID NO: 1792422 - RNA, 14 nt, Salmonella enterica enterica serovar Typhi Ty2
gacaggacgccagc

SEQ ID NO: 1792423 - RNA, 17 nt, Salmonella enterica enterica serovar Typhi Ty2
gacacucauccagacca

SEQ ID NO: 1792424 - RNA, 21 nt, Salmonella enterica enterica serovar Typhi Ty2
gacacgcuaccuugagguggu

SEQ ID NO: 1792425 - RNA, 21 nt, Salmonella enterica enterica serovar Typhi Ty2
gacacgcucauaaauugcagc

SEQ ID NO: 1792426 - RNA, 15 nt, Salmonella enterica enterica serovar Typhi Ty2
gacacaguaaaaaaa

SEQ ID NO: 1792427 - RNA, 18 nt, Salmonella enterica enterica serovar Typhi Ty2
gacagcaaguugcgccac

SEQ ID NO: 1792428 - RNA, 16 nt, Salmonella enterica enterica serovar Typhi Ty2
gacagcaagauuucaa

SEQ ID NO: 1792429 - RNA, 15 nt, Salmonella enterica enterica serovar Typhi Ty2
gacagcaaaacggcu

SEQ ID NO: 1792430 - RNA, 14 nt, Salmonella enterica enterica serovar Typhi Ty2
gacagcaaugagca

SEQ ID NO: 1792431 - RNA, 17 nt, Salmonella enterica enterica serovar Typhi Ty2
gacagcaccgccgggaa

SEQ ID NO: 1792432 - RNA, 23 nt, Salmonella enterica enterica serovar Typhi Ty2
gacagcgaacaguguaaacgcca

SEQ ID NO: 1792433 - RNA, 23 nt, Salmonella enterica enterica serovar Typhi Ty2
gacagcgacacuccgcgcaugua

SEQ ID NO: 1792434 - RNA, 14 nt, Salmonella enterica enterica serovar Typhi Ty2
gacagaacugauuu

SEQ ID NO: 1792435 - RNA, 18 nt, Salmonella enterica enterica serovar Typhi Ty2
gacagaacugauuuccgg

SEQ ID NO: 1792436 - RNA, 11 nt, Salmonella enterica enterica serovar Typhi Ty2
gacagcaagau

SEQ ID NO: 1792437 - RNA, 18 nt, Salmonella enterica enterica serovar Typhi Ty2
gacagaagcugagaaaag

SEQ ID NO: 1792438 - RNA, 16 nt, Salmonella enterica enterica serovar Typhi Ty2
gacagaauaugcauau

SEQ ID NO: 1792439 - RNA, 18 nt, Salmonella enterica enterica serovar Typhi Ty2
gacacuugcaacucgcac

SEQ ID NO: 1792440 - RNA, 15 nt, Salmonella enterica enterica serovar Typhi Ty2
gaccaacguuuuucc

SEQ ID NO: 1792441 - RNA, 13 nt, Salmonella enterica enterica serovar Typhi Ty2
gaccaagcgucag

SEQ ID NO: 1792442 - RNA, 17 nt, Salmonella enterica enterica serovar Typhi Ty2
gaccaagcgucagcaug

SEQ ID NO: 1792443 - RNA, 19 nt, Salmonella enterica enterica serovar Typhi Ty2
gaccaaagcgaauacucac

SEQ ID NO: 1792444 - RNA, 15 nt, Salmonella enterica enterica serovar Typhi Ty2
gaccaacaacagaua

SEQ ID NO: 1792445 - RNA, 11 nt, Salmonella enterica enterica serovar Typhi Ty2
gaccagcagca

SEQ ID NO: 1792446 - RNA, 15 nt, Salmonella enterica enterica serovar Typhi Ty2
gaccagccaggcgau

SEQ ID NO: 1792447 - RNA, 17 nt, Salmonella enterica enterica serovar Typhi Ty2
gaccagaugcagcaacg

SEQ ID NO: 1792448 - RNA, 11 nt, Salmonella enterica enterica serovar Typhi Ty2
gaccagcaccu

SEQ ID NO: 1792449 - RNA, 13 nt, Salmonella enterica enterica serovar Typhi Ty2
gaccagcaccugc

SEQ ID NO: 1792450 - RNA, 15 nt, Salmonella enterica enterica serovar Typhi Ty2
gaccagcagcaucac

SEQ ID NO: 1792451 - RNA, 17 nt, Salmonella enterica enterica serovar Typhi Ty2
gaccaggauggccagca

SEQ ID NO: 1792452 - RNA, 16 nt, Salmonella enterica enterica serovar Typhi Ty2
gaccaggauggccagc

SEQ ID NO: 1792453 - RNA, 11 nt, Salmonella enterica enterica serovar Typhi Ty2
gaccagcgccc

SEQ ID NO: 1792454 - RNA, 15 nt, Salmonella enterica enterica serovar Typhi Ty2
gaccaggaucagacc

SEQ ID NO: 1792455 - RNA, 13 nt, Salmonella enterica enterica serovar Typhi Ty2
gaccaggaucaga

SEQ ID NO: 1792456 - RNA, 22 nt, Salmonella enterica enterica serovar Typhi Ty2
gacccguuacgcagucagcacu

SEQ ID NO: 1792457 - RNA, 23 nt, Salmonella enterica enterica serovar Typhi Ty2
gacccacaguuucauauccgaca

SEQ ID NO: 1792458 - RNA, 14 nt, Salmonella enterica enterica serovar Typhi Ty2
gacccacgccagca

SEQ ID NO: 1792459 - RNA, 16 nt, Salmonella enterica enterica serovar Typhi Ty2
gacccacuuucagcuc

SEQ ID NO: 1792460 - RNA, 18 nt, Salmonella enterica enterica serovar Typhi Ty2
gacccgcaucgccgcggc

SEQ ID NO: 1792461 - RNA, 15 nt, Salmonella enterica enterica serovar Typhi Ty2
gacccgcaucagacc

SEQ ID NO: 1792462 - RNA, 18 nt, Salmonella enterica enterica serovar Typhi Ty2
gaccagugaacgucugca

SEQ ID NO: 1792463 - RNA, 12 nt, Salmonella enterica enterica serovar Typhi Ty2
gaauucuucugu

SEQ ID NO: 1792464 - RNA, 20 nt, Salmonella enterica enterica serovar Typhi Ty2
gaauuucugcugccagcgcc

SEQ ID NO: 1792465 - RNA, 18 nt, Salmonella enterica enterica serovar Typhi Ty2
gaauuugaacucuuucag

SEQ ID NO: 1792466 - RNA, 20 nt, Salmonella enterica enterica serovar Typhi Ty2
gaauuuuauuaagcaggccg

SEQ ID NO: 1792467 - RNA, 22 nt, Salmonella enterica enterica serovar Typhi Ty2
gaauuuguugguuuaaacucug

SEQ ID NO: 1792468 - RNA, 18 nt, Salmonella enterica enterica serovar Typhi Ty2
gaaugguauuaccucgcg

SEQ ID NO: 1792469 - RNA, 18 nt, Salmonella enterica enterica serovar Typhi Ty2
gaauucaccgcaugacaa

SEQ ID NO: 1792470 - RNA, 11 nt, Salmonella enterica enterica serovar Typhi Ty2
gacaauagcgg

SEQ ID NO: 1792471 - RNA, 16 nt, Salmonella enterica enterica serovar Typhi Ty2
gacaauagcggacggc

SEQ ID NO: 1792472 - RNA, 18 nt, Salmonella enterica enterica serovar Typhi Ty2
gacaagcugauuuuucgc

SEQ ID NO: 1792473 - RNA, 23 nt, Salmonella enterica enterica serovar Typhi Ty2
gacaacguaaacggcagccgcca

SEQ ID NO: 1792474 - RNA, 18 nt, Salmonella enterica enterica serovar Typhi Ty2
gacaacguuuucagcagu

SEQ ID NO: 1792475 - RNA, 17 nt, Salmonella enterica enterica serovar Typhi Ty2
gacaagaaucacguaau

SEQ ID NO: 1792476 - RNA, 14 nt, Salmonella enterica enterica serovar Typhi Ty2
gacaaucagcacca

SEQ ID NO: 1792477 - RNA, 16 nt, Salmonella enterica enterica serovar Typhi Ty2
gacaaucagcaccauu

SEQ ID NO: 1792478 - RNA, 18 nt, Salmonella enterica enterica serovar Typhi Ty2
gacaaucacucucuugua

SEQ ID NO: 1792479 - RNA, 23 nt, Salmonella enterica enterica serovar Typhi Ty2
gacaaucuccuccggcuucagca

SEQ ID NO: 1792480 - RNA, 19 nt, Salmonella enterica enterica serovar Typhi Ty2
gacacagcguacaauggca

SEQ ID NO: 1792481 - RNA, 17 nt, Salmonella enterica enterica serovar Typhi Ty2
gacaaauaccuccuggc

SEQ ID NO: 1792482 - RNA, 16 nt, Salmonella enterica enterica serovar Typhi Ty2
gacaaauuguuuaaaa

SEQ ID NO: 1792483 - RNA, 21 nt, Salmonella enterica enterica serovar Typhi Ty2
gaauuuuccgccgugauucau

SEQ ID NO: 1792484 - RNA, 16 nt, Salmonella enterica enterica serovar Typhi Ty2
gacaaagagcucccca

SEQ ID NO: 1792485 - RNA, 17 nt, Salmonella enterica enterica serovar Typhi Ty2
gacaaaggcaagauccg

SEQ ID NO: 1792486 - RNA, 15 nt, Salmonella enterica enterica serovar Typhi Ty2
gaauaguuucaccuu

SEQ ID NO: 1792487 - RNA, 19 nt, Salmonella enterica enterica serovar Typhi Ty2
gaauaguuacggacaugcg

SEQ ID NO: 1792488 - RNA, 19 nt, Salmonella enterica enterica serovar Typhi Ty2
gaauaggccgccaaugaca

SEQ ID NO: 1792489 - RNA, 19 nt, Salmonella enterica enterica serovar Typhi Ty2
gaauacugggcgcaugagg

SEQ ID NO: 1792490 - RNA, 15 nt, Salmonella enterica enterica serovar Typhi Ty2
gaaucaccgacagca

SEQ ID NO: 1792491 - RNA, 13 nt, Salmonella enterica enterica serovar Typhi Ty2
gaauaugcagugc

SEQ ID NO: 1792492 - RNA, 15 nt, Salmonella enterica enterica serovar Typhi Ty2
gaauaucuuuguccu

SEQ ID NO: 1792493 - RNA, 19 nt, Salmonella enterica enterica serovar Typhi Ty2
gaauauccccugacagagc

SEQ ID NO: 1792494 - RNA, 15 nt, Salmonella enterica enterica serovar Typhi Ty2
gaauauccgccgccc

SEQ ID NO: 1792495 - RNA, 20 nt, Salmonella enterica enterica serovar Typhi Ty2
gaauauccgguacaccaacu

SEQ ID NO: 1792496 - RNA, 12 nt, Salmonella enterica enterica serovar Typhi Ty2
gaauaucgccaa

SEQ ID NO: 1792497 - RNA, 16 nt, Salmonella enterica enterica serovar Typhi Ty2
gaaucagauuacccuc

SEQ ID NO: 1792498 - RNA, 20 nt, Salmonella enterica enterica serovar Typhi Ty2
gaaucccgucguagccacca

SEQ ID NO: 1792499 - RNA, 17 nt, Salmonella enterica enterica serovar Typhi Ty2
gaaucacuuacuaaggu

SEQ ID NO: 1792500 - RNA, 24 nt, Salmonella enterica enterica serovar Typhi Ty2
gaaucguccagauugagacaaaua

SEQ ID NO: 1792501 - RNA, 14 nt, Salmonella enterica enterica serovar Typhi Ty2
gaaucguccagauu

SEQ ID NO: 1792502 - RNA, 19 nt, Salmonella enterica enterica serovar Typhi Ty2
gaaucguucgccagugaca

SEQ ID NO: 1792503 - RNA, 15 nt, Salmonella enterica enterica serovar Typhi Ty2
gaaucguucgccagu

SEQ ID NO: 1792504 - RNA, 18 nt, Salmonella enterica enterica serovar Typhi Ty2
gaaucgcuuccuggguua

SEQ ID NO: 1792505 - RNA, 21 nt, Salmonella enterica enterica serovar Typhi Ty2
gaaucgccuggcuugccggca

SEQ ID NO: 1792506 - RNA, 14 nt, Salmonella enterica enterica serovar Typhi Ty2
gaaucgccucuucg

SEQ ID NO: 1792507 - RNA, 15 nt, Salmonella enterica enterica serovar Typhi Ty2
gaaucgccgucagug

SEQ ID NO: 1792508 - RNA, 18 nt, Salmonella enterica enterica serovar Typhi Ty2
gaauccucccggaugcac

SEQ ID NO: 1792509 - RNA, 14 nt, Salmonella enterica enterica serovar Typhi Ty2
gaauccgucagguu

SEQ ID NO: 1792510 - RNA, 16 nt, Salmonella enterica enterica serovar Typhi Ty2
gaaucucaucagacug

SEQ ID NO: 1792511 - RNA, 23 nt, Salmonella enterica enterica serovar Typhi Ty2
gaaucugcggcugcgugauuuug

SEQ ID NO: 1792512 - RNA, 15 nt, Salmonella enterica enterica serovar Typhi Ty2
gaaugcacuguuucu

SEQ ID NO: 1792513 - RNA, 22 nt, Salmonella enterica enterica serovar Typhi Ty2
gaaugcaagcagcauaaugaau

SEQ ID NO: 1792514 - RNA, 21 nt, Salmonella enterica enterica serovar Typhi Ty2
gaaugcaaagaagggcagggg

SEQ ID NO: 1792515 - RNA, 15 nt, Salmonella enterica enterica serovar Typhi Ty2
gaaugaugugcuauu

SEQ ID NO: 1792516 - RNA, 17 nt, Salmonella enterica enterica serovar Typhi Ty2
gaaugcuauaugcaggc

SEQ ID NO: 1792517 - RNA, 20 nt, Salmonella enterica enterica serovar Typhi Ty2
gaaugcugacgcguuuuuuc

SEQ ID NO: 1792518 - RNA, 14 nt, Salmonella enterica enterica serovar Typhi Ty2
gaaugcuauaugca

SEQ ID NO: 1792519 - RNA, 17 nt, Salmonella enterica enterica serovar Typhi Ty2
gaaugcguuuuuucacc

SEQ ID NO: 1792520 - RNA, 17 nt, Salmonella enterica enterica serovar Typhi Ty2
gaaguucuucuggcgca

SEQ ID NO: 1792521 - RNA, 19 nt, Salmonella enterica enterica serovar Typhi Ty2
gaaguuuaauucuuugagc

SEQ ID NO: 1792522 - RNA, 16 nt, Salmonella enterica enterica serovar Typhi Ty2
gaaguuuaauucuuug

SEQ ID NO: 1792523 - RNA, 15 nt, Salmonella enterica enterica serovar Typhi Ty2
gaauaaaggccggga

SEQ ID NO: 1792524 - RNA, 14 nt, Salmonella enterica enterica serovar Typhi Ty2
aaagauaaucugaa

SEQ ID NO: 1792525 - RNA, 13 nt, Salmonella enterica enterica serovar Typhi Ty2
aaagauaaucuga

SEQ ID NO: 1792526 - RNA, 20 nt, Salmonella enterica enterica serovar Typhi Ty2
gaaguggugggugaugacgg

SEQ ID NO: 1792527 - RNA, 20 nt, Salmonella enterica enterica serovar Typhi Ty2
gaagugguggcgaacaggcu

SEQ ID NO: 1792528 - RNA, 15 nt, Salmonella enterica enterica serovar Typhi Ty2
gaaguggugggugau

SEQ ID NO: 1792529 - RNA, 16 nt, Salmonella enterica enterica serovar Typhi Ty2
gaauaaccacugaugg

SEQ ID NO: 1792530 - RNA, 15 nt, Salmonella enterica enterica serovar Typhi Ty2
gaauaauccuucccg

SEQ ID NO: 1792531 - RNA, 15 nt, Salmonella enterica enterica serovar Typhi Ty2
gaauaaucgccgccg

SEQ ID NO: 1792532 - RNA, 13 nt, Salmonella enterica enterica serovar Typhi Ty2
gaauaaccucccg

SEQ ID NO: 1792533 - RNA, 17 nt, Salmonella enterica enterica serovar Typhi Ty2
gaauaaugaccagcgcc

SEQ ID NO: 1792534 - RNA, 16 nt, Salmonella enterica enterica serovar Typhi Ty2
gaauaauguaaaaaaa

SEQ ID NO: 1792535 - RNA, 17 nt, Salmonella enterica enterica serovar Typhi Ty2
gaauaaaggauuguacu

SEQ ID NO: 1792536 - RNA, 23 nt, Salmonella enterica enterica serovar Typhi Ty2
gaauaaaugaauuauuuuuucau

SEQ ID NO: 1792537 - RNA, 11 nt, Salmonella enterica enterica serovar Typhi Ty2
gaauaaauccu

SEQ ID NO: 1792538 - RNA, 17 nt, Salmonella enterica enterica serovar Typhi Ty2
gaauaacaucguaaauc

SEQ ID NO: 1792539 - RNA, 19 nt, Salmonella enterica enterica serovar Typhi Ty2
gaauacggaaggauagccg

SEQ ID NO: 1792540 - RNA, 22 nt, Salmonella enterica enterica serovar Typhi Ty2
gaauacgcuccagcuggcuggc

SEQ ID NO: 1792541 - RNA, 16 nt, Salmonella enterica enterica serovar Typhi Ty2
gaauaauuucggcggc

SEQ ID NO: 1792542 - RNA, 16 nt, Salmonella enterica enterica serovar Typhi Ty2
gaagucaaaggccagu

SEQ ID NO: 1792543 - RNA, 18 nt, Salmonella enterica enterica serovar Typhi Ty2
gaaguauccuggaacaaa

SEQ ID NO: 1792544 - RNA, 15 nt, Salmonella enterica enterica serovar Typhi Ty2
gaagugccaguaacu

SEQ ID NO: 1792545 - RNA, 21 nt, Salmonella enterica enterica serovar Typhi Ty2
gaaguccguauuauccacccc

SEQ ID NO: 1792546 - RNA, 14 nt, Salmonella enterica enterica serovar Typhi Ty2
gaagcugaccaggg

SEQ ID NO: 1792547 - RNA, 21 nt, Salmonella enterica enterica serovar Typhi Ty2
gaagcugaccagggcaaauua

SEQ ID NO: 1792548 - RNA, 14 nt, Salmonella enterica enterica serovar Typhi Ty2
gaagcugagaaaag

SEQ ID NO: 1792549 - RNA, 17 nt, Salmonella enterica enterica serovar Typhi Ty2
gaagcuggagccacauc

SEQ ID NO: 1792550 - RNA, 17 nt, Salmonella enterica enterica serovar Typhi Ty2
gaagggcagaucgagga

SEQ ID NO: 1792551 - RNA, 17 nt, Salmonella enterica enterica serovar Typhi Ty2
gaagggcaauaucauga

SEQ ID NO: 1792552 - RNA, 14 nt, Salmonella enterica enterica serovar Typhi Ty2
gaagggcaggggaa

SEQ ID NO: 1792553 - RNA, 15 nt, Salmonella enterica enterica serovar Typhi Ty2
gaagggauucccauc

SEQ ID NO: 1792554 - RNA, 16 nt, Salmonella enterica enterica serovar Typhi Ty2
gaagggauucccaucc

SEQ ID NO: 1792555 - RNA, 13 nt, Salmonella enterica enterica serovar Typhi Ty2
gaagcuuaccacc

SEQ ID NO: 1792556 - RNA, 14 nt, Salmonella enterica enterica serovar Typhi Ty2
gaaggcgugcagcg

SEQ ID NO: 1792557 - RNA, 16 nt, Salmonella enterica enterica serovar Typhi Ty2
gaaggcuaacagcugg

SEQ ID NO: 1792558 - RNA, 17 nt, Salmonella enterica enterica serovar Typhi Ty2
gaaggcuaacagcuggc

SEQ ID NO: 1792559 - RNA, 22 nt, Salmonella enterica enterica serovar Typhi Ty2
gaagauuucuuaauuccucaga

SEQ ID NO: 1792560 - RNA, 21 nt, Salmonella enterica enterica serovar Typhi Ty2
gaagccaccggauugccuucu

SEQ ID NO: 1792561 - RNA, 14 nt, Salmonella enterica enterica serovar Typhi Ty2
gaagccagcgcagu

SEQ ID NO: 1792562 - RNA, 19 nt, Salmonella enterica enterica serovar Typhi Ty2
gaagcaucuuuccggaacg

SEQ ID NO: 1792563 - RNA, 20 nt, Salmonella enterica enterica serovar Typhi Ty2
gaagccacaaucugauaauc

SEQ ID NO: 1792564 - RNA, 18 nt, Salmonella enterica enterica serovar Typhi Ty2
gaagcguuucucuugugc

SEQ ID NO: 1792565 - RNA, 18 nt, Salmonella enterica enterica serovar Typhi Ty2
gaagcgacgcuggcggcc

SEQ ID NO: 1792566 - RNA, 13 nt, Salmonella enterica enterica serovar Typhi Ty2
gaagcgaccggcg

SEQ ID NO: 1792567 - RNA, 19 nt, Salmonella enterica enterica serovar Typhi Ty2
gaagccuuagcgggaggug

SEQ ID NO: 1792568 - RNA, 22 nt, Salmonella enterica enterica serovar Typhi Ty2
gaagcucaugugcagcauccag

SEQ ID NO: 1792569 - RNA, 21 nt, Salmonella enterica enterica serovar Typhi Ty2
gaagcuacuugaucggcuggc

SEQ ID NO: 1792570 - RNA, 13 nt, Salmonella enterica enterica serovar Typhi Ty2
gaagccugcuuca

SEQ ID NO: 1792571 - RNA, 15 nt, Salmonella enterica enterica serovar Typhi Ty2
gaacauccucuccug

SEQ ID NO: 1792572 - RNA, 18 nt, Salmonella enterica enterica serovar Typhi Ty2
gaacaucgcgacggaggc

SEQ ID NO: 1792573 - RNA, 15 nt, Salmonella enterica enterica serovar Typhi Ty2
gaacaugccgacgga

SEQ ID NO: 1792574 - RNA, 17 nt, Salmonella enterica enterica serovar Typhi Ty2
gaacaugccgacggaga

SEQ ID NO: 1792575 - RNA, 22 nt, Salmonella enterica enterica serovar Typhi Ty2
gaagacaacgucgcucuuuuca

SEQ ID NO: 1792576 - RNA, 17 nt, Salmonella enterica enterica serovar Typhi Ty2
gaagaaggcuccggcac

SEQ ID NO: 1792577 - RNA, 14 nt, Salmonella enterica enterica serovar Typhi Ty2
gaagaauccaggga

SEQ ID NO: 1792578 - RNA, 18 nt, Salmonella enterica enterica serovar Typhi Ty2
gaagagcucgaccaacau

SEQ ID NO: 1792579 - RNA, 19 nt, Salmonella enterica enterica serovar Typhi Ty2
gaagagcucgaccaacaua

SEQ ID NO: 1792580 - RNA, 17 nt, Salmonella enterica enterica serovar Typhi Ty2
gaagaucgggagaaggc

SEQ ID NO: 1792581 - RNA, 16 nt, Salmonella enterica enterica serovar Typhi Ty2
gaagaucguuauccag

SEQ ID NO: 1792582 - RNA, 18 nt, Salmonella enterica enterica serovar Typhi Ty2
gaagagagauaguugagc

SEQ ID NO: 1792583 - RNA, 14 nt, Salmonella enterica enterica serovar Typhi Ty2
gaagagaccugugu

SEQ ID NO: 1792584 - RNA, 20 nt, Salmonella enterica enterica serovar Typhi Ty2
gaagacauucacauauauuu

SEQ ID NO: 1792585 - RNA, 18 nt, Salmonella enterica enterica serovar Typhi Ty2
gaaagguccggcccgcua

SEQ ID NO: 1792586 - RNA, 15 nt, Salmonella enterica enterica serovar Typhi Ty2
gaaagguauguacug

SEQ ID NO: 1792587 - RNA, 16 nt, Salmonella enterica enterica serovar Typhi Ty2
gaaagggaucaaugua

SEQ ID NO: 1792588 - RNA, 17 nt, Salmonella enterica enterica serovar Typhi Ty2
gaaagggugcccgccug

SEQ ID NO: 1792589 - RNA, 21 nt, Salmonella enterica enterica serovar Typhi Ty2
gaaagucuucccgcaaacugg

SEQ ID NO: 1792590 - RNA, 18 nt, Salmonella enterica enterica serovar Typhi Ty2
gaaagugcugaaauuucc

SEQ ID NO: 1792591 - RNA, 24 nt, Salmonella enterica enterica serovar Typhi Ty2
gaaaguuacuuuccauauacucuu

SEQ ID NO: 1792592 - RNA, 23 nt, Salmonella enterica enterica serovar Typhi Ty2
gaaaguuacuuuccauauacucu

SEQ ID NO: 1792593 - RNA, 19 nt, Salmonella enterica enterica serovar Typhi Ty2
gaaaguuacuuuccauaua

SEQ ID NO: 1792594 - RNA, 23 nt, Salmonella enterica enterica serovar Typhi Ty2
gaaauccgcgaauaccuucccgc

SEQ ID NO: 1792595 - RNA, 23 nt, Salmonella enterica enterica serovar Typhi Ty2
gaaauccaccagcggacggcuaa

SEQ ID NO: 1792596 - RNA, 14 nt, Salmonella enterica enterica serovar Typhi Ty2
gaaauccagcagaa

SEQ ID NO: 1792597 - RNA, 13 nt, Salmonella enterica enterica serovar Typhi Ty2
gaaaucagcaggu

SEQ ID NO: 1792598 - RNA, 16 nt, Salmonella enterica enterica serovar Typhi Ty2
gaaauaugacgaggau

SEQ ID NO: 1792599 - RNA, 21 nt, Salmonella enterica enterica serovar Typhi Ty2
gaaacgcgccacgcgccagcc

SEQ ID NO: 1792600 - RNA, 17 nt, Salmonella enterica enterica serovar Typhi Ty2
gaaacgcggcguagccg

SEQ ID NO: 1792601 - RNA, 18 nt, Salmonella enterica enterica serovar Typhi Ty2
gaaacgcacccgcgcagg

SEQ ID NO: 1792602 - RNA, 20 nt, Salmonella enterica enterica serovar Typhi Ty2
gaaacgcauacgcaggacuu

SEQ ID NO: 1792603 - RNA, 16 nt, Salmonella enterica enterica serovar Typhi Ty2
gaaacggaucaaaaag

SEQ ID NO: 1792604 - RNA, 22 nt, Salmonella enterica enterica serovar Typhi Ty2
gaaacgguccugauccggaaua

SEQ ID NO: 1792605 - RNA, 11 nt, Salmonella enterica enterica serovar Typhi Ty2
gaaagaaaauu

SEQ ID NO: 1792606 - RNA, 13 nt, Salmonella enterica enterica serovar Typhi Ty2
gaaagagcaaaua

SEQ ID NO: 1792607 - RNA, 23 nt, Salmonella enterica enterica serovar Typhi Ty2
gaaagaucagcagaacaaaggcu

SEQ ID NO: 1792608 - RNA, 20 nt, Salmonella enterica enterica serovar Typhi Ty2
gaaagcgaccuucuccccgu

SEQ ID NO: 1792609 - RNA, 18 nt, Salmonella enterica enterica serovar Typhi Ty2
gaaagccccggcucaagc

SEQ ID NO: 1792610 - RNA, 18 nt, Salmonella enterica enterica serovar Typhi Ty2
gaaagccucuuccgccug

SEQ ID NO: 1792611 - RNA, 15 nt, Salmonella enterica enterica serovar Typhi Ty2
gaaagccucuuccgc

SEQ ID NO: 1792612 - RNA, 20 nt, Salmonella enterica enterica serovar Typhi Ty2
gaacagcaaugcccaaaaua

SEQ ID NO: 1792613 - RNA, 15 nt, Salmonella enterica enterica serovar Typhi Ty2
gaacagauaaauguc

SEQ ID NO: 1792614 - RNA, 21 nt, Salmonella enterica enterica serovar Typhi Ty2
gaacagggcgggcgauagaga

SEQ ID NO: 1792615 - RNA, 18 nt, Salmonella enterica enterica serovar Typhi Ty2
gaacaggcuuuucaggcu

SEQ ID NO: 1792616 - RNA, 16 nt, Salmonella enterica enterica serovar Typhi Ty2
gaacagcggcaggcgg

SEQ ID NO: 1792617 - RNA, 22 nt, Salmonella enterica enterica serovar Typhi Ty2
gaacagugacaaacucacguuc

SEQ ID NO: 1792618 - RNA, 16 nt, Salmonella enterica enterica serovar Typhi Ty2
gaacagaaaaaaugca

SEQ ID NO: 1792619 - RNA, 14 nt, Salmonella enterica enterica serovar Typhi Ty2
gaacagacggcggc

SEQ ID NO: 1792620 - RNA, 20 nt, Salmonella enterica enterica serovar Typhi Ty2
gaacaacgagauucaauaau

SEQ ID NO: 1792621 - RNA, 23 nt, Salmonella enterica enterica serovar Typhi Ty2
gaacaaaucgaaccggggcgcgc

SEQ ID NO: 1792622 - RNA, 19 nt, Salmonella enterica enterica serovar Typhi Ty2
aaagagcguaucgccggcg

SEQ ID NO: 1792623 - RNA, 18 nt, Salmonella enterica enterica serovar Typhi Ty2
gaaauuaaacugccuucg

SEQ ID NO: 1792624 - RNA, 22 nt, Salmonella enterica enterica serovar Typhi Ty2
gaaauuuaggucaaaaaagcga

SEQ ID NO: 1792625 - RNA, 16 nt, Salmonella enterica enterica serovar Typhi Ty2
gaaauuagagccgaua

SEQ ID NO: 1792626 - RNA, 17 nt, Salmonella enterica enterica serovar Typhi Ty2
gaaauggguaucuucau

SEQ ID NO: 1792627 - RNA, 15 nt, Salmonella enterica enterica serovar Typhi Ty2
gaaaugucuggcgcu

SEQ ID NO: 1792628 - RNA, 18 nt, Salmonella enterica enterica serovar Typhi Ty2
gaaaugccuuauccggcc

SEQ ID NO: 1792629 - RNA, 17 nt, Salmonella enterica enterica serovar Typhi Ty2
gaaaugcgacaucucag

SEQ ID NO: 1792630 - RNA, 22 nt, Salmonella enterica enterica serovar Typhi Ty2
gaaaugcgacaucucaggcaag

SEQ ID NO: 1792631 - RNA, 21 nt, Salmonella enterica enterica serovar Typhi Ty2
gaaaugcgcggugucauugac

SEQ ID NO: 1792632 - RNA, 20 nt, Salmonella enterica enterica serovar Typhi Ty2
gaaauggccccaaaucagac

SEQ ID NO: 1792633 - RNA, 17 nt, Salmonella enterica enterica serovar Typhi Ty2
gaaaucucccuggcagu

SEQ ID NO: 1792634 - RNA, 18 nt, Salmonella enterica enterica serovar Typhi Ty2
gaaaucgugcgccccagg

SEQ ID NO: 1792635 - RNA, 20 nt, Salmonella enterica enterica serovar Typhi Ty2
gaaaugcccauaaagaaaua

SEQ ID NO: 1792636 - RNA, 18 nt, Salmonella enterica enterica serovar Typhi Ty2
gaaaugccgggcaaaaaa

SEQ ID NO: 1792637 - RNA, 17 nt, Salmonella enterica enterica serovar Typhi Ty2
gaaaugccggauggcgu

SEQ ID NO: 1792638 - RNA, 21 nt, Salmonella enterica enterica serovar Typhi Ty2
gaaaugcccauaaagaaauau

SEQ ID NO: 1792639 - RNA, 24 nt, Salmonella enterica enterica serovar Typhi Ty2
gaaaugcccgauagugcaagcuca

SEQ ID NO: 1792640 - RNA, 19 nt, Salmonella enterica enterica serovar Typhi Ty2
cuuuuaguucaaccugcgc

SEQ ID NO: 1792641 - RNA, 14 nt, Salmonella enterica enterica serovar Typhi Ty2
cuuuuaguauuuac

SEQ ID NO: 1792642 - RNA, 19 nt, Salmonella enterica enterica serovar Typhi Ty2
cuuuuaguuacgcacgcca

SEQ ID NO: 1792643 - RNA, 16 nt, Salmonella enterica enterica serovar Typhi Ty2
cuuuuauccccaccac

SEQ ID NO: 1792644 - RNA, 20 nt, Salmonella enterica enterica serovar Typhi Ty2
cuuuuggcguaauggcggga

SEQ ID NO: 1792645 - RNA, 18 nt, Salmonella enterica enterica serovar Typhi Ty2
cuuuuuaggcuauaaaaa

SEQ ID NO: 1792646 - RNA, 16 nt, Salmonella enterica enterica serovar Typhi Ty2
cuuuuuauauaagcau

SEQ ID NO: 1792647 - RNA, 22 nt, Salmonella enterica enterica serovar Typhi Ty2
cuuuuuagcacagcucuaauug

SEQ ID NO: 1792648 - RNA, 17 nt, Salmonella enterica enterica serovar Typhi Ty2
cuuuuuauuuacugccg

SEQ ID NO: 1792649 - RNA, 16 nt, Salmonella enterica enterica serovar Typhi Ty2
cuuuuuauuacuuucu

SEQ ID NO: 1792650 - RNA, 13 nt, Salmonella enterica enterica serovar Typhi Ty2
cuuuuuaaaauga

SEQ ID NO: 1792651 - RNA, 19 nt, Salmonella enterica enterica serovar Typhi Ty2
cuuuugguuuuucaaccac

SEQ ID NO: 1792652 - RNA, 15 nt, Salmonella enterica enterica serovar Typhi Ty2
cuuuugguuuuucaa

SEQ ID NO: 1792653 - RNA, 14 nt, Salmonella enterica enterica serovar Typhi Ty2
cuuuugguggcaac

SEQ ID NO: 1792654 - RNA, 17 nt, Salmonella enterica enterica serovar Typhi Ty2
cuuuugguggcaacaga

SEQ ID NO: 1792655 - RNA, 12 nt, Salmonella enterica enterica serovar Typhi Ty2
gaaaaaauuccc

SEQ ID NO: 1792656 - RNA, 21 nt, Salmonella enterica enterica serovar Typhi Ty2
gaaaaaauucccggcaugcca

SEQ ID NO: 1792657 - RNA, 14 nt, Salmonella enterica enterica serovar Typhi Ty2
gaaaaaauuaaaaa

SEQ ID NO: 1792658 - RNA, 17 nt, Salmonella enterica enterica serovar Typhi Ty2
cuuuuuuuaugccuggg

SEQ ID NO: 1792659 - RNA, 23 nt, Salmonella enterica enterica serovar Typhi Ty2
gaaaaaauacugauaaaaaacag

SEQ ID NO: 1792660 - RNA, 19 nt, Salmonella enterica enterica serovar Typhi Ty2
gaaaaaauacugauaaaaa

SEQ ID NO: 1792661 - RNA, 19 nt, Salmonella enterica enterica serovar Typhi Ty2
cuuuuugcgccacuuuucc

SEQ ID NO: 1792662 - RNA, 20 nt, Salmonella enterica enterica serovar Typhi Ty2
cuuuuucauagaaccacuua

SEQ ID NO: 1792663 - RNA, 12 nt, Salmonella enterica enterica serovar Typhi Ty2
cuuuuucaggca

SEQ ID NO: 1792664 - RNA, 13 nt, Salmonella enterica enterica serovar Typhi Ty2
cuuuuucagaucu

SEQ ID NO: 1792665 - RNA, 21 nt, Salmonella enterica enterica serovar Typhi Ty2
gaaaccggcgcgccuuccagc

SEQ ID NO: 1792666 - RNA, 15 nt, Salmonella enterica enterica serovar Typhi Ty2
gaaaccgcagaaaaa

SEQ ID NO: 1792667 - RNA, 14 nt, Salmonella enterica enterica serovar Typhi Ty2
gaaaccgauuuccu

SEQ ID NO: 1792668 - RNA, 19 nt, Salmonella enterica enterica serovar Typhi Ty2
gaaaccgagguucaccagc

SEQ ID NO: 1792669 - RNA, 12 nt, Salmonella enterica enterica serovar Typhi Ty2
gaaaccuccgca

SEQ ID NO: 1792670 - RNA, 17 nt, Salmonella enterica enterica serovar Typhi Ty2
gaaaccgcuacccggca

SEQ ID NO: 1792671 - RNA, 17 nt, Salmonella enterica enterica serovar Typhi Ty2
gaaacccgcucgcccgc

SEQ ID NO: 1792672 - RNA, 16 nt, Salmonella enterica enterica serovar Typhi Ty2
gaaacccgccaccgcc

SEQ ID NO: 1792673 - RNA, 23 nt, Salmonella enterica enterica serovar Typhi Ty2
gaaacaacacaaaucgggcgggc

SEQ ID NO: 1792674 - RNA, 14 nt, Salmonella enterica enterica serovar Typhi Ty2
gaaacaagaagcac

SEQ ID NO: 1792675 - RNA, 15 nt, Salmonella enterica enterica serovar Typhi Ty2
gaaacaagcggcggc

SEQ ID NO: 1792676 - RNA, 23 nt, Salmonella enterica enterica serovar Typhi Ty2
gaaacaauccguuauuucacagc

SEQ ID NO: 1792677 - RNA, 13 nt, Salmonella enterica enterica serovar Typhi Ty2
gaaacauacuguc

SEQ ID NO: 1792678 - RNA, 18 nt, Salmonella enterica enterica serovar Typhi Ty2
gaaacaggucggcaugca

SEQ ID NO: 1792679 - RNA, 13 nt, Salmonella enterica enterica serovar Typhi Ty2
gaaacagaauaaa

SEQ ID NO: 1792680 - RNA, 19 nt, Salmonella enterica enterica serovar Typhi Ty2
gaaaaaucagucauuugca

SEQ ID NO: 1792681 - RNA, 20 nt, Salmonella enterica enterica serovar Typhi Ty2
gaaaagcgcgucgaaugacg

SEQ ID NO: 1792682 - RNA, 19 nt, Salmonella enterica enterica serovar Typhi Ty2
gaaaagccggaauauugag

SEQ ID NO: 1792683 - RNA, 20 nt, Salmonella enterica enterica serovar Typhi Ty2
gaaaagcgggggcgacagcc

SEQ ID NO: 1792684 - RNA, 16 nt, Salmonella enterica enterica serovar Typhi Ty2
gaaaagcgucuucuua

SEQ ID NO: 1792685 - RNA, 11 nt, Salmonella enterica enterica serovar Typhi Ty2
gaaaagcuggu

SEQ ID NO: 1792686 - RNA, 21 nt, Salmonella enterica enterica serovar Typhi Ty2
gaaaagcugguauugaauauu

SEQ ID NO: 1792687 - RNA, 20 nt, Salmonella enterica enterica serovar Typhi Ty2
gaaaagcuguagcauaaaug

SEQ ID NO: 1792688 - RNA, 23 nt, Salmonella enterica enterica serovar Typhi Ty2
gaaaaggccuggcugagaaaaau

SEQ ID NO: 1792689 - RNA, 16 nt, Salmonella enterica enterica serovar Typhi Ty2
gaaaagucauuuucau

SEQ ID NO: 1792690 - RNA, 19 nt, Salmonella enterica enterica serovar Typhi Ty2
gaaaauauuagcggcggca

SEQ ID NO: 1792691 - RNA, 18 nt, Salmonella enterica enterica serovar Typhi Ty2
gaaaauaucggccugaau

SEQ ID NO: 1792692 - RNA, 23 nt, Salmonella enterica enterica serovar Typhi Ty2
gaaaauaaacgcuugacucugaa

SEQ ID NO: 1792693 - RNA, 21 nt, Salmonella enterica enterica serovar Typhi Ty2
gaaaauuguccacggggcggc

SEQ ID NO: 1792694 - RNA, 22 nt, Salmonella enterica enterica serovar Typhi Ty2
gaaaauuguccacggggcggca

SEQ ID NO: 1792695 - RNA, 18 nt, Salmonella enterica enterica serovar Typhi Ty2
gaaaauauuagcggcggc

SEQ ID NO: 1792696 - RNA, 18 nt, Salmonella enterica enterica serovar Typhi Ty2
gaaaaucacaucgccgga

SEQ ID NO: 1792697 - RNA, 14 nt, Salmonella enterica enterica serovar Typhi Ty2
gaaaaugugcaaag

SEQ ID NO: 1792698 - RNA, 16 nt, Salmonella enterica enterica serovar Typhi Ty2
gaaaaugugcaaagag

SEQ ID NO: 1792699 - RNA, 17 nt, Salmonella enterica enterica serovar Typhi Ty2
gaaaaugugcaaagaga

SEQ ID NO: 1792700 - RNA, 17 nt, Salmonella enterica enterica serovar Typhi Ty2
gaaaauuccuggauuaa

SEQ ID NO: 1792701 - RNA, 23 nt, Salmonella enterica enterica serovar Typhi Ty2
gaaaauuaaucccaacccgacca

SEQ ID NO: 1792702 - RNA, 16 nt, Salmonella enterica enterica serovar Typhi Ty2
cuuucagaugcagcgg

SEQ ID NO: 1792703 - RNA, 14 nt, Salmonella enterica enterica serovar Typhi Ty2
cuuuccacaaucaa

SEQ ID NO: 1792704 - RNA, 21 nt, Salmonella enterica enterica serovar Typhi Ty2
cuuucagaccaaauucagcgu

SEQ ID NO: 1792705 - RNA, 13 nt, Salmonella enterica enterica serovar Typhi Ty2
cuuuccagaccaa

SEQ ID NO: 1792706 - RNA, 13 nt, Salmonella enterica enterica serovar Typhi Ty2
cuuuccagcagcc

SEQ ID NO: 1792707 - RNA, 20 nt, Salmonella enterica enterica serovar Typhi Ty2
cuuuccagcaacugacgcgc

SEQ ID NO: 1792708 - RNA, 15 nt, Salmonella enterica enterica serovar Typhi Ty2
cuuuccagcuccagc

SEQ ID NO: 1792709 - RNA, 19 nt, Salmonella enterica enterica serovar Typhi Ty2
cuuuccagcuccagccgcu

SEQ ID NO: 1792710 - RNA, 23 nt, Salmonella enterica enterica serovar Typhi Ty2
cuuuauaaaaagcacaucagcaa

SEQ ID NO: 1792711 - RNA, 20 nt, Salmonella enterica enterica serovar Typhi Ty2
cuuuauaaaucaggaaaaag

SEQ ID NO: 1792712 - RNA, 14 nt, Salmonella enterica enterica serovar Typhi Ty2
cuuuauacaguaag

SEQ ID NO: 1792713 - RNA, 20 nt, Salmonella enterica enterica serovar Typhi Ty2
cuuuagaaaaagaaaccucc

SEQ ID NO: 1792714 - RNA, 19 nt, Salmonella enterica enterica serovar Typhi Ty2
cuuuacuaauaccuggaau

SEQ ID NO: 1792715 - RNA, 20 nt, Salmonella enterica enterica serovar Typhi Ty2
cuuuaucuucugcugcuccc

SEQ ID NO: 1792716 - RNA, 22 nt, Salmonella enterica enterica serovar Typhi Ty2
cuuuaucuucugcugcucccuc

SEQ ID NO: 1792717 - RNA, 20 nt, Salmonella enterica enterica serovar Typhi Ty2
cuuuaucuuuuagcgcgccg

SEQ ID NO: 1792718 - RNA, 17 nt, Salmonella enterica enterica serovar Typhi Ty2
cuuuaucguaaccgaug

SEQ ID NO: 1792719 - RNA, 14 nt, Salmonella enterica enterica serovar Typhi Ty2
cuuuaucguaaccg

SEQ ID NO: 1792720 - RNA, 24 nt, Salmonella enterica enterica serovar Typhi Ty2
cuuuaugcccuucgacaaucagca

SEQ ID NO: 1792721 - RNA, 13 nt, Salmonella enterica enterica serovar Typhi Ty2
cuuuacaccccac

SEQ ID NO: 1792722 - RNA, 20 nt, Salmonella enterica enterica serovar Typhi Ty2
cuuuacugcgccagccugcu

SEQ ID NO: 1792723 - RNA, 16 nt, Salmonella enterica enterica serovar Typhi Ty2
cuuuaaccucuuuuuc

SEQ ID NO: 1792724 - RNA, 23 nt, Salmonella enterica enterica serovar Typhi Ty2
cuuuaacgccuucauauuaaauu

SEQ ID NO: 1792725 - RNA, 13 nt, Salmonella enterica enterica serovar Typhi Ty2
cuuuaacgcuggc

SEQ ID NO: 1792726 - RNA, 16 nt, Salmonella enterica enterica serovar Typhi Ty2
cuuuaaccacagccuu

SEQ ID NO: 1792727 - RNA, 20 nt, Salmonella enterica enterica serovar Typhi Ty2
cuuuaagccgauugaauaau

SEQ ID NO: 1792728 - RNA, 16 nt, Salmonella enterica enterica serovar Typhi Ty2
cuuuaagcaccgcuuu

SEQ ID NO: 1792729 - RNA, 18 nt, Salmonella enterica enterica serovar Typhi Ty2
aaagaaugaaaaaaaaau

SEQ ID NO: 1792730 - RNA, 19 nt, Salmonella enterica enterica serovar Typhi Ty2
aaagaaguuagauauuaau

SEQ ID NO: 1792731 - RNA, 22 nt, Salmonella enterica enterica serovar Typhi Ty2
cuuucggguugcccugcuuguc

SEQ ID NO: 1792732 - RNA, 17 nt, Salmonella enterica enterica serovar Typhi Ty2
cuuucggacuuccugua

SEQ ID NO: 1792733 - RNA, 21 nt, Salmonella enterica enterica serovar Typhi Ty2
cuuucgucguccacucuuccg

SEQ ID NO: 1792734 - RNA, 20 nt, Salmonella enterica enterica serovar Typhi Ty2
cuuugaacagccagaagccu

SEQ ID NO: 1792735 - RNA, 21 nt, Salmonella enterica enterica serovar Typhi Ty2
cuuucgcaacauccgaaagcu

SEQ ID NO: 1792736 - RNA, 14 nt, Salmonella enterica enterica serovar Typhi Ty2
cuuucgccaguuca

SEQ ID NO: 1792737 - RNA, 17 nt, Salmonella enterica enterica serovar Typhi Ty2
cuuuccggcgcuuccug

SEQ ID NO: 1792738 - RNA, 21 nt, Salmonella enterica enterica serovar Typhi Ty2
cuuuccaguucuggcugcgcu

SEQ ID NO: 1792739 - RNA, 23 nt, Salmonella enterica enterica serovar Typhi Ty2
cuuuccuuauuaaagccccuucc

SEQ ID NO: 1792740 - RNA, 18 nt, Salmonella enterica enterica serovar Typhi Ty2
cuuuccuuauuaaagccc

SEQ ID NO: 1792741 - RNA, 21 nt, Salmonella enterica enterica serovar Typhi Ty2
cuuucgaagccgaccaccauc

SEQ ID NO: 1792742 - RNA, 21 nt, Salmonella enterica enterica serovar Typhi Ty2
cuuuccugaucaaucaacucu

SEQ ID NO: 1792743 - RNA, 20 nt, Salmonella enterica enterica serovar Typhi Ty2
cuuugcuuuguaaagcgcca

SEQ ID NO: 1792744 - RNA, 20 nt, Salmonella enterica enterica serovar Typhi Ty2
cuuugcgccauuucaauaau

SEQ ID NO: 1792745 - RNA, 13 nt, Salmonella enterica enterica serovar Typhi Ty2
cuuugccuuucuu

SEQ ID NO: 1792746 - RNA, 22 nt, Salmonella enterica enterica serovar Typhi Ty2
cuuugccguucucugacaaaau

SEQ ID NO: 1792747 - RNA, 20 nt, Salmonella enterica enterica serovar Typhi Ty2
cuuugcccgagcgcuggcau

SEQ ID NO: 1792748 - RNA, 23 nt, Salmonella enterica enterica serovar Typhi Ty2
cuuugccgcaaacgccgaagcca

SEQ ID NO: 1792749 - RNA, 15 nt, Salmonella enterica enterica serovar Typhi Ty2
cuuugaggaucaauu

SEQ ID NO: 1792750 - RNA, 22 nt, Salmonella enterica enterica serovar Typhi Ty2
cuuugagggcgauaauccgcuc

SEQ ID NO: 1792751 - RNA, 23 nt, Salmonella enterica enterica serovar Typhi Ty2
cuuugagcaucaaacuuuuaaau

SEQ ID NO: 1792752 - RNA, 22 nt, Salmonella enterica enterica serovar Typhi Ty2
cuuugagcaucaaacuuuuaaa

SEQ ID NO: 1792753 - RNA, 18 nt, Salmonella enterica enterica serovar Typhi Ty2
cuuuggcaaacggcgcca

SEQ ID NO: 1792754 - RNA, 15 nt, Salmonella enterica enterica serovar Typhi Ty2
cuuuggcaaaaaagg

SEQ ID NO: 1792755 - RNA, 21 nt, Salmonella enterica enterica serovar Typhi Ty2
cuuuggcuuaaucauugcuca

SEQ ID NO: 1792756 - RNA, 17 nt, Salmonella enterica enterica serovar Typhi Ty2
cuuuuaagguuaauucu

SEQ ID NO: 1792757 - RNA, 23 nt, Salmonella enterica enterica serovar Typhi Ty2
cuuguauuacguguaguuauaaa

SEQ ID NO: 1792758 - RNA, 17 nt, Salmonella enterica enterica serovar Typhi Ty2
cuuguagaaaagaaggg

SEQ ID NO: 1792759 - RNA, 14 nt, Salmonella enterica enterica serovar Typhi Ty2
cuuguaagggaggu

SEQ ID NO: 1792760 - RNA, 23 nt, Salmonella enterica enterica serovar Typhi Ty2
cuuguaagggaggugcucuccca

SEQ ID NO: 1792761 - RNA, 12 nt, Salmonella enterica enterica serovar Typhi Ty2
cuuggucauaau

SEQ ID NO: 1792762 - RNA, 18 nt, Salmonella enterica enterica serovar Typhi Ty2
cuugguaccaaacagcag

SEQ ID NO: 1792763 - RNA, 17 nt, Salmonella enterica enterica serovar Typhi Ty2
cuuggcguauagccgcc

SEQ ID NO: 1792764 - RNA, 19 nt, Salmonella enterica enterica serovar Typhi Ty2
cuuggcguuaaagacgcca

SEQ ID NO: 1792765 - RNA, 21 nt, Salmonella enterica enterica serovar Typhi Ty2
cuuggagagcaucaucugcca

SEQ ID NO: 1792766 - RNA, 20 nt, Salmonella enterica enterica serovar Typhi Ty2
cuuguuauccaucagccagg

SEQ ID NO: 1792767 - RNA, 14 nt, Salmonella enterica enterica serovar Typhi Ty2
cuuguucgcagguc

SEQ ID NO: 1792768 - RNA, 16 nt, Salmonella enterica enterica serovar Typhi Ty2
cuuguuacucaauaaa

SEQ ID NO: 1792769 - RNA, 22 nt, Salmonella enterica enterica serovar Typhi Ty2
cuuguguggagguuucuucauc

SEQ ID NO: 1792770 - RNA, 23 nt, Salmonella enterica enterica serovar Typhi Ty2
cuuguguggagguuucuucauca

SEQ ID NO: 1792771 - RNA, 13 nt, Salmonella enterica enterica serovar Typhi Ty2
cuugugacugaua

SEQ ID NO: 1792772 - RNA, 15 nt, Salmonella enterica enterica serovar Typhi Ty2
cuugugaugagcuca

SEQ ID NO: 1792773 - RNA, 16 nt, Salmonella enterica enterica serovar Typhi Ty2
cuugugcuuccagcuc

SEQ ID NO: 1792774 - RNA, 24 nt, Salmonella enterica enterica serovar Typhi Ty2
cuugugcuuccagcuccauccacc

SEQ ID NO: 1792775 - RNA, 14 nt, Salmonella enterica enterica serovar Typhi Ty2
aaagaaagcauuaa

SEQ ID NO: 1792776 - RNA, 19 nt, Salmonella enterica enterica serovar Typhi Ty2
aaagaaaacuuucauuuca

SEQ ID NO: 1792777 - RNA, 18 nt, Salmonella enterica enterica serovar Typhi Ty2
aaagaaaguagaucacca

SEQ ID NO: 1792778 - RNA, 18 nt, Salmonella enterica enterica serovar Typhi Ty2
cuugucgccaaccuccca

SEQ ID NO: 1792779 - RNA, 23 nt, Salmonella enterica enterica serovar Typhi Ty2
aaagaagaaaccgcagaaaaagc

SEQ ID NO: 1792780 - RNA, 18 nt, Salmonella enterica enterica serovar Typhi Ty2
aaagaacguguuuuucca

SEQ ID NO: 1792781 - RNA, 16 nt, Salmonella enterica enterica serovar Typhi Ty2
aaagaacaauaaucau

SEQ ID NO: 1792782 - RNA, 13 nt, Salmonella enterica enterica serovar Typhi Ty2
cuuguucuuuuca

SEQ ID NO: 1792783 - RNA, 16 nt, Salmonella enterica enterica serovar Typhi Ty2
cuuguucgcaggucaa

SEQ ID NO: 1792784 - RNA, 16 nt, Salmonella enterica enterica serovar Typhi Ty2
cuuuaaagcccagcac

SEQ ID NO: 1792785 - RNA, 21 nt, Salmonella enterica enterica serovar Typhi Ty2
cuuuaaagcgcugcguggcgg

SEQ ID NO: 1792786 - RNA, 19 nt, Salmonella enterica enterica serovar Typhi Ty2
cuuguuucaucgucagcuc

SEQ ID NO: 1792787 - RNA, 14 nt, Salmonella enterica enterica serovar Typhi Ty2
cuucaccacgccau

SEQ ID NO: 1792788 - RNA, 19 nt, Salmonella enterica enterica serovar Typhi Ty2
cuucacccagacugugaug

SEQ ID NO: 1792789 - RNA, 13 nt, Salmonella enterica enterica serovar Typhi Ty2
cuucaccacgcca

SEQ ID NO: 1792790 - RNA, 19 nt, Salmonella enterica enterica serovar Typhi Ty2
cuucacauuuuuaucagcu

SEQ ID NO: 1792791 - RNA, 18 nt, Salmonella enterica enterica serovar Typhi Ty2
cuucaaugcgccccgucu

SEQ ID NO: 1792792 - RNA, 23 nt, Salmonella enterica enterica serovar Typhi Ty2
cuucaaugcgccccgucuguguu

SEQ ID NO: 1792793 - RNA, 12 nt, Salmonella enterica enterica serovar Typhi Ty2
cuucaaugaaca

SEQ ID NO: 1792794 - RNA, 22 nt, Salmonella enterica enterica serovar Typhi Ty2
cuucaauguuagcauuauuuuu

SEQ ID NO: 1792795 - RNA, 16 nt, Salmonella enterica enterica serovar Typhi Ty2
cuucaauucagaaagu

SEQ ID NO: 1792796 - RNA, 19 nt, Salmonella enterica enterica serovar Typhi Ty2
cuucaauucagaaaguuac

SEQ ID NO: 1792797 - RNA, 20 nt, Salmonella enterica enterica serovar Typhi Ty2
cuucaauuccuggaacugac

SEQ ID NO: 1792798 - RNA, 15 nt, Salmonella enterica enterica serovar Typhi Ty2
cuucacuaaaaacag

SEQ ID NO: 1792799 - RNA, 18 nt, Salmonella enterica enterica serovar Typhi Ty2
cuucacguugacgcaaac

SEQ ID NO: 1792800 - RNA, 18 nt, Salmonella enterica enterica serovar Typhi Ty2
cuucaccgagaaauuuag

SEQ ID NO: 1792801 - RNA, 14 nt, Salmonella enterica enterica serovar Typhi Ty2
cuucaagccaggcu

SEQ ID NO: 1792802 - RNA, 18 nt, Salmonella enterica enterica serovar Typhi Ty2
cuucaagccaggcuuuaa

SEQ ID NO: 1792803 - RNA, 22 nt, Salmonella enterica enterica serovar Typhi Ty2
cuucaacgcgccgcucacaacc

SEQ ID NO: 1792804 - RNA, 19 nt, Salmonella enterica enterica serovar Typhi Ty2
cuucaacgcucaguacgcu

SEQ ID NO: 1792805 - RNA, 18 nt, Salmonella enterica enterica serovar Typhi Ty2
cuucaaccuuugggcaga

SEQ ID NO: 1792806 - RNA, 14 nt, Salmonella enterica enterica serovar Typhi Ty2
cuucaagaaucaau

SEQ ID NO: 1792807 - RNA, 20 nt, Salmonella enterica enterica serovar Typhi Ty2
cuuauuuuauuuuuauauuc

SEQ ID NO: 1792808 - RNA, 15 nt, Salmonella enterica enterica serovar Typhi Ty2
cuucauccagauagg

SEQ ID NO: 1792809 - RNA, 14 nt, Salmonella enterica enterica serovar Typhi Ty2
cuucaucagccagc

SEQ ID NO: 1792810 - RNA, 18 nt, Salmonella enterica enterica serovar Typhi Ty2
cuucaguucagccgccag

SEQ ID NO: 1792811 - RNA, 20 nt, Salmonella enterica enterica serovar Typhi Ty2
cuucaggagaccuaaagucu

SEQ ID NO: 1792812 - RNA, 20 nt, Salmonella enterica enterica serovar Typhi Ty2
cuucaggcucaucagcgcca

SEQ ID NO: 1792813 - RNA, 19 nt, Salmonella enterica enterica serovar Typhi Ty2
cuucagcaucaucucccag

SEQ ID NO: 1792814 - RNA, 21 nt, Salmonella enterica enterica serovar Typhi Ty2
cuucagagcugaaaauguggu

SEQ ID NO: 1792815 - RNA, 12 nt, Salmonella enterica enterica serovar Typhi Ty2
cuucagagcagg

SEQ ID NO: 1792816 - RNA, 13 nt, Salmonella enterica enterica serovar Typhi Ty2
cuucagagcaggu

SEQ ID NO: 1792817 - RNA, 18 nt, Salmonella enterica enterica serovar Typhi Ty2
cuuccucacagccuugcc

SEQ ID NO: 1792818 - RNA, 18 nt, Salmonella enterica enterica serovar Typhi Ty2
cuuccucauuuuugccca

SEQ ID NO: 1792819 - RNA, 22 nt, Salmonella enterica enterica serovar Typhi Ty2
cuuccuccagcaucagguggaa

SEQ ID NO: 1792820 - RNA, 18 nt, Salmonella enterica enterica serovar Typhi Ty2
cuuccguccccagcccau

SEQ ID NO: 1792821 - RNA, 15 nt, Salmonella enterica enterica serovar Typhi Ty2
cuuccgucagcgaau

SEQ ID NO: 1792822 - RNA, 23 nt, Salmonella enterica enterica serovar Typhi Ty2
cuuccgucaaaaaaucgaccaac

SEQ ID NO: 1792823 - RNA, 20 nt, Salmonella enterica enterica serovar Typhi Ty2
cuuccgguugaccgcauaau

SEQ ID NO: 1792824 - RNA, 20 nt, Salmonella enterica enterica serovar Typhi Ty2
cuuccggugugaccagcgcg

SEQ ID NO: 1792825 - RNA, 17 nt, Salmonella enterica enterica serovar Typhi Ty2
cuuccuguaucccaaac

SEQ ID NO: 1792826 - RNA, 21 nt, Salmonella enterica enterica serovar Typhi Ty2
cuuccugcgcgccaaaccguu

SEQ ID NO: 1792827 - RNA, 15 nt, Salmonella enterica enterica serovar Typhi Ty2
cuuccugcugcgcuu

SEQ ID NO: 1792828 - RNA, 21 nt, Salmonella enterica enterica serovar Typhi Ty2
cuuccuguacaaaaucaucau

SEQ ID NO: 1792829 - RNA, 22 nt, Salmonella enterica enterica serovar Typhi Ty2
cuucgaggauaaaaucgccaaa

SEQ ID NO: 1792830 - RNA, 21 nt, Salmonella enterica enterica serovar Typhi Ty2
cuucgccuaaaucaagcagug

SEQ ID NO: 1792831 - RNA, 12 nt, Salmonella enterica enterica serovar Typhi Ty2
cuucgauaaacg

SEQ ID NO: 1792832 - RNA, 19 nt, Salmonella enterica enterica serovar Typhi Ty2
cuucgccguuaucggccug

SEQ ID NO: 1792833 - RNA, 20 nt, Salmonella enterica enterica serovar Typhi Ty2
cuucgccguuaucggccugc

SEQ ID NO: 1792834 - RNA, 21 nt, Salmonella enterica enterica serovar Typhi Ty2
cuucgccuucgcccauaucca

SEQ ID NO: 1792835 - RNA, 21 nt, Salmonella enterica enterica serovar Typhi Ty2
cuucgcgccuucuaccgcuuc

SEQ ID NO: 1792836 - RNA, 13 nt, Salmonella enterica enterica serovar Typhi Ty2
cuucgcggccgcu

SEQ ID NO: 1792837 - RNA, 16 nt, Salmonella enterica enterica serovar Typhi Ty2
cuuccaccucuucugc

SEQ ID NO: 1792838 - RNA, 23 nt, Salmonella enterica enterica serovar Typhi Ty2
cuuccaccauccgcgcauacucu

SEQ ID NO: 1792839 - RNA, 14 nt, Salmonella enterica enterica serovar Typhi Ty2
cuuccacucguaac

SEQ ID NO: 1792840 - RNA, 15 nt, Salmonella enterica enterica serovar Typhi Ty2
cuuccacgcacgccg

SEQ ID NO: 1792841 - RNA, 23 nt, Salmonella enterica enterica serovar Typhi Ty2
cuuccagaauucguacguuuuuc

SEQ ID NO: 1792842 - RNA, 12 nt, Salmonella enterica enterica serovar Typhi Ty2
cuuccacugcgg

SEQ ID NO: 1792843 - RNA, 24 nt, Salmonella enterica enterica serovar Typhi Ty2
cuuccagcgcgccgucaucgcuca

SEQ ID NO: 1792844 - RNA, 20 nt, Salmonella enterica enterica serovar Typhi Ty2
aaacuucccgcgcagugcag

SEQ ID NO: 1792845 - RNA, 21 nt, Salmonella enterica enterica serovar Typhi Ty2
aaacuucaauucagaaaguua

SEQ ID NO: 1792846 - RNA, 16 nt, Salmonella enterica enterica serovar Typhi Ty2
cuuccggcgagagaau

SEQ ID NO: 1792847 - RNA, 20 nt, Salmonella enterica enterica serovar Typhi Ty2
cuuccggcaucacaucgccg

SEQ ID NO: 1792848 - RNA, 19 nt, Salmonella enterica enterica serovar Typhi Ty2
cuuccgcuuuaagcgcugc

SEQ ID NO: 1792849 - RNA, 16 nt, Salmonella enterica enterica serovar Typhi Ty2
cuucccgcgcagugca

SEQ ID NO: 1792850 - RNA, 19 nt, Salmonella enterica enterica serovar Typhi Ty2
cuucccggggaacagaagc

SEQ ID NO: 1792851 - RNA, 23 nt, Salmonella enterica enterica serovar Typhi Ty2
cuuccccggcagccucaggccug

SEQ ID NO: 1792852 - RNA, 16 nt, Salmonella enterica enterica serovar Typhi Ty2
cuuccaguuuugccag

SEQ ID NO: 1792853 - RNA, 23 nt, Salmonella enterica enterica serovar Typhi Ty2
cuucccgcaccgcgaugcugcuc

SEQ ID NO: 1792854 - RNA, 22 nt, Salmonella enterica enterica serovar Typhi Ty2
cuuccaguucgcugaggcguug

SEQ ID NO: 1792855 - RNA, 16 nt, Salmonella enterica enterica serovar Typhi Ty2
cuuauuaaagccccuu

SEQ ID NO: 1792856 - RNA, 13 nt, Salmonella enterica enterica serovar Typhi Ty2
cuuauuuguauug

SEQ ID NO: 1792857 - RNA, 17 nt, Salmonella enterica enterica serovar Typhi Ty2
cuuaucgccaaagauau

SEQ ID NO: 1792858 - RNA, 19 nt, Salmonella enterica enterica serovar Typhi Ty2
cuuaucgagugucaauaag

SEQ ID NO: 1792859 - RNA, 15 nt, Salmonella enterica enterica serovar Typhi Ty2
cuuaucgccaaagau

SEQ ID NO: 1792860 - RNA, 14 nt, Salmonella enterica enterica serovar Typhi Ty2
cuuaucgcgcuggc

SEQ ID NO: 1792861 - RNA, 22 nt, Salmonella enterica enterica serovar Typhi Ty2
cuuauccggccugcaaaccgcc

SEQ ID NO: 1792862 - RNA, 20 nt, Salmonella enterica enterica serovar Typhi Ty2
cuuauccggccugcaggcaa

SEQ ID NO: 1792863 - RNA, 15 nt, Salmonella enterica enterica serovar Typhi Ty2
cuuaugaucgcccag

SEQ ID NO: 1792864 - RNA, 12 nt, Salmonella enterica enterica serovar Typhi Ty2
cuuaugcccggc

SEQ ID NO: 1792865 - RNA, 17 nt, Salmonella enterica enterica serovar Typhi Ty2
cuuauccggccuccaaa

SEQ ID NO: 1792866 - RNA, 12 nt, Salmonella enterica enterica serovar Typhi Ty2
cuuauauuuauu

SEQ ID NO: 1792867 - RNA, 17 nt, Salmonella enterica enterica serovar Typhi Ty2
cuuagcgccagcagaaa

SEQ ID NO: 1792868 - RNA, 18 nt, Salmonella enterica enterica serovar Typhi Ty2
cuuaggauaauuccccca

SEQ ID NO: 1792869 - RNA, 14 nt, Salmonella enterica enterica serovar Typhi Ty2
cuuaggcagccagg

SEQ ID NO: 1792870 - RNA, 23 nt, Salmonella enterica enterica serovar Typhi Ty2
cuuaggcagccaggcaaagcccc

SEQ ID NO: 1792871 - RNA, 23 nt, Salmonella enterica enterica serovar Typhi Ty2
cuuagcacccaccaucacuucca

SEQ ID NO: 1792872 - RNA, 17 nt, Salmonella enterica enterica serovar Typhi Ty2
cuuagcagcauaaacau

SEQ ID NO: 1792873 - RNA, 19 nt, Salmonella enterica enterica serovar Typhi Ty2
cuuagaucguaucggcugg

SEQ ID NO: 1792874 - RNA, 13 nt, Salmonella enterica enterica serovar Typhi Ty2
cuuacugcugucc

SEQ ID NO: 1792875 - RNA, 15 nt, Salmonella enterica enterica serovar Typhi Ty2
cuuaccgggcaucug

SEQ ID NO: 1792876 - RNA, 23 nt, Salmonella enterica enterica serovar Typhi Ty2
cuuaccuauuuuaaauucccagc

SEQ ID NO: 1792877 - RNA, 23 nt, Salmonella enterica enterica serovar Typhi Ty2
cuuaccggugcgauucagcgcag

SEQ ID NO: 1792878 - RNA, 16 nt, Salmonella enterica enterica serovar Typhi Ty2
cuuacgagaggcuuua

SEQ ID NO: 1792879 - RNA, 18 nt, Salmonella enterica enterica serovar Typhi Ty2
cuuacgaauuuuaucuuc

SEQ ID NO: 1792880 - RNA, 13 nt, Salmonella enterica enterica serovar Typhi Ty2
cuuacuaauaaau

SEQ ID NO: 1792881 - RNA, 17 nt, Salmonella enterica enterica serovar Typhi Ty2
cuuaauuaacgccgcga

SEQ ID NO: 1792882 - RNA, 16 nt, Salmonella enterica enterica serovar Typhi Ty2
cuuaaugcucugcugu

SEQ ID NO: 1792883 - RNA, 22 nt, Salmonella enterica enterica serovar Typhi Ty2
cuuaaugcauggcagauaaacc

SEQ ID NO: 1792884 - RNA, 23 nt, Salmonella enterica enterica serovar Typhi Ty2
cuuacagggcgaugccucacccc

SEQ ID NO: 1792885 - RNA, 17 nt, Salmonella enterica enterica serovar Typhi Ty2
cuuacaggcgcaucaga

SEQ ID NO: 1792886 - RNA, 14 nt, Salmonella enterica enterica serovar Typhi Ty2
cuuaccaucuggcc

SEQ ID NO: 1792887 - RNA, 19 nt, Salmonella enterica enterica serovar Typhi Ty2
cuuaccagguauuaaauac

SEQ ID NO: 1792888 - RNA, 16 nt, Salmonella enterica enterica serovar Typhi Ty2
cuuaccgcuaaaauac

SEQ ID NO: 1792889 - RNA, 19 nt, Salmonella enterica enterica serovar Typhi Ty2
cuguuuuuuguugauuuua

SEQ ID NO: 1792890 - RNA, 23 nt, Salmonella enterica enterica serovar Typhi Ty2
cuguuuuuggaaacuaugcaaaa

SEQ ID NO: 1792891 - RNA, 16 nt, Salmonella enterica enterica serovar Typhi Ty2
cuguuuuugcuuuaau

SEQ ID NO: 1792892 - RNA, 20 nt, Salmonella enterica enterica serovar Typhi Ty2
cuuaaacgccggauuccaga

SEQ ID NO: 1792893 - RNA, 21 nt, Salmonella enterica enterica serovar Typhi Ty2
cuuaaacgccggauuccagaa

SEQ ID NO: 1792894 - RNA, 21 nt, Salmonella enterica enterica serovar Typhi Ty2
cuuaaauggcgcuguaaggca

SEQ ID NO: 1792895 - RNA, 19 nt, Salmonella enterica enterica serovar Typhi Ty2
cuuaaauaugaaagagaaa

SEQ ID NO: 1792896 - RNA, 16 nt, Salmonella enterica enterica serovar Typhi Ty2
aaacuggcgcuggcag

SEQ ID NO: 1792897 - RNA, 14 nt, Salmonella enterica enterica serovar Typhi Ty2
aaacugcugacaau

SEQ ID NO: 1792898 - RNA, 13 nt, Salmonella enterica enterica serovar Typhi Ty2
cuuaaauuuuuaa

SEQ ID NO: 1792899 - RNA, 14 nt, Salmonella enterica enterica serovar Typhi Ty2
aaacuggaagaaga

SEQ ID NO: 1792900 - RNA, 23 nt, Salmonella enterica enterica serovar Typhi Ty2
aaacuggcacgccguuugccaua

SEQ ID NO: 1792901 - RNA, 18 nt, Salmonella enterica enterica serovar Typhi Ty2
cuuaauaucaauauaauu

SEQ ID NO: 1792902 - RNA, 14 nt, Salmonella enterica enterica serovar Typhi Ty2
cuuaacccacaaga

SEQ ID NO: 1792903 - RNA, 18 nt, Salmonella enterica enterica serovar Typhi Ty2
cuuaaccucgcuacuggc

SEQ ID NO: 1792904 - RNA, 22 nt, Salmonella enterica enterica serovar Typhi Ty2
cuguuauauauuuuucagcuuc

SEQ ID NO: 1792905 - RNA, 18 nt, Salmonella enterica enterica serovar Typhi Ty2
cuguuaucgccauuauuc

SEQ ID NO: 1792906 - RNA, 17 nt, Salmonella enterica enterica serovar Typhi Ty2
cuguuacgcugguuugu

SEQ ID NO: 1792907 - RNA, 19 nt, Salmonella enterica enterica serovar Typhi Ty2
cuguuaucuggauguaaau

SEQ ID NO: 1792908 - RNA, 15 nt, Salmonella enterica enterica serovar Typhi Ty2
cuguuaugaaacccg

SEQ ID NO: 1792909 - RNA, 19 nt, Salmonella enterica enterica serovar Typhi Ty2
cuguuauucagggcuuuau

SEQ ID NO: 1792910 - RNA, 19 nt, Salmonella enterica enterica serovar Typhi Ty2
cuguuuaagcgccuccaca

SEQ ID NO: 1792911 - RNA, 20 nt, Salmonella enterica enterica serovar Typhi Ty2
cuguucggggaauucaaaga

SEQ ID NO: 1792912 - RNA, 15 nt, Salmonella enterica enterica serovar Typhi Ty2
cuguucgcuuauucc

SEQ ID NO: 1792913 - RNA, 14 nt, Salmonella enterica enterica serovar Typhi Ty2
cuguuccuucagaa

SEQ ID NO: 1792914 - RNA, 22 nt, Salmonella enterica enterica serovar Typhi Ty2
cuguuuaaugcuuucaauacuc

SEQ ID NO: 1792915 - RNA, 23 nt, Salmonella enterica enterica serovar Typhi Ty2
cuguuuauucuucgucagaugcg

SEQ ID NO: 1792916 - RNA, 14 nt, Salmonella enterica enterica serovar Typhi Ty2
cuguuuccaguuac

SEQ ID NO: 1792917 - RNA, 21 nt, Salmonella enterica enterica serovar Typhi Ty2
cuguuucugauagcccuauuc

SEQ ID NO: 1792918 - RNA, 16 nt, Salmonella enterica enterica serovar Typhi Ty2
cuguuucugcuggccu

SEQ ID NO: 1792919 - RNA, 17 nt, Salmonella enterica enterica serovar Typhi Ty2
cuguuucgccaggccgc

SEQ ID NO: 1792920 - RNA, 22 nt, Salmonella enterica enterica serovar Typhi Ty2
cuugcgccgccauccggccugu

SEQ ID NO: 1792921 - RNA, 13 nt, Salmonella enterica enterica serovar Typhi Ty2
cuugcgccgccau

SEQ ID NO: 1792922 - RNA, 17 nt, Salmonella enterica enterica serovar Typhi Ty2
cuugcgcaucgcaucag

SEQ ID NO: 1792923 - RNA, 13 nt, Salmonella enterica enterica serovar Typhi Ty2
cuugcgccauucu

SEQ ID NO: 1792924 - RNA, 21 nt, Salmonella enterica enterica serovar Typhi Ty2
cuugcgccaucauccggcaac

SEQ ID NO: 1792925 - RNA, 18 nt, Salmonella enterica enterica serovar Typhi Ty2
cuugcggcgccaggacaa

SEQ ID NO: 1792926 - RNA, 21 nt, Salmonella enterica enterica serovar Typhi Ty2
cuugcggaaagaagaauaagc

SEQ ID NO: 1792927 - RNA, 18 nt, Salmonella enterica enterica serovar Typhi Ty2
cuugcuuuucaucaccau

SEQ ID NO: 1792928 - RNA, 19 nt, Salmonella enterica enterica serovar Typhi Ty2
cuugcugcggcacgaaaaa

SEQ ID NO: 1792929 - RNA, 14 nt, Salmonella enterica enterica serovar Typhi Ty2
cuugcucucaggca

SEQ ID NO: 1792930 - RNA, 13 nt, Salmonella enterica enterica serovar Typhi Ty2
aaacuuuuaaauu

SEQ ID NO: 1792931 - RNA, 17 nt, Salmonella enterica enterica serovar Typhi Ty2
cuugccgaauuuacugu

SEQ ID NO: 1792932 - RNA, 23 nt, Salmonella enterica enterica serovar Typhi Ty2
aaacuuucauuucacuuguucuu

SEQ ID NO: 1792933 - RNA, 21 nt, Salmonella enterica enterica serovar Typhi Ty2
cuugcccagcauauuaacagu

SEQ ID NO: 1792934 - RNA, 21 nt, Salmonella enterica enterica serovar Typhi Ty2
cuugcccuguuucgcaggccg

SEQ ID NO: 1792935 - RNA, 19 nt, Salmonella enterica enterica serovar Typhi Ty2
cuugccugcuuuuucauca

SEQ ID NO: 1792936 - RNA, 19 nt, Salmonella enterica enterica serovar Typhi Ty2
cuugccguuuuucucauca

SEQ ID NO: 1792937 - RNA, 17 nt, Salmonella enterica enterica serovar Typhi Ty2
cuugccgugaaaacgaa

SEQ ID NO: 1792938 - RNA, 23 nt, Salmonella enterica enterica serovar Typhi Ty2
cuugccgcaucuucgcccggcgu

SEQ ID NO: 1792939 - RNA, 15 nt, Salmonella enterica enterica serovar Typhi Ty2
cuugccgccagcgcg

SEQ ID NO: 1792940 - RNA, 18 nt, Salmonella enterica enterica serovar Typhi Ty2
cuugcacaauacuuuuug

SEQ ID NO: 1792941 - RNA, 13 nt, Salmonella enterica enterica serovar Typhi Ty2
cuugccacuggcc

SEQ ID NO: 1792942 - RNA, 19 nt, Salmonella enterica enterica serovar Typhi Ty2
cuugccacuacgcagcucc

SEQ ID NO: 1792943 - RNA, 17 nt, Salmonella enterica enterica serovar Typhi Ty2
cuugcauggcagccccg

SEQ ID NO: 1792944 - RNA, 13 nt, Salmonella enterica enterica serovar Typhi Ty2
cuugccagcgaga

SEQ ID NO: 1792945 - RNA, 23 nt, Salmonella enterica enterica serovar Typhi Ty2
cuugcaaugaaaaauccccgcaa

SEQ ID NO: 1792946 - RNA, 19 nt, Salmonella enterica enterica serovar Typhi Ty2
cuugcaaugaaaaaucccc

SEQ ID NO: 1792947 - RNA, 18 nt, Salmonella enterica enterica serovar Typhi Ty2
cuugcaacccauacagcc

SEQ ID NO: 1792948 - RNA, 19 nt, Salmonella enterica enterica serovar Typhi Ty2
cuugaugugucuauuuauu

SEQ ID NO: 1792949 - RNA, 20 nt, Salmonella enterica enterica serovar Typhi Ty2
cuugauggcgaucagcgcca

SEQ ID NO: 1792950 - RNA, 20 nt, Salmonella enterica enterica serovar Typhi Ty2
cuugaugauacccccagaga

SEQ ID NO: 1792951 - RNA, 14 nt, Salmonella enterica enterica serovar Typhi Ty2
cuugaucggcuggc

SEQ ID NO: 1792952 - RNA, 15 nt, Salmonella enterica enterica serovar Typhi Ty2
cuugaucucucccug

SEQ ID NO: 1792953 - RNA, 15 nt, Salmonella enterica enterica serovar Typhi Ty2
cuugaccgccugauc

SEQ ID NO: 1792954 - RNA, 20 nt, Salmonella enterica enterica serovar Typhi Ty2
cuugagaaauuauuuuaaau

SEQ ID NO: 1792955 - RNA, 19 nt, Salmonella enterica enterica serovar Typhi Ty2
cuugagacuguuugucuca

SEQ ID NO: 1792956 - RNA, 18 nt, Salmonella enterica enterica serovar Typhi Ty2
cuugacucugaagcggga

SEQ ID NO: 1792957 - RNA, 22 nt, Salmonella enterica enterica serovar Typhi Ty2
cuugaguuuuccgccauuggcg

SEQ ID NO: 1792958 - RNA, 17 nt, Salmonella enterica enterica serovar Typhi Ty2
cuugauaaauaucaaga

SEQ ID NO: 1792959 - RNA, 11 nt, Salmonella enterica enterica serovar Typhi Ty2
cuugauaaaua

SEQ ID NO: 1792960 - RNA, 20 nt, Salmonella enterica enterica serovar Typhi Ty2
cuugauacgccaucuuucuu

SEQ ID NO: 1792961 - RNA, 17 nt, Salmonella enterica enterica serovar Typhi Ty2
cuugauccuguaacgca

SEQ ID NO: 1792962 - RNA, 15 nt, Salmonella enterica enterica serovar Typhi Ty2
cuugaauaacauaaa

SEQ ID NO: 1792963 - RNA, 20 nt, Salmonella enterica enterica serovar Typhi Ty2
cuugaaguuauccagcgccc

SEQ ID NO: 1792964 - RNA, 15 nt, Salmonella enterica enterica serovar Typhi Ty2
cuugaccagcacuuc

SEQ ID NO: 1792965 - RNA, 15 nt, Salmonella enterica enterica serovar Typhi Ty2
cuugaaagcaguccc

SEQ ID NO: 1792966 - RNA, 13 nt, Salmonella enterica enterica serovar Typhi Ty2
cuucuuuuacugc

SEQ ID NO: 1792967 - RNA, 17 nt, Salmonella enterica enterica serovar Typhi Ty2
cuucuuuggcuuaauca

SEQ ID NO: 1792968 - RNA, 23 nt, Salmonella enterica enterica serovar Typhi Ty2
cuucuuugaccagcgacgaugaa

SEQ ID NO: 1792969 - RNA, 14 nt, Salmonella enterica enterica serovar Typhi Ty2
cuucuuuagauaau

SEQ ID NO: 1792970 - RNA, 14 nt, Salmonella enterica enterica serovar Typhi Ty2
cuucuuuauccuga

SEQ ID NO: 1792971 - RNA, 18 nt, Salmonella enterica enterica serovar Typhi Ty2
cuucuggcgucccuuucc

SEQ ID NO: 1792972 - RNA, 18 nt, Salmonella enterica enterica serovar Typhi Ty2
cuucugguagccagacau

SEQ ID NO: 1792973 - RNA, 17 nt, Salmonella enterica enterica serovar Typhi Ty2
cuucuucaagccaggcu

SEQ ID NO: 1792974 - RNA, 15 nt, Salmonella enterica enterica serovar Typhi Ty2
cuucuucacuaaaaa

SEQ ID NO: 1792975 - RNA, 14 nt, Salmonella enterica enterica serovar Typhi Ty2
cuucuucaggcuug

SEQ ID NO: 1792976 - RNA, 19 nt, Salmonella enterica enterica serovar Typhi Ty2
cuucuucaguuccgccaga

SEQ ID NO: 1792977 - RNA, 14 nt, Salmonella enterica enterica serovar Typhi Ty2
cuucuucaucuuca

SEQ ID NO: 1792978 - RNA, 12 nt, Salmonella enterica enterica serovar Typhi Ty2
cuucuuccagcg

SEQ ID NO: 1792979 - RNA, 14 nt, Salmonella enterica enterica serovar Typhi Ty2
cuucuuccagcccg

SEQ ID NO: 1792980 - RNA, 18 nt, Salmonella enterica enterica serovar Typhi Ty2
cuucuucaguuccgccag

SEQ ID NO: 1792981 - RNA, 18 nt, Salmonella enterica enterica serovar Typhi Ty2
cuucuucuaccaccuuau

SEQ ID NO: 1792982 - RNA, 19 nt, Salmonella enterica enterica serovar Typhi Ty2
cuucucaaaaucgccgccg

SEQ ID NO: 1792983 - RNA, 12 nt, Salmonella enterica enterica serovar Typhi Ty2
cuucuauccacu

SEQ ID NO: 1792984 - RNA, 18 nt, Salmonella enterica enterica serovar Typhi Ty2
cuucuaccuucaccccca

SEQ ID NO: 1792985 - RNA, 13 nt, Salmonella enterica enterica serovar Typhi Ty2
cuucuaccuggaa

SEQ ID NO: 1792986 - RNA, 16 nt, Salmonella enterica enterica serovar Typhi Ty2
cuucuaauuccaggau

SEQ ID NO: 1792987 - RNA, 19 nt, Salmonella enterica enterica serovar Typhi Ty2
cuucuaacgcaacggaagg

SEQ ID NO: 1792988 - RNA, 18 nt, Salmonella enterica enterica serovar Typhi Ty2
cuucuaauuuuuccagca

SEQ ID NO: 1792989 - RNA, 14 nt, Salmonella enterica enterica serovar Typhi Ty2
cuucuaccgcuucg

SEQ ID NO: 1792990 - RNA, 15 nt, Salmonella enterica enterica serovar Typhi Ty2
cuucuaccugcacau

SEQ ID NO: 1792991 - RNA, 14 nt, Salmonella enterica enterica serovar Typhi Ty2
cuucguucuguauc

SEQ ID NO: 1792992 - RNA, 15 nt, Salmonella enterica enterica serovar Typhi Ty2
cuucguuauuuuccu

SEQ ID NO: 1792993 - RNA, 19 nt, Salmonella enterica enterica serovar Typhi Ty2
cuucguuauuuuccugaaa

SEQ ID NO: 1792994 - RNA, 16 nt, Salmonella enterica enterica serovar Typhi Ty2
cuucguucaguuccag

SEQ ID NO: 1792995 - RNA, 18 nt, Salmonella enterica enterica serovar Typhi Ty2
cuucguuauaaggccugc

SEQ ID NO: 1792996 - RNA, 14 nt, Salmonella enterica enterica serovar Typhi Ty2
cuucgucuuuauuc

SEQ ID NO: 1792997 - RNA, 17 nt, Salmonella enterica enterica serovar Typhi Ty2
cuucgucaaugcugcuu

SEQ ID NO: 1792998 - RNA, 14 nt, Salmonella enterica enterica serovar Typhi Ty2
cuucguauuucuuc

SEQ ID NO: 1792999 - RNA, 19 nt, Salmonella enterica enterica serovar Typhi Ty2
cuucucgccuucggccuga

SEQ ID NO: 1793000 - RNA, 14 nt, Salmonella enterica enterica serovar Typhi Ty2
cuucucgcaagagc

SEQ ID NO: 1793001 - RNA, 17 nt, Salmonella enterica enterica serovar Typhi Ty2
cuucuccucaacagaca

SEQ ID NO: 1793002 - RNA, 18 nt, Salmonella enterica enterica serovar Typhi Ty2
cuucucaauuucuuaucu

SEQ ID NO: 1793003 - RNA, 21 nt, Salmonella enterica enterica serovar Typhi Ty2
cuucucacggauccagaacug

SEQ ID NO: 1793004 - RNA, 21 nt, Salmonella enterica enterica serovar Typhi Ty2
cuucucccaacagacgaucua

SEQ ID NO: 1793005 - RNA, 13 nt, Salmonella enterica enterica serovar Typhi Ty2
cuucuccgccugc

SEQ ID NO: 1793006 - RNA, 12 nt, Salmonella enterica enterica serovar Typhi Ty2
cuucuggaauuc

SEQ ID NO: 1793007 - RNA, 14 nt, Salmonella enterica enterica serovar Typhi Ty2
cuucugcugugcau

SEQ ID NO: 1793008 - RNA, 22 nt, Salmonella enterica enterica serovar Typhi Ty2
cuucugcgcaggaggcuuccgc

SEQ ID NO: 1793009 - RNA, 23 nt, Salmonella enterica enterica serovar Typhi Ty2
cuucugcgucaugcuuuuuuucu

SEQ ID NO: 1793010 - RNA, 12 nt, Salmonella enterica enterica serovar Typhi Ty2
cuucugaaaacc

SEQ ID NO: 1793011 - RNA, 21 nt, Salmonella enterica enterica serovar Typhi Ty2
cuucucugucgagcaucucca

SEQ ID NO: 1793012 - RNA, 16 nt, Salmonella enterica enterica serovar Typhi Ty2
cuucugacucgcugau

SEQ ID NO: 1793013 - RNA, 20 nt, Salmonella enterica enterica serovar Typhi Ty2
cuucugauuauugacauuca

SEQ ID NO: 1793014 - RNA, 17 nt, Salmonella enterica enterica serovar Typhi Ty2
cgggucagauucagcau

SEQ ID NO: 1793015 - RNA, 19 nt, Salmonella enterica enterica serovar Typhi Ty2
cgggucagcgucugcccca

SEQ ID NO: 1793016 - RNA, 18 nt, Salmonella enterica enterica serovar Typhi Ty2
cggguagucccaggauag

SEQ ID NO: 1793017 - RNA, 14 nt, Salmonella enterica enterica serovar Typhi Ty2
cggguagucccagg

SEQ ID NO: 1793018 - RNA, 14 nt, Salmonella enterica enterica serovar Typhi Ty2
cgggucgcgcgccg

SEQ ID NO: 1793019 - RNA, 20 nt, Salmonella enterica enterica serovar Typhi Ty2
cgguaacagcuugaucauca

SEQ ID NO: 1793020 - RNA, 18 nt, Salmonella enterica enterica serovar Typhi Ty2
cgguaaacgugccacagu

SEQ ID NO: 1793021 - RNA, 13 nt, Salmonella enterica enterica serovar Typhi Ty2
cgguaaacgucga

SEQ ID NO: 1793022 - RNA, 17 nt, Salmonella enterica enterica serovar Typhi Ty2
cgguaaagcagugcagu

SEQ ID NO: 1793023 - RNA, 22 nt, Salmonella enterica enterica serovar Typhi Ty2
cgguaaaugcuuaucugaugaa

SEQ ID NO: 1793024 - RNA, 15 nt, Salmonella enterica enterica serovar Typhi Ty2
cgguaaaggcgaccg

SEQ ID NO: 1793025 - RNA, 16 nt, Salmonella enterica enterica serovar Typhi Ty2
cgguaaaccaggccag

SEQ ID NO: 1793026 - RNA, 14 nt, Salmonella enterica enterica serovar Typhi Ty2
cgguaaaccucuuu

SEQ ID NO: 1793027 - RNA, 13 nt, Salmonella enterica enterica serovar Typhi Ty2
cggguucaucgcc

SEQ ID NO: 1793028 - RNA, 21 nt, Salmonella enterica enterica serovar Typhi Ty2
cggguuaaaucgcgcaaauau

SEQ ID NO: 1793029 - RNA, 15 nt, Salmonella enterica enterica serovar Typhi Ty2
cggguuaaagcccug

SEQ ID NO: 1793030 - RNA, 14 nt, Salmonella enterica enterica serovar Typhi Ty2
cgggugcgcagcaa

SEQ ID NO: 1793031 - RNA, 17 nt, Salmonella enterica enterica serovar Typhi Ty2
cggggaucgguuuaucc

SEQ ID NO: 1793032 - RNA, 20 nt, Salmonella enterica enterica serovar Typhi Ty2
cggggauuuuuuugcccggu

SEQ ID NO: 1793033 - RNA, 21 nt, Salmonella enterica enterica serovar Typhi Ty2
cggggauuuuuuugcccggug

SEQ ID NO: 1793034 - RNA, 23 nt, Salmonella enterica enterica serovar Typhi Ty2
cggggcaucuauuuaacagagag

SEQ ID NO: 1793035 - RNA, 15 nt, Salmonella enterica enterica serovar Typhi Ty2
cggggaagcgcgcgc

SEQ ID NO: 1793036 - RNA, 18 nt, Salmonella enterica enterica serovar Typhi Ty2
cgggcuuuuagccgcgcc

SEQ ID NO: 1793037 - RNA, 23 nt, Salmonella enterica enterica serovar Typhi Ty2
cgggcuuuguugucuauaaagcg

SEQ ID NO: 1793038 - RNA, 20 nt, Salmonella enterica enterica serovar Typhi Ty2
cgggcugccccagacgcccu

SEQ ID NO: 1793039 - RNA, 17 nt, Salmonella enterica enterica serovar Typhi Ty2
cgggggacgcgacgccc

SEQ ID NO: 1793040 - RNA, 24 nt, Salmonella enterica enterica serovar Typhi Ty2
cggggcuuuugagucgcauccagu

SEQ ID NO: 1793041 - RNA, 16 nt, Salmonella enterica enterica serovar Typhi Ty2
cggggguuauucagcg

SEQ ID NO: 1793042 - RNA, 15 nt, Salmonella enterica enterica serovar Typhi Ty2
cgggguaaaauggac

SEQ ID NO: 1793043 - RNA, 16 nt, Salmonella enterica enterica serovar Typhi Ty2
cgggggcgacagcccc

SEQ ID NO: 1793044 - RNA, 16 nt, Salmonella enterica enterica serovar Typhi Ty2
cgggggcgaucagcag

SEQ ID NO: 1793045 - RNA, 17 nt, Salmonella enterica enterica serovar Typhi Ty2
cgggggcgaucagcagg

SEQ ID NO: 1793046 - RNA, 13 nt, Salmonella enterica enterica serovar Typhi Ty2
cggguaacgucga

SEQ ID NO: 1793047 - RNA, 22 nt, Salmonella enterica enterica serovar Typhi Ty2
cggguaaacaaacacagccauc

SEQ ID NO: 1793048 - RNA, 23 nt, Salmonella enterica enterica serovar Typhi Ty2
cggguaaaugcgcgcggcuaccg

SEQ ID NO: 1793049 - RNA, 14 nt, Salmonella enterica enterica serovar Typhi Ty2
cggguaaacaaaca

SEQ ID NO: 1793050 - RNA, 18 nt, Salmonella enterica enterica serovar Typhi Ty2
cgggguucgggcagcgcu

SEQ ID NO: 1793051 - RNA, 21 nt, Salmonella enterica enterica serovar Typhi Ty2
cgggguuagcguuucaaccgc

SEQ ID NO: 1793052 - RNA, 14 nt, Salmonella enterica enterica serovar Typhi Ty2
cggggugcuguucu

SEQ ID NO: 1793053 - RNA, 22 nt, Salmonella enterica enterica serovar Typhi Ty2
cggucagcggcgcgccgcucga

SEQ ID NO: 1793054 - RNA, 16 nt, Salmonella enterica enterica serovar Typhi Ty2
cggucaacgcgccgcc

SEQ ID NO: 1793055 - RNA, 16 nt, Salmonella enterica enterica serovar Typhi Ty2
cggucacaggcauaca

SEQ ID NO: 1793056 - RNA, 22 nt, Salmonella enterica enterica serovar Typhi Ty2
cgguaucgacaaccgccugcgu

SEQ ID NO: 1793057 - RNA, 15 nt, Salmonella enterica enterica serovar Typhi Ty2
cgguauuauccgccg

SEQ ID NO: 1793058 - RNA, 20 nt, Salmonella enterica enterica serovar Typhi Ty2
cgguauaaauuuccgcagcc

SEQ ID NO: 1793059 - RNA, 16 nt, Salmonella enterica enterica serovar Typhi Ty2
cgguacggaacgucca

SEQ ID NO: 1793060 - RNA, 17 nt, Salmonella enterica enterica serovar Typhi Ty2
cgguacgcaucaccagg

SEQ ID NO: 1793061 - RNA, 14 nt, Salmonella enterica enterica serovar Typhi Ty2
cgguacuccccuuu

SEQ ID NO: 1793062 - RNA, 17 nt, Salmonella enterica enterica serovar Typhi Ty2
cgguacgcagcaggcag

SEQ ID NO: 1793063 - RNA, 16 nt, Salmonella enterica enterica serovar Typhi Ty2
cgguacgcaucaccag

SEQ ID NO: 1793064 - RNA, 15 nt, Salmonella enterica enterica serovar Typhi Ty2
cgguaccauaccugc

SEQ ID NO: 1793065 - RNA, 19 nt, Salmonella enterica enterica serovar Typhi Ty2
cgguagagcgcggucaggu

SEQ ID NO: 1793066 - RNA, 17 nt, Salmonella enterica enterica serovar Typhi Ty2
cgguagagcgcggucag

SEQ ID NO: 1793067 - RNA, 18 nt, Salmonella enterica enterica serovar Typhi Ty2
cgguagagcgcggucagg

SEQ ID NO: 1793068 - RNA, 17 nt, Salmonella enterica enterica serovar Typhi Ty2
cgguagcacuuuaaaca

SEQ ID NO: 1793069 - RNA, 14 nt, Salmonella enterica enterica serovar Typhi Ty2
cgguagccacaccc

SEQ ID NO: 1793070 - RNA, 17 nt, Salmonella enterica enterica serovar Typhi Ty2
cgguagcuuuuuaaaua

SEQ ID NO: 1793071 - RNA, 18 nt, Salmonella enterica enterica serovar Typhi Ty2
cgguaaucugccagcuua

SEQ ID NO: 1793072 - RNA, 18 nt, Salmonella enterica enterica serovar Typhi Ty2
cgguaaucgccugccagc

SEQ ID NO: 1793073 - RNA, 23 nt, Salmonella enterica enterica serovar Typhi Ty2
cgguaauauauuucacuucauca

SEQ ID NO: 1793074 - RNA, 19 nt, Salmonella enterica enterica serovar Typhi Ty2
cgguacaaaccccacccac

SEQ ID NO: 1793075 - RNA, 18 nt, Salmonella enterica enterica serovar Typhi Ty2
cgguacccgcugcuucac

SEQ ID NO: 1793076 - RNA, 18 nt, Salmonella enterica enterica serovar Typhi Ty2
cgguaacgauacccacca

SEQ ID NO: 1793077 - RNA, 16 nt, Salmonella enterica enterica serovar Typhi Ty2
cgguaagucugauaac

SEQ ID NO: 1793078 - RNA, 15 nt, Salmonella enterica enterica serovar Typhi Ty2
cgguaagccaccaga

SEQ ID NO: 1793079 - RNA, 13 nt, Salmonella enterica enterica serovar Typhi Ty2
cgguaagccgaaa

SEQ ID NO: 1793080 - RNA, 17 nt, Salmonella enterica enterica serovar Typhi Ty2
cgguaagcacaacgcau

SEQ ID NO: 1793081 - RNA, 19 nt, Salmonella enterica enterica serovar Typhi Ty2
cggucagggugaaucccgc

SEQ ID NO: 1793082 - RNA, 23 nt, Salmonella enterica enterica serovar Typhi Ty2
cggucagggcuuacucccuggug

SEQ ID NO: 1793083 - RNA, 18 nt, Salmonella enterica enterica serovar Typhi Ty2
cggucauacugaacaagc

SEQ ID NO: 1793084 - RNA, 14 nt, Salmonella enterica enterica serovar Typhi Ty2
cggucaguuugccc

SEQ ID NO: 1793085 - RNA, 22 nt, Salmonella enterica enterica serovar Typhi Ty2
cggucagcuuuucagcccaggc

SEQ ID NO: 1793086 - RNA, 22 nt, Salmonella enterica enterica serovar Typhi Ty2
cggucauucauugucuuuuucu

SEQ ID NO: 1793087 - RNA, 15 nt, Salmonella enterica enterica serovar Typhi Ty2
cggucauccagcggu

SEQ ID NO: 1793088 - RNA, 18 nt, Salmonella enterica enterica serovar Typhi Ty2
cggucauuaauccccggc

SEQ ID NO: 1793089 - RNA, 20 nt, Salmonella enterica enterica serovar Typhi Ty2
cggucgcuuuuugcgccagc

SEQ ID NO: 1793090 - RNA, 17 nt, Salmonella enterica enterica serovar Typhi Ty2
cggucgagcguaauucc

SEQ ID NO: 1793091 - RNA, 17 nt, Salmonella enterica enterica serovar Typhi Ty2
cggugacggaaaccagc

SEQ ID NO: 1793092 - RNA, 14 nt, Salmonella enterica enterica serovar Typhi Ty2
cggugagcgccgcg

SEQ ID NO: 1793093 - RNA, 13 nt, Salmonella enterica enterica serovar Typhi Ty2
cggugaagacgac

SEQ ID NO: 1793094 - RNA, 17 nt, Salmonella enterica enterica serovar Typhi Ty2
cggugaagaaaaucccg

SEQ ID NO: 1793095 - RNA, 15 nt, Salmonella enterica enterica serovar Typhi Ty2
cggucuuucaacaua

SEQ ID NO: 1793096 - RNA, 13 nt, Salmonella enterica enterica serovar Typhi Ty2
cggucugacggcc

SEQ ID NO: 1793097 - RNA, 16 nt, Salmonella enterica enterica serovar Typhi Ty2
cggucugcgcgccgca

SEQ ID NO: 1793098 - RNA, 23 nt, Salmonella enterica enterica serovar Typhi Ty2
cggucguaaacacgacgccgccg

SEQ ID NO: 1793099 - RNA, 23 nt, Salmonella enterica enterica serovar Typhi Ty2
cgggcagacauucgcgcacggcg

SEQ ID NO: 1793100 - RNA, 18 nt, Salmonella enterica enterica serovar Typhi Ty2
cgggcagcggcaagacag

SEQ ID NO: 1793101 - RNA, 19 nt, Salmonella enterica enterica serovar Typhi Ty2
cgggcagucuggcggcagc

SEQ ID NO: 1793102 - RNA, 23 nt, Salmonella enterica enterica serovar Typhi Ty2
cgggcaggcuuccacgcacgccg

SEQ ID NO: 1793103 - RNA, 15 nt, Salmonella enterica enterica serovar Typhi Ty2
cgggcaucgccgcaa

SEQ ID NO: 1793104 - RNA, 14 nt, Salmonella enterica enterica serovar Typhi Ty2
cgggcaacacacgc

SEQ ID NO: 1793105 - RNA, 19 nt, Salmonella enterica enterica serovar Typhi Ty2
cgggauuguauaccgcuuu

SEQ ID NO: 1793106 - RNA, 17 nt, Salmonella enterica enterica serovar Typhi Ty2
cgggcaaugccaccagc

SEQ ID NO: 1793107 - RNA, 20 nt, Salmonella enterica enterica serovar Typhi Ty2
cgggcaaugccacugcccuc

SEQ ID NO: 1793108 - RNA, 23 nt, Salmonella enterica enterica serovar Typhi Ty2
cgggcacuccggcucgcacauau

SEQ ID NO: 1793109 - RNA, 23 nt, Salmonella enterica enterica serovar Typhi Ty2
cgggacugguggcgagauaagcc

SEQ ID NO: 1793110 - RNA, 12 nt, Salmonella enterica enterica serovar Typhi Ty2
cgggagcaaaau

SEQ ID NO: 1793111 - RNA, 18 nt, Salmonella enterica enterica serovar Typhi Ty2
cgggauccccugcuccug

SEQ ID NO: 1793112 - RNA, 16 nt, Salmonella enterica enterica serovar Typhi Ty2
cgggaucagcgcgcuc

SEQ ID NO: 1793113 - RNA, 14 nt, Salmonella enterica enterica serovar Typhi Ty2
cgggauauaaaauu

SEQ ID NO: 1793114 - RNA, 12 nt, Salmonella enterica enterica serovar Typhi Ty2
cgggagcuugcc

SEQ ID NO: 1793115 - RNA, 15 nt, Salmonella enterica enterica serovar Typhi Ty2
cgggauaaccaccgc

SEQ ID NO: 1793116 - RNA, 23 nt, Salmonella enterica enterica serovar Typhi Ty2
cgggaucgaaccgccgacccccu

SEQ ID NO: 1793117 - RNA, 16 nt, Salmonella enterica enterica serovar Typhi Ty2
cgggauccugcaaaau

SEQ ID NO: 1793118 - RNA, 22 nt, Salmonella enterica enterica serovar Typhi Ty2
cgggaucgccagaucgaacagc

SEQ ID NO: 1793119 - RNA, 16 nt, Salmonella enterica enterica serovar Typhi Ty2
cgggaucgaaccgccg

SEQ ID NO: 1793120 - RNA, 16 nt, Salmonella enterica enterica serovar Typhi Ty2
cgggaugcauaaaaaa

SEQ ID NO: 1793121 - RNA, 12 nt, Salmonella enterica enterica serovar Typhi Ty2
cgggcgccacgu

SEQ ID NO: 1793122 - RNA, 23 nt, Salmonella enterica enterica serovar Typhi Ty2
cgggcgauaaccucucaccgccu

SEQ ID NO: 1793123 - RNA, 18 nt, Salmonella enterica enterica serovar Typhi Ty2
cgggcgauacaccuucac

SEQ ID NO: 1793124 - RNA, 15 nt, Salmonella enterica enterica serovar Typhi Ty2
cgggcgaagccugac

SEQ ID NO: 1793125 - RNA, 16 nt, Salmonella enterica enterica serovar Typhi Ty2
cgggcgaccgucgggc

SEQ ID NO: 1793126 - RNA, 20 nt, Salmonella enterica enterica serovar Typhi Ty2
cgggcggcgcagcgcgcgac

SEQ ID NO: 1793127 - RNA, 14 nt, Salmonella enterica enterica serovar Typhi Ty2
cgggcggcgcagcg

SEQ ID NO: 1793128 - RNA, 22 nt, Salmonella enterica enterica serovar Typhi Ty2
cgggcgguauuauccgccgcaa

SEQ ID NO: 1793129 - RNA, 13 nt, Salmonella enterica enterica serovar Typhi Ty2
cgggccgcgcugc

SEQ ID NO: 1793130 - RNA, 20 nt, Salmonella enterica enterica serovar Typhi Ty2
cgggccgcgcugcgccugcu

SEQ ID NO: 1793131 - RNA, 19 nt, Salmonella enterica enterica serovar Typhi Ty2
cgggccguccggcaaaccc

SEQ ID NO: 1793132 - RNA, 21 nt, Salmonella enterica enterica serovar Typhi Ty2
cgggccguaaaguucccagcg

SEQ ID NO: 1793133 - RNA, 20 nt, Salmonella enterica enterica serovar Typhi Ty2
cgggccguagugcuucucuu

SEQ ID NO: 1793134 - RNA, 18 nt, Salmonella enterica enterica serovar Typhi Ty2
cgggccugagcgcgcagc

SEQ ID NO: 1793135 - RNA, 19 nt, Salmonella enterica enterica serovar Typhi Ty2
cgggccguggccaggaaua

SEQ ID NO: 1793136 - RNA, 15 nt, Salmonella enterica enterica serovar Typhi Ty2
cgggccugagcgcgc

SEQ ID NO: 1793137 - RNA, 16 nt, Salmonella enterica enterica serovar Typhi Ty2
cgggccagcagccagg

SEQ ID NO: 1793138 - RNA, 16 nt, Salmonella enterica enterica serovar Typhi Ty2
cggcucauccagcaac

SEQ ID NO: 1793139 - RNA, 19 nt, Salmonella enterica enterica serovar Typhi Ty2
cggcucaaacggccugcgc

SEQ ID NO: 1793140 - RNA, 17 nt, Salmonella enterica enterica serovar Typhi Ty2
cggcucauccagcaaca

SEQ ID NO: 1793141 - RNA, 14 nt, Salmonella enterica enterica serovar Typhi Ty2
cggcuccaauauuu

SEQ ID NO: 1793142 - RNA, 17 nt, Salmonella enterica enterica serovar Typhi Ty2
cggcuccagguugcuca

SEQ ID NO: 1793143 - RNA, 22 nt, Salmonella enterica enterica serovar Typhi Ty2
cggcuccagguugcucagguua

SEQ ID NO: 1793144 - RNA, 22 nt, Salmonella enterica enterica serovar Typhi Ty2
cggcuccggcaaauucuuccgc

SEQ ID NO: 1793145 - RNA, 13 nt, Salmonella enterica enterica serovar Typhi Ty2
cggcguugcgccc

SEQ ID NO: 1793146 - RNA, 19 nt, Salmonella enterica enterica serovar Typhi Ty2
cggcguugcgcccaggcca

SEQ ID NO: 1793147 - RNA, 17 nt, Salmonella enterica enterica serovar Typhi Ty2
cggcuaaucaccaccuc

SEQ ID NO: 1793148 - RNA, 13 nt, Salmonella enterica enterica serovar Typhi Ty2
cggcuaccgccug

SEQ ID NO: 1793149 - RNA, 17 nt, Salmonella enterica enterica serovar Typhi Ty2
cggcguuuuaauauccu

SEQ ID NO: 1793150 - RNA, 14 nt, Salmonella enterica enterica serovar Typhi Ty2
cggcuaacgccuga

SEQ ID NO: 1793151 - RNA, 15 nt, Salmonella enterica enterica serovar Typhi Ty2
cggcuagucaauaaa

SEQ ID NO: 1793152 - RNA, 20 nt, Salmonella enterica enterica serovar Typhi Ty2
cggcuacgccuuauccggcc

SEQ ID NO: 1793153 - RNA, 14 nt, Salmonella enterica enterica serovar Typhi Ty2
cggcgugaaucccc

SEQ ID NO: 1793154 - RNA, 17 nt, Salmonella enterica enterica serovar Typhi Ty2
cggcgugaauaaaauag

SEQ ID NO: 1793155 - RNA, 16 nt, Salmonella enterica enterica serovar Typhi Ty2
cggcgugaauaaaaua

SEQ ID NO: 1793156 - RNA, 22 nt, Salmonella enterica enterica serovar Typhi Ty2
cggcgugaaagcgcuugauaau

SEQ ID NO: 1793157 - RNA, 23 nt, Salmonella enterica enterica serovar Typhi Ty2
cggcgucgucaucgcgcgcaggc

SEQ ID NO: 1793158 - RNA, 16 nt, Salmonella enterica enterica serovar Typhi Ty2
cggcguggaaccgccg

SEQ ID NO: 1793159 - RNA, 17 nt, Salmonella enterica enterica serovar Typhi Ty2
cggcguggagcauucca

SEQ ID NO: 1793160 - RNA, 22 nt, Salmonella enterica enterica serovar Typhi Ty2
cggcguguuguaaaacgcgccc

SEQ ID NO: 1793161 - RNA, 16 nt, Salmonella enterica enterica serovar Typhi Ty2
cggcguguuucaucuc

SEQ ID NO: 1793162 - RNA, 21 nt, Salmonella enterica enterica serovar Typhi Ty2
cggcguguagccaaucagccc

SEQ ID NO: 1793163 - RNA, 20 nt, Salmonella enterica enterica serovar Typhi Ty2
cggcguccggcacgcgcagc

SEQ ID NO: 1793164 - RNA, 15 nt, Salmonella enterica enterica serovar Typhi Ty2
cggcguccaucaccg

SEQ ID NO: 1793165 - RNA, 15 nt, Salmonella enterica enterica serovar Typhi Ty2
cggcgucgccugucc

SEQ ID NO: 1793166 - RNA, 15 nt, Salmonella enterica enterica serovar Typhi Ty2
cggcguagcucgccc

SEQ ID NO: 1793167 - RNA, 22 nt, Salmonella enterica enterica serovar Typhi Ty2
cggcgucauaguuuuccagccc

SEQ ID NO: 1793168 - RNA, 14 nt, Salmonella enterica enterica serovar Typhi Ty2
cggcgucaacucag

SEQ ID NO: 1793169 - RNA, 21 nt, Salmonella enterica enterica serovar Typhi Ty2
cggcgucacguucgucgccgg

SEQ ID NO: 1793170 - RNA, 15 nt, Salmonella enterica enterica serovar Typhi Ty2
cggcuuuuuucucca

SEQ ID NO: 1793171 - RNA, 19 nt, Salmonella enterica enterica serovar Typhi Ty2
cggcuuugcgccggcaguc

SEQ ID NO: 1793172 - RNA, 22 nt, Salmonella enterica enterica serovar Typhi Ty2
cggcuuugaacagcgucaucca

SEQ ID NO: 1793173 - RNA, 21 nt, Salmonella enterica enterica serovar Typhi Ty2
cggcuuucuguuccgaaauaa

SEQ ID NO: 1793174 - RNA, 15 nt, Salmonella enterica enterica serovar Typhi Ty2
cggcuuuauuacuuc

SEQ ID NO: 1793175 - RNA, 22 nt, Salmonella enterica enterica serovar Typhi Ty2
cgggaaaacggccagugaaaua

SEQ ID NO: 1793176 - RNA, 15 nt, Salmonella enterica enterica serovar Typhi Ty2
cgggaacagauaaau

SEQ ID NO: 1793177 - RNA, 17 nt, Salmonella enterica enterica serovar Typhi Ty2
cgggaaagggcggcagc

SEQ ID NO: 1793178 - RNA, 15 nt, Salmonella enterica enterica serovar Typhi Ty2
cggcuuccucgcagu

SEQ ID NO: 1793179 - RNA, 19 nt, Salmonella enterica enterica serovar Typhi Ty2
cggcuugaguuuuccgcca

SEQ ID NO: 1793180 - RNA, 13 nt, Salmonella enterica enterica serovar Typhi Ty2
cggcugucaucaa

SEQ ID NO: 1793181 - RNA, 15 nt, Salmonella enterica enterica serovar Typhi Ty2
cggcuguugguuuau

SEQ ID NO: 1793182 - RNA, 22 nt, Salmonella enterica enterica serovar Typhi Ty2
cggcuguguccgccaugugcug

SEQ ID NO: 1793183 - RNA, 16 nt, Salmonella enterica enterica serovar Typhi Ty2
cggcuuaaauggcgcu

SEQ ID NO: 1793184 - RNA, 18 nt, Salmonella enterica enterica serovar Typhi Ty2
cggcuuaaugcccggccc

SEQ ID NO: 1793185 - RNA, 23 nt, Salmonella enterica enterica serovar Typhi Ty2
cggcuuacugcuucgcgccuucu

SEQ ID NO: 1793186 - RNA, 22 nt, Salmonella enterica enterica serovar Typhi Ty2
cggcuuaucguuaaggccugcg

SEQ ID NO: 1793187 - RNA, 22 nt, Salmonella enterica enterica serovar Typhi Ty2
cggcuuacaacauuguuauguu

SEQ ID NO: 1793188 - RNA, 14 nt, Salmonella enterica enterica serovar Typhi Ty2
cggcuuccggcagc

SEQ ID NO: 1793189 - RNA, 18 nt, Salmonella enterica enterica serovar Typhi Ty2
cggcugacgcccaucagc

SEQ ID NO: 1793190 - RNA, 22 nt, Salmonella enterica enterica serovar Typhi Ty2
cggcugacgauacucagcccca

SEQ ID NO: 1793191 - RNA, 18 nt, Salmonella enterica enterica serovar Typhi Ty2
cggcugaguucaggcacg

SEQ ID NO: 1793192 - RNA, 16 nt, Salmonella enterica enterica serovar Typhi Ty2
cggcugcacaaaauac

SEQ ID NO: 1793193 - RNA, 13 nt, Salmonella enterica enterica serovar Typhi Ty2
cggcugcauauac

SEQ ID NO: 1793194 - RNA, 19 nt, Salmonella enterica enterica serovar Typhi Ty2
cggcuggacgucaugccgc

SEQ ID NO: 1793195 - RNA, 15 nt, Salmonella enterica enterica serovar Typhi Ty2
cggcugcucccccag

SEQ ID NO: 1793196 - RNA, 13 nt, Salmonella enterica enterica serovar Typhi Ty2
cggcugccugccg

SEQ ID NO: 1793197 - RNA, 14 nt, Salmonella enterica enterica serovar Typhi Ty2
cuaaaucauaccag

SEQ ID NO: 1793198 - RNA, 20 nt, Salmonella enterica enterica serovar Typhi Ty2
cuaaauccguuaagcccuga

SEQ ID NO: 1793199 - RNA, 16 nt, Salmonella enterica enterica serovar Typhi Ty2
cuaaaugaacuuacac

SEQ ID NO: 1793200 - RNA, 21 nt, Salmonella enterica enterica serovar Typhi Ty2
cuaaauggcauagccugauau

SEQ ID NO: 1793201 - RNA, 18 nt, Salmonella enterica enterica serovar Typhi Ty2
cuaaaugcauagccccag

SEQ ID NO: 1793202 - RNA, 18 nt, Salmonella enterica enterica serovar Typhi Ty2
cuaaauugggauguugcc

SEQ ID NO: 1793203 - RNA, 13 nt, Salmonella enterica enterica serovar Typhi Ty2
cuaaauaaaaaua

SEQ ID NO: 1793204 - RNA, 13 nt, Salmonella enterica enterica serovar Typhi Ty2
cuaaacucaucuu

SEQ ID NO: 1793205 - RNA, 18 nt, Salmonella enterica enterica serovar Typhi Ty2
cuaaacucaucuuuauuc

SEQ ID NO: 1793206 - RNA, 11 nt, Salmonella enterica enterica serovar Typhi Ty2
cuaaagaaaaa

SEQ ID NO: 1793207 - RNA, 18 nt, Salmonella enterica enterica serovar Typhi Ty2
cuaaacucaacugggcga

SEQ ID NO: 1793208 - RNA, 15 nt, Salmonella enterica enterica serovar Typhi Ty2
cuaaacucaacuggg

SEQ ID NO: 1793209 - RNA, 21 nt, Salmonella enterica enterica serovar Typhi Ty2
cuaaacguucaucuucccgaa

SEQ ID NO: 1793210 - RNA, 15 nt, Salmonella enterica enterica serovar Typhi Ty2
cguuugcgcgcgcca

SEQ ID NO: 1793211 - RNA, 15 nt, Salmonella enterica enterica serovar Typhi Ty2
cguuugcgccgccau

SEQ ID NO: 1793212 - RNA, 21 nt, Salmonella enterica enterica serovar Typhi Ty2
cuaaaaaccagaauuuccaga

SEQ ID NO: 1793213 - RNA, 14 nt, Salmonella enterica enterica serovar Typhi Ty2
cguuugcgccgcca

SEQ ID NO: 1793214 - RNA, 22 nt, Salmonella enterica enterica serovar Typhi Ty2
cguuugcgcgaggucgagcuca

SEQ ID NO: 1793215 - RNA, 22 nt, Salmonella enterica enterica serovar Typhi Ty2
cuaaaaaucaaucuacuguuau

SEQ ID NO: 1793216 - RNA, 23 nt, Salmonella enterica enterica serovar Typhi Ty2
cguuugaaauaccaggcggcuuu

SEQ ID NO: 1793217 - RNA, 18 nt, Salmonella enterica enterica serovar Typhi Ty2
cguuugacggauuuuuuu

SEQ ID NO: 1793218 - RNA, 14 nt, Salmonella enterica enterica serovar Typhi Ty2
cguuugcagccaga

SEQ ID NO: 1793219 - RNA, 12 nt, Salmonella enterica enterica serovar Typhi Ty2
cguuuccagacu

SEQ ID NO: 1793220 - RNA, 16 nt, Salmonella enterica enterica serovar Typhi Ty2
cguuuaagcaugguga

SEQ ID NO: 1793221 - RNA, 18 nt, Salmonella enterica enterica serovar Typhi Ty2
cguugguagacccggcau

SEQ ID NO: 1793222 - RNA, 19 nt, Salmonella enterica enterica serovar Typhi Ty2
cguuggcuugaucaacgcc

SEQ ID NO: 1793223 - RNA, 19 nt, Salmonella enterica enterica serovar Typhi Ty2
cguuuauguucuuugugau

SEQ ID NO: 1793224 - RNA, 23 nt, Salmonella enterica enterica serovar Typhi Ty2
cguuuauauaaaaauagcuggcu

SEQ ID NO: 1793225 - RNA, 16 nt, Salmonella enterica enterica serovar Typhi Ty2
cguuuauaccccacca

SEQ ID NO: 1793226 - RNA, 17 nt, Salmonella enterica enterica serovar Typhi Ty2
cguuuauguuugcugau

SEQ ID NO: 1793227 - RNA, 18 nt, Salmonella enterica enterica serovar Typhi Ty2
cguuuaccggugcagacc

SEQ ID NO: 1793228 - RNA, 14 nt, Salmonella enterica enterica serovar Typhi Ty2
cguuuagcgccagc

SEQ ID NO: 1793229 - RNA, 20 nt, Salmonella enterica enterica serovar Typhi Ty2
cguuggaauaaaucacaacg

SEQ ID NO: 1793230 - RNA, 17 nt, Salmonella enterica enterica serovar Typhi Ty2
cguugccgcaggcaacg

SEQ ID NO: 1793231 - RNA, 21 nt, Salmonella enterica enterica serovar Typhi Ty2
cguugccgcaggcaacggccc

SEQ ID NO: 1793232 - RNA, 12 nt, Salmonella enterica enterica serovar Typhi Ty2
cguugccgccgu

SEQ ID NO: 1793233 - RNA, 17 nt, Salmonella enterica enterica serovar Typhi Ty2
cguugccguaggcaacg

SEQ ID NO: 1793234 - RNA, 15 nt, Salmonella enterica enterica serovar Typhi Ty2
cguugcgccgccagg

SEQ ID NO: 1793235 - RNA, 18 nt, Salmonella enterica enterica serovar Typhi Ty2
cguugcgaaucagguaca

SEQ ID NO: 1793236 - RNA, 15 nt, Salmonella enterica enterica serovar Typhi Ty2
cguugccugauaaau

SEQ ID NO: 1793237 - RNA, 18 nt, Salmonella enterica enterica serovar Typhi Ty2
cguugccuggccuccggc

SEQ ID NO: 1793238 - RNA, 22 nt, Salmonella enterica enterica serovar Typhi Ty2
cguuaaggugcauuccgcgcaa

SEQ ID NO: 1793239 - RNA, 16 nt, Salmonella enterica enterica serovar Typhi Ty2
cguuaaauaccagcac

SEQ ID NO: 1793240 - RNA, 18 nt, Salmonella enterica enterica serovar Typhi Ty2
cguuaaauaccagcaccu

SEQ ID NO: 1793241 - RNA, 14 nt, Salmonella enterica enterica serovar Typhi Ty2
cguuaaccagcggc

SEQ ID NO: 1793242 - RNA, 15 nt, Salmonella enterica enterica serovar Typhi Ty2
cguuaaccagcggcg

SEQ ID NO: 1793243 - RNA, 15 nt, Salmonella enterica enterica serovar Typhi Ty2
cguuaacccggcauu

SEQ ID NO: 1793244 - RNA, 19 nt, Salmonella enterica enterica serovar Typhi Ty2
cguuaacaucaucaggccu

SEQ ID NO: 1793245 - RNA, 20 nt, Salmonella enterica enterica serovar Typhi Ty2
cguuaacguaaagccaucca

SEQ ID NO: 1793246 - RNA, 22 nt, Salmonella enterica enterica serovar Typhi Ty2
cguucgauagcguuuuccagcu

SEQ ID NO: 1793247 - RNA, 22 nt, Salmonella enterica enterica serovar Typhi Ty2
cguuccauuccagaaucuggcc

SEQ ID NO: 1793248 - RNA, 19 nt, Salmonella enterica enterica serovar Typhi Ty2
cguuccacgucgcacgcca

SEQ ID NO: 1793249 - RNA, 15 nt, Salmonella enterica enterica serovar Typhi Ty2
cguugacgugagaga

SEQ ID NO: 1793250 - RNA, 14 nt, Salmonella enterica enterica serovar Typhi Ty2
cguugacgggcgac

SEQ ID NO: 1793251 - RNA, 22 nt, Salmonella enterica enterica serovar Typhi Ty2
cguugaccagccuaccugccgc

SEQ ID NO: 1793252 - RNA, 12 nt, Salmonella enterica enterica serovar Typhi Ty2
cguugaccagcg

SEQ ID NO: 1793253 - RNA, 13 nt, Salmonella enterica enterica serovar Typhi Ty2
cguugaaauccuc

SEQ ID NO: 1793254 - RNA, 11 nt, Salmonella enterica enterica serovar Typhi Ty2
cguugaaaacg

SEQ ID NO: 1793255 - RNA, 11 nt, Salmonella enterica enterica serovar Typhi Ty2
cguucuuccug

SEQ ID NO: 1793256 - RNA, 17 nt, Salmonella enterica enterica serovar Typhi Ty2
cguucuuuccaguucug

SEQ ID NO: 1793257 - RNA, 21 nt, Salmonella enterica enterica serovar Typhi Ty2
cguucggaagacugcuccggc

SEQ ID NO: 1793258 - RNA, 20 nt, Salmonella enterica enterica serovar Typhi Ty2
cguucggcaaaacgccgcag

SEQ ID NO: 1793259 - RNA, 20 nt, Salmonella enterica enterica serovar Typhi Ty2
cguguggcggaaugaccuga

SEQ ID NO: 1793260 - RNA, 13 nt, Salmonella enterica enterica serovar Typhi Ty2
cguguuauuuuca

SEQ ID NO: 1793261 - RNA, 18 nt, Salmonella enterica enterica serovar Typhi Ty2
cguuaaacaccucaccgg

SEQ ID NO: 1793262 - RNA, 22 nt, Salmonella enterica enterica serovar Typhi Ty2
cgugucgcguaacgccuccacc

SEQ ID NO: 1793263 - RNA, 16 nt, Salmonella enterica enterica serovar Typhi Ty2
cgugucgggaauugcc

SEQ ID NO: 1793264 - RNA, 22 nt, Salmonella enterica enterica serovar Typhi Ty2
cgugugcgguauagaucagacg

SEQ ID NO: 1793265 - RNA, 14 nt, Salmonella enterica enterica serovar Typhi Ty2
cguggugggguucc

SEQ ID NO: 1793266 - RNA, 20 nt, Salmonella enterica enterica serovar Typhi Ty2
cguggucguaaaacugcacc

SEQ ID NO: 1793267 - RNA, 22 nt, Salmonella enterica enterica serovar Typhi Ty2
cguguaguuauaaauuuauuuu

SEQ ID NO: 1793268 - RNA, 22 nt, Salmonella enterica enterica serovar Typhi Ty2
cguguauuccagucgcuccacc

SEQ ID NO: 1793269 - RNA, 20 nt, Salmonella enterica enterica serovar Typhi Ty2
cguguauuccagucgcucca

SEQ ID NO: 1793270 - RNA, 17 nt, Salmonella enterica enterica serovar Typhi Ty2
cguguaaggcuuccggc

SEQ ID NO: 1793271 - RNA, 13 nt, Salmonella enterica enterica serovar Typhi Ty2
cgugguuuccggc

SEQ ID NO: 1793272 - RNA, 21 nt, Salmonella enterica enterica serovar Typhi Ty2
cgugguuuguugcgcgacgac

SEQ ID NO: 1793273 - RNA, 20 nt, Salmonella enterica enterica serovar Typhi Ty2
cguggaucucgucgccggug

SEQ ID NO: 1793274 - RNA, 12 nt, Salmonella enterica enterica serovar Typhi Ty2
cguggaaaagag

SEQ ID NO: 1793275 - RNA, 17 nt, Salmonella enterica enterica serovar Typhi Ty2
cguggaacugcagcgcg

SEQ ID NO: 1793276 - RNA, 20 nt, Salmonella enterica enterica serovar Typhi Ty2
cguggguucgaaucccauua

SEQ ID NO: 1793277 - RNA, 22 nt, Salmonella enterica enterica serovar Typhi Ty2
cguggcguuuucauuagccgcc

SEQ ID NO: 1793278 - RNA, 15 nt, Salmonella enterica enterica serovar Typhi Ty2
cgugcaaccccuugc

SEQ ID NO: 1793279 - RNA, 16 nt, Salmonella enterica enterica serovar Typhi Ty2
cgugaucgccaaagcg

SEQ ID NO: 1793280 - RNA, 13 nt, Salmonella enterica enterica serovar Typhi Ty2
cgugaucacuccc

SEQ ID NO: 1793281 - RNA, 20 nt, Salmonella enterica enterica serovar Typhi Ty2
cgugauaaagguauagugga

SEQ ID NO: 1793282 - RNA, 21 nt, Salmonella enterica enterica serovar Typhi Ty2
cgugagugguagaaacuggca

SEQ ID NO: 1793283 - RNA, 18 nt, Salmonella enterica enterica serovar Typhi Ty2
cgugauaaauacgcugcg

SEQ ID NO: 1793284 - RNA, 23 nt, Salmonella enterica enterica serovar Typhi Ty2
cgugauaaacgguucagucagcg

SEQ ID NO: 1793285 - RNA, 19 nt, Salmonella enterica enterica serovar Typhi Ty2
cgugcaaugucaugacugg

SEQ ID NO: 1793286 - RNA, 20 nt, Salmonella enterica enterica serovar Typhi Ty2
cgugccagaaacaagaagca

SEQ ID NO: 1793287 - RNA, 18 nt, Salmonella enterica enterica serovar Typhi Ty2
cgugccaugaccauucac

SEQ ID NO: 1793288 - RNA, 21 nt, Salmonella enterica enterica serovar Typhi Ty2
cgugcgccgugaaauauccuc

SEQ ID NO: 1793289 - RNA, 17 nt, Salmonella enterica enterica serovar Typhi Ty2
cgucgcgcauggcaggg

SEQ ID NO: 1793290 - RNA, 15 nt, Salmonella enterica enterica serovar Typhi Ty2
cgucgcgaucacaga

SEQ ID NO: 1793291 - RNA, 15 nt, Salmonella enterica enterica serovar Typhi Ty2
cgucgcgacguccgc

SEQ ID NO: 1793292 - RNA, 17 nt, Salmonella enterica enterica serovar Typhi Ty2
cgucuuaaugcucucca

SEQ ID NO: 1793293 - RNA, 21 nt, Salmonella enterica enterica serovar Typhi Ty2
cgucuuaaugguggucgcggc

SEQ ID NO: 1793294 - RNA, 15 nt, Salmonella enterica enterica serovar Typhi Ty2
cgucuguguuuaucc

SEQ ID NO: 1793295 - RNA, 15 nt, Salmonella enterica enterica serovar Typhi Ty2
cgucuuauccggccu

SEQ ID NO: 1793296 - RNA, 12 nt, Salmonella enterica enterica serovar Typhi Ty2
cgucuuaaaauu

SEQ ID NO: 1793297 - RNA, 20 nt, Salmonella enterica enterica serovar Typhi Ty2
cgucugaagaaguucuucug

SEQ ID NO: 1793298 - RNA, 16 nt, Salmonella enterica enterica serovar Typhi Ty2
cgugaacaccacugaa

SEQ ID NO: 1793299 - RNA, 20 nt, Salmonella enterica enterica serovar Typhi Ty2
cgugacaccgguuugcgccu

SEQ ID NO: 1793300 - RNA, 17 nt, Salmonella enterica enterica serovar Typhi Ty2
cgugacgcgccagcgga

SEQ ID NO: 1793301 - RNA, 16 nt, Salmonella enterica enterica serovar Typhi Ty2
cgugaacaaugccauu

SEQ ID NO: 1793302 - RNA, 22 nt, Salmonella enterica enterica serovar Typhi Ty2
cgugaaaaugcguccagaggau

SEQ ID NO: 1793303 - RNA, 17 nt, Salmonella enterica enterica serovar Typhi Ty2
cgucuuuugcugcuuug

SEQ ID NO: 1793304 - RNA, 18 nt, Salmonella enterica enterica serovar Typhi Ty2
cgucuucaucagccagca

SEQ ID NO: 1793305 - RNA, 18 nt, Salmonella enterica enterica serovar Typhi Ty2
cgucuucaucguucauug

SEQ ID NO: 1793306 - RNA, 14 nt, Salmonella enterica enterica serovar Typhi Ty2
cgucuuagaacugg

SEQ ID NO: 1793307 - RNA, 13 nt, Salmonella enterica enterica serovar Typhi Ty2
cgucuucaucuuc

SEQ ID NO: 1793308 - RNA, 19 nt, Salmonella enterica enterica serovar Typhi Ty2
cgucuucaggucauucagg

SEQ ID NO: 1793309 - RNA, 17 nt, Salmonella enterica enterica serovar Typhi Ty2
cgucuucaucuucgucu

SEQ ID NO: 1793310 - RNA, 16 nt, Salmonella enterica enterica serovar Typhi Ty2
cgguucaucuucgccu

SEQ ID NO: 1793311 - RNA, 15 nt, Salmonella enterica enterica serovar Typhi Ty2
cgguuccggggaaag

SEQ ID NO: 1793312 - RNA, 14 nt, Salmonella enterica enterica serovar Typhi Ty2
cgguucgccgcgcg

SEQ ID NO: 1793313 - RNA, 15 nt, Salmonella enterica enterica serovar Typhi Ty2
cgguucucugccauc

SEQ ID NO: 1793314 - RNA, 19 nt, Salmonella enterica enterica serovar Typhi Ty2
cgguuaugcauugcugauc

SEQ ID NO: 1793315 - RNA, 13 nt, Salmonella enterica enterica serovar Typhi Ty2
cgguuaugccugc

SEQ ID NO: 1793316 - RNA, 14 nt, Salmonella enterica enterica serovar Typhi Ty2
cgguucaaucacgc

SEQ ID NO: 1793317 - RNA, 13 nt, Salmonella enterica enterica serovar Typhi Ty2
cgguuccagcggc

SEQ ID NO: 1793318 - RNA, 13 nt, Salmonella enterica enterica serovar Typhi Ty2
cgguucauccugc

SEQ ID NO: 1793319 - RNA, 14 nt, Salmonella enterica enterica serovar Typhi Ty2
cgguuguucagugc

SEQ ID NO: 1793320 - RNA, 18 nt, Salmonella enterica enterica serovar Typhi Ty2
cgguugccuuucgccagc

SEQ ID NO: 1793321 - RNA, 14 nt, Salmonella enterica enterica serovar Typhi Ty2
cgguuuccauggca

SEQ ID NO: 1793322 - RNA, 15 nt, Salmonella enterica enterica serovar Typhi Ty2
cgguuucugcgcgcu

SEQ ID NO: 1793323 - RNA, 17 nt, Salmonella enterica enterica serovar Typhi Ty2
cgguuucuccagccucg

SEQ ID NO: 1793324 - RNA, 17 nt, Salmonella enterica enterica serovar Typhi Ty2
cgguuucuaccacccag

SEQ ID NO: 1793325 - RNA, 20 nt, Salmonella enterica enterica serovar Typhi Ty2
cgguuucuaccacccagcca

SEQ ID NO: 1793326 - RNA, 16 nt, Salmonella enterica enterica serovar Typhi Ty2
cguaaacacguuaucu

SEQ ID NO: 1793327 - RNA, 22 nt, Salmonella enterica enterica serovar Typhi Ty2
cguaaaauauauauuuucucaa

SEQ ID NO: 1793328 - RNA, 14 nt, Salmonella enterica enterica serovar Typhi Ty2
cguaaaauauacag

SEQ ID NO: 1793329 - RNA, 15 nt, Salmonella enterica enterica serovar Typhi Ty2
cguaaaacuuuucug

SEQ ID NO: 1793330 - RNA, 19 nt, Salmonella enterica enterica serovar Typhi Ty2
cguaaaagcgauaaagaca

SEQ ID NO: 1793331 - RNA, 15 nt, Salmonella enterica enterica serovar Typhi Ty2
cguaaaacaacagcg

SEQ ID NO: 1793332 - RNA, 16 nt, Salmonella enterica enterica serovar Typhi Ty2
cguaaagcgcauccag

SEQ ID NO: 1793333 - RNA, 18 nt, Salmonella enterica enterica serovar Typhi Ty2
cguaaagcaucagacuac

SEQ ID NO: 1793334 - RNA, 16 nt, Salmonella enterica enterica serovar Typhi Ty2
cguaaacggcagccgc

SEQ ID NO: 1793335 - RNA, 18 nt, Salmonella enterica enterica serovar Typhi Ty2
cguaaacacguuaucuga

SEQ ID NO: 1793336 - RNA, 15 nt, Salmonella enterica enterica serovar Typhi Ty2
cguaaaccauuucuc

SEQ ID NO: 1793337 - RNA, 20 nt, Salmonella enterica enterica serovar Typhi Ty2
cguaaaccccuucaccgcuu

SEQ ID NO: 1793338 - RNA, 17 nt, Salmonella enterica enterica serovar Typhi Ty2
cgguuuuauccccuuca

SEQ ID NO: 1793339 - RNA, 21 nt, Salmonella enterica enterica serovar Typhi Ty2
cgguuuuauccccuucaggaa

SEQ ID NO: 1793340 - RNA, 19 nt, Salmonella enterica enterica serovar Typhi Ty2
cgguuuguaagugcccgga

SEQ ID NO: 1793341 - RNA, 13 nt, Salmonella enterica enterica serovar Typhi Ty2
cgguuuugcgcug

SEQ ID NO: 1793342 - RNA, 21 nt, Salmonella enterica enterica serovar Typhi Ty2
cgguuuuuuuguggccugcuu

SEQ ID NO: 1793343 - RNA, 22 nt, Salmonella enterica enterica serovar Typhi Ty2
cgguuuuuuuguggccugcuua

SEQ ID NO: 1793344 - RNA, 23 nt, Salmonella enterica enterica serovar Typhi Ty2
cgguuuuuuuguggccugcuuaa

SEQ ID NO: 1793345 - RNA, 14 nt, Salmonella enterica enterica serovar Typhi Ty2
cguaaauacccagg

SEQ ID NO: 1793346 - RNA, 21 nt, Salmonella enterica enterica serovar Typhi Ty2
cguaaauaccaccugccaaag

SEQ ID NO: 1793347 - RNA, 15 nt, Salmonella enterica enterica serovar Typhi Ty2
cguaaaguucccagc

SEQ ID NO: 1793348 - RNA, 13 nt, Salmonella enterica enterica serovar Typhi Ty2
cguaacaggucac

SEQ ID NO: 1793349 - RNA, 17 nt, Salmonella enterica enterica serovar Typhi Ty2
cguaaccgcaaaugcca

SEQ ID NO: 1793350 - RNA, 13 nt, Salmonella enterica enterica serovar Typhi Ty2
cguaaccgcagcg

SEQ ID NO: 1793351 - RNA, 16 nt, Salmonella enterica enterica serovar Typhi Ty2
cguaaccgcagcgccu

SEQ ID NO: 1793352 - RNA, 15 nt, Salmonella enterica enterica serovar Typhi Ty2
cguaacguagcaauc

SEQ ID NO: 1793353 - RNA, 20 nt, Salmonella enterica enterica serovar Typhi Ty2
cguaacggcugacgcccauc

SEQ ID NO: 1793354 - RNA, 16 nt, Salmonella enterica enterica serovar Typhi Ty2
cguaacgcgcaucuuc

SEQ ID NO: 1793355 - RNA, 21 nt, Salmonella enterica enterica serovar Typhi Ty2
cguaagcgcuaugcccaccgc

SEQ ID NO: 1793356 - RNA, 22 nt, Salmonella enterica enterica serovar Typhi Ty2
cguaagccaccgcccagagaau

SEQ ID NO: 1793357 - RNA, 14 nt, Salmonella enterica enterica serovar Typhi Ty2
cguaagaucccagg

SEQ ID NO: 1793358 - RNA, 18 nt, Salmonella enterica enterica serovar Typhi Ty2
cguaacuugauuccuggc

SEQ ID NO: 1793359 - RNA, 19 nt, Salmonella enterica enterica serovar Typhi Ty2
cguaacuugauuccuggcu

SEQ ID NO: 1793360 - RNA, 13 nt, Salmonella enterica enterica serovar Typhi Ty2
cggugaucccagg

SEQ ID NO: 1793361 - RNA, 17 nt, Salmonella enterica enterica serovar Typhi Ty2
cggugcagaccucugca

SEQ ID NO: 1793362 - RNA, 16 nt, Salmonella enterica enterica serovar Typhi Ty2
cggugccugccgccuc

SEQ ID NO: 1793363 - RNA, 23 nt, Salmonella enterica enterica serovar Typhi Ty2
cggugccguuaauuuucacgcac

SEQ ID NO: 1793364 - RNA, 21 nt, Salmonella enterica enterica serovar Typhi Ty2
cggugccuuguucgcagguca

SEQ ID NO: 1793365 - RNA, 22 nt, Salmonella enterica enterica serovar Typhi Ty2
cggugcgagaaaaagcaauaau

SEQ ID NO: 1793366 - RNA, 16 nt, Salmonella enterica enterica serovar Typhi Ty2
cggugcucaauaaaag

SEQ ID NO: 1793367 - RNA, 19 nt, Salmonella enterica enterica serovar Typhi Ty2
cggugucaaagcgccagau

SEQ ID NO: 1793368 - RNA, 15 nt, Salmonella enterica enterica serovar Typhi Ty2
cgguguaccccgccu

SEQ ID NO: 1793369 - RNA, 17 nt, Salmonella enterica enterica serovar Typhi Ty2
cggugugaucaccgccc

SEQ ID NO: 1793370 - RNA, 16 nt, Salmonella enterica enterica serovar Typhi Ty2
cgguguuaaccagaua

SEQ ID NO: 1793371 - RNA, 19 nt, Salmonella enterica enterica serovar Typhi Ty2
cgguuaaaaacagccagca

SEQ ID NO: 1793372 - RNA, 20 nt, Salmonella enterica enterica serovar Typhi Ty2
cggugcuguagcugcccgga

SEQ ID NO: 1793373 - RNA, 16 nt, Salmonella enterica enterica serovar Typhi Ty2
cggugcuuucuccugc

SEQ ID NO: 1793374 - RNA, 16 nt, Salmonella enterica enterica serovar Typhi Ty2
cgguggcgcugugcuu

SEQ ID NO: 1793375 - RNA, 13 nt, Salmonella enterica enterica serovar Typhi Ty2
cgguggcgcugcg

SEQ ID NO: 1793376 - RNA, 21 nt, Salmonella enterica enterica serovar Typhi Ty2
cgucacgccgacgaccggcag

SEQ ID NO: 1793377 - RNA, 20 nt, Salmonella enterica enterica serovar Typhi Ty2
cgucagccacuucuuccagc

SEQ ID NO: 1793378 - RNA, 15 nt, Salmonella enterica enterica serovar Typhi Ty2
cgucagccagaacga

SEQ ID NO: 1793379 - RNA, 21 nt, Salmonella enterica enterica serovar Typhi Ty2
cgucagccccguacaaggucg

SEQ ID NO: 1793380 - RNA, 16 nt, Salmonella enterica enterica serovar Typhi Ty2
cgucagcacgccgccc

SEQ ID NO: 1793381 - RNA, 17 nt, Salmonella enterica enterica serovar Typhi Ty2
cgucagcacgccgcccg

SEQ ID NO: 1793382 - RNA, 18 nt, Salmonella enterica enterica serovar Typhi Ty2
cgucaguaaaagcccgcc

SEQ ID NO: 1793383 - RNA, 22 nt, Salmonella enterica enterica serovar Typhi Ty2
cgucaguaccagcgagauaacc

SEQ ID NO: 1793384 - RNA, 21 nt, Salmonella enterica enterica serovar Typhi Ty2
cgucagugagcccuccuccag

SEQ ID NO: 1793385 - RNA, 13 nt, Salmonella enterica enterica serovar Typhi Ty2
cgucagcgcgucg

SEQ ID NO: 1793386 - RNA, 19 nt, Salmonella enterica enterica serovar Typhi Ty2
cgucaauaaucgcgcgcgu

SEQ ID NO: 1793387 - RNA, 19 nt, Salmonella enterica enterica serovar Typhi Ty2
cgucaauaaagccgcccau

SEQ ID NO: 1793388 - RNA, 13 nt, Salmonella enterica enterica serovar Typhi Ty2
cgucaauaacagg

SEQ ID NO: 1793389 - RNA, 23 nt, Salmonella enterica enterica serovar Typhi Ty2
cgucaaauagagaaaauaacaau

SEQ ID NO: 1793390 - RNA, 20 nt, Salmonella enterica enterica serovar Typhi Ty2
cgucaaauucacccguuauu

SEQ ID NO: 1793391 - RNA, 16 nt, Salmonella enterica enterica serovar Typhi Ty2
cgucaacguuuuucag

SEQ ID NO: 1793392 - RNA, 23 nt, Salmonella enterica enterica serovar Typhi Ty2
cgucacccgccggcagcagcuuc

SEQ ID NO: 1793393 - RNA, 11 nt, Salmonella enterica enterica serovar Typhi Ty2
cgucacccggc

SEQ ID NO: 1793394 - RNA, 18 nt, Salmonella enterica enterica serovar Typhi Ty2
cgucaccaccgcaggcag

SEQ ID NO: 1793395 - RNA, 13 nt, Salmonella enterica enterica serovar Typhi Ty2
cgucaccagcagg

SEQ ID NO: 1793396 - RNA, 19 nt, Salmonella enterica enterica serovar Typhi Ty2
cgucacaagcucacaacga

SEQ ID NO: 1793397 - RNA, 15 nt, Salmonella enterica enterica serovar Typhi Ty2
cgucaaugcugcuuu

SEQ ID NO: 1793398 - RNA, 22 nt, Salmonella enterica enterica serovar Typhi Ty2
cgucaaugugaauccaggccag

SEQ ID NO: 1793399 - RNA, 17 nt, Salmonella enterica enterica serovar Typhi Ty2
cguagcguugccaaaag

SEQ ID NO: 1793400 - RNA, 15 nt, Salmonella enterica enterica serovar Typhi Ty2
cguagcgcguucagg

SEQ ID NO: 1793401 - RNA, 14 nt, Salmonella enterica enterica serovar Typhi Ty2
cguagcggcaggga

SEQ ID NO: 1793402 - RNA, 19 nt, Salmonella enterica enterica serovar Typhi Ty2
cguagcgaauaaucccggc

SEQ ID NO: 1793403 - RNA, 19 nt, Salmonella enterica enterica serovar Typhi Ty2
cguaaucuaaaauuauuuu

SEQ ID NO: 1793404 - RNA, 23 nt, Salmonella enterica enterica serovar Typhi Ty2
cguagcgaauaaucccggcgcca

SEQ ID NO: 1793405 - RNA, 18 nt, Salmonella enterica enterica serovar Typhi Ty2
cguagcgagucaaaccuc

SEQ ID NO: 1793406 - RNA, 20 nt, Salmonella enterica enterica serovar Typhi Ty2
cguagcgcgcggauauggcg

SEQ ID NO: 1793407 - RNA, 15 nt, Salmonella enterica enterica serovar Typhi Ty2
cguaauccggccugg

SEQ ID NO: 1793408 - RNA, 15 nt, Salmonella enterica enterica serovar Typhi Ty2
cguaaucccgccagc

SEQ ID NO: 1793409 - RNA, 23 nt, Salmonella enterica enterica serovar Typhi Ty2
cguaauaugaauauccgccgccc

SEQ ID NO: 1793410 - RNA, 17 nt, Salmonella enterica enterica serovar Typhi Ty2
cguaauauacgccaccu

SEQ ID NO: 1793411 - RNA, 18 nt, Salmonella enterica enterica serovar Typhi Ty2
cguaaguuaaaacgccau

SEQ ID NO: 1793412 - RNA, 17 nt, Salmonella enterica enterica serovar Typhi Ty2
cguaaguuaaaacgcca

SEQ ID NO: 1793413 - RNA, 18 nt, Salmonella enterica enterica serovar Typhi Ty2
cguaaggauacucagcga

SEQ ID NO: 1793414 - RNA, 16 nt, Salmonella enterica enterica serovar Typhi Ty2
cguaagcgggaugggu

SEQ ID NO: 1793415 - RNA, 20 nt, Salmonella enterica enterica serovar Typhi Ty2
cguauuacaaguaauaaaau

SEQ ID NO: 1793416 - RNA, 12 nt, Salmonella enterica enterica serovar Typhi Ty2
cguauucccccu

SEQ ID NO: 1793417 - RNA, 15 nt, Salmonella enterica enterica serovar Typhi Ty2
cguauuauccacccc

SEQ ID NO: 1793418 - RNA, 18 nt, Salmonella enterica enterica serovar Typhi Ty2
cgucaaacucuuccgggc

SEQ ID NO: 1793419 - RNA, 17 nt, Salmonella enterica enterica serovar Typhi Ty2
cgucaaacaguucagac

SEQ ID NO: 1793420 - RNA, 15 nt, Salmonella enterica enterica serovar Typhi Ty2
cgucaaaacgcgcau

SEQ ID NO: 1793421 - RNA, 16 nt, Salmonella enterica enterica serovar Typhi Ty2
cgucaaaacagauucc

SEQ ID NO: 1793422 - RNA, 12 nt, Salmonella enterica enterica serovar Typhi Ty2
cgucaaaacagg

SEQ ID NO: 1793423 - RNA, 18 nt, Salmonella enterica enterica serovar Typhi Ty2
cgucaaaacuuauuuuau

SEQ ID NO: 1793424 - RNA, 22 nt, Salmonella enterica enterica serovar Typhi Ty2
cguaugacguggccagcaugcc

SEQ ID NO: 1793425 - RNA, 14 nt, Salmonella enterica enterica serovar Typhi Ty2
cguaugaaugaaac

SEQ ID NO: 1793426 - RNA, 18 nt, Salmonella enterica enterica serovar Typhi Ty2
cguaugcagccaggccau

SEQ ID NO: 1793427 - RNA, 17 nt, Salmonella enterica enterica serovar Typhi Ty2
cguagugcuucucuuca

SEQ ID NO: 1793428 - RNA, 14 nt, Salmonella enterica enterica serovar Typhi Ty2
cguccccagccaga

SEQ ID NO: 1793429 - RNA, 22 nt, Salmonella enterica enterica serovar Typhi Ty2
cguccgcuaaucucgaccuggc

SEQ ID NO: 1793430 - RNA, 16 nt, Salmonella enterica enterica serovar Typhi Ty2
cguccggaaaauccuc

SEQ ID NO: 1793431 - RNA, 23 nt, Salmonella enterica enterica serovar Typhi Ty2
cgucccacgcgccgccgaacaga

SEQ ID NO: 1793432 - RNA, 15 nt, Salmonella enterica enterica serovar Typhi Ty2
cgucccacgcgccgc

SEQ ID NO: 1793433 - RNA, 16 nt, Salmonella enterica enterica serovar Typhi Ty2
cguccggcacgcgcag

SEQ ID NO: 1793434 - RNA, 20 nt, Salmonella enterica enterica serovar Typhi Ty2
cguccggcgaaaaccgagca

SEQ ID NO: 1793435 - RNA, 12 nt, Salmonella enterica enterica serovar Typhi Ty2
cguccggcugcc

SEQ ID NO: 1793436 - RNA, 11 nt, Salmonella enterica enterica serovar Typhi Ty2
cguccagcggc

SEQ ID NO: 1793437 - RNA, 19 nt, Salmonella enterica enterica serovar Typhi Ty2
cguccaggccugauaagca

SEQ ID NO: 1793438 - RNA, 12 nt, Salmonella enterica enterica serovar Typhi Ty2
cguccaggcucg

SEQ ID NO: 1793439 - RNA, 23 nt, Salmonella enterica enterica serovar Typhi Ty2
cguccaguaaaaucggaccuccg

SEQ ID NO: 1793440 - RNA, 23 nt, Salmonella enterica enterica serovar Typhi Ty2
cguccaguccugucccugccagc

SEQ ID NO: 1793441 - RNA, 16 nt, Salmonella enterica enterica serovar Typhi Ty2
cgucgacgccuuccac

SEQ ID NO: 1793442 - RNA, 15 nt, Salmonella enterica enterica serovar Typhi Ty2
cgucgacgccuucca

SEQ ID NO: 1793443 - RNA, 20 nt, Salmonella enterica enterica serovar Typhi Ty2
cguccuucacguuauucgga

SEQ ID NO: 1793444 - RNA, 13 nt, Salmonella enterica enterica serovar Typhi Ty2
cucgguccacacc

SEQ ID NO: 1793445 - RNA, 20 nt, Salmonella enterica enterica serovar Typhi Ty2
cucggcgagcaguacgccug

SEQ ID NO: 1793446 - RNA, 23 nt, Salmonella enterica enterica serovar Typhi Ty2
cucguaucugucccagccuuccu

SEQ ID NO: 1793447 - RNA, 20 nt, Salmonella enterica enterica serovar Typhi Ty2
cucguauaucgcgauaaacu

SEQ ID NO: 1793448 - RNA, 18 nt, Salmonella enterica enterica serovar Typhi Ty2
cucguacacgcgcccgcc

SEQ ID NO: 1793449 - RNA, 22 nt, Salmonella enterica enterica serovar Typhi Ty2
cucguacacgcgcccgccgcca

SEQ ID NO: 1793450 - RNA, 15 nt, Salmonella enterica enterica serovar Typhi Ty2
cucgucgccagggcg

SEQ ID NO: 1793451 - RNA, 13 nt, Salmonella enterica enterica serovar Typhi Ty2
cucgcuacuggca

SEQ ID NO: 1793452 - RNA, 20 nt, Salmonella enterica enterica serovar Typhi Ty2
cucgcuaauuggcuuaccuu

SEQ ID NO: 1793453 - RNA, 16 nt, Salmonella enterica enterica serovar Typhi Ty2
cucgcucccuuccccc

SEQ ID NO: 1793454 - RNA, 11 nt, Salmonella enterica enterica serovar Typhi Ty2
cucgcuuguug

SEQ ID NO: 1793455 - RNA, 16 nt, Salmonella enterica enterica serovar Typhi Ty2
cucgcuuacgcggcgc

SEQ ID NO: 1793456 - RNA, 14 nt, Salmonella enterica enterica serovar Typhi Ty2
cucgcguccccagc

SEQ ID NO: 1793457 - RNA, 18 nt, Salmonella enterica enterica serovar Typhi Ty2
cucgcguaccagaaacag

SEQ ID NO: 1793458 - RNA, 13 nt, Salmonella enterica enterica serovar Typhi Ty2
cucgaucgccugg

SEQ ID NO: 1793459 - RNA, 18 nt, Salmonella enterica enterica serovar Typhi Ty2
cucggcauacaccgccag

SEQ ID NO: 1793460 - RNA, 21 nt, Salmonella enterica enterica serovar Typhi Ty2
cucggcauacaccgccagcgu

SEQ ID NO: 1793461 - RNA, 20 nt, Salmonella enterica enterica serovar Typhi Ty2
cucucuuucaccagcgccag

SEQ ID NO: 1793462 - RNA, 19 nt, Salmonella enterica enterica serovar Typhi Ty2
cucucuuucaccagcgcca

SEQ ID NO: 1793463 - RNA, 21 nt, Salmonella enterica enterica serovar Typhi Ty2
cucucuggcgcauuccagacc

SEQ ID NO: 1793464 - RNA, 16 nt, Salmonella enterica enterica serovar Typhi Ty2
cucugaaucucuuccc

SEQ ID NO: 1793465 - RNA, 15 nt, Salmonella enterica enterica serovar Typhi Ty2
cucucuuucugccua

SEQ ID NO: 1793466 - RNA, 21 nt, Salmonella enterica enterica serovar Typhi Ty2
cucucuuucgguagccacaga

SEQ ID NO: 1793467 - RNA, 20 nt, Salmonella enterica enterica serovar Typhi Ty2
cucugccucagcaagaaguu

SEQ ID NO: 1793468 - RNA, 18 nt, Salmonella enterica enterica serovar Typhi Ty2
cucugccaguugcucaua

SEQ ID NO: 1793469 - RNA, 19 nt, Salmonella enterica enterica serovar Typhi Ty2
cucugccgguugaccggcc

SEQ ID NO: 1793470 - RNA, 21 nt, Salmonella enterica enterica serovar Typhi Ty2
cucugcaaagaaauugggcuu

SEQ ID NO: 1793471 - RNA, 12 nt, Salmonella enterica enterica serovar Typhi Ty2
cucuauuuuuua

SEQ ID NO: 1793472 - RNA, 14 nt, Salmonella enterica enterica serovar Typhi Ty2
cucuaucagcgccu

SEQ ID NO: 1793473 - RNA, 17 nt, Salmonella enterica enterica serovar Typhi Ty2
cucuaucagcgccuccg

SEQ ID NO: 1793474 - RNA, 15 nt, Salmonella enterica enterica serovar Typhi Ty2
cucuaucggcaaacc

SEQ ID NO: 1793475 - RNA, 21 nt, Salmonella enterica enterica serovar Typhi Ty2
cucuauaccauaaaugaaacc

SEQ ID NO: 1793476 - RNA, 16 nt, Salmonella enterica enterica serovar Typhi Ty2
cucuaggcgcugcugg

SEQ ID NO: 1793477 - RNA, 14 nt, Salmonella enterica enterica serovar Typhi Ty2
cucuccugaagcca

SEQ ID NO: 1793478 - RNA, 14 nt, Salmonella enterica enterica serovar Typhi Ty2
cucucccuggcagg

SEQ ID NO: 1793479 - RNA, 18 nt, Salmonella enterica enterica serovar Typhi Ty2
cucuccgcaauuaauuua

SEQ ID NO: 1793480 - RNA, 22 nt, Salmonella enterica enterica serovar Typhi Ty2
cucucagcgucggugaagaaaa

SEQ ID NO: 1793481 - RNA, 16 nt, Salmonella enterica enterica serovar Typhi Ty2
cucucaccgccuaggc

SEQ ID NO: 1793482 - RNA, 23 nt, Salmonella enterica enterica serovar Typhi Ty2
cucucaccgccuaggccagugcc

SEQ ID NO: 1793483 - RNA, 16 nt, Salmonella enterica enterica serovar Typhi Ty2
cucucccaggcauccu

SEQ ID NO: 1793484 - RNA, 20 nt, Salmonella enterica enterica serovar Typhi Ty2
cucucccccaccgacacaaa

SEQ ID NO: 1793485 - RNA, 14 nt, Salmonella enterica enterica serovar Typhi Ty2
cucucccagcugag

SEQ ID NO: 1793486 - RNA, 23 nt, Salmonella enterica enterica serovar Typhi Ty2
cucuccaguuugcguucacagca

SEQ ID NO: 1793487 - RNA, 14 nt, Salmonella enterica enterica serovar Typhi Ty2
cucucauuuucuuu

SEQ ID NO: 1793488 - RNA, 17 nt, Salmonella enterica enterica serovar Typhi Ty2
cucuccagcaggguauu

SEQ ID NO: 1793489 - RNA, 20 nt, Salmonella enterica enterica serovar Typhi Ty2
cucgaggaacuguucagcca

SEQ ID NO: 1793490 - RNA, 16 nt, Salmonella enterica enterica serovar Typhi Ty2
cucgacguccagcgcg

SEQ ID NO: 1793491 - RNA, 23 nt, Salmonella enterica enterica serovar Typhi Ty2
cuccuugcggugagaaacgcgcc

SEQ ID NO: 1793492 - RNA, 21 nt, Salmonella enterica enterica serovar Typhi Ty2
cuccuuguaagggaggugcuc

SEQ ID NO: 1793493 - RNA, 19 nt, Salmonella enterica enterica serovar Typhi Ty2
cuccuguugaagauuagcc

SEQ ID NO: 1793494 - RNA, 17 nt, Salmonella enterica enterica serovar Typhi Ty2
cucgaauuguuaaaagc

SEQ ID NO: 1793495 - RNA, 18 nt, Salmonella enterica enterica serovar Typhi Ty2
cucgacacacucaucuuc

SEQ ID NO: 1793496 - RNA, 15 nt, Salmonella enterica enterica serovar Typhi Ty2
cuccggccagcgcca

SEQ ID NO: 1793497 - RNA, 18 nt, Salmonella enterica enterica serovar Typhi Ty2
cuccggcacauucaccac

SEQ ID NO: 1793498 - RNA, 12 nt, Salmonella enterica enterica serovar Typhi Ty2
cuccggcagcau

SEQ ID NO: 1793499 - RNA, 23 nt, Salmonella enterica enterica serovar Typhi Ty2
cuccggcaucuuaaagcgggcuu

SEQ ID NO: 1793500 - RNA, 22 nt, Salmonella enterica enterica serovar Typhi Ty2
cuccugcggccuugccgccagc

SEQ ID NO: 1793501 - RNA, 13 nt, Salmonella enterica enterica serovar Typhi Ty2
cuccugcucccag

SEQ ID NO: 1793502 - RNA, 11 nt, Salmonella enterica enterica serovar Typhi Ty2
cuccugcuccu

SEQ ID NO: 1793503 - RNA, 22 nt, Salmonella enterica enterica serovar Typhi Ty2
cuccuggcauggcucgccgcug

SEQ ID NO: 1793504 - RNA, 15 nt, Salmonella enterica enterica serovar Typhi Ty2
cuccuggcauggcuc

SEQ ID NO: 1793505 - RNA, 16 nt, Salmonella enterica enterica serovar Typhi Ty2
cuccuggauuuuaccu

SEQ ID NO: 1793506 - RNA, 18 nt, Salmonella enterica enterica serovar Typhi Ty2
cuccuggcuuaccugcuc

SEQ ID NO: 1793507 - RNA, 14 nt, Salmonella enterica enterica serovar Typhi Ty2
cuccugucaggcga

SEQ ID NO: 1793508 - RNA, 22 nt, Salmonella enterica enterica serovar Typhi Ty2
cuccugaauagcuuucaccggu

SEQ ID NO: 1793509 - RNA, 20 nt, Salmonella enterica enterica serovar Typhi Ty2
cuccugccagauuuucuuua

SEQ ID NO: 1793510 - RNA, 23 nt, Salmonella enterica enterica serovar Typhi Ty2
cuccugccugacaaugacgcuuc

SEQ ID NO: 1793511 - RNA, 18 nt, Salmonella enterica enterica serovar Typhi Ty2
cuccugcgauagcugcug

SEQ ID NO: 1793512 - RNA, 12 nt, Salmonella enterica enterica serovar Typhi Ty2
cuccugcauuug

SEQ ID NO: 1793513 - RNA, 21 nt, Salmonella enterica enterica serovar Typhi Ty2
cuccugcaaucguucuugcac

SEQ ID NO: 1793514 - RNA, 16 nt, Salmonella enterica enterica serovar Typhi Ty2
cuccaggcguuuauga

SEQ ID NO: 1793515 - RNA, 17 nt, Salmonella enterica enterica serovar Typhi Ty2
cuccaggcguuuaugag

SEQ ID NO: 1793516 - RNA, 16 nt, Salmonella enterica enterica serovar Typhi Ty2
cuccaggcgaaucccc

SEQ ID NO: 1793517 - RNA, 20 nt, Salmonella enterica enterica serovar Typhi Ty2
cuccauacccuauuuacaga

SEQ ID NO: 1793518 - RNA, 22 nt, Salmonella enterica enterica serovar Typhi Ty2
cuccaguuguuccagcagcuca

SEQ ID NO: 1793519 - RNA, 12 nt, Salmonella enterica enterica serovar Typhi Ty2
cuccaguugaua

SEQ ID NO: 1793520 - RNA, 16 nt, Salmonella enterica enterica serovar Typhi Ty2
cucaugugcagcaucc

SEQ ID NO: 1793521 - RNA, 15 nt, Salmonella enterica enterica serovar Typhi Ty2
cucauguucaagcug

SEQ ID NO: 1793522 - RNA, 17 nt, Salmonella enterica enterica serovar Typhi Ty2
cucauguucaagcuggu

SEQ ID NO: 1793523 - RNA, 17 nt, Salmonella enterica enterica serovar Typhi Ty2
cuccagcgccagcucca

SEQ ID NO: 1793524 - RNA, 17 nt, Salmonella enterica enterica serovar Typhi Ty2
cuccagcgcauugccuu

SEQ ID NO: 1793525 - RNA, 11 nt, Salmonella enterica enterica serovar Typhi Ty2
cucaugccucg

SEQ ID NO: 1793526 - RNA, 19 nt, Salmonella enterica enterica serovar Typhi Ty2
cucaugccguagaacagca

SEQ ID NO: 1793527 - RNA, 16 nt, Salmonella enterica enterica serovar Typhi Ty2
cuccaggccaagcgcc

SEQ ID NO: 1793528 - RNA, 12 nt, Salmonella enterica enterica serovar Typhi Ty2
cuccagcuggcu

SEQ ID NO: 1793529 - RNA, 16 nt, Salmonella enterica enterica serovar Typhi Ty2
cuccagcuggcuggca

SEQ ID NO: 1793530 - RNA, 22 nt, Salmonella enterica enterica serovar Typhi Ty2
cuccagcgggcuggcauucauu

SEQ ID NO: 1793531 - RNA, 16 nt, Salmonella enterica enterica serovar Typhi Ty2
cuccagcgccuguuga

SEQ ID NO: 1793532 - RNA, 19 nt, Salmonella enterica enterica serovar Typhi Ty2
cucccaaauuuuuuuagca

SEQ ID NO: 1793533 - RNA, 23 nt, Salmonella enterica enterica serovar Typhi Ty2
cucccaacagacgaucuacggua

SEQ ID NO: 1793534 - RNA, 20 nt, Salmonella enterica enterica serovar Typhi Ty2
cucccacucuuccagcaccg

SEQ ID NO: 1793535 - RNA, 13 nt, Salmonella enterica enterica serovar Typhi Ty2
cucccagcugagc

SEQ ID NO: 1793536 - RNA, 22 nt, Salmonella enterica enterica serovar Typhi Ty2
cuccccugucguuaaugggauc

SEQ ID NO: 1793537 - RNA, 18 nt, Salmonella enterica enterica serovar Typhi Ty2
cucccuggcagugaucca

SEQ ID NO: 1793538 - RNA, 18 nt, Salmonella enterica enterica serovar Typhi Ty2
cucccugagucuugccug

SEQ ID NO: 1793539 - RNA, 20 nt, Salmonella enterica enterica serovar Typhi Ty2
cucccugagucuugccuguc

SEQ ID NO: 1793540 - RNA, 13 nt, Salmonella enterica enterica serovar Typhi Ty2
cucccuccugcuc

SEQ ID NO: 1793541 - RNA, 21 nt, Salmonella enterica enterica serovar Typhi Ty2
cucccgcugcggcguggagca

SEQ ID NO: 1793542 - RNA, 15 nt, Salmonella enterica enterica serovar Typhi Ty2
cuccccuuuuuuacu

SEQ ID NO: 1793543 - RNA, 15 nt, Salmonella enterica enterica serovar Typhi Ty2
cuccgcgcuggcaau

SEQ ID NO: 1793544 - RNA, 14 nt, Salmonella enterica enterica serovar Typhi Ty2
cuccgcgcauguaa

SEQ ID NO: 1793545 - RNA, 16 nt, Salmonella enterica enterica serovar Typhi Ty2
cuccgcgagcagccaa

SEQ ID NO: 1793546 - RNA, 21 nt, Salmonella enterica enterica serovar Typhi Ty2
cuccgccgcuuuaucguaacc

SEQ ID NO: 1793547 - RNA, 16 nt, Salmonella enterica enterica serovar Typhi Ty2
cucccugagucuugcc

SEQ ID NO: 1793548 - RNA, 19 nt, Salmonella enterica enterica serovar Typhi Ty2
cucccuguuccuguauuug

SEQ ID NO: 1793549 - RNA, 23 nt, Salmonella enterica enterica serovar Typhi Ty2
cuccgcaaagcccaucagcgcca

SEQ ID NO: 1793550 - RNA, 21 nt, Salmonella enterica enterica serovar Typhi Ty2
cuccgccagcaaugccgccgc

SEQ ID NO: 1793551 - RNA, 22 nt, Salmonella enterica enterica serovar Typhi Ty2
cucagaccgaucucaugcaacu

SEQ ID NO: 1793552 - RNA, 18 nt, Salmonella enterica enterica serovar Typhi Ty2
cucagggcaaaaaugauc

SEQ ID NO: 1793553 - RNA, 17 nt, Salmonella enterica enterica serovar Typhi Ty2
cucagggagaacucauc

SEQ ID NO: 1793554 - RNA, 21 nt, Salmonella enterica enterica serovar Typhi Ty2
cucaggguuuuacgcuggaca

SEQ ID NO: 1793555 - RNA, 22 nt, Salmonella enterica enterica serovar Typhi Ty2
cucagguuauacugugacgaca

SEQ ID NO: 1793556 - RNA, 17 nt, Salmonella enterica enterica serovar Typhi Ty2
cucauaaaacauuccug

SEQ ID NO: 1793557 - RNA, 16 nt, Salmonella enterica enterica serovar Typhi Ty2
cucauaaugauggggu

SEQ ID NO: 1793558 - RNA, 16 nt, Salmonella enterica enterica serovar Typhi Ty2
cucauagccgcuuucc

SEQ ID NO: 1793559 - RNA, 14 nt, Salmonella enterica enterica serovar Typhi Ty2
cucauagccgcuuu

SEQ ID NO: 1793560 - RNA, 15 nt, Salmonella enterica enterica serovar Typhi Ty2
cucauacccuuccag

SEQ ID NO: 1793561 - RNA, 13 nt, Salmonella enterica enterica serovar Typhi Ty2
cucauacccuucc

SEQ ID NO: 1793562 - RNA, 20 nt, Salmonella enterica enterica serovar Typhi Ty2
cucauacagcccgcgcagaa

SEQ ID NO: 1793563 - RNA, 20 nt, Salmonella enterica enterica serovar Typhi Ty2
cucaucggucgcauccauau

SEQ ID NO: 1793564 - RNA, 14 nt, Salmonella enterica enterica serovar Typhi Ty2
cucaucggucgcau

SEQ ID NO: 1793565 - RNA, 21 nt, Salmonella enterica enterica serovar Typhi Ty2
cucaucggcaaacauagccuc

SEQ ID NO: 1793566 - RNA, 17 nt, Salmonella enterica enterica serovar Typhi Ty2
cucaucuucuuuuuccg

SEQ ID NO: 1793567 - RNA, 18 nt, Salmonella enterica enterica serovar Typhi Ty2
cucaucugaugauuaauu

SEQ ID NO: 1793568 - RNA, 22 nt, Salmonella enterica enterica serovar Typhi Ty2
cucaugcaagacaucuaacucu

SEQ ID NO: 1793569 - RNA, 18 nt, Salmonella enterica enterica serovar Typhi Ty2
cucaugauagggcagcag

SEQ ID NO: 1793570 - RNA, 13 nt, Salmonella enterica enterica serovar Typhi Ty2
cucaucuuuuaca

SEQ ID NO: 1793571 - RNA, 16 nt, Salmonella enterica enterica serovar Typhi Ty2
cucaucaaacagcggc

SEQ ID NO: 1793572 - RNA, 14 nt, Salmonella enterica enterica serovar Typhi Ty2
cucauauacccugc

SEQ ID NO: 1793573 - RNA, 22 nt, Salmonella enterica enterica serovar Typhi Ty2
cucaucaauucuuuaauuugug

SEQ ID NO: 1793574 - RNA, 15 nt, Salmonella enterica enterica serovar Typhi Ty2
cucaucacccagucg

SEQ ID NO: 1793575 - RNA, 21 nt, Salmonella enterica enterica serovar Typhi Ty2
cucaucaauggauuuauggca

SEQ ID NO: 1793576 - RNA, 15 nt, Salmonella enterica enterica serovar Typhi Ty2
cucaucagaccguga

SEQ ID NO: 1793577 - RNA, 22 nt, Salmonella enterica enterica serovar Typhi Ty2
cucaucagccugaaagauuauu

SEQ ID NO: 1793578 - RNA, 14 nt, Salmonella enterica enterica serovar Typhi Ty2
cucauccaccuuau

SEQ ID NO: 1793579 - RNA, 21 nt, Salmonella enterica enterica serovar Typhi Ty2
cucauccagauguuauaaacu

SEQ ID NO: 1793580 - RNA, 13 nt, Salmonella enterica enterica serovar Typhi Ty2
cucaacuauuaaa

SEQ ID NO: 1793581 - RNA, 22 nt, Salmonella enterica enterica serovar Typhi Ty2
cucaacugggcgagggaggcaa

SEQ ID NO: 1793582 - RNA, 13 nt, Salmonella enterica enterica serovar Typhi Ty2
cucaacugagcgg

SEQ ID NO: 1793583 - RNA, 21 nt, Salmonella enterica enterica serovar Typhi Ty2
cucaaggcuauuagccaaagc

SEQ ID NO: 1793584 - RNA, 18 nt, Salmonella enterica enterica serovar Typhi Ty2
cucaaggcuauuagccaa

SEQ ID NO: 1793585 - RNA, 14 nt, Salmonella enterica enterica serovar Typhi Ty2
cucaagcgcagcac

SEQ ID NO: 1793586 - RNA, 18 nt, Salmonella enterica enterica serovar Typhi Ty2
cuauuaccggcuggaagc

SEQ ID NO: 1793587 - RNA, 21 nt, Salmonella enterica enterica serovar Typhi Ty2
cucaacauugccggcaucauu

SEQ ID NO: 1793588 - RNA, 22 nt, Salmonella enterica enterica serovar Typhi Ty2
cucaacauugccggcaucauuc

SEQ ID NO: 1793589 - RNA, 12 nt, Salmonella enterica enterica serovar Typhi Ty2
cucaaccagccg

SEQ ID NO: 1793590 - RNA, 18 nt, Salmonella enterica enterica serovar Typhi Ty2
cucaaccaguaccgggcc

SEQ ID NO: 1793591 - RNA, 21 nt, Salmonella enterica enterica serovar Typhi Ty2
cucaaccaucaaaaaaaauag

SEQ ID NO: 1793592 - RNA, 14 nt, Salmonella enterica enterica serovar Typhi Ty2
cucaacaucauuaa

SEQ ID NO: 1793593 - RNA, 13 nt, Salmonella enterica enterica serovar Typhi Ty2
cucaacaucauua

SEQ ID NO: 1793594 - RNA, 23 nt, Salmonella enterica enterica serovar Typhi Ty2
cucaacauacgccgccagccacu

SEQ ID NO: 1793595 - RNA, 18 nt, Salmonella enterica enterica serovar Typhi Ty2
cucaccguagcuccagac

SEQ ID NO: 1793596 - RNA, 22 nt, Salmonella enterica enterica serovar Typhi Ty2
cucacgaaguuuacguugguau

SEQ ID NO: 1793597 - RNA, 18 nt, Salmonella enterica enterica serovar Typhi Ty2
cucacgaauaagaaucag

SEQ ID NO: 1793598 - RNA, 24 nt, Salmonella enterica enterica serovar Typhi Ty2
cucacgaauaagaaucagaugcuc

SEQ ID NO: 1793599 - RNA, 19 nt, Salmonella enterica enterica serovar Typhi Ty2
cucacgauaacgcagcgcg

SEQ ID NO: 1793600 - RNA, 17 nt, Salmonella enterica enterica serovar Typhi Ty2
cucaccugguaagcgcc

SEQ ID NO: 1793601 - RNA, 13 nt, Salmonella enterica enterica serovar Typhi Ty2
cucaccgugguga

SEQ ID NO: 1793602 - RNA, 14 nt, Salmonella enterica enterica serovar Typhi Ty2
cucacguuccccag

SEQ ID NO: 1793603 - RNA, 18 nt, Salmonella enterica enterica serovar Typhi Ty2
cucacugccgacgcccuc

SEQ ID NO: 1793604 - RNA, 20 nt, Salmonella enterica enterica serovar Typhi Ty2
cucaaguuauguuaucccca

SEQ ID NO: 1793605 - RNA, 21 nt, Salmonella enterica enterica serovar Typhi Ty2
cucaaucacuuuugcgaccca

SEQ ID NO: 1793606 - RNA, 15 nt, Salmonella enterica enterica serovar Typhi Ty2
cucaccccuucuuua

SEQ ID NO: 1793607 - RNA, 20 nt, Salmonella enterica enterica serovar Typhi Ty2
cucaccgagacugcccggca

SEQ ID NO: 1793608 - RNA, 14 nt, Salmonella enterica enterica serovar Typhi Ty2
cucacauaacaaaa

SEQ ID NO: 1793609 - RNA, 12 nt, Salmonella enterica enterica serovar Typhi Ty2
cuaucgccgccc

SEQ ID NO: 1793610 - RNA, 22 nt, Salmonella enterica enterica serovar Typhi Ty2
cuaucgcccaaauaguccagca

SEQ ID NO: 1793611 - RNA, 20 nt, Salmonella enterica enterica serovar Typhi Ty2
cuauccgccagguauucuaa

SEQ ID NO: 1793612 - RNA, 23 nt, Salmonella enterica enterica serovar Typhi Ty2
cuauccauaccggacuccaggca

SEQ ID NO: 1793613 - RNA, 18 nt, Salmonella enterica enterica serovar Typhi Ty2
cuauccguccucuuuccc

SEQ ID NO: 1793614 - RNA, 14 nt, Salmonella enterica enterica serovar Typhi Ty2
cuauccgcgccggg

SEQ ID NO: 1793615 - RNA, 12 nt, Salmonella enterica enterica serovar Typhi Ty2
cuauccagcagu

SEQ ID NO: 1793616 - RNA, 16 nt, Salmonella enterica enterica serovar Typhi Ty2
cuaucaugcugcgguu

SEQ ID NO: 1793617 - RNA, 22 nt, Salmonella enterica enterica serovar Typhi Ty2
cuaucaccgcgaugaccaucaa

SEQ ID NO: 1793618 - RNA, 13 nt, Salmonella enterica enterica serovar Typhi Ty2
cuaucaccgccuc

SEQ ID NO: 1793619 - RNA, 14 nt, Salmonella enterica enterica serovar Typhi Ty2
cuaucagccgcgac

SEQ ID NO: 1793620 - RNA, 20 nt, Salmonella enterica enterica serovar Typhi Ty2
cuaucgcgacggaccggcag

SEQ ID NO: 1793621 - RNA, 15 nt, Salmonella enterica enterica serovar Typhi Ty2
cuaucgcugcgcugc

SEQ ID NO: 1793622 - RNA, 23 nt, Salmonella enterica enterica serovar Typhi Ty2
cuaucguuauauauacuucacca

SEQ ID NO: 1793623 - RNA, 14 nt, Salmonella enterica enterica serovar Typhi Ty2
cuaugcaaaagaaa

SEQ ID NO: 1793624 - RNA, 15 nt, Salmonella enterica enterica serovar Typhi Ty2
cuaugcaaaagaaaa

SEQ ID NO: 1793625 - RNA, 13 nt, Salmonella enterica enterica serovar Typhi Ty2
cuaugcaaaacgu

SEQ ID NO: 1793626 - RNA, 22 nt, Salmonella enterica enterica serovar Typhi Ty2
cuaugauggccgacuggcacca

SEQ ID NO: 1793627 - RNA, 16 nt, Salmonella enterica enterica serovar Typhi Ty2
cuauguuugcugagaa

SEQ ID NO: 1793628 - RNA, 20 nt, Salmonella enterica enterica serovar Typhi Ty2
cuauguaaagaaugaaaaaa

SEQ ID NO: 1793629 - RNA, 17 nt, Salmonella enterica enterica serovar Typhi Ty2
cuauauggcgcaagugu

SEQ ID NO: 1793630 - RNA, 20 nt, Salmonella enterica enterica serovar Typhi Ty2
cuauaugcaggcauaaaaaa

SEQ ID NO: 1793631 - RNA, 15 nt, Salmonella enterica enterica serovar Typhi Ty2
cuauaugcaggcaua

SEQ ID NO: 1793632 - RNA, 12 nt, Salmonella enterica enterica serovar Typhi Ty2
cuauacaguaaa

SEQ ID NO: 1793633 - RNA, 17 nt, Salmonella enterica enterica serovar Typhi Ty2
cuauacccaaaauaauu

SEQ ID NO: 1793634 - RNA, 18 nt, Salmonella enterica enterica serovar Typhi Ty2
cuauacgguaaaucauuu

SEQ ID NO: 1793635 - RNA, 17 nt, Salmonella enterica enterica serovar Typhi Ty2
cuauaguggcauuuacc

SEQ ID NO: 1793636 - RNA, 18 nt, Salmonella enterica enterica serovar Typhi Ty2
cuauaguggcauuuaccu

SEQ ID NO: 1793637 - RNA, 18 nt, Salmonella enterica enterica serovar Typhi Ty2
cuagauuuuagaaaauaa

SEQ ID NO: 1793638 - RNA, 20 nt, Salmonella enterica enterica serovar Typhi Ty2
cuagcacuacggcaaacaca

SEQ ID NO: 1793639 - RNA, 16 nt, Salmonella enterica enterica serovar Typhi Ty2
cuagcgucccggcaau

SEQ ID NO: 1793640 - RNA, 17 nt, Salmonella enterica enterica serovar Typhi Ty2
cuacuucaauuuuccag

SEQ ID NO: 1793641 - RNA, 14 nt, Salmonella enterica enterica serovar Typhi Ty2
cuacuuuuacccuu

SEQ ID NO: 1793642 - RNA, 21 nt, Salmonella enterica enterica serovar Typhi Ty2
cuagaugaugauuuaugaaua

SEQ ID NO: 1793643 - RNA, 23 nt, Salmonella enterica enterica serovar Typhi Ty2
cuacucguaaucuaaaauuauuu

SEQ ID NO: 1793644 - RNA, 22 nt, Salmonella enterica enterica serovar Typhi Ty2
cuacucgggccagcucuuuucu

SEQ ID NO: 1793645 - RNA, 21 nt, Salmonella enterica enterica serovar Typhi Ty2
cuacuccgcgguguccugcuu

SEQ ID NO: 1793646 - RNA, 13 nt, Salmonella enterica enterica serovar Typhi Ty2
cuacucaggagau

SEQ ID NO: 1793647 - RNA, 16 nt, Salmonella enterica enterica serovar Typhi Ty2
cuacuuaccggcgcca

SEQ ID NO: 1793648 - RNA, 23 nt, Salmonella enterica enterica serovar Typhi Ty2
cuaacagucgcgccgugcccagc

SEQ ID NO: 1793649 - RNA, 13 nt, Salmonella enterica enterica serovar Typhi Ty2
cuaacagugaaau

SEQ ID NO: 1793650 - RNA, 13 nt, Salmonella enterica enterica serovar Typhi Ty2
cuacgccauggca

SEQ ID NO: 1793651 - RNA, 16 nt, Salmonella enterica enterica serovar Typhi Ty2
cuacuacacacuuacc

SEQ ID NO: 1793652 - RNA, 17 nt, Salmonella enterica enterica serovar Typhi Ty2
cuacgcaaaaaaagcca

SEQ ID NO: 1793653 - RNA, 17 nt, Salmonella enterica enterica serovar Typhi Ty2
cuaccuucacccccauc

SEQ ID NO: 1793654 - RNA, 14 nt, Salmonella enterica enterica serovar Typhi Ty2
cugcgcccgccugc

SEQ ID NO: 1793655 - RNA, 16 nt, Salmonella enterica enterica serovar Typhi Ty2
cugcgcccgccugcug

SEQ ID NO: 1793656 - RNA, 16 nt, Salmonella enterica enterica serovar Typhi Ty2
cugcgccgcaucgcca

SEQ ID NO: 1793657 - RNA, 13 nt, Salmonella enterica enterica serovar Typhi Ty2
cugcgccgccagc

SEQ ID NO: 1793658 - RNA, 13 nt, Salmonella enterica enterica serovar Typhi Ty2
cugcgccgcuugu

SEQ ID NO: 1793659 - RNA, 23 nt, Salmonella enterica enterica serovar Typhi Ty2
cugcgccauugcgggagcuugcc

SEQ ID NO: 1793660 - RNA, 15 nt, Salmonella enterica enterica serovar Typhi Ty2
cugcgccauauccuc

SEQ ID NO: 1793661 - RNA, 17 nt, Salmonella enterica enterica serovar Typhi Ty2
cugcgccagcggcacug

SEQ ID NO: 1793662 - RNA, 14 nt, Salmonella enterica enterica serovar Typhi Ty2
cugcgccagcucau

SEQ ID NO: 1793663 - RNA, 16 nt, Salmonella enterica enterica serovar Typhi Ty2
cugcgccagccugcug

SEQ ID NO: 1793664 - RNA, 12 nt, Salmonella enterica enterica serovar Typhi Ty2
cugcgccagccg

SEQ ID NO: 1793665 - RNA, 13 nt, Salmonella enterica enterica serovar Typhi Ty2
cugcgccagcaug

SEQ ID NO: 1793666 - RNA, 13 nt, Salmonella enterica enterica serovar Typhi Ty2
cugcgcgccgcag

SEQ ID NO: 1793667 - RNA, 22 nt, Salmonella enterica enterica serovar Typhi Ty2
cugcgcgccgcccugcaucaug

SEQ ID NO: 1793668 - RNA, 17 nt, Salmonella enterica enterica serovar Typhi Ty2
cugcgcgccaaaccguu

SEQ ID NO: 1793669 - RNA, 15 nt, Salmonella enterica enterica serovar Typhi Ty2
cugcgcgccugcgcu

SEQ ID NO: 1793670 - RNA, 20 nt, Salmonella enterica enterica serovar Typhi Ty2
cugcgcgcgaugcugcucca

SEQ ID NO: 1793671 - RNA, 18 nt, Salmonella enterica enterica serovar Typhi Ty2
cugcgcgccgggcuucau

SEQ ID NO: 1793672 - RNA, 15 nt, Salmonella enterica enterica serovar Typhi Ty2
cugcgcggccugcgc

SEQ ID NO: 1793673 - RNA, 22 nt, Salmonella enterica enterica serovar Typhi Ty2
cugcgcgucccucuccagggca

SEQ ID NO: 1793674 - RNA, 22 nt, Salmonella enterica enterica serovar Typhi Ty2
cugcgccuggaaaaaagcgccc

SEQ ID NO: 1793675 - RNA, 15 nt, Salmonella enterica enterica serovar Typhi Ty2
cugcgccugcucagc

SEQ ID NO: 1793676 - RNA, 12 nt, Salmonella enterica enterica serovar Typhi Ty2
cugcgccugcau

SEQ ID NO: 1793677 - RNA, 23 nt, Salmonella enterica enterica serovar Typhi Ty2
cugcgccugaaaggcacgcuccu

SEQ ID NO: 1793678 - RNA, 15 nt, Salmonella enterica enterica serovar Typhi Ty2
cugcgccggcugcgc

SEQ ID NO: 1793679 - RNA, 19 nt, Salmonella enterica enterica serovar Typhi Ty2
cugccggucggcgucugau

SEQ ID NO: 1793680 - RNA, 14 nt, Salmonella enterica enterica serovar Typhi Ty2
cugccggugguggu

SEQ ID NO: 1793681 - RNA, 15 nt, Salmonella enterica enterica serovar Typhi Ty2
cugccgcagccgcuc

SEQ ID NO: 1793682 - RNA, 21 nt, Salmonella enterica enterica serovar Typhi Ty2
cugccgcagcacccgcucgcu

SEQ ID NO: 1793683 - RNA, 13 nt, Salmonella enterica enterica serovar Typhi Ty2
cugccgcaccagu

SEQ ID NO: 1793684 - RNA, 22 nt, Salmonella enterica enterica serovar Typhi Ty2
cugccgccauaacgccggcgcu

SEQ ID NO: 1793685 - RNA, 13 nt, Salmonella enterica enterica serovar Typhi Ty2
cugccgccaucgc

SEQ ID NO: 1793686 - RNA, 16 nt, Salmonella enterica enterica serovar Typhi Ty2
cugccgggacuuuaaa

SEQ ID NO: 1793687 - RNA, 23 nt, Salmonella enterica enterica serovar Typhi Ty2
cugccggcuuaccagcgggccgc

SEQ ID NO: 1793688 - RNA, 17 nt, Salmonella enterica enterica serovar Typhi Ty2
cugccgcccaucgccac

SEQ ID NO: 1793689 - RNA, 18 nt, Salmonella enterica enterica serovar Typhi Ty2
cugccgggguaucauaaa

SEQ ID NO: 1793690 - RNA, 22 nt, Salmonella enterica enterica serovar Typhi Ty2
cugccuguuuacggcaggcccg

SEQ ID NO: 1793691 - RNA, 18 nt, Salmonella enterica enterica serovar Typhi Ty2
cugccuguagcagcgcca

SEQ ID NO: 1793692 - RNA, 13 nt, Salmonella enterica enterica serovar Typhi Ty2
cugccugcagacc

SEQ ID NO: 1793693 - RNA, 21 nt, Salmonella enterica enterica serovar Typhi Ty2
cugcgcaacauucugcuucca

SEQ ID NO: 1793694 - RNA, 19 nt, Salmonella enterica enterica serovar Typhi Ty2
cugcgcaacauucugcuuc

SEQ ID NO: 1793695 - RNA, 17 nt, Salmonella enterica enterica serovar Typhi Ty2
cugcgcauccgcggcgc

SEQ ID NO: 1793696 - RNA, 18 nt, Salmonella enterica enterica serovar Typhi Ty2
cugcgcauccgcggcgcu

SEQ ID NO: 1793697 - RNA, 15 nt, Salmonella enterica enterica serovar Typhi Ty2
cugcgcauccucuuu

SEQ ID NO: 1793698 - RNA, 20 nt, Salmonella enterica enterica serovar Typhi Ty2
cugcgcauacgucaugccuu

SEQ ID NO: 1793699 - RNA, 14 nt, Salmonella enterica enterica serovar Typhi Ty2
cugccacaggccaa

SEQ ID NO: 1793700 - RNA, 22 nt, Salmonella enterica enterica serovar Typhi Ty2
cugccaaccggccccaucgccg

SEQ ID NO: 1793701 - RNA, 16 nt, Salmonella enterica enterica serovar Typhi Ty2
cugccaacauggggag

SEQ ID NO: 1793702 - RNA, 22 nt, Salmonella enterica enterica serovar Typhi Ty2
cugccagcagaagacggaaacc

SEQ ID NO: 1793703 - RNA, 18 nt, Salmonella enterica enterica serovar Typhi Ty2
cugccaguccgcccgccu

SEQ ID NO: 1793704 - RNA, 20 nt, Salmonella enterica enterica serovar Typhi Ty2
cugccagcaaggcaagaaag

SEQ ID NO: 1793705 - RNA, 12 nt, Salmonella enterica enterica serovar Typhi Ty2
cugccaucaucc

SEQ ID NO: 1793706 - RNA, 13 nt, Salmonella enterica enterica serovar Typhi Ty2
cugcccaccuucg

SEQ ID NO: 1793707 - RNA, 22 nt, Salmonella enterica enterica serovar Typhi Ty2
cugcccaucuaaccgggccuga

SEQ ID NO: 1793708 - RNA, 15 nt, Salmonella enterica enterica serovar Typhi Ty2
cugccccagacgccc

SEQ ID NO: 1793709 - RNA, 19 nt, Salmonella enterica enterica serovar Typhi Ty2
cugccgcaaacgccugcuc

SEQ ID NO: 1793710 - RNA, 23 nt, Salmonella enterica enterica serovar Typhi Ty2
cugccgaugaaagagcgcgcgcg

SEQ ID NO: 1793711 - RNA, 13 nt, Salmonella enterica enterica serovar Typhi Ty2
cugcccgccaggg

SEQ ID NO: 1793712 - RNA, 13 nt, Salmonella enterica enterica serovar Typhi Ty2
cugcccgccgccg

SEQ ID NO: 1793713 - RNA, 22 nt, Salmonella enterica enterica serovar Typhi Ty2
cugcaggguuugcgcagacugc

SEQ ID NO: 1793714 - RNA, 15 nt, Salmonella enterica enterica serovar Typhi Ty2
cugcaguauuucaga

SEQ ID NO: 1793715 - RNA, 20 nt, Salmonella enterica enterica serovar Typhi Ty2
cugcaaugguaaaacgcugg

SEQ ID NO: 1793716 - RNA, 22 nt, Salmonella enterica enterica serovar Typhi Ty2
cugcaaugguaaaacgcuggcc

SEQ ID NO: 1793717 - RNA, 19 nt, Salmonella enterica enterica serovar Typhi Ty2
cugcacaaucgccagcccc

SEQ ID NO: 1793718 - RNA, 20 nt, Salmonella enterica enterica serovar Typhi Ty2
cugcacaacauuccgcuucc

SEQ ID NO: 1793719 - RNA, 13 nt, Salmonella enterica enterica serovar Typhi Ty2
cugcaauucauag

SEQ ID NO: 1793720 - RNA, 19 nt, Salmonella enterica enterica serovar Typhi Ty2
cugcaucguuugcaguucc

SEQ ID NO: 1793721 - RNA, 20 nt, Salmonella enterica enterica serovar Typhi Ty2
cugcaucguuugcaguuccg

SEQ ID NO: 1793722 - RNA, 20 nt, Salmonella enterica enterica serovar Typhi Ty2
cugcauucaggccucugcuu

SEQ ID NO: 1793723 - RNA, 22 nt, Salmonella enterica enterica serovar Typhi Ty2
cugcauuguuccugcuggcaaa

SEQ ID NO: 1793724 - RNA, 17 nt, Salmonella enterica enterica serovar Typhi Ty2
cugcauuacauucauaa

SEQ ID NO: 1793725 - RNA, 11 nt, Salmonella enterica enterica serovar Typhi Ty2
cugcauucagg

SEQ ID NO: 1793726 - RNA, 17 nt, Salmonella enterica enterica serovar Typhi Ty2
cugcguaaaaucagcau

SEQ ID NO: 1793727 - RNA, 21 nt, Salmonella enterica enterica serovar Typhi Ty2
cugcguaaaccauuucuccug

SEQ ID NO: 1793728 - RNA, 22 nt, Salmonella enterica enterica serovar Typhi Ty2
cugcgucacgcgcaaagcugcg

SEQ ID NO: 1793729 - RNA, 13 nt, Salmonella enterica enterica serovar Typhi Ty2
cugcgucacagac

SEQ ID NO: 1793730 - RNA, 22 nt, Salmonella enterica enterica serovar Typhi Ty2
cugcguggucguaaaacugcac

SEQ ID NO: 1793731 - RNA, 15 nt, Salmonella enterica enterica serovar Typhi Ty2
cugcguugcgcgcgu

SEQ ID NO: 1793732 - RNA, 21 nt, Salmonella enterica enterica serovar Typhi Ty2
cugcuaucaggauucgacggc

SEQ ID NO: 1793733 - RNA, 17 nt, Salmonella enterica enterica serovar Typhi Ty2
cugcgcugacggcggca

SEQ ID NO: 1793734 - RNA, 14 nt, Salmonella enterica enterica serovar Typhi Ty2
cugcgcugacggcg

SEQ ID NO: 1793735 - RNA, 13 nt, Salmonella enterica enterica serovar Typhi Ty2
cugcgcugggccg

SEQ ID NO: 1793736 - RNA, 18 nt, Salmonella enterica enterica serovar Typhi Ty2
cugcgcuuaucaggccua

SEQ ID NO: 1793737 - RNA, 18 nt, Salmonella enterica enterica serovar Typhi Ty2
cugcgcuuaccgggccua

SEQ ID NO: 1793738 - RNA, 15 nt, Salmonella enterica enterica serovar Typhi Ty2
cugcgcuuacggcca

SEQ ID NO: 1793739 - RNA, 18 nt, Salmonella enterica enterica serovar Typhi Ty2
cugcgcuucuauccacug

SEQ ID NO: 1793740 - RNA, 19 nt, Salmonella enterica enterica serovar Typhi Ty2
cugcgcguucugcuccaga

SEQ ID NO: 1793741 - RNA, 16 nt, Salmonella enterica enterica serovar Typhi Ty2
cugcgcguucugcucc

SEQ ID NO: 1793742 - RNA, 17 nt, Salmonella enterica enterica serovar Typhi Ty2
cugcgcucacgcggcgc

SEQ ID NO: 1793743 - RNA, 23 nt, Salmonella enterica enterica serovar Typhi Ty2
cugcgcucaucaggccugggcga

SEQ ID NO: 1793744 - RNA, 18 nt, Salmonella enterica enterica serovar Typhi Ty2
cugcggcuauauaaaauc

SEQ ID NO: 1793745 - RNA, 15 nt, Salmonella enterica enterica serovar Typhi Ty2
cugcggcucgccaau

SEQ ID NO: 1793746 - RNA, 16 nt, Salmonella enterica enterica serovar Typhi Ty2
cugcugcgccuuuacc

SEQ ID NO: 1793747 - RNA, 14 nt, Salmonella enterica enterica serovar Typhi Ty2
cugcugcgcgugcu

SEQ ID NO: 1793748 - RNA, 17 nt, Salmonella enterica enterica serovar Typhi Ty2
cugcugccagcgccgcc

SEQ ID NO: 1793749 - RNA, 18 nt, Salmonella enterica enterica serovar Typhi Ty2
cugcugccagcgccgccg

SEQ ID NO: 1793750 - RNA, 14 nt, Salmonella enterica enterica serovar Typhi Ty2
cugcugccagccgc

SEQ ID NO: 1793751 - RNA, 16 nt, Salmonella enterica enterica serovar Typhi Ty2
cugcugcauccgcgcu

SEQ ID NO: 1793752 - RNA, 20 nt, Salmonella enterica enterica serovar Typhi Ty2
cugcugaaaaagaacaauaa

SEQ ID NO: 1793753 - RNA, 15 nt, Salmonella enterica enterica serovar Typhi Ty2
aaacucacccaggcg

SEQ ID NO: 1793754 - RNA, 23 nt, Salmonella enterica enterica serovar Typhi Ty2
cugcuccugccagauuuucuuua

SEQ ID NO: 1793755 - RNA, 15 nt, Salmonella enterica enterica serovar Typhi Ty2
cugcuccugcggcgu

SEQ ID NO: 1793756 - RNA, 16 nt, Salmonella enterica enterica serovar Typhi Ty2
cugcucccucacgcgu

SEQ ID NO: 1793757 - RNA, 22 nt, Salmonella enterica enterica serovar Typhi Ty2
cugcuccggcuuaaugcccggc

SEQ ID NO: 1793758 - RNA, 20 nt, Salmonella enterica enterica serovar Typhi Ty2
cugcucuaccaacugagcua

SEQ ID NO: 1793759 - RNA, 14 nt, Salmonella enterica enterica serovar Typhi Ty2
cugcucuccacgcc

SEQ ID NO: 1793760 - RNA, 13 nt, Salmonella enterica enterica serovar Typhi Ty2
aaacuauuuuuag

SEQ ID NO: 1793761 - RNA, 22 nt, Salmonella enterica enterica serovar Typhi Ty2
cugcucggguaaggcaucguug

SEQ ID NO: 1793762 - RNA, 24 nt, Salmonella enterica enterica serovar Typhi Ty2
cugcucguaaagcaucagacuacu

SEQ ID NO: 1793763 - RNA, 22 nt, Salmonella enterica enterica serovar Typhi Ty2
cugcucguaaguuuccugcgcg

SEQ ID NO: 1793764 - RNA, 14 nt, Salmonella enterica enterica serovar Typhi Ty2
cuggccaguuucaa

SEQ ID NO: 1793765 - RNA, 14 nt, Salmonella enterica enterica serovar Typhi Ty2
cuggccaggcuuuc

SEQ ID NO: 1793766 - RNA, 17 nt, Salmonella enterica enterica serovar Typhi Ty2
cuggccaguucgucuuc

SEQ ID NO: 1793767 - RNA, 17 nt, Salmonella enterica enterica serovar Typhi Ty2
cuggccauuucaucauu

SEQ ID NO: 1793768 - RNA, 22 nt, Salmonella enterica enterica serovar Typhi Ty2
cuggccaauuuuucacaugcaa

SEQ ID NO: 1793769 - RNA, 17 nt, Salmonella enterica enterica serovar Typhi Ty2
cuggcaaaacgcaucca

SEQ ID NO: 1793770 - RNA, 14 nt, Salmonella enterica enterica serovar Typhi Ty2
cuggcaacagccau

SEQ ID NO: 1793771 - RNA, 21 nt, Salmonella enterica enterica serovar Typhi Ty2
cuggcaagcgccagcauggcg

SEQ ID NO: 1793772 - RNA, 22 nt, Salmonella enterica enterica serovar Typhi Ty2
cuggaucgugcggcgaagcauc

SEQ ID NO: 1793773 - RNA, 16 nt, Salmonella enterica enterica serovar Typhi Ty2
cuggaugacugaauua

SEQ ID NO: 1793774 - RNA, 13 nt, Salmonella enterica enterica serovar Typhi Ty2
cuggcaaaacgca

SEQ ID NO: 1793775 - RNA, 16 nt, Salmonella enterica enterica serovar Typhi Ty2
cuggaucagauucccc

SEQ ID NO: 1793776 - RNA, 21 nt, Salmonella enterica enterica serovar Typhi Ty2
cuggaucacuuuugccgucag

SEQ ID NO: 1793777 - RNA, 23 nt, Salmonella enterica enterica serovar Typhi Ty2
cuggaucaccugaaugcaaagaa

SEQ ID NO: 1793778 - RNA, 22 nt, Salmonella enterica enterica serovar Typhi Ty2
cuggaaaucuuucuccugguuu

SEQ ID NO: 1793779 - RNA, 17 nt, Salmonella enterica enterica serovar Typhi Ty2
cuggacaaaccacagug

SEQ ID NO: 1793780 - RNA, 20 nt, Salmonella enterica enterica serovar Typhi Ty2
cuggacauguuccgccccgc

SEQ ID NO: 1793781 - RNA, 22 nt, Salmonella enterica enterica serovar Typhi Ty2
cuggacauguuccgccccgccu

SEQ ID NO: 1793782 - RNA, 15 nt, Salmonella enterica enterica serovar Typhi Ty2
cuggaauuuuuccag

SEQ ID NO: 1793783 - RNA, 23 nt, Salmonella enterica enterica serovar Typhi Ty2
cugcuuuuugauacagcagcacc

SEQ ID NO: 1793784 - RNA, 17 nt, Salmonella enterica enterica serovar Typhi Ty2
cuggaaaauuucaguga

SEQ ID NO: 1793785 - RNA, 15 nt, Salmonella enterica enterica serovar Typhi Ty2
cugcugcuggguuga

SEQ ID NO: 1793786 - RNA, 20 nt, Salmonella enterica enterica serovar Typhi Ty2
cugcugcugauggccuuugu

SEQ ID NO: 1793787 - RNA, 12 nt, Salmonella enterica enterica serovar Typhi Ty2
cugcugcucccu

SEQ ID NO: 1793788 - RNA, 18 nt, Salmonella enterica enterica serovar Typhi Ty2
cugcuggaaaucuuucuc

SEQ ID NO: 1793789 - RNA, 16 nt, Salmonella enterica enterica serovar Typhi Ty2
cugcuggcaaaacgca

SEQ ID NO: 1793790 - RNA, 14 nt, Salmonella enterica enterica serovar Typhi Ty2
cugcuucaccgcgc

SEQ ID NO: 1793791 - RNA, 12 nt, Salmonella enterica enterica serovar Typhi Ty2
cugcuucagcca

SEQ ID NO: 1793792 - RNA, 13 nt, Salmonella enterica enterica serovar Typhi Ty2
cugcuuccagaau

SEQ ID NO: 1793793 - RNA, 14 nt, Salmonella enterica enterica serovar Typhi Ty2
cugcaacucuccca

SEQ ID NO: 1793794 - RNA, 20 nt, Salmonella enterica enterica serovar Typhi Ty2
cugcaagagaaauaacaccu

SEQ ID NO: 1793795 - RNA, 17 nt, Salmonella enterica enterica serovar Typhi Ty2
cugcaauagcagaucgc

SEQ ID NO: 1793796 - RNA, 19 nt, Salmonella enterica enterica serovar Typhi Ty2
cugcaaauaccacaucaga

SEQ ID NO: 1793797 - RNA, 16 nt, Salmonella enterica enterica serovar Typhi Ty2
cugcaaauacugcuuu

SEQ ID NO: 1793798 - RNA, 22 nt, Salmonella enterica enterica serovar Typhi Ty2
cugcaaauacugcuuuuccggc

SEQ ID NO: 1793799 - RNA, 14 nt, Salmonella enterica enterica serovar Typhi Ty2
cugcaacgccagau

SEQ ID NO: 1793800 - RNA, 18 nt, Salmonella enterica enterica serovar Typhi Ty2
cugcaacggcgaggugcu

SEQ ID NO: 1793801 - RNA, 13 nt, Salmonella enterica enterica serovar Typhi Ty2
cugcaaaauuugu

SEQ ID NO: 1793802 - RNA, 15 nt, Salmonella enterica enterica serovar Typhi Ty2
cugaugcagcuugca

SEQ ID NO: 1793803 - RNA, 13 nt, Salmonella enterica enterica serovar Typhi Ty2
cugaugccgucga

SEQ ID NO: 1793804 - RNA, 19 nt, Salmonella enterica enterica serovar Typhi Ty2
cugauuuaaucgcuucaau

SEQ ID NO: 1793805 - RNA, 13 nt, Salmonella enterica enterica serovar Typhi Ty2
cugauugucagca

SEQ ID NO: 1793806 - RNA, 19 nt, Salmonella enterica enterica serovar Typhi Ty2
cugaugcguuguaccguuu

SEQ ID NO: 1793807 - RNA, 18 nt, Salmonella enterica enterica serovar Typhi Ty2
cugauccuguaaaaaauc

SEQ ID NO: 1793808 - RNA, 20 nt, Salmonella enterica enterica serovar Typhi Ty2
cugauccggaauagagauag

SEQ ID NO: 1793809 - RNA, 17 nt, Salmonella enterica enterica serovar Typhi Ty2
cugaucgauccacuucc

SEQ ID NO: 1793810 - RNA, 20 nt, Salmonella enterica enterica serovar Typhi Ty2
cugaucgacgaaaucccggc

SEQ ID NO: 1793811 - RNA, 17 nt, Salmonella enterica enterica serovar Typhi Ty2
cugaucguuuuugucca

SEQ ID NO: 1793812 - RNA, 14 nt, Salmonella enterica enterica serovar Typhi Ty2
cugaucgugcccac

SEQ ID NO: 1793813 - RNA, 20 nt, Salmonella enterica enterica serovar Typhi Ty2
cugaucgugauaggccagac

SEQ ID NO: 1793814 - RNA, 19 nt, Salmonella enterica enterica serovar Typhi Ty2
cugaucgccaacgaccggc

SEQ ID NO: 1793815 - RNA, 22 nt, Salmonella enterica enterica serovar Typhi Ty2
cugaucgcgcagacaguggcca

SEQ ID NO: 1793816 - RNA, 19 nt, Salmonella enterica enterica serovar Typhi Ty2
cugaucggccagcgucgcu

SEQ ID NO: 1793817 - RNA, 17 nt, Salmonella enterica enterica serovar Typhi Ty2
cugauauuuuacuuuuu

SEQ ID NO: 1793818 - RNA, 21 nt, Salmonella enterica enterica serovar Typhi Ty2
cugauauugcguaagcagcug

SEQ ID NO: 1793819 - RNA, 21 nt, Salmonella enterica enterica serovar Typhi Ty2
cugauauucccguuccagcuu

SEQ ID NO: 1793820 - RNA, 12 nt, Salmonella enterica enterica serovar Typhi Ty2
cugauaauaaga

SEQ ID NO: 1793821 - RNA, 23 nt, Salmonella enterica enterica serovar Typhi Ty2
cugaguuucucccgccagaugca

SEQ ID NO: 1793822 - RNA, 16 nt, Salmonella enterica enterica serovar Typhi Ty2
cugauaagguaaagcc

SEQ ID NO: 1793823 - RNA, 19 nt, Salmonella enterica enterica serovar Typhi Ty2
cugauaagguaaagccgcc

SEQ ID NO: 1793824 - RNA, 22 nt, Salmonella enterica enterica serovar Typhi Ty2
cugauauuacuaauaaaauuca

SEQ ID NO: 1793825 - RNA, 17 nt, Salmonella enterica enterica serovar Typhi Ty2
cugauaccccagcgauc

SEQ ID NO: 1793826 - RNA, 20 nt, Salmonella enterica enterica serovar Typhi Ty2
cugauaccgcguuugcgcaa

SEQ ID NO: 1793827 - RNA, 23 nt, Salmonella enterica enterica serovar Typhi Ty2
cugagccgcccggcgcgcuggag

SEQ ID NO: 1793828 - RNA, 14 nt, Salmonella enterica enterica serovar Typhi Ty2
cugagccgcccggc

SEQ ID NO: 1793829 - RNA, 17 nt, Salmonella enterica enterica serovar Typhi Ty2
cugaguuuagccagcag

SEQ ID NO: 1793830 - RNA, 20 nt, Salmonella enterica enterica serovar Typhi Ty2
cugaguuaaugccaucauca

SEQ ID NO: 1793831 - RNA, 13 nt, Salmonella enterica enterica serovar Typhi Ty2
cugaagccugcuu

SEQ ID NO: 1793832 - RNA, 20 nt, Salmonella enterica enterica serovar Typhi Ty2
cugaagcgcgacgggaagga

SEQ ID NO: 1793833 - RNA, 21 nt, Salmonella enterica enterica serovar Typhi Ty2
cugacagaaauagccgguaac

SEQ ID NO: 1793834 - RNA, 15 nt, Salmonella enterica enterica serovar Typhi Ty2
cugacacccucugcg

SEQ ID NO: 1793835 - RNA, 15 nt, Salmonella enterica enterica serovar Typhi Ty2
cugacauuuauauua

SEQ ID NO: 1793836 - RNA, 21 nt, Salmonella enterica enterica serovar Typhi Ty2
cugacauuugcaucaaacuuc

SEQ ID NO: 1793837 - RNA, 22 nt, Salmonella enterica enterica serovar Typhi Ty2
cugacaacacauccgcagcgaa

SEQ ID NO: 1793838 - RNA, 18 nt, Salmonella enterica enterica serovar Typhi Ty2
cugaccauugauuuccgc

SEQ ID NO: 1793839 - RNA, 21 nt, Salmonella enterica enterica serovar Typhi Ty2
cugaccauugauuuccgcgca

SEQ ID NO: 1793840 - RNA, 14 nt, Salmonella enterica enterica serovar Typhi Ty2
cugaccaugccaca

SEQ ID NO: 1793841 - RNA, 22 nt, Salmonella enterica enterica serovar Typhi Ty2
cugaccaugcauauaagagacg

SEQ ID NO: 1793842 - RNA, 14 nt, Salmonella enterica enterica serovar Typhi Ty2
cugaccagggcaaa

SEQ ID NO: 1793843 - RNA, 15 nt, Salmonella enterica enterica serovar Typhi Ty2
cugaccacauuuucu

SEQ ID NO: 1793844 - RNA, 17 nt, Salmonella enterica enterica serovar Typhi Ty2
cugaccaacaacagaua

SEQ ID NO: 1793845 - RNA, 19 nt, Salmonella enterica enterica serovar Typhi Ty2
cugaccaagcgucagcaug

SEQ ID NO: 1793846 - RNA, 13 nt, Salmonella enterica enterica serovar Typhi Ty2
cugacgcgccugg

SEQ ID NO: 1793847 - RNA, 13 nt, Salmonella enterica enterica serovar Typhi Ty2
cugacgcgcagcg

SEQ ID NO: 1793848 - RNA, 17 nt, Salmonella enterica enterica serovar Typhi Ty2
cugacgaauagcgcgcu

SEQ ID NO: 1793849 - RNA, 18 nt, Salmonella enterica enterica serovar Typhi Ty2
cugaccuuuuucauccuc

SEQ ID NO: 1793850 - RNA, 16 nt, Salmonella enterica enterica serovar Typhi Ty2
cugacgaaaaccgucc

SEQ ID NO: 1793851 - RNA, 15 nt, Salmonella enterica enterica serovar Typhi Ty2
cugacuauccacagc

SEQ ID NO: 1793852 - RNA, 14 nt, Salmonella enterica enterica serovar Typhi Ty2
cugacuccagcugg

SEQ ID NO: 1793853 - RNA, 23 nt, Salmonella enterica enterica serovar Typhi Ty2
cugacggccugucuccucagcag

SEQ ID NO: 1793854 - RNA, 21 nt, Salmonella enterica enterica serovar Typhi Ty2
cugacugaucgauccacuucc

SEQ ID NO: 1793855 - RNA, 20 nt, Salmonella enterica enterica serovar Typhi Ty2
cugagaaaagggcgcaccaa

SEQ ID NO: 1793856 - RNA, 18 nt, Salmonella enterica enterica serovar Typhi Ty2
cugacugcaaaucugccg

SEQ ID NO: 1793857 - RNA, 19 nt, Salmonella enterica enterica serovar Typhi Ty2
cugacugcauaauggugga

SEQ ID NO: 1793858 - RNA, 13 nt, Salmonella enterica enterica serovar Typhi Ty2
cugagaucaaaca

SEQ ID NO: 1793859 - RNA, 12 nt, Salmonella enterica enterica serovar Typhi Ty2
cugaaaaauccc

SEQ ID NO: 1793860 - RNA, 13 nt, Salmonella enterica enterica serovar Typhi Ty2
cugaaaaugcccg

SEQ ID NO: 1793861 - RNA, 15 nt, Salmonella enterica enterica serovar Typhi Ty2
cucuuuguuggcugc

SEQ ID NO: 1793862 - RNA, 17 nt, Salmonella enterica enterica serovar Typhi Ty2
cucuuuuaauuuucugu

SEQ ID NO: 1793863 - RNA, 20 nt, Salmonella enterica enterica serovar Typhi Ty2
cucuuuuucauagaaccacu

SEQ ID NO: 1793864 - RNA, 11 nt, Salmonella enterica enterica serovar Typhi Ty2
cucuuuuucau

SEQ ID NO: 1793865 - RNA, 15 nt, Salmonella enterica enterica serovar Typhi Ty2
cucuuuaucaaacaa

SEQ ID NO: 1793866 - RNA, 13 nt, Salmonella enterica enterica serovar Typhi Ty2
cucuuucagacca

SEQ ID NO: 1793867 - RNA, 16 nt, Salmonella enterica enterica serovar Typhi Ty2
cucuuuauugcuggug

SEQ ID NO: 1793868 - RNA, 20 nt, Salmonella enterica enterica serovar Typhi Ty2
cucuuucagccgacuaucuu

SEQ ID NO: 1793869 - RNA, 17 nt, Salmonella enterica enterica serovar Typhi Ty2
cucuuucauuucugccu

SEQ ID NO: 1793870 - RNA, 17 nt, Salmonella enterica enterica serovar Typhi Ty2
cugaagaaaaggaaugc

SEQ ID NO: 1793871 - RNA, 16 nt, Salmonella enterica enterica serovar Typhi Ty2
cugaagauaaaauugu

SEQ ID NO: 1793872 - RNA, 17 nt, Salmonella enterica enterica serovar Typhi Ty2
cugaagauaaacagcag

SEQ ID NO: 1793873 - RNA, 11 nt, Salmonella enterica enterica serovar Typhi Ty2
cugaacgcugc

SEQ ID NO: 1793874 - RNA, 15 nt, Salmonella enterica enterica serovar Typhi Ty2
cugaaccugccuuug

SEQ ID NO: 1793875 - RNA, 13 nt, Salmonella enterica enterica serovar Typhi Ty2
cugaaccugccuu

SEQ ID NO: 1793876 - RNA, 21 nt, Salmonella enterica enterica serovar Typhi Ty2
cugaacuuccguaaaaagaac

SEQ ID NO: 1793877 - RNA, 15 nt, Salmonella enterica enterica serovar Typhi Ty2
cugaacauagccauc

SEQ ID NO: 1793878 - RNA, 16 nt, Salmonella enterica enterica serovar Typhi Ty2
cugaacccugccugcc

SEQ ID NO: 1793879 - RNA, 15 nt, Salmonella enterica enterica serovar Typhi Ty2
cugaaaucagccugc

SEQ ID NO: 1793880 - RNA, 16 nt, Salmonella enterica enterica serovar Typhi Ty2
cucuucaucgcgccuc

SEQ ID NO: 1793881 - RNA, 16 nt, Salmonella enterica enterica serovar Typhi Ty2
cucuucaucuguggca

SEQ ID NO: 1793882 - RNA, 15 nt, Salmonella enterica enterica serovar Typhi Ty2
cucuucaucuuuuuc

SEQ ID NO: 1793883 - RNA, 20 nt, Salmonella enterica enterica serovar Typhi Ty2
cucuucaguaaccagggagg

SEQ ID NO: 1793884 - RNA, 22 nt, Salmonella enterica enterica serovar Typhi Ty2
cucuucaguaagcguaccauuc

SEQ ID NO: 1793885 - RNA, 19 nt, Salmonella enterica enterica serovar Typhi Ty2
cucuucaaacuccccuguc

SEQ ID NO: 1793886 - RNA, 23 nt, Salmonella enterica enterica serovar Typhi Ty2
cucuucaauuuccaucuguaaca

SEQ ID NO: 1793887 - RNA, 22 nt, Salmonella enterica enterica serovar Typhi Ty2
cucugguaguuguaauaaacag

SEQ ID NO: 1793888 - RNA, 20 nt, Salmonella enterica enterica serovar Typhi Ty2
cucugcuuuucucacaauaa

SEQ ID NO: 1793889 - RNA, 17 nt, Salmonella enterica enterica serovar Typhi Ty2
cucuucccgucgcagca

SEQ ID NO: 1793890 - RNA, 15 nt, Salmonella enterica enterica serovar Typhi Ty2
cucuuccaucagcca

SEQ ID NO: 1793891 - RNA, 17 nt, Salmonella enterica enterica serovar Typhi Ty2
cucuuccggcauaaaaa

SEQ ID NO: 1793892 - RNA, 12 nt, Salmonella enterica enterica serovar Typhi Ty2
cucuuccgccag

SEQ ID NO: 1793893 - RNA, 18 nt, Salmonella enterica enterica serovar Typhi Ty2
cucuuccgguacacgcag

SEQ ID NO: 1793894 - RNA, 15 nt, Salmonella enterica enterica serovar Typhi Ty2
cucuuccuccccagg

SEQ ID NO: 1793895 - RNA, 17 nt, Salmonella enterica enterica serovar Typhi Ty2
cucuuccuccccaggcg

SEQ ID NO: 1793896 - RNA, 14 nt, Salmonella enterica enterica serovar Typhi Ty2
cucuucgacacauu

SEQ ID NO: 1793897 - RNA, 12 nt, Salmonella enterica enterica serovar Typhi Ty2
cucuucggcuuc

SEQ ID NO: 1793898 - RNA, 20 nt, Salmonella enterica enterica serovar Typhi Ty2
cucuucgugacccgccagca

SEQ ID NO: 1793899 - RNA, 16 nt, Salmonella enterica enterica serovar Typhi Ty2
cucuucguuauuuucc

SEQ ID NO: 1793900 - RNA, 16 nt, Salmonella enterica enterica serovar Typhi Ty2
cucuucugaccaucuu

SEQ ID NO: 1793901 - RNA, 11 nt, Salmonella enterica enterica serovar Typhi Ty2
cucuucugcug

SEQ ID NO: 1793902 - RNA, 17 nt, Salmonella enterica enterica serovar Typhi Ty2
cucuucuggcucccgca

SEQ ID NO: 1793903 - RNA, 17 nt, Salmonella enterica enterica serovar Typhi Ty2
cucuucuuuuacaagaa

SEQ ID NO: 1793904 - RNA, 13 nt, Salmonella enterica enterica serovar Typhi Ty2
cucuucuuuuaau

SEQ ID NO: 1793905 - RNA, 20 nt, Salmonella enterica enterica serovar Typhi Ty2
cucuuuaaugauguccagaa

SEQ ID NO: 1793906 - RNA, 20 nt, Salmonella enterica enterica serovar Typhi Ty2
cucuugugcuuccagcucca

SEQ ID NO: 1793907 - RNA, 13 nt, Salmonella enterica enterica serovar Typhi Ty2
aaaaaaacgcauu

SEQ ID NO: 1793908 - RNA, 13 nt, Salmonella enterica enterica serovar Typhi Ty2
aaaaaauaucucu

SEQ ID NO: 1793909 - RNA, 17 nt, Salmonella enterica enterica serovar Typhi Ty2
aaaaaagugauccccca

SEQ ID NO: 1793910 - RNA, 18 nt, Salmonella enterica enterica serovar Typhi Ty2
aaaaaaguuauuuuuucu

SEQ ID NO: 1793911 - RNA, 19 nt, Salmonella enterica enterica serovar Typhi Ty2
aaaaaaccggcaacucgcc

SEQ ID NO: 1793912 - RNA, 22 nt, Salmonella enterica enterica serovar Typhi Ty2
aaaaaagcugcgaucaaguuuu

SEQ ID NO: 1793913 - RNA, 11 nt, Salmonella enterica enterica serovar Typhi Ty2
aaaaaaccaga

SEQ ID NO: 1793914 - RNA, 13 nt, Salmonella enterica enterica serovar Typhi Ty2
aaaaaacaccugu

SEQ ID NO: 1793915 - RNA, 10 nt, Salmonella enterica enterica serovar Typhi Ty2
aaaaaacagg

SEQ ID NO: 1793916 - RNA, 12 nt, Salmonella enterica enterica serovar Typhi Ty2
aaaaaacaucau

SEQ ID NO: 1793917 - RNA, 21 nt, Salmonella enterica enterica serovar Typhi Ty2
aaaaaagucacuuacuuucuu

SEQ ID NO: 1793918 - RNA, 20 nt, Salmonella enterica enterica serovar Typhi Ty2
aaaaaagccguauuuuauuu

SEQ ID NO: 1793919 - RNA, 11 nt, Salmonella enterica enterica serovar Typhi Ty2
aaaaacaaggg

SEQ ID NO: 1793920 - RNA, 11 nt, Salmonella enterica enterica serovar Typhi Ty2
aaaaaauuccc

SEQ ID NO: 1793921 - RNA, 15 nt, Salmonella enterica enterica serovar Typhi Ty2
aaaaaccaaaaaaua

SEQ ID NO: 1793922 - RNA, 15 nt, Salmonella enterica enterica serovar Typhi Ty2
aaaaaccagaauuuc

SEQ ID NO: 1793923 - RNA, 12 nt, Salmonella enterica enterica serovar Typhi Ty2
aaaaaauccuca

SEQ ID NO: 1793924 - RNA, 16 nt, Salmonella enterica enterica serovar Typhi Ty2
aaaaaaugagaacacc

SEQ ID NO: 1793925 - RNA, 12 nt, Salmonella enterica enterica serovar Typhi Ty2
aaaaaaucagca

SEQ ID NO: 1793926 - RNA, 16 nt, Salmonella enterica enterica serovar Typhi Ty2
aaaaacagccagcagc

SEQ ID NO: 1793927 - RNA, 11 nt, Salmonella enterica enterica serovar Typhi Ty2
aaaaacaucau

SEQ ID NO: 1793928 - RNA, 11 nt, Salmonella enterica enterica serovar Typhi Ty2
aaaaauaaaaa

SEQ ID NO: 1793929 - RNA, 14 nt, Salmonella enterica enterica serovar Typhi Ty2
aaaaauaaaaaaac

SEQ ID NO: 1793930 - RNA, 19 nt, Salmonella enterica enterica serovar Typhi Ty2
aaaaacagcgcaauaugca

SEQ ID NO: 1793931 - RNA, 21 nt, Salmonella enterica enterica serovar Typhi Ty2
aaaaacaggcgcaggcauuaa

SEQ ID NO: 1793932 - RNA, 16 nt, Salmonella enterica enterica serovar Typhi Ty2
aaaaacaucgcugaua

SEQ ID NO: 1793933 - RNA, 16 nt, Salmonella enterica enterica serovar Typhi Ty2
aaaaaccaaaaaauau

SEQ ID NO: 1793934 - RNA, 20 nt, Salmonella enterica enterica serovar Typhi Ty2
aaaaauacugauaaaaaaca

SEQ ID NO: 1793935 - RNA, 20 nt, Salmonella enterica enterica serovar Typhi Ty2
aaaaauaggcuuuugauuca

SEQ ID NO: 1793936 - RNA, 21 nt, Salmonella enterica enterica serovar Typhi Ty2
aaaaauaauuacuaucuucaa

SEQ ID NO: 1793937 - RNA, 18 nt, Salmonella enterica enterica serovar Typhi Ty2
aaaaauaucauuaaauca

SEQ ID NO: 1793938 - RNA, 13 nt, Salmonella enterica enterica serovar Typhi Ty2
aaaaauauaaaaa

SEQ ID NO: 1793939 - RNA, 12 nt, Salmonella enterica enterica serovar Typhi Ty2
aaaaauccagua

SEQ ID NO: 1793940 - RNA, 15 nt, Salmonella enterica enterica serovar Typhi Ty2
aaaaauccccccucc

SEQ ID NO: 1793941 - RNA, 16 nt, Salmonella enterica enterica serovar Typhi Ty2
aaaaauuaaaaauacc

SEQ ID NO: 1793942 - RNA, 14 nt, Salmonella enterica enterica serovar Typhi Ty2
aaaaauuaaaaaua

SEQ ID NO: 1793943 - RNA, 12 nt, Salmonella enterica enterica serovar Typhi Ty2
aaaaauuaaaaa

SEQ ID NO: 1793944 - RNA, 14 nt, Salmonella enterica enterica serovar Typhi Ty2
aaaaauccggauca

SEQ ID NO: 1793945 - RNA, 12 nt, Salmonella enterica enterica serovar Typhi Ty2
aaaaauuucgaa

SEQ ID NO: 1793946 - RNA, 14 nt, Salmonella enterica enterica serovar Typhi Ty2
aaaacaagcaguau

SEQ ID NO: 1793947 - RNA, 13 nt, Salmonella enterica enterica serovar Typhi Ty2
aaaacagcauaau

SEQ ID NO: 1793948 - RNA, 20 nt, Salmonella enterica enterica serovar Typhi Ty2
aaaacaucgcugauauuguu

SEQ ID NO: 1793949 - RNA, 17 nt, Salmonella enterica enterica serovar Typhi Ty2
aaaacauuccugacauu

SEQ ID NO: 1793950 - RNA, 22 nt, Salmonella enterica enterica serovar Typhi Ty2
aaaacagaaccccaucgccuga

SEQ ID NO: 1793951 - RNA, 16 nt, Salmonella enterica enterica serovar Typhi Ty2
aaaagagagcgccaaa

SEQ ID NO: 1793952 - RNA, 21 nt, Salmonella enterica enterica serovar Typhi Ty2
aaaagaauagccggauaaaau

SEQ ID NO: 1793953 - RNA, 15 nt, Salmonella enterica enterica serovar Typhi Ty2
aaaagaacaauaauc

SEQ ID NO: 1793954 - RNA, 15 nt, Salmonella enterica enterica serovar Typhi Ty2
aaaagaacucacuca

SEQ ID NO: 1793955 - RNA, 11 nt, Salmonella enterica enterica serovar Typhi Ty2
aaaagaaaaca

SEQ ID NO: 1793956 - RNA, 15 nt, Salmonella enterica enterica serovar Typhi Ty2
aaaagaaaaaaguga

SEQ ID NO: 1793957 - RNA, 20 nt, Salmonella enterica enterica serovar Typhi Ty2
aaaagaaaaaacuuauuucu

SEQ ID NO: 1793958 - RNA, 11 nt, Salmonella enterica enterica serovar Typhi Ty2
aaaagaaacug

SEQ ID NO: 1793959 - RNA, 17 nt, Salmonella enterica enterica serovar Typhi Ty2
aaaagauauuauaaaau

SEQ ID NO: 1793960 - RNA, 15 nt, Salmonella enterica enterica serovar Typhi Ty2
aaaagauaaaaaaau

SEQ ID NO: 1793961 - RNA, 15 nt, Salmonella enterica enterica serovar Typhi Ty2
aaaagaguaaaguua

SEQ ID NO: 1793962 - RNA, 13 nt, Salmonella enterica enterica serovar Typhi Ty2
aaaagcaauaauc

SEQ ID NO: 1793963 - RNA, 21 nt, Salmonella enterica enterica serovar Typhi Ty2
aaaagcacaucagcaaaugaa

SEQ ID NO: 1793964 - RNA, 17 nt, Salmonella enterica enterica serovar Typhi Ty2
aaaagcagaggccugaa

SEQ ID NO: 1793965 - RNA, 17 nt, Salmonella enterica enterica serovar Typhi Ty2
aaaacggcuaccgucau

SEQ ID NO: 1793966 - RNA, 13 nt, Salmonella enterica enterica serovar Typhi Ty2
aaaacgguuuuca

SEQ ID NO: 1793967 - RNA, 21 nt, Salmonella enterica enterica serovar Typhi Ty2
aaaacguuugcaaauagguuu

SEQ ID NO: 1793968 - RNA, 20 nt, Salmonella enterica enterica serovar Typhi Ty2
aaaacguugacuuaaaaagc

SEQ ID NO: 1793969 - RNA, 15 nt, Salmonella enterica enterica serovar Typhi Ty2
aaaacuaauccucuu

SEQ ID NO: 1793970 - RNA, 12 nt, Salmonella enterica enterica serovar Typhi Ty2
aaaagaaaaaac

SEQ ID NO: 1793971 - RNA, 18 nt, Salmonella enterica enterica serovar Typhi Ty2
aaaacuuuaacacuaacu

SEQ ID NO: 1793972 - RNA, 22 nt, Salmonella enterica enterica serovar Typhi Ty2
aaaacuuauuuuauuuuuauau

SEQ ID NO: 1793973 - RNA, 13 nt, Salmonella enterica enterica serovar Typhi Ty2
aaaacucaggaaa

SEQ ID NO: 1793974 - RNA, 16 nt, Salmonella enterica enterica serovar Typhi Ty2
aaaagccgugaauaaa

SEQ ID NO: 1793975 - RNA, 14 nt, Salmonella enterica enterica serovar Typhi Ty2
aaaagcgaaaauaa

SEQ ID NO: 1793976 - RNA, 18 nt, Salmonella enterica enterica serovar Typhi Ty2
aaaagccugcacauugca

SEQ ID NO: 1793977 - RNA, 22 nt, Salmonella enterica enterica serovar Typhi Ty2
aaaagccagcacggcuucacgu

SEQ ID NO: 1793978 - RNA, 18 nt, Salmonella enterica enterica serovar Typhi Ty2
aaaagcaucguaccuuca

SEQ ID NO: 1793979 - RNA, 23 nt, Salmonella enterica enterica serovar Typhi Ty2
aaaagucacuuacuuucuugcca

SEQ ID NO: 1793980 - RNA, 15 nt, Salmonella enterica enterica serovar Typhi Ty2
aaaauaaaaaaggca

SEQ ID NO: 1793981 - RNA, 20 nt, Salmonella enterica enterica serovar Typhi Ty2
aaaaguguguaccagcagcg

SEQ ID NO: 1793982 - RNA, 21 nt, Salmonella enterica enterica serovar Typhi Ty2
aaaagugcgcacucagaaaau

SEQ ID NO: 1793983 - RNA, 13 nt, Salmonella enterica enterica serovar Typhi Ty2
aaaauaauaaaaa

SEQ ID NO: 1793984 - RNA, 13 nt, Salmonella enterica enterica serovar Typhi Ty2
aaaauaauaggua

SEQ ID NO: 1793985 - RNA, 18 nt, Salmonella enterica enterica serovar Typhi Ty2
aaaauaaacacuaaauca

SEQ ID NO: 1793986 - RNA, 18 nt, Salmonella enterica enterica serovar Typhi Ty2
aaaauaaaauuauauucu

SEQ ID NO: 1793987 - RNA, 10 nt, Salmonella enterica enterica serovar Typhi Ty2
aaaauagcgg

SEQ ID NO: 1793988 - RNA, 22 nt, Salmonella enterica enterica serovar Typhi Ty2
aaaauagugcggccaaauugcu

SEQ ID NO: 1793989 - RNA, 23 nt, Salmonella enterica enterica serovar Typhi Ty2
aaaauagccgaaacuuauacuga

SEQ ID NO: 1793990 - RNA, 21 nt, Salmonella enterica enterica serovar Typhi Ty2
aaaauagcccggcuucccauc

SEQ ID NO: 1793991 - RNA, 22 nt, Salmonella enterica enterica serovar Typhi Ty2
aaaauagccagaaugccagcgc

SEQ ID NO: 1793992 - RNA, 14 nt, Salmonella enterica enterica serovar Typhi Ty2
aaaauaccggcagc

SEQ ID NO: 1793993 - RNA, 16 nt, Salmonella enterica enterica serovar Typhi Ty2
aaaauaccgcacauca

SEQ ID NO: 1793994 - RNA, 15 nt, Salmonella enterica enterica serovar Typhi Ty2
aaaauaccccagcgc

SEQ ID NO: 1793995 - RNA, 14 nt, Salmonella enterica enterica serovar Typhi Ty2
aaaauaauugauaa

SEQ ID NO: 1793996 - RNA, 17 nt, Salmonella enterica enterica serovar Typhi Ty2
aaaauccccaccugacu

SEQ ID NO: 1793997 - RNA, 23 nt, Salmonella enterica enterica serovar Typhi Ty2
aaaauccucuaccggaaaacagc

SEQ ID NO: 1793998 - RNA, 19 nt, Salmonella enterica enterica serovar Typhi Ty2
aaaauccggaucaucuuuu

SEQ ID NO: 1793999 - RNA, 23 nt, Salmonella enterica enterica serovar Typhi Ty2
aaaaucacgcuggauaagacgac

SEQ ID NO: 1794000 - RNA, 15 nt, Salmonella enterica enterica serovar Typhi Ty2
aaaaucacuccccga

SEQ ID NO: 1794001 - RNA, 23 nt, Salmonella enterica enterica serovar Typhi Ty2
aaaauauacaccugacggcagcc

SEQ ID NO: 1794002 - RNA, 13 nt, Salmonella enterica enterica serovar Typhi Ty2
aaaaucaccacac

SEQ ID NO: 1794003 - RNA, 13 nt, Salmonella enterica enterica serovar Typhi Ty2
aaacaacauaucg

SEQ ID NO: 1794004 - RNA, 18 nt, Salmonella enterica enterica serovar Typhi Ty2
aaaauuuugcauaaauaa

SEQ ID NO: 1794005 - RNA, 15 nt, Salmonella enterica enterica serovar Typhi Ty2
aaaauucagacucaa

SEQ ID NO: 1794006 - RNA, 16 nt, Salmonella enterica enterica serovar Typhi Ty2
aaaaucgucaucagau

SEQ ID NO: 1794007 - RNA, 16 nt, Salmonella enterica enterica serovar Typhi Ty2
aaaaugaugcaacaug

SEQ ID NO: 1794008 - RNA, 22 nt, Salmonella enterica enterica serovar Typhi Ty2
aaaauccuuuuucaugcaauaa

SEQ ID NO: 1794009 - RNA, 18 nt, Salmonella enterica enterica serovar Typhi Ty2
aaaauccuucuuccauuc

SEQ ID NO: 1794010 - RNA, 22 nt, Salmonella enterica enterica serovar Typhi Ty2
aaaaucggggucuuccagcaga

SEQ ID NO: 1794011 - RNA, 19 nt, Salmonella enterica enterica serovar Typhi Ty2
aaaaucgcgcuuuauguuu

SEQ ID NO: 1794012 - RNA, 16 nt, Salmonella enterica enterica serovar Typhi Ty2
aaaauucaaaaaagca

SEQ ID NO: 1794013 - RNA, 19 nt, Salmonella enterica enterica serovar Typhi Ty2
aaaauuauuuuuacuuaaa

SEQ ID NO: 1794014 - RNA, 22 nt, Salmonella enterica enterica serovar Typhi Ty2
aaaauuauuuuuacuuaaaauu

SEQ ID NO: 1794015 - RNA, 20 nt, Salmonella enterica enterica serovar Typhi Ty2
aaaauuauuggcuuuguaaa

SEQ ID NO: 1794016 - RNA, 16 nt, Salmonella enterica enterica serovar Typhi Ty2
aaaauggaaaauaaua

SEQ ID NO: 1794017 - RNA, 19 nt, Salmonella enterica enterica serovar Typhi Ty2
aaaaugcgccaggaaacuc

SEQ ID NO: 1794018 - RNA, 14 nt, Salmonella enterica enterica serovar Typhi Ty2
aaaaugcgcaugau

SEQ ID NO: 1794019 - RNA, 13 nt, Salmonella enterica enterica serovar Typhi Ty2
aaaaugcacauua

SEQ ID NO: 1794020 - RNA, 18 nt, Salmonella enterica enterica serovar Typhi Ty2
aaaaugcauugauaggcu

SEQ ID NO: 1794021 - RNA, 16 nt, Salmonella enterica enterica serovar Typhi Ty2
aaaugcgcuuugauag

SEQ ID NO: 1794022 - RNA, 19 nt, Salmonella enterica enterica serovar Typhi Ty2
aaaugcguggcauuaacaa

SEQ ID NO: 1794023 - RNA, 20 nt, Salmonella enterica enterica serovar Typhi Ty2
aaaugcguggcauuaacaaa

SEQ ID NO: 1794024 - RNA, 15 nt, Salmonella enterica enterica serovar Typhi Ty2
aaaugcuuaucugau

SEQ ID NO: 1794025 - RNA, 18 nt, Salmonella enterica enterica serovar Typhi Ty2
aaaugcuugcuuuagcuu

SEQ ID NO: 1794026 - RNA, 13 nt, Salmonella enterica enterica serovar Typhi Ty2
aaaugcugggcuu

SEQ ID NO: 1794027 - RNA, 22 nt, Salmonella enterica enterica serovar Typhi Ty2
aaaugccugccguuuuuaacgc

SEQ ID NO: 1794028 - RNA, 16 nt, Salmonella enterica enterica serovar Typhi Ty2
aaaugcccgucucauu

SEQ ID NO: 1794029 - RNA, 18 nt, Salmonella enterica enterica serovar Typhi Ty2
aaaugcccgucucauuuc

SEQ ID NO: 1794030 - RNA, 15 nt, Salmonella enterica enterica serovar Typhi Ty2
aaaugcgaaaaaaag

SEQ ID NO: 1794031 - RNA, 14 nt, Salmonella enterica enterica serovar Typhi Ty2
aaaugccugugcca

SEQ ID NO: 1794032 - RNA, 16 nt, Salmonella enterica enterica serovar Typhi Ty2
aaaugcgcaaagcaua

SEQ ID NO: 1794033 - RNA, 13 nt, Salmonella enterica enterica serovar Typhi Ty2
aaaucuuccaguu

SEQ ID NO: 1794034 - RNA, 21 nt, Salmonella enterica enterica serovar Typhi Ty2
aaaucuucggcaaaauauuca

SEQ ID NO: 1794035 - RNA, 13 nt, Salmonella enterica enterica serovar Typhi Ty2
aaaugauguguuu

SEQ ID NO: 1794036 - RNA, 23 nt, Salmonella enterica enterica serovar Typhi Ty2
aaaugaugacucauuaaaaaaac

SEQ ID NO: 1794037 - RNA, 19 nt, Salmonella enterica enterica serovar Typhi Ty2
aaaucgcgcaaauauuaca

SEQ ID NO: 1794038 - RNA, 14 nt, Salmonella enterica enterica serovar Typhi Ty2
aaaucguucgcgga

SEQ ID NO: 1794039 - RNA, 20 nt, Salmonella enterica enterica serovar Typhi Ty2
aaaucuggugauaaagcaga

SEQ ID NO: 1794040 - RNA, 13 nt, Salmonella enterica enterica serovar Typhi Ty2
aaaucgcgagccu

SEQ ID NO: 1794041 - RNA, 19 nt, Salmonella enterica enterica serovar Typhi Ty2
aaaucgccucauucgggca

SEQ ID NO: 1794042 - RNA, 16 nt, Salmonella enterica enterica serovar Typhi Ty2
aaaucgcccaggccug

SEQ ID NO: 1794043 - RNA, 20 nt, Salmonella enterica enterica serovar Typhi Ty2
aaaucauuuguacaaaaaau

SEQ ID NO: 1794044 - RNA, 16 nt, Salmonella enterica enterica serovar Typhi Ty2
aaaucauuacuuauau

SEQ ID NO: 1794045 - RNA, 13 nt, Salmonella enterica enterica serovar Typhi Ty2
aaaucaucaucag

SEQ ID NO: 1794046 - RNA, 23 nt, Salmonella enterica enterica serovar Typhi Ty2
aaaucaucgcgcugauauuuuua

SEQ ID NO: 1794047 - RNA, 19 nt, Salmonella enterica enterica serovar Typhi Ty2
aaaaagccucugauuucga

SEQ ID NO: 1794048 - RNA, 21 nt, Salmonella enterica enterica serovar Typhi Ty2
aaaaagccggcggaaaaaagc

SEQ ID NO: 1794049 - RNA, 19 nt, Salmonella enterica enterica serovar Typhi Ty2
aaaaagccggcggaaaaaa

SEQ ID NO: 1794050 - RNA, 20 nt, Salmonella enterica enterica serovar Typhi Ty2
aaaaagccggcggaaaaaag

SEQ ID NO: 1794051 - RNA, 18 nt, Salmonella enterica enterica serovar Typhi Ty2
aaaaagccaaaaggcgcc

SEQ ID NO: 1794052 - RNA, 20 nt, Salmonella enterica enterica serovar Typhi Ty2
aaaaagccacgcaagcagca

SEQ ID NO: 1794053 - RNA, 21 nt, Salmonella enterica enterica serovar Typhi Ty2
aaaaagccacgcaagcagcac

SEQ ID NO: 1794054 - RNA, 23 nt, Salmonella enterica enterica serovar Typhi Ty2
aaaaagcuccggacgcaccagcc

SEQ ID NO: 1794055 - RNA, 11 nt, Salmonella enterica enterica serovar Typhi Ty2
aaaaagcugcg

SEQ ID NO: 1794056 - RNA, 24 nt, Salmonella enterica enterica serovar Typhi Ty2
aaaaagccugcacauugcaggcuu

SEQ ID NO: 1794057 - RNA, 10 nt, Salmonella enterica enterica serovar Typhi Ty2
aaaaaggaca

SEQ ID NO: 1794058 - RNA, 20 nt, Salmonella enterica enterica serovar Typhi Ty2
aaaaaggcgaacuccagcgc

SEQ ID NO: 1794059 - RNA, 15 nt, Salmonella enterica enterica serovar Typhi Ty2
aaaaaggcagaagaa

SEQ ID NO: 1794060 - RNA, 15 nt, Salmonella enterica enterica serovar Typhi Ty2
aaauuaaauccugaa

SEQ ID NO: 1794061 - RNA, 19 nt, Salmonella enterica enterica serovar Typhi Ty2
aaauuaaauaacaaaugaa

SEQ ID NO: 1794062 - RNA, 13 nt, Salmonella enterica enterica serovar Typhi Ty2
aaauggaucgaca

SEQ ID NO: 1794063 - RNA, 22 nt, Salmonella enterica enterica serovar Typhi Ty2
aaauggaaaauaauaaucguuu

SEQ ID NO: 1794064 - RNA, 18 nt, Salmonella enterica enterica serovar Typhi Ty2
aaauuacgccauaaaaag

SEQ ID NO: 1794065 - RNA, 23 nt, Salmonella enterica enterica serovar Typhi Ty2
aaauuauuccuugaucaggaaau

SEQ ID NO: 1794066 - RNA, 21 nt, Salmonella enterica enterica serovar Typhi Ty2
aaauucacuuccgucauguag

SEQ ID NO: 1794067 - RNA, 14 nt, Salmonella enterica enterica serovar Typhi Ty2
aaauucaggguugu

SEQ ID NO: 1794068 - RNA, 20 nt, Salmonella enterica enterica serovar Typhi Ty2
aaauucaaugagaaaguggu

SEQ ID NO: 1794069 - RNA, 20 nt, Salmonella enterica enterica serovar Typhi Ty2
aaauucacccguuauucauu

SEQ ID NO: 1794070 - RNA, 16 nt, Salmonella enterica enterica serovar Typhi Ty2
aaauucacaccaaugu

SEQ ID NO: 1794071 - RNA, 21 nt, Salmonella enterica enterica serovar Typhi Ty2
aaauuccuuccggcgcaauaa

SEQ ID NO: 1794072 - RNA, 16 nt, Salmonella enterica enterica serovar Typhi Ty2
aaauuccuggauuaaa

SEQ ID NO: 1794073 - RNA, 19 nt, Salmonella enterica enterica serovar Typhi Ty2
aaauucggcguuacccguc

SEQ ID NO: 1794074 - RNA, 19 nt, Salmonella enterica enterica serovar Typhi Ty2
aaauucgcuaauccccccu

SEQ ID NO: 1794075 - RNA, 21 nt, Salmonella enterica enterica serovar Typhi Ty2
aaauaaggcugcgcguuuuca

SEQ ID NO: 1794076 - RNA, 13 nt, Salmonella enterica enterica serovar Typhi Ty2
aaauaacuuuuaa

SEQ ID NO: 1794077 - RNA, 19 nt, Salmonella enterica enterica serovar Typhi Ty2
aaauaauaaucguuuuaug

SEQ ID NO: 1794078 - RNA, 20 nt, Salmonella enterica enterica serovar Typhi Ty2
aaauaacuuuuaauuuuuau

SEQ ID NO: 1794079 - RNA, 16 nt, Salmonella enterica enterica serovar Typhi Ty2
aaauaacuuuuaauuu

SEQ ID NO: 1794080 - RNA, 18 nt, Salmonella enterica enterica serovar Typhi Ty2
aaauaacucuggaucagu

SEQ ID NO: 1794081 - RNA, 21 nt, Salmonella enterica enterica serovar Typhi Ty2
aaauaacgccuuucaccauuc

SEQ ID NO: 1794082 - RNA, 19 nt, Salmonella enterica enterica serovar Typhi Ty2
aaauaacgcgauaaucccc

SEQ ID NO: 1794083 - RNA, 21 nt, Salmonella enterica enterica serovar Typhi Ty2
aaauaacaggaaucauucuau

SEQ ID NO: 1794084 - RNA, 14 nt, Salmonella enterica enterica serovar Typhi Ty2
aaauaacagacgaa

SEQ ID NO: 1794085 - RNA, 21 nt, Salmonella enterica enterica serovar Typhi Ty2
aaauaaacgcuugacucugaa

SEQ ID NO: 1794086 - RNA, 12 nt, Salmonella enterica enterica serovar Typhi Ty2
aaauaaaauacg

SEQ ID NO: 1794087 - RNA, 13 nt, Salmonella enterica enterica serovar Typhi Ty2
aaauaaaauuaua

SEQ ID NO: 1794088 - RNA, 18 nt, Salmonella enterica enterica serovar Typhi Ty2
aaauagcccuaauaggau

SEQ ID NO: 1794089 - RNA, 17 nt, Salmonella enterica enterica serovar Typhi Ty2
aaauagccagaaugcca

SEQ ID NO: 1794090 - RNA, 20 nt, Salmonella enterica enterica serovar Typhi Ty2
aaauagccgaaacuuauacu

SEQ ID NO: 1794091 - RNA, 14 nt, Salmonella enterica enterica serovar Typhi Ty2
aaauaggagaugca

SEQ ID NO: 1794092 - RNA, 14 nt, Salmonella enterica enterica serovar Typhi Ty2
aaauagcuggcugu

SEQ ID NO: 1794093 - RNA, 17 nt, Salmonella enterica enterica serovar Typhi Ty2
aaauagcgguucaauca

SEQ ID NO: 1794094 - RNA, 19 nt, Salmonella enterica enterica serovar Typhi Ty2
aaauagcgccagacagaua

SEQ ID NO: 1794095 - RNA, 18 nt, Salmonella enterica enterica serovar Typhi Ty2
aaauagccguuaccgccg

SEQ ID NO: 1794096 - RNA, 17 nt, Salmonella enterica enterica serovar Typhi Ty2
aaauacggaccuggcgu

SEQ ID NO: 1794097 - RNA, 15 nt, Salmonella enterica enterica serovar Typhi Ty2
aaauacgcugcggcc

SEQ ID NO: 1794098 - RNA, 16 nt, Salmonella enterica enterica serovar Typhi Ty2
aaauacgcucaauaua

SEQ ID NO: 1794099 - RNA, 15 nt, Salmonella enterica enterica serovar Typhi Ty2
aaauacgccagauaa

SEQ ID NO: 1794100 - RNA, 12 nt, Salmonella enterica enterica serovar Typhi Ty2
aaauaauaccac

SEQ ID NO: 1794101 - RNA, 22 nt, Salmonella enterica enterica serovar Typhi Ty2
aaauaauagguacggggcaucu

SEQ ID NO: 1794102 - RNA, 14 nt, Salmonella enterica enterica serovar Typhi Ty2
aaauauuucuuugu

SEQ ID NO: 1794103 - RNA, 18 nt, Salmonella enterica enterica serovar Typhi Ty2
aaaucaaagaccuccgcc

SEQ ID NO: 1794104 - RNA, 15 nt, Salmonella enterica enterica serovar Typhi Ty2
aaaucaaacagaaua

SEQ ID NO: 1794105 - RNA, 12 nt, Salmonella enterica enterica serovar Typhi Ty2
aaaucaaaaagu

SEQ ID NO: 1794106 - RNA, 22 nt, Salmonella enterica enterica serovar Typhi Ty2
aaauauugagguauaggaaaau

SEQ ID NO: 1794107 - RNA, 20 nt, Salmonella enterica enterica serovar Typhi Ty2
aaauauugauuaaucgucau

SEQ ID NO: 1794108 - RNA, 18 nt, Salmonella enterica enterica serovar Typhi Ty2
aaauauuggcggcaaaga

SEQ ID NO: 1794109 - RNA, 16 nt, Salmonella enterica enterica serovar Typhi Ty2
aaauaugaaagagaaa

SEQ ID NO: 1794110 - RNA, 17 nt, Salmonella enterica enterica serovar Typhi Ty2
aaauaugcggagccucu

SEQ ID NO: 1794111 - RNA, 19 nt, Salmonella enterica enterica serovar Typhi Ty2
aaauaguaaauagaaaaua

SEQ ID NO: 1794112 - RNA, 20 nt, Salmonella enterica enterica serovar Typhi Ty2
aaauaggcgaggaaaacauu

SEQ ID NO: 1794113 - RNA, 22 nt, Salmonella enterica enterica serovar Typhi Ty2
aaaucacagggggaacauuuaa

SEQ ID NO: 1794114 - RNA, 16 nt, Salmonella enterica enterica serovar Typhi Ty2
aaaucacaucgccgga

SEQ ID NO: 1794115 - RNA, 19 nt, Salmonella enterica enterica serovar Typhi Ty2
aaaucaacauuauuaaaau

SEQ ID NO: 1794116 - RNA, 22 nt, Salmonella enterica enterica serovar Typhi Ty2
aaaucaacgcucagaccgaucu

SEQ ID NO: 1794117 - RNA, 18 nt, Salmonella enterica enterica serovar Typhi Ty2
aaaucaacauuauuaaaa

SEQ ID NO: 1794118 - RNA, 18 nt, Salmonella enterica enterica serovar Typhi Ty2
aaaucacuaagaccagca

SEQ ID NO: 1794119 - RNA, 20 nt, Salmonella enterica enterica serovar Typhi Ty2
aaaucacuaagaccagcauc

SEQ ID NO: 1794120 - RNA, 18 nt, Salmonella enterica enterica serovar Typhi Ty2
aaaucacguuuacuaaaa

SEQ ID NO: 1794121 - RNA, 20 nt, Salmonella enterica enterica serovar Typhi Ty2
aaaucagcaaaaacauuacc

SEQ ID NO: 1794122 - RNA, 21 nt, Salmonella enterica enterica serovar Typhi Ty2
aaaucagcaaucguuggcgua

SEQ ID NO: 1794123 - RNA, 14 nt, Salmonella enterica enterica serovar Typhi Ty2
aaaucagcauuacc

SEQ ID NO: 1794124 - RNA, 21 nt, Salmonella enterica enterica serovar Typhi Ty2
aaaucacuggagcgcauuuua

SEQ ID NO: 1794125 - RNA, 13 nt, Salmonella enterica enterica serovar Typhi Ty2
aaaucauaccagc

SEQ ID NO: 1794126 - RNA, 15 nt, Salmonella enterica enterica serovar Typhi Ty2
aaaucaggaaaaagg

SEQ ID NO: 1794127 - RNA, 16 nt, Salmonella enterica enterica serovar Typhi Ty2
aaaucagcauuacccc

SEQ ID NO: 1794128 - RNA, 21 nt, Salmonella enterica enterica serovar Typhi Ty2
aaaucagcccggacaucaucc

SEQ ID NO: 1794129 - RNA, 20 nt, Salmonella enterica enterica serovar Typhi Ty2
aaagucacuuacuuucuugc

SEQ ID NO: 1794130 - RNA, 20 nt, Salmonella enterica enterica serovar Typhi Ty2
aaagucaacugcucuaccaa

SEQ ID NO: 1794131 - RNA, 17 nt, Salmonella enterica enterica serovar Typhi Ty2
aaaguaccaaaacagaa

SEQ ID NO: 1794132 - RNA, 19 nt, Salmonella enterica enterica serovar Typhi Ty2
aaaguaccaaaacagaaaa

SEQ ID NO: 1794133 - RNA, 16 nt, Salmonella enterica enterica serovar Typhi Ty2
aaaguacuucacaauc

SEQ ID NO: 1794134 - RNA, 16 nt, Salmonella enterica enterica serovar Typhi Ty2
aaagggaaaagccauu

SEQ ID NO: 1794135 - RNA, 16 nt, Salmonella enterica enterica serovar Typhi Ty2
aaaggccuggcugaga

SEQ ID NO: 1794136 - RNA, 18 nt, Salmonella enterica enterica serovar Typhi Ty2
aaaggggagcccaguagc

SEQ ID NO: 1794137 - RNA, 22 nt, Salmonella enterica enterica serovar Typhi Ty2
aaaggggagucgguacuccccu

SEQ ID NO: 1794138 - RNA, 18 nt, Salmonella enterica enterica serovar Typhi Ty2
aaaggggaucguguaaca

SEQ ID NO: 1794139 - RNA, 22 nt, Salmonella enterica enterica serovar Typhi Ty2
aaaggggccugcacaauaccaa

SEQ ID NO: 1794140 - RNA, 19 nt, Salmonella enterica enterica serovar Typhi Ty2
aaaggggggcuagcugugg

SEQ ID NO: 1794141 - RNA, 14 nt, Salmonella enterica enterica serovar Typhi Ty2
aaagcccgcccagc

SEQ ID NO: 1794142 - RNA, 14 nt, Salmonella enterica enterica serovar Typhi Ty2
aaagccccggcuca

SEQ ID NO: 1794143 - RNA, 13 nt, Salmonella enterica enterica serovar Typhi Ty2
aaagccgaccugg

SEQ ID NO: 1794144 - RNA, 20 nt, Salmonella enterica enterica serovar Typhi Ty2
aaagccgccauccggcauuu

SEQ ID NO: 1794145 - RNA, 18 nt, Salmonella enterica enterica serovar Typhi Ty2
aaagccgaugacaucuca

SEQ ID NO: 1794146 - RNA, 18 nt, Salmonella enterica enterica serovar Typhi Ty2
aaagccgguuuucguuaa

SEQ ID NO: 1794147 - RNA, 19 nt, Salmonella enterica enterica serovar Typhi Ty2
aaaggacguucuucuccca

SEQ ID NO: 1794148 - RNA, 13 nt, Salmonella enterica enterica serovar Typhi Ty2
aaaggcagaagaa

SEQ ID NO: 1794149 - RNA, 20 nt, Salmonella enterica enterica serovar Typhi Ty2
aaagcugguauugaauauuu

SEQ ID NO: 1794150 - RNA, 13 nt, Salmonella enterica enterica serovar Typhi Ty2
aaagcuguagcau

SEQ ID NO: 1794151 - RNA, 22 nt, Salmonella enterica enterica serovar Typhi Ty2
aaagcuggccuucagguuuuua

SEQ ID NO: 1794152 - RNA, 20 nt, Salmonella enterica enterica serovar Typhi Ty2
aaagcuggauaucacgcgcg

SEQ ID NO: 1794153 - RNA, 19 nt, Salmonella enterica enterica serovar Typhi Ty2
aaagcugguauugaauauu

SEQ ID NO: 1794154 - RNA, 15 nt, Salmonella enterica enterica serovar Typhi Ty2
aaagauaaucugaau

SEQ ID NO: 1794155 - RNA, 15 nt, Salmonella enterica enterica serovar Typhi Ty2
aaagaucauuccuga

SEQ ID NO: 1794156 - RNA, 17 nt, Salmonella enterica enterica serovar Typhi Ty2
aaagcacggguagcuag

SEQ ID NO: 1794157 - RNA, 16 nt, Salmonella enterica enterica serovar Typhi Ty2
aaagcagaggucugca

SEQ ID NO: 1794158 - RNA, 17 nt, Salmonella enterica enterica serovar Typhi Ty2
aaagccagauaaagcag

SEQ ID NO: 1794159 - RNA, 15 nt, Salmonella enterica enterica serovar Typhi Ty2
aaagccaggccgcca

SEQ ID NO: 1794160 - RNA, 15 nt, Salmonella enterica enterica serovar Typhi Ty2
aaagccaguuucucu

SEQ ID NO: 1794161 - RNA, 16 nt, Salmonella enterica enterica serovar Typhi Ty2
aaagccaucaauccau

SEQ ID NO: 1794162 - RNA, 20 nt, Salmonella enterica enterica serovar Typhi Ty2
aaagacuacuuuaucgaaug

SEQ ID NO: 1794163 - RNA, 16 nt, Salmonella enterica enterica serovar Typhi Ty2
aaagaccuccgcccgg

SEQ ID NO: 1794164 - RNA, 12 nt, Salmonella enterica enterica serovar Typhi Ty2
aaacuuuuaaau

SEQ ID NO: 1794165 - RNA, 19 nt, Salmonella enterica enterica serovar Typhi Ty2
aaagaaguggacuuccauu

SEQ ID NO: 1794166 - RNA, 13 nt, Salmonella enterica enterica serovar Typhi Ty2
aaagaagggcagg

SEQ ID NO: 1794167 - RNA, 23 nt, Salmonella enterica enterica serovar Typhi Ty2
aaagacuuugaugcggaagagaa

SEQ ID NO: 1794168 - RNA, 23 nt, Salmonella enterica enterica serovar Typhi Ty2
aaagagaacgacgcauaaaaaau

SEQ ID NO: 1794169 - RNA, 17 nt, Salmonella enterica enterica serovar Typhi Ty2
aaagagagcgccaaaaa

SEQ ID NO: 1794170 - RNA, 20 nt, Salmonella enterica enterica serovar Typhi Ty2
aaagagacagaaucaggcca

SEQ ID NO: 1794171 - RNA, 22 nt, Salmonella enterica enterica serovar Typhi Ty2
aaagauaaccauuucaaacguu

SEQ ID NO: 1794172 - RNA, 22 nt, Salmonella enterica enterica serovar Typhi Ty2
aaacuuccacacggcauucacg

SEQ ID NO: 1794173 - RNA, 14 nt, Salmonella enterica enterica serovar Typhi Ty2
aaacugauacugga

SEQ ID NO: 1794174 - RNA, 21 nt, Salmonella enterica enterica serovar Typhi Ty2
aaacugauaguuuaaauccag

SEQ ID NO: 1794175 - RNA, 15 nt, Salmonella enterica enterica serovar Typhi Ty2
aaacuggccacagca

SEQ ID NO: 1794176 - RNA, 15 nt, Salmonella enterica enterica serovar Typhi Ty2
aaacugcugccgcag

SEQ ID NO: 1794177 - RNA, 23 nt, Salmonella enterica enterica serovar Typhi Ty2
aaacucacguuccccagcaccga

SEQ ID NO: 1794178 - RNA, 13 nt, Salmonella enterica enterica serovar Typhi Ty2
aaacucagcaaua

SEQ ID NO: 1794179 - RNA, 22 nt, Salmonella enterica enterica serovar Typhi Ty2
aaacucccgcacgcuggcauca

SEQ ID NO: 1794180 - RNA, 16 nt, Salmonella enterica enterica serovar Typhi Ty2
aaacuccaccugaucg

SEQ ID NO: 1794181 - RNA, 19 nt, Salmonella enterica enterica serovar Typhi Ty2
aaacuccuccgggaaaaca

SEQ ID NO: 1794182 - RNA, 19 nt, Salmonella enterica enterica serovar Typhi Ty2
aaacucgacacacucaucu

SEQ ID NO: 1794183 - RNA, 15 nt, Salmonella enterica enterica serovar Typhi Ty2
aaacuccgcgcuggc

SEQ ID NO: 1794184 - RNA, 21 nt, Salmonella enterica enterica serovar Typhi Ty2
aaacucuuuuucaauaaacgg

SEQ ID NO: 1794185 - RNA, 22 nt, Salmonella enterica enterica serovar Typhi Ty2
aaacugacaucccccucuugcc

SEQ ID NO: 1794186 - RNA, 23 nt, Salmonella enterica enterica serovar Typhi Ty2
aaacuauuucaacccggcauuuc

SEQ ID NO: 1794187 - RNA, 19 nt, Salmonella enterica enterica serovar Typhi Ty2
aaacuauuuuuagcccuug

SEQ ID NO: 1794188 - RNA, 14 nt, Salmonella enterica enterica serovar Typhi Ty2
aaacucaaucaggc

SEQ ID NO: 1794189 - RNA, 17 nt, Salmonella enterica enterica serovar Typhi Ty2
aaacuaauccucuucuc

SEQ ID NO: 1794190 - RNA, 23 nt, Salmonella enterica enterica serovar Typhi Ty2
aaacuaauccucuucucugaaaa

SEQ ID NO: 1794191 - RNA, 18 nt, Salmonella enterica enterica serovar Typhi Ty2
aaacuaaguaaggaggaa

SEQ ID NO: 1794192 - RNA, 15 nt, Salmonella enterica enterica serovar Typhi Ty2
aaacgccgucacaaa

SEQ ID NO: 1794193 - RNA, 12 nt, Salmonella enterica enterica serovar Typhi Ty2
aaacgccuguaa

SEQ ID NO: 1794194 - RNA, 17 nt, Salmonella enterica enterica serovar Typhi Ty2
aaacgcggacauauuuu

SEQ ID NO: 1794195 - RNA, 15 nt, Salmonella enterica enterica serovar Typhi Ty2
aaacgcgcuaucaac

SEQ ID NO: 1794196 - RNA, 23 nt, Salmonella enterica enterica serovar Typhi Ty2
aaacgcgucuucaucagccagca

SEQ ID NO: 1794197 - RNA, 13 nt, Salmonella enterica enterica serovar Typhi Ty2
aaacgcugcgcaa

SEQ ID NO: 1794198 - RNA, 14 nt, Salmonella enterica enterica serovar Typhi Ty2
aaacggaucuucca

SEQ ID NO: 1794199 - RNA, 15 nt, Salmonella enterica enterica serovar Typhi Ty2
aaacggaucuuccac

SEQ ID NO: 1794200 - RNA, 17 nt, Salmonella enterica enterica serovar Typhi Ty2
aaacggccugcgcugga

SEQ ID NO: 1794201 - RNA, 23 nt, Salmonella enterica enterica serovar Typhi Ty2
aaacggcagccgccaccacaaag

SEQ ID NO: 1794202 - RNA, 12 nt, Salmonella enterica enterica serovar Typhi Ty2
aaacgcuuuuuu

SEQ ID NO: 1794203 - RNA, 14 nt, Salmonella enterica enterica serovar Typhi Ty2
aaacgggcgcggca

SEQ ID NO: 1794204 - RNA, 20 nt, Salmonella enterica enterica serovar Typhi Ty2
aaacggcuuuaauaccccug

SEQ ID NO: 1794205 - RNA, 21 nt, Salmonella enterica enterica serovar Typhi Ty2
aaacgugcggcggccucuuug

SEQ ID NO: 1794206 - RNA, 15 nt, Salmonella enterica enterica serovar Typhi Ty2
aaacgguaugaaaca

SEQ ID NO: 1794207 - RNA, 19 nt, Salmonella enterica enterica serovar Typhi Ty2
aaacguagcguucauuccc

SEQ ID NO: 1794208 - RNA, 18 nt, Salmonella enterica enterica serovar Typhi Ty2
aaacgucacaauacuucc

SEQ ID NO: 1794209 - RNA, 17 nt, Salmonella enterica enterica serovar Typhi Ty2
aaacgucguaaaaccug

SEQ ID NO: 1794210 - RNA, 16 nt, Salmonella enterica enterica serovar Typhi Ty2
aaacgucguaaaaccu

SEQ ID NO: 1794211 - RNA, 17 nt, Salmonella enterica enterica serovar Typhi Ty2
aaaccugguauuacaac

SEQ ID NO: 1794212 - RNA, 16 nt, Salmonella enterica enterica serovar Typhi Ty2
aaaccugagcauauaa

SEQ ID NO: 1794213 - RNA, 14 nt, Salmonella enterica enterica serovar Typhi Ty2
aaacaagccgccaa

SEQ ID NO: 1794214 - RNA, 23 nt, Salmonella enterica enterica serovar Typhi Ty2
aaaccuucgcuuuuaaaacuucc

SEQ ID NO: 1794215 - RNA, 15 nt, Salmonella enterica enterica serovar Typhi Ty2
aaaccuuucuucucu

SEQ ID NO: 1794216 - RNA, 21 nt, Salmonella enterica enterica serovar Typhi Ty2
aaacgagucagcguuacuggc

SEQ ID NO: 1794217 - RNA, 15 nt, Salmonella enterica enterica serovar Typhi Ty2
aaacgacgcguuuca

SEQ ID NO: 1794218 - RNA, 15 nt, Salmonella enterica enterica serovar Typhi Ty2
aaacgaauuuaaaua

SEQ ID NO: 1794219 - RNA, 22 nt, Salmonella enterica enterica serovar Typhi Ty2
aaacgagcgcaauaacaauaaa

SEQ ID NO: 1794220 - RNA, 15 nt, Salmonella enterica enterica serovar Typhi Ty2
aaacgacucaucagu

SEQ ID NO: 1794221 - RNA, 22 nt, Salmonella enterica enterica serovar Typhi Ty2
aaacgccgauggcgccagauac

SEQ ID NO: 1794222 - RNA, 16 nt, Salmonella enterica enterica serovar Typhi Ty2
aaacgccgcagaaaau

SEQ ID NO: 1794223 - RNA, 19 nt, Salmonella enterica enterica serovar Typhi Ty2
aaacgcccccagauagaac

SEQ ID NO: 1794224 - RNA, 17 nt, Salmonella enterica enterica serovar Typhi Ty2
auuuaauauaugaacca

SEQ ID NO: 1794225 - RNA, 13 nt, Salmonella enterica enterica serovar Typhi Ty2
auuuaauacauca

SEQ ID NO: 1794226 - RNA, 20 nt, Salmonella enterica enterica serovar Typhi Ty2
auuuaacgaguugaauaacg

SEQ ID NO: 1794227 - RNA, 13 nt, Salmonella enterica enterica serovar Typhi Ty2
auuuauaacguau

SEQ ID NO: 1794228 - RNA, 15 nt, Salmonella enterica enterica serovar Typhi Ty2
auuuauagagcagca

SEQ ID NO: 1794229 - RNA, 22 nt, Salmonella enterica enterica serovar Typhi Ty2
auuuaucuuccggcaucacauc

SEQ ID NO: 1794230 - RNA, 14 nt, Salmonella enterica enterica serovar Typhi Ty2
auuuaucugcguga

SEQ ID NO: 1794231 - RNA, 16 nt, Salmonella enterica enterica serovar Typhi Ty2
aaaaguauauaucccg

SEQ ID NO: 1794232 - RNA, 23 nt, Salmonella enterica enterica serovar Typhi Ty2
aaaaguaucucgccaguaaagac

SEQ ID NO: 1794233 - RNA, 16 nt, Salmonella enterica enterica serovar Typhi Ty2
auuuauauugugccuc

SEQ ID NO: 1794234 - RNA, 17 nt, Salmonella enterica enterica serovar Typhi Ty2
auuuaucaaucugcuuu

SEQ ID NO: 1794235 - RNA, 14 nt, Salmonella enterica enterica serovar Typhi Ty2
auuuaucaauaacc

SEQ ID NO: 1794236 - RNA, 14 nt, Salmonella enterica enterica serovar Typhi Ty2
auuuauccagcagg

SEQ ID NO: 1794237 - RNA, 16 nt, Salmonella enterica enterica serovar Typhi Ty2
auuuaucaauuuuuaa

SEQ ID NO: 1794238 - RNA, 23 nt, Salmonella enterica enterica serovar Typhi Ty2
auuuaucccguggugggguuccc

SEQ ID NO: 1794239 - RNA, 19 nt, Salmonella enterica enterica serovar Typhi Ty2
auuuaucccgugguggggu

SEQ ID NO: 1794240 - RNA, 13 nt, Salmonella enterica enterica serovar Typhi Ty2
auuuauccaguaa

SEQ ID NO: 1794241 - RNA, 20 nt, Salmonella enterica enterica serovar Typhi Ty2
auuuauccauguuuguuuaa

SEQ ID NO: 1794242 - RNA, 23 nt, Salmonella enterica enterica serovar Typhi Ty2
auuuauuugcauuguacuuuuaa

SEQ ID NO: 1794243 - RNA, 21 nt, Salmonella enterica enterica serovar Typhi Ty2
auuuauuugcauuguacuuuu

SEQ ID NO: 1794244 - RNA, 23 nt, Salmonella enterica enterica serovar Typhi Ty2
auuuauuuuuugggcgcuuagaa

SEQ ID NO: 1794245 - RNA, 18 nt, Salmonella enterica enterica serovar Typhi Ty2
auuuauuuugaauuuuua

SEQ ID NO: 1794246 - RNA, 19 nt, Salmonella enterica enterica serovar Typhi Ty2
auuuauuuugaauuuuuau

SEQ ID NO: 1794247 - RNA, 14 nt, Salmonella enterica enterica serovar Typhi Ty2
auuucaaucaucau

SEQ ID NO: 1794248 - RNA, 16 nt, Salmonella enterica enterica serovar Typhi Ty2
auuuauuagugagugc

SEQ ID NO: 1794249 - RNA, 12 nt, Salmonella enterica enterica serovar Typhi Ty2
auuuauucuauu

SEQ ID NO: 1794250 - RNA, 17 nt, Salmonella enterica enterica serovar Typhi Ty2
auuuauugccugaaacg

SEQ ID NO: 1794251 - RNA, 16 nt, Salmonella enterica enterica serovar Typhi Ty2
auuuaugcgcugggca

SEQ ID NO: 1794252 - RNA, 15 nt, Salmonella enterica enterica serovar Typhi Ty2
auuuaucuucucuau

SEQ ID NO: 1794253 - RNA, 15 nt, Salmonella enterica enterica serovar Typhi Ty2
auuucccccacuucu

SEQ ID NO: 1794254 - RNA, 22 nt, Salmonella enterica enterica serovar Typhi Ty2
auuucgccuuugcgacgguuuu

SEQ ID NO: 1794255 - RNA, 19 nt, Salmonella enterica enterica serovar Typhi Ty2
auuucgccuauuuucucuu

SEQ ID NO: 1794256 - RNA, 22 nt, Salmonella enterica enterica serovar Typhi Ty2
auuucgcuggcggccccucuuc

SEQ ID NO: 1794257 - RNA, 22 nt, Salmonella enterica enterica serovar Typhi Ty2
auuucacgcuucacgucagcga

SEQ ID NO: 1794258 - RNA, 18 nt, Salmonella enterica enterica serovar Typhi Ty2
auuucacguuucaucucu

SEQ ID NO: 1794259 - RNA, 18 nt, Salmonella enterica enterica serovar Typhi Ty2
auuucaccgucaauaacg

SEQ ID NO: 1794260 - RNA, 17 nt, Salmonella enterica enterica serovar Typhi Ty2
auuucaggcaaaggaau

SEQ ID NO: 1794261 - RNA, 20 nt, Salmonella enterica enterica serovar Typhi Ty2
auuucaggcaaaaaaaaacc

SEQ ID NO: 1794262 - RNA, 14 nt, Salmonella enterica enterica serovar Typhi Ty2
auuucagcgcagaa

SEQ ID NO: 1794263 - RNA, 17 nt, Salmonella enterica enterica serovar Typhi Ty2
auuucagggcuuauuca

SEQ ID NO: 1794264 - RNA, 17 nt, Salmonella enterica enterica serovar Typhi Ty2
auuucagggaaaagaag

SEQ ID NO: 1794265 - RNA, 20 nt, Salmonella enterica enterica serovar Typhi Ty2
auuucaguacagccaaaaau

SEQ ID NO: 1794266 - RNA, 14 nt, Salmonella enterica enterica serovar Typhi Ty2
auuuccauauuaac

SEQ ID NO: 1794267 - RNA, 17 nt, Salmonella enterica enterica serovar Typhi Ty2
auuucaguacagccaaa

SEQ ID NO: 1794268 - RNA, 22 nt, Salmonella enterica enterica serovar Typhi Ty2
auuucugccugcuucagacaac

SEQ ID NO: 1794269 - RNA, 17 nt, Salmonella enterica enterica serovar Typhi Ty2
auuucugccugcuucag

SEQ ID NO: 1794270 - RNA, 23 nt, Salmonella enterica enterica serovar Typhi Ty2
auuucugcugccagcgccgccgc

SEQ ID NO: 1794271 - RNA, 14 nt, Salmonella enterica enterica serovar Typhi Ty2
auuucuggccccug

SEQ ID NO: 1794272 - RNA, 18 nt, Salmonella enterica enterica serovar Typhi Ty2
auuucugaccacauuuuc

SEQ ID NO: 1794273 - RNA, 22 nt, Salmonella enterica enterica serovar Typhi Ty2
auuucguccggcugccacucuu

SEQ ID NO: 1794274 - RNA, 13 nt, Salmonella enterica enterica serovar Typhi Ty2
auuucuuccauua

SEQ ID NO: 1794275 - RNA, 14 nt, Salmonella enterica enterica serovar Typhi Ty2
auuucuuagcgcca

SEQ ID NO: 1794276 - RNA, 17 nt, Salmonella enterica enterica serovar Typhi Ty2
auuucuuaauuccucag

SEQ ID NO: 1794277 - RNA, 16 nt, Salmonella enterica enterica serovar Typhi Ty2
auuucuugaucaaucu

SEQ ID NO: 1794278 - RNA, 16 nt, Salmonella enterica enterica serovar Typhi Ty2
auuucuugcaauagcg

SEQ ID NO: 1794279 - RNA, 23 nt, Salmonella enterica enterica serovar Typhi Ty2
auuugaaggacugauacagccaa

SEQ ID NO: 1794280 - RNA, 19 nt, Salmonella enterica enterica serovar Typhi Ty2
auuuucaugauauucuguc

SEQ ID NO: 1794281 - RNA, 21 nt, Salmonella enterica enterica serovar Typhi Ty2
auuuucaucauaucugauaaa

SEQ ID NO: 1794282 - RNA, 13 nt, Salmonella enterica enterica serovar Typhi Ty2
auuuucaaaaaca

SEQ ID NO: 1794283 - RNA, 14 nt, Salmonella enterica enterica serovar Typhi Ty2
auuuucaaaaacaa

SEQ ID NO: 1794284 - RNA, 17 nt, Salmonella enterica enterica serovar Typhi Ty2
auuuucaaaaacaaggg

SEQ ID NO: 1794285 - RNA, 15 nt, Salmonella enterica enterica serovar Typhi Ty2
auuuucaaaaacaag

SEQ ID NO: 1794286 - RNA, 13 nt, Salmonella enterica enterica serovar Typhi Ty2
auuuuauuuuuca

SEQ ID NO: 1794287 - RNA, 19 nt, Salmonella enterica enterica serovar Typhi Ty2
auuuucaacggcaucaaua

SEQ ID NO: 1794288 - RNA, 22 nt, Salmonella enterica enterica serovar Typhi Ty2
auuuucaacggcaucaauaauu

SEQ ID NO: 1794289 - RNA, 14 nt, Salmonella enterica enterica serovar Typhi Ty2
auuuuagaucccca

SEQ ID NO: 1794290 - RNA, 16 nt, Salmonella enterica enterica serovar Typhi Ty2
auuuuauagcagucag

SEQ ID NO: 1794291 - RNA, 17 nt, Salmonella enterica enterica serovar Typhi Ty2
auuuuagaaauagaaau

SEQ ID NO: 1794292 - RNA, 21 nt, Salmonella enterica enterica serovar Typhi Ty2
auuuuagaaauagaaauugca

SEQ ID NO: 1794293 - RNA, 14 nt, Salmonella enterica enterica serovar Typhi Ty2
auuuuacuuucauu

SEQ ID NO: 1794294 - RNA, 15 nt, Salmonella enterica enterica serovar Typhi Ty2
auuuuacuaaugaau

SEQ ID NO: 1794295 - RNA, 21 nt, Salmonella enterica enterica serovar Typhi Ty2
auuuuacccgcgcaucccaca

SEQ ID NO: 1794296 - RNA, 14 nt, Salmonella enterica enterica serovar Typhi Ty2
auuuuacgagaacc

SEQ ID NO: 1794297 - RNA, 23 nt, Salmonella enterica enterica serovar Typhi Ty2
auuuuaccuucgcguuuaucacc

SEQ ID NO: 1794298 - RNA, 14 nt, Salmonella enterica enterica serovar Typhi Ty2
auuuuaaaaauauc

SEQ ID NO: 1794299 - RNA, 18 nt, Salmonella enterica enterica serovar Typhi Ty2
auuuuaaauuuccucuug

SEQ ID NO: 1794300 - RNA, 20 nt, Salmonella enterica enterica serovar Typhi Ty2
auuuuaaauugguuauauua

SEQ ID NO: 1794301 - RNA, 20 nt, Salmonella enterica enterica serovar Typhi Ty2
auuuuuaagguauugauuuu

SEQ ID NO: 1794302 - RNA, 18 nt, Salmonella enterica enterica serovar Typhi Ty2
auuuuucauggcauagcc

SEQ ID NO: 1794303 - RNA, 13 nt, Salmonella enterica enterica serovar Typhi Ty2
auuuuucacaugc

SEQ ID NO: 1794304 - RNA, 24 nt, Salmonella enterica enterica serovar Typhi Ty2
auuuuguugcuccagcaucacauc

SEQ ID NO: 1794305 - RNA, 18 nt, Salmonella enterica enterica serovar Typhi Ty2
auuuuguugcuccagcau

SEQ ID NO: 1794306 - RNA, 13 nt, Salmonella enterica enterica serovar Typhi Ty2
auuuuuaaauaac

SEQ ID NO: 1794307 - RNA, 19 nt, Salmonella enterica enterica serovar Typhi Ty2
auuuugucauguccagggc

SEQ ID NO: 1794308 - RNA, 17 nt, Salmonella enterica enterica serovar Typhi Ty2
auuuuggggaaaauacc

SEQ ID NO: 1794309 - RNA, 13 nt, Salmonella enterica enterica serovar Typhi Ty2
auuuugcuuuuuc

SEQ ID NO: 1794310 - RNA, 17 nt, Salmonella enterica enterica serovar Typhi Ty2
auuuuggacgaggaaaa

SEQ ID NO: 1794311 - RNA, 19 nt, Salmonella enterica enterica serovar Typhi Ty2
auuuuggacgaggaaaaau

SEQ ID NO: 1794312 - RNA, 23 nt, Salmonella enterica enterica serovar Typhi Ty2
auuuuggacgaggaaaaaugaga

SEQ ID NO: 1794313 - RNA, 19 nt, Salmonella enterica enterica serovar Typhi Ty2
auuuuggacggcgucacca

SEQ ID NO: 1794314 - RNA, 13 nt, Salmonella enterica enterica serovar Typhi Ty2
auuuugcuuggcc

SEQ ID NO: 1794315 - RNA, 14 nt, Salmonella enterica enterica serovar Typhi Ty2
auuuucguaaaaua

SEQ ID NO: 1794316 - RNA, 21 nt, Salmonella enterica enterica serovar Typhi Ty2
auuuucgucguuucuacaaua

SEQ ID NO: 1794317 - RNA, 17 nt, Salmonella enterica enterica serovar Typhi Ty2
auuuucggcaucagcag

SEQ ID NO: 1794318 - RNA, 16 nt, Salmonella enterica enterica serovar Typhi Ty2
auuuucggcaucagca

SEQ ID NO: 1794319 - RNA, 23 nt, Salmonella enterica enterica serovar Typhi Ty2
auuuucaugguaucccacaugag

SEQ ID NO: 1794320 - RNA, 15 nt, Salmonella enterica enterica serovar Typhi Ty2
auuuuuuaucuucca

SEQ ID NO: 1794321 - RNA, 19 nt, Salmonella enterica enterica serovar Typhi Ty2
auuuuuuauauucgcucau

SEQ ID NO: 1794322 - RNA, 18 nt, Salmonella enterica enterica serovar Typhi Ty2
auuuuucccuggccggaa

SEQ ID NO: 1794323 - RNA, 17 nt, Salmonella enterica enterica serovar Typhi Ty2
auuuuucgaucuucucc

SEQ ID NO: 1794324 - RNA, 19 nt, Salmonella enterica enterica serovar Typhi Ty2
auuuuucgcgucaaaacuu

SEQ ID NO: 1794325 - RNA, 20 nt, Salmonella enterica enterica serovar Typhi Ty2
auuuuucuggcuucuuaaaa

SEQ ID NO: 1794326 - RNA, 23 nt, Salmonella enterica enterica serovar Typhi Ty2
auuuuucucagccagauccagug

SEQ ID NO: 1794327 - RNA, 13 nt, Salmonella enterica enterica serovar Typhi Ty2
caaaaaaaaaccg

SEQ ID NO: 1794328 - RNA, 13 nt, Salmonella enterica enterica serovar Typhi Ty2
auuuuuuuugccu

SEQ ID NO: 1794329 - RNA, 22 nt, Salmonella enterica enterica serovar Typhi Ty2
caaaaaauauagccauuuaaug

SEQ ID NO: 1794330 - RNA, 15 nt, Salmonella enterica enterica serovar Typhi Ty2
auuggugauauaaac

SEQ ID NO: 1794331 - RNA, 17 nt, Salmonella enterica enterica serovar Typhi Ty2
auuggugaaaaaucauu

SEQ ID NO: 1794332 - RNA, 23 nt, Salmonella enterica enterica serovar Typhi Ty2
auugggccagcagcgcaucaucc

SEQ ID NO: 1794333 - RNA, 15 nt, Salmonella enterica enterica serovar Typhi Ty2
auuggcguuuuauga

SEQ ID NO: 1794334 - RNA, 16 nt, Salmonella enterica enterica serovar Typhi Ty2
auuggcggcaaagaaa

SEQ ID NO: 1794335 - RNA, 23 nt, Salmonella enterica enterica serovar Typhi Ty2
auuggcgucgacgugucuaugcu

SEQ ID NO: 1794336 - RNA, 21 nt, Salmonella enterica enterica serovar Typhi Ty2
auuggcggacgaaucuggaua

SEQ ID NO: 1794337 - RNA, 15 nt, Salmonella enterica enterica serovar Typhi Ty2
auugcuguauuuuau

SEQ ID NO: 1794338 - RNA, 23 nt, Salmonella enterica enterica serovar Typhi Ty2
auugcuguaggcacuuuccagac

SEQ ID NO: 1794339 - RNA, 14 nt, Salmonella enterica enterica serovar Typhi Ty2
auugcugcuauuuc

SEQ ID NO: 1794340 - RNA, 15 nt, Salmonella enterica enterica serovar Typhi Ty2
auuguaaaaccgacu

SEQ ID NO: 1794341 - RNA, 16 nt, Salmonella enterica enterica serovar Typhi Ty2
auuguagcugcgccag

SEQ ID NO: 1794342 - RNA, 19 nt, Salmonella enterica enterica serovar Typhi Ty2
auuguuucggauaauucug

SEQ ID NO: 1794343 - RNA, 18 nt, Salmonella enterica enterica serovar Typhi Ty2
auuuaaacgggguaaacu

SEQ ID NO: 1794344 - RNA, 18 nt, Salmonella enterica enterica serovar Typhi Ty2
auuuaaagauagcugcuu

SEQ ID NO: 1794345 - RNA, 19 nt, Salmonella enterica enterica serovar Typhi Ty2
auuguuggugaguggccug

SEQ ID NO: 1794346 - RNA, 14 nt, Salmonella enterica enterica serovar Typhi Ty2
auuguugcgccaug

SEQ ID NO: 1794347 - RNA, 19 nt, Salmonella enterica enterica serovar Typhi Ty2
auuuaaauagcaauuauau

SEQ ID NO: 1794348 - RNA, 20 nt, Salmonella enterica enterica serovar Typhi Ty2
auuuaaauagcaauuauauu

SEQ ID NO: 1794349 - RNA, 15 nt, Salmonella enterica enterica serovar Typhi Ty2
auuuaaauagcaauu

SEQ ID NO: 1794350 - RNA, 22 nt, Salmonella enterica enterica serovar Typhi Ty2
auuuaacagagagggaaaaaaa

SEQ ID NO: 1794351 - RNA, 17 nt, Salmonella enterica enterica serovar Typhi Ty2
auuguguuuaccucaua

SEQ ID NO: 1794352 - RNA, 18 nt, Salmonella enterica enterica serovar Typhi Ty2
auugucugcgcugggccg

SEQ ID NO: 1794353 - RNA, 21 nt, Salmonella enterica enterica serovar Typhi Ty2
auugccggcgaccaugccagc

SEQ ID NO: 1794354 - RNA, 21 nt, Salmonella enterica enterica serovar Typhi Ty2
auugccgccaucuuuacccug

SEQ ID NO: 1794355 - RNA, 18 nt, Salmonella enterica enterica serovar Typhi Ty2
auugccgcgcccugcgga

SEQ ID NO: 1794356 - RNA, 22 nt, Salmonella enterica enterica serovar Typhi Ty2
auugccgaccgccagcagagcg

SEQ ID NO: 1794357 - RNA, 19 nt, Salmonella enterica enterica serovar Typhi Ty2
auugccgaccauuacccac

SEQ ID NO: 1794358 - RNA, 15 nt, Salmonella enterica enterica serovar Typhi Ty2
auugccgcacauguu

SEQ ID NO: 1794359 - RNA, 13 nt, Salmonella enterica enterica serovar Typhi Ty2
auugccgaccauu

SEQ ID NO: 1794360 - RNA, 17 nt, Salmonella enterica enterica serovar Typhi Ty2
auugcccuuuuguuuuu

SEQ ID NO: 1794361 - RNA, 16 nt, Salmonella enterica enterica serovar Typhi Ty2
auugccacagccucag

SEQ ID NO: 1794362 - RNA, 21 nt, Salmonella enterica enterica serovar Typhi Ty2
auugccacuuaauaucaauau

SEQ ID NO: 1794363 - RNA, 12 nt, Salmonella enterica enterica serovar Typhi Ty2
auugccaggacu

SEQ ID NO: 1794364 - RNA, 17 nt, Salmonella enterica enterica serovar Typhi Ty2
auugccauaaaaacaau

SEQ ID NO: 1794365 - RNA, 23 nt, Salmonella enterica enterica serovar Typhi Ty2
auugccaguccggaugucucagc

SEQ ID NO: 1794366 - RNA, 23 nt, Salmonella enterica enterica serovar Typhi Ty2
auugccauaaauacaauucaacu

SEQ ID NO: 1794367 - RNA, 22 nt, Salmonella enterica enterica serovar Typhi Ty2
auugcguaucguaagccaccgc

SEQ ID NO: 1794368 - RNA, 15 nt, Salmonella enterica enterica serovar Typhi Ty2
auugcgguucugcau

SEQ ID NO: 1794369 - RNA, 13 nt, Salmonella enterica enterica serovar Typhi Ty2
auugcguugcuuu

SEQ ID NO: 1794370 - RNA, 15 nt, Salmonella enterica enterica serovar Typhi Ty2
auugccuaaauaacu

SEQ ID NO: 1794371 - RNA, 20 nt, Salmonella enterica enterica serovar Typhi Ty2
auugcgacaagcucauuucc

SEQ ID NO: 1794372 - RNA, 20 nt, Salmonella enterica enterica serovar Typhi Ty2
auugaaaagcagccagaccc

SEQ ID NO: 1794373 - RNA, 20 nt, Salmonella enterica enterica serovar Typhi Ty2
auucuuuacuaauaccugga

SEQ ID NO: 1794374 - RNA, 16 nt, Salmonella enterica enterica serovar Typhi Ty2
auugcagaauauguuc

SEQ ID NO: 1794375 - RNA, 20 nt, Salmonella enterica enterica serovar Typhi Ty2
auugcagcgguaaacaccac

SEQ ID NO: 1794376 - RNA, 22 nt, Salmonella enterica enterica serovar Typhi Ty2
auugcagggugcagcaaauaau

SEQ ID NO: 1794377 - RNA, 17 nt, Salmonella enterica enterica serovar Typhi Ty2
auugcaacgaucccuaa

SEQ ID NO: 1794378 - RNA, 22 nt, Salmonella enterica enterica serovar Typhi Ty2
auugcaacgaucccuaauaaaa

SEQ ID NO: 1794379 - RNA, 13 nt, Salmonella enterica enterica serovar Typhi Ty2
auugcaagaauau

SEQ ID NO: 1794380 - RNA, 22 nt, Salmonella enterica enterica serovar Typhi Ty2
auucugcuuccagaauucguac

SEQ ID NO: 1794381 - RNA, 16 nt, Salmonella enterica enterica serovar Typhi Ty2
auucuggaaucaauuu

SEQ ID NO: 1794382 - RNA, 15 nt, Salmonella enterica enterica serovar Typhi Ty2
auucugcgccagcca

SEQ ID NO: 1794383 - RNA, 13 nt, Salmonella enterica enterica serovar Typhi Ty2
auucugcgguaau

SEQ ID NO: 1794384 - RNA, 20 nt, Salmonella enterica enterica serovar Typhi Ty2
auucugcugaaaaagaacaa

SEQ ID NO: 1794385 - RNA, 18 nt, Salmonella enterica enterica serovar Typhi Ty2
auucugcuuaccagaccg

SEQ ID NO: 1794386 - RNA, 18 nt, Salmonella enterica enterica serovar Typhi Ty2
auucugguaguaagucag

SEQ ID NO: 1794387 - RNA, 19 nt, Salmonella enterica enterica serovar Typhi Ty2
auucugggcuuacuuucca

SEQ ID NO: 1794388 - RNA, 17 nt, Salmonella enterica enterica serovar Typhi Ty2
auucuugcccuauaaua

SEQ ID NO: 1794389 - RNA, 22 nt, Salmonella enterica enterica serovar Typhi Ty2
auucuucgccgaagugugccag

SEQ ID NO: 1794390 - RNA, 15 nt, Salmonella enterica enterica serovar Typhi Ty2
auucuucgucagaug

SEQ ID NO: 1794391 - RNA, 15 nt, Salmonella enterica enterica serovar Typhi Ty2
auucuucuuagaaua

SEQ ID NO: 1794392 - RNA, 21 nt, Salmonella enterica enterica serovar Typhi Ty2
auucugauuuuacuaaugaau

SEQ ID NO: 1794393 - RNA, 12 nt, Salmonella enterica enterica serovar Typhi Ty2
auucugcagcga

SEQ ID NO: 1794394 - RNA, 20 nt, Salmonella enterica enterica serovar Typhi Ty2
auucucuucuaccacgcugc

SEQ ID NO: 1794395 - RNA, 19 nt, Salmonella enterica enterica serovar Typhi Ty2
auucucugcccccgagcca

SEQ ID NO: 1794396 - RNA, 17 nt, Salmonella enterica enterica serovar Typhi Ty2
auucuacaaguucagua

SEQ ID NO: 1794397 - RNA, 14 nt, Salmonella enterica enterica serovar Typhi Ty2
auucucgcacuuua

SEQ ID NO: 1794398 - RNA, 14 nt, Salmonella enterica enterica serovar Typhi Ty2
auucguaacaugcu

SEQ ID NO: 1794399 - RNA, 12 nt, Salmonella enterica enterica serovar Typhi Ty2
auucgcuugccc

SEQ ID NO: 1794400 - RNA, 14 nt, Salmonella enterica enterica serovar Typhi Ty2
auucgcuaauaauu

SEQ ID NO: 1794401 - RNA, 16 nt, Salmonella enterica enterica serovar Typhi Ty2
auucgucaccgaauag

SEQ ID NO: 1794402 - RNA, 18 nt, Salmonella enterica enterica serovar Typhi Ty2
auucgcgaugcucaacca

SEQ ID NO: 1794403 - RNA, 21 nt, Salmonella enterica enterica serovar Typhi Ty2
auuccuuuuuccgccaccugu

SEQ ID NO: 1794404 - RNA, 14 nt, Salmonella enterica enterica serovar Typhi Ty2
auucauuucaaugu

SEQ ID NO: 1794405 - RNA, 15 nt, Salmonella enterica enterica serovar Typhi Ty2
auucauuucaaugua

SEQ ID NO: 1794406 - RNA, 14 nt, Salmonella enterica enterica serovar Typhi Ty2
auucauuauuuuua

SEQ ID NO: 1794407 - RNA, 15 nt, Salmonella enterica enterica serovar Typhi Ty2
auucauucccauacu

SEQ ID NO: 1794408 - RNA, 21 nt, Salmonella enterica enterica serovar Typhi Ty2
auucauucacccaauaaauaa

SEQ ID NO: 1794409 - RNA, 18 nt, Salmonella enterica enterica serovar Typhi Ty2
auucauugucuuuuucuc

SEQ ID NO: 1794410 - RNA, 22 nt, Salmonella enterica enterica serovar Typhi Ty2
auucauuguccguaauuugcuu

SEQ ID NO: 1794411 - RNA, 16 nt, Salmonella enterica enterica serovar Typhi Ty2
auucauuauuuuuaaa

SEQ ID NO: 1794412 - RNA, 19 nt, Salmonella enterica enterica serovar Typhi Ty2
auucaugcaacuucaccuc

SEQ ID NO: 1794413 - RNA, 20 nt, Salmonella enterica enterica serovar Typhi Ty2
auucaugguacucaacauca

SEQ ID NO: 1794414 - RNA, 21 nt, Salmonella enterica enterica serovar Typhi Ty2
auucaugguacucaacaucau

SEQ ID NO: 1794415 - RNA, 19 nt, Salmonella enterica enterica serovar Typhi Ty2
auucaugguacucaacauc

SEQ ID NO: 1794416 - RNA, 12 nt, Salmonella enterica enterica serovar Typhi Ty2
auucauauugcc

SEQ ID NO: 1794417 - RNA, 16 nt, Salmonella enterica enterica serovar Typhi Ty2
aaaaggauacagcgcc

SEQ ID NO: 1794418 - RNA, 13 nt, Salmonella enterica enterica serovar Typhi Ty2
auucaucuccucu

SEQ ID NO: 1794419 - RNA, 21 nt, Salmonella enterica enterica serovar Typhi Ty2
auucccguaucuucauguucu

SEQ ID NO: 1794420 - RNA, 16 nt, Salmonella enterica enterica serovar Typhi Ty2
auucccgucccugcau

SEQ ID NO: 1794421 - RNA, 15 nt, Salmonella enterica enterica serovar Typhi Ty2
auucccguaaaagaa

SEQ ID NO: 1794422 - RNA, 18 nt, Salmonella enterica enterica serovar Typhi Ty2
auucccggcggaaaugcg

SEQ ID NO: 1794423 - RNA, 22 nt, Salmonella enterica enterica serovar Typhi Ty2
auucccugcgcauacgucaugc

SEQ ID NO: 1794424 - RNA, 12 nt, Salmonella enterica enterica serovar Typhi Ty2
auuccuucggug

SEQ ID NO: 1794425 - RNA, 18 nt, Salmonella enterica enterica serovar Typhi Ty2
auuccucgaucgccuggc

SEQ ID NO: 1794426 - RNA, 16 nt, Salmonella enterica enterica serovar Typhi Ty2
auuccucagaauccgu

SEQ ID NO: 1794427 - RNA, 17 nt, Salmonella enterica enterica serovar Typhi Ty2
auuccgugucugaauga

SEQ ID NO: 1794428 - RNA, 14 nt, Salmonella enterica enterica serovar Typhi Ty2
auuccaaaauaaua

SEQ ID NO: 1794429 - RNA, 19 nt, Salmonella enterica enterica serovar Typhi Ty2
auuagaugcgaauaagcug

SEQ ID NO: 1794430 - RNA, 20 nt, Salmonella enterica enterica serovar Typhi Ty2
auuagaggucagaauaacuc

SEQ ID NO: 1794431 - RNA, 14 nt, Salmonella enterica enterica serovar Typhi Ty2
aaaagcggauaaga

SEQ ID NO: 1794432 - RNA, 15 nt, Salmonella enterica enterica serovar Typhi Ty2
aaaagcgccccuggg

SEQ ID NO: 1794433 - RNA, 22 nt, Salmonella enterica enterica serovar Typhi Ty2
aaaagccggcggaaaaaagcag

SEQ ID NO: 1794434 - RNA, 22 nt, Salmonella enterica enterica serovar Typhi Ty2
auuagccgccauccggcaucuc

SEQ ID NO: 1794435 - RNA, 13 nt, Salmonella enterica enterica serovar Typhi Ty2
auuacuggaucau

SEQ ID NO: 1794436 - RNA, 23 nt, Salmonella enterica enterica serovar Typhi Ty2
auuacugcguaaaccauuucucc

SEQ ID NO: 1794437 - RNA, 14 nt, Salmonella enterica enterica serovar Typhi Ty2
auuacuuauauuua

SEQ ID NO: 1794438 - RNA, 15 nt, Salmonella enterica enterica serovar Typhi Ty2
auuacuuaugauaua

SEQ ID NO: 1794439 - RNA, 15 nt, Salmonella enterica enterica serovar Typhi Ty2
auuagacuucuucca

SEQ ID NO: 1794440 - RNA, 13 nt, Salmonella enterica enterica serovar Typhi Ty2
auuaauacccaua

SEQ ID NO: 1794441 - RNA, 17 nt, Salmonella enterica enterica serovar Typhi Ty2
aaaagccagauaaagca

SEQ ID NO: 1794442 - RNA, 20 nt, Salmonella enterica enterica serovar Typhi Ty2
auuaccgcucguuaauccaa

SEQ ID NO: 1794443 - RNA, 20 nt, Salmonella enterica enterica serovar Typhi Ty2
auuacaugccguuaauaaug

SEQ ID NO: 1794444 - RNA, 18 nt, Salmonella enterica enterica serovar Typhi Ty2
auuacagguguuaaucau

SEQ ID NO: 1794445 - RNA, 14 nt, Salmonella enterica enterica serovar Typhi Ty2
auuaauaucagccc

SEQ ID NO: 1794446 - RNA, 15 nt, Salmonella enterica enterica serovar Typhi Ty2
auuacggguaaugau

SEQ ID NO: 1794447 - RNA, 23 nt, Salmonella enterica enterica serovar Typhi Ty2
auuaccgggauuuccauauuaac

SEQ ID NO: 1794448 - RNA, 16 nt, Salmonella enterica enterica serovar Typhi Ty2
auuaccggcugccgau

SEQ ID NO: 1794449 - RNA, 22 nt, Salmonella enterica enterica serovar Typhi Ty2
auuaccgggauuuccauauuaa

SEQ ID NO: 1794450 - RNA, 14 nt, Salmonella enterica enterica serovar Typhi Ty2
auuaccgcuauuca

SEQ ID NO: 1794451 - RNA, 15 nt, Salmonella enterica enterica serovar Typhi Ty2
auuaccugccagggu

SEQ ID NO: 1794452 - RNA, 16 nt, Salmonella enterica enterica serovar Typhi Ty2
auuaccugccagggug

SEQ ID NO: 1794453 - RNA, 22 nt, Salmonella enterica enterica serovar Typhi Ty2
auuacguuggggauaaccagaa

SEQ ID NO: 1794454 - RNA, 21 nt, Salmonella enterica enterica serovar Typhi Ty2
auuacguuggggauaaccaga

SEQ ID NO: 1794455 - RNA, 22 nt, Salmonella enterica enterica serovar Typhi Ty2
auuauugucuuuguugccuucg

SEQ ID NO: 1794456 - RNA, 15 nt, Salmonella enterica enterica serovar Typhi Ty2
auuauuggugaaaaa

SEQ ID NO: 1794457 - RNA, 20 nt, Salmonella enterica enterica serovar Typhi Ty2
auuauuggugaaaaaucauu

SEQ ID NO: 1794458 - RNA, 15 nt, Salmonella enterica enterica serovar Typhi Ty2
auuauuggucaguag

SEQ ID NO: 1794459 - RNA, 15 nt, Salmonella enterica enterica serovar Typhi Ty2
auuauugcguugcuu

SEQ ID NO: 1794460 - RNA, 14 nt, Salmonella enterica enterica serovar Typhi Ty2
auuauuguuaaaaa

SEQ ID NO: 1794461 - RNA, 22 nt, Salmonella enterica enterica serovar Typhi Ty2
auuauuuuuaaauaacuuuuaa

SEQ ID NO: 1794462 - RNA, 17 nt, Salmonella enterica enterica serovar Typhi Ty2
auuauuuuucaaaugau

SEQ ID NO: 1794463 - RNA, 17 nt, Salmonella enterica enterica serovar Typhi Ty2
auuauuuuagugaaaaa

SEQ ID NO: 1794464 - RNA, 14 nt, Salmonella enterica enterica serovar Typhi Ty2
auuauuuucacgcu

SEQ ID NO: 1794465 - RNA, 21 nt, Salmonella enterica enterica serovar Typhi Ty2
auucaaaccuucaagaaucaa

SEQ ID NO: 1794466 - RNA, 15 nt, Salmonella enterica enterica serovar Typhi Ty2
auucaaaauccgcca

SEQ ID NO: 1794467 - RNA, 16 nt, Salmonella enterica enterica serovar Typhi Ty2
auuauuaaaucaauac

SEQ ID NO: 1794468 - RNA, 18 nt, Salmonella enterica enterica serovar Typhi Ty2
auuaugccugucaucauc

SEQ ID NO: 1794469 - RNA, 16 nt, Salmonella enterica enterica serovar Typhi Ty2
auuaugccugucauca

SEQ ID NO: 1794470 - RNA, 20 nt, Salmonella enterica enterica serovar Typhi Ty2
auuaugccgcacuccccaga

SEQ ID NO: 1794471 - RNA, 14 nt, Salmonella enterica enterica serovar Typhi Ty2
auuaguaauaucag

SEQ ID NO: 1794472 - RNA, 17 nt, Salmonella enterica enterica serovar Typhi Ty2
auuauauugcguaaaaa

SEQ ID NO: 1794473 - RNA, 18 nt, Salmonella enterica enterica serovar Typhi Ty2
auuaucgauuugguaaau

SEQ ID NO: 1794474 - RNA, 22 nt, Salmonella enterica enterica serovar Typhi Ty2
auuaucgauuugguaaauaacu

SEQ ID NO: 1794475 - RNA, 16 nt, Salmonella enterica enterica serovar Typhi Ty2
auuaacgacaaaaaua

SEQ ID NO: 1794476 - RNA, 16 nt, Salmonella enterica enterica serovar Typhi Ty2
auuaacgcgaaaauac

SEQ ID NO: 1794477 - RNA, 21 nt, Salmonella enterica enterica serovar Typhi Ty2
auuaacgccgcgaggaucugc

SEQ ID NO: 1794478 - RNA, 18 nt, Salmonella enterica enterica serovar Typhi Ty2
auuaaaugcgccagcggc

SEQ ID NO: 1794479 - RNA, 16 nt, Salmonella enterica enterica serovar Typhi Ty2
auuaauaaaauuuuug

SEQ ID NO: 1794480 - RNA, 17 nt, Salmonella enterica enterica serovar Typhi Ty2
auuaaguuuuuuuaaaa

SEQ ID NO: 1794481 - RNA, 21 nt, Salmonella enterica enterica serovar Typhi Ty2
auuaagaccauacuuugcauu

SEQ ID NO: 1794482 - RNA, 20 nt, Salmonella enterica enterica serovar Typhi Ty2
auuaagcaauccauuuuaaa

SEQ ID NO: 1794483 - RNA, 17 nt, Salmonella enterica enterica serovar Typhi Ty2
auuaaaucaucauaauc

SEQ ID NO: 1794484 - RNA, 15 nt, Salmonella enterica enterica serovar Typhi Ty2
auuaaaucaucauaa

SEQ ID NO: 1794485 - RNA, 20 nt, Salmonella enterica enterica serovar Typhi Ty2
auuaaauccugaaacccaua

SEQ ID NO: 1794486 - RNA, 21 nt, Salmonella enterica enterica serovar Typhi Ty2
auuaaagcacaagaacuuaaa

SEQ ID NO: 1794487 - RNA, 11 nt, Salmonella enterica enterica serovar Typhi Ty2
auuaaagccac

SEQ ID NO: 1794488 - RNA, 13 nt, Salmonella enterica enterica serovar Typhi Ty2
auuaaagccccuu

SEQ ID NO: 1794489 - RNA, 19 nt, Salmonella enterica enterica serovar Typhi Ty2
auuaaaacgagucagcguu

SEQ ID NO: 1794490 - RNA, 17 nt, Salmonella enterica enterica serovar Typhi Ty2
auuaaagauuagcguuu

SEQ ID NO: 1794491 - RNA, 21 nt, Salmonella enterica enterica serovar Typhi Ty2
auuaaaaauaccccaggggca

SEQ ID NO: 1794492 - RNA, 15 nt, Salmonella enterica enterica serovar Typhi Ty2
auuaaaaaggccgac

SEQ ID NO: 1794493 - RNA, 15 nt, Salmonella enterica enterica serovar Typhi Ty2
auguuugccacgcca

SEQ ID NO: 1794494 - RNA, 14 nt, Salmonella enterica enterica serovar Typhi Ty2
auguucgaacaugc

SEQ ID NO: 1794495 - RNA, 18 nt, Salmonella enterica enterica serovar Typhi Ty2
auguuccuggauagauuu

SEQ ID NO: 1794496 - RNA, 15 nt, Salmonella enterica enterica serovar Typhi Ty2
auguucuaucuuuca

SEQ ID NO: 1794497 - RNA, 14 nt, Salmonella enterica enterica serovar Typhi Ty2
auguugaaccguca

SEQ ID NO: 1794498 - RNA, 13 nt, Salmonella enterica enterica serovar Typhi Ty2
auguucuuucgcc

SEQ ID NO: 1794499 - RNA, 17 nt, Salmonella enterica enterica serovar Typhi Ty2
auguuaggguagaaaaa

SEQ ID NO: 1794500 - RNA, 18 nt, Salmonella enterica enterica serovar Typhi Ty2
auguuagcauuauuuuua

SEQ ID NO: 1794501 - RNA, 17 nt, Salmonella enterica enterica serovar Typhi Ty2
auguuagcuucacuucg

SEQ ID NO: 1794502 - RNA, 16 nt, Salmonella enterica enterica serovar Typhi Ty2
auguuagaaucuauua

SEQ ID NO: 1794503 - RNA, 22 nt, Salmonella enterica enterica serovar Typhi Ty2
auguuaauaccagcgccaauca

SEQ ID NO: 1794504 - RNA, 17 nt, Salmonella enterica enterica serovar Typhi Ty2
auguuaacuacuuuaca

SEQ ID NO: 1794505 - RNA, 14 nt, Salmonella enterica enterica serovar Typhi Ty2
auguguuucagcag

SEQ ID NO: 1794506 - RNA, 14 nt, Salmonella enterica enterica serovar Typhi Ty2
auguuccgcagggg

SEQ ID NO: 1794507 - RNA, 13 nt, Salmonella enterica enterica serovar Typhi Ty2
augugcgccagcc

SEQ ID NO: 1794508 - RNA, 17 nt, Salmonella enterica enterica serovar Typhi Ty2
augugcaucggcacagc

SEQ ID NO: 1794509 - RNA, 20 nt, Salmonella enterica enterica serovar Typhi Ty2
augugguaaccgaacugggu

SEQ ID NO: 1794510 - RNA, 22 nt, Salmonella enterica enterica serovar Typhi Ty2
augugucuauuuauugaagaug

SEQ ID NO: 1794511 - RNA, 17 nt, Salmonella enterica enterica serovar Typhi Ty2
augucuggcgcuaaaau

SEQ ID NO: 1794512 - RNA, 22 nt, Salmonella enterica enterica serovar Typhi Ty2
augucuggcgcuaaaauccacu

SEQ ID NO: 1794513 - RNA, 18 nt, Salmonella enterica enterica serovar Typhi Ty2
augucuggugcagcaagc

SEQ ID NO: 1794514 - RNA, 23 nt, Salmonella enterica enterica serovar Typhi Ty2
augucuuuucgguauuuaucaaa

SEQ ID NO: 1794515 - RNA, 16 nt, Salmonella enterica enterica serovar Typhi Ty2
augugaauccaggcca

SEQ ID NO: 1794516 - RNA, 15 nt, Salmonella enterica enterica serovar Typhi Ty2
augugacaaucacuc

SEQ ID NO: 1794517 - RNA, 23 nt, Salmonella enterica enterica serovar Typhi Ty2
augugauuuuugacccgcagcaa

SEQ ID NO: 1794518 - RNA, 19 nt, Salmonella enterica enterica serovar Typhi Ty2
augugaugccgucaguuau

SEQ ID NO: 1794519 - RNA, 19 nt, Salmonella enterica enterica serovar Typhi Ty2
auguacagaaugguauuau

SEQ ID NO: 1794520 - RNA, 16 nt, Salmonella enterica enterica serovar Typhi Ty2
auguacgccuaaaaau

SEQ ID NO: 1794521 - RNA, 23 nt, Salmonella enterica enterica serovar Typhi Ty2
augucgauucacguagcguauca

SEQ ID NO: 1794522 - RNA, 19 nt, Salmonella enterica enterica serovar Typhi Ty2
augucgauaauacagccug

SEQ ID NO: 1794523 - RNA, 17 nt, Salmonella enterica enterica serovar Typhi Ty2
augucgcgucagguuua

SEQ ID NO: 1794524 - RNA, 18 nt, Salmonella enterica enterica serovar Typhi Ty2
auguaauuugcaaaccau

SEQ ID NO: 1794525 - RNA, 19 nt, Salmonella enterica enterica serovar Typhi Ty2
auguaaacuccauuaaauu

SEQ ID NO: 1794526 - RNA, 23 nt, Salmonella enterica enterica serovar Typhi Ty2
auguaaacuccauuaaauuacuu

SEQ ID NO: 1794527 - RNA, 22 nt, Salmonella enterica enterica serovar Typhi Ty2
augguuaaauuaaauaacaaau

SEQ ID NO: 1794528 - RNA, 14 nt, Salmonella enterica enterica serovar Typhi Ty2
augguuaaauucau

SEQ ID NO: 1794529 - RNA, 20 nt, Salmonella enterica enterica serovar Typhi Ty2
augguucaggcggauauaug

SEQ ID NO: 1794530 - RNA, 19 nt, Salmonella enterica enterica serovar Typhi Ty2
augguuauuaauuacgcug

SEQ ID NO: 1794531 - RNA, 11 nt, Salmonella enterica enterica serovar Typhi Ty2
augguuauuuu

SEQ ID NO: 1794532 - RNA, 18 nt, Salmonella enterica enterica serovar Typhi Ty2
augguugaacaggcugug

SEQ ID NO: 1794533 - RNA, 20 nt, Salmonella enterica enterica serovar Typhi Ty2
augguugacuuacaaaaaau

SEQ ID NO: 1794534 - RNA, 18 nt, Salmonella enterica enterica serovar Typhi Ty2
augguggucgcggccacc

SEQ ID NO: 1794535 - RNA, 19 nt, Salmonella enterica enterica serovar Typhi Ty2
augguggagggguauuuau

SEQ ID NO: 1794536 - RNA, 22 nt, Salmonella enterica enterica serovar Typhi Ty2
augguauaaaucccggugggga

SEQ ID NO: 1794537 - RNA, 19 nt, Salmonella enterica enterica serovar Typhi Ty2
augguaggccugauaagcg

SEQ ID NO: 1794538 - RNA, 20 nt, Salmonella enterica enterica serovar Typhi Ty2
augguacucaacaucauuaa

SEQ ID NO: 1794539 - RNA, 24 nt, Salmonella enterica enterica serovar Typhi Ty2
augguaacugcggcuauauaaaau

SEQ ID NO: 1794540 - RNA, 21 nt, Salmonella enterica enterica serovar Typhi Ty2
augguacaccaggaguuaaac

SEQ ID NO: 1794541 - RNA, 23 nt, Salmonella enterica enterica serovar Typhi Ty2
auggugauagcgcgccagcacca

SEQ ID NO: 1794542 - RNA, 23 nt, Salmonella enterica enterica serovar Typhi Ty2
auggcugcgauaaugaagcauaa

SEQ ID NO: 1794543 - RNA, 16 nt, Salmonella enterica enterica serovar Typhi Ty2
auggcucagauugaac

SEQ ID NO: 1794544 - RNA, 17 nt, Salmonella enterica enterica serovar Typhi Ty2
auggcugagaaucaccu

SEQ ID NO: 1794545 - RNA, 16 nt, Salmonella enterica enterica serovar Typhi Ty2
augggcgggauccugc

SEQ ID NO: 1794546 - RNA, 23 nt, Salmonella enterica enterica serovar Typhi Ty2
augguaaaauuauugugagaaaa

SEQ ID NO: 1794547 - RNA, 20 nt, Salmonella enterica enterica serovar Typhi Ty2
augguaaaauccuuuuucau

SEQ ID NO: 1794548 - RNA, 19 nt, Salmonella enterica enterica serovar Typhi Ty2
auggggauuaucaggauga

SEQ ID NO: 1794549 - RNA, 16 nt, Salmonella enterica enterica serovar Typhi Ty2
auggggcaagcucagc

SEQ ID NO: 1794550 - RNA, 22 nt, Salmonella enterica enterica serovar Typhi Ty2
auggggaaauaaauauguuauu

SEQ ID NO: 1794551 - RNA, 15 nt, Salmonella enterica enterica serovar Typhi Ty2
auggcccaauguuuu

SEQ ID NO: 1794552 - RNA, 22 nt, Salmonella enterica enterica serovar Typhi Ty2
auggcauaacgcuguagcguuu

SEQ ID NO: 1794553 - RNA, 19 nt, Salmonella enterica enterica serovar Typhi Ty2
auggcaguauaaauaccuu

SEQ ID NO: 1794554 - RNA, 12 nt, Salmonella enterica enterica serovar Typhi Ty2
auggccgcagcc

SEQ ID NO: 1794555 - RNA, 19 nt, Salmonella enterica enterica serovar Typhi Ty2
auggcccaguguacugcca

SEQ ID NO: 1794556 - RNA, 20 nt, Salmonella enterica enterica serovar Typhi Ty2
auggccguuuucaugcacga

SEQ ID NO: 1794557 - RNA, 15 nt, Salmonella enterica enterica serovar Typhi Ty2
auggcgucgugcagc

SEQ ID NO: 1794558 - RNA, 15 nt, Salmonella enterica enterica serovar Typhi Ty2
auggaaaauaauaau

SEQ ID NO: 1794559 - RNA, 23 nt, Salmonella enterica enterica serovar Typhi Ty2
augcuuuuuauaaagugauuaua

SEQ ID NO: 1794560 - RNA, 15 nt, Salmonella enterica enterica serovar Typhi Ty2
auggacaaaaaagga

SEQ ID NO: 1794561 - RNA, 12 nt, Salmonella enterica enterica serovar Typhi Ty2
auggaaguacug

SEQ ID NO: 1794562 - RNA, 22 nt, Salmonella enterica enterica serovar Typhi Ty2
auggaacucugcgacgccaggc

SEQ ID NO: 1794563 - RNA, 11 nt, Salmonella enterica enterica serovar Typhi Ty2
auggcacugcg

SEQ ID NO: 1794564 - RNA, 16 nt, Salmonella enterica enterica serovar Typhi Ty2
auggcagaauaaaaca

SEQ ID NO: 1794565 - RNA, 13 nt, Salmonella enterica enterica serovar Typhi Ty2
auggacuuccgca

SEQ ID NO: 1794566 - RNA, 12 nt, Salmonella enterica enterica serovar Typhi Ty2
auggaggcagug

SEQ ID NO: 1794567 - RNA, 17 nt, Salmonella enterica enterica serovar Typhi Ty2
auggacgggauacggcg

SEQ ID NO: 1794568 - RNA, 16 nt, Salmonella enterica enterica serovar Typhi Ty2
auggacagauuuccac

SEQ ID NO: 1794569 - RNA, 20 nt, Salmonella enterica enterica serovar Typhi Ty2
augcuugcuuugcggcauaa

SEQ ID NO: 1794570 - RNA, 15 nt, Salmonella enterica enterica serovar Typhi Ty2
augcuuuaaaugccu

SEQ ID NO: 1794571 - RNA, 17 nt, Salmonella enterica enterica serovar Typhi Ty2
augcuuuaaaugccugu

SEQ ID NO: 1794572 - RNA, 20 nt, Salmonella enterica enterica serovar Typhi Ty2
augcuuuccagccaugccag

SEQ ID NO: 1794573 - RNA, 18 nt, Salmonella enterica enterica serovar Typhi Ty2
augcuuucgcgauaauca

SEQ ID NO: 1794574 - RNA, 19 nt, Salmonella enterica enterica serovar Typhi Ty2
augcuuucaauaaaucaau

SEQ ID NO: 1794575 - RNA, 14 nt, Salmonella enterica enterica serovar Typhi Ty2
augcuucuucgcca

SEQ ID NO: 1794576 - RNA, 22 nt, Salmonella enterica enterica serovar Typhi Ty2
augcuuccagccguuuaaucuc

SEQ ID NO: 1794577 - RNA, 21 nt, Salmonella enterica enterica serovar Typhi Ty2
augcgcgucccggcagugcau

SEQ ID NO: 1794578 - RNA, 20 nt, Salmonella enterica enterica serovar Typhi Ty2
augcgcgucccggcagugca

SEQ ID NO: 1794579 - RNA, 20 nt, Salmonella enterica enterica serovar Typhi Ty2
augcgcguuuagcgccagca

SEQ ID NO: 1794580 - RNA, 21 nt, Salmonella enterica enterica serovar Typhi Ty2
augcuccaguuguuccagcag

SEQ ID NO: 1794581 - RNA, 16 nt, Salmonella enterica enterica serovar Typhi Ty2
augcgcguagcccaca

SEQ ID NO: 1794582 - RNA, 21 nt, Salmonella enterica enterica serovar Typhi Ty2
augcgcgcgugaccccaggca

SEQ ID NO: 1794583 - RNA, 22 nt, Salmonella enterica enterica serovar Typhi Ty2
augcucgccgucggcagacugg

SEQ ID NO: 1794584 - RNA, 13 nt, Salmonella enterica enterica serovar Typhi Ty2
augcucuccagca

SEQ ID NO: 1794585 - RNA, 21 nt, Salmonella enterica enterica serovar Typhi Ty2
augcucuccuggcauggcucg

SEQ ID NO: 1794586 - RNA, 20 nt, Salmonella enterica enterica serovar Typhi Ty2
augcucugcugugccaguac

SEQ ID NO: 1794587 - RNA, 16 nt, Salmonella enterica enterica serovar Typhi Ty2
augcugcaucuuacug

SEQ ID NO: 1794588 - RNA, 21 nt, Salmonella enterica enterica serovar Typhi Ty2
augcugcguacaaucgcguuu

SEQ ID NO: 1794589 - RNA, 21 nt, Salmonella enterica enterica serovar Typhi Ty2
augcugcaccgcaucaaacuu

SEQ ID NO: 1794590 - RNA, 14 nt, Salmonella enterica enterica serovar Typhi Ty2
augccaccagcgcc

SEQ ID NO: 1794591 - RNA, 21 nt, Salmonella enterica enterica serovar Typhi Ty2
augccacacccugagcgccgc

SEQ ID NO: 1794592 - RNA, 20 nt, Salmonella enterica enterica serovar Typhi Ty2
augcagcgucugcccuccug

SEQ ID NO: 1794593 - RNA, 14 nt, Salmonella enterica enterica serovar Typhi Ty2
augccaagcggcau

SEQ ID NO: 1794594 - RNA, 21 nt, Salmonella enterica enterica serovar Typhi Ty2
augcagcaucaugucacccac

SEQ ID NO: 1794595 - RNA, 20 nt, Salmonella enterica enterica serovar Typhi Ty2
augcacauuagcaauugcca

SEQ ID NO: 1794596 - RNA, 13 nt, Salmonella enterica enterica serovar Typhi Ty2
augcacacgcagc

SEQ ID NO: 1794597 - RNA, 23 nt, Salmonella enterica enterica serovar Typhi Ty2
augcagcaccagauauuuuuccg

SEQ ID NO: 1794598 - RNA, 14 nt, Salmonella enterica enterica serovar Typhi Ty2
augcagaccucugc

SEQ ID NO: 1794599 - RNA, 10 nt, Salmonella enterica enterica serovar Typhi Ty2
augccgccgc

SEQ ID NO: 1794600 - RNA, 16 nt, Salmonella enterica enterica serovar Typhi Ty2
augccgaguuccggau

SEQ ID NO: 1794601 - RNA, 19 nt, Salmonella enterica enterica serovar Typhi Ty2
augccaucggccagcaggc

SEQ ID NO: 1794602 - RNA, 20 nt, Salmonella enterica enterica serovar Typhi Ty2
augccauaaucgauauaauu

SEQ ID NO: 1794603 - RNA, 14 nt, Salmonella enterica enterica serovar Typhi Ty2
augccacgaucccc

SEQ ID NO: 1794604 - RNA, 23 nt, Salmonella enterica enterica serovar Typhi Ty2
augcgccagccagucgccaggca

SEQ ID NO: 1794605 - RNA, 17 nt, Salmonella enterica enterica serovar Typhi Ty2
augcgccagcggccagc

SEQ ID NO: 1794606 - RNA, 12 nt, Salmonella enterica enterica serovar Typhi Ty2
augcgccaggca

SEQ ID NO: 1794607 - RNA, 12 nt, Salmonella enterica enterica serovar Typhi Ty2
augcgcccagcc

SEQ ID NO: 1794608 - RNA, 19 nt, Salmonella enterica enterica serovar Typhi Ty2
augcgccaucccaugcacc

SEQ ID NO: 1794609 - RNA, 15 nt, Salmonella enterica enterica serovar Typhi Ty2
augcgccaggugacg

SEQ ID NO: 1794610 - RNA, 17 nt, Salmonella enterica enterica serovar Typhi Ty2
augcgccccugcaggcg

SEQ ID NO: 1794611 - RNA, 14 nt, Salmonella enterica enterica serovar Typhi Ty2
augcgccugucucc

SEQ ID NO: 1794612 - RNA, 13 nt, Salmonella enterica enterica serovar Typhi Ty2
augcgccugcaau

SEQ ID NO: 1794613 - RNA, 21 nt, Salmonella enterica enterica serovar Typhi Ty2
augcgccugguugacccgcau

SEQ ID NO: 1794614 - RNA, 19 nt, Salmonella enterica enterica serovar Typhi Ty2
augcgccgcgucagcacau

SEQ ID NO: 1794615 - RNA, 22 nt, Salmonella enterica enterica serovar Typhi Ty2
augcgccgccuuggcgaccuga

SEQ ID NO: 1794616 - RNA, 16 nt, Salmonella enterica enterica serovar Typhi Ty2
augcgaaugcuggcug

SEQ ID NO: 1794617 - RNA, 16 nt, Salmonella enterica enterica serovar Typhi Ty2
augcgacgcccaacca

SEQ ID NO: 1794618 - RNA, 15 nt, Salmonella enterica enterica serovar Typhi Ty2
augcgacugaaaauc

SEQ ID NO: 1794619 - RNA, 16 nt, Salmonella enterica enterica serovar Typhi Ty2
augcgacuaaccugau

SEQ ID NO: 1794620 - RNA, 16 nt, Salmonella enterica enterica serovar Typhi Ty2
augcgcaugugagcau

SEQ ID NO: 1794621 - RNA, 16 nt, Salmonella enterica enterica serovar Typhi Ty2
augcgcaugggcauaa

SEQ ID NO: 1794622 - RNA, 22 nt, Salmonella enterica enterica serovar Typhi Ty2
augccugcgccauguucauaaa

SEQ ID NO: 1794623 - RNA, 21 nt, Salmonella enterica enterica serovar Typhi Ty2
augccugcgcauccucuuucc

SEQ ID NO: 1794624 - RNA, 17 nt, Salmonella enterica enterica serovar Typhi Ty2
augccuggggucgucag

SEQ ID NO: 1794625 - RNA, 14 nt, Salmonella enterica enterica serovar Typhi Ty2
augccugucaucau

SEQ ID NO: 1794626 - RNA, 22 nt, Salmonella enterica enterica serovar Typhi Ty2
augccuuauccggccugcaggc

SEQ ID NO: 1794627 - RNA, 21 nt, Salmonella enterica enterica serovar Typhi Ty2
augccuucauaaugaauacgc

SEQ ID NO: 1794628 - RNA, 22 nt, Salmonella enterica enterica serovar Typhi Ty2
augccgccugccgcgccgccgc

SEQ ID NO: 1794629 - RNA, 15 nt, Salmonella enterica enterica serovar Typhi Ty2
augccuaacccuuuu

SEQ ID NO: 1794630 - RNA, 21 nt, Salmonella enterica enterica serovar Typhi Ty2
augagcacgcggaagaaauag

SEQ ID NO: 1794631 - RNA, 14 nt, Salmonella enterica enterica serovar Typhi Ty2
augaugaaaaagaa

SEQ ID NO: 1794632 - RNA, 17 nt, Salmonella enterica enterica serovar Typhi Ty2
augaugaccgaagcagg

SEQ ID NO: 1794633 - RNA, 21 nt, Salmonella enterica enterica serovar Typhi Ty2
augaugaccuggugcaucaua

SEQ ID NO: 1794634 - RNA, 21 nt, Salmonella enterica enterica serovar Typhi Ty2
augaugagaugcaggccaagc

SEQ ID NO: 1794635 - RNA, 19 nt, Salmonella enterica enterica serovar Typhi Ty2
augauuauuguuaaaaaga

SEQ ID NO: 1794636 - RNA, 15 nt, Salmonella enterica enterica serovar Typhi Ty2
augauuacggaacaa

SEQ ID NO: 1794637 - RNA, 14 nt, Salmonella enterica enterica serovar Typhi Ty2
augauggugagagc

SEQ ID NO: 1794638 - RNA, 17 nt, Salmonella enterica enterica serovar Typhi Ty2
augauggggucacaggu

SEQ ID NO: 1794639 - RNA, 23 nt, Salmonella enterica enterica serovar Typhi Ty2
augauguccgccuugaggcguuu

SEQ ID NO: 1794640 - RNA, 15 nt, Salmonella enterica enterica serovar Typhi Ty2
augauuaucaucuau

SEQ ID NO: 1794641 - RNA, 23 nt, Salmonella enterica enterica serovar Typhi Ty2
augauuuucuuauuacaagaaag

SEQ ID NO: 1794642 - RNA, 14 nt, Salmonella enterica enterica serovar Typhi Ty2
augauuuuaacauc

SEQ ID NO: 1794643 - RNA, 16 nt, Salmonella enterica enterica serovar Typhi Ty2
augauuuuaacaucac

SEQ ID NO: 1794644 - RNA, 21 nt, Salmonella enterica enterica serovar Typhi Ty2
augauuugcaaccgcucuuuu

SEQ ID NO: 1794645 - RNA, 16 nt, Salmonella enterica enterica serovar Typhi Ty2
augcaaaagaaaaaac

SEQ ID NO: 1794646 - RNA, 19 nt, Salmonella enterica enterica serovar Typhi Ty2
augcaauuccgcuuucuuc

SEQ ID NO: 1794647 - RNA, 19 nt, Salmonella enterica enterica serovar Typhi Ty2
augcacaauacgccgagca

SEQ ID NO: 1794648 - RNA, 15 nt, Salmonella enterica enterica serovar Typhi Ty2
augcacaacacgcuu

SEQ ID NO: 1794649 - RNA, 18 nt, Salmonella enterica enterica serovar Typhi Ty2
caauucuggaaucaauuu

SEQ ID NO: 1794650 - RNA, 20 nt, Salmonella enterica enterica serovar Typhi Ty2
caauucuggcgcacauugcu

SEQ ID NO: 1794651 - RNA, 16 nt, Salmonella enterica enterica serovar Typhi Ty2
caauucuggaaucaau

SEQ ID NO: 1794652 - RNA, 19 nt, Salmonella enterica enterica serovar Typhi Ty2
caauguuaacuacuuuaca

SEQ ID NO: 1794653 - RNA, 21 nt, Salmonella enterica enterica serovar Typhi Ty2
caaugugcagcaggacgcgca

SEQ ID NO: 1794654 - RNA, 19 nt, Salmonella enterica enterica serovar Typhi Ty2
caauuccggcccaggccau

SEQ ID NO: 1794655 - RNA, 14 nt, Salmonella enterica enterica serovar Typhi Ty2
caauugcaggcagc

SEQ ID NO: 1794656 - RNA, 24 nt, Salmonella enterica enterica serovar Typhi Ty2
caauugccacauagcauccagacc

SEQ ID NO: 1794657 - RNA, 12 nt, Salmonella enterica enterica serovar Typhi Ty2
caauuuaucugc

SEQ ID NO: 1794658 - RNA, 15 nt, Salmonella enterica enterica serovar Typhi Ty2
caauuucaaugaugc

SEQ ID NO: 1794659 - RNA, 16 nt, Salmonella enterica enterica serovar Typhi Ty2
caauuucauauuauua

SEQ ID NO: 1794660 - RNA, 18 nt, Salmonella enterica enterica serovar Typhi Ty2
caauuucagcauccuccg

SEQ ID NO: 1794661 - RNA, 15 nt, Salmonella enterica enterica serovar Typhi Ty2
caauuucccccacuu

SEQ ID NO: 1794662 - RNA, 14 nt, Salmonella enterica enterica serovar Typhi Ty2
caauuuccgccgcc

SEQ ID NO: 1794663 - RNA, 21 nt, Salmonella enterica enterica serovar Typhi Ty2
caauuucucgcucgcccauca

SEQ ID NO: 1794664 - RNA, 18 nt, Salmonella enterica enterica serovar Typhi Ty2
caaucugguggcguuccu

SEQ ID NO: 1794665 - RNA, 20 nt, Salmonella enterica enterica serovar Typhi Ty2
caaucugguggcguuccuua

SEQ ID NO: 1794666 - RNA, 22 nt, Salmonella enterica enterica serovar Typhi Ty2
caaucugguggcguuccuuauc

SEQ ID NO: 1794667 - RNA, 21 nt, Salmonella enterica enterica serovar Typhi Ty2
caaucuggugacgaugauaac

SEQ ID NO: 1794668 - RNA, 19 nt, Salmonella enterica enterica serovar Typhi Ty2
caaucuguucguugcugua

SEQ ID NO: 1794669 - RNA, 17 nt, Salmonella enterica enterica serovar Typhi Ty2
caaucuguuuguuagaa

SEQ ID NO: 1794670 - RNA, 17 nt, Salmonella enterica enterica serovar Typhi Ty2
caaugaccacaaauucu

SEQ ID NO: 1794671 - RNA, 17 nt, Salmonella enterica enterica serovar Typhi Ty2
caauguacguaaaacca

SEQ ID NO: 1794672 - RNA, 18 nt, Salmonella enterica enterica serovar Typhi Ty2
caauguacguaaaaccag

SEQ ID NO: 1794673 - RNA, 19 nt, Salmonella enterica enterica serovar Typhi Ty2
caauguaaaacugacuaaa

SEQ ID NO: 1794674 - RNA, 14 nt, Salmonella enterica enterica serovar Typhi Ty2
caauguaaaacuga

SEQ ID NO: 1794675 - RNA, 21 nt, Salmonella enterica enterica serovar Typhi Ty2
caauguauuguucaugcaauu

SEQ ID NO: 1794676 - RNA, 17 nt, Salmonella enterica enterica serovar Typhi Ty2
caaugucgcaaucggcu

SEQ ID NO: 1794677 - RNA, 13 nt, Salmonella enterica enterica serovar Typhi Ty2
caauggcgacgau

SEQ ID NO: 1794678 - RNA, 18 nt, Salmonella enterica enterica serovar Typhi Ty2
caauggcgucaaacagcu

SEQ ID NO: 1794679 - RNA, 19 nt, Salmonella enterica enterica serovar Typhi Ty2
caauggcuagggaaacgcu

SEQ ID NO: 1794680 - RNA, 16 nt, Salmonella enterica enterica serovar Typhi Ty2
caauggccgcagcgcc

SEQ ID NO: 1794681 - RNA, 21 nt, Salmonella enterica enterica serovar Typhi Ty2
cacaacauuccgcuuccagaa

SEQ ID NO: 1794682 - RNA, 12 nt, Salmonella enterica enterica serovar Typhi Ty2
cacaacccaaag

SEQ ID NO: 1794683 - RNA, 16 nt, Salmonella enterica enterica serovar Typhi Ty2
cacaacgaguccccuc

SEQ ID NO: 1794684 - RNA, 17 nt, Salmonella enterica enterica serovar Typhi Ty2
cacaaccggcuggcuau

SEQ ID NO: 1794685 - RNA, 15 nt, Salmonella enterica enterica serovar Typhi Ty2
cacaaccugaaagaa

SEQ ID NO: 1794686 - RNA, 22 nt, Salmonella enterica enterica serovar Typhi Ty2
cacaacgcgaguauucgcgccc

SEQ ID NO: 1794687 - RNA, 13 nt, Salmonella enterica enterica serovar Typhi Ty2
cacaacuguucuu

SEQ ID NO: 1794688 - RNA, 21 nt, Salmonella enterica enterica serovar Typhi Ty2
cacaacgucaguggaaaacag

SEQ ID NO: 1794689 - RNA, 12 nt, Salmonella enterica enterica serovar Typhi Ty2
cacaacguaaua

SEQ ID NO: 1794690 - RNA, 13 nt, Salmonella enterica enterica serovar Typhi Ty2
cacaaucaaggca

SEQ ID NO: 1794691 - RNA, 21 nt, Salmonella enterica enterica serovar Typhi Ty2
cacaaucccgccagacccgca

SEQ ID NO: 1794692 - RNA, 13 nt, Salmonella enterica enterica serovar Typhi Ty2
cacaaguuuaucc

SEQ ID NO: 1794693 - RNA, 17 nt, Salmonella enterica enterica serovar Typhi Ty2
cacaaguuuauccagca

SEQ ID NO: 1794694 - RNA, 19 nt, Salmonella enterica enterica serovar Typhi Ty2
cacaagagcagcaacccug

SEQ ID NO: 1794695 - RNA, 20 nt, Salmonella enterica enterica serovar Typhi Ty2
cacagaaaaaccaaaaaaua

SEQ ID NO: 1794696 - RNA, 15 nt, Salmonella enterica enterica serovar Typhi Ty2
cacacuuucugcuuu

SEQ ID NO: 1794697 - RNA, 22 nt, Salmonella enterica enterica serovar Typhi Ty2
cacacuguuuaaugcuuucaau

SEQ ID NO: 1794698 - RNA, 13 nt, Salmonella enterica enterica serovar Typhi Ty2
cacacuuaccgac

SEQ ID NO: 1794699 - RNA, 14 nt, Salmonella enterica enterica serovar Typhi Ty2
cacacuuucaucag

SEQ ID NO: 1794700 - RNA, 15 nt, Salmonella enterica enterica serovar Typhi Ty2
cacacuuucaucagc

SEQ ID NO: 1794701 - RNA, 13 nt, Salmonella enterica enterica serovar Typhi Ty2
cacagaagcgccu

SEQ ID NO: 1794702 - RNA, 20 nt, Salmonella enterica enterica serovar Typhi Ty2
cacagaaggcuaacagcugg

SEQ ID NO: 1794703 - RNA, 20 nt, Salmonella enterica enterica serovar Typhi Ty2
cacagcacuaacgaggccac

SEQ ID NO: 1794704 - RNA, 19 nt, Salmonella enterica enterica serovar Typhi Ty2
cacagcacgauaugcauaa

SEQ ID NO: 1794705 - RNA, 21 nt, Salmonella enterica enterica serovar Typhi Ty2
cacagcagaaagcaacagcaa

SEQ ID NO: 1794706 - RNA, 19 nt, Salmonella enterica enterica serovar Typhi Ty2
cacagcaccauguugacca

SEQ ID NO: 1794707 - RNA, 15 nt, Salmonella enterica enterica serovar Typhi Ty2
cacagcaaacauccc

SEQ ID NO: 1794708 - RNA, 22 nt, Salmonella enterica enterica serovar Typhi Ty2
cacaaugacagaaaugcaggga

SEQ ID NO: 1794709 - RNA, 18 nt, Salmonella enterica enterica serovar Typhi Ty2
cacacaggaguucaucau

SEQ ID NO: 1794710 - RNA, 23 nt, Salmonella enterica enterica serovar Typhi Ty2
cacacacuguuuaaugcuuucaa

SEQ ID NO: 1794711 - RNA, 15 nt, Salmonella enterica enterica serovar Typhi Ty2
cacaccaacgcuggc

SEQ ID NO: 1794712 - RNA, 13 nt, Salmonella enterica enterica serovar Typhi Ty2
cacacaugcaaaa

SEQ ID NO: 1794713 - RNA, 19 nt, Salmonella enterica enterica serovar Typhi Ty2
cacacgucugagcaggcgg

SEQ ID NO: 1794714 - RNA, 14 nt, Salmonella enterica enterica serovar Typhi Ty2
cacacggcauucac

SEQ ID NO: 1794715 - RNA, 16 nt, Salmonella enterica enterica serovar Typhi Ty2
caccagcacagcccag

SEQ ID NO: 1794716 - RNA, 23 nt, Salmonella enterica enterica serovar Typhi Ty2
caccacugaaaaauaauuacuau

SEQ ID NO: 1794717 - RNA, 21 nt, Salmonella enterica enterica serovar Typhi Ty2
caccacguaaugcgccccggc

SEQ ID NO: 1794718 - RNA, 15 nt, Salmonella enterica enterica serovar Typhi Ty2
caccacgcccuucac

SEQ ID NO: 1794719 - RNA, 21 nt, Salmonella enterica enterica serovar Typhi Ty2
caccacgaucuugucacaaua

SEQ ID NO: 1794720 - RNA, 15 nt, Salmonella enterica enterica serovar Typhi Ty2
caccacgccgagaaa

SEQ ID NO: 1794721 - RNA, 13 nt, Salmonella enterica enterica serovar Typhi Ty2
caccaccugguua

SEQ ID NO: 1794722 - RNA, 14 nt, Salmonella enterica enterica serovar Typhi Ty2
caccaccaggaacg

SEQ ID NO: 1794723 - RNA, 18 nt, Salmonella enterica enterica serovar Typhi Ty2
caccagcggaauccccgc

SEQ ID NO: 1794724 - RNA, 12 nt, Salmonella enterica enterica serovar Typhi Ty2
aaaauaaacacu

SEQ ID NO: 1794725 - RNA, 17 nt, Salmonella enterica enterica serovar Typhi Ty2
caccagguucagcaacg

SEQ ID NO: 1794726 - RNA, 20 nt, Salmonella enterica enterica serovar Typhi Ty2
caccaggcguaagaucccag

SEQ ID NO: 1794727 - RNA, 19 nt, Salmonella enterica enterica serovar Typhi Ty2
aaaaguguguaccagcagc

SEQ ID NO: 1794728 - RNA, 13 nt, Salmonella enterica enterica serovar Typhi Ty2
caccagcgccaga

SEQ ID NO: 1794729 - RNA, 17 nt, Salmonella enterica enterica serovar Typhi Ty2
caccagcgccugcgcug

SEQ ID NO: 1794730 - RNA, 19 nt, Salmonella enterica enterica serovar Typhi Ty2
caccagcgcgccgccgccc

SEQ ID NO: 1794731 - RNA, 11 nt, Salmonella enterica enterica serovar Typhi Ty2
caccagcgccg

SEQ ID NO: 1794732 - RNA, 16 nt, Salmonella enterica enterica serovar Typhi Ty2
caccagcgccugcgcu

SEQ ID NO: 1794733 - RNA, 12 nt, Salmonella enterica enterica serovar Typhi Ty2
caccagcccauc

SEQ ID NO: 1794734 - RNA, 21 nt, Salmonella enterica enterica serovar Typhi Ty2
caccagcccaucuuucgccag

SEQ ID NO: 1794735 - RNA, 17 nt, Salmonella enterica enterica serovar Typhi Ty2
caccagccaggccgcca

SEQ ID NO: 1794736 - RNA, 19 nt, Salmonella enterica enterica serovar Typhi Ty2
caccagcagggcaugauua

SEQ ID NO: 1794737 - RNA, 13 nt, Salmonella enterica enterica serovar Typhi Ty2
cacauccagcgcc

SEQ ID NO: 1794738 - RNA, 17 nt, Salmonella enterica enterica serovar Typhi Ty2
cacaucauuaaagcgcu

SEQ ID NO: 1794739 - RNA, 16 nt, Salmonella enterica enterica serovar Typhi Ty2
cacaucaggaaugcca

SEQ ID NO: 1794740 - RNA, 14 nt, Salmonella enterica enterica serovar Typhi Ty2
cacauauugcgcuu

SEQ ID NO: 1794741 - RNA, 17 nt, Salmonella enterica enterica serovar Typhi Ty2
cacauauugcgcuucac

SEQ ID NO: 1794742 - RNA, 15 nt, Salmonella enterica enterica serovar Typhi Ty2
cacagccagcacgag

SEQ ID NO: 1794743 - RNA, 21 nt, Salmonella enterica enterica serovar Typhi Ty2
cacagcggacacccgcagcca

SEQ ID NO: 1794744 - RNA, 21 nt, Salmonella enterica enterica serovar Typhi Ty2
cacauauaacaaacgccgcuc

SEQ ID NO: 1794745 - RNA, 18 nt, Salmonella enterica enterica serovar Typhi Ty2
cacauagcauccagaccc

SEQ ID NO: 1794746 - RNA, 21 nt, Salmonella enterica enterica serovar Typhi Ty2
cacagcuugccguagcgcgcu

SEQ ID NO: 1794747 - RNA, 22 nt, Salmonella enterica enterica serovar Typhi Ty2
cacagcuugccguagcgcgcuu

SEQ ID NO: 1794748 - RNA, 23 nt, Salmonella enterica enterica serovar Typhi Ty2
cacauuuuuaucaggccugccug

SEQ ID NO: 1794749 - RNA, 12 nt, Salmonella enterica enterica serovar Typhi Ty2
caccaaaaagcc

SEQ ID NO: 1794750 - RNA, 13 nt, Salmonella enterica enterica serovar Typhi Ty2
caccaaaaagcca

SEQ ID NO: 1794751 - RNA, 17 nt, Salmonella enterica enterica serovar Typhi Ty2
caccaaaaauucuuuua

SEQ ID NO: 1794752 - RNA, 12 nt, Salmonella enterica enterica serovar Typhi Ty2
cacauuccauuu

SEQ ID NO: 1794753 - RNA, 22 nt, Salmonella enterica enterica serovar Typhi Ty2
cacauucagagcguccacgcca

SEQ ID NO: 1794754 - RNA, 14 nt, Salmonella enterica enterica serovar Typhi Ty2
cacauguuggcauu

SEQ ID NO: 1794755 - RNA, 15 nt, Salmonella enterica enterica serovar Typhi Ty2
cacaucgcgcagcag

SEQ ID NO: 1794756 - RNA, 15 nt, Salmonella enterica enterica serovar Typhi Ty2
cacaucgccguucca

SEQ ID NO: 1794757 - RNA, 22 nt, Salmonella enterica enterica serovar Typhi Ty2
caccacaaacgccgucacaaag

SEQ ID NO: 1794758 - RNA, 14 nt, Salmonella enterica enterica serovar Typhi Ty2
caccacaaaggcgc

SEQ ID NO: 1794759 - RNA, 23 nt, Salmonella enterica enterica serovar Typhi Ty2
caccaacgauaaauuuucagaca

SEQ ID NO: 1794760 - RNA, 19 nt, Salmonella enterica enterica serovar Typhi Ty2
caccaaagccaggccgcca

SEQ ID NO: 1794761 - RNA, 15 nt, Salmonella enterica enterica serovar Typhi Ty2
caccaaaucccccaa

SEQ ID NO: 1794762 - RNA, 20 nt, Salmonella enterica enterica serovar Typhi Ty2
cacgaucuugucacaauaac

SEQ ID NO: 1794763 - RNA, 13 nt, Salmonella enterica enterica serovar Typhi Ty2
cacgacacaaaag

SEQ ID NO: 1794764 - RNA, 18 nt, Salmonella enterica enterica serovar Typhi Ty2
cacgacuaucgucacccu

SEQ ID NO: 1794765 - RNA, 22 nt, Salmonella enterica enterica serovar Typhi Ty2
cacgacuaucgucacccuauuu

SEQ ID NO: 1794766 - RNA, 15 nt, Salmonella enterica enterica serovar Typhi Ty2
cacgacuuucaccag

SEQ ID NO: 1794767 - RNA, 21 nt, Salmonella enterica enterica serovar Typhi Ty2
cacgaaaaguguguaccagca

SEQ ID NO: 1794768 - RNA, 14 nt, Salmonella enterica enterica serovar Typhi Ty2
cacgaaaaauaaaa

SEQ ID NO: 1794769 - RNA, 13 nt, Salmonella enterica enterica serovar Typhi Ty2
cacgaaaaauaaa

SEQ ID NO: 1794770 - RNA, 21 nt, Salmonella enterica enterica serovar Typhi Ty2
aaaauagccgaaacuuauacu

SEQ ID NO: 1794771 - RNA, 13 nt, Salmonella enterica enterica serovar Typhi Ty2
cacgaaucaggau

SEQ ID NO: 1794772 - RNA, 17 nt, Salmonella enterica enterica serovar Typhi Ty2
caccuggaugcugccug

SEQ ID NO: 1794773 - RNA, 18 nt, Salmonella enterica enterica serovar Typhi Ty2
caccuggagcgccuccca

SEQ ID NO: 1794774 - RNA, 20 nt, Salmonella enterica enterica serovar Typhi Ty2
caccugcuguugcggaauac

SEQ ID NO: 1794775 - RNA, 23 nt, Salmonella enterica enterica serovar Typhi Ty2
caccuggucuauucguucucuga

SEQ ID NO: 1794776 - RNA, 15 nt, Salmonella enterica enterica serovar Typhi Ty2
caccuggugcauuuu

SEQ ID NO: 1794777 - RNA, 14 nt, Salmonella enterica enterica serovar Typhi Ty2
caccuccagcgccu

SEQ ID NO: 1794778 - RNA, 23 nt, Salmonella enterica enterica serovar Typhi Ty2
caccucaucgcuaccuucuuccc

SEQ ID NO: 1794779 - RNA, 20 nt, Salmonella enterica enterica serovar Typhi Ty2
caccucagguaaauccgcca

SEQ ID NO: 1794780 - RNA, 17 nt, Salmonella enterica enterica serovar Typhi Ty2
caccucaucacccaguc

SEQ ID NO: 1794781 - RNA, 20 nt, Salmonella enterica enterica serovar Typhi Ty2
aaaauaccccaggggcauau

SEQ ID NO: 1794782 - RNA, 22 nt, Salmonella enterica enterica serovar Typhi Ty2
caccuuacgaauuuuaucuucc

SEQ ID NO: 1794783 - RNA, 15 nt, Salmonella enterica enterica serovar Typhi Ty2
caccuuacccggcgu

SEQ ID NO: 1794784 - RNA, 17 nt, Salmonella enterica enterica serovar Typhi Ty2
caccuuaaacuugccgu

SEQ ID NO: 1794785 - RNA, 22 nt, Salmonella enterica enterica serovar Typhi Ty2
caccuguaaccccagcaucugc

SEQ ID NO: 1794786 - RNA, 18 nt, Salmonella enterica enterica serovar Typhi Ty2
caccuguaaccccagcau

SEQ ID NO: 1794787 - RNA, 19 nt, Salmonella enterica enterica serovar Typhi Ty2
cacgauguucaacgucagc

SEQ ID NO: 1794788 - RNA, 15 nt, Salmonella enterica enterica serovar Typhi Ty2
cacgcccugaagggc

SEQ ID NO: 1794789 - RNA, 21 nt, Salmonella enterica enterica serovar Typhi Ty2
cacgccgugaauuucugcugc

SEQ ID NO: 1794790 - RNA, 14 nt, Salmonella enterica enterica serovar Typhi Ty2
cacgccguccagca

SEQ ID NO: 1794791 - RNA, 20 nt, Salmonella enterica enterica serovar Typhi Ty2
cacgccguccagcaccaccu

SEQ ID NO: 1794792 - RNA, 15 nt, Salmonella enterica enterica serovar Typhi Ty2
cacgccgucgaugau

SEQ ID NO: 1794793 - RNA, 19 nt, Salmonella enterica enterica serovar Typhi Ty2
cacgccgacgcauccgcca

SEQ ID NO: 1794794 - RNA, 17 nt, Salmonella enterica enterica serovar Typhi Ty2
cacgccgacgaccggca

SEQ ID NO: 1794795 - RNA, 13 nt, Salmonella enterica enterica serovar Typhi Ty2
cacgcgaauagcc

SEQ ID NO: 1794796 - RNA, 19 nt, Salmonella enterica enterica serovar Typhi Ty2
cacgcgaugcaaccccuga

SEQ ID NO: 1794797 - RNA, 18 nt, Salmonella enterica enterica serovar Typhi Ty2
cacgcgaugagcugcgau

SEQ ID NO: 1794798 - RNA, 17 nt, Salmonella enterica enterica serovar Typhi Ty2
cacgccugcauaaagga

SEQ ID NO: 1794799 - RNA, 22 nt, Salmonella enterica enterica serovar Typhi Ty2
cacgccucuggcguacgcagau

SEQ ID NO: 1794800 - RNA, 13 nt, Salmonella enterica enterica serovar Typhi Ty2
cacgccuuccucc

SEQ ID NO: 1794801 - RNA, 15 nt, Salmonella enterica enterica serovar Typhi Ty2
cacgcgcgcgcguca

SEQ ID NO: 1794802 - RNA, 13 nt, Salmonella enterica enterica serovar Typhi Ty2
cacgcgcggcgcc

SEQ ID NO: 1794803 - RNA, 19 nt, Salmonella enterica enterica serovar Typhi Ty2
cacgcgcgcugcgccugga

SEQ ID NO: 1794804 - RNA, 14 nt, Salmonella enterica enterica serovar Typhi Ty2
cacgcgccagccgu

SEQ ID NO: 1794805 - RNA, 21 nt, Salmonella enterica enterica serovar Typhi Ty2
cacgcgcgccugccgccagca

SEQ ID NO: 1794806 - RNA, 20 nt, Salmonella enterica enterica serovar Typhi Ty2
cacgcguaucuggucaucgu

SEQ ID NO: 1794807 - RNA, 17 nt, Salmonella enterica enterica serovar Typhi Ty2
cacgcguaaacuuccgc

SEQ ID NO: 1794808 - RNA, 20 nt, Salmonella enterica enterica serovar Typhi Ty2
cacgcggucgucaucggcga

SEQ ID NO: 1794809 - RNA, 22 nt, Salmonella enterica enterica serovar Typhi Ty2
cacgcggaaucgucacagaccc

SEQ ID NO: 1794810 - RNA, 14 nt, Salmonella enterica enterica serovar Typhi Ty2
cacggacucgccuu

SEQ ID NO: 1794811 - RNA, 16 nt, Salmonella enterica enterica serovar Typhi Ty2
cacgcuaaucccgcuc

SEQ ID NO: 1794812 - RNA, 22 nt, Salmonella enterica enterica serovar Typhi Ty2
cacgcucaagaugauagccauu

SEQ ID NO: 1794813 - RNA, 19 nt, Salmonella enterica enterica serovar Typhi Ty2
cacgcucaauggcgcgcca

SEQ ID NO: 1794814 - RNA, 20 nt, Salmonella enterica enterica serovar Typhi Ty2
cacgcuauaaaguagccauu

SEQ ID NO: 1794815 - RNA, 19 nt, Salmonella enterica enterica serovar Typhi Ty2
cacggagagucgcaccgcg

SEQ ID NO: 1794816 - RNA, 20 nt, Salmonella enterica enterica serovar Typhi Ty2
cacgcuccugcuccugcggc

SEQ ID NO: 1794817 - RNA, 21 nt, Salmonella enterica enterica serovar Typhi Ty2
cacggcaacgccguacuccag

SEQ ID NO: 1794818 - RNA, 17 nt, Salmonella enterica enterica serovar Typhi Ty2
aaaauaguucagcgcag

SEQ ID NO: 1794819 - RNA, 18 nt, Salmonella enterica enterica serovar Typhi Ty2
cacgggguuggcccuccc

SEQ ID NO: 1794820 - RNA, 18 nt, Salmonella enterica enterica serovar Typhi Ty2
cacggguagcuagccaau

SEQ ID NO: 1794821 - RNA, 18 nt, Salmonella enterica enterica serovar Typhi Ty2
cacggggcggacgaugaa

SEQ ID NO: 1794822 - RNA, 16 nt, Salmonella enterica enterica serovar Typhi Ty2
cacggcgacaaccgga

SEQ ID NO: 1794823 - RNA, 20 nt, Salmonella enterica enterica serovar Typhi Ty2
caccgcuaaaaaacaggcgc

SEQ ID NO: 1794824 - RNA, 23 nt, Salmonella enterica enterica serovar Typhi Ty2
caccgcuaaucccagcgcgcgcg

SEQ ID NO: 1794825 - RNA, 20 nt, Salmonella enterica enterica serovar Typhi Ty2
caccgcugcgcucacgcggc

SEQ ID NO: 1794826 - RNA, 14 nt, Salmonella enterica enterica serovar Typhi Ty2
caccgcuugccggc

SEQ ID NO: 1794827 - RNA, 19 nt, Salmonella enterica enterica serovar Typhi Ty2
caccgcuugccggcgcagc

SEQ ID NO: 1794828 - RNA, 21 nt, Salmonella enterica enterica serovar Typhi Ty2
caccgcuucacauacccgcuu

SEQ ID NO: 1794829 - RNA, 17 nt, Salmonella enterica enterica serovar Typhi Ty2
caccgcggcgcucgcca

SEQ ID NO: 1794830 - RNA, 22 nt, Salmonella enterica enterica serovar Typhi Ty2
caccgcggagaucgcucccgcg

SEQ ID NO: 1794831 - RNA, 20 nt, Salmonella enterica enterica serovar Typhi Ty2
caccgcggcaaccagcccau

SEQ ID NO: 1794832 - RNA, 18 nt, Salmonella enterica enterica serovar Typhi Ty2
caccgcggcaaccagccc

SEQ ID NO: 1794833 - RNA, 22 nt, Salmonella enterica enterica serovar Typhi Ty2
caccgcgaauauacgcaccuga

SEQ ID NO: 1794834 - RNA, 15 nt, Salmonella enterica enterica serovar Typhi Ty2
caccgcauccgcauc

SEQ ID NO: 1794835 - RNA, 22 nt, Salmonella enterica enterica serovar Typhi Ty2
caccgauacaggacugacugcu

SEQ ID NO: 1794836 - RNA, 13 nt, Salmonella enterica enterica serovar Typhi Ty2
caccggaagugaa

SEQ ID NO: 1794837 - RNA, 22 nt, Salmonella enterica enterica serovar Typhi Ty2
caccgucaacaucaucccgcgc

SEQ ID NO: 1794838 - RNA, 21 nt, Salmonella enterica enterica serovar Typhi Ty2
caccgggagaaaacgcggccu

SEQ ID NO: 1794839 - RNA, 18 nt, Salmonella enterica enterica serovar Typhi Ty2
caccggcuguauacacuu

SEQ ID NO: 1794840 - RNA, 18 nt, Salmonella enterica enterica serovar Typhi Ty2
caccguuugcagccagau

SEQ ID NO: 1794841 - RNA, 19 nt, Salmonella enterica enterica serovar Typhi Ty2
caccguuuaaucgcccugc

SEQ ID NO: 1794842 - RNA, 16 nt, Salmonella enterica enterica serovar Typhi Ty2
caccguucuggcugcc

SEQ ID NO: 1794843 - RNA, 23 nt, Salmonella enterica enterica serovar Typhi Ty2
caccguugggcgcgacgccuggg

SEQ ID NO: 1794844 - RNA, 23 nt, Salmonella enterica enterica serovar Typhi Ty2
caccgucgagaaaccgcucgccg

SEQ ID NO: 1794845 - RNA, 16 nt, Salmonella enterica enterica serovar Typhi Ty2
caccuaacccaccaua

SEQ ID NO: 1794846 - RNA, 19 nt, Salmonella enterica enterica serovar Typhi Ty2
caccucacguucugcauau

SEQ ID NO: 1794847 - RNA, 16 nt, Salmonella enterica enterica serovar Typhi Ty2
caccucacuccagacc

SEQ ID NO: 1794848 - RNA, 20 nt, Salmonella enterica enterica serovar Typhi Ty2
caccucagaauucugcgcgu

SEQ ID NO: 1794849 - RNA, 22 nt, Salmonella enterica enterica serovar Typhi Ty2
caccucaagguagcgugucuac

SEQ ID NO: 1794850 - RNA, 13 nt, Salmonella enterica enterica serovar Typhi Ty2
caccucagccaac

SEQ ID NO: 1794851 - RNA, 19 nt, Salmonella enterica enterica serovar Typhi Ty2
caccucagccaacccacgc

SEQ ID NO: 1794852 - RNA, 20 nt, Salmonella enterica enterica serovar Typhi Ty2
cacccauuuuauccucuuca

SEQ ID NO: 1794853 - RNA, 22 nt, Salmonella enterica enterica serovar Typhi Ty2
cacccauugaacccgaccgucu

SEQ ID NO: 1794854 - RNA, 16 nt, Salmonella enterica enterica serovar Typhi Ty2
cacccauugaacccga

SEQ ID NO: 1794855 - RNA, 14 nt, Salmonella enterica enterica serovar Typhi Ty2
cacccaugccgcga

SEQ ID NO: 1794856 - RNA, 18 nt, Salmonella enterica enterica serovar Typhi Ty2
cacccauagauaccuucu

SEQ ID NO: 1794857 - RNA, 20 nt, Salmonella enterica enterica serovar Typhi Ty2
cacccaguuuuuuucugcca

SEQ ID NO: 1794858 - RNA, 21 nt, Salmonella enterica enterica serovar Typhi Ty2
caccccaaaucucccccggca

SEQ ID NO: 1794859 - RNA, 14 nt, Salmonella enterica enterica serovar Typhi Ty2
caccccaacaaaua

SEQ ID NO: 1794860 - RNA, 20 nt, Salmonella enterica enterica serovar Typhi Ty2
caccagugauuggcuggaca

SEQ ID NO: 1794861 - RNA, 19 nt, Salmonella enterica enterica serovar Typhi Ty2
caccaguagcgcgacgcca

SEQ ID NO: 1794862 - RNA, 21 nt, Salmonella enterica enterica serovar Typhi Ty2
cacccagaauacggccuucuu

SEQ ID NO: 1794863 - RNA, 13 nt, Salmonella enterica enterica serovar Typhi Ty2
cacccgccuuacc

SEQ ID NO: 1794864 - RNA, 12 nt, Salmonella enterica enterica serovar Typhi Ty2
cacccgccggca

SEQ ID NO: 1794865 - RNA, 24 nt, Salmonella enterica enterica serovar Typhi Ty2
cacccgggccggaagagcgcagag

SEQ ID NO: 1794866 - RNA, 18 nt, Salmonella enterica enterica serovar Typhi Ty2
cacccggcugacugccgu

SEQ ID NO: 1794867 - RNA, 22 nt, Salmonella enterica enterica serovar Typhi Ty2
cacccuucuucuggcucagacc

SEQ ID NO: 1794868 - RNA, 10 nt, Salmonella enterica enterica serovar Typhi Ty2
cacccugccc

SEQ ID NO: 1794869 - RNA, 17 nt, Salmonella enterica enterica serovar Typhi Ty2
cacccuugcggcuugca

SEQ ID NO: 1794870 - RNA, 12 nt, Salmonella enterica enterica serovar Typhi Ty2
cacccugccccg

SEQ ID NO: 1794871 - RNA, 21 nt, Salmonella enterica enterica serovar Typhi Ty2
caaagcgguauaacggccaga

SEQ ID NO: 1794872 - RNA, 19 nt, Salmonella enterica enterica serovar Typhi Ty2
caaagcgagguaaaaagcg

SEQ ID NO: 1794873 - RNA, 16 nt, Salmonella enterica enterica serovar Typhi Ty2
caaaggcguaaaaagg

SEQ ID NO: 1794874 - RNA, 13 nt, Salmonella enterica enterica serovar Typhi Ty2
caaagccugcugg

SEQ ID NO: 1794875 - RNA, 20 nt, Salmonella enterica enterica serovar Typhi Ty2
caaagccgccauccggccug

SEQ ID NO: 1794876 - RNA, 19 nt, Salmonella enterica enterica serovar Typhi Ty2
caaagcaauaccacgcccg

SEQ ID NO: 1794877 - RNA, 14 nt, Salmonella enterica enterica serovar Typhi Ty2
caaagcaaucgcca

SEQ ID NO: 1794878 - RNA, 13 nt, Salmonella enterica enterica serovar Typhi Ty2
caaagaccaauaa

SEQ ID NO: 1794879 - RNA, 15 nt, Salmonella enterica enterica serovar Typhi Ty2
caaagauuagcccca

SEQ ID NO: 1794880 - RNA, 19 nt, Salmonella enterica enterica serovar Typhi Ty2
caaagauuagccccagcgc

SEQ ID NO: 1794881 - RNA, 14 nt, Salmonella enterica enterica serovar Typhi Ty2
caaacuuuccguug

SEQ ID NO: 1794882 - RNA, 18 nt, Salmonella enterica enterica serovar Typhi Ty2
caaaccugccacaggcca

SEQ ID NO: 1794883 - RNA, 15 nt, Salmonella enterica enterica serovar Typhi Ty2
caaaccugccacagg

SEQ ID NO: 1794884 - RNA, 21 nt, Salmonella enterica enterica serovar Typhi Ty2
caaaccugccacaggccaaca

SEQ ID NO: 1794885 - RNA, 19 nt, Salmonella enterica enterica serovar Typhi Ty2
caaacgaaccguggccucc

SEQ ID NO: 1794886 - RNA, 13 nt, Salmonella enterica enterica serovar Typhi Ty2
caaacgcuuuuuu

SEQ ID NO: 1794887 - RNA, 19 nt, Salmonella enterica enterica serovar Typhi Ty2
caaacggcagcucuuucaa

SEQ ID NO: 1794888 - RNA, 16 nt, Salmonella enterica enterica serovar Typhi Ty2
caaacggaucuuccac

SEQ ID NO: 1794889 - RNA, 21 nt, Salmonella enterica enterica serovar Typhi Ty2
caaacggccugcgcuggaacu

SEQ ID NO: 1794890 - RNA, 23 nt, Salmonella enterica enterica serovar Typhi Ty2
caaacggcacuacagcccuuuca

SEQ ID NO: 1794891 - RNA, 20 nt, Salmonella enterica enterica serovar Typhi Ty2
caaacuuaucucuuuuucuc

SEQ ID NO: 1794892 - RNA, 18 nt, Salmonella enterica enterica serovar Typhi Ty2
caaacuuugcgccauuuc

SEQ ID NO: 1794893 - RNA, 21 nt, Salmonella enterica enterica serovar Typhi Ty2
caaaccgguaaucccuucacg

SEQ ID NO: 1794894 - RNA, 23 nt, Salmonella enterica enterica serovar Typhi Ty2
caaaccagacgcguaaccccugc

SEQ ID NO: 1794895 - RNA, 12 nt, Salmonella enterica enterica serovar Typhi Ty2
caaaccacugcu

SEQ ID NO: 1794896 - RNA, 14 nt, Salmonella enterica enterica serovar Typhi Ty2
caaaccacugcugu

SEQ ID NO: 1794897 - RNA, 16 nt, Salmonella enterica enterica serovar Typhi Ty2
caaaccagcuuuucau

SEQ ID NO: 1794898 - RNA, 17 nt, Salmonella enterica enterica serovar Typhi Ty2
caaaccaugauaauaau

SEQ ID NO: 1794899 - RNA, 16 nt, Salmonella enterica enterica serovar Typhi Ty2
caaacaaauaaaucca

SEQ ID NO: 1794900 - RNA, 13 nt, Salmonella enterica enterica serovar Typhi Ty2
caaacaaauaaau

SEQ ID NO: 1794901 - RNA, 22 nt, Salmonella enterica enterica serovar Typhi Ty2
caaaagauuuaucaauuuuuaa

SEQ ID NO: 1794902 - RNA, 16 nt, Salmonella enterica enterica serovar Typhi Ty2
caaaagcaucaauuug

SEQ ID NO: 1794903 - RNA, 23 nt, Salmonella enterica enterica serovar Typhi Ty2
caaaagaggaaguugcucccgca

SEQ ID NO: 1794904 - RNA, 18 nt, Salmonella enterica enterica serovar Typhi Ty2
caaaagaaagcaauagcu

SEQ ID NO: 1794905 - RNA, 14 nt, Salmonella enterica enterica serovar Typhi Ty2
caaaagaaaaaacu

SEQ ID NO: 1794906 - RNA, 21 nt, Salmonella enterica enterica serovar Typhi Ty2
caaaacuuauuuuauuuuuau

SEQ ID NO: 1794907 - RNA, 17 nt, Salmonella enterica enterica serovar Typhi Ty2
caaaacuacgccaauga

SEQ ID NO: 1794908 - RNA, 20 nt, Salmonella enterica enterica serovar Typhi Ty2
caaaaagauauuauaaaaua

SEQ ID NO: 1794909 - RNA, 11 nt, Salmonella enterica enterica serovar Typhi Ty2
caaaaagccuu

SEQ ID NO: 1794910 - RNA, 20 nt, Salmonella enterica enterica serovar Typhi Ty2
caaaaagaacucacucagug

SEQ ID NO: 1794911 - RNA, 23 nt, Salmonella enterica enterica serovar Typhi Ty2
caaaaacggcuuuaauaccccug

SEQ ID NO: 1794912 - RNA, 23 nt, Salmonella enterica enterica serovar Typhi Ty2
caaaaacguuaggcgcaaaggca

SEQ ID NO: 1794913 - RNA, 15 nt, Salmonella enterica enterica serovar Typhi Ty2
caaaaacgcccccag

SEQ ID NO: 1794914 - RNA, 18 nt, Salmonella enterica enterica serovar Typhi Ty2
caaaacguagagugcuuc

SEQ ID NO: 1794915 - RNA, 17 nt, Salmonella enterica enterica serovar Typhi Ty2
caaaacgucgugagugg

SEQ ID NO: 1794916 - RNA, 17 nt, Salmonella enterica enterica serovar Typhi Ty2
caaaacgcugcuauuuu

SEQ ID NO: 1794917 - RNA, 19 nt, Salmonella enterica enterica serovar Typhi Ty2
caaaaccuucauaaauacg

SEQ ID NO: 1794918 - RNA, 21 nt, Salmonella enterica enterica serovar Typhi Ty2
caaaacgccgguacuggagac

SEQ ID NO: 1794919 - RNA, 17 nt, Salmonella enterica enterica serovar Typhi Ty2
caaaacgcauccagcgc

SEQ ID NO: 1794920 - RNA, 23 nt, Salmonella enterica enterica serovar Typhi Ty2
caaaaggucgauuaaacgccugg

SEQ ID NO: 1794921 - RNA, 21 nt, Salmonella enterica enterica serovar Typhi Ty2
caaaaggcuggaacagauguu

SEQ ID NO: 1794922 - RNA, 23 nt, Salmonella enterica enterica serovar Typhi Ty2
caaaaggcuccacuucgguuugu

SEQ ID NO: 1794923 - RNA, 17 nt, Salmonella enterica enterica serovar Typhi Ty2
caaaaggcuggaacaga

SEQ ID NO: 1794924 - RNA, 20 nt, Salmonella enterica enterica serovar Typhi Ty2
caaaaggcgccgcuuccccc

SEQ ID NO: 1794925 - RNA, 22 nt, Salmonella enterica enterica serovar Typhi Ty2
caaaaggccuuuuuuuuaugcg

SEQ ID NO: 1794926 - RNA, 14 nt, Salmonella enterica enterica serovar Typhi Ty2
caaaauucacacca

SEQ ID NO: 1794927 - RNA, 18 nt, Salmonella enterica enterica serovar Typhi Ty2
caaaauuuuuuaucaggu

SEQ ID NO: 1794928 - RNA, 14 nt, Salmonella enterica enterica serovar Typhi Ty2
caaaauagucaguu

SEQ ID NO: 1794929 - RNA, 24 nt, Salmonella enterica enterica serovar Typhi Ty2
caaaauccuuguugauaaaacgaa

SEQ ID NO: 1794930 - RNA, 20 nt, Salmonella enterica enterica serovar Typhi Ty2
caaaauccuuguugauaaaa

SEQ ID NO: 1794931 - RNA, 20 nt, Salmonella enterica enterica serovar Typhi Ty2
caaaaucccggcuggguuca

SEQ ID NO: 1794932 - RNA, 16 nt, Salmonella enterica enterica serovar Typhi Ty2
caaaaucccggcuggg

SEQ ID NO: 1794933 - RNA, 16 nt, Salmonella enterica enterica serovar Typhi Ty2
caaaauccgccaccgc

SEQ ID NO: 1794934 - RNA, 23 nt, Salmonella enterica enterica serovar Typhi Ty2
caaaaucguuaaccagcggcgac

SEQ ID NO: 1794935 - RNA, 23 nt, Salmonella enterica enterica serovar Typhi Ty2
caacaccaucccgcucuucagua

SEQ ID NO: 1794936 - RNA, 12 nt, Salmonella enterica enterica serovar Typhi Ty2
caacaccauccc

SEQ ID NO: 1794937 - RNA, 19 nt, Salmonella enterica enterica serovar Typhi Ty2
caacaccgauccgaagaac

SEQ ID NO: 1794938 - RNA, 14 nt, Salmonella enterica enterica serovar Typhi Ty2
caacaaagguuugu

SEQ ID NO: 1794939 - RNA, 12 nt, Salmonella enterica enterica serovar Typhi Ty2
caacaaacauaa

SEQ ID NO: 1794940 - RNA, 14 nt, Salmonella enterica enterica serovar Typhi Ty2
caacaaacauaagc

SEQ ID NO: 1794941 - RNA, 14 nt, Salmonella enterica enterica serovar Typhi Ty2
caacaacagauaua

SEQ ID NO: 1794942 - RNA, 18 nt, Salmonella enterica enterica serovar Typhi Ty2
caacaaagccugcuggaa

SEQ ID NO: 1794943 - RNA, 17 nt, Salmonella enterica enterica serovar Typhi Ty2
caacaucgcaaaauucc

SEQ ID NO: 1794944 - RNA, 13 nt, Salmonella enterica enterica serovar Typhi Ty2
caacaucuuugcc

SEQ ID NO: 1794945 - RNA, 16 nt, Salmonella enterica enterica serovar Typhi Ty2
caacaucaguucagaa

SEQ ID NO: 1794946 - RNA, 19 nt, Salmonella enterica enterica serovar Typhi Ty2
caacaucauuauuccccuc

SEQ ID NO: 1794947 - RNA, 15 nt, Salmonella enterica enterica serovar Typhi Ty2
caacaguaccuucaa

SEQ ID NO: 1794948 - RNA, 15 nt, Salmonella enterica enterica serovar Typhi Ty2
caacagcggagagac

SEQ ID NO: 1794949 - RNA, 21 nt, Salmonella enterica enterica serovar Typhi Ty2
caacagugggcuaugaagaga

SEQ ID NO: 1794950 - RNA, 16 nt, Salmonella enterica enterica serovar Typhi Ty2
caacagugggcuauga

SEQ ID NO: 1794951 - RNA, 20 nt, Salmonella enterica enterica serovar Typhi Ty2
caacagugugccgucaucca

SEQ ID NO: 1794952 - RNA, 18 nt, Salmonella enterica enterica serovar Typhi Ty2
caacccuggcgcuuuaaa

SEQ ID NO: 1794953 - RNA, 21 nt, Salmonella enterica enterica serovar Typhi Ty2
caaccggcuccggguugccug

SEQ ID NO: 1794954 - RNA, 19 nt, Salmonella enterica enterica serovar Typhi Ty2
caacccuauugccacaaua

SEQ ID NO: 1794955 - RNA, 14 nt, Salmonella enterica enterica serovar Typhi Ty2
caacccaaaggcca

SEQ ID NO: 1794956 - RNA, 15 nt, Salmonella enterica enterica serovar Typhi Ty2
caacccacauuggcc

SEQ ID NO: 1794957 - RNA, 22 nt, Salmonella enterica enterica serovar Typhi Ty2
caaccaugauaaccagccccgg

SEQ ID NO: 1794958 - RNA, 23 nt, Salmonella enterica enterica serovar Typhi Ty2
caaccaugauaaccagccccggg

SEQ ID NO: 1794959 - RNA, 20 nt, Salmonella enterica enterica serovar Typhi Ty2
caaccaugauaaccagcccc

SEQ ID NO: 1794960 - RNA, 11 nt, Salmonella enterica enterica serovar Typhi Ty2
caaccauacau

SEQ ID NO: 1794961 - RNA, 22 nt, Salmonella enterica enterica serovar Typhi Ty2
caaccaguggcggggcagaacc

SEQ ID NO: 1794962 - RNA, 21 nt, Salmonella enterica enterica serovar Typhi Ty2
caacauuaucaaaagugauca

SEQ ID NO: 1794963 - RNA, 15 nt, Salmonella enterica enterica serovar Typhi Ty2
caacauucugcuucc

SEQ ID NO: 1794964 - RNA, 22 nt, Salmonella enterica enterica serovar Typhi Ty2
caacauggacaccggaagugaa

SEQ ID NO: 1794965 - RNA, 23 nt, Salmonella enterica enterica serovar Typhi Ty2
caacaugcugaccgaaccgcugu

SEQ ID NO: 1794966 - RNA, 21 nt, Salmonella enterica enterica serovar Typhi Ty2
caacaucuuaccggugcgauu

SEQ ID NO: 1794967 - RNA, 23 nt, Salmonella enterica enterica serovar Typhi Ty2
caacauugccggcaucauucugc

SEQ ID NO: 1794968 - RNA, 21 nt, Salmonella enterica enterica serovar Typhi Ty2
caacauuggaaaacuccagca

SEQ ID NO: 1794969 - RNA, 18 nt, Salmonella enterica enterica serovar Typhi Ty2
caacauuauuaaaauguc

SEQ ID NO: 1794970 - RNA, 19 nt, Salmonella enterica enterica serovar Typhi Ty2
caacauugaggcuacccag

SEQ ID NO: 1794971 - RNA, 12 nt, Salmonella enterica enterica serovar Typhi Ty2
caaccaggcaaa

SEQ ID NO: 1794972 - RNA, 17 nt, Salmonella enterica enterica serovar Typhi Ty2
caaccaggcaaaccagc

SEQ ID NO: 1794973 - RNA, 22 nt, Salmonella enterica enterica serovar Typhi Ty2
caaccagcgaaaugacggccac

SEQ ID NO: 1794974 - RNA, 17 nt, Salmonella enterica enterica serovar Typhi Ty2
caaccagcgaaaugacg

SEQ ID NO: 1794975 - RNA, 18 nt, Salmonella enterica enterica serovar Typhi Ty2
caaccagccgaucagcgc

SEQ ID NO: 1794976 - RNA, 14 nt, Salmonella enterica enterica serovar Typhi Ty2
caaaucaacauuau

SEQ ID NO: 1794977 - RNA, 15 nt, Salmonella enterica enterica serovar Typhi Ty2
caaaucagacgcuuc

SEQ ID NO: 1794978 - RNA, 19 nt, Salmonella enterica enterica serovar Typhi Ty2
caaauccagcucaguuucc

SEQ ID NO: 1794979 - RNA, 13 nt, Salmonella enterica enterica serovar Typhi Ty2
caaauccuccaua

SEQ ID NO: 1794980 - RNA, 15 nt, Salmonella enterica enterica serovar Typhi Ty2
caaaucgacagccag

SEQ ID NO: 1794981 - RNA, 21 nt, Salmonella enterica enterica serovar Typhi Ty2
caaauccgcauuucgcccucg

SEQ ID NO: 1794982 - RNA, 18 nt, Salmonella enterica enterica serovar Typhi Ty2
caaaucgcccaucacaug

SEQ ID NO: 1794983 - RNA, 16 nt, Salmonella enterica enterica serovar Typhi Ty2
caaaucgcccaucaca

SEQ ID NO: 1794984 - RNA, 20 nt, Salmonella enterica enterica serovar Typhi Ty2
caaauauccuaccacgccgc

SEQ ID NO: 1794985 - RNA, 22 nt, Salmonella enterica enterica serovar Typhi Ty2
caaauauccuaccacgccgcua

SEQ ID NO: 1794986 - RNA, 14 nt, Salmonella enterica enterica serovar Typhi Ty2
caaauauuucuuug

SEQ ID NO: 1794987 - RNA, 16 nt, Salmonella enterica enterica serovar Typhi Ty2
caaagucuucaugguc

SEQ ID NO: 1794988 - RNA, 22 nt, Salmonella enterica enterica serovar Typhi Ty2
caaagucagcgcgcgcuuucac

SEQ ID NO: 1794989 - RNA, 20 nt, Salmonella enterica enterica serovar Typhi Ty2
caaauguuguuugaaaagug

SEQ ID NO: 1794990 - RNA, 21 nt, Salmonella enterica enterica serovar Typhi Ty2
caaauucagcgucgagcaccu

SEQ ID NO: 1794991 - RNA, 22 nt, Salmonella enterica enterica serovar Typhi Ty2
caaauuccggcacaaccuggcu

SEQ ID NO: 1794992 - RNA, 16 nt, Salmonella enterica enterica serovar Typhi Ty2
caaauuccagcaauga

SEQ ID NO: 1794993 - RNA, 15 nt, Salmonella enterica enterica serovar Typhi Ty2
caaauugcuguucca

SEQ ID NO: 1794994 - RNA, 15 nt, Salmonella enterica enterica serovar Typhi Ty2
caaaugagaauagac

SEQ ID NO: 1794995 - RNA, 15 nt, Salmonella enterica enterica serovar Typhi Ty2
caaaugaccucaaga

SEQ ID NO: 1794996 - RNA, 17 nt, Salmonella enterica enterica serovar Typhi Ty2
caaaugaucguuuuuug

SEQ ID NO: 1794997 - RNA, 22 nt, Salmonella enterica enterica serovar Typhi Ty2
caaaugaaccugaugugcuuuu

SEQ ID NO: 1794998 - RNA, 14 nt, Salmonella enterica enterica serovar Typhi Ty2
caaaugaagucugg

SEQ ID NO: 1794999 - RNA, 13 nt, Salmonella enterica enterica serovar Typhi Ty2
caaaugucagauc

SEQ ID NO: 1795000 - RNA, 18 nt, Salmonella enterica enterica serovar Typhi Ty2
caaaucgggaaaaugaug

SEQ ID NO: 1795001 - RNA, 16 nt, Salmonella enterica enterica serovar Typhi Ty2
caaaucgguaaauguc

SEQ ID NO: 1795002 - RNA, 14 nt, Salmonella enterica enterica serovar Typhi Ty2
caaaucguuuucua

SEQ ID NO: 1795003 - RNA, 16 nt, Salmonella enterica enterica serovar Typhi Ty2
caaaucuguuaucugg

SEQ ID NO: 1795004 - RNA, 15 nt, Salmonella enterica enterica serovar Typhi Ty2
caacggcuugugagc

SEQ ID NO: 1795005 - RNA, 21 nt, Salmonella enterica enterica serovar Typhi Ty2
caacgggcuuuuagccgcgcc

SEQ ID NO: 1795006 - RNA, 20 nt, Salmonella enterica enterica serovar Typhi Ty2
caacgcuuuagugccgccau

SEQ ID NO: 1795007 - RNA, 19 nt, Salmonella enterica enterica serovar Typhi Ty2
caacgcuuuagugccgcca

SEQ ID NO: 1795008 - RNA, 19 nt, Salmonella enterica enterica serovar Typhi Ty2
caacggaagcugaccaggg

SEQ ID NO: 1795009 - RNA, 16 nt, Salmonella enterica enterica serovar Typhi Ty2
caacgcguugccgccg

SEQ ID NO: 1795010 - RNA, 13 nt, Salmonella enterica enterica serovar Typhi Ty2
caacgcucagacc

SEQ ID NO: 1795011 - RNA, 21 nt, Salmonella enterica enterica serovar Typhi Ty2
caacgcugaauaucgucagua

SEQ ID NO: 1795012 - RNA, 15 nt, Salmonella enterica enterica serovar Typhi Ty2
caacgcuucacaacc

SEQ ID NO: 1795013 - RNA, 15 nt, Salmonella enterica enterica serovar Typhi Ty2
caacgcuuccaccuc

SEQ ID NO: 1795014 - RNA, 14 nt, Salmonella enterica enterica serovar Typhi Ty2
caacgcgccgccaa

SEQ ID NO: 1795015 - RNA, 17 nt, Salmonella enterica enterica serovar Typhi Ty2
caacgcgggccauacac

SEQ ID NO: 1795016 - RNA, 22 nt, Salmonella enterica enterica serovar Typhi Ty2
caaccuccgcggggaucgguuu

SEQ ID NO: 1795017 - RNA, 17 nt, Salmonella enterica enterica serovar Typhi Ty2
caacgccuucguccgga

SEQ ID NO: 1795018 - RNA, 19 nt, Salmonella enterica enterica serovar Typhi Ty2
caaccgguaucaaacccuu

SEQ ID NO: 1795019 - RNA, 15 nt, Salmonella enterica enterica serovar Typhi Ty2
caaccgucaucucuu

SEQ ID NO: 1795020 - RNA, 15 nt, Salmonella enterica enterica serovar Typhi Ty2
caaccguuucuuuuu

SEQ ID NO: 1795021 - RNA, 19 nt, Salmonella enterica enterica serovar Typhi Ty2
caaccgugucugcugaucg

SEQ ID NO: 1795022 - RNA, 19 nt, Salmonella enterica enterica serovar Typhi Ty2
caacugcugcgcgugcugu

SEQ ID NO: 1795023 - RNA, 14 nt, Salmonella enterica enterica serovar Typhi Ty2
caacuccacaaaua

SEQ ID NO: 1795024 - RNA, 12 nt, Salmonella enterica enterica serovar Typhi Ty2
caacgucauccc

SEQ ID NO: 1795025 - RNA, 16 nt, Salmonella enterica enterica serovar Typhi Ty2
caacguaaauagagaa

SEQ ID NO: 1795026 - RNA, 22 nt, Salmonella enterica enterica serovar Typhi Ty2
caacguaaucaucaugcugcac

SEQ ID NO: 1795027 - RNA, 16 nt, Salmonella enterica enterica serovar Typhi Ty2
caacguuaacugcugc

SEQ ID NO: 1795028 - RNA, 18 nt, Salmonella enterica enterica serovar Typhi Ty2
caacguuucuuucaucag

SEQ ID NO: 1795029 - RNA, 15 nt, Salmonella enterica enterica serovar Typhi Ty2
caacucauccaccuu

SEQ ID NO: 1795030 - RNA, 13 nt, Salmonella enterica enterica serovar Typhi Ty2
caacucagcaaua

SEQ ID NO: 1795031 - RNA, 18 nt, Salmonella enterica enterica serovar Typhi Ty2
caacuauuaauucuuuua

SEQ ID NO: 1795032 - RNA, 14 nt, Salmonella enterica enterica serovar Typhi Ty2
caagccgccaacgc

SEQ ID NO: 1795033 - RNA, 17 nt, Salmonella enterica enterica serovar Typhi Ty2
caagccgaccuuauucc

SEQ ID NO: 1795034 - RNA, 13 nt, Salmonella enterica enterica serovar Typhi Ty2
caagaugcugaau

SEQ ID NO: 1795035 - RNA, 21 nt, Salmonella enterica enterica serovar Typhi Ty2
caagauuaagaccguauaaua

SEQ ID NO: 1795036 - RNA, 17 nt, Salmonella enterica enterica serovar Typhi Ty2
caagcguuuaauuccau

SEQ ID NO: 1795037 - RNA, 17 nt, Salmonella enterica enterica serovar Typhi Ty2
caagcgccuguucaaca

SEQ ID NO: 1795038 - RNA, 23 nt, Salmonella enterica enterica serovar Typhi Ty2
caagcgaagcgccgucggcaucg

SEQ ID NO: 1795039 - RNA, 15 nt, Salmonella enterica enterica serovar Typhi Ty2
caagcugauuuuucg

SEQ ID NO: 1795040 - RNA, 18 nt, Salmonella enterica enterica serovar Typhi Ty2
caagcugacggauacgcu

SEQ ID NO: 1795041 - RNA, 20 nt, Salmonella enterica enterica serovar Typhi Ty2
caagcucaucgggcaacuga

SEQ ID NO: 1795042 - RNA, 22 nt, Salmonella enterica enterica serovar Typhi Ty2
caagcuaauccccagcgcucca

SEQ ID NO: 1795043 - RNA, 12 nt, Salmonella enterica enterica serovar Typhi Ty2
caagaaucaaua

SEQ ID NO: 1795044 - RNA, 21 nt, Salmonella enterica enterica serovar Typhi Ty2
caagaagcguugaccguacug

SEQ ID NO: 1795045 - RNA, 10 nt, Salmonella enterica enterica serovar Typhi Ty2
caacuucaug

SEQ ID NO: 1795046 - RNA, 15 nt, Salmonella enterica enterica serovar Typhi Ty2
caacuuccaccaccu

SEQ ID NO: 1795047 - RNA, 19 nt, Salmonella enterica enterica serovar Typhi Ty2
caagaauuacaucaauaaa

SEQ ID NO: 1795048 - RNA, 16 nt, Salmonella enterica enterica serovar Typhi Ty2
caagaauuauuucagg

SEQ ID NO: 1795049 - RNA, 18 nt, Salmonella enterica enterica serovar Typhi Ty2
caagaauuauuucaggaa

SEQ ID NO: 1795050 - RNA, 20 nt, Salmonella enterica enterica serovar Typhi Ty2
caagaaugaccagccgaagu

SEQ ID NO: 1795051 - RNA, 21 nt, Salmonella enterica enterica serovar Typhi Ty2
caagaaugaccagccgaaguu

SEQ ID NO: 1795052 - RNA, 15 nt, Salmonella enterica enterica serovar Typhi Ty2
caagagauucaggcc

SEQ ID NO: 1795053 - RNA, 13 nt, Salmonella enterica enterica serovar Typhi Ty2
caagauaaaaaga

SEQ ID NO: 1795054 - RNA, 15 nt, Salmonella enterica enterica serovar Typhi Ty2
caagagcagcaaccc

SEQ ID NO: 1795055 - RNA, 19 nt, Salmonella enterica enterica serovar Typhi Ty2
caagagcagcaacccugcc

SEQ ID NO: 1795056 - RNA, 21 nt, Salmonella enterica enterica serovar Typhi Ty2
caagagagcaacauaccgcag

SEQ ID NO: 1795057 - RNA, 14 nt, Salmonella enterica enterica serovar Typhi Ty2
caagagaaauaaca

SEQ ID NO: 1795058 - RNA, 17 nt, Salmonella enterica enterica serovar Typhi Ty2
caagacccgaaccugcg

SEQ ID NO: 1795059 - RNA, 20 nt, Salmonella enterica enterica serovar Typhi Ty2
caagaucacauacaaagaga

SEQ ID NO: 1795060 - RNA, 16 nt, Salmonella enterica enterica serovar Typhi Ty2
caagauccguccaugu

SEQ ID NO: 1795061 - RNA, 19 nt, Salmonella enterica enterica serovar Typhi Ty2
caagaucaaugugcucaac

SEQ ID NO: 1795062 - RNA, 19 nt, Salmonella enterica enterica serovar Typhi Ty2
caagauaagaaguaaacag

SEQ ID NO: 1795063 - RNA, 15 nt, Salmonella enterica enterica serovar Typhi Ty2
caaucucacugccca

SEQ ID NO: 1795064 - RNA, 15 nt, Salmonella enterica enterica serovar Typhi Ty2
caaucucaauaccac

SEQ ID NO: 1795065 - RNA, 19 nt, Salmonella enterica enterica serovar Typhi Ty2
caaucguuaauucauggcc

SEQ ID NO: 1795066 - RNA, 12 nt, Salmonella enterica enterica serovar Typhi Ty2
caaucuacuuuu

SEQ ID NO: 1795067 - RNA, 20 nt, Salmonella enterica enterica serovar Typhi Ty2
caauccuucuaccuucaccc

SEQ ID NO: 1795068 - RNA, 23 nt, Salmonella enterica enterica serovar Typhi Ty2
caauccugucgucaccagcaggu

SEQ ID NO: 1795069 - RNA, 17 nt, Salmonella enterica enterica serovar Typhi Ty2
caaucgcaaauugcugu

SEQ ID NO: 1795070 - RNA, 20 nt, Salmonella enterica enterica serovar Typhi Ty2
caaucaguaugaugaccugg

SEQ ID NO: 1795071 - RNA, 17 nt, Salmonella enterica enterica serovar Typhi Ty2
caauccaacgaaacuca

SEQ ID NO: 1795072 - RNA, 23 nt, Salmonella enterica enterica serovar Typhi Ty2
caauccagaauaccagaaucacc

SEQ ID NO: 1795073 - RNA, 23 nt, Salmonella enterica enterica serovar Typhi Ty2
caauccagguggaucggaaauca

SEQ ID NO: 1795074 - RNA, 15 nt, Salmonella enterica enterica serovar Typhi Ty2
caaucaguuccaauc

SEQ ID NO: 1795075 - RNA, 17 nt, Salmonella enterica enterica serovar Typhi Ty2
caauccacggguuacaa

SEQ ID NO: 1795076 - RNA, 19 nt, Salmonella enterica enterica serovar Typhi Ty2
caaucacugaugccacacc

SEQ ID NO: 1795077 - RNA, 19 nt, Salmonella enterica enterica serovar Typhi Ty2
caaucacuuuugcgaccca

SEQ ID NO: 1795078 - RNA, 13 nt, Salmonella enterica enterica serovar Typhi Ty2
caaucagcaccau

SEQ ID NO: 1795079 - RNA, 19 nt, Salmonella enterica enterica serovar Typhi Ty2
caaucagguauuuccugcu

SEQ ID NO: 1795080 - RNA, 13 nt, Salmonella enterica enterica serovar Typhi Ty2
caauauuuuuccg

SEQ ID NO: 1795081 - RNA, 15 nt, Salmonella enterica enterica serovar Typhi Ty2
caaucaaaacauuag

SEQ ID NO: 1795082 - RNA, 14 nt, Salmonella enterica enterica serovar Typhi Ty2
caaucacaaaaugg

SEQ ID NO: 1795083 - RNA, 15 nt, Salmonella enterica enterica serovar Typhi Ty2
caaucacaaaauggc

SEQ ID NO: 1795084 - RNA, 15 nt, Salmonella enterica enterica serovar Typhi Ty2
caauauccccagccc

SEQ ID NO: 1795085 - RNA, 13 nt, Salmonella enterica enterica serovar Typhi Ty2
caauauccuccgg

SEQ ID NO: 1795086 - RNA, 16 nt, Salmonella enterica enterica serovar Typhi Ty2
caauaucguugccgcc

SEQ ID NO: 1795087 - RNA, 20 nt, Salmonella enterica enterica serovar Typhi Ty2
caauaucagccauuaaccag

SEQ ID NO: 1795088 - RNA, 21 nt, Salmonella enterica enterica serovar Typhi Ty2
caauaucagccauuaaccaga

SEQ ID NO: 1795089 - RNA, 20 nt, Salmonella enterica enterica serovar Typhi Ty2
caauauaccgucaguaccag

SEQ ID NO: 1795090 - RNA, 16 nt, Salmonella enterica enterica serovar Typhi Ty2
caauauagaguccuga

SEQ ID NO: 1795091 - RNA, 16 nt, Salmonella enterica enterica serovar Typhi Ty2
caauauagccguggcu

SEQ ID NO: 1795092 - RNA, 19 nt, Salmonella enterica enterica serovar Typhi Ty2
caauacgcugaacuucggg

SEQ ID NO: 1795093 - RNA, 16 nt, Salmonella enterica enterica serovar Typhi Ty2
caauaccuucugcgcc

SEQ ID NO: 1795094 - RNA, 20 nt, Salmonella enterica enterica serovar Typhi Ty2
caauaagcuugcuuuccaua

SEQ ID NO: 1795095 - RNA, 20 nt, Salmonella enterica enterica serovar Typhi Ty2
caauaaacucccgcauauau

SEQ ID NO: 1795096 - RNA, 23 nt, Salmonella enterica enterica serovar Typhi Ty2
caauaagggucgcgcuguauaau

SEQ ID NO: 1795097 - RNA, 19 nt, Salmonella enterica enterica serovar Typhi Ty2
caauaagggucgcgcugua

SEQ ID NO: 1795098 - RNA, 21 nt, Salmonella enterica enterica serovar Typhi Ty2
caauaaguuagcuuuuuuaug

SEQ ID NO: 1795099 - RNA, 21 nt, Salmonella enterica enterica serovar Typhi Ty2
caaguuuggcaaucaaaucca

SEQ ID NO: 1795100 - RNA, 12 nt, Salmonella enterica enterica serovar Typhi Ty2
caaguuuaucca

SEQ ID NO: 1795101 - RNA, 16 nt, Salmonella enterica enterica serovar Typhi Ty2
caauaaaauuauccag

SEQ ID NO: 1795102 - RNA, 20 nt, Salmonella enterica enterica serovar Typhi Ty2
caauaaacuaaguaaggagg

SEQ ID NO: 1795103 - RNA, 13 nt, Salmonella enterica enterica serovar Typhi Ty2
caauaaagcaggg

SEQ ID NO: 1795104 - RNA, 15 nt, Salmonella enterica enterica serovar Typhi Ty2
caauaaaguuuauuu

SEQ ID NO: 1795105 - RNA, 20 nt, Salmonella enterica enterica serovar Typhi Ty2
caauaaaaauaucauuaaau

SEQ ID NO: 1795106 - RNA, 23 nt, Salmonella enterica enterica serovar Typhi Ty2
caagcugcuggcgagcaggaaaa

SEQ ID NO: 1795107 - RNA, 20 nt, Salmonella enterica enterica serovar Typhi Ty2
caagcugguaaaugcgccua

SEQ ID NO: 1795108 - RNA, 22 nt, Salmonella enterica enterica serovar Typhi Ty2
caaggauauguauuuguucucg

SEQ ID NO: 1795109 - RNA, 15 nt, Salmonella enterica enterica serovar Typhi Ty2
caaggcauucaggcc

SEQ ID NO: 1795110 - RNA, 14 nt, Salmonella enterica enterica serovar Typhi Ty2
caagucaccaucag

SEQ ID NO: 1795111 - RNA, 15 nt, Salmonella enterica enterica serovar Typhi Ty2
aucaggcauaaaccu

SEQ ID NO: 1795112 - RNA, 17 nt, Salmonella enterica enterica serovar Typhi Ty2
aucaggcauccugcccu

SEQ ID NO: 1795113 - RNA, 19 nt, Salmonella enterica enterica serovar Typhi Ty2
aucaggcaauaaacaucag

SEQ ID NO: 1795114 - RNA, 14 nt, Salmonella enterica enterica serovar Typhi Ty2
aucagggaaaaaug

SEQ ID NO: 1795115 - RNA, 17 nt, Salmonella enterica enterica serovar Typhi Ty2
aucaguaacacaaucag

SEQ ID NO: 1795116 - RNA, 20 nt, Salmonella enterica enterica serovar Typhi Ty2
aucaguaacugacgaccggg

SEQ ID NO: 1795117 - RNA, 14 nt, Salmonella enterica enterica serovar Typhi Ty2
aucagguuguccug

SEQ ID NO: 1795118 - RNA, 19 nt, Salmonella enterica enterica serovar Typhi Ty2
aucaguuccaaucucuuuu

SEQ ID NO: 1795119 - RNA, 23 nt, Salmonella enterica enterica serovar Typhi Ty2
aucagucgcagcggcugcgccug

SEQ ID NO: 1795120 - RNA, 18 nt, Salmonella enterica enterica serovar Typhi Ty2
aucagugaacacccugcc

SEQ ID NO: 1795121 - RNA, 14 nt, Salmonella enterica enterica serovar Typhi Ty2
aaaacgaaaaaccc

SEQ ID NO: 1795122 - RNA, 18 nt, Salmonella enterica enterica serovar Typhi Ty2
aucaguccccacauuacg

SEQ ID NO: 1795123 - RNA, 19 nt, Salmonella enterica enterica serovar Typhi Ty2
aucaguccgggcauaaccu

SEQ ID NO: 1795124 - RNA, 22 nt, Salmonella enterica enterica serovar Typhi Ty2
aaaacguaacguacgggugucc

SEQ ID NO: 1795125 - RNA, 14 nt, Salmonella enterica enterica serovar Typhi Ty2
aaaacggccaguga

SEQ ID NO: 1795126 - RNA, 14 nt, Salmonella enterica enterica serovar Typhi Ty2
aucagccccagcac

SEQ ID NO: 1795127 - RNA, 23 nt, Salmonella enterica enterica serovar Typhi Ty2
aucagcccgcaaaggaccaacac

SEQ ID NO: 1795128 - RNA, 22 nt, Salmonella enterica enterica serovar Typhi Ty2
aucagcccgauacccgcccaga

SEQ ID NO: 1795129 - RNA, 20 nt, Salmonella enterica enterica serovar Typhi Ty2
aucagccguuacuuccccca

SEQ ID NO: 1795130 - RNA, 17 nt, Salmonella enterica enterica serovar Typhi Ty2
aucagcgauugcgccag

SEQ ID NO: 1795131 - RNA, 14 nt, Salmonella enterica enterica serovar Typhi Ty2
aucagcgacucauu

SEQ ID NO: 1795132 - RNA, 15 nt, Salmonella enterica enterica serovar Typhi Ty2
aucagcgaaggcaac

SEQ ID NO: 1795133 - RNA, 16 nt, Salmonella enterica enterica serovar Typhi Ty2
aucaggaugaauauga

SEQ ID NO: 1795134 - RNA, 21 nt, Salmonella enterica enterica serovar Typhi Ty2
aucaggcaaaaaucgucauca

SEQ ID NO: 1795135 - RNA, 23 nt, Salmonella enterica enterica serovar Typhi Ty2
aucaggcaagacccgaaccugcg

SEQ ID NO: 1795136 - RNA, 14 nt, Salmonella enterica enterica serovar Typhi Ty2
aucaggaucaaaau

SEQ ID NO: 1795137 - RNA, 22 nt, Salmonella enterica enterica serovar Typhi Ty2
aucagcuauuagcguuuuuacc

SEQ ID NO: 1795138 - RNA, 23 nt, Salmonella enterica enterica serovar Typhi Ty2
aucagcguuucgccguaaaacaa

SEQ ID NO: 1795139 - RNA, 19 nt, Salmonella enterica enterica serovar Typhi Ty2
aucagaagcuaagggaugc

SEQ ID NO: 1795140 - RNA, 15 nt, Salmonella enterica enterica serovar Typhi Ty2
aucagaagaaauauu

SEQ ID NO: 1795141 - RNA, 18 nt, Salmonella enterica enterica serovar Typhi Ty2
aucacuuaucaaaccagc

SEQ ID NO: 1795142 - RNA, 15 nt, Salmonella enterica enterica serovar Typhi Ty2
aucagcaccacgccc

SEQ ID NO: 1795143 - RNA, 17 nt, Salmonella enterica enterica serovar Typhi Ty2
aucagcacacuacacag

SEQ ID NO: 1795144 - RNA, 15 nt, Salmonella enterica enterica serovar Typhi Ty2
aucagaauaguuuug

SEQ ID NO: 1795145 - RNA, 18 nt, Salmonella enterica enterica serovar Typhi Ty2
aucagcagccgggccaga

SEQ ID NO: 1795146 - RNA, 21 nt, Salmonella enterica enterica serovar Typhi Ty2
aucacuaucaguuuuggcaau

SEQ ID NO: 1795147 - RNA, 13 nt, Salmonella enterica enterica serovar Typhi Ty2
aucacuaauuugc

SEQ ID NO: 1795148 - RNA, 22 nt, Salmonella enterica enterica serovar Typhi Ty2
aucacuaacugaccauauauga

SEQ ID NO: 1795149 - RNA, 15 nt, Salmonella enterica enterica serovar Typhi Ty2
aucacuaagaccagc

SEQ ID NO: 1795150 - RNA, 14 nt, Salmonella enterica enterica serovar Typhi Ty2
aucacugccgccac

SEQ ID NO: 1795151 - RNA, 13 nt, Salmonella enterica enterica serovar Typhi Ty2
aucacugcaccuc

SEQ ID NO: 1795152 - RNA, 13 nt, Salmonella enterica enterica serovar Typhi Ty2
aucacucucuugu

SEQ ID NO: 1795153 - RNA, 23 nt, Salmonella enterica enterica serovar Typhi Ty2
aucaccugcuggcggcguaagcg

SEQ ID NO: 1795154 - RNA, 15 nt, Salmonella enterica enterica serovar Typhi Ty2
aucaccugcaucacg

SEQ ID NO: 1795155 - RNA, 22 nt, Salmonella enterica enterica serovar Typhi Ty2
aucaccugaccgauauagccac

SEQ ID NO: 1795156 - RNA, 21 nt, Salmonella enterica enterica serovar Typhi Ty2
aucaccugaccgauauagcca

SEQ ID NO: 1795157 - RNA, 22 nt, Salmonella enterica enterica serovar Typhi Ty2
aucaccugauugauacgcgccc

SEQ ID NO: 1795158 - RNA, 21 nt, Salmonella enterica enterica serovar Typhi Ty2
aucacguuggggaauaaauau

SEQ ID NO: 1795159 - RNA, 19 nt, Salmonella enterica enterica serovar Typhi Ty2
aucacguuuugcagcgcca

SEQ ID NO: 1795160 - RNA, 16 nt, Salmonella enterica enterica serovar Typhi Ty2
aucaccaaguagacag

SEQ ID NO: 1795161 - RNA, 20 nt, Salmonella enterica enterica serovar Typhi Ty2
aucaccagcccgaauccacu

SEQ ID NO: 1795162 - RNA, 13 nt, Salmonella enterica enterica serovar Typhi Ty2
aucaccaccucaa

SEQ ID NO: 1795163 - RNA, 12 nt, Salmonella enterica enterica serovar Typhi Ty2
aucaccagcgca

SEQ ID NO: 1795164 - RNA, 14 nt, Salmonella enterica enterica serovar Typhi Ty2
aucaccaggcaaug

SEQ ID NO: 1795165 - RNA, 21 nt, Salmonella enterica enterica serovar Typhi Ty2
aucaccaucguugccagcggc

SEQ ID NO: 1795166 - RNA, 15 nt, Salmonella enterica enterica serovar Typhi Ty2
aucaccaucuucaca

SEQ ID NO: 1795167 - RNA, 18 nt, Salmonella enterica enterica serovar Typhi Ty2
aucaccauucccagcgcc

SEQ ID NO: 1795168 - RNA, 17 nt, Salmonella enterica enterica serovar Typhi Ty2
aucaccauucccagcgc

SEQ ID NO: 1795169 - RNA, 19 nt, Salmonella enterica enterica serovar Typhi Ty2
aucaccauucccagcgccc

SEQ ID NO: 1795170 - RNA, 17 nt, Salmonella enterica enterica serovar Typhi Ty2
aucacccaacguucaug

SEQ ID NO: 1795171 - RNA, 15 nt, Salmonella enterica enterica serovar Typhi Ty2
aucacccugaauuuc

SEQ ID NO: 1795172 - RNA, 18 nt, Salmonella enterica enterica serovar Typhi Ty2
aucaccugaaugcaaaga

SEQ ID NO: 1795173 - RNA, 16 nt, Salmonella enterica enterica serovar Typhi Ty2
aucaccucuuucucca

SEQ ID NO: 1795174 - RNA, 17 nt, Salmonella enterica enterica serovar Typhi Ty2
aucaccucuuucuccac

SEQ ID NO: 1795175 - RNA, 19 nt, Salmonella enterica enterica serovar Typhi Ty2
aucacccugaauuucaaua

SEQ ID NO: 1795176 - RNA, 20 nt, Salmonella enterica enterica serovar Typhi Ty2
aucaauuucccuucaaucac

SEQ ID NO: 1795177 - RNA, 23 nt, Salmonella enterica enterica serovar Typhi Ty2
aucaauuucucuuuuauuauuuu

SEQ ID NO: 1795178 - RNA, 12 nt, Salmonella enterica enterica serovar Typhi Ty2
aucaauuuuucg

SEQ ID NO: 1795179 - RNA, 19 nt, Salmonella enterica enterica serovar Typhi Ty2
aucaauuugccuuuauuca

SEQ ID NO: 1795180 - RNA, 18 nt, Salmonella enterica enterica serovar Typhi Ty2
aucaauucuuuaauuugu

SEQ ID NO: 1795181 - RNA, 20 nt, Salmonella enterica enterica serovar Typhi Ty2
aucacacauaucgccagcca

SEQ ID NO: 1795182 - RNA, 22 nt, Salmonella enterica enterica serovar Typhi Ty2
aucacaccaacgcuggcccggc

SEQ ID NO: 1795183 - RNA, 23 nt, Salmonella enterica enterica serovar Typhi Ty2
aucacaauuacgcaagagagcaa

SEQ ID NO: 1795184 - RNA, 21 nt, Salmonella enterica enterica serovar Typhi Ty2
aucacaaucagccacggcaac

SEQ ID NO: 1795185 - RNA, 19 nt, Salmonella enterica enterica serovar Typhi Ty2
aucacaaaauggcugauaa

SEQ ID NO: 1795186 - RNA, 14 nt, Salmonella enterica enterica serovar Typhi Ty2
aucacaaauaacag

SEQ ID NO: 1795187 - RNA, 18 nt, Salmonella enterica enterica serovar Typhi Ty2
aucacaaauaacagacga

SEQ ID NO: 1795188 - RNA, 19 nt, Salmonella enterica enterica serovar Typhi Ty2
aucacaagcuguuucuccg

SEQ ID NO: 1795189 - RNA, 17 nt, Salmonella enterica enterica serovar Typhi Ty2
aucacacccgcacgccu

SEQ ID NO: 1795190 - RNA, 17 nt, Salmonella enterica enterica serovar Typhi Ty2
aucacauccgccagcgc

SEQ ID NO: 1795191 - RNA, 22 nt, Salmonella enterica enterica serovar Typhi Ty2
auauuauugacgcuuucuuccc

SEQ ID NO: 1795192 - RNA, 13 nt, Salmonella enterica enterica serovar Typhi Ty2
auauuauuauaua

SEQ ID NO: 1795193 - RNA, 14 nt, Salmonella enterica enterica serovar Typhi Ty2
auauuauaaaauaa

SEQ ID NO: 1795194 - RNA, 20 nt, Salmonella enterica enterica serovar Typhi Ty2
auauuccucuuccucgauau

SEQ ID NO: 1795195 - RNA, 14 nt, Salmonella enterica enterica serovar Typhi Ty2
auauucgauuuaau

SEQ ID NO: 1795196 - RNA, 18 nt, Salmonella enterica enterica serovar Typhi Ty2
auauucgcagcucugugu

SEQ ID NO: 1795197 - RNA, 13 nt, Salmonella enterica enterica serovar Typhi Ty2
auauuaaauaaau

SEQ ID NO: 1795198 - RNA, 21 nt, Salmonella enterica enterica serovar Typhi Ty2
auauuaaauaaauaguaaaua

SEQ ID NO: 1795199 - RNA, 15 nt, Salmonella enterica enterica serovar Typhi Ty2
auauuacuaauaaaa

SEQ ID NO: 1795200 - RNA, 14 nt, Salmonella enterica enterica serovar Typhi Ty2
auauuaauuaagga

SEQ ID NO: 1795201 - RNA, 17 nt, Salmonella enterica enterica serovar Typhi Ty2
auauguguaucuugcuu

SEQ ID NO: 1795202 - RNA, 17 nt, Salmonella enterica enterica serovar Typhi Ty2
auauguuugacaagcag

SEQ ID NO: 1795203 - RNA, 23 nt, Salmonella enterica enterica serovar Typhi Ty2
auauggcgcaaguguauggcugg

SEQ ID NO: 1795204 - RNA, 15 nt, Salmonella enterica enterica serovar Typhi Ty2
auaugguuauccagc

SEQ ID NO: 1795205 - RNA, 22 nt, Salmonella enterica enterica serovar Typhi Ty2
auaugccaaguaauaaagagaa

SEQ ID NO: 1795206 - RNA, 14 nt, Salmonella enterica enterica serovar Typhi Ty2
auaugccaaguaau

SEQ ID NO: 1795207 - RNA, 19 nt, Salmonella enterica enterica serovar Typhi Ty2
auaugccaaguaauaaaga

SEQ ID NO: 1795208 - RNA, 22 nt, Salmonella enterica enterica serovar Typhi Ty2
auaugccugcacuaaaccagau

SEQ ID NO: 1795209 - RNA, 17 nt, Salmonella enterica enterica serovar Typhi Ty2
auaugccggauaguuac

SEQ ID NO: 1795210 - RNA, 18 nt, Salmonella enterica enterica serovar Typhi Ty2
auaugccccgacaucaga

SEQ ID NO: 1795211 - RNA, 13 nt, Salmonella enterica enterica serovar Typhi Ty2
auaugccaggcau

SEQ ID NO: 1795212 - RNA, 22 nt, Salmonella enterica enterica serovar Typhi Ty2
auauccugcaccgccugcggca

SEQ ID NO: 1795213 - RNA, 22 nt, Salmonella enterica enterica serovar Typhi Ty2
auauccugcuuaauauccaguu

SEQ ID NO: 1795214 - RNA, 17 nt, Salmonella enterica enterica serovar Typhi Ty2
auauccuguaacucauc

SEQ ID NO: 1795215 - RNA, 20 nt, Salmonella enterica enterica serovar Typhi Ty2
auauccuggcgagaauagaa

SEQ ID NO: 1795216 - RNA, 21 nt, Salmonella enterica enterica serovar Typhi Ty2
auaugcaggcauaaaaaagag

SEQ ID NO: 1795217 - RNA, 19 nt, Salmonella enterica enterica serovar Typhi Ty2
auaugcgacagaaauugaa

SEQ ID NO: 1795218 - RNA, 15 nt, Salmonella enterica enterica serovar Typhi Ty2
auaugcgccaacugc

SEQ ID NO: 1795219 - RNA, 18 nt, Salmonella enterica enterica serovar Typhi Ty2
auaugcaggcauaaaaaa

SEQ ID NO: 1795220 - RNA, 22 nt, Salmonella enterica enterica serovar Typhi Ty2
auaugcgcugcgaagugaauau

SEQ ID NO: 1795221 - RNA, 19 nt, Salmonella enterica enterica serovar Typhi Ty2
auaugcguguagcagauag

SEQ ID NO: 1795222 - RNA, 19 nt, Salmonella enterica enterica serovar Typhi Ty2
auaugcggagccucuuccu

SEQ ID NO: 1795223 - RNA, 23 nt, Salmonella enterica enterica serovar Typhi Ty2
auaugcggucguauuaccaaccc

SEQ ID NO: 1795224 - RNA, 18 nt, Salmonella enterica enterica serovar Typhi Ty2
auaugcuguuuauggcgc

SEQ ID NO: 1795225 - RNA, 17 nt, Salmonella enterica enterica serovar Typhi Ty2
auauggaugagucuugc

SEQ ID NO: 1795226 - RNA, 20 nt, Salmonella enterica enterica serovar Typhi Ty2
auauggauauucaucgccgu

SEQ ID NO: 1795227 - RNA, 17 nt, Salmonella enterica enterica serovar Typhi Ty2
aucaaauaagacaugga

SEQ ID NO: 1795228 - RNA, 20 nt, Salmonella enterica enterica serovar Typhi Ty2
aucaaauacgcuauuuaaaa

SEQ ID NO: 1795229 - RNA, 24 nt, Salmonella enterica enterica serovar Typhi Ty2
aucaacugggugugaucgccgcga

SEQ ID NO: 1795230 - RNA, 20 nt, Salmonella enterica enterica serovar Typhi Ty2
aucaacgucgucgucuucaa

SEQ ID NO: 1795231 - RNA, 15 nt, Salmonella enterica enterica serovar Typhi Ty2
aucaacauuauuaaa

SEQ ID NO: 1795232 - RNA, 17 nt, Salmonella enterica enterica serovar Typhi Ty2
auauuuauuuaauguuu

SEQ ID NO: 1795233 - RNA, 13 nt, Salmonella enterica enterica serovar Typhi Ty2
auauuuauuuaau

SEQ ID NO: 1795234 - RNA, 16 nt, Salmonella enterica enterica serovar Typhi Ty2
auauuuaccgccgcuu

SEQ ID NO: 1795235 - RNA, 21 nt, Salmonella enterica enterica serovar Typhi Ty2
auauucuucuuagaauagaau

SEQ ID NO: 1795236 - RNA, 17 nt, Salmonella enterica enterica serovar Typhi Ty2
auauuuaaucgcuuuua

SEQ ID NO: 1795237 - RNA, 12 nt, Salmonella enterica enterica serovar Typhi Ty2
auauuuuucccu

SEQ ID NO: 1795238 - RNA, 16 nt, Salmonella enterica enterica serovar Typhi Ty2
auauuuuucacacaua

SEQ ID NO: 1795239 - RNA, 21 nt, Salmonella enterica enterica serovar Typhi Ty2
auauuucuguaaucgauacua

SEQ ID NO: 1795240 - RNA, 14 nt, Salmonella enterica enterica serovar Typhi Ty2
auauuuuuucagga

SEQ ID NO: 1795241 - RNA, 16 nt, Salmonella enterica enterica serovar Typhi Ty2
auaguccacuuucugu

SEQ ID NO: 1795242 - RNA, 12 nt, Salmonella enterica enterica serovar Typhi Ty2
auaguccagcag

SEQ ID NO: 1795243 - RNA, 20 nt, Salmonella enterica enterica serovar Typhi Ty2
auagugucgccauaaaucag

SEQ ID NO: 1795244 - RNA, 15 nt, Salmonella enterica enterica serovar Typhi Ty2
auauaacagaauaag

SEQ ID NO: 1795245 - RNA, 18 nt, Salmonella enterica enterica serovar Typhi Ty2
auauaaccacgaaaauua

SEQ ID NO: 1795246 - RNA, 22 nt, Salmonella enterica enterica serovar Typhi Ty2
auauaauuuuauuauauuuaaa

SEQ ID NO: 1795247 - RNA, 16 nt, Salmonella enterica enterica serovar Typhi Ty2
auauaauuuauagcca

SEQ ID NO: 1795248 - RNA, 23 nt, Salmonella enterica enterica serovar Typhi Ty2
auauacagccuuuugagcagcau

SEQ ID NO: 1795249 - RNA, 17 nt, Salmonella enterica enterica serovar Typhi Ty2
auauagccguggcuggc

SEQ ID NO: 1795250 - RNA, 14 nt, Salmonella enterica enterica serovar Typhi Ty2
auauagcaaucaua

SEQ ID NO: 1795251 - RNA, 15 nt, Salmonella enterica enterica serovar Typhi Ty2
auauagccauuuaau

SEQ ID NO: 1795252 - RNA, 15 nt, Salmonella enterica enterica serovar Typhi Ty2
auauaggguuuuccg

SEQ ID NO: 1795253 - RNA, 16 nt, Salmonella enterica enterica serovar Typhi Ty2
auauauucagcaaaug

SEQ ID NO: 1795254 - RNA, 21 nt, Salmonella enterica enterica serovar Typhi Ty2
auauaugacaacacucacaaa

SEQ ID NO: 1795255 - RNA, 14 nt, Salmonella enterica enterica serovar Typhi Ty2
auaucaaugcgaaa

SEQ ID NO: 1795256 - RNA, 20 nt, Salmonella enterica enterica serovar Typhi Ty2
auaucaaacacaaauuucga

SEQ ID NO: 1795257 - RNA, 22 nt, Salmonella enterica enterica serovar Typhi Ty2
auaucauucgcgucauacuuaa

SEQ ID NO: 1795258 - RNA, 13 nt, Salmonella enterica enterica serovar Typhi Ty2
auaucauuuuacc

SEQ ID NO: 1795259 - RNA, 17 nt, Salmonella enterica enterica serovar Typhi Ty2
auauccagccaguccuc

SEQ ID NO: 1795260 - RNA, 14 nt, Salmonella enterica enterica serovar Typhi Ty2
auauccuaacuuau

SEQ ID NO: 1795261 - RNA, 13 nt, Salmonella enterica enterica serovar Typhi Ty2
auaguaaauagaa

SEQ ID NO: 1795262 - RNA, 15 nt, Salmonella enterica enterica serovar Typhi Ty2
auaguaaauagaaaa

SEQ ID NO: 1795263 - RNA, 23 nt, Salmonella enterica enterica serovar Typhi Ty2
auaguaaauagaaaauaauucuu

SEQ ID NO: 1795264 - RNA, 21 nt, Salmonella enterica enterica serovar Typhi Ty2
auaguacccucugcaccagaa

SEQ ID NO: 1795265 - RNA, 20 nt, Salmonella enterica enterica serovar Typhi Ty2
auagucauaauacucaauau

SEQ ID NO: 1795266 - RNA, 23 nt, Salmonella enterica enterica serovar Typhi Ty2
auaguaucgcugcuaaacgagcc

SEQ ID NO: 1795267 - RNA, 12 nt, Salmonella enterica enterica serovar Typhi Ty2
auaggcgccgcc

SEQ ID NO: 1795268 - RNA, 23 nt, Salmonella enterica enterica serovar Typhi Ty2
auaggccucgaccaguuuuuccg

SEQ ID NO: 1795269 - RNA, 22 nt, Salmonella enterica enterica serovar Typhi Ty2
auaggccagcuacaccugggcu

SEQ ID NO: 1795270 - RNA, 13 nt, Salmonella enterica enterica serovar Typhi Ty2
auaggccaggcua

SEQ ID NO: 1795271 - RNA, 19 nt, Salmonella enterica enterica serovar Typhi Ty2
auaggugacuuuccuggcu

SEQ ID NO: 1795272 - RNA, 15 nt, Salmonella enterica enterica serovar Typhi Ty2
auagguacggggcau

SEQ ID NO: 1795273 - RNA, 13 nt, Salmonella enterica enterica serovar Typhi Ty2
auagguuuuaugc

SEQ ID NO: 1795274 - RNA, 22 nt, Salmonella enterica enterica serovar Typhi Ty2
auagguugaauaaccauacuga

SEQ ID NO: 1795275 - RNA, 12 nt, Salmonella enterica enterica serovar Typhi Ty2
auagguugaaag

SEQ ID NO: 1795276 - RNA, 20 nt, Salmonella enterica enterica serovar Typhi Ty2
auagguuaagccaaacucac

SEQ ID NO: 1795277 - RNA, 17 nt, Salmonella enterica enterica serovar Typhi Ty2
auagcgcugaaguccgc

SEQ ID NO: 1795278 - RNA, 22 nt, Salmonella enterica enterica serovar Typhi Ty2
auagcgcuggcgccgcaaacca

SEQ ID NO: 1795279 - RNA, 17 nt, Salmonella enterica enterica serovar Typhi Ty2
auagcggccagauggca

SEQ ID NO: 1795280 - RNA, 23 nt, Salmonella enterica enterica serovar Typhi Ty2
auagcggcguuuauauaaaaaua

SEQ ID NO: 1795281 - RNA, 20 nt, Salmonella enterica enterica serovar Typhi Ty2
auagcggcguuuauauaaaa

SEQ ID NO: 1795282 - RNA, 20 nt, Salmonella enterica enterica serovar Typhi Ty2
auagcuggcuuuauauaaaa

SEQ ID NO: 1795283 - RNA, 19 nt, Salmonella enterica enterica serovar Typhi Ty2
auagcuggcugucuuccgu

SEQ ID NO: 1795284 - RNA, 19 nt, Salmonella enterica enterica serovar Typhi Ty2
auagcuuuucaagaauuac

SEQ ID NO: 1795285 - RNA, 19 nt, Salmonella enterica enterica serovar Typhi Ty2
auaggauguugcugcugcg

SEQ ID NO: 1795286 - RNA, 11 nt, Salmonella enterica enterica serovar Typhi Ty2
auagcgcccca

SEQ ID NO: 1795287 - RNA, 14 nt, Salmonella enterica enterica serovar Typhi Ty2
auagcgcgcuaaac

SEQ ID NO: 1795288 - RNA, 17 nt, Salmonella enterica enterica serovar Typhi Ty2
auagcgccaucaggcau

SEQ ID NO: 1795289 - RNA, 22 nt, Salmonella enterica enterica serovar Typhi Ty2
auagcccggcauguccaucaga

SEQ ID NO: 1795290 - RNA, 12 nt, Salmonella enterica enterica serovar Typhi Ty2
auagcccggcuu

SEQ ID NO: 1795291 - RNA, 15 nt, Salmonella enterica enterica serovar Typhi Ty2
auagcccguuaugcc

SEQ ID NO: 1795292 - RNA, 14 nt, Salmonella enterica enterica serovar Typhi Ty2
auagagaguuccuc

SEQ ID NO: 1795293 - RNA, 17 nt, Salmonella enterica enterica serovar Typhi Ty2
auagagacugccgccgu

SEQ ID NO: 1795294 - RNA, 14 nt, Salmonella enterica enterica serovar Typhi Ty2
auagccccaguaaa

SEQ ID NO: 1795295 - RNA, 12 nt, Salmonella enterica enterica serovar Typhi Ty2
auaauuccccca

SEQ ID NO: 1795296 - RNA, 14 nt, Salmonella enterica enterica serovar Typhi Ty2
auacaggcuuaaca

SEQ ID NO: 1795297 - RNA, 19 nt, Salmonella enterica enterica serovar Typhi Ty2
auaauucauaacaccaaua

SEQ ID NO: 1795298 - RNA, 11 nt, Salmonella enterica enterica serovar Typhi Ty2
auacauaaauc

SEQ ID NO: 1795299 - RNA, 17 nt, Salmonella enterica enterica serovar Typhi Ty2
auacaguaguuuucauc

SEQ ID NO: 1795300 - RNA, 13 nt, Salmonella enterica enterica serovar Typhi Ty2
auacauaaauccg

SEQ ID NO: 1795301 - RNA, 22 nt, Salmonella enterica enterica serovar Typhi Ty2
auacaucacuuuaugaccauac

SEQ ID NO: 1795302 - RNA, 20 nt, Salmonella enterica enterica serovar Typhi Ty2
auacauauuguuuucuauuu

SEQ ID NO: 1795303 - RNA, 23 nt, Salmonella enterica enterica serovar Typhi Ty2
auacauccugauuauuacaauaa

SEQ ID NO: 1795304 - RNA, 15 nt, Salmonella enterica enterica serovar Typhi Ty2
auacauccugauuau

SEQ ID NO: 1795305 - RNA, 18 nt, Salmonella enterica enterica serovar Typhi Ty2
auacaugccugcgccaug

SEQ ID NO: 1795306 - RNA, 23 nt, Salmonella enterica enterica serovar Typhi Ty2
auacauuuuguauucgcagggcu

SEQ ID NO: 1795307 - RNA, 20 nt, Salmonella enterica enterica serovar Typhi Ty2
auacauuuuuguaauaaaaa

SEQ ID NO: 1795308 - RNA, 13 nt, Salmonella enterica enterica serovar Typhi Ty2
auaccaaaaauaa

SEQ ID NO: 1795309 - RNA, 20 nt, Salmonella enterica enterica serovar Typhi Ty2
auacauugaguaaauaaauc

SEQ ID NO: 1795310 - RNA, 14 nt, Salmonella enterica enterica serovar Typhi Ty2
auacauucgcucag

SEQ ID NO: 1795311 - RNA, 14 nt, Salmonella enterica enterica serovar Typhi Ty2
auaccauccccuuu

SEQ ID NO: 1795312 - RNA, 22 nt, Salmonella enterica enterica serovar Typhi Ty2
auaccauaaaugaaaccucaau

SEQ ID NO: 1795313 - RNA, 21 nt, Salmonella enterica enterica serovar Typhi Ty2
auaccaggguucgcuggccag

SEQ ID NO: 1795314 - RNA, 20 nt, Salmonella enterica enterica serovar Typhi Ty2
auaccaugcugccauuuuau

SEQ ID NO: 1795315 - RNA, 19 nt, Salmonella enterica enterica serovar Typhi Ty2
auaccccgaucgauauuua

SEQ ID NO: 1795316 - RNA, 15 nt, Salmonella enterica enterica serovar Typhi Ty2
auaccccuguucaaa

SEQ ID NO: 1795317 - RNA, 18 nt, Salmonella enterica enterica serovar Typhi Ty2
auacccaguagcagacag

SEQ ID NO: 1795318 - RNA, 21 nt, Salmonella enterica enterica serovar Typhi Ty2
auacccaguagcagacagccg

SEQ ID NO: 1795319 - RNA, 14 nt, Salmonella enterica enterica serovar Typhi Ty2
auaccacaaauuuu

SEQ ID NO: 1795320 - RNA, 15 nt, Salmonella enterica enterica serovar Typhi Ty2
auaccacaacagaau

SEQ ID NO: 1795321 - RNA, 21 nt, Salmonella enterica enterica serovar Typhi Ty2
auaccaggcacuugagaaauu

SEQ ID NO: 1795322 - RNA, 17 nt, Salmonella enterica enterica serovar Typhi Ty2
auaccagcguaauccuc

SEQ ID NO: 1795323 - RNA, 15 nt, Salmonella enterica enterica serovar Typhi Ty2
auaccaccugccaaa

SEQ ID NO: 1795324 - RNA, 23 nt, Salmonella enterica enterica serovar Typhi Ty2
auaccaagucucaggagugaaca

SEQ ID NO: 1795325 - RNA, 16 nt, Salmonella enterica enterica serovar Typhi Ty2
auacugugggauuuuu

SEQ ID NO: 1795326 - RNA, 18 nt, Salmonella enterica enterica serovar Typhi Ty2
auacugugggauuuuugg

SEQ ID NO: 1795327 - RNA, 17 nt, Salmonella enterica enterica serovar Typhi Ty2
auacuguuccaggcgaa

SEQ ID NO: 1795328 - RNA, 20 nt, Salmonella enterica enterica serovar Typhi Ty2
auacuggucgcgucaauauu

SEQ ID NO: 1795329 - RNA, 16 nt, Salmonella enterica enterica serovar Typhi Ty2
auacuguuuuugcuuu

SEQ ID NO: 1795330 - RNA, 12 nt, Salmonella enterica enterica serovar Typhi Ty2
auacuuaacccu

SEQ ID NO: 1795331 - RNA, 21 nt, Salmonella enterica enterica serovar Typhi Ty2
auacuuaacccugaaccggga

SEQ ID NO: 1795332 - RNA, 22 nt, Salmonella enterica enterica serovar Typhi Ty2
auagaacgcucgcgcaugaccu

SEQ ID NO: 1795333 - RNA, 16 nt, Salmonella enterica enterica serovar Typhi Ty2
auagaacgcuugucuu

SEQ ID NO: 1795334 - RNA, 20 nt, Salmonella enterica enterica serovar Typhi Ty2
auagaauaggaaauaauuaa

SEQ ID NO: 1795335 - RNA, 16 nt, Salmonella enterica enterica serovar Typhi Ty2
auagaaguuaugcauc

SEQ ID NO: 1795336 - RNA, 20 nt, Salmonella enterica enterica serovar Typhi Ty2
auagaagcucaugugcagca

SEQ ID NO: 1795337 - RNA, 16 nt, Salmonella enterica enterica serovar Typhi Ty2
auagacagugauuuac

SEQ ID NO: 1795338 - RNA, 16 nt, Salmonella enterica enterica serovar Typhi Ty2
auagacauacaggaau

SEQ ID NO: 1795339 - RNA, 15 nt, Salmonella enterica enterica serovar Typhi Ty2
auagacgacaucuuu

SEQ ID NO: 1795340 - RNA, 17 nt, Salmonella enterica enterica serovar Typhi Ty2
auagagagcgacagccc

SEQ ID NO: 1795341 - RNA, 22 nt, Salmonella enterica enterica serovar Typhi Ty2
auagacgcccugcaaagcaaaa

SEQ ID NO: 1795342 - RNA, 13 nt, Salmonella enterica enterica serovar Typhi Ty2
auagaccacgcca

SEQ ID NO: 1795343 - RNA, 13 nt, Salmonella enterica enterica serovar Typhi Ty2
auacugauaaaaa

SEQ ID NO: 1795344 - RNA, 17 nt, Salmonella enterica enterica serovar Typhi Ty2
auacugaccaacaacag

SEQ ID NO: 1795345 - RNA, 18 nt, Salmonella enterica enterica serovar Typhi Ty2
auacugaccaacaacaga

SEQ ID NO: 1795346 - RNA, 21 nt, Salmonella enterica enterica serovar Typhi Ty2
auacugaagauaaacagcagc

SEQ ID NO: 1795347 - RNA, 19 nt, Salmonella enterica enterica serovar Typhi Ty2
auacucuuugaacagccag

SEQ ID NO: 1795348 - RNA, 11 nt, Salmonella enterica enterica serovar Typhi Ty2
auacucuuucc

SEQ ID NO: 1795349 - RNA, 22 nt, Salmonella enterica enterica serovar Typhi Ty2
auacucuuggagagcaucaucu

SEQ ID NO: 1795350 - RNA, 19 nt, Salmonella enterica enterica serovar Typhi Ty2
auacguuauaaauuuuuua

SEQ ID NO: 1795351 - RNA, 18 nt, Salmonella enterica enterica serovar Typhi Ty2
auacguguacggcgaauu

SEQ ID NO: 1795352 - RNA, 14 nt, Salmonella enterica enterica serovar Typhi Ty2
auacguuccagcag

SEQ ID NO: 1795353 - RNA, 15 nt, Salmonella enterica enterica serovar Typhi Ty2
auacuaaaacuuuaa

SEQ ID NO: 1795354 - RNA, 17 nt, Salmonella enterica enterica serovar Typhi Ty2
auacuaaagggaucuuc

SEQ ID NO: 1795355 - RNA, 21 nt, Salmonella enterica enterica serovar Typhi Ty2
auacggcggcaaugccgccgu

SEQ ID NO: 1795356 - RNA, 15 nt, Salmonella enterica enterica serovar Typhi Ty2
auacggggucuaagg

SEQ ID NO: 1795357 - RNA, 23 nt, Salmonella enterica enterica serovar Typhi Ty2
auacggcgugauguagcuugaaa

SEQ ID NO: 1795358 - RNA, 14 nt, Salmonella enterica enterica serovar Typhi Ty2
auacguggcucaag

SEQ ID NO: 1795359 - RNA, 19 nt, Salmonella enterica enterica serovar Typhi Ty2
auacgucauaucauccagc

SEQ ID NO: 1795360 - RNA, 15 nt, Salmonella enterica enterica serovar Typhi Ty2
auacguaauaccuga

SEQ ID NO: 1795361 - RNA, 19 nt, Salmonella enterica enterica serovar Typhi Ty2
auaccguuuggaucugucg

SEQ ID NO: 1795362 - RNA, 19 nt, Salmonella enterica enterica serovar Typhi Ty2
auaccgugugcagugacag

SEQ ID NO: 1795363 - RNA, 15 nt, Salmonella enterica enterica serovar Typhi Ty2
auaccgaaauccgcu

SEQ ID NO: 1795364 - RNA, 13 nt, Salmonella enterica enterica serovar Typhi Ty2
augaaagcggcac

SEQ ID NO: 1795365 - RNA, 13 nt, Salmonella enterica enterica serovar Typhi Ty2
augaacuuacacu

SEQ ID NO: 1795366 - RNA, 20 nt, Salmonella enterica enterica serovar Typhi Ty2
augaacuuacacuuaccuga

SEQ ID NO: 1795367 - RNA, 11 nt, Salmonella enterica enterica serovar Typhi Ty2
augaaaaaaac

SEQ ID NO: 1795368 - RNA, 12 nt, Salmonella enterica enterica serovar Typhi Ty2
augaaaaaaacg

SEQ ID NO: 1795369 - RNA, 23 nt, Salmonella enterica enterica serovar Typhi Ty2
augaaacgguuaaaaacagccag

SEQ ID NO: 1795370 - RNA, 13 nt, Salmonella enterica enterica serovar Typhi Ty2
augaaaccccaaa

SEQ ID NO: 1795371 - RNA, 21 nt, Salmonella enterica enterica serovar Typhi Ty2
augaauuauuuucuaaaaucu

SEQ ID NO: 1795372 - RNA, 12 nt, Salmonella enterica enterica serovar Typhi Ty2
augaauuauuuu

SEQ ID NO: 1795373 - RNA, 13 nt, Salmonella enterica enterica serovar Typhi Ty2
augacaacauaaa

SEQ ID NO: 1795374 - RNA, 20 nt, Salmonella enterica enterica serovar Typhi Ty2
augaauagccccucaauuau

SEQ ID NO: 1795375 - RNA, 23 nt, Salmonella enterica enterica serovar Typhi Ty2
augaauacgcuccagcuggcugg

SEQ ID NO: 1795376 - RNA, 20 nt, Salmonella enterica enterica serovar Typhi Ty2
augaauacgcaagccgaacu

SEQ ID NO: 1795377 - RNA, 22 nt, Salmonella enterica enterica serovar Typhi Ty2
augaauauccgccgcccagcgg

SEQ ID NO: 1795378 - RNA, 15 nt, Salmonella enterica enterica serovar Typhi Ty2
augaagcauaaaaag

SEQ ID NO: 1795379 - RNA, 19 nt, Salmonella enterica enterica serovar Typhi Ty2
augacgguauugcuuucaa

SEQ ID NO: 1795380 - RNA, 14 nt, Salmonella enterica enterica serovar Typhi Ty2
augagauaauaaau

SEQ ID NO: 1795381 - RNA, 22 nt, Salmonella enterica enterica serovar Typhi Ty2
augagauacgucaucaugcugc

SEQ ID NO: 1795382 - RNA, 13 nt, Salmonella enterica enterica serovar Typhi Ty2
augacgaacagga

SEQ ID NO: 1795383 - RNA, 19 nt, Salmonella enterica enterica serovar Typhi Ty2
augacgcccugcgccagca

SEQ ID NO: 1795384 - RNA, 19 nt, Salmonella enterica enterica serovar Typhi Ty2
augacguauucaccucccu

SEQ ID NO: 1795385 - RNA, 14 nt, Salmonella enterica enterica serovar Typhi Ty2
augacguccaggcc

SEQ ID NO: 1795386 - RNA, 15 nt, Salmonella enterica enterica serovar Typhi Ty2
augacgcgcaggccg

SEQ ID NO: 1795387 - RNA, 13 nt, Salmonella enterica enterica serovar Typhi Ty2
augacggcagggg

SEQ ID NO: 1795388 - RNA, 16 nt, Salmonella enterica enterica serovar Typhi Ty2
augacgcuggaaguau

SEQ ID NO: 1795389 - RNA, 23 nt, Salmonella enterica enterica serovar Typhi Ty2
augacaauauugccauaaauaca

SEQ ID NO: 1795390 - RNA, 16 nt, Salmonella enterica enterica serovar Typhi Ty2
augaccgcgacuugga

SEQ ID NO: 1795391 - RNA, 20 nt, Salmonella enterica enterica serovar Typhi Ty2
augaccguuaguaaucggau

SEQ ID NO: 1795392 - RNA, 21 nt, Salmonella enterica enterica serovar Typhi Ty2
augaccugggcgccagagagc

SEQ ID NO: 1795393 - RNA, 18 nt, Salmonella enterica enterica serovar Typhi Ty2
augaccuggugcaucaua

SEQ ID NO: 1795394 - RNA, 18 nt, Salmonella enterica enterica serovar Typhi Ty2
aucuucuacaaugcggua

SEQ ID NO: 1795395 - RNA, 15 nt, Salmonella enterica enterica serovar Typhi Ty2
aucuucuacaaugcg

SEQ ID NO: 1795396 - RNA, 18 nt, Salmonella enterica enterica serovar Typhi Ty2
aucugugccagcccaaua

SEQ ID NO: 1795397 - RNA, 14 nt, Salmonella enterica enterica serovar Typhi Ty2
aucugucugcugua

SEQ ID NO: 1795398 - RNA, 17 nt, Salmonella enterica enterica serovar Typhi Ty2
aucugguuugguaaaga

SEQ ID NO: 1795399 - RNA, 21 nt, Salmonella enterica enterica serovar Typhi Ty2
aucugucccagccuuccuggu

SEQ ID NO: 1795400 - RNA, 17 nt, Salmonella enterica enterica serovar Typhi Ty2
aucuugaaugauuuugu

SEQ ID NO: 1795401 - RNA, 17 nt, Salmonella enterica enterica serovar Typhi Ty2
aucuucugcugcucccu

SEQ ID NO: 1795402 - RNA, 13 nt, Salmonella enterica enterica serovar Typhi Ty2
aucuucugcugcu

SEQ ID NO: 1795403 - RNA, 17 nt, Salmonella enterica enterica serovar Typhi Ty2
aucuugauaucaucauc

SEQ ID NO: 1795404 - RNA, 17 nt, Salmonella enterica enterica serovar Typhi Ty2
aucuugaguuuggccug

SEQ ID NO: 1795405 - RNA, 17 nt, Salmonella enterica enterica serovar Typhi Ty2
aucuugcuuuauuuuua

SEQ ID NO: 1795406 - RNA, 11 nt, Salmonella enterica enterica serovar Typhi Ty2
aucuuuuuccc

SEQ ID NO: 1795407 - RNA, 18 nt, Salmonella enterica enterica serovar Typhi Ty2
aucuuuugcgccuuccag

SEQ ID NO: 1795408 - RNA, 14 nt, Salmonella enterica enterica serovar Typhi Ty2
aucuuuuccugaag

SEQ ID NO: 1795409 - RNA, 12 nt, Salmonella enterica enterica serovar Typhi Ty2
aucuuucuuuuu

SEQ ID NO: 1795410 - RNA, 14 nt, Salmonella enterica enterica serovar Typhi Ty2
aucuuucuuuuuau

SEQ ID NO: 1795411 - RNA, 17 nt, Salmonella enterica enterica serovar Typhi Ty2
aucuuuaccaaugugca

SEQ ID NO: 1795412 - RNA, 22 nt, Salmonella enterica enterica serovar Typhi Ty2
aucuuguccucaucauucgguu

SEQ ID NO: 1795413 - RNA, 13 nt, Salmonella enterica enterica serovar Typhi Ty2
aucuuguccucau

SEQ ID NO: 1795414 - RNA, 16 nt, Salmonella enterica enterica serovar Typhi Ty2
aucuuguccucaucau

SEQ ID NO: 1795415 - RNA, 12 nt, Salmonella enterica enterica serovar Typhi Ty2
aucuugggaaua

SEQ ID NO: 1795416 - RNA, 20 nt, Salmonella enterica enterica serovar Typhi Ty2
aucugcacguaccugcucca

SEQ ID NO: 1795417 - RNA, 17 nt, Salmonella enterica enterica serovar Typhi Ty2
aucugcacguaccugcu

SEQ ID NO: 1795418 - RNA, 20 nt, Salmonella enterica enterica serovar Typhi Ty2
aucugcauguaguaagccau

SEQ ID NO: 1795419 - RNA, 16 nt, Salmonella enterica enterica serovar Typhi Ty2
aucugcaugcgcugga

SEQ ID NO: 1795420 - RNA, 13 nt, Salmonella enterica enterica serovar Typhi Ty2
aucugcaaaauau

SEQ ID NO: 1795421 - RNA, 14 nt, Salmonella enterica enterica serovar Typhi Ty2
aucugaugauuaau

SEQ ID NO: 1795422 - RNA, 19 nt, Salmonella enterica enterica serovar Typhi Ty2
aucucuugcauaauaucca

SEQ ID NO: 1795423 - RNA, 24 nt, Salmonella enterica enterica serovar Typhi Ty2
aucugccucaacaaguccuucuuc

SEQ ID NO: 1795424 - RNA, 13 nt, Salmonella enterica enterica serovar Typhi Ty2
aucugcccuuucu

SEQ ID NO: 1795425 - RNA, 16 nt, Salmonella enterica enterica serovar Typhi Ty2
aucugccauuucugcu

SEQ ID NO: 1795426 - RNA, 19 nt, Salmonella enterica enterica serovar Typhi Ty2
aucugguggaaaagaaaac

SEQ ID NO: 1795427 - RNA, 18 nt, Salmonella enterica enterica serovar Typhi Ty2
aucuggugauaaagcaga

SEQ ID NO: 1795428 - RNA, 17 nt, Salmonella enterica enterica serovar Typhi Ty2
aucuggucaaguauuuc

SEQ ID NO: 1795429 - RNA, 14 nt, Salmonella enterica enterica serovar Typhi Ty2
aucuggacgccaau

SEQ ID NO: 1795430 - RNA, 18 nt, Salmonella enterica enterica serovar Typhi Ty2
aucuccccuucagaguga

SEQ ID NO: 1795431 - RNA, 16 nt, Salmonella enterica enterica serovar Typhi Ty2
aucuccaucauuuccg

SEQ ID NO: 1795432 - RNA, 11 nt, Salmonella enterica enterica serovar Typhi Ty2
aucuccagcau

SEQ ID NO: 1795433 - RNA, 21 nt, Salmonella enterica enterica serovar Typhi Ty2
aucuccagcgcauugccuuuc

SEQ ID NO: 1795434 - RNA, 14 nt, Salmonella enterica enterica serovar Typhi Ty2
aucucaaggucugu

SEQ ID NO: 1795435 - RNA, 19 nt, Salmonella enterica enterica serovar Typhi Ty2
aucucaaggucugucagga

SEQ ID NO: 1795436 - RNA, 15 nt, Salmonella enterica enterica serovar Typhi Ty2
aucucuacuuuccug

SEQ ID NO: 1795437 - RNA, 18 nt, Salmonella enterica enterica serovar Typhi Ty2
aucucuacuuuccugaag

SEQ ID NO: 1795438 - RNA, 14 nt, Salmonella enterica enterica serovar Typhi Ty2
aucucuacgccggc

SEQ ID NO: 1795439 - RNA, 17 nt, Salmonella enterica enterica serovar Typhi Ty2
aucucgugaucgccaaa

SEQ ID NO: 1795440 - RNA, 21 nt, Salmonella enterica enterica serovar Typhi Ty2
aucucgucaaacucuuccggg

SEQ ID NO: 1795441 - RNA, 23 nt, Salmonella enterica enterica serovar Typhi Ty2
aucgugcaagcccaacuauuuua

SEQ ID NO: 1795442 - RNA, 23 nt, Salmonella enterica enterica serovar Typhi Ty2
aucgugcgcguaugauuuucuua

SEQ ID NO: 1795443 - RNA, 18 nt, Salmonella enterica enterica serovar Typhi Ty2
aucgugauaaauugcuga

SEQ ID NO: 1795444 - RNA, 18 nt, Salmonella enterica enterica serovar Typhi Ty2
aucgucucucauccgcca

SEQ ID NO: 1795445 - RNA, 14 nt, Salmonella enterica enterica serovar Typhi Ty2
aucguuauauauac

SEQ ID NO: 1795446 - RNA, 16 nt, Salmonella enterica enterica serovar Typhi Ty2
aucguuauccagcagc

SEQ ID NO: 1795447 - RNA, 22 nt, Salmonella enterica enterica serovar Typhi Ty2
aucguguuauuuucaaaaacaa

SEQ ID NO: 1795448 - RNA, 15 nt, Salmonella enterica enterica serovar Typhi Ty2
aucguguugcagccc

SEQ ID NO: 1795449 - RNA, 19 nt, Salmonella enterica enterica serovar Typhi Ty2
aucguguuauuuucaaaaa

SEQ ID NO: 1795450 - RNA, 21 nt, Salmonella enterica enterica serovar Typhi Ty2
aucggagauuucauccucuug

SEQ ID NO: 1795451 - RNA, 13 nt, Salmonella enterica enterica serovar Typhi Ty2
aucggauccaucg

SEQ ID NO: 1795452 - RNA, 21 nt, Salmonella enterica enterica serovar Typhi Ty2
aucgcuuaacggcccaggcau

SEQ ID NO: 1795453 - RNA, 14 nt, Salmonella enterica enterica serovar Typhi Ty2
aucgcuguggcauu

SEQ ID NO: 1795454 - RNA, 16 nt, Salmonella enterica enterica serovar Typhi Ty2
aucggcacacagccag

SEQ ID NO: 1795455 - RNA, 20 nt, Salmonella enterica enterica serovar Typhi Ty2
aucggcaaacauagccucaa

SEQ ID NO: 1795456 - RNA, 16 nt, Salmonella enterica enterica serovar Typhi Ty2
aucgucgggauaagcg

SEQ ID NO: 1795457 - RNA, 16 nt, Salmonella enterica enterica serovar Typhi Ty2
aucgucguuccgccag

SEQ ID NO: 1795458 - RNA, 19 nt, Salmonella enterica enterica serovar Typhi Ty2
aucgucguuccgccaggcg

SEQ ID NO: 1795459 - RNA, 21 nt, Salmonella enterica enterica serovar Typhi Ty2
aucgucggcgauugucaucau

SEQ ID NO: 1795460 - RNA, 16 nt, Salmonella enterica enterica serovar Typhi Ty2
aucgucgccagaccca

SEQ ID NO: 1795461 - RNA, 13 nt, Salmonella enterica enterica serovar Typhi Ty2
aucguccagccau

SEQ ID NO: 1795462 - RNA, 14 nt, Salmonella enterica enterica serovar Typhi Ty2
aucuacuucagcac

SEQ ID NO: 1795463 - RNA, 20 nt, Salmonella enterica enterica serovar Typhi Ty2
aucuaccuucacgcagugcg

SEQ ID NO: 1795464 - RNA, 18 nt, Salmonella enterica enterica serovar Typhi Ty2
aucguucgccagugacaa

SEQ ID NO: 1795465 - RNA, 15 nt, Salmonella enterica enterica serovar Typhi Ty2
aucguucgcggaacg

SEQ ID NO: 1795466 - RNA, 19 nt, Salmonella enterica enterica serovar Typhi Ty2
aucguucuugcacaauacu

SEQ ID NO: 1795467 - RNA, 15 nt, Salmonella enterica enterica serovar Typhi Ty2
aucguuuccagcauc

SEQ ID NO: 1795468 - RNA, 19 nt, Salmonella enterica enterica serovar Typhi Ty2
aucgccauccugcaccgua

SEQ ID NO: 1795469 - RNA, 15 nt, Salmonella enterica enterica serovar Typhi Ty2
aucgcaaauucugua

SEQ ID NO: 1795470 - RNA, 21 nt, Salmonella enterica enterica serovar Typhi Ty2
aucgcaacgccggugccugcc

SEQ ID NO: 1795471 - RNA, 22 nt, Salmonella enterica enterica serovar Typhi Ty2
aucgcagaaauauuuugccugc

SEQ ID NO: 1795472 - RNA, 21 nt, Salmonella enterica enterica serovar Typhi Ty2
aucgcacagagaucgugcauc

SEQ ID NO: 1795473 - RNA, 17 nt, Salmonella enterica enterica serovar Typhi Ty2
aucgaggccauauuuaa

SEQ ID NO: 1795474 - RNA, 14 nt, Salmonella enterica enterica serovar Typhi Ty2
aucgaugugauaaa

SEQ ID NO: 1795475 - RNA, 11 nt, Salmonella enterica enterica serovar Typhi Ty2
aucgagauaag

SEQ ID NO: 1795476 - RNA, 15 nt, Salmonella enterica enterica serovar Typhi Ty2
auccuuuuucaugca

SEQ ID NO: 1795477 - RNA, 18 nt, Salmonella enterica enterica serovar Typhi Ty2
aucgagcggcaguagcag

SEQ ID NO: 1795478 - RNA, 15 nt, Salmonella enterica enterica serovar Typhi Ty2
aucgagaucagacuu

SEQ ID NO: 1795479 - RNA, 13 nt, Salmonella enterica enterica serovar Typhi Ty2
aucgagauaagau

SEQ ID NO: 1795480 - RNA, 16 nt, Salmonella enterica enterica serovar Typhi Ty2
aucgccgcgacagucg

SEQ ID NO: 1795481 - RNA, 19 nt, Salmonella enterica enterica serovar Typhi Ty2
aucgccgcgacagucgcag

SEQ ID NO: 1795482 - RNA, 22 nt, Salmonella enterica enterica serovar Typhi Ty2
aucgcccccaucgugauaaagg

SEQ ID NO: 1795483 - RNA, 14 nt, Salmonella enterica enterica serovar Typhi Ty2
aucgccggagaucu

SEQ ID NO: 1795484 - RNA, 21 nt, Salmonella enterica enterica serovar Typhi Ty2
aucgccgguuuugguaucuuc

SEQ ID NO: 1795485 - RNA, 22 nt, Salmonella enterica enterica serovar Typhi Ty2
aucgccgguagcuucagcggcg

SEQ ID NO: 1795486 - RNA, 16 nt, Salmonella enterica enterica serovar Typhi Ty2
aucgccucccugccua

SEQ ID NO: 1795487 - RNA, 22 nt, Salmonella enterica enterica serovar Typhi Ty2
aucgccucccugccuaaagaaa

SEQ ID NO: 1795488 - RNA, 23 nt, Salmonella enterica enterica serovar Typhi Ty2
aucgccucccugccuaaagaaaa

SEQ ID NO: 1795489 - RNA, 16 nt, Salmonella enterica enterica serovar Typhi Ty2
aucgccugccagcgcu

SEQ ID NO: 1795490 - RNA, 18 nt, Salmonella enterica enterica serovar Typhi Ty2
aucgccugcgcgccugac

SEQ ID NO: 1795491 - RNA, 14 nt, Salmonella enterica enterica serovar Typhi Ty2
aucgccuggagcug

SEQ ID NO: 1795492 - RNA, 22 nt, Salmonella enterica enterica serovar Typhi Ty2
aucgcugaccaacgucagcauc

SEQ ID NO: 1795493 - RNA, 18 nt, Salmonella enterica enterica serovar Typhi Ty2
aucgcgguuuuccggguc

SEQ ID NO: 1795494 - RNA, 16 nt, Salmonella enterica enterica serovar Typhi Ty2
aucgcguacaggaugu

SEQ ID NO: 1795495 - RNA, 21 nt, Salmonella enterica enterica serovar Typhi Ty2
aucgcguuacggccaaauuua

SEQ ID NO: 1795496 - RNA, 17 nt, Salmonella enterica enterica serovar Typhi Ty2
aucgcgcagcaaaucag

SEQ ID NO: 1795497 - RNA, 20 nt, Salmonella enterica enterica serovar Typhi Ty2
aucgcgcacaugcugugcgc

SEQ ID NO: 1795498 - RNA, 20 nt, Salmonella enterica enterica serovar Typhi Ty2
aucgcgauuccggacaacgc

SEQ ID NO: 1795499 - RNA, 19 nt, Salmonella enterica enterica serovar Typhi Ty2
aucgcgcagcguaaagcgu

SEQ ID NO: 1795500 - RNA, 22 nt, Salmonella enterica enterica serovar Typhi Ty2
aucgccuggugugaacaucacg

SEQ ID NO: 1795501 - RNA, 19 nt, Salmonella enterica enterica serovar Typhi Ty2
aucgcgauacugccgccca

SEQ ID NO: 1795502 - RNA, 13 nt, Salmonella enterica enterica serovar Typhi Ty2
aucgcgagaaaau

SEQ ID NO: 1795503 - RNA, 19 nt, Salmonella enterica enterica serovar Typhi Ty2
aucgcgagcacuuuuuccu

SEQ ID NO: 1795504 - RNA, 20 nt, Salmonella enterica enterica serovar Typhi Ty2
auccucuuggguuauuucga

SEQ ID NO: 1795505 - RNA, 13 nt, Salmonella enterica enterica serovar Typhi Ty2
auccugaagaugg

SEQ ID NO: 1795506 - RNA, 22 nt, Salmonella enterica enterica serovar Typhi Ty2
auccugaaccagcggcaccagc

SEQ ID NO: 1795507 - RNA, 16 nt, Salmonella enterica enterica serovar Typhi Ty2
auccucauacagcccg

SEQ ID NO: 1795508 - RNA, 23 nt, Salmonella enterica enterica serovar Typhi Ty2
auccucauuuuguugcuccagca

SEQ ID NO: 1795509 - RNA, 12 nt, Salmonella enterica enterica serovar Typhi Ty2
auccucgaugaa

SEQ ID NO: 1795510 - RNA, 13 nt, Salmonella enterica enterica serovar Typhi Ty2
auccugauuauua

SEQ ID NO: 1795511 - RNA, 13 nt, Salmonella enterica enterica serovar Typhi Ty2
auccugcacccgc

SEQ ID NO: 1795512 - RNA, 13 nt, Salmonella enterica enterica serovar Typhi Ty2
auccuguucaaac

SEQ ID NO: 1795513 - RNA, 18 nt, Salmonella enterica enterica serovar Typhi Ty2
auccuguucaaacaucag

SEQ ID NO: 1795514 - RNA, 14 nt, Salmonella enterica enterica serovar Typhi Ty2
auccuuaucagacu

SEQ ID NO: 1795515 - RNA, 20 nt, Salmonella enterica enterica serovar Typhi Ty2
auccugcaaauagcgcugau

SEQ ID NO: 1795516 - RNA, 21 nt, Salmonella enterica enterica serovar Typhi Ty2
auccuucaaucgguacgccaa

SEQ ID NO: 1795517 - RNA, 16 nt, Salmonella enterica enterica serovar Typhi Ty2
auccuuucucugguuu

SEQ ID NO: 1795518 - RNA, 15 nt, Salmonella enterica enterica serovar Typhi Ty2
auccgguuacucgca

SEQ ID NO: 1795519 - RNA, 18 nt, Salmonella enterica enterica serovar Typhi Ty2
auccgucaggaugggcuu

SEQ ID NO: 1795520 - RNA, 14 nt, Salmonella enterica enterica serovar Typhi Ty2
auccguccucuuuc

SEQ ID NO: 1795521 - RNA, 15 nt, Salmonella enterica enterica serovar Typhi Ty2
auccguccucuuucc

SEQ ID NO: 1795522 - RNA, 16 nt, Salmonella enterica enterica serovar Typhi Ty2
auccuaaaucugccau

SEQ ID NO: 1795523 - RNA, 16 nt, Salmonella enterica enterica serovar Typhi Ty2
auccguuucagaaaga

SEQ ID NO: 1795524 - RNA, 18 nt, Salmonella enterica enterica serovar Typhi Ty2
auccguuauuucacagca

SEQ ID NO: 1795525 - RNA, 18 nt, Salmonella enterica enterica serovar Typhi Ty2
auccguuuccgcaauaag

SEQ ID NO: 1795526 - RNA, 14 nt, Salmonella enterica enterica serovar Typhi Ty2
auccggcagccaau

SEQ ID NO: 1795527 - RNA, 18 nt, Salmonella enterica enterica serovar Typhi Ty2
auccggcauuuuucucag

SEQ ID NO: 1795528 - RNA, 23 nt, Salmonella enterica enterica serovar Typhi Ty2
auccggcaguuauuuuacgggcg

SEQ ID NO: 1795529 - RNA, 21 nt, Salmonella enterica enterica serovar Typhi Ty2
auccggccugcacaagaaaca

SEQ ID NO: 1795530 - RNA, 21 nt, Salmonella enterica enterica serovar Typhi Ty2
auccgggauauaaaauuauug

SEQ ID NO: 1795531 - RNA, 19 nt, Salmonella enterica enterica serovar Typhi Ty2
auccggcaaaagaggcuaa

SEQ ID NO: 1795532 - RNA, 13 nt, Salmonella enterica enterica serovar Typhi Ty2
aucccgcaucacc

SEQ ID NO: 1795533 - RNA, 15 nt, Salmonella enterica enterica serovar Typhi Ty2
aucccgccaaaccgg

SEQ ID NO: 1795534 - RNA, 22 nt, Salmonella enterica enterica serovar Typhi Ty2
aucccgacccauacucuuuccc

SEQ ID NO: 1795535 - RNA, 14 nt, Salmonella enterica enterica serovar Typhi Ty2
auccccugcuccug

SEQ ID NO: 1795536 - RNA, 12 nt, Salmonella enterica enterica serovar Typhi Ty2
auccccauccca

SEQ ID NO: 1795537 - RNA, 16 nt, Salmonella enterica enterica serovar Typhi Ty2
auccauguacgcaggc

SEQ ID NO: 1795538 - RNA, 21 nt, Salmonella enterica enterica serovar Typhi Ty2
auccauguacgcaggcgacug

SEQ ID NO: 1795539 - RNA, 16 nt, Salmonella enterica enterica serovar Typhi Ty2
auccaugcuuucaaua

SEQ ID NO: 1795540 - RNA, 18 nt, Salmonella enterica enterica serovar Typhi Ty2
aucccaccauaaagcgaa

SEQ ID NO: 1795541 - RNA, 20 nt, Salmonella enterica enterica serovar Typhi Ty2
aucccaccaauugccacaua

SEQ ID NO: 1795542 - RNA, 17 nt, Salmonella enterica enterica serovar Typhi Ty2
aucccacaacuguucuu

SEQ ID NO: 1795543 - RNA, 12 nt, Salmonella enterica enterica serovar Typhi Ty2
aucccaaucagg

SEQ ID NO: 1795544 - RNA, 21 nt, Salmonella enterica enterica serovar Typhi Ty2
aucccacggagaaaagcgaaa

SEQ ID NO: 1795545 - RNA, 19 nt, Salmonella enterica enterica serovar Typhi Ty2
aucccaugcaccaguccca

SEQ ID NO: 1795546 - RNA, 17 nt, Salmonella enterica enterica serovar Typhi Ty2
aucccauugcguucuau

SEQ ID NO: 1795547 - RNA, 17 nt, Salmonella enterica enterica serovar Typhi Ty2
aucccaugcaccagucc

SEQ ID NO: 1795548 - RNA, 13 nt, Salmonella enterica enterica serovar Typhi Ty2
auccccaaacugc

SEQ ID NO: 1795549 - RNA, 17 nt, Salmonella enterica enterica serovar Typhi Ty2
auccccaaacugcucgu

SEQ ID NO: 1795550 - RNA, 15 nt, Salmonella enterica enterica serovar Typhi Ty2
auccaguuuuuucca

SEQ ID NO: 1795551 - RNA, 24 nt, Salmonella enterica enterica serovar Typhi Ty2
auccaguuucuucggcuucaccga

SEQ ID NO: 1795552 - RNA, 14 nt, Salmonella enterica enterica serovar Typhi Ty2
auccaguuuauauu

SEQ ID NO: 1795553 - RNA, 23 nt, Salmonella enterica enterica serovar Typhi Ty2
auccaguggugaaaaagcggcug

SEQ ID NO: 1795554 - RNA, 21 nt, Salmonella enterica enterica serovar Typhi Ty2
auccaguaacgcguccaacug

SEQ ID NO: 1795555 - RNA, 20 nt, Salmonella enterica enterica serovar Typhi Ty2
auccagcuugccgucacagg

SEQ ID NO: 1795556 - RNA, 15 nt, Salmonella enterica enterica serovar Typhi Ty2
auccagucagaggaa

SEQ ID NO: 1795557 - RNA, 17 nt, Salmonella enterica enterica serovar Typhi Ty2
auccauaauuuucccca

SEQ ID NO: 1795558 - RNA, 14 nt, Salmonella enterica enterica serovar Typhi Ty2
auccauauucuucg

SEQ ID NO: 1795559 - RNA, 13 nt, Salmonella enterica enterica serovar Typhi Ty2
auccaucaucuau

SEQ ID NO: 1795560 - RNA, 17 nt, Salmonella enterica enterica serovar Typhi Ty2
auccagcgcucaaucag

SEQ ID NO: 1795561 - RNA, 13 nt, Salmonella enterica enterica serovar Typhi Ty2
auccagacccaga

SEQ ID NO: 1795562 - RNA, 20 nt, Salmonella enterica enterica serovar Typhi Ty2
auccagcaaucguccucaca

SEQ ID NO: 1795563 - RNA, 11 nt, Salmonella enterica enterica serovar Typhi Ty2
auccagcacag

SEQ ID NO: 1795564 - RNA, 17 nt, Salmonella enterica enterica serovar Typhi Ty2
auccagcgguuacuuuu

SEQ ID NO: 1795565 - RNA, 17 nt, Salmonella enterica enterica serovar Typhi Ty2
auccagcucaguuucca

SEQ ID NO: 1795566 - RNA, 23 nt, Salmonella enterica enterica serovar Typhi Ty2
auccagcguaggguagaucacgc

SEQ ID NO: 1795567 - RNA, 15 nt, Salmonella enterica enterica serovar Typhi Ty2
auccagcucuucuuc

SEQ ID NO: 1795568 - RNA, 19 nt, Salmonella enterica enterica serovar Typhi Ty2
auccagcucaguuuccagc

SEQ ID NO: 1795569 - RNA, 21 nt, Salmonella enterica enterica serovar Typhi Ty2
auccagcucuuucaauccuuc

SEQ ID NO: 1795570 - RNA, 20 nt, Salmonella enterica enterica serovar Typhi Ty2
auccacgcggugcccugggu

SEQ ID NO: 1795571 - RNA, 22 nt, Salmonella enterica enterica serovar Typhi Ty2
auccacgguucucaccguggca

SEQ ID NO: 1795572 - RNA, 16 nt, Salmonella enterica enterica serovar Typhi Ty2
auccagauguuauaaa

SEQ ID NO: 1795573 - RNA, 19 nt, Salmonella enterica enterica serovar Typhi Ty2
auccagauguuauaaacuu

SEQ ID NO: 1795574 - RNA, 22 nt, Salmonella enterica enterica serovar Typhi Ty2
auccagagcggauaaauaguga

SEQ ID NO: 1795575 - RNA, 17 nt, Salmonella enterica enterica serovar Typhi Ty2
auccagauauggcaaac

SEQ ID NO: 1795576 - RNA, 20 nt, Salmonella enterica enterica serovar Typhi Ty2
auccacugagcgcgccauga

SEQ ID NO: 1795577 - RNA, 19 nt, Salmonella enterica enterica serovar Typhi Ty2
auccacaaccggcuggcua

SEQ ID NO: 1795578 - RNA, 16 nt, Salmonella enterica enterica serovar Typhi Ty2
auccacagcgccagaa

SEQ ID NO: 1795579 - RNA, 23 nt, Salmonella enterica enterica serovar Typhi Ty2
auccacgccgcuaucgaccagca

SEQ ID NO: 1795580 - RNA, 20 nt, Salmonella enterica enterica serovar Typhi Ty2
auccacauuccagaccugaa

SEQ ID NO: 1795581 - RNA, 15 nt, Salmonella enterica enterica serovar Typhi Ty2
auccaacgaaacgca

SEQ ID NO: 1795582 - RNA, 21 nt, Salmonella enterica enterica serovar Typhi Ty2
auccaacacggcgcucaggau

SEQ ID NO: 1795583 - RNA, 22 nt, Salmonella enterica enterica serovar Typhi Ty2
aucauugguuaacucaagcgaa

SEQ ID NO: 1795584 - RNA, 22 nt, Salmonella enterica enterica serovar Typhi Ty2
auccaaacggaccggcgacuau

SEQ ID NO: 1795585 - RNA, 15 nt, Salmonella enterica enterica serovar Typhi Ty2
aucauugauacugua

SEQ ID NO: 1795586 - RNA, 16 nt, Salmonella enterica enterica serovar Typhi Ty2
aucauucucuacgccc

SEQ ID NO: 1795587 - RNA, 23 nt, Salmonella enterica enterica serovar Typhi Ty2
aaaagaaugucccaguaauaucg

SEQ ID NO: 1795588 - RNA, 15 nt, Salmonella enterica enterica serovar Typhi Ty2
aucaugugaucuaua

SEQ ID NO: 1795589 - RNA, 17 nt, Salmonella enterica enterica serovar Typhi Ty2
aaaacugucccugaugu

SEQ ID NO: 1795590 - RNA, 20 nt, Salmonella enterica enterica serovar Typhi Ty2
aucaugcugcaccgcaucaa

SEQ ID NO: 1795591 - RNA, 13 nt, Salmonella enterica enterica serovar Typhi Ty2
aucaugcuugcaa

SEQ ID NO: 1795592 - RNA, 16 nt, Salmonella enterica enterica serovar Typhi Ty2
aucaugcuugcuuugc

SEQ ID NO: 1795593 - RNA, 22 nt, Salmonella enterica enterica serovar Typhi Ty2
aucauggcuugaucgcgcagca

SEQ ID NO: 1795594 - RNA, 14 nt, Salmonella enterica enterica serovar Typhi Ty2
aucauggcucagau

SEQ ID NO: 1795595 - RNA, 18 nt, Salmonella enterica enterica serovar Typhi Ty2
aucauggacagauuucca

SEQ ID NO: 1795596 - RNA, 15 nt, Salmonella enterica enterica serovar Typhi Ty2
aucaugcugaugacu

SEQ ID NO: 1795597 - RNA, 21 nt, Salmonella enterica enterica serovar Typhi Ty2
aaaacucgccgcgaacaaagc

SEQ ID NO: 1795598 - RNA, 17 nt, Salmonella enterica enterica serovar Typhi Ty2
aaaacugacuaaaaauc

SEQ ID NO: 1795599 - RNA, 11 nt, Salmonella enterica enterica serovar Typhi Ty2
aaaacugcacc

SEQ ID NO: 1795600 - RNA, 16 nt, Salmonella enterica enterica serovar Typhi Ty2
aucaugucaaauucaa

SEQ ID NO: 1795601 - RNA, 14 nt, Salmonella enterica enterica serovar Typhi Ty2
aucaugaaaaauau

SEQ ID NO: 1795602 - RNA, 16 nt, Salmonella enterica enterica serovar Typhi Ty2
aucaugaaaaauauaa

SEQ ID NO: 1795603 - RNA, 18 nt, Salmonella enterica enterica serovar Typhi Ty2
aucaucuuuuaccgccug

SEQ ID NO: 1795604 - RNA, 15 nt, Salmonella enterica enterica serovar Typhi Ty2
aucaugaauaaucgu

SEQ ID NO: 1795605 - RNA, 11 nt, Salmonella enterica enterica serovar Typhi Ty2
aucaugcccac

SEQ ID NO: 1795606 - RNA, 16 nt, Salmonella enterica enterica serovar Typhi Ty2
aucaugccgcccaggc

SEQ ID NO: 1795607 - RNA, 18 nt, Salmonella enterica enterica serovar Typhi Ty2
aucaucuauagacgcuga

SEQ ID NO: 1795608 - RNA, 16 nt, Salmonella enterica enterica serovar Typhi Ty2
aucaucuauaauaccu

SEQ ID NO: 1795609 - RNA, 19 nt, Salmonella enterica enterica serovar Typhi Ty2
aucaucuucacuucacaaa

SEQ ID NO: 1795610 - RNA, 14 nt, Salmonella enterica enterica serovar Typhi Ty2
aucaucuucacuuc

SEQ ID NO: 1795611 - RNA, 16 nt, Salmonella enterica enterica serovar Typhi Ty2
aucaucuucacuucac

SEQ ID NO: 1795612 - RNA, 12 nt, Salmonella enterica enterica serovar Typhi Ty2
aucaucuucacu

SEQ ID NO: 1795613 - RNA, 14 nt, Salmonella enterica enterica serovar Typhi Ty2
aucauaaucacuau

SEQ ID NO: 1795614 - RNA, 22 nt, Salmonella enterica enterica serovar Typhi Ty2
aaaacguuauuggcaggaugua

SEQ ID NO: 1795615 - RNA, 13 nt, Salmonella enterica enterica serovar Typhi Ty2
aaaacuauuucaa

SEQ ID NO: 1795616 - RNA, 23 nt, Salmonella enterica enterica serovar Typhi Ty2
auaaaguuuauuugaauagucaa

SEQ ID NO: 1795617 - RNA, 16 nt, Salmonella enterica enterica serovar Typhi Ty2
auaaagguauagugga

SEQ ID NO: 1795618 - RNA, 21 nt, Salmonella enterica enterica serovar Typhi Ty2
auaaagugcugaacaauaaca

SEQ ID NO: 1795619 - RNA, 16 nt, Salmonella enterica enterica serovar Typhi Ty2
auaaaucaggaaaaag

SEQ ID NO: 1795620 - RNA, 18 nt, Salmonella enterica enterica serovar Typhi Ty2
auaaaugaauuauuuuuu

SEQ ID NO: 1795621 - RNA, 19 nt, Salmonella enterica enterica serovar Typhi Ty2
auaaaucaacauacugauu

SEQ ID NO: 1795622 - RNA, 15 nt, Salmonella enterica enterica serovar Typhi Ty2
auaaauucgaaauaa

SEQ ID NO: 1795623 - RNA, 20 nt, Salmonella enterica enterica serovar Typhi Ty2
auaaaugaggcuguuuuuua

SEQ ID NO: 1795624 - RNA, 21 nt, Salmonella enterica enterica serovar Typhi Ty2
auaaaugguacuuuucaucca

SEQ ID NO: 1795625 - RNA, 18 nt, Salmonella enterica enterica serovar Typhi Ty2
auaaauguacugcaauaa

SEQ ID NO: 1795626 - RNA, 22 nt, Salmonella enterica enterica serovar Typhi Ty2
auaaacuucaauucagaaaguu

SEQ ID NO: 1795627 - RNA, 22 nt, Salmonella enterica enterica serovar Typhi Ty2
auaaagcugguugagauccaua

SEQ ID NO: 1795628 - RNA, 22 nt, Salmonella enterica enterica serovar Typhi Ty2
auaaagauauugucgcccugca

SEQ ID NO: 1795629 - RNA, 17 nt, Salmonella enterica enterica serovar Typhi Ty2
auaaagauauucuccuc

SEQ ID NO: 1795630 - RNA, 20 nt, Salmonella enterica enterica serovar Typhi Ty2
auaaagaccggcacaaccgu

SEQ ID NO: 1795631 - RNA, 17 nt, Salmonella enterica enterica serovar Typhi Ty2
auaaacagcguuuucau

SEQ ID NO: 1795632 - RNA, 20 nt, Salmonella enterica enterica serovar Typhi Ty2
auaaacagauaugaaaugag

SEQ ID NO: 1795633 - RNA, 17 nt, Salmonella enterica enterica serovar Typhi Ty2
auaaacagcagcgcggc

SEQ ID NO: 1795634 - RNA, 14 nt, Salmonella enterica enterica serovar Typhi Ty2
auaaacgggaagua

SEQ ID NO: 1795635 - RNA, 14 nt, Salmonella enterica enterica serovar Typhi Ty2
auaaacucagcaau

SEQ ID NO: 1795636 - RNA, 16 nt, Salmonella enterica enterica serovar Typhi Ty2
auaaacgguuucagua

SEQ ID NO: 1795637 - RNA, 17 nt, Salmonella enterica enterica serovar Typhi Ty2
aguugguuguagcacag

SEQ ID NO: 1795638 - RNA, 14 nt, Salmonella enterica enterica serovar Typhi Ty2
aguuggugggugau

SEQ ID NO: 1795639 - RNA, 16 nt, Salmonella enterica enterica serovar Typhi Ty2
aguugguguuucucaa

SEQ ID NO: 1795640 - RNA, 13 nt, Salmonella enterica enterica serovar Typhi Ty2
aguuggcuucagc

SEQ ID NO: 1795641 - RNA, 17 nt, Salmonella enterica enterica serovar Typhi Ty2
aguuguacaaacuguga

SEQ ID NO: 1795642 - RNA, 16 nt, Salmonella enterica enterica serovar Typhi Ty2
aguuuugcuucaugca

SEQ ID NO: 1795643 - RNA, 19 nt, Salmonella enterica enterica serovar Typhi Ty2
aguuuugcuucaugcacaa

SEQ ID NO: 1795644 - RNA, 13 nt, Salmonella enterica enterica serovar Typhi Ty2
auaaaaaaggcag

SEQ ID NO: 1795645 - RNA, 14 nt, Salmonella enterica enterica serovar Typhi Ty2
auaaaaaacaucau

SEQ ID NO: 1795646 - RNA, 20 nt, Salmonella enterica enterica serovar Typhi Ty2
aguuuuuuuaagaaggucag

SEQ ID NO: 1795647 - RNA, 13 nt, Salmonella enterica enterica serovar Typhi Ty2
aguuuuuuuaaaa

SEQ ID NO: 1795648 - RNA, 14 nt, Salmonella enterica enterica serovar Typhi Ty2
aguuuuuuucugcc

SEQ ID NO: 1795649 - RNA, 16 nt, Salmonella enterica enterica serovar Typhi Ty2
aguuuuuaaacaacau

SEQ ID NO: 1795650 - RNA, 18 nt, Salmonella enterica enterica serovar Typhi Ty2
aguuuugucggucugaua

SEQ ID NO: 1795651 - RNA, 12 nt, Salmonella enterica enterica serovar Typhi Ty2
aguuuuuaaaca

SEQ ID NO: 1795652 - RNA, 22 nt, Salmonella enterica enterica serovar Typhi Ty2
aguuuuucuacuaacuggcaau

SEQ ID NO: 1795653 - RNA, 19 nt, Salmonella enterica enterica serovar Typhi Ty2
aguuuuugcgccagcgcaa

SEQ ID NO: 1795654 - RNA, 14 nt, Salmonella enterica enterica serovar Typhi Ty2
auaaaaaucgggua

SEQ ID NO: 1795655 - RNA, 12 nt, Salmonella enterica enterica serovar Typhi Ty2
auaaaaauuccc

SEQ ID NO: 1795656 - RNA, 14 nt, Salmonella enterica enterica serovar Typhi Ty2
auaaaaccauucaa

SEQ ID NO: 1795657 - RNA, 13 nt, Salmonella enterica enterica serovar Typhi Ty2
auaaaaagcacau

SEQ ID NO: 1795658 - RNA, 21 nt, Salmonella enterica enterica serovar Typhi Ty2
auaaaaagugcgcacucagaa

SEQ ID NO: 1795659 - RNA, 23 nt, Salmonella enterica enterica serovar Typhi Ty2
auaaaagcucuggaaaaauuguu

SEQ ID NO: 1795660 - RNA, 21 nt, Salmonella enterica enterica serovar Typhi Ty2
auaaaagagagcgccaaaaag

SEQ ID NO: 1795661 - RNA, 20 nt, Salmonella enterica enterica serovar Typhi Ty2
auaaaagagagcgccaaaaa

SEQ ID NO: 1795662 - RNA, 18 nt, Salmonella enterica enterica serovar Typhi Ty2
auaaaacgcccccugcca

SEQ ID NO: 1795663 - RNA, 15 nt, Salmonella enterica enterica serovar Typhi Ty2
auaauccagacaaau

SEQ ID NO: 1795664 - RNA, 20 nt, Salmonella enterica enterica serovar Typhi Ty2
auaauauguuccacaaucaa

SEQ ID NO: 1795665 - RNA, 20 nt, Salmonella enterica enterica serovar Typhi Ty2
auaauaucguuaagccuuca

SEQ ID NO: 1795666 - RNA, 14 nt, Salmonella enterica enterica serovar Typhi Ty2
auaaucaaacccuu

SEQ ID NO: 1795667 - RNA, 12 nt, Salmonella enterica enterica serovar Typhi Ty2
auaaucaaccau

SEQ ID NO: 1795668 - RNA, 14 nt, Salmonella enterica enterica serovar Typhi Ty2
auaaucaaccauac

SEQ ID NO: 1795669 - RNA, 20 nt, Salmonella enterica enterica serovar Typhi Ty2
auaauacuuaauucauaacg

SEQ ID NO: 1795670 - RNA, 11 nt, Salmonella enterica enterica serovar Typhi Ty2
auaauacuuaa

SEQ ID NO: 1795671 - RNA, 16 nt, Salmonella enterica enterica serovar Typhi Ty2
auaauagcugaaaaga

SEQ ID NO: 1795672 - RNA, 21 nt, Salmonella enterica enterica serovar Typhi Ty2
auaauagcugaaaagauaaag

SEQ ID NO: 1795673 - RNA, 22 nt, Salmonella enterica enterica serovar Typhi Ty2
auaauaucgaauggggaaauaa

SEQ ID NO: 1795674 - RNA, 13 nt, Salmonella enterica enterica serovar Typhi Ty2
auaagucauauca

SEQ ID NO: 1795675 - RNA, 15 nt, Salmonella enterica enterica serovar Typhi Ty2
auaauuaauaauggu

SEQ ID NO: 1795676 - RNA, 22 nt, Salmonella enterica enterica serovar Typhi Ty2
auaauuaagaccauacuuugca

SEQ ID NO: 1795677 - RNA, 18 nt, Salmonella enterica enterica serovar Typhi Ty2
auaauguugguaaauuua

SEQ ID NO: 1795678 - RNA, 20 nt, Salmonella enterica enterica serovar Typhi Ty2
auaauccggaauaagaauau

SEQ ID NO: 1795679 - RNA, 14 nt, Salmonella enterica enterica serovar Typhi Ty2
auaaucgccgccgg

SEQ ID NO: 1795680 - RNA, 17 nt, Salmonella enterica enterica serovar Typhi Ty2
auaaucgguagcacuuu

SEQ ID NO: 1795681 - RNA, 18 nt, Salmonella enterica enterica serovar Typhi Ty2
auaaucggcgucauuuuc

SEQ ID NO: 1795682 - RNA, 16 nt, Salmonella enterica enterica serovar Typhi Ty2
auaaucggccaggaug

SEQ ID NO: 1795683 - RNA, 11 nt, Salmonella enterica enterica serovar Typhi Ty2
auaaugcaauc

SEQ ID NO: 1795684 - RNA, 22 nt, Salmonella enterica enterica serovar Typhi Ty2
auaaucgguagcacuuuaaaca

SEQ ID NO: 1795685 - RNA, 13 nt, Salmonella enterica enterica serovar Typhi Ty2
auaaugccgccgu

SEQ ID NO: 1795686 - RNA, 12 nt, Salmonella enterica enterica serovar Typhi Ty2
auaaugcuuacg

SEQ ID NO: 1795687 - RNA, 21 nt, Salmonella enterica enterica serovar Typhi Ty2
auaagcuaguaaagaaauuuu

SEQ ID NO: 1795688 - RNA, 19 nt, Salmonella enterica enterica serovar Typhi Ty2
auaagcugcgacaacaagu

SEQ ID NO: 1795689 - RNA, 22 nt, Salmonella enterica enterica serovar Typhi Ty2
auaagguaacgcgaaaaaagau

SEQ ID NO: 1795690 - RNA, 18 nt, Salmonella enterica enterica serovar Typhi Ty2
auaaggguaagcaauaug

SEQ ID NO: 1795691 - RNA, 20 nt, Salmonella enterica enterica serovar Typhi Ty2
auaaggucgcuauccagcag

SEQ ID NO: 1795692 - RNA, 23 nt, Salmonella enterica enterica serovar Typhi Ty2
auaaggcggacaacgcauauuau

SEQ ID NO: 1795693 - RNA, 19 nt, Salmonella enterica enterica serovar Typhi Ty2
auaagcaacugggcuugca

SEQ ID NO: 1795694 - RNA, 18 nt, Salmonella enterica enterica serovar Typhi Ty2
auaagauuuacaacagau

SEQ ID NO: 1795695 - RNA, 17 nt, Salmonella enterica enterica serovar Typhi Ty2
auaagccacuucaacca

SEQ ID NO: 1795696 - RNA, 12 nt, Salmonella enterica enterica serovar Typhi Ty2
auaagccagccc

SEQ ID NO: 1795697 - RNA, 16 nt, Salmonella enterica enterica serovar Typhi Ty2
auaagccagguuuuca

SEQ ID NO: 1795698 - RNA, 19 nt, Salmonella enterica enterica serovar Typhi Ty2
auaagcgccgaguagcuga

SEQ ID NO: 1795699 - RNA, 14 nt, Salmonella enterica enterica serovar Typhi Ty2
auaacuauaauugc

SEQ ID NO: 1795700 - RNA, 15 nt, Salmonella enterica enterica serovar Typhi Ty2
auaacguuuccuuau

SEQ ID NO: 1795701 - RNA, 17 nt, Salmonella enterica enterica serovar Typhi Ty2
auaacgccgguuccaac

SEQ ID NO: 1795702 - RNA, 23 nt, Salmonella enterica enterica serovar Typhi Ty2
auaacgcgagaagaagaauuauu

SEQ ID NO: 1795703 - RNA, 22 nt, Salmonella enterica enterica serovar Typhi Ty2
auaacgcgauggccaaauaacc

SEQ ID NO: 1795704 - RNA, 14 nt, Salmonella enterica enterica serovar Typhi Ty2
auaacguucuuuug

SEQ ID NO: 1795705 - RNA, 15 nt, Salmonella enterica enterica serovar Typhi Ty2
auaacguuguggaau

SEQ ID NO: 1795706 - RNA, 22 nt, Salmonella enterica enterica serovar Typhi Ty2
auaacgcaggcgauagccccag

SEQ ID NO: 1795707 - RNA, 20 nt, Salmonella enterica enterica serovar Typhi Ty2
auaacgaugaugaaaaagaa

SEQ ID NO: 1795708 - RNA, 22 nt, Salmonella enterica enterica serovar Typhi Ty2
auaacgaugauuauuguuaaaa

SEQ ID NO: 1795709 - RNA, 19 nt, Salmonella enterica enterica serovar Typhi Ty2
auaaauuugucagacauga

SEQ ID NO: 1795710 - RNA, 16 nt, Salmonella enterica enterica serovar Typhi Ty2
auaacgauaugagcua

SEQ ID NO: 1795711 - RNA, 14 nt, Salmonella enterica enterica serovar Typhi Ty2
auaacgauaaauuu

SEQ ID NO: 1795712 - RNA, 19 nt, Salmonella enterica enterica serovar Typhi Ty2
auaaauuucauccaugcca

SEQ ID NO: 1795713 - RNA, 20 nt, Salmonella enterica enterica serovar Typhi Ty2
auaaauuugucagacaugau

SEQ ID NO: 1795714 - RNA, 22 nt, Salmonella enterica enterica serovar Typhi Ty2
auaaauuuauuuuuugcuggga

SEQ ID NO: 1795715 - RNA, 16 nt, Salmonella enterica enterica serovar Typhi Ty2
auaagaaaaaacuggu

SEQ ID NO: 1795716 - RNA, 18 nt, Salmonella enterica enterica serovar Typhi Ty2
auaagaccaauacgaucg

SEQ ID NO: 1795717 - RNA, 19 nt, Salmonella enterica enterica serovar Typhi Ty2
auaagacgacgguuaaaaa

SEQ ID NO: 1795718 - RNA, 14 nt, Salmonella enterica enterica serovar Typhi Ty2
auaagacgcagggc

SEQ ID NO: 1795719 - RNA, 14 nt, Salmonella enterica enterica serovar Typhi Ty2
auaacuuuccugcc

SEQ ID NO: 1795720 - RNA, 15 nt, Salmonella enterica enterica serovar Typhi Ty2
auaacucaauagcgg

SEQ ID NO: 1795721 - RNA, 20 nt, Salmonella enterica enterica serovar Typhi Ty2
aguucaucauccugcagggu

SEQ ID NO: 1795722 - RNA, 17 nt, Salmonella enterica enterica serovar Typhi Ty2
aguucauagccguggcu

SEQ ID NO: 1795723 - RNA, 14 nt, Salmonella enterica enterica serovar Typhi Ty2
aguucauaaaugua

SEQ ID NO: 1795724 - RNA, 12 nt, Salmonella enterica enterica serovar Typhi Ty2
aguucagccgcc

SEQ ID NO: 1795725 - RNA, 16 nt, Salmonella enterica enterica serovar Typhi Ty2
aguucagcagcaccac

SEQ ID NO: 1795726 - RNA, 12 nt, Salmonella enterica enterica serovar Typhi Ty2
aguuccuccugg

SEQ ID NO: 1795727 - RNA, 12 nt, Salmonella enterica enterica serovar Typhi Ty2
aguuccggauac

SEQ ID NO: 1795728 - RNA, 14 nt, Salmonella enterica enterica serovar Typhi Ty2
aguucccuacucuc

SEQ ID NO: 1795729 - RNA, 22 nt, Salmonella enterica enterica serovar Typhi Ty2
aguucccuacucucgcaugggg

SEQ ID NO: 1795730 - RNA, 18 nt, Salmonella enterica enterica serovar Typhi Ty2
aguuccgcaauccuggcu

SEQ ID NO: 1795731 - RNA, 14 nt, Salmonella enterica enterica serovar Typhi Ty2
aguuaaucagcgcc

SEQ ID NO: 1795732 - RNA, 17 nt, Salmonella enterica enterica serovar Typhi Ty2
aguuaauacaguggaaa

SEQ ID NO: 1795733 - RNA, 23 nt, Salmonella enterica enterica serovar Typhi Ty2
aguuauaaauccccgccgccauc

SEQ ID NO: 1795734 - RNA, 14 nt, Salmonella enterica enterica serovar Typhi Ty2
aguuauaaauuuau

SEQ ID NO: 1795735 - RNA, 17 nt, Salmonella enterica enterica serovar Typhi Ty2
aguucaaguuuagaaaa

SEQ ID NO: 1795736 - RNA, 14 nt, Salmonella enterica enterica serovar Typhi Ty2
aguucgacuuaacg

SEQ ID NO: 1795737 - RNA, 19 nt, Salmonella enterica enterica serovar Typhi Ty2
aguucgccuucuucaucuu

SEQ ID NO: 1795738 - RNA, 15 nt, Salmonella enterica enterica serovar Typhi Ty2
aguucgccuucuuca

SEQ ID NO: 1795739 - RNA, 12 nt, Salmonella enterica enterica serovar Typhi Ty2
aguucgccgcca

SEQ ID NO: 1795740 - RNA, 15 nt, Salmonella enterica enterica serovar Typhi Ty2
aguucgccgccagga

SEQ ID NO: 1795741 - RNA, 18 nt, Salmonella enterica enterica serovar Typhi Ty2
aguugaaaggaaaggucg

SEQ ID NO: 1795742 - RNA, 16 nt, Salmonella enterica enterica serovar Typhi Ty2
aguugaacgguaaaca

SEQ ID NO: 1795743 - RNA, 14 nt, Salmonella enterica enterica serovar Typhi Ty2
aguugcgccacugc

SEQ ID NO: 1795744 - RNA, 17 nt, Salmonella enterica enterica serovar Typhi Ty2
aguugcggcaacgugaa

SEQ ID NO: 1795745 - RNA, 16 nt, Salmonella enterica enterica serovar Typhi Ty2
aguugaccacaucaaa

SEQ ID NO: 1795746 - RNA, 21 nt, Salmonella enterica enterica serovar Typhi Ty2
aguuggaaccaaacaccagau

SEQ ID NO: 1795747 - RNA, 20 nt, Salmonella enterica enterica serovar Typhi Ty2
aguugcuucguuaccgguga

SEQ ID NO: 1795748 - RNA, 12 nt, Salmonella enterica enterica serovar Typhi Ty2
aguugcugcauc

SEQ ID NO: 1795749 - RNA, 15 nt, Salmonella enterica enterica serovar Typhi Ty2
aguugcuuaccuugu

SEQ ID NO: 1795750 - RNA, 14 nt, Salmonella enterica enterica serovar Typhi Ty2
aguugcuggagcag

SEQ ID NO: 1795751 - RNA, 16 nt, Salmonella enterica enterica serovar Typhi Ty2
aguuaaauaaacaaaa

SEQ ID NO: 1795752 - RNA, 14 nt, Salmonella enterica enterica serovar Typhi Ty2
aguuaaauaaacaa

SEQ ID NO: 1795753 - RNA, 21 nt, Salmonella enterica enterica serovar Typhi Ty2
aguuaacgcguuaaucacuac

SEQ ID NO: 1795754 - RNA, 23 nt, Salmonella enterica enterica serovar Typhi Ty2
aguuaacagaaugcugaacagcc

SEQ ID NO: 1795755 - RNA, 18 nt, Salmonella enterica enterica serovar Typhi Ty2
aguguuucccaacaaugc

SEQ ID NO: 1795756 - RNA, 15 nt, Salmonella enterica enterica serovar Typhi Ty2
aguguguaccagcag

SEQ ID NO: 1795757 - RNA, 21 nt, Salmonella enterica enterica serovar Typhi Ty2
aguguuauauucccgaaaggu

SEQ ID NO: 1795758 - RNA, 13 nt, Salmonella enterica enterica serovar Typhi Ty2
agugucgccauaa

SEQ ID NO: 1795759 - RNA, 22 nt, Salmonella enterica enterica serovar Typhi Ty2
agugugcaaacgauaaaagcuc

SEQ ID NO: 1795760 - RNA, 19 nt, Salmonella enterica enterica serovar Typhi Ty2
agugugauaagccccuuua

SEQ ID NO: 1795761 - RNA, 15 nt, Salmonella enterica enterica serovar Typhi Ty2
agugggcuaugaaga

SEQ ID NO: 1795762 - RNA, 16 nt, Salmonella enterica enterica serovar Typhi Ty2
agugcuugcauuuuac

SEQ ID NO: 1795763 - RNA, 21 nt, Salmonella enterica enterica serovar Typhi Ty2
aguggcgccgcaaugccgccu

SEQ ID NO: 1795764 - RNA, 13 nt, Salmonella enterica enterica serovar Typhi Ty2
agugauaaagcac

SEQ ID NO: 1795765 - RNA, 20 nt, Salmonella enterica enterica serovar Typhi Ty2
agugaguaacguuaauacau

SEQ ID NO: 1795766 - RNA, 17 nt, Salmonella enterica enterica serovar Typhi Ty2
agugaguacgcaggagg

SEQ ID NO: 1795767 - RNA, 20 nt, Salmonella enterica enterica serovar Typhi Ty2
agugaggaccguacucagau

SEQ ID NO: 1795768 - RNA, 20 nt, Salmonella enterica enterica serovar Typhi Ty2
aguccugcgucgcuucgcca

SEQ ID NO: 1795769 - RNA, 18 nt, Salmonella enterica enterica serovar Typhi Ty2
agucgaaauuuucuucuu

SEQ ID NO: 1795770 - RNA, 14 nt, Salmonella enterica enterica serovar Typhi Ty2
aguccgacuuuuuu

SEQ ID NO: 1795771 - RNA, 17 nt, Salmonella enterica enterica serovar Typhi Ty2
agucccuccgcuuccac

SEQ ID NO: 1795772 - RNA, 20 nt, Salmonella enterica enterica serovar Typhi Ty2
agucccgcgcuuuccagccc

SEQ ID NO: 1795773 - RNA, 15 nt, Salmonella enterica enterica serovar Typhi Ty2
agucccuaauagcgc

SEQ ID NO: 1795774 - RNA, 18 nt, Salmonella enterica enterica serovar Typhi Ty2
aguccccuuuucacccaa

SEQ ID NO: 1795775 - RNA, 17 nt, Salmonella enterica enterica serovar Typhi Ty2
agucgccaggcaagguu

SEQ ID NO: 1795776 - RNA, 14 nt, Salmonella enterica enterica serovar Typhi Ty2
agucgccaggcaag

SEQ ID NO: 1795777 - RNA, 13 nt, Salmonella enterica enterica serovar Typhi Ty2
agucgccaggauc

SEQ ID NO: 1795778 - RNA, 21 nt, Salmonella enterica enterica serovar Typhi Ty2
agucguaauucagcucgcugc

SEQ ID NO: 1795779 - RNA, 23 nt, Salmonella enterica enterica serovar Typhi Ty2
agucguggcggauucuacugguu

SEQ ID NO: 1795780 - RNA, 16 nt, Salmonella enterica enterica serovar Typhi Ty2
agugacugacacccau

SEQ ID NO: 1795781 - RNA, 22 nt, Salmonella enterica enterica serovar Typhi Ty2
agugacguggcuucgccgagaa

SEQ ID NO: 1795782 - RNA, 18 nt, Salmonella enterica enterica serovar Typhi Ty2
agugacgaggccuguccc

SEQ ID NO: 1795783 - RNA, 17 nt, Salmonella enterica enterica serovar Typhi Ty2
agugacgccaguuccca

SEQ ID NO: 1795784 - RNA, 22 nt, Salmonella enterica enterica serovar Typhi Ty2
agugacauuauucaccuggauu

SEQ ID NO: 1795785 - RNA, 15 nt, Salmonella enterica enterica serovar Typhi Ty2
agugaacacccugcc

SEQ ID NO: 1795786 - RNA, 20 nt, Salmonella enterica enterica serovar Typhi Ty2
agugaacacguaauuuauua

SEQ ID NO: 1795787 - RNA, 18 nt, Salmonella enterica enterica serovar Typhi Ty2
agugaacgguugagcuuu

SEQ ID NO: 1795788 - RNA, 19 nt, Salmonella enterica enterica serovar Typhi Ty2
agugaauuaugaccaaugu

SEQ ID NO: 1795789 - RNA, 14 nt, Salmonella enterica enterica serovar Typhi Ty2
agugaauuuaaacg

SEQ ID NO: 1795790 - RNA, 16 nt, Salmonella enterica enterica serovar Typhi Ty2
agugacagaggaauga

SEQ ID NO: 1795791 - RNA, 22 nt, Salmonella enterica enterica serovar Typhi Ty2
agugacagaggaaugaaaacga

SEQ ID NO: 1795792 - RNA, 14 nt, Salmonella enterica enterica serovar Typhi Ty2
agucugugagaaaa

SEQ ID NO: 1795793 - RNA, 18 nt, Salmonella enterica enterica serovar Typhi Ty2
agucuggguuagcuguau

SEQ ID NO: 1795794 - RNA, 23 nt, Salmonella enterica enterica serovar Typhi Ty2
agucucauugaucaguuugguau

SEQ ID NO: 1795795 - RNA, 11 nt, Salmonella enterica enterica serovar Typhi Ty2
agucuuccugc

SEQ ID NO: 1795796 - RNA, 16 nt, Salmonella enterica enterica serovar Typhi Ty2
agucuucauggucgga

SEQ ID NO: 1795797 - RNA, 15 nt, Salmonella enterica enterica serovar Typhi Ty2
agucauaauuaaaaa

SEQ ID NO: 1795798 - RNA, 23 nt, Salmonella enterica enterica serovar Typhi Ty2
agucauaccuguuccucuuuccc

SEQ ID NO: 1795799 - RNA, 15 nt, Salmonella enterica enterica serovar Typhi Ty2
agucaguuuaugacu

SEQ ID NO: 1795800 - RNA, 21 nt, Salmonella enterica enterica serovar Typhi Ty2
agucagcucgguggcgguauc

SEQ ID NO: 1795801 - RNA, 18 nt, Salmonella enterica enterica serovar Typhi Ty2
agucaucuguucaacuuu

SEQ ID NO: 1795802 - RNA, 13 nt, Salmonella enterica enterica serovar Typhi Ty2
agucaucugccag

SEQ ID NO: 1795803 - RNA, 16 nt, Salmonella enterica enterica serovar Typhi Ty2
agucaucugccaguua

SEQ ID NO: 1795804 - RNA, 13 nt, Salmonella enterica enterica serovar Typhi Ty2
agucauccuuccc

SEQ ID NO: 1795805 - RNA, 15 nt, Salmonella enterica enterica serovar Typhi Ty2
agucaucauaauuca

SEQ ID NO: 1795806 - RNA, 15 nt, Salmonella enterica enterica serovar Typhi Ty2
agucauugacagcaa

SEQ ID NO: 1795807 - RNA, 12 nt, Salmonella enterica enterica serovar Typhi Ty2
aguccaaauaag

SEQ ID NO: 1795808 - RNA, 15 nt, Salmonella enterica enterica serovar Typhi Ty2
aguccacuuucugua

SEQ ID NO: 1795809 - RNA, 14 nt, Salmonella enterica enterica serovar Typhi Ty2
aguccagcagccau

SEQ ID NO: 1795810 - RNA, 17 nt, Salmonella enterica enterica serovar Typhi Ty2
aguccauaccguuucaa

SEQ ID NO: 1795811 - RNA, 14 nt, Salmonella enterica enterica serovar Typhi Ty2
aguccauuuuccua

SEQ ID NO: 1795812 - RNA, 16 nt, Salmonella enterica enterica serovar Typhi Ty2
aguacuuucuuuugau

SEQ ID NO: 1795813 - RNA, 16 nt, Salmonella enterica enterica serovar Typhi Ty2
aguagaccaacaauca

SEQ ID NO: 1795814 - RNA, 23 nt, Salmonella enterica enterica serovar Typhi Ty2
agucaacucaugccgcugcuggc

SEQ ID NO: 1795815 - RNA, 18 nt, Salmonella enterica enterica serovar Typhi Ty2
agucaauaagcuugcuuu

SEQ ID NO: 1795816 - RNA, 22 nt, Salmonella enterica enterica serovar Typhi Ty2
agucaacucaugccgcugcugg

SEQ ID NO: 1795817 - RNA, 18 nt, Salmonella enterica enterica serovar Typhi Ty2
agucaaggcauccagcag

SEQ ID NO: 1795818 - RNA, 23 nt, Salmonella enterica enterica serovar Typhi Ty2
agucacccugcaacauuccuugc

SEQ ID NO: 1795819 - RNA, 20 nt, Salmonella enterica enterica serovar Typhi Ty2
agucacggcucgaucccgac

SEQ ID NO: 1795820 - RNA, 20 nt, Salmonella enterica enterica serovar Typhi Ty2
agucacuagcacuacggcaa

SEQ ID NO: 1795821 - RNA, 17 nt, Salmonella enterica enterica serovar Typhi Ty2
agucacuuacuuucuug

SEQ ID NO: 1795822 - RNA, 16 nt, Salmonella enterica enterica serovar Typhi Ty2
agucacuuacuuucuu

SEQ ID NO: 1795823 - RNA, 21 nt, Salmonella enterica enterica serovar Typhi Ty2
agucagacaaguagccugcca

SEQ ID NO: 1795824 - RNA, 19 nt, Salmonella enterica enterica serovar Typhi Ty2
agucagcuccuuucggacu

SEQ ID NO: 1795825 - RNA, 23 nt, Salmonella enterica enterica serovar Typhi Ty2
aggucugagauaauacauaucau

SEQ ID NO: 1795826 - RNA, 17 nt, Salmonella enterica enterica serovar Typhi Ty2
aggugaaauaggggaga

SEQ ID NO: 1795827 - RNA, 19 nt, Salmonella enterica enterica serovar Typhi Ty2
aggugaacauuacaaugua

SEQ ID NO: 1795828 - RNA, 16 nt, Salmonella enterica enterica serovar Typhi Ty2
aggugacgaagaucgc

SEQ ID NO: 1795829 - RNA, 14 nt, Salmonella enterica enterica serovar Typhi Ty2
aggucgacauuuaa

SEQ ID NO: 1795830 - RNA, 15 nt, Salmonella enterica enterica serovar Typhi Ty2
aggucugacaacuau

SEQ ID NO: 1795831 - RNA, 23 nt, Salmonella enterica enterica serovar Typhi Ty2
agguaaagccgccauccggcauu

SEQ ID NO: 1795832 - RNA, 22 nt, Salmonella enterica enterica serovar Typhi Ty2
agguaaagaucggcuuauaaaa

SEQ ID NO: 1795833 - RNA, 20 nt, Salmonella enterica enterica serovar Typhi Ty2
agguaaaggucguuaggcca

SEQ ID NO: 1795834 - RNA, 13 nt, Salmonella enterica enterica serovar Typhi Ty2
agguaacauacaa

SEQ ID NO: 1795835 - RNA, 18 nt, Salmonella enterica enterica serovar Typhi Ty2
agguauucuaacugauca

SEQ ID NO: 1795836 - RNA, 20 nt, Salmonella enterica enterica serovar Typhi Ty2
agguauucaccaaaaggcag

SEQ ID NO: 1795837 - RNA, 15 nt, Salmonella enterica enterica serovar Typhi Ty2
aggucaauaagauau

SEQ ID NO: 1795838 - RNA, 16 nt, Salmonella enterica enterica serovar Typhi Ty2
aggucagcaguuuuuc

SEQ ID NO: 1795839 - RNA, 16 nt, Salmonella enterica enterica serovar Typhi Ty2
agguguucagguaaau

SEQ ID NO: 1795840 - RNA, 22 nt, Salmonella enterica enterica serovar Typhi Ty2
aggugugguacggcuuucacac

SEQ ID NO: 1795841 - RNA, 15 nt, Salmonella enterica enterica serovar Typhi Ty2
agguuaaauagcagg

SEQ ID NO: 1795842 - RNA, 21 nt, Salmonella enterica enterica serovar Typhi Ty2
agguuaauauacauucauuuu

SEQ ID NO: 1795843 - RNA, 20 nt, Salmonella enterica enterica serovar Typhi Ty2
agguuaguaaugccuucuga

SEQ ID NO: 1795844 - RNA, 17 nt, Salmonella enterica enterica serovar Typhi Ty2
agguuaucgccgcccgu

SEQ ID NO: 1795845 - RNA, 24 nt, Salmonella enterica enterica serovar Typhi Ty2
agguuauuaaaaagccagcguaaa

SEQ ID NO: 1795846 - RNA, 17 nt, Salmonella enterica enterica serovar Typhi Ty2
agguuauucagguggau

SEQ ID NO: 1795847 - RNA, 19 nt, Salmonella enterica enterica serovar Typhi Ty2
agguucagcgugcguucau

SEQ ID NO: 1795848 - RNA, 18 nt, Salmonella enterica enterica serovar Typhi Ty2
aggugcggauaguccugc

SEQ ID NO: 1795849 - RNA, 17 nt, Salmonella enterica enterica serovar Typhi Ty2
aggugccuggguuccag

SEQ ID NO: 1795850 - RNA, 19 nt, Salmonella enterica enterica serovar Typhi Ty2
aggugacgccaugcaaaaa

SEQ ID NO: 1795851 - RNA, 19 nt, Salmonella enterica enterica serovar Typhi Ty2
aggugcggcugggcgaggc

SEQ ID NO: 1795852 - RNA, 20 nt, Salmonella enterica enterica serovar Typhi Ty2
aggugcggugcgacaaagau

SEQ ID NO: 1795853 - RNA, 20 nt, Salmonella enterica enterica serovar Typhi Ty2
agguguaaaccguuuuuccg

SEQ ID NO: 1795854 - RNA, 17 nt, Salmonella enterica enterica serovar Typhi Ty2
aggugucagauccuuca

SEQ ID NO: 1795855 - RNA, 17 nt, Salmonella enterica enterica serovar Typhi Ty2
aguaccgccgccgggcc

SEQ ID NO: 1795856 - RNA, 20 nt, Salmonella enterica enterica serovar Typhi Ty2
aguaccgaacagccaggcuu

SEQ ID NO: 1795857 - RNA, 21 nt, Salmonella enterica enterica serovar Typhi Ty2
aguaccgaacagccaggcuuu

SEQ ID NO: 1795858 - RNA, 23 nt, Salmonella enterica enterica serovar Typhi Ty2
aguacgauagcaauuaauaaaca

SEQ ID NO: 1795859 - RNA, 23 nt, Salmonella enterica enterica serovar Typhi Ty2
aguacgguuugcggauuggauaa

SEQ ID NO: 1795860 - RNA, 19 nt, Salmonella enterica enterica serovar Typhi Ty2
aguacggcgcgccaauaaa

SEQ ID NO: 1795861 - RNA, 18 nt, Salmonella enterica enterica serovar Typhi Ty2
aguacggcgcgaaucccg

SEQ ID NO: 1795862 - RNA, 22 nt, Salmonella enterica enterica serovar Typhi Ty2
aguacgcaccagcccagguuac

SEQ ID NO: 1795863 - RNA, 22 nt, Salmonella enterica enterica serovar Typhi Ty2
aguacgcccgugacgccaggca

SEQ ID NO: 1795864 - RNA, 15 nt, Salmonella enterica enterica serovar Typhi Ty2
aguacgcgaccgccg

SEQ ID NO: 1795865 - RNA, 23 nt, Salmonella enterica enterica serovar Typhi Ty2
aguacagcuuaaucaccagcgca

SEQ ID NO: 1795866 - RNA, 19 nt, Salmonella enterica enterica serovar Typhi Ty2
aguacauaguucuggcuuu

SEQ ID NO: 1795867 - RNA, 16 nt, Salmonella enterica enterica serovar Typhi Ty2
aguacagacuggaugg

SEQ ID NO: 1795868 - RNA, 16 nt, Salmonella enterica enterica serovar Typhi Ty2
aguaauggacagguaa

SEQ ID NO: 1795869 - RNA, 17 nt, Salmonella enterica enterica serovar Typhi Ty2
aguaaugccuucugaaa

SEQ ID NO: 1795870 - RNA, 19 nt, Salmonella enterica enterica serovar Typhi Ty2
aguaauggacagguaaacc

SEQ ID NO: 1795871 - RNA, 23 nt, Salmonella enterica enterica serovar Typhi Ty2
aguaaugcgcgaauaucuuuguc

SEQ ID NO: 1795872 - RNA, 16 nt, Salmonella enterica enterica serovar Typhi Ty2
aguaagcuauuccugu

SEQ ID NO: 1795873 - RNA, 16 nt, Salmonella enterica enterica serovar Typhi Ty2
aguaagcgccagccgu

SEQ ID NO: 1795874 - RNA, 16 nt, Salmonella enterica enterica serovar Typhi Ty2
aguaaaugaacguuuu

SEQ ID NO: 1795875 - RNA, 17 nt, Salmonella enterica enterica serovar Typhi Ty2
aguaacugguuaccaca

SEQ ID NO: 1795876 - RNA, 21 nt, Salmonella enterica enterica serovar Typhi Ty2
aguaacggcaguguuucccaa

SEQ ID NO: 1795877 - RNA, 11 nt, Salmonella enterica enterica serovar Typhi Ty2
agguuuugcug

SEQ ID NO: 1795878 - RNA, 23 nt, Salmonella enterica enterica serovar Typhi Ty2
agguuuugucaugguaaaugccg

SEQ ID NO: 1795879 - RNA, 19 nt, Salmonella enterica enterica serovar Typhi Ty2
agguucaauaugccaggca

SEQ ID NO: 1795880 - RNA, 13 nt, Salmonella enterica enterica serovar Typhi Ty2
agguucccgcccu

SEQ ID NO: 1795881 - RNA, 13 nt, Salmonella enterica enterica serovar Typhi Ty2
agggcagcgagca

SEQ ID NO: 1795882 - RNA, 21 nt, Salmonella enterica enterica serovar Typhi Ty2
agggauuaucagaaggcuuga

SEQ ID NO: 1795883 - RNA, 21 nt, Salmonella enterica enterica serovar Typhi Ty2
agggccgcguuaacgccguug

SEQ ID NO: 1795884 - RNA, 22 nt, Salmonella enterica enterica serovar Typhi Ty2
agggcauaaugauugcuggcag

SEQ ID NO: 1795885 - RNA, 17 nt, Salmonella enterica enterica serovar Typhi Ty2
agggcgaugccucaccc

SEQ ID NO: 1795886 - RNA, 18 nt, Salmonella enterica enterica serovar Typhi Ty2
agggcgaugccucacccc

SEQ ID NO: 1795887 - RNA, 21 nt, Salmonella enterica enterica serovar Typhi Ty2
agggcgauaauccgcuccaca

SEQ ID NO: 1795888 - RNA, 19 nt, Salmonella enterica enterica serovar Typhi Ty2
agggcgaggcccaugaaug

SEQ ID NO: 1795889 - RNA, 14 nt, Salmonella enterica enterica serovar Typhi Ty2
agggcgacgucaga

SEQ ID NO: 1795890 - RNA, 19 nt, Salmonella enterica enterica serovar Typhi Ty2
agggcaucaauaaaaucac

SEQ ID NO: 1795891 - RNA, 23 nt, Salmonella enterica enterica serovar Typhi Ty2
aggcuucgacaaacagcuaucca

SEQ ID NO: 1795892 - RNA, 21 nt, Salmonella enterica enterica serovar Typhi Ty2
agggauaagaaagauaaaaua

SEQ ID NO: 1795893 - RNA, 22 nt, Salmonella enterica enterica serovar Typhi Ty2
agggaucgauaauugcucaccc

SEQ ID NO: 1795894 - RNA, 16 nt, Salmonella enterica enterica serovar Typhi Ty2
agggaugacagaaagc

SEQ ID NO: 1795895 - RNA, 21 nt, Salmonella enterica enterica serovar Typhi Ty2
aggcuguugaggaaauucuga

SEQ ID NO: 1795896 - RNA, 23 nt, Salmonella enterica enterica serovar Typhi Ty2
aggcuguugaggaaauucugacg

SEQ ID NO: 1795897 - RNA, 13 nt, Salmonella enterica enterica serovar Typhi Ty2
aggcuuccagaag

SEQ ID NO: 1795898 - RNA, 15 nt, Salmonella enterica enterica serovar Typhi Ty2
aggcuuccacgcacg

SEQ ID NO: 1795899 - RNA, 20 nt, Salmonella enterica enterica serovar Typhi Ty2
agggucgccgcgcccagcag

SEQ ID NO: 1795900 - RNA, 17 nt, Salmonella enterica enterica serovar Typhi Ty2
aggguugccagaggcag

SEQ ID NO: 1795901 - RNA, 13 nt, Salmonella enterica enterica serovar Typhi Ty2
agggcgcggcugg

SEQ ID NO: 1795902 - RNA, 19 nt, Salmonella enterica enterica serovar Typhi Ty2
agggcgcggcgcaacuuuu

SEQ ID NO: 1795903 - RNA, 14 nt, Salmonella enterica enterica serovar Typhi Ty2
aggggggaaaugag

SEQ ID NO: 1795904 - RNA, 14 nt, Salmonella enterica enterica serovar Typhi Ty2
aggcguuacagacg

SEQ ID NO: 1795905 - RNA, 21 nt, Salmonella enterica enterica serovar Typhi Ty2
aggcgugguggauauccagca

SEQ ID NO: 1795906 - RNA, 18 nt, Salmonella enterica enterica serovar Typhi Ty2
aggcgugccccgcaacgc

SEQ ID NO: 1795907 - RNA, 19 nt, Salmonella enterica enterica serovar Typhi Ty2
aggcgucgaccgguccacc

SEQ ID NO: 1795908 - RNA, 16 nt, Salmonella enterica enterica serovar Typhi Ty2
aggcgucgaacuccgc

SEQ ID NO: 1795909 - RNA, 13 nt, Salmonella enterica enterica serovar Typhi Ty2
aggcuacccagac

SEQ ID NO: 1795910 - RNA, 17 nt, Salmonella enterica enterica serovar Typhi Ty2
aggcuacccagacaagc

SEQ ID NO: 1795911 - RNA, 19 nt, Salmonella enterica enterica serovar Typhi Ty2
aggcuacccgcaauaccaa

SEQ ID NO: 1795912 - RNA, 16 nt, Salmonella enterica enterica serovar Typhi Ty2
aggcuacccagacaag

SEQ ID NO: 1795913 - RNA, 14 nt, Salmonella enterica enterica serovar Typhi Ty2
aggcuacccagaca

SEQ ID NO: 1795914 - RNA, 22 nt, Salmonella enterica enterica serovar Typhi Ty2
aggcuaacagcuggcuugccag

SEQ ID NO: 1795915 - RNA, 16 nt, Salmonella enterica enterica serovar Typhi Ty2
aggcguaaccgccauc

SEQ ID NO: 1795916 - RNA, 16 nt, Salmonella enterica enterica serovar Typhi Ty2
aggcguaaaauugccg

SEQ ID NO: 1795917 - RNA, 15 nt, Salmonella enterica enterica serovar Typhi Ty2
aggcgucaaaacagg

SEQ ID NO: 1795918 - RNA, 16 nt, Salmonella enterica enterica serovar Typhi Ty2
aggccggcauaaugau

SEQ ID NO: 1795919 - RNA, 14 nt, Salmonella enterica enterica serovar Typhi Ty2
aggcucgcaaauaa

SEQ ID NO: 1795920 - RNA, 19 nt, Salmonella enterica enterica serovar Typhi Ty2
aggcugacgaagaacuuag

SEQ ID NO: 1795921 - RNA, 20 nt, Salmonella enterica enterica serovar Typhi Ty2
aggcucuuauucaaucaauu

SEQ ID NO: 1795922 - RNA, 21 nt, Salmonella enterica enterica serovar Typhi Ty2
aggcuacgguacugcccaccu

SEQ ID NO: 1795923 - RNA, 18 nt, Salmonella enterica enterica serovar Typhi Ty2
aggcuaccgggcaaacau

SEQ ID NO: 1795924 - RNA, 15 nt, Salmonella enterica enterica serovar Typhi Ty2
aggcuaccguucaga

SEQ ID NO: 1795925 - RNA, 21 nt, Salmonella enterica enterica serovar Typhi Ty2
aggcucccuuauacaggcgca

SEQ ID NO: 1795926 - RNA, 21 nt, Salmonella enterica enterica serovar Typhi Ty2
aggcucaucagcgccauugcu

SEQ ID NO: 1795927 - RNA, 22 nt, Salmonella enterica enterica serovar Typhi Ty2
aggcucaucagcgccauugcua

SEQ ID NO: 1795928 - RNA, 16 nt, Salmonella enterica enterica serovar Typhi Ty2
aggcucaggaaaacaa

SEQ ID NO: 1795929 - RNA, 17 nt, Salmonella enterica enterica serovar Typhi Ty2
aggcuggagagcaacgc

SEQ ID NO: 1795930 - RNA, 15 nt, Salmonella enterica enterica serovar Typhi Ty2
aggcugccgccagaa

SEQ ID NO: 1795931 - RNA, 21 nt, Salmonella enterica enterica serovar Typhi Ty2
aggcugcggcacgcuaaacca

SEQ ID NO: 1795932 - RNA, 18 nt, Salmonella enterica enterica serovar Typhi Ty2
aggcugagcguagaccgc

SEQ ID NO: 1795933 - RNA, 18 nt, Salmonella enterica enterica serovar Typhi Ty2
aggauggggcaauuguca

SEQ ID NO: 1795934 - RNA, 17 nt, Salmonella enterica enterica serovar Typhi Ty2
aggaugcgcugcgcgcg

SEQ ID NO: 1795935 - RNA, 21 nt, Salmonella enterica enterica serovar Typhi Ty2
aggauggccagcaccagcauu

SEQ ID NO: 1795936 - RNA, 19 nt, Salmonella enterica enterica serovar Typhi Ty2
aggcaauaaaaaaggcaga

SEQ ID NO: 1795937 - RNA, 23 nt, Salmonella enterica enterica serovar Typhi Ty2
aggcaaaucaacauuauuaaaau

SEQ ID NO: 1795938 - RNA, 22 nt, Salmonella enterica enterica serovar Typhi Ty2
aggcaaaucaacauuauuaaaa

SEQ ID NO: 1795939 - RNA, 17 nt, Salmonella enterica enterica serovar Typhi Ty2
aggcaaaucaacauuau

SEQ ID NO: 1795940 - RNA, 14 nt, Salmonella enterica enterica serovar Typhi Ty2
aggcaaaggaaugc

SEQ ID NO: 1795941 - RNA, 14 nt, Salmonella enterica enterica serovar Typhi Ty2
aggcaaagccccag

SEQ ID NO: 1795942 - RNA, 14 nt, Salmonella enterica enterica serovar Typhi Ty2
aggcaaaccagcac

SEQ ID NO: 1795943 - RNA, 12 nt, Salmonella enterica enterica serovar Typhi Ty2
aggcaaaccagc

SEQ ID NO: 1795944 - RNA, 20 nt, Salmonella enterica enterica serovar Typhi Ty2
aggcaaacaccucagccacc

SEQ ID NO: 1795945 - RNA, 17 nt, Salmonella enterica enterica serovar Typhi Ty2
aggcaaagcauaggcca

SEQ ID NO: 1795946 - RNA, 13 nt, Salmonella enterica enterica serovar Typhi Ty2
aggcacaacaaua

SEQ ID NO: 1795947 - RNA, 15 nt, Salmonella enterica enterica serovar Typhi Ty2
aggcagauucuucug

SEQ ID NO: 1795948 - RNA, 15 nt, Salmonella enterica enterica serovar Typhi Ty2
aggcaggaaauccag

SEQ ID NO: 1795949 - RNA, 20 nt, Salmonella enterica enterica serovar Typhi Ty2
aggcagcguaauacaggcga

SEQ ID NO: 1795950 - RNA, 18 nt, Salmonella enterica enterica serovar Typhi Ty2
aggcagccggauuuuaaa

SEQ ID NO: 1795951 - RNA, 17 nt, Salmonella enterica enterica serovar Typhi Ty2
aggcagcacaucaauau

SEQ ID NO: 1795952 - RNA, 14 nt, Salmonella enterica enterica serovar Typhi Ty2
aggcagcacaauca

SEQ ID NO: 1795953 - RNA, 23 nt, Salmonella enterica enterica serovar Typhi Ty2
aggcaucccguuuucgucccagc

SEQ ID NO: 1795954 - RNA, 14 nt, Salmonella enterica enterica serovar Typhi Ty2
aggcauacacaucu

SEQ ID NO: 1795955 - RNA, 11 nt, Salmonella enterica enterica serovar Typhi Ty2
aggcaguuugc

SEQ ID NO: 1795956 - RNA, 17 nt, Salmonella enterica enterica serovar Typhi Ty2
aggcauaccgcccagaa

SEQ ID NO: 1795957 - RNA, 19 nt, Salmonella enterica enterica serovar Typhi Ty2
aggcauaauggaacugccu

SEQ ID NO: 1795958 - RNA, 20 nt, Salmonella enterica enterica serovar Typhi Ty2
aggccagcuacaccugggcu

SEQ ID NO: 1795959 - RNA, 16 nt, Salmonella enterica enterica serovar Typhi Ty2
aggccagugccaagca

SEQ ID NO: 1795960 - RNA, 23 nt, Salmonella enterica enterica serovar Typhi Ty2
aggccagugccaagcaacacggc

SEQ ID NO: 1795961 - RNA, 22 nt, Salmonella enterica enterica serovar Typhi Ty2
aggcccguucacguuuuuacuc

SEQ ID NO: 1795962 - RNA, 20 nt, Salmonella enterica enterica serovar Typhi Ty2
aggcccggcaaggaaggaaa

SEQ ID NO: 1795963 - RNA, 18 nt, Salmonella enterica enterica serovar Typhi Ty2
aggccggauaagcaacgc

SEQ ID NO: 1795964 - RNA, 23 nt, Salmonella enterica enterica serovar Typhi Ty2
aggccggauaagagaauccgaca

SEQ ID NO: 1795965 - RNA, 17 nt, Salmonella enterica enterica serovar Typhi Ty2
aggccggaugaggcgca

SEQ ID NO: 1795966 - RNA, 13 nt, Salmonella enterica enterica serovar Typhi Ty2
aggccgcggcugu

SEQ ID NO: 1795967 - RNA, 17 nt, Salmonella enterica enterica serovar Typhi Ty2
aggauaguacugaccag

SEQ ID NO: 1795968 - RNA, 15 nt, Salmonella enterica enterica serovar Typhi Ty2
aggauagugauauag

SEQ ID NO: 1795969 - RNA, 15 nt, Salmonella enterica enterica serovar Typhi Ty2
aggauauaagcgcca

SEQ ID NO: 1795970 - RNA, 18 nt, Salmonella enterica enterica serovar Typhi Ty2
aggauaaccuuccggcac

SEQ ID NO: 1795971 - RNA, 16 nt, Salmonella enterica enterica serovar Typhi Ty2
aggauaaaauccugca

SEQ ID NO: 1795972 - RNA, 22 nt, Salmonella enterica enterica serovar Typhi Ty2
aggauaaaauccugcacgccgg

SEQ ID NO: 1795973 - RNA, 11 nt, Salmonella enterica enterica serovar Typhi Ty2
aggagugaaca

SEQ ID NO: 1795974 - RNA, 16 nt, Salmonella enterica enterica serovar Typhi Ty2
aggauacagccgacua

SEQ ID NO: 1795975 - RNA, 19 nt, Salmonella enterica enterica serovar Typhi Ty2
aggauaauucccccaguag

SEQ ID NO: 1795976 - RNA, 16 nt, Salmonella enterica enterica serovar Typhi Ty2
aggauaagaauaggug

SEQ ID NO: 1795977 - RNA, 22 nt, Salmonella enterica enterica serovar Typhi Ty2
aggaguccaaaacgaacaggcc

SEQ ID NO: 1795978 - RNA, 15 nt, Salmonella enterica enterica serovar Typhi Ty2
aggacucaaucacuu

SEQ ID NO: 1795979 - RNA, 13 nt, Salmonella enterica enterica serovar Typhi Ty2
aggaaaacgcuuc

SEQ ID NO: 1795980 - RNA, 14 nt, Salmonella enterica enterica serovar Typhi Ty2
aggaaaagcuguag

SEQ ID NO: 1795981 - RNA, 15 nt, Salmonella enterica enterica serovar Typhi Ty2
aggaaaagucauuuu

SEQ ID NO: 1795982 - RNA, 23 nt, Salmonella enterica enterica serovar Typhi Ty2
aggaaacauaaggguaagcaaua

SEQ ID NO: 1795983 - RNA, 20 nt, Salmonella enterica enterica serovar Typhi Ty2
aggaaacgcgccggaaggcg

SEQ ID NO: 1795984 - RNA, 13 nt, Salmonella enterica enterica serovar Typhi Ty2
aggaauaacgcgc

SEQ ID NO: 1795985 - RNA, 19 nt, Salmonella enterica enterica serovar Typhi Ty2
aggaauacauuaacgcugg

SEQ ID NO: 1795986 - RNA, 19 nt, Salmonella enterica enterica serovar Typhi Ty2
aggaaucauucuauugcau

SEQ ID NO: 1795987 - RNA, 14 nt, Salmonella enterica enterica serovar Typhi Ty2
aggaauaacaucgu

SEQ ID NO: 1795988 - RNA, 19 nt, Salmonella enterica enterica serovar Typhi Ty2
aggaaugaaaacgaaucga

SEQ ID NO: 1795989 - RNA, 16 nt, Salmonella enterica enterica serovar Typhi Ty2
aggacgggacuugaac

SEQ ID NO: 1795990 - RNA, 16 nt, Salmonella enterica enterica serovar Typhi Ty2
agcuuauuccagucau

SEQ ID NO: 1795991 - RNA, 22 nt, Salmonella enterica enterica serovar Typhi Ty2
agcuuaucgccaaagauauagu

SEQ ID NO: 1795992 - RNA, 23 nt, Salmonella enterica enterica serovar Typhi Ty2
agcuuaucgaacugugagccuaa

SEQ ID NO: 1795993 - RNA, 14 nt, Salmonella enterica enterica serovar Typhi Ty2
agcuuauccugccc

SEQ ID NO: 1795994 - RNA, 14 nt, Salmonella enterica enterica serovar Typhi Ty2
agcuuaaucaccag

SEQ ID NO: 1795995 - RNA, 15 nt, Salmonella enterica enterica serovar Typhi Ty2
agcuuaaucaccagc

SEQ ID NO: 1795996 - RNA, 17 nt, Salmonella enterica enterica serovar Typhi Ty2
agcuuaaaaaauccugc

SEQ ID NO: 1795997 - RNA, 18 nt, Salmonella enterica enterica serovar Typhi Ty2
agcuuaaaaaauccugca

SEQ ID NO: 1795998 - RNA, 15 nt, Salmonella enterica enterica serovar Typhi Ty2
agcuugcgcuggugu

SEQ ID NO: 1795999 - RNA, 17 nt, Salmonella enterica enterica serovar Typhi Ty2
agcuugcgcugguguuu

SEQ ID NO: 1796000 - RNA, 15 nt, Salmonella enterica enterica serovar Typhi Ty2
agcuugcgcagagua

SEQ ID NO: 1796001 - RNA, 16 nt, Salmonella enterica enterica serovar Typhi Ty2
agcuugaaagcgcaaa

SEQ ID NO: 1796002 - RNA, 16 nt, Salmonella enterica enterica serovar Typhi Ty2
agcuuuccaccagcca

SEQ ID NO: 1796003 - RNA, 20 nt, Salmonella enterica enterica serovar Typhi Ty2
agcuuuugcugcgccagcca

SEQ ID NO: 1796004 - RNA, 23 nt, Salmonella enterica enterica serovar Typhi Ty2
agcuuuacucaacggucaaaaua

SEQ ID NO: 1796005 - RNA, 22 nt, Salmonella enterica enterica serovar Typhi Ty2
agcuuggccaguggggcugcug

SEQ ID NO: 1796006 - RNA, 16 nt, Salmonella enterica enterica serovar Typhi Ty2
agcugcgaucaaguuu

SEQ ID NO: 1796007 - RNA, 20 nt, Salmonella enterica enterica serovar Typhi Ty2
agcugcgcaagaaacaucau

SEQ ID NO: 1796008 - RNA, 17 nt, Salmonella enterica enterica serovar Typhi Ty2
agcugcgccauaccccg

SEQ ID NO: 1796009 - RNA, 17 nt, Salmonella enterica enterica serovar Typhi Ty2
agcugcgccagcgugcu

SEQ ID NO: 1796010 - RNA, 20 nt, Salmonella enterica enterica serovar Typhi Ty2
agcugcgucagcgcuugccg

SEQ ID NO: 1796011 - RNA, 13 nt, Salmonella enterica enterica serovar Typhi Ty2
agcuggauaagcu

SEQ ID NO: 1796012 - RNA, 23 nt, Salmonella enterica enterica serovar Typhi Ty2
agcugcgggugcuugagacuguu

SEQ ID NO: 1796013 - RNA, 20 nt, Salmonella enterica enterica serovar Typhi Ty2
agcugauauuuuacuuuuug

SEQ ID NO: 1796014 - RNA, 15 nt, Salmonella enterica enterica serovar Typhi Ty2
agcugauauuuuacu

SEQ ID NO: 1796015 - RNA, 16 nt, Salmonella enterica enterica serovar Typhi Ty2
agcugauauuuuacuu

SEQ ID NO: 1796016 - RNA, 18 nt, Salmonella enterica enterica serovar Typhi Ty2
agcugaugauuggccucc

SEQ ID NO: 1796017 - RNA, 15 nt, Salmonella enterica enterica serovar Typhi Ty2
agcugcaccaggagc

SEQ ID NO: 1796018 - RNA, 16 nt, Salmonella enterica enterica serovar Typhi Ty2
agcugcaccaggagca

SEQ ID NO: 1796019 - RNA, 16 nt, Salmonella enterica enterica serovar Typhi Ty2
agcuggccuucuccac

SEQ ID NO: 1796020 - RNA, 21 nt, Salmonella enterica enterica serovar Typhi Ty2
agcuggcgagaaagugguggg

SEQ ID NO: 1796021 - RNA, 20 nt, Salmonella enterica enterica serovar Typhi Ty2
agcuggcgagaaaguggugg

SEQ ID NO: 1796022 - RNA, 23 nt, Salmonella enterica enterica serovar Typhi Ty2
agcuggcuuuauauaaaaaaugg

SEQ ID NO: 1796023 - RNA, 18 nt, Salmonella enterica enterica serovar Typhi Ty2
agcugggcguuacuggcg

SEQ ID NO: 1796024 - RNA, 15 nt, Salmonella enterica enterica serovar Typhi Ty2
agcuuaaaaaauccu

SEQ ID NO: 1796025 - RNA, 16 nt, Salmonella enterica enterica serovar Typhi Ty2
agcuguuuugucggcc

SEQ ID NO: 1796026 - RNA, 16 nt, Salmonella enterica enterica serovar Typhi Ty2
agcugauaagcuagua

SEQ ID NO: 1796027 - RNA, 14 nt, Salmonella enterica enterica serovar Typhi Ty2
agcugaguaaggac

SEQ ID NO: 1796028 - RNA, 17 nt, Salmonella enterica enterica serovar Typhi Ty2
agcugaguaaggacaga

SEQ ID NO: 1796029 - RNA, 17 nt, Salmonella enterica enterica serovar Typhi Ty2
agcugagcuaaucaccc

SEQ ID NO: 1796030 - RNA, 14 nt, Salmonella enterica enterica serovar Typhi Ty2
agcugagcgucagg

SEQ ID NO: 1796031 - RNA, 13 nt, Salmonella enterica enterica serovar Typhi Ty2
agcugacgcagca

SEQ ID NO: 1796032 - RNA, 18 nt, Salmonella enterica enterica serovar Typhi Ty2
agcugaauguauauaacg

SEQ ID NO: 1796033 - RNA, 10 nt, Salmonella enterica enterica serovar Typhi Ty2
agcucuuuca

SEQ ID NO: 1796034 - RNA, 16 nt, Salmonella enterica enterica serovar Typhi Ty2
agcucuucaauuucca

SEQ ID NO: 1796035 - RNA, 14 nt, Salmonella enterica enterica serovar Typhi Ty2
agcucugugugacg

SEQ ID NO: 1796036 - RNA, 22 nt, Salmonella enterica enterica serovar Typhi Ty2
agcucuucuucgcucucgccgc

SEQ ID NO: 1796037 - RNA, 21 nt, Salmonella enterica enterica serovar Typhi Ty2
agcucgguggcgguaucaaug

SEQ ID NO: 1796038 - RNA, 20 nt, Salmonella enterica enterica serovar Typhi Ty2
agcucgguucuucggcauaa

SEQ ID NO: 1796039 - RNA, 19 nt, Salmonella enterica enterica serovar Typhi Ty2
agcucuggaaaaauuguuu

SEQ ID NO: 1796040 - RNA, 23 nt, Salmonella enterica enterica serovar Typhi Ty2
agcucuguggggggaacggcaga

SEQ ID NO: 1796041 - RNA, 22 nt, Salmonella enterica enterica serovar Typhi Ty2
agcucgccgaccggcgcgccgu

SEQ ID NO: 1796042 - RNA, 19 nt, Salmonella enterica enterica serovar Typhi Ty2
agcucgcuguagcgccaac

SEQ ID NO: 1796043 - RNA, 18 nt, Salmonella enterica enterica serovar Typhi Ty2
agcuccuuuuaauaaaga

SEQ ID NO: 1796044 - RNA, 22 nt, Salmonella enterica enterica serovar Typhi Ty2
agcgucgccagaaccccugcca

SEQ ID NO: 1796045 - RNA, 17 nt, Salmonella enterica enterica serovar Typhi Ty2
agcgucgcgauccugcc

SEQ ID NO: 1796046 - RNA, 16 nt, Salmonella enterica enterica serovar Typhi Ty2
agcgucucagcaggcg

SEQ ID NO: 1796047 - RNA, 19 nt, Salmonella enterica enterica serovar Typhi Ty2
agcgucagguagcccggca

SEQ ID NO: 1796048 - RNA, 21 nt, Salmonella enterica enterica serovar Typhi Ty2
agcgucaggcgaaguuccggg

SEQ ID NO: 1796049 - RNA, 13 nt, Salmonella enterica enterica serovar Typhi Ty2
agcgucacaggcu

SEQ ID NO: 1796050 - RNA, 13 nt, Salmonella enterica enterica serovar Typhi Ty2
agcgucagcaugg

SEQ ID NO: 1796051 - RNA, 23 nt, Salmonella enterica enterica serovar Typhi Ty2
agcgucagcccuucuuuaugcgc

SEQ ID NO: 1796052 - RNA, 15 nt, Salmonella enterica enterica serovar Typhi Ty2
agcgucugcggcuga

SEQ ID NO: 1796053 - RNA, 16 nt, Salmonella enterica enterica serovar Typhi Ty2
agcuccgcaaagccca

SEQ ID NO: 1796054 - RNA, 19 nt, Salmonella enterica enterica serovar Typhi Ty2
agcuccgcaaagcccauca

SEQ ID NO: 1796055 - RNA, 20 nt, Salmonella enterica enterica serovar Typhi Ty2
accgacagauagcccugagc

SEQ ID NO: 1796056 - RNA, 22 nt, Salmonella enterica enterica serovar Typhi Ty2
accgacacgugguacacaauca

SEQ ID NO: 1796057 - RNA, 12 nt, Salmonella enterica enterica serovar Typhi Ty2
accgaccugccu

SEQ ID NO: 1796058 - RNA, 13 nt, Salmonella enterica enterica serovar Typhi Ty2
accgaccugccuu

SEQ ID NO: 1796059 - RNA, 18 nt, Salmonella enterica enterica serovar Typhi Ty2
accgauaaucaccagccc

SEQ ID NO: 1796060 - RNA, 21 nt, Salmonella enterica enterica serovar Typhi Ty2
accgaugugcguauugagcgc

SEQ ID NO: 1796061 - RNA, 20 nt, Salmonella enterica enterica serovar Typhi Ty2
accgagguucaccagcgcgc

SEQ ID NO: 1796062 - RNA, 14 nt, Salmonella enterica enterica serovar Typhi Ty2
accgaggcaggggc

SEQ ID NO: 1796063 - RNA, 18 nt, Salmonella enterica enterica serovar Typhi Ty2
acccuuugaccauuacca

SEQ ID NO: 1796064 - RNA, 16 nt, Salmonella enterica enterica serovar Typhi Ty2
accgaaaucuucgccu

SEQ ID NO: 1796065 - RNA, 13 nt, Salmonella enterica enterica serovar Typhi Ty2
accgaaaucuucg

SEQ ID NO: 1796066 - RNA, 17 nt, Salmonella enterica enterica serovar Typhi Ty2
accgaacagccaggcuu

SEQ ID NO: 1796067 - RNA, 18 nt, Salmonella enterica enterica serovar Typhi Ty2
accgaaauccgcuuugag

SEQ ID NO: 1796068 - RNA, 22 nt, Salmonella enterica enterica serovar Typhi Ty2
acccuggcauauggauauucau

SEQ ID NO: 1796069 - RNA, 22 nt, Salmonella enterica enterica serovar Typhi Ty2
acccugccguuugcgccagccc

SEQ ID NO: 1796070 - RNA, 20 nt, Salmonella enterica enterica serovar Typhi Ty2
acccuguauuaccugaugag

SEQ ID NO: 1796071 - RNA, 13 nt, Salmonella enterica enterica serovar Typhi Ty2
acccuuccuuuuc

SEQ ID NO: 1796072 - RNA, 18 nt, Salmonella enterica enterica serovar Typhi Ty2
acccuuccccggcagccu

SEQ ID NO: 1796073 - RNA, 20 nt, Salmonella enterica enterica serovar Typhi Ty2
acccuucuucuggcucagac

SEQ ID NO: 1796074 - RNA, 15 nt, Salmonella enterica enterica serovar Typhi Ty2
acccgcccagaucag

SEQ ID NO: 1796075 - RNA, 16 nt, Salmonella enterica enterica serovar Typhi Ty2
acccgccgccagcacc

SEQ ID NO: 1796076 - RNA, 19 nt, Salmonella enterica enterica serovar Typhi Ty2
acccgccgccagcaccgcc

SEQ ID NO: 1796077 - RNA, 17 nt, Salmonella enterica enterica serovar Typhi Ty2
acccgccggcagcagcu

SEQ ID NO: 1796078 - RNA, 17 nt, Salmonella enterica enterica serovar Typhi Ty2
acccgauaccgccagcc

SEQ ID NO: 1796079 - RNA, 20 nt, Salmonella enterica enterica serovar Typhi Ty2
acccgauaccgccagcccca

SEQ ID NO: 1796080 - RNA, 16 nt, Salmonella enterica enterica serovar Typhi Ty2
acccgauaaaaucauc

SEQ ID NO: 1796081 - RNA, 21 nt, Salmonella enterica enterica serovar Typhi Ty2
acccgaccauuuuugacacag

SEQ ID NO: 1796082 - RNA, 16 nt, Salmonella enterica enterica serovar Typhi Ty2
acccgaccgucuuugu

SEQ ID NO: 1796083 - RNA, 15 nt, Salmonella enterica enterica serovar Typhi Ty2
acccgcagcggaaga

SEQ ID NO: 1796084 - RNA, 15 nt, Salmonella enterica enterica serovar Typhi Ty2
acccgcagccagaac

SEQ ID NO: 1796085 - RNA, 17 nt, Salmonella enterica enterica serovar Typhi Ty2
acccgcagccagaacag

SEQ ID NO: 1796086 - RNA, 14 nt, Salmonella enterica enterica serovar Typhi Ty2
acccgcaauaccaa

SEQ ID NO: 1796087 - RNA, 20 nt, Salmonella enterica enterica serovar Typhi Ty2
acccgaucgccauccugcac

SEQ ID NO: 1796088 - RNA, 20 nt, Salmonella enterica enterica serovar Typhi Ty2
acccgaugcgaguagcaaau

SEQ ID NO: 1796089 - RNA, 15 nt, Salmonella enterica enterica serovar Typhi Ty2
acccgauucugccag

SEQ ID NO: 1796090 - RNA, 20 nt, Salmonella enterica enterica serovar Typhi Ty2
acccgauucugccaguucac

SEQ ID NO: 1796091 - RNA, 22 nt, Salmonella enterica enterica serovar Typhi Ty2
acccccuccuuguaagggaggu

SEQ ID NO: 1796092 - RNA, 13 nt, Salmonella enterica enterica serovar Typhi Ty2
acccccuggccgg

SEQ ID NO: 1796093 - RNA, 20 nt, Salmonella enterica enterica serovar Typhi Ty2
accccgauaaaccaggcagc

SEQ ID NO: 1796094 - RNA, 14 nt, Salmonella enterica enterica serovar Typhi Ty2
accccggccucgcc

SEQ ID NO: 1796095 - RNA, 19 nt, Salmonella enterica enterica serovar Typhi Ty2
acccauuaccuggcaacau

SEQ ID NO: 1796096 - RNA, 17 nt, Salmonella enterica enterica serovar Typhi Ty2
acccauuuuauccucuu

SEQ ID NO: 1796097 - RNA, 18 nt, Salmonella enterica enterica serovar Typhi Ty2
accccaaaucagcaaaaa

SEQ ID NO: 1796098 - RNA, 15 nt, Salmonella enterica enterica serovar Typhi Ty2
acccaggcaucagau

SEQ ID NO: 1796099 - RNA, 18 nt, Salmonella enterica enterica serovar Typhi Ty2
acccagcgccaacgccac

SEQ ID NO: 1796100 - RNA, 18 nt, Salmonella enterica enterica serovar Typhi Ty2
acccagccagacgccagc

SEQ ID NO: 1796101 - RNA, 17 nt, Salmonella enterica enterica serovar Typhi Ty2
acccagccagacgccag

SEQ ID NO: 1796102 - RNA, 16 nt, Salmonella enterica enterica serovar Typhi Ty2
acccauagcagcuccg

SEQ ID NO: 1796103 - RNA, 19 nt, Salmonella enterica enterica serovar Typhi Ty2
acccauacucuuucccggc

SEQ ID NO: 1796104 - RNA, 19 nt, Salmonella enterica enterica serovar Typhi Ty2
acccauaacgggaagccgu

SEQ ID NO: 1796105 - RNA, 22 nt, Salmonella enterica enterica serovar Typhi Ty2
acccaguuuuaagcgcaggugc

SEQ ID NO: 1796106 - RNA, 16 nt, Salmonella enterica enterica serovar Typhi Ty2
acccagucgcagccac

SEQ ID NO: 1796107 - RNA, 17 nt, Salmonella enterica enterica serovar Typhi Ty2
acccagucgcagccacc

SEQ ID NO: 1796108 - RNA, 18 nt, Salmonella enterica enterica serovar Typhi Ty2
acccacuuugcuuuucug

SEQ ID NO: 1796109 - RNA, 16 nt, Salmonella enterica enterica serovar Typhi Ty2
acccacuuugcuuuuc

SEQ ID NO: 1796110 - RNA, 19 nt, Salmonella enterica enterica serovar Typhi Ty2
acccagauuauggguaaug

SEQ ID NO: 1796111 - RNA, 17 nt, Salmonella enterica enterica serovar Typhi Ty2
acccaccucguucaaac

SEQ ID NO: 1796112 - RNA, 22 nt, Salmonella enterica enterica serovar Typhi Ty2
accaugacgcagggcaauauua

SEQ ID NO: 1796113 - RNA, 15 nt, Salmonella enterica enterica serovar Typhi Ty2
acccacgccagcagc

SEQ ID NO: 1796114 - RNA, 18 nt, Salmonella enterica enterica serovar Typhi Ty2
accagguacagcuuagcu

SEQ ID NO: 1796115 - RNA, 21 nt, Salmonella enterica enterica serovar Typhi Ty2
accaguacaauuucuggcccc

SEQ ID NO: 1796116 - RNA, 15 nt, Salmonella enterica enterica serovar Typhi Ty2
accaguaaccgccac

SEQ ID NO: 1796117 - RNA, 15 nt, Salmonella enterica enterica serovar Typhi Ty2
accaguaacggcagu

SEQ ID NO: 1796118 - RNA, 22 nt, Salmonella enterica enterica serovar Typhi Ty2
accaggucuuaccuauuuuaaa

SEQ ID NO: 1796119 - RNA, 21 nt, Salmonella enterica enterica serovar Typhi Ty2
accagcuuguuauccaucagc

SEQ ID NO: 1796120 - RNA, 16 nt, Salmonella enterica enterica serovar Typhi Ty2
accagcuucaugcugg

SEQ ID NO: 1796121 - RNA, 21 nt, Salmonella enterica enterica serovar Typhi Ty2
accagcuucaugcuggauacc

SEQ ID NO: 1796122 - RNA, 18 nt, Salmonella enterica enterica serovar Typhi Ty2
accagcugacgcagcagu

SEQ ID NO: 1796123 - RNA, 18 nt, Salmonella enterica enterica serovar Typhi Ty2
accagcugacgacgccag

SEQ ID NO: 1796124 - RNA, 19 nt, Salmonella enterica enterica serovar Typhi Ty2
accagcugacgacgccagc

SEQ ID NO: 1796125 - RNA, 20 nt, Salmonella enterica enterica serovar Typhi Ty2
accagcugacgacgccagcc

SEQ ID NO: 1796126 - RNA, 21 nt, Salmonella enterica enterica serovar Typhi Ty2
accagcugacgacgccagccc

SEQ ID NO: 1796127 - RNA, 23 nt, Salmonella enterica enterica serovar Typhi Ty2
accaggauggccagcaccagcau

SEQ ID NO: 1796128 - RNA, 14 nt, Salmonella enterica enterica serovar Typhi Ty2
accaggcacuugag

SEQ ID NO: 1796129 - RNA, 17 nt, Salmonella enterica enterica serovar Typhi Ty2
accaggaugccaaccac

SEQ ID NO: 1796130 - RNA, 20 nt, Salmonella enterica enterica serovar Typhi Ty2
accagucggcaaagaccaau

SEQ ID NO: 1796131 - RNA, 23 nt, Salmonella enterica enterica serovar Typhi Ty2
accagucggcaaagaccaauaaa

SEQ ID NO: 1796132 - RNA, 20 nt, Salmonella enterica enterica serovar Typhi Ty2
accagucgaccgcagaccgg

SEQ ID NO: 1796133 - RNA, 17 nt, Salmonella enterica enterica serovar Typhi Ty2
accaguaccgucauuuc

SEQ ID NO: 1796134 - RNA, 18 nt, Salmonella enterica enterica serovar Typhi Ty2
accaguaccgucauuucc

SEQ ID NO: 1796135 - RNA, 23 nt, Salmonella enterica enterica serovar Typhi Ty2
accaguccggcagaaagcagcag

SEQ ID NO: 1796136 - RNA, 14 nt, Salmonella enterica enterica serovar Typhi Ty2
accagucccagccc

SEQ ID NO: 1796137 - RNA, 21 nt, Salmonella enterica enterica serovar Typhi Ty2
accaguucacuccuaagagaa

SEQ ID NO: 1796138 - RNA, 15 nt, Salmonella enterica enterica serovar Typhi Ty2
accaguugcgucagc

SEQ ID NO: 1796139 - RNA, 18 nt, Salmonella enterica enterica serovar Typhi Ty2
accaguugaccaaacagc

SEQ ID NO: 1796140 - RNA, 14 nt, Salmonella enterica enterica serovar Typhi Ty2
accauauucacgca

SEQ ID NO: 1796141 - RNA, 15 nt, Salmonella enterica enterica serovar Typhi Ty2
accauauucccacag

SEQ ID NO: 1796142 - RNA, 16 nt, Salmonella enterica enterica serovar Typhi Ty2
accauaucgccgcugc

SEQ ID NO: 1796143 - RNA, 19 nt, Salmonella enterica enterica serovar Typhi Ty2
accauauuauucugcugaa

SEQ ID NO: 1796144 - RNA, 16 nt, Salmonella enterica enterica serovar Typhi Ty2
accauaaacaaaacaa

SEQ ID NO: 1796145 - RNA, 21 nt, Salmonella enterica enterica serovar Typhi Ty2
accauagccguagcccuugau

SEQ ID NO: 1796146 - RNA, 16 nt, Salmonella enterica enterica serovar Typhi Ty2
accaucgccagccauu

SEQ ID NO: 1796147 - RNA, 15 nt, Salmonella enterica enterica serovar Typhi Ty2
accaucaaaaaaaau

SEQ ID NO: 1796148 - RNA, 16 nt, Salmonella enterica enterica serovar Typhi Ty2
accauccgcgccgagg

SEQ ID NO: 1796149 - RNA, 18 nt, Salmonella enterica enterica serovar Typhi Ty2
accagaucaacauggugu

SEQ ID NO: 1796150 - RNA, 23 nt, Salmonella enterica enterica serovar Typhi Ty2
accagacugaugaugaagaacag

SEQ ID NO: 1796151 - RNA, 14 nt, Salmonella enterica enterica serovar Typhi Ty2
accagcacaaaaaa

SEQ ID NO: 1796152 - RNA, 22 nt, Salmonella enterica enterica serovar Typhi Ty2
accagcaauuggccaucuucgu

SEQ ID NO: 1796153 - RNA, 20 nt, Salmonella enterica enterica serovar Typhi Ty2
accagcaaugauaacggcgc

SEQ ID NO: 1796154 - RNA, 21 nt, Salmonella enterica enterica serovar Typhi Ty2
accagcagcgccagcgaagua

SEQ ID NO: 1796155 - RNA, 22 nt, Salmonella enterica enterica serovar Typhi Ty2
accagcagcgcggcguacacuu

SEQ ID NO: 1796156 - RNA, 15 nt, Salmonella enterica enterica serovar Typhi Ty2
accagcagcgggcug

SEQ ID NO: 1796157 - RNA, 12 nt, Salmonella enterica enterica serovar Typhi Ty2
accagcagcaga

SEQ ID NO: 1796158 - RNA, 14 nt, Salmonella enterica enterica serovar Typhi Ty2
accagaaucgccag

SEQ ID NO: 1796159 - RNA, 17 nt, Salmonella enterica enterica serovar Typhi Ty2
accagaaucauuaauaa

SEQ ID NO: 1796160 - RNA, 18 nt, Salmonella enterica enterica serovar Typhi Ty2
accagaaucgccagcauc

SEQ ID NO: 1796161 - RNA, 14 nt, Salmonella enterica enterica serovar Typhi Ty2
accagaccggcauc

SEQ ID NO: 1796162 - RNA, 22 nt, Salmonella enterica enterica serovar Typhi Ty2
accagacgcuggcacuggcagc

SEQ ID NO: 1796163 - RNA, 18 nt, Salmonella enterica enterica serovar Typhi Ty2
accagacucaccccuucu

SEQ ID NO: 1796164 - RNA, 15 nt, Salmonella enterica enterica serovar Typhi Ty2
accagacuaaaacgu

SEQ ID NO: 1796165 - RNA, 14 nt, Salmonella enterica enterica serovar Typhi Ty2
accaacaucauuau

SEQ ID NO: 1796166 - RNA, 13 nt, Salmonella enterica enterica serovar Typhi Ty2
accaaccaacagg

SEQ ID NO: 1796167 - RNA, 18 nt, Salmonella enterica enterica serovar Typhi Ty2
accagcccaugaaggagc

SEQ ID NO: 1796168 - RNA, 24 nt, Salmonella enterica enterica serovar Typhi Ty2
accagccgcgcccuaacaggcgca

SEQ ID NO: 1796169 - RNA, 18 nt, Salmonella enterica enterica serovar Typhi Ty2
accagccgcaucuuauau

SEQ ID NO: 1796170 - RNA, 18 nt, Salmonella enterica enterica serovar Typhi Ty2
accagccgaucaucacga

SEQ ID NO: 1796171 - RNA, 20 nt, Salmonella enterica enterica serovar Typhi Ty2
accagccgagugcuuaugua

SEQ ID NO: 1796172 - RNA, 22 nt, Salmonella enterica enterica serovar Typhi Ty2
accagcaguguaucguugucgc

SEQ ID NO: 1796173 - RNA, 21 nt, Salmonella enterica enterica serovar Typhi Ty2
accagcaggugguacaucaaa

SEQ ID NO: 1796174 - RNA, 22 nt, Salmonella enterica enterica serovar Typhi Ty2
accagcaucaauagcagcuuca

SEQ ID NO: 1796175 - RNA, 14 nt, Salmonella enterica enterica serovar Typhi Ty2
accagccugccguc

SEQ ID NO: 1796176 - RNA, 15 nt, Salmonella enterica enterica serovar Typhi Ty2
accagcgccauaauc

SEQ ID NO: 1796177 - RNA, 19 nt, Salmonella enterica enterica serovar Typhi Ty2
accagcgcaguaaacuccu

SEQ ID NO: 1796178 - RNA, 19 nt, Salmonella enterica enterica serovar Typhi Ty2
accagcgguaugcaccucu

SEQ ID NO: 1796179 - RNA, 17 nt, Salmonella enterica enterica serovar Typhi Ty2
accagcggcagcuucag

SEQ ID NO: 1796180 - RNA, 19 nt, Salmonella enterica enterica serovar Typhi Ty2
accagcguggcuauccaua

SEQ ID NO: 1796181 - RNA, 22 nt, Salmonella enterica enterica serovar Typhi Ty2
accagcgguugcauaaaauccu

SEQ ID NO: 1796182 - RNA, 15 nt, Salmonella enterica enterica serovar Typhi Ty2
accagcgccugcgcu

SEQ ID NO: 1796183 - RNA, 12 nt, Salmonella enterica enterica serovar Typhi Ty2
accagcgcgcca

SEQ ID NO: 1796184 - RNA, 14 nt, Salmonella enterica enterica serovar Typhi Ty2
accagcgccgccag

SEQ ID NO: 1796185 - RNA, 17 nt, Salmonella enterica enterica serovar Typhi Ty2
accgauuucaucgcuga

SEQ ID NO: 1796186 - RNA, 19 nt, Salmonella enterica enterica serovar Typhi Ty2
accgauaaucaccagcccg

SEQ ID NO: 1796187 - RNA, 18 nt, Salmonella enterica enterica serovar Typhi Ty2
accgauguuggcgacaga

SEQ ID NO: 1796188 - RNA, 23 nt, Salmonella enterica enterica serovar Typhi Ty2
accgcguuuugcugaugaagcga

SEQ ID NO: 1796189 - RNA, 13 nt, Salmonella enterica enterica serovar Typhi Ty2
accgcguuugcgc

SEQ ID NO: 1796190 - RNA, 15 nt, Salmonella enterica enterica serovar Typhi Ty2
accgcuacccggcac

SEQ ID NO: 1796191 - RNA, 16 nt, Salmonella enterica enterica serovar Typhi Ty2
accgcuaaugaggaaa

SEQ ID NO: 1796192 - RNA, 13 nt, Salmonella enterica enterica serovar Typhi Ty2
accgcucaggcgc

SEQ ID NO: 1796193 - RNA, 23 nt, Salmonella enterica enterica serovar Typhi Ty2
accgcuaucauaccuacaccaac

SEQ ID NO: 1796194 - RNA, 19 nt, Salmonella enterica enterica serovar Typhi Ty2
accgcucuccgcaauuaau

SEQ ID NO: 1796195 - RNA, 15 nt, Salmonella enterica enterica serovar Typhi Ty2
accgcucgccgccuc

SEQ ID NO: 1796196 - RNA, 18 nt, Salmonella enterica enterica serovar Typhi Ty2
accgcuugggccaccugc

SEQ ID NO: 1796197 - RNA, 13 nt, Salmonella enterica enterica serovar Typhi Ty2
accggaacagaag

SEQ ID NO: 1796198 - RNA, 15 nt, Salmonella enterica enterica serovar Typhi Ty2
accggacuccaggca

SEQ ID NO: 1796199 - RNA, 15 nt, Salmonella enterica enterica serovar Typhi Ty2
accggcacucaccuc

SEQ ID NO: 1796200 - RNA, 18 nt, Salmonella enterica enterica serovar Typhi Ty2
accggcacucaccucuuc

SEQ ID NO: 1796201 - RNA, 16 nt, Salmonella enterica enterica serovar Typhi Ty2
accgcuucgcgcgcca

SEQ ID NO: 1796202 - RNA, 16 nt, Salmonella enterica enterica serovar Typhi Ty2
accgcuucgcauugcg

SEQ ID NO: 1796203 - RNA, 22 nt, Salmonella enterica enterica serovar Typhi Ty2
accgcuuuggcgcccauuucgu

SEQ ID NO: 1796204 - RNA, 22 nt, Salmonella enterica enterica serovar Typhi Ty2
accgcuuugccgcgcucuuuaa

SEQ ID NO: 1796205 - RNA, 16 nt, Salmonella enterica enterica serovar Typhi Ty2
accgcuuucccggcau

SEQ ID NO: 1796206 - RNA, 13 nt, Salmonella enterica enterica serovar Typhi Ty2
accgcuuaacucc

SEQ ID NO: 1796207 - RNA, 19 nt, Salmonella enterica enterica serovar Typhi Ty2
accguauccuuccagcccg

SEQ ID NO: 1796208 - RNA, 22 nt, Salmonella enterica enterica serovar Typhi Ty2
accguaguagguauccagcaga

SEQ ID NO: 1796209 - RNA, 18 nt, Salmonella enterica enterica serovar Typhi Ty2
accguauugccagaucug

SEQ ID NO: 1796210 - RNA, 21 nt, Salmonella enterica enterica serovar Typhi Ty2
accgucacugaaccugccuuu

SEQ ID NO: 1796211 - RNA, 23 nt, Salmonella enterica enterica serovar Typhi Ty2
accguaagcuuucugaauuucac

SEQ ID NO: 1796212 - RNA, 15 nt, Salmonella enterica enterica serovar Typhi Ty2
accggccacgagcug

SEQ ID NO: 1796213 - RNA, 14 nt, Salmonella enterica enterica serovar Typhi Ty2
accggcaucggcag

SEQ ID NO: 1796214 - RNA, 15 nt, Salmonella enterica enterica serovar Typhi Ty2
accggcagcgucagc

SEQ ID NO: 1796215 - RNA, 14 nt, Salmonella enterica enterica serovar Typhi Ty2
accggcagccugcc

SEQ ID NO: 1796216 - RNA, 20 nt, Salmonella enterica enterica serovar Typhi Ty2
accgggagaaaacgcggccu

SEQ ID NO: 1796217 - RNA, 18 nt, Salmonella enterica enterica serovar Typhi Ty2
accgguagccaggcgcga

SEQ ID NO: 1796218 - RNA, 22 nt, Salmonella enterica enterica serovar Typhi Ty2
accgguaaauuucacuucgccc

SEQ ID NO: 1796219 - RNA, 15 nt, Salmonella enterica enterica serovar Typhi Ty2
accgguaaggcaggc

SEQ ID NO: 1796220 - RNA, 18 nt, Salmonella enterica enterica serovar Typhi Ty2
accggguuaaagcccuga

SEQ ID NO: 1796221 - RNA, 16 nt, Salmonella enterica enterica serovar Typhi Ty2
accgggaucgggacau

SEQ ID NO: 1796222 - RNA, 22 nt, Salmonella enterica enterica serovar Typhi Ty2
accuaaucccuggcgaauaaaa

SEQ ID NO: 1796223 - RNA, 23 nt, Salmonella enterica enterica serovar Typhi Ty2
accuaaucccuggcgaauaaaau

SEQ ID NO: 1796224 - RNA, 15 nt, Salmonella enterica enterica serovar Typhi Ty2
accuaauagccagcc

SEQ ID NO: 1796225 - RNA, 16 nt, Salmonella enterica enterica serovar Typhi Ty2
accuaauagccagccc

SEQ ID NO: 1796226 - RNA, 22 nt, Salmonella enterica enterica serovar Typhi Ty2
accuaaauaagcgccgaguagc

SEQ ID NO: 1796227 - RNA, 12 nt, Salmonella enterica enterica serovar Typhi Ty2
accguuuuccag

SEQ ID NO: 1796228 - RNA, 21 nt, Salmonella enterica enterica serovar Typhi Ty2
accuacuuuauuuuucgccag

SEQ ID NO: 1796229 - RNA, 14 nt, Salmonella enterica enterica serovar Typhi Ty2
accuacuguggugu

SEQ ID NO: 1796230 - RNA, 16 nt, Salmonella enterica enterica serovar Typhi Ty2
accuauuuaauaagca

SEQ ID NO: 1796231 - RNA, 13 nt, Salmonella enterica enterica serovar Typhi Ty2
accuauuuaauaa

SEQ ID NO: 1796232 - RNA, 20 nt, Salmonella enterica enterica serovar Typhi Ty2
accucaaaauggaaaauaau

SEQ ID NO: 1796233 - RNA, 14 nt, Salmonella enterica enterica serovar Typhi Ty2
accuauuuugcaaa

SEQ ID NO: 1796234 - RNA, 13 nt, Salmonella enterica enterica serovar Typhi Ty2
accuauuuuaaau

SEQ ID NO: 1796235 - RNA, 15 nt, Salmonella enterica enterica serovar Typhi Ty2
accuccaaagcgcua

SEQ ID NO: 1796236 - RNA, 18 nt, Salmonella enterica enterica serovar Typhi Ty2
accgucuggcgaggcgcc

SEQ ID NO: 1796237 - RNA, 16 nt, Salmonella enterica enterica serovar Typhi Ty2
accgucuccaugucac

SEQ ID NO: 1796238 - RNA, 18 nt, Salmonella enterica enterica serovar Typhi Ty2
accgucguuacccuccug

SEQ ID NO: 1796239 - RNA, 15 nt, Salmonella enterica enterica serovar Typhi Ty2
accgugcacgcugcg

SEQ ID NO: 1796240 - RNA, 22 nt, Salmonella enterica enterica serovar Typhi Ty2
accgugaauaaugaccagcgcc

SEQ ID NO: 1796241 - RNA, 21 nt, Salmonella enterica enterica serovar Typhi Ty2
accgucgcgcccuccuccagc

SEQ ID NO: 1796242 - RNA, 22 nt, Salmonella enterica enterica serovar Typhi Ty2
accgucgcgcccuccuccagcg

SEQ ID NO: 1796243 - RNA, 21 nt, Salmonella enterica enterica serovar Typhi Ty2
accgucauuuccggcgcgguc

SEQ ID NO: 1796244 - RNA, 13 nt, Salmonella enterica enterica serovar Typhi Ty2
accguccacaucc

SEQ ID NO: 1796245 - RNA, 15 nt, Salmonella enterica enterica serovar Typhi Ty2
accguugcgcccauc

SEQ ID NO: 1796246 - RNA, 23 nt, Salmonella enterica enterica serovar Typhi Ty2
accguugucggggcuuuaaugcu

SEQ ID NO: 1796247 - RNA, 20 nt, Salmonella enterica enterica serovar Typhi Ty2
accguuuaaucgcccugcgg

SEQ ID NO: 1796248 - RNA, 18 nt, Salmonella enterica enterica serovar Typhi Ty2
accguuuaaaaacaucau

SEQ ID NO: 1796249 - RNA, 22 nt, Salmonella enterica enterica serovar Typhi Ty2
accguuaacguuuuacgcugcc

SEQ ID NO: 1796250 - RNA, 14 nt, Salmonella enterica enterica serovar Typhi Ty2
accguuauccggca

SEQ ID NO: 1796251 - RNA, 19 nt, Salmonella enterica enterica serovar Typhi Ty2
accguucacgcucacgcag

SEQ ID NO: 1796252 - RNA, 19 nt, Salmonella enterica enterica serovar Typhi Ty2
accguucuuccuggggauc

SEQ ID NO: 1796253 - RNA, 16 nt, Salmonella enterica enterica serovar Typhi Ty2
accgugugcagugaca

SEQ ID NO: 1796254 - RNA, 16 nt, Salmonella enterica enterica serovar Typhi Ty2
accguggucuccgccu

SEQ ID NO: 1796255 - RNA, 15 nt, Salmonella enterica enterica serovar Typhi Ty2
acgacaaaaauacca

SEQ ID NO: 1796256 - RNA, 18 nt, Salmonella enterica enterica serovar Typhi Ty2
acgacaacuucuaauuuu

SEQ ID NO: 1796257 - RNA, 23 nt, Salmonella enterica enterica serovar Typhi Ty2
acgaaugccgauagucuccgcca

SEQ ID NO: 1796258 - RNA, 18 nt, Salmonella enterica enterica serovar Typhi Ty2
acgaaucucgcugccgga

SEQ ID NO: 1796259 - RNA, 19 nt, Salmonella enterica enterica serovar Typhi Ty2
acgaauggcggcguuuucc

SEQ ID NO: 1796260 - RNA, 19 nt, Salmonella enterica enterica serovar Typhi Ty2
acgaaugucgcgucagguu

SEQ ID NO: 1796261 - RNA, 23 nt, Salmonella enterica enterica serovar Typhi Ty2
acgacauaaccggcaaccaaagu

SEQ ID NO: 1796262 - RNA, 12 nt, Salmonella enterica enterica serovar Typhi Ty2
acgacagaauau

SEQ ID NO: 1796263 - RNA, 21 nt, Salmonella enterica enterica serovar Typhi Ty2
acgacacccgauacacgccga

SEQ ID NO: 1796264 - RNA, 22 nt, Salmonella enterica enterica serovar Typhi Ty2
accuuugcccgagcgcuggcau

SEQ ID NO: 1796265 - RNA, 16 nt, Salmonella enterica enterica serovar Typhi Ty2
acgaaaaucauccgcu

SEQ ID NO: 1796266 - RNA, 14 nt, Salmonella enterica enterica serovar Typhi Ty2
acgaaaauuauuuu

SEQ ID NO: 1796267 - RNA, 22 nt, Salmonella enterica enterica serovar Typhi Ty2
acgaaaauuauuuucgaugccc

SEQ ID NO: 1796268 - RNA, 22 nt, Salmonella enterica enterica serovar Typhi Ty2
acgacgucgacgccuuccacuu

SEQ ID NO: 1796269 - RNA, 21 nt, Salmonella enterica enterica serovar Typhi Ty2
acgacuccaauaauggagaug

SEQ ID NO: 1796270 - RNA, 13 nt, Salmonella enterica enterica serovar Typhi Ty2
acgacgccagcca

SEQ ID NO: 1796271 - RNA, 16 nt, Salmonella enterica enterica serovar Typhi Ty2
acgacgccagccagcc

SEQ ID NO: 1796272 - RNA, 14 nt, Salmonella enterica enterica serovar Typhi Ty2
acgacgccagcccu

SEQ ID NO: 1796273 - RNA, 17 nt, Salmonella enterica enterica serovar Typhi Ty2
acgaccaugguucccgc

SEQ ID NO: 1796274 - RNA, 23 nt, Salmonella enterica enterica serovar Typhi Ty2
acgaccaugguucccgccacuga

SEQ ID NO: 1796275 - RNA, 24 nt, Salmonella enterica enterica serovar Typhi Ty2
acgaccagaaucaucaugucguca

SEQ ID NO: 1796276 - RNA, 20 nt, Salmonella enterica enterica serovar Typhi Ty2
acgaccgccgacaaucguca

SEQ ID NO: 1796277 - RNA, 12 nt, Salmonella enterica enterica serovar Typhi Ty2
acgauaaaaugc

SEQ ID NO: 1796278 - RNA, 19 nt, Salmonella enterica enterica serovar Typhi Ty2
acgauaaauuuucagacac

SEQ ID NO: 1796279 - RNA, 20 nt, Salmonella enterica enterica serovar Typhi Ty2
acgauaaauuuucagacacu

SEQ ID NO: 1796280 - RNA, 23 nt, Salmonella enterica enterica serovar Typhi Ty2
acgauaucgccuggugugaacau

SEQ ID NO: 1796281 - RNA, 21 nt, Salmonella enterica enterica serovar Typhi Ty2
acgauaggcauacacaucuuc

SEQ ID NO: 1796282 - RNA, 18 nt, Salmonella enterica enterica serovar Typhi Ty2
acgauaaaccucacgcaa

SEQ ID NO: 1796283 - RNA, 23 nt, Salmonella enterica enterica serovar Typhi Ty2
acgaguugaauaacguguuaugc

SEQ ID NO: 1796284 - RNA, 21 nt, Salmonella enterica enterica serovar Typhi Ty2
acgaguccccucaaacaggcu

SEQ ID NO: 1796285 - RNA, 16 nt, Salmonella enterica enterica serovar Typhi Ty2
acgagcggucaggcca

SEQ ID NO: 1796286 - RNA, 18 nt, Salmonella enterica enterica serovar Typhi Ty2
acgagcgaaaaacugucg

SEQ ID NO: 1796287 - RNA, 20 nt, Salmonella enterica enterica serovar Typhi Ty2
acgagcgcgucagcgccucc

SEQ ID NO: 1796288 - RNA, 19 nt, Salmonella enterica enterica serovar Typhi Ty2
acgacugcaaaaagguagu

SEQ ID NO: 1796289 - RNA, 19 nt, Salmonella enterica enterica serovar Typhi Ty2
acgagcacuguagcggcug

SEQ ID NO: 1796290 - RNA, 15 nt, Salmonella enterica enterica serovar Typhi Ty2
accuucuuuuggaaa

SEQ ID NO: 1796291 - RNA, 15 nt, Salmonella enterica enterica serovar Typhi Ty2
accuucucuuuaugc

SEQ ID NO: 1796292 - RNA, 22 nt, Salmonella enterica enterica serovar Typhi Ty2
accuucugugaaaguuucagga

SEQ ID NO: 1796293 - RNA, 19 nt, Salmonella enterica enterica serovar Typhi Ty2
accuuucuucucuucuuca

SEQ ID NO: 1796294 - RNA, 13 nt, Salmonella enterica enterica serovar Typhi Ty2
accuuucuucucu

SEQ ID NO: 1796295 - RNA, 14 nt, Salmonella enterica enterica serovar Typhi Ty2
accuuguucuucca

SEQ ID NO: 1796296 - RNA, 15 nt, Salmonella enterica enterica serovar Typhi Ty2
accuuguucuuccau

SEQ ID NO: 1796297 - RNA, 22 nt, Salmonella enterica enterica serovar Typhi Ty2
accugucguacgccuaaaugaa

SEQ ID NO: 1796298 - RNA, 23 nt, Salmonella enterica enterica serovar Typhi Ty2
accuggcgggcagccuucaaguu

SEQ ID NO: 1796299 - RNA, 20 nt, Salmonella enterica enterica serovar Typhi Ty2
accuggcguaguacgcgcgc

SEQ ID NO: 1796300 - RNA, 23 nt, Salmonella enterica enterica serovar Typhi Ty2
accuggauuccuccaauucaggu

SEQ ID NO: 1796301 - RNA, 19 nt, Salmonella enterica enterica serovar Typhi Ty2
accuggccguugauaaagu

SEQ ID NO: 1796302 - RNA, 17 nt, Salmonella enterica enterica serovar Typhi Ty2
accuguaaccuuaaaag

SEQ ID NO: 1796303 - RNA, 14 nt, Salmonella enterica enterica serovar Typhi Ty2
accuguauuuucgu

SEQ ID NO: 1796304 - RNA, 13 nt, Salmonella enterica enterica serovar Typhi Ty2
accugccgaugaa

SEQ ID NO: 1796305 - RNA, 22 nt, Salmonella enterica enterica serovar Typhi Ty2
accugcccauccuuucucuggu

SEQ ID NO: 1796306 - RNA, 20 nt, Salmonella enterica enterica serovar Typhi Ty2
accugccacaggccaacaua

SEQ ID NO: 1796307 - RNA, 23 nt, Salmonella enterica enterica serovar Typhi Ty2
accugauugauacgcgcccgauc

SEQ ID NO: 1796308 - RNA, 21 nt, Salmonella enterica enterica serovar Typhi Ty2
accugauguagcucuucaucu

SEQ ID NO: 1796309 - RNA, 16 nt, Salmonella enterica enterica serovar Typhi Ty2
accugauucugcagcg

SEQ ID NO: 1796310 - RNA, 22 nt, Salmonella enterica enterica serovar Typhi Ty2
accuccacgcccagcgccgaga

SEQ ID NO: 1796311 - RNA, 13 nt, Salmonella enterica enterica serovar Typhi Ty2
accuccagcgccu

SEQ ID NO: 1796312 - RNA, 21 nt, Salmonella enterica enterica serovar Typhi Ty2
accugcgcugacggcggcaga

SEQ ID NO: 1796313 - RNA, 21 nt, Salmonella enterica enterica serovar Typhi Ty2
accuggcccugcaucagcucg

SEQ ID NO: 1796314 - RNA, 19 nt, Salmonella enterica enterica serovar Typhi Ty2
accuggaugcugccugccu

SEQ ID NO: 1796315 - RNA, 19 nt, Salmonella enterica enterica serovar Typhi Ty2
accugcuguaccucuugcu

SEQ ID NO: 1796316 - RNA, 24 nt, Salmonella enterica enterica serovar Typhi Ty2
accugcugucgcgguacuucugac

SEQ ID NO: 1796317 - RNA, 14 nt, Salmonella enterica enterica serovar Typhi Ty2
accugcuucagguu

SEQ ID NO: 1796318 - RNA, 18 nt, Salmonella enterica enterica serovar Typhi Ty2
accugcuggucaccuggc

SEQ ID NO: 1796319 - RNA, 17 nt, Salmonella enterica enterica serovar Typhi Ty2
acggcccauaucaauca

SEQ ID NO: 1796320 - RNA, 21 nt, Salmonella enterica enterica serovar Typhi Ty2
acggcccgaagggugaggagc

SEQ ID NO: 1796321 - RNA, 14 nt, Salmonella enterica enterica serovar Typhi Ty2
acggcccaggcauc

SEQ ID NO: 1796322 - RNA, 17 nt, Salmonella enterica enterica serovar Typhi Ty2
acggccagugaaauaaa

SEQ ID NO: 1796323 - RNA, 16 nt, Salmonella enterica enterica serovar Typhi Ty2
acggcgauacugcucc

SEQ ID NO: 1796324 - RNA, 18 nt, Salmonella enterica enterica serovar Typhi Ty2
acggcgauaccaguaaua

SEQ ID NO: 1796325 - RNA, 20 nt, Salmonella enterica enterica serovar Typhi Ty2
acggcgauaaaugucaggau

SEQ ID NO: 1796326 - RNA, 23 nt, Salmonella enterica enterica serovar Typhi Ty2
acggccugcaaacgaaucaccuc

SEQ ID NO: 1796327 - RNA, 20 nt, Salmonella enterica enterica serovar Typhi Ty2
acggccuagcugcguuucca

SEQ ID NO: 1796328 - RNA, 22 nt, Salmonella enterica enterica serovar Typhi Ty2
acggccuucgcagaucgccugg

SEQ ID NO: 1796329 - RNA, 18 nt, Salmonella enterica enterica serovar Typhi Ty2
acggcaguguuucccaac

SEQ ID NO: 1796330 - RNA, 12 nt, Salmonella enterica enterica serovar Typhi Ty2
acggcauaagcc

SEQ ID NO: 1796331 - RNA, 15 nt, Salmonella enterica enterica serovar Typhi Ty2
acggcauauucccug

SEQ ID NO: 1796332 - RNA, 18 nt, Salmonella enterica enterica serovar Typhi Ty2
acggcaucugcggcauga

SEQ ID NO: 1796333 - RNA, 16 nt, Salmonella enterica enterica serovar Typhi Ty2
acggcaucaagcccau

SEQ ID NO: 1796334 - RNA, 16 nt, Salmonella enterica enterica serovar Typhi Ty2
acggcacaacggccag

SEQ ID NO: 1796335 - RNA, 18 nt, Salmonella enterica enterica serovar Typhi Ty2
acggcacaacggccagca

SEQ ID NO: 1796336 - RNA, 12 nt, Salmonella enterica enterica serovar Typhi Ty2
acggucaggcuc

SEQ ID NO: 1796337 - RNA, 19 nt, Salmonella enterica enterica serovar Typhi Ty2
acgguccuggccaggcuuc

SEQ ID NO: 1796338 - RNA, 20 nt, Salmonella enterica enterica serovar Typhi Ty2
acggucauaucgucaucggu

SEQ ID NO: 1796339 - RNA, 14 nt, Salmonella enterica enterica serovar Typhi Ty2
acggucaaucauca

SEQ ID NO: 1796340 - RNA, 21 nt, Salmonella enterica enterica serovar Typhi Ty2
acgguaugaaacauauauauc

SEQ ID NO: 1796341 - RNA, 19 nt, Salmonella enterica enterica serovar Typhi Ty2
acgguaugaaacauauaua

SEQ ID NO: 1796342 - RNA, 13 nt, Salmonella enterica enterica serovar Typhi Ty2
acgguaugaaaca

SEQ ID NO: 1796343 - RNA, 22 nt, Salmonella enterica enterica serovar Typhi Ty2
acgguaucagcgcguuuuccau

SEQ ID NO: 1796344 - RNA, 18 nt, Salmonella enterica enterica serovar Typhi Ty2
acgggcuuuuagccgcgc

SEQ ID NO: 1796345 - RNA, 23 nt, Salmonella enterica enterica serovar Typhi Ty2
acggcgucaccaccgcaggcagc

SEQ ID NO: 1796346 - RNA, 16 nt, Salmonella enterica enterica serovar Typhi Ty2
acggcggguuuaagug

SEQ ID NO: 1796347 - RNA, 14 nt, Salmonella enterica enterica serovar Typhi Ty2
acggcgucagccac

SEQ ID NO: 1796348 - RNA, 18 nt, Salmonella enterica enterica serovar Typhi Ty2
acgggacgaauuuccagc

SEQ ID NO: 1796349 - RNA, 19 nt, Salmonella enterica enterica serovar Typhi Ty2
acgggcacggucugcugac

SEQ ID NO: 1796350 - RNA, 14 nt, Salmonella enterica enterica serovar Typhi Ty2
acgggcagucuggc

SEQ ID NO: 1796351 - RNA, 11 nt, Salmonella enterica enterica serovar Typhi Ty2
acgggcaaagc

SEQ ID NO: 1796352 - RNA, 15 nt, Salmonella enterica enterica serovar Typhi Ty2
acgggcuuccaguac

SEQ ID NO: 1796353 - RNA, 11 nt, Salmonella enterica enterica serovar Typhi Ty2
acggggaacag

SEQ ID NO: 1796354 - RNA, 17 nt, Salmonella enterica enterica serovar Typhi Ty2
acgguucauccagcagc

SEQ ID NO: 1796355 - RNA, 22 nt, Salmonella enterica enterica serovar Typhi Ty2
acgucaauguaauucaccaaau

SEQ ID NO: 1796356 - RNA, 19 nt, Salmonella enterica enterica serovar Typhi Ty2
acgucacaauacuuccgcu

SEQ ID NO: 1796357 - RNA, 12 nt, Salmonella enterica enterica serovar Typhi Ty2
acgucaccauca

SEQ ID NO: 1796358 - RNA, 22 nt, Salmonella enterica enterica serovar Typhi Ty2
acgguuaaaaacagccagcagc

SEQ ID NO: 1796359 - RNA, 13 nt, Salmonella enterica enterica serovar Typhi Ty2
acgguuaaaaagu

SEQ ID NO: 1796360 - RNA, 20 nt, Salmonella enterica enterica serovar Typhi Ty2
acggugugccgccaucagcg

SEQ ID NO: 1796361 - RNA, 16 nt, Salmonella enterica enterica serovar Typhi Ty2
acggugugccgccauc

SEQ ID NO: 1796362 - RNA, 19 nt, Salmonella enterica enterica serovar Typhi Ty2
acgucagccgggauaauca

SEQ ID NO: 1796363 - RNA, 12 nt, Salmonella enterica enterica serovar Typhi Ty2
acgucagcugga

SEQ ID NO: 1796364 - RNA, 15 nt, Salmonella enterica enterica serovar Typhi Ty2
acgucauaucaucca

SEQ ID NO: 1796365 - RNA, 16 nt, Salmonella enterica enterica serovar Typhi Ty2
acgucauuuuuucaau

SEQ ID NO: 1796366 - RNA, 22 nt, Salmonella enterica enterica serovar Typhi Ty2
acgucauaucauccagccccgg

SEQ ID NO: 1796367 - RNA, 18 nt, Salmonella enterica enterica serovar Typhi Ty2
acgucauuuuuucaauuu

SEQ ID NO: 1796368 - RNA, 20 nt, Salmonella enterica enterica serovar Typhi Ty2
acgucccgucagggcgaggc

SEQ ID NO: 1796369 - RNA, 18 nt, Salmonella enterica enterica serovar Typhi Ty2
acguccucuucuacacga

SEQ ID NO: 1796370 - RNA, 15 nt, Salmonella enterica enterica serovar Typhi Ty2
acguccauccgggua

SEQ ID NO: 1796371 - RNA, 14 nt, Salmonella enterica enterica serovar Typhi Ty2
acgucgcaaagauu

SEQ ID NO: 1796372 - RNA, 18 nt, Salmonella enterica enterica serovar Typhi Ty2
acgucgccuuccugcagg

SEQ ID NO: 1796373 - RNA, 20 nt, Salmonella enterica enterica serovar Typhi Ty2
acgucgcucuuuucaggcgc

SEQ ID NO: 1796374 - RNA, 21 nt, Salmonella enterica enterica serovar Typhi Ty2
acgucgcgcgccgccugcgcc

SEQ ID NO: 1796375 - RNA, 19 nt, Salmonella enterica enterica serovar Typhi Ty2
acgugagugguagaaacug

SEQ ID NO: 1796376 - RNA, 13 nt, Salmonella enterica enterica serovar Typhi Ty2
acgucgucccagg

SEQ ID NO: 1796377 - RNA, 19 nt, Salmonella enterica enterica serovar Typhi Ty2
acguuaauacaucaugcuu

SEQ ID NO: 1796378 - RNA, 15 nt, Salmonella enterica enterica serovar Typhi Ty2
acguuaauacaucau

SEQ ID NO: 1796379 - RNA, 18 nt, Salmonella enterica enterica serovar Typhi Ty2
acguuaauggcacgcugg

SEQ ID NO: 1796380 - RNA, 18 nt, Salmonella enterica enterica serovar Typhi Ty2
acguggugcgggauacgu

SEQ ID NO: 1796381 - RNA, 15 nt, Salmonella enterica enterica serovar Typhi Ty2
acguggccagcaugc

SEQ ID NO: 1796382 - RNA, 13 nt, Salmonella enterica enterica serovar Typhi Ty2
acgugggucgaga

SEQ ID NO: 1796383 - RNA, 13 nt, Salmonella enterica enterica serovar Typhi Ty2
acgugcaucuccu

SEQ ID NO: 1796384 - RNA, 14 nt, Salmonella enterica enterica serovar Typhi Ty2
acgugcauaaaacg

SEQ ID NO: 1796385 - RNA, 22 nt, Salmonella enterica enterica serovar Typhi Ty2
acgugaugaucguguugcagcc

SEQ ID NO: 1796386 - RNA, 14 nt, Salmonella enterica enterica serovar Typhi Ty2
acgcgauagauacc

SEQ ID NO: 1796387 - RNA, 17 nt, Salmonella enterica enterica serovar Typhi Ty2
acgcgauauguuugcgc

SEQ ID NO: 1796388 - RNA, 21 nt, Salmonella enterica enterica serovar Typhi Ty2
acgcgauaaaaaacgcccaga

SEQ ID NO: 1796389 - RNA, 15 nt, Salmonella enterica enterica serovar Typhi Ty2
acgcgagaagcccgg

SEQ ID NO: 1796390 - RNA, 21 nt, Salmonella enterica enterica serovar Typhi Ty2
acgcgacuuuccgccaccaga

SEQ ID NO: 1796391 - RNA, 15 nt, Salmonella enterica enterica serovar Typhi Ty2
acgcgaccagcgcgc

SEQ ID NO: 1796392 - RNA, 20 nt, Salmonella enterica enterica serovar Typhi Ty2
acgcgcagagauagccagcg

SEQ ID NO: 1796393 - RNA, 20 nt, Salmonella enterica enterica serovar Typhi Ty2
acgcgcaucaacgccaggca

SEQ ID NO: 1796394 - RNA, 21 nt, Salmonella enterica enterica serovar Typhi Ty2
acgcgccagcagugggaaaau

SEQ ID NO: 1796395 - RNA, 15 nt, Salmonella enterica enterica serovar Typhi Ty2
acgcgccagcaaaau

SEQ ID NO: 1796396 - RNA, 21 nt, Salmonella enterica enterica serovar Typhi Ty2
acgcgccaucgucaccggauc

SEQ ID NO: 1796397 - RNA, 21 nt, Salmonella enterica enterica serovar Typhi Ty2
acgcgggguaaaauggacuuc

SEQ ID NO: 1796398 - RNA, 12 nt, Salmonella enterica enterica serovar Typhi Ty2
acgcggcgcgcu

SEQ ID NO: 1796399 - RNA, 16 nt, Salmonella enterica enterica serovar Typhi Ty2
acgcggauugccgccc

SEQ ID NO: 1796400 - RNA, 21 nt, Salmonella enterica enterica serovar Typhi Ty2
acgcggcacaaaguccgccgu

SEQ ID NO: 1796401 - RNA, 23 nt, Salmonella enterica enterica serovar Typhi Ty2
acgcggccuggaagcgcccaggc

SEQ ID NO: 1796402 - RNA, 19 nt, Salmonella enterica enterica serovar Typhi Ty2
acgcgcucaccuccgccac

SEQ ID NO: 1796403 - RNA, 22 nt, Salmonella enterica enterica serovar Typhi Ty2
acgcgccgagguuuucauccac

SEQ ID NO: 1796404 - RNA, 17 nt, Salmonella enterica enterica serovar Typhi Ty2
acgcgcgucaggacggc

SEQ ID NO: 1796405 - RNA, 13 nt, Salmonella enterica enterica serovar Typhi Ty2
acgcgcguucguu

SEQ ID NO: 1796406 - RNA, 14 nt, Salmonella enterica enterica serovar Typhi Ty2
acgcgcgcgaaaag

SEQ ID NO: 1796407 - RNA, 14 nt, Salmonella enterica enterica serovar Typhi Ty2
acgcgcgucaggac

SEQ ID NO: 1796408 - RNA, 18 nt, Salmonella enterica enterica serovar Typhi Ty2
acgcgcgagaacugcugc

SEQ ID NO: 1796409 - RNA, 17 nt, Salmonella enterica enterica serovar Typhi Ty2
acgcgcucgccagcgcu

SEQ ID NO: 1796410 - RNA, 13 nt, Salmonella enterica enterica serovar Typhi Ty2
acgcgcugaccuc

SEQ ID NO: 1796411 - RNA, 12 nt, Salmonella enterica enterica serovar Typhi Ty2
acgcggaaguau

SEQ ID NO: 1796412 - RNA, 19 nt, Salmonella enterica enterica serovar Typhi Ty2
acgcggaacuggugaaaca

SEQ ID NO: 1796413 - RNA, 14 nt, Salmonella enterica enterica serovar Typhi Ty2
acgcgcuuguucgu

SEQ ID NO: 1796414 - RNA, 15 nt, Salmonella enterica enterica serovar Typhi Ty2
acgcugcgcaacagc

SEQ ID NO: 1796415 - RNA, 21 nt, Salmonella enterica enterica serovar Typhi Ty2
acgcugcuauccggcaacacg

SEQ ID NO: 1796416 - RNA, 20 nt, Salmonella enterica enterica serovar Typhi Ty2
acgcugcuauuuugcgcuuu

SEQ ID NO: 1796417 - RNA, 20 nt, Salmonella enterica enterica serovar Typhi Ty2
acgcugccauccucauuuug

SEQ ID NO: 1796418 - RNA, 16 nt, Salmonella enterica enterica serovar Typhi Ty2
acgcuccggcaggcaa

SEQ ID NO: 1796419 - RNA, 15 nt, Salmonella enterica enterica serovar Typhi Ty2
acgcuccugcuccug

SEQ ID NO: 1796420 - RNA, 11 nt, Salmonella enterica enterica serovar Typhi Ty2
acgcuccugga

SEQ ID NO: 1796421 - RNA, 13 nt, Salmonella enterica enterica serovar Typhi Ty2
acgcuccuggauu

SEQ ID NO: 1796422 - RNA, 21 nt, Salmonella enterica enterica serovar Typhi Ty2
acgcuggaaaauuucagugaa

SEQ ID NO: 1796423 - RNA, 20 nt, Salmonella enterica enterica serovar Typhi Ty2
acgcuggaaaauuucaguga

SEQ ID NO: 1796424 - RNA, 15 nt, Salmonella enterica enterica serovar Typhi Ty2
acgcuggacaauagc

SEQ ID NO: 1796425 - RNA, 19 nt, Salmonella enterica enterica serovar Typhi Ty2
acgcugguuugugugcagg

SEQ ID NO: 1796426 - RNA, 19 nt, Salmonella enterica enterica serovar Typhi Ty2
acgcuggcacuuuccgguu

SEQ ID NO: 1796427 - RNA, 18 nt, Salmonella enterica enterica serovar Typhi Ty2
acgcggugacuuuggccg

SEQ ID NO: 1796428 - RNA, 23 nt, Salmonella enterica enterica serovar Typhi Ty2
acgcgucuucaucagccagcauc

SEQ ID NO: 1796429 - RNA, 17 nt, Salmonella enterica enterica serovar Typhi Ty2
acgcgucugaaugacgc

SEQ ID NO: 1796430 - RNA, 19 nt, Salmonella enterica enterica serovar Typhi Ty2
acgcgucagggcgauaaua

SEQ ID NO: 1796431 - RNA, 20 nt, Salmonella enterica enterica serovar Typhi Ty2
acgcgucaaauagagaaaau

SEQ ID NO: 1796432 - RNA, 21 nt, Salmonella enterica enterica serovar Typhi Ty2
acgcgucaaauagagaaaaua

SEQ ID NO: 1796433 - RNA, 17 nt, Salmonella enterica enterica serovar Typhi Ty2
acgcguucugaauaaau

SEQ ID NO: 1796434 - RNA, 21 nt, Salmonella enterica enterica serovar Typhi Ty2
acgcguuuuccagcaccaguu

SEQ ID NO: 1796435 - RNA, 15 nt, Salmonella enterica enterica serovar Typhi Ty2
acgcguucugaauaa

SEQ ID NO: 1796436 - RNA, 13 nt, Salmonella enterica enterica serovar Typhi Ty2
acgcgugcgaauu

SEQ ID NO: 1796437 - RNA, 18 nt, Salmonella enterica enterica serovar Typhi Ty2
acgcgugaacauggguuu

SEQ ID NO: 1796438 - RNA, 22 nt, Salmonella enterica enterica serovar Typhi Ty2
acgcucauuaacgacaacuucu

SEQ ID NO: 1796439 - RNA, 18 nt, Salmonella enterica enterica serovar Typhi Ty2
acgcuccagcuggcuggc

SEQ ID NO: 1796440 - RNA, 12 nt, Salmonella enterica enterica serovar Typhi Ty2
acgcuccagcag

SEQ ID NO: 1796441 - RNA, 16 nt, Salmonella enterica enterica serovar Typhi Ty2
acgccgauuaaugcuc

SEQ ID NO: 1796442 - RNA, 15 nt, Salmonella enterica enterica serovar Typhi Ty2
acgccgauuaaugcu

SEQ ID NO: 1796443 - RNA, 13 nt, Salmonella enterica enterica serovar Typhi Ty2
acgccgcaaacgc

SEQ ID NO: 1796444 - RNA, 18 nt, Salmonella enterica enterica serovar Typhi Ty2
acgccgacgaccggcagc

SEQ ID NO: 1796445 - RNA, 23 nt, Salmonella enterica enterica serovar Typhi Ty2
acgcccuucacgccgaagugcgc

SEQ ID NO: 1796446 - RNA, 16 nt, Salmonella enterica enterica serovar Typhi Ty2
acgcccuucaauauca

SEQ ID NO: 1796447 - RNA, 14 nt, Salmonella enterica enterica serovar Typhi Ty2
acgcccugccauuc

SEQ ID NO: 1796448 - RNA, 16 nt, Salmonella enterica enterica serovar Typhi Ty2
acgcccucaauaucuu

SEQ ID NO: 1796449 - RNA, 13 nt, Salmonella enterica enterica serovar Typhi Ty2
acgcccucaauau

SEQ ID NO: 1796450 - RNA, 14 nt, Salmonella enterica enterica serovar Typhi Ty2
acgcccucaauauc

SEQ ID NO: 1796451 - RNA, 14 nt, Salmonella enterica enterica serovar Typhi Ty2
acgcccugcaaagc

SEQ ID NO: 1796452 - RNA, 18 nt, Salmonella enterica enterica serovar Typhi Ty2
acgcccgccguaacgcgc

SEQ ID NO: 1796453 - RNA, 16 nt, Salmonella enterica enterica serovar Typhi Ty2
acgccccuaaggcagc

SEQ ID NO: 1796454 - RNA, 16 nt, Salmonella enterica enterica serovar Typhi Ty2
acgcccccugccagcg

SEQ ID NO: 1796455 - RNA, 17 nt, Salmonella enterica enterica serovar Typhi Ty2
acgcccaugcaaccagu

SEQ ID NO: 1796456 - RNA, 21 nt, Salmonella enterica enterica serovar Typhi Ty2
acgcccaucagcaucccaccg

SEQ ID NO: 1796457 - RNA, 12 nt, Salmonella enterica enterica serovar Typhi Ty2
acgcccagcgcc

SEQ ID NO: 1796458 - RNA, 22 nt, Salmonella enterica enterica serovar Typhi Ty2
acgcccagcgccgagaaaauca

SEQ ID NO: 1796459 - RNA, 14 nt, Salmonella enterica enterica serovar Typhi Ty2
acgcccagccguga

SEQ ID NO: 1796460 - RNA, 17 nt, Salmonella enterica enterica serovar Typhi Ty2
acgcccagcuauuuuuc

SEQ ID NO: 1796461 - RNA, 21 nt, Salmonella enterica enterica serovar Typhi Ty2
acgcccacgcggcgugcgcug

SEQ ID NO: 1796462 - RNA, 16 nt, Salmonella enterica enterica serovar Typhi Ty2
acgaucaacagaccga

SEQ ID NO: 1796463 - RNA, 14 nt, Salmonella enterica enterica serovar Typhi Ty2
acgccaucuuccuc

SEQ ID NO: 1796464 - RNA, 16 nt, Salmonella enterica enterica serovar Typhi Ty2
acgccaucuuucuuuu

SEQ ID NO: 1796465 - RNA, 18 nt, Salmonella enterica enterica serovar Typhi Ty2
acgccaucuuucuuuucg

SEQ ID NO: 1796466 - RNA, 15 nt, Salmonella enterica enterica serovar Typhi Ty2
acgccaugcaaaaaa

SEQ ID NO: 1796467 - RNA, 23 nt, Salmonella enterica enterica serovar Typhi Ty2
acgccaugcucauccaacugcgc

SEQ ID NO: 1796468 - RNA, 20 nt, Salmonella enterica enterica serovar Typhi Ty2
acgccauggggugaggcauc

SEQ ID NO: 1796469 - RNA, 18 nt, Salmonella enterica enterica serovar Typhi Ty2
acgccugggcauuuguug

SEQ ID NO: 1796470 - RNA, 19 nt, Salmonella enterica enterica serovar Typhi Ty2
acgccuggugggauaggcu

SEQ ID NO: 1796471 - RNA, 19 nt, Salmonella enterica enterica serovar Typhi Ty2
acgccuuacccgaccuaca

SEQ ID NO: 1796472 - RNA, 17 nt, Salmonella enterica enterica serovar Typhi Ty2
acgccuuccuccagcau

SEQ ID NO: 1796473 - RNA, 18 nt, Salmonella enterica enterica serovar Typhi Ty2
acgccuuccuccagcauc

SEQ ID NO: 1796474 - RNA, 22 nt, Salmonella enterica enterica serovar Typhi Ty2
acgccuucguccggauguucga

SEQ ID NO: 1796475 - RNA, 15 nt, Salmonella enterica enterica serovar Typhi Ty2
acgccuuugcccggu

SEQ ID NO: 1796476 - RNA, 13 nt, Salmonella enterica enterica serovar Typhi Ty2
acgccuaaaugaa

SEQ ID NO: 1796477 - RNA, 19 nt, Salmonella enterica enterica serovar Typhi Ty2
acgccuaccgcuucccaca

SEQ ID NO: 1796478 - RNA, 22 nt, Salmonella enterica enterica serovar Typhi Ty2
acgccguccggcgaacaaacuc

SEQ ID NO: 1796479 - RNA, 16 nt, Salmonella enterica enterica serovar Typhi Ty2
acgccguuaccagcau

SEQ ID NO: 1796480 - RNA, 15 nt, Salmonella enterica enterica serovar Typhi Ty2
acgccuccaggcuac

SEQ ID NO: 1796481 - RNA, 22 nt, Salmonella enterica enterica serovar Typhi Ty2
acgccugccagauaguuagcua

SEQ ID NO: 1796482 - RNA, 16 nt, Salmonella enterica enterica serovar Typhi Ty2
acgccugcauaaagga

SEQ ID NO: 1796483 - RNA, 21 nt, Salmonella enterica enterica serovar Typhi Ty2
acgccugaauuucgucaggaa

SEQ ID NO: 1796484 - RNA, 12 nt, Salmonella enterica enterica serovar Typhi Ty2
acgccuggagug

SEQ ID NO: 1796485 - RNA, 22 nt, Salmonella enterica enterica serovar Typhi Ty2
acgccuggcgcauuuuaaugau

SEQ ID NO: 1796486 - RNA, 15 nt, Salmonella enterica enterica serovar Typhi Ty2
acgccugaaaacaga

SEQ ID NO: 1796487 - RNA, 22 nt, Salmonella enterica enterica serovar Typhi Ty2
acgccgcuaucgaccagcaccu

SEQ ID NO: 1796488 - RNA, 21 nt, Salmonella enterica enterica serovar Typhi Ty2
acgccgugaauuucugcugcc

SEQ ID NO: 1796489 - RNA, 14 nt, Salmonella enterica enterica serovar Typhi Ty2
acgccgucucuuuu

SEQ ID NO: 1796490 - RNA, 21 nt, Salmonella enterica enterica serovar Typhi Ty2
acgccgucacaaagcccaccg

SEQ ID NO: 1796491 - RNA, 20 nt, Salmonella enterica enterica serovar Typhi Ty2
acgccggugccugccgccuc

SEQ ID NO: 1796492 - RNA, 16 nt, Salmonella enterica enterica serovar Typhi Ty2
acgccgcuguuuucac

SEQ ID NO: 1796493 - RNA, 15 nt, Salmonella enterica enterica serovar Typhi Ty2
acgccggugccugcc

SEQ ID NO: 1796494 - RNA, 16 nt, Salmonella enterica enterica serovar Typhi Ty2
acgccggugccugccg

SEQ ID NO: 1796495 - RNA, 21 nt, Salmonella enterica enterica serovar Typhi Ty2
acgccggggauaucaaugcgc

SEQ ID NO: 1796496 - RNA, 20 nt, Salmonella enterica enterica serovar Typhi Ty2
acuguaaaucugccgucauc

SEQ ID NO: 1796497 - RNA, 21 nt, Salmonella enterica enterica serovar Typhi Ty2
acuguacgccacggcuuaaau

SEQ ID NO: 1796498 - RNA, 16 nt, Salmonella enterica enterica serovar Typhi Ty2
acuguagcaacugcca

SEQ ID NO: 1796499 - RNA, 18 nt, Salmonella enterica enterica serovar Typhi Ty2
acugucgaaaccagcaua

SEQ ID NO: 1796500 - RNA, 19 nt, Salmonella enterica enterica serovar Typhi Ty2
acuguggugugccugcgcu

SEQ ID NO: 1796501 - RNA, 15 nt, Salmonella enterica enterica serovar Typhi Ty2
acuguggugugccug

SEQ ID NO: 1796502 - RNA, 22 nt, Salmonella enterica enterica serovar Typhi Ty2
acugugcugauuuuggcuucac

SEQ ID NO: 1796503 - RNA, 18 nt, Salmonella enterica enterica serovar Typhi Ty2
acuguuuaaugcuuucaa

SEQ ID NO: 1796504 - RNA, 19 nt, Salmonella enterica enterica serovar Typhi Ty2
acuguuuuaccaaaucaau

SEQ ID NO: 1796505 - RNA, 20 nt, Salmonella enterica enterica serovar Typhi Ty2
acuguuuuaccaaaucaaua

SEQ ID NO: 1796506 - RNA, 14 nt, Salmonella enterica enterica serovar Typhi Ty2
acuguuuuugcuuu

SEQ ID NO: 1796507 - RNA, 18 nt, Salmonella enterica enterica serovar Typhi Ty2
acuggcuuuccugaucaa

SEQ ID NO: 1796508 - RNA, 15 nt, Salmonella enterica enterica serovar Typhi Ty2
acuggcgauuuucau

SEQ ID NO: 1796509 - RNA, 16 nt, Salmonella enterica enterica serovar Typhi Ty2
acuggcccccuguucc

SEQ ID NO: 1796510 - RNA, 17 nt, Salmonella enterica enterica serovar Typhi Ty2
acuggcgacagccgcgu

SEQ ID NO: 1796511 - RNA, 20 nt, Salmonella enterica enterica serovar Typhi Ty2
acuggccguuuucccggcaa

SEQ ID NO: 1796512 - RNA, 19 nt, Salmonella enterica enterica serovar Typhi Ty2
acuggugcccgcaaaaccu

SEQ ID NO: 1796513 - RNA, 21 nt, Salmonella enterica enterica serovar Typhi Ty2
acugguggcgagauaagccgu

SEQ ID NO: 1796514 - RNA, 19 nt, Salmonella enterica enterica serovar Typhi Ty2
acugguuaaggaugacuaa

SEQ ID NO: 1796515 - RNA, 16 nt, Salmonella enterica enterica serovar Typhi Ty2
acugguaaaccgugcg

SEQ ID NO: 1796516 - RNA, 19 nt, Salmonella enterica enterica serovar Typhi Ty2
acucgugcagugauucgua

SEQ ID NO: 1796517 - RNA, 23 nt, Salmonella enterica enterica serovar Typhi Ty2
acucuaugcaaaagaaaaaacuu

SEQ ID NO: 1796518 - RNA, 20 nt, Salmonella enterica enterica serovar Typhi Ty2
acugaagauaaacagcagcg

SEQ ID NO: 1796519 - RNA, 16 nt, Salmonella enterica enterica serovar Typhi Ty2
acugaagguuuuuccc

SEQ ID NO: 1796520 - RNA, 15 nt, Salmonella enterica enterica serovar Typhi Ty2
acucucaaugcccau

SEQ ID NO: 1796521 - RNA, 21 nt, Salmonella enterica enterica serovar Typhi Ty2
acucucaccgaccugccuugc

SEQ ID NO: 1796522 - RNA, 16 nt, Salmonella enterica enterica serovar Typhi Ty2
acugaccagacagccc

SEQ ID NO: 1796523 - RNA, 15 nt, Salmonella enterica enterica serovar Typhi Ty2
acugaccauauauga

SEQ ID NO: 1796524 - RNA, 17 nt, Salmonella enterica enterica serovar Typhi Ty2
acugacaauuuccagau

SEQ ID NO: 1796525 - RNA, 19 nt, Salmonella enterica enterica serovar Typhi Ty2
acugagacucagcagcgca

SEQ ID NO: 1796526 - RNA, 15 nt, Salmonella enterica enterica serovar Typhi Ty2
acugacggcgcucuu

SEQ ID NO: 1796527 - RNA, 15 nt, Salmonella enterica enterica serovar Typhi Ty2
acugacugcugucau

SEQ ID NO: 1796528 - RNA, 17 nt, Salmonella enterica enterica serovar Typhi Ty2
acugacuucaucaaaua

SEQ ID NO: 1796529 - RNA, 23 nt, Salmonella enterica enterica serovar Typhi Ty2
acugacguugcgaaucagguaca

SEQ ID NO: 1796530 - RNA, 21 nt, Salmonella enterica enterica serovar Typhi Ty2
acugauucaaaaggugagaaa

SEQ ID NO: 1796531 - RNA, 22 nt, Salmonella enterica enterica serovar Typhi Ty2
acugauggaguuucaucagcac

SEQ ID NO: 1796532 - RNA, 13 nt, Salmonella enterica enterica serovar Typhi Ty2
acugauggcuggc

SEQ ID NO: 1796533 - RNA, 15 nt, Salmonella enterica enterica serovar Typhi Ty2
acugcacgccagggu

SEQ ID NO: 1796534 - RNA, 13 nt, Salmonella enterica enterica serovar Typhi Ty2
acugcacuuccug

SEQ ID NO: 1796535 - RNA, 22 nt, Salmonella enterica enterica serovar Typhi Ty2
acugcccuacgcuucucuccau

SEQ ID NO: 1796536 - RNA, 13 nt, Salmonella enterica enterica serovar Typhi Ty2
acugcccggcaua

SEQ ID NO: 1796537 - RNA, 16 nt, Salmonella enterica enterica serovar Typhi Ty2
acugccguauccaggg

SEQ ID NO: 1796538 - RNA, 17 nt, Salmonella enterica enterica serovar Typhi Ty2
acugcuaaggagauaac

SEQ ID NO: 1796539 - RNA, 20 nt, Salmonella enterica enterica serovar Typhi Ty2
acugcuuagcucaucagccu

SEQ ID NO: 1796540 - RNA, 11 nt, Salmonella enterica enterica serovar Typhi Ty2
acuccagcaga

SEQ ID NO: 1796541 - RNA, 12 nt, Salmonella enterica enterica serovar Typhi Ty2
acuccagcagac

SEQ ID NO: 1796542 - RNA, 15 nt, Salmonella enterica enterica serovar Typhi Ty2
acuccagcccaucag

SEQ ID NO: 1796543 - RNA, 14 nt, Salmonella enterica enterica serovar Typhi Ty2
acuccagcccauca

SEQ ID NO: 1796544 - RNA, 14 nt, Salmonella enterica enterica serovar Typhi Ty2
acuccagcggcagg

SEQ ID NO: 1796545 - RNA, 19 nt, Salmonella enterica enterica serovar Typhi Ty2
acuccgcgguagagcgcgg

SEQ ID NO: 1796546 - RNA, 17 nt, Salmonella enterica enterica serovar Typhi Ty2
acucccugcuuuuucag

SEQ ID NO: 1796547 - RNA, 19 nt, Salmonella enterica enterica serovar Typhi Ty2
acucccuggugacgcgcau

SEQ ID NO: 1796548 - RNA, 16 nt, Salmonella enterica enterica serovar Typhi Ty2
acuccauucccagcuc

SEQ ID NO: 1796549 - RNA, 16 nt, Salmonella enterica enterica serovar Typhi Ty2
acucgcuacgcucgcc

SEQ ID NO: 1796550 - RNA, 21 nt, Salmonella enterica enterica serovar Typhi Ty2
acuccugcaucgauuccccac

SEQ ID NO: 1796551 - RNA, 11 nt, Salmonella enterica enterica serovar Typhi Ty2
acuccagaccu

SEQ ID NO: 1796552 - RNA, 19 nt, Salmonella enterica enterica serovar Typhi Ty2
acucaucggccaccacaua

SEQ ID NO: 1796553 - RNA, 17 nt, Salmonella enterica enterica serovar Typhi Ty2
acucaucaugauauaau

SEQ ID NO: 1796554 - RNA, 20 nt, Salmonella enterica enterica serovar Typhi Ty2
acucaucgguuaacacauau

SEQ ID NO: 1796555 - RNA, 17 nt, Salmonella enterica enterica serovar Typhi Ty2
acucaugacuucacacu

SEQ ID NO: 1796556 - RNA, 19 nt, Salmonella enterica enterica serovar Typhi Ty2
acucaugacuucacacugu

SEQ ID NO: 1796557 - RNA, 21 nt, Salmonella enterica enterica serovar Typhi Ty2
acucauggacaaaaaaggaaa

SEQ ID NO: 1796558 - RNA, 13 nt, Salmonella enterica enterica serovar Typhi Ty2
acucauuaaaaaa

SEQ ID NO: 1796559 - RNA, 22 nt, Salmonella enterica enterica serovar Typhi Ty2
acucagggugacggaagagaga

SEQ ID NO: 1796560 - RNA, 15 nt, Salmonella enterica enterica serovar Typhi Ty2
acucagcacauucag

SEQ ID NO: 1796561 - RNA, 17 nt, Salmonella enterica enterica serovar Typhi Ty2
acucaggcgcaucugac

SEQ ID NO: 1796562 - RNA, 17 nt, Salmonella enterica enterica serovar Typhi Ty2
acucagcuaaaaacagc

SEQ ID NO: 1796563 - RNA, 15 nt, Salmonella enterica enterica serovar Typhi Ty2
acucagccagauacc

SEQ ID NO: 1796564 - RNA, 16 nt, Salmonella enterica enterica serovar Typhi Ty2
acuauccacagcgaau

SEQ ID NO: 1796565 - RNA, 14 nt, Salmonella enterica enterica serovar Typhi Ty2
acuacguguacgcu

SEQ ID NO: 1796566 - RNA, 17 nt, Salmonella enterica enterica serovar Typhi Ty2
acuacucguaaucuaaa

SEQ ID NO: 1796567 - RNA, 18 nt, Salmonella enterica enterica serovar Typhi Ty2
acuacugguggaauaaau

SEQ ID NO: 1796568 - RNA, 22 nt, Salmonella enterica enterica serovar Typhi Ty2
acuacggguuuuuguguugaaa

SEQ ID NO: 1796569 - RNA, 17 nt, Salmonella enterica enterica serovar Typhi Ty2
acuacguucaucaggca

SEQ ID NO: 1796570 - RNA, 14 nt, Salmonella enterica enterica serovar Typhi Ty2
acuacggcaaacac

SEQ ID NO: 1796571 - RNA, 17 nt, Salmonella enterica enterica serovar Typhi Ty2
acguucauccuccuucg

SEQ ID NO: 1796572 - RNA, 19 nt, Salmonella enterica enterica serovar Typhi Ty2
acguucaucaggccugcaa

SEQ ID NO: 1796573 - RNA, 23 nt, Salmonella enterica enterica serovar Typhi Ty2
acguucauccgaccacggccaca

SEQ ID NO: 1796574 - RNA, 14 nt, Salmonella enterica enterica serovar Typhi Ty2
acguucauccuccu

SEQ ID NO: 1796575 - RNA, 19 nt, Salmonella enterica enterica serovar Typhi Ty2
acguuccauggucucuuuu

SEQ ID NO: 1796576 - RNA, 17 nt, Salmonella enterica enterica serovar Typhi Ty2
acuaccggcaccagcaa

SEQ ID NO: 1796577 - RNA, 19 nt, Salmonella enterica enterica serovar Typhi Ty2
acguuccuucaggagaccu

SEQ ID NO: 1796578 - RNA, 21 nt, Salmonella enterica enterica serovar Typhi Ty2
acguucggcguguagccaauc

SEQ ID NO: 1796579 - RNA, 13 nt, Salmonella enterica enterica serovar Typhi Ty2
acuauuaaagcac

SEQ ID NO: 1796580 - RNA, 23 nt, Salmonella enterica enterica serovar Typhi Ty2
acucaaaccccagauuacugccc

SEQ ID NO: 1796581 - RNA, 14 nt, Salmonella enterica enterica serovar Typhi Ty2
acucaaagaaaaca

SEQ ID NO: 1796582 - RNA, 12 nt, Salmonella enterica enterica serovar Typhi Ty2
acucaaagaaaa

SEQ ID NO: 1796583 - RNA, 22 nt, Salmonella enterica enterica serovar Typhi Ty2
acuaugcuaauccgcugauuaa

SEQ ID NO: 1796584 - RNA, 14 nt, Salmonella enterica enterica serovar Typhi Ty2
acucaaucaggcua

SEQ ID NO: 1796585 - RNA, 14 nt, Salmonella enterica enterica serovar Typhi Ty2
acucaauaaaaguu

SEQ ID NO: 1796586 - RNA, 19 nt, Salmonella enterica enterica serovar Typhi Ty2
acucaagguagccacgccc

SEQ ID NO: 1796587 - RNA, 20 nt, Salmonella enterica enterica serovar Typhi Ty2
acucaaggcuauuagccaaa

SEQ ID NO: 1796588 - RNA, 22 nt, Salmonella enterica enterica serovar Typhi Ty2
acucaaggcuauuagccaaagc

SEQ ID NO: 1796589 - RNA, 20 nt, Salmonella enterica enterica serovar Typhi Ty2
acucaaccaaccaacccaaa

SEQ ID NO: 1796590 - RNA, 21 nt, Salmonella enterica enterica serovar Typhi Ty2
acucaaccaucaaaaaaaaua

SEQ ID NO: 1796591 - RNA, 18 nt, Salmonella enterica enterica serovar Typhi Ty2
acucacgacuuucaccag

SEQ ID NO: 1796592 - RNA, 19 nt, Salmonella enterica enterica serovar Typhi Ty2
acucaccugaugcgaugaa

SEQ ID NO: 1796593 - RNA, 17 nt, Salmonella enterica enterica serovar Typhi Ty2
acucaccgcuaauccca

SEQ ID NO: 1796594 - RNA, 19 nt, Salmonella enterica enterica serovar Typhi Ty2
acucacgacuuucaccaga

SEQ ID NO: 1796595 - RNA, 21 nt, Salmonella enterica enterica serovar Typhi Ty2
acucacgcgcgcuuuucgcca

SEQ ID NO: 1796596 - RNA, 12 nt, Salmonella enterica enterica serovar Typhi Ty2
acucacgggcgu

SEQ ID NO: 1796597 - RNA, 18 nt, Salmonella enterica enterica serovar Typhi Ty2
acucacguuccccagcac

SEQ ID NO: 1796598 - RNA, 19 nt, Salmonella enterica enterica serovar Typhi Ty2
acucacguuccccagcacc

SEQ ID NO: 1796599 - RNA, 19 nt, Salmonella enterica enterica serovar Typhi Ty2
acucaaugaauugaacuaa

SEQ ID NO: 1796600 - RNA, 24 nt, Salmonella enterica enterica serovar Typhi Ty2
acucacauaacaaaaccagcauca

SEQ ID NO: 1796601 - RNA, 13 nt, Salmonella enterica enterica serovar Typhi Ty2
agcaagaacagag

SEQ ID NO: 1796602 - RNA, 16 nt, Salmonella enterica enterica serovar Typhi Ty2
agcaagaacagagcaa

SEQ ID NO: 1796603 - RNA, 12 nt, Salmonella enterica enterica serovar Typhi Ty2
agcaagaacaga

SEQ ID NO: 1796604 - RNA, 14 nt, Salmonella enterica enterica serovar Typhi Ty2
agcaagauuucaaa

SEQ ID NO: 1796605 - RNA, 13 nt, Salmonella enterica enterica serovar Typhi Ty2
agcaaggcaagaa

SEQ ID NO: 1796606 - RNA, 19 nt, Salmonella enterica enterica serovar Typhi Ty2
agauuauuuuaucaucagc

SEQ ID NO: 1796607 - RNA, 22 nt, Salmonella enterica enterica serovar Typhi Ty2
agcaacgugaacugcgccugca

SEQ ID NO: 1796608 - RNA, 18 nt, Salmonella enterica enterica serovar Typhi Ty2
agcaacguuaaggccgca

SEQ ID NO: 1796609 - RNA, 23 nt, Salmonella enterica enterica serovar Typhi Ty2
agcaacguaaucccgccagccuu

SEQ ID NO: 1796610 - RNA, 22 nt, Salmonella enterica enterica serovar Typhi Ty2
agcaacuguuuuaccaaaucaa

SEQ ID NO: 1796611 - RNA, 15 nt, Salmonella enterica enterica serovar Typhi Ty2
agcaacuguagaaug

SEQ ID NO: 1796612 - RNA, 20 nt, Salmonella enterica enterica serovar Typhi Ty2
agcaaucagguauuuccugc

SEQ ID NO: 1796613 - RNA, 16 nt, Salmonella enterica enterica serovar Typhi Ty2
agcaaucacuuccgcc

SEQ ID NO: 1796614 - RNA, 14 nt, Salmonella enterica enterica serovar Typhi Ty2
agcaaucaguucuc

SEQ ID NO: 1796615 - RNA, 22 nt, Salmonella enterica enterica serovar Typhi Ty2
agcaauauuuuguaguuguuuu

SEQ ID NO: 1796616 - RNA, 15 nt, Salmonella enterica enterica serovar Typhi Ty2
agcaauauuuuuccg

SEQ ID NO: 1796617 - RNA, 13 nt, Salmonella enterica enterica serovar Typhi Ty2
agcaaugauuuua

SEQ ID NO: 1796618 - RNA, 14 nt, Salmonella enterica enterica serovar Typhi Ty2
agcaaugauuuuua

SEQ ID NO: 1796619 - RNA, 15 nt, Salmonella enterica enterica serovar Typhi Ty2
agcaaugauuuuuag

SEQ ID NO: 1796620 - RNA, 20 nt, Salmonella enterica enterica serovar Typhi Ty2
agcaaugcgaauaacaucau

SEQ ID NO: 1796621 - RNA, 20 nt, Salmonella enterica enterica serovar Typhi Ty2
agcaaugcccaaaauagcgu

SEQ ID NO: 1796622 - RNA, 16 nt, Salmonella enterica enterica serovar Typhi Ty2
agcaaugcccaaaaua

SEQ ID NO: 1796623 - RNA, 21 nt, Salmonella enterica enterica serovar Typhi Ty2
agcaauugccauaaaaacaau

SEQ ID NO: 1796624 - RNA, 19 nt, Salmonella enterica enterica serovar Typhi Ty2
agcaauuucagcauccucc

SEQ ID NO: 1796625 - RNA, 17 nt, Salmonella enterica enterica serovar Typhi Ty2
agcaaugugcgccagaa

SEQ ID NO: 1796626 - RNA, 22 nt, Salmonella enterica enterica serovar Typhi Ty2
agcaauuaauauuuaacacauu

SEQ ID NO: 1796627 - RNA, 19 nt, Salmonella enterica enterica serovar Typhi Ty2
agcaauuucucgcccgcca

SEQ ID NO: 1796628 - RNA, 18 nt, Salmonella enterica enterica serovar Typhi Ty2
agcacaacgaguccccuc

SEQ ID NO: 1796629 - RNA, 20 nt, Salmonella enterica enterica serovar Typhi Ty2
agcacaauaacgaccccaau

SEQ ID NO: 1796630 - RNA, 21 nt, Salmonella enterica enterica serovar Typhi Ty2
agcacaagaacuuaaauuaau

SEQ ID NO: 1796631 - RNA, 15 nt, Salmonella enterica enterica serovar Typhi Ty2
agcacaccauuucac

SEQ ID NO: 1796632 - RNA, 20 nt, Salmonella enterica enterica serovar Typhi Ty2
agcagaagacggaaaccaga

SEQ ID NO: 1796633 - RNA, 21 nt, Salmonella enterica enterica serovar Typhi Ty2
agcagaacuggcgcgaugacu

SEQ ID NO: 1796634 - RNA, 13 nt, Salmonella enterica enterica serovar Typhi Ty2
agcacuucuccac

SEQ ID NO: 1796635 - RNA, 21 nt, Salmonella enterica enterica serovar Typhi Ty2
aaaaccggaauuuguugguuu

SEQ ID NO: 1796636 - RNA, 23 nt, Salmonella enterica enterica serovar Typhi Ty2
aaaaccggcauacacgccgggca

SEQ ID NO: 1796637 - RNA, 13 nt, Salmonella enterica enterica serovar Typhi Ty2
agcagacagguga

SEQ ID NO: 1796638 - RNA, 14 nt, Salmonella enterica enterica serovar Typhi Ty2
agcagacaggugaa

SEQ ID NO: 1796639 - RNA, 14 nt, Salmonella enterica enterica serovar Typhi Ty2
aaaaccguucugag

SEQ ID NO: 1796640 - RNA, 14 nt, Salmonella enterica enterica serovar Typhi Ty2
aaaaccggcccagc

SEQ ID NO: 1796641 - RNA, 18 nt, Salmonella enterica enterica serovar Typhi Ty2
agcacuucacccaucgcc

SEQ ID NO: 1796642 - RNA, 16 nt, Salmonella enterica enterica serovar Typhi Ty2
agcacuuccggaucgc

SEQ ID NO: 1796643 - RNA, 23 nt, Salmonella enterica enterica serovar Typhi Ty2
agcacugucccagggccaaacug

SEQ ID NO: 1796644 - RNA, 17 nt, Salmonella enterica enterica serovar Typhi Ty2
agcacgguaaaccucuu

SEQ ID NO: 1796645 - RNA, 21 nt, Salmonella enterica enterica serovar Typhi Ty2
agcacgcggaagaaauagaac

SEQ ID NO: 1796646 - RNA, 16 nt, Salmonella enterica enterica serovar Typhi Ty2
agcaccgccgggaaga

SEQ ID NO: 1796647 - RNA, 18 nt, Salmonella enterica enterica serovar Typhi Ty2
agcaccgauccaauauua

SEQ ID NO: 1796648 - RNA, 20 nt, Salmonella enterica enterica serovar Typhi Ty2
agcaccggauacaagguauc

SEQ ID NO: 1796649 - RNA, 19 nt, Salmonella enterica enterica serovar Typhi Ty2
agcacgaccuuuucuucau

SEQ ID NO: 1796650 - RNA, 14 nt, Salmonella enterica enterica serovar Typhi Ty2
agcacauccucaau

SEQ ID NO: 1796651 - RNA, 12 nt, Salmonella enterica enterica serovar Typhi Ty2
agcacauccaug

SEQ ID NO: 1796652 - RNA, 22 nt, Salmonella enterica enterica serovar Typhi Ty2
agcacauuacaggcaucuucca

SEQ ID NO: 1796653 - RNA, 15 nt, Salmonella enterica enterica serovar Typhi Ty2
agcacauucagcagc

SEQ ID NO: 1796654 - RNA, 12 nt, Salmonella enterica enterica serovar Typhi Ty2
agcaccaccugc

SEQ ID NO: 1796655 - RNA, 19 nt, Salmonella enterica enterica serovar Typhi Ty2
agcacaccauuucacaaau

SEQ ID NO: 1796656 - RNA, 12 nt, Salmonella enterica enterica serovar Typhi Ty2
agcacacgcauc

SEQ ID NO: 1796657 - RNA, 16 nt, Salmonella enterica enterica serovar Typhi Ty2
agcacaccauuucaca

SEQ ID NO: 1796658 - RNA, 16 nt, Salmonella enterica enterica serovar Typhi Ty2
agcacagcccaguaau

SEQ ID NO: 1796659 - RNA, 13 nt, Salmonella enterica enterica serovar Typhi Ty2
agcacagcccuac

SEQ ID NO: 1796660 - RNA, 22 nt, Salmonella enterica enterica serovar Typhi Ty2
agcacaucagccguaucuuccg

SEQ ID NO: 1796661 - RNA, 12 nt, Salmonella enterica enterica serovar Typhi Ty2
agcacaggccau

SEQ ID NO: 1796662 - RNA, 17 nt, Salmonella enterica enterica serovar Typhi Ty2
agcacagcucuaauuga

SEQ ID NO: 1796663 - RNA, 12 nt, Salmonella enterica enterica serovar Typhi Ty2
agcaccagcauu

SEQ ID NO: 1796664 - RNA, 12 nt, Salmonella enterica enterica serovar Typhi Ty2
agcaccaucaug

SEQ ID NO: 1796665 - RNA, 18 nt, Salmonella enterica enterica serovar Typhi Ty2
agcaccagaccgacaagc

SEQ ID NO: 1796666 - RNA, 13 nt, Salmonella enterica enterica serovar Typhi Ty2
agcaccagcagug

SEQ ID NO: 1796667 - RNA, 13 nt, Salmonella enterica enterica serovar Typhi Ty2
agcaccagcagcg

SEQ ID NO: 1796668 - RNA, 19 nt, Salmonella enterica enterica serovar Typhi Ty2
agccaaacacuuccccugc

SEQ ID NO: 1796669 - RNA, 15 nt, Salmonella enterica enterica serovar Typhi Ty2
agccaaacacuuccc

SEQ ID NO: 1796670 - RNA, 12 nt, Salmonella enterica enterica serovar Typhi Ty2
agccaaacacuu

SEQ ID NO: 1796671 - RNA, 16 nt, Salmonella enterica enterica serovar Typhi Ty2
agcauuuuucacaguu

SEQ ID NO: 1796672 - RNA, 18 nt, Salmonella enterica enterica serovar Typhi Ty2
agcauuuccgcagccaac

SEQ ID NO: 1796673 - RNA, 12 nt, Salmonella enterica enterica serovar Typhi Ty2
agcauuuguagc

SEQ ID NO: 1796674 - RNA, 18 nt, Salmonella enterica enterica serovar Typhi Ty2
agcauugccguuuucaau

SEQ ID NO: 1796675 - RNA, 19 nt, Salmonella enterica enterica serovar Typhi Ty2
agcauugggccgauaaagc

SEQ ID NO: 1796676 - RNA, 13 nt, Salmonella enterica enterica serovar Typhi Ty2
agcauuuccagcu

SEQ ID NO: 1796677 - RNA, 20 nt, Salmonella enterica enterica serovar Typhi Ty2
agcauugcuucgucccugca

SEQ ID NO: 1796678 - RNA, 21 nt, Salmonella enterica enterica serovar Typhi Ty2
agcauuguaggggcuuaucuc

SEQ ID NO: 1796679 - RNA, 15 nt, Salmonella enterica enterica serovar Typhi Ty2
agcauuguauuucag

SEQ ID NO: 1796680 - RNA, 14 nt, Salmonella enterica enterica serovar Typhi Ty2
agcaucugcggcuu

SEQ ID NO: 1796681 - RNA, 18 nt, Salmonella enterica enterica serovar Typhi Ty2
agcaucugauagcccauc

SEQ ID NO: 1796682 - RNA, 14 nt, Salmonella enterica enterica serovar Typhi Ty2
agcauuauuuuuaa

SEQ ID NO: 1796683 - RNA, 15 nt, Salmonella enterica enterica serovar Typhi Ty2
agcauuauuuuuaac

SEQ ID NO: 1796684 - RNA, 14 nt, Salmonella enterica enterica serovar Typhi Ty2
agcauuaaaucauc

SEQ ID NO: 1796685 - RNA, 22 nt, Salmonella enterica enterica serovar Typhi Ty2
agccacggcguguugaaauccu

SEQ ID NO: 1796686 - RNA, 16 nt, Salmonella enterica enterica serovar Typhi Ty2
agccacguaaagacga

SEQ ID NO: 1796687 - RNA, 19 nt, Salmonella enterica enterica serovar Typhi Ty2
agccacgucugaugcgugg

SEQ ID NO: 1796688 - RNA, 22 nt, Salmonella enterica enterica serovar Typhi Ty2
agccagccguugugcugguuga

SEQ ID NO: 1796689 - RNA, 18 nt, Salmonella enterica enterica serovar Typhi Ty2
agccagcauuuccagcug

SEQ ID NO: 1796690 - RNA, 23 nt, Salmonella enterica enterica serovar Typhi Ty2
agccacuucaugcgcuuuuucac

SEQ ID NO: 1796691 - RNA, 14 nt, Salmonella enterica enterica serovar Typhi Ty2
agccaaacugcugu

SEQ ID NO: 1796692 - RNA, 18 nt, Salmonella enterica enterica serovar Typhi Ty2
agccaaacuccucacugc

SEQ ID NO: 1796693 - RNA, 19 nt, Salmonella enterica enterica serovar Typhi Ty2
agccaaacucugaaaaaau

SEQ ID NO: 1796694 - RNA, 19 nt, Salmonella enterica enterica serovar Typhi Ty2
agccaaauagcgccagaca

SEQ ID NO: 1796695 - RNA, 18 nt, Salmonella enterica enterica serovar Typhi Ty2
agccaauaaucaaaugau

SEQ ID NO: 1796696 - RNA, 12 nt, Salmonella enterica enterica serovar Typhi Ty2
agccaauaauca

SEQ ID NO: 1796697 - RNA, 21 nt, Salmonella enterica enterica serovar Typhi Ty2
agccacacgacgguauuggua

SEQ ID NO: 1796698 - RNA, 17 nt, Salmonella enterica enterica serovar Typhi Ty2
agccacaagagcagcaa

SEQ ID NO: 1796699 - RNA, 23 nt, Salmonella enterica enterica serovar Typhi Ty2
agccacaaugggggcauaauacg

SEQ ID NO: 1796700 - RNA, 19 nt, Salmonella enterica enterica serovar Typhi Ty2
agccaaucagccccagcac

SEQ ID NO: 1796701 - RNA, 21 nt, Salmonella enterica enterica serovar Typhi Ty2
agcaggugcggacugggcuga

SEQ ID NO: 1796702 - RNA, 13 nt, Salmonella enterica enterica serovar Typhi Ty2
agcaggugcggcu

SEQ ID NO: 1796703 - RNA, 16 nt, Salmonella enterica enterica serovar Typhi Ty2
agcaguucagcagcac

SEQ ID NO: 1796704 - RNA, 14 nt, Salmonella enterica enterica serovar Typhi Ty2
agcaguucagcagc

SEQ ID NO: 1796705 - RNA, 15 nt, Salmonella enterica enterica serovar Typhi Ty2
agcaguuccagcauc

SEQ ID NO: 1796706 - RNA, 17 nt, Salmonella enterica enterica serovar Typhi Ty2
agcaguucgauaauccc

SEQ ID NO: 1796707 - RNA, 13 nt, Salmonella enterica enterica serovar Typhi Ty2
agcauaaaaagac

SEQ ID NO: 1796708 - RNA, 21 nt, Salmonella enterica enterica serovar Typhi Ty2
agcaguuuuaucuaugugugg

SEQ ID NO: 1796709 - RNA, 21 nt, Salmonella enterica enterica serovar Typhi Ty2
agcauccgggauauaaaauua

SEQ ID NO: 1796710 - RNA, 16 nt, Salmonella enterica enterica serovar Typhi Ty2
agcaucaauagcagcu

SEQ ID NO: 1796711 - RNA, 14 nt, Salmonella enterica enterica serovar Typhi Ty2
agcauauccagcgc

SEQ ID NO: 1796712 - RNA, 20 nt, Salmonella enterica enterica serovar Typhi Ty2
agcagggcaugauuacagau

SEQ ID NO: 1796713 - RNA, 15 nt, Salmonella enterica enterica serovar Typhi Ty2
agcagcuuggcggcu

SEQ ID NO: 1796714 - RNA, 14 nt, Salmonella enterica enterica serovar Typhi Ty2
agcagcgcaucaug

SEQ ID NO: 1796715 - RNA, 15 nt, Salmonella enterica enterica serovar Typhi Ty2
agcaggaacggcagg

SEQ ID NO: 1796716 - RNA, 20 nt, Salmonella enterica enterica serovar Typhi Ty2
agcagcugcuuaacuucugc

SEQ ID NO: 1796717 - RNA, 13 nt, Salmonella enterica enterica serovar Typhi Ty2
agcagcuucagca

SEQ ID NO: 1796718 - RNA, 15 nt, Salmonella enterica enterica serovar Typhi Ty2
agcagcgcaccugcc

SEQ ID NO: 1796719 - RNA, 20 nt, Salmonella enterica enterica serovar Typhi Ty2
agcagacucauggacaaaaa

SEQ ID NO: 1796720 - RNA, 14 nt, Salmonella enterica enterica serovar Typhi Ty2
aaaaccuccggcua

SEQ ID NO: 1796721 - RNA, 18 nt, Salmonella enterica enterica serovar Typhi Ty2
aaaaccuucauaaauacg

SEQ ID NO: 1796722 - RNA, 17 nt, Salmonella enterica enterica serovar Typhi Ty2
agcgcguaggccagaug

SEQ ID NO: 1796723 - RNA, 19 nt, Salmonella enterica enterica serovar Typhi Ty2
agcgcgguuucuauuaaau

SEQ ID NO: 1796724 - RNA, 21 nt, Salmonella enterica enterica serovar Typhi Ty2
agcgcguaaauaccuucuggc

SEQ ID NO: 1796725 - RNA, 18 nt, Salmonella enterica enterica serovar Typhi Ty2
agcgcgucagcgccuccg

SEQ ID NO: 1796726 - RNA, 13 nt, Salmonella enterica enterica serovar Typhi Ty2
agcgcgucaaugg

SEQ ID NO: 1796727 - RNA, 22 nt, Salmonella enterica enterica serovar Typhi Ty2
agcgcuccaccaaccaggcaaa

SEQ ID NO: 1796728 - RNA, 14 nt, Salmonella enterica enterica serovar Typhi Ty2
agcgcucaggcagc

SEQ ID NO: 1796729 - RNA, 18 nt, Salmonella enterica enterica serovar Typhi Ty2
agcgcuccgggguucuuu

SEQ ID NO: 1796730 - RNA, 16 nt, Salmonella enterica enterica serovar Typhi Ty2
agcgcgcguagcagca

SEQ ID NO: 1796731 - RNA, 23 nt, Salmonella enterica enterica serovar Typhi Ty2
agcgcggaagccacguucuucca

SEQ ID NO: 1796732 - RNA, 16 nt, Salmonella enterica enterica serovar Typhi Ty2
agcgcgcucugccuuu

SEQ ID NO: 1796733 - RNA, 19 nt, Salmonella enterica enterica serovar Typhi Ty2
agcgcggcgugaucaaauu

SEQ ID NO: 1796734 - RNA, 13 nt, Salmonella enterica enterica serovar Typhi Ty2
agcgcggcaagga

SEQ ID NO: 1796735 - RNA, 16 nt, Salmonella enterica enterica serovar Typhi Ty2
agcgcggcagcagcuu

SEQ ID NO: 1796736 - RNA, 16 nt, Salmonella enterica enterica serovar Typhi Ty2
agcgccgcgccuacca

SEQ ID NO: 1796737 - RNA, 19 nt, Salmonella enterica enterica serovar Typhi Ty2
agcgccggaucgggcuucc

SEQ ID NO: 1796738 - RNA, 20 nt, Salmonella enterica enterica serovar Typhi Ty2
agcgccggaugaggacauaa

SEQ ID NO: 1796739 - RNA, 15 nt, Salmonella enterica enterica serovar Typhi Ty2
agcgccggcagcagu

SEQ ID NO: 1796740 - RNA, 19 nt, Salmonella enterica enterica serovar Typhi Ty2
agcgccgucauaccgccca

SEQ ID NO: 1796741 - RNA, 20 nt, Salmonella enterica enterica serovar Typhi Ty2
agcgccggcagcaguucuuc

SEQ ID NO: 1796742 - RNA, 18 nt, Salmonella enterica enterica serovar Typhi Ty2
agcgccguuaaacugcgc

SEQ ID NO: 1796743 - RNA, 20 nt, Salmonella enterica enterica serovar Typhi Ty2
agcgccgucgccaucaccag

SEQ ID NO: 1796744 - RNA, 16 nt, Salmonella enterica enterica serovar Typhi Ty2
agcgccguuaaacugc

SEQ ID NO: 1796745 - RNA, 20 nt, Salmonella enterica enterica serovar Typhi Ty2
agcgcgcagcugggccugcu

SEQ ID NO: 1796746 - RNA, 20 nt, Salmonella enterica enterica serovar Typhi Ty2
agcgcgagagucaaggcauc

SEQ ID NO: 1796747 - RNA, 22 nt, Salmonella enterica enterica serovar Typhi Ty2
agcgcgaucgccccgaccagga

SEQ ID NO: 1796748 - RNA, 21 nt, Salmonella enterica enterica serovar Typhi Ty2
agcgcgauacgcagcaccgcc

SEQ ID NO: 1796749 - RNA, 16 nt, Salmonella enterica enterica serovar Typhi Ty2
agcgccgccagauaaa

SEQ ID NO: 1796750 - RNA, 17 nt, Salmonella enterica enterica serovar Typhi Ty2
agcgccgccagauaaag

SEQ ID NO: 1796751 - RNA, 22 nt, Salmonella enterica enterica serovar Typhi Ty2
agcgcccgguucaucggcucga

SEQ ID NO: 1796752 - RNA, 17 nt, Salmonella enterica enterica serovar Typhi Ty2
agcgccaugaagauggu

SEQ ID NO: 1796753 - RNA, 17 nt, Salmonella enterica enterica serovar Typhi Ty2
agcgccacccauuuucc

SEQ ID NO: 1796754 - RNA, 13 nt, Salmonella enterica enterica serovar Typhi Ty2
agcgccauugcua

SEQ ID NO: 1796755 - RNA, 14 nt, Salmonella enterica enterica serovar Typhi Ty2
agcgccacccgaca

SEQ ID NO: 1796756 - RNA, 14 nt, Salmonella enterica enterica serovar Typhi Ty2
agcgccaaucacua

SEQ ID NO: 1796757 - RNA, 21 nt, Salmonella enterica enterica serovar Typhi Ty2
agcgcauugcgccccagcaca

SEQ ID NO: 1796758 - RNA, 16 nt, Salmonella enterica enterica serovar Typhi Ty2
agcgcauuugcggcgu

SEQ ID NO: 1796759 - RNA, 18 nt, Salmonella enterica enterica serovar Typhi Ty2
agcgcagagugaccagcg

SEQ ID NO: 1796760 - RNA, 13 nt, Salmonella enterica enterica serovar Typhi Ty2
agcgcagcaaaac

SEQ ID NO: 1796761 - RNA, 20 nt, Salmonella enterica enterica serovar Typhi Ty2
agcgcagcgccaucaggcac

SEQ ID NO: 1796762 - RNA, 22 nt, Salmonella enterica enterica serovar Typhi Ty2
agcgaccacgccaccgccgcca

SEQ ID NO: 1796763 - RNA, 22 nt, Salmonella enterica enterica serovar Typhi Ty2
agcgcaccugccccgcucgaaa

SEQ ID NO: 1796764 - RNA, 13 nt, Salmonella enterica enterica serovar Typhi Ty2
agcggguaaacag

SEQ ID NO: 1796765 - RNA, 15 nt, Salmonella enterica enterica serovar Typhi Ty2
agcggccagauggca

SEQ ID NO: 1796766 - RNA, 23 nt, Salmonella enterica enterica serovar Typhi Ty2
agcggcgauuuauagagcagcac

SEQ ID NO: 1796767 - RNA, 19 nt, Salmonella enterica enterica serovar Typhi Ty2
agcggcgcagacacugcca

SEQ ID NO: 1796768 - RNA, 16 nt, Salmonella enterica enterica serovar Typhi Ty2
agcggucaucaaugau

SEQ ID NO: 1796769 - RNA, 20 nt, Salmonella enterica enterica serovar Typhi Ty2
agcggucggagguucgaauc

SEQ ID NO: 1796770 - RNA, 17 nt, Salmonella enterica enterica serovar Typhi Ty2
agcguagcgccaucagg

SEQ ID NO: 1796771 - RNA, 14 nt, Salmonella enterica enterica serovar Typhi Ty2
agcguaguccaggu

SEQ ID NO: 1796772 - RNA, 18 nt, Salmonella enterica enterica serovar Typhi Ty2
agcguagaccgcccagga

SEQ ID NO: 1796773 - RNA, 16 nt, Salmonella enterica enterica serovar Typhi Ty2
agcguaccggccacaa

SEQ ID NO: 1796774 - RNA, 15 nt, Salmonella enterica enterica serovar Typhi Ty2
agcguaucgccggcg

SEQ ID NO: 1796775 - RNA, 14 nt, Salmonella enterica enterica serovar Typhi Ty2
agcguauccagcac

SEQ ID NO: 1796776 - RNA, 15 nt, Salmonella enterica enterica serovar Typhi Ty2
agcguauugagcugg

SEQ ID NO: 1796777 - RNA, 19 nt, Salmonella enterica enterica serovar Typhi Ty2
agcgcugaggcgcuggcuu

SEQ ID NO: 1796778 - RNA, 20 nt, Salmonella enterica enterica serovar Typhi Ty2
agcgcuggcauuccccaucg

SEQ ID NO: 1796779 - RNA, 19 nt, Salmonella enterica enterica serovar Typhi Ty2
agcgcuggagaaugggauu

SEQ ID NO: 1796780 - RNA, 16 nt, Salmonella enterica enterica serovar Typhi Ty2
agcgcuucuaacgaaa

SEQ ID NO: 1796781 - RNA, 22 nt, Salmonella enterica enterica serovar Typhi Ty2
agcgcuucuaacgaaacagauu

SEQ ID NO: 1796782 - RNA, 15 nt, Salmonella enterica enterica serovar Typhi Ty2
agcgcuucucuuucc

SEQ ID NO: 1796783 - RNA, 16 nt, Salmonella enterica enterica serovar Typhi Ty2
agcgcuucgccugccg

SEQ ID NO: 1796784 - RNA, 22 nt, Salmonella enterica enterica serovar Typhi Ty2
  misc_feature (9)..(9): n is a, c, g or u
agcgcuuanccgaccgacaaaa

SEQ ID NO: 1796785 - RNA, 23 nt, Salmonella enterica enterica serovar Typhi Ty2
agcgcuuaccacuuugcgcuccu

SEQ ID NO: 1796786 - RNA, 16 nt, Salmonella enterica enterica serovar Typhi Ty2
agcgcuuuuuuuaugc

SEQ ID NO: 1796787 - RNA, 22 nt, Salmonella enterica enterica serovar Typhi Ty2
agcgcuuuccugcguauauuua

SEQ ID NO: 1796788 - RNA, 16 nt, Salmonella enterica enterica serovar Typhi Ty2
agcgcuuucuucuuca

SEQ ID NO: 1796789 - RNA, 14 nt, Salmonella enterica enterica serovar Typhi Ty2
agcgcuugugccug

SEQ ID NO: 1796790 - RNA, 16 nt, Salmonella enterica enterica serovar Typhi Ty2
agcgcuuugccgcugc

SEQ ID NO: 1796791 - RNA, 23 nt, Salmonella enterica enterica serovar Typhi Ty2
agcggaaaauauucagcacauca

SEQ ID NO: 1796792 - RNA, 14 nt, Salmonella enterica enterica serovar Typhi Ty2
agcggcaacagcac

SEQ ID NO: 1796793 - RNA, 12 nt, Salmonella enterica enterica serovar Typhi Ty2
agcggauucuuc

SEQ ID NO: 1796794 - RNA, 20 nt, Salmonella enterica enterica serovar Typhi Ty2
agcggaucgcguccauuacu

SEQ ID NO: 1796795 - RNA, 20 nt, Salmonella enterica enterica serovar Typhi Ty2
agcggaaucgcuuccugggu

SEQ ID NO: 1796796 - RNA, 22 nt, Salmonella enterica enterica serovar Typhi Ty2
agcggcaaggaaaaccaguaac

SEQ ID NO: 1796797 - RNA, 21 nt, Salmonella enterica enterica serovar Typhi Ty2
agcggcagaucguuuacgacc

SEQ ID NO: 1796798 - RNA, 22 nt, Salmonella enterica enterica serovar Typhi Ty2
agcggcagaucguuuacgaccu

SEQ ID NO: 1796799 - RNA, 16 nt, Salmonella enterica enterica serovar Typhi Ty2
agccguuacuuccccc

SEQ ID NO: 1796800 - RNA, 21 nt, Salmonella enterica enterica serovar Typhi Ty2
agccgucgauaaaauccucua

SEQ ID NO: 1796801 - RNA, 18 nt, Salmonella enterica enterica serovar Typhi Ty2
agccguuuugcugucugg

SEQ ID NO: 1796802 - RNA, 16 nt, Salmonella enterica enterica serovar Typhi Ty2
agccuaccugccgcca

SEQ ID NO: 1796803 - RNA, 21 nt, Salmonella enterica enterica serovar Typhi Ty2
agccgguguuaaccagauaag

SEQ ID NO: 1796804 - RNA, 19 nt, Salmonella enterica enterica serovar Typhi Ty2
agccguaacgagugaggac

SEQ ID NO: 1796805 - RNA, 19 nt, Salmonella enterica enterica serovar Typhi Ty2
agccguaacuaugccagaa

SEQ ID NO: 1796806 - RNA, 23 nt, Salmonella enterica enterica serovar Typhi Ty2
agcgaagcgucauccggcaauca

SEQ ID NO: 1796807 - RNA, 14 nt, Salmonella enterica enterica serovar Typhi Ty2
agcgaaccuuccau

SEQ ID NO: 1796808 - RNA, 22 nt, Salmonella enterica enterica serovar Typhi Ty2
agcgaaggggcgggcagcagca

SEQ ID NO: 1796809 - RNA, 17 nt, Salmonella enterica enterica serovar Typhi Ty2
agcgacacuccgcgcau

SEQ ID NO: 1796810 - RNA, 13 nt, Salmonella enterica enterica serovar Typhi Ty2
agcgaacagucca

SEQ ID NO: 1796811 - RNA, 19 nt, Salmonella enterica enterica serovar Typhi Ty2
agcgaaaugcgaauccggc

SEQ ID NO: 1796812 - RNA, 21 nt, Salmonella enterica enterica serovar Typhi Ty2
agcgaaaugacggccaccagc

SEQ ID NO: 1796813 - RNA, 19 nt, Salmonella enterica enterica serovar Typhi Ty2
agccuuccuggucugccag

SEQ ID NO: 1796814 - RNA, 15 nt, Salmonella enterica enterica serovar Typhi Ty2
agccuuccuggucug

SEQ ID NO: 1796815 - RNA, 22 nt, Salmonella enterica enterica serovar Typhi Ty2
agccuucccggggaacagaagc

SEQ ID NO: 1796816 - RNA, 15 nt, Salmonella enterica enterica serovar Typhi Ty2
agccuucuccccuuc

SEQ ID NO: 1796817 - RNA, 14 nt, Salmonella enterica enterica serovar Typhi Ty2
agccuugcgcuauu

SEQ ID NO: 1796818 - RNA, 23 nt, Salmonella enterica enterica serovar Typhi Ty2
agccuuacaggcgcaucagaaaa

SEQ ID NO: 1796819 - RNA, 21 nt, Salmonella enterica enterica serovar Typhi Ty2
agccuuacaggcgcaucagaa

SEQ ID NO: 1796820 - RNA, 22 nt, Salmonella enterica enterica serovar Typhi Ty2
agccuuaaucaacugcgccaca

SEQ ID NO: 1796821 - RNA, 23 nt, Salmonella enterica enterica serovar Typhi Ty2
agccuucaauuugaccugaccug

SEQ ID NO: 1796822 - RNA, 11 nt, Salmonella enterica enterica serovar Typhi Ty2
agccucuuuca

SEQ ID NO: 1796823 - RNA, 23 nt, Salmonella enterica enterica serovar Typhi Ty2
agccucauuuuugaguuugucau

SEQ ID NO: 1796824 - RNA, 20 nt, Salmonella enterica enterica serovar Typhi Ty2
agccgcgccaucuccuccuc

SEQ ID NO: 1796825 - RNA, 16 nt, Salmonella enterica enterica serovar Typhi Ty2
agccgcggaccuuuug

SEQ ID NO: 1796826 - RNA, 20 nt, Salmonella enterica enterica serovar Typhi Ty2
agccgcggcgcuuucgccac

SEQ ID NO: 1796827 - RNA, 21 nt, Salmonella enterica enterica serovar Typhi Ty2
agccgcgccaucuccuccuca

SEQ ID NO: 1796828 - RNA, 16 nt, Salmonella enterica enterica serovar Typhi Ty2
agccgcgcauagcugg

SEQ ID NO: 1796829 - RNA, 21 nt, Salmonella enterica enterica serovar Typhi Ty2
agccgcccugcggacaggcga

SEQ ID NO: 1796830 - RNA, 13 nt, Salmonella enterica enterica serovar Typhi Ty2
agccgcccggcgc

SEQ ID NO: 1796831 - RNA, 14 nt, Salmonella enterica enterica serovar Typhi Ty2
agccgcccacaacc

SEQ ID NO: 1796832 - RNA, 16 nt, Salmonella enterica enterica serovar Typhi Ty2
agccgccauccggcac

SEQ ID NO: 1796833 - RNA, 21 nt, Salmonella enterica enterica serovar Typhi Ty2
agccgccauccggcacaguau

SEQ ID NO: 1796834 - RNA, 22 nt, Salmonella enterica enterica serovar Typhi Ty2
agccgccggugacggcggaaga

SEQ ID NO: 1796835 - RNA, 19 nt, Salmonella enterica enterica serovar Typhi Ty2
agccggaaucauucuacaa

SEQ ID NO: 1796836 - RNA, 18 nt, Salmonella enterica enterica serovar Typhi Ty2
agccgcuguuuuucauca

SEQ ID NO: 1796837 - RNA, 21 nt, Salmonella enterica enterica serovar Typhi Ty2
agccggcgauagcgccccaaa

SEQ ID NO: 1796838 - RNA, 21 nt, Salmonella enterica enterica serovar Typhi Ty2
agcccuauuaggcacuaccac

SEQ ID NO: 1796839 - RNA, 20 nt, Salmonella enterica enterica serovar Typhi Ty2
agcccuauuaggcacuacca

SEQ ID NO: 1796840 - RNA, 17 nt, Salmonella enterica enterica serovar Typhi Ty2
agcccuauaacagcgcu

SEQ ID NO: 1796841 - RNA, 21 nt, Salmonella enterica enterica serovar Typhi Ty2
agcccggaaauaaacgccagu

SEQ ID NO: 1796842 - RNA, 21 nt, Salmonella enterica enterica serovar Typhi Ty2
agcccggcauguccaucagau

SEQ ID NO: 1796843 - RNA, 17 nt, Salmonella enterica enterica serovar Typhi Ty2
agcccggccacagcgcc

SEQ ID NO: 1796844 - RNA, 18 nt, Salmonella enterica enterica serovar Typhi Ty2
agcccggccacagcgcca

SEQ ID NO: 1796845 - RNA, 22 nt, Salmonella enterica enterica serovar Typhi Ty2
agcccggccacagcgccagaca

SEQ ID NO: 1796846 - RNA, 22 nt, Salmonella enterica enterica serovar Typhi Ty2
agccagguauuuagccacgccg

SEQ ID NO: 1796847 - RNA, 20 nt, Salmonella enterica enterica serovar Typhi Ty2
agccagguugcgcccggcgc

SEQ ID NO: 1796848 - RNA, 19 nt, Salmonella enterica enterica serovar Typhi Ty2
agccagguggcaauauccu

SEQ ID NO: 1796849 - RNA, 19 nt, Salmonella enterica enterica serovar Typhi Ty2
agccaggcuuuaaauucag

SEQ ID NO: 1796850 - RNA, 17 nt, Salmonella enterica enterica serovar Typhi Ty2
agccaggcgauugucac

SEQ ID NO: 1796851 - RNA, 13 nt, Salmonella enterica enterica serovar Typhi Ty2
agccaggccgcca

SEQ ID NO: 1796852 - RNA, 19 nt, Salmonella enterica enterica serovar Typhi Ty2
agccaguagcuggugacuu

SEQ ID NO: 1796853 - RNA, 17 nt, Salmonella enterica enterica serovar Typhi Ty2
agccaguccugccacca

SEQ ID NO: 1796854 - RNA, 15 nt, Salmonella enterica enterica serovar Typhi Ty2
agccagguuuugcuc

SEQ ID NO: 1796855 - RNA, 19 nt, Salmonella enterica enterica serovar Typhi Ty2
agccgaccaucgcgccgcu

SEQ ID NO: 1796856 - RNA, 21 nt, Salmonella enterica enterica serovar Typhi Ty2
agccgaccaucgcgccgcugg

SEQ ID NO: 1796857 - RNA, 23 nt, Salmonella enterica enterica serovar Typhi Ty2
agcccuuugagaaaacugcgccc

SEQ ID NO: 1796858 - RNA, 15 nt, Salmonella enterica enterica serovar Typhi Ty2
agccgaacucuucca

SEQ ID NO: 1796859 - RNA, 15 nt, Salmonella enterica enterica serovar Typhi Ty2
acuuguucuucuguu

SEQ ID NO: 1796860 - RNA, 16 nt, Salmonella enterica enterica serovar Typhi Ty2
acuuaucaguaacaga

SEQ ID NO: 1796861 - RNA, 23 nt, Salmonella enterica enterica serovar Typhi Ty2
acuuggaaaguugcgccgugccu

SEQ ID NO: 1796862 - RNA, 13 nt, Salmonella enterica enterica serovar Typhi Ty2
acuuuacugaaua

SEQ ID NO: 1796863 - RNA, 13 nt, Salmonella enterica enterica serovar Typhi Ty2
acuuuaucaccag

SEQ ID NO: 1796864 - RNA, 13 nt, Salmonella enterica enterica serovar Typhi Ty2
acuuuauuuuucg

SEQ ID NO: 1796865 - RNA, 16 nt, Salmonella enterica enterica serovar Typhi Ty2
acuuuccaaaauccag

SEQ ID NO: 1796866 - RNA, 17 nt, Salmonella enterica enterica serovar Typhi Ty2
acuuuccaaaauccagg

SEQ ID NO: 1796867 - RNA, 17 nt, Salmonella enterica enterica serovar Typhi Ty2
acuuuccagcaacugac

SEQ ID NO: 1796868 - RNA, 17 nt, Salmonella enterica enterica serovar Typhi Ty2
acuuucagauuuuuaau

SEQ ID NO: 1796869 - RNA, 20 nt, Salmonella enterica enterica serovar Typhi Ty2
acuuuacccacaucaaucac

SEQ ID NO: 1796870 - RNA, 17 nt, Salmonella enterica enterica serovar Typhi Ty2
acuuuaccgccguuagc

SEQ ID NO: 1796871 - RNA, 14 nt, Salmonella enterica enterica serovar Typhi Ty2
acuuuaagcggcag

SEQ ID NO: 1796872 - RNA, 17 nt, Salmonella enterica enterica serovar Typhi Ty2
agaaaauggucugccag

SEQ ID NO: 1796873 - RNA, 17 nt, Salmonella enterica enterica serovar Typhi Ty2
agaaaauuauuuuaaau

SEQ ID NO: 1796874 - RNA, 13 nt, Salmonella enterica enterica serovar Typhi Ty2
agaaaauauauug

SEQ ID NO: 1796875 - RNA, 22 nt, Salmonella enterica enterica serovar Typhi Ty2
agaaaauauauuggccuuaugc

SEQ ID NO: 1796876 - RNA, 16 nt, Salmonella enterica enterica serovar Typhi Ty2
agaaaaucagugaaca

SEQ ID NO: 1796877 - RNA, 13 nt, Salmonella enterica enterica serovar Typhi Ty2
acuuuugaacaua

SEQ ID NO: 1796878 - RNA, 18 nt, Salmonella enterica enterica serovar Typhi Ty2
acuuuucuuuccugcaaa

SEQ ID NO: 1796879 - RNA, 13 nt, Salmonella enterica enterica serovar Typhi Ty2
acuuucuacaaau

SEQ ID NO: 1796880 - RNA, 23 nt, Salmonella enterica enterica serovar Typhi Ty2
acuuuccauauacucuuuguggg

SEQ ID NO: 1796881 - RNA, 19 nt, Salmonella enterica enterica serovar Typhi Ty2
acuuucauuucacuuguuc

SEQ ID NO: 1796882 - RNA, 19 nt, Salmonella enterica enterica serovar Typhi Ty2
acuuuccuggcugucggca

SEQ ID NO: 1796883 - RNA, 23 nt, Salmonella enterica enterica serovar Typhi Ty2
acuuucgcccggcgccagcucaa

SEQ ID NO: 1796884 - RNA, 18 nt, Salmonella enterica enterica serovar Typhi Ty2
acuuugcucuccuuaaaa

SEQ ID NO: 1796885 - RNA, 19 nt, Salmonella enterica enterica serovar Typhi Ty2
acuuugcccuuuuugcauu

SEQ ID NO: 1796886 - RNA, 16 nt, Salmonella enterica enterica serovar Typhi Ty2
acuuugcgcuccugcu

SEQ ID NO: 1796887 - RNA, 20 nt, Salmonella enterica enterica serovar Typhi Ty2
acuuugcccuuuuugcauuc

SEQ ID NO: 1796888 - RNA, 17 nt, Salmonella enterica enterica serovar Typhi Ty2
acuuuuaaauugaagag

SEQ ID NO: 1796889 - RNA, 12 nt, Salmonella enterica enterica serovar Typhi Ty2
agaaucagaugc

SEQ ID NO: 1796890 - RNA, 20 nt, Salmonella enterica enterica serovar Typhi Ty2
agaaucaccucuuucuccac

SEQ ID NO: 1796891 - RNA, 12 nt, Salmonella enterica enterica serovar Typhi Ty2
agaaucacguaa

SEQ ID NO: 1796892 - RNA, 13 nt, Salmonella enterica enterica serovar Typhi Ty2
agaaucaccucuu

SEQ ID NO: 1796893 - RNA, 23 nt, Salmonella enterica enterica serovar Typhi Ty2
agaaucauuaauacacugcguag

SEQ ID NO: 1796894 - RNA, 20 nt, Salmonella enterica enterica serovar Typhi Ty2
agaaucaguaacacaaucag

SEQ ID NO: 1796895 - RNA, 19 nt, Salmonella enterica enterica serovar Typhi Ty2
agaauaucggcgucaacgu

SEQ ID NO: 1796896 - RNA, 16 nt, Salmonella enterica enterica serovar Typhi Ty2
agaauauaggagagcg

SEQ ID NO: 1796897 - RNA, 15 nt, Salmonella enterica enterica serovar Typhi Ty2
agaauauguucuuuc

SEQ ID NO: 1796898 - RNA, 16 nt, Salmonella enterica enterica serovar Typhi Ty2
agaauauuuuucucag

SEQ ID NO: 1796899 - RNA, 13 nt, Salmonella enterica enterica serovar Typhi Ty2
agaaugcccagca

SEQ ID NO: 1796900 - RNA, 23 nt, Salmonella enterica enterica serovar Typhi Ty2
agaaugccgcccauccagagcag

SEQ ID NO: 1796901 - RNA, 15 nt, Salmonella enterica enterica serovar Typhi Ty2
agaaugcuccauugc

SEQ ID NO: 1796902 - RNA, 14 nt, Salmonella enterica enterica serovar Typhi Ty2
agaaugcuggucac

SEQ ID NO: 1796903 - RNA, 14 nt, Salmonella enterica enterica serovar Typhi Ty2
agaaucucugacag

SEQ ID NO: 1796904 - RNA, 20 nt, Salmonella enterica enterica serovar Typhi Ty2
agaauuauuaucaauuucau

SEQ ID NO: 1796905 - RNA, 14 nt, Salmonella enterica enterica serovar Typhi Ty2
agaauuauuucagg

SEQ ID NO: 1796906 - RNA, 22 nt, Salmonella enterica enterica serovar Typhi Ty2
agaauuauuaccaaugagcugc

SEQ ID NO: 1796907 - RNA, 16 nt, Salmonella enterica enterica serovar Typhi Ty2
agaauuauuaccaaug

SEQ ID NO: 1796908 - RNA, 13 nt, Salmonella enterica enterica serovar Typhi Ty2
agaauuaucugaa

SEQ ID NO: 1796909 - RNA, 16 nt, Salmonella enterica enterica serovar Typhi Ty2
agaauggaacaauaga

SEQ ID NO: 1796910 - RNA, 22 nt, Salmonella enterica enterica serovar Typhi Ty2
agaauggucgguauuaucaaua

SEQ ID NO: 1796911 - RNA, 15 nt, Salmonella enterica enterica serovar Typhi Ty2
agaagcccggccaca

SEQ ID NO: 1796912 - RNA, 13 nt, Salmonella enterica enterica serovar Typhi Ty2
agaagccaucaaa

SEQ ID NO: 1796913 - RNA, 14 nt, Salmonella enterica enterica serovar Typhi Ty2
agaauagacuggcg

SEQ ID NO: 1796914 - RNA, 22 nt, Salmonella enterica enterica serovar Typhi Ty2
agaauacacuucucaacauuga

SEQ ID NO: 1796915 - RNA, 23 nt, Salmonella enterica enterica serovar Typhi Ty2
agaauacugaagucgaaauuuuc

SEQ ID NO: 1796916 - RNA, 23 nt, Salmonella enterica enterica serovar Typhi Ty2
agaauacccuuuacacguuccau

SEQ ID NO: 1796917 - RNA, 15 nt, Salmonella enterica enterica serovar Typhi Ty2
agaauaagccagguu

SEQ ID NO: 1796918 - RNA, 23 nt, Salmonella enterica enterica serovar Typhi Ty2
agaauaaaaagugcgcacucaga

SEQ ID NO: 1796919 - RNA, 21 nt, Salmonella enterica enterica serovar Typhi Ty2
agaauaaaaagugcgcacuca

SEQ ID NO: 1796920 - RNA, 14 nt, Salmonella enterica enterica serovar Typhi Ty2
agaaacgcugaucu

SEQ ID NO: 1796921 - RNA, 14 nt, Salmonella enterica enterica serovar Typhi Ty2
agaaacaccagaau

SEQ ID NO: 1796922 - RNA, 17 nt, Salmonella enterica enterica serovar Typhi Ty2
agaaaccgcagaaaaag

SEQ ID NO: 1796923 - RNA, 19 nt, Salmonella enterica enterica serovar Typhi Ty2
agaaaccgcucgccgccuc

SEQ ID NO: 1796924 - RNA, 19 nt, Salmonella enterica enterica serovar Typhi Ty2
agaaacaacaccguaaaag

SEQ ID NO: 1796925 - RNA, 14 nt, Salmonella enterica enterica serovar Typhi Ty2
agaaaucaacgaaa

SEQ ID NO: 1796926 - RNA, 18 nt, Salmonella enterica enterica serovar Typhi Ty2
agaaaucaacgaaaucag

SEQ ID NO: 1796927 - RNA, 20 nt, Salmonella enterica enterica serovar Typhi Ty2
aaaacaccuaacccaccaua

SEQ ID NO: 1796928 - RNA, 17 nt, Salmonella enterica enterica serovar Typhi Ty2
aaaacacgucuggaaac

SEQ ID NO: 1796929 - RNA, 13 nt, Salmonella enterica enterica serovar Typhi Ty2
agaaaucagcagg

SEQ ID NO: 1796930 - RNA, 19 nt, Salmonella enterica enterica serovar Typhi Ty2
agaagagaauggccagcac

SEQ ID NO: 1796931 - RNA, 14 nt, Salmonella enterica enterica serovar Typhi Ty2
agaagaauuauuau

SEQ ID NO: 1796932 - RNA, 16 nt, Salmonella enterica enterica serovar Typhi Ty2
agaagaauaagccgga

SEQ ID NO: 1796933 - RNA, 20 nt, Salmonella enterica enterica serovar Typhi Ty2
agaagaaaccgcagaaaaag

SEQ ID NO: 1796934 - RNA, 17 nt, Salmonella enterica enterica serovar Typhi Ty2
agaacuuguaaaaaugc

SEQ ID NO: 1796935 - RNA, 22 nt, Salmonella enterica enterica serovar Typhi Ty2
agaacgguucauccagcagcag

SEQ ID NO: 1796936 - RNA, 13 nt, Salmonella enterica enterica serovar Typhi Ty2
agaacgccgggcc

SEQ ID NO: 1796937 - RNA, 19 nt, Salmonella enterica enterica serovar Typhi Ty2
agaacgccgggccugccag

SEQ ID NO: 1796938 - RNA, 21 nt, Salmonella enterica enterica serovar Typhi Ty2
agaacgacgcauaaaaaauga

SEQ ID NO: 1796939 - RNA, 14 nt, Salmonella enterica enterica serovar Typhi Ty2
agaaccacuugaac

SEQ ID NO: 1796940 - RNA, 20 nt, Salmonella enterica enterica serovar Typhi Ty2
agaaccaauaguauggagca

SEQ ID NO: 1796941 - RNA, 19 nt, Salmonella enterica enterica serovar Typhi Ty2
agaacauuucccgaaaaaa

SEQ ID NO: 1796942 - RNA, 14 nt, Salmonella enterica enterica serovar Typhi Ty2
agaacaugacggca

SEQ ID NO: 1796943 - RNA, 12 nt, Salmonella enterica enterica serovar Typhi Ty2
agauaaugccgc

SEQ ID NO: 1796944 - RNA, 20 nt, Salmonella enterica enterica serovar Typhi Ty2
agauaaugcucauuauuugg

SEQ ID NO: 1796945 - RNA, 18 nt, Salmonella enterica enterica serovar Typhi Ty2
agauacauggcuauucca

SEQ ID NO: 1796946 - RNA, 15 nt, Salmonella enterica enterica serovar Typhi Ty2
agauagggccaggcg

SEQ ID NO: 1796947 - RNA, 20 nt, Salmonella enterica enterica serovar Typhi Ty2
agauaggcgcgaaauguccc

SEQ ID NO: 1796948 - RNA, 16 nt, Salmonella enterica enterica serovar Typhi Ty2
agauagucgaucccca

SEQ ID NO: 1796949 - RNA, 20 nt, Salmonella enterica enterica serovar Typhi Ty2
agauagucacgauaguuugc

SEQ ID NO: 1796950 - RNA, 18 nt, Salmonella enterica enterica serovar Typhi Ty2
agauaguuuuuaauucca

SEQ ID NO: 1796951 - RNA, 11 nt, Salmonella enterica enterica serovar Typhi Ty2
agauaguuuuu

SEQ ID NO: 1796952 - RNA, 15 nt, Salmonella enterica enterica serovar Typhi Ty2
agauaguugagcagc

SEQ ID NO: 1796953 - RNA, 13 nt, Salmonella enterica enterica serovar Typhi Ty2
agaucaaaaaucu

SEQ ID NO: 1796954 - RNA, 17 nt, Salmonella enterica enterica serovar Typhi Ty2
agaucaaacaggcgaaa

SEQ ID NO: 1796955 - RNA, 20 nt, Salmonella enterica enterica serovar Typhi Ty2
agagugagccacguuuuccu

SEQ ID NO: 1796956 - RNA, 20 nt, Salmonella enterica enterica serovar Typhi Ty2
agagugacgguuuucacugg

SEQ ID NO: 1796957 - RNA, 13 nt, Salmonella enterica enterica serovar Typhi Ty2
agaguccugacgu

SEQ ID NO: 1796958 - RNA, 13 nt, Salmonella enterica enterica serovar Typhi Ty2
agaguccagccau

SEQ ID NO: 1796959 - RNA, 17 nt, Salmonella enterica enterica serovar Typhi Ty2
agaguccagcgccagcg

SEQ ID NO: 1796960 - RNA, 22 nt, Salmonella enterica enterica serovar Typhi Ty2
agaguccauucggccugcggug

SEQ ID NO: 1796961 - RNA, 14 nt, Salmonella enterica enterica serovar Typhi Ty2
aaaaccagcgccgc

SEQ ID NO: 1796962 - RNA, 12 nt, Salmonella enterica enterica serovar Typhi Ty2
aaaaccagcgcc

SEQ ID NO: 1796963 - RNA, 20 nt, Salmonella enterica enterica serovar Typhi Ty2
agagucaaggcauccagcag

SEQ ID NO: 1796964 - RNA, 23 nt, Salmonella enterica enterica serovar Typhi Ty2
aaaaccaccuacgccguuccagc

SEQ ID NO: 1796965 - RNA, 15 nt, Salmonella enterica enterica serovar Typhi Ty2
aaaaccaccuacgcc

SEQ ID NO: 1796966 - RNA, 20 nt, Salmonella enterica enterica serovar Typhi Ty2
agaguguaggccugauaaga

SEQ ID NO: 1796967 - RNA, 16 nt, Salmonella enterica enterica serovar Typhi Ty2
agauaagaaguaaaca

SEQ ID NO: 1796968 - RNA, 19 nt, Salmonella enterica enterica serovar Typhi Ty2
agauaacuauaugcccggg

SEQ ID NO: 1796969 - RNA, 17 nt, Salmonella enterica enterica serovar Typhi Ty2
agauaagaaaaaacugg

SEQ ID NO: 1796970 - RNA, 23 nt, Salmonella enterica enterica serovar Typhi Ty2
agauaacuuccuuugccuuucuu

SEQ ID NO: 1796971 - RNA, 16 nt, Salmonella enterica enterica serovar Typhi Ty2
agauaacgcuaugcuu

SEQ ID NO: 1796972 - RNA, 12 nt, Salmonella enterica enterica serovar Typhi Ty2
agaucuaucuga

SEQ ID NO: 1796973 - RNA, 20 nt, Salmonella enterica enterica serovar Typhi Ty2
agaucguaugcgccuguuag

SEQ ID NO: 1796974 - RNA, 20 nt, Salmonella enterica enterica serovar Typhi Ty2
agaucguuauuaaacagaca

SEQ ID NO: 1796975 - RNA, 17 nt, Salmonella enterica enterica serovar Typhi Ty2
agaucgguaauuuccac

SEQ ID NO: 1796976 - RNA, 18 nt, Salmonella enterica enterica serovar Typhi Ty2
agaucguaugcgccuguu

SEQ ID NO: 1796977 - RNA, 22 nt, Salmonella enterica enterica serovar Typhi Ty2
agaucgcggggcaacagauacg

SEQ ID NO: 1796978 - RNA, 17 nt, Salmonella enterica enterica serovar Typhi Ty2
agaucgcgggcaaucaa

SEQ ID NO: 1796979 - RNA, 19 nt, Salmonella enterica enterica serovar Typhi Ty2
agaucgcagucgauuuaau

SEQ ID NO: 1796980 - RNA, 17 nt, Salmonella enterica enterica serovar Typhi Ty2
agaucgaaacgguccag

SEQ ID NO: 1796981 - RNA, 23 nt, Salmonella enterica enterica serovar Typhi Ty2
agauccuucauucagaucaaaaa

SEQ ID NO: 1796982 - RNA, 21 nt, Salmonella enterica enterica serovar Typhi Ty2
agauccauuaaaugcgccagc

SEQ ID NO: 1796983 - RNA, 17 nt, Salmonella enterica enterica serovar Typhi Ty2
agauccuuaacgucaaa

SEQ ID NO: 1796984 - RNA, 13 nt, Salmonella enterica enterica serovar Typhi Ty2
agauccgcaagag

SEQ ID NO: 1796985 - RNA, 19 nt, Salmonella enterica enterica serovar Typhi Ty2
agaugaugauuuaugaaua

SEQ ID NO: 1796986 - RNA, 17 nt, Salmonella enterica enterica serovar Typhi Ty2
agaugauggaugucagc

SEQ ID NO: 1796987 - RNA, 17 nt, Salmonella enterica enterica serovar Typhi Ty2
agaugaaacucgcugug

SEQ ID NO: 1796988 - RNA, 14 nt, Salmonella enterica enterica serovar Typhi Ty2
agaucuuuuugcuc

SEQ ID NO: 1796989 - RNA, 22 nt, Salmonella enterica enterica serovar Typhi Ty2
agaucuuuugcgccuuccaguu

SEQ ID NO: 1796990 - RNA, 14 nt, Salmonella enterica enterica serovar Typhi Ty2
agaugaugauuuau

SEQ ID NO: 1796991 - RNA, 17 nt, Salmonella enterica enterica serovar Typhi Ty2
agaugaacguaacguga

SEQ ID NO: 1796992 - RNA, 18 nt, Salmonella enterica enterica serovar Typhi Ty2
agaugaagacaacgucgc

SEQ ID NO: 1796993 - RNA, 22 nt, Salmonella enterica enterica serovar Typhi Ty2
agauuaacagcgcgaccagcgu

SEQ ID NO: 1796994 - RNA, 21 nt, Salmonella enterica enterica serovar Typhi Ty2
agauguuuuaaucucuucuau

SEQ ID NO: 1796995 - RNA, 20 nt, Salmonella enterica enterica serovar Typhi Ty2
agauguugauacagaaaacc

SEQ ID NO: 1796996 - RNA, 20 nt, Salmonella enterica enterica serovar Typhi Ty2
agaugcugggcgugucccug

SEQ ID NO: 1796997 - RNA, 21 nt, Salmonella enterica enterica serovar Typhi Ty2
agaugguauaaaucacgcuga

SEQ ID NO: 1796998 - RNA, 17 nt, Salmonella enterica enterica serovar Typhi Ty2
agagacauugccuucca

SEQ ID NO: 1796999 - RNA, 22 nt, Salmonella enterica enterica serovar Typhi Ty2
agagacggcgacaguugauauu

SEQ ID NO: 1797000 - RNA, 22 nt, Salmonella enterica enterica serovar Typhi Ty2
agagaagucugagcgcaaacau

SEQ ID NO: 1797001 - RNA, 16 nt, Salmonella enterica enterica serovar Typhi Ty2
agagaauuaacagcgc

SEQ ID NO: 1797002 - RNA, 14 nt, Salmonella enterica enterica serovar Typhi Ty2
agagaagucugagc

SEQ ID NO: 1797003 - RNA, 22 nt, Salmonella enterica enterica serovar Typhi Ty2
agagaacgaaauauggcacagc

SEQ ID NO: 1797004 - RNA, 22 nt, Salmonella enterica enterica serovar Typhi Ty2
agagaacguugccgcaggcaac

SEQ ID NO: 1797005 - RNA, 22 nt, Salmonella enterica enterica serovar Typhi Ty2
agagaaacaacaccguaaaagg

SEQ ID NO: 1797006 - RNA, 10 nt, Salmonella enterica enterica serovar Typhi Ty2
agagaaaaaa

SEQ ID NO: 1797007 - RNA, 21 nt, Salmonella enterica enterica serovar Typhi Ty2
agagaaaaccccguacaggac

SEQ ID NO: 1797008 - RNA, 17 nt, Salmonella enterica enterica serovar Typhi Ty2
agagaaaaaaauccagu

SEQ ID NO: 1797009 - RNA, 18 nt, Salmonella enterica enterica serovar Typhi Ty2
agacuuugcacagucugc

SEQ ID NO: 1797010 - RNA, 13 nt, Salmonella enterica enterica serovar Typhi Ty2
agagagccuuaca

SEQ ID NO: 1797011 - RNA, 19 nt, Salmonella enterica enterica serovar Typhi Ty2
agagagcgccaaaaagaaa

SEQ ID NO: 1797012 - RNA, 13 nt, Salmonella enterica enterica serovar Typhi Ty2
agagaguaaaacc

SEQ ID NO: 1797013 - RNA, 19 nt, Salmonella enterica enterica serovar Typhi Ty2
agagagcgggccguggcca

SEQ ID NO: 1797014 - RNA, 20 nt, Salmonella enterica enterica serovar Typhi Ty2
agagaguucguuaaucucaa

SEQ ID NO: 1797015 - RNA, 21 nt, Salmonella enterica enterica serovar Typhi Ty2
agagauaauuuucccaguuca

SEQ ID NO: 1797016 - RNA, 16 nt, Salmonella enterica enterica serovar Typhi Ty2
agagauaauuuuccca

SEQ ID NO: 1797017 - RNA, 12 nt, Salmonella enterica enterica serovar Typhi Ty2
agagauagaacg

SEQ ID NO: 1797018 - RNA, 17 nt, Salmonella enterica enterica serovar Typhi Ty2
agagauucugcaggcca

SEQ ID NO: 1797019 - RNA, 20 nt, Salmonella enterica enterica serovar Typhi Ty2
agagcgggccguggccagga

SEQ ID NO: 1797020 - RNA, 18 nt, Salmonella enterica enterica serovar Typhi Ty2
agagcgggucaacgccaa

SEQ ID NO: 1797021 - RNA, 16 nt, Salmonella enterica enterica serovar Typhi Ty2
agagcguggucauuag

SEQ ID NO: 1797022 - RNA, 13 nt, Salmonella enterica enterica serovar Typhi Ty2
agagcugaaaaug

SEQ ID NO: 1797023 - RNA, 22 nt, Salmonella enterica enterica serovar Typhi Ty2
agagccagacgguuaagccggu

SEQ ID NO: 1797024 - RNA, 23 nt, Salmonella enterica enterica serovar Typhi Ty2
agagccgcgcagcgcaacgccuu

SEQ ID NO: 1797025 - RNA, 18 nt, Salmonella enterica enterica serovar Typhi Ty2
agagcaacauaccgcaga

SEQ ID NO: 1797026 - RNA, 13 nt, Salmonella enterica enterica serovar Typhi Ty2
agagcaacgccau

SEQ ID NO: 1797027 - RNA, 21 nt, Salmonella enterica enterica serovar Typhi Ty2
agagcaucuaccgcauacuga

SEQ ID NO: 1797028 - RNA, 16 nt, Salmonella enterica enterica serovar Typhi Ty2
agacugcacuuccugc

SEQ ID NO: 1797029 - RNA, 20 nt, Salmonella enterica enterica serovar Typhi Ty2
agacucgcucccuuccccca

SEQ ID NO: 1797030 - RNA, 14 nt, Salmonella enterica enterica serovar Typhi Ty2
agacugcacuuccu

SEQ ID NO: 1797031 - RNA, 16 nt, Salmonella enterica enterica serovar Typhi Ty2
agacuggucgcccgga

SEQ ID NO: 1797032 - RNA, 17 nt, Salmonella enterica enterica serovar Typhi Ty2
agacugugauggcgguc

SEQ ID NO: 1797033 - RNA, 20 nt, Salmonella enterica enterica serovar Typhi Ty2
agacuuagggcggagauacc

SEQ ID NO: 1797034 - RNA, 22 nt, Salmonella enterica enterica serovar Typhi Ty2
agacuucaacgccgcacacuca

SEQ ID NO: 1797035 - RNA, 20 nt, Salmonella enterica enterica serovar Typhi Ty2
agacuucuuccauacgacca

SEQ ID NO: 1797036 - RNA, 14 nt, Salmonella enterica enterica serovar Typhi Ty2
agacuucuucaguc

SEQ ID NO: 1797037 - RNA, 16 nt, Salmonella enterica enterica serovar Typhi Ty2
agacuucuucagucag

SEQ ID NO: 1797038 - RNA, 21 nt, Salmonella enterica enterica serovar Typhi Ty2
agacuacuuuuacccuucaga

SEQ ID NO: 1797039 - RNA, 13 nt, Salmonella enterica enterica serovar Typhi Ty2
agacggccaccca

SEQ ID NO: 1797040 - RNA, 23 nt, Salmonella enterica enterica serovar Typhi Ty2
agacuauccguccucuuucccuu

SEQ ID NO: 1797041 - RNA, 21 nt, Salmonella enterica enterica serovar Typhi Ty2
agacucaaagaaaacaucagc

SEQ ID NO: 1797042 - RNA, 13 nt, Salmonella enterica enterica serovar Typhi Ty2
agacucagccagg

SEQ ID NO: 1797043 - RNA, 15 nt, Salmonella enterica enterica serovar Typhi Ty2
agacuccggcagcau

SEQ ID NO: 1797044 - RNA, 17 nt, Salmonella enterica enterica serovar Typhi Ty2
agacuccgucaaagaaa

SEQ ID NO: 1797045 - RNA, 16 nt, Salmonella enterica enterica serovar Typhi Ty2
agacucgcggguuuca

SEQ ID NO: 1797046 - RNA, 12 nt, Salmonella enterica enterica serovar Typhi Ty2
agacucaggcgc

SEQ ID NO: 1797047 - RNA, 18 nt, Salmonella enterica enterica serovar Typhi Ty2
agacuauccguccucuuu

SEQ ID NO: 1797048 - RNA, 14 nt, Salmonella enterica enterica serovar Typhi Ty2
agacccaggcgcgu

SEQ ID NO: 1797049 - RNA, 21 nt, Salmonella enterica enterica serovar Typhi Ty2
agaauucccuauguaaagaau

SEQ ID NO: 1797050 - RNA, 15 nt, Salmonella enterica enterica serovar Typhi Ty2
agaauuuccaguuca

SEQ ID NO: 1797051 - RNA, 16 nt, Salmonella enterica enterica serovar Typhi Ty2
agaauuugaacucuuu

SEQ ID NO: 1797052 - RNA, 21 nt, Salmonella enterica enterica serovar Typhi Ty2
agacccgcaauaacgccgaua

SEQ ID NO: 1797053 - RNA, 15 nt, Salmonella enterica enterica serovar Typhi Ty2
agaccccgcaucgcc

SEQ ID NO: 1797054 - RNA, 17 nt, Salmonella enterica enterica serovar Typhi Ty2
agacgccugggcauuug

SEQ ID NO: 1797055 - RNA, 17 nt, Salmonella enterica enterica serovar Typhi Ty2
agacgccgcgcugcggc

SEQ ID NO: 1797056 - RNA, 18 nt, Salmonella enterica enterica serovar Typhi Ty2
agacgcgcuagcuucagg

SEQ ID NO: 1797057 - RNA, 18 nt, Salmonella enterica enterica serovar Typhi Ty2
agacgcucgacguccagc

SEQ ID NO: 1797058 - RNA, 22 nt, Salmonella enterica enterica serovar Typhi Ty2
agacgcugacauccaucaucua

SEQ ID NO: 1797059 - RNA, 13 nt, Salmonella enterica enterica serovar Typhi Ty2
agacgcugguugu

SEQ ID NO: 1797060 - RNA, 22 nt, Salmonella enterica enterica serovar Typhi Ty2
agaccuccgcccggugcucaau

SEQ ID NO: 1797061 - RNA, 18 nt, Salmonella enterica enterica serovar Typhi Ty2
agacgacgguuaaaaagu

SEQ ID NO: 1797062 - RNA, 16 nt, Salmonella enterica enterica serovar Typhi Ty2
agacgacaucuuuucc

SEQ ID NO: 1797063 - RNA, 18 nt, Salmonella enterica enterica serovar Typhi Ty2
acagcaaugcccaaaaua

SEQ ID NO: 1797064 - RNA, 14 nt, Salmonella enterica enterica serovar Typhi Ty2
acagcaacaucuau

SEQ ID NO: 1797065 - RNA, 22 nt, Salmonella enterica enterica serovar Typhi Ty2
acagcagcgcggcacacagcac

SEQ ID NO: 1797066 - RNA, 19 nt, Salmonella enterica enterica serovar Typhi Ty2
acacgguuauaaccggaca

SEQ ID NO: 1797067 - RNA, 21 nt, Salmonella enterica enterica serovar Typhi Ty2
acacguaacugacaauuucca

SEQ ID NO: 1797068 - RNA, 18 nt, Salmonella enterica enterica serovar Typhi Ty2
acacguauaaacgccgcc

SEQ ID NO: 1797069 - RNA, 21 nt, Salmonella enterica enterica serovar Typhi Ty2
acagcaggcuuugcugcugcg

SEQ ID NO: 1797070 - RNA, 12 nt, Salmonella enterica enterica serovar Typhi Ty2
acagccagcauu

SEQ ID NO: 1797071 - RNA, 13 nt, Salmonella enterica enterica serovar Typhi Ty2
acagccagcagcg

SEQ ID NO: 1797072 - RNA, 14 nt, Salmonella enterica enterica serovar Typhi Ty2
acagccagaagccu

SEQ ID NO: 1797073 - RNA, 14 nt, Salmonella enterica enterica serovar Typhi Ty2
acagccaaaucagc

SEQ ID NO: 1797074 - RNA, 15 nt, Salmonella enterica enterica serovar Typhi Ty2
acagccaaucauaaa

SEQ ID NO: 1797075 - RNA, 15 nt, Salmonella enterica enterica serovar Typhi Ty2
acagccaucuucugc

SEQ ID NO: 1797076 - RNA, 14 nt, Salmonella enterica enterica serovar Typhi Ty2
acagccauccgacg

SEQ ID NO: 1797077 - RNA, 22 nt, Salmonella enterica enterica serovar Typhi Ty2
acagccaggcuuucccuucaga

SEQ ID NO: 1797078 - RNA, 14 nt, Salmonella enterica enterica serovar Typhi Ty2
acagccgcauuuuu

SEQ ID NO: 1797079 - RNA, 17 nt, Salmonella enterica enterica serovar Typhi Ty2
acaggaagcagcuugcu

SEQ ID NO: 1797080 - RNA, 16 nt, Salmonella enterica enterica serovar Typhi Ty2
acaggcgcaucagaaa

SEQ ID NO: 1797081 - RNA, 22 nt, Salmonella enterica enterica serovar Typhi Ty2
acaggcgcaucagaaaaaccuc

SEQ ID NO: 1797082 - RNA, 23 nt, Salmonella enterica enterica serovar Typhi Ty2
acaggcgcaggcauuaaaaaaac

SEQ ID NO: 1797083 - RNA, 13 nt, Salmonella enterica enterica serovar Typhi Ty2
acaggcugacaaa

SEQ ID NO: 1797084 - RNA, 16 nt, Salmonella enterica enterica serovar Typhi Ty2
acaggcggaugaaaca

SEQ ID NO: 1797085 - RNA, 12 nt, Salmonella enterica enterica serovar Typhi Ty2
acaggcggauga

SEQ ID NO: 1797086 - RNA, 17 nt, Salmonella enterica enterica serovar Typhi Ty2
acaggcggcuguugguu

SEQ ID NO: 1797087 - RNA, 16 nt, Salmonella enterica enterica serovar Typhi Ty2
acaggcugucugccau

SEQ ID NO: 1797088 - RNA, 16 nt, Salmonella enterica enterica serovar Typhi Ty2
acaggcuuuucaggcu

SEQ ID NO: 1797089 - RNA, 20 nt, Salmonella enterica enterica serovar Typhi Ty2
acagcuugcgcccaugcuca

SEQ ID NO: 1797090 - RNA, 15 nt, Salmonella enterica enterica serovar Typhi Ty2
acagcgccaucagga

SEQ ID NO: 1797091 - RNA, 18 nt, Salmonella enterica enterica serovar Typhi Ty2
acagugcuauacaguaaa

SEQ ID NO: 1797092 - RNA, 23 nt, Salmonella enterica enterica serovar Typhi Ty2
acaguguugauugaaacucgcca

SEQ ID NO: 1797093 - RNA, 17 nt, Salmonella enterica enterica serovar Typhi Ty2
acagugacccgccgcca

SEQ ID NO: 1797094 - RNA, 21 nt, Salmonella enterica enterica serovar Typhi Ty2
acagugacccgccgccagcac

SEQ ID NO: 1797095 - RNA, 21 nt, Salmonella enterica enterica serovar Typhi Ty2
acagugauuacaaaaugugca

SEQ ID NO: 1797096 - RNA, 19 nt, Salmonella enterica enterica serovar Typhi Ty2
acaguuaccacacaugcaa

SEQ ID NO: 1797097 - RNA, 18 nt, Salmonella enterica enterica serovar Typhi Ty2
acagugugccgucaucca

SEQ ID NO: 1797098 - RNA, 18 nt, Salmonella enterica enterica serovar Typhi Ty2
acaguucccggcaacagu

SEQ ID NO: 1797099 - RNA, 13 nt, Salmonella enterica enterica serovar Typhi Ty2
acaguucaaacgg

SEQ ID NO: 1797100 - RNA, 20 nt, Salmonella enterica enterica serovar Typhi Ty2
acaguucaaacggcccggcg

SEQ ID NO: 1797101 - RNA, 18 nt, Salmonella enterica enterica serovar Typhi Ty2
acaguugcgacugauaac

SEQ ID NO: 1797102 - RNA, 17 nt, Salmonella enterica enterica serovar Typhi Ty2
acauaaaaugguuauug

SEQ ID NO: 1797103 - RNA, 12 nt, Salmonella enterica enterica serovar Typhi Ty2
acaguuugucaa

SEQ ID NO: 1797104 - RNA, 17 nt, Salmonella enterica enterica serovar Typhi Ty2
acaguuugugccgccac

SEQ ID NO: 1797105 - RNA, 17 nt, Salmonella enterica enterica serovar Typhi Ty2
acauaacagcagcagac

SEQ ID NO: 1797106 - RNA, 14 nt, Salmonella enterica enterica serovar Typhi Ty2
acagucgcagagcc

SEQ ID NO: 1797107 - RNA, 21 nt, Salmonella enterica enterica serovar Typhi Ty2
acaguauuuguucagacacau

SEQ ID NO: 1797108 - RNA, 19 nt, Salmonella enterica enterica serovar Typhi Ty2
acaguauuuguucagacac

SEQ ID NO: 1797109 - RNA, 18 nt, Salmonella enterica enterica serovar Typhi Ty2
acaguacggucaggcuca

SEQ ID NO: 1797110 - RNA, 15 nt, Salmonella enterica enterica serovar Typhi Ty2
acaguacgccgaggg

SEQ ID NO: 1797111 - RNA, 22 nt, Salmonella enterica enterica serovar Typhi Ty2
acagguugcguaacgccacaua

SEQ ID NO: 1797112 - RNA, 17 nt, Salmonella enterica enterica serovar Typhi Ty2
acagggcgaugccucac

SEQ ID NO: 1797113 - RNA, 15 nt, Salmonella enterica enterica serovar Typhi Ty2
acagggcggccuccu

SEQ ID NO: 1797114 - RNA, 17 nt, Salmonella enterica enterica serovar Typhi Ty2
acaggggggaacagcaa

SEQ ID NO: 1797115 - RNA, 13 nt, Salmonella enterica enterica serovar Typhi Ty2
acagguaaaacaa

SEQ ID NO: 1797116 - RNA, 14 nt, Salmonella enterica enterica serovar Typhi Ty2
acagguaaaacaaa

SEQ ID NO: 1797117 - RNA, 22 nt, Salmonella enterica enterica serovar Typhi Ty2
acagguaaaacaaaaaaacggc

SEQ ID NO: 1797118 - RNA, 19 nt, Salmonella enterica enterica serovar Typhi Ty2
acaggucgaugauuuucaa

SEQ ID NO: 1797119 - RNA, 14 nt, Salmonella enterica enterica serovar Typhi Ty2
acaggugaccaggc

SEQ ID NO: 1797120 - RNA, 17 nt, Salmonella enterica enterica serovar Typhi Ty2
acaggugaccaggcuuc

SEQ ID NO: 1797121 - RNA, 22 nt, Salmonella enterica enterica serovar Typhi Ty2
acaggucggcaugcaucucuuc

SEQ ID NO: 1797122 - RNA, 15 nt, Salmonella enterica enterica serovar Typhi Ty2
acaggucggccaacc

SEQ ID NO: 1797123 - RNA, 19 nt, Salmonella enterica enterica serovar Typhi Ty2
acaggugaaauaggggaga

SEQ ID NO: 1797124 - RNA, 20 nt, Salmonella enterica enterica serovar Typhi Ty2
acagguugcguaacgccaca

SEQ ID NO: 1797125 - RNA, 16 nt, Salmonella enterica enterica serovar Typhi Ty2
acagguucgaaucccg

SEQ ID NO: 1797126 - RNA, 22 nt, Salmonella enterica enterica serovar Typhi Ty2
acagguuaacgaagguaaacgc

SEQ ID NO: 1797127 - RNA, 13 nt, Salmonella enterica enterica serovar Typhi Ty2
acagguuaacucc

SEQ ID NO: 1797128 - RNA, 15 nt, Salmonella enterica enterica serovar Typhi Ty2
acauccggcggcguc

SEQ ID NO: 1797129 - RNA, 15 nt, Salmonella enterica enterica serovar Typhi Ty2
acauccucuccugaa

SEQ ID NO: 1797130 - RNA, 16 nt, Salmonella enterica enterica serovar Typhi Ty2
acaucaugcuugcuuu

SEQ ID NO: 1797131 - RNA, 19 nt, Salmonella enterica enterica serovar Typhi Ty2
acaucgccugguaaggcaa

SEQ ID NO: 1797132 - RNA, 16 nt, Salmonella enterica enterica serovar Typhi Ty2
acaucgcgucgaggaa

SEQ ID NO: 1797133 - RNA, 16 nt, Salmonella enterica enterica serovar Typhi Ty2
acaucgcucccggcac

SEQ ID NO: 1797134 - RNA, 14 nt, Salmonella enterica enterica serovar Typhi Ty2
acaucgcuccggca

SEQ ID NO: 1797135 - RNA, 22 nt, Salmonella enterica enterica serovar Typhi Ty2
acaucgcucgcgccacgcagau

SEQ ID NO: 1797136 - RNA, 22 nt, Salmonella enterica enterica serovar Typhi Ty2
acaucgccguuccauuccagaa

SEQ ID NO: 1797137 - RNA, 20 nt, Salmonella enterica enterica serovar Typhi Ty2
acaucggagauuucauccuc

SEQ ID NO: 1797138 - RNA, 18 nt, Salmonella enterica enterica serovar Typhi Ty2
acaucggauuauuuucac

SEQ ID NO: 1797139 - RNA, 16 nt, Salmonella enterica enterica serovar Typhi Ty2
acaucaauagcgcuac

SEQ ID NO: 1797140 - RNA, 20 nt, Salmonella enterica enterica serovar Typhi Ty2
acauaauguaaaggugagcu

SEQ ID NO: 1797141 - RNA, 12 nt, Salmonella enterica enterica serovar Typhi Ty2
acaucaagccca

SEQ ID NO: 1797142 - RNA, 16 nt, Salmonella enterica enterica serovar Typhi Ty2
acauaagugcaggcug

SEQ ID NO: 1797143 - RNA, 24 nt, Salmonella enterica enterica serovar Typhi Ty2
acauaaccggcaaccaaaguccaa

SEQ ID NO: 1797144 - RNA, 17 nt, Salmonella enterica enterica serovar Typhi Ty2
acaugcgcagaaaggcg

SEQ ID NO: 1797145 - RNA, 16 nt, Salmonella enterica enterica serovar Typhi Ty2
acaugcucaugaaggc

SEQ ID NO: 1797146 - RNA, 18 nt, Salmonella enterica enterica serovar Typhi Ty2
acaugcucaugaaggcau

SEQ ID NO: 1797147 - RNA, 18 nt, Salmonella enterica enterica serovar Typhi Ty2
acaugaccugaauauggc

SEQ ID NO: 1797148 - RNA, 20 nt, Salmonella enterica enterica serovar Typhi Ty2
acaugaccugaauauggcca

SEQ ID NO: 1797149 - RNA, 20 nt, Salmonella enterica enterica serovar Typhi Ty2
acaugacgguucaucgcaga

SEQ ID NO: 1797150 - RNA, 14 nt, Salmonella enterica enterica serovar Typhi Ty2
acaugaccgcacag

SEQ ID NO: 1797151 - RNA, 15 nt, Salmonella enterica enterica serovar Typhi Ty2
acaucguaaaucaaa

SEQ ID NO: 1797152 - RNA, 19 nt, Salmonella enterica enterica serovar Typhi Ty2
acaucguguauaccaaaaa

SEQ ID NO: 1797153 - RNA, 11 nt, Salmonella enterica enterica serovar Typhi Ty2
acaucuacuuc

SEQ ID NO: 1797154 - RNA, 22 nt, Salmonella enterica enterica serovar Typhi Ty2
acaucucuucguguaacgcaua

SEQ ID NO: 1797155 - RNA, 16 nt, Salmonella enterica enterica serovar Typhi Ty2
acaucuguuugagaaa

SEQ ID NO: 1797156 - RNA, 12 nt, Salmonella enterica enterica serovar Typhi Ty2
acauuucuuuug

SEQ ID NO: 1797157 - RNA, 21 nt, Salmonella enterica enterica serovar Typhi Ty2
acauuuaagauuuaaaacaag

SEQ ID NO: 1797158 - RNA, 20 nt, Salmonella enterica enterica serovar Typhi Ty2
acauuuaagauuuaaaacaa

SEQ ID NO: 1797159 - RNA, 16 nt, Salmonella enterica enterica serovar Typhi Ty2
acauuuaagauuuaaa

SEQ ID NO: 1797160 - RNA, 13 nt, Salmonella enterica enterica serovar Typhi Ty2
acauuuucccaac

SEQ ID NO: 1797161 - RNA, 15 nt, Salmonella enterica enterica serovar Typhi Ty2
acauuacaauguaca

SEQ ID NO: 1797162 - RNA, 22 nt, Salmonella enterica enterica serovar Typhi Ty2
accaaacccuuuggcaaaaaag

SEQ ID NO: 1797163 - RNA, 13 nt, Salmonella enterica enterica serovar Typhi Ty2
accaaaaggcaga

SEQ ID NO: 1797164 - RNA, 15 nt, Salmonella enterica enterica serovar Typhi Ty2
accaaaucaauagaa

SEQ ID NO: 1797165 - RNA, 22 nt, Salmonella enterica enterica serovar Typhi Ty2
accaaaguccaacuguuaucau

SEQ ID NO: 1797166 - RNA, 14 nt, Salmonella enterica enterica serovar Typhi Ty2
accaacaacagaua

SEQ ID NO: 1797167 - RNA, 15 nt, Salmonella enterica enterica serovar Typhi Ty2
acaaccuccacgccc

SEQ ID NO: 1797168 - RNA, 23 nt, Salmonella enterica enterica serovar Typhi Ty2
acaaccaggauucaacgcgugau

SEQ ID NO: 1797169 - RNA, 16 nt, Salmonella enterica enterica serovar Typhi Ty2
acaacccuuuuccgga

SEQ ID NO: 1797170 - RNA, 23 nt, Salmonella enterica enterica serovar Typhi Ty2
acaacauaucgccggggaaaaua

SEQ ID NO: 1797171 - RNA, 17 nt, Salmonella enterica enterica serovar Typhi Ty2
acaacaucccagaaaau

SEQ ID NO: 1797172 - RNA, 18 nt, Salmonella enterica enterica serovar Typhi Ty2
acaacauuguuauguuuu

SEQ ID NO: 1797173 - RNA, 17 nt, Salmonella enterica enterica serovar Typhi Ty2
acaacauugaggcuacc

SEQ ID NO: 1797174 - RNA, 20 nt, Salmonella enterica enterica serovar Typhi Ty2
acaaauuguuuaaaaacagg

SEQ ID NO: 1797175 - RNA, 16 nt, Salmonella enterica enterica serovar Typhi Ty2
acaaauugcagcgcgc

SEQ ID NO: 1797176 - RNA, 13 nt, Salmonella enterica enterica serovar Typhi Ty2
acaacaaaaagau

SEQ ID NO: 1797177 - RNA, 15 nt, Salmonella enterica enterica serovar Typhi Ty2
acaacacgcuuuuca

SEQ ID NO: 1797178 - RNA, 17 nt, Salmonella enterica enterica serovar Typhi Ty2
acaacacucacaaaacu

SEQ ID NO: 1797179 - RNA, 21 nt, Salmonella enterica enterica serovar Typhi Ty2
acaacaaggauagcuuuguau

SEQ ID NO: 1797180 - RNA, 20 nt, Salmonella enterica enterica serovar Typhi Ty2
acaaagguugcgccaaagca

SEQ ID NO: 1797181 - RNA, 14 nt, Salmonella enterica enterica serovar Typhi Ty2
acaaauaaauccau

SEQ ID NO: 1797182 - RNA, 13 nt, Salmonella enterica enterica serovar Typhi Ty2
acaaauacauggu

SEQ ID NO: 1797183 - RNA, 23 nt, Salmonella enterica enterica serovar Typhi Ty2
acaaauagaagccacaaucugau

SEQ ID NO: 1797184 - RNA, 19 nt, Salmonella enterica enterica serovar Typhi Ty2
acaaauagcacacaaacga

SEQ ID NO: 1797185 - RNA, 15 nt, Salmonella enterica enterica serovar Typhi Ty2
acaaauucugaagag

SEQ ID NO: 1797186 - RNA, 20 nt, Salmonella enterica enterica serovar Typhi Ty2
acaaaugaccucaagaauau

SEQ ID NO: 1797187 - RNA, 22 nt, Salmonella enterica enterica serovar Typhi Ty2
acaaaucaucgguuacuccuua

SEQ ID NO: 1797188 - RNA, 21 nt, Salmonella enterica enterica serovar Typhi Ty2
acaaaggcagccaacaaagag

SEQ ID NO: 1797189 - RNA, 19 nt, Salmonella enterica enterica serovar Typhi Ty2
acaaagcguggggaaaacc

SEQ ID NO: 1797190 - RNA, 14 nt, Salmonella enterica enterica serovar Typhi Ty2
acaaagccggauau

SEQ ID NO: 1797191 - RNA, 16 nt, Salmonella enterica enterica serovar Typhi Ty2
acaaagagcuccccac

SEQ ID NO: 1797192 - RNA, 19 nt, Salmonella enterica enterica serovar Typhi Ty2
acaaagacgaauaaggaau

SEQ ID NO: 1797193 - RNA, 16 nt, Salmonella enterica enterica serovar Typhi Ty2
acaaacagugaaaaaa

SEQ ID NO: 1797194 - RNA, 19 nt, Salmonella enterica enterica serovar Typhi Ty2
acaaacaaauaaauccaug

SEQ ID NO: 1797195 - RNA, 14 nt, Salmonella enterica enterica serovar Typhi Ty2
acaaacacagccau

SEQ ID NO: 1797196 - RNA, 19 nt, Salmonella enterica enterica serovar Typhi Ty2
acaaacaccaccaguaacc

SEQ ID NO: 1797197 - RNA, 22 nt, Salmonella enterica enterica serovar Typhi Ty2
acaaaauuuugcauaaauaaug

SEQ ID NO: 1797198 - RNA, 15 nt, Salmonella enterica enterica serovar Typhi Ty2
acaaacaaauaaauc

SEQ ID NO: 1797199 - RNA, 19 nt, Salmonella enterica enterica serovar Typhi Ty2
acaaaccagacgcguaacc

SEQ ID NO: 1797200 - RNA, 23 nt, Salmonella enterica enterica serovar Typhi Ty2
acaaaccgcgcgguuauaucucc

SEQ ID NO: 1797201 - RNA, 16 nt, Salmonella enterica enterica serovar Typhi Ty2
acaaacgcaccgccaa

SEQ ID NO: 1797202 - RNA, 22 nt, Salmonella enterica enterica serovar Typhi Ty2
acaaacucacguuccccagcac

SEQ ID NO: 1797203 - RNA, 14 nt, Salmonella enterica enterica serovar Typhi Ty2
acaaaaucauugcg

SEQ ID NO: 1797204 - RNA, 13 nt, Salmonella enterica enterica serovar Typhi Ty2
acaaaauauugcc

SEQ ID NO: 1797205 - RNA, 17 nt, Salmonella enterica enterica serovar Typhi Ty2
acaaaauggcugauaaa

SEQ ID NO: 1797206 - RNA, 16 nt, Salmonella enterica enterica serovar Typhi Ty2
acaaaauaaagugaaa

SEQ ID NO: 1797207 - RNA, 18 nt, Salmonella enterica enterica serovar Typhi Ty2
acaaaagaaagcaauagc

SEQ ID NO: 1797208 - RNA, 15 nt, Salmonella enterica enterica serovar Typhi Ty2
aauuuauaacguauc

SEQ ID NO: 1797209 - RNA, 16 nt, Salmonella enterica enterica serovar Typhi Ty2
acaaaaaaaccgcuca

SEQ ID NO: 1797210 - RNA, 18 nt, Salmonella enterica enterica serovar Typhi Ty2
acaaaaaaacggccucaa

SEQ ID NO: 1797211 - RNA, 16 nt, Salmonella enterica enterica serovar Typhi Ty2
acaaaaaguaguucca

SEQ ID NO: 1797212 - RNA, 21 nt, Salmonella enterica enterica serovar Typhi Ty2
acaaaaagcgcgccgaaaaua

SEQ ID NO: 1797213 - RNA, 21 nt, Salmonella enterica enterica serovar Typhi Ty2
acaaaaccgcuaaugaggaaa

SEQ ID NO: 1797214 - RNA, 17 nt, Salmonella enterica enterica serovar Typhi Ty2
acaccaacgcuggcccg

SEQ ID NO: 1797215 - RNA, 15 nt, Salmonella enterica enterica serovar Typhi Ty2
acacccauagcagcu

SEQ ID NO: 1797216 - RNA, 14 nt, Salmonella enterica enterica serovar Typhi Ty2
acacccgcacgccu

SEQ ID NO: 1797217 - RNA, 15 nt, Salmonella enterica enterica serovar Typhi Ty2
acacccgcagccaga

SEQ ID NO: 1797218 - RNA, 15 nt, Salmonella enterica enterica serovar Typhi Ty2
acacccgcagccgca

SEQ ID NO: 1797219 - RNA, 19 nt, Salmonella enterica enterica serovar Typhi Ty2
acacauuuucaaugcacgc

SEQ ID NO: 1797220 - RNA, 19 nt, Salmonella enterica enterica serovar Typhi Ty2
acacauuaaaaaagauuaa

SEQ ID NO: 1797221 - RNA, 20 nt, Salmonella enterica enterica serovar Typhi Ty2
acaauuuugauaagagaaaa

SEQ ID NO: 1797222 - RNA, 22 nt, Salmonella enterica enterica serovar Typhi Ty2
acacaaaagcaucguaccuuca

SEQ ID NO: 1797223 - RNA, 13 nt, Salmonella enterica enterica serovar Typhi Ty2
acacaacggcaca

SEQ ID NO: 1797224 - RNA, 18 nt, Salmonella enterica enterica serovar Typhi Ty2
acacgccacaaacugcgc

SEQ ID NO: 1797225 - RNA, 16 nt, Salmonella enterica enterica serovar Typhi Ty2
acacgauaaaccucac

SEQ ID NO: 1797226 - RNA, 13 nt, Salmonella enterica enterica serovar Typhi Ty2
acacgauggcaaa

SEQ ID NO: 1797227 - RNA, 17 nt, Salmonella enterica enterica serovar Typhi Ty2
acacggcgcucaggauc

SEQ ID NO: 1797228 - RNA, 14 nt, Salmonella enterica enterica serovar Typhi Ty2
acacggcgcucagg

SEQ ID NO: 1797229 - RNA, 21 nt, Salmonella enterica enterica serovar Typhi Ty2
acacgcgcaccaguucacucc

SEQ ID NO: 1797230 - RNA, 14 nt, Salmonella enterica enterica serovar Typhi Ty2
acacgccuuccucc

SEQ ID NO: 1797231 - RNA, 17 nt, Salmonella enterica enterica serovar Typhi Ty2
acacgcgaauagccaga

SEQ ID NO: 1797232 - RNA, 17 nt, Salmonella enterica enterica serovar Typhi Ty2
acacgcuggaagagaac

SEQ ID NO: 1797233 - RNA, 14 nt, Salmonella enterica enterica serovar Typhi Ty2
acacgcucauguuc

SEQ ID NO: 1797234 - RNA, 21 nt, Salmonella enterica enterica serovar Typhi Ty2
acaccugggcuugcuuuucuc

SEQ ID NO: 1797235 - RNA, 20 nt, Salmonella enterica enterica serovar Typhi Ty2
acaccuguaacgucacauuc

SEQ ID NO: 1797236 - RNA, 12 nt, Salmonella enterica enterica serovar Typhi Ty2
acaccuuugggg

SEQ ID NO: 1797237 - RNA, 20 nt, Salmonella enterica enterica serovar Typhi Ty2
acaccgguugcgcaaccucc

SEQ ID NO: 1797238 - RNA, 13 nt, Salmonella enterica enterica serovar Typhi Ty2
acaccggccugcc

SEQ ID NO: 1797239 - RNA, 22 nt, Salmonella enterica enterica serovar Typhi Ty2
acaccggcggcgccaucgccuc

SEQ ID NO: 1797240 - RNA, 19 nt, Salmonella enterica enterica serovar Typhi Ty2
acaccggaauucuguucag

SEQ ID NO: 1797241 - RNA, 13 nt, Salmonella enterica enterica serovar Typhi Ty2
acaagcucauuuc

SEQ ID NO: 1797242 - RNA, 15 nt, Salmonella enterica enterica serovar Typhi Ty2
acaagcuaaucccca

SEQ ID NO: 1797243 - RNA, 21 nt, Salmonella enterica enterica serovar Typhi Ty2
acaaggucggcuccuggugag

SEQ ID NO: 1797244 - RNA, 16 nt, Salmonella enterica enterica serovar Typhi Ty2
acaaggcuuuuggcuu

SEQ ID NO: 1797245 - RNA, 17 nt, Salmonella enterica enterica serovar Typhi Ty2
acaaggcuuuuggcuua

SEQ ID NO: 1797246 - RNA, 14 nt, Salmonella enterica enterica serovar Typhi Ty2
acaauacgccgagc

SEQ ID NO: 1797247 - RNA, 18 nt, Salmonella enterica enterica serovar Typhi Ty2
acaauacuuaaaccugcg

SEQ ID NO: 1797248 - RNA, 19 nt, Salmonella enterica enterica serovar Typhi Ty2
acaauacuuaaaccugcgc

SEQ ID NO: 1797249 - RNA, 22 nt, Salmonella enterica enterica serovar Typhi Ty2
acaauauucgccgcgauaauaa

SEQ ID NO: 1797250 - RNA, 12 nt, Salmonella enterica enterica serovar Typhi Ty2
acaauaccaaua

SEQ ID NO: 1797251 - RNA, 17 nt, Salmonella enterica enterica serovar Typhi Ty2
acaauaccaauaagaac

SEQ ID NO: 1797252 - RNA, 19 nt, Salmonella enterica enterica serovar Typhi Ty2
acaauaauucgugugauuu

SEQ ID NO: 1797253 - RNA, 22 nt, Salmonella enterica enterica serovar Typhi Ty2
acaauaaucgcgagaaaauaga

SEQ ID NO: 1797254 - RNA, 15 nt, Salmonella enterica enterica serovar Typhi Ty2
acaagugucgugaau

SEQ ID NO: 1797255 - RNA, 17 nt, Salmonella enterica enterica serovar Typhi Ty2
acaaguaauaaaauaau

SEQ ID NO: 1797256 - RNA, 15 nt, Salmonella enterica enterica serovar Typhi Ty2
acaaguaauaaaaua

SEQ ID NO: 1797257 - RNA, 17 nt, Salmonella enterica enterica serovar Typhi Ty2
acaaguuuauccagcac

SEQ ID NO: 1797258 - RNA, 17 nt, Salmonella enterica enterica serovar Typhi Ty2
acaauuccggcccaggc

SEQ ID NO: 1797259 - RNA, 15 nt, Salmonella enterica enterica serovar Typhi Ty2
acaauuugcccagcg

SEQ ID NO: 1797260 - RNA, 21 nt, Salmonella enterica enterica serovar Typhi Ty2
acaauucauagccacagcgcg

SEQ ID NO: 1797261 - RNA, 22 nt, Salmonella enterica enterica serovar Typhi Ty2
acaaugccauuauugcaucaau

SEQ ID NO: 1797262 - RNA, 15 nt, Salmonella enterica enterica serovar Typhi Ty2
acaaugaauccucgg

SEQ ID NO: 1797263 - RNA, 23 nt, Salmonella enterica enterica serovar Typhi Ty2
acaaucaauucacguuccauuuc

SEQ ID NO: 1797264 - RNA, 14 nt, Salmonella enterica enterica serovar Typhi Ty2
acaaucagcaccau

SEQ ID NO: 1797265 - RNA, 13 nt, Salmonella enterica enterica serovar Typhi Ty2
acaaucagcacca

SEQ ID NO: 1797266 - RNA, 15 nt, Salmonella enterica enterica serovar Typhi Ty2
acaaucagcacacua

SEQ ID NO: 1797267 - RNA, 15 nt, Salmonella enterica enterica serovar Typhi Ty2
acaaucagaagaaau

SEQ ID NO: 1797268 - RNA, 18 nt, Salmonella enterica enterica serovar Typhi Ty2
acaauccguuauuucaca

SEQ ID NO: 1797269 - RNA, 16 nt, Salmonella enterica enterica serovar Typhi Ty2
acaauccgccacgcuc

SEQ ID NO: 1797270 - RNA, 16 nt, Salmonella enterica enterica serovar Typhi Ty2
acaauccccgaaagcc

SEQ ID NO: 1797271 - RNA, 16 nt, Salmonella enterica enterica serovar Typhi Ty2
acaaucccggcaacug

SEQ ID NO: 1797272 - RNA, 21 nt, Salmonella enterica enterica serovar Typhi Ty2
acaaucgcguuuuccagcauc

SEQ ID NO: 1797273 - RNA, 14 nt, Salmonella enterica enterica serovar Typhi Ty2
acaaucgccagccc

SEQ ID NO: 1797274 - RNA, 17 nt, Salmonella enterica enterica serovar Typhi Ty2
acaaucguuaauucaug

SEQ ID NO: 1797275 - RNA, 14 nt, Salmonella enterica enterica serovar Typhi Ty2
aauccagcaggcug

SEQ ID NO: 1797276 - RNA, 13 nt, Salmonella enterica enterica serovar Typhi Ty2
aauccaucccccu

SEQ ID NO: 1797277 - RNA, 17 nt, Salmonella enterica enterica serovar Typhi Ty2
aauccaugagaagaaaa

SEQ ID NO: 1797278 - RNA, 12 nt, Salmonella enterica enterica serovar Typhi Ty2
aauccaucucag

SEQ ID NO: 1797279 - RNA, 18 nt, Salmonella enterica enterica serovar Typhi Ty2
aauccaugagaagaaaaa

SEQ ID NO: 1797280 - RNA, 17 nt, Salmonella enterica enterica serovar Typhi Ty2
aaucccaccaauugcca

SEQ ID NO: 1797281 - RNA, 17 nt, Salmonella enterica enterica serovar Typhi Ty2
aaucccacgccgcugau

SEQ ID NO: 1797282 - RNA, 21 nt, Salmonella enterica enterica serovar Typhi Ty2
aauccacuggucgucugaaag

SEQ ID NO: 1797283 - RNA, 21 nt, Salmonella enterica enterica serovar Typhi Ty2
aauccacggguuacaacugcg

SEQ ID NO: 1797284 - RNA, 18 nt, Salmonella enterica enterica serovar Typhi Ty2
aaucauugugguuucccu

SEQ ID NO: 1797285 - RNA, 18 nt, Salmonella enterica enterica serovar Typhi Ty2
aaucauuuagucgauggu

SEQ ID NO: 1797286 - RNA, 21 nt, Salmonella enterica enterica serovar Typhi Ty2
aaucagauugccacaggacca

SEQ ID NO: 1797287 - RNA, 13 nt, Salmonella enterica enterica serovar Typhi Ty2
aaucagaugcuca

SEQ ID NO: 1797288 - RNA, 18 nt, Salmonella enterica enterica serovar Typhi Ty2
aaucagcaauuuuguuaa

SEQ ID NO: 1797289 - RNA, 11 nt, Salmonella enterica enterica serovar Typhi Ty2
aaucagcagcg

SEQ ID NO: 1797290 - RNA, 16 nt, Salmonella enterica enterica serovar Typhi Ty2
aaucgaguucgcuuuu

SEQ ID NO: 1797291 - RNA, 12 nt, Salmonella enterica enterica serovar Typhi Ty2
aaucgacucacg

SEQ ID NO: 1797292 - RNA, 23 nt, Salmonella enterica enterica serovar Typhi Ty2
aauccuuguccauguaaacucca

SEQ ID NO: 1797293 - RNA, 19 nt, Salmonella enterica enterica serovar Typhi Ty2
aaucgauguaguuguucuu

SEQ ID NO: 1797294 - RNA, 15 nt, Salmonella enterica enterica serovar Typhi Ty2
aauccucacugccga

SEQ ID NO: 1797295 - RNA, 12 nt, Salmonella enterica enterica serovar Typhi Ty2
aauccuucuucc

SEQ ID NO: 1797296 - RNA, 23 nt, Salmonella enterica enterica serovar Typhi Ty2
aauccuucuaccuucacccccau

SEQ ID NO: 1797297 - RNA, 17 nt, Salmonella enterica enterica serovar Typhi Ty2
aauccugucgucaccag

SEQ ID NO: 1797298 - RNA, 18 nt, Salmonella enterica enterica serovar Typhi Ty2
aauccgccggaaacuggc

SEQ ID NO: 1797299 - RNA, 17 nt, Salmonella enterica enterica serovar Typhi Ty2
aauccgcuccacauccu

SEQ ID NO: 1797300 - RNA, 14 nt, Salmonella enterica enterica serovar Typhi Ty2
aauccgcgcccugg

SEQ ID NO: 1797301 - RNA, 17 nt, Salmonella enterica enterica serovar Typhi Ty2
aauccguuaagcccuga

SEQ ID NO: 1797302 - RNA, 21 nt, Salmonella enterica enterica serovar Typhi Ty2
aauccgagacgguaagaauaa

SEQ ID NO: 1797303 - RNA, 13 nt, Salmonella enterica enterica serovar Typhi Ty2
aaucccuucuuuu

SEQ ID NO: 1797304 - RNA, 14 nt, Salmonella enterica enterica serovar Typhi Ty2
aaucccuucuuuua

SEQ ID NO: 1797305 - RNA, 20 nt, Salmonella enterica enterica serovar Typhi Ty2
aaucccuucuuuuacugccc

SEQ ID NO: 1797306 - RNA, 14 nt, Salmonella enterica enterica serovar Typhi Ty2
aaucucaauaccac

SEQ ID NO: 1797307 - RNA, 22 nt, Salmonella enterica enterica serovar Typhi Ty2
aaucucagauaauagcugcggc

SEQ ID NO: 1797308 - RNA, 17 nt, Salmonella enterica enterica serovar Typhi Ty2
aaucucacugcccauuc

SEQ ID NO: 1797309 - RNA, 13 nt, Salmonella enterica enterica serovar Typhi Ty2
aaucucagauaau

SEQ ID NO: 1797310 - RNA, 20 nt, Salmonella enterica enterica serovar Typhi Ty2
aaucgugguuagacaucacg

SEQ ID NO: 1797311 - RNA, 16 nt, Salmonella enterica enterica serovar Typhi Ty2
aaucuaagagccuguc

SEQ ID NO: 1797312 - RNA, 17 nt, Salmonella enterica enterica serovar Typhi Ty2
aaucuaccagaucgcgg

SEQ ID NO: 1797313 - RNA, 19 nt, Salmonella enterica enterica serovar Typhi Ty2
aaucuaccauugauaccaa

SEQ ID NO: 1797314 - RNA, 14 nt, Salmonella enterica enterica serovar Typhi Ty2
aaucgauuuucucc

SEQ ID NO: 1797315 - RNA, 15 nt, Salmonella enterica enterica serovar Typhi Ty2
aaucgcaaacgccag

SEQ ID NO: 1797316 - RNA, 17 nt, Salmonella enterica enterica serovar Typhi Ty2
aaucgcaucauaaaugg

SEQ ID NO: 1797317 - RNA, 20 nt, Salmonella enterica enterica serovar Typhi Ty2
aaucgcgauaucaacccagu

SEQ ID NO: 1797318 - RNA, 14 nt, Salmonella enterica enterica serovar Typhi Ty2
aaucgucacagacc

SEQ ID NO: 1797319 - RNA, 18 nt, Salmonella enterica enterica serovar Typhi Ty2
aaucgucgaggaagcugc

SEQ ID NO: 1797320 - RNA, 20 nt, Salmonella enterica enterica serovar Typhi Ty2
aaucgucgccaacaccgauc

SEQ ID NO: 1797321 - RNA, 19 nt, Salmonella enterica enterica serovar Typhi Ty2
aaucuggucggugauauau

SEQ ID NO: 1797322 - RNA, 18 nt, Salmonella enterica enterica serovar Typhi Ty2
aaucuggucguaagaauu

SEQ ID NO: 1797323 - RNA, 23 nt, Salmonella enterica enterica serovar Typhi Ty2
aaucugcgccaaucgcgauauca

SEQ ID NO: 1797324 - RNA, 16 nt, Salmonella enterica enterica serovar Typhi Ty2
aaucuggauagucagg

SEQ ID NO: 1797325 - RNA, 20 nt, Salmonella enterica enterica serovar Typhi Ty2
aaucugccgucaucgacuuc

SEQ ID NO: 1797326 - RNA, 19 nt, Salmonella enterica enterica serovar Typhi Ty2
aaucugccaucagcaccuu

SEQ ID NO: 1797327 - RNA, 23 nt, Salmonella enterica enterica serovar Typhi Ty2
aaucugacgcauccgcuucucua

SEQ ID NO: 1797328 - RNA, 17 nt, Salmonella enterica enterica serovar Typhi Ty2
aaucuguucguugcugu

SEQ ID NO: 1797329 - RNA, 15 nt, Salmonella enterica enterica serovar Typhi Ty2
aaucuuaccuguucc

SEQ ID NO: 1797330 - RNA, 21 nt, Salmonella enterica enterica serovar Typhi Ty2
aauauuuuuccgcggagagau

SEQ ID NO: 1797331 - RNA, 21 nt, Salmonella enterica enterica serovar Typhi Ty2
aauauuugaaucucagacgcc

SEQ ID NO: 1797332 - RNA, 18 nt, Salmonella enterica enterica serovar Typhi Ty2
aauauuucuuugucgcca

SEQ ID NO: 1797333 - RNA, 19 nt, Salmonella enterica enterica serovar Typhi Ty2
aauauuuauuuaauguuuc

SEQ ID NO: 1797334 - RNA, 18 nt, Salmonella enterica enterica serovar Typhi Ty2
aauauuguuuaacguuuc

SEQ ID NO: 1797335 - RNA, 16 nt, Salmonella enterica enterica serovar Typhi Ty2
aauauugaacauuuuu

SEQ ID NO: 1797336 - RNA, 15 nt, Salmonella enterica enterica serovar Typhi Ty2
aauauugacaguaau

SEQ ID NO: 1797337 - RNA, 15 nt, Salmonella enterica enterica serovar Typhi Ty2
aauauugagaauaaa

SEQ ID NO: 1797338 - RNA, 10 nt, Salmonella enterica enterica serovar Typhi Ty2
aauauucauu

SEQ ID NO: 1797339 - RNA, 21 nt, Salmonella enterica enterica serovar Typhi Ty2
aauauucauucugucagaaau

SEQ ID NO: 1797340 - RNA, 14 nt, Salmonella enterica enterica serovar Typhi Ty2
aauauucagcacau

SEQ ID NO: 1797341 - RNA, 22 nt, Salmonella enterica enterica serovar Typhi Ty2
aauauuauugacgcuuucuucc

SEQ ID NO: 1797342 - RNA, 22 nt, Salmonella enterica enterica serovar Typhi Ty2
aauauggugaguaauaacaaaa

SEQ ID NO: 1797343 - RNA, 21 nt, Salmonella enterica enterica serovar Typhi Ty2
aauaugggauuugaugcccaa

SEQ ID NO: 1797344 - RNA, 13 nt, Salmonella enterica enterica serovar Typhi Ty2
aauauggaauauc

SEQ ID NO: 1797345 - RNA, 17 nt, Salmonella enterica enterica serovar Typhi Ty2
aauauuaacggucuuuc

SEQ ID NO: 1797346 - RNA, 21 nt, Salmonella enterica enterica serovar Typhi Ty2
aauauuaaggccgaauuugaa

SEQ ID NO: 1797347 - RNA, 20 nt, Salmonella enterica enterica serovar Typhi Ty2
aauauuagcgguacucuuuu

SEQ ID NO: 1797348 - RNA, 16 nt, Salmonella enterica enterica serovar Typhi Ty2
aauauuaaugaauaaa

SEQ ID NO: 1797349 - RNA, 23 nt, Salmonella enterica enterica serovar Typhi Ty2
aauaugauauguguaucuugcuu

SEQ ID NO: 1797350 - RNA, 17 nt, Salmonella enterica enterica serovar Typhi Ty2
aauaugauuuaaaaaag

SEQ ID NO: 1797351 - RNA, 15 nt, Salmonella enterica enterica serovar Typhi Ty2
aauaugcgcaaucac

SEQ ID NO: 1797352 - RNA, 13 nt, Salmonella enterica enterica serovar Typhi Ty2
aauaugccaggcu

SEQ ID NO: 1797353 - RNA, 14 nt, Salmonella enterica enterica serovar Typhi Ty2
aauaugccaggcau

SEQ ID NO: 1797354 - RNA, 17 nt, Salmonella enterica enterica serovar Typhi Ty2
aauaugcuggcuuaacu

SEQ ID NO: 1797355 - RNA, 17 nt, Salmonella enterica enterica serovar Typhi Ty2
aauaugcgucagauaaa

SEQ ID NO: 1797356 - RNA, 21 nt, Salmonella enterica enterica serovar Typhi Ty2
aauagccagaaugccagcgcc

SEQ ID NO: 1797357 - RNA, 19 nt, Salmonella enterica enterica serovar Typhi Ty2
aauagccagccccagaaaa

SEQ ID NO: 1797358 - RNA, 18 nt, Salmonella enterica enterica serovar Typhi Ty2
aaucacgcaucacuuuug

SEQ ID NO: 1797359 - RNA, 21 nt, Salmonella enterica enterica serovar Typhi Ty2
aaucacgcccgcagcaauaga

SEQ ID NO: 1797360 - RNA, 15 nt, Salmonella enterica enterica serovar Typhi Ty2
aaucacgccgaugac

SEQ ID NO: 1797361 - RNA, 23 nt, Salmonella enterica enterica serovar Typhi Ty2
aaucacgcguaucuggucaucgu

SEQ ID NO: 1797362 - RNA, 14 nt, Salmonella enterica enterica serovar Typhi Ty2
aaucacgcaucacu

SEQ ID NO: 1797363 - RNA, 18 nt, Salmonella enterica enterica serovar Typhi Ty2
aaucacuaagaccagcau

SEQ ID NO: 1797364 - RNA, 20 nt, Salmonella enterica enterica serovar Typhi Ty2
aaucacguuuugcagcgcca

SEQ ID NO: 1797365 - RNA, 14 nt, Salmonella enterica enterica serovar Typhi Ty2
aaucacugacggaa

SEQ ID NO: 1797366 - RNA, 15 nt, Salmonella enterica enterica serovar Typhi Ty2
aaucagaagaaauau

SEQ ID NO: 1797367 - RNA, 18 nt, Salmonella enterica enterica serovar Typhi Ty2
aaucagagacaaauacau

SEQ ID NO: 1797368 - RNA, 21 nt, Salmonella enterica enterica serovar Typhi Ty2
aaucagacuaucuucgauaaa

SEQ ID NO: 1797369 - RNA, 17 nt, Salmonella enterica enterica serovar Typhi Ty2
aaucacaacguaaucau

SEQ ID NO: 1797370 - RNA, 12 nt, Salmonella enterica enterica serovar Typhi Ty2
aaucacaucgcc

SEQ ID NO: 1797371 - RNA, 13 nt, Salmonella enterica enterica serovar Typhi Ty2
aaucacaugcauu

SEQ ID NO: 1797372 - RNA, 20 nt, Salmonella enterica enterica serovar Typhi Ty2
aaucaccacguaacucggca

SEQ ID NO: 1797373 - RNA, 15 nt, Salmonella enterica enterica serovar Typhi Ty2
aaucacaucauuaaa

SEQ ID NO: 1797374 - RNA, 22 nt, Salmonella enterica enterica serovar Typhi Ty2
aaucacccagaugcgaaucuuc

SEQ ID NO: 1797375 - RNA, 17 nt, Salmonella enterica enterica serovar Typhi Ty2
aaucaccgacagcaccg

SEQ ID NO: 1797376 - RNA, 15 nt, Salmonella enterica enterica serovar Typhi Ty2
aaucaccgccagcaa

SEQ ID NO: 1797377 - RNA, 12 nt, Salmonella enterica enterica serovar Typhi Ty2
aaucaccgccag

SEQ ID NO: 1797378 - RNA, 20 nt, Salmonella enterica enterica serovar Typhi Ty2
aaucaacugcgccacaucau

SEQ ID NO: 1797379 - RNA, 13 nt, Salmonella enterica enterica serovar Typhi Ty2
aaucaagauuaau

SEQ ID NO: 1797380 - RNA, 20 nt, Salmonella enterica enterica serovar Typhi Ty2
aaucaacauuauuaaaaugu

SEQ ID NO: 1797381 - RNA, 22 nt, Salmonella enterica enterica serovar Typhi Ty2
aaucaacacgucgauuuucccu

SEQ ID NO: 1797382 - RNA, 12 nt, Salmonella enterica enterica serovar Typhi Ty2
aaucaaacucac

SEQ ID NO: 1797383 - RNA, 11 nt, Salmonella enterica enterica serovar Typhi Ty2
aauauuuuucc

SEQ ID NO: 1797384 - RNA, 11 nt, Salmonella enterica enterica serovar Typhi Ty2
aauugcugaag

SEQ ID NO: 1797385 - RNA, 14 nt, Salmonella enterica enterica serovar Typhi Ty2
aauugcucugccag

SEQ ID NO: 1797386 - RNA, 16 nt, Salmonella enterica enterica serovar Typhi Ty2
aauugccgucgccgga

SEQ ID NO: 1797387 - RNA, 13 nt, Salmonella enterica enterica serovar Typhi Ty2
aauugccgcccgu

SEQ ID NO: 1797388 - RNA, 22 nt, Salmonella enterica enterica serovar Typhi Ty2
aauuuaagccagacgcgcagca

SEQ ID NO: 1797389 - RNA, 18 nt, Salmonella enterica enterica serovar Typhi Ty2
aauuuaagcuuaaugaua

SEQ ID NO: 1797390 - RNA, 19 nt, Salmonella enterica enterica serovar Typhi Ty2
aauuuaauauaugaaccaa

SEQ ID NO: 1797391 - RNA, 16 nt, Salmonella enterica enterica serovar Typhi Ty2
aauuguuuaaaaacag

SEQ ID NO: 1797392 - RNA, 20 nt, Salmonella enterica enterica serovar Typhi Ty2
aauuguugcgccauggcuuc

SEQ ID NO: 1797393 - RNA, 17 nt, Salmonella enterica enterica serovar Typhi Ty2
aauuguuccuguaaagc

SEQ ID NO: 1797394 - RNA, 16 nt, Salmonella enterica enterica serovar Typhi Ty2
aauugucagaaucaca

SEQ ID NO: 1797395 - RNA, 14 nt, Salmonella enterica enterica serovar Typhi Ty2
aauugguuauauua

SEQ ID NO: 1797396 - RNA, 18 nt, Salmonella enterica enterica serovar Typhi Ty2
aauuguaggcaggaauuc

SEQ ID NO: 1797397 - RNA, 18 nt, Salmonella enterica enterica serovar Typhi Ty2
aauucaccgcaugacaau

SEQ ID NO: 1797398 - RNA, 19 nt, Salmonella enterica enterica serovar Typhi Ty2
aauucaccaaauccucacu

SEQ ID NO: 1797399 - RNA, 22 nt, Salmonella enterica enterica serovar Typhi Ty2
aauuauuaucaauuucauauua

SEQ ID NO: 1797400 - RNA, 22 nt, Salmonella enterica enterica serovar Typhi Ty2
aauucagcauuaggcguaaaau

SEQ ID NO: 1797401 - RNA, 19 nt, Salmonella enterica enterica serovar Typhi Ty2
aauucagcgucgagcaccu

SEQ ID NO: 1797402 - RNA, 23 nt, Salmonella enterica enterica serovar Typhi Ty2
aauucacuuccgucauguagcaa

SEQ ID NO: 1797403 - RNA, 12 nt, Salmonella enterica enterica serovar Typhi Ty2
aauucagacuca

SEQ ID NO: 1797404 - RNA, 18 nt, Salmonella enterica enterica serovar Typhi Ty2
aauucacgcuucucuggc

SEQ ID NO: 1797405 - RNA, 17 nt, Salmonella enterica enterica serovar Typhi Ty2
aauucaccaaauccuca

SEQ ID NO: 1797406 - RNA, 15 nt, Salmonella enterica enterica serovar Typhi Ty2
aauuaacucaucaca

SEQ ID NO: 1797407 - RNA, 21 nt, Salmonella enterica enterica serovar Typhi Ty2
aauuaacgacaaaaauaccac

SEQ ID NO: 1797408 - RNA, 12 nt, Salmonella enterica enterica serovar Typhi Ty2
aauuauaaagca

SEQ ID NO: 1797409 - RNA, 13 nt, Salmonella enterica enterica serovar Typhi Ty2
aauuauaaagcau

SEQ ID NO: 1797410 - RNA, 17 nt, Salmonella enterica enterica serovar Typhi Ty2
aauuauacacucaacca

SEQ ID NO: 1797411 - RNA, 22 nt, Salmonella enterica enterica serovar Typhi Ty2
aauuauauugcguaaaaacccu

SEQ ID NO: 1797412 - RNA, 22 nt, Salmonella enterica enterica serovar Typhi Ty2
aauuccaggcccggugucagac

SEQ ID NO: 1797413 - RNA, 14 nt, Salmonella enterica enterica serovar Typhi Ty2
aauuccaggaugac

SEQ ID NO: 1797414 - RNA, 11 nt, Salmonella enterica enterica serovar Typhi Ty2
aauuccagcaa

SEQ ID NO: 1797415 - RNA, 20 nt, Salmonella enterica enterica serovar Typhi Ty2
aauucauuacgaaguuuaau

SEQ ID NO: 1797416 - RNA, 17 nt, Salmonella enterica enterica serovar Typhi Ty2
aauuccuuguuuuaacg

SEQ ID NO: 1797417 - RNA, 16 nt, Salmonella enterica enterica serovar Typhi Ty2
aauuccugacugcgcg

SEQ ID NO: 1797418 - RNA, 21 nt, Salmonella enterica enterica serovar Typhi Ty2
aauucgaaauaaagaaaguag

SEQ ID NO: 1797419 - RNA, 21 nt, Salmonella enterica enterica serovar Typhi Ty2
aauucucccaaauuuuuuuag

SEQ ID NO: 1797420 - RNA, 21 nt, Salmonella enterica enterica serovar Typhi Ty2
aauucugacgcagcuucugau

SEQ ID NO: 1797421 - RNA, 17 nt, Salmonella enterica enterica serovar Typhi Ty2
aauguugguauauucga

SEQ ID NO: 1797422 - RNA, 11 nt, Salmonella enterica enterica serovar Typhi Ty2
aauuaaaaaua

SEQ ID NO: 1797423 - RNA, 22 nt, Salmonella enterica enterica serovar Typhi Ty2
aauguuuuuguuguuaauuuga

SEQ ID NO: 1797424 - RNA, 20 nt, Salmonella enterica enterica serovar Typhi Ty2
aauuaaauagggacuuauaa

SEQ ID NO: 1797425 - RNA, 13 nt, Salmonella enterica enterica serovar Typhi Ty2
aauuaacccacau

SEQ ID NO: 1797426 - RNA, 14 nt, Salmonella enterica enterica serovar Typhi Ty2
aauuaacaaauaaa

SEQ ID NO: 1797427 - RNA, 16 nt, Salmonella enterica enterica serovar Typhi Ty2
aaugucgcgucagguu

SEQ ID NO: 1797428 - RNA, 21 nt, Salmonella enterica enterica serovar Typhi Ty2
aaugucggccugauuucugac

SEQ ID NO: 1797429 - RNA, 16 nt, Salmonella enterica enterica serovar Typhi Ty2
aaugugauccgccccc

SEQ ID NO: 1797430 - RNA, 18 nt, Salmonella enterica enterica serovar Typhi Ty2
aaugugaaauacagccag

SEQ ID NO: 1797431 - RNA, 18 nt, Salmonella enterica enterica serovar Typhi Ty2
aaugucuggcgcuaaaau

SEQ ID NO: 1797432 - RNA, 16 nt, Salmonella enterica enterica serovar Typhi Ty2
aauguauuuuuuguaa

SEQ ID NO: 1797433 - RNA, 14 nt, Salmonella enterica enterica serovar Typhi Ty2
aauguauuucagac

SEQ ID NO: 1797434 - RNA, 20 nt, Salmonella enterica enterica serovar Typhi Ty2
aauguccguuuucgacaugg

SEQ ID NO: 1797435 - RNA, 20 nt, Salmonella enterica enterica serovar Typhi Ty2
aauguccauaaauagaucau

SEQ ID NO: 1797436 - RNA, 17 nt, Salmonella enterica enterica serovar Typhi Ty2
aauguccauaaauagau

SEQ ID NO: 1797437 - RNA, 20 nt, Salmonella enterica enterica serovar Typhi Ty2
aaugucccaguaauaucgcc

SEQ ID NO: 1797438 - RNA, 13 nt, Salmonella enterica enterica serovar Typhi Ty2
aauguccagcagu

SEQ ID NO: 1797439 - RNA, 23 nt, Salmonella enterica enterica serovar Typhi Ty2
aaugugcaaucacacuacacgaa

SEQ ID NO: 1797440 - RNA, 17 nt, Salmonella enterica enterica serovar Typhi Ty2
aauguuaauaagcagaa

SEQ ID NO: 1797441 - RNA, 22 nt, Salmonella enterica enterica serovar Typhi Ty2
aauguuagcauuauuuuuaacc

SEQ ID NO: 1797442 - RNA, 18 nt, Salmonella enterica enterica serovar Typhi Ty2
aauguucgguauaugaau

SEQ ID NO: 1797443 - RNA, 23 nt, Salmonella enterica enterica serovar Typhi Ty2
aaugauuuuguguauauauugca

SEQ ID NO: 1797444 - RNA, 13 nt, Salmonella enterica enterica serovar Typhi Ty2
aaugauuugcuuu

SEQ ID NO: 1797445 - RNA, 14 nt, Salmonella enterica enterica serovar Typhi Ty2
aaugccuuccugug

SEQ ID NO: 1797446 - RNA, 14 nt, Salmonella enterica enterica serovar Typhi Ty2
aaugcgaaaaaaag

SEQ ID NO: 1797447 - RNA, 24 nt, Salmonella enterica enterica serovar Typhi Ty2
aaugccuuauccggccugcaggca

SEQ ID NO: 1797448 - RNA, 16 nt, Salmonella enterica enterica serovar Typhi Ty2
aaugccuguuuauauu

SEQ ID NO: 1797449 - RNA, 13 nt, Salmonella enterica enterica serovar Typhi Ty2
aaugccuguuuau

SEQ ID NO: 1797450 - RNA, 12 nt, Salmonella enterica enterica serovar Typhi Ty2
aaugcccaaaau

SEQ ID NO: 1797451 - RNA, 19 nt, Salmonella enterica enterica serovar Typhi Ty2
aaugcgcaaucccggagag

SEQ ID NO: 1797452 - RNA, 18 nt, Salmonella enterica enterica serovar Typhi Ty2
aaugccacgauccccguc

SEQ ID NO: 1797453 - RNA, 13 nt, Salmonella enterica enterica serovar Typhi Ty2
aauggaaaauaau

SEQ ID NO: 1797454 - RNA, 14 nt, Salmonella enterica enterica serovar Typhi Ty2
aauggaaaauaaua

SEQ ID NO: 1797455 - RNA, 14 nt, Salmonella enterica enterica serovar Typhi Ty2
aaugcuuuaaaugc

SEQ ID NO: 1797456 - RNA, 18 nt, Salmonella enterica enterica serovar Typhi Ty2
aaugcggcguguggcugu

SEQ ID NO: 1797457 - RNA, 19 nt, Salmonella enterica enterica serovar Typhi Ty2
aaugcgcuuuuuuugcccu

SEQ ID NO: 1797458 - RNA, 16 nt, Salmonella enterica enterica serovar Typhi Ty2
aaugcggccauccugc

SEQ ID NO: 1797459 - RNA, 21 nt, Salmonella enterica enterica serovar Typhi Ty2
aaugcgcgugcgguuuuccug

SEQ ID NO: 1797460 - RNA, 15 nt, Salmonella enterica enterica serovar Typhi Ty2
aaugcgccccggcgg

SEQ ID NO: 1797461 - RNA, 14 nt, Salmonella enterica enterica serovar Typhi Ty2
aauggaggcaguga

SEQ ID NO: 1797462 - RNA, 11 nt, Salmonella enterica enterica serovar Typhi Ty2
aauggagauga

SEQ ID NO: 1797463 - RNA, 12 nt, Salmonella enterica enterica serovar Typhi Ty2
aauggcgaaaaa

SEQ ID NO: 1797464 - RNA, 20 nt, Salmonella enterica enterica serovar Typhi Ty2
aauggccagaugaaacugca

SEQ ID NO: 1797465 - RNA, 21 nt, Salmonella enterica enterica serovar Typhi Ty2
aauggcgcgucuuaaaauugc

SEQ ID NO: 1797466 - RNA, 13 nt, Salmonella enterica enterica serovar Typhi Ty2
aaugguuauuaau

SEQ ID NO: 1797467 - RNA, 13 nt, Salmonella enterica enterica serovar Typhi Ty2
aauguaaaacuga

SEQ ID NO: 1797468 - RNA, 15 nt, Salmonella enterica enterica serovar Typhi Ty2
aauguacaucacauu

SEQ ID NO: 1797469 - RNA, 14 nt, Salmonella enterica enterica serovar Typhi Ty2
aacagcaauguuuc

SEQ ID NO: 1797470 - RNA, 21 nt, Salmonella enterica enterica serovar Typhi Ty2
aacagcauaaacguuaccaua

SEQ ID NO: 1797471 - RNA, 18 nt, Salmonella enterica enterica serovar Typhi Ty2
aacagcauaauaaagcag

SEQ ID NO: 1797472 - RNA, 13 nt, Salmonella enterica enterica serovar Typhi Ty2
aacagcaggaccc

SEQ ID NO: 1797473 - RNA, 13 nt, Salmonella enterica enterica serovar Typhi Ty2
aacagccagcagc

SEQ ID NO: 1797474 - RNA, 12 nt, Salmonella enterica enterica serovar Typhi Ty2
aacagccaggcu

SEQ ID NO: 1797475 - RNA, 23 nt, Salmonella enterica enterica serovar Typhi Ty2
aacagccaaucauaaacgccuga

SEQ ID NO: 1797476 - RNA, 19 nt, Salmonella enterica enterica serovar Typhi Ty2
aacagaaucgcgcugaggg

SEQ ID NO: 1797477 - RNA, 17 nt, Salmonella enterica enterica serovar Typhi Ty2
aacagaauuaccugggu

SEQ ID NO: 1797478 - RNA, 14 nt, Salmonella enterica enterica serovar Typhi Ty2
aacagaaaccauaa

SEQ ID NO: 1797479 - RNA, 21 nt, Salmonella enterica enterica serovar Typhi Ty2
aacagaaaccauaaacaaaac

SEQ ID NO: 1797480 - RNA, 23 nt, Salmonella enterica enterica serovar Typhi Ty2
aacagaaaccauaaacaaaacaa

SEQ ID NO: 1797481 - RNA, 21 nt, Salmonella enterica enterica serovar Typhi Ty2
aacagaaaaaaugcaccgccu

SEQ ID NO: 1797482 - RNA, 18 nt, Salmonella enterica enterica serovar Typhi Ty2
aacagaaaagaucgcugc

SEQ ID NO: 1797483 - RNA, 22 nt, Salmonella enterica enterica serovar Typhi Ty2
aacagagagggaaaaaaauccu

SEQ ID NO: 1797484 - RNA, 22 nt, Salmonella enterica enterica serovar Typhi Ty2
aacagagcgccggcaaagccau

SEQ ID NO: 1797485 - RNA, 12 nt, Salmonella enterica enterica serovar Typhi Ty2
aacagagcaauu

SEQ ID NO: 1797486 - RNA, 22 nt, Salmonella enterica enterica serovar Typhi Ty2
aacagacaauuagcgacgcaua

SEQ ID NO: 1797487 - RNA, 15 nt, Salmonella enterica enterica serovar Typhi Ty2
aacagaguaacccga

SEQ ID NO: 1797488 - RNA, 13 nt, Salmonella enterica enterica serovar Typhi Ty2
aacagauaaaugu

SEQ ID NO: 1797489 - RNA, 13 nt, Salmonella enterica enterica serovar Typhi Ty2
aacagauacugga

SEQ ID NO: 1797490 - RNA, 20 nt, Salmonella enterica enterica serovar Typhi Ty2
aacacucacaaaacuauuuu

SEQ ID NO: 1797491 - RNA, 20 nt, Salmonella enterica enterica serovar Typhi Ty2
aacacuaacuaauuguuugu

SEQ ID NO: 1797492 - RNA, 16 nt, Salmonella enterica enterica serovar Typhi Ty2
aacacuaaaucauaau

SEQ ID NO: 1797493 - RNA, 13 nt, Salmonella enterica enterica serovar Typhi Ty2
aacacucuccacc

SEQ ID NO: 1797494 - RNA, 21 nt, Salmonella enterica enterica serovar Typhi Ty2
aacacgccgccuaucgccagc

SEQ ID NO: 1797495 - RNA, 22 nt, Salmonella enterica enterica serovar Typhi Ty2
aacacgauggcaaauaauacca

SEQ ID NO: 1797496 - RNA, 15 nt, Salmonella enterica enterica serovar Typhi Ty2
aacacgauaaaacgc

SEQ ID NO: 1797497 - RNA, 15 nt, Salmonella enterica enterica serovar Typhi Ty2
aacacgucgauuuuc

SEQ ID NO: 1797498 - RNA, 22 nt, Salmonella enterica enterica serovar Typhi Ty2
aacaccuguaacgucacauucc

SEQ ID NO: 1797499 - RNA, 17 nt, Salmonella enterica enterica serovar Typhi Ty2
aacaccagcgauccaga

SEQ ID NO: 1797500 - RNA, 21 nt, Salmonella enterica enterica serovar Typhi Ty2
aacaccagccgcaucuuauau

SEQ ID NO: 1797501 - RNA, 16 nt, Salmonella enterica enterica serovar Typhi Ty2
aacacacuuucugcuu

SEQ ID NO: 1797502 - RNA, 23 nt, Salmonella enterica enterica serovar Typhi Ty2
aacacacguaacaaccagaauaa

SEQ ID NO: 1797503 - RNA, 18 nt, Salmonella enterica enterica serovar Typhi Ty2
aacacacaguugccuucg

SEQ ID NO: 1797504 - RNA, 22 nt, Salmonella enterica enterica serovar Typhi Ty2
aacacauaacgcccgacaaucg

SEQ ID NO: 1797505 - RNA, 15 nt, Salmonella enterica enterica serovar Typhi Ty2
aaaaagguaacuauu

SEQ ID NO: 1797506 - RNA, 17 nt, Salmonella enterica enterica serovar Typhi Ty2
aacaauuugcccagcgc

SEQ ID NO: 1797507 - RNA, 17 nt, Salmonella enterica enterica serovar Typhi Ty2
aacaaugggauaaaaug

SEQ ID NO: 1797508 - RNA, 19 nt, Salmonella enterica enterica serovar Typhi Ty2
aacaauccccgucacagcg

SEQ ID NO: 1797509 - RNA, 20 nt, Salmonella enterica enterica serovar Typhi Ty2
aaauucuuuacgcagcaaga

SEQ ID NO: 1797510 - RNA, 22 nt, Salmonella enterica enterica serovar Typhi Ty2
aaauucugucucaauaaaaugu

SEQ ID NO: 1797511 - RNA, 19 nt, Salmonella enterica enterica serovar Typhi Ty2
aaccacggauaagccagcc

SEQ ID NO: 1797512 - RNA, 20 nt, Salmonella enterica enterica serovar Typhi Ty2
aaccacggagagacaguuca

SEQ ID NO: 1797513 - RNA, 15 nt, Salmonella enterica enterica serovar Typhi Ty2
aaccacaaguuuauc

SEQ ID NO: 1797514 - RNA, 13 nt, Salmonella enterica enterica serovar Typhi Ty2
aaccacgaaaauu

SEQ ID NO: 1797515 - RNA, 21 nt, Salmonella enterica enterica serovar Typhi Ty2
aaccauucccguaaaagaaga

SEQ ID NO: 1797516 - RNA, 20 nt, Salmonella enterica enterica serovar Typhi Ty2
aaccauucccgauaaugacc

SEQ ID NO: 1797517 - RNA, 22 nt, Salmonella enterica enterica serovar Typhi Ty2
aaccauguugaucguaaaauga

SEQ ID NO: 1797518 - RNA, 12 nt, Salmonella enterica enterica serovar Typhi Ty2
aaccaugaucac

SEQ ID NO: 1797519 - RNA, 15 nt, Salmonella enterica enterica serovar Typhi Ty2
aaccaucaaaaaaaa

SEQ ID NO: 1797520 - RNA, 19 nt, Salmonella enterica enterica serovar Typhi Ty2
aacccauauucgucuucau

SEQ ID NO: 1797521 - RNA, 12 nt, Salmonella enterica enterica serovar Typhi Ty2
aacccggcauuu

SEQ ID NO: 1797522 - RNA, 19 nt, Salmonella enterica enterica serovar Typhi Ty2
aacccaccagcgccaggcc

SEQ ID NO: 1797523 - RNA, 15 nt, Salmonella enterica enterica serovar Typhi Ty2
aacccacgacgcggu

SEQ ID NO: 1797524 - RNA, 14 nt, Salmonella enterica enterica serovar Typhi Ty2
aacccaccagcgcc

SEQ ID NO: 1797525 - RNA, 13 nt, Salmonella enterica enterica serovar Typhi Ty2
aaccgaucuccca

SEQ ID NO: 1797526 - RNA, 13 nt, Salmonella enterica enterica serovar Typhi Ty2
aaccgcagaaaaa

SEQ ID NO: 1797527 - RNA, 19 nt, Salmonella enterica enterica serovar Typhi Ty2
aaccgcccaucaacaccag

SEQ ID NO: 1797528 - RNA, 15 nt, Salmonella enterica enterica serovar Typhi Ty2
aaccgcccccaacug

SEQ ID NO: 1797529 - RNA, 20 nt, Salmonella enterica enterica serovar Typhi Ty2
aacccugguuugcuggaaau

SEQ ID NO: 1797530 - RNA, 19 nt, Salmonella enterica enterica serovar Typhi Ty2
aacccucgaaugugaauuc

SEQ ID NO: 1797531 - RNA, 21 nt, Salmonella enterica enterica serovar Typhi Ty2
aacccuauugccacaauauca

SEQ ID NO: 1797532 - RNA, 19 nt, Salmonella enterica enterica serovar Typhi Ty2
aaccgagguucaccagcgc

SEQ ID NO: 1797533 - RNA, 23 nt, Salmonella enterica enterica serovar Typhi Ty2
aaccgacugucgaaaccagcaua

SEQ ID NO: 1797534 - RNA, 16 nt, Salmonella enterica enterica serovar Typhi Ty2
aaccgaauaacgccag

SEQ ID NO: 1797535 - RNA, 22 nt, Salmonella enterica enterica serovar Typhi Ty2
aacauauuuuuaugcacgcuau

SEQ ID NO: 1797536 - RNA, 12 nt, Salmonella enterica enterica serovar Typhi Ty2
aacauauuuuua

SEQ ID NO: 1797537 - RNA, 19 nt, Salmonella enterica enterica serovar Typhi Ty2
aacauauuuuucacacaua

SEQ ID NO: 1797538 - RNA, 15 nt, Salmonella enterica enterica serovar Typhi Ty2
aacauauuuuucaca

SEQ ID NO: 1797539 - RNA, 24 nt, Salmonella enterica enterica serovar Typhi Ty2
aacaucauggcuuaaaacgauuug

SEQ ID NO: 1797540 - RNA, 19 nt, Salmonella enterica enterica serovar Typhi Ty2
aacaucaucaggccugacu

SEQ ID NO: 1797541 - RNA, 13 nt, Salmonella enterica enterica serovar Typhi Ty2
aacaucaucguuu

SEQ ID NO: 1797542 - RNA, 18 nt, Salmonella enterica enterica serovar Typhi Ty2
aacaucuuccaugccuuc

SEQ ID NO: 1797543 - RNA, 17 nt, Salmonella enterica enterica serovar Typhi Ty2
aacaucuuuuaccugug

SEQ ID NO: 1797544 - RNA, 16 nt, Salmonella enterica enterica serovar Typhi Ty2
aacaugaccagcgcaa

SEQ ID NO: 1797545 - RNA, 14 nt, Salmonella enterica enterica serovar Typhi Ty2
aacaugaccagcgc

SEQ ID NO: 1797546 - RNA, 18 nt, Salmonella enterica enterica serovar Typhi Ty2
aacauccucuccugaagc

SEQ ID NO: 1797547 - RNA, 23 nt, Salmonella enterica enterica serovar Typhi Ty2
aacagcgaucacgccguccagca

SEQ ID NO: 1797548 - RNA, 20 nt, Salmonella enterica enterica serovar Typhi Ty2
aacagcgaucacgccgucca

SEQ ID NO: 1797549 - RNA, 15 nt, Salmonella enterica enterica serovar Typhi Ty2
aacagcgccaucagg

SEQ ID NO: 1797550 - RNA, 16 nt, Salmonella enterica enterica serovar Typhi Ty2
aacagcccgauaaaca

SEQ ID NO: 1797551 - RNA, 17 nt, Salmonella enterica enterica serovar Typhi Ty2
aacagcgccaucaggaa

SEQ ID NO: 1797552 - RNA, 23 nt, Salmonella enterica enterica serovar Typhi Ty2
aacauacgggcaugaagaaaaua

SEQ ID NO: 1797553 - RNA, 20 nt, Salmonella enterica enterica serovar Typhi Ty2
aacauuaaucgccauugcaa

SEQ ID NO: 1797554 - RNA, 19 nt, Salmonella enterica enterica serovar Typhi Ty2
aacauguccuacacucaau

SEQ ID NO: 1797555 - RNA, 12 nt, Salmonella enterica enterica serovar Typhi Ty2
aacauuccgcuu

SEQ ID NO: 1797556 - RNA, 22 nt, Salmonella enterica enterica serovar Typhi Ty2
aacauuccgcccaagaacauga

SEQ ID NO: 1797557 - RNA, 20 nt, Salmonella enterica enterica serovar Typhi Ty2
aacauuccgcccaagaacau

SEQ ID NO: 1797558 - RNA, 19 nt, Salmonella enterica enterica serovar Typhi Ty2
aacauuccgcccaagaaca

SEQ ID NO: 1797559 - RNA, 22 nt, Salmonella enterica enterica serovar Typhi Ty2
aacauugaggcuacccagacaa

SEQ ID NO: 1797560 - RNA, 19 nt, Salmonella enterica enterica serovar Typhi Ty2
aacauuauuaaaaugucuu

SEQ ID NO: 1797561 - RNA, 17 nt, Salmonella enterica enterica serovar Typhi Ty2
aacauuaucaaaaguga

SEQ ID NO: 1797562 - RNA, 13 nt, Salmonella enterica enterica serovar Typhi Ty2
aacauuacugacc

SEQ ID NO: 1797563 - RNA, 12 nt, Salmonella enterica enterica serovar Typhi Ty2
aaccaaugcagc

SEQ ID NO: 1797564 - RNA, 17 nt, Salmonella enterica enterica serovar Typhi Ty2
aagaauacccuuuacac

SEQ ID NO: 1797565 - RNA, 21 nt, Salmonella enterica enterica serovar Typhi Ty2
aagaauagcgcuuuccugcgu

SEQ ID NO: 1797566 - RNA, 14 nt, Salmonella enterica enterica serovar Typhi Ty2
aagaaucacgccga

SEQ ID NO: 1797567 - RNA, 17 nt, Salmonella enterica enterica serovar Typhi Ty2
aagaaucacgccgauga

SEQ ID NO: 1797568 - RNA, 16 nt, Salmonella enterica enterica serovar Typhi Ty2
aagaauagccugggca

SEQ ID NO: 1797569 - RNA, 22 nt, Salmonella enterica enterica serovar Typhi Ty2
aagaauagccggauaaaauuau

SEQ ID NO: 1797570 - RNA, 15 nt, Salmonella enterica enterica serovar Typhi Ty2
aagaagucugugaga

SEQ ID NO: 1797571 - RNA, 21 nt, Salmonella enterica enterica serovar Typhi Ty2
aagaagucugugagaaaagcg

SEQ ID NO: 1797572 - RNA, 19 nt, Salmonella enterica enterica serovar Typhi Ty2
aagaagaauuauuaucaau

SEQ ID NO: 1797573 - RNA, 16 nt, Salmonella enterica enterica serovar Typhi Ty2
aagaagaaaccgcaga

SEQ ID NO: 1797574 - RNA, 15 nt, Salmonella enterica enterica serovar Typhi Ty2
aagaacguguuuuuc

SEQ ID NO: 1797575 - RNA, 22 nt, Salmonella enterica enterica serovar Typhi Ty2
aagaacugcaaauaccacauca

SEQ ID NO: 1797576 - RNA, 15 nt, Salmonella enterica enterica serovar Typhi Ty2
aagaagcgcuggaga

SEQ ID NO: 1797577 - RNA, 12 nt, Salmonella enterica enterica serovar Typhi Ty2
aagaagaauuau

SEQ ID NO: 1797578 - RNA, 15 nt, Salmonella enterica enterica serovar Typhi Ty2
aagaaagauaaaaua

SEQ ID NO: 1797579 - RNA, 15 nt, Salmonella enterica enterica serovar Typhi Ty2
aagaaacugugguua

SEQ ID NO: 1797580 - RNA, 22 nt, Salmonella enterica enterica serovar Typhi Ty2
aagaaacgcuuaaagcguucca

SEQ ID NO: 1797581 - RNA, 20 nt, Salmonella enterica enterica serovar Typhi Ty2
aagaaaaaacuuauuucuau

SEQ ID NO: 1797582 - RNA, 16 nt, Salmonella enterica enterica serovar Typhi Ty2
aacuugauuccuggcu

SEQ ID NO: 1797583 - RNA, 22 nt, Salmonella enterica enterica serovar Typhi Ty2
aagaaauguccauaaauagauc

SEQ ID NO: 1797584 - RNA, 15 nt, Salmonella enterica enterica serovar Typhi Ty2
aagaaauguccauaa

SEQ ID NO: 1797585 - RNA, 22 nt, Salmonella enterica enterica serovar Typhi Ty2
aagaaauuuugcacuguuuuua

SEQ ID NO: 1797586 - RNA, 13 nt, Salmonella enterica enterica serovar Typhi Ty2
aacuucugcaggg

SEQ ID NO: 1797587 - RNA, 19 nt, Salmonella enterica enterica serovar Typhi Ty2
aacuugaaguuuucgggca

SEQ ID NO: 1797588 - RNA, 17 nt, Salmonella enterica enterica serovar Typhi Ty2
aacuuauuuuauuuuua

SEQ ID NO: 1797589 - RNA, 23 nt, Salmonella enterica enterica serovar Typhi Ty2
aacugggcuugcauugcuuuuag

SEQ ID NO: 1797590 - RNA, 22 nt, Salmonella enterica enterica serovar Typhi Ty2
aacuggucgcucuauuccaacu

SEQ ID NO: 1797591 - RNA, 19 nt, Salmonella enterica enterica serovar Typhi Ty2
aacugggugccgugaauau

SEQ ID NO: 1797592 - RNA, 23 nt, Salmonella enterica enterica serovar Typhi Ty2
aacuuaaauuaaugauuaaaaua

SEQ ID NO: 1797593 - RNA, 21 nt, Salmonella enterica enterica serovar Typhi Ty2
aacucuuccgggcugacauaa

SEQ ID NO: 1797594 - RNA, 23 nt, Salmonella enterica enterica serovar Typhi Ty2
aacucuuucagaccauaguccau

SEQ ID NO: 1797595 - RNA, 20 nt, Salmonella enterica enterica serovar Typhi Ty2
aacugauggcgcuaagccag

SEQ ID NO: 1797596 - RNA, 23 nt, Salmonella enterica enterica serovar Typhi Ty2
aacugauggcgcuaagccagcca

SEQ ID NO: 1797597 - RNA, 19 nt, Salmonella enterica enterica serovar Typhi Ty2
aacucuuuuucagcaaaua

SEQ ID NO: 1797598 - RNA, 19 nt, Salmonella enterica enterica serovar Typhi Ty2
aacugaaccaacagcuggg

SEQ ID NO: 1797599 - RNA, 15 nt, Salmonella enterica enterica serovar Typhi Ty2
aacuggcgcuggcag

SEQ ID NO: 1797600 - RNA, 17 nt, Salmonella enterica enterica serovar Typhi Ty2
aacuggccacagcaaau

SEQ ID NO: 1797601 - RNA, 19 nt, Salmonella enterica enterica serovar Typhi Ty2
aacuggcaagcgcuaagca

SEQ ID NO: 1797602 - RNA, 16 nt, Salmonella enterica enterica serovar Typhi Ty2
aacugcgccugcauau

SEQ ID NO: 1797603 - RNA, 17 nt, Salmonella enterica enterica serovar Typhi Ty2
aacugcgcgccgcccug

SEQ ID NO: 1797604 - RNA, 15 nt, Salmonella enterica enterica serovar Typhi Ty2
aacugcgccugcuca

SEQ ID NO: 1797605 - RNA, 20 nt, Salmonella enterica enterica serovar Typhi Ty2
aacugcggaauuuuauccug

SEQ ID NO: 1797606 - RNA, 18 nt, Salmonella enterica enterica serovar Typhi Ty2
aacugcgguaaauaaugc

SEQ ID NO: 1797607 - RNA, 20 nt, Salmonella enterica enterica serovar Typhi Ty2
aacugcggcuauauaaaauc

SEQ ID NO: 1797608 - RNA, 22 nt, Salmonella enterica enterica serovar Typhi Ty2
aacugcggaauuuuauccugug

SEQ ID NO: 1797609 - RNA, 16 nt, Salmonella enterica enterica serovar Typhi Ty2
aacugcucuaccaacu

SEQ ID NO: 1797610 - RNA, 19 nt, Salmonella enterica enterica serovar Typhi Ty2
aacguauuucuuuugccau

SEQ ID NO: 1797611 - RNA, 12 nt, Salmonella enterica enterica serovar Typhi Ty2
aacguauuauua

SEQ ID NO: 1797612 - RNA, 16 nt, Salmonella enterica enterica serovar Typhi Ty2
aacguaaauacccagg

SEQ ID NO: 1797613 - RNA, 23 nt, Salmonella enterica enterica serovar Typhi Ty2
aacguaaagcuggccuucagguu

SEQ ID NO: 1797614 - RNA, 21 nt, Salmonella enterica enterica serovar Typhi Ty2
aacguaacuugauuccuggcu

SEQ ID NO: 1797615 - RNA, 21 nt, Salmonella enterica enterica serovar Typhi Ty2
aacgucagcuggaaugcccac

SEQ ID NO: 1797616 - RNA, 20 nt, Salmonella enterica enterica serovar Typhi Ty2
aacgucagcgccacccauuu

SEQ ID NO: 1797617 - RNA, 11 nt, Salmonella enterica enterica serovar Typhi Ty2
aacgucaguac

SEQ ID NO: 1797618 - RNA, 17 nt, Salmonella enterica enterica serovar Typhi Ty2
aacgucuugccaugugc

SEQ ID NO: 1797619 - RNA, 15 nt, Salmonella enterica enterica serovar Typhi Ty2
aacguccaacuaugc

SEQ ID NO: 1797620 - RNA, 17 nt, Salmonella enterica enterica serovar Typhi Ty2
aacgucgcguacaccuu

SEQ ID NO: 1797621 - RNA, 15 nt, Salmonella enterica enterica serovar Typhi Ty2
aacguuguauaaaca

SEQ ID NO: 1797622 - RNA, 18 nt, Salmonella enterica enterica serovar Typhi Ty2
aacguugacguuucaguc

SEQ ID NO: 1797623 - RNA, 18 nt, Salmonella enterica enterica serovar Typhi Ty2
aacguuuguaacagcagg

SEQ ID NO: 1797624 - RNA, 14 nt, Salmonella enterica enterica serovar Typhi Ty2
aacguuugccagcg

SEQ ID NO: 1797625 - RNA, 21 nt, Salmonella enterica enterica serovar Typhi Ty2
aacguuuaaugucaccaucau

SEQ ID NO: 1797626 - RNA, 16 nt, Salmonella enterica enterica serovar Typhi Ty2
aacguuguccagcaga

SEQ ID NO: 1797627 - RNA, 18 nt, Salmonella enterica enterica serovar Typhi Ty2
aacguuaccgcagcgaau

SEQ ID NO: 1797628 - RNA, 12 nt, Salmonella enterica enterica serovar Typhi Ty2
aacguguuaucg

SEQ ID NO: 1797629 - RNA, 22 nt, Salmonella enterica enterica serovar Typhi Ty2
aacguguuacguuuaaaccaug

SEQ ID NO: 1797630 - RNA, 12 nt, Salmonella enterica enterica serovar Typhi Ty2
aacguggcggca

SEQ ID NO: 1797631 - RNA, 23 nt, Salmonella enterica enterica serovar Typhi Ty2
aacgugcauuauuuuagugaaaa

SEQ ID NO: 1797632 - RNA, 20 nt, Salmonella enterica enterica serovar Typhi Ty2
aacuauugcugccccggcgc

SEQ ID NO: 1797633 - RNA, 22 nt, Salmonella enterica enterica serovar Typhi Ty2
aacuacucguaaucuaaaauua

SEQ ID NO: 1797634 - RNA, 18 nt, Salmonella enterica enterica serovar Typhi Ty2
aacguuuugugucaaaaa

SEQ ID NO: 1797635 - RNA, 22 nt, Salmonella enterica enterica serovar Typhi Ty2
aacguuuuuccuugauuucauu

SEQ ID NO: 1797636 - RNA, 16 nt, Salmonella enterica enterica serovar Typhi Ty2
aacuaaaaauucaaaa

SEQ ID NO: 1797637 - RNA, 13 nt, Salmonella enterica enterica serovar Typhi Ty2
aacggaaccaaau

SEQ ID NO: 1797638 - RNA, 22 nt, Salmonella enterica enterica serovar Typhi Ty2
aacggaccggcaaucgccugca

SEQ ID NO: 1797639 - RNA, 16 nt, Salmonella enterica enterica serovar Typhi Ty2
aacgguaaguugaaag

SEQ ID NO: 1797640 - RNA, 19 nt, Salmonella enterica enterica serovar Typhi Ty2
aacggguuugauugccauc

SEQ ID NO: 1797641 - RNA, 21 nt, Salmonella enterica enterica serovar Typhi Ty2
aacggucgguaaucgccugca

SEQ ID NO: 1797642 - RNA, 12 nt, Salmonella enterica enterica serovar Typhi Ty2
aacggucaggau

SEQ ID NO: 1797643 - RNA, 23 nt, Salmonella enterica enterica serovar Typhi Ty2
aacgguccagguucaucacuuuc

SEQ ID NO: 1797644 - RNA, 15 nt, Salmonella enterica enterica serovar Typhi Ty2
aacgcuuauccggcc

SEQ ID NO: 1797645 - RNA, 14 nt, Salmonella enterica enterica serovar Typhi Ty2
aacgcuuaaagcgu

SEQ ID NO: 1797646 - RNA, 22 nt, Salmonella enterica enterica serovar Typhi Ty2
aacgcuggccgcaaauccacug

SEQ ID NO: 1797647 - RNA, 17 nt, Salmonella enterica enterica serovar Typhi Ty2
aacgccgccgcaaggcg

SEQ ID NO: 1797648 - RNA, 23 nt, Salmonella enterica enterica serovar Typhi Ty2
aacgccgcgcaaagcaauaccac

SEQ ID NO: 1797649 - RNA, 17 nt, Salmonella enterica enterica serovar Typhi Ty2
aacgccggauuccagaa

SEQ ID NO: 1797650 - RNA, 20 nt, Salmonella enterica enterica serovar Typhi Ty2
aacgccgcuuuaccgccuuc

SEQ ID NO: 1797651 - RNA, 16 nt, Salmonella enterica enterica serovar Typhi Ty2
aacgccugauccggcc

SEQ ID NO: 1797652 - RNA, 14 nt, Salmonella enterica enterica serovar Typhi Ty2
aacgccugauccgg

SEQ ID NO: 1797653 - RNA, 13 nt, Salmonella enterica enterica serovar Typhi Ty2
aacgccugcacca

SEQ ID NO: 1797654 - RNA, 17 nt, Salmonella enterica enterica serovar Typhi Ty2
aacgccguuaccagcau

SEQ ID NO: 1797655 - RNA, 19 nt, Salmonella enterica enterica serovar Typhi Ty2
aacgaugaugaaaaagaau

SEQ ID NO: 1797656 - RNA, 18 nt, Salmonella enterica enterica serovar Typhi Ty2
aacgaugauuauuguuaa

SEQ ID NO: 1797657 - RNA, 16 nt, Salmonella enterica enterica serovar Typhi Ty2
aacgaucccuaauaaa

SEQ ID NO: 1797658 - RNA, 22 nt, Salmonella enterica enterica serovar Typhi Ty2
aacgauguaaaaccuggcacuu

SEQ ID NO: 1797659 - RNA, 15 nt, Salmonella enterica enterica serovar Typhi Ty2
aaccggcaugaagac

SEQ ID NO: 1797660 - RNA, 15 nt, Salmonella enterica enterica serovar Typhi Ty2
aaccggcugccagcg

SEQ ID NO: 1797661 - RNA, 23 nt, Salmonella enterica enterica serovar Typhi Ty2
aaccggcgauguuggcgcccuga

SEQ ID NO: 1797662 - RNA, 20 nt, Salmonella enterica enterica serovar Typhi Ty2
aaccggaccagcacaaaaaa

SEQ ID NO: 1797663 - RNA, 16 nt, Salmonella enterica enterica serovar Typhi Ty2
aaccggcaaccaaagu

SEQ ID NO: 1797664 - RNA, 18 nt, Salmonella enterica enterica serovar Typhi Ty2
aaccggcaacucgccggu

SEQ ID NO: 1797665 - RNA, 23 nt, Salmonella enterica enterica serovar Typhi Ty2
aaccggcaacucgccgguuuuuu

SEQ ID NO: 1797666 - RNA, 19 nt, Salmonella enterica enterica serovar Typhi Ty2
aaccgcuucgaaguuuuga

SEQ ID NO: 1797667 - RNA, 18 nt, Salmonella enterica enterica serovar Typhi Ty2
aacgcccccugccagcgc

SEQ ID NO: 1797668 - RNA, 16 nt, Salmonella enterica enterica serovar Typhi Ty2
aacgccgaagccagcg

SEQ ID NO: 1797669 - RNA, 17 nt, Salmonella enterica enterica serovar Typhi Ty2
aacgccgaagccagcgc

SEQ ID NO: 1797670 - RNA, 19 nt, Salmonella enterica enterica serovar Typhi Ty2
aacgccgcacacucauuuu

SEQ ID NO: 1797671 - RNA, 20 nt, Salmonella enterica enterica serovar Typhi Ty2
aacgcccucaaguaaaaugc

SEQ ID NO: 1797672 - RNA, 14 nt, Salmonella enterica enterica serovar Typhi Ty2
aacgccgaagccag

SEQ ID NO: 1797673 - RNA, 22 nt, Salmonella enterica enterica serovar Typhi Ty2
aacgccaggccguugugucccu

SEQ ID NO: 1797674 - RNA, 17 nt, Salmonella enterica enterica serovar Typhi Ty2
aacgccauugcgaacau

SEQ ID NO: 1797675 - RNA, 17 nt, Salmonella enterica enterica serovar Typhi Ty2
aacgccaucagcaaaau

SEQ ID NO: 1797676 - RNA, 13 nt, Salmonella enterica enterica serovar Typhi Ty2
aacgccaucagcc

SEQ ID NO: 1797677 - RNA, 19 nt, Salmonella enterica enterica serovar Typhi Ty2
aagcuuucugaauuucacg

SEQ ID NO: 1797678 - RNA, 17 nt, Salmonella enterica enterica serovar Typhi Ty2
aagcuuugcguaaaaaa

SEQ ID NO: 1797679 - RNA, 17 nt, Salmonella enterica enterica serovar Typhi Ty2
aaggauacucagcgacg

SEQ ID NO: 1797680 - RNA, 21 nt, Salmonella enterica enterica serovar Typhi Ty2
aaggauaauaguguuagcguc

SEQ ID NO: 1797681 - RNA, 15 nt, Salmonella enterica enterica serovar Typhi Ty2
aagcugaccagggca

SEQ ID NO: 1797682 - RNA, 21 nt, Salmonella enterica enterica serovar Typhi Ty2
aagcugaccagggcaaauuau

SEQ ID NO: 1797683 - RNA, 13 nt, Salmonella enterica enterica serovar Typhi Ty2
aagcugauauuuu

SEQ ID NO: 1797684 - RNA, 16 nt, Salmonella enterica enterica serovar Typhi Ty2
aagcugauauuuuacu

SEQ ID NO: 1797685 - RNA, 21 nt, Salmonella enterica enterica serovar Typhi Ty2
aagcuguugugucccggccca

SEQ ID NO: 1797686 - RNA, 15 nt, Salmonella enterica enterica serovar Typhi Ty2
aagcugcggcccaga

SEQ ID NO: 1797687 - RNA, 18 nt, Salmonella enterica enterica serovar Typhi Ty2
aagcuaauccccagcgcu

SEQ ID NO: 1797688 - RNA, 19 nt, Salmonella enterica enterica serovar Typhi Ty2
aagcguugccguaggcaac

SEQ ID NO: 1797689 - RNA, 20 nt, Salmonella enterica enterica serovar Typhi Ty2
aagcguugccguaggcaacg

SEQ ID NO: 1797690 - RNA, 18 nt, Salmonella enterica enterica serovar Typhi Ty2
aagcguuacggaaaaaau

SEQ ID NO: 1797691 - RNA, 12 nt, Salmonella enterica enterica serovar Typhi Ty2
aagcguuccagu

SEQ ID NO: 1797692 - RNA, 15 nt, Salmonella enterica enterica serovar Typhi Ty2
aagcguuaaugcguu

SEQ ID NO: 1797693 - RNA, 21 nt, Salmonella enterica enterica serovar Typhi Ty2
aagcguuagcgucauccggca

SEQ ID NO: 1797694 - RNA, 21 nt, Salmonella enterica enterica serovar Typhi Ty2
aagcguuguacggauggggua

SEQ ID NO: 1797695 - RNA, 22 nt, Salmonella enterica enterica serovar Typhi Ty2
aagcguuuccagaguacauucu

SEQ ID NO: 1797696 - RNA, 15 nt, Salmonella enterica enterica serovar Typhi Ty2
aagcguuucucuugu

SEQ ID NO: 1797697 - RNA, 17 nt, Salmonella enterica enterica serovar Typhi Ty2
aagccgcauuacaaaca

SEQ ID NO: 1797698 - RNA, 20 nt, Salmonella enterica enterica serovar Typhi Ty2
aagccgcccugcggacaggc

SEQ ID NO: 1797699 - RNA, 15 nt, Salmonella enterica enterica serovar Typhi Ty2
aagccgaccuuauuc

SEQ ID NO: 1797700 - RNA, 20 nt, Salmonella enterica enterica serovar Typhi Ty2
aagcggaccaaugcuggcag

SEQ ID NO: 1797701 - RNA, 13 nt, Salmonella enterica enterica serovar Typhi Ty2
aagcggcacaaau

SEQ ID NO: 1797702 - RNA, 14 nt, Salmonella enterica enterica serovar Typhi Ty2
aagcggcacaaaua

SEQ ID NO: 1797703 - RNA, 17 nt, Salmonella enterica enterica serovar Typhi Ty2
aagcgcuaugcccaccg

SEQ ID NO: 1797704 - RNA, 12 nt, Salmonella enterica enterica serovar Typhi Ty2
aagcguagcgcc

SEQ ID NO: 1797705 - RNA, 14 nt, Salmonella enterica enterica serovar Typhi Ty2
aagcggcagacgug

SEQ ID NO: 1797706 - RNA, 13 nt, Salmonella enterica enterica serovar Typhi Ty2
aaggguaagcaau

SEQ ID NO: 1797707 - RNA, 15 nt, Salmonella enterica enterica serovar Typhi Ty2
aagggcaccugggca

SEQ ID NO: 1797708 - RNA, 15 nt, Salmonella enterica enterica serovar Typhi Ty2
aagggcaauaucaug

SEQ ID NO: 1797709 - RNA, 11 nt, Salmonella enterica enterica serovar Typhi Ty2
aagguaacuau

SEQ ID NO: 1797710 - RNA, 17 nt, Salmonella enterica enterica serovar Typhi Ty2
aaggcguugaugaaggu

SEQ ID NO: 1797711 - RNA, 15 nt, Salmonella enterica enterica serovar Typhi Ty2
aaggcguucacaccg

SEQ ID NO: 1797712 - RNA, 22 nt, Salmonella enterica enterica serovar Typhi Ty2
aaggcguaagucguaccggcgc

SEQ ID NO: 1797713 - RNA, 18 nt, Salmonella enterica enterica serovar Typhi Ty2
aagggaggugcucuccca

SEQ ID NO: 1797714 - RNA, 21 nt, Salmonella enterica enterica serovar Typhi Ty2
aagggaucgauaauugcucac

SEQ ID NO: 1797715 - RNA, 20 nt, Salmonella enterica enterica serovar Typhi Ty2
aagggaggugcucucccagc

SEQ ID NO: 1797716 - RNA, 13 nt, Salmonella enterica enterica serovar Typhi Ty2
aaggcgaaaacau

SEQ ID NO: 1797717 - RNA, 16 nt, Salmonella enterica enterica serovar Typhi Ty2
aaggcaaaaugccagc

SEQ ID NO: 1797718 - RNA, 15 nt, Salmonella enterica enterica serovar Typhi Ty2
aaggcggcaaagaua

SEQ ID NO: 1797719 - RNA, 21 nt, Salmonella enterica enterica serovar Typhi Ty2
aaggcgcuugcgccaucaucc

SEQ ID NO: 1797720 - RNA, 21 nt, Salmonella enterica enterica serovar Typhi Ty2
aaggcgaacaaggauauguau

SEQ ID NO: 1797721 - RNA, 17 nt, Salmonella enterica enterica serovar Typhi Ty2
aaggcgcgauccgccca

SEQ ID NO: 1797722 - RNA, 14 nt, Salmonella enterica enterica serovar Typhi Ty2
aagguaauuuucac

SEQ ID NO: 1797723 - RNA, 17 nt, Salmonella enterica enterica serovar Typhi Ty2
aagguauugauuuuuaa

SEQ ID NO: 1797724 - RNA, 21 nt, Salmonella enterica enterica serovar Typhi Ty2
aaggucacgccggguacauau

SEQ ID NO: 1797725 - RNA, 18 nt, Salmonella enterica enterica serovar Typhi Ty2
aaggucgacauuuaauga

SEQ ID NO: 1797726 - RNA, 14 nt, Salmonella enterica enterica serovar Typhi Ty2
aaggugagaaaaag

SEQ ID NO: 1797727 - RNA, 15 nt, Salmonella enterica enterica serovar Typhi Ty2
aagguuauccgccgg

SEQ ID NO: 1797728 - RNA, 18 nt, Salmonella enterica enterica serovar Typhi Ty2
aagguuauccgccggagg

SEQ ID NO: 1797729 - RNA, 16 nt, Salmonella enterica enterica serovar Typhi Ty2
aagguucccugcgcca

SEQ ID NO: 1797730 - RNA, 21 nt, Salmonella enterica enterica serovar Typhi Ty2
aagguucuggcauuggcaucu

SEQ ID NO: 1797731 - RNA, 18 nt, Salmonella enterica enterica serovar Typhi Ty2
aagcauugccguuuucaa

SEQ ID NO: 1797732 - RNA, 18 nt, Salmonella enterica enterica serovar Typhi Ty2
aagcauggcguuaaugcg

SEQ ID NO: 1797733 - RNA, 20 nt, Salmonella enterica enterica serovar Typhi Ty2
aagcaugguuaacuccuucu

SEQ ID NO: 1797734 - RNA, 13 nt, Salmonella enterica enterica serovar Typhi Ty2
aagccagguuuuc

SEQ ID NO: 1797735 - RNA, 15 nt, Salmonella enterica enterica serovar Typhi Ty2
aagccaggcuuuaaa

SEQ ID NO: 1797736 - RNA, 14 nt, Salmonella enterica enterica serovar Typhi Ty2
aagccaggcaccau

SEQ ID NO: 1797737 - RNA, 17 nt, Salmonella enterica enterica serovar Typhi Ty2
aagccaggccgccagca

SEQ ID NO: 1797738 - RNA, 19 nt, Salmonella enterica enterica serovar Typhi Ty2
aagccagccaaauagcgcc

SEQ ID NO: 1797739 - RNA, 17 nt, Salmonella enterica enterica serovar Typhi Ty2
aagccagacucgcuccc

SEQ ID NO: 1797740 - RNA, 15 nt, Salmonella enterica enterica serovar Typhi Ty2
aagccacaaucugau

SEQ ID NO: 1797741 - RNA, 13 nt, Salmonella enterica enterica serovar Typhi Ty2
aagccaccagauc

SEQ ID NO: 1797742 - RNA, 21 nt, Salmonella enterica enterica serovar Typhi Ty2
aagcccaccgcgaacauugga

SEQ ID NO: 1797743 - RNA, 12 nt, Salmonella enterica enterica serovar Typhi Ty2
aagcccagcacg

SEQ ID NO: 1797744 - RNA, 12 nt, Salmonella enterica enterica serovar Typhi Ty2
aagcccacgccc

SEQ ID NO: 1797745 - RNA, 23 nt, Salmonella enterica enterica serovar Typhi Ty2
aagccccuuccucgggaggggcu

SEQ ID NO: 1797746 - RNA, 21 nt, Salmonella enterica enterica serovar Typhi Ty2
aagccccccgcacagcacaua

SEQ ID NO: 1797747 - RNA, 17 nt, Salmonella enterica enterica serovar Typhi Ty2
aagccccaugugccuug

SEQ ID NO: 1797748 - RNA, 18 nt, Salmonella enterica enterica serovar Typhi Ty2
aagccccccgcacagcac

SEQ ID NO: 1797749 - RNA, 15 nt, Salmonella enterica enterica serovar Typhi Ty2
aagcaucugauauau

SEQ ID NO: 1797750 - RNA, 19 nt, Salmonella enterica enterica serovar Typhi Ty2
aagcauagcgucaucaaca

SEQ ID NO: 1797751 - RNA, 18 nt, Salmonella enterica enterica serovar Typhi Ty2
aagcauagcgccuucagg

SEQ ID NO: 1797752 - RNA, 17 nt, Salmonella enterica enterica serovar Typhi Ty2
aagcauagcgccuucag

SEQ ID NO: 1797753 - RNA, 16 nt, Salmonella enterica enterica serovar Typhi Ty2
aagcaguuccagcauc

SEQ ID NO: 1797754 - RNA, 15 nt, Salmonella enterica enterica serovar Typhi Ty2
aagcauaaaaagacg

SEQ ID NO: 1797755 - RNA, 15 nt, Salmonella enterica enterica serovar Typhi Ty2
aagcagugaaucccc

SEQ ID NO: 1797756 - RNA, 16 nt, Salmonella enterica enterica serovar Typhi Ty2
aagcagcuugcugcuu

SEQ ID NO: 1797757 - RNA, 23 nt, Salmonella enterica enterica serovar Typhi Ty2
aagcagcugcuuaacuucugcag

SEQ ID NO: 1797758 - RNA, 12 nt, Salmonella enterica enterica serovar Typhi Ty2
aagcagcuugcu

SEQ ID NO: 1797759 - RNA, 18 nt, Salmonella enterica enterica serovar Typhi Ty2
aagcaggcgggacgccau

SEQ ID NO: 1797760 - RNA, 13 nt, Salmonella enterica enterica serovar Typhi Ty2
aagcagucccgcc

SEQ ID NO: 1797761 - RNA, 21 nt, Salmonella enterica enterica serovar Typhi Ty2
aagcacgggcuugaauaacau

SEQ ID NO: 1797762 - RNA, 18 nt, Salmonella enterica enterica serovar Typhi Ty2
aagcacgccgcuuucugu

SEQ ID NO: 1797763 - RNA, 14 nt, Salmonella enterica enterica serovar Typhi Ty2
aagcacuucuccac

SEQ ID NO: 1797764 - RNA, 19 nt, Salmonella enterica enterica serovar Typhi Ty2
aagcagaacguagcccauu

SEQ ID NO: 1797765 - RNA, 12 nt, Salmonella enterica enterica serovar Typhi Ty2
aagcagcgacaa

SEQ ID NO: 1797766 - RNA, 15 nt, Salmonella enterica enterica serovar Typhi Ty2
aagcagcgacaauau

SEQ ID NO: 1797767 - RNA, 14 nt, Salmonella enterica enterica serovar Typhi Ty2
aagcagacgcucga

SEQ ID NO: 1797768 - RNA, 20 nt, Salmonella enterica enterica serovar Typhi Ty2
aagcagaccaccccacagua

SEQ ID NO: 1797769 - RNA, 18 nt, Salmonella enterica enterica serovar Typhi Ty2
aagcaaaccuauuucagu

SEQ ID NO: 1797770 - RNA, 16 nt, Salmonella enterica enterica serovar Typhi Ty2
aagcaaaaaucaccac

SEQ ID NO: 1797771 - RNA, 20 nt, Salmonella enterica enterica serovar Typhi Ty2
aagcaacugauuaaucugcc

SEQ ID NO: 1797772 - RNA, 12 nt, Salmonella enterica enterica serovar Typhi Ty2
aagcaaauucag

SEQ ID NO: 1797773 - RNA, 20 nt, Salmonella enterica enterica serovar Typhi Ty2
aagauugcgcagggucuggu

SEQ ID NO: 1797774 - RNA, 18 nt, Salmonella enterica enterica serovar Typhi Ty2
aagcacauaacugagacu

SEQ ID NO: 1797775 - RNA, 19 nt, Salmonella enterica enterica serovar Typhi Ty2
aagcacaucagcaaaugaa

SEQ ID NO: 1797776 - RNA, 17 nt, Salmonella enterica enterica serovar Typhi Ty2
aagcaauccauuuuaaa

SEQ ID NO: 1797777 - RNA, 16 nt, Salmonella enterica enterica serovar Typhi Ty2
aagcaauuaauauuua

SEQ ID NO: 1797778 - RNA, 19 nt, Salmonella enterica enterica serovar Typhi Ty2
aagcaauauggcugcgaua

SEQ ID NO: 1797779 - RNA, 20 nt, Salmonella enterica enterica serovar Typhi Ty2
aagcaacuguagaaugcuau

SEQ ID NO: 1797780 - RNA, 22 nt, Salmonella enterica enterica serovar Typhi Ty2
aagauuacucucuugccagcgc

SEQ ID NO: 1797781 - RNA, 19 nt, Salmonella enterica enterica serovar Typhi Ty2
aagauuagccccagcgcca

SEQ ID NO: 1797782 - RNA, 20 nt, Salmonella enterica enterica serovar Typhi Ty2
aagauuaauugauuacaaag

SEQ ID NO: 1797783 - RNA, 23 nt, Salmonella enterica enterica serovar Typhi Ty2
aagaugggucagugcauguacaa

SEQ ID NO: 1797784 - RNA, 17 nt, Salmonella enterica enterica serovar Typhi Ty2
aagaugggucagugcau

SEQ ID NO: 1797785 - RNA, 15 nt, Salmonella enterica enterica serovar Typhi Ty2
aagauguagucgccu

SEQ ID NO: 1797786 - RNA, 11 nt, Salmonella enterica enterica serovar Typhi Ty2
aagauguagac

SEQ ID NO: 1797787 - RNA, 22 nt, Salmonella enterica enterica serovar Typhi Ty2
aagaauuauuaucaauuucaua

SEQ ID NO: 1797788 - RNA, 14 nt, Salmonella enterica enterica serovar Typhi Ty2
aagaauucgcaaug

SEQ ID NO: 1797789 - RNA, 19 nt, Salmonella enterica enterica serovar Typhi Ty2
aauacucccggcgcuggac

SEQ ID NO: 1797790 - RNA, 18 nt, Salmonella enterica enterica serovar Typhi Ty2
aauacugcuuuuccggca

SEQ ID NO: 1797791 - RNA, 12 nt, Salmonella enterica enterica serovar Typhi Ty2
aauacugauaaa

SEQ ID NO: 1797792 - RNA, 20 nt, Salmonella enterica enterica serovar Typhi Ty2
aauacugaagucgaaauuuu

SEQ ID NO: 1797793 - RNA, 19 nt, Salmonella enterica enterica serovar Typhi Ty2
aauacuggaccccagauaa

SEQ ID NO: 1797794 - RNA, 15 nt, Salmonella enterica enterica serovar Typhi Ty2
aauagaguaaugaca

SEQ ID NO: 1797795 - RNA, 17 nt, Salmonella enterica enterica serovar Typhi Ty2
aauagaggaaauaacau

SEQ ID NO: 1797796 - RNA, 14 nt, Salmonella enterica enterica serovar Typhi Ty2
aauagagaaaauaa

SEQ ID NO: 1797797 - RNA, 12 nt, Salmonella enterica enterica serovar Typhi Ty2
aauagaaaauaa

SEQ ID NO: 1797798 - RNA, 15 nt, Salmonella enterica enterica serovar Typhi Ty2
aauacuuuccagcug

SEQ ID NO: 1797799 - RNA, 14 nt, Salmonella enterica enterica serovar Typhi Ty2
aauacccuucacgg

SEQ ID NO: 1797800 - RNA, 13 nt, Salmonella enterica enterica serovar Typhi Ty2
aauaccgcccauc

SEQ ID NO: 1797801 - RNA, 16 nt, Salmonella enterica enterica serovar Typhi Ty2
aauaccgcaauaaaca

SEQ ID NO: 1797802 - RNA, 17 nt, Salmonella enterica enterica serovar Typhi Ty2
aauaccgguuauccaua

SEQ ID NO: 1797803 - RNA, 18 nt, Salmonella enterica enterica serovar Typhi Ty2
aauacccgacucuuuuuu

SEQ ID NO: 1797804 - RNA, 23 nt, Salmonella enterica enterica serovar Typhi Ty2
aauacaucaacaaagggcaccug

SEQ ID NO: 1797805 - RNA, 20 nt, Salmonella enterica enterica serovar Typhi Ty2
aauacaucgccaccaccagc

SEQ ID NO: 1797806 - RNA, 23 nt, Salmonella enterica enterica serovar Typhi Ty2
aauacaggguuugucagcauaaa

SEQ ID NO: 1797807 - RNA, 18 nt, Salmonella enterica enterica serovar Typhi Ty2
aauacgccgccagcaaua

SEQ ID NO: 1797808 - RNA, 18 nt, Salmonella enterica enterica serovar Typhi Ty2
aauacgcgucuguagcgc

SEQ ID NO: 1797809 - RNA, 14 nt, Salmonella enterica enterica serovar Typhi Ty2
aauacgcugaacuu

SEQ ID NO: 1797810 - RNA, 17 nt, Salmonella enterica enterica serovar Typhi Ty2
aauacgcuguagcuggc

SEQ ID NO: 1797811 - RNA, 17 nt, Salmonella enterica enterica serovar Typhi Ty2
aauacggagcaaaaaau

SEQ ID NO: 1797812 - RNA, 20 nt, Salmonella enterica enterica serovar Typhi Ty2
aauacgucgugacccacaca

SEQ ID NO: 1797813 - RNA, 18 nt, Salmonella enterica enterica serovar Typhi Ty2
aauacgugagcgaaguuc

SEQ ID NO: 1797814 - RNA, 19 nt, Salmonella enterica enterica serovar Typhi Ty2
aauacgguaaacagauaag

SEQ ID NO: 1797815 - RNA, 17 nt, Salmonella enterica enterica serovar Typhi Ty2
aauacguuuauucuuuu

SEQ ID NO: 1797816 - RNA, 23 nt, Salmonella enterica enterica serovar Typhi Ty2
aauaauaugccccgacaucagau

SEQ ID NO: 1797817 - RNA, 20 nt, Salmonella enterica enterica serovar Typhi Ty2
aauaauauguuccacaauca

SEQ ID NO: 1797818 - RNA, 22 nt, Salmonella enterica enterica serovar Typhi Ty2
aauaaucaaccauacauccuga

SEQ ID NO: 1797819 - RNA, 13 nt, Salmonella enterica enterica serovar Typhi Ty2
aaaaauauagcca

SEQ ID NO: 1797820 - RNA, 23 nt, Salmonella enterica enterica serovar Typhi Ty2
aaaaaucagcccggacaucaucc

SEQ ID NO: 1797821 - RNA, 12 nt, Salmonella enterica enterica serovar Typhi Ty2
aaaaaucauuau

SEQ ID NO: 1797822 - RNA, 11 nt, Salmonella enterica enterica serovar Typhi Ty2
aaaaaucagcc

SEQ ID NO: 1797823 - RNA, 23 nt, Salmonella enterica enterica serovar Typhi Ty2
aauaacucagcccauaagcuuag

SEQ ID NO: 1797824 - RNA, 21 nt, Salmonella enterica enterica serovar Typhi Ty2
aauaacuauaauugcuuuuuu

SEQ ID NO: 1797825 - RNA, 11 nt, Salmonella enterica enterica serovar Typhi Ty2
aaaaauacuga

SEQ ID NO: 1797826 - RNA, 17 nt, Salmonella enterica enterica serovar Typhi Ty2
aaaaauacugauaaaaa

SEQ ID NO: 1797827 - RNA, 22 nt, Salmonella enterica enterica serovar Typhi Ty2
aauaacgaugaugaaaaagaau

SEQ ID NO: 1797828 - RNA, 19 nt, Salmonella enterica enterica serovar Typhi Ty2
aauaacgcacuaccagaaa

SEQ ID NO: 1797829 - RNA, 19 nt, Salmonella enterica enterica serovar Typhi Ty2
aauaacgaugaugaaaaag

SEQ ID NO: 1797830 - RNA, 16 nt, Salmonella enterica enterica serovar Typhi Ty2
aauaacgugucaggau

SEQ ID NO: 1797831 - RNA, 20 nt, Salmonella enterica enterica serovar Typhi Ty2
aauaacgguaacggacauaa

SEQ ID NO: 1797832 - RNA, 19 nt, Salmonella enterica enterica serovar Typhi Ty2
aauaacgcgagaagaagaa

SEQ ID NO: 1797833 - RNA, 24 nt, Salmonella enterica enterica serovar Typhi Ty2
aauacaauccgccgcaauagccaa

SEQ ID NO: 1797834 - RNA, 16 nt, Salmonella enterica enterica serovar Typhi Ty2
aauacaauucaacuca

SEQ ID NO: 1797835 - RNA, 23 nt, Salmonella enterica enterica serovar Typhi Ty2
aauaauucuuaacccacaagaaa

SEQ ID NO: 1797836 - RNA, 15 nt, Salmonella enterica enterica serovar Typhi Ty2
aauaauuaauccaaa

SEQ ID NO: 1797837 - RNA, 17 nt, Salmonella enterica enterica serovar Typhi Ty2
aauaaucgaaauaaagu

SEQ ID NO: 1797838 - RNA, 18 nt, Salmonella enterica enterica serovar Typhi Ty2
aauaaucgcgagaaaaua

SEQ ID NO: 1797839 - RNA, 18 nt, Salmonella enterica enterica serovar Typhi Ty2
aauaaucgccgccgguaa

SEQ ID NO: 1797840 - RNA, 23 nt, Salmonella enterica enterica serovar Typhi Ty2
aauaauccuucccgcuauagaau

SEQ ID NO: 1797841 - RNA, 14 nt, Salmonella enterica enterica serovar Typhi Ty2
aaguggugggugau

SEQ ID NO: 1797842 - RNA, 15 nt, Salmonella enterica enterica serovar Typhi Ty2
aaguuuauccagcac

SEQ ID NO: 1797843 - RNA, 21 nt, Salmonella enterica enterica serovar Typhi Ty2
aaguuugaugcaaaugucaga

SEQ ID NO: 1797844 - RNA, 19 nt, Salmonella enterica enterica serovar Typhi Ty2
aaguuugaaguguuccuga

SEQ ID NO: 1797845 - RNA, 15 nt, Salmonella enterica enterica serovar Typhi Ty2
aaguucuuguuucau

SEQ ID NO: 1797846 - RNA, 17 nt, Salmonella enterica enterica serovar Typhi Ty2
aaguugcgccacugcca

SEQ ID NO: 1797847 - RNA, 13 nt, Salmonella enterica enterica serovar Typhi Ty2
aaguaauaaaaua

SEQ ID NO: 1797848 - RNA, 15 nt, Salmonella enterica enterica serovar Typhi Ty2
aagucugugagaaaa

SEQ ID NO: 1797849 - RNA, 18 nt, Salmonella enterica enterica serovar Typhi Ty2
aaguaaggaggaaucgcu

SEQ ID NO: 1797850 - RNA, 14 nt, Salmonella enterica enterica serovar Typhi Ty2
aaguaauaaaauaa

SEQ ID NO: 1797851 - RNA, 21 nt, Salmonella enterica enterica serovar Typhi Ty2
aagugauacggcgugaucacu

SEQ ID NO: 1797852 - RNA, 23 nt, Salmonella enterica enterica serovar Typhi Ty2
aagugauacaugcuacaggcaag

SEQ ID NO: 1797853 - RNA, 22 nt, Salmonella enterica enterica serovar Typhi Ty2
aagugaguaaacgcucaagcaa

SEQ ID NO: 1797854 - RNA, 14 nt, Salmonella enterica enterica serovar Typhi Ty2
aauaacaccacaac

SEQ ID NO: 1797855 - RNA, 21 nt, Salmonella enterica enterica serovar Typhi Ty2
aauaaccgguaacugucagau

SEQ ID NO: 1797856 - RNA, 20 nt, Salmonella enterica enterica serovar Typhi Ty2
aauaaccggcagaccggaaa

SEQ ID NO: 1797857 - RNA, 19 nt, Salmonella enterica enterica serovar Typhi Ty2
aauaaccucaacgucgcuc

SEQ ID NO: 1797858 - RNA, 20 nt, Salmonella enterica enterica serovar Typhi Ty2
aauaacaggaaucauucuau

SEQ ID NO: 1797859 - RNA, 16 nt, Salmonella enterica enterica serovar Typhi Ty2
aauaacaggaaucauu

SEQ ID NO: 1797860 - RNA, 12 nt, Salmonella enterica enterica serovar Typhi Ty2
aauaaccgccag

SEQ ID NO: 1797861 - RNA, 23 nt, Salmonella enterica enterica serovar Typhi Ty2
aauaaauucuuuacgcagcaaga

SEQ ID NO: 1797862 - RNA, 22 nt, Salmonella enterica enterica serovar Typhi Ty2
aauaaauaguaaauagaaaaua

SEQ ID NO: 1797863 - RNA, 15 nt, Salmonella enterica enterica serovar Typhi Ty2
aauaaagccgcccau

SEQ ID NO: 1797864 - RNA, 11 nt, Salmonella enterica enterica serovar Typhi Ty2
aauaaacuccc

SEQ ID NO: 1797865 - RNA, 15 nt, Salmonella enterica enterica serovar Typhi Ty2
aauaaacaucagcca

SEQ ID NO: 1797866 - RNA, 13 nt, Salmonella enterica enterica serovar Typhi Ty2
aauaaacauuuuu

SEQ ID NO: 1797867 - RNA, 15 nt, Salmonella enterica enterica serovar Typhi Ty2
aauaaagacuggccc

SEQ ID NO: 1797868 - RNA, 23 nt, Salmonella enterica enterica serovar Typhi Ty2
aauaaacuguccaguuuuugcau

SEQ ID NO: 1797869 - RNA, 17 nt, Salmonella enterica enterica serovar Typhi Ty2
aauaaacugcauccccu

SEQ ID NO: 1797870 - RNA, 11 nt, Salmonella enterica enterica serovar Typhi Ty2
aauaaaaguug

SEQ ID NO: 1797871 - RNA, 15 nt, Salmonella enterica enterica serovar Typhi Ty2
aauaaaauucagcgc

SEQ ID NO: 1797872 - RNA, 14 nt, Salmonella enterica enterica serovar Typhi Ty2
aauaaacaucagcc

SEQ ID NO: 1797873 - RNA, 13 nt, Salmonella enterica enterica serovar Typhi Ty2
aauaaaaauaauc

SEQ ID NO: 1797874 - RNA, 22 nt, Salmonella enterica enterica serovar Typhi Ty2
aauaaaaauaagcuauugcgcu

SEQ ID NO: 1797875 - RNA, 18 nt, Salmonella enterica enterica serovar Typhi Ty2
aaguuuuuuuaaaaaacc

SEQ ID NO: 1797876 - RNA, 14 nt, Salmonella enterica enterica serovar Typhi Ty2
aaguuuuuuuaaaa

SEQ ID NO: 1797877 - RNA, 15 nt, Salmonella enterica enterica serovar Typhi Ty2
aaguuuuucucuuau

SEQ ID NO: 1797878 - RNA, 20 nt, Salmonella enterica enterica serovar Typhi Ty2
cggauaaacgcugcgcaaca

SEQ ID NO: 1797879 - RNA, 22 nt, Salmonella enterica enterica serovar Typhi Ty2
cggauaaauagugacgccgcca

SEQ ID NO: 1797880 - RNA, 15 nt, Salmonella enterica enterica serovar Typhi Ty2
cggauaaaauuauuu

SEQ ID NO: 1797881 - RNA, 23 nt, Salmonella enterica enterica serovar Typhi Ty2
cggagugcgcggcgaaaaagccg

SEQ ID NO: 1797882 - RNA, 21 nt, Salmonella enterica enterica serovar Typhi Ty2
cggaggccagauucaccacca

SEQ ID NO: 1797883 - RNA, 15 nt, Salmonella enterica enterica serovar Typhi Ty2
cggaggagugcgcca

SEQ ID NO: 1797884 - RNA, 19 nt, Salmonella enterica enterica serovar Typhi Ty2
cggauaacgcgcuggcgga

SEQ ID NO: 1797885 - RNA, 16 nt, Salmonella enterica enterica serovar Typhi Ty2
cggauaacgcgcuggc

SEQ ID NO: 1797886 - RNA, 15 nt, Salmonella enterica enterica serovar Typhi Ty2
cggauaagcaacgcg

SEQ ID NO: 1797887 - RNA, 14 nt, Salmonella enterica enterica serovar Typhi Ty2
cggauagcucgcug

SEQ ID NO: 1797888 - RNA, 18 nt, Salmonella enterica enterica serovar Typhi Ty2
cggauagucauaauuaaa

SEQ ID NO: 1797889 - RNA, 14 nt, Salmonella enterica enterica serovar Typhi Ty2
cggauaucagacag

SEQ ID NO: 1797890 - RNA, 23 nt, Salmonella enterica enterica serovar Typhi Ty2
cggauaugcgucuuaaugguggu

SEQ ID NO: 1797891 - RNA, 15 nt, Salmonella enterica enterica serovar Typhi Ty2
cggaucaauaaacag

SEQ ID NO: 1797892 - RNA, 19 nt, Salmonella enterica enterica serovar Typhi Ty2
cggaucaaaaaggugagca

SEQ ID NO: 1797893 - RNA, 13 nt, Salmonella enterica enterica serovar Typhi Ty2
cggauccagaacu

SEQ ID NO: 1797894 - RNA, 17 nt, Salmonella enterica enterica serovar Typhi Ty2
cggaucaugguugaaaa

SEQ ID NO: 1797895 - RNA, 16 nt, Salmonella enterica enterica serovar Typhi Ty2
cggaucgacagcaaug

SEQ ID NO: 1797896 - RNA, 21 nt, Salmonella enterica enterica serovar Typhi Ty2
cggaugaaacaguccggcgaa

SEQ ID NO: 1797897 - RNA, 13 nt, Salmonella enterica enterica serovar Typhi Ty2
cggaugaccagaa

SEQ ID NO: 1797898 - RNA, 22 nt, Salmonella enterica enterica serovar Typhi Ty2
cggauggaauuuugcaccauca

SEQ ID NO: 1797899 - RNA, 14 nt, Salmonella enterica enterica serovar Typhi Ty2
cggauggcgcggca

SEQ ID NO: 1797900 - RNA, 17 nt, Salmonella enterica enterica serovar Typhi Ty2
cggaugaucuucauaaa

SEQ ID NO: 1797901 - RNA, 14 nt, Salmonella enterica enterica serovar Typhi Ty2
cggauuccagaaua

SEQ ID NO: 1797902 - RNA, 19 nt, Salmonella enterica enterica serovar Typhi Ty2
cggauuaucguccggcauc

SEQ ID NO: 1797903 - RNA, 24 nt, Salmonella enterica enterica serovar Typhi Ty2
cggauuacgaauaccguaagacca

SEQ ID NO: 1797904 - RNA, 20 nt, Salmonella enterica enterica serovar Typhi Ty2
cggauuaacaagcagauacc

SEQ ID NO: 1797905 - RNA, 13 nt, Salmonella enterica enterica serovar Typhi Ty2
cggaugugcauug

SEQ ID NO: 1797906 - RNA, 20 nt, Salmonella enterica enterica serovar Typhi Ty2
cggauguuagcuucacuucg

SEQ ID NO: 1797907 - RNA, 22 nt, Salmonella enterica enterica serovar Typhi Ty2
cggauggcguuuagcuggcggg

SEQ ID NO: 1797908 - RNA, 18 nt, Salmonella enterica enterica serovar Typhi Ty2
cggaugguggcguaaaua

SEQ ID NO: 1797909 - RNA, 14 nt, Salmonella enterica enterica serovar Typhi Ty2
cggcaacaguaccu

SEQ ID NO: 1797910 - RNA, 16 nt, Salmonella enterica enterica serovar Typhi Ty2
cggcaaccaaagucca

SEQ ID NO: 1797911 - RNA, 15 nt, Salmonella enterica enterica serovar Typhi Ty2
cggcaaauccuccau

SEQ ID NO: 1797912 - RNA, 16 nt, Salmonella enterica enterica serovar Typhi Ty2
cggcaaaguuccaggu

SEQ ID NO: 1797913 - RNA, 21 nt, Salmonella enterica enterica serovar Typhi Ty2
cggcaaagaaaaagaguugca

SEQ ID NO: 1797914 - RNA, 22 nt, Salmonella enterica enterica serovar Typhi Ty2
cggauugucaucugacugcgug

SEQ ID NO: 1797915 - RNA, 21 nt, Salmonella enterica enterica serovar Typhi Ty2
cggauuguuguucauggucag

SEQ ID NO: 1797916 - RNA, 24 nt, Salmonella enterica enterica serovar Typhi Ty2
cggcaaaccaugaucgucaggcgc

SEQ ID NO: 1797917 - RNA, 16 nt, Salmonella enterica enterica serovar Typhi Ty2
cggcaaaccaaacggc

SEQ ID NO: 1797918 - RNA, 23 nt, Salmonella enterica enterica serovar Typhi Ty2
cggcaaacggggggauucauuau

SEQ ID NO: 1797919 - RNA, 15 nt, Salmonella enterica enterica serovar Typhi Ty2
cggcaaacgcuggug

SEQ ID NO: 1797920 - RNA, 14 nt, Salmonella enterica enterica serovar Typhi Ty2
cggcaaaaacguug

SEQ ID NO: 1797921 - RNA, 20 nt, Salmonella enterica enterica serovar Typhi Ty2
cggcaaaaaauauagccauu

SEQ ID NO: 1797922 - RNA, 18 nt, Salmonella enterica enterica serovar Typhi Ty2
cggcaaggucugcgccca

SEQ ID NO: 1797923 - RNA, 13 nt, Salmonella enterica enterica serovar Typhi Ty2
cggcaaucucacu

SEQ ID NO: 1797924 - RNA, 14 nt, Salmonella enterica enterica serovar Typhi Ty2
cggcaauacuggac

SEQ ID NO: 1797925 - RNA, 23 nt, Salmonella enterica enterica serovar Typhi Ty2
cggcaauauugccgcacgguacu

SEQ ID NO: 1797926 - RNA, 17 nt, Salmonella enterica enterica serovar Typhi Ty2
cggcaagcgcugggcga

SEQ ID NO: 1797927 - RNA, 11 nt, Salmonella enterica enterica serovar Typhi Ty2
cggcaccagca

SEQ ID NO: 1797928 - RNA, 14 nt, Salmonella enterica enterica serovar Typhi Ty2
cggcaccagcaaug

SEQ ID NO: 1797929 - RNA, 13 nt, Salmonella enterica enterica serovar Typhi Ty2
cggcaccagccag

SEQ ID NO: 1797930 - RNA, 16 nt, Salmonella enterica enterica serovar Typhi Ty2
cggcaccagcgaugcg

SEQ ID NO: 1797931 - RNA, 18 nt, Salmonella enterica enterica serovar Typhi Ty2
cggcacaaugcccggcau

SEQ ID NO: 1797932 - RNA, 17 nt, Salmonella enterica enterica serovar Typhi Ty2
cggcaauuuacaaccgu

SEQ ID NO: 1797933 - RNA, 18 nt, Salmonella enterica enterica serovar Typhi Ty2
cggcaaugcggguuucgu

SEQ ID NO: 1797934 - RNA, 17 nt, Salmonella enterica enterica serovar Typhi Ty2
cggcaauuaccgccagc

SEQ ID NO: 1797935 - RNA, 17 nt, Salmonella enterica enterica serovar Typhi Ty2
cggcacaucgcgcguga

SEQ ID NO: 1797936 - RNA, 13 nt, Salmonella enterica enterica serovar Typhi Ty2
cggcacacagcac

SEQ ID NO: 1797937 - RNA, 23 nt, Salmonella enterica enterica serovar Typhi Ty2
cggcacauaggcaaacaccucag

SEQ ID NO: 1797938 - RNA, 23 nt, Salmonella enterica enterica serovar Typhi Ty2
cggcaccggaaccggcaucggga

SEQ ID NO: 1797939 - RNA, 18 nt, Salmonella enterica enterica serovar Typhi Ty2
cggcacgguuaaugaaau

SEQ ID NO: 1797940 - RNA, 17 nt, Salmonella enterica enterica serovar Typhi Ty2
cggcacguuuuccaggu

SEQ ID NO: 1797941 - RNA, 20 nt, Salmonella enterica enterica serovar Typhi Ty2
cggcacgucgucccaggcca

SEQ ID NO: 1797942 - RNA, 12 nt, Salmonella enterica enterica serovar Typhi Ty2
cggacaucccaa

SEQ ID NO: 1797943 - RNA, 15 nt, Salmonella enterica enterica serovar Typhi Ty2
cggacaucggccucg

SEQ ID NO: 1797944 - RNA, 14 nt, Salmonella enterica enterica serovar Typhi Ty2
cggaccccucuucu

SEQ ID NO: 1797945 - RNA, 18 nt, Salmonella enterica enterica serovar Typhi Ty2
cggaaucggacacuugca

SEQ ID NO: 1797946 - RNA, 22 nt, Salmonella enterica enterica serovar Typhi Ty2
cggaauccaucccccugccguu

SEQ ID NO: 1797947 - RNA, 23 nt, Salmonella enterica enterica serovar Typhi Ty2
cggaauaacuccagugcagaaag

SEQ ID NO: 1797948 - RNA, 19 nt, Salmonella enterica enterica serovar Typhi Ty2
cggaauaugcgcuuuuuuc

SEQ ID NO: 1797949 - RNA, 15 nt, Salmonella enterica enterica serovar Typhi Ty2
cggaaugaugugcua

SEQ ID NO: 1797950 - RNA, 15 nt, Salmonella enterica enterica serovar Typhi Ty2
cggaaugagagaagg

SEQ ID NO: 1797951 - RNA, 23 nt, Salmonella enterica enterica serovar Typhi Ty2
cggaaugacaaacgccaccgcca

SEQ ID NO: 1797952 - RNA, 18 nt, Salmonella enterica enterica serovar Typhi Ty2
cggaauggcgggcgcagg

SEQ ID NO: 1797953 - RNA, 15 nt, Salmonella enterica enterica serovar Typhi Ty2
cggaauggcgacgac

SEQ ID NO: 1797954 - RNA, 17 nt, Salmonella enterica enterica serovar Typhi Ty2
cggaaugaugugcuauu

SEQ ID NO: 1797955 - RNA, 15 nt, Salmonella enterica enterica serovar Typhi Ty2
cggacaaggcgcgcc

SEQ ID NO: 1797956 - RNA, 15 nt, Salmonella enterica enterica serovar Typhi Ty2
cggacaacgcuccag

SEQ ID NO: 1797957 - RNA, 15 nt, Salmonella enterica enterica serovar Typhi Ty2
cggacagcagaauau

SEQ ID NO: 1797958 - RNA, 15 nt, Salmonella enterica enterica serovar Typhi Ty2
cggacagcggcagcg

SEQ ID NO: 1797959 - RNA, 16 nt, Salmonella enterica enterica serovar Typhi Ty2
cggacacaugaccuga

SEQ ID NO: 1797960 - RNA, 16 nt, Salmonella enterica enterica serovar Typhi Ty2
cggacacgcucauaaa

SEQ ID NO: 1797961 - RNA, 14 nt, Salmonella enterica enterica serovar Typhi Ty2
cggacacccgcagc

SEQ ID NO: 1797962 - RNA, 16 nt, Salmonella enterica enterica serovar Typhi Ty2
cggagaaaaagcgaua

SEQ ID NO: 1797963 - RNA, 21 nt, Salmonella enterica enterica serovar Typhi Ty2
cggacugcggccugcaaagac

SEQ ID NO: 1797964 - RNA, 11 nt, Salmonella enterica enterica serovar Typhi Ty2
cggacugcugg

SEQ ID NO: 1797965 - RNA, 22 nt, Salmonella enterica enterica serovar Typhi Ty2
cggagaacggcacaauagcgcu

SEQ ID NO: 1797966 - RNA, 13 nt, Salmonella enterica enterica serovar Typhi Ty2
cggacucagggug

SEQ ID NO: 1797967 - RNA, 14 nt, Salmonella enterica enterica serovar Typhi Ty2
cggacucaggccuu

SEQ ID NO: 1797968 - RNA, 16 nt, Salmonella enterica enterica serovar Typhi Ty2
cggacucgcuggacau

SEQ ID NO: 1797969 - RNA, 23 nt, Salmonella enterica enterica serovar Typhi Ty2
cggacggucggcguaauguugcu

SEQ ID NO: 1797970 - RNA, 14 nt, Salmonella enterica enterica serovar Typhi Ty2
cggacguugcuccg

SEQ ID NO: 1797971 - RNA, 16 nt, Salmonella enterica enterica serovar Typhi Ty2
cggacuagacagccuc

SEQ ID NO: 1797972 - RNA, 17 nt, Salmonella enterica enterica serovar Typhi Ty2
cggacgguaccugaagc

SEQ ID NO: 1797973 - RNA, 17 nt, Salmonella enterica enterica serovar Typhi Ty2
cggagagagcaacuggc

SEQ ID NO: 1797974 - RNA, 17 nt, Salmonella enterica enterica serovar Typhi Ty2
cggagauuaacagcgcg

SEQ ID NO: 1797975 - RNA, 21 nt, Salmonella enterica enterica serovar Typhi Ty2
cggagauuaacagcgcgacca

SEQ ID NO: 1797976 - RNA, 18 nt, Salmonella enterica enterica serovar Typhi Ty2
cggagauuucauccucuu

SEQ ID NO: 1797977 - RNA, 14 nt, Salmonella enterica enterica serovar Typhi Ty2
cggagcaaaaaaug

SEQ ID NO: 1797978 - RNA, 22 nt, Salmonella enterica enterica serovar Typhi Ty2
cggagcuaaaccgucauuuacc

SEQ ID NO: 1797979 - RNA, 15 nt, Salmonella enterica enterica serovar Typhi Ty2
cggagcuaauaugaa

SEQ ID NO: 1797980 - RNA, 15 nt, Salmonella enterica enterica serovar Typhi Ty2
cggagcuggcacgcg

SEQ ID NO: 1797981 - RNA, 20 nt, Salmonella enterica enterica serovar Typhi Ty2
cggaaaucaaaccaucccag

SEQ ID NO: 1797982 - RNA, 16 nt, Salmonella enterica enterica serovar Typhi Ty2
cggaaaucaacaaucc

SEQ ID NO: 1797983 - RNA, 15 nt, Salmonella enterica enterica serovar Typhi Ty2
cggaaagaauaaucg

SEQ ID NO: 1797984 - RNA, 20 nt, Salmonella enterica enterica serovar Typhi Ty2
cggaaaggacguucuucucc

SEQ ID NO: 1797985 - RNA, 14 nt, Salmonella enterica enterica serovar Typhi Ty2
cggaaccuguccug

SEQ ID NO: 1797986 - RNA, 22 nt, Salmonella enterica enterica serovar Typhi Ty2
cggaaccgcccaucaacaccag

SEQ ID NO: 1797987 - RNA, 17 nt, Salmonella enterica enterica serovar Typhi Ty2
cggaaccaaaugcccag

SEQ ID NO: 1797988 - RNA, 14 nt, Salmonella enterica enterica serovar Typhi Ty2
cggaacccagcaaa

SEQ ID NO: 1797989 - RNA, 23 nt, Salmonella enterica enterica serovar Typhi Ty2
cggaaaugcgcggugucauugac

SEQ ID NO: 1797990 - RNA, 12 nt, Salmonella enterica enterica serovar Typhi Ty2
cggaaauggucg

SEQ ID NO: 1797991 - RNA, 16 nt, Salmonella enterica enterica serovar Typhi Ty2
cggaagagcucgacca

SEQ ID NO: 1797992 - RNA, 16 nt, Salmonella enterica enterica serovar Typhi Ty2
cggaacuggugaaaca

SEQ ID NO: 1797993 - RNA, 22 nt, Salmonella enterica enterica serovar Typhi Ty2
cggaaggcuaccgcugggauga

SEQ ID NO: 1797994 - RNA, 21 nt, Salmonella enterica enterica serovar Typhi Ty2
cggaaggugccguauggcguc

SEQ ID NO: 1797995 - RNA, 16 nt, Salmonella enterica enterica serovar Typhi Ty2
cggaagugcucuccac

SEQ ID NO: 1797996 - RNA, 15 nt, Salmonella enterica enterica serovar Typhi Ty2
cggaauaccgucaaa

SEQ ID NO: 1797997 - RNA, 16 nt, Salmonella enterica enterica serovar Typhi Ty2
cgcuaaccggcggcgu

SEQ ID NO: 1797998 - RNA, 12 nt, Salmonella enterica enterica serovar Typhi Ty2
cgcuaauaauuc

SEQ ID NO: 1797999 - RNA, 20 nt, Salmonella enterica enterica serovar Typhi Ty2
cgcuaaacagcgccgcgaau

SEQ ID NO: 1798000 - RNA, 15 nt, Salmonella enterica enterica serovar Typhi Ty2
cgcuaaaauccacgu

SEQ ID NO: 1798001 - RNA, 16 nt, Salmonella enterica enterica serovar Typhi Ty2
cgcguuuuuucaugaa

SEQ ID NO: 1798002 - RNA, 22 nt, Salmonella enterica enterica serovar Typhi Ty2
cgcuaaccagcgcuucgccugc

SEQ ID NO: 1798003 - RNA, 14 nt, Salmonella enterica enterica serovar Typhi Ty2
cgcuaaaugcauag

SEQ ID NO: 1798004 - RNA, 21 nt, Salmonella enterica enterica serovar Typhi Ty2
cgcuuuacccgggccaucuuu

SEQ ID NO: 1798005 - RNA, 22 nt, Salmonella enterica enterica serovar Typhi Ty2
cgcuacauccgccagccgccau

SEQ ID NO: 1798006 - RNA, 16 nt, Salmonella enterica enterica serovar Typhi Ty2
cgcuuucaccgccuca

SEQ ID NO: 1798007 - RNA, 13 nt, Salmonella enterica enterica serovar Typhi Ty2
cgcuuucaccauc

SEQ ID NO: 1798008 - RNA, 14 nt, Salmonella enterica enterica serovar Typhi Ty2
cgcuuucccggcau

SEQ ID NO: 1798009 - RNA, 13 nt, Salmonella enterica enterica serovar Typhi Ty2
cgcuuucauacga

SEQ ID NO: 1798010 - RNA, 20 nt, Salmonella enterica enterica serovar Typhi Ty2
cgcuuucgucguccacucuu

SEQ ID NO: 1798011 - RNA, 19 nt, Salmonella enterica enterica serovar Typhi Ty2
cgcuuucugagccgcccgg

SEQ ID NO: 1798012 - RNA, 17 nt, Salmonella enterica enterica serovar Typhi Ty2
cgcuuugagcugcugcu

SEQ ID NO: 1798013 - RNA, 15 nt, Salmonella enterica enterica serovar Typhi Ty2
cgcuuuggaggucau

SEQ ID NO: 1798014 - RNA, 19 nt, Salmonella enterica enterica serovar Typhi Ty2
cgcuuugacauugucauaa

SEQ ID NO: 1798015 - RNA, 13 nt, Salmonella enterica enterica serovar Typhi Ty2
cggaaaaaacguu

SEQ ID NO: 1798016 - RNA, 16 nt, Salmonella enterica enterica serovar Typhi Ty2
cgcuuuuuucucugcu

SEQ ID NO: 1798017 - RNA, 20 nt, Salmonella enterica enterica serovar Typhi Ty2
cggaaaauauucagcacauc

SEQ ID NO: 1798018 - RNA, 23 nt, Salmonella enterica enterica serovar Typhi Ty2
cggaaaaaugucgcuuaucgccu

SEQ ID NO: 1798019 - RNA, 15 nt, Salmonella enterica enterica serovar Typhi Ty2
cgcuuuuccccgcag

SEQ ID NO: 1798020 - RNA, 13 nt, Salmonella enterica enterica serovar Typhi Ty2
cgcuuuucuggcu

SEQ ID NO: 1798021 - RNA, 19 nt, Salmonella enterica enterica serovar Typhi Ty2
cgcuuuuacucuuccugcu

SEQ ID NO: 1798022 - RNA, 18 nt, Salmonella enterica enterica serovar Typhi Ty2
cgcuuuuugcgccagcgc

SEQ ID NO: 1798023 - RNA, 17 nt, Salmonella enterica enterica serovar Typhi Ty2
cgcuuuugguuuuucaa

SEQ ID NO: 1798024 - RNA, 17 nt, Salmonella enterica enterica serovar Typhi Ty2
cggcgcaaauggcugcg

SEQ ID NO: 1798025 - RNA, 19 nt, Salmonella enterica enterica serovar Typhi Ty2
cggcgcaaauggcugcgac

SEQ ID NO: 1798026 - RNA, 19 nt, Salmonella enterica enterica serovar Typhi Ty2
cggcgauuuccagcgccgc

SEQ ID NO: 1798027 - RNA, 15 nt, Salmonella enterica enterica serovar Typhi Ty2
cggcgccacgcgcca

SEQ ID NO: 1798028 - RNA, 22 nt, Salmonella enterica enterica serovar Typhi Ty2
cggcccuggcucaauccaggug

SEQ ID NO: 1798029 - RNA, 16 nt, Salmonella enterica enterica serovar Typhi Ty2
cggcgacaagaauaug

SEQ ID NO: 1798030 - RNA, 18 nt, Salmonella enterica enterica serovar Typhi Ty2
cggcgaaggucgcgccgc

SEQ ID NO: 1798031 - RNA, 18 nt, Salmonella enterica enterica serovar Typhi Ty2
cggcgaauuaaucgucga

SEQ ID NO: 1798032 - RNA, 15 nt, Salmonella enterica enterica serovar Typhi Ty2
cggcgaaggucgcgc

SEQ ID NO: 1798033 - RNA, 13 nt, Salmonella enterica enterica serovar Typhi Ty2
cggccuuauuuuu

SEQ ID NO: 1798034 - RNA, 16 nt, Salmonella enterica enterica serovar Typhi Ty2
cggccuuauuuuucag

SEQ ID NO: 1798035 - RNA, 23 nt, Salmonella enterica enterica serovar Typhi Ty2
cggccuugaaguuauccagcgcc

SEQ ID NO: 1798036 - RNA, 13 nt, Salmonella enterica enterica serovar Typhi Ty2
cggccucccagcu

SEQ ID NO: 1798037 - RNA, 17 nt, Salmonella enterica enterica serovar Typhi Ty2
cggccuacaaagccaaa

SEQ ID NO: 1798038 - RNA, 16 nt, Salmonella enterica enterica serovar Typhi Ty2
cggccuacaacucagc

SEQ ID NO: 1798039 - RNA, 15 nt, Salmonella enterica enterica serovar Typhi Ty2
cggccuggcucuucc

SEQ ID NO: 1798040 - RNA, 15 nt, Salmonella enterica enterica serovar Typhi Ty2
cggccugucgcgacc

SEQ ID NO: 1798041 - RNA, 14 nt, Salmonella enterica enterica serovar Typhi Ty2
cggccuccgcuucc

SEQ ID NO: 1798042 - RNA, 14 nt, Salmonella enterica enterica serovar Typhi Ty2
cggccagcgccagc

SEQ ID NO: 1798043 - RNA, 16 nt, Salmonella enterica enterica serovar Typhi Ty2
cggccagcgcaggcug

SEQ ID NO: 1798044 - RNA, 19 nt, Salmonella enterica enterica serovar Typhi Ty2
cggccagcgagucgccgcu

SEQ ID NO: 1798045 - RNA, 20 nt, Salmonella enterica enterica serovar Typhi Ty2
cggccagucgcucuaacuga

SEQ ID NO: 1798046 - RNA, 18 nt, Salmonella enterica enterica serovar Typhi Ty2
cggccauugccgcgccga

SEQ ID NO: 1798047 - RNA, 17 nt, Salmonella enterica enterica serovar Typhi Ty2
cggccaguagcgggggc

SEQ ID NO: 1798048 - RNA, 13 nt, Salmonella enterica enterica serovar Typhi Ty2
cggcccgcgcuga

SEQ ID NO: 1798049 - RNA, 14 nt, Salmonella enterica enterica serovar Typhi Ty2
cggccccgggcgac

SEQ ID NO: 1798050 - RNA, 15 nt, Salmonella enterica enterica serovar Typhi Ty2
cggccacagccaucc

SEQ ID NO: 1798051 - RNA, 21 nt, Salmonella enterica enterica serovar Typhi Ty2
cggccagauaguggcugaggc

SEQ ID NO: 1798052 - RNA, 15 nt, Salmonella enterica enterica serovar Typhi Ty2
cggccacgcgcguca

SEQ ID NO: 1798053 - RNA, 14 nt, Salmonella enterica enterica serovar Typhi Ty2
cggccacgagcugu

SEQ ID NO: 1798054 - RNA, 23 nt, Salmonella enterica enterica serovar Typhi Ty2
cggcacugacucuuccgggcgcg

SEQ ID NO: 1798055 - RNA, 21 nt, Salmonella enterica enterica serovar Typhi Ty2
cggcacugacucuuccgggcg

SEQ ID NO: 1798056 - RNA, 14 nt, Salmonella enterica enterica serovar Typhi Ty2
cggccacagcgcca

SEQ ID NO: 1798057 - RNA, 14 nt, Salmonella enterica enterica serovar Typhi Ty2
cggccacaaaacag

SEQ ID NO: 1798058 - RNA, 21 nt, Salmonella enterica enterica serovar Typhi Ty2
cggcauuucaccgucaauaac

SEQ ID NO: 1798059 - RNA, 21 nt, Salmonella enterica enterica serovar Typhi Ty2
cggcauuucugucugacgacc

SEQ ID NO: 1798060 - RNA, 18 nt, Salmonella enterica enterica serovar Typhi Ty2
cgagguucccgccgccau

SEQ ID NO: 1798061 - RNA, 18 nt, Salmonella enterica enterica serovar Typhi Ty2
cgaggugaauaaauccuu

SEQ ID NO: 1798062 - RNA, 17 nt, Salmonella enterica enterica serovar Typhi Ty2
cgaggugaauaaauccu

SEQ ID NO: 1798063 - RNA, 14 nt, Salmonella enterica enterica serovar Typhi Ty2
cgagggugggcgca

SEQ ID NO: 1798064 - RNA, 16 nt, Salmonella enterica enterica serovar Typhi Ty2
cgagucgucaguucca

SEQ ID NO: 1798065 - RNA, 13 nt, Salmonella enterica enterica serovar Typhi Ty2
cgagucgccgcuu

SEQ ID NO: 1798066 - RNA, 16 nt, Salmonella enterica enterica serovar Typhi Ty2
cgagugcguucuucca

SEQ ID NO: 1798067 - RNA, 14 nt, Salmonella enterica enterica serovar Typhi Ty2
cgauaaacgccagc

SEQ ID NO: 1798068 - RNA, 19 nt, Salmonella enterica enterica serovar Typhi Ty2
cgauaaagcgguuaucggc

SEQ ID NO: 1798069 - RNA, 13 nt, Salmonella enterica enterica serovar Typhi Ty2
cgauaaagacagg

SEQ ID NO: 1798070 - RNA, 17 nt, Salmonella enterica enterica serovar Typhi Ty2
cgauaaaccuucguaau

SEQ ID NO: 1798071 - RNA, 15 nt, Salmonella enterica enterica serovar Typhi Ty2
cgauaaaccaggcag

SEQ ID NO: 1798072 - RNA, 15 nt, Salmonella enterica enterica serovar Typhi Ty2
cgauaaauaagaagg

SEQ ID NO: 1798073 - RNA, 17 nt, Salmonella enterica enterica serovar Typhi Ty2
cgauaaaguggcauccg

SEQ ID NO: 1798074 - RNA, 14 nt, Salmonella enterica enterica serovar Typhi Ty2
cgauaaaaaagccu

SEQ ID NO: 1798075 - RNA, 12 nt, Salmonella enterica enterica serovar Typhi Ty2
cgaguucaaguc

SEQ ID NO: 1798076 - RNA, 18 nt, Salmonella enterica enterica serovar Typhi Ty2
cgauagagaguuccuccu

SEQ ID NO: 1798077 - RNA, 19 nt, Salmonella enterica enterica serovar Typhi Ty2
cgauagagaccgcuuuagc

SEQ ID NO: 1798078 - RNA, 19 nt, Salmonella enterica enterica serovar Typhi Ty2
cgauagagaguuccuccug

SEQ ID NO: 1798079 - RNA, 13 nt, Salmonella enterica enterica serovar Typhi Ty2
cgauagaccacgc

SEQ ID NO: 1798080 - RNA, 15 nt, Salmonella enterica enterica serovar Typhi Ty2
cgauagcgccccaaa

SEQ ID NO: 1798081 - RNA, 14 nt, Salmonella enterica enterica serovar Typhi Ty2
cgauagcauuuuua

SEQ ID NO: 1798082 - RNA, 17 nt, Salmonella enterica enterica serovar Typhi Ty2
cgauaauugcucaccca

SEQ ID NO: 1798083 - RNA, 19 nt, Salmonella enterica enterica serovar Typhi Ty2
cgauaaccaugcucagcgg

SEQ ID NO: 1798084 - RNA, 21 nt, Salmonella enterica enterica serovar Typhi Ty2
cgauaaccaugcucagcggcg

SEQ ID NO: 1798085 - RNA, 15 nt, Salmonella enterica enterica serovar Typhi Ty2
cgauaaccaggucac

SEQ ID NO: 1798086 - RNA, 14 nt, Salmonella enterica enterica serovar Typhi Ty2
cgauaaccagcgcg

SEQ ID NO: 1798087 - RNA, 21 nt, Salmonella enterica enterica serovar Typhi Ty2
cgauaaugaagcauaaaaaga

SEQ ID NO: 1798088 - RNA, 18 nt, Salmonella enterica enterica serovar Typhi Ty2
cgauaaucccggcgcgcg

SEQ ID NO: 1798089 - RNA, 17 nt, Salmonella enterica enterica serovar Typhi Ty2
cgauaacgaccagauac

SEQ ID NO: 1798090 - RNA, 15 nt, Salmonella enterica enterica serovar Typhi Ty2
cgagcugguuucaau

SEQ ID NO: 1798091 - RNA, 17 nt, Salmonella enterica enterica serovar Typhi Ty2
cgagcgcgucagcgccu

SEQ ID NO: 1798092 - RNA, 14 nt, Salmonella enterica enterica serovar Typhi Ty2
cgagcguagccaac

SEQ ID NO: 1798093 - RNA, 18 nt, Salmonella enterica enterica serovar Typhi Ty2
cgagcggccaaagggagc

SEQ ID NO: 1798094 - RNA, 22 nt, Salmonella enterica enterica serovar Typhi Ty2
aaacggaaccaaaugcccagcu

SEQ ID NO: 1798095 - RNA, 18 nt, Salmonella enterica enterica serovar Typhi Ty2
cgaggccacgcagcgcag

SEQ ID NO: 1798096 - RNA, 23 nt, Salmonella enterica enterica serovar Typhi Ty2
cgaggaacaucagccagcagcuc

SEQ ID NO: 1798097 - RNA, 22 nt, Salmonella enterica enterica serovar Typhi Ty2
cgaggcuuuguccuuugcuaca

SEQ ID NO: 1798098 - RNA, 14 nt, Salmonella enterica enterica serovar Typhi Ty2
cgagggaaggggau

SEQ ID NO: 1798099 - RNA, 15 nt, Salmonella enterica enterica serovar Typhi Ty2
cgaggcgcccaacgc

SEQ ID NO: 1798100 - RNA, 20 nt, Salmonella enterica enterica serovar Typhi Ty2
cgaauacuccugcaacagaa

SEQ ID NO: 1798101 - RNA, 22 nt, Salmonella enterica enterica serovar Typhi Ty2
cgaauacuacugguggaauaaa

SEQ ID NO: 1798102 - RNA, 13 nt, Salmonella enterica enterica serovar Typhi Ty2
cgaauaauuauuu

SEQ ID NO: 1798103 - RNA, 13 nt, Salmonella enterica enterica serovar Typhi Ty2
cgacguugcgccu

SEQ ID NO: 1798104 - RNA, 17 nt, Salmonella enterica enterica serovar Typhi Ty2
cgacguuaucucgccag

SEQ ID NO: 1798105 - RNA, 14 nt, Salmonella enterica enterica serovar Typhi Ty2
cgacucacgcgcgc

SEQ ID NO: 1798106 - RNA, 14 nt, Salmonella enterica enterica serovar Typhi Ty2
cgacuaucuucuuc

SEQ ID NO: 1798107 - RNA, 19 nt, Salmonella enterica enterica serovar Typhi Ty2
cgacuccaauaauggagau

SEQ ID NO: 1798108 - RNA, 13 nt, Salmonella enterica enterica serovar Typhi Ty2
cgacuccagaaua

SEQ ID NO: 1798109 - RNA, 15 nt, Salmonella enterica enterica serovar Typhi Ty2
cgacugauaacggcg

SEQ ID NO: 1798110 - RNA, 23 nt, Salmonella enterica enterica serovar Typhi Ty2
cgacucuguauuuaauaccuggu

SEQ ID NO: 1798111 - RNA, 18 nt, Salmonella enterica enterica serovar Typhi Ty2
cgagaagaagaauuauua

SEQ ID NO: 1798112 - RNA, 14 nt, Salmonella enterica enterica serovar Typhi Ty2
cgagaaacaccaga

SEQ ID NO: 1798113 - RNA, 21 nt, Salmonella enterica enterica serovar Typhi Ty2
cgagaaaaucagugaacaccc

SEQ ID NO: 1798114 - RNA, 14 nt, Salmonella enterica enterica serovar Typhi Ty2
cgagaaaaaacuca

SEQ ID NO: 1798115 - RNA, 23 nt, Salmonella enterica enterica serovar Typhi Ty2
cgacuuuaaacuuauccgccauc

SEQ ID NO: 1798116 - RNA, 21 nt, Salmonella enterica enterica serovar Typhi Ty2
cgacuuuaaacuuauccgcca

SEQ ID NO: 1798117 - RNA, 15 nt, Salmonella enterica enterica serovar Typhi Ty2
cgacuucgcuuccug

SEQ ID NO: 1798118 - RNA, 15 nt, Salmonella enterica enterica serovar Typhi Ty2
cgacuucgaagguuc

SEQ ID NO: 1798119 - RNA, 14 nt, Salmonella enterica enterica serovar Typhi Ty2
cgacuguuguucuu

SEQ ID NO: 1798120 - RNA, 13 nt, Salmonella enterica enterica serovar Typhi Ty2
cgacuuaucuucc

SEQ ID NO: 1798121 - RNA, 16 nt, Salmonella enterica enterica serovar Typhi Ty2
cgacuuaucuuccacg

SEQ ID NO: 1798122 - RNA, 17 nt, Salmonella enterica enterica serovar Typhi Ty2
cgacuuaucuuccacgc

SEQ ID NO: 1798123 - RNA, 15 nt, Salmonella enterica enterica serovar Typhi Ty2
cgagagaaaaaaauc

SEQ ID NO: 1798124 - RNA, 17 nt, Salmonella enterica enterica serovar Typhi Ty2
cgagacucaaagaaaac

SEQ ID NO: 1798125 - RNA, 23 nt, Salmonella enterica enterica serovar Typhi Ty2
cgagacuacccaucacgcccugu

SEQ ID NO: 1798126 - RNA, 17 nt, Salmonella enterica enterica serovar Typhi Ty2
cgagagugacgacgcca

SEQ ID NO: 1798127 - RNA, 15 nt, Salmonella enterica enterica serovar Typhi Ty2
cgagaguuugugaug

SEQ ID NO: 1798128 - RNA, 14 nt, Salmonella enterica enterica serovar Typhi Ty2
cgagagucaaggca

SEQ ID NO: 1798129 - RNA, 19 nt, Salmonella enterica enterica serovar Typhi Ty2
cgagaauguguucucccug

SEQ ID NO: 1798130 - RNA, 14 nt, Salmonella enterica enterica serovar Typhi Ty2
cgagacccagcgcg

SEQ ID NO: 1798131 - RNA, 18 nt, Salmonella enterica enterica serovar Typhi Ty2
cgagcacuguagcggcug

SEQ ID NO: 1798132 - RNA, 19 nt, Salmonella enterica enterica serovar Typhi Ty2
cgagcacuaauauucgauu

SEQ ID NO: 1798133 - RNA, 17 nt, Salmonella enterica enterica serovar Typhi Ty2
cgagcaguucagcagca

SEQ ID NO: 1798134 - RNA, 14 nt, Salmonella enterica enterica serovar Typhi Ty2
cgagcaguucagca

SEQ ID NO: 1798135 - RNA, 21 nt, Salmonella enterica enterica serovar Typhi Ty2
cgagauuacugcgugcuggcg

SEQ ID NO: 1798136 - RNA, 14 nt, Salmonella enterica enterica serovar Typhi Ty2
cgagauucaauaau

SEQ ID NO: 1798137 - RNA, 13 nt, Salmonella enterica enterica serovar Typhi Ty2
cgagcaauaguga

SEQ ID NO: 1798138 - RNA, 13 nt, Salmonella enterica enterica serovar Typhi Ty2
cgagauaaaaacg

SEQ ID NO: 1798139 - RNA, 18 nt, Salmonella enterica enterica serovar Typhi Ty2
cgagcauccgcgcaauau

SEQ ID NO: 1798140 - RNA, 20 nt, Salmonella enterica enterica serovar Typhi Ty2
cgagccauuaaugcaggcag

SEQ ID NO: 1798141 - RNA, 20 nt, Salmonella enterica enterica serovar Typhi Ty2
cgagcgacgcccugcccaug

SEQ ID NO: 1798142 - RNA, 20 nt, Salmonella enterica enterica serovar Typhi Ty2
cgagcgaucauaagggagcu

SEQ ID NO: 1798143 - RNA, 18 nt, Salmonella enterica enterica serovar Typhi Ty2
cgagccgucgccggccug

SEQ ID NO: 1798144 - RNA, 17 nt, Salmonella enterica enterica serovar Typhi Ty2
aaacgcuccggcaggca

SEQ ID NO: 1798145 - RNA, 16 nt, Salmonella enterica enterica serovar Typhi Ty2
aaacgcuauuuaaccc

SEQ ID NO: 1798146 - RNA, 14 nt, Salmonella enterica enterica serovar Typhi Ty2
aaacgcgcaaaacu

SEQ ID NO: 1798147 - RNA, 13 nt, Salmonella enterica enterica serovar Typhi Ty2
cgccacccggcuu

SEQ ID NO: 1798148 - RNA, 12 nt, Salmonella enterica enterica serovar Typhi Ty2
cgccacccggcu

SEQ ID NO: 1798149 - RNA, 13 nt, Salmonella enterica enterica serovar Typhi Ty2
cgccaccaccagc

SEQ ID NO: 1798150 - RNA, 20 nt, Salmonella enterica enterica serovar Typhi Ty2
cgccaccaaagccaggccgc

SEQ ID NO: 1798151 - RNA, 16 nt, Salmonella enterica enterica serovar Typhi Ty2
cgccaccaaagccagg

SEQ ID NO: 1798152 - RNA, 14 nt, Salmonella enterica enterica serovar Typhi Ty2
cgccaccgcgcgca

SEQ ID NO: 1798153 - RNA, 15 nt, Salmonella enterica enterica serovar Typhi Ty2
cgccaccgcgcgcuu

SEQ ID NO: 1798154 - RNA, 15 nt, Salmonella enterica enterica serovar Typhi Ty2
cgccaccgccgccac

SEQ ID NO: 1798155 - RNA, 17 nt, Salmonella enterica enterica serovar Typhi Ty2
cgccacauugcgcgccg

SEQ ID NO: 1798156 - RNA, 15 nt, Salmonella enterica enterica serovar Typhi Ty2
cgccacaugcggcag

SEQ ID NO: 1798157 - RNA, 23 nt, Salmonella enterica enterica serovar Typhi Ty2
cgccacaccgagacagagaaccu

SEQ ID NO: 1798158 - RNA, 15 nt, Salmonella enterica enterica serovar Typhi Ty2
cgccaaugccgcagc

SEQ ID NO: 1798159 - RNA, 18 nt, Salmonella enterica enterica serovar Typhi Ty2
cgccaaucgcgauaucaa

SEQ ID NO: 1798160 - RNA, 20 nt, Salmonella enterica enterica serovar Typhi Ty2
cgccaaucaacgccgccagg

SEQ ID NO: 1798161 - RNA, 12 nt, Salmonella enterica enterica serovar Typhi Ty2
cgccaauaucca

SEQ ID NO: 1798162 - RNA, 14 nt, Salmonella enterica enterica serovar Typhi Ty2
cgccaauauccauu

SEQ ID NO: 1798163 - RNA, 17 nt, Salmonella enterica enterica serovar Typhi Ty2
cgccaauggccgccccc

SEQ ID NO: 1798164 - RNA, 15 nt, Salmonella enterica enterica serovar Typhi Ty2
cgccaauaccgccgu

SEQ ID NO: 1798165 - RNA, 15 nt, Salmonella enterica enterica serovar Typhi Ty2
cgccaauccaugccg

SEQ ID NO: 1798166 - RNA, 20 nt, Salmonella enterica enterica serovar Typhi Ty2
cgccaagcgcggcagcagcu

SEQ ID NO: 1798167 - RNA, 13 nt, Salmonella enterica enterica serovar Typhi Ty2
cgccaagcgcggc

SEQ ID NO: 1798168 - RNA, 14 nt, Salmonella enterica enterica serovar Typhi Ty2
cgccaagcugugau

SEQ ID NO: 1798169 - RNA, 13 nt, Salmonella enterica enterica serovar Typhi Ty2
cgccaaccgccau

SEQ ID NO: 1798170 - RNA, 20 nt, Salmonella enterica enterica serovar Typhi Ty2
cgccaaccgugagcgcgccg

SEQ ID NO: 1798171 - RNA, 18 nt, Salmonella enterica enterica serovar Typhi Ty2
cgccaacgccacugccau

SEQ ID NO: 1798172 - RNA, 15 nt, Salmonella enterica enterica serovar Typhi Ty2
cgccaaccaucggca

SEQ ID NO: 1798173 - RNA, 20 nt, Salmonella enterica enterica serovar Typhi Ty2
cgccaagaccgccuaacagc

SEQ ID NO: 1798174 - RNA, 15 nt, Salmonella enterica enterica serovar Typhi Ty2
cgccaacguccgccg

SEQ ID NO: 1798175 - RNA, 21 nt, Salmonella enterica enterica serovar Typhi Ty2
cgccaaaagaggcagcaaagc

SEQ ID NO: 1798176 - RNA, 19 nt, Salmonella enterica enterica serovar Typhi Ty2
cgcauuuuucuucacgccg

SEQ ID NO: 1798177 - RNA, 23 nt, Salmonella enterica enterica serovar Typhi Ty2
cgccaaagcagugaauccccaga

SEQ ID NO: 1798178 - RNA, 19 nt, Salmonella enterica enterica serovar Typhi Ty2
cgccaaagcgauccggcau

SEQ ID NO: 1798179 - RNA, 18 nt, Salmonella enterica enterica serovar Typhi Ty2
cgccaaagaaacgcugau

SEQ ID NO: 1798180 - RNA, 14 nt, Salmonella enterica enterica serovar Typhi Ty2
cgccaaacgggcaa

SEQ ID NO: 1798181 - RNA, 16 nt, Salmonella enterica enterica serovar Typhi Ty2
cgccaaaccagacccg

SEQ ID NO: 1798182 - RNA, 23 nt, Salmonella enterica enterica serovar Typhi Ty2
cgcauuuaaucgccugcgcgccu

SEQ ID NO: 1798183 - RNA, 13 nt, Salmonella enterica enterica serovar Typhi Ty2
cgcauucuuuuuu

SEQ ID NO: 1798184 - RNA, 16 nt, Salmonella enterica enterica serovar Typhi Ty2
cgcauucuuuuuucuc

SEQ ID NO: 1798185 - RNA, 19 nt, Salmonella enterica enterica serovar Typhi Ty2
cgcauucucugucgccgcc

SEQ ID NO: 1798186 - RNA, 20 nt, Salmonella enterica enterica serovar Typhi Ty2
cgcauucucugucgccgccc

SEQ ID NO: 1798187 - RNA, 19 nt, Salmonella enterica enterica serovar Typhi Ty2
cgcauugcgccccagcaca

SEQ ID NO: 1798188 - RNA, 20 nt, Salmonella enterica enterica serovar Typhi Ty2
cgcauugcgcuauuacucuu

SEQ ID NO: 1798189 - RNA, 12 nt, Salmonella enterica enterica serovar Typhi Ty2
cgcauucauaag

SEQ ID NO: 1798190 - RNA, 15 nt, Salmonella enterica enterica serovar Typhi Ty2
cgcaugggcauaauc

SEQ ID NO: 1798191 - RNA, 16 nt, Salmonella enterica enterica serovar Typhi Ty2
cgcauguuucgcuuca

SEQ ID NO: 1798192 - RNA, 21 nt, Salmonella enterica enterica serovar Typhi Ty2
cgcauguuucgcuucaauucg

SEQ ID NO: 1798193 - RNA, 16 nt, Salmonella enterica enterica serovar Typhi Ty2
cgcauagcggccagau

SEQ ID NO: 1798194 - RNA, 23 nt, Salmonella enterica enterica serovar Typhi Ty2
cgcauauuuuuuaccgcccgcuu

SEQ ID NO: 1798195 - RNA, 19 nt, Salmonella enterica enterica serovar Typhi Ty2
cgcaucaacguaaauagag

SEQ ID NO: 1798196 - RNA, 16 nt, Salmonella enterica enterica serovar Typhi Ty2
cgcaucacggcagcac

SEQ ID NO: 1798197 - RNA, 14 nt, Salmonella enterica enterica serovar Typhi Ty2
aaacggcuuuaauc

SEQ ID NO: 1798198 - RNA, 18 nt, Salmonella enterica enterica serovar Typhi Ty2
aaacgggugagacauguu

SEQ ID NO: 1798199 - RNA, 14 nt, Salmonella enterica enterica serovar Typhi Ty2
aaacggcccggcgu

SEQ ID NO: 1798200 - RNA, 15 nt, Salmonella enterica enterica serovar Typhi Ty2
aaacggccugcgcug

SEQ ID NO: 1798201 - RNA, 18 nt, Salmonella enterica enterica serovar Typhi Ty2
aaacggccagugaaauaa

SEQ ID NO: 1798202 - RNA, 18 nt, Salmonella enterica enterica serovar Typhi Ty2
cgcaucaggaucuucauc

SEQ ID NO: 1798203 - RNA, 15 nt, Salmonella enterica enterica serovar Typhi Ty2
cgcaucauucaucuc

SEQ ID NO: 1798204 - RNA, 21 nt, Salmonella enterica enterica serovar Typhi Ty2
cgcaucgccgcggcgcuggcc

SEQ ID NO: 1798205 - RNA, 15 nt, Salmonella enterica enterica serovar Typhi Ty2
cgcaugacccaggca

SEQ ID NO: 1798206 - RNA, 22 nt, Salmonella enterica enterica serovar Typhi Ty2
cgcaugaucucuugcauaauau

SEQ ID NO: 1798207 - RNA, 14 nt, Salmonella enterica enterica serovar Typhi Ty2
cgcaucuuuuuccc

SEQ ID NO: 1798208 - RNA, 16 nt, Salmonella enterica enterica serovar Typhi Ty2
cgcaucuucgcccggc

SEQ ID NO: 1798209 - RNA, 18 nt, Salmonella enterica enterica serovar Typhi Ty2
cgcaucgggucgcgcgcc

SEQ ID NO: 1798210 - RNA, 19 nt, Salmonella enterica enterica serovar Typhi Ty2
cgcaucggcccuguauaca

SEQ ID NO: 1798211 - RNA, 16 nt, Salmonella enterica enterica serovar Typhi Ty2
cgcaucucccugccag

SEQ ID NO: 1798212 - RNA, 12 nt, Salmonella enterica enterica serovar Typhi Ty2
cgcagcggcggu

SEQ ID NO: 1798213 - RNA, 13 nt, Salmonella enterica enterica serovar Typhi Ty2
cgcagcggcugcg

SEQ ID NO: 1798214 - RNA, 19 nt, Salmonella enterica enterica serovar Typhi Ty2
cgcagauaucuuccagcgc

SEQ ID NO: 1798215 - RNA, 12 nt, Salmonella enterica enterica serovar Typhi Ty2
cgcagaugcugc

SEQ ID NO: 1798216 - RNA, 23 nt, Salmonella enterica enterica serovar Typhi Ty2
cgcagaucguauccagcggcaaa

SEQ ID NO: 1798217 - RNA, 22 nt, Salmonella enterica enterica serovar Typhi Ty2
cgcaggauaaagaccggcacaa

SEQ ID NO: 1798218 - RNA, 19 nt, Salmonella enterica enterica serovar Typhi Ty2
cgcaggacuuucgcuucac

SEQ ID NO: 1798219 - RNA, 16 nt, Salmonella enterica enterica serovar Typhi Ty2
cgcaggaggcuuccgc

SEQ ID NO: 1798220 - RNA, 22 nt, Salmonella enterica enterica serovar Typhi Ty2
cgcaggcauuaaaaaaacguag

SEQ ID NO: 1798221 - RNA, 15 nt, Salmonella enterica enterica serovar Typhi Ty2
cgcaggcuugcccau

SEQ ID NO: 1798222 - RNA, 18 nt, Salmonella enterica enterica serovar Typhi Ty2
cgcaacggucggucuuuu

SEQ ID NO: 1798223 - RNA, 22 nt, Salmonella enterica enterica serovar Typhi Ty2
cgcaacgcuuccaccucuucug

SEQ ID NO: 1798224 - RNA, 18 nt, Salmonella enterica enterica serovar Typhi Ty2
cgcaacgcuaggcaaccu

SEQ ID NO: 1798225 - RNA, 13 nt, Salmonella enterica enterica serovar Typhi Ty2
cgcaacgcgcacg

SEQ ID NO: 1798226 - RNA, 17 nt, Salmonella enterica enterica serovar Typhi Ty2
cgcaacgcgcaucaacg

SEQ ID NO: 1798227 - RNA, 14 nt, Salmonella enterica enterica serovar Typhi Ty2
cgcaaccuccgcgg

SEQ ID NO: 1798228 - RNA, 16 nt, Salmonella enterica enterica serovar Typhi Ty2
cgcaaagcccaucagc

SEQ ID NO: 1798229 - RNA, 12 nt, Salmonella enterica enterica serovar Typhi Ty2
cgcaagcagcac

SEQ ID NO: 1798230 - RNA, 15 nt, Salmonella enterica enterica serovar Typhi Ty2
cgcaacgucaguacg

SEQ ID NO: 1798231 - RNA, 23 nt, Salmonella enterica enterica serovar Typhi Ty2
cgcaacguguaggcccgguaagc

SEQ ID NO: 1798232 - RNA, 15 nt, Salmonella enterica enterica serovar Typhi Ty2
cgcacaugaucuucg

SEQ ID NO: 1798233 - RNA, 23 nt, Salmonella enterica enterica serovar Typhi Ty2
cgcacagcagacaaccgacgcau

SEQ ID NO: 1798234 - RNA, 15 nt, Salmonella enterica enterica serovar Typhi Ty2
cgcacacgccgugca

SEQ ID NO: 1798235 - RNA, 14 nt, Salmonella enterica enterica serovar Typhi Ty2
cgcacgccagcggu

SEQ ID NO: 1798236 - RNA, 12 nt, Salmonella enterica enterica serovar Typhi Ty2
cgcacgcgcgcc

SEQ ID NO: 1798237 - RNA, 14 nt, Salmonella enterica enterica serovar Typhi Ty2
cgcacucagaaaau

SEQ ID NO: 1798238 - RNA, 13 nt, Salmonella enterica enterica serovar Typhi Ty2
cgcacuccccaga

SEQ ID NO: 1798239 - RNA, 14 nt, Salmonella enterica enterica serovar Typhi Ty2
cgcacuccagaugc

SEQ ID NO: 1798240 - RNA, 16 nt, Salmonella enterica enterica serovar Typhi Ty2
cgcacuuuucccgcca

SEQ ID NO: 1798241 - RNA, 14 nt, Salmonella enterica enterica serovar Typhi Ty2
cgcacuuuuccagc

SEQ ID NO: 1798242 - RNA, 14 nt, Salmonella enterica enterica serovar Typhi Ty2
cgcagaaaaagccc

SEQ ID NO: 1798243 - RNA, 12 nt, Salmonella enterica enterica serovar Typhi Ty2
cgcaccagccag

SEQ ID NO: 1798244 - RNA, 15 nt, Salmonella enterica enterica serovar Typhi Ty2
cgauggucgccuccg

SEQ ID NO: 1798245 - RNA, 22 nt, Salmonella enterica enterica serovar Typhi Ty2
cgauggggcaagcucagcggca

SEQ ID NO: 1798246 - RNA, 15 nt, Salmonella enterica enterica serovar Typhi Ty2
cgaugcguucaaaaa

SEQ ID NO: 1798247 - RNA, 22 nt, Salmonella enterica enterica serovar Typhi Ty2
cgaugcucagggcauccgccgc

SEQ ID NO: 1798248 - RNA, 17 nt, Salmonella enterica enterica serovar Typhi Ty2
cgaugcgguucaacgcg

SEQ ID NO: 1798249 - RNA, 21 nt, Salmonella enterica enterica serovar Typhi Ty2
cgaugcggagauagcggugcc

SEQ ID NO: 1798250 - RNA, 14 nt, Salmonella enterica enterica serovar Typhi Ty2
cgaugcggauccgg

SEQ ID NO: 1798251 - RNA, 14 nt, Salmonella enterica enterica serovar Typhi Ty2
cgaugcgcuuuucc

SEQ ID NO: 1798252 - RNA, 19 nt, Salmonella enterica enterica serovar Typhi Ty2
cgaugcgcguuuuccacca

SEQ ID NO: 1798253 - RNA, 18 nt, Salmonella enterica enterica serovar Typhi Ty2
cgaugaucgaggcgugcg

SEQ ID NO: 1798254 - RNA, 21 nt, Salmonella enterica enterica serovar Typhi Ty2
cgauauucgggcgcaugucag

SEQ ID NO: 1798255 - RNA, 17 nt, Salmonella enterica enterica serovar Typhi Ty2
cgaugaugaaaaagaau

SEQ ID NO: 1798256 - RNA, 20 nt, Salmonella enterica enterica serovar Typhi Ty2
cgaugauuuucaagccaaaa

SEQ ID NO: 1798257 - RNA, 14 nt, Salmonella enterica enterica serovar Typhi Ty2
cgaugcaaccccug

SEQ ID NO: 1798258 - RNA, 19 nt, Salmonella enterica enterica serovar Typhi Ty2
cgaugccguuuuaacguca

SEQ ID NO: 1798259 - RNA, 16 nt, Salmonella enterica enterica serovar Typhi Ty2
cgauuuuaugcauggu

SEQ ID NO: 1798260 - RNA, 18 nt, Salmonella enterica enterica serovar Typhi Ty2
cgauuuucuccggaagca

SEQ ID NO: 1798261 - RNA, 15 nt, Salmonella enterica enterica serovar Typhi Ty2
cgcaaaagcgcgccc

SEQ ID NO: 1798262 - RNA, 23 nt, Salmonella enterica enterica serovar Typhi Ty2
cgcaaacugcgcgcccgccuccg

SEQ ID NO: 1798263 - RNA, 16 nt, Salmonella enterica enterica serovar Typhi Ty2
cgcaaacugcgcgccc

SEQ ID NO: 1798264 - RNA, 18 nt, Salmonella enterica enterica serovar Typhi Ty2
cgcaaaauuccggcugau

SEQ ID NO: 1798265 - RNA, 20 nt, Salmonella enterica enterica serovar Typhi Ty2
cgcaaaaucgcaaacgccag

SEQ ID NO: 1798266 - RNA, 15 nt, Salmonella enterica enterica serovar Typhi Ty2
cgcaaacaguacgcc

SEQ ID NO: 1798267 - RNA, 16 nt, Salmonella enterica enterica serovar Typhi Ty2
cgcaaaauucacacca

SEQ ID NO: 1798268 - RNA, 20 nt, Salmonella enterica enterica serovar Typhi Ty2
cgauucucugaggguguuca

SEQ ID NO: 1798269 - RNA, 12 nt, Salmonella enterica enterica serovar Typhi Ty2
cgauuugccccg

SEQ ID NO: 1798270 - RNA, 18 nt, Salmonella enterica enterica serovar Typhi Ty2
cgauugcggaggccggcc

SEQ ID NO: 1798271 - RNA, 20 nt, Salmonella enterica enterica serovar Typhi Ty2
cgccgcgauguuugcucgcc

SEQ ID NO: 1798272 - RNA, 13 nt, Salmonella enterica enterica serovar Typhi Ty2
cgccgcgagcagc

SEQ ID NO: 1798273 - RNA, 18 nt, Salmonella enterica enterica serovar Typhi Ty2
cgccgcgaacaaagcccc

SEQ ID NO: 1798274 - RNA, 16 nt, Salmonella enterica enterica serovar Typhi Ty2
aaacguaccugagaga

SEQ ID NO: 1798275 - RNA, 12 nt, Salmonella enterica enterica serovar Typhi Ty2
cgccgccugaug

SEQ ID NO: 1798276 - RNA, 16 nt, Salmonella enterica enterica serovar Typhi Ty2
cgccgccugcgccagc

SEQ ID NO: 1798277 - RNA, 16 nt, Salmonella enterica enterica serovar Typhi Ty2
cgccgccuaucgccag

SEQ ID NO: 1798278 - RNA, 24 nt, Salmonella enterica enterica serovar Typhi Ty2
cgccgccggccugacgaccguugc

SEQ ID NO: 1798279 - RNA, 14 nt, Salmonella enterica enterica serovar Typhi Ty2
cgccgcuccacagc

SEQ ID NO: 1798280 - RNA, 19 nt, Salmonella enterica enterica serovar Typhi Ty2
cgccgcuaucgaccagcac

SEQ ID NO: 1798281 - RNA, 22 nt, Salmonella enterica enterica serovar Typhi Ty2
cgccggaaagaauaaucgccgc

SEQ ID NO: 1798282 - RNA, 19 nt, Salmonella enterica enterica serovar Typhi Ty2
cgccggaaagaaacgccgc

SEQ ID NO: 1798283 - RNA, 19 nt, Salmonella enterica enterica serovar Typhi Ty2
cgccggaaaaaaugggcug

SEQ ID NO: 1798284 - RNA, 20 nt, Salmonella enterica enterica serovar Typhi Ty2
cgccggaaaaccggucauau

SEQ ID NO: 1798285 - RNA, 19 nt, Salmonella enterica enterica serovar Typhi Ty2
cgccgcuuuucaggggucc

SEQ ID NO: 1798286 - RNA, 13 nt, Salmonella enterica enterica serovar Typhi Ty2
cgccgcuuccccc

SEQ ID NO: 1798287 - RNA, 13 nt, Salmonella enterica enterica serovar Typhi Ty2
cgccgcuggcggg

SEQ ID NO: 1798288 - RNA, 19 nt, Salmonella enterica enterica serovar Typhi Ty2
cgccgcuguuuucacucuu

SEQ ID NO: 1798289 - RNA, 23 nt, Salmonella enterica enterica serovar Typhi Ty2
cgccgcuggcgcuuugccguucu

SEQ ID NO: 1798290 - RNA, 22 nt, Salmonella enterica enterica serovar Typhi Ty2
cgccgcguaaauccacauucca

SEQ ID NO: 1798291 - RNA, 22 nt, Salmonella enterica enterica serovar Typhi Ty2
cgccgcggcgguuauccuccgg

SEQ ID NO: 1798292 - RNA, 13 nt, Salmonella enterica enterica serovar Typhi Ty2
aaacgucaugcug

SEQ ID NO: 1798293 - RNA, 14 nt, Salmonella enterica enterica serovar Typhi Ty2
aaacgucgaacaua

SEQ ID NO: 1798294 - RNA, 16 nt, Salmonella enterica enterica serovar Typhi Ty2
aaacguucauccgacc

SEQ ID NO: 1798295 - RNA, 15 nt, Salmonella enterica enterica serovar Typhi Ty2
aaacguuccugccag

SEQ ID NO: 1798296 - RNA, 22 nt, Salmonella enterica enterica serovar Typhi Ty2
aaacguugcuggacauauucca

SEQ ID NO: 1798297 - RNA, 15 nt, Salmonella enterica enterica serovar Typhi Ty2
cgccguaaccgccug

SEQ ID NO: 1798298 - RNA, 17 nt, Salmonella enterica enterica serovar Typhi Ty2
cgccguagaacgggccg

SEQ ID NO: 1798299 - RNA, 18 nt, Salmonella enterica enterica serovar Typhi Ty2
cgccgucgccaucaccag

SEQ ID NO: 1798300 - RNA, 14 nt, Salmonella enterica enterica serovar Typhi Ty2
cgccguauucuuac

SEQ ID NO: 1798301 - RNA, 16 nt, Salmonella enterica enterica serovar Typhi Ty2
cgccgguauagcgccu

SEQ ID NO: 1798302 - RNA, 20 nt, Salmonella enterica enterica serovar Typhi Ty2
cgccgggcuucauaccguga

SEQ ID NO: 1798303 - RNA, 13 nt, Salmonella enterica enterica serovar Typhi Ty2
cgccgguuuaucc

SEQ ID NO: 1798304 - RNA, 17 nt, Salmonella enterica enterica serovar Typhi Ty2
cgccgggaugcuuuccg

SEQ ID NO: 1798305 - RNA, 20 nt, Salmonella enterica enterica serovar Typhi Ty2
cgccgggagcguuaaucacc

SEQ ID NO: 1798306 - RNA, 15 nt, Salmonella enterica enterica serovar Typhi Ty2
cgccgggaauuauua

SEQ ID NO: 1798307 - RNA, 23 nt, Salmonella enterica enterica serovar Typhi Ty2
cgccgggcgucacccgccggcag

SEQ ID NO: 1798308 - RNA, 16 nt, Salmonella enterica enterica serovar Typhi Ty2
cgccggccccgcuucc

SEQ ID NO: 1798309 - RNA, 17 nt, Salmonella enterica enterica serovar Typhi Ty2
cgccgcuuuaccgccuu

SEQ ID NO: 1798310 - RNA, 20 nt, Salmonella enterica enterica serovar Typhi Ty2
cgccggagaggggacucacc

SEQ ID NO: 1798311 - RNA, 20 nt, Salmonella enterica enterica serovar Typhi Ty2
cgccggaugaggacauaaac

SEQ ID NO: 1798312 - RNA, 19 nt, Salmonella enterica enterica serovar Typhi Ty2
cgccggaaucgcgauccag

SEQ ID NO: 1798313 - RNA, 21 nt, Salmonella enterica enterica serovar Typhi Ty2
cgccggaauggcgacgacgcu

SEQ ID NO: 1798314 - RNA, 20 nt, Salmonella enterica enterica serovar Typhi Ty2
cgccggagagcauuuguagc

SEQ ID NO: 1798315 - RNA, 23 nt, Salmonella enterica enterica serovar Typhi Ty2
cgccggcagcaguucuucgccgg

SEQ ID NO: 1798316 - RNA, 17 nt, Salmonella enterica enterica serovar Typhi Ty2
cgccggcaacacccgcc

SEQ ID NO: 1798317 - RNA, 14 nt, Salmonella enterica enterica serovar Typhi Ty2
cgccgaagccagcg

SEQ ID NO: 1798318 - RNA, 12 nt, Salmonella enterica enterica serovar Typhi Ty2
cgccgaagugug

SEQ ID NO: 1798319 - RNA, 15 nt, Salmonella enterica enterica serovar Typhi Ty2
cgcccuguccuccau

SEQ ID NO: 1798320 - RNA, 19 nt, Salmonella enterica enterica serovar Typhi Ty2
cgcccuguauacaggcaug

SEQ ID NO: 1798321 - RNA, 23 nt, Salmonella enterica enterica serovar Typhi Ty2
cgcccuggcgggaaacagguacu

SEQ ID NO: 1798322 - RNA, 21 nt, Salmonella enterica enterica serovar Typhi Ty2
cgcccuggaggaacagcgccg

SEQ ID NO: 1798323 - RNA, 18 nt, Salmonella enterica enterica serovar Typhi Ty2
cgcccugcucccacagcu

SEQ ID NO: 1798324 - RNA, 17 nt, Salmonella enterica enterica serovar Typhi Ty2
cgcccggauaacggcgc

SEQ ID NO: 1798325 - RNA, 13 nt, Salmonella enterica enterica serovar Typhi Ty2
cgcccucgccagc

SEQ ID NO: 1798326 - RNA, 15 nt, Salmonella enterica enterica serovar Typhi Ty2
cgcccucgccacggu

SEQ ID NO: 1798327 - RNA, 20 nt, Salmonella enterica enterica serovar Typhi Ty2
cgcccgguaaacgcgccauc

SEQ ID NO: 1798328 - RNA, 22 nt, Salmonella enterica enterica serovar Typhi Ty2
cgccgauaaauccuccggcgcg

SEQ ID NO: 1798329 - RNA, 14 nt, Salmonella enterica enterica serovar Typhi Ty2
cgccgauacugccc

SEQ ID NO: 1798330 - RNA, 16 nt, Salmonella enterica enterica serovar Typhi Ty2
cgccgaguagcugagc

SEQ ID NO: 1798331 - RNA, 18 nt, Salmonella enterica enterica serovar Typhi Ty2
cgccgauaaauccuccgg

SEQ ID NO: 1798332 - RNA, 17 nt, Salmonella enterica enterica serovar Typhi Ty2
cgccgacgcauccgcca

SEQ ID NO: 1798333 - RNA, 17 nt, Salmonella enterica enterica serovar Typhi Ty2
cgccgacgaccggcagc

SEQ ID NO: 1798334 - RNA, 22 nt, Salmonella enterica enterica serovar Typhi Ty2
cgccgccaaacugcgcgccgcc

SEQ ID NO: 1798335 - RNA, 18 nt, Salmonella enterica enterica serovar Typhi Ty2
cgccgcaggccaucauac

SEQ ID NO: 1798336 - RNA, 13 nt, Salmonella enterica enterica serovar Typhi Ty2
cgccgccaccaaa

SEQ ID NO: 1798337 - RNA, 22 nt, Salmonella enterica enterica serovar Typhi Ty2
cgccgccaccauguugcgcagc

SEQ ID NO: 1798338 - RNA, 13 nt, Salmonella enterica enterica serovar Typhi Ty2
cgccgccaccaug

SEQ ID NO: 1798339 - RNA, 14 nt, Salmonella enterica enterica serovar Typhi Ty2
cgccgccaucacca

SEQ ID NO: 1798340 - RNA, 14 nt, Salmonella enterica enterica serovar Typhi Ty2
cgccgccaucaacg

SEQ ID NO: 1798341 - RNA, 23 nt, Salmonella enterica enterica serovar Typhi Ty2
cgccgcccaucgggccgcucagc

SEQ ID NO: 1798342 - RNA, 13 nt, Salmonella enterica enterica serovar Typhi Ty2
cgcccagccaaag

SEQ ID NO: 1798343 - RNA, 15 nt, Salmonella enterica enterica serovar Typhi Ty2
cgcccagcaugggca

SEQ ID NO: 1798344 - RNA, 19 nt, Salmonella enterica enterica serovar Typhi Ty2
cgccaugcggaaucacgca

SEQ ID NO: 1798345 - RNA, 16 nt, Salmonella enterica enterica serovar Typhi Ty2
cgccaucuccggcagc

SEQ ID NO: 1798346 - RNA, 18 nt, Salmonella enterica enterica serovar Typhi Ty2
cgccaucucauucgccag

SEQ ID NO: 1798347 - RNA, 14 nt, Salmonella enterica enterica serovar Typhi Ty2
cgccaucucacgca

SEQ ID NO: 1798348 - RNA, 18 nt, Salmonella enterica enterica serovar Typhi Ty2
cgccaucguuccgguucu

SEQ ID NO: 1798349 - RNA, 13 nt, Salmonella enterica enterica serovar Typhi Ty2
cgccaucuuucuu

SEQ ID NO: 1798350 - RNA, 18 nt, Salmonella enterica enterica serovar Typhi Ty2
cgccaucuuccgggucag

SEQ ID NO: 1798351 - RNA, 14 nt, Salmonella enterica enterica serovar Typhi Ty2
cgccaucugugcca

SEQ ID NO: 1798352 - RNA, 15 nt, Salmonella enterica enterica serovar Typhi Ty2
cgccaucuucacgca

SEQ ID NO: 1798353 - RNA, 17 nt, Salmonella enterica enterica serovar Typhi Ty2
cgccaucuccuccucau

SEQ ID NO: 1798354 - RNA, 15 nt, Salmonella enterica enterica serovar Typhi Ty2
cgccaucuccuccuc

SEQ ID NO: 1798355 - RNA, 21 nt, Salmonella enterica enterica serovar Typhi Ty2
cgccaugaccugggcgccaga

SEQ ID NO: 1798356 - RNA, 22 nt, Salmonella enterica enterica serovar Typhi Ty2
cgccaugccaucggccagcagg

SEQ ID NO: 1798357 - RNA, 19 nt, Salmonella enterica enterica serovar Typhi Ty2
cgccacgccgcuccacagc

SEQ ID NO: 1798358 - RNA, 17 nt, Salmonella enterica enterica serovar Typhi Ty2
cgccacgcgccaggucu

SEQ ID NO: 1798359 - RNA, 14 nt, Salmonella enterica enterica serovar Typhi Ty2
cgccaucggcgagc

SEQ ID NO: 1798360 - RNA, 22 nt, Salmonella enterica enterica serovar Typhi Ty2
cgcccauuaauaucagccccac

SEQ ID NO: 1798361 - RNA, 21 nt, Salmonella enterica enterica serovar Typhi Ty2
cgcccauuaauaucagcccca

SEQ ID NO: 1798362 - RNA, 17 nt, Salmonella enterica enterica serovar Typhi Ty2
cgcccaguccuuccggc

SEQ ID NO: 1798363 - RNA, 12 nt, Salmonella enterica enterica serovar Typhi Ty2
cgcccagucacg

SEQ ID NO: 1798364 - RNA, 16 nt, Salmonella enterica enterica serovar Typhi Ty2
cgcccaggucgcccag

SEQ ID NO: 1798365 - RNA, 12 nt, Salmonella enterica enterica serovar Typhi Ty2
cgcccaggccug

SEQ ID NO: 1798366 - RNA, 15 nt, Salmonella enterica enterica serovar Typhi Ty2
cgcccauuccgccug

SEQ ID NO: 1798367 - RNA, 21 nt, Salmonella enterica enterica serovar Typhi Ty2
cgcccauuccgccugccgcgc

SEQ ID NO: 1798368 - RNA, 15 nt, Salmonella enterica enterica serovar Typhi Ty2
cgccccaaucgccag

SEQ ID NO: 1798369 - RNA, 20 nt, Salmonella enterica enterica serovar Typhi Ty2
cgccccagaagagcgagucu

SEQ ID NO: 1798370 - RNA, 14 nt, Salmonella enterica enterica serovar Typhi Ty2
cgcccccugccagc

SEQ ID NO: 1798371 - RNA, 13 nt, Salmonella enterica enterica serovar Typhi Ty2
cgccccgaccagg

SEQ ID NO: 1798372 - RNA, 21 nt, Salmonella enterica enterica serovar Typhi Ty2
cgccccacuuucaccuccgcu

SEQ ID NO: 1798373 - RNA, 19 nt, Salmonella enterica enterica serovar Typhi Ty2
cgcccgauaauaucacucc

SEQ ID NO: 1798374 - RNA, 18 nt, Salmonella enterica enterica serovar Typhi Ty2
cgccccgccgcgcggccc

SEQ ID NO: 1798375 - RNA, 14 nt, Salmonella enterica enterica serovar Typhi Ty2
cgccccgcuucccg

SEQ ID NO: 1798376 - RNA, 15 nt, Salmonella enterica enterica serovar Typhi Ty2
cgcccgccaucgccc

SEQ ID NO: 1798377 - RNA, 15 nt, Salmonella enterica enterica serovar Typhi Ty2
cgcccgcaccgccga

SEQ ID NO: 1798378 - RNA, 14 nt, Salmonella enterica enterica serovar Typhi Ty2
cgcccgccaccagc

SEQ ID NO: 1798379 - RNA, 15 nt, Salmonella enterica enterica serovar Typhi Ty2
cgcgcuuccugccag

SEQ ID NO: 1798380 - RNA, 16 nt, Salmonella enterica enterica serovar Typhi Ty2
cgcgcuguaucacuuu

SEQ ID NO: 1798381 - RNA, 21 nt, Salmonella enterica enterica serovar Typhi Ty2
cgcgcuugcguguuugggcga

SEQ ID NO: 1798382 - RNA, 19 nt, Salmonella enterica enterica serovar Typhi Ty2
cgcggccagaaugcccagc

SEQ ID NO: 1798383 - RNA, 22 nt, Salmonella enterica enterica serovar Typhi Ty2
cgcggccaaaacccaccagcag

SEQ ID NO: 1798384 - RNA, 22 nt, Salmonella enterica enterica serovar Typhi Ty2
cgcggcaaccguauccagaccc

SEQ ID NO: 1798385 - RNA, 15 nt, Salmonella enterica enterica serovar Typhi Ty2
cgcggcaaccagccc

SEQ ID NO: 1798386 - RNA, 22 nt, Salmonella enterica enterica serovar Typhi Ty2
cgcggcaaugagcggccagcgg

SEQ ID NO: 1798387 - RNA, 22 nt, Salmonella enterica enterica serovar Typhi Ty2
cgcggcacacuuucaucagccg

SEQ ID NO: 1798388 - RNA, 13 nt, Salmonella enterica enterica serovar Typhi Ty2
cgcggcaggaaug

SEQ ID NO: 1798389 - RNA, 15 nt, Salmonella enterica enterica serovar Typhi Ty2
cgcgggcuggccggc

SEQ ID NO: 1798390 - RNA, 22 nt, Salmonella enterica enterica serovar Typhi Ty2
cgcgggcgguauuauccgccgc

SEQ ID NO: 1798391 - RNA, 19 nt, Salmonella enterica enterica serovar Typhi Ty2
cgcggccuuugccuucgcc

SEQ ID NO: 1798392 - RNA, 19 nt, Salmonella enterica enterica serovar Typhi Ty2
cgcggcgaaaaagccggcg

SEQ ID NO: 1798393 - RNA, 18 nt, Salmonella enterica enterica serovar Typhi Ty2
cgcggcugguaagagagc

SEQ ID NO: 1798394 - RNA, 15 nt, Salmonella enterica enterica serovar Typhi Ty2
cgcggcgguucaucc

SEQ ID NO: 1798395 - RNA, 16 nt, Salmonella enterica enterica serovar Typhi Ty2
cgcgucguucacgcca

SEQ ID NO: 1798396 - RNA, 19 nt, Salmonella enterica enterica serovar Typhi Ty2
cgcgugaauugcgguuuau

SEQ ID NO: 1798397 - RNA, 16 nt, Salmonella enterica enterica serovar Typhi Ty2
cgcguuuuccauuuua

SEQ ID NO: 1798398 - RNA, 19 nt, Salmonella enterica enterica serovar Typhi Ty2
cgcguucgccgucacgccg

SEQ ID NO: 1798399 - RNA, 18 nt, Salmonella enterica enterica serovar Typhi Ty2
cgcguuaauuuuccccgc

SEQ ID NO: 1798400 - RNA, 17 nt, Salmonella enterica enterica serovar Typhi Ty2
cgcgguuucguggcgcu

SEQ ID NO: 1798401 - RNA, 18 nt, Salmonella enterica enterica serovar Typhi Ty2
cgcguagcccagcgccgc

SEQ ID NO: 1798402 - RNA, 13 nt, Salmonella enterica enterica serovar Typhi Ty2
cgcguaccagcgc

SEQ ID NO: 1798403 - RNA, 15 nt, Salmonella enterica enterica serovar Typhi Ty2
cgcgucccucuccag

SEQ ID NO: 1798404 - RNA, 14 nt, Salmonella enterica enterica serovar Typhi Ty2
cgcgucccucucca

SEQ ID NO: 1798405 - RNA, 17 nt, Salmonella enterica enterica serovar Typhi Ty2
cgcguauaacgccgccc

SEQ ID NO: 1798406 - RNA, 19 nt, Salmonella enterica enterica serovar Typhi Ty2
cgcguauucucaaccagcc

SEQ ID NO: 1798407 - RNA, 23 nt, Salmonella enterica enterica serovar Typhi Ty2
cgcgucacaaaaacacccgcagc

SEQ ID NO: 1798408 - RNA, 17 nt, Salmonella enterica enterica serovar Typhi Ty2
cgcggucauugagccgc

SEQ ID NO: 1798409 - RNA, 18 nt, Salmonella enterica enterica serovar Typhi Ty2
cgcggucagcggcgcgcc

SEQ ID NO: 1798410 - RNA, 19 nt, Salmonella enterica enterica serovar Typhi Ty2
cgcggucagcggcgcgccg

SEQ ID NO: 1798411 - RNA, 21 nt, Salmonella enterica enterica serovar Typhi Ty2
cgcgguauuucgcaacgccgc

SEQ ID NO: 1798412 - RNA, 23 nt, Salmonella enterica enterica serovar Typhi Ty2
cgcgguauuucgcaacgccgccg

SEQ ID NO: 1798413 - RNA, 18 nt, Salmonella enterica enterica serovar Typhi Ty2
cgcgguauuucgccgccg

SEQ ID NO: 1798414 - RNA, 21 nt, Salmonella enterica enterica serovar Typhi Ty2
cgcggucaacguuaacugcug

SEQ ID NO: 1798415 - RNA, 18 nt, Salmonella enterica enterica serovar Typhi Ty2
cgcgguauucauaccuuu

SEQ ID NO: 1798416 - RNA, 16 nt, Salmonella enterica enterica serovar Typhi Ty2
cgcggguucuuuccac

SEQ ID NO: 1798417 - RNA, 17 nt, Salmonella enterica enterica serovar Typhi Ty2
cgcgguaaauuccgcag

SEQ ID NO: 1798418 - RNA, 12 nt, Salmonella enterica enterica serovar Typhi Ty2
cgcggucggcag

SEQ ID NO: 1798419 - RNA, 13 nt, Salmonella enterica enterica serovar Typhi Ty2
cgcgguugacgcu

SEQ ID NO: 1798420 - RNA, 21 nt, Salmonella enterica enterica serovar Typhi Ty2
cgcgguucuguuccgcuaucu

SEQ ID NO: 1798421 - RNA, 17 nt, Salmonella enterica enterica serovar Typhi Ty2
cgcgaucgcgccagccu

SEQ ID NO: 1798422 - RNA, 19 nt, Salmonella enterica enterica serovar Typhi Ty2
cgcgaucgaugugauaaau

SEQ ID NO: 1798423 - RNA, 13 nt, Salmonella enterica enterica serovar Typhi Ty2
cgcgaucgcgcca

SEQ ID NO: 1798424 - RNA, 20 nt, Salmonella enterica enterica serovar Typhi Ty2
cgcgcaaaacucucaccgac

SEQ ID NO: 1798425 - RNA, 15 nt, Salmonella enterica enterica serovar Typhi Ty2
cgcgcaaccgcauca

SEQ ID NO: 1798426 - RNA, 18 nt, Salmonella enterica enterica serovar Typhi Ty2
cgcgcaaccgcaucacgc

SEQ ID NO: 1798427 - RNA, 19 nt, Salmonella enterica enterica serovar Typhi Ty2
cgcgauggugacuauucuu

SEQ ID NO: 1798428 - RNA, 17 nt, Salmonella enterica enterica serovar Typhi Ty2
cgcgcaccuucucuccu

SEQ ID NO: 1798429 - RNA, 16 nt, Salmonella enterica enterica serovar Typhi Ty2
cgcgcagaaucacuuc

SEQ ID NO: 1798430 - RNA, 23 nt, Salmonella enterica enterica serovar Typhi Ty2
cgcgcauggcagggcgauaucca

SEQ ID NO: 1798431 - RNA, 17 nt, Salmonella enterica enterica serovar Typhi Ty2
cgcgccaaugcgaaaau

SEQ ID NO: 1798432 - RNA, 21 nt, Salmonella enterica enterica serovar Typhi Ty2
cgcgccaauccaugccggcuu

SEQ ID NO: 1798433 - RNA, 17 nt, Salmonella enterica enterica serovar Typhi Ty2
cgcgccaaacggcagcu

SEQ ID NO: 1798434 - RNA, 16 nt, Salmonella enterica enterica serovar Typhi Ty2
cgcgccaaacggcagc

SEQ ID NO: 1798435 - RNA, 15 nt, Salmonella enterica enterica serovar Typhi Ty2
cgcgccaaaccguuc

SEQ ID NO: 1798436 - RNA, 22 nt, Salmonella enterica enterica serovar Typhi Ty2
cgcgccaaaguuaaucagcgcc

SEQ ID NO: 1798437 - RNA, 15 nt, Salmonella enterica enterica serovar Typhi Ty2
cgcgcccgccgccaa

SEQ ID NO: 1798438 - RNA, 21 nt, Salmonella enterica enterica serovar Typhi Ty2
cgcgcccgccaucaugcccac

SEQ ID NO: 1798439 - RNA, 20 nt, Salmonella enterica enterica serovar Typhi Ty2
cgcgcccgaucguccgccuc

SEQ ID NO: 1798440 - RNA, 13 nt, Salmonella enterica enterica serovar Typhi Ty2
cgcgccgcgcagc

SEQ ID NO: 1798441 - RNA, 13 nt, Salmonella enterica enterica serovar Typhi Ty2
cgcgcgccgccug

SEQ ID NO: 1798442 - RNA, 22 nt, Salmonella enterica enterica serovar Typhi Ty2
cgcgccuccccugccggcggca

SEQ ID NO: 1798443 - RNA, 17 nt, Salmonella enterica enterica serovar Typhi Ty2
cgcgccuagcgcgcgca

SEQ ID NO: 1798444 - RNA, 16 nt, Salmonella enterica enterica serovar Typhi Ty2
cgcgccuccccugccg

SEQ ID NO: 1798445 - RNA, 15 nt, Salmonella enterica enterica serovar Typhi Ty2
cgccuucuucaucuu

SEQ ID NO: 1798446 - RNA, 16 nt, Salmonella enterica enterica serovar Typhi Ty2
cgccuucuucaucuuc

SEQ ID NO: 1798447 - RNA, 15 nt, Salmonella enterica enterica serovar Typhi Ty2
cgccuucuucaccca

SEQ ID NO: 1798448 - RNA, 15 nt, Salmonella enterica enterica serovar Typhi Ty2
cgccuuauccggccu

SEQ ID NO: 1798449 - RNA, 20 nt, Salmonella enterica enterica serovar Typhi Ty2
cgccuuaagaauguccaucu

SEQ ID NO: 1798450 - RNA, 15 nt, Salmonella enterica enterica serovar Typhi Ty2
cgccuugccgggggc

SEQ ID NO: 1798451 - RNA, 14 nt, Salmonella enterica enterica serovar Typhi Ty2
cgccuugcggcggc

SEQ ID NO: 1798452 - RNA, 15 nt, Salmonella enterica enterica serovar Typhi Ty2
cgccuuucagauggu

SEQ ID NO: 1798453 - RNA, 23 nt, Salmonella enterica enterica serovar Typhi Ty2
cgccuuugcgaauggccuccagc

SEQ ID NO: 1798454 - RNA, 15 nt, Salmonella enterica enterica serovar Typhi Ty2
cgccugcugccagcc

SEQ ID NO: 1798455 - RNA, 22 nt, Salmonella enterica enterica serovar Typhi Ty2
cgccuguaaggcucucuuacca

SEQ ID NO: 1798456 - RNA, 22 nt, Salmonella enterica enterica serovar Typhi Ty2
cgccugugcuuucgccaccagc

SEQ ID NO: 1798457 - RNA, 15 nt, Salmonella enterica enterica serovar Typhi Ty2
cgccugugcuggcga

SEQ ID NO: 1798458 - RNA, 19 nt, Salmonella enterica enterica serovar Typhi Ty2
cgccuguuagggcgcggcu

SEQ ID NO: 1798459 - RNA, 17 nt, Salmonella enterica enterica serovar Typhi Ty2
cgccugucuccagcgcc

SEQ ID NO: 1798460 - RNA, 14 nt, Salmonella enterica enterica serovar Typhi Ty2
cgccuguccggccu

SEQ ID NO: 1798461 - RNA, 13 nt, Salmonella enterica enterica serovar Typhi Ty2
cgccugcgcgccu

SEQ ID NO: 1798462 - RNA, 12 nt, Salmonella enterica enterica serovar Typhi Ty2
cgccugcuccgu

SEQ ID NO: 1798463 - RNA, 18 nt, Salmonella enterica enterica serovar Typhi Ty2
cgcgaauaguggcgcgcc

SEQ ID NO: 1798464 - RNA, 20 nt, Salmonella enterica enterica serovar Typhi Ty2
cgcgaauaccuaacagccgc

SEQ ID NO: 1798465 - RNA, 15 nt, Salmonella enterica enterica serovar Typhi Ty2
cgcgaauagccagac

SEQ ID NO: 1798466 - RNA, 22 nt, Salmonella enterica enterica serovar Typhi Ty2
cgcgaagaucguuauccagcag

SEQ ID NO: 1798467 - RNA, 20 nt, Salmonella enterica enterica serovar Typhi Ty2
cgcgaaaucaaagaccuccg

SEQ ID NO: 1798468 - RNA, 19 nt, Salmonella enterica enterica serovar Typhi Ty2
cgcgaaaaucgguaacauc

SEQ ID NO: 1798469 - RNA, 16 nt, Salmonella enterica enterica serovar Typhi Ty2
cgcgaaaaucgguaac

SEQ ID NO: 1798470 - RNA, 23 nt, Salmonella enterica enterica serovar Typhi Ty2
cgcgaaaauaccccagcgcgccg

SEQ ID NO: 1798471 - RNA, 12 nt, Salmonella enterica enterica serovar Typhi Ty2
cgcgaaaacagc

SEQ ID NO: 1798472 - RNA, 22 nt, Salmonella enterica enterica serovar Typhi Ty2
cgcgaucaguucuugcaggcag

SEQ ID NO: 1798473 - RNA, 14 nt, Salmonella enterica enterica serovar Typhi Ty2
cgcgaucacagaca

SEQ ID NO: 1798474 - RNA, 19 nt, Salmonella enterica enterica serovar Typhi Ty2
cgcgaucacagacagaugc

SEQ ID NO: 1798475 - RNA, 16 nt, Salmonella enterica enterica serovar Typhi Ty2
cgcgauacugccgccc

SEQ ID NO: 1798476 - RNA, 20 nt, Salmonella enterica enterica serovar Typhi Ty2
cgcgauacacuccggcgcgc

SEQ ID NO: 1798477 - RNA, 23 nt, Salmonella enterica enterica serovar Typhi Ty2
cgcgauauccaccaccugauucu

SEQ ID NO: 1798478 - RNA, 15 nt, Salmonella enterica enterica serovar Typhi Ty2
cgcgauauccaccac

SEQ ID NO: 1798479 - RNA, 15 nt, Salmonella enterica enterica serovar Typhi Ty2
cgcgauauccaccug

SEQ ID NO: 1798480 - RNA, 20 nt, Salmonella enterica enterica serovar Typhi Ty2
cgcgauaaaaacccaccagc

SEQ ID NO: 1798481 - RNA, 21 nt, Salmonella enterica enterica serovar Typhi Ty2
cgcgagccuuuuaucaaugca

SEQ ID NO: 1798482 - RNA, 19 nt, Salmonella enterica enterica serovar Typhi Ty2
cgcgacgacgccagccagc

SEQ ID NO: 1798483 - RNA, 22 nt, Salmonella enterica enterica serovar Typhi Ty2
cgcgacuuuaauuaccugccag

SEQ ID NO: 1798484 - RNA, 18 nt, Salmonella enterica enterica serovar Typhi Ty2
cgcgacuuuuuucaccca

SEQ ID NO: 1798485 - RNA, 21 nt, Salmonella enterica enterica serovar Typhi Ty2
cgcgagaagcccggccacagc

SEQ ID NO: 1798486 - RNA, 22 nt, Salmonella enterica enterica serovar Typhi Ty2
cgcgagaagcccggccacagcg

SEQ ID NO: 1798487 - RNA, 17 nt, Salmonella enterica enterica serovar Typhi Ty2
ccgucauccugcaacuc

SEQ ID NO: 1798488 - RNA, 15 nt, Salmonella enterica enterica serovar Typhi Ty2
ccgucaucgcccagg

SEQ ID NO: 1798489 - RNA, 18 nt, Salmonella enterica enterica serovar Typhi Ty2
ccgucauccagcagcaga

SEQ ID NO: 1798490 - RNA, 18 nt, Salmonella enterica enterica serovar Typhi Ty2
ccgucagugagcccuccu

SEQ ID NO: 1798491 - RNA, 20 nt, Salmonella enterica enterica serovar Typhi Ty2
ccgucauauagccgcgcagu

SEQ ID NO: 1798492 - RNA, 20 nt, Salmonella enterica enterica serovar Typhi Ty2
ccgucauaaaaucaaucugc

SEQ ID NO: 1798493 - RNA, 20 nt, Salmonella enterica enterica serovar Typhi Ty2
ccgucauccagcagcagagc

SEQ ID NO: 1798494 - RNA, 23 nt, Salmonella enterica enterica serovar Typhi Ty2
ccgucagggucuuauuucuccug

SEQ ID NO: 1798495 - RNA, 23 nt, Salmonella enterica enterica serovar Typhi Ty2
ccgucaggcuugccgcgccagac

SEQ ID NO: 1798496 - RNA, 23 nt, Salmonella enterica enterica serovar Typhi Ty2
ccgucaguaccagcgagauaacc

SEQ ID NO: 1798497 - RNA, 18 nt, Salmonella enterica enterica serovar Typhi Ty2
ccgucagggcgaggccca

SEQ ID NO: 1798498 - RNA, 15 nt, Salmonella enterica enterica serovar Typhi Ty2
ccgucagcaaccccu

SEQ ID NO: 1798499 - RNA, 14 nt, Salmonella enterica enterica serovar Typhi Ty2
ccgucagcaacccc

SEQ ID NO: 1798500 - RNA, 17 nt, Salmonella enterica enterica serovar Typhi Ty2
ccgucagauucugcggu

SEQ ID NO: 1798501 - RNA, 18 nt, Salmonella enterica enterica serovar Typhi Ty2
ccgucacaggcggccagg

SEQ ID NO: 1798502 - RNA, 15 nt, Salmonella enterica enterica serovar Typhi Ty2
ccguccaccuggccc

SEQ ID NO: 1798503 - RNA, 16 nt, Salmonella enterica enterica serovar Typhi Ty2
ccgucaugcuucaccu

SEQ ID NO: 1798504 - RNA, 15 nt, Salmonella enterica enterica serovar Typhi Ty2
aaaccuguuuguuua

SEQ ID NO: 1798505 - RNA, 13 nt, Salmonella enterica enterica serovar Typhi Ty2
aaaccuuucuucu

SEQ ID NO: 1798506 - RNA, 17 nt, Salmonella enterica enterica serovar Typhi Ty2
aaaccuuccgccaggcg

SEQ ID NO: 1798507 - RNA, 21 nt, Salmonella enterica enterica serovar Typhi Ty2
aaacgaaucaccucgcuuccc

SEQ ID NO: 1798508 - RNA, 18 nt, Salmonella enterica enterica serovar Typhi Ty2
ccgucggcgccagccaca

SEQ ID NO: 1798509 - RNA, 16 nt, Salmonella enterica enterica serovar Typhi Ty2
ccgucggcgucugcgc

SEQ ID NO: 1798510 - RNA, 14 nt, Salmonella enterica enterica serovar Typhi Ty2
ccgucuucagguca

SEQ ID NO: 1798511 - RNA, 18 nt, Salmonella enterica enterica serovar Typhi Ty2
ccgugaauuucugcugcc

SEQ ID NO: 1798512 - RNA, 22 nt, Salmonella enterica enterica serovar Typhi Ty2
ccgugaauaaugaccagcgccc

SEQ ID NO: 1798513 - RNA, 16 nt, Salmonella enterica enterica serovar Typhi Ty2
ccgugacgucccacaa

SEQ ID NO: 1798514 - RNA, 21 nt, Salmonella enterica enterica serovar Typhi Ty2
ccgugaaagcauaccuucaca

SEQ ID NO: 1798515 - RNA, 19 nt, Salmonella enterica enterica serovar Typhi Ty2
ccgucuuuucugucguguc

SEQ ID NO: 1798516 - RNA, 19 nt, Salmonella enterica enterica serovar Typhi Ty2
ccguccccagcccaucggu

SEQ ID NO: 1798517 - RNA, 14 nt, Salmonella enterica enterica serovar Typhi Ty2
ccguacucagaucg

SEQ ID NO: 1798518 - RNA, 21 nt, Salmonella enterica enterica serovar Typhi Ty2
ccguagauaagcgccacgucg

SEQ ID NO: 1798519 - RNA, 19 nt, Salmonella enterica enterica serovar Typhi Ty2
ccguaagcggcggaccagc

SEQ ID NO: 1798520 - RNA, 23 nt, Salmonella enterica enterica serovar Typhi Ty2
ccguacagccuaaaaaaccggcc

SEQ ID NO: 1798521 - RNA, 13 nt, Salmonella enterica enterica serovar Typhi Ty2
ccgguuuuuuaau

SEQ ID NO: 1798522 - RNA, 23 nt, Salmonella enterica enterica serovar Typhi Ty2
ccgguuuuuuuuugccugaaaug

SEQ ID NO: 1798523 - RNA, 20 nt, Salmonella enterica enterica serovar Typhi Ty2
ccgguuugggcgcgaaacug

SEQ ID NO: 1798524 - RNA, 14 nt, Salmonella enterica enterica serovar Typhi Ty2
ccguaaaaugcugg

SEQ ID NO: 1798525 - RNA, 18 nt, Salmonella enterica enterica serovar Typhi Ty2
ccguaaacgccugcacca

SEQ ID NO: 1798526 - RNA, 19 nt, Salmonella enterica enterica serovar Typhi Ty2
ccguagcguacuuucaaau

SEQ ID NO: 1798527 - RNA, 16 nt, Salmonella enterica enterica serovar Typhi Ty2
ccguagcugcgcgccg

SEQ ID NO: 1798528 - RNA, 17 nt, Salmonella enterica enterica serovar Typhi Ty2
ccguauccgccaccaug

SEQ ID NO: 1798529 - RNA, 19 nt, Salmonella enterica enterica serovar Typhi Ty2
ccguaugacguggccagca

SEQ ID NO: 1798530 - RNA, 21 nt, Salmonella enterica enterica serovar Typhi Ty2
ccgucaaaguugguucccagc

SEQ ID NO: 1798531 - RNA, 22 nt, Salmonella enterica enterica serovar Typhi Ty2
ccgucaaaguugguucccagca

SEQ ID NO: 1798532 - RNA, 12 nt, Salmonella enterica enterica serovar Typhi Ty2
ccgucacaaagc

SEQ ID NO: 1798533 - RNA, 13 nt, Salmonella enterica enterica serovar Typhi Ty2
ccgucaauaauau

SEQ ID NO: 1798534 - RNA, 15 nt, Salmonella enterica enterica serovar Typhi Ty2
ccgguccgguggcgc

SEQ ID NO: 1798535 - RNA, 19 nt, Salmonella enterica enterica serovar Typhi Ty2
ccgggguaucuguuuauuc

SEQ ID NO: 1798536 - RNA, 19 nt, Salmonella enterica enterica serovar Typhi Ty2
ccggggugcagaacaucaa

SEQ ID NO: 1798537 - RNA, 14 nt, Salmonella enterica enterica serovar Typhi Ty2
ccggguacaaaaac

SEQ ID NO: 1798538 - RNA, 21 nt, Salmonella enterica enterica serovar Typhi Ty2
ccggguaaugcugcagggccg

SEQ ID NO: 1798539 - RNA, 20 nt, Salmonella enterica enterica serovar Typhi Ty2
ccggucauguuccaacaaug

SEQ ID NO: 1798540 - RNA, 14 nt, Salmonella enterica enterica serovar Typhi Ty2
ccggguaaacgcca

SEQ ID NO: 1798541 - RNA, 20 nt, Salmonella enterica enterica serovar Typhi Ty2
ccgggguucgaauccccgcc

SEQ ID NO: 1798542 - RNA, 15 nt, Salmonella enterica enterica serovar Typhi Ty2
ccggugcgccccagc

SEQ ID NO: 1798543 - RNA, 14 nt, Salmonella enterica enterica serovar Typhi Ty2
ccggugcgccccag

SEQ ID NO: 1798544 - RNA, 17 nt, Salmonella enterica enterica serovar Typhi Ty2
ccgguggcgcugcgcuu

SEQ ID NO: 1798545 - RNA, 15 nt, Salmonella enterica enterica serovar Typhi Ty2
ccgguguagcuggca

SEQ ID NO: 1798546 - RNA, 23 nt, Salmonella enterica enterica serovar Typhi Ty2
ccggugccguuaauuuucacgca

SEQ ID NO: 1798547 - RNA, 19 nt, Salmonella enterica enterica serovar Typhi Ty2
ccggugcgagaaaaagcaa

SEQ ID NO: 1798548 - RNA, 18 nt, Salmonella enterica enterica serovar Typhi Ty2
ccggccauugccgcgccg

SEQ ID NO: 1798549 - RNA, 23 nt, Salmonella enterica enterica serovar Typhi Ty2
ccggauaaggcauuucgccgcca

SEQ ID NO: 1798550 - RNA, 19 nt, Salmonella enterica enterica serovar Typhi Ty2
ccggauaagcggcagcgcc

SEQ ID NO: 1798551 - RNA, 22 nt, Salmonella enterica enterica serovar Typhi Ty2
ccggauaaggcguucacgccgc

SEQ ID NO: 1798552 - RNA, 21 nt, Salmonella enterica enterica serovar Typhi Ty2
ccggauaaggcgcuugcgcca

SEQ ID NO: 1798553 - RNA, 23 nt, Salmonella enterica enterica serovar Typhi Ty2
ccggauaaggcgcuugcgccgcc

SEQ ID NO: 1798554 - RNA, 18 nt, Salmonella enterica enterica serovar Typhi Ty2
ccggauaauccagacaaa

SEQ ID NO: 1798555 - RNA, 21 nt, Salmonella enterica enterica serovar Typhi Ty2
ccggagggcgaacuggcgguc

SEQ ID NO: 1798556 - RNA, 15 nt, Salmonella enterica enterica serovar Typhi Ty2
ccggccugacgcagc

SEQ ID NO: 1798557 - RNA, 20 nt, Salmonella enterica enterica serovar Typhi Ty2
ccggccuacucuugagccgg

SEQ ID NO: 1798558 - RNA, 21 nt, Salmonella enterica enterica serovar Typhi Ty2
ccggcgccaaucaccgccagc

SEQ ID NO: 1798559 - RNA, 18 nt, Salmonella enterica enterica serovar Typhi Ty2
ccggcgccagaagcuggc

SEQ ID NO: 1798560 - RNA, 18 nt, Salmonella enterica enterica serovar Typhi Ty2
ccggcgacagcgaccacg

SEQ ID NO: 1798561 - RNA, 19 nt, Salmonella enterica enterica serovar Typhi Ty2
ccggccugcaaaccgccuc

SEQ ID NO: 1798562 - RNA, 15 nt, Salmonella enterica enterica serovar Typhi Ty2
ccggccuggcgcagc

SEQ ID NO: 1798563 - RNA, 18 nt, Salmonella enterica enterica serovar Typhi Ty2
ccggcgacgcuuucaccu

SEQ ID NO: 1798564 - RNA, 18 nt, Salmonella enterica enterica serovar Typhi Ty2
ccggcgcuaaccagcgcu

SEQ ID NO: 1798565 - RNA, 17 nt, Salmonella enterica enterica serovar Typhi Ty2
ccggcgcuggcgcacgc

SEQ ID NO: 1798566 - RNA, 18 nt, Salmonella enterica enterica serovar Typhi Ty2
ccggcgcuggcgcuggcu

SEQ ID NO: 1798567 - RNA, 20 nt, Salmonella enterica enterica serovar Typhi Ty2
ccggcgcguuuuggcagaca

SEQ ID NO: 1798568 - RNA, 14 nt, Salmonella enterica enterica serovar Typhi Ty2
ccggcgcgggugau

SEQ ID NO: 1798569 - RNA, 15 nt, Salmonella enterica enterica serovar Typhi Ty2
ccggcgcgcguggcu

SEQ ID NO: 1798570 - RNA, 17 nt, Salmonella enterica enterica serovar Typhi Ty2
ccggcgcgccuuccagc

SEQ ID NO: 1798571 - RNA, 13 nt, Salmonella enterica enterica serovar Typhi Ty2
ccggcgcgccagc

SEQ ID NO: 1798572 - RNA, 11 nt, Salmonella enterica enterica serovar Typhi Ty2
ccggcgcgccu

SEQ ID NO: 1798573 - RNA, 19 nt, Salmonella enterica enterica serovar Typhi Ty2
ccggcuucuccaccauauc

SEQ ID NO: 1798574 - RNA, 17 nt, Salmonella enterica enterica serovar Typhi Ty2
ccggcuuuccgcaccgc

SEQ ID NO: 1798575 - RNA, 18 nt, Salmonella enterica enterica serovar Typhi Ty2
ccgggaaaugucuggcgc

SEQ ID NO: 1798576 - RNA, 19 nt, Salmonella enterica enterica serovar Typhi Ty2
ccgggaaaugucuggcgcu

SEQ ID NO: 1798577 - RNA, 21 nt, Salmonella enterica enterica serovar Typhi Ty2
ccgggaaauggcaauggcggc

SEQ ID NO: 1798578 - RNA, 16 nt, Salmonella enterica enterica serovar Typhi Ty2
ccgggaagaaggcucc

SEQ ID NO: 1798579 - RNA, 13 nt, Salmonella enterica enterica serovar Typhi Ty2
ccgggaacuggca

SEQ ID NO: 1798580 - RNA, 23 nt, Salmonella enterica enterica serovar Typhi Ty2
ccgggacuuuaaacgucaugcug

SEQ ID NO: 1798581 - RNA, 23 nt, Salmonella enterica enterica serovar Typhi Ty2
ccgggagaaaacgcggccuggaa

SEQ ID NO: 1798582 - RNA, 22 nt, Salmonella enterica enterica serovar Typhi Ty2
ccgggagaacgccgggccugcc

SEQ ID NO: 1798583 - RNA, 15 nt, Salmonella enterica enterica serovar Typhi Ty2
aaaccguagauuuuc

SEQ ID NO: 1798584 - RNA, 16 nt, Salmonella enterica enterica serovar Typhi Ty2
aaaccgggaaaucccg

SEQ ID NO: 1798585 - RNA, 20 nt, Salmonella enterica enterica serovar Typhi Ty2
aaaccggucagguagcagac

SEQ ID NO: 1798586 - RNA, 11 nt, Salmonella enterica enterica serovar Typhi Ty2
ccggcucgccu

SEQ ID NO: 1798587 - RNA, 18 nt, Salmonella enterica enterica serovar Typhi Ty2
ccggcucgccuugcgguu

SEQ ID NO: 1798588 - RNA, 19 nt, Salmonella enterica enterica serovar Typhi Ty2
ccggcggcaaggucugcgc

SEQ ID NO: 1798589 - RNA, 17 nt, Salmonella enterica enterica serovar Typhi Ty2
aaaccggaauuuguugg

SEQ ID NO: 1798590 - RNA, 19 nt, Salmonella enterica enterica serovar Typhi Ty2
aaaccggcggucaugcugg

SEQ ID NO: 1798591 - RNA, 17 nt, Salmonella enterica enterica serovar Typhi Ty2
aaaccggcggccuacca

SEQ ID NO: 1798592 - RNA, 22 nt, Salmonella enterica enterica serovar Typhi Ty2
aaaccgcucgccgccucccccu

SEQ ID NO: 1798593 - RNA, 18 nt, Salmonella enterica enterica serovar Typhi Ty2
ccgggcggcugucccaga

SEQ ID NO: 1798594 - RNA, 17 nt, Salmonella enterica enterica serovar Typhi Ty2
ccgggcggcgcagcgcg

SEQ ID NO: 1798595 - RNA, 20 nt, Salmonella enterica enterica serovar Typhi Ty2
ccggggcuggcggcgauggc

SEQ ID NO: 1798596 - RNA, 14 nt, Salmonella enterica enterica serovar Typhi Ty2
ccggggcgcgccgc

SEQ ID NO: 1798597 - RNA, 17 nt, Salmonella enterica enterica serovar Typhi Ty2
ccgggccugagcgcgca

SEQ ID NO: 1798598 - RNA, 20 nt, Salmonella enterica enterica serovar Typhi Ty2
ccgggccgacaggcggccgc

SEQ ID NO: 1798599 - RNA, 19 nt, Salmonella enterica enterica serovar Typhi Ty2
aaaccugguauuacaacgu

SEQ ID NO: 1798600 - RNA, 20 nt, Salmonella enterica enterica serovar Typhi Ty2
ccgcugcgcucacgcggcgc

SEQ ID NO: 1798601 - RNA, 15 nt, Salmonella enterica enterica serovar Typhi Ty2
ccgcuggcgcgggga

SEQ ID NO: 1798602 - RNA, 11 nt, Salmonella enterica enterica serovar Typhi Ty2
ccgcugcugug

SEQ ID NO: 1798603 - RNA, 12 nt, Salmonella enterica enterica serovar Typhi Ty2
ccgcuggaauaa

SEQ ID NO: 1798604 - RNA, 18 nt, Salmonella enterica enterica serovar Typhi Ty2
ccgcugauauucaccugu

SEQ ID NO: 1798605 - RNA, 22 nt, Salmonella enterica enterica serovar Typhi Ty2
ccgcugauguuuugcgccgcgc

SEQ ID NO: 1798606 - RNA, 23 nt, Salmonella enterica enterica serovar Typhi Ty2
ccgcugauucguuuuuacacuga

SEQ ID NO: 1798607 - RNA, 22 nt, Salmonella enterica enterica serovar Typhi Ty2
ccgcucgcuuacgcggcgcgcu

SEQ ID NO: 1798608 - RNA, 16 nt, Salmonella enterica enterica serovar Typhi Ty2
ccgcucuucagcgucc

SEQ ID NO: 1798609 - RNA, 19 nt, Salmonella enterica enterica serovar Typhi Ty2
ccgcugacgaccccaggca

SEQ ID NO: 1798610 - RNA, 17 nt, Salmonella enterica enterica serovar Typhi Ty2
ccggaacgggcaugacu

SEQ ID NO: 1798611 - RNA, 15 nt, Salmonella enterica enterica serovar Typhi Ty2
ccggaauuugcuucu

SEQ ID NO: 1798612 - RNA, 21 nt, Salmonella enterica enterica serovar Typhi Ty2
ccggaaucgccugcgucgccc

SEQ ID NO: 1798613 - RNA, 18 nt, Salmonella enterica enterica serovar Typhi Ty2
ccggagagcuugauaaau

SEQ ID NO: 1798614 - RNA, 19 nt, Salmonella enterica enterica serovar Typhi Ty2
ccggagaggcguucaugcc

SEQ ID NO: 1798615 - RNA, 18 nt, Salmonella enterica enterica serovar Typhi Ty2
ccggagauuuaucuucuc

SEQ ID NO: 1798616 - RNA, 14 nt, Salmonella enterica enterica serovar Typhi Ty2
ccggaacagggccg

SEQ ID NO: 1798617 - RNA, 13 nt, Salmonella enterica enterica serovar Typhi Ty2
ccggaaaucugca

SEQ ID NO: 1798618 - RNA, 20 nt, Salmonella enterica enterica serovar Typhi Ty2
ccggaaauaaacgccagugg

SEQ ID NO: 1798619 - RNA, 18 nt, Salmonella enterica enterica serovar Typhi Ty2
ccgcugguugccuuccug

SEQ ID NO: 1798620 - RNA, 19 nt, Salmonella enterica enterica serovar Typhi Ty2
ccgcucgcccgccgcaaaa

SEQ ID NO: 1798621 - RNA, 15 nt, Salmonella enterica enterica serovar Typhi Ty2
ccgcucgcccgccgc

SEQ ID NO: 1798622 - RNA, 22 nt, Salmonella enterica enterica serovar Typhi Ty2
ccgcucacgguuucaacuucca

SEQ ID NO: 1798623 - RNA, 20 nt, Salmonella enterica enterica serovar Typhi Ty2
ccgcuaucugcuccgccagc

SEQ ID NO: 1798624 - RNA, 21 nt, Salmonella enterica enterica serovar Typhi Ty2
ccgcuaucgaccagcaccugc

SEQ ID NO: 1798625 - RNA, 15 nt, Salmonella enterica enterica serovar Typhi Ty2
ccgcuaucauaccua

SEQ ID NO: 1798626 - RNA, 19 nt, Salmonella enterica enterica serovar Typhi Ty2
ccgcuagcugcagcgcucc

SEQ ID NO: 1798627 - RNA, 16 nt, Salmonella enterica enterica serovar Typhi Ty2
ccgcguuguccccuca

SEQ ID NO: 1798628 - RNA, 18 nt, Salmonella enterica enterica serovar Typhi Ty2
ccgcuacaauccaggacg

SEQ ID NO: 1798629 - RNA, 19 nt, Salmonella enterica enterica serovar Typhi Ty2
ccgcgguacgaaucgccgc

SEQ ID NO: 1798630 - RNA, 13 nt, Salmonella enterica enterica serovar Typhi Ty2
ccgcgguccagcc

SEQ ID NO: 1798631 - RNA, 15 nt, Salmonella enterica enterica serovar Typhi Ty2
ccgcggcggacagcg

SEQ ID NO: 1798632 - RNA, 20 nt, Salmonella enterica enterica serovar Typhi Ty2
ccgcggcggacagcggcagc

SEQ ID NO: 1798633 - RNA, 20 nt, Salmonella enterica enterica serovar Typhi Ty2
ccgcgugaacaccacugaaa

SEQ ID NO: 1798634 - RNA, 12 nt, Salmonella enterica enterica serovar Typhi Ty2
ccgcgucagcac

SEQ ID NO: 1798635 - RNA, 20 nt, Salmonella enterica enterica serovar Typhi Ty2
ccgcguccuaccgccgcgau

SEQ ID NO: 1798636 - RNA, 13 nt, Salmonella enterica enterica serovar Typhi Ty2
ccgcguaaugacu

SEQ ID NO: 1798637 - RNA, 22 nt, Salmonella enterica enterica serovar Typhi Ty2
ccgcguaaucuucgcggcugcc

SEQ ID NO: 1798638 - RNA, 16 nt, Salmonella enterica enterica serovar Typhi Ty2
ccgcguaaucuucgcg

SEQ ID NO: 1798639 - RNA, 20 nt, Salmonella enterica enterica serovar Typhi Ty2
ccgcguagcccagcgccgca

SEQ ID NO: 1798640 - RNA, 19 nt, Salmonella enterica enterica serovar Typhi Ty2
ccgcguaucauugcgcucu

SEQ ID NO: 1798641 - RNA, 19 nt, Salmonella enterica enterica serovar Typhi Ty2
ccgcgcuuuaugcagucgg

SEQ ID NO: 1798642 - RNA, 15 nt, Salmonella enterica enterica serovar Typhi Ty2
ccgcgcugaugcagc

SEQ ID NO: 1798643 - RNA, 14 nt, Salmonella enterica enterica serovar Typhi Ty2
ccgcgcucaacaca

SEQ ID NO: 1798644 - RNA, 20 nt, Salmonella enterica enterica serovar Typhi Ty2
ccgcgcuaucgggucugcgc

SEQ ID NO: 1798645 - RNA, 16 nt, Salmonella enterica enterica serovar Typhi Ty2
ccgcgcucgccagcau

SEQ ID NO: 1798646 - RNA, 15 nt, Salmonella enterica enterica serovar Typhi Ty2
ccgcgcuccaucaua

SEQ ID NO: 1798647 - RNA, 14 nt, Salmonella enterica enterica serovar Typhi Ty2
ccgcgcucuccggc

SEQ ID NO: 1798648 - RNA, 17 nt, Salmonella enterica enterica serovar Typhi Ty2
aaaccgauaaucaccag

SEQ ID NO: 1798649 - RNA, 16 nt, Salmonella enterica enterica serovar Typhi Ty2
aaaccgacccaaaaau

SEQ ID NO: 1798650 - RNA, 19 nt, Salmonella enterica enterica serovar Typhi Ty2
aaaccgcagaaggucacgc

SEQ ID NO: 1798651 - RNA, 16 nt, Salmonella enterica enterica serovar Typhi Ty2
ccgcgcggcguucugc

SEQ ID NO: 1798652 - RNA, 14 nt, Salmonella enterica enterica serovar Typhi Ty2
ccgcgcgccgccuc

SEQ ID NO: 1798653 - RNA, 13 nt, Salmonella enterica enterica serovar Typhi Ty2
ccgcgcgccgccu

SEQ ID NO: 1798654 - RNA, 13 nt, Salmonella enterica enterica serovar Typhi Ty2
ccgcgcgaagagg

SEQ ID NO: 1798655 - RNA, 14 nt, Salmonella enterica enterica serovar Typhi Ty2
ccgcgcggcguucu

SEQ ID NO: 1798656 - RNA, 17 nt, Salmonella enterica enterica serovar Typhi Ty2
ccgcgccuaccagcgcu

SEQ ID NO: 1798657 - RNA, 11 nt, Salmonella enterica enterica serovar Typhi Ty2
ccgcgccgccg

SEQ ID NO: 1798658 - RNA, 14 nt, Salmonella enterica enterica serovar Typhi Ty2
ccgcgccgccgccg

SEQ ID NO: 1798659 - RNA, 17 nt, Salmonella enterica enterica serovar Typhi Ty2
ccgccuucagcgcgccc

SEQ ID NO: 1798660 - RNA, 15 nt, Salmonella enterica enterica serovar Typhi Ty2
ccgccuggcgcgacu

SEQ ID NO: 1798661 - RNA, 17 nt, Salmonella enterica enterica serovar Typhi Ty2
ccgcgaaccggaccagc

SEQ ID NO: 1798662 - RNA, 23 nt, Salmonella enterica enterica serovar Typhi Ty2
ccgcgaacaaagccccgggcgcu

SEQ ID NO: 1798663 - RNA, 15 nt, Salmonella enterica enterica serovar Typhi Ty2
ccgccugccgcgccg

SEQ ID NO: 1798664 - RNA, 16 nt, Salmonella enterica enterica serovar Typhi Ty2
ccgccugccgcgccgc

SEQ ID NO: 1798665 - RNA, 14 nt, Salmonella enterica enterica serovar Typhi Ty2
ccgccugccgcgcc

SEQ ID NO: 1798666 - RNA, 15 nt, Salmonella enterica enterica serovar Typhi Ty2
ccgcagcgcggaagc

SEQ ID NO: 1798667 - RNA, 14 nt, Salmonella enterica enterica serovar Typhi Ty2
ccgcagccaacaac

SEQ ID NO: 1798668 - RNA, 15 nt, Salmonella enterica enterica serovar Typhi Ty2
ccgcagccagaauca

SEQ ID NO: 1798669 - RNA, 12 nt, Salmonella enterica enterica serovar Typhi Ty2
ccgcagccagaa

SEQ ID NO: 1798670 - RNA, 21 nt, Salmonella enterica enterica serovar Typhi Ty2
ccgcagccaacaacaggccgc

SEQ ID NO: 1798671 - RNA, 21 nt, Salmonella enterica enterica serovar Typhi Ty2
ccgcagcccgcccacaggcug

SEQ ID NO: 1798672 - RNA, 12 nt, Salmonella enterica enterica serovar Typhi Ty2
ccgcagcccgcc

SEQ ID NO: 1798673 - RNA, 23 nt, Salmonella enterica enterica serovar Typhi Ty2
ccgcgacaaaaagcgcgccgaaa

SEQ ID NO: 1798674 - RNA, 16 nt, Salmonella enterica enterica serovar Typhi Ty2
ccgcgacagucgcaga

SEQ ID NO: 1798675 - RNA, 23 nt, Salmonella enterica enterica serovar Typhi Ty2
ccgcgauagaccacgccaucaac

SEQ ID NO: 1798676 - RNA, 16 nt, Salmonella enterica enterica serovar Typhi Ty2
ccgcgaucgcggcaac

SEQ ID NO: 1798677 - RNA, 23 nt, Salmonella enterica enterica serovar Typhi Ty2
ccgcgauaaagaauagccugggc

SEQ ID NO: 1798678 - RNA, 17 nt, Salmonella enterica enterica serovar Typhi Ty2
ccgcgagaacuuccgcc

SEQ ID NO: 1798679 - RNA, 15 nt, Salmonella enterica enterica serovar Typhi Ty2
ccgcgacuuuggcuu

SEQ ID NO: 1798680 - RNA, 22 nt, Salmonella enterica enterica serovar Typhi Ty2
ccgcgcaaggcguucacaccgc

SEQ ID NO: 1798681 - RNA, 16 nt, Salmonella enterica enterica serovar Typhi Ty2
ccgcgcaaagcaauac

SEQ ID NO: 1798682 - RNA, 22 nt, Salmonella enterica enterica serovar Typhi Ty2
ccgcgcaaagcaauaccacgcc

SEQ ID NO: 1798683 - RNA, 18 nt, Salmonella enterica enterica serovar Typhi Ty2
ccgcgcaauaugcggcgc

SEQ ID NO: 1798684 - RNA, 21 nt, Salmonella enterica enterica serovar Typhi Ty2
ccgcgcagaaucacuucaucc

SEQ ID NO: 1798685 - RNA, 12 nt, Salmonella enterica enterica serovar Typhi Ty2
ccgcgcagcgcc

SEQ ID NO: 1798686 - RNA, 15 nt, Salmonella enterica enterica serovar Typhi Ty2
ccgcgcagugcagcg

SEQ ID NO: 1798687 - RNA, 15 nt, Salmonella enterica enterica serovar Typhi Ty2
ccgcgcauagcuggc

SEQ ID NO: 1798688 - RNA, 22 nt, Salmonella enterica enterica serovar Typhi Ty2
ccgcgccaaacguggcggcaga

SEQ ID NO: 1798689 - RNA, 17 nt, Salmonella enterica enterica serovar Typhi Ty2
ccucguugauguuuuua

SEQ ID NO: 1798690 - RNA, 19 nt, Salmonella enterica enterica serovar Typhi Ty2
ccucguucggcgcaccugu

SEQ ID NO: 1798691 - RNA, 17 nt, Salmonella enterica enterica serovar Typhi Ty2
ccucguaucugucccag

SEQ ID NO: 1798692 - RNA, 16 nt, Salmonella enterica enterica serovar Typhi Ty2
ccucguccagaugggc

SEQ ID NO: 1798693 - RNA, 22 nt, Salmonella enterica enterica serovar Typhi Ty2
ccucuaccggaaaacagccgcc

SEQ ID NO: 1798694 - RNA, 15 nt, Salmonella enterica enterica serovar Typhi Ty2
ccucuaccuacacau

SEQ ID NO: 1798695 - RNA, 23 nt, Salmonella enterica enterica serovar Typhi Ty2
ccucucaccguggugaccgccag

SEQ ID NO: 1798696 - RNA, 13 nt, Salmonella enterica enterica serovar Typhi Ty2
ccucuaucuucuc

SEQ ID NO: 1798697 - RNA, 22 nt, Salmonella enterica enterica serovar Typhi Ty2
ccucucccacugcgaacgcauc

SEQ ID NO: 1798698 - RNA, 14 nt, Salmonella enterica enterica serovar Typhi Ty2
ccucucuucucgcu

SEQ ID NO: 1798699 - RNA, 16 nt, Salmonella enterica enterica serovar Typhi Ty2
ccucugcaccagaacu

SEQ ID NO: 1798700 - RNA, 12 nt, Salmonella enterica enterica serovar Typhi Ty2
ccucugauuuuu

SEQ ID NO: 1798701 - RNA, 15 nt, Salmonella enterica enterica serovar Typhi Ty2
ccucgcuaaugcccg

SEQ ID NO: 1798702 - RNA, 13 nt, Salmonella enterica enterica serovar Typhi Ty2
ccucgcucaccgg

SEQ ID NO: 1798703 - RNA, 21 nt, Salmonella enterica enterica serovar Typhi Ty2
ccucgcucaccggucccggaa

SEQ ID NO: 1798704 - RNA, 23 nt, Salmonella enterica enterica serovar Typhi Ty2
ccucgcucucuuucaccagcgcc

SEQ ID NO: 1798705 - RNA, 17 nt, Salmonella enterica enterica serovar Typhi Ty2
ccucgcguagcgccaac

SEQ ID NO: 1798706 - RNA, 17 nt, Salmonella enterica enterica serovar Typhi Ty2
ccuccucauucagcggc

SEQ ID NO: 1798707 - RNA, 22 nt, Salmonella enterica enterica serovar Typhi Ty2
ccuccguaugaccgccgcgcgu

SEQ ID NO: 1798708 - RNA, 22 nt, Salmonella enterica enterica serovar Typhi Ty2
ccuccgcguagcccagcgccgc

SEQ ID NO: 1798709 - RNA, 23 nt, Salmonella enterica enterica serovar Typhi Ty2
ccuccgcguagcccagcgccgca

SEQ ID NO: 1798710 - RNA, 17 nt, Salmonella enterica enterica serovar Typhi Ty2
ccuccgcguaccucagc

SEQ ID NO: 1798711 - RNA, 21 nt, Salmonella enterica enterica serovar Typhi Ty2
ccuccgcguagcccagcgccg

SEQ ID NO: 1798712 - RNA, 13 nt, Salmonella enterica enterica serovar Typhi Ty2
ccucgcccgcgau

SEQ ID NO: 1798713 - RNA, 18 nt, Salmonella enterica enterica serovar Typhi Ty2
ccucgccaaagcgcugcu

SEQ ID NO: 1798714 - RNA, 17 nt, Salmonella enterica enterica serovar Typhi Ty2
ccucgcauaacuucgaa

SEQ ID NO: 1798715 - RNA, 23 nt, Salmonella enterica enterica serovar Typhi Ty2
ccuccugauaaccuauuuugcaa

SEQ ID NO: 1798716 - RNA, 13 nt, Salmonella enterica enterica serovar Typhi Ty2
ccucauauuugua

SEQ ID NO: 1798717 - RNA, 22 nt, Salmonella enterica enterica serovar Typhi Ty2
aaacgcauaggggcgcaaagca

SEQ ID NO: 1798718 - RNA, 22 nt, Salmonella enterica enterica serovar Typhi Ty2
ccucauacagcccgcgcagaau

SEQ ID NO: 1798719 - RNA, 15 nt, Salmonella enterica enterica serovar Typhi Ty2
aaacgccaagaauga

SEQ ID NO: 1798720 - RNA, 21 nt, Salmonella enterica enterica serovar Typhi Ty2
aaacgcaucugggcugagaaa

SEQ ID NO: 1798721 - RNA, 18 nt, Salmonella enterica enterica serovar Typhi Ty2
aaacgccaggcgcugcgu

SEQ ID NO: 1798722 - RNA, 23 nt, Salmonella enterica enterica serovar Typhi Ty2
aaacgccauugcgaacaucacga

SEQ ID NO: 1798723 - RNA, 22 nt, Salmonella enterica enterica serovar Typhi Ty2
aaacgcccgccgcgaccagcag

SEQ ID NO: 1798724 - RNA, 17 nt, Salmonella enterica enterica serovar Typhi Ty2
aaacgccugaauaaucg

SEQ ID NO: 1798725 - RNA, 23 nt, Salmonella enterica enterica serovar Typhi Ty2
aaacgccugcccgguuaaggggc

SEQ ID NO: 1798726 - RNA, 16 nt, Salmonella enterica enterica serovar Typhi Ty2
ccucauuaguucaagu

SEQ ID NO: 1798727 - RNA, 22 nt, Salmonella enterica enterica serovar Typhi Ty2
ccucauuacuggaucgcuccau

SEQ ID NO: 1798728 - RNA, 20 nt, Salmonella enterica enterica serovar Typhi Ty2
ccucauucagcggcugcgcc

SEQ ID NO: 1798729 - RNA, 20 nt, Salmonella enterica enterica serovar Typhi Ty2
ccuccagccauaaugcaauc

SEQ ID NO: 1798730 - RNA, 17 nt, Salmonella enterica enterica serovar Typhi Ty2
ccuccagcuccgcguau

SEQ ID NO: 1798731 - RNA, 13 nt, Salmonella enterica enterica serovar Typhi Ty2
ccucccaguuccc

SEQ ID NO: 1798732 - RNA, 18 nt, Salmonella enterica enterica serovar Typhi Ty2
ccuccccaggcgcuauuc

SEQ ID NO: 1798733 - RNA, 21 nt, Salmonella enterica enterica serovar Typhi Ty2
ccucauuuuguugcuccagca

SEQ ID NO: 1798734 - RNA, 15 nt, Salmonella enterica enterica serovar Typhi Ty2
ccucccugacuggcu

SEQ ID NO: 1798735 - RNA, 11 nt, Salmonella enterica enterica serovar Typhi Ty2
ccucccuuucu

SEQ ID NO: 1798736 - RNA, 23 nt, Salmonella enterica enterica serovar Typhi Ty2
ccucccggugcgggaggaauaaa

SEQ ID NO: 1798737 - RNA, 14 nt, Salmonella enterica enterica serovar Typhi Ty2
ccgugaguuuuaac

SEQ ID NO: 1798738 - RNA, 14 nt, Salmonella enterica enterica serovar Typhi Ty2
ccgugccgccgcga

SEQ ID NO: 1798739 - RNA, 16 nt, Salmonella enterica enterica serovar Typhi Ty2
ccgugauuuauuuucg

SEQ ID NO: 1798740 - RNA, 13 nt, Salmonella enterica enterica serovar Typhi Ty2
ccuaucgccauau

SEQ ID NO: 1798741 - RNA, 13 nt, Salmonella enterica enterica serovar Typhi Ty2
ccucacugccgac

SEQ ID NO: 1798742 - RNA, 11 nt, Salmonella enterica enterica serovar Typhi Ty2
ccucacuccag

SEQ ID NO: 1798743 - RNA, 17 nt, Salmonella enterica enterica serovar Typhi Ty2
ccucaccucccccgccc

SEQ ID NO: 1798744 - RNA, 16 nt, Salmonella enterica enterica serovar Typhi Ty2
ccucaccguagcucca

SEQ ID NO: 1798745 - RNA, 17 nt, Salmonella enterica enterica serovar Typhi Ty2
ccucaagaauaucuuua

SEQ ID NO: 1798746 - RNA, 23 nt, Salmonella enterica enterica serovar Typhi Ty2
ccucaacgcccugcucccacagc

SEQ ID NO: 1798747 - RNA, 16 nt, Salmonella enterica enterica serovar Typhi Ty2
ccucaacgcccugcuc

SEQ ID NO: 1798748 - RNA, 22 nt, Salmonella enterica enterica serovar Typhi Ty2
ccucaacaaguccuucuucccc

SEQ ID NO: 1798749 - RNA, 14 nt, Salmonella enterica enterica serovar Typhi Ty2
ccugccgccuccag

SEQ ID NO: 1798750 - RNA, 15 nt, Salmonella enterica enterica serovar Typhi Ty2
ccugccgcgccgccg

SEQ ID NO: 1798751 - RNA, 22 nt, Salmonella enterica enterica serovar Typhi Ty2
ccugccggauuuuacauagcag

SEQ ID NO: 1798752 - RNA, 15 nt, Salmonella enterica enterica serovar Typhi Ty2
ccugccggcggcaga

SEQ ID NO: 1798753 - RNA, 18 nt, Salmonella enterica enterica serovar Typhi Ty2
ccugcgauagcugcugac

SEQ ID NO: 1798754 - RNA, 22 nt, Salmonella enterica enterica serovar Typhi Ty2
ccugcgaucugugucguccagg

SEQ ID NO: 1798755 - RNA, 15 nt, Salmonella enterica enterica serovar Typhi Ty2
ccugccggguuuaau

SEQ ID NO: 1798756 - RNA, 22 nt, Salmonella enterica enterica serovar Typhi Ty2
ccugccacaacggcaauuuuua

SEQ ID NO: 1798757 - RNA, 14 nt, Salmonella enterica enterica serovar Typhi Ty2
ccugccaccagcgu

SEQ ID NO: 1798758 - RNA, 16 nt, Salmonella enterica enterica serovar Typhi Ty2
ccugcauauuuuucau

SEQ ID NO: 1798759 - RNA, 15 nt, Salmonella enterica enterica serovar Typhi Ty2
ccugcgccagccgga

SEQ ID NO: 1798760 - RNA, 14 nt, Salmonella enterica enterica serovar Typhi Ty2
ccugcgccagccgg

SEQ ID NO: 1798761 - RNA, 16 nt, Salmonella enterica enterica serovar Typhi Ty2
ccugcgucgccccaau

SEQ ID NO: 1798762 - RNA, 19 nt, Salmonella enterica enterica serovar Typhi Ty2
ccugcgguagcuccagaca

SEQ ID NO: 1798763 - RNA, 16 nt, Salmonella enterica enterica serovar Typhi Ty2
ccugcgguacugcugg

SEQ ID NO: 1798764 - RNA, 14 nt, Salmonella enterica enterica serovar Typhi Ty2
ccugcgucacagac

SEQ ID NO: 1798765 - RNA, 18 nt, Salmonella enterica enterica serovar Typhi Ty2
ccugcgguuucuaccacc

SEQ ID NO: 1798766 - RNA, 22 nt, Salmonella enterica enterica serovar Typhi Ty2
ccugcgguuucuaccacccagc

SEQ ID NO: 1798767 - RNA, 15 nt, Salmonella enterica enterica serovar Typhi Ty2
ccugcggaaccgccc

SEQ ID NO: 1798768 - RNA, 23 nt, Salmonella enterica enterica serovar Typhi Ty2
ccugcgcuuuggguuaaugccag

SEQ ID NO: 1798769 - RNA, 15 nt, Salmonella enterica enterica serovar Typhi Ty2
ccugcgcuuugacau

SEQ ID NO: 1798770 - RNA, 20 nt, Salmonella enterica enterica serovar Typhi Ty2
ccugcgguaaucgccgcgac

SEQ ID NO: 1798771 - RNA, 16 nt, Salmonella enterica enterica serovar Typhi Ty2
ccugcgcuugcggccg

SEQ ID NO: 1798772 - RNA, 17 nt, Salmonella enterica enterica serovar Typhi Ty2
ccugcgcugauuuucuc

SEQ ID NO: 1798773 - RNA, 20 nt, Salmonella enterica enterica serovar Typhi Ty2
ccugcaaagcaaaaaucacc

SEQ ID NO: 1798774 - RNA, 17 nt, Salmonella enterica enterica serovar Typhi Ty2
ccugcaacagcaccagc

SEQ ID NO: 1798775 - RNA, 12 nt, Salmonella enterica enterica serovar Typhi Ty2
ccugcaauuccg

SEQ ID NO: 1798776 - RNA, 15 nt, Salmonella enterica enterica serovar Typhi Ty2
ccugaucaaggcgca

SEQ ID NO: 1798777 - RNA, 18 nt, Salmonella enterica enterica serovar Typhi Ty2
ccugauauacaaaaccca

SEQ ID NO: 1798778 - RNA, 14 nt, Salmonella enterica enterica serovar Typhi Ty2
ccugauauccacgc

SEQ ID NO: 1798779 - RNA, 16 nt, Salmonella enterica enterica serovar Typhi Ty2
ccugauccagcucuuc

SEQ ID NO: 1798780 - RNA, 18 nt, Salmonella enterica enterica serovar Typhi Ty2
ccugauccggcuguucca

SEQ ID NO: 1798781 - RNA, 22 nt, Salmonella enterica enterica serovar Typhi Ty2
ccugauccggaauagagauaga

SEQ ID NO: 1798782 - RNA, 15 nt, Salmonella enterica enterica serovar Typhi Ty2
ccugaucggccagcg

SEQ ID NO: 1798783 - RNA, 21 nt, Salmonella enterica enterica serovar Typhi Ty2
ccugaucgcgcagacaguggc

SEQ ID NO: 1798784 - RNA, 21 nt, Salmonella enterica enterica serovar Typhi Ty2
ccugaucgugccaugaccauu

SEQ ID NO: 1798785 - RNA, 19 nt, Salmonella enterica enterica serovar Typhi Ty2
ccugauuuaacgaguugaa

SEQ ID NO: 1798786 - RNA, 15 nt, Salmonella enterica enterica serovar Typhi Ty2
ccugaugugcuuuuu

SEQ ID NO: 1798787 - RNA, 12 nt, Salmonella enterica enterica serovar Typhi Ty2
ccugauggcgcu

SEQ ID NO: 1798788 - RNA, 17 nt, Salmonella enterica enterica serovar Typhi Ty2
ccugauggcgcugcgcu

SEQ ID NO: 1798789 - RNA, 23 nt, Salmonella enterica enterica serovar Typhi Ty2
ccugaugauagcgccauauaaau

SEQ ID NO: 1798790 - RNA, 19 nt, Salmonella enterica enterica serovar Typhi Ty2
ccugaagcccuuuagugaa

SEQ ID NO: 1798791 - RNA, 18 nt, Salmonella enterica enterica serovar Typhi Ty2
ccugaaggacaagcugcg

SEQ ID NO: 1798792 - RNA, 23 nt, Salmonella enterica enterica serovar Typhi Ty2
ccugaagauagucgauccccaac

SEQ ID NO: 1798793 - RNA, 14 nt, Salmonella enterica enterica serovar Typhi Ty2
ccugaagacaugcu

SEQ ID NO: 1798794 - RNA, 22 nt, Salmonella enterica enterica serovar Typhi Ty2
ccugaauaacccgcagcccugc

SEQ ID NO: 1798795 - RNA, 23 nt, Salmonella enterica enterica serovar Typhi Ty2
ccugaauaacccgcagcccugcg

SEQ ID NO: 1798796 - RNA, 14 nt, Salmonella enterica enterica serovar Typhi Ty2
ccugaaucauauuc

SEQ ID NO: 1798797 - RNA, 15 nt, Salmonella enterica enterica serovar Typhi Ty2
ccugaauauggccag

SEQ ID NO: 1798798 - RNA, 20 nt, Salmonella enterica enterica serovar Typhi Ty2
ccugaauauggccagucccc

SEQ ID NO: 1798799 - RNA, 12 nt, Salmonella enterica enterica serovar Typhi Ty2
ccucuuuuucau

SEQ ID NO: 1798800 - RNA, 15 nt, Salmonella enterica enterica serovar Typhi Ty2
ccucuuuugucgucc

SEQ ID NO: 1798801 - RNA, 13 nt, Salmonella enterica enterica serovar Typhi Ty2
ccugaaaaagggu

SEQ ID NO: 1798802 - RNA, 14 nt, Salmonella enterica enterica serovar Typhi Ty2
ccugaaacgugcau

SEQ ID NO: 1798803 - RNA, 15 nt, Salmonella enterica enterica serovar Typhi Ty2
ccugaaagaagcgcc

SEQ ID NO: 1798804 - RNA, 14 nt, Salmonella enterica enterica serovar Typhi Ty2
ccugaaccagcggc

SEQ ID NO: 1798805 - RNA, 20 nt, Salmonella enterica enterica serovar Typhi Ty2
ccugaaauacccgacucuuu

SEQ ID NO: 1798806 - RNA, 13 nt, Salmonella enterica enterica serovar Typhi Ty2
ccugaaccagcgg

SEQ ID NO: 1798807 - RNA, 21 nt, Salmonella enterica enterica serovar Typhi Ty2
ccucuuccgguagcgccugug

SEQ ID NO: 1798808 - RNA, 19 nt, Salmonella enterica enterica serovar Typhi Ty2
ccucuuccaucagccaggc

SEQ ID NO: 1798809 - RNA, 23 nt, Salmonella enterica enterica serovar Typhi Ty2
ccucuucauagcguuuuuucauc

SEQ ID NO: 1798810 - RNA, 22 nt, Salmonella enterica enterica serovar Typhi Ty2
ccucuggccgcgcuuuuuuaac

SEQ ID NO: 1798811 - RNA, 17 nt, Salmonella enterica enterica serovar Typhi Ty2
ccucuggccaguuucaa

SEQ ID NO: 1798812 - RNA, 21 nt, Salmonella enterica enterica serovar Typhi Ty2
ccucuuuugucguccccugga

SEQ ID NO: 1798813 - RNA, 12 nt, Salmonella enterica enterica serovar Typhi Ty2
ccucuuuccguu

SEQ ID NO: 1798814 - RNA, 13 nt, Salmonella enterica enterica serovar Typhi Ty2
ccucuuuggaggc

SEQ ID NO: 1798815 - RNA, 15 nt, Salmonella enterica enterica serovar Typhi Ty2
ccucuuucugauaac

SEQ ID NO: 1798816 - RNA, 20 nt, Salmonella enterica enterica serovar Typhi Ty2
ccucuuucagaucgccgccg

SEQ ID NO: 1798817 - RNA, 23 nt, Salmonella enterica enterica serovar Typhi Ty2
ccucuuuaucuuuuagcgcgccg

SEQ ID NO: 1798818 - RNA, 13 nt, Salmonella enterica enterica serovar Typhi Ty2
ccucuugugcgac

SEQ ID NO: 1798819 - RNA, 16 nt, Salmonella enterica enterica serovar Typhi Ty2
ccucuugcagcaagaa

SEQ ID NO: 1798820 - RNA, 20 nt, Salmonella enterica enterica serovar Typhi Ty2
ccucuucuuuuaauugccag

SEQ ID NO: 1798821 - RNA, 19 nt, Salmonella enterica enterica serovar Typhi Ty2
ccugacuggcugagcucac

SEQ ID NO: 1798822 - RNA, 17 nt, Salmonella enterica enterica serovar Typhi Ty2
ccugacggcgcugucac

SEQ ID NO: 1798823 - RNA, 15 nt, Salmonella enterica enterica serovar Typhi Ty2
ccugagcgccgccaa

SEQ ID NO: 1798824 - RNA, 15 nt, Salmonella enterica enterica serovar Typhi Ty2
ccugagcccacagcg

SEQ ID NO: 1798825 - RNA, 18 nt, Salmonella enterica enterica serovar Typhi Ty2
ccugaggaaaaagcgcac

SEQ ID NO: 1798826 - RNA, 22 nt, Salmonella enterica enterica serovar Typhi Ty2
ccugauaaaaaaacgccgccuu

SEQ ID NO: 1798827 - RNA, 18 nt, Salmonella enterica enterica serovar Typhi Ty2
ccugauaagcgcagcgcc

SEQ ID NO: 1798828 - RNA, 13 nt, Salmonella enterica enterica serovar Typhi Ty2
ccugaguaucaau

SEQ ID NO: 1798829 - RNA, 19 nt, Salmonella enterica enterica serovar Typhi Ty2
ccugaccgauauagccacu

SEQ ID NO: 1798830 - RNA, 13 nt, Salmonella enterica enterica serovar Typhi Ty2
ccugacggcagcc

SEQ ID NO: 1798831 - RNA, 14 nt, Salmonella enterica enterica serovar Typhi Ty2
ccugacgcugagag

SEQ ID NO: 1798832 - RNA, 21 nt, Salmonella enterica enterica serovar Typhi Ty2
ccugaauuucaauaaucccuu

SEQ ID NO: 1798833 - RNA, 19 nt, Salmonella enterica enterica serovar Typhi Ty2
ccugaaugcucucauauuc

SEQ ID NO: 1798834 - RNA, 14 nt, Salmonella enterica enterica serovar Typhi Ty2
ccugacagaaauag

SEQ ID NO: 1798835 - RNA, 23 nt, Salmonella enterica enterica serovar Typhi Ty2
ccugacauuacccggccaggcgu

SEQ ID NO: 1798836 - RNA, 16 nt, Salmonella enterica enterica serovar Typhi Ty2
ccugacauuuauauua

SEQ ID NO: 1798837 - RNA, 22 nt, Salmonella enterica enterica serovar Typhi Ty2
ccugacagagcucgucaaaaau

SEQ ID NO: 1798838 - RNA, 15 nt, Salmonella enterica enterica serovar Typhi Ty2
cgaacgcuccacugc

SEQ ID NO: 1798839 - RNA, 15 nt, Salmonella enterica enterica serovar Typhi Ty2
cgaacgcuaugcgcc

SEQ ID NO: 1798840 - RNA, 23 nt, Salmonella enterica enterica serovar Typhi Ty2
cgaacggcuuuccagcagccaga

SEQ ID NO: 1798841 - RNA, 14 nt, Salmonella enterica enterica serovar Typhi Ty2
cgaagcgcggcagu

SEQ ID NO: 1798842 - RNA, 15 nt, Salmonella enterica enterica serovar Typhi Ty2
cgaagaucagugaga

SEQ ID NO: 1798843 - RNA, 23 nt, Salmonella enterica enterica serovar Typhi Ty2
cgaaggguagggauagcaucuuc

SEQ ID NO: 1798844 - RNA, 18 nt, Salmonella enterica enterica serovar Typhi Ty2
cgaagguaaacgcgacca

SEQ ID NO: 1798845 - RNA, 18 nt, Salmonella enterica enterica serovar Typhi Ty2
cgaaggucagauccuuuu

SEQ ID NO: 1798846 - RNA, 13 nt, Salmonella enterica enterica serovar Typhi Ty2
cgaacagcgcucc

SEQ ID NO: 1798847 - RNA, 13 nt, Salmonella enterica enterica serovar Typhi Ty2
cgaacagcccgcu

SEQ ID NO: 1798848 - RNA, 20 nt, Salmonella enterica enterica serovar Typhi Ty2
cgaacagguuauuguugcua

SEQ ID NO: 1798849 - RNA, 21 nt, Salmonella enterica enterica serovar Typhi Ty2
cgaacagaaaaaaugcaccgc

SEQ ID NO: 1798850 - RNA, 18 nt, Salmonella enterica enterica serovar Typhi Ty2
cgaaauuggccaucaggu

SEQ ID NO: 1798851 - RNA, 12 nt, Salmonella enterica enterica serovar Typhi Ty2
cgaaauuuaaua

SEQ ID NO: 1798852 - RNA, 22 nt, Salmonella enterica enterica serovar Typhi Ty2
cgaacauccuugcacgccaaaa

SEQ ID NO: 1798853 - RNA, 20 nt, Salmonella enterica enterica serovar Typhi Ty2
cgaacaucugcguugcgcgc

SEQ ID NO: 1798854 - RNA, 15 nt, Salmonella enterica enterica serovar Typhi Ty2
cgaacauucuuaugc

SEQ ID NO: 1798855 - RNA, 12 nt, Salmonella enterica enterica serovar Typhi Ty2
cgaacauuggaa

SEQ ID NO: 1798856 - RNA, 20 nt, Salmonella enterica enterica serovar Typhi Ty2
cgaaccaucauuaauauaau

SEQ ID NO: 1798857 - RNA, 17 nt, Salmonella enterica enterica serovar Typhi Ty2
cgaacccaucagggaaa

SEQ ID NO: 1798858 - RNA, 20 nt, Salmonella enterica enterica serovar Typhi Ty2
cgaacgccgacaucacgcaa

SEQ ID NO: 1798859 - RNA, 21 nt, Salmonella enterica enterica serovar Typhi Ty2
cgaaccggaccagcacaaaaa

SEQ ID NO: 1798860 - RNA, 18 nt, Salmonella enterica enterica serovar Typhi Ty2
cgaaagucaucugccagu

SEQ ID NO: 1798861 - RNA, 23 nt, Salmonella enterica enterica serovar Typhi Ty2
cgaaaucaaagaccuccgcccgg

SEQ ID NO: 1798862 - RNA, 20 nt, Salmonella enterica enterica serovar Typhi Ty2
cgaaaucaaagaccuccgcc

SEQ ID NO: 1798863 - RNA, 13 nt, Salmonella enterica enterica serovar Typhi Ty2
cgaaaggaagcgg

SEQ ID NO: 1798864 - RNA, 13 nt, Salmonella enterica enterica serovar Typhi Ty2
cgaaagcugccuu

SEQ ID NO: 1798865 - RNA, 17 nt, Salmonella enterica enterica serovar Typhi Ty2
cgaaagcgaccuucucc

SEQ ID NO: 1798866 - RNA, 22 nt, Salmonella enterica enterica serovar Typhi Ty2
cgaaaugaccaccgcaucggca

SEQ ID NO: 1798867 - RNA, 20 nt, Salmonella enterica enterica serovar Typhi Ty2
cgaaaccggcggcgacuggc

SEQ ID NO: 1798868 - RNA, 23 nt, Salmonella enterica enterica serovar Typhi Ty2
cgaaacgaaucucaucagacugu

SEQ ID NO: 1798869 - RNA, 13 nt, Salmonella enterica enterica serovar Typhi Ty2
cgaaacucagcgg

SEQ ID NO: 1798870 - RNA, 15 nt, Salmonella enterica enterica serovar Typhi Ty2
cgaaagauaaaaaua

SEQ ID NO: 1798871 - RNA, 12 nt, Salmonella enterica enterica serovar Typhi Ty2
cgaaaaucaucc

SEQ ID NO: 1798872 - RNA, 22 nt, Salmonella enterica enterica serovar Typhi Ty2
cgaaaaccgagcgcaugguaga

SEQ ID NO: 1798873 - RNA, 22 nt, Salmonella enterica enterica serovar Typhi Ty2
cgaaaacggcgcaggcaaauca

SEQ ID NO: 1798874 - RNA, 23 nt, Salmonella enterica enterica serovar Typhi Ty2
cgaaaacggcgcaggcaaaucaa

SEQ ID NO: 1798875 - RNA, 19 nt, Salmonella enterica enterica serovar Typhi Ty2
cgaaaauaaacgcuugacu

SEQ ID NO: 1798876 - RNA, 19 nt, Salmonella enterica enterica serovar Typhi Ty2
ccuuuuugcauucgcuccu

SEQ ID NO: 1798877 - RNA, 17 nt, Salmonella enterica enterica serovar Typhi Ty2
ccuuuuuuauugccuga

SEQ ID NO: 1798878 - RNA, 20 nt, Salmonella enterica enterica serovar Typhi Ty2
ccuuuuuuauacuccagcag

SEQ ID NO: 1798879 - RNA, 13 nt, Salmonella enterica enterica serovar Typhi Ty2
ccuuuuuuguauu

SEQ ID NO: 1798880 - RNA, 14 nt, Salmonella enterica enterica serovar Typhi Ty2
ccuuuuaacgcggu

SEQ ID NO: 1798881 - RNA, 11 nt, Salmonella enterica enterica serovar Typhi Ty2
ccuuugugauc

SEQ ID NO: 1798882 - RNA, 18 nt, Salmonella enterica enterica serovar Typhi Ty2
ccuuugugaucugguuug

SEQ ID NO: 1798883 - RNA, 13 nt, Salmonella enterica enterica serovar Typhi Ty2
ccuuugaccauua

SEQ ID NO: 1798884 - RNA, 14 nt, Salmonella enterica enterica serovar Typhi Ty2
ccuuugacaaccug

SEQ ID NO: 1798885 - RNA, 14 nt, Salmonella enterica enterica serovar Typhi Ty2
ccuuucugcgccag

SEQ ID NO: 1798886 - RNA, 15 nt, Salmonella enterica enterica serovar Typhi Ty2
ccuuucuguucuuug

SEQ ID NO: 1798887 - RNA, 16 nt, Salmonella enterica enterica serovar Typhi Ty2
ccuuucuuauuuuuuu

SEQ ID NO: 1798888 - RNA, 21 nt, Salmonella enterica enterica serovar Typhi Ty2
ccuuucucugguuucccugcc

SEQ ID NO: 1798889 - RNA, 20 nt, Salmonella enterica enterica serovar Typhi Ty2
ccuuacgcucgcugauggcg

SEQ ID NO: 1798890 - RNA, 12 nt, Salmonella enterica enterica serovar Typhi Ty2
ccuuauaaugcu

SEQ ID NO: 1798891 - RNA, 21 nt, Salmonella enterica enterica serovar Typhi Ty2
ccuucauuguccucggcaaca

SEQ ID NO: 1798892 - RNA, 23 nt, Salmonella enterica enterica serovar Typhi Ty2
ccuucauucagaucaaaaaucug

SEQ ID NO: 1798893 - RNA, 14 nt, Salmonella enterica enterica serovar Typhi Ty2
ccuucggugccaua

SEQ ID NO: 1798894 - RNA, 16 nt, Salmonella enterica enterica serovar Typhi Ty2
ccuucuccgguaauca

SEQ ID NO: 1798895 - RNA, 14 nt, Salmonella enterica enterica serovar Typhi Ty2
ccuucuccccuuca

SEQ ID NO: 1798896 - RNA, 14 nt, Salmonella enterica enterica serovar Typhi Ty2
ccuuccgccaccag

SEQ ID NO: 1798897 - RNA, 22 nt, Salmonella enterica enterica serovar Typhi Ty2
ccuuccgcaagcucaccaucuu

SEQ ID NO: 1798898 - RNA, 19 nt, Salmonella enterica enterica serovar Typhi Ty2
ccuucccccagaaugccgc

SEQ ID NO: 1798899 - RNA, 19 nt, Salmonella enterica enterica serovar Typhi Ty2
ccuucccgcgauaaaaaca

SEQ ID NO: 1798900 - RNA, 15 nt, Salmonella enterica enterica serovar Typhi Ty2
ccuuccagaaauaaa

SEQ ID NO: 1798901 - RNA, 21 nt, Salmonella enterica enterica serovar Typhi Ty2
ccuugcgggcaugggaaauaa

SEQ ID NO: 1798902 - RNA, 23 nt, Salmonella enterica enterica serovar Typhi Ty2
ccuugcgggcaugggaaauaacg

SEQ ID NO: 1798903 - RNA, 18 nt, Salmonella enterica enterica serovar Typhi Ty2
ccuugcgggauacaugcc

SEQ ID NO: 1798904 - RNA, 13 nt, Salmonella enterica enterica serovar Typhi Ty2
ccuugcgaagacc

SEQ ID NO: 1798905 - RNA, 19 nt, Salmonella enterica enterica serovar Typhi Ty2
ccuugcccuggaauuuuuc

SEQ ID NO: 1798906 - RNA, 14 nt, Salmonella enterica enterica serovar Typhi Ty2
ccuucugcgcccgc

SEQ ID NO: 1798907 - RNA, 18 nt, Salmonella enterica enterica serovar Typhi Ty2
ccuucugguagccagaca

SEQ ID NO: 1798908 - RNA, 22 nt, Salmonella enterica enterica serovar Typhi Ty2
ccuugaucaggaaaucuuccag

SEQ ID NO: 1798909 - RNA, 20 nt, Salmonella enterica enterica serovar Typhi Ty2
ccuguuccagggcuuccaga

SEQ ID NO: 1798910 - RNA, 15 nt, Salmonella enterica enterica serovar Typhi Ty2
ccuguucaugccaga

SEQ ID NO: 1798911 - RNA, 22 nt, Salmonella enterica enterica serovar Typhi Ty2
ccuguugcgggccagcagccag

SEQ ID NO: 1798912 - RNA, 22 nt, Salmonella enterica enterica serovar Typhi Ty2
ccuguucuggcucggccugucg

SEQ ID NO: 1798913 - RNA, 20 nt, Salmonella enterica enterica serovar Typhi Ty2
ccuguuuuuucagcgcgccg

SEQ ID NO: 1798914 - RNA, 13 nt, Salmonella enterica enterica serovar Typhi Ty2
ccuguuuaucuga

SEQ ID NO: 1798915 - RNA, 15 nt, Salmonella enterica enterica serovar Typhi Ty2
ccuguuucgcccgcu

SEQ ID NO: 1798916 - RNA, 14 nt, Salmonella enterica enterica serovar Typhi Ty2
ccugugcuuugauu

SEQ ID NO: 1798917 - RNA, 19 nt, Salmonella enterica enterica serovar Typhi Ty2
ccugugcuuucgccaccag

SEQ ID NO: 1798918 - RNA, 20 nt, Salmonella enterica enterica serovar Typhi Ty2
ccuguggcuguugguuuauu

SEQ ID NO: 1798919 - RNA, 18 nt, Salmonella enterica enterica serovar Typhi Ty2
ccuguguaaugaaagaaa

SEQ ID NO: 1798920 - RNA, 20 nt, Salmonella enterica enterica serovar Typhi Ty2
ccuguuagggcgcggcuggu

SEQ ID NO: 1798921 - RNA, 23 nt, Salmonella enterica enterica serovar Typhi Ty2
ccuguguuacgccaauaauauug

SEQ ID NO: 1798922 - RNA, 22 nt, Salmonella enterica enterica serovar Typhi Ty2
ccugugucguuucauccugaca

SEQ ID NO: 1798923 - RNA, 13 nt, Salmonella enterica enterica serovar Typhi Ty2
ccugugccauacu

SEQ ID NO: 1798924 - RNA, 14 nt, Salmonella enterica enterica serovar Typhi Ty2
ccugucuccucagc

SEQ ID NO: 1798925 - RNA, 15 nt, Salmonella enterica enterica serovar Typhi Ty2
ccugucgucaccagc

SEQ ID NO: 1798926 - RNA, 18 nt, Salmonella enterica enterica serovar Typhi Ty2
ccugucggucuuuuucgc

SEQ ID NO: 1798927 - RNA, 21 nt, Salmonella enterica enterica serovar Typhi Ty2
ccugucuauuguuuagacaga

SEQ ID NO: 1798928 - RNA, 18 nt, Salmonella enterica enterica serovar Typhi Ty2
ccugcugccagccgccgc

SEQ ID NO: 1798929 - RNA, 23 nt, Salmonella enterica enterica serovar Typhi Ty2
ccugcugcaacauugcaggucug

SEQ ID NO: 1798930 - RNA, 18 nt, Salmonella enterica enterica serovar Typhi Ty2
ccugcugacaaaaacggc

SEQ ID NO: 1798931 - RNA, 12 nt, Salmonella enterica enterica serovar Typhi Ty2
ccuguaaagcuu

SEQ ID NO: 1798932 - RNA, 19 nt, Salmonella enterica enterica serovar Typhi Ty2
ccuguaaaaaauccagcgu

SEQ ID NO: 1798933 - RNA, 13 nt, Salmonella enterica enterica serovar Typhi Ty2
ccuguaaaaaauc

SEQ ID NO: 1798934 - RNA, 19 nt, Salmonella enterica enterica serovar Typhi Ty2
ccuguauacaggcauggcc

SEQ ID NO: 1798935 - RNA, 15 nt, Salmonella enterica enterica serovar Typhi Ty2
ccuguaucaaaccaa

SEQ ID NO: 1798936 - RNA, 16 nt, Salmonella enterica enterica serovar Typhi Ty2
ccuguaacaacuguuu

SEQ ID NO: 1798937 - RNA, 21 nt, Salmonella enterica enterica serovar Typhi Ty2
ccuguaacaacuguuuuucac

SEQ ID NO: 1798938 - RNA, 21 nt, Salmonella enterica enterica serovar Typhi Ty2
ccuguaaccccagcaucugca

SEQ ID NO: 1798939 - RNA, 16 nt, Salmonella enterica enterica serovar Typhi Ty2
ccugucgaucauccac

SEQ ID NO: 1798940 - RNA, 15 nt, Salmonella enterica enterica serovar Typhi Ty2
ccuguaucugcugac

SEQ ID NO: 1798941 - RNA, 20 nt, Salmonella enterica enterica serovar Typhi Ty2
ccgaauuugaaaaaaacauc

SEQ ID NO: 1798942 - RNA, 15 nt, Salmonella enterica enterica serovar Typhi Ty2
aaaccaaacuuaucu

SEQ ID NO: 1798943 - RNA, 16 nt, Salmonella enterica enterica serovar Typhi Ty2
aaaccaaacaccagau

SEQ ID NO: 1798944 - RNA, 14 nt, Salmonella enterica enterica serovar Typhi Ty2
aaaccaaacaccag

SEQ ID NO: 1798945 - RNA, 20 nt, Salmonella enterica enterica serovar Typhi Ty2
aaaccaauacgcauuagcuu

SEQ ID NO: 1798946 - RNA, 20 nt, Salmonella enterica enterica serovar Typhi Ty2
aaaccaaccacggggcaugc

SEQ ID NO: 1798947 - RNA, 18 nt, Salmonella enterica enterica serovar Typhi Ty2
aaaccaaagguauugccu

SEQ ID NO: 1798948 - RNA, 13 nt, Salmonella enterica enterica serovar Typhi Ty2
aaaccacagugac

SEQ ID NO: 1798949 - RNA, 16 nt, Salmonella enterica enterica serovar Typhi Ty2
ccgaacgcguccauga

SEQ ID NO: 1798950 - RNA, 22 nt, Salmonella enterica enterica serovar Typhi Ty2
aaacaucgcugauauuguugaa

SEQ ID NO: 1798951 - RNA, 17 nt, Salmonella enterica enterica serovar Typhi Ty2
aaacagugaaaaaacgg

SEQ ID NO: 1798952 - RNA, 19 nt, Salmonella enterica enterica serovar Typhi Ty2
aaacaguccggcgaaaaaa

SEQ ID NO: 1798953 - RNA, 13 nt, Salmonella enterica enterica serovar Typhi Ty2
cccuuucuuaugc

SEQ ID NO: 1798954 - RNA, 18 nt, Salmonella enterica enterica serovar Typhi Ty2
cccuuccgccacggcuuu

SEQ ID NO: 1798955 - RNA, 21 nt, Salmonella enterica enterica serovar Typhi Ty2
cccuuccagcagccagccguu

SEQ ID NO: 1798956 - RNA, 14 nt, Salmonella enterica enterica serovar Typhi Ty2
cccuucccaggugg

SEQ ID NO: 1798957 - RNA, 23 nt, Salmonella enterica enterica serovar Typhi Ty2
cccuucccccagaaugccgccca

SEQ ID NO: 1798958 - RNA, 16 nt, Salmonella enterica enterica serovar Typhi Ty2
cccuucgcuguccauu

SEQ ID NO: 1798959 - RNA, 23 nt, Salmonella enterica enterica serovar Typhi Ty2
cccuucgcggaauuucaggaagc

SEQ ID NO: 1798960 - RNA, 17 nt, Salmonella enterica enterica serovar Typhi Ty2
cccuucgcccucgccag

SEQ ID NO: 1798961 - RNA, 14 nt, Salmonella enterica enterica serovar Typhi Ty2
cccuucgcccggcg

SEQ ID NO: 1798962 - RNA, 19 nt, Salmonella enterica enterica serovar Typhi Ty2
cccuucaugcagcccgcac

SEQ ID NO: 1798963 - RNA, 14 nt, Salmonella enterica enterica serovar Typhi Ty2
cccuguucaaaaua

SEQ ID NO: 1798964 - RNA, 14 nt, Salmonella enterica enterica serovar Typhi Ty2
cccuguucaaaagc

SEQ ID NO: 1798965 - RNA, 20 nt, Salmonella enterica enterica serovar Typhi Ty2
cccuguggaaacuccagcgg

SEQ ID NO: 1798966 - RNA, 14 nt, Salmonella enterica enterica serovar Typhi Ty2
cccuguccuccaug

SEQ ID NO: 1798967 - RNA, 19 nt, Salmonella enterica enterica serovar Typhi Ty2
cccuuucauucgucaaauu

SEQ ID NO: 1798968 - RNA, 19 nt, Salmonella enterica enterica serovar Typhi Ty2
cccuuucaaaaaagagaag

SEQ ID NO: 1798969 - RNA, 15 nt, Salmonella enterica enterica serovar Typhi Ty2
cccuuuccuuauuaa

SEQ ID NO: 1798970 - RNA, 20 nt, Salmonella enterica enterica serovar Typhi Ty2
cccuuuaggcggcgccgcgc

SEQ ID NO: 1798971 - RNA, 23 nt, Salmonella enterica enterica serovar Typhi Ty2
cccuuguuauccuaaaucugcca

SEQ ID NO: 1798972 - RNA, 20 nt, Salmonella enterica enterica serovar Typhi Ty2
cccuucuuuaugcgccuucu

SEQ ID NO: 1798973 - RNA, 15 nt, Salmonella enterica enterica serovar Typhi Ty2
cccuucuuuuacugc

SEQ ID NO: 1798974 - RNA, 13 nt, Salmonella enterica enterica serovar Typhi Ty2
cccugcgcggccu

SEQ ID NO: 1798975 - RNA, 15 nt, Salmonella enterica enterica serovar Typhi Ty2
cccugcgcggccugc

SEQ ID NO: 1798976 - RNA, 21 nt, Salmonella enterica enterica serovar Typhi Ty2
cccugcgcuucuauccacugg

SEQ ID NO: 1798977 - RNA, 19 nt, Salmonella enterica enterica serovar Typhi Ty2
cccugcggaaccgcccauc

SEQ ID NO: 1798978 - RNA, 21 nt, Salmonella enterica enterica serovar Typhi Ty2
cccugcggauuacgaauaccg

SEQ ID NO: 1798979 - RNA, 21 nt, Salmonella enterica enterica serovar Typhi Ty2
cccugcuggcgaaccaccagc

SEQ ID NO: 1798980 - RNA, 22 nt, Salmonella enterica enterica serovar Typhi Ty2
cccugcuugucgaucaucagac

SEQ ID NO: 1798981 - RNA, 14 nt, Salmonella enterica enterica serovar Typhi Ty2
cccuggcgcgccag

SEQ ID NO: 1798982 - RNA, 21 nt, Salmonella enterica enterica serovar Typhi Ty2
cccuggcucaauccaggugga

SEQ ID NO: 1798983 - RNA, 14 nt, Salmonella enterica enterica serovar Typhi Ty2
cccuggauugugau

SEQ ID NO: 1798984 - RNA, 19 nt, Salmonella enterica enterica serovar Typhi Ty2
cccugcgccucaagcgcuu

SEQ ID NO: 1798985 - RNA, 20 nt, Salmonella enterica enterica serovar Typhi Ty2
cccgucgccuguuucugcgc

SEQ ID NO: 1798986 - RNA, 21 nt, Salmonella enterica enterica serovar Typhi Ty2
cccgucgccuguuucugcgcc

SEQ ID NO: 1798987 - RNA, 18 nt, Salmonella enterica enterica serovar Typhi Ty2
cccgucgcgcccacgcgc

SEQ ID NO: 1798988 - RNA, 16 nt, Salmonella enterica enterica serovar Typhi Ty2
cccgucgccuguuucu

SEQ ID NO: 1798989 - RNA, 14 nt, Salmonella enterica enterica serovar Typhi Ty2
ccgacuaauuauuu

SEQ ID NO: 1798990 - RNA, 16 nt, Salmonella enterica enterica serovar Typhi Ty2
ccgacuaauuauuuuu

SEQ ID NO: 1798991 - RNA, 17 nt, Salmonella enterica enterica serovar Typhi Ty2
ccgacuaauuauuuuuc

SEQ ID NO: 1798992 - RNA, 19 nt, Salmonella enterica enterica serovar Typhi Ty2
ccgacuaccggcaccagca

SEQ ID NO: 1798993 - RNA, 13 nt, Salmonella enterica enterica serovar Typhi Ty2
ccgacguaguuca

SEQ ID NO: 1798994 - RNA, 18 nt, Salmonella enterica enterica serovar Typhi Ty2
ccgacgguuauugcgcug

SEQ ID NO: 1798995 - RNA, 18 nt, Salmonella enterica enterica serovar Typhi Ty2
ccgacggcauaacggccu

SEQ ID NO: 1798996 - RNA, 15 nt, Salmonella enterica enterica serovar Typhi Ty2
ccgacgcucuuccuc

SEQ ID NO: 1798997 - RNA, 15 nt, Salmonella enterica enterica serovar Typhi Ty2
ccgacgcucaaccgg

SEQ ID NO: 1798998 - RNA, 21 nt, Salmonella enterica enterica serovar Typhi Ty2
ccgagcgaaggggcgggcagc

SEQ ID NO: 1798999 - RNA, 13 nt, Salmonella enterica enterica serovar Typhi Ty2
ccgagacugcccg

SEQ ID NO: 1799000 - RNA, 19 nt, Salmonella enterica enterica serovar Typhi Ty2
ccgagucuacaucaagaga

SEQ ID NO: 1799001 - RNA, 15 nt, Salmonella enterica enterica serovar Typhi Ty2
ccgagguucaccagc

SEQ ID NO: 1799002 - RNA, 21 nt, Salmonella enterica enterica serovar Typhi Ty2
ccgagguucaccagcgcgccg

SEQ ID NO: 1799003 - RNA, 17 nt, Salmonella enterica enterica serovar Typhi Ty2
ccgagguuuucauccac

SEQ ID NO: 1799004 - RNA, 18 nt, Salmonella enterica enterica serovar Typhi Ty2
ccgauaaauucugucuca

SEQ ID NO: 1799005 - RNA, 21 nt, Salmonella enterica enterica serovar Typhi Ty2
ccgauaagcaagcgccaucgg

SEQ ID NO: 1799006 - RNA, 22 nt, Salmonella enterica enterica serovar Typhi Ty2
ccgauaaagcgaccgaucauca

SEQ ID NO: 1799007 - RNA, 16 nt, Salmonella enterica enterica serovar Typhi Ty2
ccgagugucgcccgcu

SEQ ID NO: 1799008 - RNA, 16 nt, Salmonella enterica enterica serovar Typhi Ty2
ccgaggcuaagccaga

SEQ ID NO: 1799009 - RNA, 16 nt, Salmonella enterica enterica serovar Typhi Ty2
ccgaugguauuuauuc

SEQ ID NO: 1799010 - RNA, 21 nt, Salmonella enterica enterica serovar Typhi Ty2
ccgcaaacggaauagcgccuu

SEQ ID NO: 1799011 - RNA, 21 nt, Salmonella enterica enterica serovar Typhi Ty2
ccgcaaacuggccacagcaaa

SEQ ID NO: 1799012 - RNA, 20 nt, Salmonella enterica enterica serovar Typhi Ty2
ccgcaaaggaccaacaccag

SEQ ID NO: 1799013 - RNA, 15 nt, Salmonella enterica enterica serovar Typhi Ty2
ccgcaaacgccgaag

SEQ ID NO: 1799014 - RNA, 17 nt, Salmonella enterica enterica serovar Typhi Ty2
ccgcaaccacggcgcag

SEQ ID NO: 1799015 - RNA, 21 nt, Salmonella enterica enterica serovar Typhi Ty2
ccgcaaauucgucgccgccaa

SEQ ID NO: 1799016 - RNA, 20 nt, Salmonella enterica enterica serovar Typhi Ty2
ccgcaaauccacuggucguc

SEQ ID NO: 1799017 - RNA, 22 nt, Salmonella enterica enterica serovar Typhi Ty2
ccgcaccuggguauuccacugg

SEQ ID NO: 1799018 - RNA, 18 nt, Salmonella enterica enterica serovar Typhi Ty2
ccgcacgcgacgcgccag

SEQ ID NO: 1799019 - RNA, 23 nt, Salmonella enterica enterica serovar Typhi Ty2
ccgcacgcgacgcgccagccagc

SEQ ID NO: 1799020 - RNA, 12 nt, Salmonella enterica enterica serovar Typhi Ty2
ccgcacgcgcgc

SEQ ID NO: 1799021 - RNA, 17 nt, Salmonella enterica enterica serovar Typhi Ty2
ccgcaccuggguauucc

SEQ ID NO: 1799022 - RNA, 15 nt, Salmonella enterica enterica serovar Typhi Ty2
ccgcaauacagcccg

SEQ ID NO: 1799023 - RNA, 12 nt, Salmonella enterica enterica serovar Typhi Ty2
ccgaucucccag

SEQ ID NO: 1799024 - RNA, 15 nt, Salmonella enterica enterica serovar Typhi Ty2
ccgaugaacgacgcu

SEQ ID NO: 1799025 - RNA, 23 nt, Salmonella enterica enterica serovar Typhi Ty2
ccgauccgaagaacagauucauu

SEQ ID NO: 1799026 - RNA, 17 nt, Salmonella enterica enterica serovar Typhi Ty2
ccgaucaggccgcagac

SEQ ID NO: 1799027 - RNA, 15 nt, Salmonella enterica enterica serovar Typhi Ty2
ccgauagcggcgcag

SEQ ID NO: 1799028 - RNA, 15 nt, Salmonella enterica enterica serovar Typhi Ty2
ccgauagcgccgcgc

SEQ ID NO: 1799029 - RNA, 16 nt, Salmonella enterica enterica serovar Typhi Ty2
ccgauagcgccgcgcu

SEQ ID NO: 1799030 - RNA, 15 nt, Salmonella enterica enterica serovar Typhi Ty2
ccgauaaucaccagc

SEQ ID NO: 1799031 - RNA, 18 nt, Salmonella enterica enterica serovar Typhi Ty2
ccgauaaucaccagcccg

SEQ ID NO: 1799032 - RNA, 23 nt, Salmonella enterica enterica serovar Typhi Ty2
ccgauagcgaaacugauauuaga

SEQ ID NO: 1799033 - RNA, 15 nt, Salmonella enterica enterica serovar Typhi Ty2
cccggcguagcgcgc

SEQ ID NO: 1799034 - RNA, 18 nt, Salmonella enterica enterica serovar Typhi Ty2
aaacacucuccaccaaau

SEQ ID NO: 1799035 - RNA, 15 nt, Salmonella enterica enterica serovar Typhi Ty2
aaacacucuccacca

SEQ ID NO: 1799036 - RNA, 17 nt, Salmonella enterica enterica serovar Typhi Ty2
aaacacgccuccauaca

SEQ ID NO: 1799037 - RNA, 15 nt, Salmonella enterica enterica serovar Typhi Ty2
aaacacgucuggaaa

SEQ ID NO: 1799038 - RNA, 14 nt, Salmonella enterica enterica serovar Typhi Ty2
aaacacuaaaucau

SEQ ID NO: 1799039 - RNA, 16 nt, Salmonella enterica enterica serovar Typhi Ty2
aaacacgccgcgcugg

SEQ ID NO: 1799040 - RNA, 18 nt, Salmonella enterica enterica serovar Typhi Ty2
cccguaaugcccaggcgg

SEQ ID NO: 1799041 - RNA, 13 nt, Salmonella enterica enterica serovar Typhi Ty2
cccgguuuaccau

SEQ ID NO: 1799042 - RNA, 15 nt, Salmonella enterica enterica serovar Typhi Ty2
cccggcgagugccug

SEQ ID NO: 1799043 - RNA, 21 nt, Salmonella enterica enterica serovar Typhi Ty2
cccggcgccaaucaccgccag

SEQ ID NO: 1799044 - RNA, 12 nt, Salmonella enterica enterica serovar Typhi Ty2
cccggcgcagcg

SEQ ID NO: 1799045 - RNA, 15 nt, Salmonella enterica enterica serovar Typhi Ty2
cccggcgcgacgccg

SEQ ID NO: 1799046 - RNA, 22 nt, Salmonella enterica enterica serovar Typhi Ty2
cccggcagcuuuaaucuaccag

SEQ ID NO: 1799047 - RNA, 12 nt, Salmonella enterica enterica serovar Typhi Ty2
cccggcaggcau

SEQ ID NO: 1799048 - RNA, 15 nt, Salmonella enterica enterica serovar Typhi Ty2
cccggcauacgccgg

SEQ ID NO: 1799049 - RNA, 18 nt, Salmonella enterica enterica serovar Typhi Ty2
cccggcaucaagcugcug

SEQ ID NO: 1799050 - RNA, 12 nt, Salmonella enterica enterica serovar Typhi Ty2
cccggcccgccg

SEQ ID NO: 1799051 - RNA, 14 nt, Salmonella enterica enterica serovar Typhi Ty2
cccggcccgccgcu

SEQ ID NO: 1799052 - RNA, 23 nt, Salmonella enterica enterica serovar Typhi Ty2
cccgcgugcggacguagggcugc

SEQ ID NO: 1799053 - RNA, 17 nt, Salmonella enterica enterica serovar Typhi Ty2
cccgcguuaagccccuc

SEQ ID NO: 1799054 - RNA, 14 nt, Salmonella enterica enterica serovar Typhi Ty2
cccgcguuggcggc

SEQ ID NO: 1799055 - RNA, 14 nt, Salmonella enterica enterica serovar Typhi Ty2
cccgcgcucuccgg

SEQ ID NO: 1799056 - RNA, 15 nt, Salmonella enterica enterica serovar Typhi Ty2
cccgcggcauggucu

SEQ ID NO: 1799057 - RNA, 14 nt, Salmonella enterica enterica serovar Typhi Ty2
cccgcgccagcagg

SEQ ID NO: 1799058 - RNA, 13 nt, Salmonella enterica enterica serovar Typhi Ty2
cccgcgcauccca

SEQ ID NO: 1799059 - RNA, 22 nt, Salmonella enterica enterica serovar Typhi Ty2
cccgcgcagaaucacuucaucc

SEQ ID NO: 1799060 - RNA, 17 nt, Salmonella enterica enterica serovar Typhi Ty2
cccgcgcagaaucacuu

SEQ ID NO: 1799061 - RNA, 15 nt, Salmonella enterica enterica serovar Typhi Ty2
cccgccuugcggcgc

SEQ ID NO: 1799062 - RNA, 20 nt, Salmonella enterica enterica serovar Typhi Ty2
cccggacguaccgcuuuauc

SEQ ID NO: 1799063 - RNA, 16 nt, Salmonella enterica enterica serovar Typhi Ty2
cccggacaaggcgcgc

SEQ ID NO: 1799064 - RNA, 19 nt, Salmonella enterica enterica serovar Typhi Ty2
cccggaucggucuggcgca

SEQ ID NO: 1799065 - RNA, 16 nt, Salmonella enterica enterica serovar Typhi Ty2
cccggagagagcaacu

SEQ ID NO: 1799066 - RNA, 21 nt, Salmonella enterica enterica serovar Typhi Ty2
cccggagagagcaacuggcaa

SEQ ID NO: 1799067 - RNA, 21 nt, Salmonella enterica enterica serovar Typhi Ty2
cccggagagaaacaacaccgu

SEQ ID NO: 1799068 - RNA, 15 nt, Salmonella enterica enterica serovar Typhi Ty2
cccggcaacugcgcc

SEQ ID NO: 1799069 - RNA, 14 nt, Salmonella enterica enterica serovar Typhi Ty2
cccggcaacugcgc

SEQ ID NO: 1799070 - RNA, 16 nt, Salmonella enterica enterica serovar Typhi Ty2
cccgcuaucaccgccc

SEQ ID NO: 1799071 - RNA, 23 nt, Salmonella enterica enterica serovar Typhi Ty2
cccgcuccagaagcacuucucca

SEQ ID NO: 1799072 - RNA, 12 nt, Salmonella enterica enterica serovar Typhi Ty2
cccgcugagugg

SEQ ID NO: 1799073 - RNA, 20 nt, Salmonella enterica enterica serovar Typhi Ty2
cccgcuggcuggcguugagc

SEQ ID NO: 1799074 - RNA, 16 nt, Salmonella enterica enterica serovar Typhi Ty2
cccgcuggcgccaccg

SEQ ID NO: 1799075 - RNA, 21 nt, Salmonella enterica enterica serovar Typhi Ty2
cccggaaauaaacgccagugg

SEQ ID NO: 1799076 - RNA, 22 nt, Salmonella enterica enterica serovar Typhi Ty2
cccggaaauggguaucuucauc

SEQ ID NO: 1799077 - RNA, 19 nt, Salmonella enterica enterica serovar Typhi Ty2
cccggaacaaaagaaagca

SEQ ID NO: 1799078 - RNA, 20 nt, Salmonella enterica enterica serovar Typhi Ty2
cccggaacaaaagaaagcaa

SEQ ID NO: 1799079 - RNA, 12 nt, Salmonella enterica enterica serovar Typhi Ty2
ccccgccccagc

SEQ ID NO: 1799080 - RNA, 24 nt, Salmonella enterica enterica serovar Typhi Ty2
ccccgccauaaugcacaauacgcc

SEQ ID NO: 1799081 - RNA, 11 nt, Salmonella enterica enterica serovar Typhi Ty2
ccccgccgcca

SEQ ID NO: 1799082 - RNA, 13 nt, Salmonella enterica enterica serovar Typhi Ty2
ccccgccgccagu

SEQ ID NO: 1799083 - RNA, 12 nt, Salmonella enterica enterica serovar Typhi Ty2
ccccgccgccau

SEQ ID NO: 1799084 - RNA, 22 nt, Salmonella enterica enterica serovar Typhi Ty2
ccccggcagcuuuaaucuacca

SEQ ID NO: 1799085 - RNA, 20 nt, Salmonella enterica enterica serovar Typhi Ty2
ccccgcuuucagcguugcag

SEQ ID NO: 1799086 - RNA, 13 nt, Salmonella enterica enterica serovar Typhi Ty2
ccccggcuugcgg

SEQ ID NO: 1799087 - RNA, 17 nt, Salmonella enterica enterica serovar Typhi Ty2
ccccggcuuuauuacuu

SEQ ID NO: 1799088 - RNA, 23 nt, Salmonella enterica enterica serovar Typhi Ty2
ccccggcgggguuuuuuuaugcg

SEQ ID NO: 1799089 - RNA, 22 nt, Salmonella enterica enterica serovar Typhi Ty2
ccccgggcgaccacccgcgacc

SEQ ID NO: 1799090 - RNA, 11 nt, Salmonella enterica enterica serovar Typhi Ty2
ccccggccucg

SEQ ID NO: 1799091 - RNA, 15 nt, Salmonella enterica enterica serovar Typhi Ty2
ccccggcgaaagaaa

SEQ ID NO: 1799092 - RNA, 22 nt, Salmonella enterica enterica serovar Typhi Ty2
ccccgacaaaaccguucugagc

SEQ ID NO: 1799093 - RNA, 19 nt, Salmonella enterica enterica serovar Typhi Ty2
ccccgaaagucaucugcca

SEQ ID NO: 1799094 - RNA, 15 nt, Salmonella enterica enterica serovar Typhi Ty2
cccccuuugacaacc

SEQ ID NO: 1799095 - RNA, 18 nt, Salmonella enterica enterica serovar Typhi Ty2
cccccaacgucaccauca

SEQ ID NO: 1799096 - RNA, 14 nt, Salmonella enterica enterica serovar Typhi Ty2
ccccauucugcuga

SEQ ID NO: 1799097 - RNA, 14 nt, Salmonella enterica enterica serovar Typhi Ty2
ccccaugugccuug

SEQ ID NO: 1799098 - RNA, 15 nt, Salmonella enterica enterica serovar Typhi Ty2
ccccaugugccuugc

SEQ ID NO: 1799099 - RNA, 14 nt, Salmonella enterica enterica serovar Typhi Ty2
ccccauuaaacugg

SEQ ID NO: 1799100 - RNA, 19 nt, Salmonella enterica enterica serovar Typhi Ty2
ccccccgcacagcacauag

SEQ ID NO: 1799101 - RNA, 22 nt, Salmonella enterica enterica serovar Typhi Ty2
ccccaacgcgcuaucguugcgc

SEQ ID NO: 1799102 - RNA, 23 nt, Salmonella enterica enterica serovar Typhi Ty2
cccauuguucuuucauuuuaccu

SEQ ID NO: 1799103 - RNA, 15 nt, Salmonella enterica enterica serovar Typhi Ty2
cccauugucaucagu

SEQ ID NO: 1799104 - RNA, 17 nt, Salmonella enterica enterica serovar Typhi Ty2
ccccaauugcugcuauu

SEQ ID NO: 1799105 - RNA, 13 nt, Salmonella enterica enterica serovar Typhi Ty2
cccauucugcuga

SEQ ID NO: 1799106 - RNA, 18 nt, Salmonella enterica enterica serovar Typhi Ty2
cccauugaugccugccca

SEQ ID NO: 1799107 - RNA, 13 nt, Salmonella enterica enterica serovar Typhi Ty2
cccagcauuacug

SEQ ID NO: 1799108 - RNA, 18 nt, Salmonella enterica enterica serovar Typhi Ty2
cccagccagacgccagcc

SEQ ID NO: 1799109 - RNA, 13 nt, Salmonella enterica enterica serovar Typhi Ty2
cccagccacgcgu

SEQ ID NO: 1799110 - RNA, 13 nt, Salmonella enterica enterica serovar Typhi Ty2
ccccagcugcggc

SEQ ID NO: 1799111 - RNA, 17 nt, Salmonella enterica enterica serovar Typhi Ty2
ccccagcguaccacgcc

SEQ ID NO: 1799112 - RNA, 21 nt, Salmonella enterica enterica serovar Typhi Ty2
ccccacgcugacgcgaucgcc

SEQ ID NO: 1799113 - RNA, 12 nt, Salmonella enterica enterica serovar Typhi Ty2
ccccagaaaauu

SEQ ID NO: 1799114 - RNA, 22 nt, Salmonella enterica enterica serovar Typhi Ty2
ccccagacgcccuucaauauca

SEQ ID NO: 1799115 - RNA, 20 nt, Salmonella enterica enterica serovar Typhi Ty2
cccgauguccgucuuuucug

SEQ ID NO: 1799116 - RNA, 20 nt, Salmonella enterica enterica serovar Typhi Ty2
cccgauucgcaugaauucaa

SEQ ID NO: 1799117 - RNA, 14 nt, Salmonella enterica enterica serovar Typhi Ty2
cccgauucugccag

SEQ ID NO: 1799118 - RNA, 13 nt, Salmonella enterica enterica serovar Typhi Ty2
cccgauucugcca

SEQ ID NO: 1799119 - RNA, 23 nt, Salmonella enterica enterica serovar Typhi Ty2
cccgccgcgauguuugcucgcca

SEQ ID NO: 1799120 - RNA, 23 nt, Salmonella enterica enterica serovar Typhi Ty2
cccgccgcggcgguuauccuccg

SEQ ID NO: 1799121 - RNA, 15 nt, Salmonella enterica enterica serovar Typhi Ty2
cccgccgcuggcggg

SEQ ID NO: 1799122 - RNA, 20 nt, Salmonella enterica enterica serovar Typhi Ty2
cccgccucggucaguauuuc

SEQ ID NO: 1799123 - RNA, 22 nt, Salmonella enterica enterica serovar Typhi Ty2
ccccugcgguuucuaccaccca

SEQ ID NO: 1799124 - RNA, 20 nt, Salmonella enterica enterica serovar Typhi Ty2
ccccuguuccagggcuucca

SEQ ID NO: 1799125 - RNA, 22 nt, Salmonella enterica enterica serovar Typhi Ty2
ccccggucaacgcgccgccaac

SEQ ID NO: 1799126 - RNA, 17 nt, Salmonella enterica enterica serovar Typhi Ty2
ccccgguagccacaccc

SEQ ID NO: 1799127 - RNA, 14 nt, Salmonella enterica enterica serovar Typhi Ty2
ccccguucgacaac

SEQ ID NO: 1799128 - RNA, 23 nt, Salmonella enterica enterica serovar Typhi Ty2
ccccucaaacaggcugucugcca

SEQ ID NO: 1799129 - RNA, 18 nt, Salmonella enterica enterica serovar Typhi Ty2
cccgauaaccgcguucau

SEQ ID NO: 1799130 - RNA, 13 nt, Salmonella enterica enterica serovar Typhi Ty2
cccgauacccuga

SEQ ID NO: 1799131 - RNA, 13 nt, Salmonella enterica enterica serovar Typhi Ty2
cccgauagcgccg

SEQ ID NO: 1799132 - RNA, 16 nt, Salmonella enterica enterica serovar Typhi Ty2
cccgaucaucuccugu

SEQ ID NO: 1799133 - RNA, 19 nt, Salmonella enterica enterica serovar Typhi Ty2
cccgacuaccggcaccagc

SEQ ID NO: 1799134 - RNA, 13 nt, Salmonella enterica enterica serovar Typhi Ty2
cccgaaguggugg

SEQ ID NO: 1799135 - RNA, 21 nt, Salmonella enterica enterica serovar Typhi Ty2
ccaugcucauccaacugcgcc

SEQ ID NO: 1799136 - RNA, 22 nt, Salmonella enterica enterica serovar Typhi Ty2
ccaugcuauccgccgccagcca

SEQ ID NO: 1799137 - RNA, 16 nt, Salmonella enterica enterica serovar Typhi Ty2
ccaugcuuucaauaaa

SEQ ID NO: 1799138 - RNA, 18 nt, Salmonella enterica enterica serovar Typhi Ty2
ccauucagcuuauucguc

SEQ ID NO: 1799139 - RNA, 15 nt, Salmonella enterica enterica serovar Typhi Ty2
ccauucaacacauuc

SEQ ID NO: 1799140 - RNA, 14 nt, Salmonella enterica enterica serovar Typhi Ty2
ccauucaaccagcc

SEQ ID NO: 1799141 - RNA, 13 nt, Salmonella enterica enterica serovar Typhi Ty2
ccauucccagccg

SEQ ID NO: 1799142 - RNA, 14 nt, Salmonella enterica enterica serovar Typhi Ty2
ccauucccaccaua

SEQ ID NO: 1799143 - RNA, 22 nt, Salmonella enterica enterica serovar Typhi Ty2
ccauucuuucgcguaaacacuc

SEQ ID NO: 1799144 - RNA, 19 nt, Salmonella enterica enterica serovar Typhi Ty2
ccauucuuucgcguaaaca

SEQ ID NO: 1799145 - RNA, 23 nt, Salmonella enterica enterica serovar Typhi Ty2
ccauuguugucauuguaaaaccg

SEQ ID NO: 1799146 - RNA, 21 nt, Salmonella enterica enterica serovar Typhi Ty2
ccauuggcuauuuuuugcugg

SEQ ID NO: 1799147 - RNA, 16 nt, Salmonella enterica enterica serovar Typhi Ty2
cccaacaucaguucag

SEQ ID NO: 1799148 - RNA, 14 nt, Salmonella enterica enterica serovar Typhi Ty2
cccaacccgaccag

SEQ ID NO: 1799149 - RNA, 18 nt, Salmonella enterica enterica serovar Typhi Ty2
cccacaaucccgccagac

SEQ ID NO: 1799150 - RNA, 15 nt, Salmonella enterica enterica serovar Typhi Ty2
cccaauugcugcuau

SEQ ID NO: 1799151 - RNA, 15 nt, Salmonella enterica enterica serovar Typhi Ty2
cccaaugcccccauc

SEQ ID NO: 1799152 - RNA, 18 nt, Salmonella enterica enterica serovar Typhi Ty2
cccaaauaaaagccgccg

SEQ ID NO: 1799153 - RNA, 19 nt, Salmonella enterica enterica serovar Typhi Ty2
cccaacagcgaccacgcca

SEQ ID NO: 1799154 - RNA, 11 nt, Salmonella enterica enterica serovar Typhi Ty2
ccauuucacaa

SEQ ID NO: 1799155 - RNA, 15 nt, Salmonella enterica enterica serovar Typhi Ty2
ccauuucaugaccga

SEQ ID NO: 1799156 - RNA, 22 nt, Salmonella enterica enterica serovar Typhi Ty2
ccauuuauguuugcccagcuca

SEQ ID NO: 1799157 - RNA, 22 nt, Salmonella enterica enterica serovar Typhi Ty2
ccauuuuuuuguccgucauuua

SEQ ID NO: 1799158 - RNA, 18 nt, Salmonella enterica enterica serovar Typhi Ty2
ccauuuccggcgcgccua

SEQ ID NO: 1799159 - RNA, 18 nt, Salmonella enterica enterica serovar Typhi Ty2
cccacgguacgacgcggc

SEQ ID NO: 1799160 - RNA, 13 nt, Salmonella enterica enterica serovar Typhi Ty2
cccacuaacugcc

SEQ ID NO: 1799161 - RNA, 19 nt, Salmonella enterica enterica serovar Typhi Ty2
cccacggagaaaagcgaaa

SEQ ID NO: 1799162 - RNA, 21 nt, Salmonella enterica enterica serovar Typhi Ty2
cccacggagaaaagcgaaaau

SEQ ID NO: 1799163 - RNA, 21 nt, Salmonella enterica enterica serovar Typhi Ty2
cccacgcggaaucgucacaga

SEQ ID NO: 1799164 - RNA, 15 nt, Salmonella enterica enterica serovar Typhi Ty2
cccacgcgccacguc

SEQ ID NO: 1799165 - RNA, 19 nt, Salmonella enterica enterica serovar Typhi Ty2
cccacggaugaucuucaua

SEQ ID NO: 1799166 - RNA, 21 nt, Salmonella enterica enterica serovar Typhi Ty2
cccacgcaaaauggccugcug

SEQ ID NO: 1799167 - RNA, 22 nt, Salmonella enterica enterica serovar Typhi Ty2
cccacgcaaaauggccugcugg

SEQ ID NO: 1799168 - RNA, 23 nt, Salmonella enterica enterica serovar Typhi Ty2
cccacgccagcagcucgccgacc

SEQ ID NO: 1799169 - RNA, 14 nt, Salmonella enterica enterica serovar Typhi Ty2
cccagacagcaaaa

SEQ ID NO: 1799170 - RNA, 20 nt, Salmonella enterica enterica serovar Typhi Ty2
cccacuuauggucguauuuu

SEQ ID NO: 1799171 - RNA, 15 nt, Salmonella enterica enterica serovar Typhi Ty2
cccacugcacauccc

SEQ ID NO: 1799172 - RNA, 15 nt, Salmonella enterica enterica serovar Typhi Ty2
cccacuauuuuucau

SEQ ID NO: 1799173 - RNA, 20 nt, Salmonella enterica enterica serovar Typhi Ty2
cccacucaaucauugucauu

SEQ ID NO: 1799174 - RNA, 19 nt, Salmonella enterica enterica serovar Typhi Ty2
cccacucauccagcaaaau

SEQ ID NO: 1799175 - RNA, 21 nt, Salmonella enterica enterica serovar Typhi Ty2
cccagacggcgauacugcucc

SEQ ID NO: 1799176 - RNA, 20 nt, Salmonella enterica enterica serovar Typhi Ty2
cccagagucacuagcacuac

SEQ ID NO: 1799177 - RNA, 23 nt, Salmonella enterica enterica serovar Typhi Ty2
cccagauaucaggauugaugguc

SEQ ID NO: 1799178 - RNA, 14 nt, Salmonella enterica enterica serovar Typhi Ty2
cccagcauauuaac

SEQ ID NO: 1799179 - RNA, 21 nt, Salmonella enterica enterica serovar Typhi Ty2
cccagcauauuuuccggcguc

SEQ ID NO: 1799180 - RNA, 15 nt, Salmonella enterica enterica serovar Typhi Ty2
cccaccacgcagcca

SEQ ID NO: 1799181 - RNA, 15 nt, Salmonella enterica enterica serovar Typhi Ty2
cccaccagcgccagg

SEQ ID NO: 1799182 - RNA, 12 nt, Salmonella enterica enterica serovar Typhi Ty2
cccacagguagg

SEQ ID NO: 1799183 - RNA, 21 nt, Salmonella enterica enterica serovar Typhi Ty2
cccacaguaauggacagguaa

SEQ ID NO: 1799184 - RNA, 14 nt, Salmonella enterica enterica serovar Typhi Ty2
cccacacaucacaa

SEQ ID NO: 1799185 - RNA, 21 nt, Salmonella enterica enterica serovar Typhi Ty2
cccacgauacgccccugcugg

SEQ ID NO: 1799186 - RNA, 13 nt, Salmonella enterica enterica serovar Typhi Ty2
cccaccgacacaa

SEQ ID NO: 1799187 - RNA, 15 nt, Salmonella enterica enterica serovar Typhi Ty2
cccaccaucacuucc

SEQ ID NO: 1799188 - RNA, 16 nt, Salmonella enterica enterica serovar Typhi Ty2
cccaccaucacuucca

SEQ ID NO: 1799189 - RNA, 20 nt, Salmonella enterica enterica serovar Typhi Ty2
cccaccauaaagcgaauaau

SEQ ID NO: 1799190 - RNA, 24 nt, Salmonella enterica enterica serovar Typhi Ty2
aaacaagccgccaacgccagcagc

SEQ ID NO: 1799191 - RNA, 23 nt, Salmonella enterica enterica serovar Typhi Ty2
ccaucaucaucggcacagccagu

SEQ ID NO: 1799192 - RNA, 12 nt, Salmonella enterica enterica serovar Typhi Ty2
aaacaauauccc

SEQ ID NO: 1799193 - RNA, 15 nt, Salmonella enterica enterica serovar Typhi Ty2
ccaucauagcccaua

SEQ ID NO: 1799194 - RNA, 22 nt, Salmonella enterica enterica serovar Typhi Ty2
ccaucaugcaagagucccagaa

SEQ ID NO: 1799195 - RNA, 15 nt, Salmonella enterica enterica serovar Typhi Ty2
ccaucauuaauauaa

SEQ ID NO: 1799196 - RNA, 16 nt, Salmonella enterica enterica serovar Typhi Ty2
ccaucauggcuuucag

SEQ ID NO: 1799197 - RNA, 21 nt, Salmonella enterica enterica serovar Typhi Ty2
ccaucauguugaaauauuuga

SEQ ID NO: 1799198 - RNA, 14 nt, Salmonella enterica enterica serovar Typhi Ty2
ccaucccccugccg

SEQ ID NO: 1799199 - RNA, 22 nt, Salmonella enterica enterica serovar Typhi Ty2
ccaucccagguuauucaggugg

SEQ ID NO: 1799200 - RNA, 17 nt, Salmonella enterica enterica serovar Typhi Ty2
ccaucccagguuauuca

SEQ ID NO: 1799201 - RNA, 19 nt, Salmonella enterica enterica serovar Typhi Ty2
ccaucagcccgcaaaggac

SEQ ID NO: 1799202 - RNA, 17 nt, Salmonella enterica enterica serovar Typhi Ty2
ccaucagcgccagcccu

SEQ ID NO: 1799203 - RNA, 23 nt, Salmonella enterica enterica serovar Typhi Ty2
ccaucagccgcgcuaucaaaaug

SEQ ID NO: 1799204 - RNA, 20 nt, Salmonella enterica enterica serovar Typhi Ty2
ccaucagcgccagcccugcg

SEQ ID NO: 1799205 - RNA, 16 nt, Salmonella enterica enterica serovar Typhi Ty2
ccaucaggcacaaugc

SEQ ID NO: 1799206 - RNA, 17 nt, Salmonella enterica enterica serovar Typhi Ty2
ccaucaggcaauucugg

SEQ ID NO: 1799207 - RNA, 16 nt, Salmonella enterica enterica serovar Typhi Ty2
ccaucaggcaauaugu

SEQ ID NO: 1799208 - RNA, 21 nt, Salmonella enterica enterica serovar Typhi Ty2
ccaucagcgcgggauaacgca

SEQ ID NO: 1799209 - RNA, 14 nt, Salmonella enterica enterica serovar Typhi Ty2
ccaucaccucuucg

SEQ ID NO: 1799210 - RNA, 13 nt, Salmonella enterica enterica serovar Typhi Ty2
ccaucagcaccuu

SEQ ID NO: 1799211 - RNA, 13 nt, Salmonella enterica enterica serovar Typhi Ty2
ccaucagcaaaau

SEQ ID NO: 1799212 - RNA, 22 nt, Salmonella enterica enterica serovar Typhi Ty2
ccaucacguuggggaauaaaua

SEQ ID NO: 1799213 - RNA, 12 nt, Salmonella enterica enterica serovar Typhi Ty2
ccaucuuccuca

SEQ ID NO: 1799214 - RNA, 13 nt, Salmonella enterica enterica serovar Typhi Ty2
ccaucuucacgca

SEQ ID NO: 1799215 - RNA, 16 nt, Salmonella enterica enterica serovar Typhi Ty2
ccaucucuuccgcggu

SEQ ID NO: 1799216 - RNA, 12 nt, Salmonella enterica enterica serovar Typhi Ty2
ccaugcaaaaaa

SEQ ID NO: 1799217 - RNA, 15 nt, Salmonella enterica enterica serovar Typhi Ty2
ccaugccuuuauuuc

SEQ ID NO: 1799218 - RNA, 22 nt, Salmonella enterica enterica serovar Typhi Ty2
ccaugccggcuuuccgcaccgc

SEQ ID NO: 1799219 - RNA, 21 nt, Salmonella enterica enterica serovar Typhi Ty2
ccaugaucaccaucuucacau

SEQ ID NO: 1799220 - RNA, 14 nt, Salmonella enterica enterica serovar Typhi Ty2
ccaugaucgucagg

SEQ ID NO: 1799221 - RNA, 22 nt, Salmonella enterica enterica serovar Typhi Ty2
ccaugaugggcaagcguagucc

SEQ ID NO: 1799222 - RNA, 19 nt, Salmonella enterica enterica serovar Typhi Ty2
ccaugauucaucccgcugu

SEQ ID NO: 1799223 - RNA, 14 nt, Salmonella enterica enterica serovar Typhi Ty2
ccaucuccaucauu

SEQ ID NO: 1799224 - RNA, 16 nt, Salmonella enterica enterica serovar Typhi Ty2
ccaucuccggcagcgu

SEQ ID NO: 1799225 - RNA, 19 nt, Salmonella enterica enterica serovar Typhi Ty2
ccaucucauucgccagcgg

SEQ ID NO: 1799226 - RNA, 23 nt, Salmonella enterica enterica serovar Typhi Ty2
ccaucgacgaaauggugugcaug

SEQ ID NO: 1799227 - RNA, 23 nt, Salmonella enterica enterica serovar Typhi Ty2
ccauccgacgccuuuaccacccg

SEQ ID NO: 1799228 - RNA, 23 nt, Salmonella enterica enterica serovar Typhi Ty2
ccaggucggcuuuuuuuuaugcc

SEQ ID NO: 1799229 - RNA, 22 nt, Salmonella enterica enterica serovar Typhi Ty2
ccagugcgcauacuaccgcugc

SEQ ID NO: 1799230 - RNA, 16 nt, Salmonella enterica enterica serovar Typhi Ty2
ccaggucgcccagcca

SEQ ID NO: 1799231 - RNA, 21 nt, Salmonella enterica enterica serovar Typhi Ty2
ccagugugcgguggcaacgcu

SEQ ID NO: 1799232 - RNA, 15 nt, Salmonella enterica enterica serovar Typhi Ty2
ccaguggaugcgcua

SEQ ID NO: 1799233 - RNA, 13 nt, Salmonella enterica enterica serovar Typhi Ty2
ccaguggcaaaau

SEQ ID NO: 1799234 - RNA, 21 nt, Salmonella enterica enterica serovar Typhi Ty2
ccaguuugcguucacagcacc

SEQ ID NO: 1799235 - RNA, 20 nt, Salmonella enterica enterica serovar Typhi Ty2
ccaguuugcguucacagcac

SEQ ID NO: 1799236 - RNA, 19 nt, Salmonella enterica enterica serovar Typhi Ty2
ccaguuugcguucacagca

SEQ ID NO: 1799237 - RNA, 14 nt, Salmonella enterica enterica serovar Typhi Ty2
ccaguuuccugacc

SEQ ID NO: 1799238 - RNA, 19 nt, Salmonella enterica enterica serovar Typhi Ty2
ccaguuuccugacccgcuc

SEQ ID NO: 1799239 - RNA, 13 nt, Salmonella enterica enterica serovar Typhi Ty2
ccauaaaggccuc

SEQ ID NO: 1799240 - RNA, 14 nt, Salmonella enterica enterica serovar Typhi Ty2
ccauaaaucauuac

SEQ ID NO: 1799241 - RNA, 23 nt, Salmonella enterica enterica serovar Typhi Ty2
ccauaaaucauuacuuauauuua

SEQ ID NO: 1799242 - RNA, 12 nt, Salmonella enterica enterica serovar Typhi Ty2
ccauaaaugaaa

SEQ ID NO: 1799243 - RNA, 17 nt, Salmonella enterica enterica serovar Typhi Ty2
ccauaacaacuauuuuu

SEQ ID NO: 1799244 - RNA, 14 nt, Salmonella enterica enterica serovar Typhi Ty2
ccaguucucuucuu

SEQ ID NO: 1799245 - RNA, 22 nt, Salmonella enterica enterica serovar Typhi Ty2
ccaguucggcgauuuccagcgc

SEQ ID NO: 1799246 - RNA, 14 nt, Salmonella enterica enterica serovar Typhi Ty2
ccaguuguuuauuc

SEQ ID NO: 1799247 - RNA, 16 nt, Salmonella enterica enterica serovar Typhi Ty2
ccaguuguucuuucac

SEQ ID NO: 1799248 - RNA, 17 nt, Salmonella enterica enterica serovar Typhi Ty2
ccaguuguuccagcagc

SEQ ID NO: 1799249 - RNA, 13 nt, Salmonella enterica enterica serovar Typhi Ty2
ccauacuuugcau

SEQ ID NO: 1799250 - RNA, 16 nt, Salmonella enterica enterica serovar Typhi Ty2
ccauacuuacugcugu

SEQ ID NO: 1799251 - RNA, 20 nt, Salmonella enterica enterica serovar Typhi Ty2
ccauacuccugccugacaau

SEQ ID NO: 1799252 - RNA, 18 nt, Salmonella enterica enterica serovar Typhi Ty2
ccauauaacagaauaagc

SEQ ID NO: 1799253 - RNA, 20 nt, Salmonella enterica enterica serovar Typhi Ty2
ccauagauaccuucuucacu

SEQ ID NO: 1799254 - RNA, 14 nt, Salmonella enterica enterica serovar Typhi Ty2
ccauagacaguacg

SEQ ID NO: 1799255 - RNA, 22 nt, Salmonella enterica enterica serovar Typhi Ty2
ccauagcagcuccgaaacaauc

SEQ ID NO: 1799256 - RNA, 20 nt, Salmonella enterica enterica serovar Typhi Ty2
ccauaauacuuaauucauaa

SEQ ID NO: 1799257 - RNA, 18 nt, Salmonella enterica enterica serovar Typhi Ty2
ccauaauaaugacuaauu

SEQ ID NO: 1799258 - RNA, 20 nt, Salmonella enterica enterica serovar Typhi Ty2
ccauauauuuacugaauaaa

SEQ ID NO: 1799259 - RNA, 21 nt, Salmonella enterica enterica serovar Typhi Ty2
ccauauauuuacugaauaaau

SEQ ID NO: 1799260 - RNA, 14 nt, Salmonella enterica enterica serovar Typhi Ty2
ccauauauuuacug

SEQ ID NO: 1799261 - RNA, 13 nt, Salmonella enterica enterica serovar Typhi Ty2
ccauauaucugaa

SEQ ID NO: 1799262 - RNA, 13 nt, Salmonella enterica enterica serovar Typhi Ty2
ccauauacucuuu

SEQ ID NO: 1799263 - RNA, 14 nt, Salmonella enterica enterica serovar Typhi Ty2
ccauaucgccgcca

SEQ ID NO: 1799264 - RNA, 14 nt, Salmonella enterica enterica serovar Typhi Ty2
ccaucaaauaauac

SEQ ID NO: 1799265 - RNA, 17 nt, Salmonella enterica enterica serovar Typhi Ty2
ccaucaauuuugcgccu

SEQ ID NO: 1799266 - RNA, 13 nt, Salmonella enterica enterica serovar Typhi Ty2
ccagcgggccgcu

SEQ ID NO: 1799267 - RNA, 15 nt, Salmonella enterica enterica serovar Typhi Ty2
ccagcggccagccau

SEQ ID NO: 1799268 - RNA, 23 nt, Salmonella enterica enterica serovar Typhi Ty2
ccagcggcaaaggcauggcaggu

SEQ ID NO: 1799269 - RNA, 22 nt, Salmonella enterica enterica serovar Typhi Ty2
ccagcggcagaucguuuacgac

SEQ ID NO: 1799270 - RNA, 22 nt, Salmonella enterica enterica serovar Typhi Ty2
ccagcggaugucggucaucagg

SEQ ID NO: 1799271 - RNA, 14 nt, Salmonella enterica enterica serovar Typhi Ty2
ccagcggcccgcgc

SEQ ID NO: 1799272 - RNA, 19 nt, Salmonella enterica enterica serovar Typhi Ty2
ccagcggcgacaguaacug

SEQ ID NO: 1799273 - RNA, 12 nt, Salmonella enterica enterica serovar Typhi Ty2
ccagcggccgcu

SEQ ID NO: 1799274 - RNA, 19 nt, Salmonella enterica enterica serovar Typhi Ty2
ccagcggaauccccgccgc

SEQ ID NO: 1799275 - RNA, 22 nt, Salmonella enterica enterica serovar Typhi Ty2
ccagcggaauauucgcuucuuc

SEQ ID NO: 1799276 - RNA, 17 nt, Salmonella enterica enterica serovar Typhi Ty2
ccagcgcuucuguuaaa

SEQ ID NO: 1799277 - RNA, 22 nt, Salmonella enterica enterica serovar Typhi Ty2
ccagcgcuucuguuaaaaaauu

SEQ ID NO: 1799278 - RNA, 18 nt, Salmonella enterica enterica serovar Typhi Ty2
ccagcgcuauccaggccg

SEQ ID NO: 1799279 - RNA, 19 nt, Salmonella enterica enterica serovar Typhi Ty2
ccagcgcugucagugaaaa

SEQ ID NO: 1799280 - RNA, 16 nt, Salmonella enterica enterica serovar Typhi Ty2
ccagcgcguuuuccau

SEQ ID NO: 1799281 - RNA, 17 nt, Salmonella enterica enterica serovar Typhi Ty2
ccagcgcgccauccuga

SEQ ID NO: 1799282 - RNA, 18 nt, Salmonella enterica enterica serovar Typhi Ty2
ccagcgcguaaauaccuu

SEQ ID NO: 1799283 - RNA, 18 nt, Salmonella enterica enterica serovar Typhi Ty2
ccagcucaggguccccau

SEQ ID NO: 1799284 - RNA, 14 nt, Salmonella enterica enterica serovar Typhi Ty2
ccagcucaccagcc

SEQ ID NO: 1799285 - RNA, 14 nt, Salmonella enterica enterica serovar Typhi Ty2
ccagcucaacgccu

SEQ ID NO: 1799286 - RNA, 16 nt, Salmonella enterica enterica serovar Typhi Ty2
ccagcucaacgccuuu

SEQ ID NO: 1799287 - RNA, 16 nt, Salmonella enterica enterica serovar Typhi Ty2
ccagcuacaccugggc

SEQ ID NO: 1799288 - RNA, 22 nt, Salmonella enterica enterica serovar Typhi Ty2
ccagcucaaaugacgaauaccg

SEQ ID NO: 1799289 - RNA, 15 nt, Salmonella enterica enterica serovar Typhi Ty2
ccagcucaaccgcgc

SEQ ID NO: 1799290 - RNA, 19 nt, Salmonella enterica enterica serovar Typhi Ty2
ccagcuccgcgcuuauuga

SEQ ID NO: 1799291 - RNA, 16 nt, Salmonella enterica enterica serovar Typhi Ty2
ccagcuccauccacca

SEQ ID NO: 1799292 - RNA, 15 nt, Salmonella enterica enterica serovar Typhi Ty2
ccagcuccauagaaa

SEQ ID NO: 1799293 - RNA, 15 nt, Salmonella enterica enterica serovar Typhi Ty2
ccagcucauguaguc

SEQ ID NO: 1799294 - RNA, 20 nt, Salmonella enterica enterica serovar Typhi Ty2
ccagcguagcuaaacccgua

SEQ ID NO: 1799295 - RNA, 18 nt, Salmonella enterica enterica serovar Typhi Ty2
ccagcguauaauuaagcu

SEQ ID NO: 1799296 - RNA, 15 nt, Salmonella enterica enterica serovar Typhi Ty2
ccagcguagcuaaac

SEQ ID NO: 1799297 - RNA, 17 nt, Salmonella enterica enterica serovar Typhi Ty2
ccagcguaccacgccgc

SEQ ID NO: 1799298 - RNA, 23 nt, Salmonella enterica enterica serovar Typhi Ty2
ccagcguaugauagcgagcaaga

SEQ ID NO: 1799299 - RNA, 22 nt, Salmonella enterica enterica serovar Typhi Ty2
ccagcgucgucauagcguugau

SEQ ID NO: 1799300 - RNA, 18 nt, Salmonella enterica enterica serovar Typhi Ty2
ccagcgucucagcaggcg

SEQ ID NO: 1799301 - RNA, 19 nt, Salmonella enterica enterica serovar Typhi Ty2
ccagcgugacccagacaaa

SEQ ID NO: 1799302 - RNA, 19 nt, Salmonella enterica enterica serovar Typhi Ty2
ccagcgacgguaauaccaa

SEQ ID NO: 1799303 - RNA, 15 nt, Salmonella enterica enterica serovar Typhi Ty2
ccagcgaaccuucca

SEQ ID NO: 1799304 - RNA, 20 nt, Salmonella enterica enterica serovar Typhi Ty2
ccagcgaccaccgucccagu

SEQ ID NO: 1799305 - RNA, 23 nt, Salmonella enterica enterica serovar Typhi Ty2
ccagcgacaguaguaucauccau

SEQ ID NO: 1799306 - RNA, 23 nt, Salmonella enterica enterica serovar Typhi Ty2
ccagcgaaaugacggccaccagc

SEQ ID NO: 1799307 - RNA, 18 nt, Salmonella enterica enterica serovar Typhi Ty2
ccagccuuccuggucugc

SEQ ID NO: 1799308 - RNA, 20 nt, Salmonella enterica enterica serovar Typhi Ty2
ccagccguugugcugguuga

SEQ ID NO: 1799309 - RNA, 18 nt, Salmonella enterica enterica serovar Typhi Ty2
ccagccguucaccagcca

SEQ ID NO: 1799310 - RNA, 16 nt, Salmonella enterica enterica serovar Typhi Ty2
ccagccuaccugccgc

SEQ ID NO: 1799311 - RNA, 13 nt, Salmonella enterica enterica serovar Typhi Ty2
ccagccucuccca

SEQ ID NO: 1799312 - RNA, 15 nt, Salmonella enterica enterica serovar Typhi Ty2
ccagccugccugccu

SEQ ID NO: 1799313 - RNA, 22 nt, Salmonella enterica enterica serovar Typhi Ty2
ccagccugcuggucugaaucug

SEQ ID NO: 1799314 - RNA, 16 nt, Salmonella enterica enterica serovar Typhi Ty2
ccacuccggugcccau

SEQ ID NO: 1799315 - RNA, 18 nt, Salmonella enterica enterica serovar Typhi Ty2
ccacuccgccaguacaua

SEQ ID NO: 1799316 - RNA, 22 nt, Salmonella enterica enterica serovar Typhi Ty2
ccacucggcgagcaguacgccu

SEQ ID NO: 1799317 - RNA, 17 nt, Salmonella enterica enterica serovar Typhi Ty2
ccacucuuuuaaggccc

SEQ ID NO: 1799318 - RNA, 22 nt, Salmonella enterica enterica serovar Typhi Ty2
ccacugauaguccaucaccucu

SEQ ID NO: 1799319 - RNA, 14 nt, Salmonella enterica enterica serovar Typhi Ty2
ccacucuuccagca

SEQ ID NO: 1799320 - RNA, 14 nt, Salmonella enterica enterica serovar Typhi Ty2
ccacugcacauccc

SEQ ID NO: 1799321 - RNA, 13 nt, Salmonella enterica enterica serovar Typhi Ty2
ccagcgccgccag

SEQ ID NO: 1799322 - RNA, 14 nt, Salmonella enterica enterica serovar Typhi Ty2
ccagcgccgccaga

SEQ ID NO: 1799323 - RNA, 12 nt, Salmonella enterica enterica serovar Typhi Ty2
ccagcgccgccu

SEQ ID NO: 1799324 - RNA, 21 nt, Salmonella enterica enterica serovar Typhi Ty2
ccagcgccgagaaaaucagug

SEQ ID NO: 1799325 - RNA, 14 nt, Salmonella enterica enterica serovar Typhi Ty2
ccagcgccgagaaa

SEQ ID NO: 1799326 - RNA, 14 nt, Salmonella enterica enterica serovar Typhi Ty2
ccagcgccaggcca

SEQ ID NO: 1799327 - RNA, 15 nt, Salmonella enterica enterica serovar Typhi Ty2
ccagcgcccccagca

SEQ ID NO: 1799328 - RNA, 19 nt, Salmonella enterica enterica serovar Typhi Ty2
ccagcgccauaauccagaa

SEQ ID NO: 1799329 - RNA, 20 nt, Salmonella enterica enterica serovar Typhi Ty2
ccagcgcgaccugcaucccu

SEQ ID NO: 1799330 - RNA, 21 nt, Salmonella enterica enterica serovar Typhi Ty2
ccagcgcgaauuugccccaga

SEQ ID NO: 1799331 - RNA, 20 nt, Salmonella enterica enterica serovar Typhi Ty2
ccagcgccugcgcugcaaua

SEQ ID NO: 1799332 - RNA, 14 nt, Salmonella enterica enterica serovar Typhi Ty2
ccagcgccugcgcu

SEQ ID NO: 1799333 - RNA, 22 nt, Salmonella enterica enterica serovar Typhi Ty2
ccagcgccggauaauccagaca

SEQ ID NO: 1799334 - RNA, 19 nt, Salmonella enterica enterica serovar Typhi Ty2
ccagcgccgggauauccuc

SEQ ID NO: 1799335 - RNA, 20 nt, Salmonella enterica enterica serovar Typhi Ty2
ccagcgccgucauaccgccc

SEQ ID NO: 1799336 - RNA, 20 nt, Salmonella enterica enterica serovar Typhi Ty2
ccagcgacgguaauaccaac

SEQ ID NO: 1799337 - RNA, 20 nt, Salmonella enterica enterica serovar Typhi Ty2
ccagcgacuccggauagaga

SEQ ID NO: 1799338 - RNA, 18 nt, Salmonella enterica enterica serovar Typhi Ty2
ccagcgaucccaguugau

SEQ ID NO: 1799339 - RNA, 16 nt, Salmonella enterica enterica serovar Typhi Ty2
ccagcgaugagcgcca

SEQ ID NO: 1799340 - RNA, 16 nt, Salmonella enterica enterica serovar Typhi Ty2
ccagcgauuauuucau

SEQ ID NO: 1799341 - RNA, 21 nt, Salmonella enterica enterica serovar Typhi Ty2
ccagcgauggggcaagcucag

SEQ ID NO: 1799342 - RNA, 21 nt, Salmonella enterica enterica serovar Typhi Ty2
ccagcgcauguuucgcuucaa

SEQ ID NO: 1799343 - RNA, 18 nt, Salmonella enterica enterica serovar Typhi Ty2
ccagcgccaccaaagcca

SEQ ID NO: 1799344 - RNA, 15 nt, Salmonella enterica enterica serovar Typhi Ty2
ccagcgcagucaaaa

SEQ ID NO: 1799345 - RNA, 21 nt, Salmonella enterica enterica serovar Typhi Ty2
ccaggcuuuaguuuccgguaa

SEQ ID NO: 1799346 - RNA, 21 nt, Salmonella enterica enterica serovar Typhi Ty2
ccaggcuuuaaauucagcacc

SEQ ID NO: 1799347 - RNA, 20 nt, Salmonella enterica enterica serovar Typhi Ty2
ccagggauugauggccagcc

SEQ ID NO: 1799348 - RNA, 14 nt, Salmonella enterica enterica serovar Typhi Ty2
ccagggagggccaa

SEQ ID NO: 1799349 - RNA, 15 nt, Salmonella enterica enterica serovar Typhi Ty2
ccaggcuucgcgcag

SEQ ID NO: 1799350 - RNA, 16 nt, Salmonella enterica enterica serovar Typhi Ty2
ccagggcaugauuaaa

SEQ ID NO: 1799351 - RNA, 18 nt, Salmonella enterica enterica serovar Typhi Ty2
ccaggcuauccagcucac

SEQ ID NO: 1799352 - RNA, 16 nt, Salmonella enterica enterica serovar Typhi Ty2
ccagguauuuagccac

SEQ ID NO: 1799353 - RNA, 17 nt, Salmonella enterica enterica serovar Typhi Ty2
ccaggucaucaccucca

SEQ ID NO: 1799354 - RNA, 18 nt, Salmonella enterica enterica serovar Typhi Ty2
ccagggcugcuggccuuc

SEQ ID NO: 1799355 - RNA, 18 nt, Salmonella enterica enterica serovar Typhi Ty2
ccagggggauccuuauuc

SEQ ID NO: 1799356 - RNA, 19 nt, Salmonella enterica enterica serovar Typhi Ty2
ccagggcgggauccccugc

SEQ ID NO: 1799357 - RNA, 18 nt, Salmonella enterica enterica serovar Typhi Ty2
ccaggccggcauaaugau

SEQ ID NO: 1799358 - RNA, 20 nt, Salmonella enterica enterica serovar Typhi Ty2
ccaggccgucggcgccagcc

SEQ ID NO: 1799359 - RNA, 23 nt, Salmonella enterica enterica serovar Typhi Ty2
ccaggccgguuguuuacacggca

SEQ ID NO: 1799360 - RNA, 15 nt, Salmonella enterica enterica serovar Typhi Ty2
ccaggccgccaccgc

SEQ ID NO: 1799361 - RNA, 16 nt, Salmonella enterica enterica serovar Typhi Ty2
ccaggccgccaccgcc

SEQ ID NO: 1799362 - RNA, 18 nt, Salmonella enterica enterica serovar Typhi Ty2
ccaggcccagccgcuccg

SEQ ID NO: 1799363 - RNA, 13 nt, Salmonella enterica enterica serovar Typhi Ty2
ccaggccugagcc

SEQ ID NO: 1799364 - RNA, 17 nt, Salmonella enterica enterica serovar Typhi Ty2
ccaggcgaccagaugca

SEQ ID NO: 1799365 - RNA, 14 nt, Salmonella enterica enterica serovar Typhi Ty2
ccaggcgcgcaccg

SEQ ID NO: 1799366 - RNA, 17 nt, Salmonella enterica enterica serovar Typhi Ty2
ccaggcgcgcagcugcc

SEQ ID NO: 1799367 - RNA, 20 nt, Salmonella enterica enterica serovar Typhi Ty2
ccaggcguaagaucccaggg

SEQ ID NO: 1799368 - RNA, 22 nt, Salmonella enterica enterica serovar Typhi Ty2
ccaggcggcuuuuucaucaucg

SEQ ID NO: 1799369 - RNA, 20 nt, Salmonella enterica enterica serovar Typhi Ty2
ccaggcggguagucccagga

SEQ ID NO: 1799370 - RNA, 20 nt, Salmonella enterica enterica serovar Typhi Ty2
ccaggauggccagcaccagc

SEQ ID NO: 1799371 - RNA, 19 nt, Salmonella enterica enterica serovar Typhi Ty2
ccaggaugccaaccaccgc

SEQ ID NO: 1799372 - RNA, 15 nt, Salmonella enterica enterica serovar Typhi Ty2
ccaggaugccaacca

SEQ ID NO: 1799373 - RNA, 15 nt, Salmonella enterica enterica serovar Typhi Ty2
ccaggaucgccgccg

SEQ ID NO: 1799374 - RNA, 16 nt, Salmonella enterica enterica serovar Typhi Ty2
ccaggauaguacugac

SEQ ID NO: 1799375 - RNA, 15 nt, Salmonella enterica enterica serovar Typhi Ty2
ccaggagcaaaccga

SEQ ID NO: 1799376 - RNA, 20 nt, Salmonella enterica enterica serovar Typhi Ty2
ccaggcaucgacgccagcgg

SEQ ID NO: 1799377 - RNA, 18 nt, Salmonella enterica enterica serovar Typhi Ty2
ccaggcauguuaugaaua

SEQ ID NO: 1799378 - RNA, 19 nt, Salmonella enterica enterica serovar Typhi Ty2
ccaggcagcguggcgagcu

SEQ ID NO: 1799379 - RNA, 13 nt, Salmonella enterica enterica serovar Typhi Ty2
ccaggccaucaga

SEQ ID NO: 1799380 - RNA, 15 nt, Salmonella enterica enterica serovar Typhi Ty2
ccaggccagauggcu

SEQ ID NO: 1799381 - RNA, 18 nt, Salmonella enterica enterica serovar Typhi Ty2
ccaggccaauuccgccau

SEQ ID NO: 1799382 - RNA, 23 nt, Salmonella enterica enterica serovar Typhi Ty2
ccaggcacuugagaaauuauuuu

SEQ ID NO: 1799383 - RNA, 19 nt, Salmonella enterica enterica serovar Typhi Ty2
ccaggcagauccaaauggc

SEQ ID NO: 1799384 - RNA, 12 nt, Salmonella enterica enterica serovar Typhi Ty2
ccaggcagcgcg

SEQ ID NO: 1799385 - RNA, 19 nt, Salmonella enterica enterica serovar Typhi Ty2
ccaggcaaugccccgccgc

SEQ ID NO: 1799386 - RNA, 17 nt, Salmonella enterica enterica serovar Typhi Ty2
ccaggcaccauccggua

SEQ ID NO: 1799387 - RNA, 19 nt, Salmonella enterica enterica serovar Typhi Ty2
ccaggcaaagccccaguca

SEQ ID NO: 1799388 - RNA, 21 nt, Salmonella enterica enterica serovar Typhi Ty2
ccaggcaaagauccaccagau

SEQ ID NO: 1799389 - RNA, 22 nt, Salmonella enterica enterica serovar Typhi Ty2
ccaggcaaagauuaccgggccc

SEQ ID NO: 1799390 - RNA, 22 nt, Salmonella enterica enterica serovar Typhi Ty2
ccaggcaaaugauuaucuccau

SEQ ID NO: 1799391 - RNA, 15 nt, Salmonella enterica enterica serovar Typhi Ty2
ccaggcaaaaauagg

SEQ ID NO: 1799392 - RNA, 11 nt, Salmonella enterica enterica serovar Typhi Ty2
ccagcuuaaau

SEQ ID NO: 1799393 - RNA, 20 nt, Salmonella enterica enterica serovar Typhi Ty2
ccagcugcgcgcuauuccag

SEQ ID NO: 1799394 - RNA, 13 nt, Salmonella enterica enterica serovar Typhi Ty2
ccagcucugccgg

SEQ ID NO: 1799395 - RNA, 12 nt, Salmonella enterica enterica serovar Typhi Ty2
ccagcucuucuu

SEQ ID NO: 1799396 - RNA, 14 nt, Salmonella enterica enterica serovar Typhi Ty2
ccagcucuucuucg

SEQ ID NO: 1799397 - RNA, 15 nt, Salmonella enterica enterica serovar Typhi Ty2
ccagcucuucuucgc

SEQ ID NO: 1799398 - RNA, 12 nt, Salmonella enterica enterica serovar Typhi Ty2
ccagcugacgac

SEQ ID NO: 1799399 - RNA, 17 nt, Salmonella enterica enterica serovar Typhi Ty2
ccagcugacgacgccag

SEQ ID NO: 1799400 - RNA, 21 nt, Salmonella enterica enterica serovar Typhi Ty2
ccagcucuuuaggcaggaaau

SEQ ID NO: 1799401 - RNA, 19 nt, Salmonella enterica enterica serovar Typhi Ty2
ccagcugaaacagaauaaa

SEQ ID NO: 1799402 - RNA, 19 nt, Salmonella enterica enterica serovar Typhi Ty2
ccagcugacgacgccagcc

SEQ ID NO: 1799403 - RNA, 20 nt, Salmonella enterica enterica serovar Typhi Ty2
ccagcucuacaucgccgcga

SEQ ID NO: 1799404 - RNA, 21 nt, Salmonella enterica enterica serovar Typhi Ty2
ccaggaagaguaucucucugg

SEQ ID NO: 1799405 - RNA, 23 nt, Salmonella enterica enterica serovar Typhi Ty2
ccaggacaacgccgguacgcagc

SEQ ID NO: 1799406 - RNA, 14 nt, Salmonella enterica enterica serovar Typhi Ty2
ccaggaacuaacuc

SEQ ID NO: 1799407 - RNA, 16 nt, Salmonella enterica enterica serovar Typhi Ty2
ccagcuucgccccggc

SEQ ID NO: 1799408 - RNA, 15 nt, Salmonella enterica enterica serovar Typhi Ty2
cauuucgaucuguuu

SEQ ID NO: 1799409 - RNA, 17 nt, Salmonella enterica enterica serovar Typhi Ty2
cauuuccugcauuaacg

SEQ ID NO: 1799410 - RNA, 14 nt, Salmonella enterica enterica serovar Typhi Ty2
cauuucgccgccau

SEQ ID NO: 1799411 - RNA, 13 nt, Salmonella enterica enterica serovar Typhi Ty2
cauuuccucugcg

SEQ ID NO: 1799412 - RNA, 15 nt, Salmonella enterica enterica serovar Typhi Ty2
cauuuccucugcgga

SEQ ID NO: 1799413 - RNA, 14 nt, Salmonella enterica enterica serovar Typhi Ty2
cauuuccggcgcgc

SEQ ID NO: 1799414 - RNA, 23 nt, Salmonella enterica enterica serovar Typhi Ty2
cauuuccggcgcgccuaaaccaa

SEQ ID NO: 1799415 - RNA, 17 nt, Salmonella enterica enterica serovar Typhi Ty2
cauuuccggcggcaacc

SEQ ID NO: 1799416 - RNA, 23 nt, Salmonella enterica enterica serovar Typhi Ty2
cauuucaucuaucugcuucuggc

SEQ ID NO: 1799417 - RNA, 18 nt, Salmonella enterica enterica serovar Typhi Ty2
cauuucagucuaauuuau

SEQ ID NO: 1799418 - RNA, 17 nt, Salmonella enterica enterica serovar Typhi Ty2
cauuucaggcacuggcu

SEQ ID NO: 1799419 - RNA, 19 nt, Salmonella enterica enterica serovar Typhi Ty2
cauuucauauucaaaaucc

SEQ ID NO: 1799420 - RNA, 18 nt, Salmonella enterica enterica serovar Typhi Ty2
cauuucccaauaguuuau

SEQ ID NO: 1799421 - RNA, 21 nt, Salmonella enterica enterica serovar Typhi Ty2
cauuuauggguuccaguugca

SEQ ID NO: 1799422 - RNA, 15 nt, Salmonella enterica enterica serovar Typhi Ty2
cauuuauguuugccc

SEQ ID NO: 1799423 - RNA, 19 nt, Salmonella enterica enterica serovar Typhi Ty2
cauuuacgccagccagaau

SEQ ID NO: 1799424 - RNA, 12 nt, Salmonella enterica enterica serovar Typhi Ty2
cauuucaagcag

SEQ ID NO: 1799425 - RNA, 19 nt, Salmonella enterica enterica serovar Typhi Ty2
cauuucaaucgccaccaca

SEQ ID NO: 1799426 - RNA, 13 nt, Salmonella enterica enterica serovar Typhi Ty2
cauuucaaugcau

SEQ ID NO: 1799427 - RNA, 16 nt, Salmonella enterica enterica serovar Typhi Ty2
cauuucacaaauuaaa

SEQ ID NO: 1799428 - RNA, 16 nt, Salmonella enterica enterica serovar Typhi Ty2
cauuucaggcaaaaaa

SEQ ID NO: 1799429 - RNA, 16 nt, Salmonella enterica enterica serovar Typhi Ty2
cauuucacuuguucuu

SEQ ID NO: 1799430 - RNA, 23 nt, Salmonella enterica enterica serovar Typhi Ty2
cauuuuaaauacaccaaacgaau

SEQ ID NO: 1799431 - RNA, 13 nt, Salmonella enterica enterica serovar Typhi Ty2
cauuuuaaaaaua

SEQ ID NO: 1799432 - RNA, 14 nt, Salmonella enterica enterica serovar Typhi Ty2
cauuuuauccucuu

SEQ ID NO: 1799433 - RNA, 20 nt, Salmonella enterica enterica serovar Typhi Ty2
cauuuuaccuuuaaacuguu

SEQ ID NO: 1799434 - RNA, 22 nt, Salmonella enterica enterica serovar Typhi Ty2
cauuugucucuuacguugcauu

SEQ ID NO: 1799435 - RNA, 20 nt, Salmonella enterica enterica serovar Typhi Ty2
cauuuguuccucgaaacgcu

SEQ ID NO: 1799436 - RNA, 13 nt, Salmonella enterica enterica serovar Typhi Ty2
cauuuguuccucg

SEQ ID NO: 1799437 - RNA, 17 nt, Salmonella enterica enterica serovar Typhi Ty2
cauuuggcuuaaauaau

SEQ ID NO: 1799438 - RNA, 17 nt, Salmonella enterica enterica serovar Typhi Ty2
cauuugauuuguuuuuu

SEQ ID NO: 1799439 - RNA, 21 nt, Salmonella enterica enterica serovar Typhi Ty2
cauuugauuuguuuuuuauau

SEQ ID NO: 1799440 - RNA, 15 nt, Salmonella enterica enterica serovar Typhi Ty2
cauuugauuuguuuu

SEQ ID NO: 1799441 - RNA, 23 nt, Salmonella enterica enterica serovar Typhi Ty2
cauuugcgacaucagccagccgc

SEQ ID NO: 1799442 - RNA, 22 nt, Salmonella enterica enterica serovar Typhi Ty2
cauuugcagguuacucacugcc

SEQ ID NO: 1799443 - RNA, 12 nt, Salmonella enterica enterica serovar Typhi Ty2
cauuugcagguu

SEQ ID NO: 1799444 - RNA, 14 nt, Salmonella enterica enterica serovar Typhi Ty2
cauuucuuccagca

SEQ ID NO: 1799445 - RNA, 17 nt, Salmonella enterica enterica serovar Typhi Ty2
cauuucuuguugacgac

SEQ ID NO: 1799446 - RNA, 12 nt, Salmonella enterica enterica serovar Typhi Ty2
cauuucugccug

SEQ ID NO: 1799447 - RNA, 17 nt, Salmonella enterica enterica serovar Typhi Ty2
cauuggcccggcgcgcg

SEQ ID NO: 1799448 - RNA, 16 nt, Salmonella enterica enterica serovar Typhi Ty2
cauuggcaaaccccug

SEQ ID NO: 1799449 - RNA, 21 nt, Salmonella enterica enterica serovar Typhi Ty2
cauuggggacgcgcaaacgcu

SEQ ID NO: 1799450 - RNA, 12 nt, Salmonella enterica enterica serovar Typhi Ty2
cauuggcaucug

SEQ ID NO: 1799451 - RNA, 16 nt, Salmonella enterica enterica serovar Typhi Ty2
cauuggcgucugcugg

SEQ ID NO: 1799452 - RNA, 20 nt, Salmonella enterica enterica serovar Typhi Ty2
cauuguacuuuuaaaucauc

SEQ ID NO: 1799453 - RNA, 22 nt, Salmonella enterica enterica serovar Typhi Ty2
cauuggggggaaauuaaacugc

SEQ ID NO: 1799454 - RNA, 20 nt, Salmonella enterica enterica serovar Typhi Ty2
cauugggauggauaaauagg

SEQ ID NO: 1799455 - RNA, 19 nt, Salmonella enterica enterica serovar Typhi Ty2
cauugguggggcuaaguga

SEQ ID NO: 1799456 - RNA, 17 nt, Salmonella enterica enterica serovar Typhi Ty2
cauuuaaucgccugcgc

SEQ ID NO: 1799457 - RNA, 13 nt, Salmonella enterica enterica serovar Typhi Ty2
cauuuacaauaau

SEQ ID NO: 1799458 - RNA, 15 nt, Salmonella enterica enterica serovar Typhi Ty2
cauuuaagaaacaau

SEQ ID NO: 1799459 - RNA, 16 nt, Salmonella enterica enterica serovar Typhi Ty2
cauuuaagauuuaaaa

SEQ ID NO: 1799460 - RNA, 22 nt, Salmonella enterica enterica serovar Typhi Ty2
cauuuaacaggacgcuccauca

SEQ ID NO: 1799461 - RNA, 22 nt, Salmonella enterica enterica serovar Typhi Ty2
cauuguuccugcuggcaaaacg

SEQ ID NO: 1799462 - RNA, 13 nt, Salmonella enterica enterica serovar Typhi Ty2
cauuguuaaucca

SEQ ID NO: 1799463 - RNA, 19 nt, Salmonella enterica enterica serovar Typhi Ty2
cauuguccuuuaucugccc

SEQ ID NO: 1799464 - RNA, 13 nt, Salmonella enterica enterica serovar Typhi Ty2
cauugucuuuuuc

SEQ ID NO: 1799465 - RNA, 14 nt, Salmonella enterica enterica serovar Typhi Ty2
cauugucuuuuucu

SEQ ID NO: 1799466 - RNA, 17 nt, Salmonella enterica enterica serovar Typhi Ty2
cauucgcuccucagcgc

SEQ ID NO: 1799467 - RNA, 16 nt, Salmonella enterica enterica serovar Typhi Ty2
cauucgcucaggacag

SEQ ID NO: 1799468 - RNA, 16 nt, Salmonella enterica enterica serovar Typhi Ty2
cauucgcgucauacuu

SEQ ID NO: 1799469 - RNA, 14 nt, Salmonella enterica enterica serovar Typhi Ty2
cauucgucaaauuc

SEQ ID NO: 1799470 - RNA, 11 nt, Salmonella enterica enterica serovar Typhi Ty2
cauugcagcgg

SEQ ID NO: 1799471 - RNA, 17 nt, Salmonella enterica enterica serovar Typhi Ty2
cauugcaggcuuuuuca

SEQ ID NO: 1799472 - RNA, 12 nt, Salmonella enterica enterica serovar Typhi Ty2
cauugcccggcg

SEQ ID NO: 1799473 - RNA, 20 nt, Salmonella enterica enterica serovar Typhi Ty2
cauugccauguuaauaccag

SEQ ID NO: 1799474 - RNA, 23 nt, Salmonella enterica enterica serovar Typhi Ty2
cauugccaugcgacuaaccugau

SEQ ID NO: 1799475 - RNA, 17 nt, Salmonella enterica enterica serovar Typhi Ty2
cauugccguuaacugcu

SEQ ID NO: 1799476 - RNA, 17 nt, Salmonella enterica enterica serovar Typhi Ty2
cauugccuuccaggcgg

SEQ ID NO: 1799477 - RNA, 14 nt, Salmonella enterica enterica serovar Typhi Ty2
cauugcgagaaaaa

SEQ ID NO: 1799478 - RNA, 18 nt, Salmonella enterica enterica serovar Typhi Ty2
cauugcgagaaaaaacuc

SEQ ID NO: 1799479 - RNA, 13 nt, Salmonella enterica enterica serovar Typhi Ty2
cauugcguauuuc

SEQ ID NO: 1799480 - RNA, 17 nt, Salmonella enterica enterica serovar Typhi Ty2
cauugcuuucuugaauc

SEQ ID NO: 1799481 - RNA, 23 nt, Salmonella enterica enterica serovar Typhi Ty2
cauugcuuuuggcaacggcagcc

SEQ ID NO: 1799482 - RNA, 19 nt, Salmonella enterica enterica serovar Typhi Ty2
cauuggaaaaccccauccc

SEQ ID NO: 1799483 - RNA, 20 nt, Salmonella enterica enterica serovar Typhi Ty2
cauuggaaaaccccaucccg

SEQ ID NO: 1799484 - RNA, 15 nt, Salmonella enterica enterica serovar Typhi Ty2
cauugcuuucuugaa

SEQ ID NO: 1799485 - RNA, 19 nt, Salmonella enterica enterica serovar Typhi Ty2
cauugcuaggaacagugac

SEQ ID NO: 1799486 - RNA, 17 nt, Salmonella enterica enterica serovar Typhi Ty2
cauucgcccagucauca

SEQ ID NO: 1799487 - RNA, 13 nt, Salmonella enterica enterica serovar Typhi Ty2
cauucgccccagc

SEQ ID NO: 1799488 - RNA, 15 nt, Salmonella enterica enterica serovar Typhi Ty2
cauucgccccagcau

SEQ ID NO: 1799489 - RNA, 22 nt, Salmonella enterica enterica serovar Typhi Ty2
cauucgccaccaggcucaaauu

SEQ ID NO: 1799490 - RNA, 16 nt, Salmonella enterica enterica serovar Typhi Ty2
cauuccugccgccgca

SEQ ID NO: 1799491 - RNA, 17 nt, Salmonella enterica enterica serovar Typhi Ty2
cauucgaauccuccugu

SEQ ID NO: 1799492 - RNA, 15 nt, Salmonella enterica enterica serovar Typhi Ty2
cauucgauaaccgcc

SEQ ID NO: 1799493 - RNA, 17 nt, Salmonella enterica enterica serovar Typhi Ty2
cauucgauaaccgccga

SEQ ID NO: 1799494 - RNA, 20 nt, Salmonella enterica enterica serovar Typhi Ty2
cauucgaucuguguacuuuu

SEQ ID NO: 1799495 - RNA, 12 nt, Salmonella enterica enterica serovar Typhi Ty2
cauuccgccugc

SEQ ID NO: 1799496 - RNA, 18 nt, Salmonella enterica enterica serovar Typhi Ty2
cauucauaagcaaacagu

SEQ ID NO: 1799497 - RNA, 20 nt, Salmonella enterica enterica serovar Typhi Ty2
cauucauaagcaaacagugg

SEQ ID NO: 1799498 - RNA, 22 nt, Salmonella enterica enterica serovar Typhi Ty2
cauucaguacgcuuuggcaggc

SEQ ID NO: 1799499 - RNA, 19 nt, Salmonella enterica enterica serovar Typhi Ty2
cauucagugaauuaugacc

SEQ ID NO: 1799500 - RNA, 15 nt, Salmonella enterica enterica serovar Typhi Ty2
cauucaggccucugc

SEQ ID NO: 1799501 - RNA, 23 nt, Salmonella enterica enterica serovar Typhi Ty2
cauuaguucaaguuuagaaaaaa

SEQ ID NO: 1799502 - RNA, 22 nt, Salmonella enterica enterica serovar Typhi Ty2
cauuaggcuuuucauucagcgc

SEQ ID NO: 1799503 - RNA, 21 nt, Salmonella enterica enterica serovar Typhi Ty2
cauuagggggcgggcugaaau

SEQ ID NO: 1799504 - RNA, 20 nt, Salmonella enterica enterica serovar Typhi Ty2
cauuagcggcauugaagagu

SEQ ID NO: 1799505 - RNA, 15 nt, Salmonella enterica enterica serovar Typhi Ty2
cauuagcgcgauaaa

SEQ ID NO: 1799506 - RNA, 19 nt, Salmonella enterica enterica serovar Typhi Ty2
cauuagcgcgauaaaacca

SEQ ID NO: 1799507 - RNA, 15 nt, Salmonella enterica enterica serovar Typhi Ty2
cauuauuuuuaaaua

SEQ ID NO: 1799508 - RNA, 20 nt, Salmonella enterica enterica serovar Typhi Ty2
cauuaggcguaauuauuaca

SEQ ID NO: 1799509 - RNA, 19 nt, Salmonella enterica enterica serovar Typhi Ty2
cauucagcagcgcccagcc

SEQ ID NO: 1799510 - RNA, 19 nt, Salmonella enterica enterica serovar Typhi Ty2
cauucaggcaggcgaaacc

SEQ ID NO: 1799511 - RNA, 23 nt, Salmonella enterica enterica serovar Typhi Ty2
cauucaggcaggcgaaaccggcc

SEQ ID NO: 1799512 - RNA, 17 nt, Salmonella enterica enterica serovar Typhi Ty2
cauuaauacaggccagc

SEQ ID NO: 1799513 - RNA, 23 nt, Salmonella enterica enterica serovar Typhi Ty2
cauuaagcccauaaagcacuggu

SEQ ID NO: 1799514 - RNA, 22 nt, Salmonella enterica enterica serovar Typhi Ty2
cauguuagcaaaaaugccguua

SEQ ID NO: 1799515 - RNA, 19 nt, Salmonella enterica enterica serovar Typhi Ty2
caugucucacccguuuucu

SEQ ID NO: 1799516 - RNA, 22 nt, Salmonella enterica enterica serovar Typhi Ty2
caugucugucuaugcacaggcg

SEQ ID NO: 1799517 - RNA, 12 nt, Salmonella enterica enterica serovar Typhi Ty2
caugucuucacu

SEQ ID NO: 1799518 - RNA, 13 nt, Salmonella enterica enterica serovar Typhi Ty2
caugucguuagaa

SEQ ID NO: 1799519 - RNA, 14 nt, Salmonella enterica enterica serovar Typhi Ty2
cauuacucguccuu

SEQ ID NO: 1799520 - RNA, 19 nt, Salmonella enterica enterica serovar Typhi Ty2
cauuagcauucccuuaucu

SEQ ID NO: 1799521 - RNA, 22 nt, Salmonella enterica enterica serovar Typhi Ty2
cauuagcaugggcuaaagcauc

SEQ ID NO: 1799522 - RNA, 13 nt, Salmonella enterica enterica serovar Typhi Ty2
cauuacccccgcc

SEQ ID NO: 1799523 - RNA, 13 nt, Salmonella enterica enterica serovar Typhi Ty2
cauuacauccuca

SEQ ID NO: 1799524 - RNA, 13 nt, Salmonella enterica enterica serovar Typhi Ty2
cauuaccuuuucc

SEQ ID NO: 1799525 - RNA, 23 nt, Salmonella enterica enterica serovar Typhi Ty2
caugcugaugacuaauggcauuu

SEQ ID NO: 1799526 - RNA, 21 nt, Salmonella enterica enterica serovar Typhi Ty2
caugcugaccgaaccgcugua

SEQ ID NO: 1799527 - RNA, 20 nt, Salmonella enterica enterica serovar Typhi Ty2
caugcucaugcgaucgggca

SEQ ID NO: 1799528 - RNA, 20 nt, Salmonella enterica enterica serovar Typhi Ty2
caugcucauuuugauaaauc

SEQ ID NO: 1799529 - RNA, 15 nt, Salmonella enterica enterica serovar Typhi Ty2
caugcucauccaacu

SEQ ID NO: 1799530 - RNA, 17 nt, Salmonella enterica enterica serovar Typhi Ty2
caucuucaccuuuccag

SEQ ID NO: 1799531 - RNA, 16 nt, Salmonella enterica enterica serovar Typhi Ty2
caucuucacgcagcgu

SEQ ID NO: 1799532 - RNA, 21 nt, Salmonella enterica enterica serovar Typhi Ty2
caucuucaccgaugcccagcu

SEQ ID NO: 1799533 - RNA, 20 nt, Salmonella enterica enterica serovar Typhi Ty2
caucuucacauaucccagac

SEQ ID NO: 1799534 - RNA, 12 nt, Salmonella enterica enterica serovar Typhi Ty2
caucuucagcaa

SEQ ID NO: 1799535 - RNA, 13 nt, Salmonella enterica enterica serovar Typhi Ty2
caucuucacuuca

SEQ ID NO: 1799536 - RNA, 22 nt, Salmonella enterica enterica serovar Typhi Ty2
caucuucgagggugggcgcaca

SEQ ID NO: 1799537 - RNA, 14 nt, Salmonella enterica enterica serovar Typhi Ty2
caucuuccaugccu

SEQ ID NO: 1799538 - RNA, 12 nt, Salmonella enterica enterica serovar Typhi Ty2
caucuuccagua

SEQ ID NO: 1799539 - RNA, 15 nt, Salmonella enterica enterica serovar Typhi Ty2
cauggcagccccggc

SEQ ID NO: 1799540 - RNA, 20 nt, Salmonella enterica enterica serovar Typhi Ty2
cauggcagauaaaccacgcc

SEQ ID NO: 1799541 - RNA, 18 nt, Salmonella enterica enterica serovar Typhi Ty2
cauggcaggcagcacaau

SEQ ID NO: 1799542 - RNA, 22 nt, Salmonella enterica enterica serovar Typhi Ty2
cauggcaaaagacauccccgcc

SEQ ID NO: 1799543 - RNA, 23 nt, Salmonella enterica enterica serovar Typhi Ty2
cauggcaaaacuaaacccggccu

SEQ ID NO: 1799544 - RNA, 20 nt, Salmonella enterica enterica serovar Typhi Ty2
cauggaguuccaguucaucu

SEQ ID NO: 1799545 - RNA, 16 nt, Salmonella enterica enterica serovar Typhi Ty2
caugcuuucaauaaau

SEQ ID NO: 1799546 - RNA, 12 nt, Salmonella enterica enterica serovar Typhi Ty2
caugcugguugg

SEQ ID NO: 1799547 - RNA, 21 nt, Salmonella enterica enterica serovar Typhi Ty2
caugcuggauaccgaauuccg

SEQ ID NO: 1799548 - RNA, 15 nt, Salmonella enterica enterica serovar Typhi Ty2
cauggguuugaccca

SEQ ID NO: 1799549 - RNA, 20 nt, Salmonella enterica enterica serovar Typhi Ty2
caugguaaaauccuuuuuca

SEQ ID NO: 1799550 - RNA, 18 nt, Salmonella enterica enterica serovar Typhi Ty2
cauggcuugaucgcgcag

SEQ ID NO: 1799551 - RNA, 16 nt, Salmonella enterica enterica serovar Typhi Ty2
cauggcguuaaugcgc

SEQ ID NO: 1799552 - RNA, 13 nt, Salmonella enterica enterica serovar Typhi Ty2
cauggcccaaaag

SEQ ID NO: 1799553 - RNA, 14 nt, Salmonella enterica enterica serovar Typhi Ty2
cauguaaccaaagc

SEQ ID NO: 1799554 - RNA, 20 nt, Salmonella enterica enterica serovar Typhi Ty2
cauguacggguccuuuuuug

SEQ ID NO: 1799555 - RNA, 20 nt, Salmonella enterica enterica serovar Typhi Ty2
cauguacgcaggcgacuggc

SEQ ID NO: 1799556 - RNA, 17 nt, Salmonella enterica enterica serovar Typhi Ty2
cauguccggcgacucca

SEQ ID NO: 1799557 - RNA, 23 nt, Salmonella enterica enterica serovar Typhi Ty2
caugucggccuuuuugcgccgcg

SEQ ID NO: 1799558 - RNA, 15 nt, Salmonella enterica enterica serovar Typhi Ty2
ccacggccacagcca

SEQ ID NO: 1799559 - RNA, 15 nt, Salmonella enterica enterica serovar Typhi Ty2
ccacggccagcagcc

SEQ ID NO: 1799560 - RNA, 15 nt, Salmonella enterica enterica serovar Typhi Ty2
ccacggaaugaaugu

SEQ ID NO: 1799561 - RNA, 22 nt, Salmonella enterica enterica serovar Typhi Ty2
ccacggacaucggccucgcugg

SEQ ID NO: 1799562 - RNA, 14 nt, Salmonella enterica enterica serovar Typhi Ty2
ccacgcuuuuuuau

SEQ ID NO: 1799563 - RNA, 16 nt, Salmonella enterica enterica serovar Typhi Ty2
ccacgcuuuuuuauuu

SEQ ID NO: 1799564 - RNA, 22 nt, Salmonella enterica enterica serovar Typhi Ty2
ccacgcugauacguaacaugac

SEQ ID NO: 1799565 - RNA, 14 nt, Salmonella enterica enterica serovar Typhi Ty2
ccacgcucacuuuu

SEQ ID NO: 1799566 - RNA, 21 nt, Salmonella enterica enterica serovar Typhi Ty2
ccacgcguacgguuacaaccc

SEQ ID NO: 1799567 - RNA, 14 nt, Salmonella enterica enterica serovar Typhi Ty2
ccacgccguagcug

SEQ ID NO: 1799568 - RNA, 14 nt, Salmonella enterica enterica serovar Typhi Ty2
ccacgccgccgcgu

SEQ ID NO: 1799569 - RNA, 18 nt, Salmonella enterica enterica serovar Typhi Ty2
ccacgccgcuaucgacca

SEQ ID NO: 1799570 - RNA, 12 nt, Salmonella enterica enterica serovar Typhi Ty2
ccacgccgccau

SEQ ID NO: 1799571 - RNA, 20 nt, Salmonella enterica enterica serovar Typhi Ty2
ccacgccgcaaggacgccag

SEQ ID NO: 1799572 - RNA, 18 nt, Salmonella enterica enterica serovar Typhi Ty2
ccacgcgaugcaaccccu

SEQ ID NO: 1799573 - RNA, 20 nt, Salmonella enterica enterica serovar Typhi Ty2
ccacgcgaugcaaccccuga

SEQ ID NO: 1799574 - RNA, 14 nt, Salmonella enterica enterica serovar Typhi Ty2
ccacgcgacgccag

SEQ ID NO: 1799575 - RNA, 16 nt, Salmonella enterica enterica serovar Typhi Ty2
ccacgcgagcugccag

SEQ ID NO: 1799576 - RNA, 19 nt, Salmonella enterica enterica serovar Typhi Ty2
ccacgcggcgugcgcugca

SEQ ID NO: 1799577 - RNA, 15 nt, Salmonella enterica enterica serovar Typhi Ty2
ccacgcgcaccaugu

SEQ ID NO: 1799578 - RNA, 17 nt, Salmonella enterica enterica serovar Typhi Ty2
ccacgcgcggcaucauu

SEQ ID NO: 1799579 - RNA, 15 nt, Salmonella enterica enterica serovar Typhi Ty2
ccacgcccagcgccg

SEQ ID NO: 1799580 - RNA, 18 nt, Salmonella enterica enterica serovar Typhi Ty2
ccacgccccuaaggcagc

SEQ ID NO: 1799581 - RNA, 18 nt, Salmonella enterica enterica serovar Typhi Ty2
ccacgccauggccgcagc

SEQ ID NO: 1799582 - RNA, 13 nt, Salmonella enterica enterica serovar Typhi Ty2
ccacgccaucauu

SEQ ID NO: 1799583 - RNA, 18 nt, Salmonella enterica enterica serovar Typhi Ty2
ccacgcacgccggccccg

SEQ ID NO: 1799584 - RNA, 15 nt, Salmonella enterica enterica serovar Typhi Ty2
ccacgccaucgcggc

SEQ ID NO: 1799585 - RNA, 20 nt, Salmonella enterica enterica serovar Typhi Ty2
ccacgccgaccaccagcuug

SEQ ID NO: 1799586 - RNA, 20 nt, Salmonella enterica enterica serovar Typhi Ty2
ccacgccgagaaacaccaga

SEQ ID NO: 1799587 - RNA, 16 nt, Salmonella enterica enterica serovar Typhi Ty2
ccacgccgaguaauuu

SEQ ID NO: 1799588 - RNA, 14 nt, Salmonella enterica enterica serovar Typhi Ty2
ccacgcccuucacg

SEQ ID NO: 1799589 - RNA, 21 nt, Salmonella enterica enterica serovar Typhi Ty2
ccacguucggcguguagccaa

SEQ ID NO: 1799590 - RNA, 17 nt, Salmonella enterica enterica serovar Typhi Ty2
ccacguucuuccagaac

SEQ ID NO: 1799591 - RNA, 14 nt, Salmonella enterica enterica serovar Typhi Ty2
ccacuaacccggcg

SEQ ID NO: 1799592 - RNA, 24 nt, Salmonella enterica enterica serovar Typhi Ty2
ccacguuuuccugcgcuugcaugg

SEQ ID NO: 1799593 - RNA, 13 nt, Salmonella enterica enterica serovar Typhi Ty2
ccacuacgcagcu

SEQ ID NO: 1799594 - RNA, 16 nt, Salmonella enterica enterica serovar Typhi Ty2
ccacguacugcuuacc

SEQ ID NO: 1799595 - RNA, 20 nt, Salmonella enterica enterica serovar Typhi Ty2
ccacguauuucgcagcgguc

SEQ ID NO: 1799596 - RNA, 17 nt, Salmonella enterica enterica serovar Typhi Ty2
ccacgucauccuccuga

SEQ ID NO: 1799597 - RNA, 17 nt, Salmonella enterica enterica serovar Typhi Ty2
ccacguaacucggcagc

SEQ ID NO: 1799598 - RNA, 16 nt, Salmonella enterica enterica serovar Typhi Ty2
ccacgguguaccccgc

SEQ ID NO: 1799599 - RNA, 21 nt, Salmonella enterica enterica serovar Typhi Ty2
ccacgggcgcguuaaugcauu

SEQ ID NO: 1799600 - RNA, 23 nt, Salmonella enterica enterica serovar Typhi Ty2
ccacggcguagcgagaaggcuuu

SEQ ID NO: 1799601 - RNA, 20 nt, Salmonella enterica enterica serovar Typhi Ty2
ccacggcguguugaaauccu

SEQ ID NO: 1799602 - RNA, 15 nt, Salmonella enterica enterica serovar Typhi Ty2
ccacaggccaacaua

SEQ ID NO: 1799603 - RNA, 16 nt, Salmonella enterica enterica serovar Typhi Ty2
ccacaggccaacauag

SEQ ID NO: 1799604 - RNA, 21 nt, Salmonella enterica enterica serovar Typhi Ty2
ccacaggccguucauucgccc

SEQ ID NO: 1799605 - RNA, 20 nt, Salmonella enterica enterica serovar Typhi Ty2
ccacaggcgcuaauuaauuc

SEQ ID NO: 1799606 - RNA, 13 nt, Salmonella enterica enterica serovar Typhi Ty2
ccaccacgcagcc

SEQ ID NO: 1799607 - RNA, 14 nt, Salmonella enterica enterica serovar Typhi Ty2
ccaccagaucuuca

SEQ ID NO: 1799608 - RNA, 18 nt, Salmonella enterica enterica serovar Typhi Ty2
ccaccacguaaugcgccc

SEQ ID NO: 1799609 - RNA, 20 nt, Salmonella enterica enterica serovar Typhi Ty2
ccaccacguuaccgcgcagu

SEQ ID NO: 1799610 - RNA, 12 nt, Salmonella enterica enterica serovar Typhi Ty2
ccaccagaaccu

SEQ ID NO: 1799611 - RNA, 20 nt, Salmonella enterica enterica serovar Typhi Ty2
ccaccaguaaccgccacagc

SEQ ID NO: 1799612 - RNA, 22 nt, Salmonella enterica enterica serovar Typhi Ty2
ccaccauaucgcagaccaucca

SEQ ID NO: 1799613 - RNA, 18 nt, Salmonella enterica enterica serovar Typhi Ty2
ccaccauuacgcccccuc

SEQ ID NO: 1799614 - RNA, 15 nt, Salmonella enterica enterica serovar Typhi Ty2
ccacccgguuuacca

SEQ ID NO: 1799615 - RNA, 17 nt, Salmonella enterica enterica serovar Typhi Ty2
ccacccggcuuuuuuau

SEQ ID NO: 1799616 - RNA, 16 nt, Salmonella enterica enterica serovar Typhi Ty2
ccacgauacgccccug

SEQ ID NO: 1799617 - RNA, 17 nt, Salmonella enterica enterica serovar Typhi Ty2
ccacgauagacagcacc

SEQ ID NO: 1799618 - RNA, 17 nt, Salmonella enterica enterica serovar Typhi Ty2
ccacgcaaucucuuccg

SEQ ID NO: 1799619 - RNA, 15 nt, Salmonella enterica enterica serovar Typhi Ty2
ccacgaaugccgaua

SEQ ID NO: 1799620 - RNA, 15 nt, Salmonella enterica enterica serovar Typhi Ty2
ccaccugccaguccg

SEQ ID NO: 1799621 - RNA, 16 nt, Salmonella enterica enterica serovar Typhi Ty2
ccaccugaucgccaac

SEQ ID NO: 1799622 - RNA, 15 nt, Salmonella enterica enterica serovar Typhi Ty2
ccaccgccaaccgcc

SEQ ID NO: 1799623 - RNA, 16 nt, Salmonella enterica enterica serovar Typhi Ty2
ccaccgccaaccgccc

SEQ ID NO: 1799624 - RNA, 18 nt, Salmonella enterica enterica serovar Typhi Ty2
ccaccgcauuuucagcuu

SEQ ID NO: 1799625 - RNA, 18 nt, Salmonella enterica enterica serovar Typhi Ty2
ccaccgccgccaccaaaa

SEQ ID NO: 1799626 - RNA, 12 nt, Salmonella enterica enterica serovar Typhi Ty2
ccaccgccgcug

SEQ ID NO: 1799627 - RNA, 22 nt, Salmonella enterica enterica serovar Typhi Ty2
ccaccggguccagucgcgccgc

SEQ ID NO: 1799628 - RNA, 14 nt, Salmonella enterica enterica serovar Typhi Ty2
ccaccgggccguca

SEQ ID NO: 1799629 - RNA, 17 nt, Salmonella enterica enterica serovar Typhi Ty2
ccacagcgccagacacu

SEQ ID NO: 1799630 - RNA, 14 nt, Salmonella enterica enterica serovar Typhi Ty2
ccacagccucagca

SEQ ID NO: 1799631 - RNA, 20 nt, Salmonella enterica enterica serovar Typhi Ty2
ccacagccgcauuuuuucuu

SEQ ID NO: 1799632 - RNA, 15 nt, Salmonella enterica enterica serovar Typhi Ty2
ccacacaugcaaaaa

SEQ ID NO: 1799633 - RNA, 14 nt, Salmonella enterica enterica serovar Typhi Ty2
ccacacaugcaaaa

SEQ ID NO: 1799634 - RNA, 15 nt, Salmonella enterica enterica serovar Typhi Ty2
ccaaucuccagcauc

SEQ ID NO: 1799635 - RNA, 14 nt, Salmonella enterica enterica serovar Typhi Ty2
ccaaugcgaaaaua

SEQ ID NO: 1799636 - RNA, 17 nt, Salmonella enterica enterica serovar Typhi Ty2
ccaauguacacgaaaua

SEQ ID NO: 1799637 - RNA, 20 nt, Salmonella enterica enterica serovar Typhi Ty2
ccacaauuguagcugcgcca

SEQ ID NO: 1799638 - RNA, 14 nt, Salmonella enterica enterica serovar Typhi Ty2
ccacaauuguagcu

SEQ ID NO: 1799639 - RNA, 12 nt, Salmonella enterica enterica serovar Typhi Ty2
ccaauuuuucac

SEQ ID NO: 1799640 - RNA, 15 nt, Salmonella enterica enterica serovar Typhi Ty2
ccaauguuaauaagc

SEQ ID NO: 1799641 - RNA, 22 nt, Salmonella enterica enterica serovar Typhi Ty2
ccaaucaugucaaauucaagcc

SEQ ID NO: 1799642 - RNA, 19 nt, Salmonella enterica enterica serovar Typhi Ty2
ccaaucgagaagccaucaa

SEQ ID NO: 1799643 - RNA, 12 nt, Salmonella enterica enterica serovar Typhi Ty2
ccaauauuuauu

SEQ ID NO: 1799644 - RNA, 16 nt, Salmonella enterica enterica serovar Typhi Ty2
ccaaucaacgccgcca

SEQ ID NO: 1799645 - RNA, 13 nt, Salmonella enterica enterica serovar Typhi Ty2
ccaaucagcccca

SEQ ID NO: 1799646 - RNA, 23 nt, Salmonella enterica enterica serovar Typhi Ty2
ccaauaccggcguaauugcgccu

SEQ ID NO: 1799647 - RNA, 16 nt, Salmonella enterica enterica serovar Typhi Ty2
ccaauaguauccauaa

SEQ ID NO: 1799648 - RNA, 14 nt, Salmonella enterica enterica serovar Typhi Ty2
ccaagcacaaaaag

SEQ ID NO: 1799649 - RNA, 20 nt, Salmonella enterica enterica serovar Typhi Ty2
ccaagcuguggaaacugugc

SEQ ID NO: 1799650 - RNA, 21 nt, Salmonella enterica enterica serovar Typhi Ty2
ccaagaucgccaagcugugau

SEQ ID NO: 1799651 - RNA, 16 nt, Salmonella enterica enterica serovar Typhi Ty2
ccaacugccaaaccac

SEQ ID NO: 1799652 - RNA, 16 nt, Salmonella enterica enterica serovar Typhi Ty2
ccaacugcgccugaag

SEQ ID NO: 1799653 - RNA, 15 nt, Salmonella enterica enterica serovar Typhi Ty2
ccaacugccaaacca

SEQ ID NO: 1799654 - RNA, 21 nt, Salmonella enterica enterica serovar Typhi Ty2
ccaacauagcuaaauaaaaau

SEQ ID NO: 1799655 - RNA, 20 nt, Salmonella enterica enterica serovar Typhi Ty2
ccaacauagcggcaaggaaa

SEQ ID NO: 1799656 - RNA, 17 nt, Salmonella enterica enterica serovar Typhi Ty2
ccaacgaaacucagcgg

SEQ ID NO: 1799657 - RNA, 21 nt, Salmonella enterica enterica serovar Typhi Ty2
ccaacgagaauaagaccaaua

SEQ ID NO: 1799658 - RNA, 18 nt, Salmonella enterica enterica serovar Typhi Ty2
ccaacgcaaugcgauaag

SEQ ID NO: 1799659 - RNA, 13 nt, Salmonella enterica enterica serovar Typhi Ty2
ccaacgcaaugcg

SEQ ID NO: 1799660 - RNA, 15 nt, Salmonella enterica enterica serovar Typhi Ty2
ccaacgccagcagcg

SEQ ID NO: 1799661 - RNA, 16 nt, Salmonella enterica enterica serovar Typhi Ty2
ccaacgccagcagcgc

SEQ ID NO: 1799662 - RNA, 19 nt, Salmonella enterica enterica serovar Typhi Ty2
ccaacgcuucacaaccuga

SEQ ID NO: 1799663 - RNA, 21 nt, Salmonella enterica enterica serovar Typhi Ty2
cauuuuaucgacgcuauuuuu

SEQ ID NO: 1799664 - RNA, 15 nt, Salmonella enterica enterica serovar Typhi Ty2
cauuuuauuuaaaaa

SEQ ID NO: 1799665 - RNA, 18 nt, Salmonella enterica enterica serovar Typhi Ty2
cauuuucaccuggaugcu

SEQ ID NO: 1799666 - RNA, 17 nt, Salmonella enterica enterica serovar Typhi Ty2
cauuuuccgcugucuau

SEQ ID NO: 1799667 - RNA, 16 nt, Salmonella enterica enterica serovar Typhi Ty2
ccaaagcgcuacaggg

SEQ ID NO: 1799668 - RNA, 20 nt, Salmonella enterica enterica serovar Typhi Ty2
cauuuuccgcugucuaucca

SEQ ID NO: 1799669 - RNA, 18 nt, Salmonella enterica enterica serovar Typhi Ty2
ccaaagucaucaauugcu

SEQ ID NO: 1799670 - RNA, 17 nt, Salmonella enterica enterica serovar Typhi Ty2
ccaaagugguuccaggc

SEQ ID NO: 1799671 - RNA, 12 nt, Salmonella enterica enterica serovar Typhi Ty2
ccaaauauuucu

SEQ ID NO: 1799672 - RNA, 15 nt, Salmonella enterica enterica serovar Typhi Ty2
ccaaaucaauagaau

SEQ ID NO: 1799673 - RNA, 15 nt, Salmonella enterica enterica serovar Typhi Ty2
ccaaagcgcugcugc

SEQ ID NO: 1799674 - RNA, 15 nt, Salmonella enterica enterica serovar Typhi Ty2
ccaacauacaugccu

SEQ ID NO: 1799675 - RNA, 15 nt, Salmonella enterica enterica serovar Typhi Ty2
ccaacagucaugaaa

SEQ ID NO: 1799676 - RNA, 12 nt, Salmonella enterica enterica serovar Typhi Ty2
ccaacagucaug

SEQ ID NO: 1799677 - RNA, 21 nt, Salmonella enterica enterica serovar Typhi Ty2
ccaacagggcggccuccuggc

SEQ ID NO: 1799678 - RNA, 19 nt, Salmonella enterica enterica serovar Typhi Ty2
ccaacaaugccacgccccu

SEQ ID NO: 1799679 - RNA, 22 nt, Salmonella enterica enterica serovar Typhi Ty2
ccaacaggaacaucguguccug

SEQ ID NO: 1799680 - RNA, 20 nt, Salmonella enterica enterica serovar Typhi Ty2
ccaaaucucccccggcacca

SEQ ID NO: 1799681 - RNA, 16 nt, Salmonella enterica enterica serovar Typhi Ty2
caucugggggaagaua

SEQ ID NO: 1799682 - RNA, 16 nt, Salmonella enterica enterica serovar Typhi Ty2
caucuggcguugccug

SEQ ID NO: 1799683 - RNA, 22 nt, Salmonella enterica enterica serovar Typhi Ty2
caucugguuguuucuuaacccc

SEQ ID NO: 1799684 - RNA, 22 nt, Salmonella enterica enterica serovar Typhi Ty2
caucugcggcaugaauugccgu

SEQ ID NO: 1799685 - RNA, 17 nt, Salmonella enterica enterica serovar Typhi Ty2
caucugcggcuuucauc

SEQ ID NO: 1799686 - RNA, 20 nt, Salmonella enterica enterica serovar Typhi Ty2
caucugcguugcgcgcguca

SEQ ID NO: 1799687 - RNA, 16 nt, Salmonella enterica enterica serovar Typhi Ty2
caucugcuucaacagc

SEQ ID NO: 1799688 - RNA, 22 nt, Salmonella enterica enterica serovar Typhi Ty2
caucuuauauuuugguguaaca

SEQ ID NO: 1799689 - RNA, 12 nt, Salmonella enterica enterica serovar Typhi Ty2
caucuuauauuu

SEQ ID NO: 1799690 - RNA, 18 nt, Salmonella enterica enterica serovar Typhi Ty2
caucugugccagcccaau

SEQ ID NO: 1799691 - RNA, 18 nt, Salmonella enterica enterica serovar Typhi Ty2
caucuguucaacuuuucg

SEQ ID NO: 1799692 - RNA, 17 nt, Salmonella enterica enterica serovar Typhi Ty2
caucuccucgcacuggc

SEQ ID NO: 1799693 - RNA, 15 nt, Salmonella enterica enterica serovar Typhi Ty2
caucuccuguaauga

SEQ ID NO: 1799694 - RNA, 21 nt, Salmonella enterica enterica serovar Typhi Ty2
caucugaacucuuccagauac

SEQ ID NO: 1799695 - RNA, 16 nt, Salmonella enterica enterica serovar Typhi Ty2
caucucuucaaacaau

SEQ ID NO: 1799696 - RNA, 19 nt, Salmonella enterica enterica serovar Typhi Ty2
caucucuuuuaauuuucug

SEQ ID NO: 1799697 - RNA, 18 nt, Salmonella enterica enterica serovar Typhi Ty2
caucugcaauucggcggc

SEQ ID NO: 1799698 - RNA, 19 nt, Salmonella enterica enterica serovar Typhi Ty2
caucugauaauuacgaugc

SEQ ID NO: 1799699 - RNA, 20 nt, Salmonella enterica enterica serovar Typhi Ty2
caucgcggucagcggcgcgc

SEQ ID NO: 1799700 - RNA, 13 nt, Salmonella enterica enterica serovar Typhi Ty2
caucgcuccagac

SEQ ID NO: 1799701 - RNA, 22 nt, Salmonella enterica enterica serovar Typhi Ty2
caucgcuaaguugaacgguaaa

SEQ ID NO: 1799702 - RNA, 18 nt, Salmonella enterica enterica serovar Typhi Ty2
caucguagucguagaaca

SEQ ID NO: 1799703 - RNA, 23 nt, Salmonella enterica enterica serovar Typhi Ty2
caucgcugaauuuggcggcgcgc

SEQ ID NO: 1799704 - RNA, 14 nt, Salmonella enterica enterica serovar Typhi Ty2
caucgcuccccaac

SEQ ID NO: 1799705 - RNA, 13 nt, Salmonella enterica enterica serovar Typhi Ty2
caucgcucccggc

SEQ ID NO: 1799706 - RNA, 12 nt, Salmonella enterica enterica serovar Typhi Ty2
caucgcuccggc

SEQ ID NO: 1799707 - RNA, 21 nt, Salmonella enterica enterica serovar Typhi Ty2
caucgucgccagacccagcgc

SEQ ID NO: 1799708 - RNA, 17 nt, Salmonella enterica enterica serovar Typhi Ty2
caucguuugcaguuccg

SEQ ID NO: 1799709 - RNA, 15 nt, Salmonella enterica enterica serovar Typhi Ty2
caucuaacacaaauu

SEQ ID NO: 1799710 - RNA, 15 nt, Salmonella enterica enterica serovar Typhi Ty2
caucuacuucagcac

SEQ ID NO: 1799711 - RNA, 21 nt, Salmonella enterica enterica serovar Typhi Ty2
caucuauaauaccuccugucu

SEQ ID NO: 1799712 - RNA, 22 nt, Salmonella enterica enterica serovar Typhi Ty2
caucuccuccucauucagcggc

SEQ ID NO: 1799713 - RNA, 21 nt, Salmonella enterica enterica serovar Typhi Ty2
caucuccgauaaauaagaagg

SEQ ID NO: 1799714 - RNA, 19 nt, Salmonella enterica enterica serovar Typhi Ty2
caucucccaggccgccacc

SEQ ID NO: 1799715 - RNA, 14 nt, Salmonella enterica enterica serovar Typhi Ty2
caucuccagcgcau

SEQ ID NO: 1799716 - RNA, 21 nt, Salmonella enterica enterica serovar Typhi Ty2
caucuccagcguggcagugag

SEQ ID NO: 1799717 - RNA, 18 nt, Salmonella enterica enterica serovar Typhi Ty2
caucucccaggccgccac

SEQ ID NO: 1799718 - RNA, 12 nt, Salmonella enterica enterica serovar Typhi Ty2
caucucaucuug

SEQ ID NO: 1799719 - RNA, 19 nt, Salmonella enterica enterica serovar Typhi Ty2
cauccugcaacucaaaaua

SEQ ID NO: 1799720 - RNA, 20 nt, Salmonella enterica enterica serovar Typhi Ty2
cauccugauuauuacaauaa

SEQ ID NO: 1799721 - RNA, 13 nt, Salmonella enterica enterica serovar Typhi Ty2
cauccucuuuccg

SEQ ID NO: 1799722 - RNA, 18 nt, Salmonella enterica enterica serovar Typhi Ty2
cauccugaguauaaaacu

SEQ ID NO: 1799723 - RNA, 13 nt, Salmonella enterica enterica serovar Typhi Ty2
cauccucauuuug

SEQ ID NO: 1799724 - RNA, 22 nt, Salmonella enterica enterica serovar Typhi Ty2
cauccuccauccagguaacaua

SEQ ID NO: 1799725 - RNA, 14 nt, Salmonella enterica enterica serovar Typhi Ty2
cauccucacgcaac

SEQ ID NO: 1799726 - RNA, 22 nt, Salmonella enterica enterica serovar Typhi Ty2
cauccucauuuuguugcuccag

SEQ ID NO: 1799727 - RNA, 14 nt, Salmonella enterica enterica serovar Typhi Ty2
cauccgucaggccc

SEQ ID NO: 1799728 - RNA, 18 nt, Salmonella enterica enterica serovar Typhi Ty2
cauccucaauguuaacua

SEQ ID NO: 1799729 - RNA, 16 nt, Salmonella enterica enterica serovar Typhi Ty2
cauccggcaaucagac

SEQ ID NO: 1799730 - RNA, 19 nt, Salmonella enterica enterica serovar Typhi Ty2
cauccggcaaacucagcgg

SEQ ID NO: 1799731 - RNA, 13 nt, Salmonella enterica enterica serovar Typhi Ty2
cauccggcacagu

SEQ ID NO: 1799732 - RNA, 15 nt, Salmonella enterica enterica serovar Typhi Ty2
cauccgcgcuuucug

SEQ ID NO: 1799733 - RNA, 21 nt, Salmonella enterica enterica serovar Typhi Ty2
cauccgcuucggacuccugac

SEQ ID NO: 1799734 - RNA, 14 nt, Salmonella enterica enterica serovar Typhi Ty2
caucauuauucccc

SEQ ID NO: 1799735 - RNA, 13 nt, Salmonella enterica enterica serovar Typhi Ty2
caucauugcgcca

SEQ ID NO: 1799736 - RNA, 15 nt, Salmonella enterica enterica serovar Typhi Ty2
caucauucugcaggc

SEQ ID NO: 1799737 - RNA, 17 nt, Salmonella enterica enterica serovar Typhi Ty2
caucauugauacuguac

SEQ ID NO: 1799738 - RNA, 15 nt, Salmonella enterica enterica serovar Typhi Ty2
caucauugauacugu

SEQ ID NO: 1799739 - RNA, 22 nt, Salmonella enterica enterica serovar Typhi Ty2
caucauucgguuaggaauagca

SEQ ID NO: 1799740 - RNA, 15 nt, Salmonella enterica enterica serovar Typhi Ty2
caucauucaacgcau

SEQ ID NO: 1799741 - RNA, 19 nt, Salmonella enterica enterica serovar Typhi Ty2
caucauucaacgcaucaaa

SEQ ID NO: 1799742 - RNA, 17 nt, Salmonella enterica enterica serovar Typhi Ty2
caucauuggcugucuua

SEQ ID NO: 1799743 - RNA, 16 nt, Salmonella enterica enterica serovar Typhi Ty2
caucccgucccaccac

SEQ ID NO: 1799744 - RNA, 14 nt, Salmonella enterica enterica serovar Typhi Ty2
caucgauggcgcca

SEQ ID NO: 1799745 - RNA, 17 nt, Salmonella enterica enterica serovar Typhi Ty2
caucgauuuccugauga

SEQ ID NO: 1799746 - RNA, 21 nt, Salmonella enterica enterica serovar Typhi Ty2
caucgacccccaccucaauca

SEQ ID NO: 1799747 - RNA, 19 nt, Salmonella enterica enterica serovar Typhi Ty2
caucgacgaaauggugugc

SEQ ID NO: 1799748 - RNA, 21 nt, Salmonella enterica enterica serovar Typhi Ty2
caucgaaugucgauguucugu

SEQ ID NO: 1799749 - RNA, 19 nt, Salmonella enterica enterica serovar Typhi Ty2
caucgacaaaggcaagauc

SEQ ID NO: 1799750 - RNA, 14 nt, Salmonella enterica enterica serovar Typhi Ty2
caucgacagcgcca

SEQ ID NO: 1799751 - RNA, 15 nt, Salmonella enterica enterica serovar Typhi Ty2
cauccuguucaagca

SEQ ID NO: 1799752 - RNA, 23 nt, Salmonella enterica enterica serovar Typhi Ty2
cauccuguuuuuucagcgcgccg

SEQ ID NO: 1799753 - RNA, 20 nt, Salmonella enterica enterica serovar Typhi Ty2
cauccuguaccaccacgccc

SEQ ID NO: 1799754 - RNA, 13 nt, Salmonella enterica enterica serovar Typhi Ty2
cauccugcggguu

SEQ ID NO: 1799755 - RNA, 20 nt, Salmonella enterica enterica serovar Typhi Ty2
cauccugcggguucaucgcc

SEQ ID NO: 1799756 - RNA, 21 nt, Salmonella enterica enterica serovar Typhi Ty2
cauccugcggguucaucgcca

SEQ ID NO: 1799757 - RNA, 14 nt, Salmonella enterica enterica serovar Typhi Ty2
cauccugcggcagu

SEQ ID NO: 1799758 - RNA, 17 nt, Salmonella enterica enterica serovar Typhi Ty2
cauccugccgcaccagu

SEQ ID NO: 1799759 - RNA, 14 nt, Salmonella enterica enterica serovar Typhi Ty2
caucgcgcuuaacu

SEQ ID NO: 1799760 - RNA, 15 nt, Salmonella enterica enterica serovar Typhi Ty2
caucgcgccuccccu

SEQ ID NO: 1799761 - RNA, 16 nt, Salmonella enterica enterica serovar Typhi Ty2
caucgcgcgcaggccc

SEQ ID NO: 1799762 - RNA, 22 nt, Salmonella enterica enterica serovar Typhi Ty2
caucgcgcugauauuuuuacug

SEQ ID NO: 1799763 - RNA, 16 nt, Salmonella enterica enterica serovar Typhi Ty2
caucgcgacacccaau

SEQ ID NO: 1799764 - RNA, 22 nt, Salmonella enterica enterica serovar Typhi Ty2
caucgcgccaaacgggcaagcc

SEQ ID NO: 1799765 - RNA, 14 nt, Salmonella enterica enterica serovar Typhi Ty2
caucgccgcgccgu

SEQ ID NO: 1799766 - RNA, 18 nt, Salmonella enterica enterica serovar Typhi Ty2
caucgccgcggcgcuggc

SEQ ID NO: 1799767 - RNA, 20 nt, Salmonella enterica enterica serovar Typhi Ty2
caucgccggagccgccuggc

SEQ ID NO: 1799768 - RNA, 19 nt, Salmonella enterica enterica serovar Typhi Ty2
caucgccugaucgcgcaga

SEQ ID NO: 1799769 - RNA, 18 nt, Salmonella enterica enterica serovar Typhi Ty2
caucgauuuccugaugac

SEQ ID NO: 1799770 - RNA, 17 nt, Salmonella enterica enterica serovar Typhi Ty2
caucgcagauuccgaac

SEQ ID NO: 1799771 - RNA, 14 nt, Salmonella enterica enterica serovar Typhi Ty2
caucgccgccucgc

SEQ ID NO: 1799772 - RNA, 20 nt, Salmonella enterica enterica serovar Typhi Ty2
caucgcauauugcguaucgu

SEQ ID NO: 1799773 - RNA, 20 nt, Salmonella enterica enterica serovar Typhi Ty2
caucauauaaccacgaaaau

SEQ ID NO: 1799774 - RNA, 22 nt, Salmonella enterica enterica serovar Typhi Ty2
caucauauaaccacgaaaauua

SEQ ID NO: 1799775 - RNA, 16 nt, Salmonella enterica enterica serovar Typhi Ty2
caucauaauccuuauu

SEQ ID NO: 1799776 - RNA, 16 nt, Salmonella enterica enterica serovar Typhi Ty2
caucauaaauggcuga

SEQ ID NO: 1799777 - RNA, 22 nt, Salmonella enterica enterica serovar Typhi Ty2
caucauaaaaggcaucgcucuu

SEQ ID NO: 1799778 - RNA, 13 nt, Salmonella enterica enterica serovar Typhi Ty2
caucauaaaaggc

SEQ ID NO: 1799779 - RNA, 14 nt, Salmonella enterica enterica serovar Typhi Ty2
caucaguuuaaccg

SEQ ID NO: 1799780 - RNA, 18 nt, Salmonella enterica enterica serovar Typhi Ty2
caucagguggaagaaacg

SEQ ID NO: 1799781 - RNA, 11 nt, Salmonella enterica enterica serovar Typhi Ty2
caucaggcuga

SEQ ID NO: 1799782 - RNA, 21 nt, Salmonella enterica enterica serovar Typhi Ty2
caucaggcugacgaagaacuu

SEQ ID NO: 1799783 - RNA, 17 nt, Salmonella enterica enterica serovar Typhi Ty2
caucaggcuuugcgcca

SEQ ID NO: 1799784 - RNA, 20 nt, Salmonella enterica enterica serovar Typhi Ty2
caucagguaauacaggguuu

SEQ ID NO: 1799785 - RNA, 22 nt, Salmonella enterica enterica serovar Typhi Ty2
caucaucgaacgccgccugcgc

SEQ ID NO: 1799786 - RNA, 14 nt, Salmonella enterica enterica serovar Typhi Ty2
caucaucccgcgcc

SEQ ID NO: 1799787 - RNA, 22 nt, Salmonella enterica enterica serovar Typhi Ty2
caucaucaggguuauccuccag

SEQ ID NO: 1799788 - RNA, 18 nt, Salmonella enterica enterica serovar Typhi Ty2
caucaucaggacucaauc

SEQ ID NO: 1799789 - RNA, 20 nt, Salmonella enterica enterica serovar Typhi Ty2
caucaucuuguccucaucau

SEQ ID NO: 1799790 - RNA, 19 nt, Salmonella enterica enterica serovar Typhi Ty2
caucaucugccauuucugc

SEQ ID NO: 1799791 - RNA, 17 nt, Salmonella enterica enterica serovar Typhi Ty2
caucaucggcacagcca

SEQ ID NO: 1799792 - RNA, 17 nt, Salmonella enterica enterica serovar Typhi Ty2
caucaucgccgauuucu

SEQ ID NO: 1799793 - RNA, 21 nt, Salmonella enterica enterica serovar Typhi Ty2
caucagaccgagacccagcgc

SEQ ID NO: 1799794 - RNA, 21 nt, Salmonella enterica enterica serovar Typhi Ty2
caucagacucucaaugcccau

SEQ ID NO: 1799795 - RNA, 15 nt, Salmonella enterica enterica serovar Typhi Ty2
caucagacuguaugu

SEQ ID NO: 1799796 - RNA, 16 nt, Salmonella enterica enterica serovar Typhi Ty2
caucagaagugccagu

SEQ ID NO: 1799797 - RNA, 22 nt, Salmonella enterica enterica serovar Typhi Ty2
caucagacaguacggaugaugu

SEQ ID NO: 1799798 - RNA, 19 nt, Salmonella enterica enterica serovar Typhi Ty2
caucacggcagcaccgcug

SEQ ID NO: 1799799 - RNA, 18 nt, Salmonella enterica enterica serovar Typhi Ty2
caucacgggaucgcagaa

SEQ ID NO: 1799800 - RNA, 22 nt, Salmonella enterica enterica serovar Typhi Ty2
caucacgcaaaugcagcggaau

SEQ ID NO: 1799801 - RNA, 19 nt, Salmonella enterica enterica serovar Typhi Ty2
caucaauggcgauuuuuag

SEQ ID NO: 1799802 - RNA, 23 nt, Salmonella enterica enterica serovar Typhi Ty2
caucaauggcgucaaacagcuua

SEQ ID NO: 1799803 - RNA, 15 nt, Salmonella enterica enterica serovar Typhi Ty2
caucaaugcccagcg

SEQ ID NO: 1799804 - RNA, 16 nt, Salmonella enterica enterica serovar Typhi Ty2
caucaauccaacgaaa

SEQ ID NO: 1799805 - RNA, 21 nt, Salmonella enterica enterica serovar Typhi Ty2
caucaaucacuacggguuuuu

SEQ ID NO: 1799806 - RNA, 13 nt, Salmonella enterica enterica serovar Typhi Ty2
caucaggcaucug

SEQ ID NO: 1799807 - RNA, 14 nt, Salmonella enterica enterica serovar Typhi Ty2
caucaggcacaaug

SEQ ID NO: 1799808 - RNA, 17 nt, Salmonella enterica enterica serovar Typhi Ty2
caucaggaucuucaucc

SEQ ID NO: 1799809 - RNA, 20 nt, Salmonella enterica enterica serovar Typhi Ty2
caucagcgggcuaugcugaa

SEQ ID NO: 1799810 - RNA, 21 nt, Salmonella enterica enterica serovar Typhi Ty2
caucagcgcuaccagcgcggc

SEQ ID NO: 1799811 - RNA, 12 nt, Salmonella enterica enterica serovar Typhi Ty2
caucagccaggc

SEQ ID NO: 1799812 - RNA, 22 nt, Salmonella enterica enterica serovar Typhi Ty2
caucagcccuaucgcugcgcug

SEQ ID NO: 1799813 - RNA, 17 nt, Salmonella enterica enterica serovar Typhi Ty2
caucagccagccgccaa

SEQ ID NO: 1799814 - RNA, 16 nt, Salmonella enterica enterica serovar Typhi Ty2
caucagauucaacagg

SEQ ID NO: 1799815 - RNA, 19 nt, Salmonella enterica enterica serovar Typhi Ty2
caucagccguuacuucccc

SEQ ID NO: 1799816 - RNA, 20 nt, Salmonella enterica enterica serovar Typhi Ty2
caucagccguuacuuccccc

SEQ ID NO: 1799817 - RNA, 19 nt, Salmonella enterica enterica serovar Typhi Ty2
cauacuauccaacagaagg

SEQ ID NO: 1799818 - RNA, 12 nt, Salmonella enterica enterica serovar Typhi Ty2
cauacucacauu

SEQ ID NO: 1799819 - RNA, 20 nt, Salmonella enterica enterica serovar Typhi Ty2
cauaguacccucugcaccag

SEQ ID NO: 1799820 - RNA, 23 nt, Salmonella enterica enterica serovar Typhi Ty2
cauacgggcaugaagaaaauacu

SEQ ID NO: 1799821 - RNA, 13 nt, Salmonella enterica enterica serovar Typhi Ty2
cauacuaccgcug

SEQ ID NO: 1799822 - RNA, 12 nt, Salmonella enterica enterica serovar Typhi Ty2
cauacuauuucc

SEQ ID NO: 1799823 - RNA, 15 nt, Salmonella enterica enterica serovar Typhi Ty2
cauaguuuuccagcc

SEQ ID NO: 1799824 - RNA, 22 nt, Salmonella enterica enterica serovar Typhi Ty2
cauauacgccacggccagcagc

SEQ ID NO: 1799825 - RNA, 16 nt, Salmonella enterica enterica serovar Typhi Ty2
cauagucgucuauuuc

SEQ ID NO: 1799826 - RNA, 21 nt, Salmonella enterica enterica serovar Typhi Ty2
cauaucuucgcgcguggugcu

SEQ ID NO: 1799827 - RNA, 21 nt, Salmonella enterica enterica serovar Typhi Ty2
cauaucuggauacccccuauc

SEQ ID NO: 1799828 - RNA, 23 nt, Salmonella enterica enterica serovar Typhi Ty2
cauaucuggcgaggcuuuguccu

SEQ ID NO: 1799829 - RNA, 15 nt, Salmonella enterica enterica serovar Typhi Ty2
cauaucugcgccgcc

SEQ ID NO: 1799830 - RNA, 14 nt, Salmonella enterica enterica serovar Typhi Ty2
cauaucuauauuuu

SEQ ID NO: 1799831 - RNA, 23 nt, Salmonella enterica enterica serovar Typhi Ty2
cauaucgucaucggucaguuugc

SEQ ID NO: 1799832 - RNA, 18 nt, Salmonella enterica enterica serovar Typhi Ty2
cauauacucuucgccauu

SEQ ID NO: 1799833 - RNA, 14 nt, Salmonella enterica enterica serovar Typhi Ty2
cauauacucacuga

SEQ ID NO: 1799834 - RNA, 22 nt, Salmonella enterica enterica serovar Typhi Ty2
cauauacugucuuguggaacac

SEQ ID NO: 1799835 - RNA, 18 nt, Salmonella enterica enterica serovar Typhi Ty2
cauaucaaucaacgguuc

SEQ ID NO: 1799836 - RNA, 11 nt, Salmonella enterica enterica serovar Typhi Ty2
cauauccagcc

SEQ ID NO: 1799837 - RNA, 16 nt, Salmonella enterica enterica serovar Typhi Ty2
cauauccaagccccuc

SEQ ID NO: 1799838 - RNA, 15 nt, Salmonella enterica enterica serovar Typhi Ty2
cauauccaagccccu

SEQ ID NO: 1799839 - RNA, 22 nt, Salmonella enterica enterica serovar Typhi Ty2
cauaucaguggggccuuuuuaa

SEQ ID NO: 1799840 - RNA, 13 nt, Salmonella enterica enterica serovar Typhi Ty2
cauaucaguugcc

SEQ ID NO: 1799841 - RNA, 12 nt, Salmonella enterica enterica serovar Typhi Ty2
cauaugggaaga

SEQ ID NO: 1799842 - RNA, 14 nt, Salmonella enterica enterica serovar Typhi Ty2
cauaugcucuccug

SEQ ID NO: 1799843 - RNA, 21 nt, Salmonella enterica enterica serovar Typhi Ty2
cauauucaccagagcaucaau

SEQ ID NO: 1799844 - RNA, 14 nt, Salmonella enterica enterica serovar Typhi Ty2
caucaaacuuuuaa

SEQ ID NO: 1799845 - RNA, 13 nt, Salmonella enterica enterica serovar Typhi Ty2
caucaaaaucauc

SEQ ID NO: 1799846 - RNA, 16 nt, Salmonella enterica enterica serovar Typhi Ty2
caucaaacuuuuaaau

SEQ ID NO: 1799847 - RNA, 15 nt, Salmonella enterica enterica serovar Typhi Ty2
caucaaagaaaacca

SEQ ID NO: 1799848 - RNA, 19 nt, Salmonella enterica enterica serovar Typhi Ty2
caucaaagaaauacccuuc

SEQ ID NO: 1799849 - RNA, 14 nt, Salmonella enterica enterica serovar Typhi Ty2
caucaacguaaaua

SEQ ID NO: 1799850 - RNA, 14 nt, Salmonella enterica enterica serovar Typhi Ty2
cauaaccucuccuu

SEQ ID NO: 1799851 - RNA, 21 nt, Salmonella enterica enterica serovar Typhi Ty2
cauaacgaaauccgcgccgcc

SEQ ID NO: 1799852 - RNA, 16 nt, Salmonella enterica enterica serovar Typhi Ty2
cauaacgaaugccauu

SEQ ID NO: 1799853 - RNA, 18 nt, Salmonella enterica enterica serovar Typhi Ty2
cauaaccgcagcgcggcc

SEQ ID NO: 1799854 - RNA, 16 nt, Salmonella enterica enterica serovar Typhi Ty2
cauaaccgcagucucc

SEQ ID NO: 1799855 - RNA, 16 nt, Salmonella enterica enterica serovar Typhi Ty2
cauaacgccuuauucg

SEQ ID NO: 1799856 - RNA, 15 nt, Salmonella enterica enterica serovar Typhi Ty2
cauaacgccgaugcc

SEQ ID NO: 1799857 - RNA, 17 nt, Salmonella enterica enterica serovar Typhi Ty2
cauaacgaccaaacaag

SEQ ID NO: 1799858 - RNA, 18 nt, Salmonella enterica enterica serovar Typhi Ty2
cauaacgcacaacgucag

SEQ ID NO: 1799859 - RNA, 15 nt, Salmonella enterica enterica serovar Typhi Ty2
cauaacaaaaccagc

SEQ ID NO: 1799860 - RNA, 14 nt, Salmonella enterica enterica serovar Typhi Ty2
cauaacaacuauuu

SEQ ID NO: 1799861 - RNA, 21 nt, Salmonella enterica enterica serovar Typhi Ty2
cauaacaacuauuuuuccggc

SEQ ID NO: 1799862 - RNA, 15 nt, Salmonella enterica enterica serovar Typhi Ty2
cauaacaccaauacg

SEQ ID NO: 1799863 - RNA, 23 nt, Salmonella enterica enterica serovar Typhi Ty2
cauaacgggguauaacucagcgg

SEQ ID NO: 1799864 - RNA, 14 nt, Salmonella enterica enterica serovar Typhi Ty2
cauaacgggaagcc

SEQ ID NO: 1799865 - RNA, 18 nt, Salmonella enterica enterica serovar Typhi Ty2
cauaacggcuacgcagcg

SEQ ID NO: 1799866 - RNA, 18 nt, Salmonella enterica enterica serovar Typhi Ty2
cauaacggccuuuuuccg

SEQ ID NO: 1799867 - RNA, 18 nt, Salmonella enterica enterica serovar Typhi Ty2
cauaacguuuccuuauau

SEQ ID NO: 1799868 - RNA, 20 nt, Salmonella enterica enterica serovar Typhi Ty2
cauaacugagacucagcagc

SEQ ID NO: 1799869 - RNA, 19 nt, Salmonella enterica enterica serovar Typhi Ty2
cauaacguuguggaaugcc

SEQ ID NO: 1799870 - RNA, 20 nt, Salmonella enterica enterica serovar Typhi Ty2
cauaagagauggaaugagca

SEQ ID NO: 1799871 - RNA, 21 nt, Salmonella enterica enterica serovar Typhi Ty2
cauaagagauggaaugagcau

SEQ ID NO: 1799872 - RNA, 22 nt, Salmonella enterica enterica serovar Typhi Ty2
cauaagcaaacagugggaagca

SEQ ID NO: 1799873 - RNA, 18 nt, Salmonella enterica enterica serovar Typhi Ty2
cauaagccaguccugcca

SEQ ID NO: 1799874 - RNA, 15 nt, Salmonella enterica enterica serovar Typhi Ty2
cauaaagccucucuu

SEQ ID NO: 1799875 - RNA, 17 nt, Salmonella enterica enterica serovar Typhi Ty2
cauaaaguagccaaugc

SEQ ID NO: 1799876 - RNA, 21 nt, Salmonella enterica enterica serovar Typhi Ty2
cauaaaggcuuuaaagcaggc

SEQ ID NO: 1799877 - RNA, 22 nt, Salmonella enterica enterica serovar Typhi Ty2
cauaaagauauugucgcccugc

SEQ ID NO: 1799878 - RNA, 22 nt, Salmonella enterica enterica serovar Typhi Ty2
cauaaauaaugccguuuuagcg

SEQ ID NO: 1799879 - RNA, 22 nt, Salmonella enterica enterica serovar Typhi Ty2
cauaaaugcugucgcccauuga

SEQ ID NO: 1799880 - RNA, 15 nt, Salmonella enterica enterica serovar Typhi Ty2
cauaaaugcugauga

SEQ ID NO: 1799881 - RNA, 17 nt, Salmonella enterica enterica serovar Typhi Ty2
cauaaauaucugcauug

SEQ ID NO: 1799882 - RNA, 24 nt, Salmonella enterica enterica serovar Typhi Ty2
cauaaaaagacgaucuucgcagua

SEQ ID NO: 1799883 - RNA, 14 nt, Salmonella enterica enterica serovar Typhi Ty2
cauaaaaagccauc

SEQ ID NO: 1799884 - RNA, 19 nt, Salmonella enterica enterica serovar Typhi Ty2
cauaaaaagcguacaaaaa

SEQ ID NO: 1799885 - RNA, 15 nt, Salmonella enterica enterica serovar Typhi Ty2
cauaaaaaagaggaa

SEQ ID NO: 1799886 - RNA, 12 nt, Salmonella enterica enterica serovar Typhi Ty2
cauaaacauuau

SEQ ID NO: 1799887 - RNA, 15 nt, Salmonella enterica enterica serovar Typhi Ty2
cauaaacaaaacaac

SEQ ID NO: 1799888 - RNA, 14 nt, Salmonella enterica enterica serovar Typhi Ty2
cauaauaaugaaua

SEQ ID NO: 1799889 - RNA, 16 nt, Salmonella enterica enterica serovar Typhi Ty2
cauaauaaugacuaau

SEQ ID NO: 1799890 - RNA, 20 nt, Salmonella enterica enterica serovar Typhi Ty2
cauaauaaacugcauccccu

SEQ ID NO: 1799891 - RNA, 12 nt, Salmonella enterica enterica serovar Typhi Ty2
cauaagucaucc

SEQ ID NO: 1799892 - RNA, 18 nt, Salmonella enterica enterica serovar Typhi Ty2
cauaaucgccgacuaauu

SEQ ID NO: 1799893 - RNA, 19 nt, Salmonella enterica enterica serovar Typhi Ty2
cauaaucgacaguggcuuu

SEQ ID NO: 1799894 - RNA, 23 nt, Salmonella enterica enterica serovar Typhi Ty2
cauaauaucucccguuuguauaa

SEQ ID NO: 1799895 - RNA, 14 nt, Salmonella enterica enterica serovar Typhi Ty2
cauaauauccugca

SEQ ID NO: 1799896 - RNA, 20 nt, Salmonella enterica enterica serovar Typhi Ty2
cauaauugcugcccgccgcc

SEQ ID NO: 1799897 - RNA, 15 nt, Salmonella enterica enterica serovar Typhi Ty2
cauaauuuuccccag

SEQ ID NO: 1799898 - RNA, 14 nt, Salmonella enterica enterica serovar Typhi Ty2
cauaauggcccagu

SEQ ID NO: 1799899 - RNA, 21 nt, Salmonella enterica enterica serovar Typhi Ty2
cauaauggcccaguguacugc

SEQ ID NO: 1799900 - RNA, 14 nt, Salmonella enterica enterica serovar Typhi Ty2
cauaauggaacugc

SEQ ID NO: 1799901 - RNA, 17 nt, Salmonella enterica enterica serovar Typhi Ty2
cauaaugguggaaugcc

SEQ ID NO: 1799902 - RNA, 22 nt, Salmonella enterica enterica serovar Typhi Ty2
cauaauggaacugccuggcuca

SEQ ID NO: 1799903 - RNA, 23 nt, Salmonella enterica enterica serovar Typhi Ty2
cauaaucgccgacuaauuauuuu

SEQ ID NO: 1799904 - RNA, 14 nt, Salmonella enterica enterica serovar Typhi Ty2
cauacauaaauccg

SEQ ID NO: 1799905 - RNA, 19 nt, Salmonella enterica enterica serovar Typhi Ty2
cauaccagcgaaaugcgaa

SEQ ID NO: 1799906 - RNA, 17 nt, Salmonella enterica enterica serovar Typhi Ty2
cauaccagccauaaaua

SEQ ID NO: 1799907 - RNA, 16 nt, Salmonella enterica enterica serovar Typhi Ty2
cauaccacaacagaau

SEQ ID NO: 1799908 - RNA, 18 nt, Salmonella enterica enterica serovar Typhi Ty2
cauacauuucgucaucgc

SEQ ID NO: 1799909 - RNA, 15 nt, Salmonella enterica enterica serovar Typhi Ty2
cauaauuuuugccuu

SEQ ID NO: 1799910 - RNA, 14 nt, Salmonella enterica enterica serovar Typhi Ty2
cauacacucaacca

SEQ ID NO: 1799911 - RNA, 19 nt, Salmonella enterica enterica serovar Typhi Ty2
cauacacugcauaaauauc

SEQ ID NO: 1799912 - RNA, 19 nt, Salmonella enterica enterica serovar Typhi Ty2
cauacacguaauacaugag

SEQ ID NO: 1799913 - RNA, 24 nt, Salmonella enterica enterica serovar Typhi Ty2
cauacacgccgggcacgcugacca

SEQ ID NO: 1799914 - RNA, 14 nt, Salmonella enterica enterica serovar Typhi Ty2
cauacagcacuucc

SEQ ID NO: 1799915 - RNA, 22 nt, Salmonella enterica enterica serovar Typhi Ty2
cauacgaucgcgcacaugcugu

SEQ ID NO: 1799916 - RNA, 21 nt, Salmonella enterica enterica serovar Typhi Ty2
cauaccuauaaaaaugaggua

SEQ ID NO: 1799917 - RNA, 19 nt, Salmonella enterica enterica serovar Typhi Ty2
cauaccgucgugaaucauc

SEQ ID NO: 1799918 - RNA, 21 nt, Salmonella enterica enterica serovar Typhi Ty2
cauaccugguuacucacgcga

SEQ ID NO: 1799919 - RNA, 17 nt, Salmonella enterica enterica serovar Typhi Ty2
cauaccuguuccucuuu

SEQ ID NO: 1799920 - RNA, 14 nt, Salmonella enterica enterica serovar Typhi Ty2
cauacccagguuug

SEQ ID NO: 1799921 - RNA, 13 nt, Salmonella enterica enterica serovar Typhi Ty2
cauacccuuccag

SEQ ID NO: 1799922 - RNA, 19 nt, Salmonella enterica enterica serovar Typhi Ty2
cauacccgcgcucuccggc

SEQ ID NO: 1799923 - RNA, 18 nt, Salmonella enterica enterica serovar Typhi Ty2
cauaccggacuccaggca

SEQ ID NO: 1799924 - RNA, 15 nt, Salmonella enterica enterica serovar Typhi Ty2
cauaccggagccugg

SEQ ID NO: 1799925 - RNA, 20 nt, Salmonella enterica enterica serovar Typhi Ty2
cauaccggugcgccccagca

SEQ ID NO: 1799926 - RNA, 19 nt, Salmonella enterica enterica serovar Typhi Ty2
cauaccgguguagcuggca

SEQ ID NO: 1799927 - RNA, 19 nt, Salmonella enterica enterica serovar Typhi Ty2
cauaccggugcgccccagc

SEQ ID NO: 1799928 - RNA, 20 nt, Salmonella enterica enterica serovar Typhi Ty2
caguuucucaaacacuucua

SEQ ID NO: 1799929 - RNA, 19 nt, Salmonella enterica enterica serovar Typhi Ty2
caguuucucgucauaguga

SEQ ID NO: 1799930 - RNA, 13 nt, Salmonella enterica enterica serovar Typhi Ty2
caguuugucauca

SEQ ID NO: 1799931 - RNA, 12 nt, Salmonella enterica enterica serovar Typhi Ty2
cauaaaaaaacg

SEQ ID NO: 1799932 - RNA, 18 nt, Salmonella enterica enterica serovar Typhi Ty2
cauaaaaaacaucaugcc

SEQ ID NO: 1799933 - RNA, 22 nt, Salmonella enterica enterica serovar Typhi Ty2
caguuuuuucaguagccgccgc

SEQ ID NO: 1799934 - RNA, 23 nt, Salmonella enterica enterica serovar Typhi Ty2
caguuuuuuacuuucaaaauacu

SEQ ID NO: 1799935 - RNA, 13 nt, Salmonella enterica enterica serovar Typhi Ty2
caguuuuuuccag

SEQ ID NO: 1799936 - RNA, 18 nt, Salmonella enterica enterica serovar Typhi Ty2
caguuuuugcauuauauu

SEQ ID NO: 1799937 - RNA, 23 nt, Salmonella enterica enterica serovar Typhi Ty2
caguuuacgagugcguucuucca

SEQ ID NO: 1799938 - RNA, 23 nt, Salmonella enterica enterica serovar Typhi Ty2
caguuuagagguuccccagccgc

SEQ ID NO: 1799939 - RNA, 17 nt, Salmonella enterica enterica serovar Typhi Ty2
caguuuagggaucaucu

SEQ ID NO: 1799940 - RNA, 13 nt, Salmonella enterica enterica serovar Typhi Ty2
caguuucggcccc

SEQ ID NO: 1799941 - RNA, 17 nt, Salmonella enterica enterica serovar Typhi Ty2
caguuggcuucagcaaa

SEQ ID NO: 1799942 - RNA, 18 nt, Salmonella enterica enterica serovar Typhi Ty2
caguuggcgaccgcugca

SEQ ID NO: 1799943 - RNA, 17 nt, Salmonella enterica enterica serovar Typhi Ty2
caguuggucgcguuuac

SEQ ID NO: 1799944 - RNA, 23 nt, Salmonella enterica enterica serovar Typhi Ty2
caguugguuagagcacaucacuc

SEQ ID NO: 1799945 - RNA, 16 nt, Salmonella enterica enterica serovar Typhi Ty2
caguuguuccagcagc

SEQ ID NO: 1799946 - RNA, 19 nt, Salmonella enterica enterica serovar Typhi Ty2
caguugucguggguucgaa

SEQ ID NO: 1799947 - RNA, 16 nt, Salmonella enterica enterica serovar Typhi Ty2
caguuccccgccgcgg

SEQ ID NO: 1799948 - RNA, 22 nt, Salmonella enterica enterica serovar Typhi Ty2
caguucgauaaucccggcgcgc

SEQ ID NO: 1799949 - RNA, 12 nt, Salmonella enterica enterica serovar Typhi Ty2
caguuccugugc

SEQ ID NO: 1799950 - RNA, 20 nt, Salmonella enterica enterica serovar Typhi Ty2
caguuccgccagacucagcc

SEQ ID NO: 1799951 - RNA, 21 nt, Salmonella enterica enterica serovar Typhi Ty2
caguucgccuucuucaucuuc

SEQ ID NO: 1799952 - RNA, 16 nt, Salmonella enterica enterica serovar Typhi Ty2
caguucguucugcguc

SEQ ID NO: 1799953 - RNA, 17 nt, Salmonella enterica enterica serovar Typhi Ty2
caguugaccaaacagca

SEQ ID NO: 1799954 - RNA, 17 nt, Salmonella enterica enterica serovar Typhi Ty2
caguugccuugccucac

SEQ ID NO: 1799955 - RNA, 15 nt, Salmonella enterica enterica serovar Typhi Ty2
caguuggcgaccgcu

SEQ ID NO: 1799956 - RNA, 13 nt, Salmonella enterica enterica serovar Typhi Ty2
caguugcuggauu

SEQ ID NO: 1799957 - RNA, 17 nt, Salmonella enterica enterica serovar Typhi Ty2
caguucauccacgcggg

SEQ ID NO: 1799958 - RNA, 19 nt, Salmonella enterica enterica serovar Typhi Ty2
caguucauccacgucauaa

SEQ ID NO: 1799959 - RNA, 23 nt, Salmonella enterica enterica serovar Typhi Ty2
caguucauauuugcuggcuugcu

SEQ ID NO: 1799960 - RNA, 12 nt, Salmonella enterica enterica serovar Typhi Ty2
caguucauuaac

SEQ ID NO: 1799961 - RNA, 16 nt, Salmonella enterica enterica serovar Typhi Ty2
caguucagcggucaua

SEQ ID NO: 1799962 - RNA, 17 nt, Salmonella enterica enterica serovar Typhi Ty2
caguucauuucaggcaa

SEQ ID NO: 1799963 - RNA, 17 nt, Salmonella enterica enterica serovar Typhi Ty2
caguuccaaucucuuuu

SEQ ID NO: 1799964 - RNA, 19 nt, Salmonella enterica enterica serovar Typhi Ty2
caguucauuucaggcaaag

SEQ ID NO: 1799965 - RNA, 17 nt, Salmonella enterica enterica serovar Typhi Ty2
caguucauucgccacca

SEQ ID NO: 1799966 - RNA, 13 nt, Salmonella enterica enterica serovar Typhi Ty2
caguucauuccgc

SEQ ID NO: 1799967 - RNA, 23 nt, Salmonella enterica enterica serovar Typhi Ty2
caguuauagcgcagauugaggcu

SEQ ID NO: 1799968 - RNA, 14 nt, Salmonella enterica enterica serovar Typhi Ty2
caguucagaaacgg

SEQ ID NO: 1799969 - RNA, 19 nt, Salmonella enterica enterica serovar Typhi Ty2
caguucacuccuaagagaa

SEQ ID NO: 1799970 - RNA, 16 nt, Salmonella enterica enterica serovar Typhi Ty2
caguucacgccgccgc

SEQ ID NO: 1799971 - RNA, 19 nt, Salmonella enterica enterica serovar Typhi Ty2
caguucaaacggcccggcg

SEQ ID NO: 1799972 - RNA, 17 nt, Salmonella enterica enterica serovar Typhi Ty2
caguguugauugaaacu

SEQ ID NO: 1799973 - RNA, 17 nt, Salmonella enterica enterica serovar Typhi Ty2
caguguuucccaacaau

SEQ ID NO: 1799974 - RNA, 14 nt, Salmonella enterica enterica serovar Typhi Ty2
cagugugccgucau

SEQ ID NO: 1799975 - RNA, 19 nt, Salmonella enterica enterica serovar Typhi Ty2
caguuaacagaaugcugaa

SEQ ID NO: 1799976 - RNA, 17 nt, Salmonella enterica enterica serovar Typhi Ty2
caguuaaauaaacaaaa

SEQ ID NO: 1799977 - RNA, 16 nt, Salmonella enterica enterica serovar Typhi Ty2
caguuaccccgaagcg

SEQ ID NO: 1799978 - RNA, 24 nt, Salmonella enterica enterica serovar Typhi Ty2
caguguacauagcuuugccacugg

SEQ ID NO: 1799979 - RNA, 16 nt, Salmonella enterica enterica serovar Typhi Ty2
caguguaaacgccaga

SEQ ID NO: 1799980 - RNA, 16 nt, Salmonella enterica enterica serovar Typhi Ty2
caguggccaucuucca

SEQ ID NO: 1799981 - RNA, 16 nt, Salmonella enterica enterica serovar Typhi Ty2
caguggacgcgucgcu

SEQ ID NO: 1799982 - RNA, 19 nt, Salmonella enterica enterica serovar Typhi Ty2
cagugggaaaacgugcccc

SEQ ID NO: 1799983 - RNA, 13 nt, Salmonella enterica enterica serovar Typhi Ty2
cagugggaaaauu

SEQ ID NO: 1799984 - RNA, 14 nt, Salmonella enterica enterica serovar Typhi Ty2
caguggaaaacagc

SEQ ID NO: 1799985 - RNA, 18 nt, Salmonella enterica enterica serovar Typhi Ty2
cagugcgucacuuuaacc

SEQ ID NO: 1799986 - RNA, 16 nt, Salmonella enterica enterica serovar Typhi Ty2
cagguauuaauccugc

SEQ ID NO: 1799987 - RNA, 13 nt, Salmonella enterica enterica serovar Typhi Ty2
cagguaucauaug

SEQ ID NO: 1799988 - RNA, 16 nt, Salmonella enterica enterica serovar Typhi Ty2
cagguauucaccaaaa

SEQ ID NO: 1799989 - RNA, 21 nt, Salmonella enterica enterica serovar Typhi Ty2
cagguaguuaccguauucugc

SEQ ID NO: 1799990 - RNA, 22 nt, Salmonella enterica enterica serovar Typhi Ty2
cagugcgcauacuaccgcugcg

SEQ ID NO: 1799991 - RNA, 12 nt, Salmonella enterica enterica serovar Typhi Ty2
cagugcgauacc

SEQ ID NO: 1799992 - RNA, 23 nt, Salmonella enterica enterica serovar Typhi Ty2
cagugcgaugggcuucagauguu

SEQ ID NO: 1799993 - RNA, 23 nt, Salmonella enterica enterica serovar Typhi Ty2
cagugccugauagcgcugugcua

SEQ ID NO: 1799994 - RNA, 23 nt, Salmonella enterica enterica serovar Typhi Ty2
cagcaacugcugcgcgugcugua

SEQ ID NO: 1799995 - RNA, 14 nt, Salmonella enterica enterica serovar Typhi Ty2
cagcaauaaaagga

SEQ ID NO: 1799996 - RNA, 23 nt, Salmonella enterica enterica serovar Typhi Ty2
cagcaagucgcgggcgcuaaacc

SEQ ID NO: 1799997 - RNA, 15 nt, Salmonella enterica enterica serovar Typhi Ty2
aaaaugcgcaaagca

SEQ ID NO: 1799998 - RNA, 14 nt, Salmonella enterica enterica serovar Typhi Ty2
cagcaacggcugau

SEQ ID NO: 1799999 - RNA, 14 nt, Salmonella enterica enterica serovar Typhi Ty2
aaaaugccccacga

SEQ ID NO: 1800000 - RNA, 20 nt, Salmonella enterica enterica serovar Typhi Ty2
cagcaaaucgggaaaaugau

SEQ ID NO: 1800001 - RNA, 16 nt, Salmonella enterica enterica serovar Typhi Ty2
cagcaacagaaguuca

SEQ ID NO: 1800002 - RNA, 14 nt, Salmonella enterica enterica serovar Typhi Ty2
cagcaaaucagcua

SEQ ID NO: 1800003 - RNA, 11 nt, Salmonella enterica enterica serovar Typhi Ty2
cagcaaauaau

SEQ ID NO: 1800004 - RNA, 15 nt, Salmonella enterica enterica serovar Typhi Ty2
cagcaaauacagaug

SEQ ID NO: 1800005 - RNA, 23 nt, Salmonella enterica enterica serovar Typhi Ty2
aaaaugaugacucauuaaaaaaa

SEQ ID NO: 1800006 - RNA, 23 nt, Salmonella enterica enterica serovar Typhi Ty2
cagcaacagugggcuaugaagag

SEQ ID NO: 1800007 - RNA, 17 nt, Salmonella enterica enterica serovar Typhi Ty2
cagcaacaguugcugga

SEQ ID NO: 1800008 - RNA, 20 nt, Salmonella enterica enterica serovar Typhi Ty2
aaaaugaggacacaguaaug

SEQ ID NO: 1800009 - RNA, 20 nt, Salmonella enterica enterica serovar Typhi Ty2
aaaaugaugccccagaacaa

SEQ ID NO: 1800010 - RNA, 17 nt, Salmonella enterica enterica serovar Typhi Ty2
cagaucaggucugagau

SEQ ID NO: 1800011 - RNA, 18 nt, Salmonella enterica enterica serovar Typhi Ty2
cagaucagcacgcgccgu

SEQ ID NO: 1800012 - RNA, 16 nt, Salmonella enterica enterica serovar Typhi Ty2
cagaucccagguaacc

SEQ ID NO: 1800013 - RNA, 14 nt, Salmonella enterica enterica serovar Typhi Ty2
cagauccuuuuucu

SEQ ID NO: 1800014 - RNA, 23 nt, Salmonella enterica enterica serovar Typhi Ty2
aaaaucggcgggcaucauaucca

SEQ ID NO: 1800015 - RNA, 19 nt, Salmonella enterica enterica serovar Typhi Ty2
aaaaucguuaaccagcggc

SEQ ID NO: 1800016 - RNA, 23 nt, Salmonella enterica enterica serovar Typhi Ty2
aaaaucuggcgagagcauugccu

SEQ ID NO: 1800017 - RNA, 19 nt, Salmonella enterica enterica serovar Typhi Ty2
cagcaaaacgcgcuaucaa

SEQ ID NO: 1800018 - RNA, 19 nt, Salmonella enterica enterica serovar Typhi Ty2
cagcaaaauaccggcagcg

SEQ ID NO: 1800019 - RNA, 15 nt, Salmonella enterica enterica serovar Typhi Ty2
cagcaaaauggcaau

SEQ ID NO: 1800020 - RNA, 22 nt, Salmonella enterica enterica serovar Typhi Ty2
cagcaaaaucacgcacacgucu

SEQ ID NO: 1800021 - RNA, 12 nt, Salmonella enterica enterica serovar Typhi Ty2
cagcaaaauggc

SEQ ID NO: 1800022 - RNA, 20 nt, Salmonella enterica enterica serovar Typhi Ty2
cagcaaacgccauagcaucg

SEQ ID NO: 1800023 - RNA, 22 nt, Salmonella enterica enterica serovar Typhi Ty2
cagcaaacgccauagcaucgac

SEQ ID NO: 1800024 - RNA, 17 nt, Salmonella enterica enterica serovar Typhi Ty2
cagauuccgaacucaug

SEQ ID NO: 1800025 - RNA, 14 nt, Salmonella enterica enterica serovar Typhi Ty2
cagauugagacaaa

SEQ ID NO: 1800026 - RNA, 22 nt, Salmonella enterica enterica serovar Typhi Ty2
cagauuuuuaauguccagcagu

SEQ ID NO: 1800027 - RNA, 18 nt, Salmonella enterica enterica serovar Typhi Ty2
cagcagcagagccggaac

SEQ ID NO: 1800028 - RNA, 22 nt, Salmonella enterica enterica serovar Typhi Ty2
aaaaugucuuuucgguauuuau

SEQ ID NO: 1800029 - RNA, 19 nt, Salmonella enterica enterica serovar Typhi Ty2
aaaauggucugccaguagc

SEQ ID NO: 1800030 - RNA, 14 nt, Salmonella enterica enterica serovar Typhi Ty2
cagcagauguggcg

SEQ ID NO: 1800031 - RNA, 18 nt, Salmonella enterica enterica serovar Typhi Ty2
cagcagauguggcggccc

SEQ ID NO: 1800032 - RNA, 13 nt, Salmonella enterica enterica serovar Typhi Ty2
cagcacuaacagc

SEQ ID NO: 1800033 - RNA, 23 nt, Salmonella enterica enterica serovar Typhi Ty2
cagcacuaacagcagcagcaaac

SEQ ID NO: 1800034 - RNA, 21 nt, Salmonella enterica enterica serovar Typhi Ty2
aaaauggcugauaaauccggu

SEQ ID NO: 1800035 - RNA, 17 nt, Salmonella enterica enterica serovar Typhi Ty2
cagcaccaucaugcaag

SEQ ID NO: 1800036 - RNA, 15 nt, Salmonella enterica enterica serovar Typhi Ty2
cagcaccaucaugca

SEQ ID NO: 1800037 - RNA, 13 nt, Salmonella enterica enterica serovar Typhi Ty2
cagcaccagcauu

SEQ ID NO: 1800038 - RNA, 15 nt, Salmonella enterica enterica serovar Typhi Ty2
cagcaccagcauuag

SEQ ID NO: 1800039 - RNA, 15 nt, Salmonella enterica enterica serovar Typhi Ty2
cagcaauauaugagc

SEQ ID NO: 1800040 - RNA, 16 nt, Salmonella enterica enterica serovar Typhi Ty2
cagcaccaacgccgcu

SEQ ID NO: 1800041 - RNA, 15 nt, Salmonella enterica enterica serovar Typhi Ty2
cagcacgcucaaaua

SEQ ID NO: 1800042 - RNA, 19 nt, Salmonella enterica enterica serovar Typhi Ty2
cagcacgcuuacccagcau

SEQ ID NO: 1800043 - RNA, 15 nt, Salmonella enterica enterica serovar Typhi Ty2
cagcaccgccgcgau

SEQ ID NO: 1800044 - RNA, 13 nt, Salmonella enterica enterica serovar Typhi Ty2
cagcaccuccagc

SEQ ID NO: 1800045 - RNA, 15 nt, Salmonella enterica enterica serovar Typhi Ty2
cagcaccuccagcgc

SEQ ID NO: 1800046 - RNA, 16 nt, Salmonella enterica enterica serovar Typhi Ty2
cagcaccuccagcgcc

SEQ ID NO: 1800047 - RNA, 17 nt, Salmonella enterica enterica serovar Typhi Ty2
cagauagggccaggcgc

SEQ ID NO: 1800048 - RNA, 19 nt, Salmonella enterica enterica serovar Typhi Ty2
cagauaguggcugaggccg

SEQ ID NO: 1800049 - RNA, 13 nt, Salmonella enterica enterica serovar Typhi Ty2
cagauaucgcgua

SEQ ID NO: 1800050 - RNA, 21 nt, Salmonella enterica enterica serovar Typhi Ty2
cagauauugcggaucagcaaa

SEQ ID NO: 1800051 - RNA, 15 nt, Salmonella enterica enterica serovar Typhi Ty2
cagaucaaaaaucug

SEQ ID NO: 1800052 - RNA, 19 nt, Salmonella enterica enterica serovar Typhi Ty2
aaaauccuuguugauaaaa

SEQ ID NO: 1800053 - RNA, 19 nt, Salmonella enterica enterica serovar Typhi Ty2
aaaauccugcacuuccagc

SEQ ID NO: 1800054 - RNA, 21 nt, Salmonella enterica enterica serovar Typhi Ty2
aaaauccucuaccggaaaaca

SEQ ID NO: 1800055 - RNA, 18 nt, Salmonella enterica enterica serovar Typhi Ty2
aaaaucccggcuggguuc

SEQ ID NO: 1800056 - RNA, 23 nt, Salmonella enterica enterica serovar Typhi Ty2
cagauacacgccuuccuccagca

SEQ ID NO: 1800057 - RNA, 15 nt, Salmonella enterica enterica serovar Typhi Ty2
cagauacgcgccggc

SEQ ID NO: 1800058 - RNA, 21 nt, Salmonella enterica enterica serovar Typhi Ty2
cagauaccgaccgugagaauc

SEQ ID NO: 1800059 - RNA, 19 nt, Salmonella enterica enterica serovar Typhi Ty2
cagauaccagcguugaauc

SEQ ID NO: 1800060 - RNA, 18 nt, Salmonella enterica enterica serovar Typhi Ty2
cagauaacaggcaguuuc

SEQ ID NO: 1800061 - RNA, 15 nt, Salmonella enterica enterica serovar Typhi Ty2
cagauaacaccagcg

SEQ ID NO: 1800062 - RNA, 23 nt, Salmonella enterica enterica serovar Typhi Ty2
cagauaaccgucggcgccggcgu

SEQ ID NO: 1800063 - RNA, 22 nt, Salmonella enterica enterica serovar Typhi Ty2
cagauaacgaaccaucauuaau

SEQ ID NO: 1800064 - RNA, 17 nt, Salmonella enterica enterica serovar Typhi Ty2
cagauaacccggcgcag

SEQ ID NO: 1800065 - RNA, 22 nt, Salmonella enterica enterica serovar Typhi Ty2
cagauaaugaucaacgcggcga

SEQ ID NO: 1800066 - RNA, 16 nt, Salmonella enterica enterica serovar Typhi Ty2
cagauacggcgcgucg

SEQ ID NO: 1800067 - RNA, 21 nt, Salmonella enterica enterica serovar Typhi Ty2
cagauagcccgccagcaccag

SEQ ID NO: 1800068 - RNA, 17 nt, Salmonella enterica enterica serovar Typhi Ty2
cagauagcccugagccc

SEQ ID NO: 1800069 - RNA, 18 nt, Salmonella enterica enterica serovar Typhi Ty2
cagauagcgaucgccgcu

SEQ ID NO: 1800070 - RNA, 15 nt, Salmonella enterica enterica serovar Typhi Ty2
cagauacuucaguuu

SEQ ID NO: 1800071 - RNA, 24 nt, Salmonella enterica enterica serovar Typhi Ty2
cagauaggcggcaaauaaagccag

SEQ ID NO: 1800072 - RNA, 15 nt, Salmonella enterica enterica serovar Typhi Ty2
cagauagcuuccaug

SEQ ID NO: 1800073 - RNA, 17 nt, Salmonella enterica enterica serovar Typhi Ty2
cagauagcgcugcgcca

SEQ ID NO: 1800074 - RNA, 22 nt, Salmonella enterica enterica serovar Typhi Ty2
cagaguaacccgauacccugag

SEQ ID NO: 1800075 - RNA, 12 nt, Salmonella enterica enterica serovar Typhi Ty2
cagaguacauuc

SEQ ID NO: 1800076 - RNA, 19 nt, Salmonella enterica enterica serovar Typhi Ty2
cagaggucucagguucgaa

SEQ ID NO: 1800077 - RNA, 16 nt, Salmonella enterica enterica serovar Typhi Ty2
cagaguaugcugcuaa

SEQ ID NO: 1800078 - RNA, 16 nt, Salmonella enterica enterica serovar Typhi Ty2
cagaggccugaaugca

SEQ ID NO: 1800079 - RNA, 18 nt, Salmonella enterica enterica serovar Typhi Ty2
cagagguaagauguucua

SEQ ID NO: 1800080 - RNA, 21 nt, Salmonella enterica enterica serovar Typhi Ty2
cagagcgacauggcccauuuc

SEQ ID NO: 1800081 - RNA, 15 nt, Salmonella enterica enterica serovar Typhi Ty2
cagagcggauaaaua

SEQ ID NO: 1800082 - RNA, 20 nt, Salmonella enterica enterica serovar Typhi Ty2
cagagcgcgcuggcaagcgc

SEQ ID NO: 1800083 - RNA, 21 nt, Salmonella enterica enterica serovar Typhi Ty2
aaaaucacuaagaccagcauc

SEQ ID NO: 1800084 - RNA, 20 nt, Salmonella enterica enterica serovar Typhi Ty2
cagacugguauagccuuuuu

SEQ ID NO: 1800085 - RNA, 18 nt, Salmonella enterica enterica serovar Typhi Ty2
cagacuguaaaucugccg

SEQ ID NO: 1800086 - RNA, 19 nt, Salmonella enterica enterica serovar Typhi Ty2
cagagauccacauugguuu

SEQ ID NO: 1800087 - RNA, 12 nt, Salmonella enterica enterica serovar Typhi Ty2
cagagcaacgag

SEQ ID NO: 1800088 - RNA, 16 nt, Salmonella enterica enterica serovar Typhi Ty2
cagaaugccagcgccg

SEQ ID NO: 1800089 - RNA, 15 nt, Salmonella enterica enterica serovar Typhi Ty2
cagaaugccagcgcc

SEQ ID NO: 1800090 - RNA, 14 nt, Salmonella enterica enterica serovar Typhi Ty2
cagaaugcaaaacu

SEQ ID NO: 1800091 - RNA, 24 nt, Salmonella enterica enterica serovar Typhi Ty2
cagaaugauaaugccgcugauaau

SEQ ID NO: 1800092 - RNA, 19 nt, Salmonella enterica enterica serovar Typhi Ty2
cagaaucagcgugccggua

SEQ ID NO: 1800093 - RNA, 16 nt, Salmonella enterica enterica serovar Typhi Ty2
cagacaacgccgccug

SEQ ID NO: 1800094 - RNA, 14 nt, Salmonella enterica enterica serovar Typhi Ty2
cagacaucaucgaa

SEQ ID NO: 1800095 - RNA, 18 nt, Salmonella enterica enterica serovar Typhi Ty2
cagacaaagggcacaccg

SEQ ID NO: 1800096 - RNA, 15 nt, Salmonella enterica enterica serovar Typhi Ty2
cagaauuuuuaacca

SEQ ID NO: 1800097 - RNA, 13 nt, Salmonella enterica enterica serovar Typhi Ty2
cagaauaccagaa

SEQ ID NO: 1800098 - RNA, 20 nt, Salmonella enterica enterica serovar Typhi Ty2
cagaauaaacggcagggcag

SEQ ID NO: 1800099 - RNA, 18 nt, Salmonella enterica enterica serovar Typhi Ty2
cagaauauccgguacacc

SEQ ID NO: 1800100 - RNA, 13 nt, Salmonella enterica enterica serovar Typhi Ty2
cagaaucacccca

SEQ ID NO: 1800101 - RNA, 19 nt, Salmonella enterica enterica serovar Typhi Ty2
cagacucgcuucacgcgga

SEQ ID NO: 1800102 - RNA, 15 nt, Salmonella enterica enterica serovar Typhi Ty2
cagacucgcuucacg

SEQ ID NO: 1800103 - RNA, 19 nt, Salmonella enterica enterica serovar Typhi Ty2
cagacugaauaaaggguuu

SEQ ID NO: 1800104 - RNA, 15 nt, Salmonella enterica enterica serovar Typhi Ty2
cagacugcacuuccu

SEQ ID NO: 1800105 - RNA, 15 nt, Salmonella enterica enterica serovar Typhi Ty2
cagacugcgccacgu

SEQ ID NO: 1800106 - RNA, 20 nt, Salmonella enterica enterica serovar Typhi Ty2
cagacucgcucccuuccccc

SEQ ID NO: 1800107 - RNA, 16 nt, Salmonella enterica enterica serovar Typhi Ty2
cagaccuguaaaaaaa

SEQ ID NO: 1800108 - RNA, 15 nt, Salmonella enterica enterica serovar Typhi Ty2
cagaccuguaaaaaa

SEQ ID NO: 1800109 - RNA, 18 nt, Salmonella enterica enterica serovar Typhi Ty2
cagacggcuccagcgcca

SEQ ID NO: 1800110 - RNA, 19 nt, Salmonella enterica enterica serovar Typhi Ty2
cagacgaccguaauagcaa

SEQ ID NO: 1800111 - RNA, 22 nt, Salmonella enterica enterica serovar Typhi Ty2
cagacgcuucauugguuaauuc

SEQ ID NO: 1800112 - RNA, 13 nt, Salmonella enterica enterica serovar Typhi Ty2
cagaccaauagag

SEQ ID NO: 1800113 - RNA, 22 nt, Salmonella enterica enterica serovar Typhi Ty2
cagaccaauagagagcgacagc

SEQ ID NO: 1800114 - RNA, 17 nt, Salmonella enterica enterica serovar Typhi Ty2
cagaccaaagucaaacu

SEQ ID NO: 1800115 - RNA, 15 nt, Salmonella enterica enterica serovar Typhi Ty2
cagacccgcaaacca

SEQ ID NO: 1800116 - RNA, 20 nt, Salmonella enterica enterica serovar Typhi Ty2
cagaccgaucucaugcaacu

SEQ ID NO: 1800117 - RNA, 23 nt, Salmonella enterica enterica serovar Typhi Ty2
cagacccaguacaaacaaauaaa

SEQ ID NO: 1800118 - RNA, 14 nt, Salmonella enterica enterica serovar Typhi Ty2
cagaccgaucucau

SEQ ID NO: 1800119 - RNA, 14 nt, Salmonella enterica enterica serovar Typhi Ty2
cagaccucugcaaa

SEQ ID NO: 1800120 - RNA, 23 nt, Salmonella enterica enterica serovar Typhi Ty2
cagaccugaauauucggcuccag

SEQ ID NO: 1800121 - RNA, 21 nt, Salmonella enterica enterica serovar Typhi Ty2
cagaccucguucggcgcaccu

SEQ ID NO: 1800122 - RNA, 20 nt, Salmonella enterica enterica serovar Typhi Ty2
cagaccgcuuaacuccggcg

SEQ ID NO: 1800123 - RNA, 21 nt, Salmonella enterica enterica serovar Typhi Ty2
cagaccgcugcggaacaccag

SEQ ID NO: 1800124 - RNA, 17 nt, Salmonella enterica enterica serovar Typhi Ty2
cagaccggcaucucauc

SEQ ID NO: 1800125 - RNA, 20 nt, Salmonella enterica enterica serovar Typhi Ty2
cagaccggcaucucaucuug

SEQ ID NO: 1800126 - RNA, 21 nt, Salmonella enterica enterica serovar Typhi Ty2
cagaccggcaucucaucuugc

SEQ ID NO: 1800127 - RNA, 20 nt, Salmonella enterica enterica serovar Typhi Ty2
cagaagugccaguaacucau

SEQ ID NO: 1800128 - RNA, 23 nt, Salmonella enterica enterica serovar Typhi Ty2
cagaaggcuugauacugaggauu

SEQ ID NO: 1800129 - RNA, 19 nt, Salmonella enterica enterica serovar Typhi Ty2
cagaaggcgaacauaagag

SEQ ID NO: 1800130 - RNA, 12 nt, Salmonella enterica enterica serovar Typhi Ty2
cagaaggcaaaa

SEQ ID NO: 1800131 - RNA, 15 nt, Salmonella enterica enterica serovar Typhi Ty2
cagaaggcaugggga

SEQ ID NO: 1800132 - RNA, 16 nt, Salmonella enterica enterica serovar Typhi Ty2
cagaagaaucugccuu

SEQ ID NO: 1800133 - RNA, 15 nt, Salmonella enterica enterica serovar Typhi Ty2
cagaagaaucugccu

SEQ ID NO: 1800134 - RNA, 14 nt, Salmonella enterica enterica serovar Typhi Ty2
cagaagcuaaggga

SEQ ID NO: 1800135 - RNA, 16 nt, Salmonella enterica enterica serovar Typhi Ty2
cagaagacagaagcug

SEQ ID NO: 1800136 - RNA, 23 nt, Salmonella enterica enterica serovar Typhi Ty2
cagaagaaaaucaacacgucgau

SEQ ID NO: 1800137 - RNA, 17 nt, Salmonella enterica enterica serovar Typhi Ty2
cagaacugcgaaaucac

SEQ ID NO: 1800138 - RNA, 15 nt, Salmonella enterica enterica serovar Typhi Ty2
cagaaccacuugaac

SEQ ID NO: 1800139 - RNA, 13 nt, Salmonella enterica enterica serovar Typhi Ty2
cagaaccauuucc

SEQ ID NO: 1800140 - RNA, 18 nt, Salmonella enterica enterica serovar Typhi Ty2
cagaaccccaucgccuga

SEQ ID NO: 1800141 - RNA, 13 nt, Salmonella enterica enterica serovar Typhi Ty2
cagaacaucaagc

SEQ ID NO: 1800142 - RNA, 14 nt, Salmonella enterica enterica serovar Typhi Ty2
cagaacucaucuuc

SEQ ID NO: 1800143 - RNA, 21 nt, Salmonella enterica enterica serovar Typhi Ty2
cagaacucacauauucaauaa

SEQ ID NO: 1800144 - RNA, 19 nt, Salmonella enterica enterica serovar Typhi Ty2
cagaacgcuuuugcgcacu

SEQ ID NO: 1800145 - RNA, 15 nt, Salmonella enterica enterica serovar Typhi Ty2
cagaacgagaggagg

SEQ ID NO: 1800146 - RNA, 21 nt, Salmonella enterica enterica serovar Typhi Ty2
cacuuuucuuuccugcaaauu

SEQ ID NO: 1800147 - RNA, 14 nt, Salmonella enterica enterica serovar Typhi Ty2
cagaaaaagccccc

SEQ ID NO: 1800148 - RNA, 15 nt, Salmonella enterica enterica serovar Typhi Ty2
cagaaaaagccccca

SEQ ID NO: 1800149 - RNA, 19 nt, Salmonella enterica enterica serovar Typhi Ty2
cacuuuuggcgacaggaac

SEQ ID NO: 1800150 - RNA, 15 nt, Salmonella enterica enterica serovar Typhi Ty2
cacuuugcgcugcgc

SEQ ID NO: 1800151 - RNA, 17 nt, Salmonella enterica enterica serovar Typhi Ty2
cacuuuuaccggcgucc

SEQ ID NO: 1800152 - RNA, 19 nt, Salmonella enterica enterica serovar Typhi Ty2
cagaaaauccuucagcguu

SEQ ID NO: 1800153 - RNA, 16 nt, Salmonella enterica enterica serovar Typhi Ty2
cagaaaagaaccgacu

SEQ ID NO: 1800154 - RNA, 15 nt, Salmonella enterica enterica serovar Typhi Ty2
cagaaaaccggcaaa

SEQ ID NO: 1800155 - RNA, 14 nt, Salmonella enterica enterica serovar Typhi Ty2
cagaaaggaugccc

SEQ ID NO: 1800156 - RNA, 17 nt, Salmonella enterica enterica serovar Typhi Ty2
cagaaagcaacagcaag

SEQ ID NO: 1800157 - RNA, 21 nt, Salmonella enterica enterica serovar Typhi Ty2
cagaaaaucuggcgagagcau

SEQ ID NO: 1800158 - RNA, 19 nt, Salmonella enterica enterica serovar Typhi Ty2
aaaauauccgccaucgaca

SEQ ID NO: 1800159 - RNA, 20 nt, Salmonella enterica enterica serovar Typhi Ty2
aaaauaucauuaaaucaaaa

SEQ ID NO: 1800160 - RNA, 13 nt, Salmonella enterica enterica serovar Typhi Ty2
aaaauauccugua

SEQ ID NO: 1800161 - RNA, 22 nt, Salmonella enterica enterica serovar Typhi Ty2
cacuuuaccaggcauaauggaa

SEQ ID NO: 1800162 - RNA, 17 nt, Salmonella enterica enterica serovar Typhi Ty2
cacuuuaaagcccagca

SEQ ID NO: 1800163 - RNA, 15 nt, Salmonella enterica enterica serovar Typhi Ty2
cacuuccgccucgcc

SEQ ID NO: 1800164 - RNA, 15 nt, Salmonella enterica enterica serovar Typhi Ty2
cacuuccggugucca

SEQ ID NO: 1800165 - RNA, 17 nt, Salmonella enterica enterica serovar Typhi Ty2
cacuuccgccaccacgc

SEQ ID NO: 1800166 - RNA, 18 nt, Salmonella enterica enterica serovar Typhi Ty2
cacuuccgccaccacgcc

SEQ ID NO: 1800167 - RNA, 21 nt, Salmonella enterica enterica serovar Typhi Ty2
cacuucaugccgaacagguua

SEQ ID NO: 1800168 - RNA, 16 nt, Salmonella enterica enterica serovar Typhi Ty2
cacuuccagccacggc

SEQ ID NO: 1800169 - RNA, 13 nt, Salmonella enterica enterica serovar Typhi Ty2
cacuuccccugcc

SEQ ID NO: 1800170 - RNA, 15 nt, Salmonella enterica enterica serovar Typhi Ty2
cacuucgaaacgauc

SEQ ID NO: 1800171 - RNA, 15 nt, Salmonella enterica enterica serovar Typhi Ty2
cacuuccauccaugu

SEQ ID NO: 1800172 - RNA, 16 nt, Salmonella enterica enterica serovar Typhi Ty2
cacuucacaaacaauu

SEQ ID NO: 1800173 - RNA, 19 nt, Salmonella enterica enterica serovar Typhi Ty2
cacuucacacgaacuuuau

SEQ ID NO: 1800174 - RNA, 13 nt, Salmonella enterica enterica serovar Typhi Ty2
cacuucugacaga

SEQ ID NO: 1800175 - RNA, 23 nt, Salmonella enterica enterica serovar Typhi Ty2
cacuucuucgcgaucgugauaaa

SEQ ID NO: 1800176 - RNA, 21 nt, Salmonella enterica enterica serovar Typhi Ty2
cacuugagaaauuauuuuaaa

SEQ ID NO: 1800177 - RNA, 22 nt, Salmonella enterica enterica serovar Typhi Ty2
cacuugccgaguggaaucagcc

SEQ ID NO: 1800178 - RNA, 22 nt, Salmonella enterica enterica serovar Typhi Ty2
cacuugagaaauuauuuuaaau

SEQ ID NO: 1800179 - RNA, 14 nt, Salmonella enterica enterica serovar Typhi Ty2
cacuguaaaaggga

SEQ ID NO: 1800180 - RNA, 13 nt, Salmonella enterica enterica serovar Typhi Ty2
cacuguaaaaggg

SEQ ID NO: 1800181 - RNA, 20 nt, Salmonella enterica enterica serovar Typhi Ty2
cacugucaugguuauuuugu

SEQ ID NO: 1800182 - RNA, 21 nt, Salmonella enterica enterica serovar Typhi Ty2
cacuggaugacgcuguucaaa

SEQ ID NO: 1800183 - RNA, 23 nt, Salmonella enterica enterica serovar Typhi Ty2
cacuggcgagcggcaccggacau

SEQ ID NO: 1800184 - RNA, 16 nt, Salmonella enterica enterica serovar Typhi Ty2
cacuggcccccuguuc

SEQ ID NO: 1800185 - RNA, 22 nt, Salmonella enterica enterica serovar Typhi Ty2
cacuggcguagucucccuccug

SEQ ID NO: 1800186 - RNA, 18 nt, Salmonella enterica enterica serovar Typhi Ty2
cacuuaggcagccaggca

SEQ ID NO: 1800187 - RNA, 11 nt, Salmonella enterica enterica serovar Typhi Ty2
cacuuaugguc

SEQ ID NO: 1800188 - RNA, 23 nt, Salmonella enterica enterica serovar Typhi Ty2
cacuuaauacucgccccguuccu

SEQ ID NO: 1800189 - RNA, 22 nt, Salmonella enterica enterica serovar Typhi Ty2
cacuguuugcugacaaucugcu

SEQ ID NO: 1800190 - RNA, 21 nt, Salmonella enterica enterica serovar Typhi Ty2
cacuguuuuuagccuguuauu

SEQ ID NO: 1800191 - RNA, 20 nt, Salmonella enterica enterica serovar Typhi Ty2
cacuguucguccauaaaggc

SEQ ID NO: 1800192 - RNA, 21 nt, Salmonella enterica enterica serovar Typhi Ty2
cacuguuuaaugcuuucaaua

SEQ ID NO: 1800193 - RNA, 15 nt, Salmonella enterica enterica serovar Typhi Ty2
cacuguucagaaauc

SEQ ID NO: 1800194 - RNA, 12 nt, Salmonella enterica enterica serovar Typhi Ty2
cacucauccagc

SEQ ID NO: 1800195 - RNA, 15 nt, Salmonella enterica enterica serovar Typhi Ty2
cacucauccagacca

SEQ ID NO: 1800196 - RNA, 16 nt, Salmonella enterica enterica serovar Typhi Ty2
cacucaggcagauggu

SEQ ID NO: 1800197 - RNA, 22 nt, Salmonella enterica enterica serovar Typhi Ty2
cacucagaaaauuauuuuaaau

SEQ ID NO: 1800198 - RNA, 16 nt, Salmonella enterica enterica serovar Typhi Ty2
cacucacaaaacuauu

SEQ ID NO: 1800199 - RNA, 19 nt, Salmonella enterica enterica serovar Typhi Ty2
cacucacaaaacuauuuuc

SEQ ID NO: 1800200 - RNA, 19 nt, Salmonella enterica enterica serovar Typhi Ty2
cacucaaucauugucauua

SEQ ID NO: 1800201 - RNA, 14 nt, Salmonella enterica enterica serovar Typhi Ty2
cacucaaccaacca

SEQ ID NO: 1800202 - RNA, 18 nt, Salmonella enterica enterica serovar Typhi Ty2
cacuacuacaccacccgu

SEQ ID NO: 1800203 - RNA, 22 nt, Salmonella enterica enterica serovar Typhi Ty2
cacuacgguccaguugcccucu

SEQ ID NO: 1800204 - RNA, 16 nt, Salmonella enterica enterica serovar Typhi Ty2
cacuacggguuuuugu

SEQ ID NO: 1800205 - RNA, 18 nt, Salmonella enterica enterica serovar Typhi Ty2
cacuacggguuuuugugu

SEQ ID NO: 1800206 - RNA, 17 nt, Salmonella enterica enterica serovar Typhi Ty2
cacuagcacuacggcaa

SEQ ID NO: 1800207 - RNA, 16 nt, Salmonella enterica enterica serovar Typhi Ty2
cacguuaaacaccuca

SEQ ID NO: 1800208 - RNA, 17 nt, Salmonella enterica enterica serovar Typhi Ty2
cacgugguacacaauca

SEQ ID NO: 1800209 - RNA, 18 nt, Salmonella enterica enterica serovar Typhi Ty2
cacguuacccgccagucg

SEQ ID NO: 1800210 - RNA, 23 nt, Salmonella enterica enterica serovar Typhi Ty2
cacguuccauuucagcgagugcg

SEQ ID NO: 1800211 - RNA, 22 nt, Salmonella enterica enterica serovar Typhi Ty2
cacguugccguaggcgacgcca

SEQ ID NO: 1800212 - RNA, 16 nt, Salmonella enterica enterica serovar Typhi Ty2
cacguuuugcagcgcc

SEQ ID NO: 1800213 - RNA, 13 nt, Salmonella enterica enterica serovar Typhi Ty2
cacguuuuuacuc

SEQ ID NO: 1800214 - RNA, 13 nt, Salmonella enterica enterica serovar Typhi Ty2
cacuaccagaaac

SEQ ID NO: 1800215 - RNA, 14 nt, Salmonella enterica enterica serovar Typhi Ty2
cacuaauuugaguc

SEQ ID NO: 1800216 - RNA, 15 nt, Salmonella enterica enterica serovar Typhi Ty2
cacuaccgggcagca

SEQ ID NO: 1800217 - RNA, 19 nt, Salmonella enterica enterica serovar Typhi Ty2
cacuaauccccauuuuuuu

SEQ ID NO: 1800218 - RNA, 18 nt, Salmonella enterica enterica serovar Typhi Ty2
cacuaauccccauuuuuu

SEQ ID NO: 1800219 - RNA, 15 nt, Salmonella enterica enterica serovar Typhi Ty2
cacuccccagaauga

SEQ ID NO: 1800220 - RNA, 23 nt, Salmonella enterica enterica serovar Typhi Ty2
cacucccgauucaacguuucgcu

SEQ ID NO: 1800221 - RNA, 17 nt, Salmonella enterica enterica serovar Typhi Ty2
cacuccuaagagaaaac

SEQ ID NO: 1800222 - RNA, 21 nt, Salmonella enterica enterica serovar Typhi Ty2
cacucgcuuccuuuauugguu

SEQ ID NO: 1800223 - RNA, 14 nt, Salmonella enterica enterica serovar Typhi Ty2
cacucgcucauuug

SEQ ID NO: 1800224 - RNA, 16 nt, Salmonella enterica enterica serovar Typhi Ty2
cacucucuuguauuac

SEQ ID NO: 1800225 - RNA, 20 nt, Salmonella enterica enterica serovar Typhi Ty2
cacucuucgggaauggggaa

SEQ ID NO: 1800226 - RNA, 14 nt, Salmonella enterica enterica serovar Typhi Ty2
cacugaagaggaga

SEQ ID NO: 1800227 - RNA, 22 nt, Salmonella enterica enterica serovar Typhi Ty2
cacugaaaaauaauuacuaucu

SEQ ID NO: 1800228 - RNA, 14 nt, Salmonella enterica enterica serovar Typhi Ty2
cacugaaccugccu

SEQ ID NO: 1800229 - RNA, 23 nt, Salmonella enterica enterica serovar Typhi Ty2
cacugacauuuaaggcgcggccu

SEQ ID NO: 1800230 - RNA, 19 nt, Salmonella enterica enterica serovar Typhi Ty2
cacugaauuacugcguaaa

SEQ ID NO: 1800231 - RNA, 18 nt, Salmonella enterica enterica serovar Typhi Ty2
cacugauaccccagcgau

SEQ ID NO: 1800232 - RNA, 18 nt, Salmonella enterica enterica serovar Typhi Ty2
cacugacuauccacagcg

SEQ ID NO: 1800233 - RNA, 21 nt, Salmonella enterica enterica serovar Typhi Ty2
cacugacucuuccgggcgcga

SEQ ID NO: 1800234 - RNA, 15 nt, Salmonella enterica enterica serovar Typhi Ty2
cacugacuauccaca

SEQ ID NO: 1800235 - RNA, 18 nt, Salmonella enterica enterica serovar Typhi Ty2
cacugcaauuucugcugg

SEQ ID NO: 1800236 - RNA, 21 nt, Salmonella enterica enterica serovar Typhi Ty2
cacugauggaguuucaucagc

SEQ ID NO: 1800237 - RNA, 21 nt, Salmonella enterica enterica serovar Typhi Ty2
cacugcauaaauaucugcauu

SEQ ID NO: 1800238 - RNA, 19 nt, Salmonella enterica enterica serovar Typhi Ty2
cacugcgcuuauccggccu

SEQ ID NO: 1800239 - RNA, 21 nt, Salmonella enterica enterica serovar Typhi Ty2
cacugcggagguuucuuuuuc

SEQ ID NO: 1800240 - RNA, 12 nt, Salmonella enterica enterica serovar Typhi Ty2
cacugcgccgcc

SEQ ID NO: 1800241 - RNA, 16 nt, Salmonella enterica enterica serovar Typhi Ty2
cacuggaaacagccaa

SEQ ID NO: 1800242 - RNA, 17 nt, Salmonella enterica enterica serovar Typhi Ty2
cacuggaaacagccaau

SEQ ID NO: 1800243 - RNA, 23 nt, Salmonella enterica enterica serovar Typhi Ty2
cacugcuguguccaggucaucac

SEQ ID NO: 1800244 - RNA, 23 nt, Salmonella enterica enterica serovar Typhi Ty2
cacugcgaacgcaucaaagccac

SEQ ID NO: 1800245 - RNA, 18 nt, Salmonella enterica enterica serovar Typhi Ty2
cacugcccucaaguuaug

SEQ ID NO: 1800246 - RNA, 21 nt, Salmonella enterica enterica serovar Typhi Ty2
cacugcccucaaguuauguua

SEQ ID NO: 1800247 - RNA, 15 nt, Salmonella enterica enterica serovar Typhi Ty2
cacugcccgccgcca

SEQ ID NO: 1800248 - RNA, 14 nt, Salmonella enterica enterica serovar Typhi Ty2
cagcguccggagca

SEQ ID NO: 1800249 - RNA, 22 nt, Salmonella enterica enterica serovar Typhi Ty2
cagcguccgccaucgccucgau

SEQ ID NO: 1800250 - RNA, 16 nt, Salmonella enterica enterica serovar Typhi Ty2
cagcgucgcaugggua

SEQ ID NO: 1800251 - RNA, 20 nt, Salmonella enterica enterica serovar Typhi Ty2
cagcgucaggaacgcggcgc

SEQ ID NO: 1800252 - RNA, 15 nt, Salmonella enterica enterica serovar Typhi Ty2
cagcgucaucagauc

SEQ ID NO: 1800253 - RNA, 18 nt, Salmonella enterica enterica serovar Typhi Ty2
cagcgucaucaggccauu

SEQ ID NO: 1800254 - RNA, 12 nt, Salmonella enterica enterica serovar Typhi Ty2
cagcgucugccc

SEQ ID NO: 1800255 - RNA, 18 nt, Salmonella enterica enterica serovar Typhi Ty2
cagcgucugcccuccuga

SEQ ID NO: 1800256 - RNA, 15 nt, Salmonella enterica enterica serovar Typhi Ty2
cagcgugacccagac

SEQ ID NO: 1800257 - RNA, 14 nt, Salmonella enterica enterica serovar Typhi Ty2
cagcgucuuccugu

SEQ ID NO: 1800258 - RNA, 21 nt, Salmonella enterica enterica serovar Typhi Ty2
cagcgugaaacgcccuuccca

SEQ ID NO: 1800259 - RNA, 23 nt, Salmonella enterica enterica serovar Typhi Ty2
cagcgugaguuaugacggggaac

SEQ ID NO: 1800260 - RNA, 21 nt, Salmonella enterica enterica serovar Typhi Ty2
cagcguuacugcaacugcgcg

SEQ ID NO: 1800261 - RNA, 14 nt, Salmonella enterica enterica serovar Typhi Ty2
cagcguugaccagc

SEQ ID NO: 1800262 - RNA, 16 nt, Salmonella enterica enterica serovar Typhi Ty2
cagcguggaugaacuc

SEQ ID NO: 1800263 - RNA, 18 nt, Salmonella enterica enterica serovar Typhi Ty2
cagcgugccuucaaauau

SEQ ID NO: 1800264 - RNA, 18 nt, Salmonella enterica enterica serovar Typhi Ty2
aaaauucccggcggaaau

SEQ ID NO: 1800265 - RNA, 22 nt, Salmonella enterica enterica serovar Typhi Ty2
cagcgguuacuuuugaacauaa

SEQ ID NO: 1800266 - RNA, 22 nt, Salmonella enterica enterica serovar Typhi Ty2
cagcgguccaauaaacgccagg

SEQ ID NO: 1800267 - RNA, 21 nt, Salmonella enterica enterica serovar Typhi Ty2
cagcguaccugcggcaauggc

SEQ ID NO: 1800268 - RNA, 21 nt, Salmonella enterica enterica serovar Typhi Ty2
cagcguacaauggcaggcaua

SEQ ID NO: 1800269 - RNA, 21 nt, Salmonella enterica enterica serovar Typhi Ty2
cagcguaauuguugccccgcu

SEQ ID NO: 1800270 - RNA, 19 nt, Salmonella enterica enterica serovar Typhi Ty2
cagcguaagucugauaaac

SEQ ID NO: 1800271 - RNA, 16 nt, Salmonella enterica enterica serovar Typhi Ty2
cagcguauugagcugg

SEQ ID NO: 1800272 - RNA, 23 nt, Salmonella enterica enterica serovar Typhi Ty2
aaaauuagacaagcaguucugaa

SEQ ID NO: 1800273 - RNA, 19 nt, Salmonella enterica enterica serovar Typhi Ty2
aaaauuaugaauaaccauc

SEQ ID NO: 1800274 - RNA, 17 nt, Salmonella enterica enterica serovar Typhi Ty2
cagcgggccgcugaugu

SEQ ID NO: 1800275 - RNA, 15 nt, Salmonella enterica enterica serovar Typhi Ty2
aaaauuauuuuuacu

SEQ ID NO: 1800276 - RNA, 15 nt, Salmonella enterica enterica serovar Typhi Ty2
aaaauuauuuuaaau

SEQ ID NO: 1800277 - RNA, 15 nt, Salmonella enterica enterica serovar Typhi Ty2
aaaauuauauucuaa

SEQ ID NO: 1800278 - RNA, 21 nt, Salmonella enterica enterica serovar Typhi Ty2
cagcgggcuaugcugaagcag

SEQ ID NO: 1800279 - RNA, 14 nt, Salmonella enterica enterica serovar Typhi Ty2
cagcgcauggaaga

SEQ ID NO: 1800280 - RNA, 21 nt, Salmonella enterica enterica serovar Typhi Ty2
cagcgcaucucccugccagug

SEQ ID NO: 1800281 - RNA, 13 nt, Salmonella enterica enterica serovar Typhi Ty2
cagcgccugcgcu

SEQ ID NO: 1800282 - RNA, 23 nt, Salmonella enterica enterica serovar Typhi Ty2
cagcgcauugccuuucgcgcgau

SEQ ID NO: 1800283 - RNA, 15 nt, Salmonella enterica enterica serovar Typhi Ty2
cagcgcgcuccagac

SEQ ID NO: 1800284 - RNA, 12 nt, Salmonella enterica enterica serovar Typhi Ty2
cagcgcgcggcu

SEQ ID NO: 1800285 - RNA, 15 nt, Salmonella enterica enterica serovar Typhi Ty2
cagcgccuguugauu

SEQ ID NO: 1800286 - RNA, 17 nt, Salmonella enterica enterica serovar Typhi Ty2
cagcgcgcuccagacca

SEQ ID NO: 1800287 - RNA, 15 nt, Salmonella enterica enterica serovar Typhi Ty2
cagcgcggcacacag

SEQ ID NO: 1800288 - RNA, 19 nt, Salmonella enterica enterica serovar Typhi Ty2
cagcgcuaacggcgguacc

SEQ ID NO: 1800289 - RNA, 15 nt, Salmonella enterica enterica serovar Typhi Ty2
cagcgcuuucaccgc

SEQ ID NO: 1800290 - RNA, 11 nt, Salmonella enterica enterica serovar Typhi Ty2
cagcgcuuugc

SEQ ID NO: 1800291 - RNA, 18 nt, Salmonella enterica enterica serovar Typhi Ty2
cagcgcuugugccugcug

SEQ ID NO: 1800292 - RNA, 20 nt, Salmonella enterica enterica serovar Typhi Ty2
cagcgcuuuugccgcgccca

SEQ ID NO: 1800293 - RNA, 16 nt, Salmonella enterica enterica serovar Typhi Ty2
cagcgcuuuugccgcg

SEQ ID NO: 1800294 - RNA, 22 nt, Salmonella enterica enterica serovar Typhi Ty2
cagcgcuuugccgcugcugccu

SEQ ID NO: 1800295 - RNA, 13 nt, Salmonella enterica enterica serovar Typhi Ty2
cagcggaaucccc

SEQ ID NO: 1800296 - RNA, 20 nt, Salmonella enterica enterica serovar Typhi Ty2
cagcggaauccccgccgcca

SEQ ID NO: 1800297 - RNA, 17 nt, Salmonella enterica enterica serovar Typhi Ty2
cagcggacggcuaauau

SEQ ID NO: 1800298 - RNA, 19 nt, Salmonella enterica enterica serovar Typhi Ty2
cagcggauuacgcgccugc

SEQ ID NO: 1800299 - RNA, 24 nt, Salmonella enterica enterica serovar Typhi Ty2
cagcgcggccugcgugcgccguga

SEQ ID NO: 1800300 - RNA, 18 nt, Salmonella enterica enterica serovar Typhi Ty2
cagcgcguccaauagccc

SEQ ID NO: 1800301 - RNA, 18 nt, Salmonella enterica enterica serovar Typhi Ty2
cagcgcguccagcccgcu

SEQ ID NO: 1800302 - RNA, 12 nt, Salmonella enterica enterica serovar Typhi Ty2
cagcgcguccuu

SEQ ID NO: 1800303 - RNA, 15 nt, Salmonella enterica enterica serovar Typhi Ty2
cagcgcuacccgcug

SEQ ID NO: 1800304 - RNA, 17 nt, Salmonella enterica enterica serovar Typhi Ty2
cagcgcuaucaggaaga

SEQ ID NO: 1800305 - RNA, 18 nt, Salmonella enterica enterica serovar Typhi Ty2
cagcgcuaucaggcacug

SEQ ID NO: 1800306 - RNA, 20 nt, Salmonella enterica enterica serovar Typhi Ty2
cagcgcuugccgcagcgcag

SEQ ID NO: 1800307 - RNA, 21 nt, Salmonella enterica enterica serovar Typhi Ty2
cagcggcguaucuuccagcgu

SEQ ID NO: 1800308 - RNA, 15 nt, Salmonella enterica enterica serovar Typhi Ty2
cagcggcgcgccgcu

SEQ ID NO: 1800309 - RNA, 14 nt, Salmonella enterica enterica serovar Typhi Ty2
cagcggcgcgcggu

SEQ ID NO: 1800310 - RNA, 15 nt, Salmonella enterica enterica serovar Typhi Ty2
cagcggcggaaugcu

SEQ ID NO: 1800311 - RNA, 12 nt, Salmonella enterica enterica serovar Typhi Ty2
cagcgggaacau

SEQ ID NO: 1800312 - RNA, 13 nt, Salmonella enterica enterica serovar Typhi Ty2
cagcggcgcgcca

SEQ ID NO: 1800313 - RNA, 18 nt, Salmonella enterica enterica serovar Typhi Ty2
cagcggcgccaucaccau

SEQ ID NO: 1800314 - RNA, 13 nt, Salmonella enterica enterica serovar Typhi Ty2
cagcggcgcaggg

SEQ ID NO: 1800315 - RNA, 21 nt, Salmonella enterica enterica serovar Typhi Ty2
cagcggcaggauccccauccc

SEQ ID NO: 1800316 - RNA, 19 nt, Salmonella enterica enterica serovar Typhi Ty2
cagcggcagcuucagccag

SEQ ID NO: 1800317 - RNA, 15 nt, Salmonella enterica enterica serovar Typhi Ty2
cagcggcaguaaauu

SEQ ID NO: 1800318 - RNA, 23 nt, Salmonella enterica enterica serovar Typhi Ty2
cagcggauugccauacacgcggc

SEQ ID NO: 1800319 - RNA, 14 nt, Salmonella enterica enterica serovar Typhi Ty2
aaaauuaaucccaa

SEQ ID NO: 1800320 - RNA, 22 nt, Salmonella enterica enterica serovar Typhi Ty2
aaaauguuuuuguuguuaauuu

SEQ ID NO: 1800321 - RNA, 13 nt, Salmonella enterica enterica serovar Typhi Ty2
aaaauguucaugu

SEQ ID NO: 1800322 - RNA, 22 nt, Salmonella enterica enterica serovar Typhi Ty2
cagccauagcgcgccgcuccag

SEQ ID NO: 1800323 - RNA, 15 nt, Salmonella enterica enterica serovar Typhi Ty2
cagccauagcccacu

SEQ ID NO: 1800324 - RNA, 22 nt, Salmonella enterica enterica serovar Typhi Ty2
cagccccagcaccaacgccgcu

SEQ ID NO: 1800325 - RNA, 13 nt, Salmonella enterica enterica serovar Typhi Ty2
cagccccagcgcc

SEQ ID NO: 1800326 - RNA, 16 nt, Salmonella enterica enterica serovar Typhi Ty2
cagccccagcgccagc

SEQ ID NO: 1800327 - RNA, 14 nt, Salmonella enterica enterica serovar Typhi Ty2
cagccccagcgcca

SEQ ID NO: 1800328 - RNA, 17 nt, Salmonella enterica enterica serovar Typhi Ty2
cagccccagcgccagcc

SEQ ID NO: 1800329 - RNA, 14 nt, Salmonella enterica enterica serovar Typhi Ty2
cagcccgccagcac

SEQ ID NO: 1800330 - RNA, 20 nt, Salmonella enterica enterica serovar Typhi Ty2
cagcccgccagcaccaggcu

SEQ ID NO: 1800331 - RNA, 22 nt, Salmonella enterica enterica serovar Typhi Ty2
cagcccgaucggcuggcauuuu

SEQ ID NO: 1800332 - RNA, 19 nt, Salmonella enterica enterica serovar Typhi Ty2
cagcccgaucaucuccugu

SEQ ID NO: 1800333 - RNA, 20 nt, Salmonella enterica enterica serovar Typhi Ty2
cagcccgaucaucuccugua

SEQ ID NO: 1800334 - RNA, 14 nt, Salmonella enterica enterica serovar Typhi Ty2
cagcccgccgcccu

SEQ ID NO: 1800335 - RNA, 17 nt, Salmonella enterica enterica serovar Typhi Ty2
cagcccgcucguuucaa

SEQ ID NO: 1800336 - RNA, 12 nt, Salmonella enterica enterica serovar Typhi Ty2
cagccacucccg

SEQ ID NO: 1800337 - RNA, 14 nt, Salmonella enterica enterica serovar Typhi Ty2
cagccacucccgau

SEQ ID NO: 1800338 - RNA, 19 nt, Salmonella enterica enterica serovar Typhi Ty2
cagccacaagagcagcaac

SEQ ID NO: 1800339 - RNA, 15 nt, Salmonella enterica enterica serovar Typhi Ty2
cagccacacacuguu

SEQ ID NO: 1800340 - RNA, 20 nt, Salmonella enterica enterica serovar Typhi Ty2
cagccacacacuguuuaaug

SEQ ID NO: 1800341 - RNA, 21 nt, Salmonella enterica enterica serovar Typhi Ty2
cagccaaucauaaacgccuga

SEQ ID NO: 1800342 - RNA, 19 nt, Salmonella enterica enterica serovar Typhi Ty2
cagccaacaacaggccgcc

SEQ ID NO: 1800343 - RNA, 21 nt, Salmonella enterica enterica serovar Typhi Ty2
cagccaaauaggcgaggaaaa

SEQ ID NO: 1800344 - RNA, 15 nt, Salmonella enterica enterica serovar Typhi Ty2
cagcagcgagauggc

SEQ ID NO: 1800345 - RNA, 18 nt, Salmonella enterica enterica serovar Typhi Ty2
cagcagcgacgcauugag

SEQ ID NO: 1800346 - RNA, 15 nt, Salmonella enterica enterica serovar Typhi Ty2
cagcagcgacgcauu

SEQ ID NO: 1800347 - RNA, 19 nt, Salmonella enterica enterica serovar Typhi Ty2
cagccagacgccagccacu

SEQ ID NO: 1800348 - RNA, 16 nt, Salmonella enterica enterica serovar Typhi Ty2
cagccacugcgccauu

SEQ ID NO: 1800349 - RNA, 23 nt, Salmonella enterica enterica serovar Typhi Ty2
cagccacugacuuuccugguaau

SEQ ID NO: 1800350 - RNA, 13 nt, Salmonella enterica enterica serovar Typhi Ty2
cagccagaaaaag

SEQ ID NO: 1800351 - RNA, 20 nt, Salmonella enterica enterica serovar Typhi Ty2
cagccacuucuuccagcggc

SEQ ID NO: 1800352 - RNA, 11 nt, Salmonella enterica enterica serovar Typhi Ty2
cagccagcagc

SEQ ID NO: 1800353 - RNA, 12 nt, Salmonella enterica enterica serovar Typhi Ty2
cagccagcagcg

SEQ ID NO: 1800354 - RNA, 12 nt, Salmonella enterica enterica serovar Typhi Ty2
cagccagcagcu

SEQ ID NO: 1800355 - RNA, 17 nt, Salmonella enterica enterica serovar Typhi Ty2
cagccagguugccagaa

SEQ ID NO: 1800356 - RNA, 18 nt, Salmonella enterica enterica serovar Typhi Ty2
cagccagguugccagaaa

SEQ ID NO: 1800357 - RNA, 18 nt, Salmonella enterica enterica serovar Typhi Ty2
cagccagguuuugcucug

SEQ ID NO: 1800358 - RNA, 21 nt, Salmonella enterica enterica serovar Typhi Ty2
cagcgaguuacguugcggcgu

SEQ ID NO: 1800359 - RNA, 15 nt, Salmonella enterica enterica serovar Typhi Ty2
cagcgagugcgccca

SEQ ID NO: 1800360 - RNA, 22 nt, Salmonella enterica enterica serovar Typhi Ty2
cagcgauccgccgucggcaaua

SEQ ID NO: 1800361 - RNA, 13 nt, Salmonella enterica enterica serovar Typhi Ty2
cagcgauccugcg

SEQ ID NO: 1800362 - RNA, 15 nt, Salmonella enterica enterica serovar Typhi Ty2
cagcgaucacgccgu

SEQ ID NO: 1800363 - RNA, 14 nt, Salmonella enterica enterica serovar Typhi Ty2
cagcgauagucguu

SEQ ID NO: 1800364 - RNA, 23 nt, Salmonella enterica enterica serovar Typhi Ty2
cagcgaucccaguugaucggcca

SEQ ID NO: 1800365 - RNA, 15 nt, Salmonella enterica enterica serovar Typhi Ty2
cagcgauauuacuuu

SEQ ID NO: 1800366 - RNA, 14 nt, Salmonella enterica enterica serovar Typhi Ty2
cagcgauugcgcca

SEQ ID NO: 1800367 - RNA, 16 nt, Salmonella enterica enterica serovar Typhi Ty2
cagcgauuacgccaga

SEQ ID NO: 1800368 - RNA, 22 nt, Salmonella enterica enterica serovar Typhi Ty2
cagcgcaaacaacccggcugcc

SEQ ID NO: 1800369 - RNA, 22 nt, Salmonella enterica enterica serovar Typhi Ty2
cagcgcaaacgacgcugacuca

SEQ ID NO: 1800370 - RNA, 14 nt, Salmonella enterica enterica serovar Typhi Ty2
cagcgacaggcugu

SEQ ID NO: 1800371 - RNA, 17 nt, Salmonella enterica enterica serovar Typhi Ty2
cagcgacauccucuuca

SEQ ID NO: 1800372 - RNA, 17 nt, Salmonella enterica enterica serovar Typhi Ty2
cagccuuauaagaacca

SEQ ID NO: 1800373 - RNA, 20 nt, Salmonella enterica enterica serovar Typhi Ty2
cagccuuaaucaacugcgcc

SEQ ID NO: 1800374 - RNA, 18 nt, Salmonella enterica enterica serovar Typhi Ty2
cagccuugauaccgccgc

SEQ ID NO: 1800375 - RNA, 18 nt, Salmonella enterica enterica serovar Typhi Ty2
cagccuucggacugcugg

SEQ ID NO: 1800376 - RNA, 19 nt, Salmonella enterica enterica serovar Typhi Ty2
cagccuuccuggucugcca

SEQ ID NO: 1800377 - RNA, 14 nt, Salmonella enterica enterica serovar Typhi Ty2
cagccgcucugcug

SEQ ID NO: 1800378 - RNA, 18 nt, Salmonella enterica enterica serovar Typhi Ty2
cagcccgucggcgucugc

SEQ ID NO: 1800379 - RNA, 23 nt, Salmonella enterica enterica serovar Typhi Ty2
cagcccgucggcgucugcgcgcu

SEQ ID NO: 1800380 - RNA, 12 nt, Salmonella enterica enterica serovar Typhi Ty2
cagcccggcgug

SEQ ID NO: 1800381 - RNA, 18 nt, Salmonella enterica enterica serovar Typhi Ty2
cagccgggccgcaaccgc

SEQ ID NO: 1800382 - RNA, 17 nt, Salmonella enterica enterica serovar Typhi Ty2
cagccgguauccagcgc

SEQ ID NO: 1800383 - RNA, 16 nt, Salmonella enterica enterica serovar Typhi Ty2
cagccgguauccagcg

SEQ ID NO: 1800384 - RNA, 23 nt, Salmonella enterica enterica serovar Typhi Ty2
cagccgucaaacaucgcgcucca

SEQ ID NO: 1800385 - RNA, 15 nt, Salmonella enterica enterica serovar Typhi Ty2
cagccguaccacccg

SEQ ID NO: 1800386 - RNA, 14 nt, Salmonella enterica enterica serovar Typhi Ty2
cagccgugagcaga

SEQ ID NO: 1800387 - RNA, 14 nt, Salmonella enterica enterica serovar Typhi Ty2
cagccguugugcug

SEQ ID NO: 1800388 - RNA, 17 nt, Salmonella enterica enterica serovar Typhi Ty2
cagccguuacuuccccc

SEQ ID NO: 1800389 - RNA, 21 nt, Salmonella enterica enterica serovar Typhi Ty2
cagccugugaucggagaaaua

SEQ ID NO: 1800390 - RNA, 16 nt, Salmonella enterica enterica serovar Typhi Ty2
cagccuaccugccgcc

SEQ ID NO: 1800391 - RNA, 21 nt, Salmonella enterica enterica serovar Typhi Ty2
cagggugaagaguauuauuuu

SEQ ID NO: 1800392 - RNA, 14 nt, Salmonella enterica enterica serovar Typhi Ty2
caggguuuaaucac

SEQ ID NO: 1800393 - RNA, 13 nt, Salmonella enterica enterica serovar Typhi Ty2
caggguugucuca

SEQ ID NO: 1800394 - RNA, 16 nt, Salmonella enterica enterica serovar Typhi Ty2
caggguucacugccag

SEQ ID NO: 1800395 - RNA, 18 nt, Salmonella enterica enterica serovar Typhi Ty2
cagguaaaaccagauacg

SEQ ID NO: 1800396 - RNA, 21 nt, Salmonella enterica enterica serovar Typhi Ty2
caggguuugccagcaccagca

SEQ ID NO: 1800397 - RNA, 23 nt, Salmonella enterica enterica serovar Typhi Ty2
cagguaaucaucaccguuuucca

SEQ ID NO: 1800398 - RNA, 15 nt, Salmonella enterica enterica serovar Typhi Ty2
cagguaaugacuuuu

SEQ ID NO: 1800399 - RNA, 20 nt, Salmonella enterica enterica serovar Typhi Ty2
cagguaagcuauuacaaaaa

SEQ ID NO: 1800400 - RNA, 16 nt, Salmonella enterica enterica serovar Typhi Ty2
cagguacagguaauga

SEQ ID NO: 1800401 - RNA, 20 nt, Salmonella enterica enterica serovar Typhi Ty2
cagguaccccgccaccgccg

SEQ ID NO: 1800402 - RNA, 17 nt, Salmonella enterica enterica serovar Typhi Ty2
cagguaccccgccaccg

SEQ ID NO: 1800403 - RNA, 21 nt, Salmonella enterica enterica serovar Typhi Ty2
cagguaccccagccauauuuc

SEQ ID NO: 1800404 - RNA, 18 nt, Salmonella enterica enterica serovar Typhi Ty2
cagguagcagaccgguac

SEQ ID NO: 1800405 - RNA, 23 nt, Salmonella enterica enterica serovar Typhi Ty2
cagggcgaacauuccgcccaaga

SEQ ID NO: 1800406 - RNA, 15 nt, Salmonella enterica enterica serovar Typhi Ty2
aaacaaaccaaacug

SEQ ID NO: 1800407 - RNA, 16 nt, Salmonella enterica enterica serovar Typhi Ty2
cagggauugauggcca

SEQ ID NO: 1800408 - RNA, 13 nt, Salmonella enterica enterica serovar Typhi Ty2
cagggauccugua

SEQ ID NO: 1800409 - RNA, 19 nt, Salmonella enterica enterica serovar Typhi Ty2
cagggauccuguaacaacu

SEQ ID NO: 1800410 - RNA, 21 nt, Salmonella enterica enterica serovar Typhi Ty2
cagggcaaauuaucccuuccu

SEQ ID NO: 1800411 - RNA, 19 nt, Salmonella enterica enterica serovar Typhi Ty2
cagggauuuugcuuuuucg

SEQ ID NO: 1800412 - RNA, 19 nt, Salmonella enterica enterica serovar Typhi Ty2
caggguaucauuaugggca

SEQ ID NO: 1800413 - RNA, 14 nt, Salmonella enterica enterica serovar Typhi Ty2
cagggucaggaacu

SEQ ID NO: 1800414 - RNA, 17 nt, Salmonella enterica enterica serovar Typhi Ty2
caggguccccauauccc

SEQ ID NO: 1800415 - RNA, 21 nt, Salmonella enterica enterica serovar Typhi Ty2
cagggucgcggcauuaaaugc

SEQ ID NO: 1800416 - RNA, 17 nt, Salmonella enterica enterica serovar Typhi Ty2
cagggucuuauuucucc

SEQ ID NO: 1800417 - RNA, 17 nt, Salmonella enterica enterica serovar Typhi Ty2
cagggcuuauucaagca

SEQ ID NO: 1800418 - RNA, 13 nt, Salmonella enterica enterica serovar Typhi Ty2
cagggcugcuggc

SEQ ID NO: 1800419 - RNA, 17 nt, Salmonella enterica enterica serovar Typhi Ty2
caggggauuagacuucc

SEQ ID NO: 1800420 - RNA, 22 nt, Salmonella enterica enterica serovar Typhi Ty2
caggcggcaaaaaaugcauuga

SEQ ID NO: 1800421 - RNA, 16 nt, Salmonella enterica enterica serovar Typhi Ty2
caggcggcaaaaaacg

SEQ ID NO: 1800422 - RNA, 14 nt, Salmonella enterica enterica serovar Typhi Ty2
caggcggcaugggu

SEQ ID NO: 1800423 - RNA, 17 nt, Salmonella enterica enterica serovar Typhi Ty2
caggcggcauggguaaa

SEQ ID NO: 1800424 - RNA, 16 nt, Salmonella enterica enterica serovar Typhi Ty2
caggcguuagccgcca

SEQ ID NO: 1800425 - RNA, 20 nt, Salmonella enterica enterica serovar Typhi Ty2
caggcguguggccagggcag

SEQ ID NO: 1800426 - RNA, 16 nt, Salmonella enterica enterica serovar Typhi Ty2
caggcguuacgcgcca

SEQ ID NO: 1800427 - RNA, 22 nt, Salmonella enterica enterica serovar Typhi Ty2
caggcguugaccgcuucgccuu

SEQ ID NO: 1800428 - RNA, 15 nt, Salmonella enterica enterica serovar Typhi Ty2
caggcguugugcaga

SEQ ID NO: 1800429 - RNA, 14 nt, Salmonella enterica enterica serovar Typhi Ty2
caggcuaccccccc

SEQ ID NO: 1800430 - RNA, 23 nt, Salmonella enterica enterica serovar Typhi Ty2
caggcggguggugagcucaucca

SEQ ID NO: 1800431 - RNA, 19 nt, Salmonella enterica enterica serovar Typhi Ty2
caggcgggugcgcagcccc

SEQ ID NO: 1800432 - RNA, 21 nt, Salmonella enterica enterica serovar Typhi Ty2
caggcggggagggucagcagg

SEQ ID NO: 1800433 - RNA, 17 nt, Salmonella enterica enterica serovar Typhi Ty2
caggcucucgguggugg

SEQ ID NO: 1800434 - RNA, 23 nt, Salmonella enterica enterica serovar Typhi Ty2
caggcugagcguagaccgcccag

SEQ ID NO: 1800435 - RNA, 13 nt, Salmonella enterica enterica serovar Typhi Ty2
caggcugaacccu

SEQ ID NO: 1800436 - RNA, 14 nt, Salmonella enterica enterica serovar Typhi Ty2
caggcuugcccauu

SEQ ID NO: 1800437 - RNA, 16 nt, Salmonella enterica enterica serovar Typhi Ty2
caggcuuuccacguuc

SEQ ID NO: 1800438 - RNA, 21 nt, Salmonella enterica enterica serovar Typhi Ty2
caggcuuuaaauucagcaccc

SEQ ID NO: 1800439 - RNA, 15 nt, Salmonella enterica enterica serovar Typhi Ty2
caggcugccaaccag

SEQ ID NO: 1800440 - RNA, 13 nt, Salmonella enterica enterica serovar Typhi Ty2
cagggagggccaa

SEQ ID NO: 1800441 - RNA, 21 nt, Salmonella enterica enterica serovar Typhi Ty2
caggcuuuucaggcuguggcu

SEQ ID NO: 1800442 - RNA, 18 nt, Salmonella enterica enterica serovar Typhi Ty2
cagggaaauggcgaacag

SEQ ID NO: 1800443 - RNA, 22 nt, Salmonella enterica enterica serovar Typhi Ty2
cagggaaauggcgaacagcccg

SEQ ID NO: 1800444 - RNA, 20 nt, Salmonella enterica enterica serovar Typhi Ty2
cagggaaaagaaguggacuu

SEQ ID NO: 1800445 - RNA, 23 nt, Salmonella enterica enterica serovar Typhi Ty2
cagggaaaagaaguggacuucca

SEQ ID NO: 1800446 - RNA, 16 nt, Salmonella enterica enterica serovar Typhi Ty2
cagggaaaccauguug

SEQ ID NO: 1800447 - RNA, 14 nt, Salmonella enterica enterica serovar Typhi Ty2
cagggaaagccagu

SEQ ID NO: 1800448 - RNA, 18 nt, Salmonella enterica enterica serovar Typhi Ty2
caggcgaauagcgcgcua

SEQ ID NO: 1800449 - RNA, 20 nt, Salmonella enterica enterica serovar Typhi Ty2
caggcgacgaaccgcguaac

SEQ ID NO: 1800450 - RNA, 16 nt, Salmonella enterica enterica serovar Typhi Ty2
caggcgacgccgccau

SEQ ID NO: 1800451 - RNA, 18 nt, Salmonella enterica enterica serovar Typhi Ty2
caggccuacacucugcgc

SEQ ID NO: 1800452 - RNA, 20 nt, Salmonella enterica enterica serovar Typhi Ty2
caggccuacacguucgcuua

SEQ ID NO: 1800453 - RNA, 15 nt, Salmonella enterica enterica serovar Typhi Ty2
caggccuacccgcgu

SEQ ID NO: 1800454 - RNA, 14 nt, Salmonella enterica enterica serovar Typhi Ty2
caggccaaaaccac

SEQ ID NO: 1800455 - RNA, 18 nt, Salmonella enterica enterica serovar Typhi Ty2
caggccaaacagcggcuc

SEQ ID NO: 1800456 - RNA, 18 nt, Salmonella enterica enterica serovar Typhi Ty2
caggcauuuuauuaccug

SEQ ID NO: 1800457 - RNA, 17 nt, Salmonella enterica enterica serovar Typhi Ty2
caggcauuuuauuaccu

SEQ ID NO: 1800458 - RNA, 14 nt, Salmonella enterica enterica serovar Typhi Ty2
caggcgcaucagaa

SEQ ID NO: 1800459 - RNA, 23 nt, Salmonella enterica enterica serovar Typhi Ty2
caggcgacucauuacgccgcguu

SEQ ID NO: 1800460 - RNA, 15 nt, Salmonella enterica enterica serovar Typhi Ty2
caggcagaaauaacu

SEQ ID NO: 1800461 - RNA, 20 nt, Salmonella enterica enterica serovar Typhi Ty2
caggcacuguggugugccug

SEQ ID NO: 1800462 - RNA, 16 nt, Salmonella enterica enterica serovar Typhi Ty2
caggcacguuaaacac

SEQ ID NO: 1800463 - RNA, 13 nt, Salmonella enterica enterica serovar Typhi Ty2
caggcacgccugu

SEQ ID NO: 1800464 - RNA, 17 nt, Salmonella enterica enterica serovar Typhi Ty2
caggcacgugcauaaaa

SEQ ID NO: 1800465 - RNA, 15 nt, Salmonella enterica enterica serovar Typhi Ty2
caggcauuuuauuac

SEQ ID NO: 1800466 - RNA, 21 nt, Salmonella enterica enterica serovar Typhi Ty2
caggcauaauggaacugccug

SEQ ID NO: 1800467 - RNA, 15 nt, Salmonella enterica enterica serovar Typhi Ty2
caggcauacagaugc

SEQ ID NO: 1800468 - RNA, 21 nt, Salmonella enterica enterica serovar Typhi Ty2
caggcauagaguaucgccugu

SEQ ID NO: 1800469 - RNA, 17 nt, Salmonella enterica enterica serovar Typhi Ty2
caggcaguuugcgaaaa

SEQ ID NO: 1800470 - RNA, 14 nt, Salmonella enterica enterica serovar Typhi Ty2
caggcauaaaaaaa

SEQ ID NO: 1800471 - RNA, 18 nt, Salmonella enterica enterica serovar Typhi Ty2
caggauuuacugagcgcc

SEQ ID NO: 1800472 - RNA, 16 nt, Salmonella enterica enterica serovar Typhi Ty2
caggcaaaggaaugcu

SEQ ID NO: 1800473 - RNA, 17 nt, Salmonella enterica enterica serovar Typhi Ty2
caggcaaaucuggugau

SEQ ID NO: 1800474 - RNA, 22 nt, Salmonella enterica enterica serovar Typhi Ty2
caggcaaaucaacauuauuaaa

SEQ ID NO: 1800475 - RNA, 15 nt, Salmonella enterica enterica serovar Typhi Ty2
caggcaaaccagcac

SEQ ID NO: 1800476 - RNA, 22 nt, Salmonella enterica enterica serovar Typhi Ty2
caggcaaaaaucggccucuuca

SEQ ID NO: 1800477 - RNA, 19 nt, Salmonella enterica enterica serovar Typhi Ty2
caggcaaucagcagccggg

SEQ ID NO: 1800478 - RNA, 17 nt, Salmonella enterica enterica serovar Typhi Ty2
caggcaaguuuaauucc

SEQ ID NO: 1800479 - RNA, 15 nt, Salmonella enterica enterica serovar Typhi Ty2
caggagugaacacgu

SEQ ID NO: 1800480 - RNA, 19 nt, Salmonella enterica enterica serovar Typhi Ty2
caggacauggucaccauga

SEQ ID NO: 1800481 - RNA, 16 nt, Salmonella enterica enterica serovar Typhi Ty2
caggauaaaauccugc

SEQ ID NO: 1800482 - RNA, 15 nt, Salmonella enterica enterica serovar Typhi Ty2
caggauaaaauccug

SEQ ID NO: 1800483 - RNA, 19 nt, Salmonella enterica enterica serovar Typhi Ty2
caggaguuagcauguggga

SEQ ID NO: 1800484 - RNA, 19 nt, Salmonella enterica enterica serovar Typhi Ty2
caggaugcuuuuuauaaag

SEQ ID NO: 1800485 - RNA, 20 nt, Salmonella enterica enterica serovar Typhi Ty2
caggauggccagcaccagca

SEQ ID NO: 1800486 - RNA, 19 nt, Salmonella enterica enterica serovar Typhi Ty2
caggaugugaggcagauau

SEQ ID NO: 1800487 - RNA, 17 nt, Salmonella enterica enterica serovar Typhi Ty2
cagcugggucgcgcuuu

SEQ ID NO: 1800488 - RNA, 16 nt, Salmonella enterica enterica serovar Typhi Ty2
cagcugggucgcgcuu

SEQ ID NO: 1800489 - RNA, 16 nt, Salmonella enterica enterica serovar Typhi Ty2
cagcugguauaggcca

SEQ ID NO: 1800490 - RNA, 17 nt, Salmonella enterica enterica serovar Typhi Ty2
cagcuucgguccggcgc

SEQ ID NO: 1800491 - RNA, 15 nt, Salmonella enterica enterica serovar Typhi Ty2
cagcuucgccccggc

SEQ ID NO: 1800492 - RNA, 17 nt, Salmonella enterica enterica serovar Typhi Ty2
caggaaagagccgcgca

SEQ ID NO: 1800493 - RNA, 21 nt, Salmonella enterica enterica serovar Typhi Ty2
caggaaauccagcagaauaac

SEQ ID NO: 1800494 - RNA, 17 nt, Salmonella enterica enterica serovar Typhi Ty2
caggaaaucuuccaguu

SEQ ID NO: 1800495 - RNA, 22 nt, Salmonella enterica enterica serovar Typhi Ty2
caggaaucgcguuaauuuuccc

SEQ ID NO: 1800496 - RNA, 14 nt, Salmonella enterica enterica serovar Typhi Ty2
caggaaugcggcca

SEQ ID NO: 1800497 - RNA, 15 nt, Salmonella enterica enterica serovar Typhi Ty2
caggaagaguaucuc

SEQ ID NO: 1800498 - RNA, 21 nt, Salmonella enterica enterica serovar Typhi Ty2
cagcugagcuaaucacccacu

SEQ ID NO: 1800499 - RNA, 21 nt, Salmonella enterica enterica serovar Typhi Ty2
cagcugacgcagcaguucccc

SEQ ID NO: 1800500 - RNA, 20 nt, Salmonella enterica enterica serovar Typhi Ty2
cagcucuuucaauccuucuu

SEQ ID NO: 1800501 - RNA, 23 nt, Salmonella enterica enterica serovar Typhi Ty2
cagcguuuccggaaugagaugca

SEQ ID NO: 1800502 - RNA, 14 nt, Salmonella enterica enterica serovar Typhi Ty2
aaaauugaauuaag

SEQ ID NO: 1800503 - RNA, 19 nt, Salmonella enterica enterica serovar Typhi Ty2
cagcuaaaaacgccaauca

SEQ ID NO: 1800504 - RNA, 16 nt, Human
uuaccagaaagcaguu

SEQ ID NO: 1800505 - RNA, 15 nt, Human
uuagaauaugccuug

SEQ ID NO: 1800506 - RNA, 22 nt, Human
uuaauguggaaaugauguuuca

SEQ ID NO: 1800507 - RNA, 11 nt, Human
uuaauguuucu

SEQ ID NO: 1800508 - RNA, 19 nt, Human
uuaagacgaaacauuuguu

SEQ ID NO: 1800509 - RNA, 19 nt, Human
uuaaaucaaccuugcuuug

SEQ ID NO: 1800510 - RNA, 16 nt, Human
uuaguagagacagggu

SEQ ID NO: 1800511 - RNA, 11 nt, Human
uuauuaugcau

SEQ ID NO: 1800512 - RNA, 20 nt, Human
uaaaagaaugauuaugaauu

SEQ ID NO: 1800513 - RNA, 13 nt, Human
uaaaacagggcca

SEQ ID NO: 1800514 - RNA, 15 nt, Human
guuugcauguucacu

SEQ ID NO: 1800515 - RNA, 16 nt, Human
guuuuaauuagugaac

SEQ ID NO: 1800516 - RNA, 14 nt, Human
uaaaaaaaaaccug

SEQ ID NO: 1800517 - RNA, 16 nt, Human
uaacuggaaacuucag

SEQ ID NO: 1800518 - RNA, 13 nt, Human
uacuucaaacuga

SEQ ID NO: 1800519 - RNA, 22 nt, Human
uagagaaguucaauauaagcuu

SEQ ID NO: 1800520 - RNA, 12 nt, Human
uaacccuggaaa

SEQ ID NO: 1800521 - RNA, 17 nt, Human
uaaaugccaggccuggc

SEQ ID NO: 1800522 - RNA, 22 nt, Human
uagucucaaacuccugaccuca

SEQ ID NO: 1800523 - RNA, 23 nt, Human
uaguagagacggguuucaccaug

SEQ ID NO: 1800524 - RNA, 14 nt, Human
uagcugagacuaca

SEQ ID NO: 1800525 - RNA, 21 nt, Human
uagcagagggaucaagcaguu

SEQ ID NO: 1800526 - RNA, 20 nt, Human
ucacauuccaagccucaugu

SEQ ID NO: 1800527 - RNA, 22 nt, Human
ucacaagacccaaaaggcagaa

SEQ ID NO: 1800528 - RNA, 13 nt, Human
ucacacacaaugu

SEQ ID NO: 1800529 - RNA, 16 nt, Human
uauccuucagccugaa

SEQ ID NO: 1800530 - RNA, 12 nt, Human
uaucaccacugg

SEQ ID NO: 1800531 - RNA, 16 nt, Human
gcucuggacaggcacu

SEQ ID NO: 1800532 - RNA, 15 nt, Human
gcucucuggccuucg

SEQ ID NO: 1800533 - RNA, 15 nt, Human
guuuaugauuccacc

SEQ ID NO: 1800534 - RNA, 22 nt, Human
guuggagcaggggugcugggac

SEQ ID NO: 1800535 - RNA, 19 nt, Human
gcuccagguagagggugug

SEQ ID NO: 1800536 - RNA, 19 nt, Human
gcuaccugcucagcccugc

SEQ ID NO: 1800537 - RNA, 23 nt, Human
gcuaccugcucagcccugcacca

SEQ ID NO: 1800538 - RNA, 17 nt, Human
gcuaauuagcauggcca

SEQ ID NO: 1800539 - RNA, 12 nt, Human
gcgcgaucucag

SEQ ID NO: 1800540 - RNA, 16 nt, Human
gccucaaaugcaccau

SEQ ID NO: 1800541 - RNA, 18 nt, Human
gccuaagggauccugccu

SEQ ID NO: 1800542 - RNA, 17 nt, Human
gccugcucccuagccag

SEQ ID NO: 1800543 - RNA, 18 nt, Human
gccugacugccaagccau

SEQ ID NO: 1800544 - RNA, 23 nt, Human
gccuccccugccucaccagcccu

SEQ ID NO: 1800545 - RNA, 13 nt, Human
gccucugagaagc

SEQ ID NO: 1800546 - RNA, 21 nt, Human
ugggacauuugcucauggaau

SEQ ID NO: 1800547 - RNA, 22 nt, Human
ugggacagucaccucauggaau

SEQ ID NO: 1800548 - RNA, 22 nt, Human
uggcuucaaauuguaagcaugc

SEQ ID NO: 1800549 - RNA, 14 nt, Human
uggccuucggccuc

SEQ ID NO: 1800550 - RNA, 19 nt, Human
uguuuaguaaucauauugu

SEQ ID NO: 1800551 - RNA, 14 nt, Human
uggcucucccagcc

SEQ ID NO: 1800552 - RNA, 16 nt, Human
ugggacuacaggcgug

SEQ ID NO: 1800553 - RNA, 23 nt, Human
uggaggcggaauugcucucccag

SEQ ID NO: 1800554 - RNA, 18 nt, Human
uggcaucaucucagcuca

SEQ ID NO: 1800555 - RNA, 18 nt, Human
uggaaacgaagcaccauc

SEQ ID NO: 1800556 - RNA, 23 nt, Human
uggaaaggggcaggccagagcua

SEQ ID NO: 1800557 - RNA, 16 nt, Human
uggagacauugaggca

SEQ ID NO: 1800558 - RNA, 22 nt, Human
uggagaucaccaguguguggcu

SEQ ID NO: 1800559 - RNA, 18 nt, Human
uggacuucugccagcaua

SEQ ID NO: 1800560 - RNA, 15 nt, Human
ugccaggccuggcaa

SEQ ID NO: 1800561 - RNA, 15 nt, Human
ugcccccaaccauuu

SEQ ID NO: 1800562 - RNA, 18 nt, Human
ugccccugcacuccagcc

SEQ ID NO: 1800563 - RNA, 12 nt, Human
ugcacauaucca

SEQ ID NO: 1800564 - RNA, 17 nt, Human
ugcagugucugcuggag

SEQ ID NO: 1800565 - RNA, 17 nt, Human
ugcugcuggggaagaca

SEQ ID NO: 1800566 - RNA, 13 nt, Human
ugcucuugaugcc

SEQ ID NO: 1800567 - RNA, 18 nt, Human
ugcucagcccugcaccau

SEQ ID NO: 1800568 - RNA, 12 nt, Human
ugcucagggcug

SEQ ID NO: 1800569 - RNA, 14 nt, Human
ugccuguaaucaca

SEQ ID NO: 1800570 - RNA, 14 nt, Human
ugcgagugcgugaa

SEQ ID NO: 1800571 - RNA, 14 nt, Human
ugccucccagguuc

SEQ ID NO: 1800572 - RNA, 19 nt, Human
ugccuaagcccuccgccau

SEQ ID NO: 1800573 - RNA, 16 nt, Human
ugaaguccaagcauuu

SEQ ID NO: 1800574 - RNA, 14 nt, Human
uccaaacugacucu

SEQ ID NO: 1800575 - RNA, 23 nt, Human
uccagucuaaaaaaggaauccuc

SEQ ID NO: 1800576 - RNA, 22 nt, Human
uccagcuggccgggagccugau

SEQ ID NO: 1800577 - RNA, 24 nt, Human
uccaacuaucucauuuccaagcaa

SEQ ID NO: 1800578 - RNA, 23 nt, Human
ucacugcaaccuccaccucgcag

SEQ ID NO: 1800579 - RNA, 19 nt, Human
ucauauuuuucauagcuaa

SEQ ID NO: 1800580 - RNA, 23 nt, Human
ucagcccugcaccaugcugcugg

SEQ ID NO: 1800581 - RNA, 16 nt, Human
ugagguaaaagcauca

SEQ ID NO: 1800582 - RNA, 18 nt, Human
ugaggagcuguugaggua

SEQ ID NO: 1800583 - RNA, 16 nt, Human
ugaucaaauugugcag

SEQ ID NO: 1800584 - RNA, 16 nt, Human
ugauuuugugauugau

SEQ ID NO: 1800585 - RNA, 22 nt, Human
ugauuaaguaaugauaacugga

SEQ ID NO: 1800586 - RNA, 18 nt, Human
ugagcaucagugagguua

SEQ ID NO: 1800587 - RNA, 19 nt, Human
ugagccaggaggccugcua

SEQ ID NO: 1800588 - RNA, 16 nt, Human
ugagauacaaacaugu

SEQ ID NO: 1800589 - RNA, 14 nt, Human
ugaauucugucauu

SEQ ID NO: 1800590 - RNA, 14 nt, Human
gcagggacuugaac

SEQ ID NO: 1800591 - RNA, 19 nt, Human
gcaguggcaucaucucagc

SEQ ID NO: 1800592 - RNA, 17 nt, Human
gcauuacugcaugcacu

SEQ ID NO: 1800593 - RNA, 22 nt, Human
gcaugcggcccaggauggcuuu

SEQ ID NO: 1800594 - RNA, 19 nt, Human
gcagcauuguuggcuguuc

SEQ ID NO: 1800595 - RNA, 13 nt, Human
gcagccaccaguc

SEQ ID NO: 1800596 - RNA, 13 nt, Human
gcacgggccauau

SEQ ID NO: 1800597 - RNA, 13 nt, Human
gcagcaguaguag

SEQ ID NO: 1800598 - RNA, 13 nt, Human
gcccuuccugcag

SEQ ID NO: 1800599 - RNA, 21 nt, Human
gccccgucccccucuggcucc

SEQ ID NO: 1800600 - RNA, 23 nt, Human
gccccucuguaucuagccuggaa

SEQ ID NO: 1800601 - RNA, 22 nt, Human
gcccaucccaaaaucauaagau

SEQ ID NO: 1800602 - RNA, 14 nt, Human
gcccccaacagcac

SEQ ID NO: 1800603 - RNA, 17 nt, Human
gcauuuuuguaaguuag

SEQ ID NO: 1800604 - RNA, 17 nt, Human
gccaaaucaaaagacuu

SEQ ID NO: 1800605 - RNA, 16 nt, Human
gccacuggacugacga

SEQ ID NO: 1800606 - RNA, 14 nt, Human
gccaugugcagcca

SEQ ID NO: 1800607 - RNA, 14 nt, Human
gccagaggcucuaa

SEQ ID NO: 1800608 - RNA, 23 nt, Human
gccagccacggggacucagcccu

SEQ ID NO: 1800609 - RNA, 21 nt, Human
gccaggaaucacuggcuguua

SEQ ID NO: 1800610 - RNA, 20 nt, Human
gccaggauggcgcaggaacu

SEQ ID NO: 1800611 - RNA, 11 nt, Human
gccaggcuggu

SEQ ID NO: 1800612 - RNA, 15 nt, Human
gaugccuggcggggu

SEQ ID NO: 1800613 - RNA, 17 nt, Human
gauccugcaauuccacu

SEQ ID NO: 1800614 - RNA, 16 nt, Human
gaugauccccacgcca

SEQ ID NO: 1800615 - RNA, 13 nt, Human
gauuacaggcgug

SEQ ID NO: 1800616 - RNA, 14 nt, Human
gauuacaggcguga

SEQ ID NO: 1800617 - RNA, 16 nt, Human
gauuuuauaugcuauu

SEQ ID NO: 1800618 - RNA, 20 nt, Human
gauccuggaaaucaggguua

SEQ ID NO: 1800619 - RNA, 18 nt, Human
gaguccuccuguccagcc

SEQ ID NO: 1800620 - RNA, 16 nt, Human
gagugcaguggcgcga

SEQ ID NO: 1800621 - RNA, 19 nt, Human
gaggggccucaaaugcacc

SEQ ID NO: 1800622 - RNA, 13 nt, Human
gagcucaccaguc

SEQ ID NO: 1800623 - RNA, 21 nt, Human
gaggccugacugccaagccau

SEQ ID NO: 1800624 - RNA, 21 nt, Human
gaggccuuucccuaagccagc

SEQ ID NO: 1800625 - RNA, 23 nt, Human
gaggcucuaauguacaauaaagc

SEQ ID NO: 1800626 - RNA, 16 nt, Human
gagacagggcccuguc

SEQ ID NO: 1800627 - RNA, 16 nt, Human
gagacgagguuucacu

SEQ ID NO: 1800628 - RNA, 13 nt, Human
gagagcacgccug

SEQ ID NO: 1800629 - RNA, 18 nt, Human
gagcccacuguacuugcu

SEQ ID NO: 1800630 - RNA, 14 nt, Human
gaagaacucucugg

SEQ ID NO: 1800631 - RNA, 21 nt, Human
gaacucucgagcguugcuggg

SEQ ID NO: 1800632 - RNA, 14 nt, Human
gaacagucucuuga

SEQ ID NO: 1800633 - RNA, 18 nt, Human
gaaccucaagcugcaucu

SEQ ID NO: 1800634 - RNA, 16 nt, Human
gaaggcaccucucugg

SEQ ID NO: 1800635 - RNA, 15 nt, Human
gaaguuucauccgca

SEQ ID NO: 1800636 - RNA, 16 nt, Human
gaaaauaaaucuauca

SEQ ID NO: 1800637 - RNA, 16 nt, Human
gaaaauacuauucuga

SEQ ID NO: 1800638 - RNA, 23 nt, Human
gaaaauuuaaaacauuacucuga

SEQ ID NO: 1800639 - RNA, 16 nt, Human
cuuuguaaugaaaacc

SEQ ID NO: 1800640 - RNA, 21 nt, Human
cuuuuuuaucaugugaaauca

SEQ ID NO: 1800641 - RNA, 18 nt, Human
gacauugaggcaggcacu

SEQ ID NO: 1800642 - RNA, 18 nt, Human
gacacugaucuggcugca

SEQ ID NO: 1800643 - RNA, 19 nt, Human
gacgagaaaacaauaacga

SEQ ID NO: 1800644 - RNA, 12 nt, Human
gacgcucucugg

SEQ ID NO: 1800645 - RNA, 12 nt, Human
cugugagggugc

SEQ ID NO: 1800646 - RNA, 22 nt, Human
cuguguggagagggaaugugaa

SEQ ID NO: 1800647 - RNA, 15 nt, Human
cuucagccugaaaga

SEQ ID NO: 1800648 - RNA, 21 nt, Human
cuugggcuuuagccuuaaaga

SEQ ID NO: 1800649 - RNA, 14 nt, Human
cugcucagggcugg

SEQ ID NO: 1800650 - RNA, 19 nt, Human
cuggcucuggacaggcacu

SEQ ID NO: 1800651 - RNA, 23 nt, Human
cugccucucugcaggucccuaau

SEQ ID NO: 1800652 - RNA, 11 nt, Human
cugcagguccc

SEQ ID NO: 1800653 - RNA, 23 nt, Human
cugcaggucccuaauaaagcugu

SEQ ID NO: 1800654 - RNA, 13 nt, Human
cguuauaaucauu

SEQ ID NO: 1800655 - RNA, 22 nt, Human
cuagacuagucucaaacuccug

SEQ ID NO: 1800656 - RNA, 22 nt, Human
cgcuuucaugaauucugucauu

SEQ ID NO: 1800657 - RNA, 13 nt, Human
cggcuaauuuuug

SEQ ID NO: 1800658 - RNA, 15 nt, Human
cggguuucaccaugu

SEQ ID NO: 1800659 - RNA, 20 nt, Human
cguccugucggagcccuguc

SEQ ID NO: 1800660 - RNA, 13 nt, Human
cgcucucuggccu

SEQ ID NO: 1800661 - RNA, 22 nt, Human
cggccaccagaugucgcccuac

SEQ ID NO: 1800662 - RNA, 14 nt, Human
cggcccaggauggc

SEQ ID NO: 1800663 - RNA, 20 nt, Human
cgauaaaagacagugaaaga

SEQ ID NO: 1800664 - RNA, 15 nt, Human
cgaucucagcucacu

SEQ ID NO: 1800665 - RNA, 15 nt, Human
cgaucucggcucacu

SEQ ID NO: 1800666 - RNA, 13 nt, Human
cgccauucucaag

SEQ ID NO: 1800667 - RNA, 17 nt, Human
cucuguucauuuccuca

SEQ ID NO: 1800668 - RNA, 19 nt, Human
cucugagaagcucugaaga

SEQ ID NO: 1800669 - RNA, 12 nt, Human
cucucuggaagc

SEQ ID NO: 1800670 - RNA, 21 nt, Human
cucaggcaaucugcccgccug

SEQ ID NO: 1800671 - RNA, 21 nt, Human
cucauggaauuggagcucgug

SEQ ID NO: 1800672 - RNA, 19 nt, Human
cucaucuccccaucauugg

SEQ ID NO: 1800673 - RNA, 21 nt, Human
cuccagagggaauugcagagu

SEQ ID NO: 1800674 - RNA, 15 nt, Human
cucaauaagccucag

SEQ ID NO: 1800675 - RNA, 12 nt, Human
cucaaaacaggg

SEQ ID NO: 1800676 - RNA, 19 nt, Human
cucacaugauuccagccau

SEQ ID NO: 1800677 - RNA, 22 nt, Human
cucagauuauaacuguugucau

SEQ ID NO: 1800678 - RNA, 20 nt, Human
cuaugucauuucauuuccua

SEQ ID NO: 1800679 - RNA, 16 nt, Human
uucagauaaucacaau

SEQ ID NO: 1800680 - RNA, 21 nt, Human
uucaccaauaaguauucugug

SEQ ID NO: 1800681 - RNA, 15 nt, Human
uuaguguucauaaau

SEQ ID NO: 1800682 - RNA, 12 nt, Human
uuaggucucaau

SEQ ID NO: 1800683 - RNA, 16 nt, Human
uguuugcuaagcauuc

SEQ ID NO: 1800684 - RNA, 16 nt, Human
uuaaggguaggcucaa

SEQ ID NO: 1800685 - RNA, 17 nt, Human
uuaauaaauuucaccaa

SEQ ID NO: 1800686 - RNA, 13 nt, Human
uuaauuagugcua

SEQ ID NO: 1800687 - RNA, 23 nt, Human
uugccucaaccucccaagcaguu

SEQ ID NO: 1800688 - RNA, 21 nt, Human
uugcuacagggcucacagaau

SEQ ID NO: 1800689 - RNA, 16 nt, Human
uugcauaagagcuuaa

SEQ ID NO: 1800690 - RNA, 14 nt, Human
uucugucaacuugu

SEQ ID NO: 1800691 - RNA, 23 nt, Human
uucuugauaccugggauacugug

SEQ ID NO: 1800692 - RNA, 19 nt, Human
uucucagaaucaugcugag

SEQ ID NO: 1800693 - RNA, 16 nt, Human
uugaaucuugucucaa

SEQ ID NO: 1800694 - RNA, 18 nt, Human
uucccaaguugugcuuga

SEQ ID NO: 1800695 - RNA, 15 nt, Human
uucccaauugcuuua

SEQ ID NO: 1800696 - RNA, 13 nt, Human
uuccgacugccau

SEQ ID NO: 1800697 - RNA, 19 nt, Human
uuccucugcccuuccugca

SEQ ID NO: 1800698 - RNA, 22 nt, Human
ccuuccuaauuccacagcugcu

SEQ ID NO: 1800699 - RNA, 13 nt, Human
ccuugucacuggu

SEQ ID NO: 1800700 - RNA, 13 nt, Human
ccugccucagccu

SEQ ID NO: 1800701 - RNA, 11 nt, Human
ccuuaaagaua

SEQ ID NO: 1800702 - RNA, 15 nt, Human
cccuggacuugccuc

SEQ ID NO: 1800703 - RNA, 21 nt, Human
cccuuccugcaggcaggaaca

SEQ ID NO: 1800704 - RNA, 17 nt, Human
ccgcaaugugacuuaau

SEQ ID NO: 1800705 - RNA, 20 nt, Human
ccucugagaagcucugaaga

SEQ ID NO: 1800706 - RNA, 21 nt, Human
ccucaccaguuuccagguggu

SEQ ID NO: 1800707 - RNA, 18 nt, Human
aaaaagcaucauggcuau

SEQ ID NO: 1800708 - RNA, 17 nt, Human
aacacaugauccugcaa

SEQ ID NO: 1800709 - RNA, 12 nt, Human
aaccaugaagag

SEQ ID NO: 1800710 - RNA, 17 nt, Human
aacagcacccucuccag

SEQ ID NO: 1800711 - RNA, 21 nt, Human
aacauagaaauugccugacga

SEQ ID NO: 1800712 - RNA, 11 nt, Human
aacuaaaugac

SEQ ID NO: 1800713 - RNA, 15 nt, Human
aagaggacuccuuaa

SEQ ID NO: 1800714 - RNA, 19 nt, Human
aagacccuuauugcugucc

SEQ ID NO: 1800715 - RNA, 20 nt, Human
aacuuugauuuuauaugcua

SEQ ID NO: 1800716 - RNA, 19 nt, Human
aagccuaagggauccugcc

SEQ ID NO: 1800717 - RNA, 14 nt, Human
aaauaaauauccuu

SEQ ID NO: 1800718 - RNA, 13 nt, Human
aaaucaugaagau

SEQ ID NO: 1800719 - RNA, 13 nt, Human
acuccagccugag

SEQ ID NO: 1800720 - RNA, 15 nt, Human
acuauuaacaacuug

SEQ ID NO: 1800721 - RNA, 20 nt, Human
acugggauuacaggcgugag

SEQ ID NO: 1800722 - RNA, 12 nt, Human
acugagaaauuu

SEQ ID NO: 1800723 - RNA, 19 nt, Human
acugauggguuucuccaga

SEQ ID NO: 1800724 - RNA, 17 nt, Human
acgucaugugcaccuuu

SEQ ID NO: 1800725 - RNA, 16 nt, Human
acggguuucaccaugu

SEQ ID NO: 1800726 - RNA, 16 nt, Human
acacagcugucccaag

SEQ ID NO: 1800727 - RNA, 15 nt, Human
acaagaaaugaaagc

SEQ ID NO: 1800728 - RNA, 15 nt, Human
accugggcugaggca

SEQ ID NO: 1800729 - RNA, 17 nt, Human
accugcucagcccugca

SEQ ID NO: 1800730 - RNA, 23 nt, Human
acaccauuuuggcaagcucuauc

SEQ ID NO: 1800731 - RNA, 13 nt, Human
accuaguccccag

SEQ ID NO: 1800732 - RNA, 21 nt, Human
acccuaaacauccuaagcuca

SEQ ID NO: 1800733 - RNA, 16 nt, Human
accuacuuacaugcau

SEQ ID NO: 1800734 - RNA, 20 nt, Human
aacaugaauauuuaguguuc

SEQ ID NO: 1800735 - RNA, 14 nt, Human
aaccagaucauugu

SEQ ID NO: 1800736 - RNA, 14 nt, Human
aaccaacacccuga

SEQ ID NO: 1800737 - RNA, 20 nt, Human
aacacuugcggauauucugg

SEQ ID NO: 1800738 - RNA, 17 nt, Human
aacaacuaccugagcua

SEQ ID NO: 1800739 - RNA, 14 nt, Human
aacaaggaugaauu

SEQ ID NO: 1800740 - RNA, 14 nt, Human
aacuaggcugagca

SEQ ID NO: 1800741 - RNA, 22 nt, Human
aagccuuggggcugaugcaguu

SEQ ID NO: 1800742 - RNA, 23 nt, Human
aagcgauucuccugccucagccu

SEQ ID NO: 1800743 - RNA, 17 nt, Human
aagccagauuuuccuga

SEQ ID NO: 1800744 - RNA, 18 nt, Human
aagccagauuuuccugaa

SEQ ID NO: 1800745 - RNA, 14 nt, Human
aagcaccaggacgc

SEQ ID NO: 1800746 - RNA, 18 nt, Human
aagaccauuuuuccucca

SEQ ID NO: 1800747 - RNA, 20 nt, Human
aauuacuggaaggcuuccac

SEQ ID NO: 1800748 - RNA, 17 nt, Human
aucacagcuucagccag

SEQ ID NO: 1800749 - RNA, 19 nt, Human
auauuccucaguucaucca

SEQ ID NO: 1800750 - RNA, 15 nt, Human
auggagucacagcca

SEQ ID NO: 1800751 - RNA, 15 nt, Human
auggagucuugcucu

SEQ ID NO: 1800752 - RNA, 17 nt, Human
augcaguucugaagaag

SEQ ID NO: 1800753 - RNA, 18 nt, Human
auagggcaauuaauuccu

SEQ ID NO: 1800754 - RNA, 13 nt, Human
auauaagugugug

SEQ ID NO: 1800755 - RNA, 22 nt, Human
auauacuugguucucuccacca

SEQ ID NO: 1800756 - RNA, 15 nt, Human
auaucaauuuccuca

SEQ ID NO: 1800757 - RNA, 21 nt, Human
auauguuagagaauuuccuua

SEQ ID NO: 1800758 - RNA, 16 nt, Human
auaucuucacuuguca

SEQ ID NO: 1800759 - RNA, 13 nt, Human
aguaacucaucug

SEQ ID NO: 1800760 - RNA, 22 nt, Human
agguucaagugcuucuccagcc

SEQ ID NO: 1800761 - RNA, 15 nt, Human
agucaccucauggaa

SEQ ID NO: 1800762 - RNA, 21 nt, Human
agugcaguggcaucaucucag

SEQ ID NO: 1800763 - RNA, 24 nt, Human
agaaacccugcacccauuagcagu

SEQ ID NO: 1800764 - RNA, 13 nt, Human
agacagugaaaga

SEQ ID NO: 1800765 - RNA, 11 nt, Human
agacagagucu

SEQ ID NO: 1800766 - RNA, 17 nt, Human
agacaauauaaugaagu

SEQ ID NO: 1800767 - RNA, 12 nt, Human
agacacacauga

SEQ ID NO: 1800768 - RNA, 18 nt, Human
acuguaaggcaaucaugg

SEQ ID NO: 1800769 - RNA, 22 nt, Human
acuuuuuaaaaucucaaacuuc

SEQ ID NO: 1800770 - RNA, 19 nt, Human
acuuuuuuuuuuuaagagu

SEQ ID NO: 1800771 - RNA, 19 nt, Human
acuuguuucagaguuugua

SEQ ID NO: 1800772 - RNA, 22 nt, Human
agggcugccuucuggccuugua

SEQ ID NO: 1800773 - RNA, 14 nt, Human
agggcuaauaucuu

SEQ ID NO: 1800774 - RNA, 21 nt, Human
agauguauguacuucaugcug

SEQ ID NO: 1800775 - RNA, 17 nt, Human
agauuuuucaugauuuu

SEQ ID NO: 1800776 - RNA, 18 nt, Human
agagccuccuuucuggcu

SEQ ID NO: 1800777 - RNA, 22 nt, Human
agagagcuggaggcacccaugc

SEQ ID NO: 1800778 - RNA, 15 nt, Human
cgccucagccuccca

SEQ ID NO: 1800779 - RNA, 11 nt, Human
cgcccucacug

SEQ ID NO: 1800780 - RNA, 12 nt, Human
cgcgcccagccu

SEQ ID NO: 1800781 - RNA, 10 nt, Human
cgaacuccug

SEQ ID NO: 1800782 - RNA, 19 nt, Human
cgaccucucucaaagugcu

SEQ ID NO: 1800783 - RNA, 14 nt, Human
ccuuguaauuugaa

SEQ ID NO: 1800784 - RNA, 16 nt, Human
ccuucuaaccugaacu

SEQ ID NO: 1800785 - RNA, 13 nt, Human
ccugcagacucac

SEQ ID NO: 1800786 - RNA, 23 nt, Human
ccugcaggcaggaacaaacaggg

SEQ ID NO: 1800787 - RNA, 17 nt, Human
ccucccgucaccccugu

SEQ ID NO: 1800788 - RNA, 18 nt, Human
ccucuggcuccagcuggc

SEQ ID NO: 1800789 - RNA, 15 nt, Human
ccggagaaccccagg

SEQ ID NO: 1800790 - RNA, 23 nt, Human
cccagccugcucccuagccagag

SEQ ID NO: 1800791 - RNA, 11 nt, Human
cccauccugcc

SEQ ID NO: 1800792 - RNA, 13 nt, Human
ccaugggacaggg

SEQ ID NO: 1800793 - RNA, 19 nt, Human
ccaggugguaagcaccagg

SEQ ID NO: 1800794 - RNA, 19 nt, Human
ccagaucauugugaaauua

SEQ ID NO: 1800795 - RNA, 13 nt, Human
cccauucaacauc

SEQ ID NO: 1800796 - RNA, 21 nt, Human
ccccagcuggggccaggcugg

SEQ ID NO: 1800797 - RNA, 13 nt, Human
cccuugaugaaga

SEQ ID NO: 1800798 - RNA, 20 nt, Human
cccugggaggcucuggagcc

SEQ ID NO: 1800799 - RNA, 14 nt, Human
cccugggcccagua

SEQ ID NO: 1800800 - RNA, 13 nt, Human
cccuggggcuuua

SEQ ID NO: 1800801 - RNA, 16 nt, Human
ccgcagugagagagug

SEQ ID NO: 1800802 - RNA, 19 nt, Human
ccgcucaggcugaccacuu

SEQ ID NO: 1800803 - RNA, 20 nt, Human
cauuguggucacaggaagua

SEQ ID NO: 1800804 - RNA, 21 nt, Human
cauucacaucgcagauucucc

SEQ ID NO: 1800805 - RNA, 21 nt, Human
cauucucaagcccugcaguca

SEQ ID NO: 1800806 - RNA, 13 nt, Human
caugggaagugac

SEQ ID NO: 1800807 - RNA, 19 nt, Human
cauuacggagaguuuccua

SEQ ID NO: 1800808 - RNA, 18 nt, Human
caugcacuuggcugcaua

SEQ ID NO: 1800809 - RNA, 23 nt, Human
caugaaaacaauucuuauugacu

SEQ ID NO: 1800810 - RNA, 13 nt, Human
caugaagauauuu

SEQ ID NO: 1800811 - RNA, 15 nt, Human
caucaccuuagacca

SEQ ID NO: 1800812 - RNA, 15 nt, Human
caucauugguaccca

SEQ ID NO: 1800813 - RNA, 16 nt, Human
cauagaaauugccuga

SEQ ID NO: 1800814 - RNA, 19 nt, Human
cauagugaggagcuuugaa

SEQ ID NO: 1800815 - RNA, 18 nt, Human
cagcuuuaguagauauua

SEQ ID NO: 1800816 - RNA, 13 nt, Human
caggaguacaccc

SEQ ID NO: 1800817 - RNA, 14 nt, Human
cagcuucacccuga

SEQ ID NO: 1800818 - RNA, 19 nt, Human
caggaaaauggacaucaaa

SEQ ID NO: 1800819 - RNA, 19 nt, Human
cagcuacacagaucacagc

SEQ ID NO: 1800820 - RNA, 16 nt, Human
cagcuggggccaggcu

SEQ ID NO: 1800821 - RNA, 21 nt, Human
auguguguuuuaaaaugagaa

SEQ ID NO: 1800822 - RNA, 16 nt, Human
auguugagcagcaucu

SEQ ID NO: 1800823 - RNA, 21 nt, Human
augggacauuugcucauggaa

SEQ ID NO: 1800824 - RNA, 15 nt, Human
augggguuucaccau

SEQ ID NO: 1800825 - RNA, 14 nt, Human
auggucuccaucuc

SEQ ID NO: 1800826 - RNA, 19 nt, Human
caacaucgcagacacaugu

SEQ ID NO: 1800827 - RNA, 19 nt, Human
caaccuucugaggagcugu

SEQ ID NO: 1800828 - RNA, 14 nt, Human
caaccggccaccag

SEQ ID NO: 1800829 - RNA, 13 nt, Human
caagcaguuugaa

SEQ ID NO: 1800830 - RNA, 17 nt, Human
caagcaguuugaaauug

SEQ ID NO: 1800831 - RNA, 15 nt, Human
caacuauggccugug

SEQ ID NO: 1800832 - RNA, 15 nt, Human
cacaccuuaucuaug

SEQ ID NO: 1800833 - RNA, 16 nt, Human
cacaaagcccaucaua

SEQ ID NO: 1800834 - RNA, 14 nt, Human
caaggguacacugc

SEQ ID NO: 1800835 - RNA, 18 nt, Human
cagaguuggugacacagc

SEQ ID NO: 1800836 - RNA, 20 nt, Human
cagauccuccucauucacau

SEQ ID NO: 1800837 - RNA, 18 nt, Human
cagaccagcaggcuggcc

SEQ ID NO: 1800838 - RNA, 16 nt, Human
caaucuuugacaauug

SEQ ID NO: 1800839 - RNA, 17 nt, Human
cagccaggcccagagca

SEQ ID NO: 1800840 - RNA, 17 nt, Human
cagcccugcaccaugcu

SEQ ID NO: 1800841 - RNA, 20 nt, Human
cagcccugcaccaugcugcu

SEQ ID NO: 1800842 - RNA, 19 nt, Human
ggaaaaaauaacaaugaaa

SEQ ID NO: 1800843 - RNA, 20 nt, Human
gcuucuuaaaauagccauaa

SEQ ID NO: 1800844 - RNA, 20 nt, Human
ggaagaauuuuuauauccac

SEQ ID NO: 1800845 - RNA, 21 nt, Human
gcuuccacuaggguccaccag

SEQ ID NO: 1800846 - RNA, 22 nt, Human
gcuguucccaccaggcugcuca

SEQ ID NO: 1800847 - RNA, 20 nt, Human
gcuggggcauggaaggcaag

SEQ ID NO: 1800848 - RNA, 16 nt, Human
gcuguguggcagucug

SEQ ID NO: 1800849 - RNA, 11 nt, Human
gcccaaacugc

SEQ ID NO: 1800850 - RNA, 22 nt, Human
gcucuaauguacaauaaagcaa

SEQ ID NO: 1800851 - RNA, 11 nt, Human
gcugccggcac

SEQ ID NO: 1800852 - RNA, 19 nt, Human
gcugcccccagagccacag

SEQ ID NO: 1800853 - RNA, 22 nt, Human
gagcuuaacccuggaaaaugaa

SEQ ID NO: 1800854 - RNA, 21 nt, Human
gaggcucuaauguacaauaaa

SEQ ID NO: 1800855 - RNA, 13 nt, Human
gaggcaggcacug

SEQ ID NO: 1800856 - RNA, 23 nt, Human
gagccgagauugugccccugcac

SEQ ID NO: 1800857 - RNA, 15 nt, Human
gacacaugcugaaca

SEQ ID NO: 1800858 - RNA, 17 nt, Human
gacacaugugcuggcca

SEQ ID NO: 1800859 - RNA, 19 nt, Human
gaauuuuuuuuaacauucc

SEQ ID NO: 1800860 - RNA, 16 nt, Human
gacaggguuucaccau

SEQ ID NO: 1800861 - RNA, 21 nt, Human
gacagugaaagaaaauaacga

SEQ ID NO: 1800862 - RNA, 22 nt, Human
gaucaaguccugcaagcagagg

SEQ ID NO: 1800863 - RNA, 22 nt, Human
gauacaaacauguuccugggau

SEQ ID NO: 1800864 - RNA, 14 nt, Human
gaucucagcucacu

SEQ ID NO: 1800865 - RNA, 15 nt, Human
gaugaaauaaguuaa

SEQ ID NO: 1800866 - RNA, 15 nt, Human
gagucagucugauga

SEQ ID NO: 1800867 - RNA, 20 nt, Human
gagugaagggaagagacagc

SEQ ID NO: 1800868 - RNA, 18 nt, Human
gaggcuguucccaccagg

SEQ ID NO: 1800869 - RNA, 21 nt, Human
gagucaagggugugugcagca

SEQ ID NO: 1800870 - RNA, 15 nt, Human
gcccagcggcaucag

SEQ ID NO: 1800871 - RNA, 17 nt, Human
gccaggcuggucucaaa

SEQ ID NO: 1800872 - RNA, 12 nt, Human
cggcaucaggcu

SEQ ID NO: 1800873 - RNA, 23 nt, Human
cgcucucuggccuucggccucca

SEQ ID NO: 1800874 - RNA, 18 nt, Human
cggcuuccuuccucucug

SEQ ID NO: 1800875 - RNA, 13 nt, Human
cggguuucaccau

SEQ ID NO: 1800876 - RNA, 16 nt, Human
cggguuucaccauguu

SEQ ID NO: 1800877 - RNA, 16 nt, Human
cggccuccauccugag

SEQ ID NO: 1800878 - RNA, 18 nt, Human
cguauucccauuagacca

SEQ ID NO: 1800879 - RNA, 21 nt, Human
cugcucagcccugcaccaugc

SEQ ID NO: 1800880 - RNA, 22 nt, Human
cugcugagccccaaguggaacg

SEQ ID NO: 1800881 - RNA, 17 nt, Human
cugcugagugcaccacu

SEQ ID NO: 1800882 - RNA, 14 nt, Human
cuggaaacacaugu

SEQ ID NO: 1800883 - RNA, 21 nt, Human
cuacccaguagaugccacuag

SEQ ID NO: 1800884 - RNA, 15 nt, Human
cuacaggcgugagcc

SEQ ID NO: 1800885 - RNA, 15 nt, Human
cgugagccaccaugc

SEQ ID NO: 1800886 - RNA, 16 nt, Human
cguugaacgucacauc

SEQ ID NO: 1800887 - RNA, 13 nt, Human
cuaaacauccuaa

SEQ ID NO: 1800888 - RNA, 15 nt, Human
cuaacgagaaauaga

SEQ ID NO: 1800889 - RNA, 18 nt, Human
gaauugaggacacugaua

SEQ ID NO: 1800890 - RNA, 21 nt, Human
gaauugcagaguacuggcuga

SEQ ID NO: 1800891 - RNA, 15 nt, Human
gaauccucucucugu

SEQ ID NO: 1800892 - RNA, 12 nt, Human
gaaugguaucaa

SEQ ID NO: 1800893 - RNA, 20 nt, Human
gaacuuccagauccuggaaa

SEQ ID NO: 1800894 - RNA, 16 nt, Human
gaacugucucucauga

SEQ ID NO: 1800895 - RNA, 16 nt, Human
gaagggguucucacag

SEQ ID NO: 1800896 - RNA, 18 nt, Human
gaagggguucucacagug

SEQ ID NO: 1800897 - RNA, 22 nt, Human
gaaguaucuugguugugacaga

SEQ ID NO: 1800898 - RNA, 18 nt, Human
cuugccuugcugaacucc

SEQ ID NO: 1800899 - RNA, 16 nt, Human
cuugcuuuuaaaaucc

SEQ ID NO: 1800900 - RNA, 16 nt, Human
cuuggacuucuugaaa

SEQ ID NO: 1800901 - RNA, 18 nt, Human
cuuggagcccacacaugg

SEQ ID NO: 1800902 - RNA, 12 nt, Human
cuugccaaauuu

SEQ ID NO: 1800903 - RNA, 13 nt, Human
cuucuugaaauca

SEQ ID NO: 1800904 - RNA, 23 nt, Human
cuucuuggccaugggaggccuuu

SEQ ID NO: 1800905 - RNA, 19 nt, Human
cuucaaauccuugaagauu

SEQ ID NO: 1800906 - RNA, 21 nt, Human
cuguucauuccuccagguauu

SEQ ID NO: 1800907 - RNA, 15 nt, Human
cugugugcucaggag

SEQ ID NO: 1800908 - RNA, 17 nt, Human
cuuaaccagaucauugu

SEQ ID NO: 1800909 - RNA, 13 nt, Human
cuuaccagauuuu

SEQ ID NO: 1800910 - RNA, 20 nt, Human
cuuacugauuuuuaaguuau

SEQ ID NO: 1800911 - RNA, 16 nt, Human
cugggauuacaggcgu

SEQ ID NO: 1800912 - RNA, 18 nt, Human
cuguccaaucuuugacaa

SEQ ID NO: 1800913 - RNA, 14 nt, Human
cugucccaaacaug

SEQ ID NO: 1800914 - RNA, 18 nt, Human
cuguauacaaaacccuuu

SEQ ID NO: 1800915 - RNA, 13 nt, Human
cuggcuucagcaa

SEQ ID NO: 1800916 - RNA, 11 nt, Human
cuggguucaag

SEQ ID NO: 1800917 - RNA, 16 nt, Human
cuggacuugccuccag

SEQ ID NO: 1800918 - RNA, 23 nt, Human
cuggccuucggccuccauccuga

SEQ ID NO: 1800919 - RNA, 16 nt, Human
uauuaaauagagaaau

SEQ ID NO: 1800920 - RNA, 15 nt, Human
uaucuuuuuauucag

SEQ ID NO: 1800921 - RNA, 21 nt, Human
uaugccuuuucccaacuccag

SEQ ID NO: 1800922 - RNA, 20 nt, Human
uaugugccagauuuaugcau

SEQ ID NO: 1800923 - RNA, 20 nt, Human
uauguuaaacuagcauaucu

SEQ ID NO: 1800924 - RNA, 23 nt, Human
uaaaccaaggcuagaaccaccug

SEQ ID NO: 1800925 - RNA, 17 nt, Human
uaaaguaaaggcaaacu

SEQ ID NO: 1800926 - RNA, 15 nt, Human
uaaccaacacccuga

SEQ ID NO: 1800927 - RNA, 20 nt, Human
uaaccaggggccaugaauca

SEQ ID NO: 1800928 - RNA, 15 nt, Human
uagcuggcucuguga

SEQ ID NO: 1800929 - RNA, 17 nt, Human
uaguuguaccgcaaugu

SEQ ID NO: 1800930 - RNA, 16 nt, Human
ggauucuuccaucuga

SEQ ID NO: 1800931 - RNA, 16 nt, Human
guagaauauauuuccu

SEQ ID NO: 1800932 - RNA, 23 nt, Human
guauaaaaauaaaaaagauccca

SEQ ID NO: 1800933 - RNA, 20 nt, Human
guagagacggguuucaccau

SEQ ID NO: 1800934 - RNA, 17 nt, Human
guaucugaggcacaugu

SEQ ID NO: 1800935 - RNA, 21 nt, Human
ggagaugggguuucaccaugu

SEQ ID NO: 1800936 - RNA, 14 nt, Human
gucuacacagaugu

SEQ ID NO: 1800937 - RNA, 12 nt, Human
gugaaacccugu

SEQ ID NO: 1800938 - RNA, 17 nt, Human
gugaaagaaaauaacga

SEQ ID NO: 1800939 - RNA, 13 nt, Human
guauucguuaucu

SEQ ID NO: 1800940 - RNA, 22 nt, Human
gucccaucuagggaaggcugga

SEQ ID NO: 1800941 - RNA, 17 nt, Human
guuucugaguuccugca

SEQ ID NO: 1800942 - RNA, 15 nt, Human
guuuaaauuaguuag

SEQ ID NO: 1800943 - RNA, 20 nt, Human
guuuuaaucuguauuucccc

SEQ ID NO: 1800944 - RNA, 17 nt, Human
uaaaaacaaagaaauua

SEQ ID NO: 1800945 - RNA, 18 nt, Human
ugaacccgggaggcagag

SEQ ID NO: 1800946 - RNA, 14 nt, Human
uccuuauauuuacu

SEQ ID NO: 1800947 - RNA, 15 nt, Human
uccuucccuuucauu

SEQ ID NO: 1800948 - RNA, 19 nt, Human
uccuuuuuuauuccauaag

SEQ ID NO: 1800949 - RNA, 14 nt, Human
uccgcgccaggaug

SEQ ID NO: 1800950 - RNA, 18 nt, Human
ucccuggauuuuuaccag

SEQ ID NO: 1800951 - RNA, 19 nt, Human
uccucccuguguauucauu

SEQ ID NO: 1800952 - RNA, 14 nt, Human
ucccauucccccag

SEQ ID NO: 1800953 - RNA, 22 nt, Human
ucccugaagaucuagugaacau

SEQ ID NO: 1800954 - RNA, 20 nt, Human
ugcggccagcuccgcgccag

SEQ ID NO: 1800955 - RNA, 23 nt, Human
ugcuaagccccagcaagcaaucc

SEQ ID NO: 1800956 - RNA, 17 nt, Human
ugccuucuggccuugua

SEQ ID NO: 1800957 - RNA, 22 nt, Human
ugccugcuuuuuauggccugug

SEQ ID NO: 1800958 - RNA, 15 nt, Human
ugccuaagugcagcc

SEQ ID NO: 1800959 - RNA, 23 nt, Human
ugaagcuuuuaugugaaacaugu

SEQ ID NO: 1800960 - RNA, 20 nt, Human
ugaacuaggcugagcaaucu

SEQ ID NO: 1800961 - RNA, 21 nt, Human
ugaacuggacccuguugcuaa

SEQ ID NO: 1800962 - RNA, 19 nt, Human
ugaccucaggcaaucugcc

SEQ ID NO: 1800963 - RNA, 18 nt, Human
ugacugccaagccauggg

SEQ ID NO: 1800964 - RNA, 18 nt, Human
uggacacacaaauuaucu

SEQ ID NO: 1800965 - RNA, 21 nt, Human
uggacugugugcucaggagcc

SEQ ID NO: 1800966 - RNA, 21 nt, Human
uggagaugggguuucaccaug

SEQ ID NO: 1800967 - RNA, 21 nt, Human
uggagggaccuugucucccag

SEQ ID NO: 1800968 - RNA, 16 nt, Human
uggccuucggccucca

SEQ ID NO: 1800969 - RNA, 15 nt, Human
ugggagccagggcug

SEQ ID NO: 1800970 - RNA, 14 nt, Human
uggcuucaaauugu

SEQ ID NO: 1800971 - RNA, 20 nt, Human
uggcucucccagccagguuc

SEQ ID NO: 1800972 - RNA, 22 nt, Human
uggucucagugucaaugcagcc

SEQ ID NO: 1800973 - RNA, 23 nt, Human
ugguaaccucuuacuuauuaucu

SEQ ID NO: 1800974 - RNA, 22 nt, Human
ugggcccaguaccuagcuggcu

SEQ ID NO: 1800975 - RNA, 18 nt, Human
ugguguacauucuuccug

SEQ ID NO: 1800976 - RNA, 17 nt, Human
ugucuccucucucugua

SEQ ID NO: 1800977 - RNA, 18 nt, Human
ugucuugcuugauuguau

SEQ ID NO: 1800978 - RNA, 17 nt, Human
uguggagagggaaugug

SEQ ID NO: 1800979 - RNA, 14 nt, Human
uguuuauaaacauu

SEQ ID NO: 1800980 - RNA, 17 nt, Human
uuuuauuaauaaacauu

SEQ ID NO: 1800981 - RNA, 11 nt, Human
uuuuguucaua

SEQ ID NO: 1800982 - RNA, 13 nt, Human
uuuucuuuucauu

SEQ ID NO: 1800983 - RNA, 22 nt, Human
uuugaacuagaguuuagcugga

SEQ ID NO: 1800984 - RNA, 15 nt, Human
ugaaauaagccagac

SEQ ID NO: 1800985 - RNA, 15 nt, Human
ucuuaucuaaucaug

SEQ ID NO: 1800986 - RNA, 12 nt, Human
ucuuucaaaauu

SEQ ID NO: 1800987 - RNA, 19 nt, Human
ugucuuguuggacgagaaa

SEQ ID NO: 1800988 - RNA, 14 nt, Human
ugucacccagguug

SEQ ID NO: 1800989 - RNA, 12 nt, Human
uguacuugcucu

SEQ ID NO: 1800990 - RNA, 15 nt, Human
uguaucuagccugga

SEQ ID NO: 1800991 - RNA, 22 nt, Human
ugguucuucuuggucucagugu

SEQ ID NO: 1800992 - RNA, 17 nt, Human
ugggguuucaccauguu

SEQ ID NO: 1800993 - RNA, 16 nt, Human
ugggucgcccuggacu

SEQ ID NO: 1800994 - RNA, 18 nt, Human
ucugacuguuuccaucaa

SEQ ID NO: 1800995 - RNA, 22 nt, Human
ucugaugagaacucugagcagu

SEQ ID NO: 1800996 - RNA, 15 nt, Human
ucuggccuuguaaga

SEQ ID NO: 1800997 - RNA, 16 nt, Human
ucuuaagaagacugca

SEQ ID NO: 1800998 - RNA, 18 nt, Human
ucuucuuuuaaaccauuu

SEQ ID NO: 1800999 - RNA, 20 nt, Human
ucuugaaucucugaauuuga

SEQ ID NO: 1801000 - RNA, 18 nt, Human
ucgcccagcggcaucagg

SEQ ID NO: 1801001 - RNA, 19 nt, Human
ucgucuucuuggccauggg

SEQ ID NO: 1801002 - RNA, 15 nt, Human
uccuuggugauuccg

SEQ ID NO: 1801003 - RNA, 20 nt, Human
uccuuggugauuccgcagug

SEQ ID NO: 1801004 - RNA, 16 nt, Human
uccuuauauuauggag

SEQ ID NO: 1801005 - RNA, 19 nt, Human
uuccacuaggguccaccag

SEQ ID NO: 1801006 - RNA, 12 nt, Human
uuccuuauucag

SEQ ID NO: 1801007 - RNA, 17 nt, Human
uuccuucauuuccuccg

SEQ ID NO: 1801008 - RNA, 15 nt, Human
uucucauaacucugu

SEQ ID NO: 1801009 - RNA, 17 nt, Human
uucuauucuagccugca

SEQ ID NO: 1801010 - RNA, 21 nt, Human
uguggccugaguaaugcauua

SEQ ID NO: 1801011 - RNA, 19 nt, Human
ugugcuaaaacaagcacua

SEQ ID NO: 1801012 - RNA, 13 nt, Human
ugucugagacaga

SEQ ID NO: 1801013 - RNA, 20 nt, Human
uguggccugaguaaugcauu

SEQ ID NO: 1801014 - RNA, 16 nt, Human
uuccaagugauugaaa

SEQ ID NO: 1801015 - RNA, 17 nt, Human
uucagugcugccgauaa

SEQ ID NO: 1801016 - RNA, 17 nt, Human
uugugcuugagccagga

SEQ ID NO: 1801017 - RNA, 15 nt, Human
uuguccuuagucaca

SEQ ID NO: 1801018 - RNA, 17 nt, Human
uuguaccgcaaugugac

SEQ ID NO: 1801019 - RNA, 15 nt, Human
uuguacuaugcuguu

SEQ ID NO: 1801020 - RNA, 18 nt, Human
uuuaauaaauuucaccaa

SEQ ID NO: 1801021 - RNA, 18 nt, Human
uuuacaaauagaauuuga

SEQ ID NO: 1801022 - RNA, 17 nt, Human
uuuagcaggaagcugug

SEQ ID NO: 1801023 - RNA, 21 nt, Human
uucuuugcccacaaugcuuug

SEQ ID NO: 1801024 - RNA, 19 nt, Human
uugagcccucuauggugug

SEQ ID NO: 1801025 - RNA, 15 nt, Human
uugaaggaugcuguc

SEQ ID NO: 1801026 - RNA, 18 nt, Human
uugagauguguucacaau

SEQ ID NO: 1801027 - RNA, 16 nt, Human
uuggaaaacccagaua

SEQ ID NO: 1801028 - RNA, 16 nt, Human
uuggcugaaaggaagc

SEQ ID NO: 1801029 - RNA, 16 nt, Human
uugggacuacaggcgu

SEQ ID NO: 1801030 - RNA, 15 nt, Human
uaaugaauaaacauu

SEQ ID NO: 1801031 - RNA, 20 nt, Human
uacagauccccaagccuggc

SEQ ID NO: 1801032 - RNA, 19 nt, Human
uacacuccagugagacagc

SEQ ID NO: 1801033 - RNA, 11 nt, Human
guucaagauug

SEQ ID NO: 1801034 - RNA, 11 nt, Human
guucacaaugg

SEQ ID NO: 1801035 - RNA, 15 nt, Human
uaaguaaggaauuuu

SEQ ID NO: 1801036 - RNA, 19 nt, Human
guggccaagccaaccgugg

SEQ ID NO: 1801037 - RNA, 23 nt, Human
gugcugggccccugccucucugc

SEQ ID NO: 1801038 - RNA, 22 nt, Human
gugcuugagccaggaggccugc

SEQ ID NO: 1801039 - RNA, 18 nt, Human
guuaggguuggagcaggg

SEQ ID NO: 1801040 - RNA, 15 nt, Human
guuaaugcucuggac

SEQ ID NO: 1801041 - RNA, 15 nt, Human
guuacuacaugcacu

SEQ ID NO: 1801042 - RNA, 17 nt, Human
guauguguaucucacac

SEQ ID NO: 1801043 - RNA, 14 nt, Human
guacuugcucuuga

SEQ ID NO: 1801044 - RNA, 14 nt, Human
gucaaggguucaag

SEQ ID NO: 1801045 - RNA, 22 nt, Human
guccugaccugucucaccaugu

SEQ ID NO: 1801046 - RNA, 21 nt, Human
gucucaaacuccugaccucag

SEQ ID NO: 1801047 - RNA, 22 nt, Human
gugauugaaaccuacacgagau

SEQ ID NO: 1801048 - RNA, 13 nt, Human
gugauuccgcagu

SEQ ID NO: 1801049 - RNA, 13 nt, Human
gugcauugugcuu

SEQ ID NO: 1801050 - RNA, 19 nt, Human
guggaauuuaaaucacuca

SEQ ID NO: 1801051 - RNA, 21 nt, Human
guggagaugggguuucaccau

SEQ ID NO: 1801052 - RNA, 23 nt, Human
guggagaugggguuucaccaugu

SEQ ID NO: 1801053 - RNA, 14 nt, Human
gucuucuuugccca

SEQ ID NO: 1801054 - RNA, 20 nt, Human
gucuucuuugcccacaaugc

SEQ ID NO: 1801055 - RNA, 18 nt, Human
uaccugcucagcccugca

SEQ ID NO: 1801056 - RNA, 13 nt, Human
uauuuuaaucacc

SEQ ID NO: 1801057 - RNA, 19 nt, Human
uauguguaucucacacuca

SEQ ID NO: 1801058 - RNA, 13 nt, Human
uauuuaauucaug

SEQ ID NO: 1801059 - RNA, 22 nt, Human
ucaaaauuacccuaaacauccu

SEQ ID NO: 1801060 - RNA, 22 nt, Human
ucccuccuuggugauuccgcag

SEQ ID NO: 1801061 - RNA, 14 nt, Human
ucccaacuccagaa

SEQ ID NO: 1801062 - RNA, 12 nt, Human
ucccaaacaugc

SEQ ID NO: 1801063 - RNA, 22 nt, Human
uccucuuuaauggguaaacagc

SEQ ID NO: 1801064 - RNA, 14 nt, Human
uccugaccucaggc

SEQ ID NO: 1801065 - RNA, 16 nt, Human
uccucagggacucagg

SEQ ID NO: 1801066 - RNA, 14 nt, Human
uccuaccacaaugc

SEQ ID NO: 1801067 - RNA, 22 nt, Human
ggagacaaaacuagagacucaa

SEQ ID NO: 1801068 - RNA, 17 nt, Human
ggagaugguggaugauc

SEQ ID NO: 1801069 - RNA, 18 nt, Human
ggacauuugcucauggaa

SEQ ID NO: 1801070 - RNA, 21 nt, Human
ggaaggcuuacacccacagug

SEQ ID NO: 1801071 - RNA, 23 nt, Human
ggaacccuacaccccaacccugg

SEQ ID NO: 1801072 - RNA, 21 nt, Human
ggcaggaacaaacagggcugc

SEQ ID NO: 1801073 - RNA, 13 nt, Human
ggcauagcccugc

SEQ ID NO: 1801074 - RNA, 17 nt, Human
ggcaugcgccaccaugg

SEQ ID NO: 1801075 - RNA, 12 nt, Human
ggccaggcuggg

SEQ ID NO: 1801076 - RNA, 23 nt, Human
ggauggcaaccagaccauugucu

SEQ ID NO: 1801077 - RNA, 19 nt, Human
ggcaagggaauuucuucaa

SEQ ID NO: 1801078 - RNA, 16 nt, Human
ggcacagaaacuccug

SEQ ID NO: 1801079 - RNA, 15 nt, Human
ccccuugguucucau

SEQ ID NO: 1801080 - RNA, 16 nt, Human
gcugggucgcccugga

SEQ ID NO: 1801081 - RNA, 11 nt, Human
cccccaacagc

SEQ ID NO: 1801082 - RNA, 14 nt, Human
gcugcgcagcaucc

SEQ ID NO: 1801083 - RNA, 23 nt, Human
ggaaagaagaaggugggaggaug

SEQ ID NO: 1801084 - RNA, 21 nt, Human
ggaaagcuucagugcugccga

SEQ ID NO: 1801085 - RNA, 20 nt, Human
ggaaaggaccaguaugcuug

SEQ ID NO: 1801086 - RNA, 24 nt, Human
guaguccuguaauggaagcaucua

SEQ ID NO: 1801087 - RNA, 20 nt, Human
guauaauauuaauaauaccu

SEQ ID NO: 1801088 - RNA, 16 nt, Human
guauaauucacauugu

SEQ ID NO: 1801089 - RNA, 17 nt, Human
gguuugcaauccaagca

SEQ ID NO: 1801090 - RNA, 21 nt, Human
ggucuaggacacaguuccugg

SEQ ID NO: 1801091 - RNA, 18 nt, Human
ggguucaagcgauucucu

SEQ ID NO: 1801092 - RNA, 22 nt, Human
ggggcauggaaggcaagauugu

SEQ ID NO: 1801093 - RNA, 21 nt, Human
gggagaaucacuugaacccgg

SEQ ID NO: 1801094 - RNA, 15 nt, Human
ggcugagcaaucuga

SEQ ID NO: 1801095 - RNA, 18 nt, Human
ggcugagccucagucucc

SEQ ID NO: 1801096 - RNA, 16 nt, Human
ggcuugccugcaggca

SEQ ID NO: 1801097 - RNA, 21 nt, Human
gggaaaaauguaggagacugu

SEQ ID NO: 1801098 - RNA, 18 nt, Human
ggccuugugaggagcugg

SEQ ID NO: 1801099 - RNA, 15 nt, Human
aaagagaacuuccag

SEQ ID NO: 1801100 - RNA, 18 nt, Human
aaagagggagugcauuua

SEQ ID NO: 1801101 - RNA, 16 nt, Human
aaagauaucucaucuc

SEQ ID NO: 1801102 - RNA, 21 nt, Human
aaaguaccaggugaacaaagu

SEQ ID NO: 1801103 - RNA, 19 nt, Human
aaaguccugggauuacagg

SEQ ID NO: 1801104 - RNA, 18 nt, Human
aaagucuugccuugcuga

SEQ ID NO: 1801105 - RNA, 13 nt, Human
aaacaggcaaauu

SEQ ID NO: 1801106 - RNA, 23 nt, Human
aaacauguuccugggaucacuga

SEQ ID NO: 1801107 - RNA, 22 nt, Human
aaaccaggacccuguccaaucu

SEQ ID NO: 1801108 - RNA, 17 nt, Human
aaacugcaaagcucggu

SEQ ID NO: 1801109 - RNA, 13 nt, Human
aaaaguauccaag

SEQ ID NO: 1801110 - RNA, 15 nt, Human
aauccucucucugug

SEQ ID NO: 1801111 - RNA, 15 nt, Human
aaugaacuuuccaca

SEQ ID NO: 1801112 - RNA, 15 nt, Human
aauauuccuuaagau

SEQ ID NO: 1801113 - RNA, 22 nt, Human
aauauuagaaacagcuucucaa

SEQ ID NO: 1801114 - RNA, 21 nt, Human
aagguacuucaaauccuugaa

SEQ ID NO: 1801115 - RNA, 22 nt, Human
aaggacuuuauagaucagccag

SEQ ID NO: 1801116 - RNA, 17 nt, Human
aagcuguguggcagucu

SEQ ID NO: 1801117 - RNA, 19 nt, Human
aaagcaucauggcuaucug

SEQ ID NO: 1801118 - RNA, 17 nt, Human
aaaccaggacccugucc

SEQ ID NO: 1801119 - RNA, 19 nt, Human
aaaaaguaaaugugauuua

SEQ ID NO: 1801120 - RNA, 13 nt, Human
aaaagaaaaagau

SEQ ID NO: 1801121 - RNA, 16 nt, Human
acaggcgugagccacc

SEQ ID NO: 1801122 - RNA, 18 nt, Human
acauauauaacaaugcug

SEQ ID NO: 1801123 - RNA, 23 nt, Human
acagggaugaggcagaccugacu

SEQ ID NO: 1801124 - RNA, 20 nt, Human
acauuaauuaucuaguuuaa

SEQ ID NO: 1801125 - RNA, 17 nt, Human
acauuacucugaaauug

SEQ ID NO: 1801126 - RNA, 15 nt, Human
acauuuuuaguuuaa

SEQ ID NO: 1801127 - RNA, 18 nt, Human
acaugauuccagccauca

SEQ ID NO: 1801128 - RNA, 17 nt, Human
acauuguauaguuggaa

SEQ ID NO: 1801129 - RNA, 23 nt, Human
aaucauucuuauuucaugaaaau

SEQ ID NO: 1801130 - RNA, 19 nt, Human
aauguacaauaaagcaaug

SEQ ID NO: 1801131 - RNA, 16 nt, Human
aauggaggccuguccu

SEQ ID NO: 1801132 - RNA, 20 nt, Human
aaugugauuuacgcucauug

SEQ ID NO: 1801133 - RNA, 11 nt, Human
aauuaaucugu

SEQ ID NO: 1801134 - RNA, 15 nt, Human
aauugauuuugaacc

SEQ ID NO: 1801135 - RNA, 23 nt, Human
aauugccugacgaacuccuugau

SEQ ID NO: 1801136 - RNA, 21 nt, Human
aauuagugcuaagugugaacu

SEQ ID NO: 1801137 - RNA, 20 nt, Human
aauuguaacuaaaguuagaa

SEQ ID NO: 1801138 - RNA, 16 nt, Human
aauuucuauuugaucu

SEQ ID NO: 1801139 - RNA, 19 nt, Human
aauuucuguucuuccauca

SEQ ID NO: 1801140 - RNA, 16 nt, Human
acaaaaguuucauccu

SEQ ID NO: 1801141 - RNA, 18 nt, Human
acucuguccagccccgua

SEQ ID NO: 1801142 - RNA, 17 nt, Human
acuguugcauauaccag

SEQ ID NO: 1801143 - RNA, 13 nt, Human
acgcucucuggcc

SEQ ID NO: 1801144 - RNA, 15 nt, Human
acggggacucagccc

SEQ ID NO: 1801145 - RNA, 20 nt, Human
accggagaaccccaggacgc

SEQ ID NO: 1801146 - RNA, 18 nt, Human
acccugaggugagcauca

SEQ ID NO: 1801147 - RNA, 15 nt, Human
accugcucagcccug

SEQ ID NO: 1801148 - RNA, 19 nt, Human
accugcucagcccugcacc

SEQ ID NO: 1801149 - RNA, 16 nt, Human
accuucugaggagcug

SEQ ID NO: 1801150 - RNA, 14 nt, Human
acgcccaggacccc

SEQ ID NO: 1801151 - RNA, 13 nt, Human
acccagauaaagg

SEQ ID NO: 1801152 - RNA, 12 nt, Human
acccaguagaug

SEQ ID NO: 1801153 - RNA, 17 nt, Human
acccaguagaugccacu

SEQ ID NO: 1801154 - RNA, 15 nt, Human
accaggucacgcuuu

SEQ ID NO: 1801155 - RNA, 14 nt, Human
aauaaguauucugu

SEQ ID NO: 1801156 - RNA, 21 nt, Human
aauaauuuuuauauuugaaau

SEQ ID NO: 1801157 - RNA, 19 nt, Human
aauacuugcuucuucccaa

SEQ ID NO: 1801158 - RNA, 16 nt, Human
aauagugauuuccaca

SEQ ID NO: 1801159 - RNA, 12 nt, Human
aauauuccucag

SEQ ID NO: 1801160 - RNA, 21 nt, Human
aaucccgauucacccugucca

SEQ ID NO: 1801161 - RNA, 14 nt, Human
aaugaaguuugaau

SEQ ID NO: 1801162 - RNA, 13 nt, Human
aauaaagcaaugu

SEQ ID NO: 1801163 - RNA, 12 nt, Human
aaguugauaagu

SEQ ID NO: 1801164 - RNA, 18 nt, Human
aagugcuggcauuacagg

SEQ ID NO: 1801165 - RNA, 23 nt, Human
aagugcuucuccagccucagccu

SEQ ID NO: 1801166 - RNA, 20 nt, Human
agaauaugccuuguuucaua

SEQ ID NO: 1801167 - RNA, 19 nt, Human
agaauuugagcaucaguga

SEQ ID NO: 1801168 - RNA, 16 nt, Human
agaacuuggaaauagu

SEQ ID NO: 1801169 - RNA, 18 nt, Human
agaacuuggaaauaguga

SEQ ID NO: 1801170 - RNA, 19 nt, Human
agaaccccaggacgcccuc

SEQ ID NO: 1801171 - RNA, 20 nt, Human
acuuuuggcauuuuacugua

SEQ ID NO: 1801172 - RNA, 18 nt, Human
acuuuauguuacuacaug

SEQ ID NO: 1801173 - RNA, 17 nt, Human
acuugcugcaguaugaa

SEQ ID NO: 1801174 - RNA, 21 nt, Human
aucgcagacacaugugcuggc

SEQ ID NO: 1801175 - RNA, 22 nt, Human
aucuaauagggcaauuaauucc

SEQ ID NO: 1801176 - RNA, 17 nt, Human
aucuuuuuacuaaacuc

SEQ ID NO: 1801177 - RNA, 20 nt, Human
auccugaugagguuucuacu

SEQ ID NO: 1801178 - RNA, 13 nt, Human
auccuaagcucau

SEQ ID NO: 1801179 - RNA, 17 nt, Human
auuaccaguuuuccuaa

SEQ ID NO: 1801180 - RNA, 11 nt, Human
augagauauua

SEQ ID NO: 1801181 - RNA, 19 nt, Human
auuccucacuuugaagagu

SEQ ID NO: 1801182 - RNA, 20 nt, Human
auucuuuuaguuuuuaaagu

SEQ ID NO: 1801183 - RNA, 22 nt, Human
auuccaccuacaugagguacug

SEQ ID NO: 1801184 - RNA, 21 nt, Human
auuauuuuugagacagagucu

SEQ ID NO: 1801185 - RNA, 13 nt, Human
auuguuacuggua

SEQ ID NO: 1801186 - RNA, 16 nt, Human
auuguuacugguacca

SEQ ID NO: 1801187 - RNA, 18 nt, Human
auuuaugagcucuucaug

SEQ ID NO: 1801188 - RNA, 21 nt, Human
auugugcuggaaauggacaca

SEQ ID NO: 1801189 - RNA, 22 nt, Human
auuuuaauaauguuucaaacau

SEQ ID NO: 1801190 - RNA, 17 nt, Human
auuugagauacaaacau

SEQ ID NO: 1801191 - RNA, 19 nt, Human
caaacauauauaacaaugc

SEQ ID NO: 1801192 - RNA, 14 nt, Human
caaaggcacacagc

SEQ ID NO: 1801193 - RNA, 18 nt, Human
caaaaucauaagauauuu

SEQ ID NO: 1801194 - RNA, 18 nt, Human
auuuugugaagcaaaauu

SEQ ID NO: 1801195 - RNA, 18 nt, Human
auuuugaugaacaaaauu

SEQ ID NO: 1801196 - RNA, 13 nt, Human
auuuuuacacaug

SEQ ID NO: 1801197 - RNA, 14 nt, Human
auuuuauuaggagu

SEQ ID NO: 1801198 - RNA, 21 nt, Human
caccuuagaccaccaagccuu

SEQ ID NO: 1801199 - RNA, 19 nt, Human
cacguacugcagccuccag

SEQ ID NO: 1801200 - RNA, 14 nt, Human
caaauccaaugaaa

SEQ ID NO: 1801201 - RNA, 21 nt, Human
caaaguccugggauuacaggu

SEQ ID NO: 1801202 - RNA, 21 nt, Human
caaagugcuggcauuacaggu

SEQ ID NO: 1801203 - RNA, 14 nt, Human
cacaugauccugca

SEQ ID NO: 1801204 - RNA, 22 nt, Human
cacagcauggagucacagccac

SEQ ID NO: 1801205 - RNA, 21 nt, Human
cacccucuccagaugagagua

SEQ ID NO: 1801206 - RNA, 23 nt, Human
cacaugucuuaaugaaguuugaa

SEQ ID NO: 1801207 - RNA, 23 nt, Human
cacauuuaaauaaaguguuugaa

SEQ ID NO: 1801208 - RNA, 19 nt, Human
cacauuuucccuucccuga

SEQ ID NO: 1801209 - RNA, 21 nt, Human
caccaccucaccaguuuccag

SEQ ID NO: 1801210 - RNA, 22 nt, Human
agcucacugcaaccuccaccuc

SEQ ID NO: 1801211 - RNA, 12 nt, Human
agcucagggcuc

SEQ ID NO: 1801212 - RNA, 23 nt, Human
agccugccuccccugccucacca

SEQ ID NO: 1801213 - RNA, 19 nt, Human
agccccaucuccucagcac

SEQ ID NO: 1801214 - RNA, 16 nt, Human
acauccucuaugccag

SEQ ID NO: 1801215 - RNA, 22 nt, Human
acauggaagaccucauuuugaa

SEQ ID NO: 1801216 - RNA, 18 nt, Human
acauguaauaagguugaa

SEQ ID NO: 1801217 - RNA, 18 nt, Human
accaaaaaucucaauauu

SEQ ID NO: 1801218 - RNA, 17 nt, Human
acccaguagaugccacc

SEQ ID NO: 1801219 - RNA, 16 nt, Human
aauuacacuuugaacu

SEQ ID NO: 1801220 - RNA, 15 nt, Human
acagagacagaaagc

SEQ ID NO: 1801221 - RNA, 18 nt, Human
acaggcaaauuccugacu

SEQ ID NO: 1801222 - RNA, 17 nt, Human
aaucuguauuuccccaa

SEQ ID NO: 1801223 - RNA, 19 nt, Human
aguuucugaguuuuaccaa

SEQ ID NO: 1801224 - RNA, 18 nt, Human
aguuguugcccacagcug

SEQ ID NO: 1801225 - RNA, 22 nt, Human
aggcugagaugggagaaucacu

SEQ ID NO: 1801226 - RNA, 20 nt, Human
aggcuccacuuggucuguga

SEQ ID NO: 1801227 - RNA, 21 nt, Human
aguguuggagaagaacugaaa

SEQ ID NO: 1801228 - RNA, 22 nt, Human
auacaugcauacacucucaaag

SEQ ID NO: 1801229 - RNA, 21 nt, Human
auacaugcuuuuuaaugagau

SEQ ID NO: 1801230 - RNA, 15 nt, Human
auacaauaaagaaug

SEQ ID NO: 1801231 - RNA, 21 nt, Human
auaacucugugaucuugcucu

SEQ ID NO: 1801232 - RNA, 18 nt, Human
auaaauggcuuccuggca

SEQ ID NO: 1801233 - RNA, 13 nt, Human
auaaagugcuuug

SEQ ID NO: 1801234 - RNA, 14 nt, Human
agcuggggccaggc

SEQ ID NO: 1801235 - RNA, 15 nt, Human
agcugguggcucugu

SEQ ID NO: 1801236 - RNA, 19 nt, Human
agcucuccccuucucugua

SEQ ID NO: 1801237 - RNA, 20 nt, Human
agcuucucauccugcaggca

SEQ ID NO: 1801238 - RNA, 12 nt, Human
agcuucuccaac

SEQ ID NO: 1801239 - RNA, 18 nt, Human
agcuucagccaggagcug

SEQ ID NO: 1801240 - RNA, 19 nt, Human
aggaggcaaauaucuugaa

SEQ ID NO: 1801241 - RNA, 10 nt, Human
aggauaaagu

SEQ ID NO: 1801242 - RNA, 18 nt, Human
aggcacacaccaccacgc

SEQ ID NO: 1801243 - RNA, 15 nt, Human
aggcacacugagcca

SEQ ID NO: 1801244 - RNA, 13 nt, Human
aggacuagggcug

SEQ ID NO: 1801245 - RNA, 23 nt, Human
agcuuuguucuucuuaaagucaa

SEQ ID NO: 1801246 - RNA, 16 nt, Human
cagacucacuguggga

SEQ ID NO: 1801247 - RNA, 16 nt, Human
cagagucaaugaacuu

SEQ ID NO: 1801248 - RNA, 18 nt, Human
cagaguuccgacugccau

SEQ ID NO: 1801249 - RNA, 17 nt, Human
cacuacaaccuccgccu

SEQ ID NO: 1801250 - RNA, 21 nt, Human
cacuaguauuucuaugaaaua

SEQ ID NO: 1801251 - RNA, 20 nt, Human
cacgccuguaaucccagcau

SEQ ID NO: 1801252 - RNA, 13 nt, Human
cacuguacuugcu

SEQ ID NO: 1801253 - RNA, 15 nt, Human
caccuacaugaggua

SEQ ID NO: 1801254 - RNA, 21 nt, Human
cacauuccucugcccuuccug

SEQ ID NO: 1801255 - RNA, 12 nt, Human
caccccaacagc

SEQ ID NO: 1801256 - RNA, 16 nt, Human
cacauauccaggcacc

SEQ ID NO: 1801257 - RNA, 11 nt, Human
cacaugaaguc

SEQ ID NO: 1801258 - RNA, 12 nt, Human
caagcauucugu

SEQ ID NO: 1801259 - RNA, 22 nt, Human
cacagaccaaccuggaguugaa

SEQ ID NO: 1801260 - RNA, 17 nt, Human
caaugcuuugccccuga

SEQ ID NO: 1801261 - RNA, 23 nt, Human
caacagcacccucuccagaugca

SEQ ID NO: 1801262 - RNA, 22 nt, Human
caaagugcugggauuaacaggu

SEQ ID NO: 1801263 - RNA, 18 nt, Human
caaagucucuggaauuug

SEQ ID NO: 1801264 - RNA, 21 nt, Human
caaagugagcuccuaagccau

SEQ ID NO: 1801265 - RNA, 14 nt, Human
caaaugcaccaugu

SEQ ID NO: 1801266 - RNA, 18 nt, Human
auuuuagccuucucuguu

SEQ ID NO: 1801267 - RNA, 15 nt, Human
auucucccuugcucu

SEQ ID NO: 1801268 - RNA, 19 nt, Human
auugauuuugaaccugaug

SEQ ID NO: 1801269 - RNA, 19 nt, Human
auuccacagcugcucaaua

SEQ ID NO: 1801270 - RNA, 14 nt, Human
auuuauuacuguaa

SEQ ID NO: 1801271 - RNA, 17 nt, Human
cagcccuggcaacugcu

SEQ ID NO: 1801272 - RNA, 17 nt, Human
cagccucccaaagugcu

SEQ ID NO: 1801273 - RNA, 19 nt, Human
cagccucccaagcaccugg

SEQ ID NO: 1801274 - RNA, 23 nt, Human
cagccugaaagaggaaugaagua

SEQ ID NO: 1801275 - RNA, 14 nt, Human
caggacgcccucac

SEQ ID NO: 1801276 - RNA, 16 nt, Human
caggacuagggcugga

SEQ ID NO: 1801277 - RNA, 14 nt, Human
cagcuuuagccaag

SEQ ID NO: 1801278 - RNA, 11 nt, Human
caggcuggguc

SEQ ID NO: 1801279 - RNA, 20 nt, Human
cagguauccaaaaaugugua

SEQ ID NO: 1801280 - RNA, 19 nt, Human
caggucccuaauaaagcug

SEQ ID NO: 1801281 - RNA, 22 nt, Human
caggucuaccaaaaaucucaau

SEQ ID NO: 1801282 - RNA, 15 nt, Human
caggugugagccacg

SEQ ID NO: 1801283 - RNA, 15 nt, Human
cauauuuuucauagc

SEQ ID NO: 1801284 - RNA, 12 nt, Human
cauacagauuug

SEQ ID NO: 1801285 - RNA, 17 nt, Human
cauacuucuuaggguua

SEQ ID NO: 1801286 - RNA, 18 nt, Human
caucaggccuagaggccu

SEQ ID NO: 1801287 - RNA, 14 nt, Human
caucucagcucacu

SEQ ID NO: 1801288 - RNA, 12 nt, Human
caugggaggccu

SEQ ID NO: 1801289 - RNA, 20 nt, Human
cauggaaacgaagcaccauc

SEQ ID NO: 1801290 - RNA, 19 nt, Human
ccaacagcacccucuccag

SEQ ID NO: 1801291 - RNA, 16 nt, Human
caugguuuuaaucugu

SEQ ID NO: 1801292 - RNA, 16 nt, Human
cauugauuuaauguaa

SEQ ID NO: 1801293 - RNA, 16 nt, Human
cauugaggcaggcacu

SEQ ID NO: 1801294 - RNA, 23 nt, Human
cauuauaucaaaucuaccacugu

SEQ ID NO: 1801295 - RNA, 18 nt, Human
ccauccugaggcuccacu

SEQ ID NO: 1801296 - RNA, 19 nt, Human
ccaucucuuguuuaaauuc

SEQ ID NO: 1801297 - RNA, 21 nt, Human
cccaggaguacaccccaacag

SEQ ID NO: 1801298 - RNA, 12 nt, Human
ccagucucacau

SEQ ID NO: 1801299 - RNA, 16 nt, Human
ccagcuggggccaggc

SEQ ID NO: 1801300 - RNA, 21 nt, Human
ccaggaguacaccccaacagc

SEQ ID NO: 1801301 - RNA, 16 nt, Human
ccaccaguugaauuuc

SEQ ID NO: 1801302 - RNA, 18 nt, Human
ccacuuauaggaauugac

SEQ ID NO: 1801303 - RNA, 12 nt, Human
auggcuaucugu

SEQ ID NO: 1801304 - RNA, 20 nt, Human
auggcuaagcaaaaugugau

SEQ ID NO: 1801305 - RNA, 16 nt, Human
auguauguacuucaug

SEQ ID NO: 1801306 - RNA, 16 nt, Human
augucauuucauuucc

SEQ ID NO: 1801307 - RNA, 15 nt, Human
augucauuugcugga

SEQ ID NO: 1801308 - RNA, 20 nt, Human
augugcuuguaaaaagucaa

SEQ ID NO: 1801309 - RNA, 18 nt, Human
auguguauuacaaauauu

SEQ ID NO: 1801310 - RNA, 12 nt, Human
augucgcccuac

SEQ ID NO: 1801311 - RNA, 15 nt, Human
auuaaguaaugauaa

SEQ ID NO: 1801312 - RNA, 19 nt, Human
auuagaccaagcuugucca

SEQ ID NO: 1801313 - RNA, 16 nt, Human
auguuacuacaugcac

SEQ ID NO: 1801314 - RNA, 22 nt, Human
auguucacccaaccacauccca

SEQ ID NO: 1801315 - RNA, 17 nt, Human
auguucuaagaagugaa

SEQ ID NO: 1801316 - RNA, 16 nt, Human
auccuaucucuccaac

SEQ ID NO: 1801317 - RNA, 15 nt, Human
aucugcuaugcuauu

SEQ ID NO: 1801318 - RNA, 12 nt, Human
aucuggcucugg

SEQ ID NO: 1801319 - RNA, 22 nt, Human
aucuggcucuggacaggcacua

SEQ ID NO: 1801320 - RNA, 18 nt, Human
augaaagaggacaggcua

SEQ ID NO: 1801321 - RNA, 16 nt, Human
augaaaaccacauugg

SEQ ID NO: 1801322 - RNA, 21 nt, Human
augauuccagccaucaccuua

SEQ ID NO: 1801323 - RNA, 21 nt, Human
augagagacacacugaagaag

SEQ ID NO: 1801324 - RNA, 11 nt, Human
augaaguacuc

SEQ ID NO: 1801325 - RNA, 18 nt, Human
auaaaaauauauagcgac

SEQ ID NO: 1801326 - RNA, 13 nt, Human
auauauuccacca

SEQ ID NO: 1801327 - RNA, 21 nt, Human
aucacucuguucauuccucca

SEQ ID NO: 1801328 - RNA, 22 nt, Human
aucacucuguucauuccuccag

SEQ ID NO: 1801329 - RNA, 17 nt, Human
aucccgauucacccugu

SEQ ID NO: 1801330 - RNA, 18 nt, Human
auccacccgccucagccu

SEQ ID NO: 1801331 - RNA, 16 nt, Human
agccaggaggccugcu

SEQ ID NO: 1801332 - RNA, 18 nt, Human
agcccugggaggcucugg

SEQ ID NO: 1801333 - RNA, 12 nt, Human
uuuuuguucaua

SEQ ID NO: 1801334 - RNA, 18 nt, Human
uuuuaaaaaagaaacauu

SEQ ID NO: 1801335 - RNA, 11 nt, Human
uuugagacaga

SEQ ID NO: 1801336 - RNA, 20 nt, Human
uuugcaucugaaaauugaug

SEQ ID NO: 1801337 - RNA, 20 nt, Human
agcucacagaccuuugaacu

SEQ ID NO: 1801338 - RNA, 21 nt, Human
agcgagugggggccagccacg

SEQ ID NO: 1801339 - RNA, 16 nt, Human
agcggcaucaggcuuu

SEQ ID NO: 1801340 - RNA, 18 nt, Human
agccucuuagaugcaguu

SEQ ID NO: 1801341 - RNA, 18 nt, Human
agccuaagggauccugcc

SEQ ID NO: 1801342 - RNA, 15 nt, Human
agccucagccuccca

SEQ ID NO: 1801343 - RNA, 23 nt, Human
uuucccuccuuggugauuccgca

SEQ ID NO: 1801344 - RNA, 14 nt, Human
uuuacagagacaga

SEQ ID NO: 1801345 - RNA, 14 nt, Human
uuuauaugcuucug

SEQ ID NO: 1801346 - RNA, 20 nt, Human
ugcagacucacugugggaag

SEQ ID NO: 1801347 - RNA, 15 nt, Human
ugcagcaucagcauc

SEQ ID NO: 1801348 - RNA, 18 nt, Human
agcuucucaauuucuaca

SEQ ID NO: 1801349 - RNA, 18 nt, Human
agcuucucauccugcagg

SEQ ID NO: 1801350 - RNA, 17 nt, Human
aggaacaaacagggcug

SEQ ID NO: 1801351 - RNA, 16 nt, Human
aggcugcucagggcug

SEQ ID NO: 1801352 - RNA, 21 nt, Human
agcuggccuugugaggagcug

SEQ ID NO: 1801353 - RNA, 19 nt, Human
aggagguccuuaggccucu

SEQ ID NO: 1801354 - RNA, 17 nt, Human
agucuguuccccauggc

SEQ ID NO: 1801355 - RNA, 22 nt, Human
aguccaggcuuuuuuaucaugu

SEQ ID NO: 1801356 - RNA, 14 nt, Human
agucacaaagccca

SEQ ID NO: 1801357 - RNA, 20 nt, Human
aguaucugaggcacauguca

SEQ ID NO: 1801358 - RNA, 19 nt, Human
aggugaucuggcucuggac

SEQ ID NO: 1801359 - RNA, 18 nt, Human
aggugcuaucgcaccacu

SEQ ID NO: 1801360 - RNA, 18 nt, Human
aggugugagccaccacau

SEQ ID NO: 1801361 - RNA, 19 nt, Human
agggauuuucagcccucag

SEQ ID NO: 1801362 - RNA, 19 nt, Human
aggcuggcgugcagcauca

SEQ ID NO: 1801363 - RNA, 18 nt, Human
aggcugggucgcccugga

SEQ ID NO: 1801364 - RNA, 15 nt, Human
aggcuugccugcagg

SEQ ID NO: 1801365 - RNA, 17 nt, Human
aggcuugccugcaggca

SEQ ID NO: 1801366 - RNA, 16 nt, Human
uacaauaaagcaaugu

SEQ ID NO: 1801367 - RNA, 14 nt, Human
uacacaacaauccu

SEQ ID NO: 1801368 - RNA, 17 nt, Human
uaauucauuaaucugcc

SEQ ID NO: 1801369 - RNA, 14 nt, Human
uacaggcgugagcc

SEQ ID NO: 1801370 - RNA, 18 nt, Human
uaccaccagucugacugu

SEQ ID NO: 1801371 - RNA, 13 nt, Human
guugagccaccaa

SEQ ID NO: 1801372 - RNA, 15 nt, Human
guugggacuacaggc

SEQ ID NO: 1801373 - RNA, 16 nt, Human
uaauaugguguacauu

SEQ ID NO: 1801374 - RNA, 20 nt, Human
ucagcccugcaccaugcugc

SEQ ID NO: 1801375 - RNA, 16 nt, Human
ucacuacgccuggcug

SEQ ID NO: 1801376 - RNA, 18 nt, Human
uagccaagugcagggccu

SEQ ID NO: 1801377 - RNA, 23 nt, Human
uacuagagcaagcaggaaucaga

SEQ ID NO: 1801378 - RNA, 19 nt, Human
uacuauuuaauuauuucac

SEQ ID NO: 1801379 - RNA, 17 nt, Human
uagacacugaucuggcu

SEQ ID NO: 1801380 - RNA, 22 nt, Human
uagcagauacagggaugaggca

SEQ ID NO: 1801381 - RNA, 14 nt, Human
ugagcucaccaguc

SEQ ID NO: 1801382 - RNA, 23 nt, Human
ucuucauguuucaggagagaguu

SEQ ID NO: 1801383 - RNA, 21 nt, Human
ucuuauuauuuuugagacaga

SEQ ID NO: 1801384 - RNA, 17 nt, Human
ucuuguuuaaauucaag

SEQ ID NO: 1801385 - RNA, 16 nt, Human
ucuugaaaaaugcaug

SEQ ID NO: 1801386 - RNA, 13 nt, Human
ucuugaccucgug

SEQ ID NO: 1801387 - RNA, 16 nt, Human
ucucuguaauaaacuc

SEQ ID NO: 1801388 - RNA, 16 nt, Human
ucuguucuuccaucac

SEQ ID NO: 1801389 - RNA, 22 nt, Human
ugauaaauggcuuccuggcaau

SEQ ID NO: 1801390 - RNA, 13 nt, Human
ugauaccugggau

SEQ ID NO: 1801391 - RNA, 15 nt, Human
ugagguaaaagcauc

SEQ ID NO: 1801392 - RNA, 21 nt, Human
ugcaccaugcugcuggggaag

SEQ ID NO: 1801393 - RNA, 11 nt, Human
ugcaccauguc

SEQ ID NO: 1801394 - RNA, 16 nt, Human
ugcacuccagccugag

SEQ ID NO: 1801395 - RNA, 18 nt, Human
ugauuucauucaauaucu

SEQ ID NO: 1801396 - RNA, 12 nt, Human
ugauuuccacag

SEQ ID NO: 1801397 - RNA, 15 nt, Human
ugauccugcaauucc

SEQ ID NO: 1801398 - RNA, 17 nt, Human
ucuccagaugagaguac

SEQ ID NO: 1801399 - RNA, 19 nt, Human
ucucccaccaccucaccag

SEQ ID NO: 1801400 - RNA, 21 nt, Human
ucggugagcuacaaaugcauu

SEQ ID NO: 1801401 - RNA, 22 nt, Human
ucuaauagggcaauuaauuccu

SEQ ID NO: 1801402 - RNA, 18 nt, Human
ucauaauauaaaacagga

SEQ ID NO: 1801403 - RNA, 16 nt, Human
ucagugcugccgauaa

SEQ ID NO: 1801404 - RNA, 19 nt, Human
gggaaaagaaaaagauuga

SEQ ID NO: 1801405 - RNA, 22 nt, Human
gggaaacaaaaggauaaugaau

SEQ ID NO: 1801406 - RNA, 21 nt, Human
ggcugcaguuuugcuaucugg

SEQ ID NO: 1801407 - RNA, 16 nt, Human
ggcugccuucuggccu

SEQ ID NO: 1801408 - RNA, 15 nt, Human
ggcuggacuaggccu

SEQ ID NO: 1801409 - RNA, 22 nt, Human
gggagucucagcuucacccuga

SEQ ID NO: 1801410 - RNA, 19 nt, Human
gggccuguaaucccagcau

SEQ ID NO: 1801411 - RNA, 18 nt, Human
gguauaauucacauugua

SEQ ID NO: 1801412 - RNA, 14 nt, Human
ggguucaagauugu

SEQ ID NO: 1801413 - RNA, 20 nt, Human
ggguucaagcgauucucuug

SEQ ID NO: 1801414 - RNA, 16 nt, Human
ggugauguuccgaagg

SEQ ID NO: 1801415 - RNA, 17 nt, Human
ggugaaagauggaacuu

SEQ ID NO: 1801416 - RNA, 22 nt, Human
guacccaguagaugccacccag

SEQ ID NO: 1801417 - RNA, 17 nt, Human
guacaccccaacagcac

SEQ ID NO: 1801418 - RNA, 13 nt, Human
gugcagccaccag

SEQ ID NO: 1801419 - RNA, 17 nt, Human
guaauccaagcaaaugu

SEQ ID NO: 1801420 - RNA, 13 nt, Human
gguuucaccaugu

SEQ ID NO: 1801421 - RNA, 21 nt, Human
gguuuuaguugcaacuuugua

SEQ ID NO: 1801422 - RNA, 15 nt, Human
gugcuucuccagccu

SEQ ID NO: 1801423 - RNA, 21 nt, Human
gugcuucuccagccucagccu

SEQ ID NO: 1801424 - RNA, 22 nt, Human
gugggacagucaccucauggaa

SEQ ID NO: 1801425 - RNA, 17 nt, Human
gugggagccagggcugu

SEQ ID NO: 1801426 - RNA, 16 nt, Human
gugugagccaccacau

SEQ ID NO: 1801427 - RNA, 14 nt, Human
gugugcaucaggcu

SEQ ID NO: 1801428 - RNA, 21 nt, Human
guuaaagggccaaaaguaucc

SEQ ID NO: 1801429 - RNA, 15 nt, Human
guuagagaauuuccu

SEQ ID NO: 1801430 - RNA, 17 nt, Human
guuaucuaauagggcaa

SEQ ID NO: 1801431 - RNA, 19 nt, Human
gcggccacggugccuccag

SEQ ID NO: 1801432 - RNA, 20 nt, Human
gccagcugcccccagagcca

SEQ ID NO: 1801433 - RNA, 13 nt, Human
gcggcaucaggcu

SEQ ID NO: 1801434 - RNA, 23 nt, Human
gccuuaacuggagccccaucagc

SEQ ID NO: 1801435 - RNA, 14 nt, Human
gccuucggccucca

SEQ ID NO: 1801436 - RNA, 16 nt, Human
gccuucucuguucauu

SEQ ID NO: 1801437 - RNA, 19 nt, Human
gcgagugggggccagccac

SEQ ID NO: 1801438 - RNA, 15 nt, Human
gcgauucuccugccu

SEQ ID NO: 1801439 - RNA, 16 nt, Human
gccaaacauccuacaa

SEQ ID NO: 1801440 - RNA, 17 nt, Human
gccaccacauccagccu

SEQ ID NO: 1801441 - RNA, 18 nt, Human
gccacccugcccagccgu

SEQ ID NO: 1801442 - RNA, 22 nt, Human
ggcaauuaauuccuucagcacu

SEQ ID NO: 1801443 - RNA, 20 nt, Human
gcuccgcgccaggauggcgc

SEQ ID NO: 1801444 - RNA, 18 nt, Human
gcuccauuuuuagugaaa

SEQ ID NO: 1801445 - RNA, 13 nt, Human
gcucagcccugca

SEQ ID NO: 1801446 - RNA, 17 nt, Human
gcucagcccugcaccau

SEQ ID NO: 1801447 - RNA, 13 nt, Human
ggcgugaucucag

SEQ ID NO: 1801448 - RNA, 17 nt, Human
ggcgugaccugccaggc

SEQ ID NO: 1801449 - RNA, 21 nt, Human
ggccccugccucucugcaggu

SEQ ID NO: 1801450 - RNA, 21 nt, Human
gauucucuugccucaaccucc

SEQ ID NO: 1801451 - RNA, 19 nt, Human
gauuugugugcaucaggcu

SEQ ID NO: 1801452 - RNA, 17 nt, Human
gauuuugaaccugauga

SEQ ID NO: 1801453 - RNA, 21 nt, Human
gcaaacccuuucauaaagucu

SEQ ID NO: 1801454 - RNA, 16 nt, Human
gcaauaauaguaguag

SEQ ID NO: 1801455 - RNA, 23 nt, Human
gcaauuaauuccuucagcacuuu

SEQ ID NO: 1801456 - RNA, 14 nt, Human
gcacauauccaggc

SEQ ID NO: 1801457 - RNA, 16 nt, Human
gcaccaugcugcuggg

SEQ ID NO: 1801458 - RNA, 16 nt, Human
gagaugggguuucacc

SEQ ID NO: 1801459 - RNA, 14 nt, Human
gagaggggccucaa

SEQ ID NO: 1801460 - RNA, 15 nt, Human
gagacggguuucacc

SEQ ID NO: 1801461 - RNA, 16 nt, Human
gagacaggguuucacc

SEQ ID NO: 1801462 - RNA, 15 nt, Human
gaugagaguacaccc

SEQ ID NO: 1801463 - RNA, 21 nt, Human
gaugggagugcccccaacagc

SEQ ID NO: 1801464 - RNA, 16 nt, Human
gauguaaaaucuuguc

SEQ ID NO: 1801465 - RNA, 21 nt, Human
gauguaaagugauauuucccc

SEQ ID NO: 1801466 - RNA, 23 nt, Human
gcagccugcagacucacuguggg

SEQ ID NO: 1801467 - RNA, 17 nt, Human
gcacuuuagaauaugcc

SEQ ID NO: 1801468 - RNA, 19 nt, Human
gcaguggcgcgaucucagc

SEQ ID NO: 1801469 - RNA, 19 nt, Human
gcaguggcgugaucucagc

SEQ ID NO: 1801470 - RNA, 18 nt, Human
gcauggaaggcaagauug

SEQ ID NO: 1801471 - RNA, 15 nt, Human
gcauuacugcaugca

SEQ ID NO: 1801472 - RNA, 18 nt, Human
cuuuuuguggguacugca

SEQ ID NO: 1801473 - RNA, 20 nt, Human
agccaaaagauuggauacgc

SEQ ID NO: 1801474 - RNA, 12 nt, Human
cuuuaacuccug

SEQ ID NO: 1801475 - RNA, 18 nt, Human
cuuuaaugaauaaacauu

SEQ ID NO: 1801476 - RNA, 14 nt, Human
gacuuaaugccacu

SEQ ID NO: 1801477 - RNA, 16 nt, Human
gagaaaacaauaacga

SEQ ID NO: 1801478 - RNA, 14 nt, Human
gagaacagggcuga

SEQ ID NO: 1801479 - RNA, 15 nt, Human
gagaaucacuugaac

SEQ ID NO: 1801480 - RNA, 12 nt, Human
gacuacaggcgu

SEQ ID NO: 1801481 - RNA, 14 nt, Human
gacuacaggcguga

SEQ ID NO: 1801482 - RNA, 12 nt, Human
gacuagggcugg

SEQ ID NO: 1801483 - RNA, 18 nt, Human
gaccuaaaauaaaaugaa

SEQ ID NO: 1801484 - RNA, 22 nt, Human
gaccugaguauccccagcucag

SEQ ID NO: 1801485 - RNA, 16 nt, Human
gacauugaggcaggca

SEQ ID NO: 1801486 - RNA, 21 nt, Human
gaaauugauuuugaaccugau

SEQ ID NO: 1801487 - RNA, 18 nt, Human
gaacagucucuugaggca

SEQ ID NO: 1801488 - RNA, 13 nt, Human
cuauucuagccug

SEQ ID NO: 1801489 - RNA, 18 nt, Human
cuauucuagccugcauug

SEQ ID NO: 1801490 - RNA, 22 nt, Human
caguugggacuacaggcgugag

SEQ ID NO: 1801491 - RNA, 16 nt, Human
cuauaauguguucauu

SEQ ID NO: 1801492 - RNA, 15 nt, Human
cuaggguccaccagg

SEQ ID NO: 1801493 - RNA, 19 nt, Human
cuauguucuaagaagugaa

SEQ ID NO: 1801494 - RNA, 22 nt, Human
cuauguagaauauauuuccuua

SEQ ID NO: 1801495 - RNA, 14 nt, Human
caggguuucaccau

SEQ ID NO: 1801496 - RNA, 17 nt, Human
caggguuucaccauguu

SEQ ID NO: 1801497 - RNA, 14 nt, Human
cagguaaaacaggg

SEQ ID NO: 1801498 - RNA, 16 nt, Human
cagucaccucauggaa

SEQ ID NO: 1801499 - RNA, 19 nt, Human
agauauuuuucaugauuuu

SEQ ID NO: 1801500 - RNA, 21 nt, Human
cugauuguuauuggguaucac

SEQ ID NO: 1801501 - RNA, 23 nt, Human
agaguaauccaagcaaaugugaa

SEQ ID NO: 1801502 - RNA, 15 nt, Human
agaggaagcagccaa

SEQ ID NO: 1801503 - RNA, 14 nt, Human
agagacucaaagag

SEQ ID NO: 1801504 - RNA, 16 nt, Human
agagcaggugcuggcu

SEQ ID NO: 1801505 - RNA, 14 nt, Human
agagccaaucagua

SEQ ID NO: 1801506 - RNA, 16 nt, Human
agagccccacccucag

SEQ ID NO: 1801507 - RNA, 20 nt, Human
cucuggccuucggccuccau

SEQ ID NO: 1801508 - RNA, 18 nt, Human
cucuguucauuccuccag

SEQ ID NO: 1801509 - RNA, 23 nt, Human
cucuugccaaaucaaaagacuuu

SEQ ID NO: 1801510 - RNA, 20 nt, Human
cucuuuaauggguaaacagc

SEQ ID NO: 1801511 - RNA, 15 nt, Human
cuccuguccagccug

SEQ ID NO: 1801512 - RNA, 13 nt, Human
cucccacugccaa

SEQ ID NO: 1801513 - RNA, 18 nt, Human
cucccuggauuuuuacca

SEQ ID NO: 1801514 - RNA, 20 nt, Human
cucugcaggucccuaauaaa

SEQ ID NO: 1801515 - RNA, 14 nt, Human
cucucguaagauuu

SEQ ID NO: 1801516 - RNA, 14 nt, Human
cucugagagcauca

SEQ ID NO: 1801517 - RNA, 13 nt, Human
cuucccuuucauu

SEQ ID NO: 1801518 - RNA, 17 nt, Human
agucuucagcagagaag

SEQ ID NO: 1801519 - RNA, 22 nt, Human
aggagacaaaacuagagacuca

SEQ ID NO: 1801520 - RNA, 19 nt, Human
ggccccugccucucugcag

SEQ ID NO: 1801521 - RNA, 13 nt, Human
uuuuaccuuugac

SEQ ID NO: 1801522 - RNA, 20 nt, Human
cuuuacaaauagaauuugag

SEQ ID NO: 1801523 - RNA, 16 nt, Human
ggccuuggcugacaug

SEQ ID NO: 1801524 - RNA, 21 nt, Human
ccaacaugaaaacaauucuua

SEQ ID NO: 1801525 - RNA, 22 nt, Human
cugcucauaugauguacaugua

SEQ ID NO: 1801526 - RNA, 21 nt, Human
uggucugguugggcagccaga

SEQ ID NO: 1801527 - RNA, 20 nt, Human
cuuccaggcuggcgugcagc

SEQ ID NO: 1801528 - RNA, 16 nt, Human
agaugagaguacaccc

SEQ ID NO: 1801529 - RNA, 20 nt, Human
uuucacuucaaaacaguauu

SEQ ID NO: 1801530 - RNA, 16 nt, Human
uuagcuaaaucccucc

SEQ ID NO: 1801531 - RNA, 17 nt, Human
ggcuuuuggcuccaccc

SEQ ID NO: 1801532 - RNA, 16 nt, Human
ucccagaaaaagcauc

SEQ ID NO: 1801533 - RNA, 15 nt, Human
aacucauuucuagca

SEQ ID NO: 1801534 - RNA, 19 nt, Human
aauuguaagcaugcacaaa

SEQ ID NO: 1801535 - RNA, 16 nt, Human
uagaauugugcaacca

SEQ ID NO: 1801536 - RNA, 12 nt, Human
ccagucccuccc

SEQ ID NO: 1801537 - RNA, 15 nt, Human
uugagacaagaaaau

SEQ ID NO: 1801538 - RNA, 15 nt, Human
aaaguccugggauua

SEQ ID NO: 1801539 - RNA, 18 nt, Human
acaaaugggaaacaaaag

SEQ ID NO: 1801540 - RNA, 20 nt, Human
cauaagaagucguuuuuagg

SEQ ID NO: 1801541 - RNA, 17 nt, Human
ccccagugcggccagcu

SEQ ID NO: 1801542 - RNA, 16 nt, Human
ucuaaaaguuuaaguu

SEQ ID NO: 1801543 - RNA, 18 nt, Human
agcaaaauuuuuucucua

SEQ ID NO: 1801544 - RNA, 23 nt, Human
ucacugcaaccucugccucccag

SEQ ID NO: 1801545 - RNA, 20 nt, Human
gaaaauaacaauaaaagaca

SEQ ID NO: 1801546 - RNA, 15 nt, Human
aagugcuguauaaaa

SEQ ID NO: 1801547 - RNA, 21 nt, Human
uggagggaccuugucucccag

SEQ ID NO: 1801548 - RNA, 17 nt, Human
auuuaugagcucuucau

SEQ ID NO: 1801549 - RNA, 23 nt, Human
auuaugaguuucuuuuugcuauu

SEQ ID NO: 1801550 - RNA, 20 nt, Human
cauuaaaauuuuuuuuguaa

SEQ ID NO: 1801551 - RNA, 18 nt, Human
gaggcagaccugacucuc

SEQ ID NO: 1801552 - RNA, 20 nt, Human
uggcuggggcauggaaggca

SEQ ID NO: 1801553 - RNA, 17 nt, Human
cugagcgcucagcuuca

SEQ ID NO: 1801554 - RNA, 14 nt, Human
uggcuccuccauau

SEQ ID NO: 1801555 - RNA, 18 nt, Human
uggcaucaucucagcuca

SEQ ID NO: 1801556 - RNA, 16 nt, Human
ucccccuccucuccac

SEQ ID NO: 1801557 - RNA, 14 nt, Human
aagggaagagacag

SEQ ID NO: 1801558 - RNA, 21 nt, Human
uaucuaauguugaguuauuaa

SEQ ID NO: 1801559 - RNA, 12 nt, Human
agcuuggaaugu

SEQ ID NO: 1801560 - RNA, 16 nt, Human
agaacucugagcagug

SEQ ID NO: 1801561 - RNA, 21 nt, Human
aagaaaauaaaucuaucaaaa

SEQ ID NO: 1801562 - RNA, 15 nt, Human
guaucuucuuuugug

SEQ ID NO: 1801563 - RNA, 14 nt, Human
uuaauuauuucacu

SEQ ID NO: 1801564 - RNA, 17 nt, Human
acuugaacccauauuug

SEQ ID NO: 1801565 - RNA, 18 nt, Human
ucaaaauuagugcuuuuu

SEQ ID NO: 1801566 - RNA, 21 nt, Human
cuuaaggaggcugagagccca

SEQ ID NO: 1801567 - RNA, 14 nt, Human
uuccuagaaacuga

SEQ ID NO: 1801568 - RNA, 19 nt, Human
agcagcuuauucacaagac

SEQ ID NO: 1801569 - RNA, 14 nt, Human
ccuuucauuuuuuc

SEQ ID NO: 1801570 - RNA, 19 nt, Human
uccccuauccuacuucccc

SEQ ID NO: 1801571 - RNA, 23 nt, Human
agcucugcccauccugccccuga

SEQ ID NO: 1801572 - RNA, 15 nt, Human
caagauuguuccugc

SEQ ID NO: 1801573 - RNA, 16 nt, Human
cuuuaccuuuuuucuu

SEQ ID NO: 1801574 - RNA, 18 nt, Human
uucugauauuggacagua

SEQ ID NO: 1801575 - RNA, 21 nt, Human
uauuacuguaagaaaauauca

SEQ ID NO: 1801576 - RNA, 15 nt, Human
ccugccccccagccc

SEQ ID NO: 1801577 - RNA, 14 nt, Human
agaaaugaaagcag

SEQ ID NO: 1801578 - RNA, 13 nt, Human
gccaggcuggguc

SEQ ID NO: 1801579 - RNA, 21 nt, Human
cuucuuggacuucuugaaauc

SEQ ID NO: 1801580 - RNA, 11 nt, Human
ccuccgccucc

SEQ ID NO: 1801581 - RNA, 18 nt, Human
cuccccccccccgccacc

SEQ ID NO: 1801582 - RNA, 17 nt, Human
uucuucggaaagaagaa

SEQ ID NO: 1801583 - RNA, 22 nt, Human
caguaccuagcuggcucuguga

SEQ ID NO: 1801584 - RNA, 13 nt, Human
ccauuuuuuucua

SEQ ID NO: 1801585 - RNA, 18 nt, Human
aaauuauuguuuuucuuu

SEQ ID NO: 1801586 - RNA, 21 nt, Human
aauauauauuaucuuuucaua

SEQ ID NO: 1801587 - RNA, 14 nt, Human
uuuaauauauacua

SEQ ID NO: 1801588 - RNA, 20 nt, Human
aaagcccucccuaccuacca

SEQ ID NO: 1801589 - RNA, 18 nt, Human
cagugggagccagggcug

SEQ ID NO: 1801590 - RNA, 14 nt, Human
cccaccaccucacc

SEQ ID NO: 1801591 - RNA, 22 nt, Human
uuaauuugacuagaaaauuuaa

SEQ ID NO: 1801592 - RNA, 17 nt, Human
uuaaucugccucccucu

SEQ ID NO: 1801593 - RNA, 18 nt, Human
cauuuccauuuacccuuc

SEQ ID NO: 1801594 - RNA, 15 nt, Human
auauagaaauguauu

SEQ ID NO: 1801595 - RNA, 15 nt, Human
guaaagaacaucccu

SEQ ID NO: 1801596 - RNA, 17 nt, Human
uguccugaccugucuca

SEQ ID NO: 1801597 - RNA, 14 nt, Human
aaaagaaagaaaau

SEQ ID NO: 1801598 - RNA, 22 nt, Human
ucuuccuggauuccucacuuug

SEQ ID NO: 1801599 - RNA, 16 nt, Human
gugaucucagcucacu

SEQ ID NO: 1801600 - RNA, 12 nt, Human
caaacugccuaa

SEQ ID NO: 1801601 - RNA, 21 nt, Human
uuaagauaugggacauuuuug

SEQ ID NO: 1801602 - RNA, 20 nt, Human
agacacugauguaugaggaa

SEQ ID NO: 1801603 - RNA, 17 nt, Human
ucugguagcuaaauaua

SEQ ID NO: 1801604 - RNA, 19 nt, Human
uaauguugaguuauuaaua

SEQ ID NO: 1801605 - RNA, 19 nt, Human
uacuggaaggcuuccacua

SEQ ID NO: 1801606 - RNA, 20 nt, Human
agacacugaucuggcugcag

SEQ ID NO: 1801607 - RNA, 21 nt, Human
caucucacauuuucccuuccc

SEQ ID NO: 1801608 - RNA, 20 nt, Human
aggugcuuuaaccucacaua

SEQ ID NO: 1801609 - RNA, 14 nt, Human
guuauaauaaaugu

SEQ ID NO: 1801610 - RNA, 19 nt, Human
cccugccucaagcuaugug

SEQ ID NO: 1801611 - RNA, 18 nt, Human
ucacagguagacaguaua

SEQ ID NO: 1801612 - RNA, 18 nt, Human
agcaggggugcugggacc

SEQ ID NO: 1801613 - RNA, 23 nt, Human
ggagaccuacccuccacaggcac

SEQ ID NO: 1801614 - RNA, 16 nt, Human
gcaggcagccugccuu

SEQ ID NO: 1801615 - RNA, 12 nt, Human
cuacuagaaaau

SEQ ID NO: 1801616 - RNA, 21 nt, Human
auucuggacuguuuuuaaaaa

SEQ ID NO: 1801617 - RNA, 23 nt, Human
auucaauaucuuuuuuuuaauaa

SEQ ID NO: 1801618 - RNA, 19 nt, Human
uaucguuagugcuagugga

SEQ ID NO: 1801619 - RNA, 13 nt, Human
caauucagggagu

SEQ ID NO: 1801620 - RNA, 16 nt, Human
cauuuuuaguuuaaaa

SEQ ID NO: 1801621 - RNA, 21 nt, Human
aauuagcuccuccuuuuuccu

SEQ ID NO: 1801622 - RNA, 20 nt, Human
uagaaagcauuugaaugcau

SEQ ID NO: 1801623 - RNA, 13 nt, Human
aauuauuuucucu

SEQ ID NO: 1801624 - RNA, 17 nt, Human
cagauuugcaaaguuua

SEQ ID NO: 1801625 - RNA, 14 nt, Human
uuauuuuuccauuu

SEQ ID NO: 1801626 - RNA, 23 nt, Human
cagagguugcagugagccgagau

SEQ ID NO: 1801627 - RNA, 19 nt, Human
acuuuuauaagaaauagga

SEQ ID NO: 1801628 - RNA, 16 nt, Human
uuauauuuccaagaaa

SEQ ID NO: 1801629 - RNA, 22 nt, Human
acuguacagacagaaaaaacug

SEQ ID NO: 1801630 - RNA, 22 nt, Human
aaacaaggaugaauuaaguuuu

SEQ ID NO: 1801631 - RNA, 22 nt, Human
aucuuuuuacuaaacucagagg

SEQ ID NO: 1801632 - RNA, 20 nt, Human
cugccuccccuucacuccca

SEQ ID NO: 1801633 - RNA, 21 nt, Human
cuugaggcacagaaacuccug

SEQ ID NO: 1801634 - RNA, 14 nt, Human
cuuguucugauaau

SEQ ID NO: 1801635 - RNA, 15 nt, Human
ucuccaacaauaaga

SEQ ID NO: 1801636 - RNA, 21 nt, Human
aaagaaaauaacgauaaaaga

SEQ ID NO: 1801637 - RNA, 23 nt, Human
uguucccuggggcuuuaacuccu

SEQ ID NO: 1801638 - RNA, 13 nt, Human
auccauucuuccc

SEQ ID NO: 1801639 - RNA, 18 nt, Human
ucuauguagaauauauuu

SEQ ID NO: 1801640 - RNA, 15 nt, Human
agcaccaucauuccc

SEQ ID NO: 1801641 - RNA, 13 nt, Human
agccaaaccagga

SEQ ID NO: 1801642 - RNA, 17 nt, Human
uaaucaagccuaaaauu

SEQ ID NO: 1801643 - RNA, 22 nt, Human
acuuuaugugcaucuuauuucu

SEQ ID NO: 1801644 - RNA, 17 nt, Human
uaugugcaucuuauuuc

SEQ ID NO: 1801645 - RNA, 19 nt, Human
uccugccucagccucccga

SEQ ID NO: 1801646 - RNA, 23 nt, Human
cuaacacggugcucauuuuuucu

SEQ ID NO: 1801647 - RNA, 12 nt, Human
uugccugcaggc

SEQ ID NO: 1801648 - RNA, 17 nt, Human
uuucugaguuccugcau

SEQ ID NO: 1801649 - RNA, 16 nt, Human
gagcaccuacuuacau

SEQ ID NO: 1801650 - RNA, 14 nt, Human
ggaggccuuucccu

SEQ ID NO: 1801651 - RNA, 16 nt, Human
ccggagaaccccagga

SEQ ID NO: 1801652 - RNA, 22 nt, Human
ccucccuuggggccuaugcaga

SEQ ID NO: 1801653 - RNA, 21 nt, Human
accaacacccugagguugugu

SEQ ID NO: 1801654 - RNA, 17 nt, Human
ccaauuagcuccuccuu

SEQ ID NO: 1801655 - RNA, 22 nt, Human
gccugccuccccugccucacca

SEQ ID NO: 1801656 - RNA, 16 nt, Human
cauuauccaucuuuca

SEQ ID NO: 1801657 - RNA, 13 nt, Human
gcuccacccucuu

SEQ ID NO: 1801658 - RNA, 21 nt, Human
auaaugguuuuuaacaccuuu

SEQ ID NO: 1801659 - RNA, 13 nt, Human
uugcauuaaaaau

SEQ ID NO: 1801660 - RNA, 15 nt, Human
aaggaggcugagagc

SEQ ID NO: 1801661 - RNA, 21 nt, Human
cuuuuauguuaaugcucugga

SEQ ID NO: 1801662 - RNA, 17 nt, Human
cucacugcaaccuccac

SEQ ID NO: 1801663 - RNA, 12 nt, Human
ucaaauaaaucu

SEQ ID NO: 1801664 - RNA, 16 nt, Human
agguugcagugagccg

SEQ ID NO: 1801665 - RNA, 22 nt, Human
acauguuucuuuguaaugaaaa

SEQ ID NO: 1801666 - RNA, 12 nt, Human
cacugacacaca

SEQ ID NO: 1801667 - RNA, 21 nt, Human
cucugcaaacugccuucuucg

SEQ ID NO: 1801668 - RNA, 22 nt, Human
gaccuucaacaaccggccacca

SEQ ID NO: 1801669 - RNA, 22 nt, Human
acuauuaacaacuugucuauua

SEQ ID NO: 1801670 - RNA, 23 nt, Human
ucaagacugcaaacccuuucaua

SEQ ID NO: 1801671 - RNA, 15 nt, Human
augguguggcaaagc

SEQ ID NO: 1801672 - RNA, 21 nt, Human
guuagaaaaguuauguagaaa

SEQ ID NO: 1801673 - RNA, 23 nt, Human
gaaagcaguugagacaagaaaau

SEQ ID NO: 1801674 - RNA, 17 nt, Human
agagcuggaggcaccca

SEQ ID NO: 1801675 - RNA, 22 nt, Human
guaccuaguccccagccugcuc

SEQ ID NO: 1801676 - RNA, 10 nt, Human
agugauuuua

SEQ ID NO: 1801677 - RNA, 18 nt, Human
auucugguagcuaaauau

SEQ ID NO: 1801678 - RNA, 17 nt, Human
cuuuauguaguuuuuau

SEQ ID NO: 1801679 - RNA, 14 nt, Human
cacaagaaaugaaa

SEQ ID NO: 1801680 - RNA, 16 nt, Human
cauguguuuacuuuau

SEQ ID NO: 1801681 - RNA, 12 nt, Human
ggaaagaaaaua

SEQ ID NO: 1801682 - RNA, 20 nt, Human
cugcugacacagacauccuc

SEQ ID NO: 1801683 - RNA, 17 nt, Human
caugagggcuggaugcu

SEQ ID NO: 1801684 - RNA, 21 nt, Human
gcugcccucccccuccucucc

SEQ ID NO: 1801685 - RNA, 19 nt, Human
gacagucaccucauggaau

SEQ ID NO: 1801686 - RNA, 17 nt, Human
caaccuucugaggagcu

SEQ ID NO: 1801687 - RNA, 14 nt, Human
auauuuuuccauuu

SEQ ID NO: 1801688 - RNA, 15 nt, Human
aauacucagguuaau

SEQ ID NO: 1801689 - RNA, 13 nt, Human
ggugugugcagca

SEQ ID NO: 1801690 - RNA, 18 nt, Human
ucugguugggcagccaga

SEQ ID NO: 1801691 - RNA, 18 nt, Human
agccugcucccuagccag

SEQ ID NO: 1801692 - RNA, 18 nt, Human
cugagucaacuccuuucu

SEQ ID NO: 1801693 - RNA, 15 nt, Human
auauaaauaaaaaua

SEQ ID NO: 1801694 - RNA, 15 nt, Human
aaacuuguauuaugu

SEQ ID NO: 1801695 - RNA, 14 nt, Human
ugacuuuuuauacu

SEQ ID NO: 1801696 - RNA, 22 nt, Human
cagcucacugcaaccucugccu

SEQ ID NO: 1801697 - RNA, 20 nt, Human
uccucaugagggcuggaugc

SEQ ID NO: 1801698 - RNA, 15 nt, Human
cauguuagccaggcu

SEQ ID NO: 1801699 - RNA, 20 nt, Human
aggccugacugccaagccau

SEQ ID NO: 1801700 - RNA, 15 nt, Human
ccugagacaaaugga

SEQ ID NO: 1801701 - RNA, 15 nt, Human
ggcgcgaucucagcu

SEQ ID NO: 1801702 - RNA, 23 nt, Human
ggaggcagagguugcagugagcc

SEQ ID NO: 1801703 - RNA, 16 nt, Human
uucaugaauucuguca

SEQ ID NO: 1801704 - RNA, 17 nt, Human
acaucugagaaaagcuu

SEQ ID NO: 1801705 - RNA, 14 nt, Human
ccaccugcugagcc

SEQ ID NO: 1801706 - RNA, 21 nt, Human
uaauaggcguaacuaauuuua

SEQ ID NO: 1801707 - RNA, 19 nt, Human
uguuaauauugauuuauua

SEQ ID NO: 1801708 - RNA, 23 nt, Human
aggaaagucauuggcuuuauccu

SEQ ID NO: 1801709 - RNA, 22 nt, Human
ucuacuaaaaauacaaaaaaaa

SEQ ID NO: 1801710 - RNA, 12 nt, Human
accccugagcuu

SEQ ID NO: 1801711 - RNA, 22 nt, Human
agcacagccucuuagaugcagu

SEQ ID NO: 1801712 - RNA, 18 nt, Human
cagagucuuccucugucu

SEQ ID NO: 1801713 - RNA, 23 nt, Human
guguuuauaauuuuaaauguuuu

SEQ ID NO: 1801714 - RNA, 13 nt, Human
uggaaggcuucca

SEQ ID NO: 1801715 - RNA, 19 nt, Human
uucaccauguuggccaggc

SEQ ID NO: 1801716 - RNA, 17 nt, Human
gaagaccucauuuugaa

SEQ ID NO: 1801717 - RNA, 23 nt, Human
uaauuuguaguguuggagaagaa

SEQ ID NO: 1801718 - RNA, 15 nt, Human
aagucaauguuuuca

SEQ ID NO: 1801719 - RNA, 14 nt, Human
aggcagccugccuu

SEQ ID NO: 1801720 - RNA, 21 nt, Human
auggaaauacacuguuaucuu

SEQ ID NO: 1801721 - RNA, 18 nt, Human
aucucaaaaaaaaaaaca

SEQ ID NO: 1801722 - RNA, 21 nt, Human
gcccugcugagucccaggcug

SEQ ID NO: 1801723 - RNA, 14 nt, Human
ucccuuuuuuuaag

SEQ ID NO: 1801724 - RNA, 14 nt, Human
gugcuugagucucc

SEQ ID NO: 1801725 - RNA, 23 nt, Human
agaaugauuaugaauuacauuug

SEQ ID NO: 1801726 - RNA, 20 nt, Human
aagauaucucaucucuucuu

SEQ ID NO: 1801727 - RNA, 15 nt, Human
acuuuauaaaggauu

SEQ ID NO: 1801728 - RNA, 19 nt, Human
auuuugugaagcaaaauuu

SEQ ID NO: 1801729 - RNA, 21 nt, Human
aaaauaagagcucaggaugag

SEQ ID NO: 1801730 - RNA, 13 nt, Human
acccucuccagau

SEQ ID NO: 1801731 - RNA, 14 nt, Human
ugagcucaccaguc

SEQ ID NO: 1801732 - RNA, 19 nt, Human
cauuugggaugcuacucua

SEQ ID NO: 1801733 - RNA, 18 nt, Human
gccugacgaacuccuuga

SEQ ID NO: 1801734 - RNA, 18 nt, Human
cauuuccucaaaaagauu

SEQ ID NO: 1801735 - RNA, 19 nt, Human
aguggcuuccaauuuuugg

SEQ ID NO: 1801736 - RNA, 12 nt, Human
uuuuuaauuucu

SEQ ID NO: 1801737 - RNA, 14 nt, Human
agaauucauucacu

SEQ ID NO: 1801738 - RNA, 22 nt, Human
auucucaagcccugcagucaca

SEQ ID NO: 1801739 - RNA, 18 nt, Human
aaguaaggaauuuuauuu

SEQ ID NO: 1801740 - RNA, 21 nt, Human
cauuugaaugcauuuuguuug

SEQ ID NO: 1801741 - RNA, 23 nt, Human
ugaucuugcucucggugcuucca

SEQ ID NO: 1801742 - RNA, 15 nt, Human
gcuuucucaauaagc

SEQ ID NO: 1801743 - RNA, 22 nt, Human
cuucaacaaccggccaccagau

SEQ ID NO: 1801744 - RNA, 19 nt, Human
aguuuuauuaauaaacauu

SEQ ID NO: 1801745 - RNA, 23 nt, Human
gcccuggugccucaccccuugcc

SEQ ID NO: 1801746 - RNA, 22 nt, Human
uauacaguuuaccgaaaaucau

SEQ ID NO: 1801747 - RNA, 20 nt, Human
cauguuuaagaaauuuuugc

SEQ ID NO: 1801748 - RNA, 16 nt, Human
cucacugugggaagga

SEQ ID NO: 1801749 - RNA, 21 nt, Human
auggcagcuuuccucaaaacu

SEQ ID NO: 1801750 - RNA, 18 nt, Human
acucugugaucuugcucu

SEQ ID NO: 1801751 - RNA, 14 nt, Human
cagauccccaagcc

SEQ ID NO: 1801752 - RNA, 17 nt, Human
ugggguggguauaaaag

SEQ ID NO: 1801753 - RNA, 19 nt, Human
aaacauguuccugggauca

SEQ ID NO: 1801754 - RNA, 22 nt, Human
agaagcaccaaucaugaauuag

SEQ ID NO: 1801755 - RNA, 15 nt, Human
accaugcugauaaac

SEQ ID NO: 1801756 - RNA, 18 nt, Human
gccccgucccccucuggc

SEQ ID NO: 1801757 - RNA, 16 nt, Human
cucauaccuuccccac

SEQ ID NO: 1801758 - RNA, 12 nt, Human
ccggccaccaga

SEQ ID NO: 1801759 - RNA, 19 nt, Human
caacucccugccccccagc

SEQ ID NO: 1801760 - RNA, 16 nt, Human
aucagccaauuauguu

SEQ ID NO: 1801761 - RNA, 18 nt, Human
uguacuuuauuuucuaua

SEQ ID NO: 1801762 - RNA, 20 nt, Human
uccacuuuaucuugaauaau

SEQ ID NO: 1801763 - RNA, 20 nt, Human
aaauauuuucuuuguuaaaa

SEQ ID NO: 1801764 - RNA, 21 nt, Human
aucuguaaugccuuuucucac

SEQ ID NO: 1801765 - RNA, 18 nt, Human
ucuugaagggcaggugcu

SEQ ID NO: 1801766 - RNA, 19 nt, Human
agcuucucauccugcaggc

SEQ ID NO: 1801767 - RNA, 16 nt, Human
ugcauagaauaaaauu

SEQ ID NO: 1801768 - RNA, 22 nt, Human
ugaaagggguugugaagaggug

SEQ ID NO: 1801769 - RNA, 21 nt, Human
ccaggugguaagcaccaggac

SEQ ID NO: 1801770 - RNA, 20 nt, Human
aaaauccacuuuaucuugaa

SEQ ID NO: 1801771 - RNA, 22 nt, Human
acccaaggaugucugccacacc

SEQ ID NO: 1801772 - RNA, 19 nt, Human
cuuggugauuccgcaguga

SEQ ID NO: 1801773 - RNA, 23 nt, Human
guuuguacacaacaauccuucua

SEQ ID NO: 1801774 - RNA, 22 nt, Human
ucaacuccaaacugacucuuaa

SEQ ID NO: 1801775 - RNA, 20 nt, Human
gaauaauguaagacaaauau

SEQ ID NO: 1801776 - RNA, 14 nt, Human
auuauuguuuuucu

SEQ ID NO: 1801777 - RNA, 17 nt, Human
acaaaugcauuucuaaa

SEQ ID NO: 1801778 - RNA, 19 nt, Human
guggcaggaaaauggacau

SEQ ID NO: 1801779 - RNA, 18 nt, Human
gagucccaggcugagccu

SEQ ID NO: 1801780 - RNA, 20 nt, Human
uuuauaauuuuaaauguuuu

SEQ ID NO: 1801781 - RNA, 20 nt, Human
gcuuccaggcuggcgugcag

SEQ ID NO: 1801782 - RNA, 16 nt, Human
acuucagccucccaag

SEQ ID NO: 1801783 - RNA, 22 nt, Human
cugaggcauccuuccucacacc

SEQ ID NO: 1801784 - RNA, 17 nt, Human
uaauguugaauuuugau

SEQ ID NO: 1801785 - RNA, 13 nt, Human
acuggucugaggu

SEQ ID NO: 1801786 - RNA, 23 nt, Human
cacugcacgaauggaagaggcac

SEQ ID NO: 1801787 - RNA, 17 nt, Human
cuaucucauuuccaagc

SEQ ID NO: 1801788 - RNA, 12 nt, Human
aagaaaauaaca

SEQ ID NO: 1801789 - RNA, 21 nt, Human
gucauguuuaagaaauuuuug

SEQ ID NO: 1801790 - RNA, 14 nt, Human
uccagauccuggaa

SEQ ID NO: 1801791 - RNA, 20 nt, Human
auaaucaagccuaaaauugu

SEQ ID NO: 1801792 - RNA, 19 nt, Human
cagaugcacaugagcuggc

SEQ ID NO: 1801793 - RNA, 19 nt, Human
aauuugugaagguggaaau

SEQ ID NO: 1801794 - RNA, 16 nt, Human
ugugcagccaccaguc

SEQ ID NO: 1801795 - RNA, 15 nt, Human
ucuuuuuuucuugaa

SEQ ID NO: 1801796 - RNA, 16 nt, Human
ugaaauuguauuacaa

SEQ ID NO: 1801797 - RNA, 14 nt, Human
aagcaccugggauu

SEQ ID NO: 1801798 - RNA, 15 nt, Human
aggccucacacacaa

SEQ ID NO: 1801799 - RNA, 17 nt, Human
cuaugucauuucauuuc

SEQ ID NO: 1801800 - RNA, 21 nt, Human
cuccuccauaucucccucuuc

SEQ ID NO: 1801801 - RNA, 22 nt, Human
ccgggaggcagagguugcagug

SEQ ID NO: 1801802 - RNA, 15 nt, Human
aagagauuuuucaug

SEQ ID NO: 1801803 - RNA, 18 nt, Human
auuuaugcauauuauuuu

SEQ ID NO: 1801804 - RNA, 15 nt, Human
gaaaugauguuucau

SEQ ID NO: 1801805 - RNA, 21 nt, Human
ucagacaagcugcauuucaga

SEQ ID NO: 1801806 - RNA, 21 nt, Human
guauaauucacauuguauuca

SEQ ID NO: 1801807 - RNA, 22 nt, Human
ucaguucucuugauuuucauua

SEQ ID NO: 1801808 - RNA, 19 nt, Human
aaccaagguuaucuuggaa

SEQ ID NO: 1801809 - RNA, 21 nt, Human
ucagccucccaaagugcuggg

SEQ ID NO: 1801810 - RNA, 17 nt, Human
caagcaaaugugaauca

SEQ ID NO: 1801811 - RNA, 17 nt, Human
accuggucucuccuugu

SEQ ID NO: 1801812 - RNA, 12 nt, Human
aggaaauauuuu

SEQ ID NO: 1801813 - RNA, 23 nt, Human
cucaggggggugguuuucccauc

SEQ ID NO: 1801814 - RNA, 18 nt, Human
caccccaacagcacccuc

SEQ ID NO: 1801815 - RNA, 17 nt, Human
ccacacaugggaucaag

SEQ ID NO: 1801816 - RNA, 13 nt, Human
uuccugcaggcag

SEQ ID NO: 1801817 - RNA, 16 nt, Human
uuauccuaucucucca

SEQ ID NO: 1801818 - RNA, 16 nt, Human
augcuguauuuuaaaa

SEQ ID NO: 1801819 - RNA, 14 nt, Human
auuacuuuugcugu

SEQ ID NO: 1801820 - RNA, 17 nt, Human
uaaaguugguaaaccuu

SEQ ID NO: 1801821 - RNA, 15 nt, Human
ucucagaaggaaaga

SEQ ID NO: 1801822 - RNA, 16 nt, Human
uggacuguuuuuaaaa

SEQ ID NO: 1801823 - RNA, 17 nt, Human
uuuuaguugaauuuuuu

SEQ ID NO: 1801824 - RNA, 14 nt, Human
gaccuuccagaaau

SEQ ID NO: 1801825 - RNA, 20 nt, Human
cuuuguucuucuuaaaguca

SEQ ID NO: 1801826 - RNA, 16 nt, Human
cuggacuugccucugc

SEQ ID NO: 1801827 - RNA, 15 nt, Human
uacccaguagaugcc

SEQ ID NO: 1801828 - RNA, 17 nt, Human
gcucaccagucccuccc

SEQ ID NO: 1801829 - RNA, 15 nt, Human
ugggaaggagacaaa

SEQ ID NO: 1801830 - RNA, 14 nt, Human
gguaucaccacugg

SEQ ID NO: 1801831 - RNA, 16 nt, Human
caagugcuucuccagc

SEQ ID NO: 1801832 - RNA, 18 nt, Human
gcccucuugaaucucuga

SEQ ID NO: 1801833 - RNA, 19 nt, Human
caaaccaggacccugucca

SEQ ID NO: 1801834 - RNA, 22 nt, Human
cccucaaacccauucccucucc

SEQ ID NO: 1801835 - RNA, 15 nt, Human
gagugaggggggggu

SEQ ID NO: 1801836 - RNA, 14 nt, Human
aauauuauuuuaua

SEQ ID NO: 1801837 - RNA, 17 nt, Human
gaggcauccuuccucac

SEQ ID NO: 1801838 - RNA, 12 nt, Human
gcucagcccugg

SEQ ID NO: 1801839 - RNA, 17 nt, Human
accacaucccacucaca

SEQ ID NO: 1801840 - RNA, 21 nt, Human
caucucuggccuguacccagu

SEQ ID NO: 1801841 - RNA, 17 nt, Human
aucugcuauucuccaua

SEQ ID NO: 1801842 - RNA, 20 nt, Human
ugcagccaccaguccauugg

SEQ ID NO: 1801843 - RNA, 13 nt, Human
uucucaucuuuuu

SEQ ID NO: 1801844 - RNA, 20 nt, Human
acagccccuggucagucugc

SEQ ID NO: 1801845 - RNA, 22 nt, Human
ugccuucuggccuuguaagacc

SEQ ID NO: 1801846 - RNA, 16 nt, Human
ugauccacccgccuca

SEQ ID NO: 1801847 - RNA, 21 nt, Human
uuauguuuaauucugaaagca

SEQ ID NO: 1801848 - RNA, 12 nt, Human
acaccuuaucua

SEQ ID NO: 1801849 - RNA, 14 nt, Human
aaaguauuuaauua

SEQ ID NO: 1801850 - RNA, 16 nt, Human
uccuacauuaauuauc

SEQ ID NO: 1801851 - RNA, 15 nt, Human
aacuccuugauuuua

SEQ ID NO: 1801852 - RNA, 19 nt, Human
ccaagguuaggguuggagc

SEQ ID NO: 1801853 - RNA, 21 nt, Human
cagaucauugugaaauuauuc

SEQ ID NO: 1801854 - RNA, 21 nt, Human
gcuuucagagccuccuuucug

SEQ ID NO: 1801855 - RNA, 20 nt, Human
cacuguggguagacacacau

SEQ ID NO: 1801856 - RNA, 16 nt, Human
ggcugggucgcccugg

SEQ ID NO: 1801857 - RNA, 18 nt, Human
acuggacucaccuccccc

SEQ ID NO: 1801858 - RNA, 22 nt, Human
uucuccagccucagccucccaa

SEQ ID NO: 1801859 - RNA, 12 nt, Human
aagggcaggggc

SEQ ID NO: 1801860 - RNA, 16 nt, Human
acucccucucugcagg

SEQ ID NO: 1801861 - RNA, 13 nt, Human
agccccaucagcu

SEQ ID NO: 1801862 - RNA, 14 nt, Human
ggguugguuucccu

SEQ ID NO: 1801863 - RNA, 17 nt, Human
cacuacauuacuucaaa

SEQ ID NO: 1801864 - RNA, 14 nt, Human
ugacuuuucuccuc

SEQ ID NO: 1801865 - RNA, 16 nt, Human
ccacuuuaucuugaau

SEQ ID NO: 1801866 - RNA, 23 nt, Human
auuccugacugcuaguuuauaua

SEQ ID NO: 1801867 - RNA, 16 nt, Human
cagcccaggauacugg

SEQ ID NO: 1801868 - RNA, 18 nt, Human
agccacggugcccggccc

SEQ ID NO: 1801869 - RNA, 15 nt, Human
ucagggcucuuuccu

SEQ ID NO: 1801870 - RNA, 22 nt, Human
cagcccuggugggcagagaggu

SEQ ID NO: 1801871 - RNA, 14 nt, Human
cugccuuuggcuuu

SEQ ID NO: 1801872 - RNA, 15 nt, Human
auuguauucagaguu

SEQ ID NO: 1801873 - RNA, 13 nt, Human
aagaaauuuuugc

SEQ ID NO: 1801874 - RNA, 18 nt, Human
ugcauucuggauuuuaaa

SEQ ID NO: 1801875 - RNA, 20 nt, Human
auuuaaauuauuuuuguuca

SEQ ID NO: 1801876 - RNA, 15 nt, Human
acaguacaccacaag

SEQ ID NO: 1801877 - RNA, 15 nt, Human
uuucauagcuaaaaa

SEQ ID NO: 1801878 - RNA, 19 nt, Human
acccagcucacaggagcuu

SEQ ID NO: 1801879 - RNA, 23 nt, Human
uaaagaaggugugggccagacaa

SEQ ID NO: 1801880 - RNA, 19 nt, Human
uucagggcuauuuuuuccc

SEQ ID NO: 1801881 - RNA, 16 nt, Human
uggggggaguaaagaa

SEQ ID NO: 1801882 - RNA, 14 nt, Human
gaaaaaguggguuu

SEQ ID NO: 1801883 - RNA, 17 nt, Human
ccauaucucccucuucc

SEQ ID NO: 1801884 - RNA, 13 nt, Human
gaaauagcccugu

SEQ ID NO: 1801885 - RNA, 20 nt, Human
cagauguucacccaaccaca

SEQ ID NO: 1801886 - RNA, 18 nt, Human
aaauaucuugaaaggggu

SEQ ID NO: 1801887 - RNA, 15 nt, Human
ucuuacaaugaaaag

SEQ ID NO: 1801888 - RNA, 17 nt, Human
uucauaaagucuugccu

SEQ ID NO: 1801889 - RNA, 20 nt, Human
cacugcaaccuccaccuccu

SEQ ID NO: 1801890 - RNA, 15 nt, Human
uguguuuuucauaaa

SEQ ID NO: 1801891 - RNA, 14 nt, Human
uccugccucagccu

SEQ ID NO: 1801892 - RNA, 19 nt, Human
uucuucaaauaaaucucuc

SEQ ID NO: 1801893 - RNA, 21 nt, Human
gggaauucagacaagcugcau

SEQ ID NO: 1801894 - RNA, 23 nt, Human
cugcuguggccaucaaccucugu

SEQ ID NO: 1801895 - RNA, 15 nt, Human
gggccaggcuggguc

SEQ ID NO: 1801896 - RNA, 12 nt, Human
aaauuuaaaaca

SEQ ID NO: 1801897 - RNA, 18 nt, Human
auggcauguguuuacuuu

SEQ ID NO: 1801898 - RNA, 15 nt, Human
aaguaaggaauuuua

SEQ ID NO: 1801899 - RNA, 16 nt, Human
ugccgccuccuugugc

SEQ ID NO: 1801900 - RNA, 17 nt, Human
ccucaagcugcaucuag

SEQ ID NO: 1801901 - RNA, 17 nt, Human
guugcugccugcccuau

SEQ ID NO: 1801902 - RNA, 23 nt, Human
ugauuuuuaaguuauuuuuacau

SEQ ID NO: 1801903 - RNA, 21 nt, Human
acaguuaccucugccucagaa

SEQ ID NO: 1801904 - RNA, 19 nt, Human
ugagugcguggugcgagug

SEQ ID NO: 1801905 - RNA, 20 nt, Human
ucucugcaggcagccugccu

SEQ ID NO: 1801906 - RNA, 17 nt, Human
cacagauguucacccaa

SEQ ID NO: 1801907 - RNA, 24 nt, Human
uaauuuaaaauaugcucuaaacau

SEQ ID NO: 1801908 - RNA, 17 nt, Human
gaaagccaugugcagcc

SEQ ID NO: 1801909 - RNA, 13 nt, Human
cuggauuuuaaaa

SEQ ID NO: 1801910 - RNA, 23 nt, Human
caggagcccugggaggcucugga

SEQ ID NO: 1801911 - RNA, 19 nt, Human
aaagucuugccuugcugaa

SEQ ID NO: 1801912 - RNA, 13 nt, Human
ccucuggcuccag

SEQ ID NO: 1801913 - RNA, 19 nt, Human
auaaggaugauaaaagcac

SEQ ID NO: 1801914 - RNA, 22 nt, Human
cuugcauaagagcuuaagaacc

SEQ ID NO: 1801915 - RNA, 20 nt, Human
acacacaaauuaucuuaaaa

SEQ ID NO: 1801916 - RNA, 16 nt, Human
aguucuauaauguaaa

SEQ ID NO: 1801917 - RNA, 20 nt, Human
ccacaguuccccuaugugga

SEQ ID NO: 1801918 - RNA, 12 nt, Human
gcacuagaggaa

SEQ ID NO: 1801919 - RNA, 22 nt, Human
accaaucaugaauuaguuuuau

SEQ ID NO: 1801920 - RNA, 21 nt, Human
aauucuuggguguuuauccua

SEQ ID NO: 1801921 - RNA, 23 nt, Human
gggguaccuaguccccagccugc

SEQ ID NO: 1801922 - RNA, 21 nt, Human
agggauuuucagcccucagaa

SEQ ID NO: 1801923 - RNA, 22 nt, Human
gcacacaccaccacgccuggcu

SEQ ID NO: 1801924 - RNA, 13 nt, Human
gcagucagggaca

SEQ ID NO: 1801925 - RNA, 20 nt, Human
cuccagcugcucugucuucu

SEQ ID NO: 1801926 - RNA, 14 nt, Human
gaauaauguaagac

SEQ ID NO: 1801927 - RNA, 17 nt, Human
ugaaauaagccagacau

SEQ ID NO: 1801928 - RNA, 20 nt, Human
auguauuugcagcugagaga

SEQ ID NO: 1801929 - RNA, 16 nt, Human
ccugaucaccugcccu

SEQ ID NO: 1801930 - RNA, 18 nt, Human
ucaagucagcucuucucc

SEQ ID NO: 1801931 - RNA, 20 nt, Human
ugcagacucacugugggaag

SEQ ID NO: 1801932 - RNA, 22 nt, Human
guuguauuagauguucucuauc

SEQ ID NO: 1801933 - RNA, 17 nt, Human
uaauauuucuucaaaua

SEQ ID NO: 1801934 - RNA, 17 nt, Human
auguugacaugggacau

SEQ ID NO: 1801935 - RNA, 20 nt, Human
ccaggcugggucgcccugga

SEQ ID NO: 1801936 - RNA, 18 nt, Human
cuaaaaaacgaaaagucu

SEQ ID NO: 1801937 - RNA, 18 nt, Human
aauuaacaugaauauuua

SEQ ID NO: 1801938 - RNA, 14 nt, Human
cugccucccucucg

SEQ ID NO: 1801939 - RNA, 15 nt, Human
aguugcaacuuugua

SEQ ID NO: 1801940 - RNA, 15 nt, Human
uucuucggaaagaag

SEQ ID NO: 1801941 - RNA, 12 nt, Human
agggauggggcu

SEQ ID NO: 1801942 - RNA, 15 nt, Human
ugcccugcugcccuc

SEQ ID NO: 1801943 - RNA, 19 nt, Human
agacagagccccacccuca

SEQ ID NO: 1801944 - RNA, 22 nt, Human
aaaaaaccugagccccaaaagg

SEQ ID NO: 1801945 - RNA, 16 nt, Human
ccugagcuugcagaga

SEQ ID NO: 1801946 - RNA, 19 nt, Human
cuggucucuccuuguucug

SEQ ID NO: 1801947 - RNA, 16 nt, Human
aaaauaacaauaaaag

SEQ ID NO: 1801948 - RNA, 17 nt, Human
caugcauuacugcaugc

SEQ ID NO: 1801949 - RNA, 17 nt, Human
gcccugcugcccucccc

SEQ ID NO: 1801950 - RNA, 15 nt, Human
cucccuuggggccua

SEQ ID NO: 1801951 - RNA, 15 nt, Human
aagccagauuuuccu

SEQ ID NO: 1801952 - RNA, 13 nt, Human
gcuggcucuuucc

SEQ ID NO: 1801953 - RNA, 22 nt, Human
guucaagugcuucuccagccuc

SEQ ID NO: 1801954 - RNA, 14 nt, Human
uggcuacugcucug

SEQ ID NO: 1801955 - RNA, 12 nt, Human
uuuaaaacauua

SEQ ID NO: 1801956 - RNA, 23 nt, Human
agagcucaggaugagggaaaaga

SEQ ID NO: 1801957 - RNA, 18 nt, Human
agaccagcaggcuggccu

SEQ ID NO: 1801958 - RNA, 14 nt, Human
cuucagucuuuucc

SEQ ID NO: 1801959 - RNA, 12 nt, Human
aggaaaauggac

SEQ ID NO: 1801960 - RNA, 23 nt, Human
agugcaguggcaucaucucagcu

SEQ ID NO: 1801961 - RNA, 22 nt, Human
uuaaugcugaaaaaucauccaa

SEQ ID NO: 1801962 - RNA, 19 nt, Human
accuggagaugguggauga

SEQ ID NO: 1801963 - RNA, 16 nt, Human
gaugguuguacauaua

SEQ ID NO: 1801964 - RNA, 22 nt, Human
cuaauuauauaauauuuuuaau

SEQ ID NO: 1801965 - RNA, 14 nt, Human
agaugcuagaacuc

SEQ ID NO: 1801966 - RNA, 18 nt, Human
ugcauagguuuaauaauu

SEQ ID NO: 1801967 - RNA, 22 nt, Human
aggauggcuaguaucaaaagaa

SEQ ID NO: 1801968 - RNA, 22 nt, Human
uuuuuaauaaauuucaccaagu

SEQ ID NO: 1801969 - RNA, 19 nt, Human
acuaucucauuuccaagca

SEQ ID NO: 1801970 - RNA, 22 nt, Human
gaaagauuacuuuuucuuuaug

SEQ ID NO: 1801971 - RNA, 15 nt, Human
ugauaagaucuuuua

SEQ ID NO: 1801972 - RNA, 22 nt, Human
cacucacuacagggaccaggga

SEQ ID NO: 1801973 - RNA, 14 nt, Human
cccuguuucuucca

SEQ ID NO: 1801974 - RNA, 23 nt, Human
aaauagaauuugagcaucaguga

SEQ ID NO: 1801975 - RNA, 14 nt, Human
cacccugagguugu

SEQ ID NO: 1801976 - RNA, 18 nt, Human
uuauuuguuuaaaaagcg

SEQ ID NO: 1801977 - RNA, 22 nt, Human
caggggccacaccaaccuucug

SEQ ID NO: 1801978 - RNA, 13 nt, Human
gugcuucuuucuu

SEQ ID NO: 1801979 - RNA, 19 nt, Human
uccacuuuaugugcaucuu

SEQ ID NO: 1801980 - RNA, 23 nt, Human
gaaaaaguucugcagauaaacag

SEQ ID NO: 1801981 - RNA, 18 nt, Human
gcugggccccugccucuc

SEQ ID NO: 1801982 - RNA, 20 nt, Human
ugaguccuccuguccagccu

SEQ ID NO: 1801983 - RNA, 20 nt, Human
acgugcacgcacacugucug

SEQ ID NO: 1801984 - RNA, 12 nt, Human
acucuucugagc

SEQ ID NO: 1801985 - RNA, 20 nt, Human
gcuguugucuuuuccuucug

SEQ ID NO: 1801986 - RNA, 14 nt, Human
uguccuuuuuaaug

SEQ ID NO: 1801987 - RNA, 14 nt, Human
uuuuucauaaagca

SEQ ID NO: 1801988 - RNA, 19 nt, Human
cacccacacucagauccuc

SEQ ID NO: 1801989 - RNA, 14 nt, Human
gaaagcauuugaau

SEQ ID NO: 1801990 - RNA, 16 nt, Human
uaagagcuuaagaacc

SEQ ID NO: 1801991 - RNA, 23 nt, Human
ucuaagaaacauuuauauugaua

SEQ ID NO: 1801992 - RNA, 16 nt, Human
gucuguuuucccuccu

SEQ ID NO: 1801993 - RNA, 18 nt, Human
agcuugcaugcuugcaua

SEQ ID NO: 1801994 - RNA, 16 nt, Human
gcuucaagaaauuacu

SEQ ID NO: 1801995 - RNA, 19 nt, Human
auuacugccuauuuuaaua

SEQ ID NO: 1801996 - RNA, 17 nt, Human
uaugcuauugaaguuuu

SEQ ID NO: 1801997 - RNA, 22 nt, Human
cuauucuagucuauuuguugau

SEQ ID NO: 1801998 - RNA, 18 nt, Human
cacccgccucagccuccc

SEQ ID NO: 1801999 - RNA, 13 nt, Human
uuaaaugccaggc

SEQ ID NO: 1802000 - RNA, 18 nt, Human
cugaggccuagacucugu

SEQ ID NO: 1802001 - RNA, 11 nt, Human
ugccucagccu

SEQ ID NO: 1802002 - RNA, 23 nt, Human
gguuucaccauguuggccaggcu

SEQ ID NO: 1802003 - RNA, 14 nt, Human
uuauuauauuuaca

SEQ ID NO: 1802004 - RNA, 17 nt, Human
auuuucaccuguuauaa

SEQ ID NO: 1802005 - RNA, 14 nt, Human
uaagaaagaacacg

SEQ ID NO: 1802006 - RNA, 23 nt, Human
aauguugaguuauuaauauguua

SEQ ID NO: 1802007 - RNA, 18 nt, Human
augagaaaucuaaaaaac

SEQ ID NO: 1802008 - RNA, 17 nt, Human
cucuccaccagguucuu

SEQ ID NO: 1802009 - RNA, 15 nt, Human
cuguccuggaggggc

SEQ ID NO: 1802010 - RNA, 20 nt, Human
agcccugucuccucucucug

SEQ ID NO: 1802011 - RNA, 19 nt, Human
gccugaucaccugcccugc

SEQ ID NO: 1802012 - RNA, 14 nt, Human
aucaggcuuucuuu

SEQ ID NO: 1802013 - RNA, 19 nt, Human
guuucuuuguaaugaaaac

SEQ ID NO: 1802014 - RNA, 22 nt, Human
uaccucugcuauuugcuguuau

SEQ ID NO: 1802015 - RNA, 19 nt, Human
aaacaaaaggauaaugaau

SEQ ID NO: 1802016 - RNA, 11 nt, Human
caaacaaaaaa

SEQ ID NO: 1802017 - RNA, 18 nt, Human
ugcaggcaggaacaaaca

SEQ ID NO: 1802018 - RNA, 13 nt, Human
uggcuccagcugg

SEQ ID NO: 1802019 - RNA, 13 nt, Human
aauuuuuauauuu

SEQ ID NO: 1802020 - RNA, 15 nt, Human
ugauccccacgccac

SEQ ID NO: 1802021 - RNA, 13 nt, Human
ucacaauacuguu

SEQ ID NO: 1802022 - RNA, 19 nt, Human
cauaaccuuaccagauuuu

SEQ ID NO: 1802023 - RNA, 12 nt, Human
uauaauuuaaaa

SEQ ID NO: 1802024 - RNA, 15 nt, Human
caugcugcuggggaa

SEQ ID NO: 1802025 - RNA, 20 nt, Human
cagaaaaagcaucauggcua

SEQ ID NO: 1802026 - RNA, 17 nt, Human
aggcugggucgcccugg

SEQ ID NO: 1802027 - RNA, 19 nt, Human
uccugucggagcccugucu

SEQ ID NO: 1802028 - RNA, 14 nt, Human
uucucaugauuauu

SEQ ID NO: 1802029 - RNA, 23 nt, Human
aguucuauaauauaagcugccau

SEQ ID NO: 1802030 - RNA, 14 nt, Human
cugucuuuuuucua

SEQ ID NO: 1802031 - RNA, 14 nt, Human
auccuugaagauuu

SEQ ID NO: 1802032 - RNA, 14 nt, Human
uccuaggaaaauac

SEQ ID NO: 1802033 - RNA, 13 nt, Human
gcugcccuccccc

SEQ ID NO: 1802034 - RNA, 18 nt, Human
gcugggucgcccuggacu

SEQ ID NO: 1802035 - RNA, 20 nt, Human
uuucaccauguuggccaggc

SEQ ID NO: 1802036 - RNA, 21 nt, Human
acaugagguacugagagugaa

SEQ ID NO: 1802037 - RNA, 14 nt, Human
uugcuguccuggag

SEQ ID NO: 1802038 - RNA, 19 nt, Human
cagagucuuccucugucuc

SEQ ID NO: 1802039 - RNA, 13 nt, Human
cccaccaccucac

SEQ ID NO: 1802040 - RNA, 16 nt, Human
uaguugcaacuuugua

SEQ ID NO: 1802041 - RNA, 19 nt, Human
agugggagccagggcuguc

SEQ ID NO: 1802042 - RNA, 16 nt, Human
caggcaaaaggaagca

SEQ ID NO: 1802043 - RNA, 21 nt, Human
agucucccucccuuggggccu

SEQ ID NO: 1802044 - RNA, 18 nt, Human
ugcuaguggauuuuacau

SEQ ID NO: 1802045 - RNA, 23 nt, Human
ucucuugccucaaccucccaagc

SEQ ID NO: 1802046 - RNA, 19 nt, Human
ucaaccucccaagcaguug

SEQ ID NO: 1802047 - RNA, 17 nt, Human
gcagauacagggaugag

SEQ ID NO: 1802048 - RNA, 19 nt, Human
aucagacagauggaaaagg

SEQ ID NO: 1802049 - RNA, 12 nt, Human
ggcuggucucaa

SEQ ID NO: 1802050 - RNA, 22 nt, Human
cucccacuagacaaguccagcc

SEQ ID NO: 1802051 - RNA, 16 nt, Human
cugauggguuucucca

SEQ ID NO: 1802052 - RNA, 20 nt, Human
cucugcacacccuccagaga

SEQ ID NO: 1802053 - RNA, 13 nt, Human
cccgccucagccu

SEQ ID NO: 1802054 - RNA, 12 nt, Human
agaaaacaauaa

SEQ ID NO: 1802055 - RNA, 17 nt, Human
cagccucccaagcaccu

SEQ ID NO: 1802056 - RNA, 17 nt, Human
uucucacacacauacau

SEQ ID NO: 1802057 - RNA, 19 nt, Human
uacauuuccuaaauauauu

SEQ ID NO: 1802058 - RNA, 15 nt, Human
guuauguagaaaaaa

SEQ ID NO: 1802059 - RNA, 21 nt, Human
aaguuauguagaaaaaaguaa

SEQ ID NO: 1802060 - RNA, 21 nt, Human
caccccaacagcacccucucc

SEQ ID NO: 1802061 - RNA, 18 nt, Human
uguaacuugaagguggcu

SEQ ID NO: 1802062 - RNA, 14 nt, Human
uauauauuuuagau

SEQ ID NO: 1802063 - RNA, 16 nt, Human
gauccccacgccacag

SEQ ID NO: 1802064 - RNA, 19 nt, Human
ucaccaaggcugauuaaac

SEQ ID NO: 1802065 - RNA, 14 nt, Human
guaauugauuuauu

SEQ ID NO: 1802066 - RNA, 23 nt, Human
agaauuuaaaccuauacucacuu

SEQ ID NO: 1802067 - RNA, 18 nt, Human
gugcuaauuuugaaaaac

SEQ ID NO: 1802068 - RNA, 13 nt, Human
ugcugcuggggaa

SEQ ID NO: 1802069 - RNA, 14 nt, Human
agauaaauuauauc

SEQ ID NO: 1802070 - RNA, 13 nt, Human
ggaagacaguggc

SEQ ID NO: 1802071 - RNA, 21 nt, Human
gcauuuaugagcucuucaugu

SEQ ID NO: 1802072 - RNA, 22 nt, Human
cagaguacuggcugauggagua

SEQ ID NO: 1802073 - RNA, 14 nt, Human
ucauccuuuucauu

SEQ ID NO: 1802074 - RNA, 14 nt, Human
cuucuaccacccac

SEQ ID NO: 1802075 - RNA, 17 nt, Human
ccauauacagcucagaa

SEQ ID NO: 1802076 - RNA, 12 nt, Human
gagugcaguggc

SEQ ID NO: 1802077 - RNA, 16 nt, Human
uugagaaagucuuauu

SEQ ID NO: 1802078 - RNA, 22 nt, Human
cucauaacucugugaucuugcu

SEQ ID NO: 1802079 - RNA, 18 nt, Human
uuuccacagugacuccac

SEQ ID NO: 1802080 - RNA, 22 nt, Human
guucaagcgauucuccugccuc

SEQ ID NO: 1802081 - RNA, 18 nt, Human
gcagacucacugugggaa

SEQ ID NO: 1802082 - RNA, 18 nt, Human
auuugggggacuuacaug

SEQ ID NO: 1802083 - RNA, 20 nt, Human
aggaguacaccccaacagca

SEQ ID NO: 1802084 - RNA, 11 nt, Human
caucuagugag

SEQ ID NO: 1802085 - RNA, 15 nt, Human
aacaugaauauuuag

SEQ ID NO: 1802086 - RNA, 18 nt, Human
agugcacauauccaggca

SEQ ID NO: 1802087 - RNA, 16 nt, Human
aaugguaucaauaaau

SEQ ID NO: 1802088 - RNA, 20 nt, Human
uaucugcuauucuccauacu

SEQ ID NO: 1802089 - RNA, 18 nt, Human
gccaggcacacugagcca

SEQ ID NO: 1802090 - RNA, 21 nt, Human
cuuggaaauagugauuuccac

SEQ ID NO: 1802091 - RNA, 19 nt, Human
agcccugcaccaugcugcu

SEQ ID NO: 1802092 - RNA, 13 nt, Human
gccacuagcccuc

SEQ ID NO: 1802093 - RNA, 17 nt, Human
guggcucugugugcucu

SEQ ID NO: 1802094 - RNA, 20 nt, Human
gcccugggaggcucuggagc

SEQ ID NO: 1802095 - RNA, 22 nt, Human
uucuucaccuuaggaauaaucu

SEQ ID NO: 1802096 - RNA, 14 nt, Human
uuaaacuuugauuu

SEQ ID NO: 1802097 - RNA, 17 nt, Human
uuugaaaucaugaagau

SEQ ID NO: 1802098 - RNA, 22 nt, Human
ccuguaacuugaagguggcuac

SEQ ID NO: 1802099 - RNA, 16 nt, Human
cuggguugaagggcag

SEQ ID NO: 1802100 - RNA, 20 nt, Human
ccaaaaauguguaagaacaa

SEQ ID NO: 1802101 - RNA, 13 nt, Human
caggcgugagcca

SEQ ID NO: 1802102 - RNA, 12 nt, Human
ccuuuuuuuaag

SEQ ID NO: 1802103 - RNA, 22 nt, Human
caaauuuacagagacagaaagc

SEQ ID NO: 1802104 - RNA, 21 nt, Human
ccuccacaccauucaggucuu

SEQ ID NO: 1802105 - RNA, 23 nt, Human
ggaacaguuaccucugccucaga

SEQ ID NO: 1802106 - RNA, 18 nt, Human
aaauagugauuuccacag

SEQ ID NO: 1802107 - RNA, 23 nt, Human
ccccacagaagugcuuucuucuc

SEQ ID NO: 1802108 - RNA, 13 nt, Human
cuuaccagauuuu

SEQ ID NO: 1802109 - RNA, 19 nt, Human
gcccaugcuggagugcagu

SEQ ID NO: 1802110 - RNA, 23 nt, Human
ggucuaucuuugagcgcccacua

SEQ ID NO: 1802111 - RNA, 16 nt, Human
ggucugaagcucaacu

SEQ ID NO: 1802112 - RNA, 14 nt, Human
gccacuagcccucc

SEQ ID NO: 1802113 - RNA, 16 nt, Human
cugucucuacaaaaaa

SEQ ID NO: 1802114 - RNA, 17 nt, Human
cccagaugagaagucug

SEQ ID NO: 1802115 - RNA, 21 nt, Human
augaauuugugaagguggaaa

SEQ ID NO: 1802116 - RNA, 22 nt, Human
accccacagaagugcuuucuuc

SEQ ID NO: 1802117 - RNA, 15 nt, Human
cgaaggaaaagggcu

SEQ ID NO: 1802118 - RNA, 14 nt, Human
cagccauguauuug

SEQ ID NO: 1802119 - RNA, 16 nt, Human
cauaauauaaaacagg

SEQ ID NO: 1802120 - RNA, 15 nt, Human
gaggaaagugauauc

SEQ ID NO: 1802121 - RNA, 14 nt, Human
cacuaaacaaagag

SEQ ID NO: 1802122 - RNA, 15 nt, Human
ggcauguagcuacag

SEQ ID NO: 1802123 - RNA, 19 nt, Human
accccaaguuauccaccug

SEQ ID NO: 1802124 - RNA, 18 nt, Human
uguaaaauuacacuuuga

SEQ ID NO: 1802125 - RNA, 16 nt, Human
auaaauaaaguuuguu

SEQ ID NO: 1802126 - RNA, 23 nt, Human
cagccugaaacucauagacacug

SEQ ID NO: 1802127 - RNA, 22 nt, Human
uggcucuuuccuggcuacucca

SEQ ID NO: 1802128 - RNA, 15 nt, Human
gccacccucccacug

SEQ ID NO: 1802129 - RNA, 20 nt, Human
accggccuuugcaccuccau

SEQ ID NO: 1802130 - RNA, 17 nt, Human
accuuuuacucuucuua

SEQ ID NO: 1802131 - RNA, 20 nt, Human
gaagcuuuuaugugaaacau

SEQ ID NO: 1802132 - RNA, 14 nt, Human
gcugacccucccca

SEQ ID NO: 1802133 - RNA, 12 nt, Human
uaauucauguug

SEQ ID NO: 1802134 - RNA, 17 nt, Human
gugaccugccaggcaca

SEQ ID NO: 1802135 - RNA, 21 nt, Human
uuucuggcaccaggaaucccc

SEQ ID NO: 1802136 - RNA, 14 nt, Human
accauuuuuacuug

SEQ ID NO: 1802137 - RNA, 16 nt, Human
agagcuacccgcagag

SEQ ID NO: 1802138 - RNA, 18 nt, Human
uggaccucaccaagcugc

SEQ ID NO: 1802139 - RNA, 19 nt, Human
cucuguucugcacacagca

SEQ ID NO: 1802140 - RNA, 24 nt, Human
auuccagaccugaagaaucacaau

SEQ ID NO: 1802141 - RNA, 14 nt, Human
auaagauauuuuuc

SEQ ID NO: 1802142 - RNA, 18 nt, Human
cuuuggagauuuuuuaau

SEQ ID NO: 1802143 - RNA, 13 nt, Human
agcuauaaaauga

SEQ ID NO: 1802144 - RNA, 15 nt, Human
aagaguuuaauuuuu

SEQ ID NO: 1802145 - RNA, 17 nt, Human
ucccaagcaccugggau

SEQ ID NO: 1802146 - RNA, 16 nt, Human
agcccugccucaagcu

SEQ ID NO: 1802147 - RNA, 13 nt, Human
gacccacuuaccu

SEQ ID NO: 1802148 - RNA, 19 nt, Human
augauggguguuuuuagca

SEQ ID NO: 1802149 - RNA, 18 nt, Human
auguuuugacauuuuuag

SEQ ID NO: 1802150 - RNA, 14 nt, Human
uguguguuuuaaac

SEQ ID NO: 1802151 - RNA, 23 nt, Human
agugcaguggcgcgaucucagcu

SEQ ID NO: 1802152 - RNA, 15 nt, Human
cucuaucauuuaaua

SEQ ID NO: 1802153 - RNA, 23 nt, Human
ucuaaaaaaggaauccucugugu

SEQ ID NO: 1802154 - RNA, 20 nt, Human
acuuuauuuucuauaauuua

SEQ ID NO: 1802155 - RNA, 16 nt, Human
caaccucugccuccca

SEQ ID NO: 1802156 - RNA, 15 nt, Human
cugggccccugccuc

SEQ ID NO: 1802157 - RNA, 22 nt, Human
acuaaaguuagaaaguugauuu

SEQ ID NO: 1802158 - RNA, 15 nt, Human
uacaaaugcauuucu

SEQ ID NO: 1802159 - RNA, 19 nt, Human
acgccuggcuaauuuuugu

SEQ ID NO: 1802160 - RNA, 13 nt, Human
cucacauuuuccc

SEQ ID NO: 1802161 - RNA, 21 nt, Human
uucuaugagauagguacuauu

SEQ ID NO: 1802162 - RNA, 22 nt, Human
guagccagcaucugccuccccu

SEQ ID NO: 1802163 - RNA, 20 nt, Human
cugagcaccuacuuacaugc

SEQ ID NO: 1802164 - RNA, 21 nt, Human
cucccaagcaccugggauuac

SEQ ID NO: 1802165 - RNA, 14 nt, Human
aaaacuucagacau

SEQ ID NO: 1802166 - RNA, 16 nt, Human
ccuagccugccucccc

SEQ ID NO: 1802167 - RNA, 18 nt, Human
auagucaaauugugugaa

SEQ ID NO: 1802168 - RNA, 16 nt, Human
uaaaaguuuuuuauua

SEQ ID NO: 1802169 - RNA, 17 nt, Human
aacagcacccucuccag

SEQ ID NO: 1802170 - RNA, 17 nt, Human
augcggcccaggauggc

SEQ ID NO: 1802171 - RNA, 18 nt, Human
uggcugaaaggaagcugu

SEQ ID NO: 1802172 - RNA, 21 nt, Human
cuucuaaccugaacugauggg

SEQ ID NO: 1802173 - RNA, 17 nt, Human
ugaagggguucucacag

SEQ ID NO: 1802174 - RNA, 20 nt, Human
cccuuccuaauuccacagcu

SEQ ID NO: 1802175 - RNA, 13 nt, Human
ccugccucagccu

SEQ ID NO: 1802176 - RNA, 22 nt, Human
aggcauccccaggcccugcucu

SEQ ID NO: 1802177 - RNA, 14 nt, Human
agagacuugggaau

SEQ ID NO: 1802178 - RNA, 15 nt, Human
ccagcacagccucuu

SEQ ID NO: 1802179 - RNA, 23 nt, Human
ggcccugcucuuccucagcugug

SEQ ID NO: 1802180 - RNA, 19 nt, Human
uauuauuuuauguugcaua

SEQ ID NO: 1802181 - RNA, 20 nt, Human
gcucccuagccagaggcucu

SEQ ID NO: 1802182 - RNA, 13 nt, Human
aaaugaaagcagg

SEQ ID NO: 1802183 - RNA, 21 nt, Human
ucuucuuugcccacaaugcuu

SEQ ID NO: 1802184 - RNA, 13 nt, Human
gcaaguccuuccc

SEQ ID NO: 1802185 - RNA, 17 nt, Human
cccaucucagguguguu

SEQ ID NO: 1802186 - RNA, 17 nt, Human
ggagccuccucucucaa

SEQ ID NO: 1802187 - RNA, 21 nt, Human
cgugcauugugcuucuuucuu

SEQ ID NO: 1802188 - RNA, 22 nt, Human
ucagcucacugcaaccuccacc

SEQ ID NO: 1802189 - RNA, 20 nt, Human
ccauucaaagugagcuccua

SEQ ID NO: 1802190 - RNA, 13 nt, Human
gaaucacaauaau

SEQ ID NO: 1802191 - RNA, 12 nt, Human
cuuuauuuugag

SEQ ID NO: 1802192 - RNA, 22 nt, Human
cuuucuuagaaauuuauuuccu

SEQ ID NO: 1802193 - RNA, 21 nt, Human
ucacaugaacuuguaaaggaa

SEQ ID NO: 1802194 - RNA, 19 nt, Human
cuuccuaauuccacagcug

SEQ ID NO: 1802195 - RNA, 18 nt, Human
uuuuuuuaaaaaauagca

SEQ ID NO: 1802196 - RNA, 14 nt, Human
uauccaccugccuu

SEQ ID NO: 1802197 - RNA, 20 nt, Human
uauucauaagauuuaaauua

SEQ ID NO: 1802198 - RNA, 23 nt, Human
cauccucgaggcccuagcauuuc

SEQ ID NO: 1802199 - RNA, 14 nt, Human
gcugcuagagugac

SEQ ID NO: 1802200 - RNA, 23 nt, Human
aauccucucucuguguuacccag

SEQ ID NO: 1802201 - RNA, 18 nt, Human
aucuuauaauuuaaaaua

SEQ ID NO: 1802202 - RNA, 12 nt, Human
uaauuccacagc

SEQ ID NO: 1802203 - RNA, 20 nt, Human
ccugucuguuuccucuguau

SEQ ID NO: 1802204 - RNA, 22 nt, Human
ucccuagccagaggcucuaaug

SEQ ID NO: 1802205 - RNA, 20 nt, Human
aaguuagaaaguugauuuua

SEQ ID NO: 1802206 - RNA, 19 nt, Human
agaaaauugugcuggaaau

SEQ ID NO: 1802207 - RNA, 15 nt, Human
uaaucuguauuuccc

SEQ ID NO: 1802208 - RNA, 21 nt, Human
cucagcuucacccugagguga

SEQ ID NO: 1802209 - RNA, 17 nt, Human
cacaugauuccagccau

SEQ ID NO: 1802210 - RNA, 23 nt, Human
aggucuuucuuuccgaggccccu

SEQ ID NO: 1802211 - RNA, 19 nt, Human
uccagaaagugacaagcuc

SEQ ID NO: 1802212 - RNA, 12 nt, Human
augccuuuucuc

SEQ ID NO: 1802213 - RNA, 17 nt, Human
auaaagaauggaaagcu

SEQ ID NO: 1802214 - RNA, 18 nt, Human
uuuuaaaaaagaaacauu

SEQ ID NO: 1802215 - RNA, 14 nt, Human
cacccacuucccac

SEQ ID NO: 1802216 - RNA, 19 nt, Human
cuaagaaacauuuauauug

SEQ ID NO: 1802217 - RNA, 20 nt, Human
uuuuaccaaauaaaguagaa

SEQ ID NO: 1802218 - RNA, 17 nt, Human
augcagagguccacaac

SEQ ID NO: 1802219 - RNA, 23 nt, Human
cuggccgggagccugaucaccug

SEQ ID NO: 1802220 - RNA, 13 nt, Human
auauccucccucc

SEQ ID NO: 1802221 - RNA, 23 nt, Human
uauaaguguguguuuuucauaaa

SEQ ID NO: 1802222 - RNA, 17 nt, Human
uaucuaugcauuuucug

SEQ ID NO: 1802223 - RNA, 13 nt, Human
cugcugcugugca

SEQ ID NO: 1802224 - RNA, 18 nt, Human
agagucuuccucugucuc

SEQ ID NO: 1802225 - RNA, 20 nt, Human
agaagucguuuuuagggaga

SEQ ID NO: 1802226 - RNA, 15 nt, Human
uugaacuuuuuauug

SEQ ID NO: 1802227 - RNA, 13 nt, Human
agucacagcuaca

SEQ ID NO: 1802228 - RNA, 14 nt, Human
accuccuggguuca

SEQ ID NO: 1802229 - RNA, 15 nt, Human
gucucuugaggcaca

SEQ ID NO: 1802230 - RNA, 13 nt, Human
acaagaaaugaaa

SEQ ID NO: 1802231 - RNA, 20 nt, Human
caaauguucaucaaugaaug

SEQ ID NO: 1802232 - RNA, 22 nt, Human
uaaaaugagaaaucuaaaaaac

SEQ ID NO: 1802233 - RNA, 14 nt, Human
cggcuccucaggga

SEQ ID NO: 1802234 - RNA, 18 nt, Human
acagucuaacaaauucca

SEQ ID NO: 1802235 - RNA, 15 nt, Human
aacuucuauuuuuau

SEQ ID NO: 1802236 - RNA, 22 nt, Human
aaaacuuguauuauguguguuu

SEQ ID NO: 1802237 - RNA, 16 nt, Human
gccaagaggcuguucc

SEQ ID NO: 1802238 - RNA, 12 nt, Human
gcaaguuagaac

SEQ ID NO: 1802239 - RNA, 20 nt, Human
auguacaauaaagcaaugug

SEQ ID NO: 1802240 - RNA, 18 nt, Human
ccaggcugcucagggcug

SEQ ID NO: 1802241 - RNA, 17 nt, Human
ugcuggaaauggacaca

SEQ ID NO: 1802242 - RNA, 21 nt, Human
gacucacugugggaaggagac

SEQ ID NO: 1802243 - RNA, 16 nt, Human
cacacugagccagcag

SEQ ID NO: 1802244 - RNA, 15 nt, Human
cucccugccccccag

SEQ ID NO: 1802245 - RNA, 17 nt, Human
aauugggagcugccaag

SEQ ID NO: 1802246 - RNA, 21 nt, Human
cuguugggguggguauaaaag

SEQ ID NO: 1802247 - RNA, 22 nt, Human
cucagcuucacccugaggugag

SEQ ID NO: 1802248 - RNA, 22 nt, Human
gaggcaccugucccagaaaaag

SEQ ID NO: 1802249 - RNA, 21 nt, Human
cucuucuggguuccuuccucu

SEQ ID NO: 1802250 - RNA, 15 nt, Human
cuucucuguucauuu

SEQ ID NO: 1802251 - RNA, 21 nt, Human
cagagguccacaacacacaga

SEQ ID NO: 1802252 - RNA, 21 nt, Human
aauccuagguaggguuuaauc

SEQ ID NO: 1802253 - RNA, 16 nt, Human
ugaacucuguuuucuu

SEQ ID NO: 1802254 - RNA, 15 nt, Human
ccuuagaccaccaag

SEQ ID NO: 1802255 - RNA, 20 nt, Human
gugaaaccccuauguggagg

SEQ ID NO: 1802256 - RNA, 14 nt, Human
ugucuuuuccuucu

SEQ ID NO: 1802257 - RNA, 16 nt, Human
uccugcaauuccacuu

SEQ ID NO: 1802258 - RNA, 12 nt, Human
ugcuuuuuaaug

SEQ ID NO: 1802259 - RNA, 21 nt, Human
ccauaccccuggccaaggaag

SEQ ID NO: 1802260 - RNA, 13 nt, Human
accaagauauacc

SEQ ID NO: 1802261 - RNA, 20 nt, Human
auuuaguguucauaaauaaa

SEQ ID NO: 1802262 - RNA, 22 nt, Human
cauuucccccuagccugccucc

SEQ ID NO: 1802263 - RNA, 15 nt, Human
ucaaaagagucuuaa

SEQ ID NO: 1802264 - RNA, 12 nt, Human
ugaucucagcuc

SEQ ID NO: 1802265 - RNA, 17 nt, Human
cuagaaaacaggcaaau

SEQ ID NO: 1802266 - RNA, 18 nt, Human
aaaucaugaagauauuuu

SEQ ID NO: 1802267 - RNA, 19 nt, Human
auuucccuguuucuuccac

SEQ ID NO: 1802268 - RNA, 16 nt, Human
aaauggacaucaaaau

SEQ ID NO: 1802269 - RNA, 19 nt, Human
ugcccuuccugcaggcagg

SEQ ID NO: 1802270 - RNA, 20 nt, Human
aacuuuuuauugauuuuugg

SEQ ID NO: 1802271 - RNA, 12 nt, Human
uauugucacuga

SEQ ID NO: 1802272 - RNA, 22 nt, Human
acauuucccccuagccugccuc

SEQ ID NO: 1802273 - RNA, 19 nt, Human
caggaugguggcaggaaaa

SEQ ID NO: 1802274 - RNA, 19 nt, Human
uagauucuaauggcuuuau

SEQ ID NO: 1802275 - RNA, 21 nt, Human
gaaaacaauaacgauaaaaga

SEQ ID NO: 1802276 - RNA, 21 nt, Human
ccugcaggcaggaacaaacag

SEQ ID NO: 1802277 - RNA, 17 nt, Human
aaaucauaagauauuuu

SEQ ID NO: 1802278 - RNA, 21 nt, Human
acuauguaggaaagaccauuu

SEQ ID NO: 1802279 - RNA, 18 nt, Human
acccaguagaugccacua

SEQ ID NO: 1802280 - RNA, 19 nt, Human
guuauuauauuuacaaaug

SEQ ID NO: 1802281 - RNA, 21 nt, Human
aacugagauccuuccuuuuga

SEQ ID NO: 1802282 - RNA, 23 nt, Human
cgaaggaaaagggcuuucucaau

SEQ ID NO: 1802283 - RNA, 17 nt, Human
aaaaauccuacuuucau

SEQ ID NO: 1802284 - RNA, 14 nt, Human
gcugcccucccccu

SEQ ID NO: 1802285 - RNA, 17 nt, Human
augccccgucccccucu

SEQ ID NO: 1802286 - RNA, 17 nt, Human
gcuauucuccauacucu

SEQ ID NO: 1802287 - RNA, 17 nt, Human
acuauucuugauguaaa

SEQ ID NO: 1802288 - RNA, 17 nt, Human
uucuauagcuuuucccu

SEQ ID NO: 1802289 - RNA, 23 nt, Human
cacagccccuggucagucugccc

SEQ ID NO: 1802290 - RNA, 22 nt, Human
cuggcaaggguucaccugggcu

SEQ ID NO: 1802291 - RNA, 20 nt, Human
aggcuguugucuuuuccuuc

SEQ ID NO: 1802292 - RNA, 16 nt, Human
ccgccucagccuccca

SEQ ID NO: 1802293 - RNA, 16 nt, Human
auaaagcaauguggua

SEQ ID NO: 1802294 - RNA, 18 nt, Human
aaucagaccuggcugcuu

SEQ ID NO: 1802295 - RNA, 13 nt, Human
aacaagccuccuu

SEQ ID NO: 1802296 - RNA, 14 nt, Human
guguuuuaaaauga

SEQ ID NO: 1802297 - RNA, 17 nt, Human
accugaagcuaucguaa

SEQ ID NO: 1802298 - RNA, 18 nt, Human
uucccccuagccugccuc

SEQ ID NO: 1802299 - RNA, 23 nt, Human
gaagugcuaauuuugaaaaacug

SEQ ID NO: 1802300 - RNA, 23 nt, Human
gcgauucuccugccucagccucc

SEQ ID NO: 1802301 - RNA, 14 nt, Human
aguacuuugugcau

SEQ ID NO: 1802302 - RNA, 14 nt, Human
acugccaucauuua

SEQ ID NO: 1802303 - RNA, 13 nt, Human
ucuccagaugaga

SEQ ID NO: 1802304 - RNA, 20 nt, Human
ucucuugauuuucauuauuc

SEQ ID NO: 1802305 - RNA, 15 nt, Human
uaauauauuuuaaau

SEQ ID NO: 1802306 - RNA, 14 nt, Human
cugccucagccucc

SEQ ID NO: 1802307 - RNA, 23 nt, Human
aauccuggggaacauagaacuca

SEQ ID NO: 1802308 - RNA, 16 nt, Human
gcuguuaaucuuucaa

SEQ ID NO: 1802309 - RNA, 20 nt, Human
accaucgucuucuuggccau

SEQ ID NO: 1802310 - RNA, 13 nt, Human
uggcagagccagg

SEQ ID NO: 1802311 - RNA, 21 nt, Human
cuaagaaagcccuuaggaaga

SEQ ID NO: 1802312 - RNA, 17 nt, Human
caggcuggcgugcagca

SEQ ID NO: 1802313 - RNA, 20 nt, Human
gucuguaaaaucuuucuuuc

SEQ ID NO: 1802314 - RNA, 20 nt, Human
ggcuguucccaccaggcugc

SEQ ID NO: 1802315 - RNA, 23 nt, Human
ugcaaauaaauauccuuuaauug

SEQ ID NO: 1802316 - RNA, 13 nt, Human
uguuuuucuuuuu

SEQ ID NO: 1802317 - RNA, 22 nt, Human
uguuuccucuguauacaaaacc

SEQ ID NO: 1802318 - RNA, 12 nt, Human
ccuaagcccucc

SEQ ID NO: 1802319 - RNA, 15 nt, Human
cuagaggcuuccuuc

SEQ ID NO: 1802320 - RNA, 20 nt, Human
auaaauggcuuccuggcaau

SEQ ID NO: 1802321 - RNA, 13 nt, Human
cucccagcucagg

SEQ ID NO: 1802322 - RNA, 13 nt, Human
cagccucagccuc

SEQ ID NO: 1802323 - RNA, 14 nt, Human
auaaauaccaaaaa

SEQ ID NO: 1802324 - RNA, 16 nt, Human
uccuucccuugcuucu

SEQ ID NO: 1802325 - RNA, 15 nt, Human
auuuaaauauuuauu

SEQ ID NO: 1802326 - RNA, 12 nt, Human
ccugccagcugg

SEQ ID NO: 1802327 - RNA, 17 nt, Human
ccucuccagaugcagcc

SEQ ID NO: 1802328 - RNA, 14 nt, Human
caugaacuuguaaa

SEQ ID NO: 1802329 - RNA, 18 nt, Human
aguucuccacuagcuaug

SEQ ID NO: 1802330 - RNA, 20 nt, Human
uagaaaaguuauguagaaaa

SEQ ID NO: 1802331 - RNA, 18 nt, Human
uacauuuguauaaaauaa

SEQ ID NO: 1802332 - RNA, 15 nt, Human
uauaaauggaauuac

SEQ ID NO: 1802333 - RNA, 16 nt, Human
cugacgaacuccuuga

SEQ ID NO: 1802334 - RNA, 22 nt, Human
cagcucagaaguuucuucuuua

SEQ ID NO: 1802335 - RNA, 12 nt, Human
acacugaagaag

SEQ ID NO: 1802336 - RNA, 18 nt, Human
ucucuaaagaaaaucucu

SEQ ID NO: 1802337 - RNA, 14 nt, Human
cuguuuaagagaca

SEQ ID NO: 1802338 - RNA, 19 nt, Human
aauauuauguuaaaacugg

SEQ ID NO: 1802339 - RNA, 17 nt, Human
uauuuauaaaaauaaaa

SEQ ID NO: 1802340 - RNA, 11 nt, Human
uacugcaugca

SEQ ID NO: 1802341 - RNA, 22 nt, Human
ggggugggaaagauuacuuuuu

SEQ ID NO: 1802342 - RNA, 21 nt, Human
ccgaaggaaaagggcuuucuc

SEQ ID NO: 1802343 - RNA, 20 nt, Human
aggcccugcucuuccucagc

SEQ ID NO: 1802344 - RNA, 22 nt, Human
aacuaggguggugcauuuuugu

SEQ ID NO: 1802345 - RNA, 13 nt, Human
cacaacuauauug

SEQ ID NO: 1802346 - RNA, 14 nt, Human
cugaguuuuaccaa

SEQ ID NO: 1802347 - RNA, 16 nt, Human
ccaacggcaagggaac

SEQ ID NO: 1802348 - RNA, 15 nt, Human
ugagcucagcccugg

SEQ ID NO: 1802349 - RNA, 18 nt, Human
aagaaaacuuguauuaug

SEQ ID NO: 1802350 - RNA, 20 nt, Human
aagcuuuuaugugaaacaug

SEQ ID NO: 1802351 - RNA, 18 nt, Human
uuaaacacauuaggaaaa

SEQ ID NO: 1802352 - RNA, 17 nt, Human
ugccugccccuacccug

SEQ ID NO: 1802353 - RNA, 12 nt, Human
uguccagccccg

SEQ ID NO: 1802354 - RNA, 13 nt, Human
auaaauaaaaaua

SEQ ID NO: 1802355 - RNA, 14 nt, Human
caauaaagcaaugu

SEQ ID NO: 1802356 - RNA, 23 nt, Human
uccucccuccagauauacuuggu

SEQ ID NO: 1802357 - RNA, 12 nt, Human
ucauacauuuuc

SEQ ID NO: 1802358 - RNA, 15 nt, Human
caggcaaauuccuga

SEQ ID NO: 1802359 - RNA, 14 nt, Human
cacugacacacacg

SEQ ID NO: 1802360 - RNA, 20 nt, Human
uuuaaauaaaguguuugaaa

SEQ ID NO: 1802361 - RNA, 17 nt, Human
cugccucaccagcccug

SEQ ID NO: 1802362 - RNA, 22 nt, Human
aguauguuagugcaaauuguca

SEQ ID NO: 1802363 - RNA, 22 nt, Human
auguagaaaaaaguaaauguga

SEQ ID NO: 1802364 - RNA, 21 nt, Human
aucucaaacuucuauuuuuau

SEQ ID NO: 1802365 - RNA, 18 nt, Human
ggaauccccaacaugcac

SEQ ID NO: 1802366 - RNA, 16 nt, Human
gaauugcucucccagc

SEQ ID NO: 1802367 - RNA, 21 nt, Human
uuugucugagacagaaucuca

SEQ ID NO: 1802368 - RNA, 16 nt, Human
auaugucuuucuuuuu

SEQ ID NO: 1802369 - RNA, 20 nt, Human
cauuuucuggguguuuucuu

SEQ ID NO: 1802370 - RNA, 12 nt, Human
ugcaaccaucac

SEQ ID NO: 1802371 - RNA, 19 nt, Human
ugggguguguggcagagcc

SEQ ID NO: 1802372 - RNA, 15 nt, Human
uaaaucuaucaaaau

SEQ ID NO: 1802373 - RNA, 21 nt, Human
cucugcaggcagccugccuuu

SEQ ID NO: 1802374 - RNA, 15 nt, Human
uccauauaaauauua

SEQ ID NO: 1802375 - RNA, 19 nt, Human
auuuaacugacuauucuug

SEQ ID NO: 1802376 - RNA, 16 nt, Human
ccaugugcagccacca

SEQ ID NO: 1802377 - RNA, 13 nt, Human
ugagccagcagcc

SEQ ID NO: 1802378 - RNA, 13 nt, Human
uguuuucccuccu

SEQ ID NO: 1802379 - RNA, 16 nt, Human
auccacccgccucagc

SEQ ID NO: 1802380 - RNA, 20 nt, Human
cuugauuuuagccuucucug

SEQ ID NO: 1802381 - RNA, 13 nt, Human
auccaucuuucac

SEQ ID NO: 1802382 - RNA, 13 nt, Human
uuuuuuuuuuccc

SEQ ID NO: 1802383 - RNA, 14 nt, Human
cucaaagugcuggc

SEQ ID NO: 1802384 - RNA, 19 nt, Human
gcuuuagccaagugcaggg

SEQ ID NO: 1802385 - RNA, 18 nt, Human
agaaauuuauaaacuuuu

SEQ ID NO: 1802386 - RNA, 16 nt, Human
agagccuccuuucugg

SEQ ID NO: 1802387 - RNA, 15 nt, Human
agcaaggagcuuaga

SEQ ID NO: 1802388 - RNA, 20 nt, Human
aauauuuucuuuguuaaaau

SEQ ID NO: 1802389 - RNA, 12 nt, Human
uauuuuuucccc

SEQ ID NO: 1802390 - RNA, 15 nt, Human
accucaguucccucu

SEQ ID NO: 1802391 - RNA, 21 nt, Human
uuuaauuuuacauuuccuaaa

SEQ ID NO: 1802392 - RNA, 17 nt, Human
cucugauccgagcucag

SEQ ID NO: 1802393 - RNA, 20 nt, Human
cugcaggcagccugccuuua

SEQ ID NO: 1802394 - RNA, 18 nt, Human
uacauuuuaaacacauua

SEQ ID NO: 1802395 - RNA, 21 nt, Human
aacugacuauucuugauguaa

SEQ ID NO: 1802396 - RNA, 15 nt, Human
gucucccagcucagg

SEQ ID NO: 1802397 - RNA, 14 nt, Human
cagauccuggaaau

SEQ ID NO: 1802398 - RNA, 14 nt, Human
auuguccaggucua

SEQ ID NO: 1802399 - RNA, 15 nt, Human
cuuagucacaaagcc

SEQ ID NO: 1802400 - RNA, 17 nt, Human
aaagaaaauaaaucuau

SEQ ID NO: 1802401 - RNA, 19 nt, Human
cauaauacuugcuuuggaa

SEQ ID NO: 1802402 - RNA, 16 nt, Human
gccaccauggccagcu

SEQ ID NO: 1802403 - RNA, 15 nt, Human
uggcugcauaaaugu

SEQ ID NO: 1802404 - RNA, 16 nt, Human
augauguacauguacu

SEQ ID NO: 1802405 - RNA, 20 nt, Human
aagcaggguugguuucccuu

SEQ ID NO: 1802406 - RNA, 19 nt, Human
aaaugcauauacuuuaaua

SEQ ID NO: 1802407 - RNA, 17 nt, Human
gaucuggcucuggacag

SEQ ID NO: 1802408 - RNA, 15 nt, Human
uaucaugugaaauca

SEQ ID NO: 1802409 - RNA, 19 nt, Human
cacagugggagccagggcu

SEQ ID NO: 1802410 - RNA, 15 nt, Human
ccucaguucccucuu

SEQ ID NO: 1802411 - RNA, 18 nt, Human
cugagaaauuuauaaacu

SEQ ID NO: 1802412 - RNA, 14 nt, Human
ccugccccugagcc

SEQ ID NO: 1802413 - RNA, 12 nt, Human
caaccuccgccu

SEQ ID NO: 1802414 - RNA, 22 nt, Human
gagugcaguggcgugaucucag

SEQ ID NO: 1802415 - RNA, 20 nt, Human
ucagaaggaaagaauaacca

SEQ ID NO: 1802416 - RNA, 12 nt, Human
uucagccugaaa

SEQ ID NO: 1802417 - RNA, 18 nt, Human
cucuccaaagcccucccu

SEQ ID NO: 1802418 - RNA, 12 nt, Human
ugcucaggagcc

SEQ ID NO: 1802419 - RNA, 22 nt, Human
ugggacuaaguguaccagagaa

SEQ ID NO: 1802420 - RNA, 19 nt, Human
acguugcuccccaucaagc

SEQ ID NO: 1802421 - RNA, 16 nt, Human
ccaugcugcuggggaa

SEQ ID NO: 1802422 - RNA, 21 nt, Human
aagcccccacuacaagugauc

SEQ ID NO: 1802423 - RNA, 15 nt, Human
gacuuuauagaucag

SEQ ID NO: 1802424 - RNA, 18 nt, Human
ugcccggcuaauuuuugu

SEQ ID NO: 1802425 - RNA, 17 nt, Human
uguuucacuugguucag

SEQ ID NO: 1802426 - RNA, 22 nt, Human
cacugugguuaguguaauaaaa

SEQ ID NO: 1802427 - RNA, 17 nt, Human
uauuauucuuauuauuu

SEQ ID NO: 1802428 - RNA, 19 nt, Human
ccuugcagcucuccccuuc

SEQ ID NO: 1802429 - RNA, 19 nt, Human
cacaaauuaucuuaaaacu

SEQ ID NO: 1802430 - RNA, 16 nt, Human
uuuuuguaacuggagc

SEQ ID NO: 1802431 - RNA, 17 nt, Human
uuugcucagcuucucca

SEQ ID NO: 1802432 - RNA, 19 nt, Human
accauuuuggcaagcucua

SEQ ID NO: 1802433 - RNA, 15 nt, Human
gcagcucucuuuccu

SEQ ID NO: 1802434 - RNA, 17 nt, Human
uguaaagugauauuucc

SEQ ID NO: 1802435 - RNA, 23 nt, Human
uaaaaucagccaauuauguuaaa

SEQ ID NO: 1802436 - RNA, 23 nt, Human
aagaagcacgugguaaaacacuu

SEQ ID NO: 1802437 - RNA, 21 nt, Human
agccagguucugacucuuggc

SEQ ID NO: 1802438 - RNA, 17 nt, Human
uguaggauguugagcag

SEQ ID NO: 1802439 - RNA, 15 nt, Human
uccaggcaccaggac

SEQ ID NO: 1802440 - RNA, 16 nt, Human
cuccccuucacuccca

SEQ ID NO: 1802441 - RNA, 16 nt, Human
guaguaugaugggugu

SEQ ID NO: 1802442 - RNA, 14 nt, Human
aguuuaauuuuuga

SEQ ID NO: 1802443 - RNA, 15 nt, Human
auauuuuuuguuaaa

SEQ ID NO: 1802444 - RNA, 14 nt, Human
ccuguacccaguag

SEQ ID NO: 1802445 - RNA, 22 nt, Human
cucucugcaggcagccugccuu

SEQ ID NO: 1802446 - RNA, 14 nt, Human
agggagauucagac

SEQ ID NO: 1802447 - RNA, 18 nt, Human
ggagguccuuaggccucu

SEQ ID NO: 1802448 - RNA, 20 nt, Human
uaauuagccagugaaaaacu

SEQ ID NO: 1802449 - RNA, 13 nt, Human
acaaagaaauuau

SEQ ID NO: 1802450 - RNA, 21 nt, Human
uaauauaagcugccauauauu

SEQ ID NO: 1802451 - RNA, 13 nt, Human
aguccccagccug

SEQ ID NO: 1802452 - RNA, 23 nt, Human
aucaccaaggcugauuaaaccaa

SEQ ID NO: 1802453 - RNA, 18 nt, Human
uauucuagucuauuuguu

SEQ ID NO: 1802454 - RNA, 15 nt, Human
aucuuauaauuuaaa

SEQ ID NO: 1802455 - RNA, 15 nt, Human
acgggaaacaaaacu

SEQ ID NO: 1802456 - RNA, 23 nt, Human
acauuuguagcauccucuuuaau

SEQ ID NO: 1802457 - RNA, 18 nt, Human
agggaaaauucuaaccca

SEQ ID NO: 1802458 - RNA, 22 nt, Human
ugaaaaaucuaaguguuucaua

SEQ ID NO: 1802459 - RNA, 14 nt, Human
cuggcugcuuggag

SEQ ID NO: 1802460 - RNA, 17 nt, Human
ccugaaggcauccccag

SEQ ID NO: 1802461 - RNA, 16 nt, Human
gcccccagagccacag

SEQ ID NO: 1802462 - RNA, 16 nt, Human
cagaaagaaaacuugu

SEQ ID NO: 1802463 - RNA, 20 nt, Human
agauuuuucaugauuuugaa

SEQ ID NO: 1802464 - RNA, 17 nt, Human
cuacacagaucacagcu

SEQ ID NO: 1802465 - RNA, 21 nt, Human
gaagcaugauuggugcccagu

SEQ ID NO: 1802466 - RNA, 22 nt, Human
uacuguacagacagaaaaaacu

SEQ ID NO: 1802467 - RNA, 13 nt, Human
cuuggccauggga

SEQ ID NO: 1802468 - RNA, 21 nt, Human
cucagugucaaugcagccccc

SEQ ID NO: 1802469 - RNA, 21 nt, Human
uggaagccccugggcccagua

SEQ ID NO: 1802470 - RNA, 15 nt, Human
ccucagucucccucc

SEQ ID NO: 1802471 - RNA, 15 nt, Human
aggaacaaacagggc

SEQ ID NO: 1802472 - RNA, 17 nt, Human
cugaucaccugcccugc

SEQ ID NO: 1802473 - RNA, 22 nt, Human
uaacuuacauucuuaaaguguc

SEQ ID NO: 1802474 - RNA, 16 nt, Human
uccucacuuugaagag

SEQ ID NO: 1802475 - RNA, 18 nt, Human
uuuaggagcaugagugcc

SEQ ID NO: 1802476 - RNA, 16 nt, Human
uaucuuuucauacauu

SEQ ID NO: 1802477 - RNA, 19 nt, Human
cagagcuacccgcagaguu

SEQ ID NO: 1802478 - RNA, 12 nt, Human
aauaaauguacc

SEQ ID NO: 1802479 - RNA, 20 nt, Human
guuccuuccucugagccuug

SEQ ID NO: 1802480 - RNA, 19 nt, Human
auccuacaagacacaguga

SEQ ID NO: 1802481 - RNA, 15 nt, Human
gacagggaggacgcu

SEQ ID NO: 1802482 - RNA, 14 nt, Human
gagagaguggcugg

SEQ ID NO: 1802483 - RNA, 13 nt, Human
ccgcagugagaga

SEQ ID NO: 1802484 - RNA, 20 nt, Human
caguauauuucccuguuucu

SEQ ID NO: 1802485 - RNA, 14 nt, Human
uuaucuugaauaau

SEQ ID NO: 1802486 - RNA, 15 nt, Human
ugucucuacaaaaaa

SEQ ID NO: 1802487 - RNA, 22 nt, Human
caagcagagguggcgauuuguu

SEQ ID NO: 1802488 - RNA, 13 nt, Human
caucaucucagcu

SEQ ID NO: 1802489 - RNA, 14 nt, Human
uuccuccacaccau

SEQ ID NO: 1802490 - RNA, 21 nt, Human
uauaaaauaauuuuuauauuu

SEQ ID NO: 1802491 - RNA, 14 nt, Human
uaaaauccauacau

SEQ ID NO: 1802492 - RNA, 16 nt, Human
uaaauaaaaauaaucc

SEQ ID NO: 1802493 - RNA, 20 nt, Human
uguuguaauauuucuucaaa

SEQ ID NO: 1802494 - RNA, 21 nt, Human
uucuuaaccagaucauuguga

SEQ ID NO: 1802495 - RNA, 20 nt, Human
acacaacaauccuucuauuc

SEQ ID NO: 1802496 - RNA, 17 nt, Human
aauucuugccaaauaua

SEQ ID NO: 1802497 - RNA, 15 nt, Human
ccccuagccugccuc

SEQ ID NO: 1802498 - RNA, 19 nt, Human
cuggggcuuuaacuccugc

SEQ ID NO: 1802499 - RNA, 12 nt, Human
cauguuccccuu

SEQ ID NO: 1802500 - RNA, 13 nt, Human
gcucagcccugca

SEQ ID NO: 1802501 - RNA, 19 nt, Human
cacccagucuguuccccau

SEQ ID NO: 1802502 - RNA, 16 nt, Human
gcccaggauacuggca

SEQ ID NO: 1802503 - RNA, 17 nt, Human
aaaagucuccaaagucu

SEQ ID NO: 1802504 - RNA, 21 nt, Human
ccucccuuggggccuaugcag

SEQ ID NO: 1802505 - RNA, 16 nt, Human
ucuccccuucucugua

SEQ ID NO: 1802506 - RNA, 22 nt, Human
auauuuccuuauucagaauuuc

SEQ ID NO: 1802507 - RNA, 17 nt, Human
agacaaauggaggccug

SEQ ID NO: 1802508 - RNA, 14 nt, Human
cccaguagaugcca

SEQ ID NO: 1802509 - RNA, 21 nt, Human
acauucuuccugauuauuuuc

SEQ ID NO: 1802510 - RNA, 22 nt, Human
aauuacauuuguauaaaauaau

SEQ ID NO: 1802511 - RNA, 21 nt, Human
acacugggagaaaugaaaaaa

SEQ ID NO: 1802512 - RNA, 23 nt, Human
gccaagagccugagugacagagc

SEQ ID NO: 1802513 - RNA, 15 nt, Human
cagccucagccuccc

SEQ ID NO: 1802514 - RNA, 21 nt, Human
uuuaauuagccagugaaaaac

SEQ ID NO: 1802515 - RNA, 15 nt, Human
gcaaccucugccucc

SEQ ID NO: 1802516 - RNA, 16 nt, Human
cuuuggaaaacccaga

SEQ ID NO: 1802517 - RNA, 13 nt, Human
uagugauuuuaau

SEQ ID NO: 1802518 - RNA, 18 nt, Human
gaaucaugcugagagagc

SEQ ID NO: 1802519 - RNA, 17 nt, Human
aagacuacuagggaaau

SEQ ID NO: 1802520 - RNA, 18 nt, Human
agcauuguuggcuguucc

SEQ ID NO: 1802521 - RNA, 13 nt, Human
uggaggccugucc

SEQ ID NO: 1802522 - RNA, 12 nt, Human
agcauaauacuu

SEQ ID NO: 1802523 - RNA, 19 nt, Human
gaaggugggaggaugugaa

SEQ ID NO: 1802524 - RNA, 16 nt, Human
uacccucauuucucau

SEQ ID NO: 1802525 - RNA, 19 nt, Human
uguauaccuuguaauuuga

SEQ ID NO: 1802526 - RNA, 13 nt, Human
uuuagugaaauau

SEQ ID NO: 1802527 - RNA, 16 nt, Human
aaaagcuccauuuuua

SEQ ID NO: 1802528 - RNA, 23 nt, Human
ucauggcuaucuguggguaguau

SEQ ID NO: 1802529 - RNA, 20 nt, Human
uaggaggccaacccaaaaua

SEQ ID NO: 1802530 - RNA, 20 nt, Human
uugucucccagcucagggcu

SEQ ID NO: 1802531 - RNA, 23 nt, Human
uuuaguaagagauuccugagcca

SEQ ID NO: 1802532 - RNA, 14 nt, Human
uguaguuuuuauau

SEQ ID NO: 1802533 - RNA, 15 nt, Human
cuccuccuuuuuccu

SEQ ID NO: 1802534 - RNA, 14 nt, Human
ucucugcagguccc

SEQ ID NO: 1802535 - RNA, 17 nt, Human
cauacacucucaaagca

SEQ ID NO: 1802536 - RNA, 21 nt, Human
uguacagacagaaaaaacuga

SEQ ID NO: 1802537 - RNA, 21 nt, Human
cacuaucuggguuuugggggg

SEQ ID NO: 1802538 - RNA, 19 nt, Human
cgauaguguuaacuugcug

SEQ ID NO: 1802539 - RNA, 15 nt, Human
aucauaauauaaaac

SEQ ID NO: 1802540 - RNA, 18 nt, Human
aauuugaaacacuuugca

SEQ ID NO: 1802541 - RNA, 20 nt, Human
ccacauagaugcugauggag

SEQ ID NO: 1802542 - RNA, 21 nt, Human
aggcucuuuugggauuuuuga

SEQ ID NO: 1802543 - RNA, 18 nt, Human
ucuuacucuguugccagg

SEQ ID NO: 1802544 - RNA, 13 nt, Human
uucuccugccuca

SEQ ID NO: 1802545 - RNA, 21 nt, Human
uagaaaguugauuuuaagaau

SEQ ID NO: 1802546 - RNA, 21 nt, Human
uugccuaggcauagcccugcc

SEQ ID NO: 1802547 - RNA, 21 nt, Human
gcuccauucaaagugagcucc

SEQ ID NO: 1802548 - RNA, 14 nt, Human
uccuucccuugcuu

SEQ ID NO: 1802549 - RNA, 16 nt, Human
aguaucuuuuuauuca

SEQ ID NO: 1802550 - RNA, 15 nt, Human
uauucauauuuucuu

SEQ ID NO: 1802551 - RNA, 15 nt, Human
gagcaaguccuuccc

SEQ ID NO: 1802552 - RNA, 22 nt, Human
uucugguagcuaaauauauauu

SEQ ID NO: 1802553 - RNA, 21 nt, Human
uggcaggaaaauggacaucaa

SEQ ID NO: 1802554 - RNA, 22 nt, Human
ugucacccagguuggagugcag

SEQ ID NO: 1802555 - RNA, 19 nt, Human
auuaauuccuucagcacuu

SEQ ID NO: 1802556 - RNA, 22 nt, Human
agcuucaagaaauuacuggaag

SEQ ID NO: 1802557 - RNA, 22 nt, Human
cauuugggaugcuacucuagua

SEQ ID NO: 1802558 - RNA, 22 nt, Human
uaauauuucuucaaauaaaucu

SEQ ID NO: 1802559 - RNA, 21 nt, Human
ucuggguugaagggcaguguu

SEQ ID NO: 1802560 - RNA, 20 nt, Human
cuccaggagaccuacccucc

SEQ ID NO: 1802561 - RNA, 14 nt, Human
ugcucauggaauug

SEQ ID NO: 1802562 - RNA, 15 nt, Human
uuccuccuucccuug

SEQ ID NO: 1802563 - RNA, 23 nt, Human
aggauaccauauacagcucagaa

SEQ ID NO: 1802564 - RNA, 21 nt, Human
uaaaauuuuuuuagaaagcau

SEQ ID NO: 1802565 - RNA, 17 nt, Human
ggauggagccagcucug

SEQ ID NO: 1802566 - RNA, 12 nt, Human
uguauuuuuagu

SEQ ID NO: 1802567 - RNA, 13 nt, Human
augggcaggaugg

SEQ ID NO: 1802568 - RNA, 21 nt, Human
ccugaucaccugcccugcuga

SEQ ID NO: 1802569 - RNA, 13 nt, Human
ggcuguacacugc

SEQ ID NO: 1802570 - RNA, 14 nt, Human
ugcucuuccucagc

SEQ ID NO: 1802571 - RNA, 22 nt, Human
cuucuuacuggugcuauuuugu

SEQ ID NO: 1802572 - RNA, 22 nt, Human
aagcugguggcucugugugcuc

SEQ ID NO: 1802573 - RNA, 22 nt, Human
uagaaauguauucuuuuaguuu

SEQ ID NO: 1802574 - RNA, 22 nt, Human
agacuugggaaugagcugaagg

SEQ ID NO: 1802575 - RNA, 18 nt, Human
auaagaaccacucauaau

SEQ ID NO: 1802576 - RNA, 22 nt, Human
uauccuacuuccccuuccuaau

SEQ ID NO: 1802577 - RNA, 14 nt, Human
guuuaauuaaaauc

SEQ ID NO: 1802578 - RNA, 14 nt, Human
cccagcucacagga

SEQ ID NO: 1802579 - RNA, 12 nt, Human
aggucuuucuuu

SEQ ID NO: 1802580 - RNA, 18 nt, Human
aacuacugaggaucagag

SEQ ID NO: 1802581 - RNA, 21 nt, Human
ggcucuuuccuccacaccauu

SEQ ID NO: 1802582 - RNA, 16 nt, Human
uugagacaagaaaaua

SEQ ID NO: 1802583 - RNA, 14 nt, Human
uuauauaauauuuu

SEQ ID NO: 1802584 - RNA, 12 nt, Human
guuuuuaaaaaa

SEQ ID NO: 1802585 - RNA, 16 nt, Human
gccuggggagauggag

SEQ ID NO: 1802586 - RNA, 16 nt, Human
uuccuucuuuuuuucu

SEQ ID NO: 1802587 - RNA, 14 nt, Human
cagagccuccuuuc

SEQ ID NO: 1802588 - RNA, 23 nt, Human
cuuccacuaggguccaccaggag

SEQ ID NO: 1802589 - RNA, 16 nt, Human
cccuggccucugcuca

SEQ ID NO: 1802590 - RNA, 21 nt, Human
caugugaaaucauucauuuuc

SEQ ID NO: 1802591 - RNA, 14 nt, Human
gagaguuuccuaug

SEQ ID NO: 1802592 - RNA, 15 nt, Human
aaacuuuaaaacuug

SEQ ID NO: 1802593 - RNA, 16 nt, Human
cccuuugcuucauuca

SEQ ID NO: 1802594 - RNA, 23 nt, Human
uuuccaucaaggguacacugccu

SEQ ID NO: 1802595 - RNA, 18 nt, Human
auuuuuagugaaauauua

SEQ ID NO: 1802596 - RNA, 22 nt, Human
ugcuauucuccauacucuguaa

SEQ ID NO: 1802597 - RNA, 16 nt, Human
cacagugggagccagg

SEQ ID NO: 1802598 - RNA, 13 nt, Human
cugguugggcagc

SEQ ID NO: 1802599 - RNA, 22 nt, Human
aaugggcacaggguuuauguuu

SEQ ID NO: 1802600 - RNA, 17 nt, Human
caggauggcuuugaaug

SEQ ID NO: 1802601 - RNA, 22 nt, Human
cacugcaaccucugccucccag

SEQ ID NO: 1802602 - RNA, 16 nt, Human
ccgccacccucccacu

SEQ ID NO: 1802603 - RNA, 14 nt, Human
agucauuggcuuua

SEQ ID NO: 1802604 - RNA, 17 nt, Human
auuauaacuggaaagaa

SEQ ID NO: 1802605 - RNA, 12 nt, Human
aagagcuuaaca

SEQ ID NO: 1802606 - RNA, 23 nt, Human
uguagucccaaagaggcuacugu

SEQ ID NO: 1802607 - RNA, 19 nt, Human
gugcauauuuauaaaaaua

SEQ ID NO: 1802608 - RNA, 20 nt, Human
auccucacucaguccagcuu

SEQ ID NO: 1802609 - RNA, 19 nt, Human
uucucaucuuuuuacuaaa

SEQ ID NO: 1802610 - RNA, 12 nt, Human
gagccagcucug

SEQ ID NO: 1802611 - RNA, 23 nt, Human
uuccucccuguguauucauucuc

SEQ ID NO: 1802612 - RNA, 20 nt, Human
accacauugagucuaucaau

SEQ ID NO: 1802613 - RNA, 16 nt, Human
caucacauuccucugc

SEQ ID NO: 1802614 - RNA, 18 nt, Human
uagcccuuccccucugca

SEQ ID NO: 1802615 - RNA, 15 nt, Human
aggcucuaauguaca

SEQ ID NO: 1802616 - RNA, 22 nt, Human
cuucagccaggagcugggcaga

SEQ ID NO: 1802617 - RNA, 19 nt, Human
caaacuccugaccucaagu

SEQ ID NO: 1802618 - RNA, 22 nt, Human
cagccucccaagcaccugggau

SEQ ID NO: 1802619 - RNA, 13 nt, Human
cgccucagccucc

SEQ ID NO: 1802620 - RNA, 15 nt, Human
uggcuaucugugggu

SEQ ID NO: 1802621 - RNA, 16 nt, Human
ccagccucagccuccc

SEQ ID NO: 1802622 - RNA, 16 nt, Human
aucucaaccucuuccc

SEQ ID NO: 1802623 - RNA, 16 nt, Human
ugcccugcugcccucc

SEQ ID NO: 1802624 - RNA, 12 nt, Human
cauagaaguaaa

SEQ ID NO: 1802625 - RNA, 13 nt, Human
aaagcaaagcucu

SEQ ID NO: 1802626 - RNA, 19 nt, Human
cucaagcccugcagucaca

SEQ ID NO: 1802627 - RNA, 14 nt, Human
ccaacagcacccuc

SEQ ID NO: 1802628 - RNA, 15 nt, Human
uuucugccacccaaa

SEQ ID NO: 1802629 - RNA, 17 nt, Human
uuaaacugguaggaaac

SEQ ID NO: 1802630 - RNA, 22 nt, Human
agaggcuacuguaaggcaauca

SEQ ID NO: 1802631 - RNA, 17 nt, Human
caacagcacccucucca

SEQ ID NO: 1802632 - RNA, 14 nt, Human
ugcagcuuccaggc

SEQ ID NO: 1802633 - RNA, 17 nt, Human
uuaugugaaacauguuu

SEQ ID NO: 1802634 - RNA, 14 nt, Human
acauccucuaugcc

SEQ ID NO: 1802635 - RNA, 22 nt, Human
cuuuuuaauuucugcaaaugua

SEQ ID NO: 1802636 - RNA, 20 nt, Human
gccaggccccaagcccacug

SEQ ID NO: 1802637 - RNA, 21 nt, Human
gaauguuaaauaaauuguaua

SEQ ID NO: 1802638 - RNA, 13 nt, Human
aucucaauauuuc

SEQ ID NO: 1802639 - RNA, 20 nt, Human
cuucccaaaguccugggauu

SEQ ID NO: 1802640 - RNA, 21 nt, Human
gcugucccaagggccccucug

SEQ ID NO: 1802641 - RNA, 22 nt, Human
agaaugagagacacacugaaga

SEQ ID NO: 1802642 - RNA, 19 nt, Human
auacuaauuauacccccug

SEQ ID NO: 1802643 - RNA, 16 nt, Human
uaggcaugcgccacca

SEQ ID NO: 1802644 - RNA, 20 nt, Human
gcacuuccuugcuuaaggua

SEQ ID NO: 1802645 - RNA, 16 nt, Human
cuucacuguaaaauaa

SEQ ID NO: 1802646 - RNA, 18 nt, Human
auauuuugcuaguuuuug

SEQ ID NO: 1802647 - RNA, 17 nt, Human
gcacagguccccagaug

SEQ ID NO: 1802648 - RNA, 18 nt, Human
ccucaguucccucuugcu

SEQ ID NO: 1802649 - RNA, 13 nt, Human
ccaaccuuuuccc

SEQ ID NO: 1802650 - RNA, 18 nt, Human
cauuacaggugugagcca

SEQ ID NO: 1802651 - RNA, 20 nt, Human
ugaccucaagugaucugccc

SEQ ID NO: 1802652 - RNA, 14 nt, Human
uaucuauuuaaaua

SEQ ID NO: 1802653 - RNA, 18 nt, Human
cuuuuaugugaaacaugu

SEQ ID NO: 1802654 - RNA, 13 nt, Human
gcagaacagugau

SEQ ID NO: 1802655 - RNA, 13 nt, Human
uaccaguuuuccu

SEQ ID NO: 1802656 - RNA, 12 nt, Human
uuuuauauuuga

SEQ ID NO: 1802657 - RNA, 20 nt, Human
aggcucuaauguacaauaaa

SEQ ID NO: 1802658 - RNA, 17 nt, Human
ucgcuccaccuugcagc

SEQ ID NO: 1802659 - RNA, 17 nt, Human
auuuauuuguuuaaaaa

SEQ ID NO: 1802660 - RNA, 23 nt, Human
caccccaacagcacccucuccag

SEQ ID NO: 1802661 - RNA, 14 nt, Human
acauuuucucccug

SEQ ID NO: 1802662 - RNA, 14 nt, Human
ccuccucucccagu

SEQ ID NO: 1802663 - RNA, 21 nt, Human
guauacugugugcuaaaacaa

SEQ ID NO: 1802664 - RNA, 21 nt, Human
augcugcuggggaagacagug

SEQ ID NO: 1802665 - RNA, 18 nt, Human
gcacuccagccugagcga

SEQ ID NO: 1802666 - RNA, 20 nt, Human
cccuuugcugacccucccca

SEQ ID NO: 1802667 - RNA, 22 nt, Human
uguucaagcgauucuccugccu

SEQ ID NO: 1802668 - RNA, 12 nt, Human
auacauguaaaa

SEQ ID NO: 1802669 - RNA, 22 nt, Human
ugugagccacccugcccagccg

SEQ ID NO: 1802670 - RNA, 14 nt, Human
agcguugagccacc

SEQ ID NO: 1802671 - RNA, 20 nt, Human
caucucagcucacugcaacc

SEQ ID NO: 1802672 - RNA, 18 nt, Human
augguguacauucuuccu

SEQ ID NO: 1802673 - RNA, 15 nt, Human
cuccucuccaccauc

SEQ ID NO: 1802674 - RNA, 12 nt, Human
aaccucuucccc

SEQ ID NO: 1802675 - RNA, 23 nt, Human
ugggccccugccucucugcaggu

SEQ ID NO: 1802676 - RNA, 22 nt, Human
agccuacaggccucacacacaa

SEQ ID NO: 1802677 - RNA, 22 nt, Human
ugaccauacuaauuauaccccc

SEQ ID NO: 1802678 - RNA, 15 nt, Human
aagauaccaaaacca

SEQ ID NO: 1802679 - RNA, 21 nt, Human
cuggccuucggccuccauccu

SEQ ID NO: 1802680 - RNA, 22 nt, Human
caugaagagauuuuucaugauu

SEQ ID NO: 1802681 - RNA, 13 nt, Human
uguuucauauuuu

SEQ ID NO: 1802682 - RNA, 16 nt, Human
cuuucucaauaagccu

SEQ ID NO: 1802683 - RNA, 12 nt, Human
uugacauuuuua

SEQ ID NO: 1802684 - RNA, 13 nt, Human
ucugaauuauuuu

SEQ ID NO: 1802685 - RNA, 19 nt, Human
auaauguaaacaauaucag

SEQ ID NO: 1802686 - RNA, 15 nt, Human
aguucugaagaagau

SEQ ID NO: 1802687 - RNA, 22 nt, Human
uuuaauaauguuucaaacauau

SEQ ID NO: 1802688 - RNA, 13 nt, Human
agauucucccuug

SEQ ID NO: 1802689 - RNA, 13 nt, Human
ccuccucucccag

SEQ ID NO: 1802690 - RNA, 13 nt, Human
ugccaggcacacu

SEQ ID NO: 1802691 - RNA, 21 nt, Human
ucuuuaggcauuaaauuuuag

SEQ ID NO: 1802692 - RNA, 15 nt, Human
agacgaaacauuugu

SEQ ID NO: 1802693 - RNA, 21 nt, Human
cuguacccaguagaugccacc

SEQ ID NO: 1802694 - RNA, 21 nt, Human
cgcuccucuauggccccugcc

SEQ ID NO: 1802695 - RNA, 21 nt, Human
uucaccuuaggaauaaucucc

SEQ ID NO: 1802696 - RNA, 13 nt, Human
cagccucccaagc

SEQ ID NO: 1802697 - RNA, 20 nt, Human
gacauuugcucauggaauug

SEQ ID NO: 1802698 - RNA, 23 nt, Human
cucagcccuggugggcagagagg

SEQ ID NO: 1802699 - RNA, 18 nt, Human
cuaauuagcauggccaca

SEQ ID NO: 1802700 - RNA, 17 nt, Human
aauuuuuguauuuuuag

SEQ ID NO: 1802701 - RNA, 21 nt, Human
auucagagcuuacuuaaaauu

SEQ ID NO: 1802702 - RNA, 15 nt, Human
acgagauacagaauu

SEQ ID NO: 1802703 - RNA, 18 nt, Human
uuuaaauauuuuuucuuu

SEQ ID NO: 1802704 - RNA, 15 nt, Human
ugaaauuguauuaca

SEQ ID NO: 1802705 - RNA, 16 nt, Human
uuucauaaagcaggca

SEQ ID NO: 1802706 - RNA, 20 nt, Human
uuaaguaaggaauuuuauuu

SEQ ID NO: 1802707 - RNA, 15 nt, Human
cguacugcagccucc

SEQ ID NO: 1802708 - RNA, 20 nt, Human
ccucccccuccucuccacca

SEQ ID NO: 1802709 - RNA, 15 nt, Human
gccucagucucccuc

SEQ ID NO: 1802710 - RNA, 16 nt, Human
ggcagagagguaggga

SEQ ID NO: 1802711 - RNA, 20 nt, Human
ccugcagacucacuguggga

SEQ ID NO: 1802712 - RNA, 21 nt, Human
ugggagugcccccaacagcac

SEQ ID NO: 1802713 - RNA, 17 nt, Human
ugcacaucaaaauaugc

SEQ ID NO: 1802714 - RNA, 17 nt, Human
auaauuuaaauauaugc

SEQ ID NO: 1802715 - RNA, 15 nt, Human
cauguuggccaggcu

SEQ ID NO: 1802716 - RNA, 14 nt, Human
auuuaauuauuuca

SEQ ID NO: 1802717 - RNA, 15 nt, Human
ccugucuguuuccuc

SEQ ID NO: 1802718 - RNA, 16 nt, Human
acuggcuacugcucug

SEQ ID NO: 1802719 - RNA, 14 nt, Human
cagugaaagaaaau

SEQ ID NO: 1802720 - RNA, 15 nt, Human
ucugucucaguccau

SEQ ID NO: 1802721 - RNA, 21 nt, Human
gucucuacccaguagaugcca

SEQ ID NO: 1802722 - RNA, 23 nt, Human
uccuagaaacugacacaugcuga

SEQ ID NO: 1802723 - RNA, 12 nt, Human
uucaucaugcuu

SEQ ID NO: 1802724 - RNA, 23 nt, Human
auaaaagccuguuuaagagacag

SEQ ID NO: 1802725 - RNA, 14 nt, Human
auuuccaagaaaua

SEQ ID NO: 1802726 - RNA, 17 nt, Human
caccaugcugcugggga

SEQ ID NO: 1802727 - RNA, 19 nt, Human
guaagauuuccuucuuuuu

SEQ ID NO: 1802728 - RNA, 19 nt, Human
caggaugagggaaaagaaa

SEQ ID NO: 1802729 - RNA, 23 nt, Human
ugggcagccagaccagcaggcug

SEQ ID NO: 1802730 - RNA, 23 nt, Human
gauuuuaauaauauauuuuaaau

SEQ ID NO: 1802731 - RNA, 21 nt, Human
uucuucuaccacccaccaguu

SEQ ID NO: 1802732 - RNA, 22 nt, Human
uaccugcucagcccugcaccau

SEQ ID NO: 1802733 - RNA, 21 nt, Human
ucaauaaguuuauuucuuaaa

SEQ ID NO: 1802734 - RNA, 21 nt, Human
acagugaaagaaaauaacaau

SEQ ID NO: 1802735 - RNA, 12 nt, Human
uuuccuuccagu

SEQ ID NO: 1802736 - RNA, 16 nt, Human
caugcuugcauaagag

SEQ ID NO: 1802737 - RNA, 13 nt, Human
aaggaggcugaga

SEQ ID NO: 1802738 - RNA, 21 nt, Human
auguaaugguggccuggggcu

SEQ ID NO: 1802739 - RNA, 18 nt, Human
gcauggccacaucugagc

SEQ ID NO: 1802740 - RNA, 15 nt, Human
aaagugcugggauua

SEQ ID NO: 1802741 - RNA, 23 nt, Human
cagguucuuucuuuaaagcagga

SEQ ID NO: 1802742 - RNA, 17 nt, Human
ggagacaaaacuagaga

SEQ ID NO: 1802743 - RNA, 18 nt, Human
aaauauguucugacauaa

SEQ ID NO: 1802744 - RNA, 23 nt, Human
caccauucaggucuuucuuuccg

SEQ ID NO: 1802745 - RNA, 22 nt, Human
agacucugucucaguccaugaa

SEQ ID NO: 1802746 - RNA, 20 nt, Human
cuuuuuuuuuuuauaaucaa

SEQ ID NO: 1802747 - RNA, 18 nt, Human
augggggcagcaccuccu

SEQ ID NO: 1802748 - RNA, 14 nt, Human
acaagagcuuaaca

SEQ ID NO: 1802749 - RNA, 23 nt, Human
gaguauccucuugccaaaucaaa

SEQ ID NO: 1802750 - RNA, 14 nt, Human
gacucuugcagggg

SEQ ID NO: 1802751 - RNA, 13 nt, Human
ucugcagcuucca

SEQ ID NO: 1802752 - RNA, 23 nt, Human
ggaugaauuaaguuuuuuuuuaa

SEQ ID NO: 1802753 - RNA, 17 nt, Human
acaagaaaugaaagcag

SEQ ID NO: 1802754 - RNA, 19 nt, Human
ccccugagcuugcagagau

SEQ ID NO: 1802755 - RNA, 15 nt, Human
agcagucccuccaca

SEQ ID NO: 1802756 - RNA, 14 nt, Human
ucucuuauugccuc

SEQ ID NO: 1802757 - RNA, 14 nt, Human
acccaaaaggcaga

SEQ ID NO: 1802758 - RNA, 19 nt, Human
uuggugauuccgcagugag

SEQ ID NO: 1802759 - RNA, 19 nt, Human
ccaucuccucagcacccca

SEQ ID NO: 1802760 - RNA, 21 nt, Human
auucauagcagcuuauucaca

SEQ ID NO: 1802761 - RNA, 17 nt, Human
auaaguacaugauaagc

SEQ ID NO: 1802762 - RNA, 21 nt, Human
agcuuaacccuggaaaaugaa

SEQ ID NO: 1802763 - RNA, 22 nt, Human
auuaugaagcuuuuaugugaaa

SEQ ID NO: 1802764 - RNA, 18 nt, Human
augugaaacauguuucuu

SEQ ID NO: 1802765 - RNA, 17 nt, Human
augacuauggaaagagu

SEQ ID NO: 1802766 - RNA, 21 nt, Human
uaauuccuucagcacuuuaga

SEQ ID NO: 1802767 - RNA, 17 nt, Human
ggcucacugcaaccucc

SEQ ID NO: 1802768 - RNA, 17 nt, Human
agcucacuacaaccucc

SEQ ID NO: 1802769 - RNA, 11 nt, Human
aaccauuuucu

SEQ ID NO: 1802770 - RNA, 19 nt, Human
gcuuggaaaggaccaguau

SEQ ID NO: 1802771 - RNA, 19 nt, Human
agaaaauaacaauaaaaga

SEQ ID NO: 1802772 - RNA, 12 nt, Human
ugauguuguguu

SEQ ID NO: 1802773 - RNA, 15 nt, Human
acucuaagaaagaac

SEQ ID NO: 1802774 - RNA, 14 nt, Human
caucauuuacuuuu

SEQ ID NO: 1802775 - RNA, 21 nt, Human
uagaugagagaacagggcuga

SEQ ID NO: 1802776 - RNA, 21 nt, Human
auuuuaacaucugagaaaagc

SEQ ID NO: 1802777 - RNA, 16 nt, Human
guccuucccuuucauu

SEQ ID NO: 1802778 - RNA, 14 nt, Human
auuuauuaaguauu

SEQ ID NO: 1802779 - RNA, 17 nt, Human
cauaucgauuuuuaaaa

SEQ ID NO: 1802780 - RNA, 23 nt, Human
gaauaggcgaucacaacgugcau

SEQ ID NO: 1802781 - RNA, 16 nt, Human
ucugcagauaaacagu

SEQ ID NO: 1802782 - RNA, 15 nt, Human
gacagcccaggauac

SEQ ID NO: 1802783 - RNA, 16 nt, Human
ucagucucccucccuu

SEQ ID NO: 1802784 - RNA, 12 nt, Human
uuaauaaaccau

SEQ ID NO: 1802785 - RNA, 14 nt, Human
aauuggcaugaagg

SEQ ID NO: 1802786 - RNA, 13 nt, Human
uaucuauuuaaau

SEQ ID NO: 1802787 - RNA, 14 nt, Human
ggcaauagucaaau

SEQ ID NO: 1802788 - RNA, 21 nt, Human
cuuucccuaagccagcugccc

SEQ ID NO: 1802789 - RNA, 13 nt, Human
uacauguggccca

SEQ ID NO: 1802790 - RNA, 14 nt, Human
uacuuugugcauuc

SEQ ID NO: 1802791 - RNA, 22 nt, Human
aaagccuucauugccuuaacug

SEQ ID NO: 1802792 - RNA, 11 nt, Human
aggagaggagu

SEQ ID NO: 1802793 - RNA, 17 nt, Human
uucucauaacucuguga

SEQ ID NO: 1802794 - RNA, 16 nt, Human
caggaaguagaggagg

SEQ ID NO: 1802795 - RNA, 15 nt, Human
auuucacuuuagaaa

SEQ ID NO: 1802796 - RNA, 17 nt, Human
cugagacaaauggaggc

SEQ ID NO: 1802797 - RNA, 17 nt, Human
agguuggagugcagugg

SEQ ID NO: 1802798 - RNA, 16 nt, Human
aaaugccaggccuggc

SEQ ID NO: 1802799 - RNA, 13 nt, Human
uccuuuuuccuuc

SEQ ID NO: 1802800 - RNA, 17 nt, Human
acuuguauuuuuuuucu

SEQ ID NO: 1802801 - RNA, 16 nt, Human
aauauauuuuaaauau

SEQ ID NO: 1802802 - RNA, 20 nt, Human
ggagaccuacccuccacagg

SEQ ID NO: 1802803 - RNA, 16 nt, Human
auaaugguuuuuaaca

SEQ ID NO: 1802804 - RNA, 16 nt, Human
uucuagucuauuuguu

SEQ ID NO: 1802805 - RNA, 17 nt, Human
ucaggucuuucuuuccg

SEQ ID NO: 1802806 - RNA, 21 nt, Human
aucaguagccagcaucugccu

SEQ ID NO: 1802807 - RNA, 17 nt, Human
gcccacaaugcuuugcc

SEQ ID NO: 1802808 - RNA, 18 nt, Human
uuuucucuccucucccca

SEQ ID NO: 1802809 - RNA, 16 nt, Human
aggaaagaaaauaaau

SEQ ID NO: 1802810 - RNA, 16 nt, Human
aaagaccauuuuuccu

SEQ ID NO: 1802811 - RNA, 19 nt, Human
uucugucaacuuguauuuu

SEQ ID NO: 1802812 - RNA, 19 nt, Human
gauucuuccaucugauugu

SEQ ID NO: 1802813 - RNA, 18 nt, Human
ucucccuggauuuuuacc

SEQ ID NO: 1802814 - RNA, 18 nt, Human
uccaggagaccuacccuc

SEQ ID NO: 1802815 - RNA, 23 nt, Human
gcuaugcuauugaaguuuuggca

SEQ ID NO: 1802816 - RNA, 18 nt, Human
uguuuccuuauauuaugg

SEQ ID NO: 1802817 - RNA, 12 nt, Human
aagauuuccuuc

SEQ ID NO: 1802818 - RNA, 15 nt, Human
gcaaauaucuugaaa

SEQ ID NO: 1802819 - RNA, 22 nt, Human
agaggccugacugccaagccau

SEQ ID NO: 1802820 - RNA, 21 nt, Human
agaaucacaauaauuuucuac

SEQ ID NO: 1802821 - RNA, 13 nt, Human
acauucagggcua

SEQ ID NO: 1802822 - RNA, 23 nt, Human
uauaccugauauauuccaccagg

SEQ ID NO: 1802823 - RNA, 18 nt, Human
uauauuuccuuauucaga

SEQ ID NO: 1802824 - RNA, 12 nt, Human
uuuauggagaua

SEQ ID NO: 1802825 - RNA, 20 nt, Human
cagcuggccgggagccugau

SEQ ID NO: 1802826 - RNA, 23 nt, Human
uagcagauacagggaugaggcag

SEQ ID NO: 1802827 - RNA, 15 nt, Human
augggacagggagga

SEQ ID NO: 1802828 - RNA, 21 nt, Human
uagugcuaguggauuuuacau

SEQ ID NO: 1802829 - RNA, 17 nt, Human
cacuguaaaauguggga

SEQ ID NO: 1802830 - RNA, 22 nt, Human
cugugaagugagaccuuccuuu

SEQ ID NO: 1802831 - RNA, 12 nt, Human
cacaacacacag

SEQ ID NO: 1802832 - RNA, 15 nt, Human
aaagggacugagaaa

SEQ ID NO: 1802833 - RNA, 18 nt, Human
aguuucauccuuuucauu

SEQ ID NO: 1802834 - RNA, 18 nt, Human
aaacugccaucauuuacu

SEQ ID NO: 1802835 - RNA, 17 nt, Human
ccaguauuguuccuuuu

SEQ ID NO: 1802836 - RNA, 21 nt, Human
caaacugagauccuuccuuuu

SEQ ID NO: 1802837 - RNA, 12 nt, Human
agacucugucua

SEQ ID NO: 1802838 - RNA, 14 nt, Human
aucaugugaaauca

SEQ ID NO: 1802839 - RNA, 23 nt, Human
gggccuaugcagagguccacaac

SEQ ID NO: 1802840 - RNA, 18 nt, Human
uggcucuggacaggcacu

SEQ ID NO: 1802841 - RNA, 14 nt, Human
cccuccccaaaggc

SEQ ID NO: 1802842 - RNA, 15 nt, Human
ucuuuuuaauuucug

SEQ ID NO: 1802843 - RNA, 23 nt, Human
gaccccugagcuugcagagauga

SEQ ID NO: 1802844 - RNA, 15 nt, Human
auuuuaaaagaauga

SEQ ID NO: 1802845 - RNA, 14 nt, Human
auaaccuuaccaga

SEQ ID NO: 1802846 - RNA, 23 nt, Human
aaaauaucacuugucaauaaaau

SEQ ID NO: 1802847 - RNA, 18 nt, Human
ucuuuaggcauuaaauuu

SEQ ID NO: 1802848 - RNA, 14 nt, Human
ggagaaaugaaaaa

SEQ ID NO: 1802849 - RNA, 22 nt, Human
agcucacuacaaccuccgccuc

SEQ ID NO: 1802850 - RNA, 15 nt, Human
aauauauaucaaaua

SEQ ID NO: 1802851 - RNA, 18 nt, Human
ugcagacucacuguggga

SEQ ID NO: 1802852 - RNA, 12 nt, Human
aguuauaaaaau

SEQ ID NO: 1802853 - RNA, 23 nt, Human
ucugcuacccucauuucucaucu

SEQ ID NO: 1802854 - RNA, 21 nt, Human
ucuaccacucagagaaacaau

SEQ ID NO: 1802855 - RNA, 23 nt, Human
uucaccaauaaguauucuguguu

SEQ ID NO: 1802856 - RNA, 17 nt, Human
caauaacgauaaaagac

SEQ ID NO: 1802857 - RNA, 20 nt, Human
aauuguaggugacuauuaua

SEQ ID NO: 1802858 - RNA, 17 nt, Human
caggaaucacuggcugu

SEQ ID NO: 1802859 - RNA, 20 nt, Human
cugcacacagcacgggggcc

SEQ ID NO: 1802860 - RNA, 20 nt, Human
uggaaacacauguuccccuu

SEQ ID NO: 1802861 - RNA, 17 nt, Human
cugagcgacagugagac

SEQ ID NO: 1802862 - RNA, 12 nt, Human
agcccugcacca

SEQ ID NO: 1802863 - RNA, 14 nt, Human
gcgccaccauggcc

SEQ ID NO: 1802864 - RNA, 22 nt, Human
cuggagacauugaggcaggcac

SEQ ID NO: 1802865 - RNA, 18 nt, Human
auaaaguguuugaaagcu

SEQ ID NO: 1802866 - RNA, 15 nt, Human
cugagagaugacagg

SEQ ID NO: 1802867 - RNA, 18 nt, Human
agucuuccucugucuccu

SEQ ID NO: 1802868 - RNA, 21 nt, Human
auuauauuuauuacuguaaga

SEQ ID NO: 1802869 - RNA, 17 nt, Human
agauaaauuauaucaau

SEQ ID NO: 1802870 - RNA, 18 nt, Human
cuuacucuguugccaggc

SEQ ID NO: 1802871 - RNA, 17 nt, Human
agccccucuccuggaag

SEQ ID NO: 1802872 - RNA, 17 nt, Human
aggcuggagugcagugg

SEQ ID NO: 1802873 - RNA, 22 nt, Human
cuugcccgcucaggcugaccac

SEQ ID NO: 1802874 - RNA, 20 nt, Human
uguaagaaaauaucacuugu

SEQ ID NO: 1802875 - RNA, 11 nt, Human
cuuuucccaac

SEQ ID NO: 1802876 - RNA, 23 nt, Human
cccagccugcucccuagccagag

SEQ ID NO: 1802877 - RNA, 21 nt, Human
aagcuccauuuuuagugaaau

SEQ ID NO: 1802878 - RNA, 22 nt, Human
cauuuuacuguacagacagaaa

SEQ ID NO: 1802879 - RNA, 14 nt, Human
agugauauuucccc

SEQ ID NO: 1802880 - RNA, 14 nt, Human
uacuuuucuucuau

SEQ ID NO: 1802881 - RNA, 12 nt, Human
cuuccugauuau

SEQ ID NO: 1802882 - RNA, 22 nt, Human
uuccccuuccuaauuccacagc

SEQ ID NO: 1802883 - RNA, 20 nt, Human
guuugacgggaaacaaaacu

SEQ ID NO: 1802884 - RNA, 19 nt, Human
cccuuccccucugcagcuu

SEQ ID NO: 1802885 - RNA, 22 nt, Human
cacaugugugguacaugguguu

SEQ ID NO: 1802886 - RNA, 14 nt, Human
caauuaauuuuaga

SEQ ID NO: 1802887 - RNA, 22 nt, Human
uuccuagucuguuuucccuccu

SEQ ID NO: 1802888 - RNA, 20 nt, Human
uucuuagaaauuuauuuccu

SEQ ID NO: 1802889 - RNA, 16 nt, Human
caauuaaaagugucuu

SEQ ID NO: 1802890 - RNA, 13 nt, Human
agguagacaguau

SEQ ID NO: 1802891 - RNA, 17 nt, Human
cugggagaaaugaaaaa

SEQ ID NO: 1802892 - RNA, 23 nt, Human
uguugagguaccuccaaggaccg

SEQ ID NO: 1802893 - RNA, 15 nt, Human
cauucuuccugauua

SEQ ID NO: 1802894 - RNA, 20 nt, Human
ucacaugaacuuguaaagga

SEQ ID NO: 1802895 - RNA, 18 nt, Human
agccaccacauccagccu

SEQ ID NO: 1802896 - RNA, 13 nt, Human
aguguuugaaagc

SEQ ID NO: 1802897 - RNA, 15 nt, Human
ccgucccccucuggc

SEQ ID NO: 1802898 - RNA, 15 nt, Human
cuaggguccaccagg

SEQ ID NO: 1802899 - RNA, 19 nt, Human
agccugaggugccgccucc

SEQ ID NO: 1802900 - RNA, 20 nt, Human
acagcuucucauccugcagg

SEQ ID NO: 1802901 - RNA, 14 nt, Human
agagaauuuccuua

SEQ ID NO: 1802902 - RNA, 16 nt, Human
uuucacauuuaaauaa

SEQ ID NO: 1802903 - RNA, 10 nt, Human
agccucccaa

SEQ ID NO: 1802904 - RNA, 17 nt, Human
agggcuauuuuuucccc

SEQ ID NO: 1802905 - RNA, 22 nt, Human
augguuguauuauuuuuuaaaa

SEQ ID NO: 1802906 - RNA, 18 nt, Human
uaugagauagguacuauu

SEQ ID NO: 1802907 - RNA, 22 nt, Human
acaauggcuaagauaccaaaac

SEQ ID NO: 1802908 - RNA, 19 nt, Human
aagccaugugcagccacca

SEQ ID NO: 1802909 - RNA, 20 nt, Human
ucaagcgauucuccugccuc

SEQ ID NO: 1802910 - RNA, 22 nt, Human
aggcaccaggacuagggcugga

SEQ ID NO: 1802911 - RNA, 14 nt, Human
auauauuuuagaua

SEQ ID NO: 1802912 - RNA, 19 nt, Human
uaccuguuaguauuauugu

SEQ ID NO: 1802913 - RNA, 17 nt, Human
agugagacagcucugca

SEQ ID NO: 1802914 - RNA, 15 nt, Human
gucccaggcugagcc

SEQ ID NO: 1802915 - RNA, 18 nt, Human
uuccucagcugugugggu

SEQ ID NO: 1802916 - RNA, 14 nt, Human
ucucuggaagcccc

SEQ ID NO: 1802917 - RNA, 17 nt, Human
aaaaaugcauauacuuu

SEQ ID NO: 1802918 - RNA, 13 nt, Human
aauuaccacacca

SEQ ID NO: 1802919 - RNA, 21 nt, Human
uuuaugauacuugaaaauuaa

SEQ ID NO: 1802920 - RNA, 14 nt, Human
gggugcugggcccc

SEQ ID NO: 1802921 - RNA, 12 nt, Human
cucaaagugcug

SEQ ID NO: 1802922 - RNA, 23 nt, Human
uacacugcacgaauggaagaggc

SEQ ID NO: 1802923 - RNA, 20 nt, Human
ugccccccagcccuccuuau

SEQ ID NO: 1802924 - RNA, 16 nt, Human
auccauucuucccuug

SEQ ID NO: 1802925 - RNA, 22 nt, Human
ccaaguugugcuugagccagga

SEQ ID NO: 1802926 - RNA, 16 nt, Human
aauuuuuaauuauaug

SEQ ID NO: 1802927 - RNA, 15 nt, Human
uuucuuuuuuuucuu

SEQ ID NO: 1802928 - RNA, 19 nt, Human
acacugggagaaaugaaaa

SEQ ID NO: 1802929 - RNA, 15 nt, Human
ucuacaguacaccac

SEQ ID NO: 1802930 - RNA, 22 nt, Human
aacucccugccccccagcccuc

SEQ ID NO: 1802931 - RNA, 19 nt, Human
auuuuagauagaugaagaa

SEQ ID NO: 1802932 - RNA, 20 nt, Human
uacaaagggggaggcuaaag

SEQ ID NO: 1802933 - RNA, 17 nt, Human
ccucuggcuccagcugg

SEQ ID NO: 1802934 - RNA, 21 nt, Human
auacauacaugcauacacucu

SEQ ID NO: 1802935 - RNA, 22 nt, Human
gaggguuucauugucugugaag

SEQ ID NO: 1802936 - RNA, 16 nt, Human
ugcccuaggugagaac

SEQ ID NO: 1802937 - RNA, 14 nt, Human
ugugaaaagcucca

SEQ ID NO: 1802938 - RNA, 18 nt, Human
cacuuuaucuugaauaau

SEQ ID NO: 1802939 - RNA, 23 nt, Human
cagugcaccugucauaugcucug

SEQ ID NO: 1802940 - RNA, 11 nt, Human
gcuuauuuccu

SEQ ID NO: 1802941 - RNA, 17 nt, Human
uuauaauuuuaaauguu

SEQ ID NO: 1802942 - RNA, 19 nt, Human
ugaaauggacuuuuguaca

SEQ ID NO: 1802943 - RNA, 19 nt, Human
accccugagcuugcagaga

SEQ ID NO: 1802944 - RNA, 21 nt, Human
guuauguagaaaaaaguaaau

SEQ ID NO: 1802945 - RNA, 16 nt, Human
ccauugucucagagca

SEQ ID NO: 1802946 - RNA, 12 nt, Human
cccauuccccca

SEQ ID NO: 1802947 - RNA, 12 nt, Human
uccuuauauuua

SEQ ID NO: 1802948 - RNA, 23 nt, Human
uccaccaggaguucucccaccac

SEQ ID NO: 1802949 - RNA, 15 nt, Human
ugacacagcuguccc

SEQ ID NO: 1802950 - RNA, 22 nt, Human
gcaggggugcugggaccugggg

SEQ ID NO: 1802951 - RNA, 18 nt, Human
acauguuacaacacggac

SEQ ID NO: 1802952 - RNA, 22 nt, Human
ucaggaugagggaaaagaaaaa

SEQ ID NO: 1802953 - RNA, 17 nt, Human
guaauagggaaaauucu

SEQ ID NO: 1802954 - RNA, 17 nt, Human
acaucgcagacacaugu

SEQ ID NO: 1802955 - RNA, 16 nt, Human
gcgauucuccugccuc

SEQ ID NO: 1802956 - RNA, 12 nt, Human
gguuuauauaag

SEQ ID NO: 1802957 - RNA, 23 nt, Human
aacccagcucacaggagcuuaaa

SEQ ID NO: 1802958 - RNA, 17 nt, Human
gacagugaaagaaaaua

SEQ ID NO: 1802959 - RNA, 14 nt, Human
ccagagaagccaaa

SEQ ID NO: 1802960 - RNA, 20 nt, Human
gagccucagucucccucccu

SEQ ID NO: 1802961 - RNA, 18 nt, Human
aagucuuucacauuuaaa

SEQ ID NO: 1802962 - RNA, 15 nt, Human
auaaaacauguuccu

SEQ ID NO: 1802963 - RNA, 14 nt, Human
cagacagaaaaaac

SEQ ID NO: 1802964 - RNA, 13 nt, Human
accaacacccuga

SEQ ID NO: 1802965 - RNA, 13 nt, Human
ucaugauuuugaa

SEQ ID NO: 1802966 - RNA, 16 nt, Human
auaaaucuaucaaaau

SEQ ID NO: 1802967 - RNA, 13 nt, Human
ucugggauccccc

SEQ ID NO: 1802968 - RNA, 19 nt, Human
auucaauaaaguauuuaau

SEQ ID NO: 1802969 - RNA, 21 nt, Human
acugggguguguggcagagcc

SEQ ID NO: 1802970 - RNA, 16 nt, Human
acuguguuggccagga

SEQ ID NO: 1802971 - RNA, 14 nt, Human
aaauauuuuuucuu

SEQ ID NO: 1802972 - RNA, 16 nt, Human
ugauuuguguauuaua

SEQ ID NO: 1802973 - RNA, 16 nt, Human
gucuucaggggccaca

SEQ ID NO: 1802974 - RNA, 18 nt, Human
agccuugauugguguugc

SEQ ID NO: 1802975 - RNA, 21 nt, Human
uuauuuucuauaauuuaaaua

SEQ ID NO: 1802976 - RNA, 18 nt, Human
uggcgugaucucagcuca

SEQ ID NO: 1802977 - RNA, 16 nt, Human
caguagucagacugga

SEQ ID NO: 1802978 - RNA, 14 nt, Human
gguccaccaggagu

SEQ ID NO: 1802979 - RNA, 19 nt, Human
acucugucucaguccauga

SEQ ID NO: 1802980 - RNA, 19 nt, Human
cuccagcuggccgggagcc

SEQ ID NO: 1802981 - RNA, 14 nt, Human
cccaggacgcccuc

SEQ ID NO: 1802982 - RNA, 16 nt, Human
cugcaaccuccaccuc

SEQ ID NO: 1802983 - RNA, 17 nt, Human
gggcaguguucccuggg

SEQ ID NO: 1802984 - RNA, 23 nt, Human
caucccacucacaacagcugccu

SEQ ID NO: 1802985 - RNA, 21 nt, Human
auuguaggauguugagcagca

SEQ ID NO: 1802986 - RNA, 19 nt, Human
ugaaaggaagcugugcgug

SEQ ID NO: 1802987 - RNA, 19 nt, Human
caggugguaagcaccagga

SEQ ID NO: 1802988 - RNA, 17 nt, Human
cagagaccuuccagaaa

SEQ ID NO: 1802989 - RNA, 14 nt, Human
ucuggggcauuauc

SEQ ID NO: 1802990 - RNA, 19 nt, Human
ucacgccuguaaucccagc

SEQ ID NO: 1802991 - RNA, 16 nt, Human
ccaauaaauaugaugu

SEQ ID NO: 1802992 - RNA, 16 nt, Human
ggcacagguccccaga

SEQ ID NO: 1802993 - RNA, 21 nt, Human
cguuaagaauuguuaaaggcu

SEQ ID NO: 1802994 - RNA, 23 nt, Human
cauaccguguaccucaguucccu

SEQ ID NO: 1802995 - RNA, 20 nt, Human
gcuagucauaaccuuaccag

SEQ ID NO: 1802996 - RNA, 15 nt, Human
aaagcauuauuauuu

SEQ ID NO: 1802997 - RNA, 17 nt, Human
ccccuggguucacagau

SEQ ID NO: 1802998 - RNA, 21 nt, Human
uuaauauauauuaucuuuuca

SEQ ID NO: 1802999 - RNA, 12 nt, Human
ccaugcccggcu

SEQ ID NO: 1803000 - RNA, 23 nt, Human
ucuauuccugguagaauagauau

SEQ ID NO: 1803001 - RNA, 23 nt, Human
agugcuucuccagccucagccuc

SEQ ID NO: 1803002 - RNA, 14 nt, Human
agauacaaacaugu

SEQ ID NO: 1803003 - RNA, 20 nt, Human
ccuucccuugcuucuuggac

SEQ ID NO: 1803004 - RNA, 23 nt, Human
uuuaacauuccucaugaauguaa

SEQ ID NO: 1803005 - RNA, 13 nt, Human
gugagcaucaucu

SEQ ID NO: 1803006 - RNA, 21 nt, Human
aaacuaggugcauauuuauaa

SEQ ID NO: 1803007 - RNA, 13 nt, Human
gugccuuucuucu

SEQ ID NO: 1803008 - RNA, 21 nt, Human
gucaucaucacauucagggcu

SEQ ID NO: 1803009 - RNA, 17 nt, Human
agauagaugaagaagcu

SEQ ID NO: 1803010 - RNA, 21 nt, Human
uagaccuaaaauaaaaugaag

SEQ ID NO: 1803011 - RNA, 17 nt, Human
ucuuucacuaucuguaa

SEQ ID NO: 1803012 - RNA, 17 nt, Human
caaccuccgccucccau

SEQ ID NO: 1803013 - RNA, 20 nt, Human
ggguuccuuccucugagccu

SEQ ID NO: 1803014 - RNA, 22 nt, Human
auguuugcucagcuucuccaac

SEQ ID NO: 1803015 - RNA, 19 nt, Human
ugcucucggugcuuccaac

SEQ ID NO: 1803016 - RNA, 15 nt, Human
caggaaguagaggag

SEQ ID NO: 1803017 - RNA, 18 nt, Human
gcaaagcccagcuugaaa

SEQ ID NO: 1803018 - RNA, 12 nt, Human
cucccuccagau

SEQ ID NO: 1803019 - RNA, 18 nt, Human
caaacauguuccugggau

SEQ ID NO: 1803020 - RNA, 16 nt, Human
cagguuggagugcagu

SEQ ID NO: 1803021 - RNA, 12 nt, Human
uagaauuucuuu

SEQ ID NO: 1803022 - RNA, 14 nt, Human
uuucuuuguuucuu

SEQ ID NO: 1803023 - RNA, 24 nt, Human
ucuuccucccuguguauucauucu

SEQ ID NO: 1803024 - RNA, 14 nt, Human
augauguuuagaaa

SEQ ID NO: 1803025 - RNA, 22 nt, Human
aaagcauuugaaugcauuuugu

SEQ ID NO: 1803026 - RNA, 14 nt, Human
ugugguuagaaaag

SEQ ID NO: 1803027 - RNA, 21 nt, Human
ccuccauaucucccucuuccc

SEQ ID NO: 1803028 - RNA, 22 nt, Human
auggaaauguuuacagaucccc

SEQ ID NO: 1803029 - RNA, 21 nt, Human
caucuagcaugucgucaaagc

SEQ ID NO: 1803030 - RNA, 22 nt, Human
acaagcauucugucuugaaggg

SEQ ID NO: 1803031 - RNA, 20 nt, Human
ccacugggguguguggcaga

SEQ ID NO: 1803032 - RNA, 22 nt, Human
caaguuuuguggggcuuuuuau

SEQ ID NO: 1803033 - RNA, 20 nt, Human
aguacugggauuacaggcgu

SEQ ID NO: 1803034 - RNA, 23 nt, Human
gcuggccuugugaggagcuggaa

SEQ ID NO: 1803035 - RNA, 17 nt, Human
augagaguacaccccaa

SEQ ID NO: 1803036 - RNA, 16 nt, Human
aauuucuucaacuccc

SEQ ID NO: 1803037 - RNA, 21 nt, Human
ugagcucagcccuggugggca

SEQ ID NO: 1803038 - RNA, 20 nt, Human
uccucccacuucagccuccc

SEQ ID NO: 1803039 - RNA, 20 nt, Human
caguugcauugacugucaca

SEQ ID NO: 1803040 - RNA, 22 nt, Human
aaaugauguuucauaagaauuc

SEQ ID NO: 1803041 - RNA, 20 nt, Human
aaguuauguagaaaaaagua

SEQ ID NO: 1803042 - RNA, 16 nt, Human
ucaggaugagggaaaa

SEQ ID NO: 1803043 - RNA, 14 nt, Human
caucuuucccuccu

SEQ ID NO: 1803044 - RNA, 16 nt, Human
agugggacccugucuc

SEQ ID NO: 1803045 - RNA, 20 nt, Human
aaucaaaagacuuuuuccuu

SEQ ID NO: 1803046 - RNA, 15 nt, Human
uggagaucaccagug

SEQ ID NO: 1803047 - RNA, 14 nt, Human
cccuaggugagaac

SEQ ID NO: 1803048 - RNA, 19 nt, Human
cuaguaucaaaagaaagaa

SEQ ID NO: 1803049 - RNA, 19 nt, Human
uuuuucuaaaguaaaaaca

SEQ ID NO: 1803050 - RNA, 11 nt, Human
ccaagcaguug

SEQ ID NO: 1803051 - RNA, 14 nt, Human
uccuaaauauauuu

SEQ ID NO: 1803052 - RNA, 17 nt, Human
uccaauuagcuccuccu

SEQ ID NO: 1803053 - RNA, 18 nt, Human
cauguagcuacaggacau

SEQ ID NO: 1803054 - RNA, 16 nt, Human
agguauccaaaaaugu

SEQ ID NO: 1803055 - RNA, 23 nt, Human
ugauggguuucuccagagggaau

SEQ ID NO: 1803056 - RNA, 19 nt, Human
ucucuccuuguucugauaa

SEQ ID NO: 1803057 - RNA, 16 nt, Human
ccuccuuaucaaagga

SEQ ID NO: 1803058 - RNA, 13 nt, Human
cugugucuucaaa

SEQ ID NO: 1803059 - RNA, 14 nt, Human
cuccugccucagcc

SEQ ID NO: 1803060 - RNA, 19 nt, Human
caauugcuuuaccuuuuuu

SEQ ID NO: 1803061 - RNA, 14 nt, Human
agauauaccugaua

SEQ ID NO: 1803062 - RNA, 20 nt, Human
ccagagcaagacccugaaga

SEQ ID NO: 1803063 - RNA, 14 nt, Human
gcucauuuuuucuu

SEQ ID NO: 1803064 - RNA, 16 nt, Human
acguggguugcacugg

SEQ ID NO: 1803065 - RNA, 17 nt, Human
agucccuccacauuucc

SEQ ID NO: 1803066 - RNA, 15 nt, Human
uaguauggcaaacug

SEQ ID NO: 1803067 - RNA, 21 nt, Human
aggucuuucuuuccgaggccc

SEQ ID NO: 1803068 - RNA, 20 nt, Human
gaccauugucucagagcagg

SEQ ID NO: 1803069 - RNA, 20 nt, Human
agccuuuuuuugaaaaaaag

SEQ ID NO: 1803070 - RNA, 17 nt, Human
gaagcaccaaucaugaa

SEQ ID NO: 1803071 - RNA, 15 nt, Human
cagcuuuauggagau

SEQ ID NO: 1803072 - RNA, 19 nt, Human
ggcaaggguucaccugggc

SEQ ID NO: 1803073 - RNA, 14 nt, Human
ucuuacugauuuuu

SEQ ID NO: 1803074 - RNA, 17 nt, Human
cuguaaugccuuuucuc

SEQ ID NO: 1803075 - RNA, 16 nt, Human
gccccugccucucugc

SEQ ID NO: 1803076 - RNA, 16 nt, Human
cccccagcccuccuua

SEQ ID NO: 1803077 - RNA, 21 nt, Human
auuugaaauauuuucuuuguu

SEQ ID NO: 1803078 - RNA, 23 nt, Human
cuaagcccuccgccauucucaag

SEQ ID NO: 1803079 - RNA, 18 nt, Human
cagccuggcucucccagc

SEQ ID NO: 1803080 - RNA, 14 nt, Human
ugcaccaugcugcu

SEQ ID NO: 1803081 - RNA, 17 nt, Human
augaggaaagcauguau

SEQ ID NO: 1803082 - RNA, 16 nt, Human
auuuagugaucaaauu

SEQ ID NO: 1803083 - RNA, 23 nt, Human
aacuuguaaaggaauuuaaaaau

SEQ ID NO: 1803084 - RNA, 13 nt, Human
ugccucugagagc

SEQ ID NO: 1803085 - RNA, 21 nt, Human
aggguuaugauuaaguaauga

SEQ ID NO: 1803086 - RNA, 22 nt, Human
uuuuuagagaaguucaauauaa

SEQ ID NO: 1803087 - RNA, 13 nt, Human
uccuugucuuuuu

SEQ ID NO: 1803088 - RNA, 16 nt, Human
ugcagacucacugugg

SEQ ID NO: 1803089 - RNA, 13 nt, Human
gcacccucuccag

SEQ ID NO: 1803090 - RNA, 12 nt, Human
uacuguacagac

SEQ ID NO: 1803091 - RNA, 23 nt, Human
auagucauguaagcugaaaauau

SEQ ID NO: 1803092 - RNA, 18 nt, Human
aaaguaacccuacaaaac

SEQ ID NO: 1803093 - RNA, 15 nt, Human
agcccacacauggga

SEQ ID NO: 1803094 - RNA, 21 nt, Human
auauucuggacuguuuuuaaa

SEQ ID NO: 1803095 - RNA, 17 nt, Human
aggcuggcgugcagcau

SEQ ID NO: 1803096 - RNA, 17 nt, Human
cuucccaggaguacacc

SEQ ID NO: 1803097 - RNA, 13 nt, Human
uaacaaauuccaa

SEQ ID NO: 1803098 - RNA, 19 nt, Human
uaagccccagcaagcaauc

SEQ ID NO: 1803099 - RNA, 14 nt, Human
agugcuuucuucuc

SEQ ID NO: 1803100 - RNA, 16 nt, Human
aaaaacaaacaaacaa

SEQ ID NO: 1803101 - RNA, 23 nt, Human
aucagccagugaccaaccuuuuc

SEQ ID NO: 1803102 - RNA, 16 nt, Human
agcuggggccaggcug

SEQ ID NO: 1803103 - RNA, 17 nt, Human
auaaacauuuguagcau

SEQ ID NO: 1803104 - RNA, 21 nt, Human
gacagcuucucauccugcagg

SEQ ID NO: 1803105 - RNA, 12 nt, Human
aucuucacuuuu

SEQ ID NO: 1803106 - RNA, 17 nt, Human
uugccaaauauaaauaa

SEQ ID NO: 1803107 - RNA, 20 nt, Human
cacauuccucugcccuuccu

SEQ ID NO: 1803108 - RNA, 13 nt, Human
aagacagugaaag

SEQ ID NO: 1803109 - RNA, 21 nt, Human
auccccaagccuggcaaggga

SEQ ID NO: 1803110 - RNA, 14 nt, Human
cuaccacucagaga

SEQ ID NO: 1803111 - RNA, 16 nt, Human
acgcucauuguagaaa

SEQ ID NO: 1803112 - RNA, 23 nt, Human
cuauucuagucuauuuguugaug

SEQ ID NO: 1803113 - RNA, 12 nt, Human
uguuuccucugu

SEQ ID NO: 1803114 - RNA, 20 nt, Human
gggaucacugaugacuuuuu

SEQ ID NO: 1803115 - RNA, 19 nt, Human
uggcaguggaacuaagaaa

SEQ ID NO: 1803116 - RNA, 14 nt, Human
auaaauuguauauu

SEQ ID NO: 1803117 - RNA, 17 nt, Human
uuacagagacagaaagc

SEQ ID NO: 1803118 - RNA, 18 nt, Human
gaugagggaaaagaaaaa

SEQ ID NO: 1803119 - RNA, 21 nt, Human
caggcacuaucuggguuuugg

SEQ ID NO: 1803120 - RNA, 11 nt, Human
aaugagaaauc

SEQ ID NO: 1803121 - RNA, 21 nt, Human
agcuccuccuuuuuccuucca

SEQ ID NO: 1803122 - RNA, 23 nt, Human
ugaaaugaguuuuucuuuucauu

SEQ ID NO: 1803123 - RNA, 18 nt, Human
gcaagacccugaagaccc

SEQ ID NO: 1803124 - RNA, 19 nt, Human
auagcuacuaauuuuaaaa

SEQ ID NO: 1803125 - RNA, 15 nt, Human
ugaaacucauagaca

SEQ ID NO: 1803126 - RNA, 13 nt, Human
ccucauggaauug

SEQ ID NO: 1803127 - RNA, 19 nt, Human
gcacacugagccagcagcc

SEQ ID NO: 1803128 - RNA, 14 nt, Human
cugcugagucccag

SEQ ID NO: 1803129 - RNA, 21 nt, Human
guaaccccagauucaugcacu

SEQ ID NO: 1803130 - RNA, 21 nt, Human
uuugaacuacuagaaaauugu

SEQ ID NO: 1803131 - RNA, 14 nt, Human
ugcuguccuggagg

SEQ ID NO: 1803132 - RNA, 22 nt, Human
aggcuccacuuggucugugaga

SEQ ID NO: 1803133 - RNA, 18 nt, Human
cagccugcucccuagcca

SEQ ID NO: 1803134 - RNA, 18 nt, Human
gcuacacagaucacagcu

SEQ ID NO: 1803135 - RNA, 21 nt, Human
ccaguccauugggcaggcaga

SEQ ID NO: 1803136 - RNA, 22 nt, Human
cagccccuggucagucugcccu

SEQ ID NO: 1803137 - RNA, 23 nt, Human
ugaauuugugaagguggaaauaa

SEQ ID NO: 1803138 - RNA, 13 nt, Human
cucugcccuuccu

SEQ ID NO: 1803139 - RNA, 18 nt, Human
ggucuaccacucagagaa

SEQ ID NO: 1803140 - RNA, 14 nt, Human
ucugugaucuugcu

SEQ ID NO: 1803141 - RNA, 19 nt, Human
cuggagggaccuugucucc

SEQ ID NO: 1803142 - RNA, 19 nt, Human
agcagagggaucaagcagu

SEQ ID NO: 1803143 - RNA, 17 nt, Human
caugagucacuacgccu

SEQ ID NO: 1803144 - RNA, 15 nt, Human
uauaauguaaacaau

SEQ ID NO: 1803145 - RNA, 20 nt, Human
uucuaagaucuaacaagaua

SEQ ID NO: 1803146 - RNA, 15 nt, Human
aagccuggcaaggga

SEQ ID NO: 1803147 - RNA, 16 nt, Human
gcaccaggacgcccuc

SEQ ID NO: 1803148 - RNA, 14 nt, Human
aucuaugccacaag

SEQ ID NO: 1803149 - RNA, 17 nt, Human
gauucaugcugauuguu

SEQ ID NO: 1803150 - RNA, 15 nt, Human
gcuguauuuuaaaag

SEQ ID NO: 1803151 - RNA, 18 nt, Human
acacucagauccuccuca

SEQ ID NO: 1803152 - RNA, 18 nt, Human
auauauuuuaaauauuuu

SEQ ID NO: 1803153 - RNA, 13 nt, Human
cuuacugauuuuu

SEQ ID NO: 1803154 - RNA, 22 nt, Human
aaucacuggcuguuaaucuuuc

SEQ ID NO: 1803155 - RNA, 23 nt, Human
cccacuggacucaccucccccau

SEQ ID NO: 1803156 - RNA, 23 nt, Human
ugcucagggacucaucuuucccu

SEQ ID NO: 1803157 - RNA, 16 nt, Human
aauguucaucauguau

SEQ ID NO: 1803158 - RNA, 24 nt, Human
ugucuugaauuguaggugacuauu

SEQ ID NO: 1803159 - RNA, 21 nt, Human
cuauguucuaagaagugaaaa

SEQ ID NO: 1803160 - RNA, 16 nt, Human
cccugccuucccagga

SEQ ID NO: 1803161 - RNA, 17 nt, Human
aguaaaaggaaaugcuc

SEQ ID NO: 1803162 - RNA, 12 nt, Human
ugacauuagaug

SEQ ID NO: 1803163 - RNA, 18 nt, Human
agguuaaacuaaggcccu

SEQ ID NO: 1803164 - RNA, 14 nt, Human
ggaaguagaggagg

SEQ ID NO: 1803165 - RNA, 14 nt, Human
cucagccucccaaa

SEQ ID NO: 1803166 - RNA, 23 nt, Human
aaaagggacugagaaauuuauaa

SEQ ID NO: 1803167 - RNA, 18 nt, Human
cacagcauggagucacag

SEQ ID NO: 1803168 - RNA, 21 nt, Human
uuuuuuaauaaauuucaccaa

SEQ ID NO: 1803169 - RNA, 15 nt, Human
uggcucucccagcca

SEQ ID NO: 1803170 - RNA, 14 nt, Human
uacaugauucauuu

SEQ ID NO: 1803171 - RNA, 21 nt, Human
gacagucaccucauggaauug

SEQ ID NO: 1803172 - RNA, 17 nt, Human
gaaaucaugaagauauu

SEQ ID NO: 1803173 - RNA, 20 nt, Human
ggagauuuuuuaauccuuuu

SEQ ID NO: 1803174 - RNA, 12 nt, Human
auccucuugcca

SEQ ID NO: 1803175 - RNA, 13 nt, Human
gaagcaugauugg

SEQ ID NO: 1803176 - RNA, 15 nt, Human
ucuuuucauacauuu

SEQ ID NO: 1803177 - RNA, 11 nt, Human
accauuuuuac

SEQ ID NO: 1803178 - RNA, 13 nt, Human
uugucuauuaccu

SEQ ID NO: 1803179 - RNA, 14 nt, Human
accucaguucccuc

SEQ ID NO: 1803180 - RNA, 15 nt, Human
acauccuacaagaca

SEQ ID NO: 1803181 - RNA, 14 nt, Human
aaaacgaaaagucu

SEQ ID NO: 1803182 - RNA, 21 nt, Human
cagccugcucccuagccagag

SEQ ID NO: 1803183 - RNA, 14 nt, Human
caguucugaagaag

SEQ ID NO: 1803184 - RNA, 16 nt, Human
caggauggcgcaggaa

SEQ ID NO: 1803185 - RNA, 23 nt, Human
uaauuaucuaguuuaauuaaucu

SEQ ID NO: 1803186 - RNA, 21 nt, Human
cucaagcuaugugagcucacc

SEQ ID NO: 1803187 - RNA, 23 nt, Human
uacacagaucacagcuucagcca

SEQ ID NO: 1803188 - RNA, 16 nt, Human
gaaguaucuugguugu

SEQ ID NO: 1803189 - RNA, 14 nt, Human
auauaauauuuuua

SEQ ID NO: 1803190 - RNA, 14 nt, Human
uauaaauaaaaaua

SEQ ID NO: 1803191 - RNA, 17 nt, Human
acuaaugauuuagugau

SEQ ID NO: 1803192 - RNA, 14 nt, Human
ggggagauggagga

SEQ ID NO: 1803193 - RNA, 15 nt, Human
gaacucccucucugc

SEQ ID NO: 1803194 - RNA, 13 nt, Human
aggacccuucccu

SEQ ID NO: 1803195 - RNA, 18 nt, Human
uucuagcaugaagacaga

SEQ ID NO: 1803196 - RNA, 12 nt, Human
guacauucuucc

SEQ ID NO: 1803197 - RNA, 18 nt, Human
aggagugugaagcaagga

SEQ ID NO: 1803198 - RNA, 14 nt, Human
uagcuggcucugug

SEQ ID NO: 1803199 - RNA, 15 nt, Human
uaaguuuugugugua

SEQ ID NO: 1803200 - RNA, 22 nt, Human
cauuuucuaagaaacauuuaua

SEQ ID NO: 1803201 - RNA, 18 nt, Human
agguccacaacacacaga

SEQ ID NO: 1803202 - RNA, 15 nt, Human
ucucaaccucuuccc

SEQ ID NO: 1803203 - RNA, 15 nt, Human
caucaaccucuguau

SEQ ID NO: 1803204 - RNA, 12 nt, Human
guauuguauuua

SEQ ID NO: 1803205 - RNA, 18 nt, Human
cucuauguucuaagaagu

SEQ ID NO: 1803206 - RNA, 20 nt, Human
auuuucaccuguuauaauaa

SEQ ID NO: 1803207 - RNA, 12 nt, Human
cucuucuuuuca

SEQ ID NO: 1803208 - RNA, 18 nt, Human
auaaacacucuugaaaaa

SEQ ID NO: 1803209 - RNA, 18 nt, Human
agaucuuuuauuuugcca

SEQ ID NO: 1803210 - RNA, 19 nt, Human
aggaaaauggacaucaaaa

SEQ ID NO: 1803211 - RNA, 20 nt, Human
acagcuuauuuccucauuuu

SEQ ID NO: 1803212 - RNA, 22 nt, Human
ugagagcccaaacugcuguccc

SEQ ID NO: 1803213 - RNA, 23 nt, Human
gcaagaccccaucucaaaaaaaa

SEQ ID NO: 1803214 - RNA, 23 nt, Human
aaacuaggugcauauuuauaaaa

SEQ ID NO: 1803215 - RNA, 14 nt, Human
uccuggaggggcug

SEQ ID NO: 1803216 - RNA, 21 nt, Human
agugagcuuggaaaggaccag

SEQ ID NO: 1803217 - RNA, 15 nt, Human
ugccccgucccccuc

SEQ ID NO: 1803218 - RNA, 16 nt, Human
gacuauuauauuucca

SEQ ID NO: 1803219 - RNA, 16 nt, Human
uacacuggaugaaaau

SEQ ID NO: 1803220 - RNA, 21 nt, Human
cgcaaacuuucuuaaaacauu

SEQ ID NO: 1803221 - RNA, 21 nt, Human
gacagugaaagaaaauaacaa

SEQ ID NO: 1803222 - RNA, 14 nt, Human
caaacguuaagaau

SEQ ID NO: 1803223 - RNA, 15 nt, Human
cugccuucuggccuu

SEQ ID NO: 1803224 - RNA, 19 nt, Human
ucuuacugucuuuuuucua

SEQ ID NO: 1803225 - RNA, 22 nt, Human
gcagagagguagggauggggcu

SEQ ID NO: 1803226 - RNA, 19 nt, Human
ggcccaacacaauucuucu

SEQ ID NO: 1803227 - RNA, 17 nt, Human
guuuaauaauuuuuaau

SEQ ID NO: 1803228 - RNA, 16 nt, Human
caugguuuagaaagcu

SEQ ID NO: 1803229 - RNA, 18 nt, Human
auuuuaagggaaggggaa

SEQ ID NO: 1803230 - RNA, 12 nt, Human
uaaaugcucaau

SEQ ID NO: 1803231 - RNA, 17 nt, Human
cggagaaccccaggacg

SEQ ID NO: 1803232 - RNA, 21 nt, Human
gaggguuucauugucugugaa

SEQ ID NO: 1803233 - RNA, 21 nt, Human
augaauacuuuauaaaggauu

SEQ ID NO: 1803234 - RNA, 18 nt, Human
aauccccaacaugcacug

SEQ ID NO: 1803235 - RNA, 20 nt, Human
acugauguuguguuuuuaac

SEQ ID NO: 1803236 - RNA, 21 nt, Human
ggaagugcuaauuuugaaaaa

SEQ ID NO: 1803237 - RNA, 22 nt, Human
aucuucacuuuuauaagaaaua

SEQ ID NO: 1803238 - RNA, 21 nt, Human
aagacccugaagacccccaac

SEQ ID NO: 1803239 - RNA, 12 nt, Human
cauuguuauaua

SEQ ID NO: 1803240 - RNA, 12 nt, Human
cagagccacagu

SEQ ID NO: 1803241 - RNA, 19 nt, Human
uugaaaacuggcuacugcu

SEQ ID NO: 1803242 - RNA, 17 nt, Human
ugcccauaccccuggcc

SEQ ID NO: 1803243 - RNA, 19 nt, Human
gucaaucagccuaguugau

SEQ ID NO: 1803244 - RNA, 18 nt, Human
aucuaugcauuuucugga

SEQ ID NO: 1803245 - RNA, 21 nt, Human
uccacccgccucagccuccca

SEQ ID NO: 1803246 - RNA, 13 nt, Human
gcuguugcugaau

SEQ ID NO: 1803247 - RNA, 16 nt, Human
agugucaaugcagccc

SEQ ID NO: 1803248 - RNA, 16 nt, Human
acaccaaccuucugag

SEQ ID NO: 1803249 - RNA, 17 nt, Human
aaauuuccuaauuuuga

SEQ ID NO: 1803250 - RNA, 18 nt, Human
auaaucaagccuaaaauu

SEQ ID NO: 1803251 - RNA, 16 nt, Human
ugucuuuuccuucuga

SEQ ID NO: 1803252 - RNA, 17 nt, Human
uccacguacugcagccu

SEQ ID NO: 1803253 - RNA, 20 nt, Human
aauaaggaacaacguugaca

SEQ ID NO: 1803254 - RNA, 16 nt, Human
uuccuuuuacuuuucu

SEQ ID NO: 1803255 - RNA, 14 nt, Human
cugaggcuccacuu

SEQ ID NO: 1803256 - RNA, 20 nt, Human
aaaaucuuauaauuuaaaau

SEQ ID NO: 1803257 - RNA, 19 nt, Human
cugggcagaaggccaagag

SEQ ID NO: 1803258 - RNA, 18 nt, Human
ugggcacaggguuuaugu

SEQ ID NO: 1803259 - RNA, 20 nt, Human
aucaugugucuucugcccua

SEQ ID NO: 1803260 - RNA, 16 nt, Human
aggguguguaaguaga

SEQ ID NO: 1803261 - RNA, 14 nt, Human
ucaaguccugcaag

SEQ ID NO: 1803262 - RNA, 15 nt, Human
cugggaccuggggca

SEQ ID NO: 1803263 - RNA, 13 nt, Human
cuacaaaaaaaaa

SEQ ID NO: 1803264 - RNA, 15 nt, Human
auccccacgccacag

SEQ ID NO: 1803265 - RNA, 13 nt, Human
aauguugaauuuu

SEQ ID NO: 1803266 - RNA, 17 nt, Human
gcuccauucaaagugag

SEQ ID NO: 1803267 - RNA, 13 nt, Human
uuccaugaacuuc

SEQ ID NO: 1803268 - RNA, 22 nt, Human
ggccccuuugcugacccucccc

SEQ ID NO: 1803269 - RNA, 17 nt, Human
caaaagacuuuuuccuu

SEQ ID NO: 1803270 - RNA, 19 nt, Human
aaaucuaucaaaauuaccc

SEQ ID NO: 1803271 - RNA, 18 nt, Human
aguagccagcaucugccu

SEQ ID NO: 1803272 - RNA, 22 nt, Human
ggcccaguaccuagcuggcucu

SEQ ID NO: 1803273 - RNA, 14 nt, Human
augaccuucaacaa

SEQ ID NO: 1803274 - RNA, 20 nt, Human
uuauguugcauagaauaaaa

SEQ ID NO: 1803275 - RNA, 18 nt, Human
acuguuuuucagggaggu

SEQ ID NO: 1803276 - RNA, 13 nt, Human
uuuauaaaaauaa

SEQ ID NO: 1803277 - RNA, 22 nt, Human
uccccagccugcucccuagcca

SEQ ID NO: 1803278 - RNA, 20 nt, Human
aagacacccccucaaaccca

SEQ ID NO: 1803279 - RNA, 17 nt, Human
ucuggaggucucugaac

SEQ ID NO: 1803280 - RNA, 16 nt, Human
aacgagacaagcagcc

SEQ ID NO: 1803281 - RNA, 16 nt, Human
gcauguucuaaauaaa

SEQ ID NO: 1803282 - RNA, 19 nt, Human
cauccuuuucauugccaug

SEQ ID NO: 1803283 - RNA, 15 nt, Human
auggagccagcucug

SEQ ID NO: 1803284 - RNA, 16 nt, Human
ggagcaguagcuggag

SEQ ID NO: 1803285 - RNA, 15 nt, Human
ucuugaggcacagaa

SEQ ID NO: 1803286 - RNA, 17 nt, Human
auuuaaauuauuuuugu

SEQ ID NO: 1803287 - RNA, 22 nt, Human
augcuuaaggccaugauuuuag

SEQ ID NO: 1803288 - RNA, 18 nt, Human
aucaacuaaugauuuagu

SEQ ID NO: 1803289 - RNA, 14 nt, Human
accauuuucuuuuu

SEQ ID NO: 1803290 - RNA, 21 nt, Human
caaaucaaaagacuuuuuccu

SEQ ID NO: 1803291 - RNA, 15 nt, Human
uucugcacacagcac

SEQ ID NO: 1803292 - RNA, 12 nt, Human
gaagaucuagug

SEQ ID NO: 1803293 - RNA, 18 nt, Human
cuaaagaaggugugggcc

SEQ ID NO: 1803294 - RNA, 16 nt, Human
auugauuuaauguaau

SEQ ID NO: 1803295 - RNA, 12 nt, Human
cagaucacagcu

SEQ ID NO: 1803296 - RNA, 21 nt, Human
auauuuccuuauucagaauuu

SEQ ID NO: 1803297 - RNA, 17 nt, Human
caggcugcucagggcug

SEQ ID NO: 1803298 - RNA, 21 nt, Human
acuaggguggugcauuuuugu

SEQ ID NO: 1803299 - RNA, 17 nt, Human
uaucuaguuuaauuaau

SEQ ID NO: 1803300 - RNA, 21 nt, Human
caggaguuucguuuucaaaau

SEQ ID NO: 1803301 - RNA, 17 nt, Human
aacuuacuacugaaucu

SEQ ID NO: 1803302 - RNA, 15 nt, Human
aguccagcuuaguuc

SEQ ID NO: 1803303 - RNA, 14 nt, Human
uucguuuucaaaau

SEQ ID NO: 1803304 - RNA, 21 nt, Human
uuagcuccuccuuuuuccuuc

SEQ ID NO: 1803305 - RNA, 19 nt, Human
uauuuuucaugauuuugaa

SEQ ID NO: 1803306 - RNA, 12 nt, Human
gacccugucucu

SEQ ID NO: 1803307 - RNA, 14 nt, Human
acaugaauauuuag

SEQ ID NO: 1803308 - RNA, 19 nt, Human
cagguaggaggcaaauauc

SEQ ID NO: 1803309 - RNA, 19 nt, Human
auuuuuuuagaaagcauuu

SEQ ID NO: 1803310 - RNA, 21 nt, Human
acugcacgaauggaagaggca

SEQ ID NO: 1803311 - RNA, 15 nt, Human
uuccaagaaauauuc

SEQ ID NO: 1803312 - RNA, 16 nt, Human
uguuccugcuuuuccc

SEQ ID NO: 1803313 - RNA, 19 nt, Human
cuccagccucagccuccca

SEQ ID NO: 1803314 - RNA, 20 nt, Human
gaucauugugaaauuauuca

SEQ ID NO: 1803315 - RNA, 21 nt, Human
gugcgagugcgugaauauugg

SEQ ID NO: 1803316 - RNA, 18 nt, Human
cagcauggagucacagcc

SEQ ID NO: 1803317 - RNA, 13 nt, Human
cauggaaaaguuu

SEQ ID NO: 1803318 - RNA, 21 nt, Human
augcuacaggauuugaaauug

SEQ ID NO: 1803319 - RNA, 16 nt, Human
aaaauggacaucaaaa

SEQ ID NO: 1803320 - RNA, 14 nt, Human
uauucuguguuaaa

SEQ ID NO: 1803321 - RNA, 12 nt, Human
ggaaaaaacugu

SEQ ID NO: 1803322 - RNA, 20 nt, Human
aaugaauacuuuauaaagga

SEQ ID NO: 1803323 - RNA, 14 nt, Human
uuuaaaaguuuuuu

SEQ ID NO: 1803324 - RNA, 16 nt, Human
uaaaucuaucaaaauu

SEQ ID NO: 1803325 - RNA, 14 nt, Human
uccagaaagaaaac

SEQ ID NO: 1803326 - RNA, 22 nt, Human
cccuguuucuuccacagugccu

SEQ ID NO: 1803327 - RNA, 20 nt, Human
cuaugaaguuuuuuuuauac

SEQ ID NO: 1803328 - RNA, 20 nt, Human
accucaccaguuuccaggug

SEQ ID NO: 1803329 - RNA, 19 nt, Human
aucagagcgcacagggagu

SEQ ID NO: 1803330 - RNA, 15 nt, Human
uaauauugcaaggca

SEQ ID NO: 1803331 - RNA, 17 nt, Human
guauuauuuuuuaaaaa

SEQ ID NO: 1803332 - RNA, 19 nt, Human
aaucacaauaauuuucuac

SEQ ID NO: 1803333 - RNA, 16 nt, Human
agaacuuaaggaugga

SEQ ID NO: 1803334 - RNA, 15 nt, Human
acacaaauuaucuua

SEQ ID NO: 1803335 - RNA, 20 nt, Human
auauaagugcuguauaaaau

SEQ ID NO: 1803336 - RNA, 14 nt, Human
ccauacucuguaac

SEQ ID NO: 1803337 - RNA, 15 nt, Human
ccugcaaagcccagc

SEQ ID NO: 1803338 - RNA, 13 nt, Human
auccugaggcucc

SEQ ID NO: 1803339 - RNA, 16 nt, Human
uuucugaguuccugca

SEQ ID NO: 1803340 - RNA, 17 nt, Human
cauuaaaaaugcauaua

SEQ ID NO: 1803341 - RNA, 18 nt, Human
ucaccauguuggccaggc

SEQ ID NO: 1803342 - RNA, 15 nt, Human
uaaaucacucaaauu

SEQ ID NO: 1803343 - RNA, 13 nt, Human
uucuuucuuuauu

SEQ ID NO: 1803344 - RNA, 18 nt, Human
ccugcucagcccugcacc

SEQ ID NO: 1803345 - RNA, 15 nt, Human
agguguguugcagug

SEQ ID NO: 1803346 - RNA, 16 nt, Human
ccugcaaagcccagcu

SEQ ID NO: 1803347 - RNA, 17 nt, Human
cagcuggucagcccccu

SEQ ID NO: 1803348 - RNA, 16 nt, Human
cgauucacccugucca

SEQ ID NO: 1803349 - RNA, 19 nt, Human
cucccaagcaccugggauu

SEQ ID NO: 1803350 - RNA, 14 nt, Human
cagucugucaccca

SEQ ID NO: 1803351 - RNA, 13 nt, Human
acaagagcuuaac

SEQ ID NO: 1803352 - RNA, 17 nt, Human
aaggccaagaggcuguu

SEQ ID NO: 1803353 - RNA, 16 nt, Human
cucuguaauaaacuca

SEQ ID NO: 1803354 - RNA, 15 nt, Human
ggcuggucucaaacu

SEQ ID NO: 1803355 - RNA, 20 nt, Human
aucuuuucauacauuuucua

SEQ ID NO: 1803356 - RNA, 17 nt, Human
cuauuuuuggaagagga

SEQ ID NO: 1803357 - RNA, 20 nt, Human
gccccaucuccucagcaccc

SEQ ID NO: 1803358 - RNA, 16 nt, Human
aagauuguuccugcuu

SEQ ID NO: 1803359 - RNA, 14 nt, Human
gcaggccagagcua

SEQ ID NO: 1803360 - RNA, 12 nt, Human
uuaaucuguauu

SEQ ID NO: 1803361 - RNA, 20 nt, Human
cugagccucagucucccucc

SEQ ID NO: 1803362 - RNA, 14 nt, Human
uccucuccaccauc

SEQ ID NO: 1803363 - RNA, 15 nt, Human
aagaagugaaaaucu

SEQ ID NO: 1803364 - RNA, 17 nt, Human
auuuucagcccucagaa

SEQ ID NO: 1803365 - RNA, 22 nt, Human
ucccuuuggagauuuuuuaauc

SEQ ID NO: 1803366 - RNA, 19 nt, Human
ccaaccacaucccacucac

SEQ ID NO: 1803367 - RNA, 17 nt, Human
aucuuaaaugccaggcc

SEQ ID NO: 1803368 - RNA, 14 nt, Human
ccucagccucccga

SEQ ID NO: 1803369 - RNA, 20 nt, Human
cuguaauguuaauauugauu

SEQ ID NO: 1803370 - RNA, 13 nt, Human
uaaagucuugccu

SEQ ID NO: 1803371 - RNA, 22 nt, Human
uccugcuuuuccccaaguacaa

SEQ ID NO: 1803372 - RNA, 16 nt, Human
cugcuuggagcagccu

SEQ ID NO: 1803373 - RNA, 18 nt, Human
ucacagaagaaggaaauu

SEQ ID NO: 1803374 - RNA, 17 nt, Human
aaacugagauccuuccu

SEQ ID NO: 1803375 - RNA, 13 nt, Human
cuuuacuuucccc

SEQ ID NO: 1803376 - RNA, 23 nt, Human
ugauguuguuaugggcaggaugg

SEQ ID NO: 1803377 - RNA, 13 nt, Human
ucugccucccucu

SEQ ID NO: 1803378 - RNA, 13 nt, Human
augggucagaguu

SEQ ID NO: 1803379 - RNA, 17 nt, Human
aaggucuaggugcuuua

SEQ ID NO: 1803380 - RNA, 23 nt, Human
agcaacguggcuuuuuuuuuuuc

SEQ ID NO: 1803381 - RNA, 18 nt, Human
gaggcuccacuuggucug

SEQ ID NO: 1803382 - RNA, 12 nt, Human
cuuauauuuacu

SEQ ID NO: 1803383 - RNA, 15 nt, Human
auuuuauuuuuuucu

SEQ ID NO: 1803384 - RNA, 20 nt, Human
gcaucuagaggcuuccuuca

SEQ ID NO: 1803385 - RNA, 22 nt, Human
gaggggagcaugggaagugacg

SEQ ID NO: 1803386 - RNA, 18 nt, Human
cuggacugugugcucagg

SEQ ID NO: 1803387 - RNA, 21 nt, Human
uaaugaaguuugaauguuaaa

SEQ ID NO: 1803388 - RNA, 22 nt, Human
ugauugugggauacuauuuaau

SEQ ID NO: 1803389 - RNA, 22 nt, Human
cucugaauuugagauacaaaca

SEQ ID NO: 1803390 - RNA, 21 nt, Human
cauagaacucaugacggaaga

SEQ ID NO: 1803391 - RNA, 19 nt, Human
uucacuguguuggccagga

SEQ ID NO: 1803392 - RNA, 21 nt, Human
ucccaauugcuuuaccuuuuu

SEQ ID NO: 1803393 - RNA, 14 nt, Human
ccuguaugauuccu

SEQ ID NO: 1803394 - RNA, 17 nt, Human
guggugcgagugcguga

SEQ ID NO: 1803395 - RNA, 14 nt, Human
cugcugcccucccc

SEQ ID NO: 1803396 - RNA, 22 nt, Human
ggcuuuuuauacacuuuuuaaa

SEQ ID NO: 1803397 - RNA, 20 nt, Human
ccaccucgcagguucaagca

SEQ ID NO: 1803398 - RNA, 15 nt, Human
gaauauauuuccuua

SEQ ID NO: 1803399 - RNA, 14 nt, Human
agggaaaagaaaaa

SEQ ID NO: 1803400 - RNA, 10 nt, Human
gacucagccc

SEQ ID NO: 1803401 - RNA, 15 nt, Human
caggaugagggaaaa

SEQ ID NO: 1803402 - RNA, 20 nt, Human
ugcauagaauaaaauuuuua

SEQ ID NO: 1803403 - RNA, 17 nt, Human
gcccaaggguggugaga

SEQ ID NO: 1803404 - RNA, 18 nt, Human
gccuucuucggaaagaag

SEQ ID NO: 1803405 - RNA, 13 nt, Human
uaauguacaauaa

SEQ ID NO: 1803406 - RNA, 15 nt, Human
uccgacucuucugag

SEQ ID NO: 1803407 - RNA, 17 nt, Human
auuguucucuaauaugu

SEQ ID NO: 1803408 - RNA, 16 nt, Human
ccuuccccucugcagc

SEQ ID NO: 1803409 - RNA, 14 nt, Human
cugcaaccuccacc

SEQ ID NO: 1803410 - RNA, 14 nt, Human
auuguuacugguac

SEQ ID NO: 1803411 - RNA, 13 nt, Human
gagguggcugggu

SEQ ID NO: 1803412 - RNA, 12 nt, Human
gggaagacagug

SEQ ID NO: 1803413 - RNA, 15 nt, Human
gaguacaccccaaca

SEQ ID NO: 1803414 - RNA, 17 nt, Human
gaacuuuccacauucag

SEQ ID NO: 1803415 - RNA, 15 nt, Human
cucuucugagcaccu

SEQ ID NO: 1803416 - RNA, 19 nt, Human
cccugcugcccucccccuc

SEQ ID NO: 1803417 - RNA, 13 nt, Human
ccagccugcuccc

SEQ ID NO: 1803418 - RNA, 12 nt, Human
auuguagaaaag

SEQ ID NO: 1803419 - RNA, 21 nt, Human
agcuaccugcucagcccugca

SEQ ID NO: 1803420 - RNA, 15 nt, Human
uuauacuuuguaaag

SEQ ID NO: 1803421 - RNA, 15 nt, Human
cugcagauaaacagu

SEQ ID NO: 1803422 - RNA, 21 nt, Human
ccaaagucucuggaauuugaa

SEQ ID NO: 1803423 - RNA, 16 nt, Human
aauuuaaaucacucaa

SEQ ID NO: 1803424 - RNA, 17 nt, Human
acugauuuuuaaguuau

SEQ ID NO: 1803425 - RNA, 15 nt, Human
uuacagagacagaaa

SEQ ID NO: 1803426 - RNA, 18 nt, Human
agcaaauaauuuuucacu

SEQ ID NO: 1803427 - RNA, 22 nt, Human
aaagcucuuuacuuuccccuug

SEQ ID NO: 1803428 - RNA, 21 nt, Human
gcuccuccuuuuuccuuccag

SEQ ID NO: 1803429 - RNA, 15 nt, Human
cgcaugcggcccagg

SEQ ID NO: 1803430 - RNA, 22 nt, Human
aacccuuucauaaagucuugcc

SEQ ID NO: 1803431 - RNA, 15 nt, Human
gaccuacccuccaca

SEQ ID NO: 1803432 - RNA, 16 nt, Human
ccuaagugcagccccg

SEQ ID NO: 1803433 - RNA, 18 nt, Human
ugcucuguguuuacagac

SEQ ID NO: 1803434 - RNA, 23 nt, Human
cucagucucccucccuuggggcc

SEQ ID NO: 1803435 - RNA, 15 nt, Human
uaccuaguccccagc

SEQ ID NO: 1803436 - RNA, 19 nt, Human
ucuuuaggcauuaaauuuu

SEQ ID NO: 1803437 - RNA, 11 nt, Human
ccacaaaccca

SEQ ID NO: 1803438 - RNA, 14 nt, Human
cucucaugaaccuc

SEQ ID NO: 1803439 - RNA, 22 nt, Human
uggaaaguuuaugguuguauua

SEQ ID NO: 1803440 - RNA, 22 nt, Human
aaaagauugagagaauuugugc

SEQ ID NO: 1803441 - RNA, 19 nt, Human
ugagucacuacgccuggcu

SEQ ID NO: 1803442 - RNA, 19 nt, Human
uaccucaguucccucuugc

SEQ ID NO: 1803443 - RNA, 15 nt, Human
auaaugugauauuau

SEQ ID NO: 1803444 - RNA, 16 nt, Human
agcauucugucuugaa

SEQ ID NO: 1803445 - RNA, 12 nt, Human
uuucuucuccca

SEQ ID NO: 1803446 - RNA, 19 nt, Human
cggcuuccuuccucucugc

SEQ ID NO: 1803447 - RNA, 17 nt, Human
uagcauccucuuuaaug

SEQ ID NO: 1803448 - RNA, 20 nt, Human
guaauauuucuucaaauaaa

SEQ ID NO: 1803449 - RNA, 23 nt, Human
uccagaugagaguacaccccaac

SEQ ID NO: 1803450 - RNA, 18 nt, Human
ccaggcccugcucuuccu

SEQ ID NO: 1803451 - RNA, 15 nt, Human
auaagaucuuuuauu

SEQ ID NO: 1803452 - RNA, 18 nt, Human
uccuguuaauauggugua

SEQ ID NO: 1803453 - RNA, 18 nt, Human
uccccaggcccugcucuu

SEQ ID NO: 1803454 - RNA, 14 nt, Human
ccacuggacucacc

SEQ ID NO: 1803455 - RNA, 16 nt, Human
cacacaccaccacgcc

SEQ ID NO: 1803456 - RNA, 17 nt, Human
ccuacuuccccuuccua

SEQ ID NO: 1803457 - RNA, 20 nt, Human
gcccccuaauccccuucucc

SEQ ID NO: 1803458 - RNA, 12 nt, Human
agcucacugcaa

SEQ ID NO: 1803459 - RNA, 15 nt, Human
guggaugauccccac

SEQ ID NO: 1803460 - RNA, 16 nt, Human
cucaaagcaaauaauu

SEQ ID NO: 1803461 - RNA, 15 nt, Human
gcauuauaucaaauc

SEQ ID NO: 1803462 - RNA, 20 nt, Human
ugagccaccacauccagccu

SEQ ID NO: 1803463 - RNA, 22 nt, Human
ccucucucuguaauaaacucau

SEQ ID NO: 1803464 - RNA, 21 nt, Human
ucuaggacacaguuccuggga

SEQ ID NO: 1803465 - RNA, 22 nt, Human
caugccaucucaaccucuuccc

SEQ ID NO: 1803466 - RNA, 16 nt, Human
uucuauucuagccugc

SEQ ID NO: 1803467 - RNA, 22 nt, Human
acuccuugauuuuagccuucuc

SEQ ID NO: 1803468 - RNA, 15 nt, Human
aagccuccuuuuaaa

SEQ ID NO: 1803469 - RNA, 14 nt, Human
gcuuuaccuuuuuu

SEQ ID NO: 1803470 - RNA, 21 nt, Human
gcuaccugcucagcccugcac

SEQ ID NO: 1803471 - RNA, 16 nt, Human
gaauauaaauuuauca

SEQ ID NO: 1803472 - RNA, 18 nt, Human
cugucuucuuugcccaca

SEQ ID NO: 1803473 - RNA, 20 nt, Human
agcuucacuguaaaauaaua

SEQ ID NO: 1803474 - RNA, 16 nt, Human
agugaaggauuuaugu

SEQ ID NO: 1803475 - RNA, 20 nt, Human
cuuuuuauacacuuuuuaaa

SEQ ID NO: 1803476 - RNA, 18 nt, Human
caaaguuuaccagaaagc

SEQ ID NO: 1803477 - RNA, 22 nt, Human
ggggugguuuucccaucucagg

SEQ ID NO: 1803478 - RNA, 16 nt, Human
gcaaagcucggugcuc

SEQ ID NO: 1803479 - RNA, 22 nt, Human
uguucuaaauaaaaagcauuau

SEQ ID NO: 1803480 - RNA, 20 nt, Human
uaaaaugaauacaauuaaag

SEQ ID NO: 1803481 - RNA, 13 nt, Human
gauacagggauga

SEQ ID NO: 1803482 - RNA, 18 nt, Human
gccuucggccuccauccu

SEQ ID NO: 1803483 - RNA, 18 nt, Human
aacucagacacaaauaaa

SEQ ID NO: 1803484 - RNA, 19 nt, Human
ucugccacaccucuccaaa

SEQ ID NO: 1803485 - RNA, 16 nt, Human
ugccucaccccuugcc

SEQ ID NO: 1803486 - RNA, 19 nt, Human
uaaaagggacugagaaauu

SEQ ID NO: 1803487 - RNA, 22 nt, Human
ugccgcuagauacaugcuuuuu

SEQ ID NO: 1803488 - RNA, 14 nt, Human
cuauaauauaagcu

SEQ ID NO: 1803489 - RNA, 15 nt, Human
ucaccauguuggcua

SEQ ID NO: 1803490 - RNA, 22 nt, Human
uaagauauuuuucaugauuuug

SEQ ID NO: 1803491 - RNA, 18 nt, Human
acaaacaaacaaaaaaaa

SEQ ID NO: 1803492 - RNA, 23 nt, Human
uagacucugucuaccuggucugg

SEQ ID NO: 1803493 - RNA, 13 nt, Human
acccuggacuugc

SEQ ID NO: 1803494 - RNA, 21 nt, Human
cuggccucugcucaacuagca

SEQ ID NO: 1803495 - RNA, 11 nt, Human
agccugccuuu

SEQ ID NO: 1803496 - RNA, 20 nt, Human
cauagugggacccugucucu

SEQ ID NO: 1803497 - RNA, 15 nt, Human
cauuucagaaaugcu

SEQ ID NO: 1803498 - RNA, 15 nt, Human
ucaucuaagccuucu

SEQ ID NO: 1803499 - RNA, 18 nt, Human
caagcuaugugagcucac

SEQ ID NO: 1803500 - RNA, 20 nt, Human
agaaucaugcugagagagcu

SEQ ID NO: 1803501 - RNA, 23 nt, Human
guuaugaguggcuuuaaugaaua

SEQ ID NO: 1803502 - RNA, 22 nt, Human
aauugcuauguuuugacauuuu

SEQ ID NO: 1803503 - RNA, 16 nt, Human
cuuaggccucugagaa

SEQ ID NO: 1803504 - RNA, 19 nt, Human
ucaauucuugccaaauaua

SEQ ID NO: 1803505 - RNA, 16 nt, Human
cuaaaauaaaaugaag

SEQ ID NO: 1803506 - RNA, 17 nt, Human
uaggguccaccaggagu

SEQ ID NO: 1803507 - RNA, 22 nt, Human
aacuccuaggaaaauacuauuc

SEQ ID NO: 1803508 - RNA, 18 nt, Human
cugcuauucuccauacuc

SEQ ID NO: 1803509 - RNA, 16 nt, Human
aauugacccacaagaa

SEQ ID NO: 1803510 - RNA, 22 nt, Human
aaccuacacgagauacagaauu

SEQ ID NO: 1803511 - RNA, 20 nt, Human
agcaucagugagguuaaacu

SEQ ID NO: 1803512 - RNA, 17 nt, Human
aguucuauaauguaaac

SEQ ID NO: 1803513 - RNA, 15 nt, Human
aacagggcugccuuc

SEQ ID NO: 1803514 - RNA, 22 nt, Human
uggguuccuuccucugagccuu

SEQ ID NO: 1803515 - RNA, 18 nt, Human
uuaaaaugagaaaucuaa

SEQ ID NO: 1803516 - RNA, 17 nt, Human
aauauaucugcuauucu

SEQ ID NO: 1803517 - RNA, 15 nt, Human
auuuauuaaguauuu

SEQ ID NO: 1803518 - RNA, 13 nt, Human
aggcagccugccu

SEQ ID NO: 1803519 - RNA, 17 nt, Human
agcuaaauauauauuuu

SEQ ID NO: 1803520 - RNA, 13 nt, Human
gacacaaauaaag

SEQ ID NO: 1803521 - RNA, 17 nt, Human
caacacaauucuucuuc

SEQ ID NO: 1803522 - RNA, 15 nt, Human
ccuggugggcagaga

SEQ ID NO: 1803523 - RNA, 13 nt, Human
gacuuuuuccuug

SEQ ID NO: 1803524 - RNA, 17 nt, Human
cucacaggagcaucucc

SEQ ID NO: 1803525 - RNA, 18 nt, Human
uacaggccucacacacaa

SEQ ID NO: 1803526 - RNA, 14 nt, Human
augcucugauuuau

SEQ ID NO: 1803527 - RNA, 13 nt, Human
ugaauuaaagaag

SEQ ID NO: 1803528 - RNA, 18 nt, Human
gcacacugagccagcagc

SEQ ID NO: 1803529 - RNA, 13 nt, Human
uaauauuuuuaau

SEQ ID NO: 1803530 - RNA, 21 nt, Human
uggggaauauguuagagaauu

SEQ ID NO: 1803531 - RNA, 16 nt, Human
ugcugugcagucccug

SEQ ID NO: 1803532 - RNA, 23 nt, Human
uguauucagcuuuaguagauauu

SEQ ID NO: 1803533 - RNA, 16 nt, Human
accaggcuugccugca

SEQ ID NO: 1803534 - RNA, 14 nt, Human
ugucuguuuccucu

SEQ ID NO: 1803535 - RNA, 17 nt, Human
cacuagacaaguccagc

SEQ ID NO: 1803536 - RNA, 12 nt, Human
aauuuaaaacau

SEQ ID NO: 1803537 - RNA, 17 nt, Human
uuuuuaauuauauggcu

SEQ ID NO: 1803538 - RNA, 20 nt, Human
cacagcccuggccucugcuc

SEQ ID NO: 1803539 - RNA, 19 nt, Human
uugucucccagcucagggc

SEQ ID NO: 1803540 - RNA, 17 nt, Human
uacaagcauucugucuu

SEQ ID NO: 1803541 - RNA, 15 nt, Human
cuacaaccuccgccu

SEQ ID NO: 1803542 - RNA, 20 nt, Human
aauaucuuuuuuuuaauaaa

SEQ ID NO: 1803543 - RNA, 18 nt, Human
ggaacuggugucuucagg

SEQ ID NO: 1803544 - RNA, 18 nt, Human
aaguuagaaaguugauuu

SEQ ID NO: 1803545 - RNA, 20 nt, Human
aauucauguugccuugcaua

SEQ ID NO: 1803546 - RNA, 21 nt, Human
ggauacagccaggcccagagc

SEQ ID NO: 1803547 - RNA, 12 nt, Human
gguauaaaagau

SEQ ID NO: 1803548 - RNA, 20 nt, Human
augggagugcccccaacagc

SEQ ID NO: 1803549 - RNA, 15 nt, Human
ucugcagauaaacag

SEQ ID NO: 1803550 - RNA, 17 nt, Human
cacagcuucagccagga

SEQ ID NO: 1803551 - RNA, 18 nt, Human
agauauuaacugagaagg

SEQ ID NO: 1803552 - RNA, 20 nt, Human
ucaauaaaauccauacauuu

SEQ ID NO: 1803553 - RNA, 14 nt, Human
acucucuggaagcc

SEQ ID NO: 1803554 - RNA, 15 nt, Human
cuguaaaauaauaac

SEQ ID NO: 1803555 - RNA, 15 nt, Human
gcccgcaugcggccc

SEQ ID NO: 1803556 - RNA, 22 nt, Human
cucuaauguacaauaaagcaau

SEQ ID NO: 1803557 - RNA, 16 nt, Human
uccuuaggccucugag

SEQ ID NO: 1803558 - RNA, 22 nt, Human
cucucaaacuggggccucccug

SEQ ID NO: 1803559 - RNA, 14 nt, Human
cccuggucccuugg

SEQ ID NO: 1803560 - RNA, 18 nt, Human
caggcuugaaucaaagaa

SEQ ID NO: 1803561 - RNA, 19 nt, Human
uuuacgcucauuguagaaa

SEQ ID NO: 1803562 - RNA, 17 nt, Human
cuaagcuucacuguaaa

SEQ ID NO: 1803563 - RNA, 18 nt, Human
cucauccacguccugucu

SEQ ID NO: 1803564 - RNA, 12 nt, Human
uaguuuuuaaag

SEQ ID NO: 1803565 - RNA, 18 nt, Human
uauuuggugauuacauuu

SEQ ID NO: 1803566 - RNA, 18 nt, Human
aggaaaaaauaacaauga

SEQ ID NO: 1803567 - RNA, 15 nt, Human
accgcuaucauucca

SEQ ID NO: 1803568 - RNA, 14 nt, Human
cuccagccucagcc

SEQ ID NO: 1803569 - RNA, 19 nt, Human
cccauggcacucuauguuc

SEQ ID NO: 1803570 - RNA, 18 nt, Human
uucauaagauuuaaauua

SEQ ID NO: 1803571 - RNA, 18 nt, Human
ucccuggucccuuggaga

SEQ ID NO: 1803572 - RNA, 16 nt, Human
cuuggaauccugggga

SEQ ID NO: 1803573 - RNA, 14 nt, Human
cccuaguuccuuca

SEQ ID NO: 1803574 - RNA, 14 nt, Human
gaaaguugauuuua

SEQ ID NO: 1803575 - RNA, 16 nt, Human
auuuagauuugugugc

SEQ ID NO: 1803576 - RNA, 14 nt, Human
gagucccagagcca

SEQ ID NO: 1803577 - RNA, 23 nt, Human
aucauuuccauuuacccuucuuu

SEQ ID NO: 1803578 - RNA, 23 nt, Human
ggaugguucccuugaugaagaag

SEQ ID NO: 1803579 - RNA, 16 nt, Human
cucauccugcaggcag

SEQ ID NO: 1803580 - RNA, 18 nt, Human
cauucagggcuauuuuuu

SEQ ID NO: 1803581 - RNA, 15 nt, Human
gaauaaccaacaccc

SEQ ID NO: 1803582 - RNA, 22 nt, Human
acccuuucauaaagucuugccu

SEQ ID NO: 1803583 - RNA, 20 nt, Human
acacugauguaugaggaauu

SEQ ID NO: 1803584 - RNA, 17 nt, Human
guuagagaauuuccuua

SEQ ID NO: 1803585 - RNA, 17 nt, Human
aauaacgauaaaagaca

SEQ ID NO: 1803586 - RNA, 22 nt, Human
cucagcccuggugggcagagag

SEQ ID NO: 1803587 - RNA, 19 nt, Human
uaaauuauuuuuguucaua

SEQ ID NO: 1803588 - RNA, 14 nt, Human
auuucuaugaaaua

SEQ ID NO: 1803589 - RNA, 22 nt, Human
agaggcucuaauguacaauaaa

SEQ ID NO: 1803590 - RNA, 19 nt, Human
uugcuuugauggaauaaac

SEQ ID NO: 1803591 - RNA, 13 nt, Human
ccuuucauuuuuu

SEQ ID NO: 1803592 - RNA, 17 nt, Human
ugcacuuggcugcauaa

SEQ ID NO: 1803593 - RNA, 19 nt, Human
uggauacgcaucagacaga

SEQ ID NO: 1803594 - RNA, 22 nt, Human
uugaagggcaggugcuucagga

SEQ ID NO: 1803595 - RNA, 23 nt, Human
uacucuucuuacuggugcuauuu

SEQ ID NO: 1803596 - RNA, 17 nt, Human
cccccuagccugccucc

SEQ ID NO: 1803597 - RNA, 17 nt, Human
aaagcagggacuugaac

SEQ ID NO: 1803598 - RNA, 19 nt, Human
agaggcuuccuucauuucc

SEQ ID NO: 1803599 - RNA, 12 nt, Human
acagcacccucu

SEQ ID NO: 1803600 - RNA, 12 nt, Human
gaauccugggga

SEQ ID NO: 1803601 - RNA, 20 nt, Human
aauuauaacuggaaagaagu

SEQ ID NO: 1803602 - RNA, 17 nt, Human
cuucuuggccaugggag

SEQ ID NO: 1803603 - RNA, 13 nt, Human
aaguuagaacuag

SEQ ID NO: 1803604 - RNA, 19 nt, Human
agaguacaccccaacagca

SEQ ID NO: 1803605 - RNA, 15 nt, Human
agcuggggccaggcu

SEQ ID NO: 1803606 - RNA, 22 nt, Human
gcuguucccaccaggcugcuca

SEQ ID NO: 1803607 - RNA, 15 nt, Human
ucucuguucauuucc

SEQ ID NO: 1803608 - RNA, 17 nt, Human
aaacucaauaaguuuau

SEQ ID NO: 1803609 - RNA, 23 nt, Human
agugaacauucgaccuccauuac

SEQ ID NO: 1803610 - RNA, 22 nt, Human
ccgaggccccugucucagggug

SEQ ID NO: 1803611 - RNA, 14 nt, Human
uggagucacagcca

SEQ ID NO: 1803612 - RNA, 18 nt, Human
ccuuccuaauuccacagc

SEQ ID NO: 1803613 - RNA, 20 nt, Human
cacuguacuugcucuugaug

SEQ ID NO: 1803614 - RNA, 14 nt, Human
cugugcgugugugu

SEQ ID NO: 1803615 - RNA, 21 nt, Human
ccagggaugaugcaacauccu

SEQ ID NO: 1803616 - RNA, 22 nt, Human
aaauaaucauucuuauuucaug

SEQ ID NO: 1803617 - RNA, 15 nt, Human
ggaaagaagaaggug

SEQ ID NO: 1803618 - RNA, 19 nt, Human
gucuuucacauuuaaauaa

SEQ ID NO: 1803619 - RNA, 15 nt, Human
ucuucuccauccuac

SEQ ID NO: 1803620 - RNA, 23 nt, Human
ugguuagaaaaguuauguagaaa

SEQ ID NO: 1803621 - RNA, 16 nt, Human
gcuggggccaggcugg

SEQ ID NO: 1803622 - RNA, 16 nt, Human
auucaugucaugugua

SEQ ID NO: 1803623 - RNA, 15 nt, Human
ugugaccucuccccu

SEQ ID NO: 1803624 - RNA, 14 nt, Human
agaaaggauaaagu

SEQ ID NO: 1803625 - RNA, 14 nt, Human
ccagguucuuucuu

SEQ ID NO: 1803626 - RNA, 16 nt, Human
acagcacccucuccag

SEQ ID NO: 1803627 - RNA, 14 nt, Human
uauuaaguauuuua

SEQ ID NO: 1803628 - RNA, 10 nt, Human
uagccagagg

SEQ ID NO: 1803629 - RNA, 13 nt, Human
ggagaaaugaaaa

SEQ ID NO: 1803630 - RNA, 20 nt, Human
cuagagccaguuacuuugug

SEQ ID NO: 1803631 - RNA, 19 nt, Human
uucucaauuucuacaaaau

SEQ ID NO: 1803632 - RNA, 18 nt, Human
gacuuuaucaugugucuu

SEQ ID NO: 1803633 - RNA, 21 nt, Human
uucuggacuguuuuuaaaaaa

SEQ ID NO: 1803634 - RNA, 15 nt, Human
gaccuuccagaaaua

SEQ ID NO: 1803635 - RNA, 20 nt, Human
agaggagaaacuggaacucu

SEQ ID NO: 1803636 - RNA, 14 nt, Human
uuccugagccagug

SEQ ID NO: 1803637 - RNA, 18 nt, Human
uuuuaacaccuuuuacuc

SEQ ID NO: 1803638 - RNA, 22 nt, Human
gggcagccagaccagcaggcug

SEQ ID NO: 1803639 - RNA, 17 nt, Human
gccaugugcagccacca

SEQ ID NO: 1803640 - RNA, 15 nt, Human
agugcuuuuuguguc

SEQ ID NO: 1803641 - RNA, 19 nt, Human
acucacugugggaaggaga

SEQ ID NO: 1803642 - RNA, 12 nt, Human
cuagccugccuc

SEQ ID NO: 1803643 - RNA, 15 nt, Human
ucuuccacagugccu

SEQ ID NO: 1803644 - RNA, 11 nt, Human
uucacagggga

SEQ ID NO: 1803645 - RNA, 19 nt, Human
caaccaaagacuacauauu

SEQ ID NO: 1803646 - RNA, 23 nt, Human
agcccuccuuaucaaaggacacc

SEQ ID NO: 1803647 - RNA, 23 nt, Human
guuaggaggguuucauugucugu

SEQ ID NO: 1803648 - RNA, 17 nt, Human
gcaauuaauuccuucag

SEQ ID NO: 1803649 - RNA, 19 nt, Human
agauaugggacauuuuuga

SEQ ID NO: 1803650 - RNA, 17 nt, Human
gccugccuuucuccccc

SEQ ID NO: 1803651 - RNA, 20 nt, Human
agcccaucauaauauaaaac

SEQ ID NO: 1803652 - RNA, 16 nt, Human
cacugggagaaaugaa

SEQ ID NO: 1803653 - RNA, 18 nt, Human
uuaaauaaauuguauauu

SEQ ID NO: 1803654 - RNA, 17 nt, Human
aaacauccuacaagaca

SEQ ID NO: 1803655 - RNA, 12 nt, Human
cuucaacucccu

SEQ ID NO: 1803656 - RNA, 15 nt, Human
ugaaacccugucucu

SEQ ID NO: 1803657 - RNA, 21 nt, Human
cacauucagggcuauuuuuuc

SEQ ID NO: 1803658 - RNA, 19 nt, Human
gaugagggaaaagaaaaag

SEQ ID NO: 1803659 - RNA, 16 nt, Human
uauuauccccauuucu

SEQ ID NO: 1803660 - RNA, 13 nt, Human
cgugauccacccg

SEQ ID NO: 1803661 - RNA, 17 nt, Human
gggagugggcuaagcac

SEQ ID NO: 1803662 - RNA, 18 nt, Human
cccugucucuacaaaaaa

SEQ ID NO: 1803663 - RNA, 23 nt, Human
uuucccccuagccugccuccccu

SEQ ID NO: 1803664 - RNA, 19 nt, Human
ccccaacagcacccucucc

SEQ ID NO: 1803665 - RNA, 18 nt, Human
gguaagcaccaggacgcc

SEQ ID NO: 1803666 - RNA, 15 nt, Human
gccagugucaggagg

SEQ ID NO: 1803667 - RNA, 22 nt, Human
aaccuuuuuggacacacaaauu

SEQ ID NO: 1803668 - RNA, 18 nt, Human
acuacugaggaucagagu

SEQ ID NO: 1803669 - RNA, 20 nt, Human
ucaugaaccucaagcugcau

SEQ ID NO: 1803670 - RNA, 23 nt, Human
auuuuauagcuacuaauuuuaaa

SEQ ID NO: 1803671 - RNA, 16 nt, Human
ucccccacaaacccaa

SEQ ID NO: 1803672 - RNA, 20 nt, Human
auauguuagagaauuuccuu

SEQ ID NO: 1803673 - RNA, 21 nt, Human
aacugauuuaucuauuuaaau

SEQ ID NO: 1803674 - RNA, 12 nt, Human
gaacucaauaaa

SEQ ID NO: 1803675 - RNA, 19 nt, Human
uaucuauguagaauauauu

SEQ ID NO: 1803676 - RNA, 16 nt, Human
ucuaauguacaauaaa

SEQ ID NO: 1803677 - RNA, 13 nt, Human
gccucagccuccc

SEQ ID NO: 1803678 - RNA, 15 nt, Human
caaacaaacaaaaaa

SEQ ID NO: 1803679 - RNA, 19 nt, Human
agggcaagagccacaguau

SEQ ID NO: 1803680 - RNA, 20 nt, Human
agaaggugggaggaugugaa

SEQ ID NO: 1803681 - RNA, 19 nt, Human
ucauguugccuugcauaau

SEQ ID NO: 1803682 - RNA, 14 nt, Human
uacuaugcuguuau

SEQ ID NO: 1803683 - RNA, 15 nt, Human
ugaaaaccacauugg

SEQ ID NO: 1803684 - RNA, 16 nt, Human
aaacauuuucucccug

SEQ ID NO: 1803685 - RNA, 12 nt, Human
uuauuuugccaa

SEQ ID NO: 1803686 - RNA, 12 nt, Human
aguugcaacuuu

SEQ ID NO: 1803687 - RNA, 22 nt, Human
agucuuacucuguugccaggcu

SEQ ID NO: 1803688 - RNA, 23 nt, Human
ugcauagaauaaaauuuuuaauc

SEQ ID NO: 1803689 - RNA, 23 nt, Human
aagggauuuucagcccucagaau

SEQ ID NO: 1803690 - RNA, 20 nt, Human
ccagccacggggacucagcc

SEQ ID NO: 1803691 - RNA, 23 nt, Human
ucaugcccauaccccuggccaag

SEQ ID NO: 1803692 - RNA, 20 nt, Human
cauacaaaaauuccuuuucc

SEQ ID NO: 1803693 - RNA, 16 nt, Human
ggcuuugcccugcugc

SEQ ID NO: 1803694 - RNA, 21 nt, Human
acuuaccuugcaucucacagg

SEQ ID NO: 1803695 - RNA, 13 nt, Human
cagcccugcacca

SEQ ID NO: 1803696 - RNA, 21 nt, Human
gggucuguaaaaucuuucuuu

SEQ ID NO: 1803697 - RNA, 14 nt, Human
uauguuauuauuaa

SEQ ID NO: 1803698 - RNA, 15 nt, Human
ccuccuucccuugcu

SEQ ID NO: 1803699 - RNA, 16 nt, Human
auugucuagugaaacu

SEQ ID NO: 1803700 - RNA, 15 nt, Human
cacccucccacugcc

SEQ ID NO: 1803701 - RNA, 17 nt, Human
gccaguuguccuccuuc

SEQ ID NO: 1803702 - RNA, 14 nt, Human
ccagcucagggcuc

SEQ ID NO: 1803703 - RNA, 18 nt, Human
augcaaacuuuauuuugu

SEQ ID NO: 1803704 - RNA, 15 nt, Human
uuauagcuacuaauu

SEQ ID NO: 1803705 - RNA, 17 nt, Human
cuuuuuuuuuuuuuaau

SEQ ID NO: 1803706 - RNA, 13 nt, Human
augaaguuuuuuu

SEQ ID NO: 1803707 - RNA, 17 nt, Human
ggccaugggacagggag

SEQ ID NO: 1803708 - RNA, 12 nt, Human
gcugcucugucu

SEQ ID NO: 1803709 - RNA, 12 nt, Human
auuuuaaaagaa

SEQ ID NO: 1803710 - RNA, 17 nt, Human
uggcugcuuggagcagc

SEQ ID NO: 1803711 - RNA, 20 nt, Human
guagauauuaccaguuuucc

SEQ ID NO: 1803712 - RNA, 19 nt, Human
auuauuuuuuaaaaaaauu

SEQ ID NO: 1803713 - RNA, 14 nt, Human
aagugcuuucuucu

SEQ ID NO: 1803714 - RNA, 20 nt, Human
ugcucagcuucuccaacaau

SEQ ID NO: 1803715 - RNA, 13 nt, Human
uuucugaauuauu

SEQ ID NO: 1803716 - RNA, 17 nt, Human
aauuuguagauuccucu

SEQ ID NO: 1803717 - RNA, 20 nt, Human
agaaaauaaaucuaucaaaa

SEQ ID NO: 1803718 - RNA, 14 nt, Human
acuauuauauuucc

SEQ ID NO: 1803719 - RNA, 12 nt, Human
ucugccuccccu

SEQ ID NO: 1803720 - RNA, 22 nt, Human
cuuccuaauuccacagcugcuc

SEQ ID NO: 1803721 - RNA, 16 nt, Human
cuacaggcgugagcca

SEQ ID NO: 1803722 - RNA, 14 nt, Human
cauuuacuuuuaaa

SEQ ID NO: 1803723 - RNA, 15 nt, Human
uuucaugauuuugaa

SEQ ID NO: 1803724 - RNA, 20 nt, Human
uaugaaaaggcuaagcuuca

SEQ ID NO: 1803725 - RNA, 15 nt, Human
ccauucucaagcccu

SEQ ID NO: 1803726 - RNA, 14 nt, Human
acauuguauucaga

SEQ ID NO: 1803727 - RNA, 15 nt, Human
agaccaccaagccuu

SEQ ID NO: 1803728 - RNA, 17 nt, Human
uccucugcccuuccugc

SEQ ID NO: 1803729 - RNA, 15 nt, Human
gccaacuauggccug

SEQ ID NO: 1803730 - RNA, 22 nt, Human
uggccaggauggucuccaucuc

SEQ ID NO: 1803731 - RNA, 18 nt, Human
ucccuuucauuuuuucca

SEQ ID NO: 1803732 - RNA, 24 nt, Human
cuuuguuaaaauagaaugguauca

SEQ ID NO: 1803733 - RNA, 21 nt, Human
uaauguaaacaauaucagacu

SEQ ID NO: 1803734 - RNA, 21 nt, Human
cuauaguccagcuuuguucuu

SEQ ID NO: 1803735 - RNA, 12 nt, Human
cuucauuuggga

SEQ ID NO: 1803736 - RNA, 12 nt, Human
uaaacucagagg

SEQ ID NO: 1803737 - RNA, 16 nt, Human
uguacauguacugauu

SEQ ID NO: 1803738 - RNA, 16 nt, Human
guccaacccgaggccc

SEQ ID NO: 1803739 - RNA, 11 nt, Human
gguuaaugcug

SEQ ID NO: 1803740 - RNA, 13 nt, Human
acccucagaugca

SEQ ID NO: 1803741 - RNA, 18 nt, Human
auuuaaaccuauacucac

SEQ ID NO: 1803742 - RNA, 19 nt, Human
ccuagccagaggcucuaau

SEQ ID NO: 1803743 - RNA, 19 nt, Human
aaucuacacuccagugaga

SEQ ID NO: 1803744 - RNA, 21 nt, Human
cacuggacugacgacuugagu

SEQ ID NO: 1803745 - RNA, 21 nt, Human
uauucagaguugaugguugua

SEQ ID NO: 1803746 - RNA, 13 nt, Human
acagauuugcaaa

SEQ ID NO: 1803747 - RNA, 19 nt, Human
ccucagaugcacaugagcu

SEQ ID NO: 1803748 - RNA, 19 nt, Human
acugccaucauuuacuuuu

SEQ ID NO: 1803749 - RNA, 16 nt, Human
aauauguccuuuuuaa

SEQ ID NO: 1803750 - RNA, 15 nt, Human
augauuuugaaauca

SEQ ID NO: 1803751 - RNA, 20 nt, Human
caccuccuaagaaggcaccu

SEQ ID NO: 1803752 - RNA, 20 nt, Human
caaauagaauuugagcauca

SEQ ID NO: 1803753 - RNA, 16 nt, Human
cauguucuaaauaaaa

SEQ ID NO: 1803754 - RNA, 15 nt, Human
aucuuaauuauugua

SEQ ID NO: 1803755 - RNA, 17 nt, Human
gauggaacuugcugcug

SEQ ID NO: 1803756 - RNA, 16 nt, Human
uucuaauaguuuuauu

SEQ ID NO: 1803757 - RNA, 14 nt, Human
gagauguuuaguaa

SEQ ID NO: 1803758 - RNA, 16 nt, Human
aguuuguugaaacaca

SEQ ID NO: 1803759 - RNA, 20 nt, Human
cuccuguuucacuugguuca

SEQ ID NO: 1803760 - RNA, 18 nt, Human
aauaccacagcuuuuuac

SEQ ID NO: 1803761 - RNA, 18 nt, Human
aaauaaaucuaucaaaau

SEQ ID NO: 1803762 - RNA, 15 nt, Human
acagggagugcacau

SEQ ID NO: 1803763 - RNA, 18 nt, Human
ccucaagcuaugugagcu

SEQ ID NO: 1803764 - RNA, 20 nt, Human
auuuuuaggcugaaagauga

SEQ ID NO: 1803765 - RNA, 16 nt, Human
caagcaauccucccac

SEQ ID NO: 1803766 - RNA, 23 nt, Human
auuuuagauagaugaagaagcua

SEQ ID NO: 1803767 - RNA, 14 nt, Human
agaaaauaacaaua

SEQ ID NO: 1803768 - RNA, 20 nt, Human
cuccagccucagccucccaa

SEQ ID NO: 1803769 - RNA, 20 nt, Human
gcccugcucuuccucagcug

SEQ ID NO: 1803770 - RNA, 22 nt, Human
aguauccucuugccaaaucaaa

SEQ ID NO: 1803771 - RNA, 18 nt, Human
guucccggguagccacug

SEQ ID NO: 1803772 - RNA, 18 nt, Human
cuccagccucagccuccc

SEQ ID NO: 1803773 - RNA, 13 nt, Human
gucagcucuucuc

SEQ ID NO: 1803774 - RNA, 12 nt, Human
cacaugggauca

SEQ ID NO: 1803775 - RNA, 20 nt, Human
gauauauuccaccaggauau

SEQ ID NO: 1803776 - RNA, 16 nt, Human
acaaacauguuccugg

SEQ ID NO: 1803777 - RNA, 17 nt, Human
cuucucuaaacauuuca

SEQ ID NO: 1803778 - RNA, 14 nt, Human
ucuccucaacucug

SEQ ID NO: 1803779 - RNA, 13 nt, Human
aauuugugaaggu

SEQ ID NO: 1803780 - RNA, 20 nt, Human
uuaaguuuuuuuuuaaaaaa

SEQ ID NO: 1803781 - RNA, 19 nt, Human
gccugcuuuuuauggccug

SEQ ID NO: 1803782 - RNA, 14 nt, Human
cuuucuuuuuuaaa

SEQ ID NO: 1803783 - RNA, 18 nt, Human
gucuaggacacaguuccu

SEQ ID NO: 1803784 - RNA, 20 nt, Human
aaagguucaugcaaacuuua

SEQ ID NO: 1803785 - RNA, 21 nt, Human
uaaaaguuuuuuauuaugcau

SEQ ID NO: 1803786 - RNA, 20 nt, Human
gccaggcugggucgcccugg

SEQ ID NO: 1803787 - RNA, 15 nt, Human
caucucaaaaaaaaa

SEQ ID NO: 1803788 - RNA, 12 nt, Human
aaguguguguuu

SEQ ID NO: 1803789 - RNA, 13 nt, Human
ccuuaggaauaau

SEQ ID NO: 1803790 - RNA, 12 nt, Human
cugaggagcugu

SEQ ID NO: 1803791 - RNA, 15 nt, Human
cuccagaugcagccc

SEQ ID NO: 1803792 - RNA, 12 nt, Human
ccacaccucucc

SEQ ID NO: 1803793 - RNA, 16 nt, Human
uauuugaaucuugucu

SEQ ID NO: 1803794 - RNA, 17 nt, Human
ugcccugcugcccuccc

SEQ ID NO: 1803795 - RNA, 18 nt, Human
agccugcagacucacugu

SEQ ID NO: 1803796 - RNA, 21 nt, Human
uccuaccacaaugcagugccu

SEQ ID NO: 1803797 - RNA, 15 nt, Human
aaucaugcugagaga

SEQ ID NO: 1803798 - RNA, 14 nt, Human
uaugggacauuuuu

SEQ ID NO: 1803799 - RNA, 19 nt, Human
uugugccccugcacuccag

SEQ ID NO: 1803800 - RNA, 18 nt, Human
cagucucccucccuuggg

SEQ ID NO: 1803801 - RNA, 17 nt, Human
cucaauaaagugcuuug

SEQ ID NO: 1803802 - RNA, 16 nt, Human
ggagccagggcugucu

SEQ ID NO: 1803803 - RNA, 22 nt, Human
ccuugauggucccuauuccucc

SEQ ID NO: 1803804 - RNA, 13 nt, Human
acuuguuucagag

SEQ ID NO: 1803805 - RNA, 24 nt, Human
aaaggagcaagucagaauagaaau

SEQ ID NO: 1803806 - RNA, 18 nt, Human
uuguacucugaaaguuuu

SEQ ID NO: 1803807 - RNA, 22 nt, Human
agcuguguccucaugagggcug

SEQ ID NO: 1803808 - RNA, 15 nt, Human
aauuauaucaauuuc

SEQ ID NO: 1803809 - RNA, 13 nt, Human
uuuuagccuucuc

SEQ ID NO: 1803810 - RNA, 22 nt, Human
aguauugacuuguauaccuugu

SEQ ID NO: 1803811 - RNA, 13 nt, Human
uuuuaaaaaagaa

SEQ ID NO: 1803812 - RNA, 14 nt, Human
gcaucaucucagcu

SEQ ID NO: 1803813 - RNA, 15 nt, Human
uaaaguaaaggcaaa

SEQ ID NO: 1803814 - RNA, 23 nt, Human
ugcugacacagacauccucuaug

SEQ ID NO: 1803815 - RNA, 13 nt, Human
uaacguauaaaag

SEQ ID NO: 1803816 - RNA, 15 nt, Human
uccuuuuuccuucca

SEQ ID NO: 1803817 - RNA, 17 nt, Human
gcugcccccagagccac

SEQ ID NO: 1803818 - RNA, 20 nt, Human
gcuguuauuuaauuagccag

SEQ ID NO: 1803819 - RNA, 14 nt, Human
agcaauacccaugu

SEQ ID NO: 1803820 - RNA, 19 nt, Human
ucacaugauuccagccauc

SEQ ID NO: 1803821 - RNA, 23 nt, Human
uccuggaggggcuggggacuugu

SEQ ID NO: 1803822 - RNA, 21 nt, Human
cucauuucucaucuuuuuacu

SEQ ID NO: 1803823 - RNA, 14 nt, Human
ccagcuuaguucaa

SEQ ID NO: 1803824 - RNA, 15 nt, Human
ccagaucauugugaa

SEQ ID NO: 1803825 - RNA, 23 nt, Human
uuccaauuagcuccuccuuuuuc

SEQ ID NO: 1803826 - RNA, 21 nt, Human
caagaaaauaagagcucagga

SEQ ID NO: 1803827 - RNA, 18 nt, Human
acacugauguaugaggaa

SEQ ID NO: 1803828 - RNA, 19 nt, Human
aaauaaaucuaucaaaauu

SEQ ID NO: 1803829 - RNA, 19 nt, Human
cccuguuucuuccacagug

SEQ ID NO: 1803830 - RNA, 17 nt, Human
cacaaauucugucucug

SEQ ID NO: 1803831 - RNA, 16 nt, Human
ucugccuccccuucac

SEQ ID NO: 1803832 - RNA, 16 nt, Human
guauagaccuaaaaua

SEQ ID NO: 1803833 - RNA, 22 nt, Human
cucuguugagccuuccuuucug

SEQ ID NO: 1803834 - RNA, 20 nt, Human
ucagcuuucuaagaucuaac

SEQ ID NO: 1803835 - RNA, 19 nt, Human
ugagagaugacagggaaaa

SEQ ID NO: 1803836 - RNA, 16 nt, Human
acucaauaaguuuauu

SEQ ID NO: 1803837 - RNA, 23 nt, Human
ccagcagccagccaacccuuuca

SEQ ID NO: 1803838 - RNA, 20 nt, Human
cagguucaagcaauccuccc

SEQ ID NO: 1803839 - RNA, 15 nt, Human
augaauuaaguuuuu

SEQ ID NO: 1803840 - RNA, 13 nt, Human
gcaaugugguagu

SEQ ID NO: 1803841 - RNA, 15 nt, Human
uccaucaccuccccc

SEQ ID NO: 1803842 - RNA, 15 nt, Human
ugcucugucuucuuu

SEQ ID NO: 1803843 - RNA, 18 nt, Human
gcggaauugcucucccag

SEQ ID NO: 1803844 - RNA, 16 nt, Human
gauuuacgcucauugu

SEQ ID NO: 1803845 - RNA, 20 nt, Human
ucaugaagauauuuuuccau

SEQ ID NO: 1803846 - RNA, 11 nt, Human
uuccucugccc

SEQ ID NO: 1803847 - RNA, 14 nt, Human
cucagucucccucc

SEQ ID NO: 1803848 - RNA, 21 nt, Human
caguaguuagcuuucuuccug

SEQ ID NO: 1803849 - RNA, 18 nt, Human
gcaccugucccagaaaaa

SEQ ID NO: 1803850 - RNA, 15 nt, Human
uacaggcgugagcca

SEQ ID NO: 1803851 - RNA, 22 nt, Human
uaauaggcguaacuaauuuuaa

SEQ ID NO: 1803852 - RNA, 23 nt, Human
agcaguuugguuucuagcaugaa

SEQ ID NO: 1803853 - RNA, 11 nt, Human
aacccugggac

SEQ ID NO: 1803854 - RNA, 17 nt, Human
ucagacauagaauuaac

SEQ ID NO: 1803855 - RNA, 15 nt, Human
caggcuuucuuuuuu

SEQ ID NO: 1803856 - RNA, 18 nt, Human
caaacaugcacuuccuug

SEQ ID NO: 1803857 - RNA, 14 nt, Human
ccacuucagccucc

SEQ ID NO: 1803858 - RNA, 17 nt, Human
gacugugggcuccauuc

SEQ ID NO: 1803859 - RNA, 11 nt, Human
gauuaucaauu

SEQ ID NO: 1803860 - RNA, 20 nt, Human
caggaguacaccccaacagc

SEQ ID NO: 1803861 - RNA, 21 nt, Human
uguuuucuuaaccagaucauu

SEQ ID NO: 1803862 - RNA, 23 nt, Human
uucccccagugcggccagcuccg

SEQ ID NO: 1803863 - RNA, 19 nt, Human
uuuaguguucauaaauaaa

SEQ ID NO: 1803864 - RNA, 20 nt, Human
cuaauuuuuguauuuuuagu

SEQ ID NO: 1803865 - RNA, 15 nt, Human
agcuuuuaugugaaa

SEQ ID NO: 1803866 - RNA, 14 nt, Human
gucccaggcugagc

SEQ ID NO: 1803867 - RNA, 21 nt, Human
gaggcagaccugacucucuua

SEQ ID NO: 1803868 - RNA, 19 nt, Human
acuccuguucaugcccaua

SEQ ID NO: 1803869 - RNA, 15 nt, Human
aaucaugaagauauu

SEQ ID NO: 1803870 - RNA, 14 nt, Human
cugagugcaccacu

SEQ ID NO: 1803871 - RNA, 21 nt, Human
agucuguuuucccuccuugga

SEQ ID NO: 1803872 - RNA, 15 nt, Human
uuuccucauuuuuau

SEQ ID NO: 1803873 - RNA, 14 nt, Human
cuguguauucauuc

SEQ ID NO: 1803874 - RNA, 20 nt, Human
ccccuuugcugacccucccc

SEQ ID NO: 1803875 - RNA, 19 nt, Human
acucucaccccugcuauaa

SEQ ID NO: 1803876 - RNA, 23 nt, Human
cagccucccaaagugcugggauu

SEQ ID NO: 1803877 - RNA, 20 nt, Human
gcauuguuggcuguuccugc

SEQ ID NO: 1803878 - RNA, 20 nt, Human
aggcuuucuuaaagugagag

SEQ ID NO: 1803879 - RNA, 19 nt, Human
cucacugcaaccuccaccu

SEQ ID NO: 1803880 - RNA, 23 nt, Human
aggcuuacacccacaguggaaag

SEQ ID NO: 1803881 - RNA, 16 nt, Human
aagugcuuucuucucc

SEQ ID NO: 1803882 - RNA, 23 nt, Human
uauuuuauuaggaguaccauaau

SEQ ID NO: 1803883 - RNA, 19 nt, Human
cccugucuccucucucugu

SEQ ID NO: 1803884 - RNA, 17 nt, Human
ggcugggucgcccugga

SEQ ID NO: 1803885 - RNA, 18 nt, Human
ggcucuggacaggcacua

SEQ ID NO: 1803886 - RNA, 16 nt, Human
aguguaauaaaacaug

SEQ ID NO: 1803887 - RNA, 16 nt, Human
uagggaaaauucuaac

SEQ ID NO: 1803888 - RNA, 14 nt, Human
cauuuccucagacu

SEQ ID NO: 1803889 - RNA, 18 nt, Human
uaggaaauauuuuaaugu

SEQ ID NO: 1803890 - RNA, 17 nt, Human
aauuuuagcaaagauau

SEQ ID NO: 1803891 - RNA, 17 nt, Human
aguccugcaagcagagg

SEQ ID NO: 1803892 - RNA, 15 nt, Human
ugagcucaccagucc

SEQ ID NO: 1803893 - RNA, 15 nt, Human
cagauuugcaaaguu

SEQ ID NO: 1803894 - RNA, 19 nt, Human
uggguaguggggaagaggg

SEQ ID NO: 1803895 - RNA, 10 nt, Human
gcuccuccuu

SEQ ID NO: 1803896 - RNA, 16 nt, Human
ccuggcugauuuuugu

SEQ ID NO: 1803897 - RNA, 15 nt, Human
ucucauccugcaggc

SEQ ID NO: 1803898 - RNA, 13 nt, Human
aucuggcucugga

SEQ ID NO: 1803899 - RNA, 20 nt, Human
ucaggaggaaggcuuacacc

SEQ ID NO: 1803900 - RNA, 14 nt, Human
uagaaaaaaguaaa

SEQ ID NO: 1803901 - RNA, 16 nt, Human
gauucuuccaucugau

SEQ ID NO: 1803902 - RNA, 21 nt, Human
auuauauuuccaagaaauauu

SEQ ID NO: 1803903 - RNA, 12 nt, Human
acacuuaaaaau

SEQ ID NO: 1803904 - RNA, 19 nt, Human
uuacugucuuuuuucuaaa

SEQ ID NO: 1803905 - RNA, 15 nt, Human
cccagccugcucccu

SEQ ID NO: 1803906 - RNA, 23 nt, Human
auuaagacuuuauguaguuuuua

SEQ ID NO: 1803907 - RNA, 17 nt, Human
uauguguguuuuaaaau

SEQ ID NO: 1803908 - RNA, 18 nt, Human
gauacugugcccagagcc

SEQ ID NO: 1803909 - RNA, 18 nt, Human
agcucagggcucuuuccu

SEQ ID NO: 1803910 - RNA, 23 nt, Human
guuuuuuuuuuuuuugagacaga

SEQ ID NO: 1803911 - RNA, 15 nt, Human
uucccuugagcccuc

SEQ ID NO: 1803912 - RNA, 16 nt, Human
uacccaguagaugcca

SEQ ID NO: 1803913 - RNA, 19 nt, Human
acucucuuauugccucacu

SEQ ID NO: 1803914 - RNA, 14 nt, Human
ucuaaguguuucau

SEQ ID NO: 1803915 - RNA, 15 nt, Human
caaauccaaugaaau

SEQ ID NO: 1803916 - RNA, 17 nt, Human
ugcccaguuagccucug

SEQ ID NO: 1803917 - RNA, 17 nt, Human
ucucuggccuucggccu

SEQ ID NO: 1803918 - RNA, 18 nt, Human
cagugaccaaccuuuucc

SEQ ID NO: 1803919 - RNA, 16 nt, Human
uauccuacuuccccuu

SEQ ID NO: 1803920 - RNA, 16 nt, Human
guauacaaaacccuuu

SEQ ID NO: 1803921 - RNA, 20 nt, Human
caaacauguuccugggauca

SEQ ID NO: 1803922 - RNA, 21 nt, Human
uucaccauguuagccaggcug

SEQ ID NO: 1803923 - RNA, 14 nt, Human
uuuuuccauuuuuu

SEQ ID NO: 1803924 - RNA, 19 nt, Human
cacucugagucccagagcc

SEQ ID NO: 1803925 - RNA, 23 nt, Human
cccuguccaaacugccuaagccc

SEQ ID NO: 1803926 - RNA, 20 nt, Human
cuuuuaggacccuucccuug

SEQ ID NO: 1803927 - RNA, 22 nt, Human
gagagaugacagggaaaacugc

SEQ ID NO: 1803928 - RNA, 22 nt, Human
ugggucuaccacucagagaaac

SEQ ID NO: 1803929 - RNA, 15 nt, Human
guuuauaaacauugu

SEQ ID NO: 1803930 - RNA, 17 nt, Human
cucauuuuuucuucucc

SEQ ID NO: 1803931 - RNA, 21 nt, Human
ggaaaggaccaguaugcuugg

SEQ ID NO: 1803932 - RNA, 17 nt, Human
uccuuuucauugccaug

SEQ ID NO: 1803933 - RNA, 21 nt, Human
cucauauccaguauuguuccu

SEQ ID NO: 1803934 - RNA, 13 nt, Human
cauuccccuugcc

SEQ ID NO: 1803935 - RNA, 16 nt, Human
ugucauacagauuugc

SEQ ID NO: 1803936 - RNA, 20 nt, Human
gcagccugcagacucacugu

SEQ ID NO: 1803937 - RNA, 17 nt, Human
ucuauguagaauauauu

SEQ ID NO: 1803938 - RNA, 22 nt, Human
gaacuccugaccccaaguuauc

SEQ ID NO: 1803939 - RNA, 20 nt, Human
uaaaaugucuauuuuuaaug

SEQ ID NO: 1803940 - RNA, 15 nt, Human
uaaguuuauuucuua

SEQ ID NO: 1803941 - RNA, 14 nt, Human
cagggagguggcug

SEQ ID NO: 1803942 - RNA, 13 nt, Human
aaaauaacaauga

SEQ ID NO: 1803943 - RNA, 14 nt, Human
aagcaacccaaaug

SEQ ID NO: 1803944 - RNA, 11 nt, Human
ccaauuuuugg

SEQ ID NO: 1803945 - RNA, 20 nt, Human
uggccucugcucaacuagca

SEQ ID NO: 1803946 - RNA, 16 nt, Human
caugggagacacugau

SEQ ID NO: 1803947 - RNA, 16 nt, Human
aauauguaaaauuaca

SEQ ID NO: 1803948 - RNA, 15 nt, Human
accaaccuuuuccca

SEQ ID NO: 1803949 - RNA, 21 nt, Human
gaaauguuuacagauccccaa

SEQ ID NO: 1803950 - RNA, 20 nt, Human
uuuuugggagagacuuguuu

SEQ ID NO: 1803951 - RNA, 16 nt, Human
ucacauuuucccuucc

SEQ ID NO: 1803952 - RNA, 19 nt, Human
uuacuuuccccuugguucu

SEQ ID NO: 1803953 - RNA, 17 nt, Human
uccccuucacucccacc

SEQ ID NO: 1803954 - RNA, 19 nt, Human
cauucuuccugauuauuuu

SEQ ID NO: 1803955 - RNA, 21 nt, Human
ucuuaggguuaugauuaagua

SEQ ID NO: 1803956 - RNA, 14 nt, Human
cuggaaaucagggu

SEQ ID NO: 1803957 - RNA, 16 nt, Human
uccucugugucuucaa

SEQ ID NO: 1803958 - RNA, 20 nt, Human
cacgccuggcuaauuuuugu

SEQ ID NO: 1803959 - RNA, 22 nt, Human
cauagaauaaaauuuuuaaucu

SEQ ID NO: 1803960 - RNA, 13 nt, Human
ggccaugggaggc

SEQ ID NO: 1803961 - RNA, 18 nt, Human
uauacucacuuucuagau

SEQ ID NO: 1803962 - RNA, 23 nt, Human
ccaguagaugccacuagcccucc

SEQ ID NO: 1803963 - RNA, 23 nt, Human
gaguauauugauccagaaagaaa

SEQ ID NO: 1803964 - RNA, 19 nt, Human
cucugccucagaaaacaag

SEQ ID NO: 1803965 - RNA, 23 nt, Human
agggaaaagaaaaagauugagag

SEQ ID NO: 1803966 - RNA, 16 nt, Human
uaccacucagagaaac

SEQ ID NO: 1803967 - RNA, 22 nt, Human
agcccugucuccucucucugua

SEQ ID NO: 1803968 - RNA, 21 nt, Human
uuuucaggcuagauguaugua

SEQ ID NO: 1803969 - RNA, 19 nt, Human
ccacuucaagugaccacca

SEQ ID NO: 1803970 - RNA, 22 nt, Human
agcccuccuuaucaaaggacac

SEQ ID NO: 1803971 - RNA, 15 nt, Human
uauugccucugagag

SEQ ID NO: 1803972 - RNA, 14 nt, Human
ccaggcaccaggac

SEQ ID NO: 1803973 - RNA, 22 nt, Human
cagccucccaaagugcugggau

SEQ ID NO: 1803974 - RNA, 21 nt, Human
augcuuaaggccaugauuuua

SEQ ID NO: 1803975 - RNA, 19 nt, Human
agccugaucaccugcccug

SEQ ID NO: 1803976 - RNA, 23 nt, Human
gcauuguuggcuguuccugcagu

SEQ ID NO: 1803977 - RNA, 20 nt, Human
cacccauuagcagucccucc

SEQ ID NO: 1803978 - RNA, 14 nt, Human
aauaguuuaugauu

SEQ ID NO: 1803979 - RNA, 19 nt, Human
cuggggaagacaguggccc

SEQ ID NO: 1803980 - RNA, 16 nt, Human
agucaacuccuuucuc

SEQ ID NO: 1803981 - RNA, 19 nt, Human
gaagaacucucuggaagcc

SEQ ID NO: 1803982 - RNA, 18 nt, Human
cucaauaagccucagcuu

SEQ ID NO: 1803983 - RNA, 20 nt, Human
uccaaacguuaagaauuguu

SEQ ID NO: 1803984 - RNA, 12 nt, Human
caugcuuuuuaa

SEQ ID NO: 1803985 - RNA, 21 nt, Human
uauacugugugcuaaaacaag

SEQ ID NO: 1803986 - RNA, 13 nt, Human
auaacuggaaacu

SEQ ID NO: 1803987 - RNA, 15 nt, Human
ucugagaagcucuga

SEQ ID NO: 1803988 - RNA, 14 nt, Human
agaucauugugaaa

SEQ ID NO: 1803989 - RNA, 23 nt, Human
ggccuccauccugaggcuccacu

SEQ ID NO: 1803990 - RNA, 14 nt, Human
gcccugcugcccuc

SEQ ID NO: 1803991 - RNA, 22 nt, Human
acuuggguaucuucuuuuguga

SEQ ID NO: 1803992 - RNA, 21 nt, Human
cuucauguaacuucccugaaa

SEQ ID NO: 1803993 - RNA, 14 nt, Human
accacauccagccu

SEQ ID NO: 1803994 - RNA, 16 nt, Human
acggauuuauuuuucc

SEQ ID NO: 1803995 - RNA, 18 nt, Human
uuuguauuuuguuuaaau

SEQ ID NO: 1803996 - RNA, 12 nt, Human
aacucucuuauu

SEQ ID NO: 1803997 - RNA, 21 nt, Human
ccaaauauaaauaaaaauaau

SEQ ID NO: 1803998 - RNA, 14 nt, Human
cugggcugugggca

SEQ ID NO: 1803999 - RNA, 15 nt, Human
acugcucacacugcu

SEQ ID NO: 1804000 - RNA, 19 nt, Human
aaccugaaauuaacucaga

SEQ ID NO: 1804001 - RNA, 22 nt, Human
gugauuuuauuagaaguuucau

SEQ ID NO: 1804002 - RNA, 16 nt, Human
cacccucuccagauga

SEQ ID NO: 1804003 - RNA, 15 nt, Human
agggaagacaagaag

SEQ ID NO: 1804004 - RNA, 16 nt, Human
uuuuaaaccauuuucu

SEQ ID NO: 1804005 - RNA, 13 nt, Human
gcucccuagccag

SEQ ID NO: 1804006 - RNA, 13 nt, Human
ucuauuuaaauau

SEQ ID NO: 1804007 - RNA, 19 nt, Human
accaagacuacuagggaaa

SEQ ID NO: 1804008 - RNA, 19 nt, Human
auucccagccagcacagcc

SEQ ID NO: 1804009 - RNA, 14 nt, Human
gauccagaaagaaa

SEQ ID NO: 1804010 - RNA, 14 nt, Human
aaaacuauuaacaa

SEQ ID NO: 1804011 - RNA, 18 nt, Human
acccacuugcuuuuaaaa

SEQ ID NO: 1804012 - RNA, 16 nt, Human
cugucggagcccuguc

SEQ ID NO: 1804013 - RNA, 20 nt, Human
uccaagccucauguccacug

SEQ ID NO: 1804014 - RNA, 15 nt, Human
ggcagcuuuuucucu

SEQ ID NO: 1804015 - RNA, 14 nt, Human
cggggugggguggg

SEQ ID NO: 1804016 - RNA, 21 nt, Human
cuucuccuacuguagcaaccu

SEQ ID NO: 1804017 - RNA, 13 nt, Human
ugagacagagucu

SEQ ID NO: 1804018 - RNA, 16 nt, Human
uccagccugcugccug

SEQ ID NO: 1804019 - RNA, 14 nt, Human
aaguucaauauaag

SEQ ID NO: 1804020 - RNA, 12 nt, Human
cagugaaagaaa

SEQ ID NO: 1804021 - RNA, 20 nt, Human
cuuugaaugcggcccaacgc

SEQ ID NO: 1804022 - RNA, 13 nt, Human
gaagcagccaagu

SEQ ID NO: 1804023 - RNA, 17 nt, Human
agaaauaucuucacuug

SEQ ID NO: 1804024 - RNA, 22 nt, Human
ccuguaaucccagcaugcugag

SEQ ID NO: 1804025 - RNA, 17 nt, Human
agguccacaacacacag

SEQ ID NO: 1804026 - RNA, 22 nt, Human
acaaaggcuuauuaauuugacu

SEQ ID NO: 1804027 - RNA, 20 nt, Human
caggacccuguccaaucuuu

SEQ ID NO: 1804028 - RNA, 12 nt, Human
auggcaguggga

SEQ ID NO: 1804029 - RNA, 18 nt, Human
uaaauugacacuuaaaaa

SEQ ID NO: 1804030 - RNA, 17 nt, Human
gccaugggacagggagg

SEQ ID NO: 1804031 - RNA, 18 nt, Human
agcucuaauuauuaagau

SEQ ID NO: 1804032 - RNA, 20 nt, Human
ucucacaugauuccagccau

SEQ ID NO: 1804033 - RNA, 16 nt, Human
ucuuuuuucuaaagua

SEQ ID NO: 1804034 - RNA, 24 nt, Human
auuuuagcaaagauaucucaucuc

SEQ ID NO: 1804035 - RNA, 15 nt, Human
cuagacaguucuuug

SEQ ID NO: 1804036 - RNA, 15 nt, Human
ccauugucucagagc

SEQ ID NO: 1804037 - RNA, 12 nt, Human
guagacacacau

SEQ ID NO: 1804038 - RNA, 16 nt, Human
uuucacuaucuguaau

SEQ ID NO: 1804039 - RNA, 15 nt, Human
uuaaguauuuuauua

SEQ ID NO: 1804040 - RNA, 16 nt, Human
gcucauuguagaaaag

SEQ ID NO: 1804041 - RNA, 14 nt, Human
cuuccacagugccu

SEQ ID NO: 1804042 - RNA, 17 nt, Human
cucagcuguguggguca

SEQ ID NO: 1804043 - RNA, 22 nt, Human
acuccauguuggcuagccucug

SEQ ID NO: 1804044 - RNA, 12 nt, Human
ccuucccuugcu

SEQ ID NO: 1804045 - RNA, 22 nt, Human
ugugguacaagcauucugucuu

SEQ ID NO: 1804046 - RNA, 13 nt, Human
guguuaacuugcu

SEQ ID NO: 1804047 - RNA, 18 nt, Human
cauucuuauuucaugaaa

SEQ ID NO: 1804048 - RNA, 19 nt, Human
ugaacaaauuuacagagac

SEQ ID NO: 1804049 - RNA, 17 nt, Human
accuaguccccagccug

SEQ ID NO: 1804050 - RNA, 13 nt, Human
uauuuuuuuucuu

SEQ ID NO: 1804051 - RNA, 16 nt, Human
caauaacgauaaaaga

SEQ ID NO: 1804052 - RNA, 16 nt, Human
gugucccauuccccca

SEQ ID NO: 1804053 - RNA, 13 nt, Human
ugcacaaaccaau

SEQ ID NO: 1804054 - RNA, 17 nt, Human
uuuauccuaucucucca

SEQ ID NO: 1804055 - RNA, 18 nt, Human
auguuagagaauuuccuu

SEQ ID NO: 1804056 - RNA, 22 nt, Human
auucuccugccucagccucccg

SEQ ID NO: 1804057 - RNA, 15 nt, Human
cuuccaacucaucca

SEQ ID NO: 1804058 - RNA, 19 nt, Human
uggugaacuugguuuuaau

SEQ ID NO: 1804059 - RNA, 22 nt, Human
uugaaaaucuuauaauuuaaaa

SEQ ID NO: 1804060 - RNA, 19 nt, Human
agauuugugugcaucaggc

SEQ ID NO: 1804061 - RNA, 14 nt, Human
ccuagccagaggcu

SEQ ID NO: 1804062 - RNA, 17 nt, Human
ccacuucaccaauaagu

SEQ ID NO: 1804063 - RNA, 20 nt, Human
gguggcaggaaaauggacau

SEQ ID NO: 1804064 - RNA, 14 nt, Human
uggcuuuuggcucc

SEQ ID NO: 1804065 - RNA, 14 nt, Human
aaaucuauuuugua

SEQ ID NO: 1804066 - RNA, 18 nt, Human
ugccucuguauuuaaaaa

SEQ ID NO: 1804067 - RNA, 19 nt, Human
ugagucccaggcugagccu

SEQ ID NO: 1804068 - RNA, 18 nt, Human
cuagaauuucuuuaacuu

SEQ ID NO: 1804069 - RNA, 14 nt, Human
acaauaauuuucua

SEQ ID NO: 1804070 - RNA, 17 nt, Human
guucacagaucuuucug

SEQ ID NO: 1804071 - RNA, 12 nt, Human
cucucuucuuuu

SEQ ID NO: 1804072 - RNA, 23 nt, Human
acgcucauuguagaaaagcuaua

SEQ ID NO: 1804073 - RNA, 15 nt, Human
caagcccuuuacuug

SEQ ID NO: 1804074 - RNA, 19 nt, Human
agcagccagccaacccuuu

SEQ ID NO: 1804075 - RNA, 15 nt, Human
caaggaaaaaauaac

SEQ ID NO: 1804076 - RNA, 22 nt, Human
ggcugggucgcccuggacugug

SEQ ID NO: 1804077 - RNA, 19 nt, Human
cucugcaaacugccuucuu

SEQ ID NO: 1804078 - RNA, 16 nt, Human
ccgccauucucaagcc

SEQ ID NO: 1804079 - RNA, 17 nt, Human
cagaacuuaaggaugga

SEQ ID NO: 1804080 - RNA, 16 nt, Human
ggaugccccguccccc

SEQ ID NO: 1804081 - RNA, 12 nt, Human
ggaggcugagau

SEQ ID NO: 1804082 - RNA, 12 nt, Human
uauuaucuuuuc

SEQ ID NO: 1804083 - RNA, 23 nt, Human
uacagcucagaaguuucuucuuu

SEQ ID NO: 1804084 - RNA, 17 nt, Human
guagaaugggggcagca

SEQ ID NO: 1804085 - RNA, 23 nt, Human
ugacggaagaguugagaccuaac

SEQ ID NO: 1804086 - RNA, 20 nt, Human
ugugauuuacgcucauugua

SEQ ID NO: 1804087 - RNA, 17 nt, Human
uuacauuuccuaaauau

SEQ ID NO: 1804088 - RNA, 22 nt, Human
ugucucuacuaaaaauacaaaa

SEQ ID NO: 1804089 - RNA, 22 nt, Human
cuccuaggaaaauacuauucug

SEQ ID NO: 1804090 - RNA, 23 nt, Human
ucugaauauguccuuuuuaaugu

SEQ ID NO: 1804091 - RNA, 15 nt, Human
acaauaauucuauga

SEQ ID NO: 1804092 - RNA, 16 nt, Human
gccucugagaagcucu

SEQ ID NO: 1804093 - RNA, 14 nt, Human
acccaguagaugcc

SEQ ID NO: 1804094 - RNA, 16 nt, Human
uuggcaguguagggag

SEQ ID NO: 1804095 - RNA, 16 nt, Human
uaauuauuaagauaug

SEQ ID NO: 1804096 - RNA, 23 nt, Human
caaauuuagauuugugugcauca

SEQ ID NO: 1804097 - RNA, 17 nt, Human
uacauuuuaaacacauu

SEQ ID NO: 1804098 - RNA, 15 nt, Human
gccuuccuuucuguu

SEQ ID NO: 1804099 - RNA, 22 nt, Human
ucccuccacauuucccccuagc

SEQ ID NO: 1804100 - RNA, 22 nt, Human
aauccacuuuaucuugaauaau

SEQ ID NO: 1804101 - RNA, 21 nt, Human
gccugaucaccugcccugcug

SEQ ID NO: 1804102 - RNA, 22 nt, Human
gaaauugagcuggaccucacca

SEQ ID NO: 1804103 - RNA, 22 nt, Human
uaagcgcuagaggaagcagcca

SEQ ID NO: 1804104 - RNA, 23 nt, Human
ugugucugagagauucaugcuga

SEQ ID NO: 1804105 - RNA, 17 nt, Human
ugugucccauuccccca

SEQ ID NO: 1804106 - RNA, 12 nt, Human
ugcuauguuuug

SEQ ID NO: 1804107 - RNA, 14 nt, Human
ggccacaucugagc

SEQ ID NO: 1804108 - RNA, 13 nt, Human
auaacgauaaaag

SEQ ID NO: 1804109 - RNA, 14 nt, Human
caucugccuccccu

SEQ ID NO: 1804110 - RNA, 13 nt, Human
caguuauuauauu

SEQ ID NO: 1804111 - RNA, 20 nt, Human
auauaucaaauauauucagc

SEQ ID NO: 1804112 - RNA, 21 nt, Human
caccaugcccggcuaauuuuu

SEQ ID NO: 1804113 - RNA, 15 nt, Human
uaccaagauauaccu

SEQ ID NO: 1804114 - RNA, 16 nt, Human
gcaauccaagcaggaa

SEQ ID NO: 1804115 - RNA, 16 nt, Human
ucagcagagaaguuuu

SEQ ID NO: 1804116 - RNA, 17 nt, Human
uuaaacacauuaggaaa

SEQ ID NO: 1804117 - RNA, 14 nt, Human
acacugaagaagca

SEQ ID NO: 1804118 - RNA, 20 nt, Human
uagaaaagcuauaaaaugaa

SEQ ID NO: 1804119 - RNA, 17 nt, Human
cucugcaaacugccuuc

SEQ ID NO: 1804120 - RNA, 18 nt, Human
auuauuucacuuuagaaa

SEQ ID NO: 1804121 - RNA, 23 nt, Human
aaaucucaaacuucuauuuuuau

SEQ ID NO: 1804122 - RNA, 19 nt, Human
ccauccugccccugagccc

SEQ ID NO: 1804123 - RNA, 17 nt, Human
cagugggggcagagcca

SEQ ID NO: 1804124 - RNA, 19 nt, Human
auccacguccugucuguuu

SEQ ID NO: 1804125 - RNA, 15 nt, Human
uccccuggguucaca

SEQ ID NO: 1804126 - RNA, 13 nt, Human
gccauauaauuca

SEQ ID NO: 1804127 - RNA, 14 nt, Human
acauuaggaaaagu

SEQ ID NO: 1804128 - RNA, 16 nt, Human
ugcaaccucugccucc

SEQ ID NO: 1804129 - RNA, 16 nt, Human
gccucagucucccucc

SEQ ID NO: 1804130 - RNA, 13 nt, Human
gcagagccaggac

SEQ ID NO: 1804131 - RNA, 22 nt, Human
uuuuacauuuccuaaauauauu

SEQ ID NO: 1804132 - RNA, 18 nt, Human
gaugcaguucugaagaag

SEQ ID NO: 1804133 - RNA, 19 nt, Human
aauauuuuuucuuuucuau

SEQ ID NO: 1804134 - RNA, 22 nt, Human
gucuaaaaaaggaauccucugu

SEQ ID NO: 1804135 - RNA, 19 nt, Human
uauuaccuguuaguauuau

SEQ ID NO: 1804136 - RNA, 13 nt, Human
ccugcuuuucccc

SEQ ID NO: 1804137 - RNA, 21 nt, Human
cuccagggagucucagcuuca

SEQ ID NO: 1804138 - RNA, 19 nt, Human
gaguacaccccaacagcac

SEQ ID NO: 1804139 - RNA, 19 nt, Human
aaugagcacgcauggaaaa

SEQ ID NO: 1804140 - RNA, 21 nt, Human
uacauauugucacugacacac

SEQ ID NO: 1804141 - RNA, 13 nt, Human
cugcucagggcug

SEQ ID NO: 1804142 - RNA, 23 nt, Human
aauauugcaaggcaaagacuauu

SEQ ID NO: 1804143 - RNA, 15 nt, Human
aucacaauaauuuuc

SEQ ID NO: 1804144 - RNA, 22 nt, Human
cugcugacacagacauccucua

SEQ ID NO: 1804145 - RNA, 13 nt, Human
cuaucgcaccacu

SEQ ID NO: 1804146 - RNA, 16 nt, Human
ccaggauauccucccu

SEQ ID NO: 1804147 - RNA, 16 nt, Human
uccucacaccaggcuu

SEQ ID NO: 1804148 - RNA, 14 nt, Human
ugaacuuuuuauug

SEQ ID NO: 1804149 - RNA, 16 nt, Human
caggaagcugugagag

SEQ ID NO: 1804150 - RNA, 13 nt, Human
aggaauccucugu

SEQ ID NO: 1804151 - RNA, 13 nt, Human
guucucuccacca

SEQ ID NO: 1804152 - RNA, 23 nt, Human
auucagggcuauuuuuuccccca

SEQ ID NO: 1804153 - RNA, 14 nt, Human
ccgcuuaagcuuuc

SEQ ID NO: 1804154 - RNA, 22 nt, Human
gccucagccucccaaagugcug

SEQ ID NO: 1804155 - RNA, 15 nt, Human
cagaauucauucacu

SEQ ID NO: 1804156 - RNA, 10 nt, Human
uggcagugua

SEQ ID NO: 1804157 - RNA, 22 nt, Human
agggcuggucuuuuaggacccu

SEQ ID NO: 1804158 - RNA, 20 nt, Human
auuagcuccuccuuuuuccu

SEQ ID NO: 1804159 - RNA, 13 nt, Human
cagcacccucucc

SEQ ID NO: 1804160 - RNA, 20 nt, Human
cacacucuguccagccccgu

SEQ ID NO: 1804161 - RNA, 15 nt, Human
aaaauaacaaugaaa

SEQ ID NO: 1804162 - RNA, 15 nt, Human
uguagcuacaggaca

SEQ ID NO: 1804163 - RNA, 15 nt, Human
cugccuuucuccccc

SEQ ID NO: 1804164 - RNA, 15 nt, Human
agcucacugcaaccu

SEQ ID NO: 1804165 - RNA, 17 nt, Human
cguaaucguguccccua

SEQ ID NO: 1804166 - RNA, 14 nt, Human
gaaaaaauaacaau

SEQ ID NO: 1804167 - RNA, 19 nt, Human
acacaguuccugggaacau

SEQ ID NO: 1804168 - RNA, 14 nt, Human
uuaauauauauuau

SEQ ID NO: 1804169 - RNA, 15 nt, Human
uuagugaaauauuau

SEQ ID NO: 1804170 - RNA, 14 nt, Human
cccauucccucucc

SEQ ID NO: 1804171 - RNA, 18 nt, Human
cccaggcugagccucagu

SEQ ID NO: 1804172 - RNA, 18 nt, Human
ccaaccuucugaggagcu

SEQ ID NO: 1804173 - RNA, 19 nt, Human
uucauaaagucuugccuug

SEQ ID NO: 1804174 - RNA, 20 nt, Human
cauacauuuucuaagaaaca

SEQ ID NO: 1804175 - RNA, 21 nt, Human
caggauauccucccuccagau

SEQ ID NO: 1804176 - RNA, 21 nt, Human
aauauauuuccuuauucagaa

SEQ ID NO: 1804177 - RNA, 14 nt, Human
ccccacgccacagc

SEQ ID NO: 1804178 - RNA, 12 nt, Human
uugaauuuccau

SEQ ID NO: 1804179 - RNA, 20 nt, Human
ugcucagugggggcagagcc

SEQ ID NO: 1804180 - RNA, 19 nt, Human
auuguuaaaggcuaugauu

SEQ ID NO: 1804181 - RNA, 18 nt, Human
gagagagcuggaggcacc

SEQ ID NO: 1804182 - RNA, 19 nt, Human
cuugagccaggaggccugc

SEQ ID NO: 1804183 - RNA, 14 nt, Human
caauuaccacacca

SEQ ID NO: 1804184 - RNA, 17 nt, Human
ccaaaaaucucaauauu

SEQ ID NO: 1804185 - RNA, 20 nt, Human
ccuauacucacuuucccaaa

SEQ ID NO: 1804186 - RNA, 18 nt, Human
agaggcucuaauguacaa

SEQ ID NO: 1804187 - RNA, 13 nt, Human
uauuguuuuucuu

SEQ ID NO: 1804188 - RNA, 16 nt, Human
cuagaacucccuuuca

SEQ ID NO: 1804189 - RNA, 17 nt, Human
uguuguguuuuuaacau

SEQ ID NO: 1804190 - RNA, 19 nt, Human
aaucauucauuuucugggu

SEQ ID NO: 1804191 - RNA, 18 nt, Human
uccaggcuggcgugcagc

SEQ ID NO: 1804192 - RNA, 23 nt, Human
gaaucccucuaucucuaaagaaa

SEQ ID NO: 1804193 - RNA, 15 nt, Human
aaaaaagaaacauuu

SEQ ID NO: 1804194 - RNA, 14 nt, Human
aucugagagaugac

SEQ ID NO: 1804195 - RNA, 24 nt, Human
agagucuuccucugucuccuaagc

SEQ ID NO: 1804196 - RNA, 20 nt, Human
ccuauuagaguauuuuccac

SEQ ID NO: 1804197 - RNA, 17 nt, Human
gcucccuagccagaggc

SEQ ID NO: 1804198 - RNA, 12 nt, Human
accaccacgccu

SEQ ID NO: 1804199 - RNA, 22 nt, Human
uggcauuacaggugugagccac

SEQ ID NO: 1804200 - RNA, 22 nt, Human
uaggagagguugucuguggcca

SEQ ID NO: 1804201 - RNA, 16 nt, Human
cuucaacucccugccc

SEQ ID NO: 1804202 - RNA, 22 nt, Human
ccucuaugguguggcaaagccu

SEQ ID NO: 1804203 - RNA, 16 nt, Human
guccugcaagcagagg

SEQ ID NO: 1804204 - RNA, 17 nt, Human
uggccccugccuuccca

SEQ ID NO: 1804205 - RNA, 21 nt, Human
caaaagagucuuaauauauau

SEQ ID NO: 1804206 - RNA, 15 nt, Human
uccugaccucaggca

SEQ ID NO: 1804207 - RNA, 18 nt, Human
aaaucuuauaauuuaaaa

SEQ ID NO: 1804208 - RNA, 18 nt, Human
gcauauuuauaaaaauaa

SEQ ID NO: 1804209 - RNA, 21 nt, Human
ugugccuuguuucaacaguuu

SEQ ID NO: 1804210 - RNA, 17 nt, Human
uuuuaaaaauuaaauca

SEQ ID NO: 1804211 - RNA, 19 nt, Human
agcacccucuccagaugag

SEQ ID NO: 1804212 - RNA, 13 nt, Human
aaauauaucugcu

SEQ ID NO: 1804213 - RNA, 20 nt, Human
agcgauucuccugccucagc

SEQ ID NO: 1804214 - RNA, 19 nt, Human
caaggaugccccguccccc

SEQ ID NO: 1804215 - RNA, 13 nt, Human
ggcccugaaagcg

SEQ ID NO: 1804216 - RNA, 23 nt, Human
uaucuaauagggcaauuaauucc

SEQ ID NO: 1804217 - RNA, 18 nt, Human
agaucauugugaaauuau

SEQ ID NO: 1804218 - RNA, 14 nt, Human
ucauuguagaaaag

SEQ ID NO: 1804219 - RNA, 16 nt, Human
gaaauguauucuuuua

SEQ ID NO: 1804220 - RNA, 15 nt, Human
aaaaucauaagauau

SEQ ID NO: 1804221 - RNA, 15 nt, Human
gaucuggcucuggac

SEQ ID NO: 1804222 - RNA, 22 nt, Human
aaauuaugugccagauuuaugc

SEQ ID NO: 1804223 - RNA, 13 nt, Human
ucucaaagugcug

SEQ ID NO: 1804224 - RNA, 20 nt, Human
cuuucagagccuccuuucug

SEQ ID NO: 1804225 - RNA, 22 nt, Human
cugcaggcuccccuccucggcu

SEQ ID NO: 1804226 - RNA, 19 nt, Human
gcuuguauuccuuuuucuc

SEQ ID NO: 1804227 - RNA, 15 nt, Human
aauagaauuauaacu

SEQ ID NO: 1804228 - RNA, 21 nt, Human
aagaaggaaauugaauuucca

SEQ ID NO: 1804229 - RNA, 23 nt, Human
gcuggcgugcagcaucagcaucc

SEQ ID NO: 1804230 - RNA, 12 nt, Human
cauuccucugcc

SEQ ID NO: 1804231 - RNA, 23 nt, Human
uguaauaaaacauguuccuuaua

SEQ ID NO: 1804232 - RNA, 21 nt, Human
cagacuggauaguccgucucu

SEQ ID NO: 1804233 - RNA, 23 nt, Human
acacaaauaaaggaaacccagcu

SEQ ID NO: 1804234 - RNA, 21 nt, Human
ccgccauucucaagcccugca

SEQ ID NO: 1804235 - RNA, 19 nt, Human
uacuauuauccccauuucu

SEQ ID NO: 1804236 - RNA, 15 nt, Human
ugcagauaaacagua

SEQ ID NO: 1804237 - RNA, 23 nt, Human
agaacucaucuagguaaauuaca

SEQ ID NO: 1804238 - RNA, 14 nt, Human
ccucaguucccucu

SEQ ID NO: 1804239 - RNA, 14 nt, Human
cugcuggggaagac

SEQ ID NO: 1804240 - RNA, 13 nt, Human
aaaaauccuacuu

SEQ ID NO: 1804241 - RNA, 16 nt, Human
aguuauguagaaaaaa

SEQ ID NO: 1804242 - RNA, 23 nt, Human
aucauauuguguguaauguugua

SEQ ID NO: 1804243 - RNA, 22 nt, Human
uacaccccaacagcacccucuc

SEQ ID NO: 1804244 - RNA, 19 nt, Human
uaucucauuuccaagcaag

SEQ ID NO: 1804245 - RNA, 19 nt, Human
gugagggugcugacuggcu

SEQ ID NO: 1804246 - RNA, 17 nt, Human
aggcucuaauguacaau

SEQ ID NO: 1804247 - RNA, 13 nt, Human
aguugcaacuuug

SEQ ID NO: 1804248 - RNA, 22 nt, Human
cauuuguagcauccucuuuaau

SEQ ID NO: 1804249 - RNA, 16 nt, Human
auguuuaagaaauuuu

SEQ ID NO: 1804250 - RNA, 19 nt, Human
ccucuccaaagcccucccu

SEQ ID NO: 1804251 - RNA, 22 nt, Human
cucacauuuggggcuagacagu

SEQ ID NO: 1804252 - RNA, 16 nt, Human
uaaaggcuaugauugu

SEQ ID NO: 1804253 - RNA, 16 nt, Human
ggcugcugcugugcag

SEQ ID NO: 1804254 - RNA, 16 nt, Human
agcccagagacagcuu

SEQ ID NO: 1804255 - RNA, 17 nt, Human
ugcucugucuucuuugc

SEQ ID NO: 1804256 - RNA, 17 nt, Human
acgcucauuguagaaaa

SEQ ID NO: 1804257 - RNA, 15 nt, Human
aaagaagagaacugc

SEQ ID NO: 1804258 - RNA, 18 nt, Human
agagccccacccucagau

SEQ ID NO: 1804259 - RNA, 16 nt, Human
ugccucaaccucccaa

SEQ ID NO: 1804260 - RNA, 19 nt, Human
agugaggagcuuugaaacg

SEQ ID NO: 1804261 - RNA, 14 nt, Human
acucuguuuucuuu

SEQ ID NO: 1804262 - RNA, 16 nt, Human
gccccaucuccucagc

SEQ ID NO: 1804263 - RNA, 19 nt, Human
gccagcaucugccuccccu

SEQ ID NO: 1804264 - RNA, 17 nt, Human
aaagaaacauuugguaa

SEQ ID NO: 1804265 - RNA, 17 nt, Human
gccaaaucaaaagacuu

SEQ ID NO: 1804266 - RNA, 19 nt, Human
auccucuugccaaaucaaa

SEQ ID NO: 1804267 - RNA, 21 nt, Human
agcugcccccagagccacagu

SEQ ID NO: 1804268 - RNA, 19 nt, Human
aggaugagggaaaagaaaa

SEQ ID NO: 1804269 - RNA, 23 nt, Human
ucacaauggauaggcacaggaaa

SEQ ID NO: 1804270 - RNA, 17 nt, Human
ucuccaacaauaagaag

SEQ ID NO: 1804271 - RNA, 16 nt, Human
cauccauucuccugag

SEQ ID NO: 1804272 - RNA, 17 nt, Human
aaaaguugcuauuugaa

SEQ ID NO: 1804273 - RNA, 18 nt, Human
aucuuacaaugaaaagga

SEQ ID NO: 1804274 - RNA, 21 nt, Human
ccucuguucugcacacagcac

SEQ ID NO: 1804275 - RNA, 13 nt, Human
acuuuuuccuugg

SEQ ID NO: 1804276 - RNA, 14 nt, Human
ccagaaagcaguug

SEQ ID NO: 1804277 - RNA, 19 nt, Human
acgcccucacugcaggcuc

SEQ ID NO: 1804278 - RNA, 16 nt, Human
ggcuaauaucuuaucu

SEQ ID NO: 1804279 - RNA, 13 nt, Human
aaaagaaaaagau

SEQ ID NO: 1804280 - RNA, 13 nt, Human
uaaauuuuagcaa

SEQ ID NO: 1804281 - RNA, 17 nt, Human
cauaaugguuuuuaaca

SEQ ID NO: 1804282 - RNA, 22 nt, Human
uuuuguuugguauuguauuuau

SEQ ID NO: 1804283 - RNA, 16 nt, Human
accucugccucagaaa

SEQ ID NO: 1804284 - RNA, 16 nt, Human
gcccucuugaaucucu

SEQ ID NO: 1804285 - RNA, 21 nt, Human
agagcaagcaggaaucagaga

SEQ ID NO: 1804286 - RNA, 20 nt, Human
caaauguaauugauuuauuu

SEQ ID NO: 1804287 - RNA, 18 nt, Human
ucugugaagugagaccuu

SEQ ID NO: 1804288 - RNA, 13 nt, Human
ugccagcuggccu

SEQ ID NO: 1804289 - RNA, 20 nt, Human
cccccucaaacccauucccu

SEQ ID NO: 1804290 - RNA, 13 nt, Human
cagagacugcucc

SEQ ID NO: 1804291 - RNA, 17 nt, Human
cucguggaacaguuacc

SEQ ID NO: 1804292 - RNA, 18 nt, Human
cuugauggucccuauucc

SEQ ID NO: 1804293 - RNA, 16 nt, Human
cugcucagggcugguc

SEQ ID NO: 1804294 - RNA, 22 nt, Human
uagaugccacuagcccuccucu

SEQ ID NO: 1804295 - RNA, 15 nt, Human
acaauaaagcaaugu

SEQ ID NO: 1804296 - RNA, 18 nt, Human
ugagucaacuccuuucuc

SEQ ID NO: 1804297 - RNA, 14 nt, Human
uacaagcauucugu

SEQ ID NO: 1804298 - RNA, 13 nt, Human
aaaggaagcaggg

SEQ ID NO: 1804299 - RNA, 20 nt, Human
agcucugaagaacucucugg

SEQ ID NO: 1804300 - RNA, 13 nt, Human
uugcuuuuaaaau

SEQ ID NO: 1804301 - RNA, 16 nt, Human
aacaucugagaaaagc

SEQ ID NO: 1804302 - RNA, 21 nt, Human
uaaaaucuuucuuucuuagaa

SEQ ID NO: 1804303 - RNA, 20 nt, Human
cucagcccugcaccaugcug

SEQ ID NO: 1804304 - RNA, 19 nt, Human
agccacggggacucagccc

SEQ ID NO: 1804305 - RNA, 23 nt, Human
cacaaugcagugccuuucuucuc

SEQ ID NO: 1804306 - RNA, 17 nt, Human
uuucccuccuuggagac

SEQ ID NO: 1804307 - RNA, 15 nt, Human
ugcuucuguuuuaua

SEQ ID NO: 1804308 - RNA, 19 nt, Human
aaggaaauaagaaccacuc

SEQ ID NO: 1804309 - RNA, 14 nt, Human
cgcaggaacucaau

SEQ ID NO: 1804310 - RNA, 12 nt, Human
agcccaaacugc

SEQ ID NO: 1804311 - RNA, 20 nt, Human
ccugcaccaugcugcugggg

SEQ ID NO: 1804312 - RNA, 17 nt, Human
gcccucagaaucgcucc

SEQ ID NO: 1804313 - RNA, 15 nt, Human
cugccagcuggccuu

SEQ ID NO: 1804314 - RNA, 20 nt, Human
cccuugagcccucuauggug

SEQ ID NO: 1804315 - RNA, 14 nt, Human
aucuaaaaaacgaa

SEQ ID NO: 1804316 - RNA, 15 nt, Human
aauaaagcaaugugg

SEQ ID NO: 1804317 - RNA, 22 nt, Human
ugcagcucuccccuucucugua

SEQ ID NO: 1804318 - RNA, 17 nt, Human
gccuaagugcagccccg

SEQ ID NO: 1804319 - RNA, 20 nt, Human
uauguccuuuuuaaugugua

SEQ ID NO: 1804320 - RNA, 18 nt, Human
auuaaaagugucuugaga

SEQ ID NO: 1804321 - RNA, 12 nt, Human
aaugcagccccc

SEQ ID NO: 1804322 - RNA, 14 nt, Human
cauguuggccaggc

SEQ ID NO: 1804323 - RNA, 21 nt, Human
uccagaugggagugcccccaa

SEQ ID NO: 1804324 - RNA, 20 nt, Human
cuugcucucggugcuuccaa

SEQ ID NO: 1804325 - RNA, 12 nt, Human
cugcaccaugcu

SEQ ID NO: 1804326 - RNA, 15 nt, Human
ccuccuuuuuccuuc

SEQ ID NO: 1804327 - RNA, 17 nt, Human
cagauccuccucauuca

SEQ ID NO: 1804328 - RNA, 23 nt, Human
ugaauuauguuugcauguucacu

SEQ ID NO: 1804329 - RNA, 19 nt, Human
uaugaacucuguuuucuuu

SEQ ID NO: 1804330 - RNA, 16 nt, Human
acugcaugcacuucuu

SEQ ID NO: 1804331 - RNA, 16 nt, Human
aaggagacaaaacuag

SEQ ID NO: 1804332 - RNA, 17 nt, Human
cuuccuaauuccacagc

SEQ ID NO: 1804333 - RNA, 16 nt, Human
uauaauguaaacaaua

SEQ ID NO: 1804334 - RNA, 17 nt, Human
aauaaaguguuugaaag

SEQ ID NO: 1804335 - RNA, 20 nt, Human
auuaugugccagauuuaugc

SEQ ID NO: 1804336 - RNA, 13 nt, Human
uagcauggccaca

SEQ ID NO: 1804337 - RNA, 19 nt, Human
auuuacagagacagaaagc

SEQ ID NO: 1804338 - RNA, 19 nt, Human
augaauuacauuuguauaa

SEQ ID NO: 1804339 - RNA, 21 nt, Human
auguacaauaaagcaaugugg

SEQ ID NO: 1804340 - RNA, 19 nt, Human
aauuuagauuugugugcau

SEQ ID NO: 1804341 - RNA, 23 nt, Human
gagccuucccaaguugugcuuga

SEQ ID NO: 1804342 - RNA, 17 nt, Human
uugaaaaaugcauguug

SEQ ID NO: 1804343 - RNA, 16 nt, Human
cuggguguaaaaccug

SEQ ID NO: 1804344 - RNA, 19 nt, Human
uaauuagccagugaaaaac

SEQ ID NO: 1804345 - RNA, 18 nt, Human
ucuaauuggcaugaaggu

SEQ ID NO: 1804346 - RNA, 16 nt, Human
guucugcacacagcac

SEQ ID NO: 1804347 - RNA, 21 nt, Human
cauuucuugagguaaaagcau

SEQ ID NO: 1804348 - RNA, 14 nt, Human
uggcuucccaaagu

SEQ ID NO: 1804349 - RNA, 14 nt, Human
cuuuucuauuguug

SEQ ID NO: 1804350 - RNA, 16 nt, Human
cucucaaagugcuggc

SEQ ID NO: 1804351 - RNA, 14 nt, Human
ugauaucaguccag

SEQ ID NO: 1804352 - RNA, 17 nt, Human
uuuguaaugaaaaccac

SEQ ID NO: 1804353 - RNA, 23 nt, Human
aaaugccuuuguacuuuagggaa

SEQ ID NO: 1804354 - RNA, 17 nt, Human
cccaaaguccugggauu

SEQ ID NO: 1804355 - RNA, 16 nt, Human
ccuuuggagauuuuuu

SEQ ID NO: 1804356 - RNA, 21 nt, Human
aguucaauauaagcuuuucuu

SEQ ID NO: 1804357 - RNA, 14 nt, Human
uugcacaaaccaau

SEQ ID NO: 1804358 - RNA, 17 nt, Human
uuucuucuauugccucu

SEQ ID NO: 1804359 - RNA, 12 nt, Human
aacauagaacuc

SEQ ID NO: 1804360 - RNA, 14 nt, Human
guucaguaccacau

SEQ ID NO: 1804361 - RNA, 21 nt, Human
ucaucauuuccauuuacccuu

SEQ ID NO: 1804362 - RNA, 16 nt, Human
uuaucuuaaaacuccu

SEQ ID NO: 1804363 - RNA, 17 nt, Human
uagucaugcuaauuaua

SEQ ID NO: 1804364 - RNA, 18 nt, Human
gcaacuuuguauaaaagg

SEQ ID NO: 1804365 - RNA, 16 nt, Human
gcaauccucccacuuc

SEQ ID NO: 1804366 - RNA, 13 nt, Human
agcucugcccauc

SEQ ID NO: 1804367 - RNA, 16 nt, Human
uuugaauguuaaauaa

SEQ ID NO: 1804368 - RNA, 14 nt, Human
acgcauggaaaagu

SEQ ID NO: 1804369 - RNA, 18 nt, Human
ccugucuguuuccucugu

SEQ ID NO: 1804370 - RNA, 18 nt, Human
uucacauuuuuguauuuu

SEQ ID NO: 1804371 - RNA, 16 nt, Human
ccccugcacuccagcc

SEQ ID NO: 1804372 - RNA, 18 nt, Human
aauguaccuucacaccaa

SEQ ID NO: 1804373 - RNA, 20 nt, Human
ccuucuuuuuuuuuuuuugu

SEQ ID NO: 1804374 - RNA, 17 nt, Human
cugaguuccugcaugcc

SEQ ID NO: 1804375 - RNA, 20 nt, Human
acucauagacacugaucugg

SEQ ID NO: 1804376 - RNA, 23 nt, Human
cacagcaagucaggguuggagca

SEQ ID NO: 1804377 - RNA, 18 nt, Human
auuuaggccaugggacag

SEQ ID NO: 1804378 - RNA, 20 nt, Human
uaaaggcuaugauugucuuu

SEQ ID NO: 1804379 - RNA, 15 nt, Human
cuuuacuugaccucc

SEQ ID NO: 1804380 - RNA, 19 nt, Human
ggagugugaagcaaggagc

SEQ ID NO: 1804381 - RNA, 22 nt, Human
ccuggguucacagaucuuucug

SEQ ID NO: 1804382 - RNA, 11 nt, Human
cuauuuaauua

SEQ ID NO: 1804383 - RNA, 18 nt, Human
gagccccaucagcuccag

SEQ ID NO: 1804384 - RNA, 18 nt, Human
uuggggccuaugcagagg

SEQ ID NO: 1804385 - RNA, 18 nt, Human
cagcccuuuugucucugc

SEQ ID NO: 1804386 - RNA, 17 nt, Human
caaguuagaacuagcca

SEQ ID NO: 1804387 - RNA, 19 nt, Human
gagacauugaggcaggcac

SEQ ID NO: 1804388 - RNA, 19 nt, Human
caaaauuguuacaaauugu

SEQ ID NO: 1804389 - RNA, 16 nt, Human
aaauagaaauggggaa

SEQ ID NO: 1804390 - RNA, 20 nt, Human
ugggaaggagacaaaacuag

SEQ ID NO: 1804391 - RNA, 16 nt, Human
uuuuagugaaauauua

SEQ ID NO: 1804392 - RNA, 15 nt, Human
augauugucuuuguu

SEQ ID NO: 1804393 - RNA, 16 nt, Human
uuccauauaaauauua

SEQ ID NO: 1804394 - RNA, 23 nt, Human
aguugagacaagaaaauaagagc

SEQ ID NO: 1804395 - RNA, 16 nt, Human
aauuugacuagaaaau

SEQ ID NO: 1804396 - RNA, 18 nt, Human
aggaaggcuuacacccac

SEQ ID NO: 1804397 - RNA, 20 nt, Human
gcuucaaauuguaagcaugc

SEQ ID NO: 1804398 - RNA, 14 nt, Human
ccugccccccagcc

SEQ ID NO: 1804399 - RNA, 14 nt, Human
aggcccugcucuuc

SEQ ID NO: 1804400 - RNA, 18 nt, Human
ccacuuggucugugagau

SEQ ID NO: 1804401 - RNA, 22 nt, Human
aauacuugcuuuggaaaaccca

SEQ ID NO: 1804402 - RNA, 19 nt, Human
uggacuucuugaaaucaau

SEQ ID NO: 1804403 - RNA, 15 nt, Human
ucaaaagacuuuuuc

SEQ ID NO: 1804404 - RNA, 16 nt, Human
agacaaggccuuggag

SEQ ID NO: 1804405 - RNA, 22 nt, Human
aucaucaagucuuucacauuua

SEQ ID NO: 1804406 - RNA, 16 nt, Human
uauuuaacuauucaua

SEQ ID NO: 1804407 - RNA, 13 nt, Human
caggcugcucagg

SEQ ID NO: 1804408 - RNA, 18 nt, Human
auggugaaaugcagaguc

SEQ ID NO: 1804409 - RNA, 18 nt, Human
acugugugcucaggagcc

SEQ ID NO: 1804410 - RNA, 17 nt, Human
cacacaugggaucaagu

SEQ ID NO: 1804411 - RNA, 13 nt, Human
acccuggaaaaug

SEQ ID NO: 1804412 - RNA, 16 nt, Human
uucacauuuaaauaaa

SEQ ID NO: 1804413 - RNA, 14 nt, Human
ugcuagaacucccu

SEQ ID NO: 1804414 - RNA, 22 nt, Human
ccucauuuuuauaaugucccuu

SEQ ID NO: 1804415 - RNA, 17 nt, Human
ucugaauauguccuuuu

SEQ ID NO: 1804416 - RNA, 14 nt, Human
augagggaaaagaa

SEQ ID NO: 1804417 - RNA, 22 nt, Human
cugacuauucuugauguaaaau

SEQ ID NO: 1804418 - RNA, 12 nt, Human
uguuccuuuugu

SEQ ID NO: 1804419 - RNA, 15 nt, Human
auugacugucacaua

SEQ ID NO: 1804420 - RNA, 22 nt, Human
cuugucuauuaccuguuaguau

SEQ ID NO: 1804421 - RNA, 23 nt, Human
agcucuccccuucucuguauucc

SEQ ID NO: 1804422 - RNA, 14 nt, Human
ccuugauuuuagcc

SEQ ID NO: 1804423 - RNA, 21 nt, Human
ccuucccaggaguacacccca

SEQ ID NO: 1804424 - RNA, 17 nt, Human
cugucaacuuguauuuu

SEQ ID NO: 1804425 - RNA, 18 nt, Human
ugccuucuggccuuguaa

SEQ ID NO: 1804426 - RNA, 18 nt, Human
gggccaaaaguauccaag

SEQ ID NO: 1804427 - RNA, 20 nt, Human
ucucguugacccucacagga

SEQ ID NO: 1804428 - RNA, 23 nt, Human
caucaacagauaaauaguuuaug

SEQ ID NO: 1804429 - RNA, 16 nt, Human
agucuugccuugcuga

SEQ ID NO: 1804430 - RNA, 13 nt, Human
aaguaaaaacaaa

SEQ ID NO: 1804431 - RNA, 13 nt, Human
caaaggucaagaa

SEQ ID NO: 1804432 - RNA, 14 nt, Human
auagaccuaaaaua

SEQ ID NO: 1804433 - RNA, 15 nt, Human
uacuuacaugcauua

SEQ ID NO: 1804434 - RNA, 22 nt, Human
agaauuuuaugcggcauuuucu

SEQ ID NO: 1804435 - RNA, 22 nt, Human
aacguggcuuuuuuuuuuuccc

SEQ ID NO: 1804436 - RNA, 16 nt, Human
guuucacaccuuaucu

SEQ ID NO: 1804437 - RNA, 17 nt, Human
ccuuaacuggagcccca

SEQ ID NO: 1804438 - RNA, 21 nt, Human
aucgacuugccaaauuuagau

SEQ ID NO: 1804439 - RNA, 19 nt, Human
guucacauuuuuguauuuu

SEQ ID NO: 1804440 - RNA, 18 nt, Human
uuuccuucuuuuuuucuu

SEQ ID NO: 1804441 - RNA, 22 nt, Human
aagugcuggcauuacaggugug

SEQ ID NO: 1804442 - RNA, 15 nt, Human
gcacagccucuuaga

SEQ ID NO: 1804443 - RNA, 16 nt, Human
uuagauagaugaagaa

SEQ ID NO: 1804444 - RNA, 14 nt, Human
cuacgccuggcuga

SEQ ID NO: 1804445 - RNA, 16 nt, Human
aguuuauauagaaaug

SEQ ID NO: 1804446 - RNA, 19 nt, Human
ugcuucuccagccucagcc

SEQ ID NO: 1804447 - RNA, 20 nt, Human
uuuaugauacuugaaaauua

SEQ ID NO: 1804448 - RNA, 14 nt, Human
cuggucucuccuug

SEQ ID NO: 1804449 - RNA, 14 nt, Human
ugccauauaauuca

SEQ ID NO: 1804450 - RNA, 17 nt, Human
acccuggaaaaugaauc

SEQ ID NO: 1804451 - RNA, 22 nt, Human
uucuaaaguaaaaacaaagaaa

SEQ ID NO: 1804452 - RNA, 13 nt, Human
cuuuggcagaguu

SEQ ID NO: 1804453 - RNA, 20 nt, Human
gcaggucccuaauaaagcug

SEQ ID NO: 1804454 - RNA, 18 nt, Human
gcuuuagccuuaaagaua

SEQ ID NO: 1804455 - RNA, 21 nt, Human
gaugcacaugagcuggcggga

SEQ ID NO: 1804456 - RNA, 22 nt, Human
uagacacacaugaaguccaagc

SEQ ID NO: 1804457 - RNA, 14 nt, Human
gcuuucuucuccca

SEQ ID NO: 1804458 - RNA, 15 nt, Human
cauuauaucaaaucu

SEQ ID NO: 1804459 - RNA, 18 nt, Human
cugccuuuauuguguuug

SEQ ID NO: 1804460 - RNA, 17 nt, Human
ugcccccaacagcaccc

SEQ ID NO: 1804461 - RNA, 13 nt, Human
ccuaauuuugaga

SEQ ID NO: 1804462 - RNA, 17 nt, Human
ucauccugcaggcagcu

SEQ ID NO: 1804463 - RNA, 16 nt, Human
gaggggcuggggacuu

SEQ ID NO: 1804464 - RNA, 15 nt, Human
ggcuggagugcagug

SEQ ID NO: 1804465 - RNA, 23 nt, Human
agcaaaaccaaauauuccagaga

SEQ ID NO: 1804466 - RNA, 22 nt, Human
cugccaaaacaucaaccugcca

SEQ ID NO: 1804467 - RNA, 17 nt, Human
acuaggugcauauuuau

SEQ ID NO: 1804468 - RNA, 14 nt, Human
gcugucccaaacau

SEQ ID NO: 1804469 - RNA, 18 nt, Human
aaggauaaaguugguaaa

SEQ ID NO: 1804470 - RNA, 12 nt, Human
cucugcaaacug

SEQ ID NO: 1804471 - RNA, 19 nt, Human
auggugcacuaauuucacu

SEQ ID NO: 1804472 - RNA, 17 nt, Human
cacagaucacagcuuca

SEQ ID NO: 1804473 - RNA, 18 nt, Human
uuacuggaaggcuuccac

SEQ ID NO: 1804474 - RNA, 12 nt, Human
ucugcagguccc

SEQ ID NO: 1804475 - RNA, 16 nt, Human
ucacugcaaccuccac

SEQ ID NO: 1804476 - RNA, 20 nt, Human
agccuuggggcugaugcagu

SEQ ID NO: 1804477 - RNA, 18 nt, Human
aaggcuuugcccugcugc

SEQ ID NO: 1804478 - RNA, 14 nt, Human
aauuauuuugugau

SEQ ID NO: 1804479 - RNA, 14 nt, Human
gaacaaacagggcu

SEQ ID NO: 1804480 - RNA, 15 nt, Human
acuggaugaaaaugu

SEQ ID NO: 1804481 - RNA, 20 nt, Human
ugggagugcccccaacagca

SEQ ID NO: 1804482 - RNA, 15 nt, Human
gccaguuguccuccu

SEQ ID NO: 1804483 - RNA, 16 nt, Human
uucacauuuuuguauu

SEQ ID NO: 1804484 - RNA, 15 nt, Human
auccauucuucccuu

SEQ ID NO: 1804485 - RNA, 15 nt, Human
cuaucuuugagcgcc

SEQ ID NO: 1804486 - RNA, 21 nt, Human
ccuauauacucacuuucuaga

SEQ ID NO: 1804487 - RNA, 13 nt, Human
uuuugcuguggca

SEQ ID NO: 1804488 - RNA, 20 nt, Human
ccaacacccugagguugugu

SEQ ID NO: 1804489 - RNA, 15 nt, Human
cucuguguuacccag

SEQ ID NO: 1804490 - RNA, 22 nt, Human
ugcauagaauaaaauuuuuaau

SEQ ID NO: 1804491 - RNA, 21 nt, Human
uccuacaagacacagugacca

SEQ ID NO: 1804492 - RNA, 23 nt, Human
cagccucccaagcaccugggauu

SEQ ID NO: 1804493 - RNA, 22 nt, Human
caugucagcaaguccuaagccu

SEQ ID NO: 1804494 - RNA, 15 nt, Human
ugagcgcccacuaga

SEQ ID NO: 1804495 - RNA, 12 nt, Human
uguaucuagccu

SEQ ID NO: 1804496 - RNA, 13 nt, Human
ucugaggccaggg

SEQ ID NO: 1804497 - RNA, 23 nt, Human
aauugccugacgaacuccuugau

SEQ ID NO: 1804498 - RNA, 16 nt, Human
ugauuguaugaauuua

SEQ ID NO: 1804499 - RNA, 16 nt, Human
ucuaauaguuuuauua

SEQ ID NO: 1804500 - RNA, 16 nt, Human
aaaucuaaaaaacgaa

SEQ ID NO: 1804501 - RNA, 22 nt, Human
uacuguaaggcaaucauggugc

SEQ ID NO: 1804502 - RNA, 20 nt, Human
uuaaagcuguuauuuaauua

SEQ ID NO: 1804503 - RNA, 16 nt, Human
ccucaagcugcaucua

SEQ ID NO: 1804504 - RNA, 13 nt, Human
gcuugccugcagg

SEQ ID NO: 1804505 - RNA, 14 nt, Human
auagcuuuucccuu

SEQ ID NO: 1804506 - RNA, 14 nt, Human
uagccaagugcagg

SEQ ID NO: 1804507 - RNA, 15 nt, Human
cuacuuucugugucu

SEQ ID NO: 1804508 - RNA, 22 nt, Human
cugacucuugcagggguagccu

SEQ ID NO: 1804509 - RNA, 23 nt, Human
uuucaguucucuugauuuucauu

SEQ ID NO: 1804510 - RNA, 22 nt, Human
ucaucucacauuuucccuuccc

SEQ ID NO: 1804511 - RNA, 19 nt, Human
ucaggagagaguugaaccu

SEQ ID NO: 1804512 - RNA, 13 nt, Human
auaagauuuaaau

SEQ ID NO: 1804513 - RNA, 17 nt, Human
agcacgugguaaaacac

SEQ ID NO: 1804514 - RNA, 22 nt, Human
cauuuuguuugguauuguauuu

SEQ ID NO: 1804515 - RNA, 14 nt, Human
agccagcugccccc

SEQ ID NO: 1804516 - RNA, 19 nt, Human
cacugucugcccccguucc

SEQ ID NO: 1804517 - RNA, 20 nt, Human
cugcuacccucauuucucau

SEQ ID NO: 1804518 - RNA, 17 nt, Human
gacaaggaaaaaauaac

SEQ ID NO: 1804519 - RNA, 20 nt, Human
uuguagguaauauugcaagg

SEQ ID NO: 1804520 - RNA, 14 nt, Human
uguguauuauaauu

SEQ ID NO: 1804521 - RNA, 13 nt, Human
accucugccuccc

SEQ ID NO: 1804522 - RNA, 17 nt, Human
uuaaauguuuuuuuuua

SEQ ID NO: 1804523 - RNA, 15 nt, Human
gacagaaaaaacuga

SEQ ID NO: 1804524 - RNA, 20 nt, Human
caugugaaaucauucauuuu

SEQ ID NO: 1804525 - RNA, 20 nt, Human
ugagcgcccacuagacccac

SEQ ID NO: 1804526 - RNA, 13 nt, Human
cucugucuccuaa

SEQ ID NO: 1804527 - RNA, 15 nt, Human
gacacaaauaaagga

SEQ ID NO: 1804528 - RNA, 12 nt, Human
acucacuguggg

SEQ ID NO: 1804529 - RNA, 14 nt, Human
cuucccuugagccc

SEQ ID NO: 1804530 - RNA, 17 nt, Human
agucugacuguuuccau

SEQ ID NO: 1804531 - RNA, 17 nt, Human
caagcagaagagaaaau

SEQ ID NO: 1804532 - RNA, 16 nt, Human
cugggaucacugauga

SEQ ID NO: 1804533 - RNA, 20 nt, Human
caggucacgcuuucaugaau

SEQ ID NO: 1804534 - RNA, 18 nt, Human
uagaauauauuuccuuau

SEQ ID NO: 1804535 - RNA, 22 nt, Human
gggagcgagugggggccagcca

SEQ ID NO: 1804536 - RNA, 15 nt, Human
guagcuacaggacau

SEQ ID NO: 1804537 - RNA, 15 nt, Human
auaaaguguuugaaa

SEQ ID NO: 1804538 - RNA, 17 nt, Human
accuauuagaguauuuu

SEQ ID NO: 1804539 - RNA, 13 nt, Human
ugcaucugaaaau

SEQ ID NO: 1804540 - RNA, 19 nt, Human
ccucugguaaccucuuacu

SEQ ID NO: 1804541 - RNA, 15 nt, Human
auaucaauuuaaaaa

SEQ ID NO: 1804542 - RNA, 18 nt, Human
ucuaccuggucucuccuu

SEQ ID NO: 1804543 - RNA, 19 nt, Human
ggacugugugcucaggagc

SEQ ID NO: 1804544 - RNA, 16 nt, Human
ucaaacccauucccuc

SEQ ID NO: 1804545 - RNA, 18 nt, Human
aggcacacugagccagca

SEQ ID NO: 1804546 - RNA, 21 nt, Human
cugaggccuagacucugucua

SEQ ID NO: 1804547 - RNA, 12 nt, Human
gaaaauaacaau

SEQ ID NO: 1804548 - RNA, 15 nt, Human
acccucccacugcca

SEQ ID NO: 1804549 - RNA, 17 nt, Human
auaaaaugaauacaauu

SEQ ID NO: 1804550 - RNA, 18 nt, Human
aagggaauuucuucaacu

SEQ ID NO: 1804551 - RNA, 21 nt, Human
uuagccuucucuguucauuuc

SEQ ID NO: 1804552 - RNA, 19 nt, Human
caagcaggaagaaggaaaa

SEQ ID NO: 1804553 - RNA, 14 nt, Human
cuugagguaaaagc

SEQ ID NO: 1804554 - RNA, 23 nt, Human
auuucauugcucagaaaugucau

SEQ ID NO: 1804555 - RNA, 13 nt, Human
uaauuuuuauauu

SEQ ID NO: 1804556 - RNA, 12 nt, Human
uuuuuuaaauag

SEQ ID NO: 1804557 - RNA, 15 nt, Human
uuuaaucuuuaauuu

SEQ ID NO: 1804558 - RNA, 19 nt, Human
auucacaucgcagauucuc

SEQ ID NO: 1804559 - RNA, 21 nt, Human
uaagcccuccgccauucucaa

SEQ ID NO: 1804560 - RNA, 14 nt, Human
caaggagcuuagau

SEQ ID NO: 1804561 - RNA, 14 nt, Human
cuccuccuuuuucc

SEQ ID NO: 1804562 - RNA, 16 nt, Human
uagcuacuaauuuuaa

SEQ ID NO: 1804563 - RNA, 22 nt, Human
aagaaauuacuggaaggcuucc

SEQ ID NO: 1804564 - RNA, 20 nt, Human
ucaaucuguccguucacaug

SEQ ID NO: 1804565 - RNA, 17 nt, Human
agacucugucuaccugg

SEQ ID NO: 1804566 - RNA, 15 nt, Human
aagguaaaucagacu

SEQ ID NO: 1804567 - RNA, 17 nt, Human
uccuucccuugcuucuu

SEQ ID NO: 1804568 - RNA, 21 nt, Human
uauuuaguguucauaaauaaa

SEQ ID NO: 1804569 - RNA, 20 nt, Human
uuucacuguguuggccagga

SEQ ID NO: 1804570 - RNA, 22 nt, Human
gaugcaguuguugcccacagcu

SEQ ID NO: 1804571 - RNA, 21 nt, Human
ugucucugcaaacugccuucu

SEQ ID NO: 1804572 - RNA, 18 nt, Human
gccugagcgacagugaga

SEQ ID NO: 1804573 - RNA, 20 nt, Human
uuucucaucuuguccccaac

SEQ ID NO: 1804574 - RNA, 15 nt, Human
ccauguacauagcuu

SEQ ID NO: 1804575 - RNA, 21 nt, Human
ugcaggcagcuuuuucucucc

SEQ ID NO: 1804576 - RNA, 17 nt, Human
cuucuccagccucagcc

SEQ ID NO: 1804577 - RNA, 15 nt, Human
cugcacuccagccug

SEQ ID NO: 1804578 - RNA, 23 nt, Human
aucuaugccacaagaacccccuu

SEQ ID NO: 1804579 - RNA, 21 nt, Human
ugcugucauaaugguuuuuaa

SEQ ID NO: 1804580 - RNA, 20 nt, Human
agcucagaaguuucuucuuu

SEQ ID NO: 1804581 - RNA, 15 nt, Human
aaacugguaggaaac

SEQ ID NO: 1804582 - RNA, 20 nt, Human
acaaugacuuguacucugaa

SEQ ID NO: 1804583 - RNA, 13 nt, Human
aaaaaugguuuaa

SEQ ID NO: 1804584 - RNA, 14 nt, Human
aauuaacucagaca

SEQ ID NO: 1804585 - RNA, 18 nt, Human
cagagccucgaggaggua

SEQ ID NO: 1804586 - RNA, 21 nt, Human
ggaaaauggacaucaaaauca

SEQ ID NO: 1804587 - RNA, 19 nt, Human
uuuccugaaaacccuugcc

SEQ ID NO: 1804588 - RNA, 17 nt, Human
gccugagcgacagugag

SEQ ID NO: 1804589 - RNA, 18 nt, Human
auuucucaucuuuuuacu

SEQ ID NO: 1804590 - RNA, 18 nt, Human
gcugcugagugcaccacu

SEQ ID NO: 1804591 - RNA, 22 nt, Human
uuuauaagaaauaggaaauauu

SEQ ID NO: 1804592 - RNA, 16 nt, Human
acuugcugcugagugc

SEQ ID NO: 1804593 - RNA, 21 nt, Human
ccauucucaagcccugcaguc

SEQ ID NO: 1804594 - RNA, 16 nt, Human
acuuuuauaagaaaua

SEQ ID NO: 1804595 - RNA, 13 nt, Human
ggaauauuugaau

SEQ ID NO: 1804596 - RNA, 16 nt, Human
ccuggugggcagagag

SEQ ID NO: 1804597 - RNA, 15 nt, Human
uucacuaucuguaau

SEQ ID NO: 1804598 - RNA, 22 nt, Human
auaacaaugcuguauuuuaaaa

SEQ ID NO: 1804599 - RNA, 16 nt, Human
gaaaggaagcugugcg

SEQ ID NO: 1804600 - RNA, 13 nt, Human
auucuuauuucau

SEQ ID NO: 1804601 - RNA, 12 nt, Human
acuugcuuuuaa

SEQ ID NO: 1804602 - RNA, 15 nt, Human
gccaaagaacuugga

SEQ ID NO: 1804603 - RNA, 17 nt, Human
gucuccuaagcuggagu

SEQ ID NO: 1804604 - RNA, 15 nt, Human
gugcuugagccagga

SEQ ID NO: 1804605 - RNA, 22 nt, Human
agcccuggcaacugcuaaucua

SEQ ID NO: 1804606 - RNA, 20 nt, Human
acuauagugugagccaggaa

SEQ ID NO: 1804607 - RNA, 15 nt, Human
agcaagucaggguug

SEQ ID NO: 1804608 - RNA, 18 nt, Human
ugagccaccaagcuggug

SEQ ID NO: 1804609 - RNA, 23 nt, Human
ucuauaauguaaacaauaucaga

SEQ ID NO: 1804610 - RNA, 19 nt, Human
uagugaucaaauugugcag

SEQ ID NO: 1804611 - RNA, 17 nt, Human
gaaaaaugcauguugcc

SEQ ID NO: 1804612 - RNA, 21 nt, Human
acucucuuauugccucacuuc

SEQ ID NO: 1804613 - RNA, 20 nt, Human
guaucaaaagaaagaaaauc

SEQ ID NO: 1804614 - RNA, 14 nt, Human
gugagcuacaaaug

SEQ ID NO: 1804615 - RNA, 15 nt, Human
aagaacacagugauu

SEQ ID NO: 1804616 - RNA, 19 nt, Human
uguucaugcccauaccccu

SEQ ID NO: 1804617 - RNA, 15 nt, Human
agaaaacaauaacga

SEQ ID NO: 1804618 - RNA, 14 nt, Human
aucuuuaauuuuac

SEQ ID NO: 1804619 - RNA, 15 nt, Human
ucgcuuaucaacuaa

SEQ ID NO: 1804620 - RNA, 18 nt, Human
ucaugcuaauuauauaau

SEQ ID NO: 1804621 - RNA, 14 nt, Human
cuuucauaaagucu

SEQ ID NO: 1804622 - RNA, 19 nt, Human
auuucaauuaccuucuauu

SEQ ID NO: 1804623 - RNA, 16 nt, Human
acaugaacuuguaaag

SEQ ID NO: 1804624 - RNA, 14 nt, Human
gcucuccaaaggcu

SEQ ID NO: 1804625 - RNA, 22 nt, Human
gccccuuugcugacccucccca

SEQ ID NO: 1804626 - RNA, 18 nt, Human
uccugcaagcagaggugg

SEQ ID NO: 1804627 - RNA, 18 nt, Human
ugaggcaggcacugccaa

SEQ ID NO: 1804628 - RNA, 19 nt, Human
aauuauauaauauuuuuaa

SEQ ID NO: 1804629 - RNA, 19 nt, Human
cagcacgggggccaaggau

SEQ ID NO: 1804630 - RNA, 23 nt, Human
agcaccaggacgcccucgagguu

SEQ ID NO: 1804631 - RNA, 17 nt, Human
caaaaauuccuuuuccc

SEQ ID NO: 1804632 - RNA, 20 nt, Human
uuuccuuccagucuaaaaaa

SEQ ID NO: 1804633 - RNA, 19 nt, Human
cucaagcuaugugagcuca

SEQ ID NO: 1804634 - RNA, 21 nt, Human
caaagcucuuuacuuuccccu

SEQ ID NO: 1804635 - RNA, 11 nt, Human
uuauaaacauu

SEQ ID NO: 1804636 - RNA, 22 nt, Human
cuccagcugcucugucuucuuu

SEQ ID NO: 1804637 - RNA, 14 nt, Human
uggacucaccuccc

SEQ ID NO: 1804638 - RNA, 13 nt, Human
aauaaaauuuuua

SEQ ID NO: 1804639 - RNA, 13 nt, Human
uauauaauauuuu

SEQ ID NO: 1804640 - RNA, 23 nt, Human
uccucaaaaagauuuccccauuu

SEQ ID NO: 1804641 - RNA, 18 nt, Human
ggagaaaugaaaaaauau

SEQ ID NO: 1804642 - RNA, 16 nt, Human
uucauaaagcaggcag

SEQ ID NO: 1804643 - RNA, 13 nt, Human
ggaaaagaaaaag

SEQ ID NO: 1804644 - RNA, 16 nt, Human
ccaacaugaaaacaau

SEQ ID NO: 1804645 - RNA, 17 nt, Human
uaggagagguugucugu

SEQ ID NO: 1804646 - RNA, 23 nt, Human
auuuccacagugacuccacucug

SEQ ID NO: 1804647 - RNA, 12 nt, Human
cccugucucagg

SEQ ID NO: 1804648 - RNA, 12 nt, Human
aacccauucccu

SEQ ID NO: 1804649 - RNA, 23 nt, Human
aguaauuggaaaggcagcucuaa

SEQ ID NO: 1804650 - RNA, 13 nt, Human
aacugccuuuggc

SEQ ID NO: 1804651 - RNA, 12 nt, Human
uuauuucacuuu

SEQ ID NO: 1804652 - RNA, 23 nt, Human
gaaaaucuuauaauuuaaaauau

SEQ ID NO: 1804653 - RNA, 16 nt, Human
agagagcuggaggcac

SEQ ID NO: 1804654 - RNA, 16 nt, Human
uaccuagcuggcucug

SEQ ID NO: 1804655 - RNA, 13 nt, Human
cccaaaaggcaga

SEQ ID NO: 1804656 - RNA, 22 nt, Human
augccuuguuucauauuuuuca

SEQ ID NO: 1804657 - RNA, 14 nt, Human
cuaucgcaccacug

SEQ ID NO: 1804658 - RNA, 15 nt, Human
cauuuacuuuuaaac

SEQ ID NO: 1804659 - RNA, 15 nt, Human
ccauuuccucagacu

SEQ ID NO: 1804660 - RNA, 19 nt, Human
uagaaaaguuauguagaaa

SEQ ID NO: 1804661 - RNA, 18 nt, Human
uucuauuugaucugauau

SEQ ID NO: 1804662 - RNA, 13 nt, Human
ucuaagaagugaa

SEQ ID NO: 1804663 - RNA, 17 nt, Human
uuaaauggucaauuuug

SEQ ID NO: 1804664 - RNA, 23 nt, Human
uuacuguacagacagaaaaaacu

SEQ ID NO: 1804665 - RNA, 19 nt, Human
aacagcacccucuccagau

SEQ ID NO: 1804666 - RNA, 16 nt, Human
uggaauuuaaaucacu

SEQ ID NO: 1804667 - RNA, 20 nt, Human
ccacccaaacggaggcagcu

SEQ ID NO: 1804668 - RNA, 16 nt, Human
guuaacaccuuuaaag

SEQ ID NO: 1804669 - RNA, 16 nt, Human
caauuguuggagagcc

SEQ ID NO: 1804670 - RNA, 23 nt, Human
uugaaguuuuggcaauugacuau

SEQ ID NO: 1804671 - RNA, 22 nt, Human
cccccaacagcacccucuccag

SEQ ID NO: 1804672 - RNA, 18 nt, Human
uucucuaggaaauauuua

SEQ ID NO: 1804673 - RNA, 15 nt, Human
cucaucucuucuuuu

SEQ ID NO: 1804674 - RNA, 14 nt, Human
cugcuauucuccau

SEQ ID NO: 1804675 - RNA, 23 nt, Human
acccaguguuuuaggagcaugag

SEQ ID NO: 1804676 - RNA, 18 nt, Human
caagugcuucuccagccu

SEQ ID NO: 1804677 - RNA, 15 nt, Human
cuucccuugcuucuu

SEQ ID NO: 1804678 - RNA, 19 nt, Human
ugagacuacaggcacacac

SEQ ID NO: 1804679 - RNA, 15 nt, Human
uuuuaaucuuuaauu

SEQ ID NO: 1804680 - RNA, 21 nt, Human
agauguagccccucuccugga

SEQ ID NO: 1804681 - RNA, 21 nt, Human
cuccagaugagaguacacccc

SEQ ID NO: 1804682 - RNA, 20 nt, Human
ccaggagcugggcagaaggc

SEQ ID NO: 1804683 - RNA, 17 nt, Human
uaagccccagcaagcaa

SEQ ID NO: 1804684 - RNA, 11 nt, Human
uccuuuuuaau

SEQ ID NO: 1804685 - RNA, 18 nt, Human
ccccaggacgcccucacu

SEQ ID NO: 1804686 - RNA, 23 nt, Human
uagauaggucagugcaaauacuc

SEQ ID NO: 1804687 - RNA, 19 nt, Human
aggcuguugucuuuuccuu

SEQ ID NO: 1804688 - RNA, 18 nt, Human
cacacugagccagcagcc

SEQ ID NO: 1804689 - RNA, 15 nt, Human
uugcuaguuuuugac

SEQ ID NO: 1804690 - RNA, 13 nt, Human
uaaggaauuuuau

SEQ ID NO: 1804691 - RNA, 22 nt, Human
aaaguuuaauggugccuucauu

SEQ ID NO: 1804692 - RNA, 20 nt, Human
agccaucaccuuagaccacc

SEQ ID NO: 1804693 - RNA, 19 nt, Human
augcagagguccacaacac

SEQ ID NO: 1804694 - RNA, 16 nt, Human
uauagaccuaaaauaa

SEQ ID NO: 1804695 - RNA, 14 nt, Human
uaguaucaaaagaa

SEQ ID NO: 1804696 - RNA, 23 nt, Human
aacacugggagaaaugaaaaaau

SEQ ID NO: 1804697 - RNA, 18 nt, Human
aggaaagcauguauucag

SEQ ID NO: 1804698 - RNA, 22 nt, Human
gaugcaguucugaagaagaugg

SEQ ID NO: 1804699 - RNA, 22 nt, Human
ucauucaagucagcucuucucc

SEQ ID NO: 1804700 - RNA, 17 nt, Human
auuagaguauuuuccac

SEQ ID NO: 1804701 - RNA, 16 nt, Human
uauuuuugugauuuug

SEQ ID NO: 1804702 - RNA, 14 nt, Human
ugaagcaaggagcu

SEQ ID NO: 1804703 - RNA, 23 nt, Human
uaauauuccucaguucauccauu

SEQ ID NO: 1804704 - RNA, 19 nt, Human
cuuggggccuaugcagagg

SEQ ID NO: 1804705 - RNA, 23 nt, Human
cccucucugcaggcagccugccu

SEQ ID NO: 1804706 - RNA, 20 nt, Human
uaaauagagaaauaugauuu

SEQ ID NO: 1804707 - RNA, 23 nt, Human
gugaccaaccuuuucccaaccau

SEQ ID NO: 1804708 - RNA, 19 nt, Human
ucccaauucauccucacuc

SEQ ID NO: 1804709 - RNA, 18 nt, Human
agucugucacccagguug

SEQ ID NO: 1804710 - RNA, 17 nt, Human
aucuauuuaaauauuua

SEQ ID NO: 1804711 - RNA, 16 nt, Human
uuugcuguuauuuuau

SEQ ID NO: 1804712 - RNA, 15 nt, Human
uucaacuuuuccuuu

SEQ ID NO: 1804713 - RNA, 20 nt, Human
cucacauccauucuucccuu

SEQ ID NO: 1804714 - RNA, 13 nt, Human
ggagccagggcug

SEQ ID NO: 1804715 - RNA, 19 nt, Human
cugagucaacuccuuucuc

SEQ ID NO: 1804716 - RNA, 12 nt, Human
uauuuuuuucug

SEQ ID NO: 1804717 - RNA, 20 nt, Human
ucuucuccuaaaacuuuaaa

SEQ ID NO: 1804718 - RNA, 15 nt, Human
ggauagagagggaau

SEQ ID NO: 1804719 - RNA, 22 nt, Human
ucauucccguugaacgucacau

SEQ ID NO: 1804720 - RNA, 16 nt, Human
gcaaugcuucaucccu

SEQ ID NO: 1804721 - RNA, 13 nt, Human
ccuuaggccucug

SEQ ID NO: 1804722 - RNA, 16 nt, Human
ucagagccuccuuucu

SEQ ID NO: 1804723 - RNA, 14 nt, Human
uugagacaagaaaa

SEQ ID NO: 1804724 - RNA, 20 nt, Human
cuccagaugagaguacaccc

SEQ ID NO: 1804725 - RNA, 20 nt, Human
acccaaggaugucugccaca

SEQ ID NO: 1804726 - RNA, 13 nt, Human
ggggccaggcugg

SEQ ID NO: 1804727 - RNA, 15 nt, Human
auuuucuuuguuaaa

SEQ ID NO: 1804728 - RNA, 17 nt, Human
auuucuuuuuguucccc

SEQ ID NO: 1804729 - RNA, 18 nt, Human
acagcuucucauccugca

SEQ ID NO: 1804730 - RNA, 19 nt, Human
acuggacucaccuccccca

SEQ ID NO: 1804731 - RNA, 22 nt, Human
guccaucucuuguuuaaauuca

SEQ ID NO: 1804732 - RNA, 18 nt, Human
cggggugggaaagauuac

SEQ ID NO: 1804733 - RNA, 19 nt, Human
ugccuugcugaacucccuc

SEQ ID NO: 1804734 - RNA, 12 nt, Human
aaggaugucugc

SEQ ID NO: 1804735 - RNA, 14 nt, Human
auuauccccauuuc

SEQ ID NO: 1804736 - RNA, 19 nt, Human
ccuucccaggaguacaccc

SEQ ID NO: 1804737 - RNA, 22 nt, Human
gagugcaguggcgcgaucucag

SEQ ID NO: 1804738 - RNA, 22 nt, Human
aucauaagauauuuuucaugau

SEQ ID NO: 1804739 - RNA, 12 nt, Human
uugggcaggcag

SEQ ID NO: 1804740 - RNA, 16 nt, Human
acagcaagucaggguu

SEQ ID NO: 1804741 - RNA, 14 nt, Human
cguguccccuaucc

SEQ ID NO: 1804742 - RNA, 22 nt, Human
auauaaauaaaaauaauccuca

SEQ ID NO: 1804743 - RNA, 17 nt, Human
auucagggcuauuuuuu

SEQ ID NO: 1804744 - RNA, 17 nt, Human
gaaagaagaagguggga

SEQ ID NO: 1804745 - RNA, 20 nt, Human
guuucugaguuccugcaugc

SEQ ID NO: 1804746 - RNA, 24 nt, Human
ucccaagcaguugggacuacaggc

SEQ ID NO: 1804747 - RNA, 17 nt, Human
guuguauaugucuuuua

SEQ ID NO: 1804748 - RNA, 12 nt, Human
augaccaacauc

SEQ ID NO: 1804749 - RNA, 22 nt, Human
cucacugcaggcuccccuccuc

SEQ ID NO: 1804750 - RNA, 16 nt, Human
aaaccuuuuauauuua

SEQ ID NO: 1804751 - RNA, 17 nt, Human
ccccaguuguuucuacu

SEQ ID NO: 1804752 - RNA, 17 nt, Human
gacucucuuaaggaggc

SEQ ID NO: 1804753 - RNA, 16 nt, Human
ccuaaaauaaaaugaa

SEQ ID NO: 1804754 - RNA, 18 nt, Human
uuuuagugauuuuaauaa

SEQ ID NO: 1804755 - RNA, 15 nt, Human
aucugagagaugaca

SEQ ID NO: 1804756 - RNA, 16 nt, Human
gaaacuaggugcauau

SEQ ID NO: 1804757 - RNA, 22 nt, Human
caggcuugucucgaacuccuga

SEQ ID NO: 1804758 - RNA, 15 nt, Human
cuucaggauaccaua

SEQ ID NO: 1804759 - RNA, 20 nt, Human
aguguucauaaauaaaguuu

SEQ ID NO: 1804760 - RNA, 12 nt, Human
cugaauuauuuu

SEQ ID NO: 1804761 - RNA, 13 nt, Human
gccuccagagagu

SEQ ID NO: 1804762 - RNA, 12 nt, Human
uaagaaggcacc

SEQ ID NO: 1804763 - RNA, 17 nt, Human
ggcuccucagggacuca

SEQ ID NO: 1804764 - RNA, 16 nt, Human
uagucucuacccagua

SEQ ID NO: 1804765 - RNA, 20 nt, Human
uggauuuaauguggaaauga

SEQ ID NO: 1804766 - RNA, 18 nt, Human
uucccaccaggcugcuca

SEQ ID NO: 1804767 - RNA, 13 nt, Human
cucccuaguuccu

SEQ ID NO: 1804768 - RNA, 20 nt, Human
gccucaaccucccaagcagu

SEQ ID NO: 1804769 - RNA, 20 nt, Human
aaagagugaaggauuuaugu

SEQ ID NO: 1804770 - RNA, 21 nt, Human
uuccugacugcuaguuuauau

SEQ ID NO: 1804771 - RNA, 19 nt, Human
ucuuaucuuccuauaauuu

SEQ ID NO: 1804772 - RNA, 15 nt, Human
aguauugacuuguau

SEQ ID NO: 1804773 - RNA, 15 nt, Human
cucacugugggaagg

SEQ ID NO: 1804774 - RNA, 18 nt, Human
cagcuggggccaggcugg

SEQ ID NO: 1804775 - RNA, 15 nt, Human
cuuaaccagaucauu

SEQ ID NO: 1804776 - RNA, 22 nt, Human
gauacuugaaaauuaacaugaa

SEQ ID NO: 1804777 - RNA, 12 nt, Human
ccucugcccuuc

SEQ ID NO: 1804778 - RNA, 19 nt, Human
auaauuuuuauauuugaaa

SEQ ID NO: 1804779 - RNA, 14 nt, Human
gaaggugggaggau

SEQ ID NO: 1804780 - RNA, 14 nt, Human
auggacaucaaaau

SEQ ID NO: 1804781 - RNA, 17 nt, Human
uccucagggacucaggu

SEQ ID NO: 1804782 - RNA, 23 nt, Human
caguaaagaacaucccuccuggg

SEQ ID NO: 1804783 - RNA, 23 nt, Human
ccucuggggcauuauccaucuuu

SEQ ID NO: 1804784 - RNA, 20 nt, Human
gggcccaggaucguuuuuuc

SEQ ID NO: 1804785 - RNA, 18 nt, Human
uguguuuacuuuauguua

SEQ ID NO: 1804786 - RNA, 18 nt, Human
ccagucaggccuaucuaa

SEQ ID NO: 1804787 - RNA, 20 nt, Human
cuuuaauuuuacauuuccua

SEQ ID NO: 1804788 - RNA, 18 nt, Human
auuuauaaacuuuuuucu

SEQ ID NO: 1804789 - RNA, 19 nt, Human
ucacugcaaccucugccuc

SEQ ID NO: 1804790 - RNA, 21 nt, Human
gacuacuagggaaaugccuuu

SEQ ID NO: 1804791 - RNA, 15 nt, Human
guauggcuccuccau

SEQ ID NO: 1804792 - RNA, 23 nt, Human
ucaucucuucuuuuaaaccauuu

SEQ ID NO: 1804793 - RNA, 21 nt, Human
accccagcuggggccaggcug

SEQ ID NO: 1804794 - RNA, 14 nt, Human
agcaaguauuagaa

SEQ ID NO: 1804795 - RNA, 18 nt, Human
ccaggaucguuuuuuccc

SEQ ID NO: 1804796 - RNA, 20 nt, Human
ucuuuccucuggggcauuau

SEQ ID NO: 1804797 - RNA, 23 nt, Human
cuguguggagagggaaugugaaa

SEQ ID NO: 1804798 - RNA, 17 nt, Human
gcaggaacaaacagggc

SEQ ID NO: 1804799 - RNA, 14 nt, Human
ccacucagagaaac

SEQ ID NO: 1804800 - RNA, 15 nt, Human
ucucagucugucacc

SEQ ID NO: 1804801 - RNA, 12 nt, Human
gucaccucagag

SEQ ID NO: 1804802 - RNA, 14 nt, Human
cugagagaugacag

SEQ ID NO: 1804803 - RNA, 23 nt, Human
uguugcccacagcuguaugauuc

SEQ ID NO: 1804804 - RNA, 11 nt, Human
cugcugugcag

SEQ ID NO: 1804805 - RNA, 17 nt, Human
gcuucagccaggagcug

SEQ ID NO: 1804806 - RNA, 16 nt, Human
ucuuggucucaguguc

SEQ ID NO: 1804807 - RNA, 18 nt, Human
aaccaggacccuguccaa

SEQ ID NO: 1804808 - RNA, 13 nt, Human
uuccuaagugauu

SEQ ID NO: 1804809 - RNA, 12 nt, Human
gccucaaccucc

SEQ ID NO: 1804810 - RNA, 15 nt, Human
uaggcucaaaacagg

SEQ ID NO: 1804811 - RNA, 14 nt, Human
uacauucuuaaagu

SEQ ID NO: 1804812 - RNA, 20 nt, Human
gaccauacuaauuauacccc

SEQ ID NO: 1804813 - RNA, 13 nt, Human
aucauucauuuuc

SEQ ID NO: 1804814 - RNA, 20 nt, Human
gucaacuccuuucucaucuu

SEQ ID NO: 1804815 - RNA, 19 nt, Human
cucaucuuuuuacuaaacu

SEQ ID NO: 1804816 - RNA, 19 nt, Human
agaugcuagaacucccuuu

SEQ ID NO: 1804817 - RNA, 16 nt, Human
cagugggagccagggc

SEQ ID NO: 1804818 - RNA, 19 nt, Human
aggcucuaauguacaauaa

SEQ ID NO: 1804819 - RNA, 15 nt, Human
gcuugaucaaaggca

SEQ ID NO: 1804820 - RNA, 16 nt, Human
aucaucacauucaggg

SEQ ID NO: 1804821 - RNA, 19 nt, Human
acaagggcuggagucugca

SEQ ID NO: 1804822 - RNA, 20 nt, Human
acuguacagacagaaaaaac

SEQ ID NO: 1804823 - RNA, 18 nt, Human
aggaaaagggcuuucuca

SEQ ID NO: 1804824 - RNA, 15 nt, Human
gugguaagcaccagg

SEQ ID NO: 1804825 - RNA, 22 nt, Human
ggcuaagcuucacuguaaaaua

SEQ ID NO: 1804826 - RNA, 16 nt, Human
acccuggacuugccuc

SEQ ID NO: 1804827 - RNA, 23 nt, Human
gaaaauugugcuggaaauggaca

SEQ ID NO: 1804828 - RNA, 18 nt, Human
gaauaauccuaaacauau

SEQ ID NO: 1804829 - RNA, 14 nt, Human
ucucuucuuuucaa

SEQ ID NO: 1804830 - RNA, 17 nt, Human
ggcaaccagaccauugu

SEQ ID NO: 1804831 - RNA, 20 nt, Human
uccucugugucuucaaagca

SEQ ID NO: 1804832 - RNA, 15 nt, Human
ccaacaugcacugau

SEQ ID NO: 1804833 - RNA, 13 nt, Human
ccagcccuccuua

SEQ ID NO: 1804834 - RNA, 22 nt, Human
ucuucaaagcaaagcucuuuac

SEQ ID NO: 1804835 - RNA, 15 nt, Human
acaagacccaaaagg

SEQ ID NO: 1804836 - RNA, 16 nt, Human
cauccacguccugucu

SEQ ID NO: 1804837 - RNA, 20 nt, Human
aguccagcuuaguucaaguc

SEQ ID NO: 1804838 - RNA, 16 nt, Human
uucugugauauaagug

SEQ ID NO: 1804839 - RNA, 20 nt, Human
acucuuguuuccuuauauua

SEQ ID NO: 1804840 - RNA, 15 nt, Human
accaccaagccuuga

SEQ ID NO: 1804841 - RNA, 18 nt, Human
uaacccuggaaaaugaau

SEQ ID NO: 1804842 - RNA, 16 nt, Human
agaagucugcuacccu

SEQ ID NO: 1804843 - RNA, 14 nt, Human
cuaguucuguagaa

SEQ ID NO: 1804844 - RNA, 16 nt, Human
uuuagcaaagauaucu

SEQ ID NO: 1804845 - RNA, 18 nt, Human
cuuaacuggagccccauc

SEQ ID NO: 1804846 - RNA, 19 nt, Human
agaaaauaacgauaaaaga

SEQ ID NO: 1804847 - RNA, 16 nt, Human
aggcugcucagggcug

SEQ ID NO: 1804848 - RNA, 14 nt, Human
auuugaaauuguau

SEQ ID NO: 1804849 - RNA, 20 nt, Human
agggacucaucauuuccauu

SEQ ID NO: 1804850 - RNA, 16 nt, Human
cuugagugcucaguag

SEQ ID NO: 1804851 - RNA, 16 nt, Human
cucuaagaaagaacac

SEQ ID NO: 1804852 - RNA, 13 nt, Human
cacauuuaaauaa

SEQ ID NO: 1804853 - RNA, 18 nt, Human
cugcagcucucuuuccuc

SEQ ID NO: 1804854 - RNA, 15 nt, Human
acauguaucuaugca

SEQ ID NO: 1804855 - RNA, 15 nt, Human
ugcuugucccugugg

SEQ ID NO: 1804856 - RNA, 15 nt, Human
aggagcccugggagg

SEQ ID NO: 1804857 - RNA, 22 nt, Human
cucagugggggcagagccaccu

SEQ ID NO: 1804858 - RNA, 23 nt, Human
auuccuugauggagauauuuaca

SEQ ID NO: 1804859 - RNA, 18 nt, Human
uguugcauuaaaaaugca

SEQ ID NO: 1804860 - RNA, 21 nt, Human
uguaaaauggugugaccacug

SEQ ID NO: 1804861 - RNA, 16 nt, Human
acuaacacccagucug

SEQ ID NO: 1804862 - RNA, 20 nt, Human
acaagacccaaaaggcagaa

SEQ ID NO: 1804863 - RNA, 22 nt, Human
uggacuaaaagauauaagugcu

SEQ ID NO: 1804864 - RNA, 13 nt, Human
ucucccagccagg

SEQ ID NO: 1804865 - RNA, 19 nt, Human
caggacuagggcuggagug

SEQ ID NO: 1804866 - RNA, 21 nt, Human
uggggcuuuaacuccugcuag

SEQ ID NO: 1804867 - RNA, 18 nt, Human
ucaaggguacacugccuu

SEQ ID NO: 1804868 - RNA, 20 nt, Human
ccauuguggucacaggaagu

SEQ ID NO: 1804869 - RNA, 18 nt, Human
acaccucuccaaagcccu

SEQ ID NO: 1804870 - RNA, 17 nt, Human
gcuguucccaccaggcu

SEQ ID NO: 1804871 - RNA, 15 nt, Human
cuaauguacaauaaa

SEQ ID NO: 1804872 - RNA, 15 nt, Human
ugcuguauuuuaaaa

SEQ ID NO: 1804873 - RNA, 18 nt, Human
ucaucuuguccccaacac

SEQ ID NO: 1804874 - RNA, 22 nt, Human
ggacagcccuucuuuccacaga

SEQ ID NO: 1804875 - RNA, 18 nt, Human
uuauuguugcauuaaaaa

SEQ ID NO: 1804876 - RNA, 21 nt, Human
ugggaggcugagaugggagaa

SEQ ID NO: 1804877 - RNA, 21 nt, Human
ucuuuuuuugugguuagaaaa

SEQ ID NO: 1804878 - RNA, 16 nt, Human
ccaccauggccagcua

SEQ ID NO: 1804879 - RNA, 15 nt, Human
ucaacacuaacauga

SEQ ID NO: 1804880 - RNA, 16 nt, Human
acacugaucuggcugc

SEQ ID NO: 1804881 - RNA, 16 nt, Human
cuuuucuauuguugua

SEQ ID NO: 1804882 - RNA, 19 nt, Human
augaauacaauuaaagcug

SEQ ID NO: 1804883 - RNA, 17 nt, Human
auccaagcaaaugugaa

SEQ ID NO: 1804884 - RNA, 22 nt, Human
guaaaauuaagaaaggauaaag

SEQ ID NO: 1804885 - RNA, 19 nt, Human
uuguacucugaaaguuuug

SEQ ID NO: 1804886 - RNA, 22 nt, Human
cagggaugaggcagaccugacu

SEQ ID NO: 1804887 - RNA, 20 nt, Human
ucuguaaugccuuuucucac

SEQ ID NO: 1804888 - RNA, 21 nt, Human
uuuguagcauccucuuuaaug

SEQ ID NO: 1804889 - RNA, 20 nt, Human
auuacuguaagaaaauauca

SEQ ID NO: 1804890 - RNA, 21 nt, Human
ucuccuuguugugauuuucac

SEQ ID NO: 1804891 - RNA, 14 nt, Human
ccccuucacuccca

SEQ ID NO: 1804892 - RNA, 23 nt, Human
ugagugcucaguagucagacugg

SEQ ID NO: 1804893 - RNA, 20 nt, Human
cccugcacuccagccugagc

SEQ ID NO: 1804894 - RNA, 19 nt, Human
gcuuuuaugugaaacaugu

SEQ ID NO: 1804895 - RNA, 23 nt, Human
ccccucuggcuccagcuggccgg

SEQ ID NO: 1804896 - RNA, 16 nt, Human
uagagaauuuccuuac

SEQ ID NO: 1804897 - RNA, 15 nt, Human
ucugacuauuuuuca

SEQ ID NO: 1804898 - RNA, 14 nt, Human
ugagugcaccacuu

SEQ ID NO: 1804899 - RNA, 17 nt, Human
auguacaauaaagcaau

SEQ ID NO: 1804900 - RNA, 14 nt, Human
ccucaaccucccaa

SEQ ID NO: 1804901 - RNA, 19 nt, Human
guugcauagaauaaaauuu

SEQ ID NO: 1804902 - RNA, 18 nt, Human
uguggucacaggaaguag

SEQ ID NO: 1804903 - RNA, 11 nt, Human
ugcuuucuucu

SEQ ID NO: 1804904 - RNA, 18 nt, Human
gggacucaucauuuccau

SEQ ID NO: 1804905 - RNA, 12 nt, Human
gaccugaagaau

SEQ ID NO: 1804906 - RNA, 15 nt, Human
ccaugugcagccacc

SEQ ID NO: 1804907 - RNA, 14 nt, Human
auucuguguuaaaa

SEQ ID NO: 1804908 - RNA, 14 nt, Human
guaacuaauuuuaa

SEQ ID NO: 1804909 - RNA, 12 nt, Human
aauuucuauuug

SEQ ID NO: 1804910 - RNA, 15 nt, Human
aagguggaaauaaac

SEQ ID NO: 1804911 - RNA, 14 nt, Human
aaugauuaugaauu

SEQ ID NO: 1804912 - RNA, 23 nt, Human
uugacccucacaggagcaucucc

SEQ ID NO: 1804913 - RNA, 13 nt, Human
ccaggaccugagu

SEQ ID NO: 1804914 - RNA, 15 nt, Human
agaauaccacaggaa

SEQ ID NO: 1804915 - RNA, 20 nt, Human
gggagugcccccaacagcac

SEQ ID NO: 1804916 - RNA, 14 nt, Human
ccucugccucccag

SEQ ID NO: 1804917 - RNA, 13 nt, Human
ugaagacccccaa

SEQ ID NO: 1804918 - RNA, 17 nt, Human
uccacaacacacagauu

SEQ ID NO: 1804919 - RNA, 14 nt, Human
aaaauuaacaugaa

SEQ ID NO: 1804920 - RNA, 13 nt, Human
uuauguuuaauuc

SEQ ID NO: 1804921 - RNA, 18 nt, Human
uauacuuuguaaagacaa

SEQ ID NO: 1804922 - RNA, 19 nt, Human
acugguagaggaugaggaa

SEQ ID NO: 1804923 - RNA, 17 nt, Human
aaucuuucacaggggac

SEQ ID NO: 1804924 - RNA, 14 nt, Human
caccaugcugcugg

SEQ ID NO: 1804925 - RNA, 13 nt, Human
cacaccaucuccc

SEQ ID NO: 1804926 - RNA, 23 nt, Human
caucaccuuagaccaccaagccu

SEQ ID NO: 1804927 - RNA, 17 nt, Human
ggcuucccaaaguccug

SEQ ID NO: 1804928 - RNA, 22 nt, Human
ucuucuuuuaaaccauuuucuu

SEQ ID NO: 1804929 - RNA, 18 nt, Human
auauacuuuaauaaaugu

SEQ ID NO: 1804930 - RNA, 16 nt, Human
cagcuuuguucuucuu

SEQ ID NO: 1804931 - RNA, 12 nt, Human
gccauucucaag

SEQ ID NO: 1804932 - RNA, 16 nt, Human
acucccuaguuccuuc

SEQ ID NO: 1804933 - RNA, 20 nt, Human
auaccugauauauuccacca

SEQ ID NO: 1804934 - RNA, 14 nt, Human
aucaaaagaaagaa

SEQ ID NO: 1804935 - RNA, 20 nt, Human
cugagguuguguguggaagg

SEQ ID NO: 1804936 - RNA, 14 nt, Human
uccagccucagccu

SEQ ID NO: 1804937 - RNA, 22 nt, Human
uuguuauuggguaucaccacug

SEQ ID NO: 1804938 - RNA, 19 nt, Human
uaaaauuuuuuuagaaagc

SEQ ID NO: 1804939 - RNA, 22 nt, Human
gaauaaccaacacccugagguu

SEQ ID NO: 1804940 - RNA, 14 nt, Human
gugagaaccggaga

SEQ ID NO: 1804941 - RNA, 15 nt, Human
cacccucuccagaug

SEQ ID NO: 1804942 - RNA, 20 nt, Human
uaaaacagggccacauagau

SEQ ID NO: 1804943 - RNA, 21 nt, Human
cgaaguauccuucagccugaa

SEQ ID NO: 1804944 - RNA, 12 nt, Human
gggagccagggc

SEQ ID NO: 1804945 - RNA, 17 nt, Human
augaauacaauuaaagc

SEQ ID NO: 1804946 - RNA, 17 nt, Human
ccaaucaguagccagca

SEQ ID NO: 1804947 - RNA, 16 nt, Human
cugccacaccucucca

SEQ ID NO: 1804948 - RNA, 18 nt, Human
ggccacaucugagccccg

SEQ ID NO: 1804949 - RNA, 14 nt, Human
uaauauuccucagu

SEQ ID NO: 1804950 - RNA, 14 nt, Human
acucuaagaaagaa

SEQ ID NO: 1804951 - RNA, 20 nt, Human
caagcucuaucaccaaggag

SEQ ID NO: 1804952 - RNA, 22 nt, Human
ugauuuacgcucauuguagaaa

SEQ ID NO: 1804953 - RNA, 22 nt, Human
caaaaguuucauccuuuucauu

SEQ ID NO: 1804954 - RNA, 14 nt, Human
gaaugauuaugaau

SEQ ID NO: 1804955 - RNA, 16 nt, Human
cguguguguuuuaaac

SEQ ID NO: 1804956 - RNA, 22 nt, Human
agcuuagauaagacacccccuc

SEQ ID NO: 1804957 - RNA, 19 nt, Human
auauugcaaggcaaagacu

SEQ ID NO: 1804958 - RNA, 18 nt, Human
agcuuacuuaaaauugua

SEQ ID NO: 1804959 - RNA, 14 nt, Human
guccauugggcagg

SEQ ID NO: 1804960 - RNA, 20 nt, Human
caaagccuucauugccuuaa

SEQ ID NO: 1804961 - RNA, 22 nt, Human
uacuagggaaaugccuuuguac

SEQ ID NO: 1804962 - RNA, 16 nt, Human
cggcuuccuuccucuc

SEQ ID NO: 1804963 - RNA, 17 nt, Human
aaaguacaagagcuuaa

SEQ ID NO: 1804964 - RNA, 14 nt, Human
uugacccacaagaa

SEQ ID NO: 1804965 - RNA, 15 nt, Human
guaagauuuccuucu

SEQ ID NO: 1804966 - RNA, 16 nt, Human
ggcagcuuuuucucuc

SEQ ID NO: 1804967 - RNA, 17 nt, Human
uuuaucaugugaaauca

SEQ ID NO: 1804968 - RNA, 19 nt, Human
cagcuuuuucucucccacu

SEQ ID NO: 1804969 - RNA, 16 nt, Human
ccagaggcucuaaugu

SEQ ID NO: 1804970 - RNA, 17 nt, Human
uguugagcagcaucucu

SEQ ID NO: 1804971 - RNA, 13 nt, Human
uaauuuugaaaaa

SEQ ID NO: 1804972 - RNA, 22 nt, Human
caccccuaaaagaaacccugca

SEQ ID NO: 1804973 - RNA, 14 nt, Human
aaaagauugagaga

SEQ ID NO: 1804974 - RNA, 15 nt, Human
accuaaacauagaaa

SEQ ID NO: 1804975 - RNA, 19 nt, Human
uccuaaauauauuuuaaga

SEQ ID NO: 1804976 - RNA, 18 nt, Human
cucauuguagaaaagcua

SEQ ID NO: 1804977 - RNA, 21 nt, Human
cugcuugaacuaggcugagca

SEQ ID NO: 1804978 - RNA, 22 nt, Human
auaagcugccauauauuuugua

SEQ ID NO: 1804979 - RNA, 17 nt, Human
agugauuaccagggacu

SEQ ID NO: 1804980 - RNA, 19 nt, Human
aaucuugucauguguauaa

SEQ ID NO: 1804981 - RNA, 17 nt, Human
aagcuggagugcagugg

SEQ ID NO: 1804982 - RNA, 17 nt, Human
accugucaucucacauu

SEQ ID NO: 1804983 - RNA, 22 nt, Human
gaagcuuuuaugugaaacaugu

SEQ ID NO: 1804984 - RNA, 20 nt, Human
uaauucugguagcuaaauau

SEQ ID NO: 1804985 - RNA, 18 nt, Human
caggacccuguccaaucu

SEQ ID NO: 1804986 - RNA, 17 nt, Human
ccacugcagaagacagu

SEQ ID NO: 1804987 - RNA, 13 nt, Human
aaaacuuaaguag

SEQ ID NO: 1804988 - RNA, 22 nt, Human
acaggauguuugcucagcuucu

SEQ ID NO: 1804989 - RNA, 16 nt, Human
augcuaagugaaauaa

SEQ ID NO: 1804990 - RNA, 21 nt, Human
gcuuucuuuuuuuucuuuuuu

SEQ ID NO: 1804991 - RNA, 21 nt, Human
uccaccaggauauccucccuc

SEQ ID NO: 1804992 - RNA, 20 nt, Human
aaucaugaagauauuuuucc

SEQ ID NO: 1804993 - RNA, 21 nt, Human
acugcaaccucugccucccag

SEQ ID NO: 1804994 - RNA, 16 nt, Human
uaaagcuguuauuuaa

SEQ ID NO: 1804995 - RNA, 16 nt, Human
caggcuggagugcagu

SEQ ID NO: 1804996 - RNA, 21 nt, Human
uaaauauuuauuuaacuauuc

SEQ ID NO: 1804997 - RNA, 15 nt, Human
aaagaaagaaaauca

SEQ ID NO: 1804998 - RNA, 18 nt, Human
accacuguguauuuaacu

SEQ ID NO: 1804999 - RNA, 16 nt, Human
gcuugccugcaggcau

SEQ ID NO: 1805000 - RNA, 22 nt, Human
caucucuucuggguuccuuccu

SEQ ID NO: 1805001 - RNA, 13 nt, Human
ugccaagagccug

SEQ ID NO: 1805002 - RNA, 15 nt, Human
ggggccaggcugggu

SEQ ID NO: 1805003 - RNA, 20 nt, Human
aagggcuguuauaaucuuuc

SEQ ID NO: 1805004 - RNA, 14 nt, Human
aauaaacucauuuc

SEQ ID NO: 1805005 - RNA, 18 nt, Human
uuggggggaguaaagaau

SEQ ID NO: 1805006 - RNA, 17 nt, Human
uuucugcauguucuaaa

SEQ ID NO: 1805007 - RNA, 16 nt, Human
uccuggaggggcuggg

SEQ ID NO: 1805008 - RNA, 13 nt, Human
cacucaaauuguu

SEQ ID NO: 1805009 - RNA, 19 nt, Human
uggugagugccuguaauca

SEQ ID NO: 1805010 - RNA, 23 nt, Human
guauucagcuuuaguagauauua

SEQ ID NO: 1805011 - RNA, 14 nt, Human
aauuauuuucucuc

SEQ ID NO: 1805012 - RNA, 18 nt, Human
cacuugcggauauucugg

SEQ ID NO: 1805013 - RNA, 15 nt, Human
ccugcucagcccugc

SEQ ID NO: 1805014 - RNA, 14 nt, Human
uaauuauuucacuu

SEQ ID NO: 1805015 - RNA, 21 nt, Human
gacaacagguaaaacagggcc

SEQ ID NO: 1805016 - RNA, 14 nt, Human
accuguuauaauaa

SEQ ID NO: 1805017 - RNA, 18 nt, Human
cucauauccaguauuguu

SEQ ID NO: 1805018 - RNA, 16 nt, Human
aggaggcugagagccc

SEQ ID NO: 1805019 - RNA, 15 nt, Human
agcuccagcugcucu

SEQ ID NO: 1805020 - RNA, 14 nt, Human
cuuccucugucucc

SEQ ID NO: 1805021 - RNA, 14 nt, Human
aaaaaugcauguug

SEQ ID NO: 1805022 - RNA, 23 nt, Human
acguaaucguguccccuauccua

SEQ ID NO: 1805023 - RNA, 15 nt, Human
cucagcuucuccaac

SEQ ID NO: 1805024 - RNA, 17 nt, Human
cucagggcuggucuuuu

SEQ ID NO: 1805025 - RNA, 21 nt, Human
gcacuguggguagacacacau

SEQ ID NO: 1805026 - RNA, 11 nt, Human
gagguaaaagc

SEQ ID NO: 1805027 - RNA, 17 nt, Human
cagcccuuuugucucug

SEQ ID NO: 1805028 - RNA, 17 nt, Human
uaugaguggcuuuaaug

SEQ ID NO: 1805029 - RNA, 15 nt, Human
ggcuacuccauguug

SEQ ID NO: 1805030 - RNA, 18 nt, Human
aaauaacgauaaaagaca

SEQ ID NO: 1805031 - RNA, 14 nt, Human
gacuccacucugag

SEQ ID NO: 1805032 - RNA, 18 nt, Human
caggcaccaggacuaggg

SEQ ID NO: 1805033 - RNA, 17 nt, Human
aaaucuaaaaaacgaaa

SEQ ID NO: 1805034 - RNA, 18 nt, Human
acagucucuugaggcaca

SEQ ID NO: 1805035 - RNA, 19 nt, Human
cccuuccugggucuaccac

SEQ ID NO: 1805036 - RNA, 15 nt, Human
uauccuaucucucca

SEQ ID NO: 1805037 - RNA, 16 nt, Human
acuugggucuucccug

SEQ ID NO: 1805038 - RNA, 12 nt, Human
ugcuuuuaaaau

SEQ ID NO: 1805039 - RNA, 19 nt, Human
aguggugacugugggcucc

SEQ ID NO: 1805040 - RNA, 13 nt, Human
gucuuuuccuucu

SEQ ID NO: 1805041 - RNA, 20 nt, Human
uuugaugaacaaaauuuccu

SEQ ID NO: 1805042 - RNA, 22 nt, Human
aaauaacaaugaaaguugauaa

SEQ ID NO: 1805043 - RNA, 23 nt, Human
cucagaaguuucuucuuuaggca

SEQ ID NO: 1805044 - RNA, 14 nt, Human
acagaauuuuaugc

SEQ ID NO: 1805045 - RNA, 16 nt, Human
gugcuuugaaaaugcu

SEQ ID NO: 1805046 - RNA, 14 nt, Human
acuggacucaccuc

SEQ ID NO: 1805047 - RNA, 13 nt, Human
gcauuauccaucu

SEQ ID NO: 1805048 - RNA, 15 nt, Human
aucucugaauuugag

SEQ ID NO: 1805049 - RNA, 21 nt, Human
aacauguuucuuuguaaugaa

SEQ ID NO: 1805050 - RNA, 15 nt, Human
gcccacuguacuugc

SEQ ID NO: 1805051 - RNA, 19 nt, Human
cacccauuagcagucccuc

SEQ ID NO: 1805052 - RNA, 18 nt, Human
uccagaaagaaaacuugu

SEQ ID NO: 1805053 - RNA, 21 nt, Human
guuucauccgcaaauuuucuu

SEQ ID NO: 1805054 - RNA, 20 nt, Human
ugacuauucuugauguaaaa

SEQ ID NO: 1805055 - RNA, 21 nt, Human
cggggaaggauuuugcaguuc

SEQ ID NO: 1805056 - RNA, 14 nt, Human
gaacccuugcacua

SEQ ID NO: 1805057 - RNA, 10 nt, Human
gucuuccucu

SEQ ID NO: 1805058 - RNA, 16 nt, Human
auuuauaaaaauaaaa

SEQ ID NO: 1805059 - RNA, 13 nt, Human
aaugcggcccaac

SEQ ID NO: 1805060 - RNA, 20 nt, Human
aaacagcuucucaauuucua

SEQ ID NO: 1805061 - RNA, 11 nt, Human
augaauacaau

SEQ ID NO: 1805062 - RNA, 14 nt, Human
uccuuaggccucug

SEQ ID NO: 1805063 - RNA, 16 nt, Human
aggaugaugacuaugg

SEQ ID NO: 1805064 - RNA, 22 nt, Human
auauaugcuaagucuuauauau

SEQ ID NO: 1805065 - RNA, 20 nt, Human
gauuaucaauuaccacacca

SEQ ID NO: 1805066 - RNA, 15 nt, Human
aacuauuuguaaagu

SEQ ID NO: 1805067 - RNA, 15 nt, Human
auucugaggccaggg

SEQ ID NO: 1805068 - RNA, 23 nt, Human
ugacuccacucugagucccagag

SEQ ID NO: 1805069 - RNA, 19 nt, Human
ggcucuaauguacaauaaa

SEQ ID NO: 1805070 - RNA, 19 nt, Human
augauuccuugauggagau

SEQ ID NO: 1805071 - RNA, 20 nt, Human
ucuucagcagagaaguuuuc

SEQ ID NO: 1805072 - RNA, 15 nt, Human
cuucugaggagcugu

SEQ ID NO: 1805073 - RNA, 18 nt, Human
acccuccccaaaggcuuu

SEQ ID NO: 1805074 - RNA, 22 nt, Human
auaaaccuuuuuggacacacaa

SEQ ID NO: 1805075 - RNA, 19 nt, Human
agcacgugguaaaacacuu

SEQ ID NO: 1805076 - RNA, 14 nt, Human
ucaucucagcucac

SEQ ID NO: 1805077 - RNA, 18 nt, Human
ucguguccgacucuucug

SEQ ID NO: 1805078 - RNA, 10 nt, Human
cuuguauuuu

SEQ ID NO: 1805079 - RNA, 14 nt, Human
cacagaucacagcu

SEQ ID NO: 1805080 - RNA, 15 nt, Human
accucuccccuggaa

SEQ ID NO: 1805081 - RNA, 18 nt, Human
uggccaccugcugagccc

SEQ ID NO: 1805082 - RNA, 14 nt, Human
guauccucuugcca

SEQ ID NO: 1805083 - RNA, 18 nt, Human
cuauguuuugacauuuuu

SEQ ID NO: 1805084 - RNA, 16 nt, Human
auccuacaagacacag

SEQ ID NO: 1805085 - RNA, 19 nt, Human
ccaaacaugcacuuccuug

SEQ ID NO: 1805086 - RNA, 20 nt, Human
cuucuccauccuaccacaau

SEQ ID NO: 1805087 - RNA, 19 nt, Human
gcauggccacaucugagcc

SEQ ID NO: 1805088 - RNA, 14 nt, Human
auauuuaguaucuu

SEQ ID NO: 1805089 - RNA, 16 nt, Human
ucugguugggcagcca

SEQ ID NO: 1805090 - RNA, 16 nt, Human
gaauuugaaacacuuu

SEQ ID NO: 1805091 - RNA, 21 nt, Human
aagagcucaggaugagggaaa

SEQ ID NO: 1805092 - RNA, 17 nt, Human
ugaggcuucuggggcuu

SEQ ID NO: 1805093 - RNA, 16 nt, Human
ccauuagaccaagcuu

SEQ ID NO: 1805094 - RNA, 22 nt, Human
ucuguauacaaaacccuuucug

SEQ ID NO: 1805095 - RNA, 14 nt, Human
auauauuuccuuau

SEQ ID NO: 1805096 - RNA, 11 nt, Human
cuaucucucca

SEQ ID NO: 1805097 - RNA, 13 nt, Human
uucuauaauuuaa

SEQ ID NO: 1805098 - RNA, 11 nt, Human
cuuguauuaug

SEQ ID NO: 1805099 - RNA, 14 nt, Human
cagagacugggacu

SEQ ID NO: 1805100 - RNA, 14 nt, Human
aaauagagaaauau

SEQ ID NO: 1805101 - RNA, 18 nt, Human
ccuuucugccccugcuga

SEQ ID NO: 1805102 - RNA, 18 nt, Human
uuuccccuugguucucau

SEQ ID NO: 1805103 - RNA, 16 nt, Human
uaauggugccuucauu

SEQ ID NO: 1805104 - RNA, 17 nt, Human
gggguucucacaguggg

SEQ ID NO: 1805105 - RNA, 15 nt, Human
uaauacaaaggcuua

SEQ ID NO: 1805106 - RNA, 12 nt, Human
cauuauauuuau

SEQ ID NO: 1805107 - RNA, 13 nt, Human
cuggaaggcuucc

SEQ ID NO: 1805108 - RNA, 15 nt, Human
aucuuuaauuuuaca

SEQ ID NO: 1805109 - RNA, 14 nt, Human
ucuccccuucucug

SEQ ID NO: 1805110 - RNA, 19 nt, Human
gcaggcacugccaaaacau

SEQ ID NO: 1805111 - RNA, 17 nt, Human
uuccauauaaauauuag

SEQ ID NO: 1805112 - RNA, 19 nt, Human
cagaugagaguacacccca

SEQ ID NO: 1805113 - RNA, 19 nt, Human
acaguuccccuauguggaa

SEQ ID NO: 1805114 - RNA, 22 nt, Human
ucuaaaaaaggaauccucugug

SEQ ID NO: 1805115 - RNA, 13 nt, Human
cuacuagaaaauu

SEQ ID NO: 1805116 - RNA, 21 nt, Human
uccccuugggggugguggaug

SEQ ID NO: 1805117 - RNA, 23 nt, Human
guucucuaauauguaaaauuaca

SEQ ID NO: 1805118 - RNA, 23 nt, Human
aaguauccuucagccugaaagag

SEQ ID NO: 1805119 - RNA, 22 nt, Human
uauguuuaacguuuucauuaaa

SEQ ID NO: 1805120 - RNA, 19 nt, Human
cuccuggguucaagcgauu

SEQ ID NO: 1805121 - RNA, 20 nt, Human
aaaaucuuaaaugccaggcc

SEQ ID NO: 1805122 - RNA, 13 nt, Human
ccuagccugccuc

SEQ ID NO: 1805123 - RNA, 20 nt, Human
cugauuuaucuauuuaaaua

SEQ ID NO: 1805124 - RNA, 19 nt, Human
augaaguacucauacaugu

SEQ ID NO: 1805125 - RNA, 11 nt, Human
aggaguacacc

SEQ ID NO: 1805126 - RNA, 23 nt, Human
uauuuauaaaaauaaaaaacacu

SEQ ID NO: 1805127 - RNA, 21 nt, Human
agaacaucccuccugggaaug

SEQ ID NO: 1805128 - RNA, 14 nt, Human
cuacaaagaugacu

SEQ ID NO: 1805129 - RNA, 23 nt, Human
aaacuuuauuuuguguuuaggaa

SEQ ID NO: 1805130 - RNA, 23 nt, Human
cucugagaagcucugaagaacuc

SEQ ID NO: 1805131 - RNA, 14 nt, Human
uaaaagcacuuacu

SEQ ID NO: 1805132 - RNA, 15 nt, Human
ucuuuaauuuuacau

SEQ ID NO: 1805133 - RNA, 21 nt, Human
ucacucacauccauucuuccc

SEQ ID NO: 1805134 - RNA, 21 nt, Human
aggaagaucccuuuguccaca

SEQ ID NO: 1805135 - RNA, 18 nt, Human
gauuuugcaguucuuugg

SEQ ID NO: 1805136 - RNA, 20 nt, Human
gaaaacccagauaaagguuc

SEQ ID NO: 1805137 - RNA, 20 nt, Human
guucaagcaauccucccacu

SEQ ID NO: 1805138 - RNA, 16 nt, Human
auuccuuaagauauua

SEQ ID NO: 1805139 - RNA, 15 nt, Human
uuuaguguucauaaa

SEQ ID NO: 1805140 - RNA, 16 nt, Human
uauaaauuuaucauuu

SEQ ID NO: 1805141 - RNA, 22 nt, Human
uauaagaaauaggaaauauuuu

SEQ ID NO: 1805142 - RNA, 13 nt, Human
ucuuauuucuguc

SEQ ID NO: 1805143 - RNA, 15 nt, Human
agagcccugaggccu

SEQ ID NO: 1805144 - RNA, 19 nt, Human
uccaguauuguuccuuuug

SEQ ID NO: 1805145 - RNA, 15 nt, Human
uugcagcucuccccu

SEQ ID NO: 1805146 - RNA, 13 nt, Human
uacacuuuuuaaa

SEQ ID NO: 1805147 - RNA, 15 nt, Human
caaagaugacugugg

SEQ ID NO: 1805148 - RNA, 17 nt, Human
cgauaaaagacagugaa

SEQ ID NO: 1805149 - RNA, 17 nt, Human
uaaucccgauucacccu

SEQ ID NO: 1805150 - RNA, 19 nt, Human
auuuucaguuauuauauuu

SEQ ID NO: 1805151 - RNA, 18 nt, Human
agcccuuuugucucugca

SEQ ID NO: 1805152 - RNA, 17 nt, Human
cccaacagcacccucuc

SEQ ID NO: 1805153 - RNA, 20 nt, Human
gacagagccccacccucaga

SEQ ID NO: 1805154 - RNA, 15 nt, Human
acuuguggacuaaaa

SEQ ID NO: 1805155 - RNA, 13 nt, Human
cacuaucuguaau

SEQ ID NO: 1805156 - RNA, 21 nt, Human
cuguuuucuuucuaaugagau

SEQ ID NO: 1805157 - RNA, 15 nt, Human
uaaacucagaggcag

SEQ ID NO: 1805158 - RNA, 18 nt, Human
auuuccucaaaaagauuu

SEQ ID NO: 1805159 - RNA, 19 nt, Human
gaaaggccuuuaaaauuuu

SEQ ID NO: 1805160 - RNA, 19 nt, Human
gucagaguuccgacugcca

SEQ ID NO: 1805161 - RNA, 18 nt, Human
accuccuuccaggggagg

SEQ ID NO: 1805162 - RNA, 18 nt, Human
gaccugaguauccccagc

SEQ ID NO: 1805163 - RNA, 17 nt, Human
agcuaggaauuguguuu

SEQ ID NO: 1805164 - RNA, 14 nt, Human
ccucugcagcuucc

SEQ ID NO: 1805165 - RNA, 14 nt, Human
ggacucaccucccc

SEQ ID NO: 1805166 - RNA, 12 nt, Human
cccaucuaggga

SEQ ID NO: 1805167 - RNA, 23 nt, Human
gaaagggauuuucagcccucaga

SEQ ID NO: 1805168 - RNA, 12 nt, Human
ucucuucuuuuc

SEQ ID NO: 1805169 - RNA, 18 nt, Human
ggucccuauuccuccuuc

SEQ ID NO: 1805170 - RNA, 16 nt, Human
ucaccugggcugaggc

SEQ ID NO: 1805171 - RNA, 14 nt, Human
agccucaagucuua

SEQ ID NO: 1805172 - RNA, 13 nt, Human
aacucuauaaugu

SEQ ID NO: 1805173 - RNA, 14 nt, Human
aucuauguagaaua

SEQ ID NO: 1805174 - RNA, 16 nt, Human
ugcaccaugcugcugg

SEQ ID NO: 1805175 - RNA, 15 nt, Human
ucaaaggacaccauu

SEQ ID NO: 1805176 - RNA, 22 nt, Human
acuggacugacgacuugagugc

SEQ ID NO: 1805177 - RNA, 21 nt, Human
guaucuagccuggaaccaagg

SEQ ID NO: 1805178 - RNA, 21 nt, Human
uaucaugugaaaucauucauu

SEQ ID NO: 1805179 - RNA, 17 nt, Human
agauacaugcuuuuuaa

SEQ ID NO: 1805180 - RNA, 22 nt, Human
uucuuuuuguuccccuuugcuu

SEQ ID NO: 1805181 - RNA, 14 nt, Human
cugcaggucccuaa

SEQ ID NO: 1805182 - RNA, 23 nt, Human
cugauuuuuaaguuauuuuuaca

SEQ ID NO: 1805183 - RNA, 18 nt, Human
gauuuuagccuucucugu

SEQ ID NO: 1805184 - RNA, 15 nt, Human
ggccuucggccucca

SEQ ID NO: 1805185 - RNA, 23 nt, Human
acauucagggcuauuuuuucccc

SEQ ID NO: 1805186 - RNA, 19 nt, Human
uaaauaaaaagcauuauua

SEQ ID NO: 1805187 - RNA, 23 nt, Human
acuuuuccuuugaauccucucuc

SEQ ID NO: 1805188 - RNA, 22 nt, Human
ccauuucuugagguaaaagcau

SEQ ID NO: 1805189 - RNA, 16 nt, Human
auaguaccucugcuau

SEQ ID NO: 1805190 - RNA, 18 nt, Human
uaguuggaaucauauugu

SEQ ID NO: 1805191 - RNA, 12 nt, Human
aguccccagccu

SEQ ID NO: 1805192 - RNA, 22 nt, Human
uucugccccugcugacacagac

SEQ ID NO: 1805193 - RNA, 15 nt, Human
ccagcuaauuuuugu

SEQ ID NO: 1805194 - RNA, 18 nt, Human
ugcaugcacuucuuacaa

SEQ ID NO: 1805195 - RNA, 15 nt, Human
ugcuagagugacuca

SEQ ID NO: 1805196 - RNA, 21 nt, Human
accuuccuuuuacuuuucuuc

SEQ ID NO: 1805197 - RNA, 15 nt, Human
cuucugagccugccu

SEQ ID NO: 1805198 - RNA, 23 nt, Human
uuucccaucucagguguguugca

SEQ ID NO: 1805199 - RNA, 18 nt, Human
uacaagcaaugccugccc

SEQ ID NO: 1805200 - RNA, 17 nt, Human
cguucacauguguggua

SEQ ID NO: 1805201 - RNA, 21 nt, Human
aagcaguugagacaagaaaau

SEQ ID NO: 1805202 - RNA, 23 nt, Human
cuucaacucccugccccccagcc

SEQ ID NO: 1805203 - RNA, 16 nt, Human
aauauaaauaaaaaua

SEQ ID NO: 1805204 - RNA, 14 nt, Human
accuccgccuccca

SEQ ID NO: 1805205 - RNA, 16 nt, Human
cuguaaaaucuuucuu

SEQ ID NO: 1805206 - RNA, 17 nt, Human
uguagcauccucuuuaa

SEQ ID NO: 1805207 - RNA, 15 nt, Human
ggcagccagaccagc

SEQ ID NO: 1805208 - RNA, 18 nt, Human
aaaagauauaagugcugu

SEQ ID NO: 1805209 - RNA, 20 nt, Human
gugacaaccaaaagucuuca

SEQ ID NO: 1805210 - RNA, 17 nt, Human
ccaccaggaguucuccc

SEQ ID NO: 1805211 - RNA, 18 nt, Human
auagaugcugauggagcc

SEQ ID NO: 1805212 - RNA, 17 nt, Human
gggacccugucucuaca

SEQ ID NO: 1805213 - RNA, 12 nt, Human
uucuucucccaa

SEQ ID NO: 1805214 - RNA, 16 nt, Human
uuaauaauuuuuaauu

SEQ ID NO: 1805215 - RNA, 17 nt, Human
uagaggcuuccuucauu

SEQ ID NO: 1805216 - RNA, 18 nt, Human
ucaguucucuugauuuuc

SEQ ID NO: 1805217 - RNA, 13 nt, Human
cuaugaaauauua

SEQ ID NO: 1805218 - RNA, 17 nt, Human
cugggaucacugaugac

SEQ ID NO: 1805219 - RNA, 17 nt, Human
auucagaauuucuaaaa

SEQ ID NO: 1805220 - RNA, 19 nt, Human
auuuccucaaaaagauuuc

SEQ ID NO: 1805221 - RNA, 13 nt, Human
auauauuuuguag

SEQ ID NO: 1805222 - RNA, 12 nt, Human
uggaaaaugaau

SEQ ID NO: 1805223 - RNA, 18 nt, Human
ucacaacagcugccugga

SEQ ID NO: 1805224 - RNA, 17 nt, Human
ucauaaugguuuuuaac

SEQ ID NO: 1805225 - RNA, 17 nt, Human
uuauauccacuaaaauc

SEQ ID NO: 1805226 - RNA, 16 nt, Human
ccuccccugccucacc

SEQ ID NO: 1805227 - RNA, 19 nt, Human
uuguaauaaaaugucuauu

SEQ ID NO: 1805228 - RNA, 14 nt, Human
agcucaccaguccc

SEQ ID NO: 1805229 - RNA, 19 nt, Human
auaaaagacaaggaaaaaa

SEQ ID NO: 1805230 - RNA, 18 nt, Human
uaacaggcaaaaggaagc

SEQ ID NO: 1805231 - RNA, 15 nt, Human
cuaagcaaaauguga

SEQ ID NO: 1805232 - RNA, 18 nt, Human
gaaaucaugaagauauuu

SEQ ID NO: 1805233 - RNA, 12 nt, Human
cagacacaugug

SEQ ID NO: 1805234 - RNA, 14 nt, Human
agcaccugggauua

SEQ ID NO: 1805235 - RNA, 12 nt, Human
ucuacacuccag

SEQ ID NO: 1805236 - RNA, 14 nt, Human
cccuagccagaggc

SEQ ID NO: 1805237 - RNA, 17 nt, Human
gaacucugagcagugcu

SEQ ID NO: 1805238 - RNA, 23 nt, Human
auaucuuguuuuggugguuuuag

SEQ ID NO: 1805239 - RNA, 19 nt, Human
auuauguguguuuuaaaau

SEQ ID NO: 1805240 - RNA, 15 nt, Human
cauuguauucagagu

SEQ ID NO: 1805241 - RNA, 18 nt, Human
acagggaugaggcagacc

SEQ ID NO: 1805242 - RNA, 17 nt, Human
acauuuccuaaauauau

SEQ ID NO: 1805243 - RNA, 20 nt, Human
aaguuuaauggugccuucau

SEQ ID NO: 1805244 - RNA, 14 nt, Human
acaagaaaauaaga

SEQ ID NO: 1805245 - RNA, 16 nt, Human
gagggaaaagaaaaag

SEQ ID NO: 1805246 - RNA, 22 nt, Human
augcaaacuuuauuuuguguuu

SEQ ID NO: 1805247 - RNA, 21 nt, Human
ccuccuaacaaguagcacccu

SEQ ID NO: 1805248 - RNA, 10 nt, Human
aggaaaaggg

SEQ ID NO: 1805249 - RNA, 16 nt, Human
caagggcuggagucug

SEQ ID NO: 1805250 - RNA, 14 nt, Human
ugcuguauuuuaaa

SEQ ID NO: 1805251 - RNA, 23 nt, Human
aagauauuuuucaugauuuugaa

SEQ ID NO: 1805252 - RNA, 18 nt, Human
ucuugaaucucugaauuu

SEQ ID NO: 1805253 - RNA, 21 nt, Human
ccucucucuguguuacccagu

SEQ ID NO: 1805254 - RNA, 15 nt, Human
uacacuuuuuaaaau

SEQ ID NO: 1805255 - RNA, 23 nt, Human
uaugaggcuguugucuuuuccuu

SEQ ID NO: 1805256 - RNA, 14 nt, Human
auuuccuucuuuuu

SEQ ID NO: 1805257 - RNA, 15 nt, Human
agcaguagcuggagg

SEQ ID NO: 1805258 - RNA, 10 nt, Human
aaacacaugu

SEQ ID NO: 1805259 - RNA, 13 nt, Human
caucucagcucac

SEQ ID NO: 1805260 - RNA, 23 nt, Human
caacauagugggacccugucucu

SEQ ID NO: 1805261 - RNA, 11 nt, Human
gugcggccagc

SEQ ID NO: 1805262 - RNA, 12 nt, Human
acucccugcccc

SEQ ID NO: 1805263 - RNA, 14 nt, Human
accacacccacacu

SEQ ID NO: 1805264 - RNA, 23 nt, Human
cucuacuaaaaauacaaaaaaaa

SEQ ID NO: 1805265 - RNA, 14 nt, Human
ugagcucagcccug

SEQ ID NO: 1805266 - RNA, 18 nt, Human
cauucccucuccaggaga

SEQ ID NO: 1805267 - RNA, 19 nt, Human
gacucaucuuucccuccuu

SEQ ID NO: 1805268 - RNA, 19 nt, Human
auguaacuucccugaaaaa

SEQ ID NO: 1805269 - RNA, 13 nt, Human
uuuuaaauguuuu

SEQ ID NO: 1805270 - RNA, 18 nt, Human
caggaacaaacagggcug

SEQ ID NO: 1805271 - RNA, 22 nt, Human
aggcucuaauguacaauaaagc

SEQ ID NO: 1805272 - RNA, 15 nt, Human
cuguugccaggcugg

SEQ ID NO: 1805273 - RNA, 13 nt, Human
ccagagacuggga

SEQ ID NO: 1805274 - RNA, 13 nt, Human
cuccucggcuucc

SEQ ID NO: 1805275 - RNA, 14 nt, Human
uguucuauuuuaau

SEQ ID NO: 1805276 - RNA, 21 nt, Human
uucaaaauuguuacaaauugu

SEQ ID NO: 1805277 - RNA, 21 nt, Human
agggcuggagucugcacggga

SEQ ID NO: 1805278 - RNA, 15 nt, Human
uacuagaaaauugug

SEQ ID NO: 1805279 - RNA, 12 nt, Human
auuccuccuucc

SEQ ID NO: 1805280 - RNA, 21 nt, Human
gagccccucacacagcccugg

SEQ ID NO: 1805281 - RNA, 14 nt, Human
uaagcugaaaauau

SEQ ID NO: 1805282 - RNA, 13 nt, Human
agguaaaucagac

SEQ ID NO: 1805283 - RNA, 12 nt, Human
ucaccaauaagu

SEQ ID NO: 1805284 - RNA, 16 nt, Human
ucaguucccucuugcu

SEQ ID NO: 1805285 - RNA, 16 nt, Human
agaauauauuuccuua

SEQ ID NO: 1805286 - RNA, 20 nt, Human
ccucuguauacaaaacccuu

SEQ ID NO: 1805287 - RNA, 14 nt, Human
cagugucaggagga

SEQ ID NO: 1805288 - RNA, 18 nt, Human
agucagucugaugagaac

SEQ ID NO: 1805289 - RNA, 18 nt, Human
cguggugcgagugcguga

SEQ ID NO: 1805290 - RNA, 15 nt, Human
ucugcaaugaccuuc

SEQ ID NO: 1805291 - RNA, 16 nt, Human
uuugugguuagaaaag

SEQ ID NO: 1805292 - RNA, 20 nt, Human
ugccuccccugccucaccag

SEQ ID NO: 1805293 - RNA, 12 nt, Human
uacaugguguuu

SEQ ID NO: 1805294 - RNA, 17 nt, Human
cauaguaccucugcuau

SEQ ID NO: 1805295 - RNA, 17 nt, Human
cuuacaugauucauuuu

SEQ ID NO: 1805296 - RNA, 13 nt, Human
uuaaaugaagaaa

SEQ ID NO: 1805297 - RNA, 15 nt, Human
uggcgcaggaacuca

SEQ ID NO: 1805298 - RNA, 16 nt, Human
ugcuuucuucucccaa

SEQ ID NO: 1805299 - RNA, 20 nt, Human
acugagauccuuccuuuuga

SEQ ID NO: 1805300 - RNA, 23 nt, Human
uaagaaaggauaaaguugguaaa

SEQ ID NO: 1805301 - RNA, 16 nt, Human
uucccuguuucuucca

SEQ ID NO: 1805302 - RNA, 14 nt, Human
ccaacguggcccag

SEQ ID NO: 1805303 - RNA, 22 nt, Human
gacacaugugcuggccaccugc

SEQ ID NO: 1805304 - RNA, 22 nt, Human
aaacauccuacaagacacagug

SEQ ID NO: 1805305 - RNA, 15 nt, Human
auuauuuucuacaca

SEQ ID NO: 1805306 - RNA, 21 nt, Human
cugauauuggacaguaaaauc

SEQ ID NO: 1805307 - RNA, 22 nt, Human
aaagauggggucuguaaaaucu

SEQ ID NO: 1805308 - RNA, 22 nt, Human
gaagcuaaaaggaaagaaaaua

SEQ ID NO: 1805309 - RNA, 13 nt, Human
aaaugagaaaucu

SEQ ID NO: 1805310 - RNA, 15 nt, Human
uggacgagaaaacaa

SEQ ID NO: 1805311 - RNA, 17 nt, Human
cugagccagcagccugg

SEQ ID NO: 1805312 - RNA, 20 nt, Human
auuacugccuauuuuaauaa

SEQ ID NO: 1805313 - RNA, 23 nt, Human
cagcuucagccaggagcugggca

SEQ ID NO: 1805314 - RNA, 23 nt, Human
ccuaagggauccugccugccccu

SEQ ID NO: 1805315 - RNA, 14 nt, Human
aauauaaauaaaaa

SEQ ID NO: 1805316 - RNA, 20 nt, Human
aagggauuuucagcccucag

SEQ ID NO: 1805317 - RNA, 20 nt, Human
cucccugccccccagcccuc

SEQ ID NO: 1805318 - RNA, 21 nt, Human
uauacucucaccauuuggauc

SEQ ID NO: 1805319 - RNA, 14 nt, Human
ugcaucugaaaauu

SEQ ID NO: 1805320 - RNA, 13 nt, Human
uccuucauuuccu

SEQ ID NO: 1805321 - RNA, 13 nt, Human
cacuagcccuccu

SEQ ID NO: 1805322 - RNA, 11 nt, Human
cuucagugcug

SEQ ID NO: 1805323 - RNA, 21 nt, Human
auaagcuuuucuuuucuuugu

SEQ ID NO: 1805324 - RNA, 22 nt, Human
guucucuaucauuuaauaauau

SEQ ID NO: 1805325 - RNA, 22 nt, Human
aagcucuccaaaggcucagauu

SEQ ID NO: 1805326 - RNA, 12 nt, Human
cugagccugccu

SEQ ID NO: 1805327 - RNA, 18 nt, Human
ggccuugugaggagcugg

SEQ ID NO: 1805328 - RNA, 17 nt, Human
gccuaacacggugcuca

SEQ ID NO: 1805329 - RNA, 23 nt, Human
uaagucugugagauucauucaug

SEQ ID NO: 1805330 - RNA, 12 nt, Human
ucccaccaggcu

SEQ ID NO: 1805331 - RNA, 17 nt, Human
uucuccauacucuguaa

SEQ ID NO: 1805332 - RNA, 14 nt, Human
caguugagacaaga

SEQ ID NO: 1805333 - RNA, 13 nt, Human
ccaccugccuaua

SEQ ID NO: 1805334 - RNA, 18 nt, Human
ccagccccguagacgugc

SEQ ID NO: 1805335 - RNA, 14 nt, Human
uauaucaaaucuac

SEQ ID NO: 1805336 - RNA, 13 nt, Human
ccaugucaagggu

SEQ ID NO: 1805337 - RNA, 16 nt, Human
auucuuauuauuuuug

SEQ ID NO: 1805338 - RNA, 21 nt, Human
gcacauauccaggcaccagga

SEQ ID NO: 1805339 - RNA, 17 nt, Human
cccaaagugcugggauu

SEQ ID NO: 1805340 - RNA, 14 nt, Human
uucugagccugccu

SEQ ID NO: 1805341 - RNA, 13 nt, Human
uauaacgucaugu

SEQ ID NO: 1805342 - RNA, 20 nt, Human
cucuguucugcacacagcac

SEQ ID NO: 1805343 - RNA, 13 nt, Human
guaacuaauuuua

SEQ ID NO: 1805344 - RNA, 15 nt, Human
aagaaaauaacaaua

SEQ ID NO: 1805345 - RNA, 12 nt, Human
aaaugaaaaaau

SEQ ID NO: 1805346 - RNA, 14 nt, Human
gaaauuuauaaacu

SEQ ID NO: 1805347 - RNA, 20 nt, Human
aggaugaggaaagcauguau

SEQ ID NO: 1805348 - RNA, 22 nt, Human
aaaugaaucccucuaucucuaa

SEQ ID NO: 1805349 - RNA, 22 nt, Human
cuccagaugagaguacacccca

SEQ ID NO: 1805350 - RNA, 20 nt, Human
uuuuggugguuuuagugauu

SEQ ID NO: 1805351 - RNA, 21 nt, Human
caggugcuucaggauaccaua

SEQ ID NO: 1805352 - RNA, 13 nt, Human
ugaguuucuuuuu

SEQ ID NO: 1805353 - RNA, 21 nt, Human
uguccucaugagggcuggaug

SEQ ID NO: 1805354 - RNA, 22 nt, Human
uggaagccagaucuaugccaca

SEQ ID NO: 1805355 - RNA, 17 nt, Human
gauaaaagacagugaaa

SEQ ID NO: 1805356 - RNA, 21 nt, Human
ccaguagaugccacuagcccu

SEQ ID NO: 1805357 - RNA, 22 nt, Human
cugauuuuuaaguuauuuuuac

SEQ ID NO: 1805358 - RNA, 19 nt, Human
gaggccuagacucugucua

SEQ ID NO: 1805359 - RNA, 23 nt, Human
ccuaacacggugcucauuuuuuc

SEQ ID NO: 1805360 - RNA, 13 nt, Human
cuugcucucggug

SEQ ID NO: 1805361 - RNA, 17 nt, Human
acuuuauguuacuacau

SEQ ID NO: 1805362 - RNA, 12 nt, Human
acacagcccugg

SEQ ID NO: 1805363 - RNA, 14 nt, Human
uugggaugcuacuc

SEQ ID NO: 1805364 - RNA, 17 nt, Human
aaguuuguugaaacaca

SEQ ID NO: 1805365 - RNA, 19 nt, Human
uaguuuaugauuccaccua

SEQ ID NO: 1805366 - RNA, 14 nt, Human
agauuuuucaugau

SEQ ID NO: 1805367 - RNA, 18 nt, Human
acuugcugcaguaugaaa

SEQ ID NO: 1805368 - RNA, 17 nt, Human
augguggccuggggcuu

SEQ ID NO: 1805369 - RNA, 20 nt, Human
aaacuaaggcccucuugaau

SEQ ID NO: 1805370 - RNA, 14 nt, Human
agaggcucuaaugu

SEQ ID NO: 1805371 - RNA, 16 nt, Human
agugaaagaaaauaac

SEQ ID NO: 1805372 - RNA, 22 nt, Human
uaaaaucuuucuuucuuagaaa

SEQ ID NO: 1805373 - RNA, 14 nt, Human
cucagccucccaag

SEQ ID NO: 1805374 - RNA, 11 nt, Human
auuucucauac

SEQ ID NO: 1805375 - RNA, 14 nt, Human
gaaacgaagcacca

SEQ ID NO: 1805376 - RNA, 17 nt, Human
agaagucugcuacccuc

SEQ ID NO: 1805377 - RNA, 15 nt, Human
aagcacuaaacaaag

SEQ ID NO: 1805378 - RNA, 19 nt, Human
acauauauauauagcagcu

SEQ ID NO: 1805379 - RNA, 21 nt, Human
aaaauuuuuucucuaggaaau

SEQ ID NO: 1805380 - RNA, 20 nt, Human
gaguggcuggggcauggaag

SEQ ID NO: 1805381 - RNA, 14 nt, Human
cucacugcaaccuc

SEQ ID NO: 1805382 - RNA, 22 nt, Human
ccccacuacaagugauccucag

SEQ ID NO: 1805383 - RNA, 19 nt, Human
caauucagggagugggcua

SEQ ID NO: 1805384 - RNA, 23 nt, Human
uuuccucaaaaagauuuccccau

SEQ ID NO: 1805385 - RNA, 18 nt, Human
acccguggcgcuuucugc

SEQ ID NO: 1805386 - RNA, 16 nt, Human
gcaacuuuguauaaaa

SEQ ID NO: 1805387 - RNA, 18 nt, Human
uuauuacuguaagaaaau

SEQ ID NO: 1805388 - RNA, 21 nt, Human
cuccagcuggccgggagccug

SEQ ID NO: 1805389 - RNA, 20 nt, Human
gcagagaugaggccgccaug

SEQ ID NO: 1805390 - RNA, 15 nt, Human
ggggcccaugaaaga

SEQ ID NO: 1805391 - RNA, 19 nt, Human
guucccaccaggcugcuca

SEQ ID NO: 1805392 - RNA, 15 nt, Human
uuccaucaccucccc

SEQ ID NO: 1805393 - RNA, 23 nt, Human
uaagagcucaggaugagggaaaa

SEQ ID NO: 1805394 - RNA, 14 nt, Human
uggaccucaccaag

SEQ ID NO: 1805395 - RNA, 19 nt, Human
caccaugcugcuggggaag

SEQ ID NO: 1805396 - RNA, 17 nt, Human
cuucacuguaaaauaau

SEQ ID NO: 1805397 - RNA, 15 nt, Human
uucuucucuccagug

SEQ ID NO: 1805398 - RNA, 21 nt, Human
uccguuuacuuguuucagagu

SEQ ID NO: 1805399 - RNA, 16 nt, Human
ccuugcugaacucccu

SEQ ID NO: 1805400 - RNA, 17 nt, Human
ucuuuaucuuuuuagua

SEQ ID NO: 1805401 - RNA, 19 nt, Human
augauacuugaaaauuaac

SEQ ID NO: 1805402 - RNA, 15 nt, Human
gauaagaucuuuuau

SEQ ID NO: 1805403 - RNA, 14 nt, Human
cucccuugcucugc

SEQ ID NO: 1805404 - RNA, 21 nt, Human
cacucaugcauuguccucuuu

SEQ ID NO: 1805405 - RNA, 18 nt, Human
auguacugauuacugccu

SEQ ID NO: 1805406 - RNA, 14 nt, Human
aagcucuaucacca

SEQ ID NO: 1805407 - RNA, 18 nt, Human
ucuguaucuagccuggaa

SEQ ID NO: 1805408 - RNA, 19 nt, Human
aaugcagugccuuucuucu

SEQ ID NO: 1805409 - RNA, 14 nt, Human
ucacaauaauuuuc

SEQ ID NO: 1805410 - RNA, 15 nt, Human
uacgcaucagacaga

SEQ ID NO: 1805411 - RNA, 18 nt, Human
cuggucucaaacuccuga

SEQ ID NO: 1805412 - RNA, 18 nt, Human
auggcuugaguuuaaauu

SEQ ID NO: 1805413 - RNA, 14 nt, Human
uucacauuuaaaua

SEQ ID NO: 1805414 - RNA, 16 nt, Human
aaaauaauccucaguu

SEQ ID NO: 1805415 - RNA, 21 nt, Human
aaugugacuuaaugccacuaa

SEQ ID NO: 1805416 - RNA, 13 nt, Human
guuguguguggaa

SEQ ID NO: 1805417 - RNA, 18 nt, Human
uuggaagaggacuccuua

SEQ ID NO: 1805418 - RNA, 16 nt, Human
uaaugguggccugggg

SEQ ID NO: 1805419 - RNA, 13 nt, Human
uauugcuguccug

SEQ ID NO: 1805420 - RNA, 21 nt, Human
cuggcacagagguagucucac

SEQ ID NO: 1805421 - RNA, 23 nt, Human
agcaauccucccacuucagccuc

SEQ ID NO: 1805422 - RNA, 15 nt, Human
uucagaguuuguauu

SEQ ID NO: 1805423 - RNA, 14 nt, Human
uucugagcaccuac

SEQ ID NO: 1805424 - RNA, 16 nt, Human
guccauugggcaggca

SEQ ID NO: 1805425 - RNA, 14 nt, Human
uuucuaugaaauau

SEQ ID NO: 1805426 - RNA, 16 nt, Human
ugggaaugaagcaaug

SEQ ID NO: 1805427 - RNA, 17 nt, Human
cugcugagugcaccacu

SEQ ID NO: 1805428 - RNA, 13 nt, Human
accuccgccuccc

SEQ ID NO: 1805429 - RNA, 21 nt, Human
ugccagcuggccuugugagga

SEQ ID NO: 1805430 - RNA, 16 nt, Human
agagguccacaacaca

SEQ ID NO: 1805431 - RNA, 17 nt, Human
cuaauaucuuaucuucc

SEQ ID NO: 1805432 - RNA, 23 nt, Human
acugcuaguuuauauagaaaugu

SEQ ID NO: 1805433 - RNA, 17 nt, Human
ucauagagacuugggaa

SEQ ID NO: 1805434 - RNA, 18 nt, Human
cucccacuucagccuccc

SEQ ID NO: 1805435 - RNA, 16 nt, Human
agccuacuaaaugcuc

SEQ ID NO: 1805436 - RNA, 16 nt, Human
acaugaaguccaagca

SEQ ID NO: 1805437 - RNA, 13 nt, Human
ugaaaugcagagu

SEQ ID NO: 1805438 - RNA, 13 nt, Human
cauuuguauaaaa

SEQ ID NO: 1805439 - RNA, 22 nt, Human
cuuggccaugggaggccuuucc

SEQ ID NO: 1805440 - RNA, 13 nt, Human
uaaagcaaugugg

SEQ ID NO: 1805441 - RNA, 16 nt, Human
ugagaugcuagaacuc

SEQ ID NO: 1805442 - RNA, 19 nt, Human
ccccuagccugccuccccu

SEQ ID NO: 1805443 - RNA, 17 nt, Human
uucccgaaggaaaaggg

SEQ ID NO: 1805444 - RNA, 14 nt, Human
agucugacuguuuc

SEQ ID NO: 1805445 - RNA, 17 nt, Human
acagggaccagggauga

SEQ ID NO: 1805446 - RNA, 16 nt, Human
uuuucucuaggaaaua

SEQ ID NO: 1805447 - RNA, 20 nt, Human
agcucugcauuaucugaggu

SEQ ID NO: 1805448 - RNA, 15 nt, Human
caccaggcugcucag

SEQ ID NO: 1805449 - RNA, 17 nt, Human
auaucuuaucuuccuau

SEQ ID NO: 1805450 - RNA, 21 nt, Human
ucaccugggcugaggcauccu

SEQ ID NO: 1805451 - RNA, 18 nt, Human
caaagccuucauugccuu

SEQ ID NO: 1805452 - RNA, 17 nt, Human
auuucauugcucagaaa

SEQ ID NO: 1805453 - RNA, 16 nt, Human
cugagcauuuaauaug

SEQ ID NO: 1805454 - RNA, 15 nt, Human
auucauauuuucuuu

SEQ ID NO: 1805455 - RNA, 18 nt, Human
caagcgauucuccugccu

SEQ ID NO: 1805456 - RNA, 17 nt, Human
caccaggcugcucaggg

SEQ ID NO: 1805457 - RNA, 22 nt, Human
aaaugcauauacuuuaauaaau

SEQ ID NO: 1805458 - RNA, 16 nt, Human
aaguaaaggcaaacuu

SEQ ID NO: 1805459 - RNA, 19 nt, Human
ugcuauuugcuguuauuuu

SEQ ID NO: 1805460 - RNA, 19 nt, Human
aauuguggggaugaugaaa

SEQ ID NO: 1805461 - RNA, 14 nt, Human
aacagcacccucuc

SEQ ID NO: 1805462 - RNA, 15 nt, Human
cuguaaucccagcau

SEQ ID NO: 1805463 - RNA, 20 nt, Human
uuuuucagaaucucucuucu

SEQ ID NO: 1805464 - RNA, 16 nt, Human
uuucauccuuuucauu

SEQ ID NO: 1805465 - RNA, 19 nt, Human
ggaauuuaaaucacucaaa

SEQ ID NO: 1805466 - RNA, 13 nt, Human
cauuuccuaaaua

SEQ ID NO: 1805467 - RNA, 14 nt, Human
accugucaucucac

SEQ ID NO: 1805468 - RNA, 18 nt, Human
acccuccagagacaacag

SEQ ID NO: 1805469 - RNA, 15 nt, Human
ugcucagaaauguca

SEQ ID NO: 1805470 - RNA, 22 nt, Human
cagcagccagccaacccuuuca

SEQ ID NO: 1805471 - RNA, 18 nt, Human
caacagcacccucuccag

SEQ ID NO: 1805472 - RNA, 22 nt, Human
uucuucucccaauucauccuca

SEQ ID NO: 1805473 - RNA, 16 nt, Human
agugaaauauuauuuu

SEQ ID NO: 1805474 - RNA, 19 nt, Human
uggaaauagugauuuccac

SEQ ID NO: 1805475 - RNA, 15 nt, Human
gacaguauggcagcu

SEQ ID NO: 1805476 - RNA, 15 nt, Human
guuagccaggcuggu

SEQ ID NO: 1805477 - RNA, 20 nt, Human
cgcaugcggcccaggauggc

SEQ ID NO: 1805478 - RNA, 15 nt, Human
agguauaccucacuu

SEQ ID NO: 1805479 - RNA, 21 nt, Human
aggauauccucccuccagaua

SEQ ID NO: 1805480 - RNA, 15 nt, Human
cauuaaauuuuagca

SEQ ID NO: 1805481 - RNA, 19 nt, Human
ucaugaagauauuuuucca

SEQ ID NO: 1805482 - RNA, 13 nt, Human
aacucccugcccc

SEQ ID NO: 1805483 - RNA, 14 nt, Human
uaacaugaauauuu

SEQ ID NO: 1805484 - RNA, 20 nt, Human
ugaaccaccgcgcccagccu

SEQ ID NO: 1805485 - RNA, 19 nt, Human
ccugauuauuuucuacaca

SEQ ID NO: 1805486 - RNA, 13 nt, Human
cuuuguauaaaag

SEQ ID NO: 1805487 - RNA, 16 nt, Human
uucuccauccuaccac

SEQ ID NO: 1805488 - RNA, 20 nt, Human
ccccagugcggccagcuccg

SEQ ID NO: 1805489 - RNA, 20 nt, Human
gugaccaaccuuuucccaac

SEQ ID NO: 1805490 - RNA, 15 nt, Human
acuccuuucucaucu

SEQ ID NO: 1805491 - RNA, 16 nt, Human
ugcacaucaaaauaug

SEQ ID NO: 1805492 - RNA, 11 nt, Human
cuccucaggga

SEQ ID NO: 1805493 - RNA, 17 nt, Human
aauaaacuauuuguaaa

SEQ ID NO: 1805494 - RNA, 16 nt, Human
gaagguggaaauaaac

SEQ ID NO: 1805495 - RNA, 11 nt, Human
aaauaaaccuu

SEQ ID NO: 1805496 - RNA, 18 nt, Human
uuuuaaauauuuuuucuu

SEQ ID NO: 1805497 - RNA, 18 nt, Human
aaaaguucugcagauaaa

SEQ ID NO: 1805498 - RNA, 13 nt, Human
uccucuccaccau

SEQ ID NO: 1805499 - RNA, 19 nt, Human
ucgcagauucucccuugcu

SEQ ID NO: 1805500 - RNA, 18 nt, Human
uguauagaccuaaaauaa

SEQ ID NO: 1805501 - RNA, 20 nt, Human
ugcggcuccucagggacuca

SEQ ID NO: 1805502 - RNA, 19 nt, Human
cuuacuggugcuauuuugu

SEQ ID NO: 1805503 - RNA, 23 nt, Human
cucauguccacugguucuucuug

SEQ ID NO: 1805504 - RNA, 16 nt, Human
accauguuggccaggc

SEQ ID NO: 1805505 - RNA, 14 nt, Human
cucugccucagaaa

SEQ ID NO: 1805506 - RNA, 19 nt, Human
uuuuauuuuuuucugaauu

SEQ ID NO: 1805507 - RNA, 14 nt, Human
guuauauaaucauu

SEQ ID NO: 1805508 - RNA, 22 nt, Human
uuagcagucccuccacauuucc

SEQ ID NO: 1805509 - RNA, 18 nt, Human
uuauaaaaauaaaaaaca

SEQ ID NO: 1805510 - RNA, 13 nt, Human
cgaaggaaaaggg

SEQ ID NO: 1805511 - RNA, 19 nt, Human
auagugaggagcuuugaaa

SEQ ID NO: 1805512 - RNA, 17 nt, Human
gaucucagcucacugca

SEQ ID NO: 1805513 - RNA, 18 nt, Human
ucggcuuccuuccucucu

SEQ ID NO: 1805514 - RNA, 19 nt, Human
cagggacagacauacauuu

SEQ ID NO: 1805515 - RNA, 21 nt, Human
ccaugucuacacagauguuca

SEQ ID NO: 1805516 - RNA, 13 nt, Human
acuucuauuuuua

SEQ ID NO: 1805517 - RNA, 15 nt, Human
gguuggagugcagug

SEQ ID NO: 1805518 - RNA, 14 nt, Human
guaggaaacuaggu

SEQ ID NO: 1805519 - RNA, 18 nt, Human
gccuaagggauccugccu

SEQ ID NO: 1805520 - RNA, 15 nt, Human
aauugacccacaaga

SEQ ID NO: 1805521 - RNA, 15 nt, Human
ggcucuaauguacaa

SEQ ID NO: 1805522 - RNA, 17 nt, Human
cacccucuccagaugca

SEQ ID NO: 1805523 - RNA, 21 nt, Human
auguuuacagauccccaagcc

SEQ ID NO: 1805524 - RNA, 15 nt, Human
agccugaaagaggaa

SEQ ID NO: 1805525 - RNA, 11 nt, Human
gccugccuccc

SEQ ID NO: 1805526 - RNA, 20 nt, Human
ccccuauccuacuuccccuu

SEQ ID NO: 1805527 - RNA, 12 nt, Human
ucccuagccaga

SEQ ID NO: 1805528 - RNA, 17 nt, Human
cugccggcacagaacuu

SEQ ID NO: 1805529 - RNA, 15 nt, Human
gcacuggccacccaa

SEQ ID NO: 1805530 - RNA, 17 nt, Human
caaaccaauuaaaccca

SEQ ID NO: 1805531 - RNA, 19 nt, Human
uggcaagcucuaucaccaa

SEQ ID NO: 1805532 - RNA, 20 nt, Human
aacagucucuugaggcacag

SEQ ID NO: 1805533 - RNA, 14 nt, Human
aguggggaagaggg

SEQ ID NO: 1805534 - RNA, 17 nt, Human
ugggagaaaugaaaaaa

SEQ ID NO: 1805535 - RNA, 22 nt, Human
aaacugauuuaucuauuuaaau

SEQ ID NO: 1805536 - RNA, 19 nt, Human
cugccaaaacaucaaccug

SEQ ID NO: 1805537 - RNA, 14 nt, Human
uauggcuccuccau

SEQ ID NO: 1805538 - RNA, 12 nt, Human
ucuuuucugacu

SEQ ID NO: 1805539 - RNA, 13 nt, Human
agcuggagugcag

SEQ ID NO: 1805540 - RNA, 16 nt, Human
uacaaaugggaaacaa

SEQ ID NO: 1805541 - RNA, 12 nt, Human
uaucuauuuaaa

SEQ ID NO: 1805542 - RNA, 18 nt, Human
ugagacagagucuuccuc

SEQ ID NO: 1805543 - RNA, 22 nt, Human
cuucaacucccugccccccagc

SEQ ID NO: 1805544 - RNA, 17 nt, Human
gcaugguuuagaaagcu

SEQ ID NO: 1805545 - RNA, 18 nt, Human
ugagccugccuuucuccc

SEQ ID NO: 1805546 - RNA, 20 nt, Human
cacuagacccacuggacuca

SEQ ID NO: 1805547 - RNA, 13 nt, Human
cauaccuucccca

SEQ ID NO: 1805548 - RNA, 19 nt, Human
caguauuguuccuuuugug

SEQ ID NO: 1805549 - RNA, 13 nt, Human
cucagccucccaa

SEQ ID NO: 1805550 - RNA, 22 nt, Human
aauaaguauucuguguuaaaaa

SEQ ID NO: 1805551 - RNA, 12 nt, Human
ucaucuaagccu

SEQ ID NO: 1805552 - RNA, 13 nt, Human
ccagccucagccu

SEQ ID NO: 1805553 - RNA, 13 nt, Human
ucccaaguagcug

SEQ ID NO: 1805554 - RNA, 21 nt, Human
uguucaagcgauucuccugcc

SEQ ID NO: 1805555 - RNA, 23 nt, Human
ggccccuuugcugacccucccca

SEQ ID NO: 1805556 - RNA, 20 nt, Human
ggauuuucagcccucagaau

SEQ ID NO: 1805557 - RNA, 14 nt, Human
uggcuucaaauugu

SEQ ID NO: 1805558 - RNA, 18 nt, Human
ccuagucucuacccagua

SEQ ID NO: 1805559 - RNA, 18 nt, Human
uuucauaaagucuugccu

SEQ ID NO: 1805560 - RNA, 17 nt, Human
uacaaaugcauuucuaa

SEQ ID NO: 1805561 - RNA, 21 nt, Human
cccccucuggcuccagcuggc

SEQ ID NO: 1805562 - RNA, 20 nt, Human
gagccugaucaccugcccug

SEQ ID NO: 1805563 - RNA, 16 nt, Human
agaugagagaacaggg

SEQ ID NO: 1805564 - RNA, 21 nt, Human
cuaccaaaaaucucaauauuu

SEQ ID NO: 1805565 - RNA, 14 nt, Human
ucugaaaauugaug

SEQ ID NO: 1805566 - RNA, 22 nt, Human
gaaucagccuacaggccucaca

SEQ ID NO: 1805567 - RNA, 19 nt, Human
uuauacacuuuuuaaaauc

SEQ ID NO: 1805568 - RNA, 20 nt, Human
cuuuaaaaauaguugcuguc

SEQ ID NO: 1805569 - RNA, 23 nt, Human
acgaggauugggaaaaaguaauu

SEQ ID NO: 1805570 - RNA, 16 nt, Human
aaacauuacucugaaa

SEQ ID NO: 1805571 - RNA, 14 nt, Human
acauccauucuucc

SEQ ID NO: 1805572 - RNA, 22 nt, Human
cuaauguacaauaaagcaaugu

SEQ ID NO: 1805573 - RNA, 17 nt, Human
guugcugggggggauug

SEQ ID NO: 1805574 - RNA, 20 nt, Human
ucucugcaaacugccuucuu

SEQ ID NO: 1805575 - RNA, 17 nt, Human
ccacaauuaauuuuaga

SEQ ID NO: 1805576 - RNA, 21 nt, Human
agcccuuccccucugcagcuu

SEQ ID NO: 1805577 - RNA, 22 nt, Human
ucuauuaccuguuaguauuauu

SEQ ID NO: 1805578 - RNA, 22 nt, Human
cugcugcccucccccuccucuc

SEQ ID NO: 1805579 - RNA, 12 nt, Human
uaccuccaagga

SEQ ID NO: 1805580 - RNA, 16 nt, Human
ugcagugucugcugga

SEQ ID NO: 1805581 - RNA, 17 nt, Human
ccuccuguccagccugc

SEQ ID NO: 1805582 - RNA, 12 nt, Human
ggcagcaccucc

SEQ ID NO: 1805583 - RNA, 15 nt, Human
accucccccaucucu

SEQ ID NO: 1805584 - RNA, 23 nt, Human
gacugugugcucaggagcccugg

SEQ ID NO: 1805585 - RNA, 15 nt, Human
gcuucucaauuucua

SEQ ID NO: 1805586 - RNA, 22 nt, Human
cugaggcuccacuuggucugug

SEQ ID NO: 1805587 - RNA, 22 nt, Human
gucacaggaaguagaggaggcc

SEQ ID NO: 1805588 - RNA, 17 nt, Human
uaacgauaaaagacagu

SEQ ID NO: 1805589 - RNA, 19 nt, Human
guacuauuauccccauuuc

SEQ ID NO: 1805590 - RNA, 19 nt, Human
gucaaauugugugaaaggu

SEQ ID NO: 1805591 - RNA, 23 nt, Human
cacuucaccaauaaguauucugu

SEQ ID NO: 1805592 - RNA, 17 nt, Human
uggugauuccgcaguga

SEQ ID NO: 1805593 - RNA, 19 nt, Human
uagaacauuuucaucaccc

SEQ ID NO: 1805594 - RNA, 16 nt, Human
ugcaaauugucacagg

SEQ ID NO: 1805595 - RNA, 16 nt, Human
ugacuuaaugccacua

SEQ ID NO: 1805596 - RNA, 23 nt, Human
aagagauuuuucaugauuuugaa

SEQ ID NO: 1805597 - RNA, 16 nt, Human
uuaaggguaggcucaa

SEQ ID NO: 1805598 - RNA, 20 nt, Human
cucaaagagggagugcauuu

SEQ ID NO: 1805599 - RNA, 16 nt, Human
cugcccuuccugcagg

SEQ ID NO: 1805600 - RNA, 21 nt, Human
cucuguauuccuagaaacuga

SEQ ID NO: 1805601 - RNA, 14 nt, Human
cccuccgccauucu

SEQ ID NO: 1805602 - RNA, 19 nt, Human
cauaucucccucuucccua

SEQ ID NO: 1805603 - RNA, 23 nt, Human
ggaucaaguccugcaagcagagg

SEQ ID NO: 1805604 - RNA, 16 nt, Human
uaaaauuuuuuuagaa

SEQ ID NO: 1805605 - RNA, 15 nt, Human
caggcagcuuuuucu

SEQ ID NO: 1805606 - RNA, 19 nt, Human
aggcgaucacaacgugcau

SEQ ID NO: 1805607 - RNA, 13 nt, Human
gcaggccagagcu

SEQ ID NO: 1805608 - RNA, 23 nt, Human
cagagucuuacucuguugccagg

SEQ ID NO: 1805609 - RNA, 17 nt, Human
acuggacccuguugcua

SEQ ID NO: 1805610 - RNA, 16 nt, Human
acucuguugccaggcu

SEQ ID NO: 1805611 - RNA, 20 nt, Human
ccucucguaagauuuccuuc

SEQ ID NO: 1805612 - RNA, 17 nt, Human
aguauuucuaugaaaua

SEQ ID NO: 1805613 - RNA, 12 nt, Human
augugugugugu

SEQ ID NO: 1805614 - RNA, 19 nt, Human
gaccaccaagccuugauug

SEQ ID NO: 1805615 - RNA, 17 nt, Human
ucuaauagggcaauuaa

SEQ ID NO: 1805616 - RNA, 16 nt, Human
ugaguccuccugucca

SEQ ID NO: 1805617 - RNA, 22 nt, Human
cccaucugggggccucuucugc

SEQ ID NO: 1805618 - RNA, 18 nt, Human
ucuucuggguuccuuccu

SEQ ID NO: 1805619 - RNA, 14 nt, Human
uaacucaucuguca

SEQ ID NO: 1805620 - RNA, 18 nt, Human
ugccuuucuucucuccag

SEQ ID NO: 1805621 - RNA, 15 nt, Human
augucugccacaccu

SEQ ID NO: 1805622 - RNA, 18 nt, Human
cuuugagcgcccacuaga

SEQ ID NO: 1805623 - RNA, 14 nt, Human
uugguauuguauuu

SEQ ID NO: 1805624 - RNA, 22 nt, Human
caccuccuggguucaagcgauu

SEQ ID NO: 1805625 - RNA, 16 nt, Human
uaucauauauauacau

SEQ ID NO: 1805626 - RNA, 21 nt, Human
ugcacauauccaggcaccagg

SEQ ID NO: 1805627 - RNA, 18 nt, Human
ggacuaaguguaccagag

SEQ ID NO: 1805628 - RNA, 15 nt, Human
cucaaauuguucucu

SEQ ID NO: 1805629 - RNA, 20 nt, Human
uuaaauggucaauuuuguua

SEQ ID NO: 1805630 - RNA, 17 nt, Human
agauacagggaugaggc

SEQ ID NO: 1805631 - RNA, 18 nt, Human
uccauaucucccucuucc

SEQ ID NO: 1805632 - RNA, 17 nt, Human
uuguguuuauaauuuua

SEQ ID NO: 1805633 - RNA, 18 nt, Human
uaaaaacaaagaaauuau

SEQ ID NO: 1805634 - RNA, 17 nt, Human
gugcccccaacagcacc

SEQ ID NO: 1805635 - RNA, 20 nt, Human
cagugaaagaaaauaacgau

SEQ ID NO: 1805636 - RNA, 12 nt, Human
cuugucucccag

SEQ ID NO: 1805637 - RNA, 12 nt, Human
auuuuaaauauu

SEQ ID NO: 1805638 - RNA, 22 nt, Human
uguugcccacagcuguaugauu

SEQ ID NO: 1805639 - RNA, 21 nt, Human
agcccugcaccaugcugcugg

SEQ ID NO: 1805640 - RNA, 23 nt, Human
cccaugguuuuaaucuguauuuc

SEQ ID NO: 1805641 - RNA, 17 nt, Human
caaacauauauaacaau

SEQ ID NO: 1805642 - RNA, 17 nt, Human
caagcaaugccugccca

SEQ ID NO: 1805643 - RNA, 14 nt, Human
aauuauuaagauau

SEQ ID NO: 1805644 - RNA, 18 nt, Human
aggagaccuacccuccac

SEQ ID NO: 1805645 - RNA, 19 nt, Human
ugggacaggggagaaccua

SEQ ID NO: 1805646 - RNA, 16 nt, Human
gccugcucccuagcca

SEQ ID NO: 1805647 - RNA, 18 nt, Human
acacaaauuaucuuaaaa

SEQ ID NO: 1805648 - RNA, 22 nt, Human
agucuccaacggcaagggaaca

SEQ ID NO: 1805649 - RNA, 14 nt, Human
cauugugaaauuau

SEQ ID NO: 1805650 - RNA, 19 nt, Human
caggcaaucugcccgccug

SEQ ID NO: 1805651 - RNA, 18 nt, Human
aacaaugcuguauuuuaa

SEQ ID NO: 1805652 - RNA, 16 nt, Human
ccuaucucuccaacca

SEQ ID NO: 1805653 - RNA, 22 nt, Human
acagcuugaucaaaggcacaca

SEQ ID NO: 1805654 - RNA, 13 nt, Human
caagcugcauuuc

SEQ ID NO: 1805655 - RNA, 20 nt, Human
auuuuuuuagaaagcauuug

SEQ ID NO: 1805656 - RNA, 21 nt, Human
augggagugcccccaacagca

SEQ ID NO: 1805657 - RNA, 13 nt, Human
uaauaaacauucu

SEQ ID NO: 1805658 - RNA, 19 nt, Human
cacuugggucuucccugua

SEQ ID NO: 1805659 - RNA, 20 nt, Human
uaaaacaagcacuaaacaaa

SEQ ID NO: 1805660 - RNA, 17 nt, Human
guacaccccaacagcac

SEQ ID NO: 1805661 - RNA, 23 nt, Human
ugaaaaucuuauaauuuaaaaua

SEQ ID NO: 1805662 - RNA, 23 nt, Human
gccagccaacccuuucauuagaa

SEQ ID NO: 1805663 - RNA, 15 nt, Human
cagaggggcccauga

SEQ ID NO: 1805664 - RNA, 16 nt, Human
agcugcauuucagaaa

SEQ ID NO: 1805665 - RNA, 21 nt, Human
augccacccaguugugacaau

SEQ ID NO: 1805666 - RNA, 15 nt, Human
acucugagucccaga

SEQ ID NO: 1805667 - RNA, 20 nt, Human
uguucccaccaggcugcuca

SEQ ID NO: 1805668 - RNA, 19 nt, Human
cagaauagaaauuaguacu

SEQ ID NO: 1805669 - RNA, 11 nt, Human
aaacugccuuc

SEQ ID NO: 1805670 - RNA, 22 nt, Human
agagacaacagguaaaacaggg

SEQ ID NO: 1805671 - RNA, 17 nt, Human
cuuccaucaccuccccc

SEQ ID NO: 1805672 - RNA, 23 nt, Human
aacuuaaguagauaaggaaauaa

SEQ ID NO: 1805673 - RNA, 17 nt, Human
cggagcccugucuccuc

SEQ ID NO: 1805674 - RNA, 20 nt, Human
cagagaaguuuucuggaggu

SEQ ID NO: 1805675 - RNA, 13 nt, Human
ugcagucccugca

SEQ ID NO: 1805676 - RNA, 14 nt, Human
cccugaagaccccc

SEQ ID NO: 1805677 - RNA, 14 nt, Human
cuuguacucugaaa

SEQ ID NO: 1805678 - RNA, 18 nt, Human
aauuuuagacauucuuua

SEQ ID NO: 1805679 - RNA, 22 nt, Human
gagugcaguggcaucaucucag

SEQ ID NO: 1805680 - RNA, 21 nt, Human
ucaugaaccucaagcugcauc

SEQ ID NO: 1805681 - RNA, 14 nt, Human
uuaaauaaauugua

SEQ ID NO: 1805682 - RNA, 14 nt, Human
accccaacagcacc

SEQ ID NO: 1805683 - RNA, 14 nt, Human
gcugguggcucugu

SEQ ID NO: 1805684 - RNA, 22 nt, Human
accuuguaauuugaaauauuuu

SEQ ID NO: 1805685 - RNA, 22 nt, Human
cacccaggaguauccucuugcc

SEQ ID NO: 1805686 - RNA, 14 nt, Human
uguucacccaacca

SEQ ID NO: 1805687 - RNA, 14 nt, Human
guauuuuaaaagaa

SEQ ID NO: 1805688 - RNA, 20 nt, Human
uuguaggcauguagcuacag

SEQ ID NO: 1805689 - RNA, 13 nt, Human
caucgcagacaca

SEQ ID NO: 1805690 - RNA, 23 nt, Human
aaaggcuuugcccugcugcccuc

SEQ ID NO: 1805691 - RNA, 14 nt, Human
uuuugucucugcaa

SEQ ID NO: 1805692 - RNA, 21 nt, Human
gcaccuacuuacaugcauuac

SEQ ID NO: 1805693 - RNA, 21 nt, Human
uuuaauccccaguaaaauugc

SEQ ID NO: 1805694 - RNA, 21 nt, Human
ugcccauccugccccugagcc

SEQ ID NO: 1805695 - RNA, 22 nt, Human
aaugaaguuugaauguuaaaua

SEQ ID NO: 1805696 - RNA, 20 nt, Human
uucccaaccauacaaaaauu

SEQ ID NO: 1805697 - RNA, 18 nt, Human
cuuccucugagccuuggg

SEQ ID NO: 1805698 - RNA, 19 nt, Human
cauuacuucaaacugagau

SEQ ID NO: 1805699 - RNA, 20 nt, Human
gaaugguaucaauaaauaga

SEQ ID NO: 1805700 - RNA, 21 nt, Human
uucuccagccucagccuccca

SEQ ID NO: 1805701 - RNA, 18 nt, Human
ucagcuccagcugcucug

SEQ ID NO: 1805702 - RNA, 20 nt, Human
gguucaagcaauccucccac

SEQ ID NO: 1805703 - RNA, 17 nt, Human
uuauaaaaauaaaaaac

SEQ ID NO: 1805704 - RNA, 17 nt, Human
uccaccucgcagguuca

SEQ ID NO: 1805705 - RNA, 24 nt, Human
uggccagaauuuaaaccuauacuc

SEQ ID NO: 1805706 - RNA, 18 nt, Human
gacacaaauaaaggaaac

SEQ ID NO: 1805707 - RNA, 21 nt, Human
agccuaagggauccugccugc

SEQ ID NO: 1805708 - RNA, 23 nt, Human
agauccuuccuuuugagggagca

SEQ ID NO: 1805709 - RNA, 21 nt, Human
uuuaaguaaggaauuuuauuu

SEQ ID NO: 1805710 - RNA, 14 nt, Human
uccuaguucuguag

SEQ ID NO: 1805711 - RNA, 18 nt, Human
cacuccagugagacagcu

SEQ ID NO: 1805712 - RNA, 14 nt, Human
aggcuggagugcag

SEQ ID NO: 1805713 - RNA, 21 nt, Human
gccucaagcuaugugagcuca

SEQ ID NO: 1805714 - RNA, 13 nt, Human
uggcugacaugaa

SEQ ID NO: 1805715 - RNA, 16 nt, Human
aacuccuugauuuuag

SEQ ID NO: 1805716 - RNA, 13 nt, Human
aaacauguuucuu

SEQ ID NO: 1805717 - RNA, 15 nt, Human
agagcaguguuucgu

SEQ ID NO: 1805718 - RNA, 22 nt, Human
cucagaggcagugacagcaguc

SEQ ID NO: 1805719 - RNA, 14 nt, Human
uccauucuucccuu

SEQ ID NO: 1805720 - RNA, 16 nt, Human
gacugccaagccaugg

SEQ ID NO: 1805721 - RNA, 22 nt, Human
uuaccucugccucagaaaacaa

SEQ ID NO: 1805722 - RNA, 19 nt, Human
ucccuagcugugaccucuc

SEQ ID NO: 1805723 - RNA, 17 nt, Human
agagaaguucaauauaa

SEQ ID NO: 1805724 - RNA, 20 nt, Human
aggcccgcaugcggcccagg

SEQ ID NO: 1805725 - RNA, 21 nt, Human
ucuucccaauugcuuuaccuu

SEQ ID NO: 1805726 - RNA, 22 nt, Human
cccacuuaccuugcaucucaca

SEQ ID NO: 1805727 - RNA, 12 nt, Human
acaggaaaaagu

SEQ ID NO: 1805728 - RNA, 18 nt, Human
cucgaggagguaaugaau

SEQ ID NO: 1805729 - RNA, 21 nt, Human
caauuaauuccuucagcacuu

SEQ ID NO: 1805730 - RNA, 22 nt, Human
acuuuaauaaauguauauugua

SEQ ID NO: 1805731 - RNA, 17 nt, Human
aaacuggggccucccug

SEQ ID NO: 1805732 - RNA, 20 nt, Human
auuccucaguucauccauuc

SEQ ID NO: 1805733 - RNA, 23 nt, Human
agcuggaaacacauguuccccuu

SEQ ID NO: 1805734 - RNA, 20 nt, Human
ucagaauuucuaaaaguuua

SEQ ID NO: 1805735 - RNA, 20 nt, Human
auaaauuauuguuuuucuuu

SEQ ID NO: 1805736 - RNA, 16 nt, Human
cugcucagcccugcac

SEQ ID NO: 1805737 - RNA, 12 nt, Human
uucucuaggaaa

SEQ ID NO: 1805738 - RNA, 22 nt, Human
aagaaagcccuuaggaagaauu

SEQ ID NO: 1805739 - RNA, 17 nt, Human
ugauuuccacagugacu

SEQ ID NO: 1805740 - RNA, 19 nt, Human
cagauccccaagccuggca

SEQ ID NO: 1805741 - RNA, 19 nt, Human
aaaacuggcuacugcucug

SEQ ID NO: 1805742 - RNA, 18 nt, Human
cugagucccaggcugagc

SEQ ID NO: 1805743 - RNA, 14 nt, Human
ucaucauuuccauu

SEQ ID NO: 1805744 - RNA, 19 nt, Human
ccuucaaguauaauauuaa

SEQ ID NO: 1805745 - RNA, 19 nt, Human
ggaggcuaaagcccagaga

SEQ ID NO: 1805746 - RNA, 13 nt, Human
uaguccccagccu

SEQ ID NO: 1805747 - RNA, 17 nt, Human
uacuguguaagggccag

SEQ ID NO: 1805748 - RNA, 14 nt, Human
cuacccgcagaguu

SEQ ID NO: 1805749 - RNA, 20 nt, Human
cucagcuucacccugaggug

SEQ ID NO: 1805750 - RNA, 20 nt, Human
ucugaaaguuuuggaaacgu

SEQ ID NO: 1805751 - RNA, 15 nt, Human
ccucucugcaggcag

SEQ ID NO: 1805752 - RNA, 22 nt, Human
gcacagccucuuagaugcaguu

SEQ ID NO: 1805753 - RNA, 11 nt, Human
uguuuuuucua

SEQ ID NO: 1805754 - RNA, 13 nt, Human
gccaguuguccuc

SEQ ID NO: 1805755 - RNA, 15 nt, Human
aagauauuuuucaug

SEQ ID NO: 1805756 - RNA, 20 nt, Human
gcuccuccuuuuuccuucca

SEQ ID NO: 1805757 - RNA, 13 nt, Human
cucgcuguugcug

SEQ ID NO: 1805758 - RNA, 17 nt, Human
caaaacuagguaaaauc

SEQ ID NO: 1805759 - RNA, 14 nt, Human
ccaguuguccuccu

SEQ ID NO: 1805760 - RNA, 16 nt, Human
guuauuuuuacauucu

SEQ ID NO: 1805761 - RNA, 20 nt, Human
cugggcccaguaccuagcug

SEQ ID NO: 1805762 - RNA, 20 nt, Human
uccacauuucccccuagccu

SEQ ID NO: 1805763 - RNA, 19 nt, Human
cuggucugaggucauuaaa

SEQ ID NO: 1805764 - RNA, 19 nt, Human
auuagaguauuuuccacaa

SEQ ID NO: 1805765 - RNA, 18 nt, Human
auucuugccaaauauaaa

SEQ ID NO: 1805766 - RNA, 18 nt, Human
gcauuuaugagcucuuca

SEQ ID NO: 1805767 - RNA, 23 nt, Human
aacuccugcuagaacagucucuu

SEQ ID NO: 1805768 - RNA, 22 nt, Human
guuucuucuuuaggcauuaaau

SEQ ID NO: 1805769 - RNA, 22 nt, Human
gaaacauuuucucccuggauuu

SEQ ID NO: 1805770 - RNA, 19 nt, Human
cugacugcuaguuuauaua

SEQ ID NO: 1805771 - RNA, 17 nt, Human
auuacugcaugcacuuc

SEQ ID NO: 1805772 - RNA, 21 nt, Human
cuggccaccugcugagcccca

SEQ ID NO: 1805773 - RNA, 12 nt, Human
aaggaugccccg

SEQ ID NO: 1805774 - RNA, 18 nt, Human
aauguugaguuauuaaua

SEQ ID NO: 1805775 - RNA, 14 nt, Human
aaauuuuuuuugua

SEQ ID NO: 1805776 - RNA, 18 nt, Human
ccuaagggauccugccug

SEQ ID NO: 1805777 - RNA, 17 nt, Human
ucaggauacuauauuuu

SEQ ID NO: 1805778 - RNA, 13 nt, Human
acuuuuuaaaauc

SEQ ID NO: 1805779 - RNA, 17 nt, Human
uuuaaagacuuuuauga

SEQ ID NO: 1805780 - RNA, 21 nt, Human
cucaaaacuucagacauagaa

SEQ ID NO: 1805781 - RNA, 15 nt, Human
aggcuguugucuuuu

SEQ ID NO: 1805782 - RNA, 22 nt, Human
acugcugaugauuuagagugcu

SEQ ID NO: 1805783 - RNA, 12 nt, Human
aaaagcuauaaa

SEQ ID NO: 1805784 - RNA, 13 nt, Human
caagaaggaaaga

SEQ ID NO: 1805785 - RNA, 17 nt, Human
cuuacaauaauucuaug

SEQ ID NO: 1805786 - RNA, 14 nt, Human
cauccauucuuccc

SEQ ID NO: 1805787 - RNA, 16 nt, Human
ucacagggccugggga

SEQ ID NO: 1805788 - RNA, 12 nt, Human
cuuuucuuuucu

SEQ ID NO: 1805789 - RNA, 23 nt, Human
cacauucagggcuauuuuuuccc

SEQ ID NO: 1805790 - RNA, 15 nt, Human
ccacaggaaccacaa

SEQ ID NO: 1805791 - RNA, 21 nt, Human
aaacauccuaagcucaucuau

SEQ ID NO: 1805792 - RNA, 22 nt, Human
cagacacaugugcuggccaccu

SEQ ID NO: 1805793 - RNA, 21 nt, Human
guguauuauaauucaaaggca

SEQ ID NO: 1805794 - RNA, 15 nt, Human
agaaauuuauuuccu

SEQ ID NO: 1805795 - RNA, 17 nt, Human
ccccuggccaaggaaga

SEQ ID NO: 1805796 - RNA, 18 nt, Human
caaaauuacccuaaacau

SEQ ID NO: 1805797 - RNA, 15 nt, Human
caugaagcuguugug

SEQ ID NO: 1805798 - RNA, 16 nt, Human
ccucuuuuuauuuaga

SEQ ID NO: 1805799 - RNA, 14 nt, Human
cccaacaccccaca

SEQ ID NO: 1805800 - RNA, 18 nt, Human
gccugaaacucauagaca

SEQ ID NO: 1805801 - RNA, 22 nt, Human
ugcauguugcccuguugcugcc

SEQ ID NO: 1805802 - RNA, 19 nt, Human
caauguuuucaguucucuu

SEQ ID NO: 1805803 - RNA, 11 nt, Human
ucauagcuaaa

SEQ ID NO: 1805804 - RNA, 17 nt, Human
ugcuaauuuugaaaaac

SEQ ID NO: 1805805 - RNA, 15 nt, Human
uguacuugcucuuga

SEQ ID NO: 1805806 - RNA, 13 nt, Human
uguauauuuuaua

SEQ ID NO: 1805807 - RNA, 20 nt, Human
gcugauaaacugauuuaucu

SEQ ID NO: 1805808 - RNA, 13 nt, Human
uagugauuuccac

SEQ ID NO: 1805809 - RNA, 20 nt, Human
uccccaaaggcuuugcccug

SEQ ID NO: 1805810 - RNA, 21 nt, Human
cuaguaucaaaagaaagaaaa

SEQ ID NO: 1805811 - RNA, 14 nt, Human
aacuuuauuuugug

SEQ ID NO: 1805812 - RNA, 20 nt, Human
cuuauucacaagacccaaaa

SEQ ID NO: 1805813 - RNA, 15 nt, Human
uaggaaauauuuauu

SEQ ID NO: 1805814 - RNA, 21 nt, Human
ccugccugccccuacccugga

SEQ ID NO: 1805815 - RNA, 17 nt, Human
aacugccaucauuuacu

SEQ ID NO: 1805816 - RNA, 13 nt, Human
aucaggcuggcca

SEQ ID NO: 1805817 - RNA, 17 nt, Human
ggcucuggacaggcacu

SEQ ID NO: 1805818 - RNA, 19 nt, Human
uguagaaaugguuguauua

SEQ ID NO: 1805819 - RNA, 13 nt, Human
uguacauucuucc

SEQ ID NO: 1805820 - RNA, 20 nt, Human
aggauaaaguugguaaaccu

SEQ ID NO: 1805821 - RNA, 16 nt, Human
aauggaggccuguccu

SEQ ID NO: 1805822 - RNA, 22 nt, Human
uagcaggaagcugugagagcag

SEQ ID NO: 1805823 - RNA, 16 nt, Human
uucccuugagcccucu

SEQ ID NO: 1805824 - RNA, 16 nt, Human
uuuauucauauuuucu

SEQ ID NO: 1805825 - RNA, 15 nt, Human
aggcaccucucuggg

SEQ ID NO: 1805826 - RNA, 17 nt, Human
cuucuccaacaauaaga

SEQ ID NO: 1805827 - RNA, 15 nt, Human
uggauuccucacuuu

SEQ ID NO: 1805828 - RNA, 16 nt, Human
gcaggcagaacucauc

SEQ ID NO: 1805829 - RNA, 19 nt, Human
uacaauuaaagcuguuauu

SEQ ID NO: 1805830 - RNA, 18 nt, Human
accccaacagcacccucu

SEQ ID NO: 1805831 - RNA, 12 nt, Human
cugucucagggu

SEQ ID NO: 1805832 - RNA, 15 nt, Human
augacggaagaguug

SEQ ID NO: 1805833 - RNA, 18 nt, Human
cuauuuuaauaaacacuc

SEQ ID NO: 1805834 - RNA, 14 nt, Human
cagggcugucuucg

SEQ ID NO: 1805835 - RNA, 20 nt, Human
cagaccagcaggcuggccua

SEQ ID NO: 1805836 - RNA, 18 nt, Human
guucccaccaggcugcuc

SEQ ID NO: 1805837 - RNA, 15 nt, Human
uuucuuuauuuugag

SEQ ID NO: 1805838 - RNA, 16 nt, Human
guucaugcaaacuuua

SEQ ID NO: 1805839 - RNA, 15 nt, Human
cucagcucacugcaa

SEQ ID NO: 1805840 - RNA, 15 nt, Human
cuccagccucagccu

SEQ ID NO: 1805841 - RNA, 22 nt, Human
auuuccuaguucuguagaaaug

SEQ ID NO: 1805842 - RNA, 22 nt, Human
aaauuguauagaccuaaaauaa

SEQ ID NO: 1805843 - RNA, 19 nt, Human
aucuuaauuauuguacauu

SEQ ID NO: 1805844 - RNA, 11 nt, Human
ugugaagaggu

SEQ ID NO: 1805845 - RNA, 10 nt, Human
agagaaguuc

SEQ ID NO: 1805846 - RNA, 13 nt, Human
uuucucaucuuuu

SEQ ID NO: 1805847 - RNA, 19 nt, Human
ccaucagcuccagcugcuc

SEQ ID NO: 1805848 - RNA, 11 nt, Human
cgauaaaagac

SEQ ID NO: 1805849 - RNA, 11 nt, Human
uuaguuucucc

SEQ ID NO: 1805850 - RNA, 20 nt, Human
cugucuucguauucccauua

SEQ ID NO: 1805851 - RNA, 17 nt, Human
uucuuuguaaugaaaac

SEQ ID NO: 1805852 - RNA, 15 nt, Human
ccacucugaguccca

SEQ ID NO: 1805853 - RNA, 21 nt, Human
acauuacucugaaauuguaac

SEQ ID NO: 1805854 - RNA, 16 nt, Human
agacaagaaaauaaga

SEQ ID NO: 1805855 - RNA, 17 nt, Human
cagcugacacaucuccc

SEQ ID NO: 1805856 - RNA, 17 nt, Human
gaaaggccuuuaaaauu

SEQ ID NO: 1805857 - RNA, 13 nt, Human
cuuguuucagagu

SEQ ID NO: 1805858 - RNA, 17 nt, Human
uaugcuaagugaaauaa

SEQ ID NO: 1805859 - RNA, 19 nt, Human
gccccccagcccuccuuau

SEQ ID NO: 1805860 - RNA, 15 nt, Human
uguauuuuaaaagaa

SEQ ID NO: 1805861 - RNA, 14 nt, Human
caaauaaaggaaac

SEQ ID NO: 1805862 - RNA, 12 nt, Human
acugugggaagg

SEQ ID NO: 1805863 - RNA, 15 nt, Human
ccuggcucucccagc

SEQ ID NO: 1805864 - RNA, 13 nt, Human
acaauaaaagaca

SEQ ID NO: 1805865 - RNA, 15 nt, Human
cauacauguaaaaua

SEQ ID NO: 1805866 - RNA, 19 nt, Human
cuugcucagugggggcaga

SEQ ID NO: 1805867 - RNA, 18 nt, Human
uuacccaguaacucaucu

SEQ ID NO: 1805868 - RNA, 21 nt, Human
uuuuuaaaaauuaaaucaacc

SEQ ID NO: 1805869 - RNA, 23 nt, Human
caauaacgauaaaagacagugaa

SEQ ID NO: 1805870 - RNA, 16 nt, Human
uauuuuguuuaaauua

SEQ ID NO: 1805871 - RNA, 14 nt, Human
ccacagaagugcuu

SEQ ID NO: 1805872 - RNA, 14 nt, Human
ggggccaggcuggg

SEQ ID NO: 1805873 - RNA, 19 nt, Human
uagggcguggaaaggggca

SEQ ID NO: 1805874 - RNA, 12 nt, Human
aaaauuuaaaac

SEQ ID NO: 1805875 - RNA, 12 nt, Human
ucuacaaaaaaa

SEQ ID NO: 1805876 - RNA, 16 nt, Human
uccaaagcccucccua

SEQ ID NO: 1805877 - RNA, 24 nt, Human
cucaaauuguucucuaauauguaa

SEQ ID NO: 1805878 - RNA, 15 nt, Human
aauauaaauaaaaau

SEQ ID NO: 1805879 - RNA, 15 nt, Human
uauaaauaaaaauaa

SEQ ID NO: 1805880 - RNA, 13 nt, Human
ggcuaugauuguc

SEQ ID NO: 1805881 - RNA, 14 nt, Human
acgaaacauuuguu

SEQ ID NO: 1805882 - RNA, 16 nt, Human
cagcuuuuucucuccc

SEQ ID NO: 1805883 - RNA, 21 nt, Human
aauagauugggcacuguggaa

SEQ ID NO: 1805884 - RNA, 18 nt, Human
ugucuggaaauagcccug

SEQ ID NO: 1805885 - RNA, 17 nt, Human
caaauccaaugaaauga

SEQ ID NO: 1805886 - RNA, 15 nt, Human
gcaggucugaagcuc

SEQ ID NO: 1805887 - RNA, 14 nt, Human
cucuugccucaacc

SEQ ID NO: 1805888 - RNA, 12 nt, Human
uaagaagacugc

SEQ ID NO: 1805889 - RNA, 13 nt, Human
ugggaucacugau

SEQ ID NO: 1805890 - RNA, 22 nt, Human
cagaucuaugccacaagaaccc

SEQ ID NO: 1805891 - RNA, 13 nt, Human
gggccaggcuggg

SEQ ID NO: 1805892 - RNA, 20 nt, Human
uauaauucaaaggcauuucu

SEQ ID NO: 1805893 - RNA, 16 nt, Human
cugagccucagucucc

SEQ ID NO: 1805894 - RNA, 15 nt, Human
acccaguagaugcca

SEQ ID NO: 1805895 - RNA, 15 nt, Human
aacagcacccucucc

SEQ ID NO: 1805896 - RNA, 20 nt, Human
ucaccauguacauagcuuga

SEQ ID NO: 1805897 - RNA, 17 nt, Human
ccucaccagcccuggca

SEQ ID NO: 1805898 - RNA, 11 nt, Human
agacacaugug

SEQ ID NO: 1805899 - RNA, 13 nt, Human
acucagaggcagu

SEQ ID NO: 1805900 - RNA, 13 nt, Human
aaaauaagcaggc

SEQ ID NO: 1805901 - RNA, 18 nt, Human
augagcacgcauggaaaa

SEQ ID NO: 1805902 - RNA, 13 nt, Human
uuaugcuaaguga

SEQ ID NO: 1805903 - RNA, 13 nt, Human
accuaguccccag

SEQ ID NO: 1805904 - RNA, 18 nt, Human
auucaggucuuucuuucc

SEQ ID NO: 1805905 - RNA, 16 nt, Human
auugcuauguuuugac

SEQ ID NO: 1805906 - RNA, 12 nt, Human
aagaaaauaacg

SEQ ID NO: 1805907 - RNA, 15 nt, Human
aagaugaaugagcaa

SEQ ID NO: 1805908 - RNA, 22 nt, Human
gagucaagggugugugcagcau

SEQ ID NO: 1805909 - RNA, 16 nt, Human
gugcugaguucuauaa

SEQ ID NO: 1805910 - RNA, 17 nt, Human
acccuccacaggcacag

SEQ ID NO: 1805911 - RNA, 18 nt, Human
uucuccauacucuguaac

SEQ ID NO: 1805912 - RNA, 13 nt, Human
caucucaaaaaaa

SEQ ID NO: 1805913 - RNA, 17 nt, Human
cacagugggagccaggg

SEQ ID NO: 1805914 - RNA, 21 nt, Human
gccaaauauaaauaaaaauaa

SEQ ID NO: 1805915 - RNA, 16 nt, Human
ggccuccauccugagg

SEQ ID NO: 1805916 - RNA, 18 nt, Human
agcccugcaccaugcugc

SEQ ID NO: 1805917 - RNA, 15 nt, Human
aaagaauuauuuugu

SEQ ID NO: 1805918 - RNA, 17 nt, Human
acuggagccccaucagc

SEQ ID NO: 1805919 - RNA, 18 nt, Human
acaccuuuuacucuucuu

SEQ ID NO: 1805920 - RNA, 17 nt, Human
ccugacucuugcagggg

SEQ ID NO: 1805921 - RNA, 19 nt, Human
uccaaaaauguguaagaac

SEQ ID NO: 1805922 - RNA, 17 nt, Human
uaucaugugaaaucauu

SEQ ID NO: 1805923 - RNA, 19 nt, Human
uugauggagauauuuacau

SEQ ID NO: 1805924 - RNA, 19 nt, Human
auuggagcucgugggacag

SEQ ID NO: 1805925 - RNA, 19 nt, Human
uucauauuuucuuucaaaa

SEQ ID NO: 1805926 - RNA, 20 nt, Human
caaccagauugucagcuccu

SEQ ID NO: 1805927 - RNA, 14 nt, Human
auaauuuuucacuu

SEQ ID NO: 1805928 - RNA, 18 nt, Human
aaacaaaacuagguaaaa

SEQ ID NO: 1805929 - RNA, 21 nt, Human
gaaauugauuuugaaccugau

SEQ ID NO: 1805930 - RNA, 20 nt, Human
ucuuuagcuguuaauuugag

SEQ ID NO: 1805931 - RNA, 22 nt, Human
auauauaacaaugcuguauuuu

SEQ ID NO: 1805932 - RNA, 12 nt, Human
uuccuuauauuu

SEQ ID NO: 1805933 - RNA, 21 nt, Human
uguagaaaaaaguaaauguga

SEQ ID NO: 1805934 - RNA, 23 nt, Human
agcagugcuugaaugaaguugua

SEQ ID NO: 1805935 - RNA, 16 nt, Human
uaggauguugaaaaag

SEQ ID NO: 1805936 - RNA, 13 nt, Human
cuggagugagggg

SEQ ID NO: 1805937 - RNA, 21 nt, Human
caauauaagcuuuucuuuucu

SEQ ID NO: 1805938 - RNA, 12 nt, Human
gcuggagugcag

SEQ ID NO: 1805939 - RNA, 14 nt, Human
cagagccucgagga

SEQ ID NO: 1805940 - RNA, 14 nt, Human
cagucuguucccca

SEQ ID NO: 1805941 - RNA, 18 nt, Human
cuuuuaaaccauuuucuu

SEQ ID NO: 1805942 - RNA, 18 nt, Human
uuaucauuuaguuauaaa

SEQ ID NO: 1805943 - RNA, 14 nt, Human
cucaaaugcaccau

SEQ ID NO: 1805944 - RNA, 13 nt, Human
caugcggcccagg

SEQ ID NO: 1805945 - RNA, 17 nt, Human
aaccaggacccugucca

SEQ ID NO: 1805946 - RNA, 15 nt, Human
gccuuggcuucccaa

SEQ ID NO: 1805947 - RNA, 21 nt, Human
uaggccuugcggcuccucagg

SEQ ID NO: 1805948 - RNA, 12 nt, Human
agccagaggcuc

SEQ ID NO: 1805949 - RNA, 18 nt, Human
agcugcucaauaaaguac

SEQ ID NO: 1805950 - RNA, 16 nt, Human
guuuuuuuuuaaaaaa

SEQ ID NO: 1805951 - RNA, 21 nt, Human
cuaacaaauuccaaauucuca

SEQ ID NO: 1805952 - RNA, 13 nt, Human
gcccccaacagca

SEQ ID NO: 1805953 - RNA, 21 nt, Human
agguaaaaucuacaguacacc

SEQ ID NO: 1805954 - RNA, 21 nt, Human
uugaacccugggacguggcua

SEQ ID NO: 1805955 - RNA, 17 nt, Human
uuucuaauaguuuuauu

SEQ ID NO: 1805956 - RNA, 13 nt, Human
uaugaaauauuau

SEQ ID NO: 1805957 - RNA, 15 nt, Human
auacacuuuuuaaaa

SEQ ID NO: 1805958 - RNA, 15 nt, Human
gagaugcuagaacuc

SEQ ID NO: 1805959 - RNA, 23 nt, Human
aacuaggguggugcauuuuugua

SEQ ID NO: 1805960 - RNA, 21 nt, Human
uaaucuuacaaugaaaaggac

SEQ ID NO: 1805961 - RNA, 20 nt, Human
ccugcucccuagccagaggc

SEQ ID NO: 1805962 - RNA, 16 nt, Human
caacagcacccucucc

SEQ ID NO: 1805963 - RNA, 16 nt, Human
gccaaggaugccccgu

SEQ ID NO: 1805964 - RNA, 16 nt, Human
uaccuuugacaaaggu

SEQ ID NO: 1805965 - RNA, 13 nt, Human
aguauaauauuaa

SEQ ID NO: 1805966 - RNA, 22 nt, Human
ucccuucucuacacucuuguaa

SEQ ID NO: 1805967 - RNA, 15 nt, Human
uagaauauauuuccu

SEQ ID NO: 1805968 - RNA, 16 nt, Human
gagaguacaccccaac

SEQ ID NO: 1805969 - RNA, 17 nt, Human
gcauaacguauaaaagc

SEQ ID NO: 1805970 - RNA, 17 nt, Human
auguuccuuauauuuac

SEQ ID NO: 1805971 - RNA, 12 nt, Human
uugccucugaga

SEQ ID NO: 1805972 - RNA, 14 nt, Human
ggagcaucuccuca

SEQ ID NO: 1805973 - RNA, 12 nt, Human
ugcucugauuua

SEQ ID NO: 1805974 - RNA, 15 nt, Human
augggacauuuuuga

SEQ ID NO: 1805975 - RNA, 15 nt, Human
ccuccucuccaccau

SEQ ID NO: 1805976 - RNA, 19 nt, Human
cucagacucuaagaaagaa

SEQ ID NO: 1805977 - RNA, 19 nt, Human
caggaagcugugagagcag

SEQ ID NO: 1805978 - RNA, 11 nt, Human
gaaaugaaaaa

SEQ ID NO: 1805979 - RNA, 12 nt, Human
aucuuauuucug

SEQ ID NO: 1805980 - RNA, 14 nt, Human
acuuggucugugag

SEQ ID NO: 1805981 - RNA, 16 nt, Human
uucccaacuccagaaa

SEQ ID NO: 1805982 - RNA, 18 nt, Human
uuaacugccuuguguaca

SEQ ID NO: 1805983 - RNA, 22 nt, Human
cucagcccugcaccaugcugcu

SEQ ID NO: 1805984 - RNA, 19 nt, Human
auguagccccucuccugga

SEQ ID NO: 1805985 - RNA, 14 nt, Human
acuaauucauuaau

SEQ ID NO: 1805986 - RNA, 20 nt, Human
uccugucggagcccugucuc

SEQ ID NO: 1805987 - RNA, 21 nt, Human
gaacagucucuugaggcacag

SEQ ID NO: 1805988 - RNA, 20 nt, Human
cuuuaaaauuuuuuuagaaa

SEQ ID NO: 1805989 - RNA, 14 nt, Human
acaaccuccgccuc

SEQ ID NO: 1805990 - RNA, 17 nt, Human
cacauaaugcucauacu

SEQ ID NO: 1805991 - RNA, 18 nt, Human
gaaacaaaaggauaauga

SEQ ID NO: 1805992 - RNA, 17 nt, Human
uaaaagacagugaaaga

SEQ ID NO: 1805993 - RNA, 16 nt, Human
uaaugaauacuuuaua

SEQ ID NO: 1805994 - RNA, 20 nt, Human
ccugccuuggcuucccaaag

SEQ ID NO: 1805995 - RNA, 17 nt, Human
cagaaucaugcugagag

SEQ ID NO: 1805996 - RNA, 23 nt, Human
gccuuuggcuuuuggcuccaccc

SEQ ID NO: 1805997 - RNA, 20 nt, Human
aguuguuucuacuacaugga

SEQ ID NO: 1805998 - RNA, 12 nt, Human
gcauuguccucu

SEQ ID NO: 1805999 - RNA, 16 nt, Human
uggggaagacaguggc

SEQ ID NO: 1806000 - RNA, 23 nt, Human
ccaauaaauaugauguuauggug

SEQ ID NO: 1806001 - RNA, 21 nt, Human
cauuuucuucucacauuuaua

SEQ ID NO: 1806002 - RNA, 21 nt, Human
ggagacauugaggcaggcacu

SEQ ID NO: 1806003 - RNA, 19 nt, Human
ccuuugcugacccucccca

SEQ ID NO: 1806004 - RNA, 22 nt, Human
uugaguacuuauggcccugaaa

SEQ ID NO: 1806005 - RNA, 18 nt, Human
accaccugccuauauuuu

SEQ ID NO: 1806006 - RNA, 18 nt, Human
aaauuguaagcaugcaca

SEQ ID NO: 1806007 - RNA, 17 nt, Human
ccaggauauccucccuc

SEQ ID NO: 1806008 - RNA, 14 nt, Human
ccgccucagccucc

SEQ ID NO: 1806009 - RNA, 19 nt, Human
cccaguagaugccacccag

SEQ ID NO: 1806010 - RNA, 15 nt, Human
cccguucacauuuuu

SEQ ID NO: 1806011 - RNA, 20 nt, Human
agcaggggugcugggaccug

SEQ ID NO: 1806012 - RNA, 21 nt, Human
acauuucucauaccuucccca

SEQ ID NO: 1806013 - RNA, 17 nt, Human
cuggggcauggaaggca

SEQ ID NO: 1806014 - RNA, 17 nt, Human
aaaaacugcucauauga

SEQ ID NO: 1806015 - RNA, 22 nt, Human
aaacaggaugguggcaggaaaa

SEQ ID NO: 1806016 - RNA, 21 nt, Human
ucauuagccugaguagaaagg

SEQ ID NO: 1806017 - RNA, 14 nt, Human
uaccuaguccccag

SEQ ID NO: 1806018 - RNA, 21 nt, Human
aagaaggugggaggaugugaa

SEQ ID NO: 1806019 - RNA, 16 nt, Human
gucacagcuacacaga

SEQ ID NO: 1806020 - RNA, 23 nt, Human
cacaagaaaugaaagcagggacu

SEQ ID NO: 1806021 - RNA, 19 nt, Human
ugcuugucccuguggaagu

SEQ ID NO: 1806022 - RNA, 19 nt, Human
gcacacugucugcccccgu

SEQ ID NO: 1806023 - RNA, 12 nt, Human
uaucuagccugg

SEQ ID NO: 1806024 - RNA, 20 nt, Human
agccacggggacucagcccu

SEQ ID NO: 1806025 - RNA, 15 nt, Human
augugcagccaccag

SEQ ID NO: 1806026 - RNA, 16 nt, Human
guuucugaguuccugc

SEQ ID NO: 1806027 - RNA, 16 nt, Human
cuucuauugccucuga

SEQ ID NO: 1806028 - RNA, 24 nt, Human
auucaaaggcauuucuuuucugca

SEQ ID NO: 1806029 - RNA, 19 nt, Human
gagagaugacagggaaaac

SEQ ID NO: 1806030 - RNA, 13 nt, Human
aaacaaagaaauu

SEQ ID NO: 1806031 - RNA, 19 nt, Human
auuuaguuauaaaaauaua

SEQ ID NO: 1806032 - RNA, 17 nt, Human
caagccuccuuuuaaag

SEQ ID NO: 1806033 - RNA, 15 nt, Human
ugcacgaauggaaga

SEQ ID NO: 1806034 - RNA, 19 nt, Human
uccuccauaucucccucuu

SEQ ID NO: 1806035 - RNA, 16 nt, Human
cucacauccauucuuc

SEQ ID NO: 1806036 - RNA, 17 nt, Human
caccugucaucucacau

SEQ ID NO: 1806037 - RNA, 15 nt, Human
ggagucacagccacu

SEQ ID NO: 1806038 - RNA, 16 nt, Human
uccccuauguggaagu

SEQ ID NO: 1806039 - RNA, 21 nt, Human
cuacacauacauguaaaauau

SEQ ID NO: 1806040 - RNA, 20 nt, Human
ugacuagaaaauuuaaaaca

SEQ ID NO: 1806041 - RNA, 24 nt, Human
uaaagaaggugugggccagacaag

SEQ ID NO: 1806042 - RNA, 20 nt, Human
cccugccccccagcccuccu

SEQ ID NO: 1806043 - RNA, 16 nt, Human
gcuuucuuuuuuuucu

SEQ ID NO: 1806044 - RNA, 23 nt, Human
augauuuugaaaucaugaagaua

SEQ ID NO: 1806045 - RNA, 23 nt, Human
ucccuagaaagccaugugcagcc

SEQ ID NO: 1806046 - RNA, 16 nt, Human
gcuuuuucucucccac

SEQ ID NO: 1806047 - RNA, 17 nt, Human
gcaggcuccccuccucg

SEQ ID NO: 1806048 - RNA, 18 nt, Human
ggauuauauuaugaagcu

SEQ ID NO: 1806049 - RNA, 12 nt, Human
ccugccucucug

SEQ ID NO: 1806050 - RNA, 22 nt, Human
agugagcuccuaagccauggga

SEQ ID NO: 1806051 - RNA, 16 nt, Human
aauuacauuuguauaa

SEQ ID NO: 1806052 - RNA, 14 nt, Human
ccauucuucccuug

SEQ ID NO: 1806053 - RNA, 13 nt, Human
caaaguuuaaugg

SEQ ID NO: 1806054 - RNA, 18 nt, Human
cuuuuuuaaaugaagaaa

SEQ ID NO: 1806055 - RNA, 20 nt, Human
gcacuagaggaacccuacac

SEQ ID NO: 1806056 - RNA, 21 nt, Human
guucuuucuuuaaagcaggau

SEQ ID NO: 1806057 - RNA, 15 nt, Human
uuggggaauauguua

SEQ ID NO: 1806058 - RNA, 16 nt, Human
gaauccucucucugug

SEQ ID NO: 1806059 - RNA, 18 nt, Human
ccuucuuuuuguucuuca

SEQ ID NO: 1806060 - RNA, 20 nt, Human
cugggacguggcuagucaua

SEQ ID NO: 1806061 - RNA, 13 nt, Human
aaagcugccggca

SEQ ID NO: 1806062 - RNA, 16 nt, Human
ccuacaugagguacug

SEQ ID NO: 1806063 - RNA, 18 nt, Human
auucuccugccucagccu

SEQ ID NO: 1806064 - RNA, 21 nt, Human
ggccucccuggucccuuggag

SEQ ID NO: 1806065 - RNA, 18 nt, Human
auuuguauaaaauaauuu

SEQ ID NO: 1806066 - RNA, 20 nt, Human
cgucaccccuguuucuggca

SEQ ID NO: 1806067 - RNA, 11 nt, Human
cuuucagagcc

SEQ ID NO: 1806068 - RNA, 17 nt, Human
aaccuagggugauauua

SEQ ID NO: 1806069 - RNA, 22 nt, Human
uauuccuguggauguaaaguga

SEQ ID NO: 1806070 - RNA, 16 nt, Human
aagucuuauuuauuca

SEQ ID NO: 1806071 - RNA, 20 nt, Human
uuugccgcuuaagcuuucag

SEQ ID NO: 1806072 - RNA, 23 nt, Human
agcaagacccugaagacccccaa

SEQ ID NO: 1806073 - RNA, 13 nt, Human
cacacugaagaag

SEQ ID NO: 1806074 - RNA, 17 nt, Human
accaccacgccuggcua

SEQ ID NO: 1806075 - RNA, 15 nt, Human
cgugaccugccaggc

SEQ ID NO: 1806076 - RNA, 23 nt, Human
caacaguuuuugcuaauuuuuag

SEQ ID NO: 1806077 - RNA, 18 nt, Human
cagccucuuagaugcagu

SEQ ID NO: 1806078 - RNA, 17 nt, Human
gcaguucuuuggcugaa

SEQ ID NO: 1806079 - RNA, 19 nt, Human
gguacccacuugcuuuuaa

SEQ ID NO: 1806080 - RNA, 12 nt, Human
ccucggcuuccu

SEQ ID NO: 1806081 - RNA, 14 nt, Human
gccucaccagcccu

SEQ ID NO: 1806082 - RNA, 14 nt, Human
cgugcuugucccug

SEQ ID NO: 1806083 - RNA, 14 nt, Human
caacccuuucauua

SEQ ID NO: 1806084 - RNA, 17 nt, Human
accaccgcgcccagccu

SEQ ID NO: 1806085 - RNA, 12 nt, Human
ccucccauguuc

SEQ ID NO: 1806086 - RNA, 15 nt, Human
cuuuuggcuccaccc

SEQ ID NO: 1806087 - RNA, 16 nt, Human
ugagacaaauggaggc

SEQ ID NO: 1806088 - RNA, 19 nt, Human
cucaccucccccaucucuu

SEQ ID NO: 1806089 - RNA, 16 nt, Human
auuauuguacauuuau

SEQ ID NO: 1806090 - RNA, 17 nt, Human
gcucagcccugcaccau

SEQ ID NO: 1806091 - RNA, 18 nt, Human
gccccugcacuccagccu

SEQ ID NO: 1806092 - RNA, 15 nt, Human
aggacgcccucacug

SEQ ID NO: 1806093 - RNA, 15 nt, Human
agugcuggcauuaca

SEQ ID NO: 1806094 - RNA, 20 nt, Human
aauaauuuuuauauuugaaa

SEQ ID NO: 1806095 - RNA, 13 nt, Human
aagcauuccaacu

SEQ ID NO: 1806096 - RNA, 17 nt, Human
ucguguguguuuuaaac

SEQ ID NO: 1806097 - RNA, 15 nt, Human
cacuguacuugcucu

SEQ ID NO: 1806098 - RNA, 15 nt, Human
gauauuuuucaugau

SEQ ID NO: 1806099 - RNA, 14 nt, Human
aagcugaguguuuc

SEQ ID NO: 1806100 - RNA, 20 nt, Human
ucauaaagucuugccuugcu

SEQ ID NO: 1806101 - RNA, 18 nt, Human
uaaaagacaaggaaaaaa

SEQ ID NO: 1806102 - RNA, 16 nt, Human
acaggcuugaaucaaa

SEQ ID NO: 1806103 - RNA, 19 nt, Human
uagaaaugguuguauuaga

SEQ ID NO: 1806104 - RNA, 21 nt, Human
uucuaaauaaaaagcauuauu

SEQ ID NO: 1806105 - RNA, 22 nt, Human
aaugauguuucauaagaauucu

SEQ ID NO: 1806106 - RNA, 16 nt, Human
aaaugggaaacaaaag

SEQ ID NO: 1806107 - RNA, 22 nt, Human
ucuaacaaauuccaaauucuca

SEQ ID NO: 1806108 - RNA, 14 nt, Human
cguuauaaucauuu

SEQ ID NO: 1806109 - RNA, 18 nt, Human
auucaugcugauuguuau

SEQ ID NO: 1806110 - RNA, 12 nt, Human
uguguaagaaca

SEQ ID NO: 1806111 - RNA, 15 nt, Human
ccucagccucccaag

SEQ ID NO: 1806112 - RNA, 16 nt, Human
aacacugggagaaaug

SEQ ID NO: 1806113 - RNA, 20 nt, Human
uggauuuuaaaaguuuuuua

SEQ ID NO: 1806114 - RNA, 18 nt, Human
gaaggcauccccaggccc

SEQ ID NO: 1806115 - RNA, 14 nt, Human
cucaucauuuccau

SEQ ID NO: 1806116 - RNA, 15 nt, Human
auaaugguuuuuaac

SEQ ID NO: 1806117 - RNA, 17 nt, Human
uagaaaaaaguaaaugu

SEQ ID NO: 1806118 - RNA, 14 nt, Human
uauuacaaauauuu

SEQ ID NO: 1806119 - RNA, 18 nt, Human
cuggggcuuuaacuccug

SEQ ID NO: 1806120 - RNA, 22 nt, Human
acuuaaguagauaaggaaauaa

SEQ ID NO: 1806121 - RNA, 19 nt, Human
cuggcucucccagccaggu

SEQ ID NO: 1806122 - RNA, 19 nt, Human
auuuccuaaauauauuuua

SEQ ID NO: 1806123 - RNA, 13 nt, Human
uagaaaauuuaaa

SEQ ID NO: 1806124 - RNA, 22 nt, Human
cauaaauguugacaugggacau

SEQ ID NO: 1806125 - RNA, 22 nt, Human
uguauuuauucaauaaaguauu

SEQ ID NO: 1806126 - RNA, 11 nt, Human
aucaugugaaa

SEQ ID NO: 1806127 - RNA, 16 nt, Human
ucucaucuuuuuacua

SEQ ID NO: 1806128 - RNA, 20 nt, Human
ucuuuguaaugaaaaccaca

SEQ ID NO: 1806129 - RNA, 17 nt, Human
cuguaaaaugugggauu

SEQ ID NO: 1806130 - RNA, 14 nt, Human
caccuuaggaauaa

SEQ ID NO: 1806131 - RNA, 17 nt, Human
gaacaucccuccuggga

SEQ ID NO: 1806132 - RNA, 19 nt, Human
cugguagaggaugaggaaa

SEQ ID NO: 1806133 - RNA, 23 nt, Human
caccucauggaauuggagcucgu

SEQ ID NO: 1806134 - RNA, 17 nt, Human
acucagguggcccuacu

SEQ ID NO: 1806135 - RNA, 19 nt, Human
auuuaguguucauaaauaa

SEQ ID NO: 1806136 - RNA, 15 nt, Human
agucucuacccagua

SEQ ID NO: 1806137 - RNA, 17 nt, Human
auuauuuuuuaaaaaaa

SEQ ID NO: 1806138 - RNA, 16 nt, Human
cacaaauucucacaca

SEQ ID NO: 1806139 - RNA, 13 nt, Human
agauuuccccauu

SEQ ID NO: 1806140 - RNA, 14 nt, Human
uuaaagcugccggc

SEQ ID NO: 1806141 - RNA, 16 nt, Human
gcucucccagccaggu

SEQ ID NO: 1806142 - RNA, 18 nt, Human
caucccuagucucuaccc

SEQ ID NO: 1806143 - RNA, 17 nt, Human
aggaugagggaaaagaa

SEQ ID NO: 1806144 - RNA, 17 nt, Human
guugcaacuuuguauaa

SEQ ID NO: 1806145 - RNA, 14 nt, Human
caucugucaccaag

SEQ ID NO: 1806146 - RNA, 15 nt, Human
agacagcucugcaua

SEQ ID NO: 1806147 - RNA, 19 nt, Human
cagaaauacagauuuugau

SEQ ID NO: 1806148 - RNA, 12 nt, Human
uauguuucacug

SEQ ID NO: 1806149 - RNA, 13 nt, Human
ucauucaugucau

SEQ ID NO: 1806150 - RNA, 14 nt, Human
ugaauuaaagaaga

SEQ ID NO: 1806151 - RNA, 16 nt, Human
cuagaaccaccugccu

SEQ ID NO: 1806152 - RNA, 20 nt, Human
cuugcucuugaugccuggcg

SEQ ID NO: 1806153 - RNA, 13 nt, Human
cagucugaugaga

SEQ ID NO: 1806154 - RNA, 15 nt, Human
cuagagacucaaaga

SEQ ID NO: 1806155 - RNA, 15 nt, Human
cuucuuuuuuucuug

SEQ ID NO: 1806156 - RNA, 16 nt, Human
ucuuuuaguuuuuaaa

SEQ ID NO: 1806157 - RNA, 22 nt, Human
gcucacugcaaccucugccucc

SEQ ID NO: 1806158 - RNA, 14 nt, Human
ccugggcugaggca

SEQ ID NO: 1806159 - RNA, 19 nt, Human
cauuagcauuugucaacaa

SEQ ID NO: 1806160 - RNA, 15 nt, Human
acugugugcucagga

SEQ ID NO: 1806161 - RNA, 13 nt, Human
ugagagaaaauaa

SEQ ID NO: 1806162 - RNA, 18 nt, Human
cuauuccuccuucccuug

SEQ ID NO: 1806163 - RNA, 23 nt, Human
auuaugugccagauuuaugcaua

SEQ ID NO: 1806164 - RNA, 19 nt, Human
aucuuaaaugccaggccug

SEQ ID NO: 1806165 - RNA, 23 nt, Human
caugauucauuuuaacaucugag

SEQ ID NO: 1806166 - RNA, 16 nt, Human
augagggaaaagaaaa

SEQ ID NO: 1806167 - RNA, 19 nt, Human
auucgcaaacuuucuuaaa

SEQ ID NO: 1806168 - RNA, 17 nt, Human
ugaaauauuauuuuaua

SEQ ID NO: 1806169 - RNA, 20 nt, Human
uacuuuuggcauuuuacugu

SEQ ID NO: 1806170 - RNA, 16 nt, Human
uaccuuuugcuguggc

SEQ ID NO: 1806171 - RNA, 17 nt, Human
agagguguuuuuucuaa

SEQ ID NO: 1806172 - RNA, 18 nt, Human
aaagauaucucaucucuu

SEQ ID NO: 1806173 - RNA, 16 nt, Human
aagaaaacuuguauua

SEQ ID NO: 1806174 - RNA, 13 nt, Human
uuuucuuuucauu

SEQ ID NO: 1806175 - RNA, 19 nt, Human
uccaauacucagguuaaug

SEQ ID NO: 1806176 - RNA, 11 nt, Human
uaaaugugauu

SEQ ID NO: 1806177 - RNA, 15 nt, Human
agcucugaagaacuc

SEQ ID NO: 1806178 - RNA, 21 nt, Human
uagagacggguuucaccaugu

SEQ ID NO: 1806179 - RNA, 13 nt, Human
cuugccugcaggc

SEQ ID NO: 1806180 - RNA, 14 nt, Human
ugguauuguauuua

SEQ ID NO: 1806181 - RNA, 17 nt, Human
auuuacccuucuuuucu

SEQ ID NO: 1806182 - RNA, 15 nt, Human
acaaaacccuuucug

SEQ ID NO: 1806183 - RNA, 12 nt, Human
agugcagccccg

SEQ ID NO: 1806184 - RNA, 15 nt, Human
cuccugccucagccu

SEQ ID NO: 1806185 - RNA, 16 nt, Human
guuaucuucacuuuua

SEQ ID NO: 1806186 - RNA, 20 nt, Human
ugagcgcucagcuucaagaa

SEQ ID NO: 1806187 - RNA, 15 nt, Human
agagugugaggaaaa

SEQ ID NO: 1806188 - RNA, 19 nt, Human
uguguuuuaaaaugagaaa

SEQ ID NO: 1806189 - RNA, 20 nt, Human
uaucuucacuuuuauaagaa

SEQ ID NO: 1806190 - RNA, 14 nt, Human
agccucagccuccc

SEQ ID NO: 1806191 - RNA, 17 nt, Human
augcauuauaaauaaau

SEQ ID NO: 1806192 - RNA, 17 nt, Human
auccaggcaccaggacu

SEQ ID NO: 1806193 - RNA, 15 nt, Human
gcagugacagcaguc

SEQ ID NO: 1806194 - RNA, 13 nt, Human
auuccuccuuccc

SEQ ID NO: 1806195 - RNA, 19 nt, Human
ugccaguuguccuccuucc

SEQ ID NO: 1806196 - RNA, 19 nt, Human
ugucacccagguuggagug

SEQ ID NO: 1806197 - RNA, 23 nt, Human
caugcaaacuuuauuuuguguuu

SEQ ID NO: 1806198 - RNA, 18 nt, Human
caaguauggcuccuccau

SEQ ID NO: 1806199 - RNA, 22 nt, Human
ggaaaugauguuucauaagaau

SEQ ID NO: 1806200 - RNA, 17 nt, Human
gcagacucacuguggga

SEQ ID NO: 1806201 - RNA, 19 nt, Human
uuccaaauucucacagaag

SEQ ID NO: 1806202 - RNA, 13 nt, Human
aaauucgcaaacu

SEQ ID NO: 1806203 - RNA, 13 nt, Human
gauuuaaauuauu

SEQ ID NO: 1806204 - RNA, 16 nt, Human
uuuuauuaauaaacau

SEQ ID NO: 1806205 - RNA, 23 nt, Human
uauaauucuuaugccauauaauu

SEQ ID NO: 1806206 - RNA, 14 nt, Human
ugguggccuggggc

SEQ ID NO: 1806207 - RNA, 17 nt, Human
augaguggcuuuaauga

SEQ ID NO: 1806208 - RNA, 21 nt, Human
uggggcacugugggacuggga

SEQ ID NO: 1806209 - RNA, 18 nt, Human
auagcuacuaauuuuaaa

SEQ ID NO: 1806210 - RNA, 14 nt, Human
agaccuaaaauaaa

SEQ ID NO: 1806211 - RNA, 21 nt, Human
uaaguauucuguguuaaaaau

SEQ ID NO: 1806212 - RNA, 16 nt, Human
ggcugccuucuggccu

SEQ ID NO: 1806213 - RNA, 15 nt, Human
cauccugcaggcagc

SEQ ID NO: 1806214 - RNA, 14 nt, Human
aagcaucacaugaa

SEQ ID NO: 1806215 - RNA, 20 nt, Human
accuaguccccagccugcuc

SEQ ID NO: 1806216 - RNA, 15 nt, Human
gcaacccaaauguuc

SEQ ID NO: 1806217 - RNA, 18 nt, Human
accucacauacccucacu

SEQ ID NO: 1806218 - RNA, 21 nt, Human
aggcuaugauugucuuuguuc

SEQ ID NO: 1806219 - RNA, 16 nt, Human
cugcugagccccaagu

SEQ ID NO: 1806220 - RNA, 22 nt, Human
uggcuuuuggcuccacccucuu

SEQ ID NO: 1806221 - RNA, 20 nt, Human
gagaugacagggaaaacugc

SEQ ID NO: 1806222 - RNA, 17 nt, Human
ugaagagauuuuucaug

SEQ ID NO: 1806223 - RNA, 21 nt, Human
aggacagcccuucuuuccaca

SEQ ID NO: 1806224 - RNA, 17 nt, Human
ugaaccucaagcugcau

SEQ ID NO: 1806225 - RNA, 18 nt, Human
guaauauugcaaggcaaa

SEQ ID NO: 1806226 - RNA, 22 nt, Human
aauuuuacauuuccuaaauaua

SEQ ID NO: 1806227 - RNA, 15 nt, Human
cccucccccuccucu

SEQ ID NO: 1806228 - RNA, 17 nt, Human
gcuuuaccuuuuuucuu

SEQ ID NO: 1806229 - RNA, 12 nt, Human
aggccaagaggc

SEQ ID NO: 1806230 - RNA, 20 nt, Human
caccgcaggauuugggcucu

SEQ ID NO: 1806231 - RNA, 23 nt, Human
gaggcucuaauguacaauaaagc

SEQ ID NO: 1806232 - RNA, 19 nt, Human
aggauaccauauacagcuc

SEQ ID NO: 1806233 - RNA, 23 nt, Human
auuuccuaguucuguagaaaugg

SEQ ID NO: 1806234 - RNA, 19 nt, Human
gccaggcuggagugcagug

SEQ ID NO: 1806235 - RNA, 20 nt, Human
cuugcacuagaggaacccua

SEQ ID NO: 1806236 - RNA, 18 nt, Human
ccuuaaagauacuugaag

SEQ ID NO: 1806237 - RNA, 13 nt, Human
uaagacaaauaug

SEQ ID NO: 1806238 - RNA, 20 nt, Human
uagaugcaguucugaagaag

SEQ ID NO: 1806239 - RNA, 14 nt, Human
agaagagaaaaugu

SEQ ID NO: 1806240 - RNA, 13 nt, Human
gaguacaccccaa

SEQ ID NO: 1806241 - RNA, 13 nt, Human
uuuaguggagaug

SEQ ID NO: 1806242 - RNA, 15 nt, Human
uuuguuaaaauagaa

SEQ ID NO: 1806243 - RNA, 19 nt, Human
uggaacaguuaccucugcc

SEQ ID NO: 1806244 - RNA, 18 nt, Human
gacauuugcucauggaau

SEQ ID NO: 1806245 - RNA, 18 nt, Human
ucaccagucccuccccaa

SEQ ID NO: 1806246 - RNA, 20 nt, Human
uguuggugaacuugguuuua

SEQ ID NO: 1806247 - RNA, 15 nt, Human
aaacauaugaauuau

SEQ ID NO: 1806248 - RNA, 21 nt, Human
gacccuucccuugagcccucu

SEQ ID NO: 1806249 - RNA, 15 nt, Human
ucacauuccucugcc

SEQ ID NO: 1806250 - RNA, 15 nt, Human
gucuuuuaggacccu

SEQ ID NO: 1806251 - RNA, 23 nt, Human
augucaaggguucaagauuguuc

SEQ ID NO: 1806252 - RNA, 23 nt, Human
uuuacacauguaucuaugcauuu

SEQ ID NO: 1806253 - RNA, 15 nt, Human
aggcugagagcccaa

SEQ ID NO: 1806254 - RNA, 15 nt, Human
auugauaagaucuuu

SEQ ID NO: 1806255 - RNA, 17 nt, Human
gcuuuggaaaacccaga

SEQ ID NO: 1806256 - RNA, 15 nt, Human
ugggacugggacacu

SEQ ID NO: 1806257 - RNA, 15 nt, Human
cuggaaacacauguu

SEQ ID NO: 1806258 - RNA, 22 nt, Human
uacaugagguacugagagugaa

SEQ ID NO: 1806259 - RNA, 12 nt, Human
agcuuucuuccu

SEQ ID NO: 1806260 - RNA, 20 nt, Human
cuacccucauuucucaucuu

SEQ ID NO: 1806261 - RNA, 20 nt, Human
auuuccuuauucagaauuuc

SEQ ID NO: 1806262 - RNA, 19 nt, Human
uggaaauguuuacagaucc

SEQ ID NO: 1806263 - RNA, 14 nt, Human
aguuuccuauguuu

SEQ ID NO: 1806264 - RNA, 13 nt, Human
ucaccaagcugcu

SEQ ID NO: 1806265 - RNA, 19 nt, Human
uguguuuuuaacaugucaa

SEQ ID NO: 1806266 - RNA, 14 nt, Human
ccugcugagcccca

SEQ ID NO: 1806267 - RNA, 19 nt, Human
acgcccucgagguugcucu

SEQ ID NO: 1806268 - RNA, 19 nt, Human
ugcaccaugcugcugggga

SEQ ID NO: 1806269 - RNA, 17 nt, Human
ccucuccaggagaccua

SEQ ID NO: 1806270 - RNA, 17 nt, Human
cugccuuuggcagaguu

SEQ ID NO: 1806271 - RNA, 21 nt, Human
ugcuggcaguggaacuaagaa

SEQ ID NO: 1806272 - RNA, 17 nt, Human
acugccaagccaugggu

SEQ ID NO: 1806273 - RNA, 14 nt, Human
aaggaggcugagag

SEQ ID NO: 1806274 - RNA, 22 nt, Human
uuacaugaauugcauuuuacuu

SEQ ID NO: 1806275 - RNA, 14 nt, Human
uguacaauaaagca

SEQ ID NO: 1806276 - RNA, 17 nt, Human
gcaaauugucacaggac

SEQ ID NO: 1806277 - RNA, 22 nt, Human
cauugucugugaagugagaccu

SEQ ID NO: 1806278 - RNA, 19 nt, Human
gguuccuuccucugagccu

SEQ ID NO: 1806279 - RNA, 22 nt, Human
ccuagccagaggcucuaaugua

SEQ ID NO: 1806280 - RNA, 12 nt, Human
ucuccagaugag

SEQ ID NO: 1806281 - RNA, 23 nt, Human
accuuauguuuaauuaaaaucag

SEQ ID NO: 1806282 - RNA, 13 nt, Human
cuuccuucauuuc

SEQ ID NO: 1806283 - RNA, 16 nt, Human
aagcauuuagauguau

SEQ ID NO: 1806284 - RNA, 17 nt, Human
cuuucuuuuuuuucuuu

SEQ ID NO: 1806285 - RNA, 15 nt, Human
acuuucuuaaaacau

SEQ ID NO: 1806286 - RNA, 10 nt, Human
ggacacacaa

SEQ ID NO: 1806287 - RNA, 13 nt, Human
cauauauuuugua

SEQ ID NO: 1806288 - RNA, 13 nt, Human
gccuccucucuca

SEQ ID NO: 1806289 - RNA, 14 nt, Human
aauauuuauuuuaa

SEQ ID NO: 1806290 - RNA, 13 nt, Human
aaaacuuuaaaac

SEQ ID NO: 1806291 - RNA, 15 nt, Human
acaucccacucacaa

SEQ ID NO: 1806292 - RNA, 23 nt, Human
uggaaauguuuacagauccccaa

SEQ ID NO: 1806293 - RNA, 19 nt, Human
cuuccagauccuggaaauc

SEQ ID NO: 1806294 - RNA, 24 nt, Human
ugugggccagacaaggccuuggag

SEQ ID NO: 1806295 - RNA, 15 nt, Human
aaaaaauaacaauga

SEQ ID NO: 1806296 - RNA, 15 nt, Human
ggugcugggaccugg

SEQ ID NO: 1806297 - RNA, 14 nt, Human
aaucacaauaauuu

SEQ ID NO: 1806298 - RNA, 14 nt, Human
uucucuguauuccu

SEQ ID NO: 1806299 - RNA, 23 nt, Human
caaucaguagccagcaucugccu

SEQ ID NO: 1806300 - RNA, 19 nt, Human
aacacugggagaaaugaaa

SEQ ID NO: 1806301 - RNA, 19 nt, Human
gagggaauugcagaguacu

SEQ ID NO: 1806302 - RNA, 18 nt, Human
uguauuauuuuuuaaaaa

SEQ ID NO: 1806303 - RNA, 10 nt, Human
ugauccccac

SEQ ID NO: 1806304 - RNA, 23 nt, Human
agaugggagugcccccaacagca

SEQ ID NO: 1806305 - RNA, 20 nt, Human
ccauacuaauuauacccccu

SEQ ID NO: 1806306 - RNA, 12 nt, Human
ucaagcucucca

SEQ ID NO: 1806307 - RNA, 20 nt, Human
ccugaguagaaaggccuuua

SEQ ID NO: 1806308 - RNA, 18 nt, Human
gcaaguuagaacuagcca

SEQ ID NO: 1806309 - RNA, 20 nt, Human
uauaugcuaagucuuauaua

SEQ ID NO: 1806310 - RNA, 14 nt, Human
caaagugcugggau

SEQ ID NO: 1806311 - RNA, 16 nt, Human
caccccaacagcaccc

SEQ ID NO: 1806312 - RNA, 18 nt, Human
caucugucaccaagccuu

SEQ ID NO: 1806313 - RNA, 21 nt, Human
cauaagauauuuuucaugauu

SEQ ID NO: 1806314 - RNA, 19 nt, Human
ugcucagcccugcaccaug

SEQ ID NO: 1806315 - RNA, 16 nt, Human
gcacauauccaggcac

SEQ ID NO: 1806316 - RNA, 17 nt, Human
ccuuuacuugaccuccu

SEQ ID NO: 1806317 - RNA, 15 nt, Human
gccauucucaagccc

SEQ ID NO: 1806318 - RNA, 15 nt, Human
ucagagccuccuuuc

SEQ ID NO: 1806319 - RNA, 21 nt, Human
cuuucucaauaagccucagcu

SEQ ID NO: 1806320 - RNA, 16 nt, Human
ccugagcgacagugag

SEQ ID NO: 1806321 - RNA, 19 nt, Human
caccccaacagcacccucu

SEQ ID NO: 1806322 - RNA, 22 nt, Human
aauggacacagucuaacaaauu

SEQ ID NO: 1806323 - RNA, 18 nt, Human
cucaaugguuaacuaauu

SEQ ID NO: 1806324 - RNA, 16 nt, Human
gaaggcauccccaggc

SEQ ID NO: 1806325 - RNA, 21 nt, Human
cggcaagggaacaaguacuuc

SEQ ID NO: 1806326 - RNA, 18 nt, Human
caugaauuaguuuuauau

SEQ ID NO: 1806327 - RNA, 22 nt, Human
ccagguucuuucuuuaaagcag

SEQ ID NO: 1806328 - RNA, 20 nt, Human
aggagacaaaacuagagacu

SEQ ID NO: 1806329 - RNA, 17 nt, Human
aauauauuuuaaauauu

SEQ ID NO: 1806330 - RNA, 17 nt, Human
ccugcucuuccucagcu

SEQ ID NO: 1806331 - RNA, 23 nt, Human
auccucucucuguguuacccagu

SEQ ID NO: 1806332 - RNA, 18 nt, Human
aaguugauaugccuuuuc

SEQ ID NO: 1806333 - RNA, 17 nt, Human
gccucgaccucucucaa

SEQ ID NO: 1806334 - RNA, 12 nt, Human
ccagagaagggc

SEQ ID NO: 1806335 - RNA, 18 nt, Human
ccauccugccccugagcc

SEQ ID NO: 1806336 - RNA, 23 nt, Human
agguaaccccagauucaugcacu

SEQ ID NO: 1806337 - RNA, 16 nt, Human
aguaaagaacaucccu

SEQ ID NO: 1806338 - RNA, 18 nt, Human
augagaguacaccccaac

SEQ ID NO: 1806339 - RNA, 13 nt, Human
ccucugccuccca

SEQ ID NO: 1806340 - RNA, 22 nt, Human
cuguuagcaugcuggugagcca

SEQ ID NO: 1806341 - RNA, 19 nt, Human
gccaggauggcgcaggaac

SEQ ID NO: 1806342 - RNA, 13 nt, Human
uuuaaaaaagaaa

SEQ ID NO: 1806343 - RNA, 14 nt, Human
uuuuaaaauccacu

SEQ ID NO: 1806344 - RNA, 20 nt, Human
accuacacgagauacagaau

SEQ ID NO: 1806345 - RNA, 20 nt, Human
aauccucccacuucagccuc

SEQ ID NO: 1806346 - RNA, 17 nt, Human
cuuugcugacccucccc

SEQ ID NO: 1806347 - RNA, 19 nt, Human
cugcccgccucgaccucuc

SEQ ID NO: 1806348 - RNA, 19 nt, Human
gugacacagcugucccaag

SEQ ID NO: 1806349 - RNA, 18 nt, Human
accacucauaauucuuca

SEQ ID NO: 1806350 - RNA, 17 nt, Human
ccugucuccucucucug

SEQ ID NO: 1806351 - RNA, 23 nt, Human
ucauaagauauuuuucaugauuu

SEQ ID NO: 1806352 - RNA, 21 nt, Human
cugaccccaaguuauccaccu

SEQ ID NO: 1806353 - RNA, 23 nt, Human
agcaagcaggaaucagagaccuu

SEQ ID NO: 1806354 - RNA, 18 nt, Human
gccuucuggccuuguaag

SEQ ID NO: 1806355 - RNA, 21 nt, Human
uggaaacguauucaaacaauu

SEQ ID NO: 1806356 - RNA, 22 nt, Human
caagccuaaaauuguauagacc

SEQ ID NO: 1806357 - RNA, 15 nt, Human
auuuuuuuuaacauu

SEQ ID NO: 1806358 - RNA, 16 nt, Human
ugaaguccaagcauuu

SEQ ID NO: 1806359 - RNA, 17 nt, Human
cuuccucugagccuugg

SEQ ID NO: 1806360 - RNA, 19 nt, Human
uguuaucuucacuuuuaua

SEQ ID NO: 1806361 - RNA, 18 nt, Human
cuggucucuccuuguucu

SEQ ID NO: 1806362 - RNA, 21 nt, Human
gcagagccaggacccaggagg

SEQ ID NO: 1806363 - RNA, 21 nt, Human
cuaaaugacuuuucuccucuc

SEQ ID NO: 1806364 - RNA, 23 nt, Human
cccaguuagccucugcaggaugu

SEQ ID NO: 1806365 - RNA, 16 nt, Human
ggucuaccacucagag

SEQ ID NO: 1806366 - RNA, 16 nt, Human
acuugccucugcacac

SEQ ID NO: 1806367 - RNA, 21 nt, Human
uuaaauguuuuuuuuuaaaga

SEQ ID NO: 1806368 - RNA, 19 nt, Human
cugcaaccucugccuccca

SEQ ID NO: 1806369 - RNA, 16 nt, Human
auaucaauuuaaaaaa

SEQ ID NO: 1806370 - RNA, 14 nt, Human
cacuuauaggaauu

SEQ ID NO: 1806371 - RNA, 13 nt, Human
ccccaggacgccc

SEQ ID NO: 1806372 - RNA, 14 nt, Human
gcagugccuuucuu

SEQ ID NO: 1806373 - RNA, 22 nt, Human
caucccuagucucuacccagua

SEQ ID NO: 1806374 - RNA, 20 nt, Human
cuucaacucccugcccccca

SEQ ID NO: 1806375 - RNA, 14 nt, Human
cucccuuggggccu

SEQ ID NO: 1806376 - RNA, 15 nt, Human
uucagucuuuuccau

SEQ ID NO: 1806377 - RNA, 22 nt, Human
agggagugcauuuaugagcucu

SEQ ID NO: 1806378 - RNA, 16 nt, Human
uaaagaauuauuuugu

SEQ ID NO: 1806379 - RNA, 14 nt, Human
uaugaauuacauuu

SEQ ID NO: 1806380 - RNA, 15 nt, Human
gcuucagccaggagc

SEQ ID NO: 1806381 - RNA, 20 nt, Human
uuuaaugagauaaugugaua

SEQ ID NO: 1806382 - RNA, 17 nt, Human
gauuuaucuauuuaaau

SEQ ID NO: 1806383 - RNA, 21 nt, Human
gcuguaauguuaauauugauu

SEQ ID NO: 1806384 - RNA, 16 nt, Human
cagcucacuacaaccu

SEQ ID NO: 1806385 - RNA, 13 nt, Human
agaauuauuuugu

SEQ ID NO: 1806386 - RNA, 20 nt, Human
uauuaucuuuucauacauuu

SEQ ID NO: 1806387 - RNA, 17 nt, Human
auucauuaaucugccuc

SEQ ID NO: 1806388 - RNA, 13 nt, Human
cugcucagcccug

SEQ ID NO: 1806389 - RNA, 15 nt, Human
ccucugucuccuaag

SEQ ID NO: 1806390 - RNA, 17 nt, Human
aaauuaucuuaaaacuc

SEQ ID NO: 1806391 - RNA, 14 nt, Human
ucuaggaaauauuu

SEQ ID NO: 1806392 - RNA, 17 nt, Human
guuuaauuaaaaucagu

SEQ ID NO: 1806393 - RNA, 16 nt, Human
cagcuuuccucaaaac

SEQ ID NO: 1806394 - RNA, 20 nt, Human
cuucucuguucauuuccuca

SEQ ID NO: 1806395 - RNA, 14 nt, Human
gcuuuaacuccugc

SEQ ID NO: 1806396 - RNA, 19 nt, Human
acuauuuaauuauuucacu

SEQ ID NO: 1806397 - RNA, 15 nt, Human
cucugggaucccccc

SEQ ID NO: 1806398 - RNA, 20 nt, Human
agaugcaguucugaagaaga

SEQ ID NO: 1806399 - RNA, 18 nt, Human
uuuuaucugcuaugcuau

SEQ ID NO: 1806400 - RNA, 15 nt, Human
uucaaauuguaagca

SEQ ID NO: 1806401 - RNA, 16 nt, Human
ccugacugccaagcca

SEQ ID NO: 1806402 - RNA, 14 nt, Human
cucaucucuucuuu

SEQ ID NO: 1806403 - RNA, 23 nt, Human
acauuucccccuagccugccucc

SEQ ID NO: 1806404 - RNA, 15 nt, Human
caguauuguuccuuu

SEQ ID NO: 1806405 - RNA, 19 nt, Human
gcagacucacugugggaag

SEQ ID NO: 1806406 - RNA, 15 nt, Human
ccccacgccacagcc

SEQ ID NO: 1806407 - RNA, 15 nt, Human
gcccacuagacccac

SEQ ID NO: 1806408 - RNA, 17 nt, Human
ccaagcugguggcucug

SEQ ID NO: 1806409 - RNA, 16 nt, Human
caauaaagcaaugugg

SEQ ID NO: 1806410 - RNA, 18 nt, Human
uuccuugggcuuuagccu

SEQ ID NO: 1806411 - RNA, 14 nt, Human
gaccucaagugauc

SEQ ID NO: 1806412 - RNA, 16 nt, Human
cucuaugccagcagcc

SEQ ID NO: 1806413 - RNA, 18 nt, Human
ggcacugugggacuggga

SEQ ID NO: 1806414 - RNA, 20 nt, Human
caccacuucaagugaccacc

SEQ ID NO: 1806415 - RNA, 15 nt, Human
ucaugcuaauuauau

SEQ ID NO: 1806416 - RNA, 14 nt, Human
aauaaaauuuuuaa

SEQ ID NO: 1806417 - RNA, 21 nt, Human
gugacaaccaaaagucuucau

SEQ ID NO: 1806418 - RNA, 20 nt, Human
gcucagauuauaacuguugu

SEQ ID NO: 1806419 - RNA, 15 nt, Human
aggucuaggugcuuu

SEQ ID NO: 1806420 - RNA, 21 nt, Human
auauuuauaaaaauaaaaaac

SEQ ID NO: 1806421 - RNA, 19 nt, Human
ggaugagggaaaagaaaaa

SEQ ID NO: 1806422 - RNA, 13 nt, Human
uaaaaugagaaau

SEQ ID NO: 1806423 - RNA, 23 nt, Human
uugagggcaagagccacaguaua

SEQ ID NO: 1806424 - RNA, 13 nt, Human
caggcaggaacaa

SEQ ID NO: 1806425 - RNA, 13 nt, Human
cugacucucuuaa

SEQ ID NO: 1806426 - RNA, 24 nt, Human
gugauccacccgccucagccuccc

SEQ ID NO: 1806427 - RNA, 21 nt, Human
auuguagaaaagcuauaaaau

SEQ ID NO: 1806428 - RNA, 13 nt, Human
gacagaaucucag

SEQ ID NO: 1806429 - RNA, 18 nt, Human
aaacuccugaccucaggc

SEQ ID NO: 1806430 - RNA, 13 nt, Human
ccugagcuugcag

SEQ ID NO: 1806431 - RNA, 20 nt, Human
agaauuucuuuaacuuaauu

SEQ ID NO: 1806432 - RNA, 23 nt, Human
caacuaaugauuuagugaucaaa

SEQ ID NO: 1806433 - RNA, 17 nt, Human
agccccucacacagccc

SEQ ID NO: 1806434 - RNA, 23 nt, Human
ucucguaagauuuccuucuuuuu

SEQ ID NO: 1806435 - RNA, 15 nt, Human
uagggugauauuaac

SEQ ID NO: 1806436 - RNA, 11 nt, Human
ccagauauacu

SEQ ID NO: 1806437 - RNA, 15 nt, Human
cauccauucuccuga

SEQ ID NO: 1806438 - RNA, 17 nt, Human
gaugauuucagcaggga

SEQ ID NO: 1806439 - RNA, 15 nt, Human
accugggcugaggca

SEQ ID NO: 1806440 - RNA, 15 nt, Human
acuuuaauaaaugua

SEQ ID NO: 1806441 - RNA, 19 nt, Human
gaggcuguugucuuuuccu

SEQ ID NO: 1806442 - RNA, 13 nt, Human
cucagcccugcac

SEQ ID NO: 1806443 - RNA, 15 nt, Human
aauuauuaagauaug

SEQ ID NO: 1806444 - RNA, 19 nt, Human
auugcucucccagcccuug

SEQ ID NO: 1806445 - RNA, 17 nt, Human
cucacauacccucacuu

SEQ ID NO: 1806446 - RNA, 19 nt, Human
uuggcaagcucuaucacca

SEQ ID NO: 1806447 - RNA, 16 nt, Human
auguacaauaaagcaa

SEQ ID NO: 1806448 - RNA, 16 nt, Human
cuucugagccugccuu

SEQ ID NO: 1806449 - RNA, 17 nt, Human
cccugcagucacagcua

SEQ ID NO: 1806450 - RNA, 22 nt, Human
auauuuuagauagaugaagaag

SEQ ID NO: 1806451 - RNA, 14 nt, Human
uaaaagacaaggaa

SEQ ID NO: 1806452 - RNA, 13 nt, Human
aaaacaggguugu

SEQ ID NO: 1806453 - RNA, 16 nt, Human
auuaccaguuuuccua

SEQ ID NO: 1806454 - RNA, 23 nt, Human
aauuucuauuugaucugauauca

SEQ ID NO: 1806455 - RNA, 23 nt, Human
cuucaaacugagauccuuccuuu

SEQ ID NO: 1806456 - RNA, 15 nt, Human
agcuaauuuuuguau

SEQ ID NO: 1806457 - RNA, 13 nt, Human
gauuguaaaaugg

SEQ ID NO: 1806458 - RNA, 22 nt, Human
acaccauucaggucuuucuuuc

SEQ ID NO: 1806459 - RNA, 19 nt, Human
uuaaaaucaguauuugucu

SEQ ID NO: 1806460 - RNA, 18 nt, Human
acuuuaugcuaagugaaa

SEQ ID NO: 1806461 - RNA, 15 nt, Human
aaauauaaauaaaaa

SEQ ID NO: 1806462 - RNA, 14 nt, Human
gaucuuucugccuu

SEQ ID NO: 1806463 - RNA, 15 nt, Human
aaucagccaauuaug

SEQ ID NO: 1806464 - RNA, 14 nt, Human
ugcuggagcucugc

SEQ ID NO: 1806465 - RNA, 20 nt, Human
cuuacuggugcuauuuugua

SEQ ID NO: 1806466 - RNA, 14 nt, Human
gguagaaagaagau

SEQ ID NO: 1806467 - RNA, 14 nt, Human
gcugucccaagggc

SEQ ID NO: 1806468 - RNA, 15 nt, Human
aguucuuuggcugaa

SEQ ID NO: 1806469 - RNA, 15 nt, Human
uagggcguggaaagg

SEQ ID NO: 1806470 - RNA, 13 nt, Human
caaacaaaaaaaa

SEQ ID NO: 1806471 - RNA, 19 nt, Human
aauuuuuauauuugaaaua

SEQ ID NO: 1806472 - RNA, 19 nt, Human
gcauccuuccucacaccag

SEQ ID NO: 1806473 - RNA, 22 nt, Human
gaaaacaauaacgauaaaagac

SEQ ID NO: 1806474 - RNA, 11 nt, Human
uuauauuucca

SEQ ID NO: 1806475 - RNA, 14 nt, Human
cucuaauguacaau

SEQ ID NO: 1806476 - RNA, 21 nt, Human
ggcacagguccccagaugaga

SEQ ID NO: 1806477 - RNA, 17 nt, Human
cuauuccuccuucccuu

SEQ ID NO: 1806478 - RNA, 21 nt, Human
gaagacagagccccacccuca

SEQ ID NO: 1806479 - RNA, 17 nt, Human
uaaaagacaaggaaaaa

SEQ ID NO: 1806480 - RNA, 19 nt, Human
cuuuguggcugaaaggucc

SEQ ID NO: 1806481 - RNA, 20 nt, Human
aacaaugcuguauuuuaaaa

SEQ ID NO: 1806482 - RNA, 13 nt, Human
uguagaaaagcua

SEQ ID NO: 1806483 - RNA, 17 nt, Human
aauuaagucugugagau

SEQ ID NO: 1806484 - RNA, 14 nt, Human
gagcucagcccugg

SEQ ID NO: 1806485 - RNA, 20 nt, Human
cauaagauauuuuucaugau

SEQ ID NO: 1806486 - RNA, 20 nt, Human
uccaagcaaaugugaaucau

SEQ ID NO: 1806487 - RNA, 12 nt, Human
gggaaugaagca

SEQ ID NO: 1806488 - RNA, 13 nt, Human
gcauauuuauaaa

SEQ ID NO: 1806489 - RNA, 14 nt, Human
uuuuaaucuguauu

SEQ ID NO: 1806490 - RNA, 17 nt, Human
aucauuuacuuuuaaac

SEQ ID NO: 1806491 - RNA, 15 nt, Human
cauguauuuggugau

SEQ ID NO: 1806492 - RNA, 14 nt, Human
caaggaaaaaauaa

SEQ ID NO: 1806493 - RNA, 14 nt, Human
aaugaauaaacauu

SEQ ID NO: 1806494 - RNA, 15 nt, Human
uguggaaguggggcg

SEQ ID NO: 1806495 - RNA, 14 nt, Human
cugaacccagggaa

SEQ ID NO: 1806496 - RNA, 22 nt, Human
acugacuauucuugauguaaaa

SEQ ID NO: 1806497 - RNA, 20 nt, Human
cuggcuaauuagcauggcca

SEQ ID NO: 1806498 - RNA, 17 nt, Human
gcccucccccuccucuc

SEQ ID NO: 1806499 - RNA, 20 nt, Human
auaagacggauuuauuuuuc

SEQ ID NO: 1806500 - RNA, 18 nt, Human
aggcuugaaucaaagaac

SEQ ID NO: 1806501 - RNA, 19 nt, Human
ucucagcucacuacaaccu

SEQ ID NO: 1806502 - RNA, 20 nt, Human
uaaaagaaacccugcaccca

SEQ ID NO: 1806503 - RNA, 23 nt, Human
acugcuugaacuaggcugagcaa

SEQ ID NO: 1806504 - RNA, 16 nt, Human
acuucuugaaaucaau

SEQ ID NO: 1806505 - RNA, 14 nt, Human
uccaacguggccca

SEQ ID NO: 1806506 - RNA, 22 nt, Human
uaaagaaggugugggccagaca

SEQ ID NO: 1806507 - RNA, 19 nt, Human
gucacauaaugcucauacu

SEQ ID NO: 1806508 - RNA, 17 nt, Human
aaugcagugccuuucuu

SEQ ID NO: 1806509 - RNA, 12 nt, Human
ugcccugcugcc

SEQ ID NO: 1806510 - RNA, 18 nt, Human
uggggggggugcugggcc

SEQ ID NO: 1806511 - RNA, 18 nt, Human
augaugcaacauccuugu

SEQ ID NO: 1806512 - RNA, 14 nt, Human
uauauuuccuuauu

SEQ ID NO: 1806513 - RNA, 18 nt, Human
acccucuccagaugagag

SEQ ID NO: 1806514 - RNA, 17 nt, Human
uauuaugaagcuuuuau

SEQ ID NO: 1806515 - RNA, 21 nt, Human
ccaauucauccucacucaguc

SEQ ID NO: 1806516 - RNA, 16 nt, Human
acaugauuuggggaaa

SEQ ID NO: 1806517 - RNA, 15 nt, Human
aagccccagcaagca

SEQ ID NO: 1806518 - RNA, 12 nt, Human
aaaacuuuaaaa

SEQ ID NO: 1806519 - RNA, 21 nt, Human
cuacacagaucacagcuucag

SEQ ID NO: 1806520 - RNA, 17 nt, Human
aacccuuucugccccug

SEQ ID NO: 1806521 - RNA, 21 nt, Human
cucuguauacaaaacccuuuc

SEQ ID NO: 1806522 - RNA, 19 nt, Human
uugauaagaucuuuuauuu

SEQ ID NO: 1806523 - RNA, 19 nt, Human
acuguguauuuaacugccu

SEQ ID NO: 1806524 - RNA, 17 nt, Human
acacuguuaucuucacu

SEQ ID NO: 1806525 - RNA, 14 nt, Human
auuauuucacuuua

SEQ ID NO: 1806526 - RNA, 22 nt, Human
aaauggacacagucuaacaaau

SEQ ID NO: 1806527 - RNA, 18 nt, Human
cuagcauaucugccuuua

SEQ ID NO: 1806528 - RNA, 17 nt, Human
auuuucuauaauuuaaa

SEQ ID NO: 1806529 - RNA, 14 nt, Human
cagaaucaugcuga

SEQ ID NO: 1806530 - RNA, 15 nt, Human
ucuuuuuucuaaagu

SEQ ID NO: 1806531 - RNA, 21 nt, Human
cuuaagguaugguacaagcaa

SEQ ID NO: 1806532 - RNA, 17 nt, Human
ccugucgguuuauucac

SEQ ID NO: 1806533 - RNA, 23 nt, Human
gucucagcuucacccugagguga

SEQ ID NO: 1806534 - RNA, 16 nt, Human
auuccaccuacaugag

SEQ ID NO: 1806535 - RNA, 22 nt, Human
aacaguuuuugcuaauuuuuag

SEQ ID NO: 1806536 - RNA, 18 nt, Human
caacagguaaaacagggc

SEQ ID NO: 1806537 - RNA, 21 nt, Human
ccaugugcagccaccagucca

SEQ ID NO: 1806538 - RNA, 17 nt, Human
uuauauuugaaauauug

SEQ ID NO: 1806539 - RNA, 17 nt, Human
gcagcauuguuggcugu

SEQ ID NO: 1806540 - RNA, 15 nt, Human
cccuggccucugcuc

SEQ ID NO: 1806541 - RNA, 21 nt, Human
cuaagcuucacuguaaaauaa

SEQ ID NO: 1806542 - RNA, 18 nt, Human
auuuaauucauguugccu

SEQ ID NO: 1806543 - RNA, 15 nt, Human
cuagcccuccucucc

SEQ ID NO: 1806544 - RNA, 18 nt, Human
cagcuuaguucaaguccu

SEQ ID NO: 1806545 - RNA, 22 nt, Human
uuaauauguuauuauuaaauag

SEQ ID NO: 1806546 - RNA, 16 nt, Human
uggcccagagaagcca

SEQ ID NO: 1806547 - RNA, 17 nt, Human
ccugccucucugcaggu

SEQ ID NO: 1806548 - RNA, 13 nt, Human
uguuucuuucuuu

SEQ ID NO: 1806549 - RNA, 18 nt, Human
uagaauaaaauuuuuaau

SEQ ID NO: 1806550 - RNA, 19 nt, Human
uucuaaauaaaaagcauua

SEQ ID NO: 1806551 - RNA, 23 nt, Human
agacagcuucucauccugcaggc

SEQ ID NO: 1806552 - RNA, 13 nt, Human
caguagcuggagg

SEQ ID NO: 1806553 - RNA, 22 nt, Human
acgcaucagacagauggaaaag

SEQ ID NO: 1806554 - RNA, 20 nt, Human
uuggagauguuuaguaauca

SEQ ID NO: 1806555 - RNA, 17 nt, Human
ugcaaaguuuaauggug

SEQ ID NO: 1806556 - RNA, 18 nt, Human
uggcuuuuggcuccaccc

SEQ ID NO: 1806557 - RNA, 16 nt, Human
cucauuguagaaaagc

SEQ ID NO: 1806558 - RNA, 18 nt, Human
agcccugcagucacagcu

SEQ ID NO: 1806559 - RNA, 17 nt, Human
guguccccuauccuacu

SEQ ID NO: 1806560 - RNA, 18 nt, Human
cucuuuccuccacaccau

SEQ ID NO: 1806561 - RNA, 20 nt, Human
agacuguuuuucagggaggu

SEQ ID NO: 1806562 - RNA, 14 nt, Human
aucucccucuuccc

SEQ ID NO: 1806563 - RNA, 14 nt, Human
ccggacgcccagga

SEQ ID NO: 1806564 - RNA, 16 nt, Human
acuaguuucccuugca

SEQ ID NO: 1806565 - RNA, 23 nt, Human
uauuguugcauuaaaaaugcaua

SEQ ID NO: 1806566 - RNA, 17 nt, Human
ucuauuucuuuuuaauu

SEQ ID NO: 1806567 - RNA, 13 nt, Human
uccuuuuuuauuc

SEQ ID NO: 1806568 - RNA, 15 nt, Human
ucugccacaccucuc

SEQ ID NO: 1806569 - RNA, 14 nt, Human
ucuauaauuuaaau

SEQ ID NO: 1806570 - RNA, 14 nt, Human
uaaaguauuuaauu

SEQ ID NO: 1806571 - RNA, 19 nt, Human
uagccuggguguaaaaccu

SEQ ID NO: 1806572 - RNA, 19 nt, Human
ucccugcagcucucuuucc

SEQ ID NO: 1806573 - RNA, 12 nt, Human
cacccacuuccc

SEQ ID NO: 1806574 - RNA, 21 nt, Human
cgaggccccugucucagggug

SEQ ID NO: 1806575 - RNA, 14 nt, Human
auuauuuuauguug

SEQ ID NO: 1806576 - RNA, 16 nt, Human
ucauuuuuucuucucc

SEQ ID NO: 1806577 - RNA, 13 nt, Human
cuccuccauaucu

SEQ ID NO: 1806578 - RNA, 14 nt, Human
ucuguucauuuccu

SEQ ID NO: 1806579 - RNA, 21 nt, Human
caguggcgcgaucucagcuca

SEQ ID NO: 1806580 - RNA, 16 nt, Human
ccugucaucucacauu

SEQ ID NO: 1806581 - RNA, 15 nt, Human
cccccagagccacag

SEQ ID NO: 1806582 - RNA, 20 nt, Human
ucacuguauguccuuggugc

SEQ ID NO: 1806583 - RNA, 17 nt, Human
aaauauaaauaaaaaua

SEQ ID NO: 1806584 - RNA, 23 nt, Human
uuaugccgcuagauacaugcuuu

SEQ ID NO: 1806585 - RNA, 17 nt, Human
gcucagggcucuuuccu

SEQ ID NO: 1806586 - RNA, 18 nt, Human
ugaagauauuuuuccauu

SEQ ID NO: 1806587 - RNA, 15 nt, Human
uggcuaauuagcaug

SEQ ID NO: 1806588 - RNA, 17 nt, Human
aagucaauguuuucagu

SEQ ID NO: 1806589 - RNA, 12 nt, Human
aauugcagagua

SEQ ID NO: 1806590 - RNA, 14 nt, Human
aggcucaaaacagg

SEQ ID NO: 1806591 - RNA, 13 nt, Human
aaacauccuacaa

SEQ ID NO: 1806592 - RNA, 13 nt, Human
ugcaagaguuuaa

SEQ ID NO: 1806593 - RNA, 18 nt, Human
gaccccaaguuauccacc

SEQ ID NO: 1806594 - RNA, 17 nt, Human
cauucagggcuauuuuu

SEQ ID NO: 1806595 - RNA, 17 nt, Human
cuugcagcucuccccuu

SEQ ID NO: 1806596 - RNA, 23 nt, Human
cucaucucuucuuuuaaaccauu

SEQ ID NO: 1806597 - RNA, 23 nt, Human
aaacauguuccugggaucacuga

SEQ ID NO: 1806598 - RNA, 23 nt, Human
uaagacggauuuauuuuuccauu

SEQ ID NO: 1806599 - RNA, 15 nt, Human
uugcugcugagugca

SEQ ID NO: 1806600 - RNA, 18 nt, Human
agguuuuaauaauuuuuu

SEQ ID NO: 1806601 - RNA, 23 nt, Human
uccaccaggauauccucccucca

SEQ ID NO: 1806602 - RNA, 11 nt, Human
cccagagacag

SEQ ID NO: 1806603 - RNA, 15 nt, Human
uugagggagcaaguc

SEQ ID NO: 1806604 - RNA, 15 nt, Human
uuuaugcauauuauu

SEQ ID NO: 1806605 - RNA, 23 nt, Human
uuaaccagaucauugugaaauua

SEQ ID NO: 1806606 - RNA, 18 nt, Human
agacacugaucuggcugc

SEQ ID NO: 1806607 - RNA, 23 nt, Human
ugucacccagguuggagugcagu

SEQ ID NO: 1806608 - RNA, 13 nt, Human
cccaacaccccac

SEQ ID NO: 1806609 - RNA, 20 nt, Human
cugccaggcacacugagcca

SEQ ID NO: 1806610 - RNA, 13 nt, Human
acuaaacucagag

SEQ ID NO: 1806611 - RNA, 19 nt, Human
ugugugagguucgcuuauc

SEQ ID NO: 1806612 - RNA, 12 nt, Human
uaaauauauauu

SEQ ID NO: 1806613 - RNA, 14 nt, Human
auauaaauggaauu

SEQ ID NO: 1806614 - RNA, 22 nt, Human
uguaggcauguagcuacaggac

SEQ ID NO: 1806615 - RNA, 16 nt, Human
uauacauacaugcaua

SEQ ID NO: 1806616 - RNA, 14 nt, Human
gcugauuaaaccaa

SEQ ID NO: 1806617 - RNA, 17 nt, Human
auuugaaugcauuuugu

SEQ ID NO: 1806618 - RNA, 17 nt, Human
ucgggauuaguacacac

SEQ ID NO: 1806619 - RNA, 13 nt, Human
uuuuuauauccac

SEQ ID NO: 1806620 - RNA, 19 nt, Human
cuccagaugagaguacacc

SEQ ID NO: 1806621 - RNA, 22 nt, Human
uaucuauguagaauauauuucc

SEQ ID NO: 1806622 - RNA, 22 nt, Human
uauacuuguggacuaaaagaua

SEQ ID NO: 1806623 - RNA, 20 nt, Human
acaagacacagugaccauac

SEQ ID NO: 1806624 - RNA, 22 nt, Human
cucccuggauuuuuaccagucu

SEQ ID NO: 1806625 - RNA, 20 nt, Human
uaugauaaggaugauaaaag

SEQ ID NO: 1806626 - RNA, 20 nt, Human
acuuucuagauuaagauaug

SEQ ID NO: 1806627 - RNA, 14 nt, Human
uuuaaaaugagaaa

SEQ ID NO: 1806628 - RNA, 17 nt, Human
acauccauucuucccuu

SEQ ID NO: 1806629 - RNA, 17 nt, Human
uauggggaaaaaacugu

SEQ ID NO: 1806630 - RNA, 18 nt, Human
uuuacauuuccuaaauau

SEQ ID NO: 1806631 - RNA, 21 nt, Human
gagcaucuccucaacucugag

SEQ ID NO: 1806632 - RNA, 16 nt, Human
aacucaugacggaaga

SEQ ID NO: 1806633 - RNA, 22 nt, Human
ucccuagaaagccaugugcagc

SEQ ID NO: 1806634 - RNA, 11 nt, Human
cauaugaaaag

SEQ ID NO: 1806635 - RNA, 14 nt, Human
ugacuauuauauuu

SEQ ID NO: 1806636 - RNA, 21 nt, Human
agcuggaggcacccaugccau

SEQ ID NO: 1806637 - RNA, 20 nt, Human
uagguaacuguaugugugug

SEQ ID NO: 1806638 - RNA, 22 nt, Human
acugucacauaaugcucauacu

SEQ ID NO: 1806639 - RNA, 12 nt, Human
uggcaucaucuc

SEQ ID NO: 1806640 - RNA, 22 nt, Human
auggucccuauuccuccuuccc

SEQ ID NO: 1806641 - RNA, 20 nt, Human
acaaaucagaccuggcugcu

SEQ ID NO: 1806642 - RNA, 17 nt, Human
ucacuguguuggccagg

SEQ ID NO: 1806643 - RNA, 18 nt, Human
cucuguaucuagccugga

SEQ ID NO: 1806644 - RNA, 20 nt, Human
cccagagaagccaaaagauu

SEQ ID NO: 1806645 - RNA, 12 nt, Human
uuggagugcagu

SEQ ID NO: 1806646 - RNA, 20 nt, Human
augcuugaaaagauaaauua

SEQ ID NO: 1806647 - RNA, 20 nt, Human
ccaaauguucaucaaugaau

SEQ ID NO: 1806648 - RNA, 23 nt, Human
ucuccaauacucagguuaaugcu

SEQ ID NO: 1806649 - RNA, 13 nt, Human
uguaauguuaaua

SEQ ID NO: 1806650 - RNA, 15 nt, Human
gcauuauaaauaaau

SEQ ID NO: 1806651 - RNA, 18 nt, Human
aucuauguagaauauauu

SEQ ID NO: 1806652 - RNA, 14 nt, Human
aaauaggaaauauu

SEQ ID NO: 1806653 - RNA, 24 nt, Human
uguucaagcgauucuccugccuca

SEQ ID NO: 1806654 - RNA, 18 nt, Human
cauagguuuaauaauuuu

SEQ ID NO: 1806655 - RNA, 22 nt, Human
aggcaggaacaaacagggcugc

SEQ ID NO: 1806656 - RNA, 22 nt, Human
gcugggcagaaggccaagaggc

SEQ ID NO: 1806657 - RNA, 13 nt, Human
gccccugccucuc

SEQ ID NO: 1806658 - RNA, 23 nt, Human
aaacccauucccucuccaggaga

SEQ ID NO: 1806659 - RNA, 19 nt, Human
caccuuagaccaccaagcc

SEQ ID NO: 1806660 - RNA, 22 nt, Human
aaguacccguucacauuuuugu

SEQ ID NO: 1806661 - RNA, 16 nt, Human
uagaaaacaggcaaau

SEQ ID NO: 1806662 - RNA, 19 nt, Human
cuaugaacucuguuuucuu

SEQ ID NO: 1806663 - RNA, 20 nt, Human
auuugggggacuuacaugau

SEQ ID NO: 1806664 - RNA, 18 nt, Human
acauuuauauuuuuguga

SEQ ID NO: 1806665 - RNA, 17 nt, Human
uccaccagguucuuucu

SEQ ID NO: 1806666 - RNA, 14 nt, Human
accaguuuccaggu

SEQ ID NO: 1806667 - RNA, 22 nt, Human
accuaacgaaguauccuucagc

SEQ ID NO: 1806668 - RNA, 17 nt, Human
ccaacccgaggcccgca

SEQ ID NO: 1806669 - RNA, 18 nt, Human
gccuccccugccucacca

SEQ ID NO: 1806670 - RNA, 20 nt, Human
auauacuugguucucuccac

SEQ ID NO: 1806671 - RNA, 15 nt, Human
acucaauaaagugcu

SEQ ID NO: 1806672 - RNA, 15 nt, Human
guguagggaguugug

SEQ ID NO: 1806673 - RNA, 13 nt, Human
gcuuuucuuuucu

SEQ ID NO: 1806674 - RNA, 20 nt, Human
uaaguguguguuuuucauaa

SEQ ID NO: 1806675 - RNA, 13 nt, Human
auaaaaauauaua

SEQ ID NO: 1806676 - RNA, 23 nt, Human
aggcucuaauguacaauaaagca

SEQ ID NO: 1806677 - RNA, 20 nt, Human
acagcuugaucaaaggcaca

SEQ ID NO: 1806678 - RNA, 11 nt, Human
agcauuauuau

SEQ ID NO: 1806679 - RNA, 17 nt, Human
agaguacaccccaacag

SEQ ID NO: 1806680 - RNA, 10 nt, Human
uuagagaagu

SEQ ID NO: 1806681 - RNA, 14 nt, Human
cuugccaaaucaaa

SEQ ID NO: 1806682 - RNA, 20 nt, Human
cagaguucuauaauguaaac

SEQ ID NO: 1806683 - RNA, 13 nt, Human
cucaagcugcauc

SEQ ID NO: 1806684 - RNA, 18 nt, Human
agcuacaggacauuuuua

SEQ ID NO: 1806685 - RNA, 23 nt, Human
uuuauaugcuucuguuuuauaau

SEQ ID NO: 1806686 - RNA, 13 nt, Human
caauaaagcaaug

SEQ ID NO: 1806687 - RNA, 12 nt, Human
ugugagccaccc

SEQ ID NO: 1806688 - RNA, 14 nt, Human
cacuucagccuccc

SEQ ID NO: 1806689 - RNA, 21 nt, Human
aacaugauuuggggaaaggag

SEQ ID NO: 1806690 - RNA, 14 nt, Human
cuccaccuccuggg

SEQ ID NO: 1806691 - RNA, 20 nt, Human
uuaacacaugauccugcaau

SEQ ID NO: 1806692 - RNA, 17 nt, Human
ccguuuacuuguuucag

SEQ ID NO: 1806693 - RNA, 19 nt, Human
uuaucuauuuaaauauuua

SEQ ID NO: 1806694 - RNA, 15 nt, Human
uucacauuuaaauaa

SEQ ID NO: 1806695 - RNA, 18 nt, Human
ccaaccuggaguugaaaa

SEQ ID NO: 1806696 - RNA, 14 nt, Human
cuccacucugaguc

SEQ ID NO: 1806697 - RNA, 16 nt, Human
cucuaauguacaauaa

SEQ ID NO: 1806698 - RNA, 16 nt, Human
ucccugccccccagcc

SEQ ID NO: 1806699 - RNA, 18 nt, Human
uccagcuggccgggagcc

SEQ ID NO: 1806700 - RNA, 23 nt, Human
uacaccccaacagcacccucucc

SEQ ID NO: 1806701 - RNA, 19 nt, Human
aauaucuucacuugucauu

SEQ ID NO: 1806702 - RNA, 14 nt, Human
cucuuccucagcug

SEQ ID NO: 1806703 - RNA, 14 nt, Human
uaauccuaaacaua

SEQ ID NO: 1806704 - RNA, 18 nt, Human
ugcaccacuucaagugac

SEQ ID NO: 1806705 - RNA, 15 nt, Human
gcaauccaagcagga

SEQ ID NO: 1806706 - RNA, 16 nt, Human
uccuguaauggaagca

SEQ ID NO: 1806707 - RNA, 15 nt, Human
aauuauguuaaacua

SEQ ID NO: 1806708 - RNA, 15 nt, Human
uuuccuaauuuugag

SEQ ID NO: 1806709 - RNA, 12 nt, Human
aaggauaaaguu

SEQ ID NO: 1806710 - RNA, 12 nt, Human
cuuuguacuuua

SEQ ID NO: 1806711 - RNA, 19 nt, Human
gccccuacccuggacuugc

SEQ ID NO: 1806712 - RNA, 21 nt, Human
accacauugagucuaucaauc

SEQ ID NO: 1806713 - RNA, 14 nt, Human
auaaugugauauua

SEQ ID NO: 1806714 - RNA, 20 nt, Human
caagccuaaaauuguauaga

SEQ ID NO: 1806715 - RNA, 17 nt, Human
gccucccaaagugcugg

SEQ ID NO: 1806716 - RNA, 17 nt, Human
acuugaccuccuaacaa

SEQ ID NO: 1806717 - RNA, 16 nt, Human
aacaucacauuccucu

SEQ ID NO: 1806718 - RNA, 20 nt, Human
cuuaagguaugguacaagca

SEQ ID NO: 1806719 - RNA, 16 nt, Human
uggcaagcucuaucac

SEQ ID NO: 1806720 - RNA, 20 nt, Human
guccccagccugcucccuag

SEQ ID NO: 1806721 - RNA, 23 nt, Human
cuacacgagauacagaauuuuau

SEQ ID NO: 1806722 - RNA, 14 nt, Human
caauugacuauagu

SEQ ID NO: 1806723 - RNA, 16 nt, Human
cugagcgacagugaga

SEQ ID NO: 1806724 - RNA, 19 nt, Human
cuaauuuuuguauuuuuag

SEQ ID NO: 1806725 - RNA, 17 nt, Human
ccuuggugccuggagcc

SEQ ID NO: 1806726 - RNA, 16 nt, Human
ucuugagguaaaagca

SEQ ID NO: 1806727 - RNA, 13 nt, Human
gcgcuaauuucua

SEQ ID NO: 1806728 - RNA, 16 nt, Human
ccuaauaaagcugugu

SEQ ID NO: 1806729 - RNA, 20 nt, Human
aagugcuaauuuugaaaaac

SEQ ID NO: 1806730 - RNA, 13 nt, Human
aucagacuaugaa

SEQ ID NO: 1806731 - RNA, 17 nt, Human
acaaguccagccuggca

SEQ ID NO: 1806732 - RNA, 14 nt, Human
guauccaaaaaugu

SEQ ID NO: 1806733 - RNA, 19 nt, Human
cucugcaggcagccugccu

SEQ ID NO: 1806734 - RNA, 14 nt, Human
uugguucucuccac

SEQ ID NO: 1806735 - RNA, 14 nt, Human
gcaaccuccaccuc

SEQ ID NO: 1806736 - RNA, 15 nt, Human
uccagccaucaccuu

SEQ ID NO: 1806737 - RNA, 13 nt, Human
cuucaucuaagcc

SEQ ID NO: 1806738 - RNA, 15 nt, Human
agucagacuggauag

SEQ ID NO: 1806739 - RNA, 21 nt, Human
ccacggugccuccagauggca

SEQ ID NO: 1806740 - RNA, 13 nt, Human
uaggaaaauacua

SEQ ID NO: 1806741 - RNA, 13 nt, Human
auuuuuuaaaaaa

SEQ ID NO: 1806742 - RNA, 14 nt, Human
aagcauucugucuu

SEQ ID NO: 1806743 - RNA, 13 nt, Human
ugcugacccuccc

SEQ ID NO: 1806744 - RNA, 21 nt, Human
uugcccugcugcccucccccu

SEQ ID NO: 1806745 - RNA, 14 nt, Human
aagccauggguagc

SEQ ID NO: 1806746 - RNA, 14 nt, Human
guauggcuccucca

SEQ ID NO: 1806747 - RNA, 20 nt, Human
agaaggcuguggauuuaaug

SEQ ID NO: 1806748 - RNA, 15 nt, Human
ggccuccauccugag

SEQ ID NO: 1806749 - RNA, 17 nt, Human
cccacuggacucaccuc

SEQ ID NO: 1806750 - RNA, 13 nt, Human
aagaaaauaacga

SEQ ID NO: 1806751 - RNA, 21 nt, Human
uauuugaacuuuuuauugauu

SEQ ID NO: 1806752 - RNA, 15 nt, Human
auuuucugccaccca

SEQ ID NO: 1806753 - RNA, 17 nt, Human
gcugcuagagugacuca

SEQ ID NO: 1806754 - RNA, 13 nt, Human
caccaagccuuga

SEQ ID NO: 1806755 - RNA, 16 nt, Human
cacauccauucuuccc

SEQ ID NO: 1806756 - RNA, 14 nt, Human
gagcuccuaagcca

SEQ ID NO: 1806757 - RNA, 22 nt, Human
acaugagguacugagagugaac

SEQ ID NO: 1806758 - RNA, 21 nt, Human
ggcacagaacuuaaggaugga

SEQ ID NO: 1806759 - RNA, 18 nt, Human
uuuguuaaaugauuucau

SEQ ID NO: 1806760 - RNA, 14 nt, Human
agaagaagguggga

SEQ ID NO: 1806761 - RNA, 16 nt, Human
uaucaaaagaaagaaa

SEQ ID NO: 1806762 - RNA, 19 nt, Human
cacacucaugcauuguccu

SEQ ID NO: 1806763 - RNA, 22 nt, Human
cuugaauuguaggugacuauua

SEQ ID NO: 1806764 - RNA, 19 nt, Human
uuauggcacuaguauuucu

SEQ ID NO: 1806765 - RNA, 14 nt, Human
cuucuuuuuuucuu

SEQ ID NO: 1806766 - RNA, 23 nt, Human
cucucuuaaggaggcugagagcc

SEQ ID NO: 1806767 - RNA, 22 nt, Human
aaauauuuucuuuguuaaaaua

SEQ ID NO: 1806768 - RNA, 22 nt, Human
cccuuugcugacccuccccaaa

SEQ ID NO: 1806769 - RNA, 13 nt, Human
acugcaaacccuu

SEQ ID NO: 1806770 - RNA, 18 nt, Human
uaaggaggcugagagccc

SEQ ID NO: 1806771 - RNA, 15 nt, Human
aucucggcucacugc

SEQ ID NO: 1806772 - RNA, 22 nt, Human
cagcuuuaguagauauuaccag

SEQ ID NO: 1806773 - RNA, 16 nt, Human
ugaccugucucaccau

SEQ ID NO: 1806774 - RNA, 20 nt, Human
uuauuaugcauuauaucaaa

SEQ ID NO: 1806775 - RNA, 20 nt, Human
uauuuccccaugguuuuaau

SEQ ID NO: 1806776 - RNA, 17 nt, Human
ucccuccccaaaugcuu

SEQ ID NO: 1806777 - RNA, 18 nt, Human
uuguaaaggaauuuaaaa

SEQ ID NO: 1806778 - RNA, 15 nt, Human
guacuggcugaugga

SEQ ID NO: 1806779 - RNA, 16 nt, Human
aaauaacaaugaaagu

SEQ ID NO: 1806780 - RNA, 18 nt, Human
agggaacaaguacuucuu

SEQ ID NO: 1806781 - RNA, 18 nt, Human
aaaggcauuucuuuucug

SEQ ID NO: 1806782 - RNA, 18 nt, Human
uuuugugaagcaaaauuu

SEQ ID NO: 1806783 - RNA, 21 nt, Human
gcccauccugccccugagccc

SEQ ID NO: 1806784 - RNA, 16 nt, Human
auuccccuugccuaaa

SEQ ID NO: 1806785 - RNA, 16 nt, Human
gaccugccgcaggggu

SEQ ID NO: 1806786 - RNA, 21 nt, Human
ugccuguaaucacagcuacuu

SEQ ID NO: 1806787 - RNA, 15 nt, Human
uuuuguauuuuguuu

SEQ ID NO: 1806788 - RNA, 17 nt, Human
gagccaggaggccugcu

SEQ ID NO: 1806789 - RNA, 18 nt, Human
gauccccacgccacagcc

SEQ ID NO: 1806790 - RNA, 15 nt, Human
aaaaggaaagaaaau

SEQ ID NO: 1806791 - RNA, 18 nt, Human
uauaagugcuguauaaaa

SEQ ID NO: 1806792 - RNA, 18 nt, Human
ggggcuuuaacuccugcu

SEQ ID NO: 1806793 - RNA, 21 nt, Human
ucuucaacucccugcccccca

SEQ ID NO: 1806794 - RNA, 14 nt, Human
gagagagcuggagg

SEQ ID NO: 1806795 - RNA, 20 nt, Human
aagaaccauugauuuaaugu

SEQ ID NO: 1806796 - RNA, 20 nt, Human
cagaaucucucuucuuuuca

SEQ ID NO: 1806797 - RNA, 19 nt, Human
aaccuuuuuggacacacaa

SEQ ID NO: 1806798 - RNA, 18 nt, Human
accauguuggccaggcuu

SEQ ID NO: 1806799 - RNA, 23 nt, Human
ccuuggggauucuuccaucugau

SEQ ID NO: 1806800 - RNA, 17 nt, Human
ugcaacuuuguauaaaa

SEQ ID NO: 1806801 - RNA, 20 nt, Human
gaaauacacuguuaucuuca

SEQ ID NO: 1806802 - RNA, 14 nt, Human
cuuggucugugaga

SEQ ID NO: 1806803 - RNA, 18 nt, Human
acaugaacuuguaaagga

SEQ ID NO: 1806804 - RNA, 23 nt, Human
uaaacucaauaaguuuauuucuu

SEQ ID NO: 1806805 - RNA, 19 nt, Human
gcucauggaauuggagcuc

SEQ ID NO: 1806806 - RNA, 21 nt, Human
cucaucuauuucuuuuuaauu

SEQ ID NO: 1806807 - RNA, 14 nt, Human
aggagaccuacccu

SEQ ID NO: 1806808 - RNA, 12 nt, Human
caugcugauaaa

SEQ ID NO: 1806809 - RNA, 19 nt, Human
uucugaauauguccuuuuu

SEQ ID NO: 1806810 - RNA, 15 nt, Human
agccugaguagaaag

SEQ ID NO: 1806811 - RNA, 19 nt, Human
aaugaaauggugaaaugca

SEQ ID NO: 1806812 - RNA, 20 nt, Human
aauuagcuccuccuuuuucc

SEQ ID NO: 1806813 - RNA, 20 nt, Human
gaaacauuugguaaggggaa

SEQ ID NO: 1806814 - RNA, 20 nt, Human
uacauguacugauuacugcc

SEQ ID NO: 1806815 - RNA, 13 nt, Human
augauuccaccua

SEQ ID NO: 1806816 - RNA, 17 nt, Human
uagaaaggccuuuaaaa

SEQ ID NO: 1806817 - RNA, 13 nt, Human
cuuagcccuuccc

SEQ ID NO: 1806818 - RNA, 17 nt, Human
uccccuucucuguauuc

SEQ ID NO: 1806819 - RNA, 17 nt, Human
uuaucaugugucuucug

SEQ ID NO: 1806820 - RNA, 11 nt, Human
gacucacugug

SEQ ID NO: 1806821 - RNA, 20 nt, Human
acuacauuacuucaaacuga

SEQ ID NO: 1806822 - RNA, 14 nt, Human
ucuuuguucuucua

SEQ ID NO: 1806823 - RNA, 19 nt, Human
ucccaggaguacaccccaa

SEQ ID NO: 1806824 - RNA, 23 nt, Human
ugccuucccaggaguacacccca

SEQ ID NO: 1806825 - RNA, 20 nt, Human
uccugucuguuuccucugua

SEQ ID NO: 1806826 - RNA, 14 nt, Human
gaacaucccuccug

SEQ ID NO: 1806827 - RNA, 20 nt, Human
ggcauccccaggcccugcuc

SEQ ID NO: 1806828 - RNA, 22 nt, Human
uuuccucaaaaagauuucccca

SEQ ID NO: 1806829 - RNA, 18 nt, Human
uccuaauuccacagcugc

SEQ ID NO: 1806830 - RNA, 15 nt, Human
uuuauaaucaagccu

SEQ ID NO: 1806831 - RNA, 21 nt, Human
uagcuacaggacauuuuuaag

SEQ ID NO: 1806832 - RNA, 12 nt, Human
ggaaggcuucca

SEQ ID NO: 1806833 - RNA, 13 nt, Human
gcaggcuggccua

SEQ ID NO: 1806834 - RNA, 13 nt, Human
acauauauauaua

SEQ ID NO: 1806835 - RNA, 16 nt, Human
ccacaucccacucaca

SEQ ID NO: 1806836 - RNA, 18 nt, Human
uaauaauguuucaaacau

SEQ ID NO: 1806837 - RNA, 20 nt, Human
aacacaauucuucuuccaac

SEQ ID NO: 1806838 - RNA, 15 nt, Human
uuuuaccagucucac

SEQ ID NO: 1806839 - RNA, 23 nt, Human
gcagaguucuauaauguaaacaa

SEQ ID NO: 1806840 - RNA, 13 nt, Human
ucaucucagcuca

SEQ ID NO: 1806841 - RNA, 18 nt, Human
acugauggguuucuccag

SEQ ID NO: 1806842 - RNA, 15 nt, Human
cuuaaauaaaccuuu

SEQ ID NO: 1806843 - RNA, 20 nt, Human
agagaugacagggaaaacug

SEQ ID NO: 1806844 - RNA, 15 nt, Human
ggcaagcucuaucac

SEQ ID NO: 1806845 - RNA, 14 nt, Human
ucucagaaggaaag

SEQ ID NO: 1806846 - RNA, 20 nt, Human
ugcuuaaggccaugauuuua

SEQ ID NO: 1806847 - RNA, 23 nt, Human
ugucaauucuugccaaauauaaa

SEQ ID NO: 1806848 - RNA, 23 nt, Human
gugacauuuucugccacccaaac

SEQ ID NO: 1806849 - RNA, 16 nt, Human
uagcuaaaucccuccc

SEQ ID NO: 1806850 - RNA, 15 nt, Human
agaguggcuggggca

SEQ ID NO: 1806851 - RNA, 16 nt, Human
auuuguauaaaauaau

SEQ ID NO: 1806852 - RNA, 13 nt, Human
caaccuuuuccca

SEQ ID NO: 1806853 - RNA, 20 nt, Human
gcauuauccaucuuucacua

SEQ ID NO: 1806854 - RNA, 13 nt, Human
auccugcaggcag

SEQ ID NO: 1806855 - RNA, 14 nt, Human
acuggaaagaaguu

SEQ ID NO: 1806856 - RNA, 17 nt, Human
uucacuguaaaauaaua

SEQ ID NO: 1806857 - RNA, 18 nt, Human
uauacuuuaauaaaugua

SEQ ID NO: 1806858 - RNA, 15 nt, Human
ggauccugccugccc

SEQ ID NO: 1806859 - RNA, 13 nt, Human
agacacagugacc

SEQ ID NO: 1806860 - RNA, 18 nt, Human
cccagcggcaucaggcuu

SEQ ID NO: 1806861 - RNA, 12 nt, Human
ugcaccaugcug

SEQ ID NO: 1806862 - RNA, 15 nt, Human
uccacaaguaaaagg

SEQ ID NO: 1806863 - RNA, 18 nt, Human
ucugagagauucaugcug

SEQ ID NO: 1806864 - RNA, 23 nt, Human
cauuguggucacaggaaguagag

SEQ ID NO: 1806865 - RNA, 23 nt, Human
aauucauuaaucugccucccucu

SEQ ID NO: 1806866 - RNA, 13 nt, Human
cugucuccuaagc

SEQ ID NO: 1806867 - RNA, 14 nt, Human
gauuacugccuauu

SEQ ID NO: 1806868 - RNA, 14 nt, Human
uugggaaaaaguaa

SEQ ID NO: 1806869 - RNA, 14 nt, Human
gcuugagucuccaa

SEQ ID NO: 1806870 - RNA, 14 nt, Human
caccaggacgcccu

SEQ ID NO: 1806871 - RNA, 19 nt, Human
augaaagcagggacuugaa

SEQ ID NO: 1806872 - RNA, 12 nt, Human
aacgcaaauucg

SEQ ID NO: 1806873 - RNA, 19 nt, Human
cuggacucaccucccccau

SEQ ID NO: 1806874 - RNA, 16 nt, Human
cuuguauaucuuguuu

SEQ ID NO: 1806875 - RNA, 20 nt, Human
ccuccauaucucccucuucc

SEQ ID NO: 1806876 - RNA, 16 nt, Human
caucccacucacaaca

SEQ ID NO: 1806877 - RNA, 14 nt, Human
uuuuacauguggcc

SEQ ID NO: 1806878 - RNA, 11 nt, Human
acugggacagg

SEQ ID NO: 1806879 - RNA, 15 nt, Human
cucacaacagcugcc

SEQ ID NO: 1806880 - RNA, 15 nt, Human
ugaagcuguugugug

SEQ ID NO: 1806881 - RNA, 12 nt, Human
ggcugaugcagu

SEQ ID NO: 1806882 - RNA, 14 nt, Human
ugcaccuccaugga

SEQ ID NO: 1806883 - RNA, 16 nt, Human
cugaagaaucacaaua

SEQ ID NO: 1806884 - RNA, 19 nt, Human
ccaaaaauguguaagaaca

SEQ ID NO: 1806885 - RNA, 20 nt, Human
ccaacaugaaaacaauucuu

SEQ ID NO: 1806886 - RNA, 19 nt, Human
agauucuaauggcuuuauu

SEQ ID NO: 1806887 - RNA, 13 nt, Human
cugugaccucucc

SEQ ID NO: 1806888 - RNA, 15 nt, Human
ucauucuuauuucau

SEQ ID NO: 1806889 - RNA, 14 nt, Human
accgcgcccagccu

SEQ ID NO: 1806890 - RNA, 12 nt, Human
gcucggugcucc

SEQ ID NO: 1806891 - RNA, 19 nt, Human
uguguuuacagacgugugc

SEQ ID NO: 1806892 - RNA, 19 nt, Human
aucuagaggcuuccuucau

SEQ ID NO: 1806893 - RNA, 20 nt, Human
uaacaagccuccuuuuaaag

SEQ ID NO: 1806894 - RNA, 13 nt, Human
ccacaacacacag

SEQ ID NO: 1806895 - RNA, 19 nt, Human
gccagaggcucuaauguac

SEQ ID NO: 1806896 - RNA, 12 nt, Human
agccugccuccc

SEQ ID NO: 1806897 - RNA, 24 nt, Human
gcucagcccugcaccaugcugcug

SEQ ID NO: 1806898 - RNA, 13 nt, Human
auucauaagauuu

SEQ ID NO: 1806899 - RNA, 20 nt, Human
cacccgccucagccucccaa

SEQ ID NO: 1806900 - RNA, 14 nt, Human
guaauauuucuuca

SEQ ID NO: 1806901 - RNA, 15 nt, Human
aggguuuggaagcca

SEQ ID NO: 1806902 - RNA, 19 nt, Human
uggacuguuuuuaaaaaau

SEQ ID NO: 1806903 - RNA, 19 nt, Human
cuaccacaaugcagugccu

SEQ ID NO: 1806904 - RNA, 16 nt, Human
gugagcuccuaagcca

SEQ ID NO: 1806905 - RNA, 16 nt, Human
ccugccuccccugccu

SEQ ID NO: 1806906 - RNA, 16 nt, Human
acagaagugcuuucuu

SEQ ID NO: 1806907 - RNA, 18 nt, Human
uuaugaguggcuuuaaug

SEQ ID NO: 1806908 - RNA, 20 nt, Human
cuuaacccuggaaaaugaau

SEQ ID NO: 1806909 - RNA, 18 nt, Human
cacaauaauuuucuaccu

SEQ ID NO: 1806910 - RNA, 20 nt, Human
guugagccaccaagcuggug

SEQ ID NO: 1806911 - RNA, 14 nt, Human
acaccccaacagca

SEQ ID NO: 1806912 - RNA, 18 nt, Human
aagcuguguggcagucug

SEQ ID NO: 1806913 - RNA, 19 nt, Human
agggagcaaguccuucccu

SEQ ID NO: 1806914 - RNA, 18 nt, Human
ugcuuccaacucauccac

SEQ ID NO: 1806915 - RNA, 12 nt, Human
uuuucuaaagua

SEQ ID NO: 1806916 - RNA, 17 nt, Human
cugccucagaaaacaag

SEQ ID NO: 1806917 - RNA, 16 nt, Human
aaauugaauuuccaug

SEQ ID NO: 1806918 - RNA, 20 nt, Human
cuauagcuuuucccuuuuuu

SEQ ID NO: 1806919 - RNA, 16 nt, Human
ugagauguguucacaa

SEQ ID NO: 1806920 - RNA, 18 nt, Human
gcuauaggauguggggaa

SEQ ID NO: 1806921 - RNA, 22 nt, Human
gaugggagugcccccaacagca

SEQ ID NO: 1806922 - RNA, 18 nt, Human
aaauagagaaauaugauu

SEQ ID NO: 1806923 - RNA, 21 nt, Human
aaacaauaacgauaaaagaca

SEQ ID NO: 1806924 - RNA, 17 nt, Human
gcuggggccaggcuggg

SEQ ID NO: 1806925 - RNA, 16 nt, Human
cauccauucuauuguu

SEQ ID NO: 1806926 - RNA, 13 nt, Human
ucguaagauuucc

SEQ ID NO: 1806927 - RNA, 11 nt, Human
auuuuugaagc

SEQ ID NO: 1806928 - RNA, 19 nt, Human
caagaaggaaagauuuugu

SEQ ID NO: 1806929 - RNA, 23 nt, Human
ggguaccuaguccccagccugcu

SEQ ID NO: 1806930 - RNA, 14 nt, Human
ccugccuuucuccc

SEQ ID NO: 1806931 - RNA, 14 nt, Human
acaguauauaacua

SEQ ID NO: 1806932 - RNA, 22 nt, Human
gcuucucauccugcaggcagcu

SEQ ID NO: 1806933 - RNA, 20 nt, Human
cugggucuaccacucagaga

SEQ ID NO: 1806934 - RNA, 16 nt, Human
ugacagggaaaacugc

SEQ ID NO: 1806935 - RNA, 12 nt, Human
augaauguaaau

SEQ ID NO: 1806936 - RNA, 18 nt, Human
aagacuacuagggaaaug

SEQ ID NO: 1806937 - RNA, 20 nt, Human
uuuaauuuuacauuuccuaa

SEQ ID NO: 1806938 - RNA, 19 nt, Human
cagguucaagcaauccucc

SEQ ID NO: 1806939 - RNA, 16 nt, Human
auacacuuuuuaaaau

SEQ ID NO: 1806940 - RNA, 13 nt, Human
cucuaauguacaa

SEQ ID NO: 1806941 - RNA, 22 nt, Human
cugcacuguaaaaugugggauu

SEQ ID NO: 1806942 - RNA, 23 nt, Human
cccuagaaagccaugugcagcca

SEQ ID NO: 1806943 - RNA, 15 nt, Human
ccagugcggccagcu

SEQ ID NO: 1806944 - RNA, 12 nt, Human
uuuuauuaauaa

SEQ ID NO: 1806945 - RNA, 17 nt, Human
aguguucauaaauaaag

SEQ ID NO: 1806946 - RNA, 19 nt, Human
ccauguuggcuagccucug

SEQ ID NO: 1806947 - RNA, 17 nt, Human
aaauggacaucaaaauc

SEQ ID NO: 1806948 - RNA, 13 nt, Human
caucccuccuggg

SEQ ID NO: 1806949 - RNA, 17 nt, Human
aaaagaaaaagauugag

SEQ ID NO: 1806950 - RNA, 16 nt, Human
gaaaaaauaacaauga

SEQ ID NO: 1806951 - RNA, 23 nt, Human
gaguacaccccaacagcacccuc

SEQ ID NO: 1806952 - RNA, 16 nt, Human
ugagaguacaccccaa

SEQ ID NO: 1806953 - RNA, 14 nt, Human
cugugaucuugcuc

SEQ ID NO: 1806954 - RNA, 20 nt, Human
agagacacacugaagaagca

SEQ ID NO: 1806955 - RNA, 19 nt, Human
guauucuuuuaguuuuuaa

SEQ ID NO: 1806956 - RNA, 23 nt, Human
ugugguuagaaaaguuauguaga

SEQ ID NO: 1806957 - RNA, 18 nt, Human
uauaaucauuauuacuuu

SEQ ID NO: 1806958 - RNA, 21 nt, Human
aaacuuguauuauguguguuu

SEQ ID NO: 1806959 - RNA, 16 nt, Human
gccaaggaagaucccu

SEQ ID NO: 1806960 - RNA, 16 nt, Human
ccauucccccagugcg

SEQ ID NO: 1806961 - RNA, 14 nt, Human
cugaugacuuuuua

SEQ ID NO: 1806962 - RNA, 16 nt, Human
ccagcugcccccagag

SEQ ID NO: 1806963 - RNA, 22 nt, Human
cuagucucaaacuccugaccuc

SEQ ID NO: 1806964 - RNA, 22 nt, Human
cuuaucuauguagaauauauuu

SEQ ID NO: 1806965 - RNA, 17 nt, Human
ucuauaauuuaaauaua

SEQ ID NO: 1806966 - RNA, 13 nt, Human
aaagacuuuuaug

SEQ ID NO: 1806967 - RNA, 17 nt, Human
aaacaaacaaacaaaaa

SEQ ID NO: 1806968 - RNA, 18 nt, Human
auuucucauaccuucccc

SEQ ID NO: 1806969 - RNA, 14 nt, Human
cuuucucaauaagc

SEQ ID NO: 1806970 - RNA, 18 nt, Human
agaaagcaguugagacaa

SEQ ID NO: 1806971 - RNA, 22 nt, Human
ugcuggagacauugaggcaggc

SEQ ID NO: 1806972 - RNA, 19 nt, Human
gcaccacuguguauuuaac

SEQ ID NO: 1806973 - RNA, 15 nt, Human
ugcagccaccagucc

SEQ ID NO: 1806974 - RNA, 19 nt, Human
guguguuuuaaacugguag

SEQ ID NO: 1806975 - RNA, 17 nt, Human
aucaagcccuuuacuug

SEQ ID NO: 1806976 - RNA, 13 nt, Human
aggcauccccagg

SEQ ID NO: 1806977 - RNA, 22 nt, Human
acccugaggugagcaucaucuu

SEQ ID NO: 1806978 - RNA, 13 nt, Human
uucaacaguuuuu

SEQ ID NO: 1806979 - RNA, 23 nt, Human
auugcagaguacuggcugaugga

SEQ ID NO: 1806980 - RNA, 14 nt, Human
gcuaucgcaccacu

SEQ ID NO: 1806981 - RNA, 17 nt, Human
uuccaagccucaugucc

SEQ ID NO: 1806982 - RNA, 19 nt, Human
cuucuuggccaugggaggc

SEQ ID NO: 1806983 - RNA, 16 nt, Human
auacauguuacaacac

SEQ ID NO: 1806984 - RNA, 16 nt, Human
cugucuguuuccucug

SEQ ID NO: 1806985 - RNA, 14 nt, Human
cucauccugcaggc

SEQ ID NO: 1806986 - RNA, 17 nt, Human
ggaaaauggacaucaaa

SEQ ID NO: 1806987 - RNA, 15 nt, Human
uaagaaauuuuugcc

SEQ ID NO: 1806988 - RNA, 19 nt, Human
uguuugccgcuuaagcuuu

SEQ ID NO: 1806989 - RNA, 17 nt, Human
caguucuuuggcugaaa

SEQ ID NO: 1806990 - RNA, 21 nt, Human
gaagcuagaaaacaggcaaau

SEQ ID NO: 1806991 - RNA, 19 nt, Human
aauaaacauucuaucuauu

SEQ ID NO: 1806992 - RNA, 17 nt, Human
cagaaguuucuucuuua

SEQ ID NO: 1806993 - RNA, 16 nt, Human
gacaagcucacagacc

SEQ ID NO: 1806994 - RNA, 20 nt, Human
acggacgaaccuugaaaacu

SEQ ID NO: 1806995 - RNA, 18 nt, Human
caggcugcucagggcugg

SEQ ID NO: 1806996 - RNA, 23 nt, Human
acucuauguucuaagaagugaaa

SEQ ID NO: 1806997 - RNA, 21 nt, Human
agcuuguccaacccgaggccc

SEQ ID NO: 1806998 - RNA, 22 nt, Human
cugagcgcucagcuucaagaaa

SEQ ID NO: 1806999 - RNA, 15 nt, Human
ccacaagaaaugaaa

SEQ ID NO: 1807000 - RNA, 18 nt, Human
guagggaguuguggguag

SEQ ID NO: 1807001 - RNA, 13 nt, Human
aagacaaggaaaa

SEQ ID NO: 1807002 - RNA, 19 nt, Human
cagggccuggggagaugga

SEQ ID NO: 1807003 - RNA, 20 nt, Human
acgcagccugcagacucacu

SEQ ID NO: 1807004 - RNA, 22 nt, Human
cuggugucuucaggggccacac

SEQ ID NO: 1807005 - RNA, 17 nt, Human
ccgcagugagagagugg

SEQ ID NO: 1807006 - RNA, 16 nt, Human
gacagggaaaacugca

SEQ ID NO: 1807007 - RNA, 20 nt, Human
ccagcuugaaaccuucacuu

SEQ ID NO: 1807008 - RNA, 13 nt, Human
gucuguaaaaucu

SEQ ID NO: 1807009 - RNA, 24 nt, Human
gcccaggaauuggaaagcagccug

SEQ ID NO: 1807010 - RNA, 23 nt, Human
auucuguguuaaaaauguucuau

SEQ ID NO: 1807011 - RNA, 23 nt, Human
guacuccccuccuugaacuagga

SEQ ID NO: 1807012 - RNA, 11 nt, Human
uaguuagcuuu

SEQ ID NO: 1807013 - RNA, 11 nt, Human
ugaggccaggg

SEQ ID NO: 1807014 - RNA, 14 nt, Human
cgcgaucucagcuc

SEQ ID NO: 1807015 - RNA, 17 nt, Human
cacagccccuggucagu

SEQ ID NO: 1807016 - RNA, 20 nt, Human
cugauauuggacaguaaaau

SEQ ID NO: 1807017 - RNA, 22 nt, Human
aaaacugugccuuguuucaaca

SEQ ID NO: 1807018 - RNA, 19 nt, Human
agggaauugcagaguacug

SEQ ID NO: 1807019 - RNA, 18 nt, Human
cagaguacuggcugaugg

SEQ ID NO: 1807020 - RNA, 22 nt, Human
auucagggcuauuuuuuccccc

SEQ ID NO: 1807021 - RNA, 14 nt, Human
ugugggacugggac

SEQ ID NO: 1807022 - RNA, 16 nt, Human
gcagcaucagcauccc

SEQ ID NO: 1807023 - RNA, 17 nt, Human
caauuaaacccaguagu

SEQ ID NO: 1807024 - RNA, 14 nt, Human
uuccggggaaggau

SEQ ID NO: 1807025 - RNA, 23 nt, Human
gugucccaucuagggaaggcugg

SEQ ID NO: 1807026 - RNA, 18 nt, Human
ucacuguguuggccagga

SEQ ID NO: 1807027 - RNA, 15 nt, Human
aagucaagauuucca

SEQ ID NO: 1807028 - RNA, 23 nt, Human
cugaaaucauacuucuuaggguu

SEQ ID NO: 1807029 - RNA, 20 nt, Human
ugauuguaugaauuuaugcu

SEQ ID NO: 1807030 - RNA, 23 nt, Human
uuuuacacauguaucuaugcauu

SEQ ID NO: 1807031 - RNA, 21 nt, Human
aaaaauagcagcuuuagccaa

SEQ ID NO: 1807032 - RNA, 21 nt, Human
aagacaagaaggaaagauuuu

SEQ ID NO: 1807033 - RNA, 17 nt, Human
caaguauggcuccucca

SEQ ID NO: 1807034 - RNA, 21 nt, Human
aaaauaugccccauucaacau

SEQ ID NO: 1807035 - RNA, 17 nt, Human
guucuaaauaaaaagca

SEQ ID NO: 1807036 - RNA, 20 nt, Human
gcuuccacuaggguccacca

SEQ ID NO: 1807037 - RNA, 19 nt, Human
cuuacucuugauuguggga

SEQ ID NO: 1807038 - RNA, 12 nt, Human
ggaaauggacac

SEQ ID NO: 1807039 - RNA, 22 nt, Human
agaggacuccuuaaauuugggg

SEQ ID NO: 1807040 - RNA, 20 nt, Human
aguaucugaggcacauguca

SEQ ID NO: 1807041 - RNA, 21 nt, Human
auuuaugccucuguauuuaaa

SEQ ID NO: 1807042 - RNA, 17 nt, Human
cccuuucugccccugcu

SEQ ID NO: 1807043 - RNA, 17 nt, Human
uguacccaguagaugcc

SEQ ID NO: 1807044 - RNA, 16 nt, Human
uagaaagccaugugca

SEQ ID NO: 1807045 - RNA, 20 nt, Human
guauuauuuuuuaaaaaaau

SEQ ID NO: 1807046 - RNA, 14 nt, Human
aaaaauaaaaaaca

SEQ ID NO: 1807047 - RNA, 13 nt, Human
auugggcaggcag

SEQ ID NO: 1807048 - RNA, 14 nt, Human
gccuguacccagua

SEQ ID NO: 1807049 - RNA, 23 nt, Human
cguucacauuuuuguauuuuguu

SEQ ID NO: 1807050 - RNA, 12 nt, Human
uucauccgcaaa

SEQ ID NO: 1807051 - RNA, 17 nt, Human
cucuggggagcucagga

SEQ ID NO: 1807052 - RNA, 22 nt, Human
auuugugaagguggaaauaaac

SEQ ID NO: 1807053 - RNA, 13 nt, Human
acuaauuuuaaaa

SEQ ID NO: 1807054 - RNA, 13 nt, Human
uauucauucucau

SEQ ID NO: 1807055 - RNA, 14 nt, Human
uggcuugaguuuaa

SEQ ID NO: 1807056 - RNA, 11 nt, Human
agcucucuuuc

SEQ ID NO: 1807057 - RNA, 23 nt, Human
ggucugaggucauuaaaauuaca

SEQ ID NO: 1807058 - RNA, 20 nt, Human
ucuucuggguuccuuccucu

SEQ ID NO: 1807059 - RNA, 15 nt, Human
acugcaggcuccccu

SEQ ID NO: 1807060 - RNA, 19 nt, Human
gugagagaguggcuggggc

SEQ ID NO: 1807061 - RNA, 18 nt, Human
ugcagugucugcuggaga

SEQ ID NO: 1807062 - RNA, 14 nt, Human
ggcuccagcuggcc

SEQ ID NO: 1807063 - RNA, 22 nt, Human
uuguacacaacaauccuucuau

SEQ ID NO: 1807064 - RNA, 18 nt, Human
caguuaaguuuugugugu

SEQ ID NO: 1807065 - RNA, 16 nt, Human
ugccucccucucguaa

SEQ ID NO: 1807066 - RNA, 18 nt, Human
uauuuucaguuauuauau

SEQ ID NO: 1807067 - RNA, 17 nt, Human
gcaggggugcugggacc

SEQ ID NO: 1807068 - RNA, 19 nt, Human
gcccugggaggcucuggag

SEQ ID NO: 1807069 - RNA, 21 nt, Human
ucagacacaaauaaaggaaac

SEQ ID NO: 1807070 - RNA, 21 nt, Human
agagccacaguauauuucccu

SEQ ID NO: 1807071 - RNA, 13 nt, Human
acaaaaaaaaaau

SEQ ID NO: 1807072 - RNA, 20 nt, Human
gcugacacagacauccucua

SEQ ID NO: 1807073 - RNA, 22 nt, Human
gcuccuccagggagucucagcu

SEQ ID NO: 1807074 - RNA, 21 nt, Human
auuuuuucucuaggaaauauu

SEQ ID NO: 1807075 - RNA, 15 nt, Human
auccuuccuuuugag

SEQ ID NO: 1807076 - RNA, 14 nt, Human
uaggcauuaaauuu

SEQ ID NO: 1807077 - RNA, 12 nt, Human
auuauauuucca

SEQ ID NO: 1807078 - RNA, 15 nt, Human
guuuuucuuuucauu

SEQ ID NO: 1807079 - RNA, 19 nt, Human
cuguugucuuuuccuucug

SEQ ID NO: 1807080 - RNA, 21 nt, Human
cuauucauaagauuuaaauua

SEQ ID NO: 1807081 - RNA, 16 nt, Human
gaaucacuugaacccg

SEQ ID NO: 1807082 - RNA, 17 nt, Human
agcucugcccauccugc

SEQ ID NO: 1807083 - RNA, 15 nt, Human
gcaggcaugagucag

SEQ ID NO: 1807084 - RNA, 18 nt, Human
cuuguauuuuuccaauua

SEQ ID NO: 1807085 - RNA, 13 nt, Human
ucuuacaauaauu

SEQ ID NO: 1807086 - RNA, 14 nt, Human
acagcuacacagau

SEQ ID NO: 1807087 - RNA, 17 nt, Human
auucuuauuauuuuuga

SEQ ID NO: 1807088 - RNA, 14 nt, Human
uaauucuaugagau

SEQ ID NO: 1807089 - RNA, 17 nt, Human
gcuacccucauuucuca

SEQ ID NO: 1807090 - RNA, 16 nt, Human
ugguuucccuucuuuu

SEQ ID NO: 1807091 - RNA, 20 nt, Human
uauaccucacuuuacacaau

SEQ ID NO: 1807092 - RNA, 14 nt, Human
ccauucucaagccc

SEQ ID NO: 1807093 - RNA, 14 nt, Human
aucuuuuauuuugc

SEQ ID NO: 1807094 - RNA, 19 nt, Human
aacccagcucacaggagcu

SEQ ID NO: 1807095 - RNA, 18 nt, Human
acaauugggagcugccaa

SEQ ID NO: 1807096 - RNA, 15 nt, Human
acacucuugaaaaau

SEQ ID NO: 1807097 - RNA, 11 nt, Human
ccauuuuuccu

SEQ ID NO: 1807098 - RNA, 23 nt, Human
gauuuccacagugacuccacucu

SEQ ID NO: 1807099 - RNA, 23 nt, Human
ucggccuccauccugaggcucca

SEQ ID NO: 1807100 - RNA, 21 nt, Human
ucacaucgcagauucucccuu

SEQ ID NO: 1807101 - RNA, 15 nt, Human
ugauuucauucaaua

SEQ ID NO: 1807102 - RNA, 14 nt, Human
aucuauuuuguaac

SEQ ID NO: 1807103 - RNA, 21 nt, Human
ugcuggccaccugcugagccc

SEQ ID NO: 1807104 - RNA, 19 nt, Human
ggagccugaucaccugccc

SEQ ID NO: 1807105 - RNA, 19 nt, Human
acaauaacgauaaaagaca

SEQ ID NO: 1807106 - RNA, 13 nt, Human
aaauccuugaaga

SEQ ID NO: 1807107 - RNA, 14 nt, Human
cccuggaaaaugaa

SEQ ID NO: 1807108 - RNA, 20 nt, Human
uuuccaauuagcuccuccuu

SEQ ID NO: 1807109 - RNA, 17 nt, Human
ugcauuauaucaaaucu

SEQ ID NO: 1807110 - RNA, 11 nt, Human
uagaaauuuau

SEQ ID NO: 1807111 - RNA, 21 nt, Human
agccuucucuguucauuuccu

SEQ ID NO: 1807112 - RNA, 15 nt, Human
auuuucaucaccccu

SEQ ID NO: 1807113 - RNA, 19 nt, Human
ccugggaggcucuggagcc

SEQ ID NO: 1807114 - RNA, 22 nt, Human
ucucuacccaguagaugccacu

SEQ ID NO: 1807115 - RNA, 22 nt, Human
uuugcuguuauuuuaucugcua

SEQ ID NO: 1807116 - RNA, 19 nt, Human
ccucuccagaugcagcccc

SEQ ID NO: 1807117 - RNA, 14 nt, Human
gucacccacuuccc

SEQ ID NO: 1807118 - RNA, 19 nt, Human
cccaggaguacaccccaac

SEQ ID NO: 1807119 - RNA, 22 nt, Human
aguaauuucgucuguuuauaaa

SEQ ID NO: 1807120 - RNA, 15 nt, Human
aucaagccuaaaauu

SEQ ID NO: 1807121 - RNA, 13 nt, Human
cuuacugucuuuu

SEQ ID NO: 1807122 - RNA, 22 nt, Human
cugugguuaguguaauaaaaca

SEQ ID NO: 1807123 - RNA, 13 nt, Human
uaccccuggccaa

SEQ ID NO: 1807124 - RNA, 20 nt, Human
ugcccuuccugcaggcagga

SEQ ID NO: 1807125 - RNA, 13 nt, Human
aaguaaaggcaaa

SEQ ID NO: 1807126 - RNA, 23 nt, Human
cuuuuccuucugagccugccuuu

SEQ ID NO: 1807127 - RNA, 15 nt, Human
cgaagcaccaucauu

SEQ ID NO: 1807128 - RNA, 20 nt, Human
aaaugaaguggugagcuuaa

SEQ ID NO: 1807129 - RNA, 21 nt, Human
cucacagugggagccagggcu

SEQ ID NO: 1807130 - RNA, 17 nt, Human
aauuguuaaaggcuaug

SEQ ID NO: 1807131 - RNA, 17 nt, Human
cagguuggagugcagug

SEQ ID NO: 1807132 - RNA, 22 nt, Human
aagauauuuuucaugauuuuga

SEQ ID NO: 1807133 - RNA, 19 nt, Human
acgccuggcugauuuuugu

SEQ ID NO: 1807134 - RNA, 17 nt, Human
auguuuacagaucccca

SEQ ID NO: 1807135 - RNA, 20 nt, Human
cacaggcacagguccccaga

SEQ ID NO: 1807136 - RNA, 15 nt, Human
aucgauuuuuaaaaa

SEQ ID NO: 1807137 - RNA, 15 nt, Human
cacugagccagcagc

SEQ ID NO: 1807138 - RNA, 19 nt, Human
ccagguauucguuaucuaa

SEQ ID NO: 1807139 - RNA, 15 nt, Human
caagauuucagauuu

SEQ ID NO: 1807140 - RNA, 20 nt, Human
cagagccaggacccaggagg

SEQ ID NO: 1807141 - RNA, 22 nt, Human
cugcaaauguaauugauuuauu

SEQ ID NO: 1807142 - RNA, 12 nt, Human
ccuuuaaaauuu

SEQ ID NO: 1807143 - RNA, 13 nt, Human
aucguuuuuuccc

SEQ ID NO: 1807144 - RNA, 20 nt, Human
aauaagccagacaucaacag

SEQ ID NO: 1807145 - RNA, 18 nt, Human
gaccccugagcuugcaga

SEQ ID NO: 1807146 - RNA, 20 nt, Human
uaacgauaaaagacagugaa

SEQ ID NO: 1807147 - RNA, 16 nt, Human
agagggagugcauuua

SEQ ID NO: 1807148 - RNA, 16 nt, Human
gauauccucccuccag

SEQ ID NO: 1807149 - RNA, 12 nt, Human
cuauuccuccuu

SEQ ID NO: 1807150 - RNA, 15 nt, Human
agcugugaccucucc

SEQ ID NO: 1807151 - RNA, 18 nt, Human
ggugauuccgcagugaga

SEQ ID NO: 1807152 - RNA, 15 nt, Human
auacuugaaaauuaa

SEQ ID NO: 1807153 - RNA, 15 nt, Human
acaaggaaaaaauaa

SEQ ID NO: 1807154 - RNA, 21 nt, Human
aucccuccugggaaugaagca

SEQ ID NO: 1807155 - RNA, 18 nt, Human
uauuccucaguucaucca

SEQ ID NO: 1807156 - RNA, 12 nt, Human
uaagcuggagug

SEQ ID NO: 1807157 - RNA, 12 nt, Human
ucuaagaaagaa

SEQ ID NO: 1807158 - RNA, 17 nt, Human
uaguccccagccugcuc

SEQ ID NO: 1807159 - RNA, 17 nt, Human
ccuucccuugcuucuug

SEQ ID NO: 1807160 - RNA, 20 nt, Human
ccucaagcuaugugagcuca

SEQ ID NO: 1807161 - RNA, 18 nt, Human
cucuggccuucggccucc

SEQ ID NO: 1807162 - RNA, 17 nt, Human
uagaauauauuuccuua

SEQ ID NO: 1807163 - RNA, 14 nt, Human
ugacgucaucauca

SEQ ID NO: 1807164 - RNA, 22 nt, Human
ucuaagaaacauuuauauugau

SEQ ID NO: 1807165 - RNA, 16 nt, Human
acagguaaaacagggc

SEQ ID NO: 1807166 - RNA, 12 nt, Human
ugccuuucuucu

SEQ ID NO: 1807167 - RNA, 14 nt, Human
cagcaucagcaucc

SEQ ID NO: 1807168 - RNA, 12 nt, Human
uaauaaaacaug

SEQ ID NO: 1807169 - RNA, 19 nt, Human
cucaugcauuguccucuuu

SEQ ID NO: 1807170 - RNA, 20 nt, Human
aaguccuucccuuucauuuu

SEQ ID NO: 1807171 - RNA, 20 nt, Human
accaggaguucucccaccac

SEQ ID NO: 1807172 - RNA, 16 nt, Human
auucuuggguguuuau

SEQ ID NO: 1807173 - RNA, 18 nt, Human
aaagcuguuauuuaauua

SEQ ID NO: 1807174 - RNA, 17 nt, Human
ccugucucuacaaaaaa

SEQ ID NO: 1807175 - RNA, 18 nt, Human
cacaugucagcaaguccu

SEQ ID NO: 1807176 - RNA, 16 nt, Human
gccuuucuucucucca

SEQ ID NO: 1807177 - RNA, 13 nt, Human
augaacuuuccac

SEQ ID NO: 1807178 - RNA, 21 nt, Human
ccgaggccccugucucagggu

SEQ ID NO: 1807179 - RNA, 15 nt, Human
aauaacgauaaaaga

SEQ ID NO: 1807180 - RNA, 20 nt, Human
agccuaguugaucagcuuau

SEQ ID NO: 1807181 - RNA, 16 nt, Human
auccuugaagauuuac

SEQ ID NO: 1807182 - RNA, 16 nt, Human
cucugcacacccucca

SEQ ID NO: 1807183 - RNA, 15 nt, Human
agaagugcuuucuuc

SEQ ID NO: 1807184 - RNA, 19 nt, Human
agacucgggauuaguacac

SEQ ID NO: 1807185 - RNA, 18 nt, Human
ggaggcuaaagcccagag

SEQ ID NO: 1807186 - RNA, 13 nt, Human
aguauuuuccaca

SEQ ID NO: 1807187 - RNA, 16 nt, Human
gcugacccuccccaaa

SEQ ID NO: 1807188 - RNA, 16 nt, Human
ugagacaagaaaauaa

SEQ ID NO: 1807189 - RNA, 22 nt, Human
uucaauaucuuuuuuuuaauaa

SEQ ID NO: 1807190 - RNA, 15 nt, Human
gagauuuuucaugau

SEQ ID NO: 1807191 - RNA, 14 nt, Human
ugaucaccugcccu

SEQ ID NO: 1807192 - RNA, 16 nt, Human
gcaaauuuucuuccau

SEQ ID NO: 1807193 - RNA, 16 nt, Human
cagccugcucccuagc

SEQ ID NO: 1807194 - RNA, 15 nt, Human
cagccagccaacccu

SEQ ID NO: 1807195 - RNA, 17 nt, Human
gacucaccucccccauc

SEQ ID NO: 1807196 - RNA, 13 nt, Human
uugauuuucauua

SEQ ID NO: 1807197 - RNA, 16 nt, Human
ccaggaguauccucuu

SEQ ID NO: 1807198 - RNA, 19 nt, Human
aauccuucuauucuagccu

SEQ ID NO: 1807199 - RNA, 13 nt, Human
gcucuccccuucu

SEQ ID NO: 1807200 - RNA, 15 nt, Human
aauuuaucauuuagu

SEQ ID NO: 1807201 - RNA, 20 nt, Human
ccuggucugguugggcagcc

SEQ ID NO: 1807202 - RNA, 22 nt, Human
aagccuaagggauccugccugc

SEQ ID NO: 1807203 - RNA, 19 nt, Human
cauaaagucuugccuugcu

SEQ ID NO: 1807204 - RNA, 20 nt, Human
gcugacaugaagcuguugug

SEQ ID NO: 1807205 - RNA, 14 nt, Human
aaugaaaaaauaua

SEQ ID NO: 1807206 - RNA, 16 nt, Human
gaaggcuuacacccac

SEQ ID NO: 1807207 - RNA, 18 nt, Human
agucuucagcagagaagu

SEQ ID NO: 1807208 - RNA, 24 nt, Human
gcugucuauucuagucuauuuguu

SEQ ID NO: 1807209 - RNA, 19 nt, Human
aguauuucuaugaaauauu

SEQ ID NO: 1807210 - RNA, 16 nt, Human
cucugugaucuugcuc

SEQ ID NO: 1807211 - RNA, 18 nt, Human
cucaaacccauucccucu

SEQ ID NO: 1807212 - RNA, 22 nt, Human
cugcaaacugccuucuucggaa

SEQ ID NO: 1807213 - RNA, 21 nt, Human
ccggccuuugcaccuccaugg

SEQ ID NO: 1807214 - RNA, 15 nt, Human
uccuuccucucugca

SEQ ID NO: 1807215 - RNA, 11 nt, Human
cuuuuuauaca

SEQ ID NO: 1807216 - RNA, 22 nt, Human
cucaaacuggggccucccuggu

SEQ ID NO: 1807217 - RNA, 16 nt, Human
acagagguagucucac

SEQ ID NO: 1807218 - RNA, 14 nt, Human
gcuggagcucugcc

SEQ ID NO: 1807219 - RNA, 21 nt, Human
guugagacaagaaaauaagag

SEQ ID NO: 1807220 - RNA, 18 nt, Human
uaaaauccauacauuugu

SEQ ID NO: 1807221 - RNA, 14 nt, Human
gaggagguaaugaa

SEQ ID NO: 1807222 - RNA, 11 nt, Human
acauuuuuaag

SEQ ID NO: 1807223 - RNA, 21 nt, Human
agaguuuccuauguuucacug

SEQ ID NO: 1807224 - RNA, 24 nt, Human
cauucuggaauaauccuaaacaua

SEQ ID NO: 1807225 - RNA, 22 nt, Human
uauuucuaugaaauauuauguu

SEQ ID NO: 1807226 - RNA, 21 nt, Human
agagcaguuugguuucuagca

SEQ ID NO: 1807227 - RNA, 21 nt, Human
uuauagcuacuaauuuuaaaa

SEQ ID NO: 1807228 - RNA, 16 nt, Human
aauuaaagaagagaac

SEQ ID NO: 1807229 - RNA, 11 nt, Human
ugugaaaucau

SEQ ID NO: 1807230 - RNA, 20 nt, Human
uguaauaggcguaacuaauu

SEQ ID NO: 1807231 - RNA, 14 nt, Human
gcaaagcccagcuu

SEQ ID NO: 1807232 - RNA, 20 nt, Human
cucuggggcauuauccaucu

SEQ ID NO: 1807233 - RNA, 17 nt, Human
agaaauuuauaaacuuu

SEQ ID NO: 1807234 - RNA, 16 nt, Human
ucccuagucucuaccc

SEQ ID NO: 1807235 - RNA, 19 nt, Human
uguuuuaaaaugagaaauc

SEQ ID NO: 1807236 - RNA, 17 nt, Human
agcuggaaacacauguu

SEQ ID NO: 1807237 - RNA, 19 nt, Human
uucaacaaccggccaccag

SEQ ID NO: 1807238 - RNA, 16 nt, Human
cugcaccaugcugcug

SEQ ID NO: 1807239 - RNA, 20 nt, Human
agugggugguagcagaggga

SEQ ID NO: 1807240 - RNA, 13 nt, Human
gaauccucugugu

SEQ ID NO: 1807241 - RNA, 18 nt, Human
accaggcuugccugcagg

SEQ ID NO: 1807242 - RNA, 13 nt, Human
cugucucagggug

SEQ ID NO: 1807243 - RNA, 20 nt, Human
uaugcuauuuauuaaguauu

SEQ ID NO: 1807244 - RNA, 17 nt, Human
ugugcuugagccaggag

SEQ ID NO: 1807245 - RNA, 18 nt, Human
agcccugucuccucucuc

SEQ ID NO: 1807246 - RNA, 18 nt, Human
gccuggcucucccagcca

SEQ ID NO: 1807247 - RNA, 18 nt, Human
acagagacagaaagcaga

SEQ ID NO: 1807248 - RNA, 20 nt, Human
aauuaaagcuguuauuuaau

SEQ ID NO: 1807249 - RNA, 19 nt, Human
caggaacaaacagggcugc

SEQ ID NO: 1807250 - RNA, 15 nt, Human
cugaacucccucucu

SEQ ID NO: 1807251 - RNA, 12 nt, Human
aaaccaugaaga

SEQ ID NO: 1807252 - RNA, 18 nt, Human
gaggaauuucuguucuuc

SEQ ID NO: 1807253 - RNA, 20 nt, Human
guaugauuccuugauggaga

SEQ ID NO: 1807254 - RNA, 22 nt, Human
aacauguuucuuuguaaugaaa

SEQ ID NO: 1807255 - RNA, 15 nt, Human
ugcuuugccccugag

SEQ ID NO: 1807256 - RNA, 20 nt, Human
acaaauauguucugacauaa

SEQ ID NO: 1807257 - RNA, 12 nt, Human
caacagcacccu

SEQ ID NO: 1807258 - RNA, 11 nt, Human
cacucuugaaa

SEQ ID NO: 1807259 - RNA, 19 nt, Human
gaaacauguuucuuuguaa

SEQ ID NO: 1807260 - RNA, 14 nt, Human
auacuauauuuuag

SEQ ID NO: 1807261 - RNA, 14 nt, Human
auuuuguuuaaauu

SEQ ID NO: 1807262 - RNA, 22 nt, Human
gccugacugccaagccaugggu

SEQ ID NO: 1807263 - RNA, 14 nt, Human
cucaccagucccuc

SEQ ID NO: 1807264 - RNA, 14 nt, Human
cuaggaauuguguu

SEQ ID NO: 1807265 - RNA, 16 nt, Human
ugcucuggacuugccu

SEQ ID NO: 1807266 - RNA, 18 nt, Human
acuucuugaaaucaauca

SEQ ID NO: 1807267 - RNA, 22 nt, Human
caagcccuuuacuugaccuccu

SEQ ID NO: 1807268 - RNA, 12 nt, Human
aacacucaaugg

SEQ ID NO: 1807269 - RNA, 22 nt, Human
ccccuuccuaauuccacagcug

SEQ ID NO: 1807270 - RNA, 20 nt, Human
gaccaccaggaggugcuauc

SEQ ID NO: 1807271 - RNA, 17 nt, Human
agaaauuaugugccaga

SEQ ID NO: 1807272 - RNA, 18 nt, Human
cauguuggcuagccucug

SEQ ID NO: 1807273 - RNA, 12 nt, Human
acaauaaagcaa

SEQ ID NO: 1807274 - RNA, 15 nt, Human
acaaccaaaagucuu

SEQ ID NO: 1807275 - RNA, 18 nt, Human
uccaauuagcuccuccuu

SEQ ID NO: 1807276 - RNA, 11 nt, Human
aacccuuucau

SEQ ID NO: 1807277 - RNA, 15 nt, Human
caucucacauuuucc

SEQ ID NO: 1807278 - RNA, 18 nt, Human
gaccagcaggcuggccua

SEQ ID NO: 1807279 - RNA, 14 nt, Human
aaauuuaucauuua

SEQ ID NO: 1807280 - RNA, 19 nt, Human
cuccuuggagacagggccc

SEQ ID NO: 1807281 - RNA, 19 nt, Human
uggagucacagccacuugg

SEQ ID NO: 1807282 - RNA, 23 nt, Human
agcccaggaauuggaaagcagcc

SEQ ID NO: 1807283 - RNA, 20 nt, Human
agggggaggcuaaagcccag

SEQ ID NO: 1807284 - RNA, 19 nt, Human
uguauuuuuuuucuuguau

SEQ ID NO: 1807285 - RNA, 19 nt, Human
aaugugguacaagcauucu

SEQ ID NO: 1807286 - RNA, 16 nt, Human
ugagcucagcccuggu

SEQ ID NO: 1807287 - RNA, 17 nt, Human
gaaaaucaggcuggcca

SEQ ID NO: 1807288 - RNA, 14 nt, Human
uuuagugauuuuaa

SEQ ID NO: 1807289 - RNA, 14 nt, Human
gacagaaaaaacug

SEQ ID NO: 1807290 - RNA, 13 nt, Human
ugcucauuuuuuc

SEQ ID NO: 1807291 - RNA, 20 nt, Human
caugugauuccaucuugccc

SEQ ID NO: 1807292 - RNA, 14 nt, Human
uguauucuuuuagu

SEQ ID NO: 1807293 - RNA, 17 nt, Human
uauuuauuaaguauuuu

SEQ ID NO: 1807294 - RNA, 23 nt, Human
aaacugauuuaucuauuuaaaua

SEQ ID NO: 1807295 - RNA, 16 nt, Human
ucagagcgcacaggga

SEQ ID NO: 1807296 - RNA, 23 nt, Human
ugcacuggccacccaaggauguc

SEQ ID NO: 1807297 - RNA, 15 nt, Human
ccugagcgcucagcu

SEQ ID NO: 1807298 - RNA, 13 nt, Human
gccugcucccuag

SEQ ID NO: 1807299 - RNA, 17 nt, Human
cacccucccacugccaa

SEQ ID NO: 1807300 - RNA, 13 nt, Human
agcaaucugaccc

SEQ ID NO: 1807301 - RNA, 19 nt, Human
auuccucaguucauccauu

SEQ ID NO: 1807302 - RNA, 23 nt, Human
ugcagcugagagaaaauaaucau

SEQ ID NO: 1807303 - RNA, 18 nt, Human
auaggaaauauuuuaaug

SEQ ID NO: 1807304 - RNA, 18 nt, Human
auuuucuuuuuuuguggu

SEQ ID NO: 1807305 - RNA, 21 nt, Human
uaguauuccagaccugaagaa

SEQ ID NO: 1807306 - RNA, 18 nt, Human
ugaaggcauccccaggcc

SEQ ID NO: 1807307 - RNA, 15 nt, Human
guuucuuucuuucuu

SEQ ID NO: 1807308 - RNA, 16 nt, Human
agagccucgaggaggu

SEQ ID NO: 1807309 - RNA, 23 nt, Human
caacccgaggcccgcaugcggcc

SEQ ID NO: 1807310 - RNA, 15 nt, Human
ucagaggcgcaugaa

SEQ ID NO: 1807311 - RNA, 19 nt, Human
caggagcugggcagaaggc

SEQ ID NO: 1807312 - RNA, 11 nt, Human
ggguuucucca

SEQ ID NO: 1807313 - RNA, 14 nt, Human
auuauauaauauuu

SEQ ID NO: 1807314 - RNA, 14 nt, Human
gugcacaaaucaga

SEQ ID NO: 1807315 - RNA, 13 nt, Human
auacaugcuuuuu

SEQ ID NO: 1807316 - RNA, 15 nt, Human
augucauuucauuuc

SEQ ID NO: 1807317 - RNA, 14 nt, Human
ccugcacuguaaaa

SEQ ID NO: 1807318 - RNA, 23 nt, Human
ccuucauugccuuaacuggagcc

SEQ ID NO: 1807319 - RNA, 20 nt, Human
aacauuuguagcauccucuu

SEQ ID NO: 1807320 - RNA, 22 nt, Human
ugggucgcccuggacugugugc

SEQ ID NO: 1807321 - RNA, 19 nt, Human
cuaggguggugcauuuuug

SEQ ID NO: 1807322 - RNA, 20 nt, Human
uaauuaucuaguuuaauuaa

SEQ ID NO: 1807323 - RNA, 21 nt, Human
ucauuuuuuccagucuuccuc

SEQ ID NO: 1807324 - RNA, 16 nt, Human
caggcuugaaucaaag

SEQ ID NO: 1807325 - RNA, 16 nt, Human
gcaguucuuuggcuga

SEQ ID NO: 1807326 - RNA, 22 nt, Human
ggcacacagcaagucaggguug

SEQ ID NO: 1807327 - RNA, 14 nt, Human
ccccugagcuugca

SEQ ID NO: 1807328 - RNA, 20 nt, Human
uauaaaagggacugagaaau

SEQ ID NO: 1807329 - RNA, 20 nt, Human
cauugcagaggggcccauga

SEQ ID NO: 1807330 - RNA, 14 nt, Human
cagucugaugagaa

SEQ ID NO: 1807331 - RNA, 19 nt, Human
caaaacccuuucugccccu

SEQ ID NO: 1807332 - RNA, 15 nt, Human
ucccuauuccuccuu

SEQ ID NO: 1807333 - RNA, 13 nt, Human
acuugccucugca

SEQ ID NO: 1807334 - RNA, 14 nt, Human
acuauuuuucagaa

SEQ ID NO: 1807335 - RNA, 17 nt, Human
gucauuucauuuccuau

SEQ ID NO: 1807336 - RNA, 13 nt, Human
augcuagaacucc

SEQ ID NO: 1807337 - RNA, 12 nt, Human
acuauucauaag

SEQ ID NO: 1807338 - RNA, 15 nt, Human
ccuggacuugccucu

SEQ ID NO: 1807339 - RNA, 22 nt, Human
auuuauaaaaauaaaaaacacu

SEQ ID NO: 1807340 - RNA, 20 nt, Human
uuugcaagccagauuuuccu

SEQ ID NO: 1807341 - RNA, 16 nt, Human
cuaccuguaacuugaa

SEQ ID NO: 1807342 - RNA, 14 nt, Human
aaaauacaaaaaaa

SEQ ID NO: 1807343 - RNA, 21 nt, Human
agugcuaauuuugaaaaacug

SEQ ID NO: 1807344 - RNA, 16 nt, Human
uggcuuccaauuuuug

SEQ ID NO: 1807345 - RNA, 16 nt, Human
acauccauucuucccu

SEQ ID NO: 1807346 - RNA, 12 nt, Human
uucauccuuuuc

SEQ ID NO: 1807347 - RNA, 21 nt, Human
aaagcaguugagacaagaaaa

SEQ ID NO: 1807348 - RNA, 18 nt, Human
acucucaccauuuggauc

SEQ ID NO: 1807349 - RNA, 17 nt, Human
uacucucaccauuugga

SEQ ID NO: 1807350 - RNA, 22 nt, Human
gcucagguggugaguccuccug

SEQ ID NO: 1807351 - RNA, 14 nt, Human
acccaguguuuuag

SEQ ID NO: 1807352 - RNA, 17 nt, Human
auaagauuuaaauuauu

SEQ ID NO: 1807353 - RNA, 13 nt, Human
cauuggagauguu

SEQ ID NO: 1807354 - RNA, 17 nt, Human
ucugcaggucccuaaua

SEQ ID NO: 1807355 - RNA, 20 nt, Human
uguagaaaaaaguaaaugug

SEQ ID NO: 1807356 - RNA, 15 nt, Human
gcucucuugugcauu

SEQ ID NO: 1807357 - RNA, 17 nt, Human
auuauuuuugagacaga

SEQ ID NO: 1807358 - RNA, 20 nt, Human
uaagcugccauauauuuugu

SEQ ID NO: 1807359 - RNA, 15 nt, Human
ccaaccauuuccuca

SEQ ID NO: 1807360 - RNA, 12 nt, Human
uagcuccuccuu

SEQ ID NO: 1807361 - RNA, 13 nt, Human
uauuuaauuauuu

SEQ ID NO: 1807362 - RNA, 18 nt, Human
caaccacacccacacuca

SEQ ID NO: 1807363 - RNA, 18 nt, Human
cagguauaccucacuuua

SEQ ID NO: 1807364 - RNA, 15 nt, Human
aaugauuaugaauua

SEQ ID NO: 1807365 - RNA, 21 nt, Human
gcagacucacugugggaagga

SEQ ID NO: 1807366 - RNA, 18 nt, Human
ccaucagcuccagcugcu

SEQ ID NO: 1807367 - RNA, 17 nt, Human
uaucucaucucuucuuu

SEQ ID NO: 1807368 - RNA, 16 nt, Human
ugaaguacucauacau

SEQ ID NO: 1807369 - RNA, 22 nt, Human
acaucugagaaaagcuuugaac

SEQ ID NO: 1807370 - RNA, 19 nt, Human
agcucugcccauccugccc

SEQ ID NO: 1807371 - RNA, 16 nt, Human
uuguugugauuuucac

SEQ ID NO: 1807372 - RNA, 14 nt, Human
ccagcuggccggga

SEQ ID NO: 1807373 - RNA, 21 nt, Human
uauugauuuauuaauauauau

SEQ ID NO: 1807374 - RNA, 18 nt, Human
agccuggaaccaagguua

SEQ ID NO: 1807375 - RNA, 19 nt, Human
cacauguaucuaugcauuu

SEQ ID NO: 1807376 - RNA, 17 nt, Human
uagcuccuccuuuuucc

SEQ ID NO: 1807377 - RNA, 21 nt, Human
cucuccaccaucgucuucuug

SEQ ID NO: 1807378 - RNA, 22 nt, Human
ccuugguucucauaacucugug

SEQ ID NO: 1807379 - RNA, 22 nt, Human
acuucuccccugguagaaagaa

SEQ ID NO: 1807380 - RNA, 14 nt, Human
uguaacuuucucua

SEQ ID NO: 1807381 - RNA, 15 nt, Human
acaggguuuauguuu

SEQ ID NO: 1807382 - RNA, 18 nt, Human
auuuaacuauucauaaga

SEQ ID NO: 1807383 - RNA, 18 nt, Human
uacaaauauuuugcuagu

SEQ ID NO: 1807384 - RNA, 12 nt, Human
aguagaugccac

SEQ ID NO: 1807385 - RNA, 12 nt, Human
aagaaauuuuug

SEQ ID NO: 1807386 - RNA, 15 nt, Human
uguugucuuuuccuu

SEQ ID NO: 1807387 - RNA, 16 nt, Human
ucuccauacucuguaa

SEQ ID NO: 1807388 - RNA, 17 nt, Human
ccuuuggagauuuuuua

SEQ ID NO: 1807389 - RNA, 16 nt, Human
aauaaaguguuugaaa

SEQ ID NO: 1807390 - RNA, 16 nt, Human
uauaauauuuuuaaua

SEQ ID NO: 1807391 - RNA, 16 nt, Human
uaaagaaaaucucugu

SEQ ID NO: 1807392 - RNA, 19 nt, Human
uauaaucaagccuaaaauu

SEQ ID NO: 1807393 - RNA, 20 nt, Human
ggaugcugucuucguacugg

SEQ ID NO: 1807394 - RNA, 16 nt, Human
uguccccuauccuacu

SEQ ID NO: 1807395 - RNA, 20 nt, Human
aagcuucacuguaaaauaau

SEQ ID NO: 1807396 - RNA, 13 nt, Human
uuuuuuaaagacu

SEQ ID NO: 1807397 - RNA, 13 nt, Human
ucacuaucuguaa

SEQ ID NO: 1807398 - RNA, 21 nt, Human
auauaagugauugcugguuuu

SEQ ID NO: 1807399 - RNA, 20 nt, Human
cuucucccaauucauccuca

SEQ ID NO: 1807400 - RNA, 16 nt, Human
ugcugaacucccucuc

SEQ ID NO: 1807401 - RNA, 16 nt, Human
uucaguuauuauauuu

SEQ ID NO: 1807402 - RNA, 15 nt, Human
acucuguugccaggc

SEQ ID NO: 1807403 - RNA, 16 nt, Human
cucacauuuucccuuc

SEQ ID NO: 1807404 - RNA, 12 nt, Human
aauauuccagag

SEQ ID NO: 1807405 - RNA, 18 nt, Human
acagaaagcagaacagug

SEQ ID NO: 1807406 - RNA, 15 nt, Human
ucuccaaagcccucc

SEQ ID NO: 1807407 - RNA, 13 nt, Human
uuccuucauuucc

SEQ ID NO: 1807408 - RNA, 15 nt, Human
acuauuauauuucca

SEQ ID NO: 1807409 - RNA, 20 nt, Human
uuaauuaucuaguuuaauua

SEQ ID NO: 1807410 - RNA, 12 nt, Human
auauaaauaaaa

SEQ ID NO: 1807411 - RNA, 13 nt, Human
aucaggcuuucuu

SEQ ID NO: 1807412 - RNA, 22 nt, Human
cagccccaucuccucagcaccc

SEQ ID NO: 1807413 - RNA, 23 nt, Human
uuuguauaaaauaauuuuuauau

SEQ ID NO: 1807414 - RNA, 15 nt, Human
gccccauucaacauc

SEQ ID NO: 1807415 - RNA, 23 nt, Human
aaaccuuuguuugcaucugaaaa

SEQ ID NO: 1807416 - RNA, 23 nt, Human
aaucagagaccuuccagaaauac

SEQ ID NO: 1807417 - RNA, 20 nt, Human
uagauuccucuggauuuugu

SEQ ID NO: 1807418 - RNA, 13 nt, Human
caucugagccccg

SEQ ID NO: 1807419 - RNA, 18 nt, Human
uuccuaauaaagcuucug

SEQ ID NO: 1807420 - RNA, 18 nt, Human
cuaauuuugaaaaacugc

SEQ ID NO: 1807421 - RNA, 18 nt, Human
acauuuuuguauuuuguu

SEQ ID NO: 1807422 - RNA, 17 nt, Human
aggucauuaaaauuaca

SEQ ID NO: 1807423 - RNA, 17 nt, Human
uuaauaaauuucaccaa

SEQ ID NO: 1807424 - RNA, 23 nt, Human
cuuaagaagacugcauuauauuu

SEQ ID NO: 1807425 - RNA, 22 nt, Human
aucugagagaugacagggaaaa

SEQ ID NO: 1807426 - RNA, 15 nt, Human
uugacacuuaaaaau

SEQ ID NO: 1807427 - RNA, 22 nt, Human
aguauuauuguugcauuaaaaa

SEQ ID NO: 1807428 - RNA, 17 nt, Human
ccacccucccacugcca

SEQ ID NO: 1807429 - RNA, 17 nt, Human
guaaugaauuaaagaag

SEQ ID NO: 1807430 - RNA, 15 nt, Human
ccccuaagcccccac

SEQ ID NO: 1807431 - RNA, 16 nt, Human
aaauucugucucugga

SEQ ID NO: 1807432 - RNA, 20 nt, Human
gacuuuauguaguuuuuaua

SEQ ID NO: 1807433 - RNA, 21 nt, Human
gcucugaagaacucucuggaa

SEQ ID NO: 1807434 - RNA, 19 nt, Human
acucucaccauuuggaucc

SEQ ID NO: 1807435 - RNA, 23 nt, Human
auaaguauuuaauucauguugcc

SEQ ID NO: 1807436 - RNA, 16 nt, Human
agauucagacuguuuu

SEQ ID NO: 1807437 - RNA, 19 nt, Human
ucauugcucagaaauguca

SEQ ID NO: 1807438 - RNA, 14 nt, Human
gagcccauggcacu

SEQ ID NO: 1807439 - RNA, 20 nt, Human
aauuguguuuauaauuuuaa

SEQ ID NO: 1807440 - RNA, 14 nt, Human
aaaaucuacaguac

SEQ ID NO: 1807441 - RNA, 18 nt, Human
auauggggaaaaaacugu

SEQ ID NO: 1807442 - RNA, 20 nt, Human
augaaguuguagguaauauu

SEQ ID NO: 1807443 - RNA, 20 nt, Human
agcccuuccccucugcagcu

SEQ ID NO: 1807444 - RNA, 17 nt, Human
cuuuuaggacccuuccc

SEQ ID NO: 1807445 - RNA, 14 nt, Human
ucuccucucagugg

SEQ ID NO: 1807446 - RNA, 19 nt, Human
auugcuuuaccuuuuuucu

SEQ ID NO: 1807447 - RNA, 17 nt, Human
uaagauuuaaauuauuu

SEQ ID NO: 1807448 - RNA, 14 nt, Human
agacuaugaaguuu

SEQ ID NO: 1807449 - RNA, 12 nt, Human
aacuuuguauaa

SEQ ID NO: 1807450 - RNA, 18 nt, Human
ggaggacgcucucuggcc

SEQ ID NO: 1807451 - RNA, 19 nt, Human
ucaaacugagauccuuccu

SEQ ID NO: 1807452 - RNA, 18 nt, Human
ucaacuuugauacuuacu

SEQ ID NO: 1807453 - RNA, 19 nt, Human
cuugcucuugaugccuggc

SEQ ID NO: 1807454 - RNA, 12 nt, Human
acagagacagaa

SEQ ID NO: 1807455 - RNA, 16 nt, Human
gcacgugguaaaacac

SEQ ID NO: 1807456 - RNA, 19 nt, Human
cucaaacccauucccucuc

SEQ ID NO: 1807457 - RNA, 14 nt, Human
ugugaucuugcucu

SEQ ID NO: 1807458 - RNA, 15 nt, Human
cacccuguccaaacu

SEQ ID NO: 1807459 - RNA, 13 nt, Human
agaccauuuuucc

SEQ ID NO: 1807460 - RNA, 13 nt, Human
aucguaaaauuaa

SEQ ID NO: 1807461 - RNA, 19 nt, Human
agccagugaccaaccuuuu

SEQ ID NO: 1807462 - RNA, 15 nt, Human
uguuguguuuuuaac

SEQ ID NO: 1807463 - RNA, 21 nt, Human
auuuauaaaaauaaaaaacac

SEQ ID NO: 1807464 - RNA, 21 nt, Human
agcaaaugugaaucauuuuac

SEQ ID NO: 1807465 - RNA, 15 nt, Human
ugcucagcuucucca

SEQ ID NO: 1807466 - RNA, 14 nt, Human
cuucuauucuagcc

SEQ ID NO: 1807467 - RNA, 14 nt, Human
uuuuuaucauguga

SEQ ID NO: 1807468 - RNA, 16 nt, Human
ccaaaggcuuugcccu

SEQ ID NO: 1807469 - RNA, 20 nt, Human
ucaagucuuucacauuuaaa

SEQ ID NO: 1807470 - RNA, 15 nt, Human
aggacuagggcugga

SEQ ID NO: 1807471 - RNA, 15 nt, Human
aaguuauguagaaaa

SEQ ID NO: 1807472 - RNA, 16 nt, Human
aauaguuuuauuaaua

SEQ ID NO: 1807473 - RNA, 19 nt, Human
ccugccuaagugcagcccc

SEQ ID NO: 1807474 - RNA, 23 nt, Human
gaaaacaauaacgauaaaagaca

SEQ ID NO: 1807475 - RNA, 13 nt, Human
caccucagagaca

SEQ ID NO: 1807476 - RNA, 24 nt, Human
augggcaggauggcaaccagacca

SEQ ID NO: 1807477 - RNA, 15 nt, Human
aaaagacuuuuuccu

SEQ ID NO: 1807478 - RNA, 15 nt, Human
ggccaccugcugagc

SEQ ID NO: 1807479 - RNA, 11 nt, Human
ugccuccagau

SEQ ID NO: 1807480 - RNA, 20 nt, Human
uaguuauaaaaauauauagc

SEQ ID NO: 1807481 - RNA, 15 nt, Human
agaggcagugacagc

SEQ ID NO: 1807482 - RNA, 13 nt, Human
acuauuauauuuc

SEQ ID NO: 1807483 - RNA, 15 nt, Human
aggaacuggugucuu

SEQ ID NO: 1807484 - RNA, 17 nt, Human
cugcccgccucgaccuc

SEQ ID NO: 1807485 - RNA, 14 nt, Human
accuaccaagauau

SEQ ID NO: 1807486 - RNA, 17 nt, Human
cugccucagccucccga

SEQ ID NO: 1807487 - RNA, 19 nt, Human
guggacguggguugcacug

SEQ ID NO: 1807488 - RNA, 18 nt, Human
cccaagccuggcaaggga

SEQ ID NO: 1807489 - RNA, 19 nt, Human
aaaagacagugaaagaaaa

SEQ ID NO: 1807490 - RNA, 19 nt, Human
aucucuuguuuaaauucaa

SEQ ID NO: 1807491 - RNA, 16 nt, Human
cacugugcaaauauau

SEQ ID NO: 1807492 - RNA, 14 nt, Human
ucauuccaaaggag

SEQ ID NO: 1807493 - RNA, 13 nt, Human
cuaccacucagag

SEQ ID NO: 1807494 - RNA, 13 nt, Human
uuuauaauuuuaa

SEQ ID NO: 1807495 - RNA, 14 nt, Human
auaacuggaaagaa

SEQ ID NO: 1807496 - RNA, 17 nt, Human
agugcccccaacagcac

SEQ ID NO: 1807497 - RNA, 12 nt, Human
cuggcuccagcu

SEQ ID NO: 1807498 - RNA, 17 nt, Human
uccuuggugccuggagc

SEQ ID NO: 1807499 - RNA, 18 nt, Human
guggcuggguuuacacgc

SEQ ID NO: 1807500 - RNA, 13 nt, Human
aagggagauucag

SEQ ID NO: 1807501 - RNA, 16 nt, Human
aaucagagaccuucca

SEQ ID NO: 1807502 - RNA, 23 nt, Human
gacguaacaaauauggggaaaaa

SEQ ID NO: 1807503 - RNA, 13 nt, Human
acacuuaaaaaug

SEQ ID NO: 1807504 - RNA, 16 nt, Human
gagcaucaucuucugg

SEQ ID NO: 1807505 - RNA, 16 nt, Human
cucagaggcagugaca

SEQ ID NO: 1807506 - RNA, 22 nt, Human
agacccacuggacucaccuccc

SEQ ID NO: 1807507 - RNA, 13 nt, Human
auuuugaaaucau

SEQ ID NO: 1807508 - RNA, 16 nt, Human
gacacccccucaaacc

SEQ ID NO: 1807509 - RNA, 18 nt, Human
acaaagcccaucauaaua

SEQ ID NO: 1807510 - RNA, 14 nt, Human
uccucagcacccca

SEQ ID NO: 1807511 - RNA, 15 nt, Human
acucaccucccccau

SEQ ID NO: 1807512 - RNA, 18 nt, Human
cagccaggagcugggcag

SEQ ID NO: 1807513 - RNA, 23 nt, Human
auuauauggcuugaguuuaaauu

SEQ ID NO: 1807514 - RNA, 17 nt, Human
auuccuccuucccuugc

SEQ ID NO: 1807515 - RNA, 20 nt, Human
uacacauguaucuaugcauu

SEQ ID NO: 1807516 - RNA, 14 nt, Human
accuggucucuccu

SEQ ID NO: 1807517 - RNA, 21 nt, Human
gacagaaagcagaacagugau

SEQ ID NO: 1807518 - RNA, 17 nt, Human
uucugagcauuuaauau

SEQ ID NO: 1807519 - RNA, 16 nt, Human
uacaauuaaagcuguu

SEQ ID NO: 1807520 - RNA, 15 nt, Human
agagacagaaagcag

SEQ ID NO: 1807521 - RNA, 18 nt, Human
uaaaagacagugaaagaa

SEQ ID NO: 1807522 - RNA, 13 nt, Human
guuuaaguucuau

SEQ ID NO: 1807523 - RNA, 18 nt, Human
acaagccuccuuuuaaag

SEQ ID NO: 1807524 - RNA, 16 nt, Human
caacuccuuucucauc

SEQ ID NO: 1807525 - RNA, 17 nt, Human
cuucauucaagucagcu

SEQ ID NO: 1807526 - RNA, 19 nt, Human
uacacuggaugaaaauguu

SEQ ID NO: 1807527 - RNA, 20 nt, Human
caggacuagggcuggaguga

SEQ ID NO: 1807528 - RNA, 17 nt, Human
ucuaccuggucucuccu

SEQ ID NO: 1807529 - RNA, 18 nt, Human
gucuguaaaaucuuucuu

SEQ ID NO: 1807530 - RNA, 16 nt, Human
cauuuguauaaaauaa

SEQ ID NO: 1807531 - RNA, 17 nt, Human
auauugauuuauuaaua

SEQ ID NO: 1807532 - RNA, 19 nt, Human
acccaguagaugccaccca

SEQ ID NO: 1807533 - RNA, 17 nt, Human
cuccagccucagccucc

SEQ ID NO: 1807534 - RNA, 21 nt, Human
aucuuuuuuuuaauaaaccau

SEQ ID NO: 1807535 - RNA, 16 nt, Human
ccucuggauuuuguau

SEQ ID NO: 1807536 - RNA, 20 nt, Human
caguugagacaagaaaauaa

SEQ ID NO: 1807537 - RNA, 13 nt, Human
ggcaggcacugcc

SEQ ID NO: 1807538 - RNA, 17 nt, Human
auuuaaaaaacuaacac

SEQ ID NO: 1807539 - RNA, 18 nt, Human
gucugagacagaaucuca

SEQ ID NO: 1807540 - RNA, 16 nt, Human
cccuauccuacuuccc

SEQ ID NO: 1807541 - RNA, 15 nt, Human
cuuaagaagacugca

SEQ ID NO: 1807542 - RNA, 17 nt, Human
uguucauaaauaaaguu

SEQ ID NO: 1807543 - RNA, 23 nt, Human
uggagagggaaugugaaauuuac

SEQ ID NO: 1807544 - RNA, 12 nt, Human
ggacuuacauga

SEQ ID NO: 1807545 - RNA, 13 nt, Human
cccaccaggcugc

SEQ ID NO: 1807546 - RNA, 22 nt, Human
cuuccccucugcagcuuccagg

SEQ ID NO: 1807547 - RNA, 19 nt, Human
uugugggauacuauuuaau

SEQ ID NO: 1807548 - RNA, 22 nt, Human
auuuuaaacacauuaggaaaag

SEQ ID NO: 1807549 - RNA, 21 nt, Human
aggguucaccugggcugaggc

SEQ ID NO: 1807550 - RNA, 18 nt, Human
aaaggcacacagcaaguc

SEQ ID NO: 1807551 - RNA, 14 nt, Human
uaacaacuugucua

SEQ ID NO: 1807552 - RNA, 17 nt, Human
uucucuaggaaauauuu

SEQ ID NO: 1807553 - RNA, 12 nt, Human
ggacacacaaau

SEQ ID NO: 1807554 - RNA, 20 nt, Human
gcuccuaauguugaauuuug

SEQ ID NO: 1807555 - RNA, 19 nt, Human
ccagagccacaguuccccu

SEQ ID NO: 1807556 - RNA, 23 nt, Human
aaacacucuugaaaaaugcaugu

SEQ ID NO: 1807557 - RNA, 21 nt, Human
cuuguuggacgagaaaacaau

SEQ ID NO: 1807558 - RNA, 13 nt, Human
ucagucuuuucca

SEQ ID NO: 1807559 - RNA, 22 nt, Human
gugagaaccggagaaccccagg

SEQ ID NO: 1807560 - RNA, 20 nt, Human
ucugccuuuauuguguuugu

SEQ ID NO: 1807561 - RNA, 12 nt, Human
gccccugagccc

SEQ ID NO: 1807562 - RNA, 17 nt, Human
cuccagaugcagcccca

SEQ ID NO: 1807563 - RNA, 16 nt, Human
uggaaagaaguugggg

SEQ ID NO: 1807564 - RNA, 24 nt, Human
acuagucucaaacuccugaccuca

SEQ ID NO: 1807565 - RNA, 18 nt, Human
ccugcaaagcccagcuug

SEQ ID NO: 1807566 - RNA, 18 nt, Human
cacucagauccuccucau

SEQ ID NO: 1807567 - RNA, 15 nt, Human
gacgcccaggacccc

SEQ ID NO: 1807568 - RNA, 12 nt, Human
cugcccgccucg

SEQ ID NO: 1807569 - RNA, 17 nt, Human
agcgacagugagacucu

SEQ ID NO: 1807570 - RNA, 19 nt, Human
guacaagagcuuaacagug

SEQ ID NO: 1807571 - RNA, 15 nt, Human
uauaauuuaaauaua

SEQ ID NO: 1807572 - RNA, 16 nt, Human
cugccaucuuggacuu

SEQ ID NO: 1807573 - RNA, 13 nt, Human
cccuccuuaucaa

SEQ ID NO: 1807574 - RNA, 15 nt, Human
cagaucuuucugccu

SEQ ID NO: 1807575 - RNA, 17 nt, Human
uuugacuagaaaauuua

SEQ ID NO: 1807576 - RNA, 13 nt, Human
aggaggcugagag

SEQ ID NO: 1807577 - RNA, 13 nt, Human
agcuccagcugcu

SEQ ID NO: 1807578 - RNA, 20 nt, Human
aaaagacagugaaagaaaau

SEQ ID NO: 1807579 - RNA, 15 nt, Human
ccggcuaauuuuugu

SEQ ID NO: 1807580 - RNA, 16 nt, Human
aagaaggugggaggau

SEQ ID NO: 1807581 - RNA, 13 nt, Human
aacacucuugaaa

SEQ ID NO: 1807582 - RNA, 18 nt, Human
gcugcuggggaagacagu

SEQ ID NO: 1807583 - RNA, 16 nt, Human
ucuuacugauuuuuaa

SEQ ID NO: 1807584 - RNA, 19 nt, Human
gguucaagcaauccuccca

SEQ ID NO: 1807585 - RNA, 17 nt, Human
agaugggguuucaccau

SEQ ID NO: 1807586 - RNA, 21 nt, Human
agcccuucuuuccacagaagc

SEQ ID NO: 1807587 - RNA, 10 nt, Human
cauucaaguc

SEQ ID NO: 1807588 - RNA, 17 nt, Human
uagccagaggcucuaau

SEQ ID NO: 1807589 - RNA, 23 nt, Human
cucauaauucuucaccuuaggaa

SEQ ID NO: 1807590 - RNA, 18 nt, Human
cauauacagcucagaagu

SEQ ID NO: 1807591 - RNA, 19 nt, Human
ucugaggcuucuggggcuu

SEQ ID NO: 1807592 - RNA, 19 nt, Human
uuuacaaauagaauuugag

SEQ ID NO: 1807593 - RNA, 19 nt, Human
ccauuacggagaguuuccu

SEQ ID NO: 1807594 - RNA, 15 nt, Human
cuguguuggccagga

SEQ ID NO: 1807595 - RNA, 15 nt, Human
ugcaaccaucaccag

SEQ ID NO: 1807596 - RNA, 17 nt, Human
cugcacuccagccugag

SEQ ID NO: 1807597 - RNA, 13 nt, Human
cuguauaaaauca

SEQ ID NO: 1807598 - RNA, 17 nt, Human
caaaacccuuucugccc

SEQ ID NO: 1807599 - RNA, 17 nt, Human
cacagcaagucaggguu

SEQ ID NO: 1807600 - RNA, 16 nt, Human
auccccauuucuuuuu

SEQ ID NO: 1807601 - RNA, 15 nt, Human
uaaaauuuuuaaucu

SEQ ID NO: 1807602 - RNA, 20 nt, Human
acucugucuaccuggucugg

SEQ ID NO: 1807603 - RNA, 15 nt, Human
ugcauuuuguuuggu

SEQ ID NO: 1807604 - RNA, 13 nt, Human
uuuuaauaaauuu

SEQ ID NO: 1807605 - RNA, 19 nt, Human
caugaguaacugauuugua

SEQ ID NO: 1807606 - RNA, 16 nt, Human
uggucugugagaugcu

SEQ ID NO: 1807607 - RNA, 21 nt, Human
acucaagcaagauuucagauu

SEQ ID NO: 1807608 - RNA, 23 nt, Human
aauacacuguuaucuucacuuuu

SEQ ID NO: 1807609 - RNA, 11 nt, Human
ucuuaauuauu

SEQ ID NO: 1807610 - RNA, 11 nt, Human
uacaaaaaaaa

SEQ ID NO: 1807611 - RNA, 19 nt, Human
ugcucagggcuggucuuuu

SEQ ID NO: 1807612 - RNA, 17 nt, Human
cuccuuaucaaaggaca

SEQ ID NO: 1807613 - RNA, 18 nt, Human
auuuauuacuguaagaaa

SEQ ID NO: 1807614 - RNA, 17 nt, Human
uuuaauaaauguauauu

SEQ ID NO: 1807615 - RNA, 15 nt, Human
agaacaacuaccuga

SEQ ID NO: 1807616 - RNA, 20 nt, Human
aauuauuuuuguucauauaa

SEQ ID NO: 1807617 - RNA, 15 nt, Human
ccaaggagccaaaca

SEQ ID NO: 1807618 - RNA, 17 nt, Human
augaauuaaagaagaga

SEQ ID NO: 1807619 - RNA, 20 nt, Human
ucccuaauaaagcugugugg

SEQ ID NO: 1807620 - RNA, 14 nt, Human
cagagucaagggug

SEQ ID NO: 1807621 - RNA, 21 nt, Human
cagugagacagcucugcauac

SEQ ID NO: 1807622 - RNA, 19 nt, Human
uacaccccaacagcacccu

SEQ ID NO: 1807623 - RNA, 18 nt, Human
augcaacauccuugucuu

SEQ ID NO: 1807624 - RNA, 22 nt, Human
acagcucagaaguuucuucuuu

SEQ ID NO: 1807625 - RNA, 19 nt, Human
ugccaaaucaaaagacuuu

SEQ ID NO: 1807626 - RNA, 20 nt, Human
ggcuaauaucuuaucuuccu

SEQ ID NO: 1807627 - RNA, 21 nt, Human
ucuauuaccuguuaguauuau

SEQ ID NO: 1807628 - RNA, 22 nt, Human
uauuuggugauuacauuuuaaa

SEQ ID NO: 1807629 - RNA, 21 nt, Human
auugcaagaguuuaauuuuug

SEQ ID NO: 1807630 - RNA, 22 nt, Human
uaaaagggacugagaaauuuau

SEQ ID NO: 1807631 - RNA, 19 nt, Human
gccucccgaguagcuggga

SEQ ID NO: 1807632 - RNA, 21 nt, Human
aucucugaauuugagauacaa

SEQ ID NO: 1807633 - RNA, 16 nt, Human
aacaauuugaauauaa

SEQ ID NO: 1807634 - RNA, 20 nt, Human
acuucuuaggguuaugauua

SEQ ID NO: 1807635 - RNA, 19 nt, Human
guacugagagugaacaaau

SEQ ID NO: 1807636 - RNA, 21 nt, Human
cucuccaccagguucuuucuu

SEQ ID NO: 1807637 - RNA, 15 nt, Human
ggaacugucucucau

SEQ ID NO: 1807638 - RNA, 18 nt, Human
cuuuccgaggccccuguc

SEQ ID NO: 1807639 - RNA, 21 nt, Human
auaaaaucagccaauuauguu

SEQ ID NO: 1807640 - RNA, 20 nt, Human
cagaugcacaugagcuggcg

SEQ ID NO: 1807641 - RNA, 20 nt, Human
caaacauccuacaagacaca

SEQ ID NO: 1807642 - RNA, 14 nt, Human
cugcaaagcccagc

SEQ ID NO: 1807643 - RNA, 19 nt, Human
ggagcuggaaacacauguu

SEQ ID NO: 1807644 - RNA, 14 nt, Human
cugcccucccccuc

SEQ ID NO: 1807645 - RNA, 17 nt, Human
cucccuaguuccuucau

SEQ ID NO: 1807646 - RNA, 16 nt, Human
cugagcuugcagagau

SEQ ID NO: 1807647 - RNA, 12 nt, Human
ucaauuaccaca

SEQ ID NO: 1807648 - RNA, 14 nt, Human
ugcuaagucuuaua

SEQ ID NO: 1807649 - RNA, 22 nt, Human
auucucuugccucaaccuccca

SEQ ID NO: 1807650 - RNA, 17 nt, Human
uauaaacuuuuuucuua

SEQ ID NO: 1807651 - RNA, 18 nt, Human
ccucaccagcccuggcaa

SEQ ID NO: 1807652 - RNA, 22 nt, Human
uugccuaggcauagcccugccu

SEQ ID NO: 1807653 - RNA, 22 nt, Human
cugggauacugugcccagagcc

SEQ ID NO: 1807654 - RNA, 17 nt, Human
caccucccccaucucuu

SEQ ID NO: 1807655 - RNA, 20 nt, Human
acuaaauugacacuuaaaaa

SEQ ID NO: 1807656 - RNA, 13 nt, Human
auuuccccauuua

SEQ ID NO: 1807657 - RNA, 17 nt, Human
cuaauuggcaugaaggu

SEQ ID NO: 1807658 - RNA, 21 nt, Human
cauacaaaaauuccuuuuccc

SEQ ID NO: 1807659 - RNA, 16 nt, Human
cuugccuccagagacu

SEQ ID NO: 1807660 - RNA, 22 nt, Human
aguucuuuggcugaaaggaagc

SEQ ID NO: 1807661 - RNA, 15 nt, Human
aaaugauguuucaua

SEQ ID NO: 1807662 - RNA, 15 nt, Human
cccaucucaggugug

SEQ ID NO: 1807663 - RNA, 16 nt, Human
auccuaucucuccaac

SEQ ID NO: 1807664 - RNA, 15 nt, Human
ugccccccagcccuc

SEQ ID NO: 1807665 - RNA, 16 nt, Human
aaauugugcuggaaau

SEQ ID NO: 1807666 - RNA, 15 nt, Human
uccuucuauucuagc

SEQ ID NO: 1807667 - RNA, 17 nt, Human
uuguacacagaaauaca

SEQ ID NO: 1807668 - RNA, 16 nt, Human
cacuggacucaccucc

SEQ ID NO: 1807669 - RNA, 16 nt, Human
ugacacuuaaaaaugg

SEQ ID NO: 1807670 - RNA, 14 nt, Human
aucccacucacaac

SEQ ID NO: 1807671 - RNA, 20 nt, Human
aguguuuuaggagcaugagu

SEQ ID NO: 1807672 - RNA, 21 nt, Human
gucccugcagcucucuuuccu

SEQ ID NO: 1807673 - RNA, 13 nt, Human
uguccacaaguaa

SEQ ID NO: 1807674 - RNA, 14 nt, Human
ccaugggacaggga

SEQ ID NO: 1807675 - RNA, 21 nt, Human
aauucauucacucaacaaaca

SEQ ID NO: 1807676 - RNA, 22 nt, Human
aaccagaucauugugaaauuau

SEQ ID NO: 1807677 - RNA, 14 nt, Human
gagugcguggugcg

SEQ ID NO: 1807678 - RNA, 14 nt, Human
ccugccuccccugc

SEQ ID NO: 1807679 - RNA, 18 nt, Human
aagugcuucuccagccuc

SEQ ID NO: 1807680 - RNA, 11 nt, Human
cuaagaaagaa

SEQ ID NO: 1807681 - RNA, 20 nt, Human
uuuaauggugccuucauuug

SEQ ID NO: 1807682 - RNA, 18 nt, Human
auuaagaaaaucuauuuu

SEQ ID NO: 1807683 - RNA, 15 nt, Human
cgaggccccugucuc

SEQ ID NO: 1807684 - RNA, 20 nt, Human
auacugugugcuaaaacaag

SEQ ID NO: 1807685 - RNA, 20 nt, Human
uuucuucaaauaaaucucuc

SEQ ID NO: 1807686 - RNA, 21 nt, Human
uuaauuugaguacuuauggcc

SEQ ID NO: 1807687 - RNA, 19 nt, Human
gggccccugccucucugca

SEQ ID NO: 1807688 - RNA, 16 nt, Human
uaaaaggaaagaaaau

SEQ ID NO: 1807689 - RNA, 22 nt, Human
aggaauccucugugucuucaaa

SEQ ID NO: 1807690 - RNA, 18 nt, Human
agcugggcagaaggccaa

SEQ ID NO: 1807691 - RNA, 14 nt, Human
ucucuggaauuuga

SEQ ID NO: 1807692 - RNA, 12 nt, Human
cuugguucagua

SEQ ID NO: 1807693 - RNA, 19 nt, Human
aauguuuacagauccccaa

SEQ ID NO: 1807694 - RNA, 23 nt, Human
aaggauaaaguugguaaaccuuu

SEQ ID NO: 1807695 - RNA, 13 nt, Human
aguguuuagcaua

SEQ ID NO: 1807696 - RNA, 21 nt, Human
cuauuuaauuauuucacuuua

SEQ ID NO: 1807697 - RNA, 20 nt, Human
ugagagugaacaaauuuaca

SEQ ID NO: 1807698 - RNA, 12 nt, Human
gcagccuggcca

SEQ ID NO: 1807699 - RNA, 16 nt, Human
cauagaauaaaauuuu

SEQ ID NO: 1807700 - RNA, 19 nt, Human
uccuauuuuuggaagagga

SEQ ID NO: 1807701 - RNA, 20 nt, Human
ccccaggcccugcucuuccu

SEQ ID NO: 1807702 - RNA, 12 nt, Human
uccuuccuuuug

SEQ ID NO: 1807703 - RNA, 15 nt, Human
auauacauacaugca

SEQ ID NO: 1807704 - RNA, 18 nt, Human
aaaagacaaggaaaaaau

SEQ ID NO: 1807705 - RNA, 15 nt, Human
gaaagaaaacuugua

SEQ ID NO: 1807706 - RNA, 20 nt, Human
cuaccugcucagcccugcac

SEQ ID NO: 1807707 - RNA, 17 nt, Human
cucugugucuucaaagc

SEQ ID NO: 1807708 - RNA, 22 nt, Human
acagaucacagcuucagccagg

SEQ ID NO: 1807709 - RNA, 19 nt, Human
cauccccaggcccugcucu

SEQ ID NO: 1807710 - RNA, 15 nt, Human
aacaugcacuuccuu

SEQ ID NO: 1807711 - RNA, 21 nt, Human
ggacacagucuaacaaauucc

SEQ ID NO: 1807712 - RNA, 19 nt, Human
cacugcaaccucugccucc

SEQ ID NO: 1807713 - RNA, 17 nt, Human
caguggcgcgaucucag

SEQ ID NO: 1807714 - RNA, 14 nt, Human
agagguccacaaca

SEQ ID NO: 1807715 - RNA, 20 nt, Human
uccuugauuuuagccuucuc

SEQ ID NO: 1807716 - RNA, 14 nt, Human
aguucuguagaaau

SEQ ID NO: 1807717 - RNA, 16 nt, Human
uuauaacuggaaagaa

SEQ ID NO: 1807718 - RNA, 23 nt, Human
uuuuguagaauaaggaacaacgu

SEQ ID NO: 1807719 - RNA, 14 nt, Human
uagauaaggaaaua

SEQ ID NO: 1807720 - RNA, 22 nt, Human
gucugagacagaaucucagucu

SEQ ID NO: 1807721 - RNA, 22 nt, Human
cuccuccauaucucccucuucc

SEQ ID NO: 1807722 - RNA, 21 nt, Human
cugcaugcacuucuuacaaua

SEQ ID NO: 1807723 - RNA, 22 nt, Human
auacucagguuaaugcugaaaa

SEQ ID NO: 1807724 - RNA, 12 nt, Human
acaagacacagu

SEQ ID NO: 1807725 - RNA, 16 nt, Human
cuccaccaucgucuuc

SEQ ID NO: 1807726 - RNA, 12 nt, Human
ucugcaggaugu

SEQ ID NO: 1807727 - RNA, 16 nt, Human
ccaguaugcuuggacu

SEQ ID NO: 1807728 - RNA, 15 nt, Human
aguuuauauagaaau

SEQ ID NO: 1807729 - RNA, 16 nt, Human
cucagggcucuuuccu

SEQ ID NO: 1807730 - RNA, 17 nt, Human
ccuaaaacuuuaaaacu

SEQ ID NO: 1807731 - RNA, 12 nt, Human
gcccucccccuc

SEQ ID NO: 1807732 - RNA, 17 nt, Human
gcaccacuguguauuua

SEQ ID NO: 1807733 - RNA, 17 nt, Human
gcagcaucagcaucccu

SEQ ID NO: 1807734 - RNA, 13 nt, Human
uaucaaaauuacc

SEQ ID NO: 1807735 - RNA, 17 nt, Human
agaugggagaaucacuu

SEQ ID NO: 1807736 - RNA, 18 nt, Human
gcuuuucuuuucuuuguu

SEQ ID NO: 1807737 - RNA, 14 nt, Human
uaauauauauuauc

SEQ ID NO: 1807738 - RNA, 18 nt, Human
acucuuguaauaaaaugu

SEQ ID NO: 1807739 - RNA, 22 nt, Human
auuccuguggauguaaagugau

SEQ ID NO: 1807740 - RNA, 15 nt, Human
ggcaauagucaaauu

SEQ ID NO: 1807741 - RNA, 17 nt, Human
aucaaggguacacugcc

SEQ ID NO: 1807742 - RNA, 21 nt, Human
ugaaauggacuuuuguacaua

SEQ ID NO: 1807743 - RNA, 14 nt, Human
ggccgggagccuga

SEQ ID NO: 1807744 - RNA, 17 nt, Human
uucuccauccuaccaca

SEQ ID NO: 1807745 - RNA, 22 nt, Human
cuucuccagccucagccuccca

SEQ ID NO: 1807746 - RNA, 23 nt, Human
auuuggugauuacauuuuaaaca

SEQ ID NO: 1807747 - RNA, 19 nt, Human
cuaauguacaauaaagcaa

SEQ ID NO: 1807748 - RNA, 17 nt, Human
aacaggcaaaaggaagc

SEQ ID NO: 1807749 - RNA, 11 nt, Human
aaauagcagcu

SEQ ID NO: 1807750 - RNA, 18 nt, Human
caggauauccucccucca

SEQ ID NO: 1807751 - RNA, 14 nt, Human
aaucauaagauauu

SEQ ID NO: 1807752 - RNA, 16 nt, Human
aauuuuugaaaacugg

SEQ ID NO: 1807753 - RNA, 14 nt, Human
auccaaugaaauga

SEQ ID NO: 1807754 - RNA, 23 nt, Human
uugccugcaggcaugagucaguc

SEQ ID NO: 1807755 - RNA, 12 nt, Human
guuuuaauaauu

SEQ ID NO: 1807756 - RNA, 19 nt, Human
uccucaacguugcucccca

SEQ ID NO: 1807757 - RNA, 17 nt, Human
ccuguguauucauucuc

SEQ ID NO: 1807758 - RNA, 20 nt, Human
gaauucauucacucaacaaa

SEQ ID NO: 1807759 - RNA, 23 nt, Human
acucucaccauuuggauccugug

SEQ ID NO: 1807760 - RNA, 19 nt, Human
auuaguuagccaauauuuu

SEQ ID NO: 1807761 - RNA, 18 nt, Human
agggccuggggagaugga

SEQ ID NO: 1807762 - RNA, 21 nt, Human
caaagcccagcuugaaaccuu

SEQ ID NO: 1807763 - RNA, 17 nt, Human
uaucuauuuaaauauuu

SEQ ID NO: 1807764 - RNA, 21 nt, Human
aaucuuugacaauugggagcu

SEQ ID NO: 1807765 - RNA, 11 nt, Human
gccaugggaca

SEQ ID NO: 1807766 - RNA, 19 nt, Human
augcacugauguuguguuu

SEQ ID NO: 1807767 - RNA, 22 nt, Human
aaagacagugaaagaaaauaac

SEQ ID NO: 1807768 - RNA, 16 nt, Human
aauuccacagcugcuc

SEQ ID NO: 1807769 - RNA, 22 nt, Human
uaauauaagcugccauauauuu

SEQ ID NO: 1807770 - RNA, 21 nt, Human
agccucuuagaugcaguucug

SEQ ID NO: 1807771 - RNA, 17 nt, Human
accuaaaauaaaaugaa

SEQ ID NO: 1807772 - RNA, 14 nt, Human
cucaccccuugcca

SEQ ID NO: 1807773 - RNA, 19 nt, Human
ccccuauccuacuuccccu

SEQ ID NO: 1807774 - RNA, 17 nt, Human
uaagaaauaggaaauau

SEQ ID NO: 1807775 - RNA, 22 nt, Human
ugagacucugucucaguccaug

SEQ ID NO: 1807776 - RNA, 16 nt, Human
cauguggcccaacaca

SEQ ID NO: 1807777 - RNA, 20 nt, Human
auuuuaauaaacacucuuga

SEQ ID NO: 1807778 - RNA, 17 nt, Human
gccugcucccuagccag

SEQ ID NO: 1807779 - RNA, 22 nt, Human
gcuggagugcaguggcgcgauc

SEQ ID NO: 1807780 - RNA, 14 nt, Human
gucagcucuucucc

SEQ ID NO: 1807781 - RNA, 22 nt, Human
accuuaucuauguagaauauau

SEQ ID NO: 1807782 - RNA, 11 nt, Human
uggucccuugg

SEQ ID NO: 1807783 - RNA, 20 nt, Human
ccccuuugcuucauucaagu

SEQ ID NO: 1807784 - RNA, 15 nt, Human
acugaagaagcacca

SEQ ID NO: 1807785 - RNA, 18 nt, Human
gugggacccugucucuac

SEQ ID NO: 1807786 - RNA, 16 nt, Human
agagggaauugcagag

SEQ ID NO: 1807787 - RNA, 14 nt, Human
ugaagauguagagg

SEQ ID NO: 1807788 - RNA, 21 nt, Human
ucggaaagaagaaggugggag

SEQ ID NO: 1807789 - RNA, 16 nt, Human
cccugcugcccucccc

SEQ ID NO: 1807790 - RNA, 18 nt, Human
gaacucugagcagugcuu

SEQ ID NO: 1807791 - RNA, 17 nt, Human
uaacaguugcauugacu

SEQ ID NO: 1807792 - RNA, 17 nt, Human
ugaaaaucuuauaauuu

SEQ ID NO: 1807793 - RNA, 20 nt, Human
aauccuagguaggguuuaau

SEQ ID NO: 1807794 - RNA, 16 nt, Human
uaagaaauaggaaaua

SEQ ID NO: 1807795 - RNA, 21 nt, Human
gacacaucucccgcuccucua

SEQ ID NO: 1807796 - RNA, 22 nt, Human
ccuguugcugccugcccuauuc

SEQ ID NO: 1807797 - RNA, 18 nt, Human
uccaugaacuucuccccu

SEQ ID NO: 1807798 - RNA, 20 nt, Human
ccuccugccuaagugcagcc

SEQ ID NO: 1807799 - RNA, 20 nt, Human
cucuucuccauccuaccaca

SEQ ID NO: 1807800 - RNA, 17 nt, Human
uauacucacuuucccaa

SEQ ID NO: 1807801 - RNA, 18 nt, Human
cuguuuucccuccuugga

SEQ ID NO: 1807802 - RNA, 18 nt, Human
ccacauucagagcuuacu

SEQ ID NO: 1807803 - RNA, 15 nt, Human
uccauugggcaggca

SEQ ID NO: 1807804 - RNA, 19 nt, Human
ucauaccguguaccucagu

SEQ ID NO: 1807805 - RNA, 23 nt, Human
guacuaagcgcuagaggaagcag

SEQ ID NO: 1807806 - RNA, 20 nt, Human
agaagaacugaaaucauacu

SEQ ID NO: 1807807 - RNA, 21 nt, Human
gcucuggacuugccuccagag

SEQ ID NO: 1807808 - RNA, 22 nt, Human
ucaaucaagacugcaaacccuu

SEQ ID NO: 1807809 - RNA, 18 nt, Human
aucugccuuuauuguguu

SEQ ID NO: 1807810 - RNA, 22 nt, Human
caagagugaagggaagagacag

SEQ ID NO: 1807811 - RNA, 16 nt, Human
acauuugcucauggaa

SEQ ID NO: 1807812 - RNA, 19 nt, Human
ggauuaugggucacaggaa

SEQ ID NO: 1807813 - RNA, 18 nt, Human
gccacggugccuccagau

SEQ ID NO: 1807814 - RNA, 21 nt, Human
aagauauuaacugagaaggcu

SEQ ID NO: 1807815 - RNA, 19 nt, Human
auucagaauuucuaaaagu

SEQ ID NO: 1807816 - RNA, 19 nt, Human
agccaaucaguagccagca

SEQ ID NO: 1807817 - RNA, 15 nt, Human
ggcuggcgugcagca

SEQ ID NO: 1807818 - RNA, 15 nt, Human
uuuaucaugugucuu

SEQ ID NO: 1807819 - RNA, 16 nt, Human
ggacuugccucugcac

SEQ ID NO: 1807820 - RNA, 18 nt, Human
auuccucugcccuuccug

SEQ ID NO: 1807821 - RNA, 18 nt, Human
ugcugugcagucccugca

SEQ ID NO: 1807822 - RNA, 21 nt, Human
ugaccauacuaauuauacccc

SEQ ID NO: 1807823 - RNA, 21 nt, Human
uuuguucuauagcuuuucccu

SEQ ID NO: 1807824 - RNA, 14 nt, Human
ucccuguuucuucc

SEQ ID NO: 1807825 - RNA, 20 nt, Human
augccugcccauuggagaga

SEQ ID NO: 1807826 - RNA, 14 nt, Human
cacaacacacagau

SEQ ID NO: 1807827 - RNA, 17 nt, Human
agucaacuccuuucuca

SEQ ID NO: 1807828 - RNA, 18 nt, Human
acucuucuuacuggugcu

SEQ ID NO: 1807829 - RNA, 18 nt, Human
uaaugaauacuuuauaaa

SEQ ID NO: 1807830 - RNA, 14 nt, Human
cugcagacucacug

SEQ ID NO: 1807831 - RNA, 18 nt, Human
ugcccauaccccuggcca

SEQ ID NO: 1807832 - RNA, 22 nt, Human
ugggcacuguggguagacacac

SEQ ID NO: 1807833 - RNA, 18 nt, Human
cucauccugcaggcagcu

SEQ ID NO: 1807834 - RNA, 16 nt, Human
caugggacagggagga

SEQ ID NO: 1807835 - RNA, 15 nt, Human
guucugcagauaaac

SEQ ID NO: 1807836 - RNA, 17 nt, Human
ucaaccucuuccccgcc

SEQ ID NO: 1807837 - RNA, 19 nt, Human
aagcccuccgccauucuca

SEQ ID NO: 1807838 - RNA, 15 nt, Human
caaacugcuguccca

SEQ ID NO: 1807839 - RNA, 17 nt, Human
guggaaaccuccuucca

SEQ ID NO: 1807840 - RNA, 17 nt, Human
aacacucuugaaaaaug

SEQ ID NO: 1807841 - RNA, 12 nt, Human
gaaggugggagg

SEQ ID NO: 1807842 - RNA, 18 nt, Human
aauaguuuuauuaauaaa

SEQ ID NO: 1807843 - RNA, 21 nt, Human
ugaauuguaggugacuauuau

SEQ ID NO: 1807844 - RNA, 19 nt, Human
gcaguggcaucaucucagc

SEQ ID NO: 1807845 - RNA, 14 nt, Human
cacagcuucagcca

SEQ ID NO: 1807846 - RNA, 16 nt, Human
ugcauagguuuaauaa

SEQ ID NO: 1807847 - RNA, 12 nt, Human
aggaaacuaggu

SEQ ID NO: 1807848 - RNA, 15 nt, Human
cugcagacucacugu

SEQ ID NO: 1807849 - RNA, 21 nt, Human
agauugugucccauuccccca

SEQ ID NO: 1807850 - RNA, 22 nt, Human
agcuaaugaaguguuuagcaua

SEQ ID NO: 1807851 - RNA, 23 nt, Human
aguacucauacauguuacaacac

SEQ ID NO: 1807852 - RNA, 15 nt, Human
aucaaaggacaccau

SEQ ID NO: 1807853 - RNA, 20 nt, Human
cacagcauggagucacagcc

SEQ ID NO: 1807854 - RNA, 12 nt, Human
ccaaaccaggac

SEQ ID NO: 1807855 - RNA, 14 nt, Human
cuggagcucugccc

SEQ ID NO: 1807856 - RNA, 19 nt, Human
ucccuagccagaggcucua

SEQ ID NO: 1807857 - RNA, 17 nt, Human
auugcucagaaauguca

SEQ ID NO: 1807858 - RNA, 18 nt, Human
ucucagguguguugcagu

SEQ ID NO: 1807859 - RNA, 14 nt, Human
cagucucccucccu

SEQ ID NO: 1807860 - RNA, 19 nt, Human
uauuuaauuauuucacuuu

SEQ ID NO: 1807861 - RNA, 19 nt, Human
caguccauugggcaggcag

SEQ ID NO: 1807862 - RNA, 17 nt, Human
cuggccuguacccagua

SEQ ID NO: 1807863 - RNA, 12 nt, Human
gcaaagcccagc

SEQ ID NO: 1807864 - RNA, 18 nt, Human
cuccaaagcccucccuac

SEQ ID NO: 1807865 - RNA, 24 nt, Human
cauaugaaaaggcuaagcuucacu

SEQ ID NO: 1807866 - RNA, 19 nt, Human
aauugaucgacuugccaaa

SEQ ID NO: 1807867 - RNA, 18 nt, Human
cuaauguacaauaaagca

SEQ ID NO: 1807868 - RNA, 16 nt, Human
uagaaaagcuauaaaa

SEQ ID NO: 1807869 - RNA, 14 nt, Human
agcugcauuucaga

SEQ ID NO: 1807870 - RNA, 21 nt, Human
cuccagcugcucugucuucuu

SEQ ID NO: 1807871 - RNA, 21 nt, Human
agcuaauuuuuguauuuuuag

SEQ ID NO: 1807872 - RNA, 13 nt, Human
ccuccgccuccca

SEQ ID NO: 1807873 - RNA, 15 nt, Human
agcucuaucaccaag

SEQ ID NO: 1807874 - RNA, 17 nt, Human
cacucacauccauucuu

SEQ ID NO: 1807875 - RNA, 14 nt, Human
cucaucuuuuuacu

SEQ ID NO: 1807876 - RNA, 18 nt, Human
acugccuucucaacucca

SEQ ID NO: 1807877 - RNA, 16 nt, Human
caaguccugcaagcag

SEQ ID NO: 1807878 - RNA, 21 nt, Human
gugagggggggguauuucaau

SEQ ID NO: 1807879 - RNA, 18 nt, Human
uaggugacuauuauauuu

SEQ ID NO: 1807880 - RNA, 13 nt, Human
gagaccuacccuc

SEQ ID NO: 1807881 - RNA, 23 nt, Human
cauuaaaaaugcauauacuuuaa

SEQ ID NO: 1807882 - RNA, 21 nt, Human
agcccugggauagugcugucu

SEQ ID NO: 1807883 - RNA, 15 nt, Human
aucuauuuaaauauu

SEQ ID NO: 1807884 - RNA, 20 nt, Human
uuaucaugugaaaucauuca

SEQ ID NO: 1807885 - RNA, 23 nt, Human
gauuacaggcgugagccaccucg

SEQ ID NO: 1807886 - RNA, 22 nt, Human
guuuaacguuuucauuaaaauu

SEQ ID NO: 1807887 - RNA, 19 nt, Human
aauuauguuaaacuagcau

SEQ ID NO: 1807888 - RNA, 18 nt, Human
gucuuuuuucuaaaguaa

SEQ ID NO: 1807889 - RNA, 18 nt, Human
uacucacauuuggggcua

SEQ ID NO: 1807890 - RNA, 23 nt, Human
acaaaaaaaaaaccauauauaua

SEQ ID NO: 1807891 - RNA, 20 nt, Human
accuuuugcuguggcaaaug

SEQ ID NO: 1807892 - RNA, 15 nt, Human
aaaacaggcaaauuc

SEQ ID NO: 1807893 - RNA, 21 nt, Human
gcacagaacuuaaggauggag

SEQ ID NO: 1807894 - RNA, 19 nt, Human
acauacauuucucauaccu

SEQ ID NO: 1807895 - RNA, 14 nt, Human
uugcuggagcucug

SEQ ID NO: 1807896 - RNA, 19 nt, Human
ccagcugcucugucuucuu

SEQ ID NO: 1807897 - RNA, 14 nt, Human
ccgccacccuccca

SEQ ID NO: 1807898 - RNA, 21 nt, Human
ugaaguacccguucacauuuu

SEQ ID NO: 1807899 - RNA, 19 nt, Human
uaauuugaaauauuuucuu

SEQ ID NO: 1807900 - RNA, 21 nt, Human
uacuauauuuuaggucuuaau

SEQ ID NO: 1807901 - RNA, 15 nt, Human
cuuucuuuauuuuga

SEQ ID NO: 1807902 - RNA, 11 nt, Human
ucaccagcccu

SEQ ID NO: 1807903 - RNA, 24 nt, Human
uuuguucauauaacgucaugugca

SEQ ID NO: 1807904 - RNA, 14 nt, Human
aaaaggaagcaggg

SEQ ID NO: 1807905 - RNA, 20 nt, Human
uuauucacuguauguccuug

SEQ ID NO: 1807906 - RNA, 13 nt, Human
agucuuccucccu

SEQ ID NO: 1807907 - RNA, 22 nt, Human
caaggaugccccgucccccucu

SEQ ID NO: 1807908 - RNA, 18 nt, Human
uccccgcccguuuuacaa

SEQ ID NO: 1807909 - RNA, 21 nt, Human
uguauaaaauaauuuuuauau

SEQ ID NO: 1807910 - RNA, 17 nt, Human
auggcuccuccauaucu

SEQ ID NO: 1807911 - RNA, 16 nt, Human
ucuggcuuuggaagcc

SEQ ID NO: 1807912 - RNA, 16 nt, Human
caucccuccugggaau

SEQ ID NO: 1807913 - RNA, 17 nt, Human
cugauggguuucuccag

SEQ ID NO: 1807914 - RNA, 14 nt, Human
uauccaaaaaugug

SEQ ID NO: 1807915 - RNA, 12 nt, Human
auaauauuuuua

SEQ ID NO: 1807916 - RNA, 16 nt, Human
ggcugagccucagucu

SEQ ID NO: 1807917 - RNA, 13 nt, Human
aacaccccacaga

SEQ ID NO: 1807918 - RNA, 23 nt, Human
ccugcagacucacugugggaagg

SEQ ID NO: 1807919 - RNA, 16 nt, Human
accacuuuauuucuuu

SEQ ID NO: 1807920 - RNA, 21 nt, Human
uaaaguaaaaacaaagaaauu

SEQ ID NO: 1807921 - RNA, 19 nt, Human
gcuggccuugugaggagcu

SEQ ID NO: 1807922 - RNA, 18 nt, Human
ccucuccaaagcccuccc

SEQ ID NO: 1807923 - RNA, 16 nt, Human
aacuucccugaaaaau

SEQ ID NO: 1807924 - RNA, 18 nt, Human
cacucauaauucuucacc

SEQ ID NO: 1807925 - RNA, 16 nt, Human
ucauaaauaaaguuug

SEQ ID NO: 1807926 - RNA, 15 nt, Human
uuuuaccaaauaaag

SEQ ID NO: 1807927 - RNA, 16 nt, Human
cauuucuaaagccauu

SEQ ID NO: 1807928 - RNA, 16 nt, Human
ccaggcugagccucag

SEQ ID NO: 1807929 - RNA, 20 nt, Human
cugauguuguguuuuuaaca

SEQ ID NO: 1807930 - RNA, 24 nt, Human
ccuggcucucccagccagguucug

SEQ ID NO: 1807931 - RNA, 17 nt, Human
cagccucagccucccaa

SEQ ID NO: 1807932 - RNA, 21 nt, Human
ugacuagaaaauuuaaaacau

SEQ ID NO: 1807933 - RNA, 18 nt, Human
ucccaauugcuuuaccuu

SEQ ID NO: 1807934 - RNA, 17 nt, Human
ucuaauguugaguuauu

SEQ ID NO: 1807935 - RNA, 14 nt, Human
gcucacugcaaccu

SEQ ID NO: 1807936 - RNA, 20 nt, Human
caaagugcuggcauuacagg

SEQ ID NO: 1807937 - RNA, 15 nt, Human
cccugccuucccagg

SEQ ID NO: 1807938 - RNA, 23 nt, Human
gacccuuauugcuguccuggagg

SEQ ID NO: 1807939 - RNA, 14 nt, Human
cagacucuaagaaa

SEQ ID NO: 1807940 - RNA, 18 nt, Human
aaagggacugagaaauuu

SEQ ID NO: 1807941 - RNA, 18 nt, Human
acaaguauggcuccucca

SEQ ID NO: 1807942 - RNA, 12 nt, Human
cuugguuuuaau

SEQ ID NO: 1807943 - RNA, 17 nt, Human
ucgcagacacaugugcu

SEQ ID NO: 1807944 - RNA, 12 nt, Human
accuuuucccaa

SEQ ID NO: 1807945 - RNA, 22 nt, Human
cugggacaggggagaaccuagg

SEQ ID NO: 1807946 - RNA, 21 nt, Human
ugucuuuuuucuaaaguaaaa

SEQ ID NO: 1807947 - RNA, 23 nt, Human
cucuucugagcaccuacuuacau

SEQ ID NO: 1807948 - RNA, 17 nt, Human
uacuuacaugcauuacu

SEQ ID NO: 1807949 - RNA, 21 nt, Human
accucgugauccacccgccuc

SEQ ID NO: 1807950 - RNA, 16 nt, Human
uucucuaggaaauauu

SEQ ID NO: 1807951 - RNA, 18 nt, Human
ccauguacauagcuugau

SEQ ID NO: 1807952 - RNA, 22 nt, Human
ccccaaguuauccaccugccuu

SEQ ID NO: 1807953 - RNA, 15 nt, Human
gccucuuagaugcag

SEQ ID NO: 1807954 - RNA, 23 nt, Human
uccaaacugacucuuaagaagac

SEQ ID NO: 1807955 - RNA, 13 nt, Human
caggggccacucu

SEQ ID NO: 1807956 - RNA, 16 nt, Human
aggccucacacacaau

SEQ ID NO: 1807957 - RNA, 12 nt, Human
uaauauauauau

SEQ ID NO: 1807958 - RNA, 19 nt, Human
ucuuacucuguugccaggc

SEQ ID NO: 1807959 - RNA, 14 nt, Human
cuguaauaaacuca

SEQ ID NO: 1807960 - RNA, 20 nt, Human
cugcacuccagccugagcga

SEQ ID NO: 1807961 - RNA, 13 nt, Human
augaguugcaguu

SEQ ID NO: 1807962 - RNA, 13 nt, Human
uucuuaaaucuag

SEQ ID NO: 1807963 - RNA, 10 nt, Human
cauucuuccu

SEQ ID NO: 1807964 - RNA, 18 nt, Human
ucauguaagcugaaaaua

SEQ ID NO: 1807965 - RNA, 22 nt, Human
caagcacuaaacaaagagugaa

SEQ ID NO: 1807966 - RNA, 22 nt, Human
aaagauaucucaucucuucuuu

SEQ ID NO: 1807967 - RNA, 24 nt, Human
cuuuguauaaaagggacugagaaa

SEQ ID NO: 1807968 - RNA, 13 nt, Human
cugcauaaaugug

SEQ ID NO: 1807969 - RNA, 17 nt, Human
cauauuguuacugguac

SEQ ID NO: 1807970 - RNA, 22 nt, Human
gcuaaaacaagcacuaaacaaa

SEQ ID NO: 1807971 - RNA, 23 nt, Human
caacguggcuuuuuuuuuuuccc

SEQ ID NO: 1807972 - RNA, 19 nt, Human
ccugauauauuccaccagg

SEQ ID NO: 1807973 - RNA, 19 nt, Human
gaugcuacucuaguauucc

SEQ ID NO: 1807974 - RNA, 13 nt, Human
uguacuugcucuu

SEQ ID NO: 1807975 - RNA, 16 nt, Human
augaagagauuuuuca

SEQ ID NO: 1807976 - RNA, 15 nt, Human
acacugaucuggcug

SEQ ID NO: 1807977 - RNA, 20 nt, Human
ucgacuugccaaauuuagau

SEQ ID NO: 1807978 - RNA, 18 nt, Human
cccuaauaaagcugugug

SEQ ID NO: 1807979 - RNA, 15 nt, Human
auuccuccuucccuu

SEQ ID NO: 1807980 - RNA, 15 nt, Human
cuuuacuuuccccuu

SEQ ID NO: 1807981 - RNA, 17 nt, Human
ccaacagcacccucucc

SEQ ID NO: 1807982 - RNA, 19 nt, Human
caaauaaaggaaacccagc

SEQ ID NO: 1807983 - RNA, 15 nt, Human
ucagccauguauuug

SEQ ID NO: 1807984 - RNA, 12 nt, Human
ccuuuuuccuuc

SEQ ID NO: 1807985 - RNA, 14 nt, Human
uaaauaaauuguau

SEQ ID NO: 1807986 - RNA, 14 nt, Human
gggagccagggcug

SEQ ID NO: 1807987 - RNA, 18 nt, Human
uuaugccucuguauuuaa

SEQ ID NO: 1807988 - RNA, 14 nt, Human
uguaacuaaaguua

SEQ ID NO: 1807989 - RNA, 14 nt, Human
caagagccugagug

SEQ ID NO: 1807990 - RNA, 15 nt, Human
uauucuugauguaaa

SEQ ID NO: 1807991 - RNA, 18 nt, Human
uguagaauugugcaacca

SEQ ID NO: 1807992 - RNA, 21 nt, Human
auuuguauaaaauaauuuuua

SEQ ID NO: 1807993 - RNA, 20 nt, Human
uucuggcaccaggaaucccc

SEQ ID NO: 1807994 - RNA, 16 nt, Human
uaaaauccauacauuu

SEQ ID NO: 1807995 - RNA, 13 nt, Human
aagcuucuguucc

SEQ ID NO: 1807996 - RNA, 15 nt, Human
ucucaaacuucuauu

SEQ ID NO: 1807997 - RNA, 21 nt, Human
cuuuccucuggggcauuaucc

SEQ ID NO: 1807998 - RNA, 13 nt, Human
aaguccuucccuu

SEQ ID NO: 1807999 - RNA, 13 nt, Human
cagcuccagcugc

SEQ ID NO: 1808000 - RNA, 21 nt, Human
ugagagauucaugcugauugu

SEQ ID NO: 1808001 - RNA, 17 nt, Human
aauauugcaaggcaaag

SEQ ID NO: 1808002 - RNA, 16 nt, Human
agcacccucuccagau

SEQ ID NO: 1808003 - RNA, 12 nt, Human
aaacccuuucau

SEQ ID NO: 1808004 - RNA, 16 nt, Human
auugugcuggaaaugg

SEQ ID NO: 1808005 - RNA, 20 nt, Human
ucucuggccuguacccagua

SEQ ID NO: 1808006 - RNA, 13 nt, Human
uugcauuuuacuu

SEQ ID NO: 1808007 - RNA, 22 nt, Human
uuuggagauuuuuuaauccuuu

SEQ ID NO: 1808008 - RNA, 15 nt, Human
auucagacuguuuuu

SEQ ID NO: 1808009 - RNA, 21 nt, Human
cugaaggcauccccaggcccu

SEQ ID NO: 1808010 - RNA, 23 nt, Human
gauauuaaccaggggccaugaau

SEQ ID NO: 1808011 - RNA, 18 nt, Human
uguuuuggugguuuuagu

SEQ ID NO: 1808012 - RNA, 18 nt, Human
guuuaugguuguauuauu

SEQ ID NO: 1808013 - RNA, 13 nt, Human
uauuuauuuuaau

SEQ ID NO: 1808014 - RNA, 18 nt, Human
aguccugcaagcagaggu

SEQ ID NO: 1808015 - RNA, 21 nt, Human
acaagaaggaaagauuuuguu

SEQ ID NO: 1808016 - RNA, 16 nt, Human
cgccucagccucccaa

SEQ ID NO: 1808017 - RNA, 16 nt, Human
caccugucccagaaaa

SEQ ID NO: 1808018 - RNA, 18 nt, Human
agauccccaagccuggca

SEQ ID NO: 1808019 - RNA, 20 nt, Human
cuuuuacuuuucuucuauug

SEQ ID NO: 1808020 - RNA, 21 nt, Human
aaaugucuugcuugauuguau

SEQ ID NO: 1808021 - RNA, 23 nt, Human
aggagcugggcagaaggccaaga

SEQ ID NO: 1808022 - RNA, 22 nt, Human
ugggcagaaggccaagaggcug

SEQ ID NO: 1808023 - RNA, 19 nt, Human
cuauaaaaugaauacaauu

SEQ ID NO: 1808024 - RNA, 14 nt, Human
uuaguguucauaaa

SEQ ID NO: 1808025 - RNA, 20 nt, Human
cuaaaugucaaucagccuag

SEQ ID NO: 1808026 - RNA, 18 nt, Human
ugaacuugguuuuaauua

SEQ ID NO: 1808027 - RNA, 17 nt, Human
uacaguuaaguuuugug

SEQ ID NO: 1808028 - RNA, 23 nt, Human
cccugcucuuccucagcugugug

SEQ ID NO: 1808029 - RNA, 23 nt, Human
accaggauauccucccuccagau

SEQ ID NO: 1808030 - RNA, 20 nt, Human
gaaccacucauaauucuuca

SEQ ID NO: 1808031 - RNA, 15 nt, Human
guuggagugcagugg

SEQ ID NO: 1808032 - RNA, 13 nt, Human
acaauaaagcaau

SEQ ID NO: 1808033 - RNA, 16 nt, Human
cuuuuuuuaaaaaaua

SEQ ID NO: 1808034 - RNA, 22 nt, Human
cuucagccugaaagaggaauga

SEQ ID NO: 1808035 - RNA, 18 nt, Human
uaauuauuucacuuuaga

SEQ ID NO: 1808036 - RNA, 15 nt, Human
gccucagccucccaa

SEQ ID NO: 1808037 - RNA, 17 nt, Human
aguuugguuucuagcau

SEQ ID NO: 1808038 - RNA, 12 nt, Human
cucauggaauug

SEQ ID NO: 1808039 - RNA, 16 nt, Human
cucaggaaggggugug

SEQ ID NO: 1808040 - RNA, 16 nt, Human
aagauuuccuucuuuu

SEQ ID NO: 1808041 - RNA, 17 nt, Human
uccagcuggccgggagc

SEQ ID NO: 1808042 - RNA, 20 nt, Human
uuuugcauccuacauuaauu

SEQ ID NO: 1808043 - RNA, 14 nt, Human
cauccccaggcccu

SEQ ID NO: 1808044 - RNA, 14 nt, Human
ccaggcacacugag

SEQ ID NO: 1808045 - RNA, 15 nt, Human
uucuuguauuuuucc

SEQ ID NO: 1808046 - RNA, 19 nt, Human
cccuucccuugagcccucu

SEQ ID NO: 1808047 - RNA, 20 nt, Human
aagacagugaaagaaaauaa

SEQ ID NO: 1808048 - RNA, 13 nt, Human
cucaagucuuauu

SEQ ID NO: 1808049 - RNA, 20 nt, Human
gcuccccuccucggcuuccu

SEQ ID NO: 1808050 - RNA, 22 nt, Human
uaaugccuuuucucaccuguca

SEQ ID NO: 1808051 - RNA, 23 nt, Human
cuuuaucaugugucuucugcccu

SEQ ID NO: 1808052 - RNA, 18 nt, Human
acuugucauuguuauaua

SEQ ID NO: 1808053 - RNA, 21 nt, Human
uauaagaaauaggaaauauuu

SEQ ID NO: 1808054 - RNA, 17 nt, Human
uuaaagucaagauuucc

SEQ ID NO: 1808055 - RNA, 20 nt, Human
cauucaagucagcucuucuc

SEQ ID NO: 1808056 - RNA, 16 nt, Human
acaaagggggaggcua

SEQ ID NO: 1808057 - RNA, 14 nt, Human
aauggugccuucau

SEQ ID NO: 1808058 - RNA, 17 nt, Human
auuugagauacaaacau

SEQ ID NO: 1808059 - RNA, 15 nt, Human
ccugccuccccugcc

SEQ ID NO: 1808060 - RNA, 21 nt, Human
aaaugacuuuucuccucucag

SEQ ID NO: 1808061 - RNA, 12 nt, Human
uggagugcagug

SEQ ID NO: 1808062 - RNA, 18 nt, Human
aaggaaaagggcuuucuc

SEQ ID NO: 1808063 - RNA, 13 nt, Human
aaaucacucaaau

SEQ ID NO: 1808064 - RNA, 22 nt, Human
uaaaauaauuuuuauauuugaa

SEQ ID NO: 1808065 - RNA, 19 nt, Human
uagugagcagucaggaaag

SEQ ID NO: 1808066 - RNA, 15 nt, Human
aacaggguuguuguu

SEQ ID NO: 1808067 - RNA, 17 nt, Human
ucagcccccuaagcccc

SEQ ID NO: 1808068 - RNA, 20 nt, Human
ggccuggggcuucugaggcu

SEQ ID NO: 1808069 - RNA, 21 nt, Human
uccccaggcccugcucuuccu

SEQ ID NO: 1808070 - RNA, 14 nt, Human
cauaccuuccccac

SEQ ID NO: 1808071 - RNA, 13 nt, Human
ccauguuggccag

SEQ ID NO: 1808072 - RNA, 21 nt, Human
cagauggccuggcugcugcug

SEQ ID NO: 1808073 - RNA, 16 nt, Human
aaaaugugauauguac

SEQ ID NO: 1808074 - RNA, 15 nt, Human
cauccauucuucccu

SEQ ID NO: 1808075 - RNA, 22 nt, Human
ugaacucuguuuucuuucuaau

SEQ ID NO: 1808076 - RNA, 16 nt, Human
auuacugcaugcacuu

SEQ ID NO: 1808077 - RNA, 13 nt, Human
cucaaccucccaa

SEQ ID NO: 1808078 - RNA, 16 nt, Human
auauuaccaguuuucc

SEQ ID NO: 1808079 - RNA, 17 nt, Human
ucacagcuacacagauc

SEQ ID NO: 1808080 - RNA, 17 nt, Human
acucagacacaaauaaa

SEQ ID NO: 1808081 - RNA, 17 nt, Human
aagacugcaaacccuuu

SEQ ID NO: 1808082 - RNA, 14 nt, Human
ggcacacaccacca

SEQ ID NO: 1808083 - RNA, 20 nt, Human
aaauuguaagcaugcacaaa

SEQ ID NO: 1808084 - RNA, 17 nt, Human
cugagucaacuccuuuc

SEQ ID NO: 1808085 - RNA, 15 nt, Human
gaaaacaaggaugaa

SEQ ID NO: 1808086 - RNA, 22 nt, Human
ugagagcccugaggccuagacu

SEQ ID NO: 1808087 - RNA, 19 nt, Human
ucaagucagcucuucucca

SEQ ID NO: 1808088 - RNA, 13 nt, Human
uaccuuuuuucuu

SEQ ID NO: 1808089 - RNA, 23 nt, Human
augucaauucuugccaaauauaa

SEQ ID NO: 1808090 - RNA, 20 nt, Human
gccacggggacucagcccuu

SEQ ID NO: 1808091 - RNA, 22 nt, Human
agucucuggaauuugaaacacu

SEQ ID NO: 1808092 - RNA, 21 nt, Human
gucugcuacccucauuucuca

SEQ ID NO: 1808093 - RNA, 19 nt, Human
ccucccaagcaccugggau

SEQ ID NO: 1808094 - RNA, 14 nt, Human
uguacuaugcuguu

SEQ ID NO: 1808095 - RNA, 13 nt, Human
uuuaacuccugcu

SEQ ID NO: 1808096 - RNA, 16 nt, Human
aacuguugucauauuu

SEQ ID NO: 1808097 - RNA, 19 nt, Human
agccagaggcucuaaugua

SEQ ID NO: 1808098 - RNA, 15 nt, Human
cgugaucucagcuca

SEQ ID NO: 1808099 - RNA, 13 nt, Human
ccgccacccuccc

SEQ ID NO: 1808100 - RNA, 15 nt, Human
ugcuauucuccauac

SEQ ID NO: 1808101 - RNA, 13 nt, Human
aacucccuaguuc

SEQ ID NO: 1808102 - RNA, 16 nt, Human
ugugaaaucauucauu

SEQ ID NO: 1808103 - RNA, 16 nt, Human
gcacacugagccagca

SEQ ID NO: 1808104 - RNA, 19 nt, Human
cuugccugcaggcaugagu

SEQ ID NO: 1808105 - RNA, 19 nt, Human
gaauuugagauacaaacau

SEQ ID NO: 1808106 - RNA, 20 nt, Human
ucucaauaagccucagcuuu

SEQ ID NO: 1808107 - RNA, 20 nt, Human
augucgucaaagcugaaaug

SEQ ID NO: 1808108 - RNA, 14 nt, Human
cucuugcucagugg

SEQ ID NO: 1808109 - RNA, 17 nt, Human
cucuucccuaggagagg

SEQ ID NO: 1808110 - RNA, 19 nt, Human
acagucaccucauggaauu

SEQ ID NO: 1808111 - RNA, 24 nt, Human
aaaaugaaucccucuaucucuaaa

SEQ ID NO: 1808112 - RNA, 23 nt, Human
uagcuuuucccuuuuuuuaagua

SEQ ID NO: 1808113 - RNA, 13 nt, Human
ucuacuaaaaaua

SEQ ID NO: 1808114 - RNA, 18 nt, Human
uccagaugagaguacacc

SEQ ID NO: 1808115 - RNA, 15 nt, Human
cuuuuuaauguguau

SEQ ID NO: 1808116 - RNA, 17 nt, Human
ugcccucccccuccucu

SEQ ID NO: 1808117 - RNA, 13 nt, Human
cuagccugccucc

SEQ ID NO: 1808118 - RNA, 16 nt, Human
cuucaagcucuccaaa

SEQ ID NO: 1808119 - RNA, 19 nt, Human
ccaccugccuauauuuuuu

SEQ ID NO: 1808120 - RNA, 18 nt, Human
ccuuuggagauuuuuuaa

SEQ ID NO: 1808121 - RNA, 18 nt, Human
aauauaagcugccauaua

SEQ ID NO: 1808122 - RNA, 20 nt, Human
caggaaggggugugcugagu

SEQ ID NO: 1808123 - RNA, 21 nt, Human
agguccccagaugagaagucu

SEQ ID NO: 1808124 - RNA, 20 nt, Human
ccacaugggugaacacucaa

SEQ ID NO: 1808125 - RNA, 19 nt, Human
auuuccuuauucagaauuu

SEQ ID NO: 1808126 - RNA, 14 nt, Human
accucugccuccca

SEQ ID NO: 1808127 - RNA, 22 nt, Human
acguuccccuggguucacagau

SEQ ID NO: 1808128 - RNA, 24 nt, Human
ccaacucauccacguccugucugu

SEQ ID NO: 1808129 - RNA, 15 nt, Human
acccuccagagacaa

SEQ ID NO: 1808130 - RNA, 18 nt, Human
auuauguuaaacuagcau

SEQ ID NO: 1808131 - RNA, 11 nt, Human
uugagacagag

SEQ ID NO: 1808132 - RNA, 17 nt, Human
auaugggacauuuuuga

SEQ ID NO: 1808133 - RNA, 17 nt, Human
aguacaccccaacagca

SEQ ID NO: 1808134 - RNA, 15 nt, Human
cuacaagacacagug

SEQ ID NO: 1808135 - RNA, 12 nt, Human
cccacccaggag

SEQ ID NO: 1808136 - RNA, 20 nt, Human
ggccaugggacagggaggac

SEQ ID NO: 1808137 - RNA, 19 nt, Human
ucuccugccucagccuccc

SEQ ID NO: 1808138 - RNA, 13 nt, Human
acagcccuucuuu

SEQ ID NO: 1808139 - RNA, 17 nt, Human
uauauauacauauauau

SEQ ID NO: 1808140 - RNA, 22 nt, Human
uaacaaccaaagacuacauauu

SEQ ID NO: 1808141 - RNA, 22 nt, Human
aaacguauucaaacaauuugaa

SEQ ID NO: 1808142 - RNA, 18 nt, Human
guuaguauuguccagguc

SEQ ID NO: 1808143 - RNA, 20 nt, Human
gaaaccccuauguggaggcg

SEQ ID NO: 1808144 - RNA, 19 nt, Human
uagauacaugcuuuuuaau

SEQ ID NO: 1808145 - RNA, 19 nt, Human
auuuauucaauaaaguauu

SEQ ID NO: 1808146 - RNA, 19 nt, Human
guacaccccaacagcaccc

SEQ ID NO: 1808147 - RNA, 18 nt, Human
ccaucucaaccucuuccc

SEQ ID NO: 1808148 - RNA, 15 nt, Human
ugacaauuaaaagug

SEQ ID NO: 1808149 - RNA, 17 nt, Human
uccacagugacuccacu

SEQ ID NO: 1808150 - RNA, 13 nt, Human
agucaauguuuuc

SEQ ID NO: 1808151 - RNA, 14 nt, Human
auguagaauauauu

SEQ ID NO: 1808152 - RNA, 19 nt, Human
uaaguguguguuuuucaua

SEQ ID NO: 1808153 - RNA, 21 nt, Human
caauuuuguuauguauauuuu

SEQ ID NO: 1808154 - RNA, 17 nt, Human
cuauccuacuuccccuu

SEQ ID NO: 1808155 - RNA, 19 nt, Human
uuaagauaugggacauuuu

SEQ ID NO: 1808156 - RNA, 16 nt, Human
ugccgacagcucucca

SEQ ID NO: 1808157 - RNA, 14 nt, Human
guccacaaguaaaa

SEQ ID NO: 1808158 - RNA, 18 nt, Human
cagaguuccgacugccau

SEQ ID NO: 1808159 - RNA, 15 nt, Human
cagccugcucccuag

SEQ ID NO: 1808160 - RNA, 21 nt, Human
agguaaaucagacuaugaagu

SEQ ID NO: 1808161 - RNA, 15 nt, Human
uccauccugaggcuc

SEQ ID NO: 1808162 - RNA, 22 nt, Human
auucacaucgcagauucucccu

SEQ ID NO: 1808163 - RNA, 20 nt, Human
caguauauaacuaacaacca

SEQ ID NO: 1808164 - RNA, 20 nt, Human
aagcaguugagacaagaaaa

SEQ ID NO: 1808165 - RNA, 10 nt, Human
ccugagcccc

SEQ ID NO: 1808166 - RNA, 22 nt, Human
uuucucccuggauuuuuaccag

SEQ ID NO: 1808167 - RNA, 14 nt, Human
ccuugaugaagaag

SEQ ID NO: 1808168 - RNA, 17 nt, Human
caucaggcuuucuuuuu

SEQ ID NO: 1808169 - RNA, 18 nt, Human
aggcugcucagggcuggu

SEQ ID NO: 1808170 - RNA, 11 nt, Human
ccuucuuuuuu

SEQ ID NO: 1808171 - RNA, 21 nt, Human
caggcaggaacaaacagggcu

SEQ ID NO: 1808172 - RNA, 17 nt, Human
ccagggaagacaagaag

SEQ ID NO: 1808173 - RNA, 14 nt, Human
ggcuaaagcccaga

SEQ ID NO: 1808174 - RNA, 15 nt, Human
cuccauacucuguaa

SEQ ID NO: 1808175 - RNA, 15 nt, Human
uacuuuaauaaaugu

SEQ ID NO: 1808176 - RNA, 15 nt, Human
caauuagcuccuccu

SEQ ID NO: 1808177 - RNA, 17 nt, Human
aauauauauuaucuuuu

SEQ ID NO: 1808178 - RNA, 18 nt, Human
acugacucuuaagaagac

SEQ ID NO: 1808179 - RNA, 15 nt, Human
gaagcucugaagaac

SEQ ID NO: 1808180 - RNA, 17 nt, Human
ccuguccagccugcauc

SEQ ID NO: 1808181 - RNA, 22 nt, Human
aagacaaauauguucugacaua

SEQ ID NO: 1808182 - RNA, 19 nt, Human
guucaagcaauccucccac

SEQ ID NO: 1808183 - RNA, 12 nt, Human
acaaacagggcu

SEQ ID NO: 1808184 - RNA, 13 nt, Human
gcaaccuccaccu

SEQ ID NO: 1808185 - RNA, 17 nt, Human
accuuccagaaauacua

SEQ ID NO: 1808186 - RNA, 22 nt, Human
uuccucuguauacaaaacccuu

SEQ ID NO: 1808187 - RNA, 15 nt, Human
uuccccuugccuaaa

SEQ ID NO: 1808188 - RNA, 12 nt, Human
cucucuuuccuc

SEQ ID NO: 1808189 - RNA, 15 nt, Human
gugaccacugcagaa

SEQ ID NO: 1808190 - RNA, 22 nt, Human
gucaaucuguccguucacaugu

SEQ ID NO: 1808191 - RNA, 13 nt, Human
cacuggccaccca

SEQ ID NO: 1808192 - RNA, 15 nt, Human
auaagacacccccuc

SEQ ID NO: 1808193 - RNA, 14 nt, Human
accccaggacgccc

SEQ ID NO: 1808194 - RNA, 18 nt, Human
cugggcugugggcaagcc

SEQ ID NO: 1808195 - RNA, 15 nt, Human
aaauaguugcuguca

SEQ ID NO: 1808196 - RNA, 20 nt, Human
uguaaaggaauuuaaaaauc

SEQ ID NO: 1808197 - RNA, 14 nt, Human
cuggugcuauuuug

SEQ ID NO: 1808198 - RNA, 16 nt, Human
aggcagaccugacucu

SEQ ID NO: 1808199 - RNA, 13 nt, Human
gagagagcuggag

SEQ ID NO: 1808200 - RNA, 16 nt, Human
caaguaaaaggaaaug

SEQ ID NO: 1808201 - RNA, 20 nt, Human
gcauaaauuauuguuuuucu

SEQ ID NO: 1808202 - RNA, 24 nt, Human
gcucagugggggcagagccaccug

SEQ ID NO: 1808203 - RNA, 13 nt, Human
cucuccccuucuc

SEQ ID NO: 1808204 - RNA, 16 nt, Human
uauguucuaagaagug

SEQ ID NO: 1808205 - RNA, 14 nt, Human
ccccagccugcucc

SEQ ID NO: 1808206 - RNA, 14 nt, Human
ucuuuuauuuugcc

SEQ ID NO: 1808207 - RNA, 18 nt, Human
aucacugcucacacugcu

SEQ ID NO: 1808208 - RNA, 23 nt, Human
ucuaccaaaaaucucaauauuuc

SEQ ID NO: 1808209 - RNA, 22 nt, Human
uccucuccaccaucgucuucuu

SEQ ID NO: 1808210 - RNA, 13 nt, Human
ggggugggaaaga

SEQ ID NO: 1808211 - RNA, 18 nt, Human
uaauuuuuguauuuuuag

SEQ ID NO: 1808212 - RNA, 18 nt, Human
aaaaaaggaauccucugu

SEQ ID NO: 1808213 - RNA, 23 nt, Human
aaauucucacagaagaaggaaau

SEQ ID NO: 1808214 - RNA, 15 nt, Human
aaaugccuuuguacu

SEQ ID NO: 1808215 - RNA, 17 nt, Human
uguucuaagaagugaaa

SEQ ID NO: 1808216 - RNA, 17 nt, Human
cagacucuaagaaagaa

SEQ ID NO: 1808217 - RNA, 20 nt, Human
uguugggguggguauaaaag

SEQ ID NO: 1808218 - RNA, 16 nt, Human
guugagguaccuccaa

SEQ ID NO: 1808219 - RNA, 21 nt, Human
cuuugacaaagguaaaucaga

SEQ ID NO: 1808220 - RNA, 20 nt, Human
gggguaccuaguccccagcc

SEQ ID NO: 1808221 - RNA, 20 nt, Human
uccucuugccaaaucaaaag

SEQ ID NO: 1808222 - RNA, 21 nt, Human
cauguuucuuuguaaugaaaa

SEQ ID NO: 1808223 - RNA, 22 nt, Human
uauuuugccaagggcauaaauu

SEQ ID NO: 1808224 - RNA, 17 nt, Human
uacugucuuuuuucuaa

SEQ ID NO: 1808225 - RNA, 20 nt, Human
uagauucuaauggcuuuauu

SEQ ID NO: 1808226 - RNA, 20 nt, Human
accucuccaaagcccucccu

SEQ ID NO: 1808227 - RNA, 13 nt, Human
auucuaugagaua

SEQ ID NO: 1808228 - RNA, 17 nt, Human
gucucagcuucacccug

SEQ ID NO: 1808229 - RNA, 15 nt, Human
ucuccugccucagcc

SEQ ID NO: 1808230 - RNA, 22 nt, Human
aagccauggguagccugggugu

SEQ ID NO: 1808231 - RNA, 17 nt, Human
aaaaagcgcuaauuucu

SEQ ID NO: 1808232 - RNA, 17 nt, Human
auugugcuggaaaugga

SEQ ID NO: 1808233 - RNA, 14 nt, Human
acccgggaggcaga

SEQ ID NO: 1808234 - RNA, 18 nt, Human
uccuggaggggcugggga

SEQ ID NO: 1808235 - RNA, 21 nt, Human
uuuagcaaagauaucucaucu

SEQ ID NO: 1808236 - RNA, 15 nt, Human
auagaaguaaaaaca

SEQ ID NO: 1808237 - RNA, 22 nt, Human
uuuccaagcaaguauuagaaua

SEQ ID NO: 1808238 - RNA, 19 nt, Human
gcuaauuuugaaaaacugc

SEQ ID NO: 1808239 - RNA, 17 nt, Human
uccauuuuuuucuaaua

SEQ ID NO: 1808240 - RNA, 14 nt, Human
aaaggaauuuaaaa

SEQ ID NO: 1808241 - RNA, 21 nt, Human
aagacucgggauuaguacaca

SEQ ID NO: 1808242 - RNA, 14 nt, Human
caugcacuuggcug

SEQ ID NO: 1808243 - RNA, 22 nt, Human
cuucccaaguugugcuugagcc

SEQ ID NO: 1808244 - RNA, 18 nt, Human
cugggguguguggcagag

SEQ ID NO: 1808245 - RNA, 23 nt, Human
cuccaccagguucuuucuuuaaa

SEQ ID NO: 1808246 - RNA, 12 nt, Human
gcugauaaacug

SEQ ID NO: 1808247 - RNA, 15 nt, Human
uuguagaaaagcuau

SEQ ID NO: 1808248 - RNA, 16 nt, Human
caugcauuguccucuu

SEQ ID NO: 1808249 - RNA, 18 nt, Human
acaaaaggauaaugaaua

SEQ ID NO: 1808250 - RNA, 22 nt, Human
uagggugcugcgcagcaucccu

SEQ ID NO: 1808251 - RNA, 13 nt, Human
cuaggcauagccc

SEQ ID NO: 1808252 - RNA, 19 nt, Human
aaauaugccccauucaaca

SEQ ID NO: 1808253 - RNA, 22 nt, Human
cuuucucaucuuguccccaaca

SEQ ID NO: 1808254 - RNA, 14 nt, Human
uugugcuucuuucu

SEQ ID NO: 1808255 - RNA, 23 nt, Human
ggucucccuucucuacacucuug

SEQ ID NO: 1808256 - RNA, 21 nt, Human
cagaugucgcccuacucaccu

SEQ ID NO: 1808257 - RNA, 13 nt, Human
uaacaauaaaaga

SEQ ID NO: 1808258 - RNA, 16 nt, Human
ccaccugcugagcccc

SEQ ID NO: 1808259 - RNA, 14 nt, Human
cugccagcuggccu

SEQ ID NO: 1808260 - RNA, 24 nt, Human
ugaaggaugcugucuucguacugg

SEQ ID NO: 1808261 - RNA, 12 nt, Human
augguuguauua

SEQ ID NO: 1808262 - RNA, 10 nt, Human
cuaacaccca

SEQ ID NO: 1808263 - RNA, 20 nt, Human
uuucuucaacucccugcccc

SEQ ID NO: 1808264 - RNA, 15 nt, Human
aaaaauaacaaugaa

SEQ ID NO: 1808265 - RNA, 14 nt, Human
acucugucuaccug

SEQ ID NO: 1808266 - RNA, 14 nt, Human
uuaaaaguuuuuua

SEQ ID NO: 1808267 - RNA, 20 nt, Human
ucugguagcuaaauauauau

SEQ ID NO: 1808268 - RNA, 20 nt, Human
ugaggcuccacuuggucugu

SEQ ID NO: 1808269 - RNA, 19 nt, Human
gaggcagagguugcaguga

SEQ ID NO: 1808270 - RNA, 23 nt, Human
auugcuguccuggaggggcuggg

SEQ ID NO: 1808271 - RNA, 21 nt, Human
ccuuccccucugcagcuucca

SEQ ID NO: 1808272 - RNA, 14 nt, Human
ucucaucucuucuu

SEQ ID NO: 1808273 - RNA, 15 nt, Human
gaccacugcagaaga

SEQ ID NO: 1808274 - RNA, 17 nt, Human
aauaaauaccaaaaaau

SEQ ID NO: 1808275 - RNA, 17 nt, Human
gacacagacauccucua

SEQ ID NO: 1808276 - RNA, 19 nt, Human
cucuugaggcacagaaacu

SEQ ID NO: 1808277 - RNA, 17 nt, Human
gccaucaccuuagacca

SEQ ID NO: 1808278 - RNA, 19 nt, Human
cacauaucgauuuuuaaaa

SEQ ID NO: 1808279 - RNA, 14 nt, Human
acaccaucucccau

SEQ ID NO: 1808280 - RNA, 14 nt, Human
aagcaaugugguag

SEQ ID NO: 1808281 - RNA, 16 nt, Human
caagcaguuauuugau

SEQ ID NO: 1808282 - RNA, 20 nt, Human
gcccauccugccccugagcc

SEQ ID NO: 1808283 - RNA, 15 nt, Human
cagcuuuuuaccaag

SEQ ID NO: 1808284 - RNA, 13 nt, Human
gaaccuaggguga

SEQ ID NO: 1808285 - RNA, 15 nt, Human
guccugaccugucuc

SEQ ID NO: 1808286 - RNA, 15 nt, Human
ccacaggcacagguc

SEQ ID NO: 1808287 - RNA, 21 nt, Human
cuucuauugccucugagagca

SEQ ID NO: 1808288 - RNA, 16 nt, Human
agcuaaauauauauuu

SEQ ID NO: 1808289 - RNA, 19 nt, Human
augccaucucaaccucuuc

SEQ ID NO: 1808290 - RNA, 13 nt, Human
uccuauguuucac

SEQ ID NO: 1808291 - RNA, 18 nt, Human
guucaaguccugccucuu

SEQ ID NO: 1808292 - RNA, 15 nt, Human
uacccucauuucuca

SEQ ID NO: 1808293 - RNA, 13 nt, Human
gcaccaggacgcc

SEQ ID NO: 1808294 - RNA, 11 nt, Human
aaacucagagg

SEQ ID NO: 1808295 - RNA, 21 nt, Human
gccugcucccuagccagaggc

SEQ ID NO: 1808296 - RNA, 15 nt, Human
uuuaacguuuucauu

SEQ ID NO: 1808297 - RNA, 22 nt, Human
aauugccugacgaacuccuuga

SEQ ID NO: 1808298 - RNA, 16 nt, Human
cacuacaaccuccgcc

SEQ ID NO: 1808299 - RNA, 15 nt, Human
gacugcuccagaguu

SEQ ID NO: 1808300 - RNA, 14 nt, Human
cugggaggcucugg

SEQ ID NO: 1808301 - RNA, 16 nt, Human
uguauuacaaauauuu

SEQ ID NO: 1808302 - RNA, 15 nt, Human
aggucucaauaccug

SEQ ID NO: 1808303 - RNA, 19 nt, Human
guggauuuaauguggaaau

SEQ ID NO: 1808304 - RNA, 15 nt, Human
uggguaucaccacug

SEQ ID NO: 1808305 - RNA, 12 nt, Human
uuucccuucuuu

SEQ ID NO: 1808306 - RNA, 12 nt, Human
gccccaucagcu

SEQ ID NO: 1808307 - RNA, 15 nt, Human
gcagagguugcagug

SEQ ID NO: 1808308 - RNA, 23 nt, Human
gaacaaaguuuaccagaaagcag

SEQ ID NO: 1808309 - RNA, 14 nt, Human
cugcuugaacuagg

SEQ ID NO: 1808310 - RNA, 18 nt, Human
ccucagagacauacaccu

SEQ ID NO: 1808311 - RNA, 19 nt, Human
aaaaucuuauaauuuaaaa

SEQ ID NO: 1808312 - RNA, 22 nt, Human
aacuacugaggaucagaguaau

SEQ ID NO: 1808313 - RNA, 13 nt, Human
cuccuguuaauau

SEQ ID NO: 1808314 - RNA, 13 nt, Human
uccauccuaccac

SEQ ID NO: 1808315 - RNA, 12 nt, Human
guugauggaaau

SEQ ID NO: 1808316 - RNA, 23 nt, Human
acuuaaggauggagccagcucug

SEQ ID NO: 1808317 - RNA, 21 nt, Human
gccuuuucccaacuccagaaa

SEQ ID NO: 1808318 - RNA, 22 nt, Human
aaaucaggguuaguauugucca

SEQ ID NO: 1808319 - RNA, 13 nt, Human
guuuucccaucuc

SEQ ID NO: 1808320 - RNA, 15 nt, Human
cucugucuaccuggu

SEQ ID NO: 1808321 - RNA, 18 nt, Human
agucuguuuucccuccuu

SEQ ID NO: 1808322 - RNA, 21 nt, Human
aaagacuuuuaugauacuuga

SEQ ID NO: 1808323 - RNA, 17 nt, Human
auuagcauggccacauc

SEQ ID NO: 1808324 - RNA, 15 nt, Human
ugcuucuccagccuc

SEQ ID NO: 1808325 - RNA, 14 nt, Human
guacuuuagggaag

SEQ ID NO: 1808326 - RNA, 15 nt, Human
agacaaaacuagaga

SEQ ID NO: 1808327 - RNA, 14 nt, Human
ucaccauguuggcc

SEQ ID NO: 1808328 - RNA, 16 nt, Human
cucagcccuggugggc

SEQ ID NO: 1808329 - RNA, 19 nt, Human
caaucuguccguucacaug

SEQ ID NO: 1808330 - RNA, 14 nt, Human
ggcuggagucugca

SEQ ID NO: 1808331 - RNA, 18 nt, Human
accucugccucccagguu

SEQ ID NO: 1808332 - RNA, 19 nt, Human
auuguucucuaauauguaa

SEQ ID NO: 1808333 - RNA, 13 nt, Human
uuuuggcauuuua

SEQ ID NO: 1808334 - RNA, 16 nt, Human
guacagacagaaaaaa

SEQ ID NO: 1808335 - RNA, 17 nt, Human
guacccaguagaugcca

SEQ ID NO: 1808336 - RNA, 19 nt, Human
aaacaauaacgauaaaaga

SEQ ID NO: 1808337 - RNA, 22 nt, Human
gcauaauacuugcuuuggaaaa

SEQ ID NO: 1808338 - RNA, 17 nt, Human
ucauacuucuuaggguu

SEQ ID NO: 1808339 - RNA, 22 nt, Human
caugaaccucaagcugcaucua

SEQ ID NO: 1808340 - RNA, 15 nt, Human
cgagacaagcagccc

SEQ ID NO: 1808341 - RNA, 16 nt, Human
cagaagcaacccaaau

SEQ ID NO: 1808342 - RNA, 19 nt, Human
uuccucccuucucuucaca

SEQ ID NO: 1808343 - RNA, 21 nt, Human
uuccuccacaccauucagguc

SEQ ID NO: 1808344 - RNA, 17 nt, Human
aauaaaggaaacccagc

SEQ ID NO: 1808345 - RNA, 14 nt, Human
acuuugauuuuaua

SEQ ID NO: 1808346 - RNA, 16 nt, Human
uggggauagugaggca

SEQ ID NO: 1808347 - RNA, 18 nt, Human
uggagggaagccuugggg

SEQ ID NO: 1808348 - RNA, 17 nt, Human
gcccagcggcaucaggc

SEQ ID NO: 1808349 - RNA, 19 nt, Human
ccuucugagccugccuuuc

SEQ ID NO: 1808350 - RNA, 21 nt, Human
gccucgaggagguaaugaauu

SEQ ID NO: 1808351 - RNA, 14 nt, Human
uguguguuuuaaaa

SEQ ID NO: 1808352 - RNA, 23 nt, Human
caguucccucuugcucagugggg

SEQ ID NO: 1808353 - RNA, 14 nt, Human
gacuacuagggaaa

SEQ ID NO: 1808354 - RNA, 20 nt, Human
accucauggaauuggagcuc

SEQ ID NO: 1808355 - RNA, 14 nt, Human
uucuccauacucug

SEQ ID NO: 1808356 - RNA, 17 nt, Human
ugaccacugcagaagac

SEQ ID NO: 1808357 - RNA, 12 nt, Human
aauuuaaaccua

SEQ ID NO: 1808358 - RNA, 19 nt, Human
cuuggccaugggaggccuu

SEQ ID NO: 1808359 - RNA, 16 nt, Human
cggccacggugccucc

SEQ ID NO: 1808360 - RNA, 16 nt, Human
uaaaaaugcauauacu

SEQ ID NO: 1808361 - RNA, 14 nt, Human
guuucacugugcaa

SEQ ID NO: 1808362 - RNA, 13 nt, Human
acaaggaaaaaau

SEQ ID NO: 1808363 - RNA, 18 nt, Human
auuaaguuuuuuuuuaaa

SEQ ID NO: 1808364 - RNA, 14 nt, Human
ccuccuuuuuccuu

SEQ ID NO: 1808365 - RNA, 14 nt, Human
auauaucaaauaua

SEQ ID NO: 1808366 - RNA, 22 nt, Human
uaauaucuuaucuuccuauaau

SEQ ID NO: 1808367 - RNA, 21 nt, Human
auaguuguaccgcaaugugac

SEQ ID NO: 1808368 - RNA, 20 nt, Human
gcaucucacagguagacagu

SEQ ID NO: 1808369 - RNA, 14 nt, Human
cagcccuuuugucu

SEQ ID NO: 1808370 - RNA, 21 nt, Human
uccaggagaccuacccuccac

SEQ ID NO: 1808371 - RNA, 16 nt, Human
ucugaagcucaacucu

SEQ ID NO: 1808372 - RNA, 16 nt, Human
cgcaugcggcccagga

SEQ ID NO: 1808373 - RNA, 20 nt, Human
uaacuggagccccaucagcu

SEQ ID NO: 1808374 - RNA, 16 nt, Human
gccuaagugcagcccc

SEQ ID NO: 1808375 - RNA, 15 nt, Human
cagacacaaauaaag

SEQ ID NO: 1808376 - RNA, 18 nt, Human
gauuacauuuuaaacaca

SEQ ID NO: 1808377 - RNA, 18 nt, Human
auguuccuaauaaagcuu

SEQ ID NO: 1808378 - RNA, 22 nt, Human
cuaguccccagccugcucccua

SEQ ID NO: 1808379 - RNA, 14 nt, Human
aguuuuuuuuuaaa

SEQ ID NO: 1808380 - RNA, 23 nt, Human
cucugcacacccuccagagacaa

SEQ ID NO: 1808381 - RNA, 15 nt, Human
cuagccugccucccc

SEQ ID NO: 1808382 - RNA, 13 nt, Human
cuaggaauugugu

SEQ ID NO: 1808383 - RNA, 14 nt, Human
uuuaaauauuuuuu

SEQ ID NO: 1808384 - RNA, 21 nt, Human
gcauggccacaucugagcccc

SEQ ID NO: 1808385 - RNA, 23 nt, Human
gaugggagugcccccaacagcac

SEQ ID NO: 1808386 - RNA, 14 nt, Human
ugucuccucucucu

SEQ ID NO: 1808387 - RNA, 16 nt, Human
ugaacuucuccccugg

SEQ ID NO: 1808388 - RNA, 15 nt, Human
auuuauuuuuccauu

SEQ ID NO: 1808389 - RNA, 19 nt, Human
caaagugucuugaauugua

SEQ ID NO: 1808390 - RNA, 18 nt, Human
uaaguuuuuuuuuaaaaa

SEQ ID NO: 1808391 - RNA, 21 nt, Human
gggaucacugaugacuuuuua

SEQ ID NO: 1808392 - RNA, 16 nt, Human
augugaaauuuacauc

SEQ ID NO: 1808393 - RNA, 22 nt, Human
uguggguaguggggaagagggu

SEQ ID NO: 1808394 - RNA, 14 nt, Human
gauucacccugucc

SEQ ID NO: 1808395 - RNA, 14 nt, Human
cgauucuccugccu

SEQ ID NO: 1808396 - RNA, 17 nt, Human
agacaggguuucaccau

SEQ ID NO: 1808397 - RNA, 11 nt, Human
aggauggagcc

SEQ ID NO: 1808398 - RNA, 20 nt, Human
uuuuaguugcaacuuuguau

SEQ ID NO: 1808399 - RNA, 18 nt, Human
aucaugcugagagagcug

SEQ ID NO: 1808400 - RNA, 14 nt, Human
guaucuuuuuauuc

SEQ ID NO: 1808401 - RNA, 15 nt, Human
ccccugagcuugcag

SEQ ID NO: 1808402 - RNA, 18 nt, Human
ggaaagacagcuucucau

SEQ ID NO: 1808403 - RNA, 20 nt, Human
aggaugagggaaaagaaaaa

SEQ ID NO: 1808404 - RNA, 11 nt, Human
uacaccccaac

SEQ ID NO: 1808405 - RNA, 20 nt, Human
uccagagggaauugcagagu

SEQ ID NO: 1808406 - RNA, 12 nt, Human
uaccuuccccac

SEQ ID NO: 1808407 - RNA, 16 nt, Human
cuuuacuuuccccuug

SEQ ID NO: 1808408 - RNA, 15 nt, Human
cagccagcacagccu

SEQ ID NO: 1808409 - RNA, 20 nt, Human
cugcaggcuccccuccucgg

SEQ ID NO: 1808410 - RNA, 22 nt, Human
auaauguaagacaaauauguuc

SEQ ID NO: 1808411 - RNA, 16 nt, Human
ugugcucaggagcccu

SEQ ID NO: 1808412 - RNA, 18 nt, Human
ucuaugaaauauuauguu

SEQ ID NO: 1808413 - RNA, 20 nt, Human
uaugcuucuguuuuauaauu

SEQ ID NO: 1808414 - RNA, 18 nt, Human
gggcccaguaccuagcug

SEQ ID NO: 1808415 - RNA, 15 nt, Human
acugauuacugccua

SEQ ID NO: 1808416 - RNA, 21 nt, Human
acauuccucugcccuuccugc

SEQ ID NO: 1808417 - RNA, 19 nt, Human
ccuggcugcugcugugcag

SEQ ID NO: 1808418 - RNA, 17 nt, Human
auuguuauauaaucauu

SEQ ID NO: 1808419 - RNA, 23 nt, Human
uacaaacauguuccugggaucac

SEQ ID NO: 1808420 - RNA, 15 nt, Human
uauguuuaacguuuu

SEQ ID NO: 1808421 - RNA, 12 nt, Human
cagacagaugga

SEQ ID NO: 1808422 - RNA, 17 nt, Human
cucuuggcacagcaugg

SEQ ID NO: 1808423 - RNA, 13 nt, Human
auuggacaguaaa

SEQ ID NO: 1808424 - RNA, 23 nt, Human
aggcuaccccuuuacaaauagaa

SEQ ID NO: 1808425 - RNA, 20 nt, Human
uaucauuuaguuauaaaaau

SEQ ID NO: 1808426 - RNA, 13 nt, Human
uuucuaaaaguuu

SEQ ID NO: 1808427 - RNA, 17 nt, Human
uuaauauguuauuauua

SEQ ID NO: 1808428 - RNA, 23 nt, Human
guggcuuucagagccuccuuucu

SEQ ID NO: 1808429 - RNA, 14 nt, Human
cagaaagaaaacuu

SEQ ID NO: 1808430 - RNA, 17 nt, Human
ccuggaacugucucuca

SEQ ID NO: 1808431 - RNA, 21 nt, Human
agugcccccaacagcacccuc

SEQ ID NO: 1808432 - RNA, 21 nt, Human
ugagccagugucaggaggaag

SEQ ID NO: 1808433 - RNA, 15 nt, Human
aagcagaagagaaaa

SEQ ID NO: 1808434 - RNA, 13 nt, Human
aacccuuucugcc

SEQ ID NO: 1808435 - RNA, 15 nt, Human
agaucacagcuucag

SEQ ID NO: 1808436 - RNA, 19 nt, Human
aauuuuuggccaugaggaa

SEQ ID NO: 1808437 - RNA, 15 nt, Human
ucuaccacccaccag

SEQ ID NO: 1808438 - RNA, 17 nt, Human
ugcucucggugcuucca

SEQ ID NO: 1808439 - RNA, 21 nt, Human
aggcaugagucagucugauga

SEQ ID NO: 1808440 - RNA, 22 nt, Human
ccaaaucaaaagacuuuuuccu

SEQ ID NO: 1808441 - RNA, 22 nt, Human
cuuguaaaggaauuuaaaaauc

SEQ ID NO: 1808442 - RNA, 12 nt, Human
auaagcuuuucu

SEQ ID NO: 1808443 - RNA, 16 nt, Human
auuugcaaaguuuaau

SEQ ID NO: 1808444 - RNA, 14 nt, Human
ugggacccugucuc

SEQ ID NO: 1808445 - RNA, 20 nt, Human
uuaaugccacuaaauugaca

SEQ ID NO: 1808446 - RNA, 13 nt, Human
gcacugugggacu

SEQ ID NO: 1808447 - RNA, 17 nt, Human
ugaugguuguacauaua

SEQ ID NO: 1808448 - RNA, 22 nt, Human
uccaugaguugcaguuuuuucc

SEQ ID NO: 1808449 - RNA, 22 nt, Human
cagucccugcagcucucuuucc

SEQ ID NO: 1808450 - RNA, 18 nt, Human
acaaccaaagacuacaua

SEQ ID NO: 1808451 - RNA, 14 nt, Human
gcuaauuuugaaaa

SEQ ID NO: 1808452 - RNA, 16 nt, Human
auuauuguuuuucuuu

SEQ ID NO: 1808453 - RNA, 17 nt, Human
uauauuuccaagaaaua

SEQ ID NO: 1808454 - RNA, 18 nt, Human
acuccugaccucaaguga

SEQ ID NO: 1808455 - RNA, 14 nt, Human
uaauaucuuaucuu

SEQ ID NO: 1808456 - RNA, 16 nt, Human
acaugugcuggccacc

SEQ ID NO: 1808457 - RNA, 14 nt, Human
ccaggagcugggca

SEQ ID NO: 1808458 - RNA, 14 nt, Human
agacaucaacagau

SEQ ID NO: 1808459 - RNA, 15 nt, Human
aucucacauuuuccc

SEQ ID NO: 1808460 - RNA, 15 nt, Human
acucauaauucuuca

SEQ ID NO: 1808461 - RNA, 12 nt, Human
cuuuaucuuuuu

SEQ ID NO: 1808462 - RNA, 16 nt, Human
ucucuguucauuuccu

SEQ ID NO: 1808463 - RNA, 12 nt, Human
cccgccucagcc

SEQ ID NO: 1808464 - RNA, 21 nt, Human
ugauggucccuauuccuccuu

SEQ ID NO: 1808465 - RNA, 22 nt, Human
aauaauuuuucacuucaaaaca

SEQ ID NO: 1808466 - RNA, 17 nt, Human
uacugaggaucagagua

SEQ ID NO: 1808467 - RNA, 12 nt, Human
agaauauauuuc

SEQ ID NO: 1808468 - RNA, 20 nt, Human
guagacgugcacgcacacug

SEQ ID NO: 1808469 - RNA, 22 nt, Human
cuuguauuauguguguuuuaaa

SEQ ID NO: 1808470 - RNA, 16 nt, Human
cuccccuccucggcuu

SEQ ID NO: 1808471 - RNA, 21 nt, Human
cuucuuccaacguggcccaga

SEQ ID NO: 1808472 - RNA, 15 nt, Human
uuagccaagugcagg

SEQ ID NO: 1808473 - RNA, 19 nt, Human
cacugaugacuuuuuauac

SEQ ID NO: 1808474 - RNA, 18 nt, Human
gccaggcuggagugcagu

SEQ ID NO: 1808475 - RNA, 13 nt, Human
aggcuaccccuuu

SEQ ID NO: 1808476 - RNA, 17 nt, Human
acuccugcuagaacagu

SEQ ID NO: 1808477 - RNA, 17 nt, Human
augaaggcuguacacug

SEQ ID NO: 1808478 - RNA, 24 nt, Human
aagccagcugcccccagagccaca

SEQ ID NO: 1808479 - RNA, 21 nt, Human
cuagcaugaagacagagcccc

SEQ ID NO: 1808480 - RNA, 16 nt, Human
uaaucaauguucauca

SEQ ID NO: 1808481 - RNA, 15 nt, Human
gaaauuaacucagac

SEQ ID NO: 1808482 - RNA, 21 nt, Human
aggcuuuuuuaucaugugaaa

SEQ ID NO: 1808483 - RNA, 20 nt, Human
cccaaaggcuuugcccugcu

SEQ ID NO: 1808484 - RNA, 23 nt, Human
aaaccacauuggagauguuuagu

SEQ ID NO: 1808485 - RNA, 18 nt, Human
ucacucaaauuguucucu

SEQ ID NO: 1808486 - RNA, 22 nt, Human
auccacuuuaucuugaauaaug

SEQ ID NO: 1808487 - RNA, 15 nt, Human
auaaucauuauuacu

SEQ ID NO: 1808488 - RNA, 21 nt, Human
ccuucucuguucauuuccuca

SEQ ID NO: 1808489 - RNA, 12 nt, Human
ccuaguccccag

SEQ ID NO: 1808490 - RNA, 19 nt, Human
gaggguuucauugucugug

SEQ ID NO: 1808491 - RNA, 14 nt, Human
ugcuucuguuuuau

SEQ ID NO: 1808492 - RNA, 17 nt, Human
ccuuugcugacccuccc

SEQ ID NO: 1808493 - RNA, 18 nt, Human
cgauucuccugccucagc

SEQ ID NO: 1808494 - RNA, 21 nt, Human
ucuccagccucagccucccaa

SEQ ID NO: 1808495 - RNA, 18 nt, Human
agaagcaacccaaauguu

SEQ ID NO: 1808496 - RNA, 22 nt, Human
agcuggaccucaccaagcugcu

SEQ ID NO: 1808497 - RNA, 17 nt, Human
aaggauaaaguugguaa

SEQ ID NO: 1808498 - RNA, 22 nt, Human
cuauucuccauacucuguaaca

SEQ ID NO: 1808499 - RNA, 15 nt, Human
gaaaugaaagcaggg

SEQ ID NO: 1808500 - RNA, 12 nt, Human
caaugaaaagga

SEQ ID NO: 1808501 - RNA, 12 nt, Human
aauacuuuauaa

SEQ ID NO: 1808502 - RNA, 22 nt, Human
caugaguaacugauuuguaaca

SEQ ID NO: 1808503 - RNA, 15 nt, Human
aaaaauaaaaaagau

SEQ ID NO: 1808504 - RNA, 15 nt, Human
aaggguacacugccu

SEQ ID NO: 1808505 - RNA, 21 nt, Human
gacaauuguuggagagccccu

SEQ ID NO: 1808506 - RNA, 19 nt, Human
gccuugcugaacucccucu

SEQ ID NO: 1808507 - RNA, 15 nt, Human
acucugagcagugcu

SEQ ID NO: 1808508 - RNA, 14 nt, Human
uauuuuaaauauuu

SEQ ID NO: 1808509 - RNA, 16 nt, Human
aacagcacccucucca

SEQ ID NO: 1808510 - RNA, 12 nt, Human
augcacaugagc

SEQ ID NO: 1808511 - RNA, 21 nt, Human
agccuacaggccucacacaca

SEQ ID NO: 1808512 - RNA, 15 nt, Human
acuuuuauaagaaau

SEQ ID NO: 1808513 - RNA, 14 nt, Human
gugcuucuccagcc

SEQ ID NO: 1808514 - RNA, 20 nt, Human
ugaguauauugauccagaaa

SEQ ID NO: 1808515 - RNA, 15 nt, Human
gccuggcuucaaauu

SEQ ID NO: 1808516 - RNA, 13 nt, Human
ggagcucaggaag

SEQ ID NO: 1808517 - RNA, 14 nt, Human
uauuugaaauauug

SEQ ID NO: 1808518 - RNA, 18 nt, Human
cuauaauguaaacaauau

SEQ ID NO: 1808519 - RNA, 22 nt, Human
acuuacaugcauuacugcaugc

SEQ ID NO: 1808520 - RNA, 17 nt, Human
ugcauuuaugagcucuu

SEQ ID NO: 1808521 - RNA, 23 nt, Human
ucuaauuggcaugaaggugucau

SEQ ID NO: 1808522 - RNA, 14 nt, Human
agaaggaaauugaa

SEQ ID NO: 1808523 - RNA, 23 nt, Human
uuaugaagcuuuuaugugaaaca

SEQ ID NO: 1808524 - RNA, 13 nt, Human
ugucuauucuagu

SEQ ID NO: 1808525 - RNA, 15 nt, Human
ugcucccuagccaga

SEQ ID NO: 1808526 - RNA, 19 nt, Human
cuucacccugaggugagca

SEQ ID NO: 1808527 - RNA, 12 nt, Human
gcuauucuccau

SEQ ID NO: 1808528 - RNA, 13 nt, Human
aggcauagcccug

SEQ ID NO: 1808529 - RNA, 13 nt, Human
uccccaaaugcuu

SEQ ID NO: 1808530 - RNA, 15 nt, Human
acuuguuuuggaugc

SEQ ID NO: 1808531 - RNA, 14 nt, Human
acuucuauuuuuau

SEQ ID NO: 1808532 - RNA, 23 nt, Human
agccccaaguggaacgagacaag

SEQ ID NO: 1808533 - RNA, 20 nt, Human
cuuccccucugcagcuucca

SEQ ID NO: 1808534 - RNA, 18 nt, Human
gaaaugaaagcagggacu

SEQ ID NO: 1808535 - RNA, 16 nt, Human
cuaguuuauauagaaa

SEQ ID NO: 1808536 - RNA, 12 nt, Human
acuagcccuccu

SEQ ID NO: 1808537 - RNA, 18 nt, Human
ucuccaaagcccucccua

SEQ ID NO: 1808538 - RNA, 14 nt, Human
acucagagaaacaa

SEQ ID NO: 1808539 - RNA, 15 nt, Human
uaucgauuuuuaaaa

SEQ ID NO: 1808540 - RNA, 14 nt, Human
auccagaaagaaaa

SEQ ID NO: 1808541 - RNA, 21 nt, Human
gagccaaucaguagccagcau

SEQ ID NO: 1808542 - RNA, 19 nt, Human
ucaguccaugaagauguag

SEQ ID NO: 1808543 - RNA, 23 nt, Human
acuggcuaauuagcauggccaca

SEQ ID NO: 1808544 - RNA, 18 nt, Human
uaugucauuucauuuccu

SEQ ID NO: 1808545 - RNA, 22 nt, Human
auccuuaucgaaacucauuuua

SEQ ID NO: 1808546 - RNA, 19 nt, Human
auuuucuauaauuuaaaua

SEQ ID NO: 1808547 - RNA, 23 nt, Human
cuaguaauuggaaaggcagcucu

SEQ ID NO: 1808548 - RNA, 19 nt, Human
aacucaauaaguuuauuuc

SEQ ID NO: 1808549 - RNA, 16 nt, Human
cuuauuucaugaaaau

SEQ ID NO: 1808550 - RNA, 13 nt, Human
acauuccucugcc

SEQ ID NO: 1808551 - RNA, 15 nt, Human
cucuacaaaaaaaaa

SEQ ID NO: 1808552 - RNA, 16 nt, Human
gaauaauguaagacaa

SEQ ID NO: 1808553 - RNA, 23 nt, Human
ucauuuuuucuucuccuaaaacu

SEQ ID NO: 1808554 - RNA, 18 nt, Human
gaauuuccuuacucuuga

SEQ ID NO: 1808555 - RNA, 18 nt, Human
uuaguaaucauauuguua

SEQ ID NO: 1808556 - RNA, 14 nt, Human
caugcugauaaacu

SEQ ID NO: 1808557 - RNA, 17 nt, Human
cucagaggcagugacag

SEQ ID NO: 1808558 - RNA, 20 nt, Human
uaaucccagcaugcugagau

SEQ ID NO: 1808559 - RNA, 17 nt, Human
agaugcacaugagcugg

SEQ ID NO: 1808560 - RNA, 15 nt, Human
augcccauaccccug

SEQ ID NO: 1808561 - RNA, 13 nt, Human
uuccuuauauuua

SEQ ID NO: 1808562 - RNA, 17 nt, Human
uauaaugucccuucaca

SEQ ID NO: 1808563 - RNA, 16 nt, Human
augucauuucauuucc

SEQ ID NO: 1808564 - RNA, 13 nt, Human
uuggacgagaaaa

SEQ ID NO: 1808565 - RNA, 19 nt, Human
cccacuggacucaccuccc

SEQ ID NO: 1808566 - RNA, 23 nt, Human
uaacuaaaguuagaaaguugauu

SEQ ID NO: 1808567 - RNA, 24 nt, Human
ggaguacaccccaacagcacccuc

SEQ ID NO: 1808568 - RNA, 22 nt, Human
aagcugcauuucagaaaugcug

SEQ ID NO: 1808569 - RNA, 16 nt, Human
ugcagcucucuuuccu

SEQ ID NO: 1808570 - RNA, 11 nt, Human
ucuagcaugaa

SEQ ID NO: 1808571 - RNA, 19 nt, Human
gagguccuuaggccucuga

SEQ ID NO: 1808572 - RNA, 13 nt, Human
uuuuauaugcuau

SEQ ID NO: 1808573 - RNA, 19 nt, Human
agcuaccugcucagcccug

SEQ ID NO: 1808574 - RNA, 15 nt, Human
gauaaugugauauua

SEQ ID NO: 1808575 - RNA, 14 nt, Human
cauaagauuuaaau

SEQ ID NO: 1808576 - RNA, 15 nt, Human
gugccgccuccuugu

SEQ ID NO: 1808577 - RNA, 16 nt, Human
caaacuccugaccuca

SEQ ID NO: 1808578 - RNA, 16 nt, Human
accuaaaauaaaauga

SEQ ID NO: 1808579 - RNA, 12 nt, Human
agcuaugaaggc

SEQ ID NO: 1808580 - RNA, 14 nt, Human
aacuucuauuuuua

SEQ ID NO: 1808581 - RNA, 20 nt, Human
aaguguguguuuuucauaaa

SEQ ID NO: 1808582 - RNA, 18 nt, Human
gcucaggagcccugggag

SEQ ID NO: 1808583 - RNA, 19 nt, Human
uuaauuaucuaguuuaauu

SEQ ID NO: 1808584 - RNA, 12 nt, Human
caugggaaguga

SEQ ID NO: 1808585 - RNA, 18 nt, Human
ccaacagcacccucucca

SEQ ID NO: 1808586 - RNA, 17 nt, Human
cagacagauggaaaagg

SEQ ID NO: 1808587 - RNA, 15 nt, Human
cucagggcuggucuu

SEQ ID NO: 1808588 - RNA, 15 nt, Human
gcacacugucugccc

SEQ ID NO: 1808589 - RNA, 12 nt, Human
cuacauuacuuc

SEQ ID NO: 1808590 - RNA, 14 nt, Human
aagauauuuuucau

SEQ ID NO: 1808591 - RNA, 21 nt, Human
gauuauuuucuacacauacau

SEQ ID NO: 1808592 - RNA, 15 nt, Human
aaggaugauaaaagc

SEQ ID NO: 1808593 - RNA, 11 nt, Human
gcagccugccu

SEQ ID NO: 1808594 - RNA, 21 nt, Human
aaaaaguucugcagauaaaca

SEQ ID NO: 1808595 - RNA, 13 nt, Human
caaccucugccuc

SEQ ID NO: 1808596 - RNA, 16 nt, Human
cugaguuccugcaugc

SEQ ID NO: 1808597 - RNA, 17 nt, Human
ggucccuauuccuccuu

SEQ ID NO: 1808598 - RNA, 15 nt, Human
caaauauuccagaga

SEQ ID NO: 1808599 - RNA, 22 nt, Human
acccaggaguauccucuugcca

SEQ ID NO: 1808600 - RNA, 16 nt, Human
auuuuuaguuuaaaaa

SEQ ID NO: 1808601 - RNA, 18 nt, Human
aauuuuauuauucuuauu

SEQ ID NO: 1808602 - RNA, 22 nt, Human
ggaaagggauuuucagcccuca

SEQ ID NO: 1808603 - RNA, 20 nt, Human
cucauaccuuccccacaucu

SEQ ID NO: 1808604 - RNA, 17 nt, Human
gaaauagugauuuccac

SEQ ID NO: 1808605 - RNA, 20 nt, Human
ugagagucugugacccacuu

SEQ ID NO: 1808606 - RNA, 21 nt, Human
uccaggugguaagcaccagga

SEQ ID NO: 1808607 - RNA, 16 nt, Human
uguugagguaccucca

SEQ ID NO: 1808608 - RNA, 21 nt, Human
ccauccugccccugagcccau

SEQ ID NO: 1808609 - RNA, 21 nt, Human
uuccuagucuguuuucccucc

SEQ ID NO: 1808610 - RNA, 15 nt, Human
gcccuguaacaggcu

SEQ ID NO: 1808611 - RNA, 16 nt, Human
ccuccagagacaacag

SEQ ID NO: 1808612 - RNA, 14 nt, Human
uuuauguaguuuuu

SEQ ID NO: 1808613 - RNA, 18 nt, Human
uuaacaccuuuaaagugu

SEQ ID NO: 1808614 - RNA, 18 nt, Human
uccuugcuuaagguaugg

SEQ ID NO: 1808615 - RNA, 21 nt, Human
ccaaggaugccccgucccccu

SEQ ID NO: 1808616 - RNA, 17 nt, Human
aagauuuaaauuauuuu

SEQ ID NO: 1808617 - RNA, 15 nt, Human
augauguacauguac

SEQ ID NO: 1808618 - RNA, 17 nt, Human
uguaaaggaauuuaaaa

SEQ ID NO: 1808619 - RNA, 21 nt, Human
cauugccuuaacuggagcccc

SEQ ID NO: 1808620 - RNA, 17 nt, Human
ccuagcuggcucuguga

SEQ ID NO: 1808621 - RNA, 11 nt, Human
ggucacaggaa

SEQ ID NO: 1808622 - RNA, 15 nt, Human
cccugcaccaugcug

SEQ ID NO: 1808623 - RNA, 23 nt, Human
guaauuugaaauauuuucuuugu

SEQ ID NO: 1808624 - RNA, 15 nt, Human
uucuguguuaaaaau

SEQ ID NO: 1808625 - RNA, 22 nt, Human
augagcuggcgggauugaagga

SEQ ID NO: 1808626 - RNA, 22 nt, Human
ucauacauuuucuaagaaacau

SEQ ID NO: 1808627 - RNA, 16 nt, Human
ucccuuauauuaauau

SEQ ID NO: 1808628 - RNA, 16 nt, Human
caaaaggauaaugaau

SEQ ID NO: 1808629 - RNA, 14 nt, Human
uuaauuuuugaaaa

SEQ ID NO: 1808630 - RNA, 18 nt, Human
aucuacacuccagugaga

SEQ ID NO: 1808631 - RNA, 20 nt, Human
uaagccuguuagcaugcugg

SEQ ID NO: 1808632 - RNA, 14 nt, Human
cuuauuauuuuuga

SEQ ID NO: 1808633 - RNA, 18 nt, Human
ugcuggggaagacagugg

SEQ ID NO: 1808634 - RNA, 22 nt, Human
caccaucgucuucuuggccaug

SEQ ID NO: 1808635 - RNA, 15 nt, Human
cuaaagcccagagac

SEQ ID NO: 1808636 - RNA, 16 nt, Human
gucacuacgccuggcu

SEQ ID NO: 1808637 - RNA, 14 nt, Human
auuucauuuccuau

SEQ ID NO: 1808638 - RNA, 18 nt, Human
cuaguccccagccugcuc

SEQ ID NO: 1808639 - RNA, 13 nt, Human
cauccccaggccc

SEQ ID NO: 1808640 - RNA, 16 nt, Human
ccuacccuccacaggc

SEQ ID NO: 1808641 - RNA, 17 nt, Human
aguugauaaguacauga

SEQ ID NO: 1808642 - RNA, 19 nt, Human
caggaguauccucuugcca

SEQ ID NO: 1808643 - RNA, 15 nt, Human
caggcugcucagggc

SEQ ID NO: 1808644 - RNA, 16 nt, Human
cuggucucuccuuguu

SEQ ID NO: 1808645 - RNA, 13 nt, Human
ggcaaauaucuug

SEQ ID NO: 1808646 - RNA, 16 nt, Human
gacuauuuuucagaau

SEQ ID NO: 1808647 - RNA, 14 nt, Human
aaagaccauuuuuc

SEQ ID NO: 1808648 - RNA, 21 nt, Human
gagagcaguuugguuucuagc

SEQ ID NO: 1808649 - RNA, 21 nt, Human
agccuaacacggugcucauuu

SEQ ID NO: 1808650 - RNA, 18 nt, Human
cugagagagcuggaggca

SEQ ID NO: 1808651 - RNA, 15 nt, Human
uggugccuucauuug

SEQ ID NO: 1808652 - RNA, 14 nt, Human
ggcaccucucuggg

SEQ ID NO: 1808653 - RNA, 14 nt, Human
gccaccacauccag

SEQ ID NO: 1808654 - RNA, 22 nt, Human
caggcccuccuugucuuuuuac

SEQ ID NO: 1808655 - RNA, 13 nt, Human
cccauucccccag

SEQ ID NO: 1808656 - RNA, 17 nt, Human
uugcacagcuaugaagg

SEQ ID NO: 1808657 - RNA, 13 nt, Human
cucagaaaacaag

SEQ ID NO: 1808658 - RNA, 21 nt, Human
gauuuaucuauuuaaauauuu

SEQ ID NO: 1808659 - RNA, 18 nt, Human
aucaaaagacuuuuuccu

SEQ ID NO: 1808660 - RNA, 22 nt, Human
caacauagugggacccugucuc

SEQ ID NO: 1808661 - RNA, 16 nt, Human
aacuugguuuuaauua

SEQ ID NO: 1808662 - RNA, 14 nt, Human
ccucagccucccaa

SEQ ID NO: 1808663 - RNA, 20 nt, Human
ucuguuuucccuccuuggag

SEQ ID NO: 1808664 - RNA, 19 nt, Human
ugccucaagcuaugugagc

SEQ ID NO: 1808665 - RNA, 12 nt, Human
acaagaaaugaa

SEQ ID NO: 1808666 - RNA, 18 nt, Human
ugcuaauuauauaauauu

SEQ ID NO: 1808667 - RNA, 19 nt, Human
uguuggacgagaaaacaau

SEQ ID NO: 1808668 - RNA, 17 nt, Human
ccugccucagccucccg

SEQ ID NO: 1808669 - RNA, 19 nt, Human
gcccucccccuccucucca

SEQ ID NO: 1808670 - RNA, 12 nt, Human
ugccacccaguu

SEQ ID NO: 1808671 - RNA, 18 nt, Human
auuuuuccauuuuuuucu

SEQ ID NO: 1808672 - RNA, 12 nt, Human
auuuuacuguac

SEQ ID NO: 1808673 - RNA, 14 nt, Human
cugcuaguuuauau

SEQ ID NO: 1808674 - RNA, 19 nt, Human
accacuguguauuuaacug

SEQ ID NO: 1808675 - RNA, 19 nt, Human
gccugcucccuagccagag

SEQ ID NO: 1808676 - RNA, 14 nt, Human
auauaauucaccuu

SEQ ID NO: 1808677 - RNA, 12 nt, Human
aauauaaugaag

SEQ ID NO: 1808678 - RNA, 17 nt, Human
agaagaaggaaauugaa

SEQ ID NO: 1808679 - RNA, 20 nt, Human
ucaccacuggagaucaccag

SEQ ID NO: 1808680 - RNA, 23 nt, Human
uuuuauagcuacuaauuuuaaaa

SEQ ID NO: 1808681 - RNA, 17 nt, Human
guagaauugugcaacca

SEQ ID NO: 1808682 - RNA, 15 nt, Human
agggguugugaagag

SEQ ID NO: 1808683 - RNA, 18 nt, Human
acaaaaucuuaaaugcca

SEQ ID NO: 1808684 - RNA, 16 nt, Human
gugaagguggaaauaa

SEQ ID NO: 1808685 - RNA, 12 nt, Human
aucauaauauaa

SEQ ID NO: 1808686 - RNA, 23 nt, Human
gcaauccucccacuucagccucc

SEQ ID NO: 1808687 - RNA, 18 nt, Human
caccaggauauccucccu

SEQ ID NO: 1808688 - RNA, 23 nt, Human
uugaaaauuaacaugaauauuua

SEQ ID NO: 1808689 - RNA, 21 nt, Human
ugaaauuuacaucauuucuuu

SEQ ID NO: 1808690 - RNA, 23 nt, Human
cagaggcucuaauguacaauaaa

SEQ ID NO: 1808691 - RNA, 17 nt, Human
aaggaggcugagagccc

SEQ ID NO: 1808692 - RNA, 22 nt, Human
aguuccuucauguaacuucccu

SEQ ID NO: 1808693 - RNA, 15 nt, Human
uuuccaauuagcucc

SEQ ID NO: 1808694 - RNA, 18 nt, Human
uucaauaucuuuuuuuua

SEQ ID NO: 1808695 - RNA, 18 nt, Human
guucugacucuuggcaca

SEQ ID NO: 1808696 - RNA, 17 nt, Human
acuuccagauccuggaa

SEQ ID NO: 1808697 - RNA, 16 nt, Human
acugauggguuucucc

SEQ ID NO: 1808698 - RNA, 15 nt, Human
agucaccucauggaa

SEQ ID NO: 1808699 - RNA, 17 nt, Human
uugugaagcaaaauuuu

SEQ ID NO: 1808700 - RNA, 18 nt, Human
ucugagagcaucaggccu

SEQ ID NO: 1808701 - RNA, 19 nt, Human
ggcuaccccuuuacaaaua

SEQ ID NO: 1808702 - RNA, 18 nt, Human
ggcacacugagccagcag

SEQ ID NO: 1808703 - RNA, 14 nt, Human
agccacccugccca

SEQ ID NO: 1808704 - RNA, 22 nt, Human
ugaauuguaggugacuauuaua

SEQ ID NO: 1808705 - RNA, 13 nt, Human
uacaccccaacag

SEQ ID NO: 1808706 - RNA, 16 nt, Human
uuaaaaaauagcagcu

SEQ ID NO: 1808707 - RNA, 13 nt, Human
accagcaggcugg

SEQ ID NO: 1808708 - RNA, 15 nt, Human
uuuaaauaggguugu

SEQ ID NO: 1808709 - RNA, 14 nt, Human
cuacaagacacagu

SEQ ID NO: 1808710 - RNA, 16 nt, Human
acaaauccaaugaaau

SEQ ID NO: 1808711 - RNA, 20 nt, Human
auaagcugccauauauuuug

SEQ ID NO: 1808712 - RNA, 11 nt, Human
aauuuaaauau

SEQ ID NO: 1808713 - RNA, 13 nt, Human
gguccacaacaca

SEQ ID NO: 1808714 - RNA, 16 nt, Human
gaguggcuuuaaugaa

SEQ ID NO: 1808715 - RNA, 21 nt, Human
cccacuggacucaccuccccc

SEQ ID NO: 1808716 - RNA, 17 nt, Human
agacacacugaagaagc

SEQ ID NO: 1808717 - RNA, 14 nt, Human
uuacauuuccuaaa

SEQ ID NO: 1808718 - RNA, 19 nt, Human
uuaagaaaaucuauuuugu

SEQ ID NO: 1808719 - RNA, 16 nt, Human
auaaugaauacuuuau

SEQ ID NO: 1808720 - RNA, 15 nt, Human
agcucuuuacuuucc

SEQ ID NO: 1808721 - RNA, 22 nt, Human
uuccaauuagcuccuccuuuuu

SEQ ID NO: 1808722 - RNA, 22 nt, Human
augagaguacaccccaacagca

SEQ ID NO: 1808723 - RNA, 13 nt, Human
aaggaauccucug

SEQ ID NO: 1808724 - RNA, 13 nt, Human
ucccuuuuuuuaa

SEQ ID NO: 1808725 - RNA, 15 nt, Human
uacacagaaauacag

SEQ ID NO: 1808726 - RNA, 14 nt, Human
cugcucauaugaug

SEQ ID NO: 1808727 - RNA, 15 nt, Human
ccuaguccccagccu

SEQ ID NO: 1808728 - RNA, 20 nt, Human
ugaaaccccuauguggaggc

SEQ ID NO: 1808729 - RNA, 15 nt, Human
aaacaauuugaauau

SEQ ID NO: 1808730 - RNA, 14 nt, Human
gcaacuuuguauaa

SEQ ID NO: 1808731 - RNA, 21 nt, Human
agccaugugauuccaucuugc

SEQ ID NO: 1808732 - RNA, 16 nt, Human
cacagggccuggggag

SEQ ID NO: 1808733 - RNA, 15 nt, Human
gcgugagccaccaug

SEQ ID NO: 1808734 - RNA, 15 nt, Human
ugcagugccuuucuu

SEQ ID NO: 1808735 - RNA, 19 nt, Human
caccagaugucgcccuacu

SEQ ID NO: 1808736 - RNA, 15 nt, Human
auaacuggaaagaag

SEQ ID NO: 1808737 - RNA, 19 nt, Human
agaguuggugacacagcug

SEQ ID NO: 1808738 - RNA, 16 nt, Human
aauuaucuuaaaacuc

SEQ ID NO: 1808739 - RNA, 20 nt, Human
uccaggagaccuacccucca

SEQ ID NO: 1808740 - RNA, 22 nt, Human
agcucacugcaaccuccaccuc

SEQ ID NO: 1808741 - RNA, 12 nt, Human
ucuauguagaau

SEQ ID NO: 1808742 - RNA, 17 nt, Human
auacuuuguaaagacaa

SEQ ID NO: 1808743 - RNA, 18 nt, Human
uccaaagcccucccuacc

SEQ ID NO: 1808744 - RNA, 23 nt, Human
agcgauucuccugccucagccuc

SEQ ID NO: 1808745 - RNA, 14 nt, Human
uacuaauuuuaaaa

SEQ ID NO: 1808746 - RNA, 12 nt, Human
gacgagaaaaca

SEQ ID NO: 1808747 - RNA, 12 nt, Human
gaaaagaaaaag

SEQ ID NO: 1808748 - RNA, 19 nt, Human
cccacugggguguguggca

SEQ ID NO: 1808749 - RNA, 17 nt, Human
auuucuaaaaguuuaag

SEQ ID NO: 1808750 - RNA, 15 nt, Human
uggcauuuuacugua

SEQ ID NO: 1808751 - RNA, 11 nt, Human
auaauuuaaau

SEQ ID NO: 1808752 - RNA, 23 nt, Human
agauagguacuauuauccccauu

SEQ ID NO: 1808753 - RNA, 18 nt, Human
accaccgcgcccagccuu

SEQ ID NO: 1808754 - RNA, 15 nt, Human
aaauaggguuguacu

SEQ ID NO: 1808755 - RNA, 17 nt, Human
acaauugggagcugcca

SEQ ID NO: 1808756 - RNA, 17 nt, Human
ccugucuguuuccucug

SEQ ID NO: 1808757 - RNA, 12 nt, Human
ccugcaagcaga

SEQ ID NO: 1808758 - RNA, 20 nt, Human
cagccugagcgacagugaga

SEQ ID NO: 1808759 - RNA, 21 nt, Human
augcacuuccuugcuuaaggu

SEQ ID NO: 1808760 - RNA, 23 nt, Human
ggucucagugucaaugcagcccc

SEQ ID NO: 1808761 - RNA, 22 nt, Human
cuggagggaccuugucucccag

SEQ ID NO: 1808762 - RNA, 20 nt, Human
aggugacuauuauauuucca

SEQ ID NO: 1808763 - RNA, 22 nt, Human
cuccagagggaauugcagagua

SEQ ID NO: 1808764 - RNA, 22 nt, Human
uaauucugguagcuaaauauau

SEQ ID NO: 1808765 - RNA, 17 nt, Human
caccugcugagccccaa

SEQ ID NO: 1808766 - RNA, 23 nt, Human
acucauaauucuucaccuuagga

SEQ ID NO: 1808767 - RNA, 22 nt, Human
uacucaccugagcgcucagcuu

SEQ ID NO: 1808768 - RNA, 12 nt, Human
cuuccucugagc

SEQ ID NO: 1808769 - RNA, 20 nt, Human
uaaccagaucauugugaaau

SEQ ID NO: 1808770 - RNA, 17 nt, Human
gauuuugcaguucuuug

SEQ ID NO: 1808771 - RNA, 20 nt, Human
uuuuuaauguguauuacaaa

SEQ ID NO: 1808772 - RNA, 20 nt, Human
gaaagcauuugaaugcauuu

SEQ ID NO: 1808773 - RNA, 15 nt, Human
uagaaagaagaugaa

SEQ ID NO: 1808774 - RNA, 11 nt, Human
gaaaaaacuga

SEQ ID NO: 1808775 - RNA, 21 nt, Human
acuuuauuuuguguuuaggaa

SEQ ID NO: 1808776 - RNA, 16 nt, Human
auacauuuucuaagaa

SEQ ID NO: 1808777 - RNA, 16 nt, Human
uuaaugaauaaacauu

SEQ ID NO: 1808778 - RNA, 20 nt, Human
ugugguacaugguguuugug

SEQ ID NO: 1808779 - RNA, 19 nt, Human
ccaccaggauauccucccu

SEQ ID NO: 1808780 - RNA, 13 nt, Human
ggaguauccucuu

SEQ ID NO: 1808781 - RNA, 21 nt, Human
acugauuuaucuauuuaaaua

SEQ ID NO: 1808782 - RNA, 14 nt, Human
gagauucagacugu

SEQ ID NO: 1808783 - RNA, 23 nt, Human
ugagauccuuccuuuugagggag

SEQ ID NO: 1808784 - RNA, 18 nt, Human
uaagcuucacuguaaaau

SEQ ID NO: 1808785 - RNA, 13 nt, Human
aauguacaauaaa

SEQ ID NO: 1808786 - RNA, 17 nt, Human
guggggggggugcuggg

SEQ ID NO: 1808787 - RNA, 20 nt, Human
cucuccaccaucgucuucuu

SEQ ID NO: 1808788 - RNA, 17 nt, Human
caccugagcgcucagcu

SEQ ID NO: 1808789 - RNA, 18 nt, Human
ugcauuucagaaaugcug

SEQ ID NO: 1808790 - RNA, 20 nt, Human
cuaauguacaauaaagcaau

SEQ ID NO: 1808791 - RNA, 21 nt, Human
gguucuuucuuuaaagcagga

SEQ ID NO: 1808792 - RNA, 15 nt, Human
cugcuggggaagaca

SEQ ID NO: 1808793 - RNA, 14 nt, Human
uuggccaugaggaa

SEQ ID NO: 1808794 - RNA, 15 nt, Human
uuccuuuuacuuuuc

SEQ ID NO: 1808795 - RNA, 17 nt, Human
ugucaacuuguauuuuu

SEQ ID NO: 1808796 - RNA, 14 nt, Human
cuauaauguaaaca

SEQ ID NO: 1808797 - RNA, 13 nt, Human
ccagcacagccuc

SEQ ID NO: 1808798 - RNA, 12 nt, Human
cuccucucucaa

SEQ ID NO: 1808799 - RNA, 10 nt, Human
ccccugccuc

SEQ ID NO: 1808800 - RNA, 15 nt, Human
cacugcaaccucugc

SEQ ID NO: 1808801 - RNA, 16 nt, Human
agcuccgcgccaggau

SEQ ID NO: 1808802 - RNA, 22 nt, Human
caccccaacagcacccucucca

SEQ ID NO: 1808803 - RNA, 22 nt, Human
ggggacacauguauuuggugau

SEQ ID NO: 1808804 - RNA, 19 nt, Human
aaagacagugaaagaaaau

SEQ ID NO: 1808805 - RNA, 16 nt, Human
auaacuggaaacuuca

SEQ ID NO: 1808806 - RNA, 11 nt, Human
gccaaaucaaa

SEQ ID NO: 1808807 - RNA, 18 nt, Human
augcauacacucucaaag

SEQ ID NO: 1808808 - RNA, 18 nt, Human
ccucuggcuccagcuggc

SEQ ID NO: 1808809 - RNA, 15 nt, Human
caugauuauuauuuu

SEQ ID NO: 1808810 - RNA, 22 nt, Human
uugacccacaagaaaugaaagc

SEQ ID NO: 1808811 - RNA, 16 nt, Human
uauuuuaauguuucuu

SEQ ID NO: 1808812 - RNA, 17 nt, Human
uaauccuuuuuuauucc

SEQ ID NO: 1808813 - RNA, 12 nt, Human
aauuugugaagg

SEQ ID NO: 1808814 - RNA, 22 nt, Human
cuccugccuaagugcagccccg

SEQ ID NO: 1808815 - RNA, 23 nt, Human
aaccugccagcuggccuugugag

SEQ ID NO: 1808816 - RNA, 17 nt, Human
uauuagauguucucuau

SEQ ID NO: 1808817 - RNA, 22 nt, Human
aguaaacucaauaaguuuauuu

SEQ ID NO: 1808818 - RNA, 23 nt, Human
uguagaaaagcuauaaaaugaau

SEQ ID NO: 1808819 - RNA, 14 nt, Human
aucaccaaggcuga

SEQ ID NO: 1808820 - RNA, 13 nt, Human
auaauuuuuuaau

SEQ ID NO: 1808821 - RNA, 14 nt, Human
aguauccaagguua

SEQ ID NO: 1808822 - RNA, 16 nt, Human
aauuguguuuauaauu

SEQ ID NO: 1808823 - RNA, 19 nt, Human
cauaucugccuuuauugug

SEQ ID NO: 1808824 - RNA, 19 nt, Human
ugcauuaaaaaugcauaua

SEQ ID NO: 1808825 - RNA, 21 nt, Human
cuguuuccucuguauacaaaa

SEQ ID NO: 1808826 - RNA, 15 nt, Human
gccacaguuccccua

SEQ ID NO: 1808827 - RNA, 13 nt, Human
acaaauuguagaa

SEQ ID NO: 1808828 - RNA, 18 nt, Human
ugaacaaaauuuccuaau

SEQ ID NO: 1808829 - RNA, 20 nt, Human
aaugauguuucauaagaauu

SEQ ID NO: 1808830 - RNA, 16 nt, Human
aguugagacaagaaaa

SEQ ID NO: 1808831 - RNA, 17 nt, Human
acuuuucuccucucagu

SEQ ID NO: 1808832 - RNA, 14 nt, Human
guguacauucuucc

SEQ ID NO: 1808833 - RNA, 19 nt, Human
uggacccguucaacuuuuc

SEQ ID NO: 1808834 - RNA, 13 nt, Human
aauauaaaacagg

SEQ ID NO: 1808835 - RNA, 13 nt, Human
cuucagccuccca

SEQ ID NO: 1808836 - RNA, 21 nt, Human
auaaguuuauuucuuaaaucu

SEQ ID NO: 1808837 - RNA, 19 nt, Human
gacagacauacauuucuca

SEQ ID NO: 1808838 - RNA, 22 nt, Human
uuguaacaagccuccuuuuaaa

SEQ ID NO: 1808839 - RNA, 18 nt, Human
cagaaggccaagaggcug

SEQ ID NO: 1808840 - RNA, 12 nt, Human
cauuauaucaaa

SEQ ID NO: 1808841 - RNA, 12 nt, Human
ugaaauuauuca

SEQ ID NO: 1808842 - RNA, 16 nt, Human
uuaaucuguauuuccc

SEQ ID NO: 1808843 - RNA, 17 nt, Human
cuguuauaauaaaugua

SEQ ID NO: 1808844 - RNA, 22 nt, Human
auguccuuggugccuggagccu

SEQ ID NO: 1808845 - RNA, 19 nt, Human
gcacacagcacgggggcca

SEQ ID NO: 1808846 - RNA, 14 nt, Human
auguuggccaggcu

SEQ ID NO: 1808847 - RNA, 14 nt, Human
gcaucugccucccc

SEQ ID NO: 1808848 - RNA, 22 nt, Human
uuugugaagguggaaauaaacu

SEQ ID NO: 1808849 - RNA, 12 nt, Human
ccaaagcccucc

SEQ ID NO: 1808850 - RNA, 19 nt, Human
cacaugauuccagccauca

SEQ ID NO: 1808851 - RNA, 18 nt, Human
caauuguuggagagcccc

SEQ ID NO: 1808852 - RNA, 19 nt, Human
ugccaggcuggagugcagu

SEQ ID NO: 1808853 - RNA, 19 nt, Human
uauauuuuuuguuaaauga

SEQ ID NO: 1808854 - RNA, 14 nt, Human
aauauuauguuaaa

SEQ ID NO: 1808855 - RNA, 19 nt, Human
gcaccaugucaaggguuca

SEQ ID NO: 1808856 - RNA, 14 nt, Human
gcugcccccagagc

SEQ ID NO: 1808857 - RNA, 23 nt, Human
gugauccacccgccucagccucc

SEQ ID NO: 1808858 - RNA, 12 nt, Human
auguuucacugu

SEQ ID NO: 1808859 - RNA, 12 nt, Human
ccagccucagcc

SEQ ID NO: 1808860 - RNA, 17 nt, Human
uccugccucagccuccc

SEQ ID NO: 1808861 - RNA, 15 nt, Human
cuuucccuaagccag

SEQ ID NO: 1808862 - RNA, 15 nt, Human
aacaccccacagaag

SEQ ID NO: 1808863 - RNA, 17 nt, Human
acaaagcccaucauaau

SEQ ID NO: 1808864 - RNA, 17 nt, Human
ucaugaauucugucauu

SEQ ID NO: 1808865 - RNA, 17 nt, Human
caugcacuuccuugcuu

SEQ ID NO: 1808866 - RNA, 19 nt, Human
cucgugauccacccgccuc

SEQ ID NO: 1808867 - RNA, 21 nt, Human
agucaagggugugugcagcau

SEQ ID NO: 1808868 - RNA, 14 nt, Human
cuguaaucacagcu

SEQ ID NO: 1808869 - RNA, 18 nt, Human
cggaauugcucucccagc

SEQ ID NO: 1808870 - RNA, 17 nt, Human
cauucacaucgcagauu

SEQ ID NO: 1808871 - RNA, 14 nt, Human
ccaucaccuccccc

SEQ ID NO: 1808872 - RNA, 18 nt, Human
cacugucugcccccguuc

SEQ ID NO: 1808873 - RNA, 23 nt, Human
ucaaaggcauuucuuuucugcau

SEQ ID NO: 1808874 - RNA, 19 nt, Human
cucagugggggcagagcca

SEQ ID NO: 1808875 - RNA, 12 nt, Human
uagcauuucucc

SEQ ID NO: 1808876 - RNA, 22 nt, Human
auccucccacuucagccuccca

SEQ ID NO: 1808877 - RNA, 17 nt, Human
uccuacaagacacagug

SEQ ID NO: 1808878 - RNA, 14 nt, Human
ugagauuacaggug

SEQ ID NO: 1808879 - RNA, 16 nt, Human
cauacauguaaaauau

SEQ ID NO: 1808880 - RNA, 23 nt, Human
auuuucaucaccccuaaaagaaa

SEQ ID NO: 1808881 - RNA, 21 nt, Human
cuccauggaaacgaagcacca

SEQ ID NO: 1808882 - RNA, 18 nt, Human
cuaagcuggagugcagug

SEQ ID NO: 1808883 - RNA, 21 nt, Human
gcauaaauuauuguuuuucuu

SEQ ID NO: 1808884 - RNA, 16 nt, Human
cacacagcccuggccu

SEQ ID NO: 1808885 - RNA, 17 nt, Human
ggcaggucugaagcuca

SEQ ID NO: 1808886 - RNA, 17 nt, Human
acaguuaaguuuugugu

SEQ ID NO: 1808887 - RNA, 18 nt, Human
acuugccaaauuuagauu

SEQ ID NO: 1808888 - RNA, 14 nt, Human
cuccugaccccaag

SEQ ID NO: 1808889 - RNA, 24 nt, Human
cuuuaucuugaauaauguaagaca

SEQ ID NO: 1808890 - RNA, 17 nt, Human
ugucuccucucucugua

SEQ ID NO: 1808891 - RNA, 23 nt, Human
uuuuauuguccguuuacuuguuu

SEQ ID NO: 1808892 - RNA, 19 nt, Human
cugucuccuaagcuggagu

SEQ ID NO: 1808893 - RNA, 19 nt, Human
ucuucacuuuuauaagaaa

SEQ ID NO: 1808894 - RNA, 14 nt, Human
gccccucuccugga

SEQ ID NO: 1808895 - RNA, 22 nt, Human
ccgggagccugaucaccugccc

SEQ ID NO: 1808896 - RNA, 21 nt, Human
caagacccaaaaggcagaagc

SEQ ID NO: 1808897 - RNA, 19 nt, Human
augaguaacugauuuguaa

SEQ ID NO: 1808898 - RNA, 17 nt, Human
agcucacugcaaccucu

SEQ ID NO: 1808899 - RNA, 19 nt, Human
gaaaggaccaguaugcuug

SEQ ID NO: 1808900 - RNA, 21 nt, Human
gcucccuuuggagauuuuuua

SEQ ID NO: 1808901 - RNA, 15 nt, Human
uuucugaguuuuacc

SEQ ID NO: 1808902 - RNA, 23 nt, Human
aaaggaccaguaugcuuggacug

SEQ ID NO: 1808903 - RNA, 18 nt, Human
auuauuuuuuaaaaaaau

SEQ ID NO: 1808904 - RNA, 12 nt, Human
aaaauaacaaua

SEQ ID NO: 1808905 - RNA, 16 nt, Human
cagggccacauagaug

SEQ ID NO: 1808906 - RNA, 17 nt, Human
ggcuuugaaugcggccc

SEQ ID NO: 1808907 - RNA, 14 nt, Human
uauaauuuaaaaua

SEQ ID NO: 1808908 - RNA, 14 nt, Human
auuauuuuuuaaaa

SEQ ID NO: 1808909 - RNA, 13 nt, Human
ucccaugaagaaa

SEQ ID NO: 1808910 - RNA, 18 nt, Human
auaaaaugaauacaauua

SEQ ID NO: 1808911 - RNA, 19 nt, Human
cuccaccuugcagcucucc

SEQ ID NO: 1808912 - RNA, 21 nt, Human
auaugcucuaaacauguuuau

SEQ ID NO: 1808913 - RNA, 20 nt, Human
guagauaaggaaauaagaac

SEQ ID NO: 1808914 - RNA, 18 nt, Human
cuuccaacguggcccaga

SEQ ID NO: 1808915 - RNA, 20 nt, Human
caaauaaaggaaacccagcu

SEQ ID NO: 1808916 - RNA, 17 nt, Human
uauauuguagauaauac

SEQ ID NO: 1808917 - RNA, 14 nt, Human
cacaggcacagguc

SEQ ID NO: 1808918 - RNA, 15 nt, Human
ugggggcagagccac

SEQ ID NO: 1808919 - RNA, 15 nt, Human
augauaacuggaaac

SEQ ID NO: 1808920 - RNA, 20 nt, Human
aucaaccugccagcuggccu

SEQ ID NO: 1808921 - RNA, 17 nt, Human
aacccauucccucucca

SEQ ID NO: 1808922 - RNA, 21 nt, Human
ccacucugagucccagagcca

SEQ ID NO: 1808923 - RNA, 19 nt, Human
aaaauaacgauaaaagaca

SEQ ID NO: 1808924 - RNA, 19 nt, Human
uuuuaucugcuaugcuauu

SEQ ID NO: 1808925 - RNA, 19 nt, Human
agagaacagggcugaagcu

SEQ ID NO: 1808926 - RNA, 14 nt, Human
ucugucauuucaaa

SEQ ID NO: 1808927 - RNA, 16 nt, Human
agugggggccagccac

SEQ ID NO: 1808928 - RNA, 23 nt, Human
gccccuuugcugacccuccccaa

SEQ ID NO: 1808929 - RNA, 16 nt, Human
acuuuaucuugaauaa

SEQ ID NO: 1808930 - RNA, 21 nt, Human
uauuuuuccauuuuuuucuaa

SEQ ID NO: 1808931 - RNA, 14 nt, Human
uaaaggaauuuaaa

SEQ ID NO: 1808932 - RNA, 19 nt, Human
aaaucaacuuaaggguagg

SEQ ID NO: 1808933 - RNA, 20 nt, Human
uaggauguugagcagcaucu

SEQ ID NO: 1808934 - RNA, 16 nt, Human
cuccaauacucagguu

SEQ ID NO: 1808935 - RNA, 22 nt, Human
caacuuuuccuuugaauccucu

SEQ ID NO: 1808936 - RNA, 19 nt, Human
aaccccaggacgcccucac

SEQ ID NO: 1808937 - RNA, 16 nt, Human
uuaauaaauguauauu

SEQ ID NO: 1808938 - RNA, 18 nt, Human
aggaguacaccccaacag

SEQ ID NO: 1808939 - RNA, 13 nt, Human
cauguuggccagg

SEQ ID NO: 1808940 - RNA, 15 nt, Human
ugucuuuguucuucu

SEQ ID NO: 1808941 - RNA, 20 nt, Human
ccuuucauaaagucuugccu

SEQ ID NO: 1808942 - RNA, 13 nt, Human
cuccagccucagc

SEQ ID NO: 1808943 - RNA, 16 nt, Human
ccugacgaacuccuug

SEQ ID NO: 1808944 - RNA, 22 nt, Human
caagccuaagggauccugccug

SEQ ID NO: 1808945 - RNA, 17 nt, Human
guucucccaccaccuca

SEQ ID NO: 1808946 - RNA, 20 nt, Human
uacccucauuucucaucuuu

SEQ ID NO: 1808947 - RNA, 22 nt, Human
cuaagcuucacuguaaaauaau

SEQ ID NO: 1808948 - RNA, 13 nt, Human
uggguugcacugg

SEQ ID NO: 1808949 - RNA, 14 nt, Human
uaaaaugaauacaa

SEQ ID NO: 1808950 - RNA, 16 nt, Human
ugcuucuccagccuca

SEQ ID NO: 1808951 - RNA, 23 nt, Human
gcucacuacaaccuccgccuccc

SEQ ID NO: 1808952 - RNA, 19 nt, Human
cucacagaagaaggaaauu

SEQ ID NO: 1808953 - RNA, 18 nt, Human
ccugcugcccucccccuc

SEQ ID NO: 1808954 - RNA, 17 nt, Human
ugaggcccuaucuuuug

SEQ ID NO: 1808955 - RNA, 14 nt, Human
accuuuuauauuua

SEQ ID NO: 1808956 - RNA, 14 nt, Human
uguacauguacuga

SEQ ID NO: 1808957 - RNA, 20 nt, Human
guucugcagauaaacaguag

SEQ ID NO: 1808958 - RNA, 14 nt, Human
aaaagcauuauuau

SEQ ID NO: 1808959 - RNA, 12 nt, Human
cuuccaucugau

SEQ ID NO: 1808960 - RNA, 21 nt, Human
cuggagccccaucagcuccag

SEQ ID NO: 1808961 - RNA, 19 nt, Human
gauaaaguugguaaaccuu

SEQ ID NO: 1808962 - RNA, 13 nt, Human
gaagaacugaaau

SEQ ID NO: 1808963 - RNA, 22 nt, Human
acuauugcuugcacaaaccaau

SEQ ID NO: 1808964 - RNA, 22 nt, Human
gcuauuugcuguuauuuuaucu

SEQ ID NO: 1808965 - RNA, 16 nt, Human
aaauauuuauuuuaau

SEQ ID NO: 1808966 - RNA, 13 nt, Human
uucuuccacagug

SEQ ID NO: 1808967 - RNA, 22 nt, Human
gaguuuaauuuuugaaaacugg

SEQ ID NO: 1808968 - RNA, 18 nt, Human
aauuauauaauauuuuua

SEQ ID NO: 1808969 - RNA, 19 nt, Human
ucacauucagggcuauuuu

SEQ ID NO: 1808970 - RNA, 16 nt, Human
cauaaauaaaguuugu

SEQ ID NO: 1808971 - RNA, 13 nt, Human
aaaguugauuuua

SEQ ID NO: 1808972 - RNA, 13 nt, Human
aaauaugauuugu

SEQ ID NO: 1808973 - RNA, 14 nt, Human
ccaaagcccucccu

SEQ ID NO: 1808974 - RNA, 14 nt, Human
acauauauaacaau

SEQ ID NO: 1808975 - RNA, 13 nt, Human
cuguccuggaggg

SEQ ID NO: 1808976 - RNA, 20 nt, Human
aaagacaaggaaaaaauaac

SEQ ID NO: 1808977 - RNA, 18 nt, Human
cagacucuaagaaagaac

SEQ ID NO: 1808978 - RNA, 23 nt, Human
uuaucugagucaacuccuuucuc

SEQ ID NO: 1808979 - RNA, 18 nt, Human
cagaggcucuaauguaca

SEQ ID NO: 1808980 - RNA, 21 nt, Human
cuguaaucccagcaugcugag

SEQ ID NO: 1808981 - RNA, 15 nt, Human
gcagagccaggaccc

SEQ ID NO: 1808982 - RNA, 23 nt, Human
caaguccugccucuuaaauaaac

SEQ ID NO: 1808983 - RNA, 15 nt, Human
ucccaggaguacacc

SEQ ID NO: 1808984 - RNA, 20 nt, Human
accucugccucagaaaacaa

SEQ ID NO: 1808985 - RNA, 13 nt, Human
uaguuuuuaaagu

SEQ ID NO: 1808986 - RNA, 14 nt, Human
accuuauguuuaau

SEQ ID NO: 1808987 - RNA, 19 nt, Human
aacagugagcuuggaaagg

SEQ ID NO: 1808988 - RNA, 22 nt, Human
cuccgccauucucaagcccugc

SEQ ID NO: 1808989 - RNA, 21 nt, Human
cucacuaauucauuaaucugc

SEQ ID NO: 1808990 - RNA, 21 nt, Human
uucagcucagcuaaugaagug

SEQ ID NO: 1808991 - RNA, 17 nt, Human
uucuaaauaaaaagcau

SEQ ID NO: 1808992 - RNA, 23 nt, Human
agggagaacgggaauucagacaa

SEQ ID NO: 1808993 - RNA, 16 nt, Human
uugugugcaucaggcu

SEQ ID NO: 1808994 - RNA, 13 nt, Human
ccaguagaugcca

SEQ ID NO: 1808995 - RNA, 20 nt, Human
acuagaguuuagcuggaaaa

SEQ ID NO: 1808996 - RNA, 19 nt, Human
gugcaguggcgugaucuca

SEQ ID NO: 1808997 - RNA, 21 nt, Human
gcggccagcuccgcgccagga

SEQ ID NO: 1808998 - RNA, 19 nt, Human
cugguccaacaugaaaaca

SEQ ID NO: 1808999 - RNA, 11 nt, Human
auggaauuaca

SEQ ID NO: 1809000 - RNA, 20 nt, Human
gcuugcagagaugaggccgc

SEQ ID NO: 1809001 - RNA, 21 nt, Human
cucuaugguguggcaaagccu

SEQ ID NO: 1809002 - RNA, 20 nt, Human
cagugccuuucuucucucca

SEQ ID NO: 1809003 - RNA, 23 nt, Human
ucuuucuuugggaauauuugaau

SEQ ID NO: 1809004 - RNA, 20 nt, Human
uaugcauauuauuuuauguu

SEQ ID NO: 1809005 - RNA, 15 nt, Human
cuguuuauaaacauu

SEQ ID NO: 1809006 - RNA, 21 nt, Human
ucuucaccuuaggaauaaucu

SEQ ID NO: 1809007 - RNA, 16 nt, Human
aaacaaacaaaaaaaa

SEQ ID NO: 1809008 - RNA, 12 nt, Human
uucuuuugugaa

SEQ ID NO: 1809009 - RNA, 21 nt, Human
uuuaguguucauaaauaaagu

SEQ ID NO: 1809010 - RNA, 13 nt, Human
uauaucaaauaua

SEQ ID NO: 1809011 - RNA, 14 nt, Human
uauuaauaaacauu

SEQ ID NO: 1809012 - RNA, 20 nt, Human
guccugucuguuuccucugu

SEQ ID NO: 1809013 - RNA, 16 nt, Human
ccuugcaucucacagg

SEQ ID NO: 1809014 - RNA, 16 nt, Human
ucuuggggaauauguu

SEQ ID NO: 1809015 - RNA, 10 nt, Human
ugaaaucaau

SEQ ID NO: 1809016 - RNA, 21 nt, Human
ugagaaggcuguggauuuaau

SEQ ID NO: 1809017 - RNA, 16 nt, Human
ucuccaccaucgucuu

SEQ ID NO: 1809018 - RNA, 15 nt, Human
cuggguuccuuccuc

SEQ ID NO: 1809019 - RNA, 13 nt, Human
acuuggcugcaua

SEQ ID NO: 1809020 - RNA, 12 nt, Human
agacagugaaag

SEQ ID NO: 1809021 - RNA, 18 nt, Human
aagcaggaagaaggaaaa

SEQ ID NO: 1809022 - RNA, 12 nt, Human
ggccagcuccgc

SEQ ID NO: 1809023 - RNA, 15 nt, Human
uguucauuuccucaa

SEQ ID NO: 1809024 - RNA, 19 nt, Human
caauucuugccaaauauaa

SEQ ID NO: 1809025 - RNA, 22 nt, Human
ugggagagacuuguuuuggaug

SEQ ID NO: 1809026 - RNA, 22 nt, Human
uucugucauuucaaagacucuc

SEQ ID NO: 1809027 - RNA, 18 nt, Human
ucaaaggcacacagcaag

SEQ ID NO: 1809028 - RNA, 11 nt, Human
agcugcucugu

SEQ ID NO: 1809029 - RNA, 15 nt, Human
gaccugccaggcaca

SEQ ID NO: 1809030 - RNA, 16 nt, Human
gacauagaauuaacac

SEQ ID NO: 1809031 - RNA, 16 nt, Human
gagcaguagcuggagg

SEQ ID NO: 1809032 - RNA, 12 nt, Human
cuaaacauuuca

SEQ ID NO: 1809033 - RNA, 14 nt, Human
ucccuugaugaaga

SEQ ID NO: 1809034 - RNA, 17 nt, Human
aaugcauauacuuuaau

SEQ ID NO: 1809035 - RNA, 13 nt, Human
accaggacccugu

SEQ ID NO: 1809036 - RNA, 20 nt, Human
aauucuugccaaauauaaau

SEQ ID NO: 1809037 - RNA, 18 nt, Human
ugauuccuugauggagau

SEQ ID NO: 1809038 - RNA, 19 nt, Human
ccccugcaaagcccagcuu

SEQ ID NO: 1809039 - RNA, 15 nt, Human
ccugcugcccucccc

SEQ ID NO: 1809040 - RNA, 15 nt, Human
agccucagucucccu

SEQ ID NO: 1809041 - RNA, 20 nt, Human
ugaaaaucuuauaauuuaaa

SEQ ID NO: 1809042 - RNA, 16 nt, Human
cuuuaauggguaaaca

SEQ ID NO: 1809043 - RNA, 19 nt, Human
agaguuuagcuggaaaagu

SEQ ID NO: 1809044 - RNA, 22 nt, Human
uucauucacucaacaaacauaa

SEQ ID NO: 1809045 - RNA, 21 nt, Human
acacuuugaacuacuagaaaa

SEQ ID NO: 1809046 - RNA, 18 nt, Human
aggcaaaaggaagcaggg

SEQ ID NO: 1809047 - RNA, 21 nt, Human
auuugacuagaaaauuuaaaa

SEQ ID NO: 1809048 - RNA, 22 nt, Human
uccaaccagauugucagcuccu

SEQ ID NO: 1809049 - RNA, 20 nt, Human
agcuccuccuuuuuccuucc

SEQ ID NO: 1809050 - RNA, 23 nt, Human
aaggaggcugagagcccaaacug

SEQ ID NO: 1809051 - RNA, 22 nt, Human
ccaagagugaagggaagagaca

SEQ ID NO: 1809052 - RNA, 12 nt, Human
aaaugugaauca

SEQ ID NO: 1809053 - RNA, 22 nt, Human
gacucaccucccccaucucuuc

SEQ ID NO: 1809054 - RNA, 18 nt, Human
aauagagaaauaugauuu

SEQ ID NO: 1809055 - RNA, 18 nt, Human
ccaagcugguggcucugu

SEQ ID NO: 1809056 - RNA, 22 nt, Human
gccugcagacucacugugggaa

SEQ ID NO: 1809057 - RNA, 19 nt, Human
uccauccugaggcuccacu

SEQ ID NO: 1809058 - RNA, 14 nt, Human
caguagcuggaggg

SEQ ID NO: 1809059 - RNA, 17 nt, Human
ucuuguauuuuuccaau

SEQ ID NO: 1809060 - RNA, 14 nt, Human
aacucccucucugc

SEQ ID NO: 1809061 - RNA, 20 nt, Human
caccuccuggguucaagcga

SEQ ID NO: 1809062 - RNA, 14 nt, Human
acgagaaaacaaua

SEQ ID NO: 1809063 - RNA, 17 nt, Human
aagaguuuaauuuuuga

SEQ ID NO: 1809064 - RNA, 21 nt, Human
uggucccuauuccuccuuccc

SEQ ID NO: 1809065 - RNA, 17 nt, Human
uuacucuguugccaggc

SEQ ID NO: 1809066 - RNA, 16 nt, Human
aaaauccauacauuug

SEQ ID NO: 1809067 - RNA, 22 nt, Human
cacuaucuguaaugccuuuucu

SEQ ID NO: 1809068 - RNA, 19 nt, Human
agcguugagccaccaagcu

SEQ ID NO: 1809069 - RNA, 18 nt, Human
cuccauuuuuagugaaau

SEQ ID NO: 1809070 - RNA, 18 nt, Human
ucaugaagauauuuuucc

SEQ ID NO: 1809071 - RNA, 18 nt, Human
gaagacagagccccaccc

SEQ ID NO: 1809072 - RNA, 23 nt, Human
caaguuauccaccugccuuggcu

SEQ ID NO: 1809073 - RNA, 15 nt, Human
augguggccuggggc

SEQ ID NO: 1809074 - RNA, 22 nt, Human
acaccuuguacuuuauuuucua

SEQ ID NO: 1809075 - RNA, 17 nt, Human
ucucuggccuguaccca

SEQ ID NO: 1809076 - RNA, 15 nt, Human
ucccuuuguccacaa

SEQ ID NO: 1809077 - RNA, 20 nt, Human
cucuguugagccuuccuuuc

SEQ ID NO: 1809078 - RNA, 17 nt, Human
uaugccacaagaacccc

SEQ ID NO: 1809079 - RNA, 17 nt, Human
uggcuaagcaaaaugug

SEQ ID NO: 1809080 - RNA, 21 nt, Human
cacucugagucccagagccaa

SEQ ID NO: 1809081 - RNA, 18 nt, Human
gggugcugcgcagcaucc

SEQ ID NO: 1809082 - RNA, 15 nt, Human
uuuaauaauuuuuaa

SEQ ID NO: 1809083 - RNA, 16 nt, Human
aaaguuuguugaaaca

SEQ ID NO: 1809084 - RNA, 14 nt, Human
auauaauucuuaug

SEQ ID NO: 1809085 - RNA, 17 nt, Human
agaauaaggaacaacgu

SEQ ID NO: 1809086 - RNA, 20 nt, Human
auauuuuauaucaauuuaaa

SEQ ID NO: 1809087 - RNA, 13 nt, Human
gacuugccucugc

SEQ ID NO: 1809088 - RNA, 21 nt, Human
acgggaccuauuagaguauuu

SEQ ID NO: 1809089 - RNA, 13 nt, Human
uggggccaggcug

SEQ ID NO: 1809090 - RNA, 22 nt, Human
uaaauucaaguccaggcuuuuu

SEQ ID NO: 1809091 - RNA, 18 nt, Human
auccuucagccugaaaga

SEQ ID NO: 1809092 - RNA, 14 nt, Human
accuccaccuccug

SEQ ID NO: 1809093 - RNA, 15 nt, Human
auguucaucauguau

SEQ ID NO: 1809094 - RNA, 20 nt, Human
uccccagccugcucccuagc

SEQ ID NO: 1809095 - RNA, 21 nt, Human
gccucccagguucaagugcuu

SEQ ID NO: 1809096 - RNA, 15 nt, Human
uguucacccaaccac

SEQ ID NO: 1809097 - RNA, 21 nt, Human
cccaacagcacccucuccaga

SEQ ID NO: 1809098 - RNA, 18 nt, Human
cauuccucugcccuuccu

SEQ ID NO: 1809099 - RNA, 18 nt, Human
uuuauguuuaauucugaa

SEQ ID NO: 1809100 - RNA, 15 nt, Human
ucuuauaauuuaaaa

SEQ ID NO: 1809101 - RNA, 16 nt, Human
uacccaguaacucauc

SEQ ID NO: 1809102 - RNA, 19 nt, Human
gaagagacagcccaggaua

SEQ ID NO: 1809103 - RNA, 19 nt, Human
gccugaggugccgccuccu

SEQ ID NO: 1809104 - RNA, 16 nt, Human
ggggcagcaccuccua

SEQ ID NO: 1809105 - RNA, 23 nt, Human
ucaugcuuaaggccaugauuuua

SEQ ID NO: 1809106 - RNA, 21 nt, Human
cagcuaccugcucagcccugc

SEQ ID NO: 1809107 - RNA, 18 nt, Human
aagaagcacgugguaaaa

SEQ ID NO: 1809108 - RNA, 17 nt, Human
aaggugaucuggcucug

SEQ ID NO: 1809109 - RNA, 22 nt, Human
cagggaugaugcaacauccuug

SEQ ID NO: 1809110 - RNA, 14 nt, Human
uucagacuguuuuu

SEQ ID NO: 1809111 - RNA, 19 nt, Human
cugccccccagcccuccuu

SEQ ID NO: 1809112 - RNA, 19 nt, Human
uuuccaagaaauauuccuu

SEQ ID NO: 1809113 - RNA, 14 nt, Human
ccuggacuugccuc

SEQ ID NO: 1809114 - RNA, 19 nt, Human
acauguggcccaacacaau

SEQ ID NO: 1809115 - RNA, 14 nt, Human
cgucccccucuggc

SEQ ID NO: 1809116 - RNA, 21 nt, Human
auuuuaggucuuaauacacac

SEQ ID NO: 1809117 - RNA, 23 nt, Human
cagaugggagugcccccaacagc

SEQ ID NO: 1809118 - RNA, 22 nt, Human
uuacacuuugaacuacuagaaa

SEQ ID NO: 1809119 - RNA, 20 nt, Human
acuccagugagacagcucug

SEQ ID NO: 1809120 - RNA, 15 nt, Human
aaauauuuauuuuaa

SEQ ID NO: 1809121 - RNA, 13 nt, Human
uauuccuccuucc

SEQ ID NO: 1809122 - RNA, 20 nt, Human
cuggccuucggccuccaucc

SEQ ID NO: 1809123 - RNA, 19 nt, Human
agauuugagcucagcccug

SEQ ID NO: 1809124 - RNA, 15 nt, Human
ugaccauuagcauuu

SEQ ID NO: 1809125 - RNA, 16 nt, Human
ucuuuggcugaaagga

SEQ ID NO: 1809126 - RNA, 21 nt, Human
cugcucccuagccagaggcuc

SEQ ID NO: 1809127 - RNA, 17 nt, Human
agcaugcugagauuaca

SEQ ID NO: 1809128 - RNA, 21 nt, Human
cacuuugcauaacguauaaaa

SEQ ID NO: 1809129 - RNA, 17 nt, Human
ugguaagcaccaggacg

SEQ ID NO: 1809130 - RNA, 14 nt, Human
agguugcagugagc

SEQ ID NO: 1809131 - RNA, 22 nt, Human
uauaauacaaaggcuuauuaau

SEQ ID NO: 1809132 - RNA, 17 nt, Human
cgccucgaccucucuca

SEQ ID NO: 1809133 - RNA, 11 nt, Human
auaaaggaaac

SEQ ID NO: 1809134 - RNA, 12 nt, Human
uaaaugaagaaa

SEQ ID NO: 1809135 - RNA, 23 nt, Human
uccacaaguaaaaggaaaugcuc

SEQ ID NO: 1809136 - RNA, 15 nt, Human
ucucaauuucuacaa

SEQ ID NO: 1809137 - RNA, 14 nt, Human
ccuuccagaaauac

SEQ ID NO: 1809138 - RNA, 14 nt, Human
gaggcucuaaugua

SEQ ID NO: 1809139 - RNA, 21 nt, Human
gauuuuauuagaaguuucauc

SEQ ID NO: 1809140 - RNA, 17 nt, Human
cagagccaccugacucu

SEQ ID NO: 1809141 - RNA, 18 nt, Human
cagaggggcccaugaaag

SEQ ID NO: 1809142 - RNA, 15 nt, Human
cugccucagccuccc

SEQ ID NO: 1809143 - RNA, 20 nt, Human
gguuaaugcugaaaaaucau

SEQ ID NO: 1809144 - RNA, 20 nt, Human
aauaaacucauuucuagcag

SEQ ID NO: 1809145 - RNA, 17 nt, Human
ccuaguccccagccugc

SEQ ID NO: 1809146 - RNA, 17 nt, Human
caucagcaucccuagaa

SEQ ID NO: 1809147 - RNA, 16 nt, Human
acacguuauaaucauu

SEQ ID NO: 1809148 - RNA, 11 nt, Human
gccaugaggaa

SEQ ID NO: 1809149 - RNA, 19 nt, Human
uggagcaggggugcuggga

SEQ ID NO: 1809150 - RNA, 13 nt, Human
ggguuaaagcugc

SEQ ID NO: 1809151 - RNA, 18 nt, Human
uaauuagcauggccacau

SEQ ID NO: 1809152 - RNA, 15 nt, Human
ccagccugcucccua

SEQ ID NO: 1809153 - RNA, 23 nt, Human
gcugaguguuucacaccuuaucu

SEQ ID NO: 1809154 - RNA, 16 nt, Human
acauucuuaaaguguc

SEQ ID NO: 1809155 - RNA, 16 nt, Human
aacauguuccuuauau

SEQ ID NO: 1809156 - RNA, 23 nt, Human
uaccuguaacuugaagguggcua

SEQ ID NO: 1809157 - RNA, 16 nt, Human
ggcuagacuagucuca

SEQ ID NO: 1809158 - RNA, 22 nt, Human
ucaacuuguauuuuuuuucuug

SEQ ID NO: 1809159 - RNA, 20 nt, Human
cugcaccaugcugcugggga

SEQ ID NO: 1809160 - RNA, 16 nt, Human
agggaggacgcucucu

SEQ ID NO: 1809161 - RNA, 16 nt, Human
cccuuuacccccauga

SEQ ID NO: 1809162 - RNA, 22 nt, Human
ucuccagagggaauugcagagu

SEQ ID NO: 1809163 - RNA, 14 nt, Human
auauauaucaaaua

SEQ ID NO: 1809164 - RNA, 16 nt, Human
ggggaagacaguggcc

SEQ ID NO: 1809165 - RNA, 15 nt, Human
uggccuguacccagu

SEQ ID NO: 1809166 - RNA, 16 nt, Human
accccaacagcacccu

SEQ ID NO: 1809167 - RNA, 23 nt, Human
uguaggaaagaccauuuuuccuc

SEQ ID NO: 1809168 - RNA, 20 nt, Human
aaugcugaaaaaucauccaa

SEQ ID NO: 1809169 - RNA, 18 nt, Human
ucuaauguacaauaaagc

SEQ ID NO: 1809170 - RNA, 21 nt, Human
cuggaaacacauguuccccuu

SEQ ID NO: 1809171 - RNA, 15 nt, Human
aucucccucuucccu

SEQ ID NO: 1809172 - RNA, 21 nt, Human
aagaaauaggaaauauuuuaa

SEQ ID NO: 1809173 - RNA, 22 nt, Human
gcaaaaccaaauauuccagaga

SEQ ID NO: 1809174 - RNA, 17 nt, Human
agggcauagaaguaaaa

SEQ ID NO: 1809175 - RNA, 15 nt, Human
uccaagccucauguc

SEQ ID NO: 1809176 - RNA, 15 nt, Human
aguauauuucccugu

SEQ ID NO: 1809177 - RNA, 16 nt, Human
uaucuuccuauaauuu

SEQ ID NO: 1809178 - RNA, 12 nt, Human
cuacaagacaca

SEQ ID NO: 1809179 - RNA, 15 nt, Human
uaaugccuuuucuca

SEQ ID NO: 1809180 - RNA, 18 nt, Human
acccaguagaugccaccc

SEQ ID NO: 1809181 - RNA, 17 nt, Human
ucauauauauacauaca

SEQ ID NO: 1809182 - RNA, 20 nt, Human
uuucuuccuggauuccucac

SEQ ID NO: 1809183 - RNA, 19 nt, Human
guuguauuauuuuuuaaaa

SEQ ID NO: 1809184 - RNA, 17 nt, Human
auuagccugaguagaaa

SEQ ID NO: 1809185 - RNA, 19 nt, Human
auggaacuugcugcugagu

SEQ ID NO: 1809186 - RNA, 13 nt, Human
gaaaaaaguaaau

SEQ ID NO: 1809187 - RNA, 22 nt, Human
augaaccaccgcgcccagccuu

SEQ ID NO: 1809188 - RNA, 20 nt, Human
aaaaugucuauuuuuaaugu

SEQ ID NO: 1809189 - RNA, 15 nt, Human
cgauucuccugccuc

SEQ ID NO: 1809190 - RNA, 13 nt, Human
gccaggcuggagu

SEQ ID NO: 1809191 - RNA, 14 nt, Human
aacacgcucucucc

SEQ ID NO: 1809192 - RNA, 20 nt, Human
uugauaaguacaugauaagc

SEQ ID NO: 1809193 - RNA, 17 nt, Human
caagucuuauuuccuca

SEQ ID NO: 1809194 - RNA, 19 nt, Human
cgcccacuagacccacugg

SEQ ID NO: 1809195 - RNA, 16 nt, Human
ucuauugccucugaga

SEQ ID NO: 1809196 - RNA, 20 nt, Human
acaccuuaucuauguagaau

SEQ ID NO: 1809197 - RNA, 22 nt, Human
ugcagugccuuucuucucucca

SEQ ID NO: 1809198 - RNA, 16 nt, Human
uguaauuugaaauauu

SEQ ID NO: 1809199 - RNA, 14 nt, Human
auauauuuuaaaua

SEQ ID NO: 1809200 - RNA, 15 nt, Human
uaaucauuauuacuu

SEQ ID NO: 1809201 - RNA, 18 nt, Human
gcacuuggguaucuucuu

SEQ ID NO: 1809202 - RNA, 20 nt, Human
caagacugcaaacccuuuca

SEQ ID NO: 1809203 - RNA, 14 nt, Human
gaucuaugccacaa

SEQ ID NO: 1809204 - RNA, 15 nt, Human
cugaaagaggaauga

SEQ ID NO: 1809205 - RNA, 23 nt, Human
cuugauaaauggcuuccuggcaa

SEQ ID NO: 1809206 - RNA, 15 nt, Human
aaugaauggcuaagc

SEQ ID NO: 1809207 - RNA, 15 nt, Human
uauauuaugaagcuu

SEQ ID NO: 1809208 - RNA, 18 nt, Human
auuauguguguuuuaaaa

SEQ ID NO: 1809209 - RNA, 19 nt, Human
cacuuggcugcauaaaugu

SEQ ID NO: 1809210 - RNA, 13 nt, Human
aguuaccucugcc

SEQ ID NO: 1809211 - RNA, 15 nt, Human
guugucuuuuccuuc

SEQ ID NO: 1809212 - RNA, 13 nt, Human
ucugcccuuguca

SEQ ID NO: 1809213 - RNA, 14 nt, Human
ucagcucacugcaa

SEQ ID NO: 1809214 - RNA, 15 nt, Human
caggacgcccucacu

SEQ ID NO: 1809215 - RNA, 17 nt, Human
agcaaaugugaaucauu

SEQ ID NO: 1809216 - RNA, 18 nt, Human
uacaauaauucuaugaga

SEQ ID NO: 1809217 - RNA, 18 nt, Human
cuucccaggaguacaccc

SEQ ID NO: 1809218 - RNA, 20 nt, Human
ucuaugagggcuaauaucuu

SEQ ID NO: 1809219 - RNA, 22 nt, Human
cccuuccugggucuaccacuca

SEQ ID NO: 1809220 - RNA, 20 nt, Human
ucaacucucuuauugccuca

SEQ ID NO: 1809221 - RNA, 13 nt, Human
cccagccugcucc

SEQ ID NO: 1809222 - RNA, 22 nt, Human
acaagcaugagucacuacgccu

SEQ ID NO: 1809223 - RNA, 18 nt, Human
aucauaagauauuuuuca

SEQ ID NO: 1809224 - RNA, 23 nt, Human
uuaaguagauaaggaaauaagaa

SEQ ID NO: 1809225 - RNA, 17 nt, Human
gacagucaccucaugga

SEQ ID NO: 1809226 - RNA, 16 nt, Human
ccccaacagcacccuc

SEQ ID NO: 1809227 - RNA, 19 nt, Human
gccccuggucagucugccc

SEQ ID NO: 1809228 - RNA, 17 nt, Human
uacuacugaaucucuaa

SEQ ID NO: 1809229 - RNA, 16 nt, Human
ccuagucucuacccag

SEQ ID NO: 1809230 - RNA, 22 nt, Human
cauuucuuuucugcauguucua

SEQ ID NO: 1809231 - RNA, 22 nt, Human
guccccagccugcucccuagcc

SEQ ID NO: 1809232 - RNA, 17 nt, Human
cucugcucaacuagcag

SEQ ID NO: 1809233 - RNA, 16 nt, Human
caguaugcuuggacug

SEQ ID NO: 1809234 - RNA, 20 nt, Human
auaagccagacaucaacaga

SEQ ID NO: 1809235 - RNA, 16 nt, Human
ugccuccccugccuca

SEQ ID NO: 1809236 - RNA, 16 nt, Human
ugaaaacuggcuacug

SEQ ID NO: 1809237 - RNA, 22 nt, Human
aaaucucaaacuucuauuuuua

SEQ ID NO: 1809238 - RNA, 14 nt, Human
uuuuuucuaaagua

SEQ ID NO: 1809239 - RNA, 15 nt, Human
ggugacacagcuguc

SEQ ID NO: 1809240 - RNA, 20 nt, Human
cugaaggcauccccaggccc

SEQ ID NO: 1809241 - RNA, 18 nt, Human
caagggaacaaguacuuc

SEQ ID NO: 1809242 - RNA, 19 nt, Human
uaagugauugcugguuuua

SEQ ID NO: 1809243 - RNA, 16 nt, Human
gaacuacuagaaaauu

SEQ ID NO: 1809244 - RNA, 22 nt, Human
caagcucuaucaccaaggagcc

SEQ ID NO: 1809245 - RNA, 16 nt, Human
cccucaaacccauucc

SEQ ID NO: 1809246 - RNA, 22 nt, Human
uaggcucaaaacaggguuguug

SEQ ID NO: 1809247 - RNA, 19 nt, Human
acaugaauugcauuuuacu

SEQ ID NO: 1809248 - RNA, 13 nt, Human
gccucuguauuua

SEQ ID NO: 1809249 - RNA, 12 nt, Human
aauuuuaaaaug

SEQ ID NO: 1809250 - RNA, 13 nt, Human
auuugucaacaaa

SEQ ID NO: 1809251 - RNA, 19 nt, Human
caaguuauccaccugccuu

SEQ ID NO: 1809252 - RNA, 13 nt, Human
cacaccucuccaa

SEQ ID NO: 1809253 - RNA, 16 nt, Human
cccuggucccuuggag

SEQ ID NO: 1809254 - RNA, 14 nt, Human
gggcuggaugcucu

SEQ ID NO: 1809255 - RNA, 12 nt, Human
caaccucugccu

SEQ ID NO: 1809256 - RNA, 20 nt, Human
ggccuaugcagagguccaca

SEQ ID NO: 1809257 - RNA, 13 nt, Human
caaagcaaauaau

SEQ ID NO: 1809258 - RNA, 14 nt, Human
ggcacacugagcca

SEQ ID NO: 1809259 - RNA, 23 nt, Human
aaauuuacagagacagaaagcag

SEQ ID NO: 1809260 - RNA, 16 nt, Human
uggaaacgaagcacca

SEQ ID NO: 1809261 - RNA, 11 nt, Human
gguagcagagg

SEQ ID NO: 1809262 - RNA, 19 nt, Human
ccuggucagucugcccuug

SEQ ID NO: 1809263 - RNA, 16 nt, Human
ccccagugcggccagc

SEQ ID NO: 1809264 - RNA, 17 nt, Human
acagaagugcuuucuuc

SEQ ID NO: 1809265 - RNA, 22 nt, Human
caucgucuucuuggccauggga

SEQ ID NO: 1809266 - RNA, 21 nt, Human
cguggaaaggggcaggccaga

SEQ ID NO: 1809267 - RNA, 18 nt, Human
auaauauuaauaauaccu

SEQ ID NO: 1809268 - RNA, 19 nt, Human
uuugccaaguucuccacua

SEQ ID NO: 1809269 - RNA, 19 nt, Human
aaauuugggggacuuacau

SEQ ID NO: 1809270 - RNA, 15 nt, Human
uuaguuuuuaaagua

SEQ ID NO: 1809271 - RNA, 17 nt, Human
uccaacccgaggcccgc

SEQ ID NO: 1809272 - RNA, 13 nt, Human
agcauucugucuu

SEQ ID NO: 1809273 - RNA, 13 nt, Human
auuuuaaaagaau

SEQ ID NO: 1809274 - RNA, 13 nt, Human
agaauaaaauuuu

SEQ ID NO: 1809275 - RNA, 15 nt, Human
ugugaaauuuacauc

SEQ ID NO: 1809276 - RNA, 18 nt, Human
uacagggaugaggcagac

SEQ ID NO: 1809277 - RNA, 18 nt, Human
gcucuaauguacaauaaa

SEQ ID NO: 1809278 - RNA, 16 nt, Human
cuggggccaggcuggg

SEQ ID NO: 1809279 - RNA, 16 nt, Human
gcuucagucuuuucca

SEQ ID NO: 1809280 - RNA, 12 nt, Human
ucccacugccaa

SEQ ID NO: 1809281 - RNA, 11 nt, Human
ucaccugcccu

SEQ ID NO: 1809282 - RNA, 18 nt, Human
gcauauacuuuaauaaau

SEQ ID NO: 1809283 - RNA, 19 nt, Human
agcaauccucccacuucag

SEQ ID NO: 1809284 - RNA, 23 nt, Human
aaggaggauggcauauaauacaa

SEQ ID NO: 1809285 - RNA, 15 nt, Human
gccccugcacuccag

SEQ ID NO: 1809286 - RNA, 17 nt, Human
gccaaaaguauccaagg

SEQ ID NO: 1809287 - RNA, 23 nt, Human
uuagaugcaguucugaagaagau

SEQ ID NO: 1809288 - RNA, 18 nt, Human
aaacugccuaagcccucc

SEQ ID NO: 1809289 - RNA, 13 nt, Human
ugaucucagcuca

SEQ ID NO: 1809290 - RNA, 17 nt, Human
ggagacaaaaucuuaaa

SEQ ID NO: 1809291 - RNA, 22 nt, Human
aggacaccauuuuggcaagcuc

SEQ ID NO: 1809292 - RNA, 14 nt, Human
aauggcuaagcaaa

SEQ ID NO: 1809293 - RNA, 12 nt, Human
ccacgccacagc

SEQ ID NO: 1809294 - RNA, 20 nt, Human
aacuagcauaucugccuuua

SEQ ID NO: 1809295 - RNA, 23 nt, Human
ccacaccaaccuucugaggagcu

SEQ ID NO: 1809296 - RNA, 15 nt, Human
gucaaugcagccccc

SEQ ID NO: 1809297 - RNA, 14 nt, Human
caguaugaaaauaa

SEQ ID NO: 1809298 - RNA, 17 nt, Human
ggaaaacccagauaaag

SEQ ID NO: 1809299 - RNA, 23 nt, Human
ggcaggaacaaacagggcugccu

SEQ ID NO: 1809300 - RNA, 20 nt, Human
auuuauucaauaaaguauuu

SEQ ID NO: 1809301 - RNA, 19 nt, Human
agcuacaggacauuuuuaa

SEQ ID NO: 1809302 - RNA, 17 nt, Human
cuacacuccagugagac

SEQ ID NO: 1809303 - RNA, 21 nt, Human
gcagcauuguuggcuguuccu

SEQ ID NO: 1809304 - RNA, 15 nt, Human
gccuauuuuaauaaa

SEQ ID NO: 1809305 - RNA, 13 nt, Human
gcauuauaucaaa

SEQ ID NO: 1809306 - RNA, 14 nt, Human
acaaggccuuggag

SEQ ID NO: 1809307 - RNA, 17 nt, Human
cugagaugggagaauca

SEQ ID NO: 1809308 - RNA, 16 nt, Human
auuuacccuucuuuuc

SEQ ID NO: 1809309 - RNA, 23 nt, Human
uuuauuaggaguaccauaauucu

SEQ ID NO: 1809310 - RNA, 18 nt, Human
cuggaaacuucagcgguu

SEQ ID NO: 1809311 - RNA, 14 nt, Human
gagucugcacggga

SEQ ID NO: 1809312 - RNA, 18 nt, Human
uauaggauguggggaagu

SEQ ID NO: 1809313 - RNA, 18 nt, Human
agaaacagcuucucaauu

SEQ ID NO: 1809314 - RNA, 21 nt, Human
aagucuuucacauuuaaauaa

SEQ ID NO: 1809315 - RNA, 14 nt, Human
cuuccacguacugc

SEQ ID NO: 1809316 - RNA, 19 nt, Human
cucaccugagcgcucagcu

SEQ ID NO: 1809317 - RNA, 19 nt, Human
cagcucagggcucuuuccu

SEQ ID NO: 1809318 - RNA, 18 nt, Human
acugccuuuggcagaguu

SEQ ID NO: 1809319 - RNA, 19 nt, Human
cucccagcucagggcucuu

SEQ ID NO: 1809320 - RNA, 13 nt, Human
uuauucacaagac

SEQ ID NO: 1809321 - RNA, 14 nt, Human
aaccuuuucccaac

SEQ ID NO: 1809322 - RNA, 17 nt, Human
gccccccagcccuccuu

SEQ ID NO: 1809323 - RNA, 14 nt, Human
uucugaggccaggg

SEQ ID NO: 1809324 - RNA, 19 nt, Human
ucugagucaacuccuuucu

SEQ ID NO: 1809325 - RNA, 14 nt, Human
auaaauaaaaauaa

SEQ ID NO: 1809326 - RNA, 21 nt, Human
uggacucaagcaagauuucag

SEQ ID NO: 1809327 - RNA, 15 nt, Human
uauauccacuaaaau

SEQ ID NO: 1809328 - RNA, 18 nt, Human
ugcuauuuauuaaguauu

SEQ ID NO: 1809329 - RNA, 20 nt, Human
aguugagacaagaaaauaag

SEQ ID NO: 1809330 - RNA, 14 nt, Human
aggggugcugggac

SEQ ID NO: 1809331 - RNA, 13 nt, Human
auguuggccaggc

SEQ ID NO: 1809332 - RNA, 13 nt, Human
gagcaugagugcc

SEQ ID NO: 1809333 - RNA, 14 nt, Human
uucuggaauaaucc

SEQ ID NO: 1809334 - RNA, 13 nt, Human
gucuuucuuuccg

SEQ ID NO: 1809335 - RNA, 14 nt, Human
aaauauaaauaaaa

SEQ ID NO: 1809336 - RNA, 15 nt, Human
ccuugccaugugcua

SEQ ID NO: 1809337 - RNA, 23 nt, Human
cucugaauuugagauacaaacau

SEQ ID NO: 1809338 - RNA, 16 nt, Human
aguaagagauuccuga

SEQ ID NO: 1809339 - RNA, 19 nt, Human
cgauucuccugccucagcc

SEQ ID NO: 1809340 - RNA, 19 nt, Human
auuguaguccuguaaugga

SEQ ID NO: 1809341 - RNA, 16 nt, Human
agacucacugugggaa

SEQ ID NO: 1809342 - RNA, 17 nt, Human
agguuaaacuaaggccc

SEQ ID NO: 1809343 - RNA, 15 nt, Human
ccugucaucucacau

SEQ ID NO: 1809344 - RNA, 15 nt, Human
ucuugaaucucugaa

SEQ ID NO: 1809345 - RNA, 16 nt, Human
aaaugaaaaaauauau

SEQ ID NO: 1809346 - RNA, 13 nt, Human
guguguguuuuaa

SEQ ID NO: 1809347 - RNA, 21 nt, Human
cccgcaugcggcccaggaugg

SEQ ID NO: 1809348 - RNA, 16 nt, Human
uguaguccuguaaugg

SEQ ID NO: 1809349 - RNA, 21 nt, Human
aaaauuuuuaaucuuuaauuu

SEQ ID NO: 1809350 - RNA, 19 nt, Human
gcaucuagaggcuuccuuc

SEQ ID NO: 1809351 - RNA, 12 nt, Human
uucuuguauuuu

SEQ ID NO: 1809352 - RNA, 14 nt, Human
ccaugaccaacauc

SEQ ID NO: 1809353 - RNA, 18 nt, Human
caguugagacaagaaaau

SEQ ID NO: 1809354 - RNA, 23 nt, Human
ucuuagaugcaguucugaagaag

SEQ ID NO: 1809355 - RNA, 16 nt, Human
auagacuccugaaaga

SEQ ID NO: 1809356 - RNA, 13 nt, Human
cggugccuccaga

SEQ ID NO: 1809357 - RNA, 15 nt, Human
cccaacagcacccuc

SEQ ID NO: 1809358 - RNA, 15 nt, Human
gcauucuggauuuua

SEQ ID NO: 1809359 - RNA, 23 nt, Human
ugcccccaacagcacccucucca

SEQ ID NO: 1809360 - RNA, 16 nt, Human
gacucaucauuuccau

SEQ ID NO: 1809361 - RNA, 17 nt, Human
uuagauagaugaagaag

SEQ ID NO: 1809362 - RNA, 19 nt, Human
agagccuuuuuuugaaaaa

SEQ ID NO: 1809363 - RNA, 14 nt, Human
ugucauuucauuuc

SEQ ID NO: 1809364 - RNA, 17 nt, Human
uuccagaccugaagaau

SEQ ID NO: 1809365 - RNA, 21 nt, Human
caccugucccagaaaaagcau

SEQ ID NO: 1809366 - RNA, 13 nt, Human
auguagaauauau

SEQ ID NO: 1809367 - RNA, 16 nt, Human
ccaccauucugaggcc

SEQ ID NO: 1809368 - RNA, 23 nt, Human
ccacauuucccccuagccugccu

SEQ ID NO: 1809369 - RNA, 17 nt, Human
uucugaauuauuuucuc

SEQ ID NO: 1809370 - RNA, 20 nt, Human
uggggcuuuaacuccugcua

SEQ ID NO: 1809371 - RNA, 18 nt, Human
cuucaaagcaaagcucuu

SEQ ID NO: 1809372 - RNA, 14 nt, Human
ccagaaaaagcauc

SEQ ID NO: 1809373 - RNA, 18 nt, Human
ugaagaagcuagaaaaca

SEQ ID NO: 1809374 - RNA, 18 nt, Human
acagcuucagccaggagc

SEQ ID NO: 1809375 - RNA, 16 nt, Human
ccaggacgcccucacu

SEQ ID NO: 1809376 - RNA, 14 nt, Human
uaaugaauaaacau

SEQ ID NO: 1809377 - RNA, 13 nt, Human
auacauuucucau

SEQ ID NO: 1809378 - RNA, 17 nt, Human
accugagccccaaaagg

SEQ ID NO: 1809379 - RNA, 17 nt, Human
ucuucguauucccauua

SEQ ID NO: 1809380 - RNA, 17 nt, Human
ucauuuuaacaucugag

SEQ ID NO: 1809381 - RNA, 18 nt, Human
ucugaugagaacucugag

SEQ ID NO: 1809382 - RNA, 19 nt, Human
gcccuuccccucugcagcu

SEQ ID NO: 1809383 - RNA, 18 nt, Human
uaauauguuauuauuaaa

SEQ ID NO: 1809384 - RNA, 18 nt, Human
ccugaggugagcaucauc

SEQ ID NO: 1809385 - RNA, 16 nt, Human
cagccuggcucuccca

SEQ ID NO: 1809386 - RNA, 22 nt, Human
cgugcuugucccuguggaagua

SEQ ID NO: 1809387 - RNA, 19 nt, Human
ggguaccuaguccccagcc

SEQ ID NO: 1809388 - RNA, 15 nt, Human
aagucagcucuucuc

SEQ ID NO: 1809389 - RNA, 19 nt, Human
gacauacauuucucauacc

SEQ ID NO: 1809390 - RNA, 13 nt, Human
caaaacccuuucu

SEQ ID NO: 1809391 - RNA, 16 nt, Human
gacucugucuaccugg

SEQ ID NO: 1809392 - RNA, 21 nt, Human
uuugggaugcuacucuaguau

SEQ ID NO: 1809393 - RNA, 13 nt, Human
agagauuccugag

SEQ ID NO: 1809394 - RNA, 19 nt, Human
aaaauuuuuuuagaaagca

SEQ ID NO: 1809395 - RNA, 18 nt, Human
aucuauuuaaauauuuau

SEQ ID NO: 1809396 - RNA, 16 nt, Human
aguucucuugauuuuc

SEQ ID NO: 1809397 - RNA, 23 nt, Human
gguuucccuucuuuuuguucuuc

SEQ ID NO: 1809398 - RNA, 16 nt, Human
uaagguugaacacuuu

SEQ ID NO: 1809399 - RNA, 17 nt, Human
ugaaaacaauucuuauu

SEQ ID NO: 1809400 - RNA, 21 nt, Human
ccacccucagaugcacaugag

SEQ ID NO: 1809401 - RNA, 17 nt, Human
gcccccaacagcacccu

SEQ ID NO: 1809402 - RNA, 23 nt, Human
gccccugcacuccagccugagcg

SEQ ID NO: 1809403 - RNA, 18 nt, Human
cagugaaagaaaauaaca

SEQ ID NO: 1809404 - RNA, 22 nt, Human
ucuccauccuaccacaaugcag

SEQ ID NO: 1809405 - RNA, 21 nt, Human
ugcugcgcagcaucccuaguc

SEQ ID NO: 1809406 - RNA, 16 nt, Human
cucagcuucuccaaca

SEQ ID NO: 1809407 - RNA, 22 nt, Human
gcucagcccugcaccaugcugc

SEQ ID NO: 1809408 - RNA, 20 nt, Human
ccagcuggccgggagccuga

SEQ ID NO: 1809409 - RNA, 23 nt, Human
cagaugagaagucugcuacccuc

SEQ ID NO: 1809410 - RNA, 23 nt, Human
accaugcugcuggggaagacagu

SEQ ID NO: 1809411 - RNA, 18 nt, Human
aaugcagugccuuucuuc

SEQ ID NO: 1809412 - RNA, 17 nt, Human
auggcuaguaucaaaag

SEQ ID NO: 1809413 - RNA, 21 nt, Human
cuguuaucuucacuuuuauaa

SEQ ID NO: 1809414 - RNA, 20 nt, Human
acuucguguccgacucuucu

SEQ ID NO: 1809415 - RNA, 14 nt, Human
uuguaauuugaaau

SEQ ID NO: 1809416 - RNA, 18 nt, Human
uauaaucauuuaucauau

SEQ ID NO: 1809417 - RNA, 20 nt, Human
agcuaucguaaaauuaagaa

SEQ ID NO: 1809418 - RNA, 20 nt, Human
ucuacccaguagaugccacu

SEQ ID NO: 1809419 - RNA, 18 nt, Human
cugccucaccagcccugg

SEQ ID NO: 1809420 - RNA, 21 nt, Human
cacuuuagaauaugccuuguu

SEQ ID NO: 1809421 - RNA, 17 nt, Human
aguuuauauagaaaugu

SEQ ID NO: 1809422 - RNA, 22 nt, Human
aucucuucuggguuccuuccuc

SEQ ID NO: 1809423 - RNA, 18 nt, Human
auguuaaaacugggacag

SEQ ID NO: 1809424 - RNA, 23 nt, Human
cagguaaccccagauucaugcac

SEQ ID NO: 1809425 - RNA, 12 nt, Human
uuuuuuuuaaaa

SEQ ID NO: 1809426 - RNA, 15 nt, Human
cuaguaauuggaaag

SEQ ID NO: 1809427 - RNA, 23 nt, Human
uagauguauagguugaugguggu

SEQ ID NO: 1809428 - RNA, 17 nt, Human
gaaauugccugacgaac

SEQ ID NO: 1809429 - RNA, 14 nt, Human
ccuaacuuacauuc

SEQ ID NO: 1809430 - RNA, 13 nt, Human
auauauagcagcu

SEQ ID NO: 1809431 - RNA, 19 nt, Human
guaguccuguaauggaagc

SEQ ID NO: 1809432 - RNA, 22 nt, Human
gguauaauucacauuguauuca

SEQ ID NO: 1809433 - RNA, 23 nt, Human
ccacuuuauuucuuuuuguuccc

SEQ ID NO: 1809434 - RNA, 21 nt, Human
uuccuguggauguaaagugau

SEQ ID NO: 1809435 - RNA, 16 nt, Human
cuccugaccucaggca

SEQ ID NO: 1809436 - RNA, 13 nt, Human
uaauuuuucacuu

SEQ ID NO: 1809437 - RNA, 20 nt, Human
ccucuccagaugcagcccca

SEQ ID NO: 1809438 - RNA, 14 nt, Human
gcauggaaggcaag

SEQ ID NO: 1809439 - RNA, 19 nt, Human
gggcugccuucuggccuug

SEQ ID NO: 1809440 - RNA, 17 nt, Human
ucuuauaauuuaaaaua

SEQ ID NO: 1809441 - RNA, 21 nt, Human
gaagugaaaaucuacacucca

SEQ ID NO: 1809442 - RNA, 18 nt, Human
acccagucuguuccccau

SEQ ID NO: 1809443 - RNA, 14 nt, Human
agcuggagugcagu

SEQ ID NO: 1809444 - RNA, 19 nt, Human
ugaaauuguauuacaaauc

SEQ ID NO: 1809445 - RNA, 15 nt, Human
cagugucaggaggaa

SEQ ID NO: 1809446 - RNA, 15 nt, Human
ggcaucaucucagcu

SEQ ID NO: 1809447 - RNA, 15 nt, Human
ucaccagucccuccc

SEQ ID NO: 1809448 - RNA, 15 nt, Human
uaaaagacaaggaaa

SEQ ID NO: 1809449 - RNA, 23 nt, Human
cuggggcuuuaacuccugcuaga

SEQ ID NO: 1809450 - RNA, 16 nt, Human
cuggucugguugggca

SEQ ID NO: 1809451 - RNA, 15 nt, Human
accacauccagccua

SEQ ID NO: 1809452 - RNA, 15 nt, Human
ggcauuauccaucuu

SEQ ID NO: 1809453 - RNA, 19 nt, Human
aaggccuuuaaaauuuuuu

SEQ ID NO: 1809454 - RNA, 14 nt, Human
caaccucugccucc

SEQ ID NO: 1809455 - RNA, 17 nt, Human
uguuuuaaaaugagaaa

SEQ ID NO: 1809456 - RNA, 15 nt, Human
uaagauauuuuucau

SEQ ID NO: 1809457 - RNA, 17 nt, Human
auguugcccuguugcug

SEQ ID NO: 1809458 - RNA, 16 nt, Human
ccaccagguucuuucu

SEQ ID NO: 1809459 - RNA, 17 nt, Human
guucauuccuccaggua

SEQ ID NO: 1809460 - RNA, 21 nt, Human
aaugaauggcuaagcaaaaug

SEQ ID NO: 1809461 - RNA, 17 nt, Human
agcgauucuccugccuc

SEQ ID NO: 1809462 - RNA, 14 nt, Human
ugacacuuaaaaau

SEQ ID NO: 1809463 - RNA, 17 nt, Human
uuugaaaccaugaagag

SEQ ID NO: 1809464 - RNA, 16 nt, Human
gugagacagcucugca

SEQ ID NO: 1809465 - RNA, 14 nt, Human
cuggucagcccccu

SEQ ID NO: 1809466 - RNA, 15 nt, Human
auuauuuuuuaaaaa

SEQ ID NO: 1809467 - RNA, 17 nt, Human
uaccucaguucccucuu

SEQ ID NO: 1809468 - RNA, 15 nt, Human
cagugucugcuggag

SEQ ID NO: 1809469 - RNA, 17 nt, Human
caaacuucuauuuuuau

SEQ ID NO: 1809470 - RNA, 17 nt, Human
cucuuuugggauuuuug

SEQ ID NO: 1809471 - RNA, 17 nt, Human
cacuucaaaacaguauu

SEQ ID NO: 1809472 - RNA, 16 nt, Human
uacauuuucuaagaaa

SEQ ID NO: 1809473 - RNA, 16 nt, Human
ugcaugguuuagaaag

SEQ ID NO: 1809474 - RNA, 21 nt, Human
cugcucuuccucagcugugug

SEQ ID NO: 1809475 - RNA, 14 nt, Human
cuucacccugaggu

SEQ ID NO: 1809476 - RNA, 21 nt, Human
aggcagcuuuuucucucccac

SEQ ID NO: 1809477 - RNA, 20 nt, Human
agcuuauugucuagugaaac

SEQ ID NO: 1809478 - RNA, 16 nt, Human
cuauuuuuggaagagg

SEQ ID NO: 1809479 - RNA, 16 nt, Human
ugcuuuggaaaaccca

SEQ ID NO: 1809480 - RNA, 21 nt, Human
aaagaaaacuuguauuaugug

SEQ ID NO: 1809481 - RNA, 18 nt, Human
gacucacugugggaagga

SEQ ID NO: 1809482 - RNA, 22 nt, Human
accauuucuugagguaaaagca

SEQ ID NO: 1809483 - RNA, 20 nt, Human
aaauuauuuuuguucauaua

SEQ ID NO: 1809484 - RNA, 10 nt, Human
aaagaaaauc

SEQ ID NO: 1809485 - RNA, 21 nt, Human
uccccagccugcucccuagcc

SEQ ID NO: 1809486 - RNA, 16 nt, Human
uuaaucugccucccuc

SEQ ID NO: 1809487 - RNA, 18 nt, Human
auaaugugauauuauaca

SEQ ID NO: 1809488 - RNA, 15 nt, Human
agagccuccuuucug

SEQ ID NO: 1809489 - RNA, 19 nt, Human
aguucaauauaagcuuuuc

SEQ ID NO: 1809490 - RNA, 16 nt, Human
uauaucaauuuaaaaa

SEQ ID NO: 1809491 - RNA, 18 nt, Human
aucucuuguuuaaauuca

SEQ ID NO: 1809492 - RNA, 16 nt, Human
cucggugcucccuuug

SEQ ID NO: 1809493 - RNA, 22 nt, Human
agacgugcacgcacacugucug

SEQ ID NO: 1809494 - RNA, 18 nt, Human
cagcauaauacuugcuuu

SEQ ID NO: 1809495 - RNA, 17 nt, Human
ggaaggggaaggauagg

SEQ ID NO: 1809496 - RNA, 20 nt, Human
gggaggcagagguugcagug

SEQ ID NO: 1809497 - RNA, 17 nt, Human
uauaauauuuuuaauau

SEQ ID NO: 1809498 - RNA, 13 nt, Human
cccacgccacagc

SEQ ID NO: 1809499 - RNA, 16 nt, Human
aaugaaagcagggacu

SEQ ID NO: 1809500 - RNA, 23 nt, Human
gcuggagugcaguggcaucaucu

SEQ ID NO: 1809501 - RNA, 18 nt, Human
ggccccaagcccacuggg

SEQ ID NO: 1809502 - RNA, 13 nt, Human
auucuccugccuc

SEQ ID NO: 1809503 - RNA, 14 nt, Human
cuuuuaguuuuuaa

SEQ ID NO: 1809504 - RNA, 15 nt, Human
auauauauacauaca

SEQ ID NO: 1809505 - RNA, 16 nt, Human
gagaaacuggaacucu

SEQ ID NO: 1809506 - RNA, 19 nt, Human
ugauccacccgccucagcc

SEQ ID NO: 1809507 - RNA, 16 nt, Human
auccuugucuuuuuau

SEQ ID NO: 1809508 - RNA, 14 nt, Human
augugaaacauguu

SEQ ID NO: 1809509 - RNA, 13 nt, Human
gcauuacugcaug

SEQ ID NO: 1809510 - RNA, 20 nt, Human
aauuauaucaauuuccucau

SEQ ID NO: 1809511 - RNA, 14 nt, Human
aaaaagaucccaaa

SEQ ID NO: 1809512 - RNA, 15 nt, Human
uguauuacaaauauu

SEQ ID NO: 1809513 - RNA, 12 nt, Human
aucguguccccu

SEQ ID NO: 1809514 - RNA, 14 nt, Human
aaaacaauucuuau

SEQ ID NO: 1809515 - RNA, 23 nt, Human
aagcgauucuccugccucagccu

SEQ ID NO: 1809516 - RNA, 16 nt, Human
cucccuaccuaccaag

SEQ ID NO: 1809517 - RNA, 15 nt, Human
ccacgccacagcccu

SEQ ID NO: 1809518 - RNA, 14 nt, Human
caucugauugugau

SEQ ID NO: 1809519 - RNA, 22 nt, Human
guguccgacucuucugagcacc

SEQ ID NO: 1809520 - RNA, 11 nt, Human
cauaauuauua

SEQ ID NO: 1809521 - RNA, 23 nt, Human
uagguuucugaguuccugcaugc

SEQ ID NO: 1809522 - RNA, 17 nt, Human
uugcaguuuuuuccuag

SEQ ID NO: 1809523 - RNA, 23 nt, Human
auguaggguucccuuauauuaau

SEQ ID NO: 1809524 - RNA, 14 nt, Human
aaaacugugccuug

SEQ ID NO: 1809525 - RNA, 14 nt, Human
ccugcucuuccuca

SEQ ID NO: 1809526 - RNA, 22 nt, Human
ucugcuggagacauugaggcag

SEQ ID NO: 1809527 - RNA, 20 nt, Human
gaaauagcccuguaacaggc

SEQ ID NO: 1809528 - RNA, 13 nt, Human
cucacugugggaa

SEQ ID NO: 1809529 - RNA, 18 nt, Human
gucgcccuacucaccuga

SEQ ID NO: 1809530 - RNA, 14 nt, Human
gaguacaccccaac

SEQ ID NO: 1809531 - RNA, 12 nt, Human
cagaacagugau

SEQ ID NO: 1809532 - RNA, 20 nt, Human
cucuggggagcucaggaagg

SEQ ID NO: 1809533 - RNA, 23 nt, Human
cacuggacucaccucccccaucu

SEQ ID NO: 1809534 - RNA, 11 nt, Human
augggacaggg

SEQ ID NO: 1809535 - RNA, 19 nt, Human
ccucacuuaaacuuuuauc

SEQ ID NO: 1809536 - RNA, 18 nt, Human
gguucaagcaauccuccc

SEQ ID NO: 1809537 - RNA, 20 nt, Human
ugauuauaugucacuuugcu

SEQ ID NO: 1809538 - RNA, 15 nt, Human
caaguuagaacuagc

SEQ ID NO: 1809539 - RNA, 18 nt, Human
uuaauuuuugaaaacugg

SEQ ID NO: 1809540 - RNA, 14 nt, Human
gcuguccuggaggg

SEQ ID NO: 1809541 - RNA, 16 nt, Human
auguuucacugugcaa

SEQ ID NO: 1809542 - RNA, 15 nt, Human
augaugacuauggaa

SEQ ID NO: 1809543 - RNA, 11 nt, Human
uuuuuuuuccc

SEQ ID NO: 1809544 - RNA, 18 nt, Human
aaguauucuguguuaaaa

SEQ ID NO: 1809545 - RNA, 16 nt, Human
uaaaccuauacucacu

SEQ ID NO: 1809546 - RNA, 11 nt, Human
uuuucacuuca

SEQ ID NO: 1809547 - RNA, 22 nt, Human
cccccugcaaagcccagcuuga

SEQ ID NO: 1809548 - RNA, 14 nt, Human
gcauauuuauaaaa

SEQ ID NO: 1809549 - RNA, 16 nt, Human
agcccaucauaauaua

SEQ ID NO: 1809550 - RNA, 13 nt, Human
cacaugggaucaa

SEQ ID NO: 1809551 - RNA, 13 nt, Human
acacucuuguaau

SEQ ID NO: 1809552 - RNA, 19 nt, Human
gguuuaauaauuuuuaauu

SEQ ID NO: 1809553 - RNA, 14 nt, Human
auuuauaaaaauaa

SEQ ID NO: 1809554 - RNA, 17 nt, Human
auggccuggcugcugcu

SEQ ID NO: 1809555 - RNA, 20 nt, Human
aauuuuuucucuaggaaaua

SEQ ID NO: 1809556 - RNA, 16 nt, Human
uagccaauauuuuucu

SEQ ID NO: 1809557 - RNA, 15 nt, Human
accaucgucuucuug

SEQ ID NO: 1809558 - RNA, 20 nt, Human
cucugcaaacugccuucuuc

SEQ ID NO: 1809559 - RNA, 20 nt, Human
caguauuguuccuuuugugg

SEQ ID NO: 1809560 - RNA, 15 nt, Human
ccagauccuggaaau

SEQ ID NO: 1809561 - RNA, 19 nt, Human
cucuugccaaaucaaaaga

SEQ ID NO: 1809562 - RNA, 14 nt, Human
auauacuuuaauaa

SEQ ID NO: 1809563 - RNA, 22 nt, Human
aaaguugguaaaccuuuuauau

SEQ ID NO: 1809564 - RNA, 16 nt, Human
aaaccauuuucuuuuu

SEQ ID NO: 1809565 - RNA, 15 nt, Human
ggaaauauuuuaaug

SEQ ID NO: 1809566 - RNA, 14 nt, Human
agcaaguccuuccc

SEQ ID NO: 1809567 - RNA, 20 nt, Human
caccaucgucuucuuggcca

SEQ ID NO: 1809568 - RNA, 23 nt, Human
ggcaauuaauuccuucagcacuu

SEQ ID NO: 1809569 - RNA, 12 nt, Human
cuguauuucccc

SEQ ID NO: 1809570 - RNA, 20 nt, Human
cuccuccauaucucccucuu

SEQ ID NO: 1809571 - RNA, 15 nt, Human
ccaucucaggugugu

SEQ ID NO: 1809572 - RNA, 11 nt, Human
cuagccagagg

SEQ ID NO: 1809573 - RNA, 15 nt, Human
ugcaauuccacuuau

SEQ ID NO: 1809574 - RNA, 20 nt, Human
uggaauaauccuaaacauau

SEQ ID NO: 1809575 - RNA, 21 nt, Human
cugguagcuaaauauauauuu

SEQ ID NO: 1809576 - RNA, 20 nt, Human
uguacccaguagaugccacc

SEQ ID NO: 1809577 - RNA, 20 nt, Human
gcccccaaccauuuccucag

SEQ ID NO: 1809578 - RNA, 14 nt, Human
ccacuagcccuccu

SEQ ID NO: 1809579 - RNA, 11 nt, Human
uuucuuuguaa

SEQ ID NO: 1809580 - RNA, 19 nt, Human
gauuuuucaugauuuugaa

SEQ ID NO: 1809581 - RNA, 15 nt, Human
agaaugguaucaaua

SEQ ID NO: 1809582 - RNA, 15 nt, Human
cuuccuucauuuccu

SEQ ID NO: 1809583 - RNA, 21 nt, Human
ugaugcaacauccuugucuuu

SEQ ID NO: 1809584 - RNA, 17 nt, Human
cacaccaaccuucugag

SEQ ID NO: 1809585 - RNA, 21 nt, Human
uuaugaguggcuuuaaugaau

SEQ ID NO: 1809586 - RNA, 22 nt, Human
cugcuuggagcagccuaacacg

SEQ ID NO: 1809587 - RNA, 11 nt, Human
gcauuguccuc

SEQ ID NO: 1809588 - RNA, 17 nt, Human
caucgcagacacaugug

SEQ ID NO: 1809589 - RNA, 13 nt, Human
uacccuucuuuuc

SEQ ID NO: 1809590 - RNA, 13 nt, Human
ccaugucuacaca

SEQ ID NO: 1809591 - RNA, 21 nt, Human
uaaauuaguuagccaauauuu

SEQ ID NO: 1809592 - RNA, 14 nt, Human
agaccuuccagaaa

SEQ ID NO: 1809593 - RNA, 20 nt, Human
accugucccagaaaaagcau

SEQ ID NO: 1809594 - RNA, 15 nt, Human
cuggcuacuccaugu

SEQ ID NO: 1809595 - RNA, 22 nt, Human
ccagcuggccuugugaggagcu

SEQ ID NO: 1809596 - RNA, 19 nt, Human
uuuaaaaucucaaacuucu

SEQ ID NO: 1809597 - RNA, 17 nt, Human
agcucacugcaaccucc

SEQ ID NO: 1809598 - RNA, 21 nt, Human
aucccacucacaacagcugcc

SEQ ID NO: 1809599 - RNA, 16 nt, Human
guugagacaagaaaau

SEQ ID NO: 1809600 - RNA, 13 nt, Human
uccccccacagcc

SEQ ID NO: 1809601 - RNA, 13 nt, Human
cauacauguaaaa

SEQ ID NO: 1809602 - RNA, 18 nt, Human
ucuuauuuauucauauuu

SEQ ID NO: 1809603 - RNA, 22 nt, Human
ucccccagugcggccagcuccg

SEQ ID NO: 1809604 - RNA, 19 nt, Human
cagcggcaucaggcuuucu

SEQ ID NO: 1809605 - RNA, 13 nt, Human
augcugagagagc

SEQ ID NO: 1809606 - RNA, 12 nt, Human
cuaagaagugaa

SEQ ID NO: 1809607 - RNA, 22 nt, Human
uggguuuuuuaguugaauuuuu

SEQ ID NO: 1809608 - RNA, 23 nt, Human
aggaccggccuuugcaccuccau

SEQ ID NO: 1809609 - RNA, 21 nt, Human
cugagccucagucucccuccc

SEQ ID NO: 1809610 - RNA, 14 nt, Human
gauuaguacacacu

SEQ ID NO: 1809611 - RNA, 22 nt, Human
cuggguuccuuccucugagccu

SEQ ID NO: 1809612 - RNA, 19 nt, Human
ccugcucccuagccagagg

SEQ ID NO: 1809613 - RNA, 13 nt, Human
caggaaaaagugg

SEQ ID NO: 1809614 - RNA, 17 nt, Human
agguucaugcaaacuuu

SEQ ID NO: 1809615 - RNA, 21 nt, Human
accagagaagggcuuggacuc

SEQ ID NO: 1809616 - RNA, 21 nt, Human
cuggguuuuggggggacgcua

SEQ ID NO: 1809617 - RNA, 17 nt, Human
ugcucauuuuuucuucu

SEQ ID NO: 1809618 - RNA, 16 nt, Human
ucauaaagcaggcaga

SEQ ID NO: 1809619 - RNA, 23 nt, Human
cagcucacuacaaccuccgccuc

SEQ ID NO: 1809620 - RNA, 17 nt, Human
aaaucuaguaauuugua

SEQ ID NO: 1809621 - RNA, 18 nt, Human
agugcauuuaugagcucu

SEQ ID NO: 1809622 - RNA, 17 nt, Human
cuagcuggcucugugag

SEQ ID NO: 1809623 - RNA, 18 nt, Human
aaggaugccccguccccc

SEQ ID NO: 1809624 - RNA, 15 nt, Human
cuuuuaugugaaaca

SEQ ID NO: 1809625 - RNA, 19 nt, Human
aucuuuuuacuaaacucag

SEQ ID NO: 1809626 - RNA, 16 nt, Human
cuggaugcucucguug

SEQ ID NO: 1809627 - RNA, 13 nt, Human
uuucuccuuguug

SEQ ID NO: 1809628 - RNA, 14 nt, Human
gcuuccaauuuuug

SEQ ID NO: 1809629 - RNA, 22 nt, Human
aauuuuuucucuaggaaauauu

SEQ ID NO: 1809630 - RNA, 19 nt, Human
gagccucagucucccuccc

SEQ ID NO: 1809631 - RNA, 20 nt, Human
acagcccuucuuuccacaga

SEQ ID NO: 1809632 - RNA, 21 nt, Human
uccuucugagccugccuuucu

SEQ ID NO: 1809633 - RNA, 20 nt, Human
cagcucagaaguuucuucuu

SEQ ID NO: 1809634 - RNA, 16 nt, Human
cugccaagccaugggu

SEQ ID NO: 1809635 - RNA, 17 nt, Human
aaaaauuccuuuucccg

SEQ ID NO: 1809636 - RNA, 18 nt, Human
ggggcccggacgcccagg

SEQ ID NO: 1809637 - RNA, 18 nt, Human
guccuggaggggcugggg

SEQ ID NO: 1809638 - RNA, 21 nt, Human
uauguuguaauauuucuucaa

SEQ ID NO: 1809639 - RNA, 20 nt, Human
ggggcuucagucuuuuccau

SEQ ID NO: 1809640 - RNA, 16 nt, Human
ugugagaugcuagaac

SEQ ID NO: 1809641 - RNA, 16 nt, Human
aaaccuauacucacuu

SEQ ID NO: 1809642 - RNA, 22 nt, Human
caucacagcuuauuuccucauu

SEQ ID NO: 1809643 - RNA, 15 nt, Human
cuaauuuugaaaaac

SEQ ID NO: 1809644 - RNA, 16 nt, Human
gcaaccucugccuccc

SEQ ID NO: 1809645 - RNA, 20 nt, Human
cagucccugcagcucucuuu

SEQ ID NO: 1809646 - RNA, 17 nt, Human
ccucagucucccucccu

SEQ ID NO: 1809647 - RNA, 16 nt, Human
ccccuagccugccucc

SEQ ID NO: 1809648 - RNA, 19 nt, Human
gcucugaagaacucucugg

SEQ ID NO: 1809649 - RNA, 16 nt, Human
acugugcaaauauauc

SEQ ID NO: 1809650 - RNA, 22 nt, Human
gcuugcagagaugaggccgcca

SEQ ID NO: 1809651 - RNA, 14 nt, Human
ucugugacccacuu

SEQ ID NO: 1809652 - RNA, 16 nt, Human
cuuggagacagggccc

SEQ ID NO: 1809653 - RNA, 14 nt, Human
gaaggcuuacaccc

SEQ ID NO: 1809654 - RNA, 18 nt, Human
uccuuucucaucuugucc

SEQ ID NO: 1809655 - RNA, 21 nt, Human
uuuauauaagcuuguauuccu

SEQ ID NO: 1809656 - RNA, 23 nt, Human
caauaaagcaaugugguaguucc

SEQ ID NO: 1809657 - RNA, 23 nt, Human
uucuuccacagugccuaauaaua

SEQ ID NO: 1809658 - RNA, 16 nt, Human
uucuauaauuuaaaua

SEQ ID NO: 1809659 - RNA, 18 nt, Human
aaaaucuuauaauuuaaa

SEQ ID NO: 1809660 - RNA, 23 nt, Human
acccaggaggugugauuccugaa

SEQ ID NO: 1809661 - RNA, 17 nt, Human
agaaaugaaagcaggga

SEQ ID NO: 1809662 - RNA, 12 nt, Human
ccuccucggcuu

SEQ ID NO: 1809663 - RNA, 17 nt, Human
cagccugcucccuagcc

SEQ ID NO: 1809664 - RNA, 15 nt, Human
cccugccccccagcc

SEQ ID NO: 1809665 - RNA, 19 nt, Human
gcaaaguuuaauggugccu

SEQ ID NO: 1809666 - RNA, 15 nt, Human
ccucugcccuuccug

SEQ ID NO: 1809667 - RNA, 22 nt, Human
gccaacccaaaauaagcaggcg

SEQ ID NO: 1809668 - RNA, 13 nt, Human
uuugucucugcaa

SEQ ID NO: 1809669 - RNA, 15 nt, Human
ugguuuagaaagcuu

SEQ ID NO: 1809670 - RNA, 15 nt, Human
aauacuuuauaaagg

SEQ ID NO: 1809671 - RNA, 17 nt, Human
ccuccauaucucccucu

SEQ ID NO: 1809672 - RNA, 21 nt, Human
gaaggaaagaauaaccaacac

SEQ ID NO: 1809673 - RNA, 18 nt, Human
cuuggaauccuggggaac

SEQ ID NO: 1809674 - RNA, 22 nt, Human
aaacacugggagaaaugaaaaa

SEQ ID NO: 1809675 - RNA, 21 nt, Human
aaagacaauuguuggagagcc

SEQ ID NO: 1809676 - RNA, 16 nt, Human
cuuguauuaugugugu

SEQ ID NO: 1809677 - RNA, 20 nt, Human
guauuccagaccugaagaau

SEQ ID NO: 1809678 - RNA, 23 nt, Human
uaagaaauaggaaauauuuuaau

SEQ ID NO: 1809679 - RNA, 23 nt, Human
uguaacuucccugaaaaaucuaa

SEQ ID NO: 1809680 - RNA, 18 nt, Human
accuagcuggcucuguga

SEQ ID NO: 1809681 - RNA, 14 nt, Human
uauacaaaacccuu

SEQ ID NO: 1809682 - RNA, 18 nt, Human
ggaccaguaugcuuggac

SEQ ID NO: 1809683 - RNA, 16 nt, Human
auauugauuuauuaau

SEQ ID NO: 1809684 - RNA, 23 nt, Human
auguaacuagaauuucuuuaacu

SEQ ID NO: 1809685 - RNA, 23 nt, Human
uguacaguuauuuaugccucugu

SEQ ID NO: 1809686 - RNA, 17 nt, Human
ucccuauuccuccuucc

SEQ ID NO: 1809687 - RNA, 18 nt, Human
ugcgccaccauggccagc

SEQ ID NO: 1809688 - RNA, 18 nt, Human
aauucaaaggcauuucuu

SEQ ID NO: 1809689 - RNA, 15 nt, Human
ucauaagaauucugu

SEQ ID NO: 1809690 - RNA, 20 nt, Human
cuuuuuuuucuuuuuuuaga

SEQ ID NO: 1809691 - RNA, 19 nt, Human
auuuugagaaagucuuauu

SEQ ID NO: 1809692 - RNA, 17 nt, Human
ugagagucugugaccca

SEQ ID NO: 1809693 - RNA, 14 nt, Human
gcacuuggcugcau

SEQ ID NO: 1809694 - RNA, 20 nt, Human
ccucuucccuaggagaggag

SEQ ID NO: 1809695 - RNA, 19 nt, Human
gugaugugaguugcacagc

SEQ ID NO: 1809696 - RNA, 23 nt, Human
augagaaaucuaaaaaacgaaaa

SEQ ID NO: 1809697 - RNA, 15 nt, Human
aacuuacauucuuaa

SEQ ID NO: 1809698 - RNA, 20 nt, Human
uagcuccuccuuuuuccuuc

SEQ ID NO: 1809699 - RNA, 22 nt, Human
acacauacauguaaaauauguc

SEQ ID NO: 1809700 - RNA, 18 nt, Human
gucuuguuuacucagaau

SEQ ID NO: 1809701 - RNA, 14 nt, Human
aaaagacuuuuucc

SEQ ID NO: 1809702 - RNA, 19 nt, Human
cucccacuucagccuccca

SEQ ID NO: 1809703 - RNA, 21 nt, Human
uaaaagacagugaaagaaaau

SEQ ID NO: 1809704 - RNA, 12 nt, Human
uuuaucauguga

SEQ ID NO: 1809705 - RNA, 14 nt, Human
acuuuuauaagaaa

SEQ ID NO: 1809706 - RNA, 17 nt, Human
cuuguauaucuuguuuu

SEQ ID NO: 1809707 - RNA, 23 nt, Human
auuuauaaaaauaaaaaacacug

SEQ ID NO: 1809708 - RNA, 17 nt, Human
accugcucagcccugca

SEQ ID NO: 1809709 - RNA, 20 nt, Human
agcauuguuggcuguuccug

SEQ ID NO: 1809710 - RNA, 17 nt, Human
aaccuucugaggagcug

SEQ ID NO: 1809711 - RNA, 21 nt, Human
ugguagauucuaauggcuuua

SEQ ID NO: 1809712 - RNA, 17 nt, Human
aaaugagaaaucuaaaa

SEQ ID NO: 1809713 - RNA, 21 nt, Human
ucaagcgauucucuugccuca

SEQ ID NO: 1809714 - RNA, 20 nt, Human
guacuagagcaagcaggaau

SEQ ID NO: 1809715 - RNA, 22 nt, Human
uacugagagugaacaaauuuac

SEQ ID NO: 1809716 - RNA, 20 nt, Human
ucccuugauggucccuauuc

SEQ ID NO: 1809717 - RNA, 17 nt, Human
auuuaugccucuguauu

SEQ ID NO: 1809718 - RNA, 15 nt, Human
auauaaucauuauua

SEQ ID NO: 1809719 - RNA, 18 nt, Human
auugauccagaaagaaaa

SEQ ID NO: 1809720 - RNA, 15 nt, Human
ucacugcaggcuccc

SEQ ID NO: 1809721 - RNA, 14 nt, Human
uuaguuuaaaaacc

SEQ ID NO: 1809722 - RNA, 22 nt, Human
uccaauuagcuccuccuuuuuc

SEQ ID NO: 1809723 - RNA, 12 nt, Human
gacuugagugcu

SEQ ID NO: 1809724 - RNA, 19 nt, Human
uuuucugcauguucuaaau

SEQ ID NO: 1809725 - RNA, 23 nt, Human
cccuccacauuucccccuagccu

SEQ ID NO: 1809726 - RNA, 23 nt, Human
agucucuacccaguagaugccac

SEQ ID NO: 1809727 - RNA, 15 nt, Human
auuuuguuuaaauua

SEQ ID NO: 1809728 - RNA, 19 nt, Human
aagucuuucacauuuaaau

SEQ ID NO: 1809729 - RNA, 15 nt, Human
cugugggaaggagac

SEQ ID NO: 1809730 - RNA, 15 nt, Human
uccuacaagacacag

SEQ ID NO: 1809731 - RNA, 16 nt, Human
cgaaggaaaagggcuu

SEQ ID NO: 1809732 - RNA, 18 nt, Human
ugggguaccuagucccca

SEQ ID NO: 1809733 - RNA, 21 nt, Human
aaagaacuucuccuacuguag

SEQ ID NO: 1809734 - RNA, 19 nt, Human
cuugguucucuccaccagg

SEQ ID NO: 1809735 - RNA, 22 nt, Human
uauuauuuuugagacagagucu

SEQ ID NO: 1809736 - RNA, 17 nt, Human
caagaaaugaaagcagg

SEQ ID NO: 1809737 - RNA, 17 nt, Human
auuuuagaacauuuuca

SEQ ID NO: 1809738 - RNA, 19 nt, Human
uaaccagaucauugugaaa

SEQ ID NO: 1809739 - RNA, 20 nt, Human
uucacauuuuuguauuuugu

SEQ ID NO: 1809740 - RNA, 19 nt, Human
ccagaucuaugccacaaga

SEQ ID NO: 1809741 - RNA, 17 nt, Human
ccuauccuacuuccccu

SEQ ID NO: 1809742 - RNA, 15 nt, Human
guauuauaauucaaa

SEQ ID NO: 1809743 - RNA, 17 nt, Human
ugacucuuggcacagca

SEQ ID NO: 1809744 - RNA, 14 nt, Human
agcuggaaacacau

SEQ ID NO: 1809745 - RNA, 14 nt, Human
cccuuucugccccu

SEQ ID NO: 1809746 - RNA, 16 nt, Human
auauuuccaagaaaua

SEQ ID NO: 1809747 - RNA, 15 nt, Human
uagacacugaucugg

SEQ ID NO: 1809748 - RNA, 20 nt, Human
ccagugagacagcucugcau

SEQ ID NO: 1809749 - RNA, 20 nt, Human
cagauucucccuugcucugc

SEQ ID NO: 1809750 - RNA, 12 nt, Human
gaauggaagagg

SEQ ID NO: 1809751 - RNA, 14 nt, Human
gaaaaaugcauguu

SEQ ID NO: 1809752 - RNA, 13 nt, Human
agcauaauacuug

SEQ ID NO: 1809753 - RNA, 20 nt, Human
agggcaguguucccuggggc

SEQ ID NO: 1809754 - RNA, 13 nt, Human
ccaggcugagccu

SEQ ID NO: 1809755 - RNA, 18 nt, Human
uuuccccaacauguaaua

SEQ ID NO: 1809756 - RNA, 16 nt, Human
cauuagaacuucaagc

SEQ ID NO: 1809757 - RNA, 20 nt, Human
cugggaggcucuggagccca

SEQ ID NO: 1809758 - RNA, 18 nt, Human
aaaaacaaagaaauuaug

SEQ ID NO: 1809759 - RNA, 21 nt, Human
aagauauuuuucaugauuuug

SEQ ID NO: 1809760 - RNA, 20 nt, Human
ccucagaugcacaugagcug

SEQ ID NO: 1809761 - RNA, 15 nt, Human
caggccucacacaca

SEQ ID NO: 1809762 - RNA, 19 nt, Human
cuagucuguuuucccuccu

SEQ ID NO: 1809763 - RNA, 16 nt, Human
cacaaugugucugaga

SEQ ID NO: 1809764 - RNA, 17 nt, Human
ucaacguugcuccccau

SEQ ID NO: 1809765 - RNA, 20 nt, Human
auuugaaacacuuugcauaa

SEQ ID NO: 1809766 - RNA, 18 nt, Human
uguaagaacaacuaccug

SEQ ID NO: 1809767 - RNA, 23 nt, Human
gggccccucuguaucuagccugg

SEQ ID NO: 1809768 - RNA, 21 nt, Human
cacccauuagcagucccucca

SEQ ID NO: 1809769 - RNA, 16 nt, Human
cuucucuaaacauuuc

SEQ ID NO: 1809770 - RNA, 18 nt, Human
aucuccuguuaauauggu

SEQ ID NO: 1809771 - RNA, 14 nt, Human
cugcucccuagcca

SEQ ID NO: 1809772 - RNA, 15 nt, Human
cauagcuaaaaaaug

SEQ ID NO: 1809773 - RNA, 23 nt, Human
agugauaucccccagccucaagu

SEQ ID NO: 1809774 - RNA, 16 nt, Human
cagccucagccuccca

SEQ ID NO: 1809775 - RNA, 15 nt, Human
cccgcaugcggccca

SEQ ID NO: 1809776 - RNA, 15 nt, Human
uaaaaauaaaaaaca

SEQ ID NO: 1809777 - RNA, 17 nt, Human
agcaaugcuucaucccu

SEQ ID NO: 1809778 - RNA, 23 nt, Human
uguagguagaucuggucuuuaga

SEQ ID NO: 1809779 - RNA, 13 nt, Human
agacuuuuuccuu

SEQ ID NO: 1809780 - RNA, 19 nt, Human
aauuuucuuccauuucauu

SEQ ID NO: 1809781 - RNA, 20 nt, Human
uacaucccuuaccugggaaa

SEQ ID NO: 1809782 - RNA, 20 nt, Human
agcccugcaccaugcugcug

SEQ ID NO: 1809783 - RNA, 16 nt, Human
cuuccaucaccucccc

SEQ ID NO: 1809784 - RNA, 19 nt, Human
cucagccucccaaagugcu

SEQ ID NO: 1809785 - RNA, 16 nt, Human
uuccuuacucuugauu

SEQ ID NO: 1809786 - RNA, 14 nt, Human
caggacacucacua

SEQ ID NO: 1809787 - RNA, 22 nt, Human
caagugcuucuccagccucagc

SEQ ID NO: 1809788 - RNA, 15 nt, Human
caaauauaucugcua

SEQ ID NO: 1809789 - RNA, 17 nt, Human
acaugggugaacacuca

SEQ ID NO: 1809790 - RNA, 19 nt, Human
caaccacaucccacucaca

SEQ ID NO: 1809791 - RNA, 16 nt, Human
cuucccuaggagagga

SEQ ID NO: 1809792 - RNA, 23 nt, Human
agaucauugugaaauuauucaua

SEQ ID NO: 1809793 - RNA, 14 nt, Human
uggccaccugcuga

SEQ ID NO: 1809794 - RNA, 17 nt, Human
uaucaauuuaaaaaaaa

SEQ ID NO: 1809795 - RNA, 18 nt, Human
augccacuagcccuccuc

SEQ ID NO: 1809796 - RNA, 22 nt, Human
caauccuagguaggguuuaauc

SEQ ID NO: 1809797 - RNA, 16 nt, Human
uaagauaccaaaacca

SEQ ID NO: 1809798 - RNA, 13 nt, Human
agccccugggccc

SEQ ID NO: 1809799 - RNA, 18 nt, Human
gucuggaaauagcccugu

SEQ ID NO: 1809800 - RNA, 11 nt, Human
aucugccuccc

SEQ ID NO: 1809801 - RNA, 20 nt, Human
cugcccagaaaccuuuguuu

SEQ ID NO: 1809802 - RNA, 22 nt, Human
aaguccugggauuacaggugug

SEQ ID NO: 1809803 - RNA, 22 nt, Human
cagaggcucuaauguacaauaa

SEQ ID NO: 1809804 - RNA, 15 nt, Human
ucucauaccuucccc

SEQ ID NO: 1809805 - RNA, 23 nt, Human
acaagcaaugccugcccauugga

SEQ ID NO: 1809806 - RNA, 13 nt, Human
ucuauugccucug

SEQ ID NO: 1809807 - RNA, 15 nt, Human
gaagauguagaggag

SEQ ID NO: 1809808 - RNA, 23 nt, Human
cuagucuguuuucccuccuugga

SEQ ID NO: 1809809 - RNA, 23 nt, Human
gagaaaugagcacgcauggaaaa

SEQ ID NO: 1809810 - RNA, 15 nt, Human
auuucuaugaaauau

SEQ ID NO: 1809811 - RNA, 13 nt, Human
cucccaccaccuc

SEQ ID NO: 1809812 - RNA, 23 nt, Human
uuguaacaagccuccuuuuaaag

SEQ ID NO: 1809813 - RNA, 19 nt, Human
ggacucaccucccccaucu

SEQ ID NO: 1809814 - RNA, 14 nt, Human
cugucucaguccau

SEQ ID NO: 1809815 - RNA, 17 nt, Human
caggaaaaaguggguuu

SEQ ID NO: 1809816 - RNA, 19 nt, Human
ccaugggaggccuuucccu

SEQ ID NO: 1809817 - RNA, 16 nt, Human
caggcuugccugcagg

SEQ ID NO: 1809818 - RNA, 16 nt, Human
accccuuuacaaauag

SEQ ID NO: 1809819 - RNA, 20 nt, Human
uuuauaaaaauaaaaaacac

SEQ ID NO: 1809820 - RNA, 19 nt, Human
aacuuaaguagauaaggaa

SEQ ID NO: 1809821 - RNA, 19 nt, Human
uuucuauuugaucugauau

SEQ ID NO: 1809822 - RNA, 16 nt, Human
cuaaguguaccagaga

SEQ ID NO: 1809823 - RNA, 16 nt, Human
ugcucaggagcccugg

SEQ ID NO: 1809824 - RNA, 14 nt, Human
caggccccaagccc

SEQ ID NO: 1809825 - RNA, 13 nt, Human
ggacuacaggcgu

SEQ ID NO: 1809826 - RNA, 17 nt, Human
ugguuucccuucuuuuu

SEQ ID NO: 1809827 - RNA, 17 nt, Human
aaaguugauuuuaagaa

SEQ ID NO: 1809828 - RNA, 22 nt, Human
agcggccacggugccuccagau

SEQ ID NO: 1809829 - RNA, 15 nt, Human
ucacaggacagcccu

SEQ ID NO: 1809830 - RNA, 23 nt, Human
cuagacccacuggacucaccucc

SEQ ID NO: 1809831 - RNA, 15 nt, Human
augaauuaaagaaga

SEQ ID NO: 1809832 - RNA, 19 nt, Human
cacaggagcuuaaacagcu

SEQ ID NO: 1809833 - RNA, 21 nt, Human
cagaguucuauaauguaaaca

SEQ ID NO: 1809834 - RNA, 15 nt, Human
acaauagaauuauaa

SEQ ID NO: 1809835 - RNA, 18 nt, Human
ccaagccuggcaagggaa

SEQ ID NO: 1809836 - RNA, 23 nt, Human
ccugauuauuuucuacacauaca

SEQ ID NO: 1809837 - RNA, 15 nt, Human
caggaggaaggcuua

SEQ ID NO: 1809838 - RNA, 13 nt, Human
uuuaaaaaaaaac

SEQ ID NO: 1809839 - RNA, 17 nt, Human
ccuugugcacaaaucag

SEQ ID NO: 1809840 - RNA, 18 nt, Human
agaaauaucuucacuugu

SEQ ID NO: 1809841 - RNA, 15 nt, Human
ggacucaccuccccc

SEQ ID NO: 1809842 - RNA, 20 nt, Human
aguuuuuuuuuaaaaaagaa

SEQ ID NO: 1809843 - RNA, 23 nt, Human
cugugaagugagaccuuccuuuu

SEQ ID NO: 1809844 - RNA, 17 nt, Human
cuccucucagugggugg

SEQ ID NO: 1809845 - RNA, 22 nt, Human
ucuaaaguaaaaacaaagaaau

SEQ ID NO: 1809846 - RNA, 22 nt, Human
aaagcaguugagacaagaaaau

SEQ ID NO: 1809847 - RNA, 17 nt, Human
ucugaagcucaacucuc

SEQ ID NO: 1809848 - RNA, 17 nt, Human
cuccccuucacucccac

SEQ ID NO: 1809849 - RNA, 19 nt, Human
uaucacuugucaauaaaau

SEQ ID NO: 1809850 - RNA, 16 nt, Human
uacacagaucacagcu

SEQ ID NO: 1809851 - RNA, 12 nt, Human
cuuaucuuccua

SEQ ID NO: 1809852 - RNA, 17 nt, Human
cugacgacuugagugcu

SEQ ID NO: 1809853 - RNA, 23 nt, Human
ucucacagugggagccagggcug

SEQ ID NO: 1809854 - RNA, 15 nt, Human
cugacucuuaagaag

SEQ ID NO: 1809855 - RNA, 14 nt, Human
gugcauauuuauaa

SEQ ID NO: 1809856 - RNA, 22 nt, Human
caggucccuaauaaagcugugu

SEQ ID NO: 1809857 - RNA, 18 nt, Human
aauuauaucaauuuccuc

SEQ ID NO: 1809858 - RNA, 19 nt, Human
auuaacaugaauauuuagu

SEQ ID NO: 1809859 - RNA, 13 nt, Human
cucccuaccuacc

SEQ ID NO: 1809860 - RNA, 18 nt, Human
uagaugccacuagcccuc

SEQ ID NO: 1809861 - RNA, 22 nt, Human
auuuuacauguggcccaacaca

SEQ ID NO: 1809862 - RNA, 16 nt, Human
ucugcauguucuaaau

SEQ ID NO: 1809863 - RNA, 15 nt, Human
aaaacaaacaaacaa

SEQ ID NO: 1809864 - RNA, 15 nt, Human
caucauaauauaaaa

SEQ ID NO: 1809865 - RNA, 19 nt, Human
agaaucucucuucuuuuca

SEQ ID NO: 1809866 - RNA, 17 nt, Human
cagugaaagaaaauaac

SEQ ID NO: 1809867 - RNA, 22 nt, Human
gaauuucuucaacucccugccc

SEQ ID NO: 1809868 - RNA, 17 nt, Human
cacgccacagcccuuuu

SEQ ID NO: 1809869 - RNA, 19 nt, Human
cagcccuuuugucucugca

SEQ ID NO: 1809870 - RNA, 12 nt, Human
ggacuaaaagau

SEQ ID NO: 1809871 - RNA, 20 nt, Human
aacaagccuccuuuuaaagu

SEQ ID NO: 1809872 - RNA, 18 nt, Human
agauugugucccauuccc

SEQ ID NO: 1809873 - RNA, 14 nt, Human
ggugcuugagucuc

SEQ ID NO: 1809874 - RNA, 23 nt, Human
ugaaaaacuauuaacaacuuguc

SEQ ID NO: 1809875 - RNA, 21 nt, Human
uuuuauggcacuaguauuucu

SEQ ID NO: 1809876 - RNA, 14 nt, Human
uuuuauaugcuauu

SEQ ID NO: 1809877 - RNA, 21 nt, Human
aauuagugcuuuuugugucau

SEQ ID NO: 1809878 - RNA, 15 nt, Human
agaaacccugcaccc

SEQ ID NO: 1809879 - RNA, 14 nt, Human
agggcuaauaucuu

SEQ ID NO: 1809880 - RNA, 16 nt, Human
aauggacaucaaaauc

SEQ ID NO: 1809881 - RNA, 22 nt, Human
agucuuucacauuuaaauaaag

SEQ ID NO: 1809882 - RNA, 15 nt, Human
uguguuuacuuuaug

SEQ ID NO: 1809883 - RNA, 18 nt, Human
gagggcaagagccacagu

SEQ ID NO: 1809884 - RNA, 21 nt, Human
uaucuuccuauaauuuuagac

SEQ ID NO: 1809885 - RNA, 14 nt, Human
agccugccuccccu

SEQ ID NO: 1809886 - RNA, 15 nt, Human
acaugugcuggccac

SEQ ID NO: 1809887 - RNA, 13 nt, Human
aagugcuuucuuc

SEQ ID NO: 1809888 - RNA, 14 nt, Human
aaccugagccccaa

SEQ ID NO: 1809889 - RNA, 14 nt, Human
cuugguucucucca

SEQ ID NO: 1809890 - RNA, 13 nt, Human
ugagagcaucagg

SEQ ID NO: 1809891 - RNA, 15 nt, Human
uccucucucuguguu

SEQ ID NO: 1809892 - RNA, 16 nt, Human
auaaucauuauuacuu

SEQ ID NO: 1809893 - RNA, 15 nt, Human
gacucacugugggaa

SEQ ID NO: 1809894 - RNA, 21 nt, Human
aacuaacaaccaaagacuaca

SEQ ID NO: 1809895 - RNA, 23 nt, Human
cccagcccuccuuaucaaaggac

SEQ ID NO: 1809896 - RNA, 23 nt, Human
agccaccaguccauugggcaggc

SEQ ID NO: 1809897 - RNA, 16 nt, Human
cucaugaaccucaagc

SEQ ID NO: 1809898 - RNA, 15 nt, Human
uacuaauuuuaaaau

SEQ ID NO: 1809899 - RNA, 14 nt, Human
uuauguuacuacau

SEQ ID NO: 1809900 - RNA, 18 nt, Human
acuuggcugcauaaaugu

SEQ ID NO: 1809901 - RNA, 15 nt, Human
cuccagggagucuca

SEQ ID NO: 1809902 - RNA, 14 nt, Human
caugcugcugggga

SEQ ID NO: 1809903 - RNA, 14 nt, Human
uaauuuuaaauguu

SEQ ID NO: 1809904 - RNA, 18 nt, Human
ucuacaguacaccacaag

SEQ ID NO: 1809905 - RNA, 16 nt, Human
cucaauaaaguacaag

SEQ ID NO: 1809906 - RNA, 15 nt, Human
uauaagcuuuucuuu

SEQ ID NO: 1809907 - RNA, 19 nt, Human
uuaaauguuuuuuuuuaaa

SEQ ID NO: 1809908 - RNA, 16 nt, Human
ccuugucucccagcuc

SEQ ID NO: 1809909 - RNA, 18 nt, Human
ugaagaaucacaauaauu

SEQ ID NO: 1809910 - RNA, 22 nt, Human
aagagccuuuuuuugaaaaaaa

SEQ ID NO: 1809911 - RNA, 15 nt, Human
aaggaaaaaauaaca

SEQ ID NO: 1809912 - RNA, 21 nt, Human
ucugaggucacagggccuggg

SEQ ID NO: 1809913 - RNA, 22 nt, Human
ccaggcuuuuuuaucaugugaa

SEQ ID NO: 1809914 - RNA, 14 nt, Human
gagacacugaugua

SEQ ID NO: 1809915 - RNA, 13 nt, Human
uuuuuuauaauca

SEQ ID NO: 1809916 - RNA, 17 nt, Human
uccauccugaggcucca

SEQ ID NO: 1809917 - RNA, 23 nt, Human
agaguuuagcuggaaaaguaugu

SEQ ID NO: 1809918 - RNA, 13 nt, Human
ugggggcagagcc

SEQ ID NO: 1809919 - RNA, 17 nt, Human
uguuuauaauuuuaaau

SEQ ID NO: 1809920 - RNA, 13 nt, Human
ggcugaaaggaag

SEQ ID NO: 1809921 - RNA, 19 nt, Human
uauauuuccaagaaauauu

SEQ ID NO: 1809922 - RNA, 14 nt, Human
guuucuuccacagu

SEQ ID NO: 1809923 - RNA, 18 nt, Human
cuggguuaggccuugccu

SEQ ID NO: 1809924 - RNA, 21 nt, Human
ccccugcaaagcccagcuuga

SEQ ID NO: 1809925 - RNA, 16 nt, Human
cuuugacaaagguaaa

SEQ ID NO: 1809926 - RNA, 20 nt, Human
aggcuuugcccugcugcccu

SEQ ID NO: 1809927 - RNA, 18 nt, Human
aguuuauauagaaaugua

SEQ ID NO: 1809928 - RNA, 21 nt, Human
agaaggugggaggaugugaau

SEQ ID NO: 1809929 - RNA, 13 nt, Human
agccuucucuguu

SEQ ID NO: 1809930 - RNA, 22 nt, Human
auuaauaaacauucuaucuauu

SEQ ID NO: 1809931 - RNA, 20 nt, Human
cagcaugcugagauuacagg

SEQ ID NO: 1809932 - RNA, 15 nt, Human
ucacccacuucccac

SEQ ID NO: 1809933 - RNA, 16 nt, Human
acuguacuugcucuug

SEQ ID NO: 1809934 - RNA, 18 nt, Human
aagaaauaggaaauauuu

SEQ ID NO: 1809935 - RNA, 22 nt, Human
aggaugccccgucccccucugg

SEQ ID NO: 1809936 - RNA, 23 nt, Human
gucucacaugauuccagccauca

SEQ ID NO: 1809937 - RNA, 14 nt, Human
auagagacuuggga

SEQ ID NO: 1809938 - RNA, 16 nt, Human
agaugcuagaacuccc

SEQ ID NO: 1809939 - RNA, 23 nt, Human
gcucagaaaugucauguggcuac

SEQ ID NO: 1809940 - RNA, 16 nt, Human
uauucagaauuucuaa

SEQ ID NO: 1809941 - RNA, 15 nt, Human
uguuaaaugauuuca

SEQ ID NO: 1809942 - RNA, 19 nt, Human
cacccucuccagaugcagc

SEQ ID NO: 1809943 - RNA, 13 nt, Human
cuuacaugcauua

SEQ ID NO: 1809944 - RNA, 13 nt, Human
cuuagauaagaca

SEQ ID NO: 1809945 - RNA, 22 nt, Human
aucaccaaggcugauuaaacca

SEQ ID NO: 1809946 - RNA, 17 nt, Human
aggcaccugucccagaa

SEQ ID NO: 1809947 - RNA, 15 nt, Human
aaaucaugaagauau

SEQ ID NO: 1809948 - RNA, 15 nt, Human
auggaggccuguccu

SEQ ID NO: 1809949 - RNA, 14 nt, Human
cauuuucuaagaaa

SEQ ID NO: 1809950 - RNA, 18 nt, Human
uguuugcucagcuucucc

SEQ ID NO: 1809951 - RNA, 15 nt, Human
aguggcuuuaaugaa

SEQ ID NO: 1809952 - RNA, 16 nt, Human
cugcugagucccaggc

SEQ ID NO: 1809953 - RNA, 18 nt, Human
augcauauuauuuuaugu

SEQ ID NO: 1809954 - RNA, 22 nt, Human
ucucagcuucacccugagguga

SEQ ID NO: 1809955 - RNA, 16 nt, Human
aaaauuccuuuucccg

SEQ ID NO: 1809956 - RNA, 14 nt, Human
uggcuagccucugg

SEQ ID NO: 1809957 - RNA, 22 nt, Human
guguccccuauccuacuucccc

SEQ ID NO: 1809958 - RNA, 18 nt, Human
acugcugucccaaacaug

SEQ ID NO: 1809959 - RNA, 11 nt, Human
uagugauuuua

SEQ ID NO: 1809960 - RNA, 13 nt, Human
caaaaaaaaaauu

SEQ ID NO: 1809961 - RNA, 23 nt, Human
aucuuccuauaauuuuagacauu

SEQ ID NO: 1809962 - RNA, 21 nt, Human
uguaaugguggccuggggcuu

SEQ ID NO: 1809963 - RNA, 20 nt, Human
uauuuauuacuguaagaaaa

SEQ ID NO: 1809964 - RNA, 17 nt, Human
agccaauauuuuucuua

SEQ ID NO: 1809965 - RNA, 20 nt, Human
ugagcagugcuugaaugaag

SEQ ID NO: 1809966 - RNA, 20 nt, Human
auccucgaggcccuagcauu

SEQ ID NO: 1809967 - RNA, 17 nt, Human
gaauaaacauuuguagc

SEQ ID NO: 1809968 - RNA, 15 nt, Human
ccucccccuccucuc

SEQ ID NO: 1809969 - RNA, 22 nt, Human
gaauuaaguuuuuuuuuaaaaa

SEQ ID NO: 1809970 - RNA, 22 nt, Human
accuuuguuugcaucugaaaau

SEQ ID NO: 1809971 - RNA, 19 nt, Human
acaaauuuacagagacaga

SEQ ID NO: 1809972 - RNA, 15 nt, Human
aucuuuaacccacua

SEQ ID NO: 1809973 - RNA, 15 nt, Human
ugaugacuuuuuaua

SEQ ID NO: 1809974 - RNA, 15 nt, Human
gaaaauggacaucaa

SEQ ID NO: 1809975 - RNA, 15 nt, Human
agccuguuuaagaga

SEQ ID NO: 1809976 - RNA, 19 nt, Human
auugaggacacugauaugg

SEQ ID NO: 1809977 - RNA, 17 nt, Human
aucuuucugccuuuggc

SEQ ID NO: 1809978 - RNA, 17 nt, Human
gaauuucuguucuucca

SEQ ID NO: 1809979 - RNA, 20 nt, Human
uuuuuuauaaucaagccuaa

SEQ ID NO: 1809980 - RNA, 15 nt, Human
auauguuauuauuaa

SEQ ID NO: 1809981 - RNA, 17 nt, Human
caauaucagacuuuuuu

SEQ ID NO: 1809982 - RNA, 19 nt, Human
aaaggagcaagucagaaua

SEQ ID NO: 1809983 - RNA, 23 nt, Human
aaagacuuuuaugauacuugaaa

SEQ ID NO: 1809984 - RNA, 19 nt, Human
auuucccccuagccugccu

SEQ ID NO: 1809985 - RNA, 22 nt, Human
ugaauggcuaagcaaaauguga

SEQ ID NO: 1809986 - RNA, 23 nt, Human
ggcagguuugcaauccaagcagg

SEQ ID NO: 1809987 - RNA, 23 nt, Human
cauaaauuauuguuuuucuuuuu

SEQ ID NO: 1809988 - RNA, 14 nt, Human
gcucaggagcccug

SEQ ID NO: 1809989 - RNA, 22 nt, Human
caguauggcagcuuuccucaaa

SEQ ID NO: 1809990 - RNA, 18 nt, Human
gucacucacauccauucu

SEQ ID NO: 1809991 - RNA, 20 nt, Human
gcccugcugcccucccccuc

SEQ ID NO: 1809992 - RNA, 23 nt, Human
auuuacgcucauuguagaaaagc

SEQ ID NO: 1809993 - RNA, 16 nt, Human
gcuucacuguaaaaua

SEQ ID NO: 1809994 - RNA, 12 nt, Human
aaagcaauaaua

SEQ ID NO: 1809995 - RNA, 16 nt, Human
aguagcugagacuaca

SEQ ID NO: 1809996 - RNA, 14 nt, Human
auuucuucaaauaa

SEQ ID NO: 1809997 - RNA, 14 nt, Human
aaugcauguugccc

SEQ ID NO: 1809998 - RNA, 20 nt, Human
uucugacuauuuuucagaau

SEQ ID NO: 1809999 - RNA, 19 nt, Human
uuguagcauccucuuuaau

SEQ ID NO: 1810000 - RNA, 17 nt, Human
aauggcuaagauaccaa

SEQ ID NO: 1810001 - RNA, 14 nt, Human
cacuucccacuauu

SEQ ID NO: 1810002 - RNA, 18 nt, Human
cuaauaucuuaucuuccu

SEQ ID NO: 1810003 - RNA, 15 nt, Human
auuugguaaggggaa

SEQ ID NO: 1810004 - RNA, 15 nt, Human
agggacucagguggc

SEQ ID NO: 1810005 - RNA, 22 nt, Human
uaaaacaagcacuaaacaaaga

SEQ ID NO: 1810006 - RNA, 17 nt, Human
uacagacagaaaaaacu

SEQ ID NO: 1810007 - RNA, 15 nt, Human
cagguaaaacagggc

SEQ ID NO: 1810008 - RNA, 14 nt, Human
cgugaucucagcuc

SEQ ID NO: 1810009 - RNA, 13 nt, Human
uucauaaagucuu

SEQ ID NO: 1810010 - RNA, 22 nt, Human
uaaaauuuuuuuagaaagcauu

SEQ ID NO: 1810011 - RNA, 14 nt, Human
aaauauuauuuuau

SEQ ID NO: 1810012 - RNA, 15 nt, Human
gacucuugcaggggu

SEQ ID NO: 1810013 - RNA, 15 nt, Human
aacugcucauaugau

SEQ ID NO: 1810014 - RNA, 16 nt, Human
gaagauguagaggaga

SEQ ID NO: 1810015 - RNA, 16 nt, Human
ugacgucaucaucaca

SEQ ID NO: 1810016 - RNA, 15 nt, Human
aauagugauuuccac

SEQ ID NO: 1810017 - RNA, 16 nt, Human
aagagacagcccagga

SEQ ID NO: 1810018 - RNA, 21 nt, Human
gcccaggaccccauggcagug

SEQ ID NO: 1810019 - RNA, 19 nt, Human
uuuaacaucugagaaaagc

SEQ ID NO: 1810020 - RNA, 19 nt, Human
ccgccucagccucccaaag

SEQ ID NO: 1810021 - RNA, 13 nt, Human
cacuacgccuggc

SEQ ID NO: 1810022 - RNA, 18 nt, Human
gauuuccauauaaauauu

SEQ ID NO: 1810023 - RNA, 23 nt, Human
augauuuugaaaccaugaagaga

SEQ ID NO: 1810024 - RNA, 20 nt, Human
uuuagacauucuuuaucuuu

SEQ ID NO: 1810025 - RNA, 15 nt, Human
uuuagugaaauauua

SEQ ID NO: 1810026 - RNA, 22 nt, Human
agaaaacaauaacgauaaaaga

SEQ ID NO: 1810027 - RNA, 14 nt, Human
uuaccuugcaucuc

SEQ ID NO: 1810028 - RNA, 12 nt, Human
agaaauuuuugc

SEQ ID NO: 1810029 - RNA, 22 nt, Human
aaaacuagagacucaaagaggg

SEQ ID NO: 1810030 - RNA, 20 nt, Human
cuuguccaacccgaggcccg

SEQ ID NO: 1810031 - RNA, 21 nt, Human
auucagggagugggcuaagca

SEQ ID NO: 1810032 - RNA, 13 nt, Human
ccccagcccuccu

SEQ ID NO: 1810033 - RNA, 18 nt, Human
ucacaucgcagauucucc

SEQ ID NO: 1810034 - RNA, 23 nt, Human
aucgcagacacaugugcuggcca

SEQ ID NO: 1810035 - RNA, 22 nt, Human
uccagagacugcuccagaguug

SEQ ID NO: 1810036 - RNA, 19 nt, Human
ucagacacaaauaaaggaa

SEQ ID NO: 1810037 - RNA, 15 nt, Human
aguccugggauuaca

SEQ ID NO: 1810038 - RNA, 20 nt, Human
uucauccucacucaguccag

SEQ ID NO: 1810039 - RNA, 19 nt, Human
uguauacugugugcuaaaa

SEQ ID NO: 1810040 - RNA, 14 nt, Human
gccaccugacucuu

SEQ ID NO: 1810041 - RNA, 22 nt, Human
agccaaacauccuacaagacac

SEQ ID NO: 1810042 - RNA, 16 nt, Human
cagcaagucaggguug

SEQ ID NO: 1810043 - RNA, 17 nt, Human
agagacagaaagcagaa

SEQ ID NO: 1810044 - RNA, 16 nt, Human
accuugucucccagcu

SEQ ID NO: 1810045 - RNA, 14 nt, Human
auggaggaaaguga

SEQ ID NO: 1810046 - RNA, 15 nt, Human
ucacagaucuuucug

SEQ ID NO: 1810047 - RNA, 18 nt, Human
acugugugcuaaaacaag

SEQ ID NO: 1810048 - RNA, 15 nt, Human
gaggccuuucccuaa

SEQ ID NO: 1810049 - RNA, 15 nt, Human
guuauaaaaauauau

SEQ ID NO: 1810050 - RNA, 15 nt, Human
uuauaugcuauuuau

SEQ ID NO: 1810051 - RNA, 19 nt, Human
cuauugccucugagagcau

SEQ ID NO: 1810052 - RNA, 12 nt, Human
cauuuuuuucua

SEQ ID NO: 1810053 - RNA, 22 nt, Human
aaccauacaaaaauuccuuuuc

SEQ ID NO: 1810054 - RNA, 19 nt, Human
aaucauaagauauuuuuca

SEQ ID NO: 1810055 - RNA, 23 nt, Human
ugcugucauaaugguuuuuaaca

SEQ ID NO: 1810056 - RNA, 15 nt, Human
ccuccgucaccucag

SEQ ID NO: 1810057 - RNA, 11 nt, Human
ugcagugagcc

SEQ ID NO: 1810058 - RNA, 18 nt, Human
ccacuagcccuccucucc

SEQ ID NO: 1810059 - RNA, 22 nt, Human
accaagacuacuagggaaaugc

SEQ ID NO: 1810060 - RNA, 18 nt, Human
cgcacagggagugcacau

SEQ ID NO: 1810061 - RNA, 20 nt, Human
ucagaaucaugcugagagag

SEQ ID NO: 1810062 - RNA, 18 nt, Human
auaauccuaaacauauga

SEQ ID NO: 1810063 - RNA, 19 nt, Human
cugagccucagucucccuc

SEQ ID NO: 1810064 - RNA, 16 nt, Human
uauguuuaauuaaaau

SEQ ID NO: 1810065 - RNA, 17 nt, Human
ugguagaggaugaggaa

SEQ ID NO: 1810066 - RNA, 14 nt, Human
cuucaccaauaagu

SEQ ID NO: 1810067 - RNA, 15 nt, Human
ugcuguauaaaauca

SEQ ID NO: 1810068 - RNA, 16 nt, Human
uuuccuggcuacucca

SEQ ID NO: 1810069 - RNA, 21 nt, Human
ccuaguccccagccugcuccc

SEQ ID NO: 1810070 - RNA, 12 nt, Human
auaacuggaaac

SEQ ID NO: 1810071 - RNA, 14 nt, Human
uugccaugugcuag

SEQ ID NO: 1810072 - RNA, 19 nt, Human
guguaaaaccuggagaugg

SEQ ID NO: 1810073 - RNA, 23 nt, Human
cugcacgaauggaagaggcaccu

SEQ ID NO: 1810074 - RNA, 16 nt, Human
cacuuaaaaaugguuu

SEQ ID NO: 1810075 - RNA, 16 nt, Human
gccaggauggcgcagg

SEQ ID NO: 1810076 - RNA, 18 nt, Human
uggacucaagcaagauuu

SEQ ID NO: 1810077 - RNA, 20 nt, Human
acaacagguaaaacagggcc

SEQ ID NO: 1810078 - RNA, 18 nt, Human
agucauuggcuuuauccu

SEQ ID NO: 1810079 - RNA, 21 nt, Human
cagcccuuagcccuuccccuc

SEQ ID NO: 1810080 - RNA, 18 nt, Human
ccuaagcuggagugcagu

SEQ ID NO: 1810081 - RNA, 16 nt, Human
agugccgacagcucuc

SEQ ID NO: 1810082 - RNA, 12 nt, Human
ugcugcugggga

SEQ ID NO: 1810083 - RNA, 19 nt, Human
cugauauauuccaccagga

SEQ ID NO: 1810084 - RNA, 17 nt, Human
cccacuucagccuccca

SEQ ID NO: 1810085 - RNA, 13 nt, Human
aaguccugggauu

SEQ ID NO: 1810086 - RNA, 19 nt, Human
caagugauccucaggcagg

SEQ ID NO: 1810087 - RNA, 13 nt, Human
uaacgauaaaaga

SEQ ID NO: 1810088 - RNA, 13 nt, Human
uuauuaauaaaca

SEQ ID NO: 1810089 - RNA, 16 nt, Human
gcccuggacugugugc

SEQ ID NO: 1810090 - RNA, 17 nt, Human
uguauuacaaauauuuu

SEQ ID NO: 1810091 - RNA, 11 nt, Human
uuccauuuuuu

SEQ ID NO: 1810092 - RNA, 18 nt, Human
ccuccagagaguaucuga

SEQ ID NO: 1810093 - RNA, 15 nt, Human
augguuguauuauuu

SEQ ID NO: 1810094 - RNA, 14 nt, Human
agcaagucaggguu

SEQ ID NO: 1810095 - RNA, 13 nt, Human
auacaaaacccuu

SEQ ID NO: 1810096 - RNA, 21 nt, Human
uccccaucaagcccuuuacuu

SEQ ID NO: 1810097 - RNA, 13 nt, Human
agccucagucucc

SEQ ID NO: 1810098 - RNA, 20 nt, Human
caagagccuuuuuuugaaaa

SEQ ID NO: 1810099 - RNA, 15 nt, Human
agacucacuguggga

SEQ ID NO: 1810100 - RNA, 16 nt, Human
auaauccuaaacauau

SEQ ID NO: 1810101 - RNA, 19 nt, Human
cucccaaagugcugggauu

SEQ ID NO: 1810102 - RNA, 19 nt, Human
ugauuuuuguaguuuuagu

SEQ ID NO: 1810103 - RNA, 23 nt, Human
cagcucacugcaaccuccaccuc

SEQ ID NO: 1810104 - RNA, 22 nt, Human
uacaguuuaccgaaaaucauau

SEQ ID NO: 1810105 - RNA, 12 nt, Human
auuccucugccc

SEQ ID NO: 1810106 - RNA, 17 nt, Human
ugaaggauuuauguuua

SEQ ID NO: 1810107 - RNA, 17 nt, Human
ccccagccugcucccua

SEQ ID NO: 1810108 - RNA, 20 nt, Human
aaaaucuaaguguuucauaa

SEQ ID NO: 1810109 - RNA, 11 nt, Human
cuucuauuuuu

SEQ ID NO: 1810110 - RNA, 13 nt, Human
aguagcuggaggg

SEQ ID NO: 1810111 - RNA, 22 nt, Human
agcagcauaaauguugacaugg

SEQ ID NO: 1810112 - RNA, 22 nt, Human
ugugagccaccacauccagccu

SEQ ID NO: 1810113 - RNA, 18 nt, Human
cgccuguaaucccagcau

SEQ ID NO: 1810114 - RNA, 14 nt, Human
cacugcucacacug

SEQ ID NO: 1810115 - RNA, 14 nt, Human
guggacuaaaagau

SEQ ID NO: 1810116 - RNA, 10 nt, Human
uucaugauuu

SEQ ID NO: 1810117 - RNA, 19 nt, Human
auauugauuuauuaauaua

SEQ ID NO: 1810118 - RNA, 19 nt, Human
ucugagcauuuaauaugga

SEQ ID NO: 1810119 - RNA, 15 nt, Human
guuuauuucuuaaau

SEQ ID NO: 1810120 - RNA, 16 nt, Human
caggacuagggcugga

SEQ ID NO: 1810121 - RNA, 14 nt, Human
auauuugaaauauu

SEQ ID NO: 1810122 - RNA, 16 nt, Human
cuguggauuuaaugug

SEQ ID NO: 1810123 - RNA, 18 nt, Human
cugccaagagugaaggga

SEQ ID NO: 1810124 - RNA, 18 nt, Human
ugaaaaaguucugcagau

SEQ ID NO: 1810125 - RNA, 11 nt, Human
aaccugagccc

SEQ ID NO: 1810126 - RNA, 13 nt, Human
ucccaucuaggga

SEQ ID NO: 1810127 - RNA, 14 nt, Human
gcagcaucccuagu

SEQ ID NO: 1810128 - RNA, 18 nt, Human
agcuggggccaggcuggg

SEQ ID NO: 1810129 - RNA, 20 nt, Human
aaaaaccugagccccaaaag

SEQ ID NO: 1810130 - RNA, 24 nt, Human
gccucagccucccgaguagcuggg

SEQ ID NO: 1810131 - RNA, 17 nt, Human
aguggcuuuaaugaaua

SEQ ID NO: 1810132 - RNA, 11 nt, Human
aaaacccuuuc

SEQ ID NO: 1810133 - RNA, 14 nt, Human
auuuauguuuaauu

SEQ ID NO: 1810134 - RNA, 16 nt, Human
uugaucgacuugccaa

SEQ ID NO: 1810135 - RNA, 17 nt, Human
auaguuuuauuaauaaa

SEQ ID NO: 1810136 - RNA, 14 nt, Human
gcacuguaaaaugu

SEQ ID NO: 1810137 - RNA, 11 nt, Human
ugggggcagca

SEQ ID NO: 1810138 - RNA, 14 nt, Human
uaauauuuuuaaua

SEQ ID NO: 1810139 - RNA, 21 nt, Human
agaauuauaacuggaaagaag

SEQ ID NO: 1810140 - RNA, 14 nt, Human
gagccagugucagg

SEQ ID NO: 1810141 - RNA, 22 nt, Human
aucagccuacaggccucacaca

SEQ ID NO: 1810142 - RNA, 22 nt, Human
uuauaagaaauaggaaauauuu

SEQ ID NO: 1810143 - RNA, 21 nt, Human
uuuaaaauuuuuuuagaaagc

SEQ ID NO: 1810144 - RNA, 18 nt, Human
cccagccugcucccuagc

SEQ ID NO: 1810145 - RNA, 22 nt, Human
ccauacuaauuauacccccugc

SEQ ID NO: 1810146 - RNA, 17 nt, Human
gcucuaauguacaauaa

SEQ ID NO: 1810147 - RNA, 17 nt, Human
cuuauugcuguccugga

SEQ ID NO: 1810148 - RNA, 18 nt, Human
ccaacaaagcaauaauag

SEQ ID NO: 1810149 - RNA, 15 nt, Human
aucucaucucuucuu

SEQ ID NO: 1810150 - RNA, 14 nt, Human
cucuggcuccagcu

SEQ ID NO: 1810151 - RNA, 20 nt, Human
ccuggcucucccagccaggu

SEQ ID NO: 1810152 - RNA, 20 nt, Human
cccucaaacccauucccucu

SEQ ID NO: 1810153 - RNA, 21 nt, Human
acuuuccccuugguucucaua

SEQ ID NO: 1810154 - RNA, 16 nt, Human
ccuaguccccagccug

SEQ ID NO: 1810155 - RNA, 14 nt, Human
aguuuguugaaaca

SEQ ID NO: 1810156 - RNA, 22 nt, Human
uuccugauuauuuucuacacau

SEQ ID NO: 1810157 - RNA, 15 nt, Human
ccuuuaaaauuuuuu

SEQ ID NO: 1810158 - RNA, 11 nt, Human
ucccagggcaa

SEQ ID NO: 1810159 - RNA, 15 nt, Human
cacaggacagcccuu

SEQ ID NO: 1810160 - RNA, 15 nt, Human
ccaggaggccugcua

SEQ ID NO: 1810161 - RNA, 13 nt, Human
guuggagcagggg

SEQ ID NO: 1810162 - RNA, 14 nt, Human
ccuuaucaaaggac

SEQ ID NO: 1810163 - RNA, 19 nt, Human
uggucccuauuccuccuuc

SEQ ID NO: 1810164 - RNA, 18 nt, Human
ugaagagugugaggaaaa

SEQ ID NO: 1810165 - RNA, 19 nt, Human
agacuuuauguaguuuuua

SEQ ID NO: 1810166 - RNA, 14 nt, Human
guuuaccagaaagc

SEQ ID NO: 1810167 - RNA, 12 nt, Human
cucuggagccca

SEQ ID NO: 1810168 - RNA, 14 nt, Human
aaaaguauccaagg

SEQ ID NO: 1810169 - RNA, 19 nt, Human
cagagcaagaccccaucuc

SEQ ID NO: 1810170 - RNA, 18 nt, Human
auaccucacuuuacacaa

SEQ ID NO: 1810171 - RNA, 12 nt, Human
accacucagaga

SEQ ID NO: 1810172 - RNA, 20 nt, Human
gcagcuuuagccaagugcag

SEQ ID NO: 1810173 - RNA, 18 nt, Human
cuuuccacagaagcucca

SEQ ID NO: 1810174 - RNA, 19 nt, Human
aaaauaacaauaaaagaca

SEQ ID NO: 1810175 - RNA, 14 nt, Human
auaugggacauuuu

SEQ ID NO: 1810176 - RNA, 13 nt, Human
auugccucugaga

SEQ ID NO: 1810177 - RNA, 17 nt, Human
aacauucgaccuccauu

SEQ ID NO: 1810178 - RNA, 12 nt, Human
uuuccuauuuuu

SEQ ID NO: 1810179 - RNA, 16 nt, Human
ccacuuggucugugag

SEQ ID NO: 1810180 - RNA, 13 nt, Human
aggcucuaaugua

SEQ ID NO: 1810181 - RNA, 19 nt, Human
uauuggucucccuucucua

SEQ ID NO: 1810182 - RNA, 21 nt, Human
agaugaaugagcaaaaccaaa

SEQ ID NO: 1810183 - RNA, 15 nt, Human
uuaguauuauuguug

SEQ ID NO: 1810184 - RNA, 21 nt, Human
aaggcuaugauugucuuuguu

SEQ ID NO: 1810185 - RNA, 18 nt, Human
guuaaugcugaaaaauca

SEQ ID NO: 1810186 - RNA, 17 nt, Human
cuccuuuuuccuuccag

SEQ ID NO: 1810187 - RNA, 17 nt, Human
ucuuucuuuauuuugag

SEQ ID NO: 1810188 - RNA, 22 nt, Human
cagcugccuggaagagcagccc

SEQ ID NO: 1810189 - RNA, 21 nt, Human
uuuucuaauaguuuuauuaau

SEQ ID NO: 1810190 - RNA, 17 nt, Human
uacauacaugcauacac

SEQ ID NO: 1810191 - RNA, 19 nt, Human
aaugaauggcuaagcaaaa

SEQ ID NO: 1810192 - RNA, 14 nt, Human
cacccgccucagcc

SEQ ID NO: 1810193 - RNA, 23 nt, Human
ccuacccuggacuugccucugca

SEQ ID NO: 1810194 - RNA, 22 nt, Human
agggagucucagcuucacccug

SEQ ID NO: 1810195 - RNA, 19 nt, Human
uugccaggcuggagugcag

SEQ ID NO: 1810196 - RNA, 14 nt, Human
ugaaggcaucccca

SEQ ID NO: 1810197 - RNA, 14 nt, Human
auuuucuauaauuu

SEQ ID NO: 1810198 - RNA, 12 nt, Human
caaguauaauau

SEQ ID NO: 1810199 - RNA, 18 nt, Human
acagguccccagaugaga

SEQ ID NO: 1810200 - RNA, 22 nt, Human
uucauacauuuucuaagaaaca

SEQ ID NO: 1810201 - RNA, 17 nt, Human
cugagcuaaauaaagau

SEQ ID NO: 1810202 - RNA, 16 nt, Human
ucuucuccuaaaacuu

SEQ ID NO: 1810203 - RNA, 11 nt, Human
gagccagcucu

SEQ ID NO: 1810204 - RNA, 17 nt, Human
cccccugcaaagcccag

SEQ ID NO: 1810205 - RNA, 12 nt, Human
uuccuuuuacuu

SEQ ID NO: 1810206 - RNA, 12 nt, Human
caggacagcccu

SEQ ID NO: 1810207 - RNA, 15 nt, Human
auaaauaaaaauaau

SEQ ID NO: 1810208 - RNA, 15 nt, Human
aaacugagauccuuc

SEQ ID NO: 1810209 - RNA, 23 nt, Human
accucucuggguugaagggcagu

SEQ ID NO: 1810210 - RNA, 14 nt, Human
cuaaacauaugaau

SEQ ID NO: 1810211 - RNA, 16 nt, Human
ucugacuauuuuucag

SEQ ID NO: 1810212 - RNA, 21 nt, Human
uguaggcauguagcuacagga

SEQ ID NO: 1810213 - RNA, 20 nt, Human
caaaauuagugcuuuuugug

SEQ ID NO: 1810214 - RNA, 19 nt, Human
caauaaauagaccauuaau

SEQ ID NO: 1810215 - RNA, 23 nt, Human
auaucuuuuuuuuaauaaaccau

SEQ ID NO: 1810216 - RNA, 17 nt, Human
acccaaaauaagcaggc

SEQ ID NO: 1810217 - RNA, 17 nt, Human
cagucucuugaggcaca

SEQ ID NO: 1810218 - RNA, 15 nt, Human
agaggccugacugcc

SEQ ID NO: 1810219 - RNA, 23 nt, Human
cuucagcacuuuagaauaugccu

SEQ ID NO: 1810220 - RNA, 21 nt, Human
agaggcucuaauguacaauaa

SEQ ID NO: 1810221 - RNA, 15 nt, Human
ugcaccaugcugcug

SEQ ID NO: 1810222 - RNA, 14 nt, Human
ccugggauuacagg

SEQ ID NO: 1810223 - RNA, 16 nt, Human
guacugcaguaaagaa

SEQ ID NO: 1810224 - RNA, 13 nt, Human
uggacgagaaaac

SEQ ID NO: 1810225 - RNA, 18 nt, Human
uaguuucuccuuguugug

SEQ ID NO: 1810226 - RNA, 18 nt, Human
cuguauuugaaucagccu

SEQ ID NO: 1810227 - RNA, 13 nt, Human
aaagauaaauuau

SEQ ID NO: 1810228 - RNA, 12 nt, Human
gaagaccucauu

SEQ ID NO: 1810229 - RNA, 16 nt, Human
gggaaggagacaaaac

SEQ ID NO: 1810230 - RNA, 17 nt, Human
gcaagcucuaucaccaa

SEQ ID NO: 1810231 - RNA, 18 nt, Human
cagcuuuguucuucuuaa

SEQ ID NO: 1810232 - RNA, 14 nt, Human
cuaagucuuauaua

SEQ ID NO: 1810233 - RNA, 13 nt, Human
uaucccccagccu

SEQ ID NO: 1810234 - RNA, 20 nt, Human
gggcaauuaauuccuucagc

SEQ ID NO: 1810235 - RNA, 14 nt, Human
ugagcaaaaccaaa

SEQ ID NO: 1810236 - RNA, 22 nt, Human
agccugaguagaaaggccuuua

SEQ ID NO: 1810237 - RNA, 23 nt, Human
ugcucuguugagccuuccuuucu

SEQ ID NO: 1810238 - RNA, 19 nt, Human
cuucuugauaccugggaua

SEQ ID NO: 1810239 - RNA, 18 nt, Human
accaagcugguggcucug

SEQ ID NO: 1810240 - RNA, 18 nt, Human
uaguaucaaaagaaagaa

SEQ ID NO: 1810241 - RNA, 22 nt, Human
cuccccaaaggcuuugcccugc

SEQ ID NO: 1810242 - RNA, 15 nt, Human
cccccuagccugccu

SEQ ID NO: 1810243 - RNA, 12 nt, Human
gacagugaaaga

SEQ ID NO: 1810244 - RNA, 20 nt, Human
uccucauauccaguauuguu

SEQ ID NO: 1810245 - RNA, 23 nt, Human
aucacugaugacuuuuuauacuu

SEQ ID NO: 1810246 - RNA, 19 nt, Human
cuuguaauuugaaauauuu

SEQ ID NO: 1810247 - RNA, 14 nt, Human
gccagaccagcagg

SEQ ID NO: 1810248 - RNA, 14 nt, Human
uccgacugccaucu

SEQ ID NO: 1810249 - RNA, 16 nt, Human
uaaagugauauuuccc

SEQ ID NO: 1810250 - RNA, 24 nt, Human
uggccgggagccugaucaccugcc

SEQ ID NO: 1810251 - RNA, 21 nt, Human
auuucuuuuuguuccccuuug

SEQ ID NO: 1810252 - RNA, 22 nt, Human
accaguguguggcuuucagagc

SEQ ID NO: 1810253 - RNA, 16 nt, Human
gucuaucuuugagcgc

SEQ ID NO: 1810254 - RNA, 18 nt, Human
caagauugugucccauuc

SEQ ID NO: 1810255 - RNA, 17 nt, Human
cguauaaaagccuguuu

SEQ ID NO: 1810256 - RNA, 20 nt, Human
ucauaaccuuaccagauuuu

SEQ ID NO: 1810257 - RNA, 17 nt, Human
ugguaaaccuuuuauau

SEQ ID NO: 1810258 - RNA, 16 nt, Human
gaagaaggugggagga

SEQ ID NO: 1810259 - RNA, 13 nt, Human
uaaacauguuuau

SEQ ID NO: 1810260 - RNA, 16 nt, Human
uuguaacuuucucuau

SEQ ID NO: 1810261 - RNA, 17 nt, Human
cauuguuggcuguuccu

SEQ ID NO: 1810262 - RNA, 13 nt, Human
cugccuccccuuc

SEQ ID NO: 1810263 - RNA, 19 nt, Human
ugauuauuuucuacacaua

SEQ ID NO: 1810264 - RNA, 14 nt, Human
aggaugucugccac

SEQ ID NO: 1810265 - RNA, 24 nt, Human
ugugauuaucaauuaccacaccau

SEQ ID NO: 1810266 - RNA, 16 nt, Human
uauuauggaggcagga

SEQ ID NO: 1810267 - RNA, 17 nt, Human
cugcuggggaagacagu

SEQ ID NO: 1810268 - RNA, 14 nt, Human
cucagcccugcacc

SEQ ID NO: 1810269 - RNA, 19 nt, Human
guugccaguuguccuccuu

SEQ ID NO: 1810270 - RNA, 19 nt, Human
aagcuaugugagcucacca

SEQ ID NO: 1810271 - RNA, 16 nt, Human
acucaaugguuaacua

SEQ ID NO: 1810272 - RNA, 19 nt, Human
cauuaaaaaugcauauacu

SEQ ID NO: 1810273 - RNA, 19 nt, Human
acauuuguauaaaauaauu

SEQ ID NO: 1810274 - RNA, 15 nt, Human
auaaacacucuugaa

SEQ ID NO: 1810275 - RNA, 21 nt, Human
uuccuuauauuauggaggcag

SEQ ID NO: 1810276 - RNA, 15 nt, Human
gacuauuuuucagaa

SEQ ID NO: 1810277 - RNA, 15 nt, Human
cauguuccugggauc

SEQ ID NO: 1810278 - RNA, 15 nt, Human
ucaagggugugugca

SEQ ID NO: 1810279 - RNA, 14 nt, Human
ccauuuuuuucuaa

SEQ ID NO: 1810280 - RNA, 19 nt, Human
auugugaugugaguugcac

SEQ ID NO: 1810281 - RNA, 16 nt, Human
aaccuuuuauauuuag

SEQ ID NO: 1810282 - RNA, 20 nt, Human
augccaggccuggcaagugg

SEQ ID NO: 1810283 - RNA, 17 nt, Human
caggggugcugggaccu

SEQ ID NO: 1810284 - RNA, 13 nt, Human
aauauauuuuaag

SEQ ID NO: 1810285 - RNA, 21 nt, Human
aacuccuguuucacuugguuc

SEQ ID NO: 1810286 - RNA, 20 nt, Human
aaucuuucacaggggacagg

SEQ ID NO: 1810287 - RNA, 22 nt, Human
auacaaaacccuuucugccccu

SEQ ID NO: 1810288 - RNA, 18 nt, Human
uuucagagccuccuuucu

SEQ ID NO: 1810289 - RNA, 14 nt, Human
ccuugucucccagc

SEQ ID NO: 1810290 - RNA, 21 nt, Human
caucugagaaaagcuuugaac

SEQ ID NO: 1810291 - RNA, 13 nt, Human
uccagauauacuu

SEQ ID NO: 1810292 - RNA, 20 nt, Human
ccauuagcauuugucaacaa

SEQ ID NO: 1810293 - RNA, 23 nt, Human
uacaaaugggaaacaaaaggaua

SEQ ID NO: 1810294 - RNA, 22 nt, Human
caauuagcuccuccuuuuuccu

SEQ ID NO: 1810295 - RNA, 15 nt, Human
uaaagcaauguggua

SEQ ID NO: 1810296 - RNA, 14 nt, Human
uaaauuauaucaau

SEQ ID NO: 1810297 - RNA, 17 nt, Human
gagccacaguuccccua

SEQ ID NO: 1810298 - RNA, 23 nt, Human
gguacaagcauucugucuugaag

SEQ ID NO: 1810299 - RNA, 14 nt, Human
auagaacucaugac

SEQ ID NO: 1810300 - RNA, 14 nt, Human
auaaggaugauaaa

SEQ ID NO: 1810301 - RNA, 23 nt, Human
cagcaccuccuaagaaggcaccu

SEQ ID NO: 1810302 - RNA, 20 nt, Human
aggcuuucuuuuuuuucuuu

SEQ ID NO: 1810303 - RNA, 22 nt, Human
uucuauaauguaaacaauauca

SEQ ID NO: 1810304 - RNA, 15 nt, Human
cugucauccacuuua

SEQ ID NO: 1810305 - RNA, 12 nt, Human
caauaucagacu

SEQ ID NO: 1810306 - RNA, 13 nt, Human
ccucagccucccg

SEQ ID NO: 1810307 - RNA, 18 nt, Human
guccugcaagcagaggug

SEQ ID NO: 1810308 - RNA, 18 nt, Human
auagaauuaacacaugau

SEQ ID NO: 1810309 - RNA, 16 nt, Human
gcuuucuucucccaau

SEQ ID NO: 1810310 - RNA, 20 nt, Human
auacauaccuauauacucac

SEQ ID NO: 1810311 - RNA, 16 nt, Human
uagccagaggcucuaa

SEQ ID NO: 1810312 - RNA, 17 nt, Human
aguuccccuauguggaa

SEQ ID NO: 1810313 - RNA, 19 nt, Human
uagccaagugcagggccug

SEQ ID NO: 1810314 - RNA, 23 nt, Human
aauugauuuugaaccugaugaaa

SEQ ID NO: 1810315 - RNA, 16 nt, Human
cuaccccuuuacaaau

SEQ ID NO: 1810316 - RNA, 14 nt, Human
acauguggcccaac

SEQ ID NO: 1810317 - RNA, 18 nt, Human
cuauguuucacugugcaa

SEQ ID NO: 1810318 - RNA, 22 nt, Human
cucuggccuucggccuccaucc

SEQ ID NO: 1810319 - RNA, 18 nt, Human
cagaaucucucuucuuuu

SEQ ID NO: 1810320 - RNA, 18 nt, Human
cuuugcuucauucaaguc

SEQ ID NO: 1810321 - RNA, 18 nt, Human
uagcagagggaucaagca

SEQ ID NO: 1810322 - RNA, 21 nt, Human
cacuucuuacaauaauucuau

SEQ ID NO: 1810323 - RNA, 19 nt, Human
cccauuuagguuucugagu

SEQ ID NO: 1810324 - RNA, 19 nt, Human
aagggauuuucagcccuca

SEQ ID NO: 1810325 - RNA, 13 nt, Human
cuucacaaaccca

SEQ ID NO: 1810326 - RNA, 21 nt, Human
agacaagaaggaaagauuuug

SEQ ID NO: 1810327 - RNA, 16 nt, Human
gccucccaaguagcug

SEQ ID NO: 1810328 - RNA, 14 nt, Human
uucucuccaccagg

SEQ ID NO: 1810329 - RNA, 15 nt, Human
ccugaaacucauaga

SEQ ID NO: 1810330 - RNA, 12 nt, Human
aguccugggauu

SEQ ID NO: 1810331 - RNA, 20 nt, Human
aaauauggggaaaaaacugu

SEQ ID NO: 1810332 - RNA, 13 nt, Human
agcuaaauauaua

SEQ ID NO: 1810333 - RNA, 21 nt, Human
auguuuaauucugaaagcaac

SEQ ID NO: 1810334 - RNA, 23 nt, Human
aaauaguugcugucauccacuuu

SEQ ID NO: 1810335 - RNA, 11 nt, Human
aaaagaaaaag

SEQ ID NO: 1810336 - RNA, 14 nt, Human
cagagcgcacaggg

SEQ ID NO: 1810337 - RNA, 22 nt, Human
ccuuucauaaagucuugccuug

SEQ ID NO: 1810338 - RNA, 23 nt, Human
ugcauagguuuaauaauuuuuaa

SEQ ID NO: 1810339 - RNA, 21 nt, Human
acccaguugugacaauuaaaa

SEQ ID NO: 1810340 - RNA, 22 nt, Human
uaagacacccccucaaacccau

SEQ ID NO: 1810341 - RNA, 23 nt, Human
uaaaacuugaaguagguagcaac

SEQ ID NO: 1810342 - RNA, 21 nt, Human
caggugguaagcaccaggacg

SEQ ID NO: 1810343 - RNA, 22 nt, Human
cucaaacuccugaccucaggca

SEQ ID NO: 1810344 - RNA, 20 nt, Human
auccaguauuguuccuuuug

SEQ ID NO: 1810345 - RNA, 13 nt, Human
ggacccaggaggu

SEQ ID NO: 1810346 - RNA, 17 nt, Human
gcuuugcccugcugccc

SEQ ID NO: 1810347 - RNA, 14 nt, Human
uugaaucucugaau

SEQ ID NO: 1810348 - RNA, 23 nt, Human
ccaggaggugcuaucgcaccacu

SEQ ID NO: 1810349 - RNA, 17 nt, Human
gggugguagcagaggga

SEQ ID NO: 1810350 - RNA, 19 nt, Human
cucacauuuauauuuuugu

SEQ ID NO: 1810351 - RNA, 14 nt, Human
caccgcgcccagcc

SEQ ID NO: 1810352 - RNA, 16 nt, Human
gccacuagcccuccuc

SEQ ID NO: 1810353 - RNA, 18 nt, Human
auacaaaaauuccuuuuc

SEQ ID NO: 1810354 - RNA, 23 nt, Human
cagaaagcaguugagacaagaaa

SEQ ID NO: 1810355 - RNA, 13 nt, Human
agccaagugcagg

SEQ ID NO: 1810356 - RNA, 22 nt, Human
gucagcccccuaagcccccacu

SEQ ID NO: 1810357 - RNA, 14 nt, Human
ccaccgcgcccagc

SEQ ID NO: 1810358 - RNA, 16 nt, Human
ucuuggaauccugggg

SEQ ID NO: 1810359 - RNA, 19 nt, Human
agcuggagugcaguggcau

SEQ ID NO: 1810360 - RNA, 14 nt, Human
agccugcagacuca

SEQ ID NO: 1810361 - RNA, 16 nt, Human
caaccuccgccuccca

SEQ ID NO: 1810362 - RNA, 21 nt, Human
cuugaaggucuaggugcuuua

SEQ ID NO: 1810363 - RNA, 13 nt, Human
agauuaagauaug

SEQ ID NO: 1810364 - RNA, 16 nt, Human
ugacuauuauauuucc

SEQ ID NO: 1810365 - RNA, 14 nt, Human
caggacuagggcug

SEQ ID NO: 1810366 - RNA, 15 nt, Human
gucuccuaagcugga

SEQ ID NO: 1810367 - RNA, 17 nt, Human
uuuccaugaguugcagu

SEQ ID NO: 1810368 - RNA, 19 nt, Human
cacugaucuggcugcaguu

SEQ ID NO: 1810369 - RNA, 18 nt, Human
ccagauuuuuacacaugu

SEQ ID NO: 1810370 - RNA, 17 nt, Human
ucuguaaaaucuuucuu

SEQ ID NO: 1810371 - RNA, 20 nt, Human
aaaccaaauauuccagagac

SEQ ID NO: 1810372 - RNA, 15 nt, Human
cacuuggucugugag

SEQ ID NO: 1810373 - RNA, 20 nt, Human
auaaaagggacugagaaauu

SEQ ID NO: 1810374 - RNA, 22 nt, Human
cuccagccugagcgacagugag

SEQ ID NO: 1810375 - RNA, 18 nt, Human
gagccucagucucccucc

SEQ ID NO: 1810376 - RNA, 16 nt, Human
uaagcaccaggacgcc

SEQ ID NO: 1810377 - RNA, 18 nt, Human
gcagugucugcuggagac

SEQ ID NO: 1810378 - RNA, 21 nt, Human
uguuuuuaacaugucaaucug

SEQ ID NO: 1810379 - RNA, 14 nt, Human
gagugcccccaaca

SEQ ID NO: 1810380 - RNA, 19 nt, Human
aucaugaagauauuuuucc

SEQ ID NO: 1810381 - RNA, 18 nt, Human
aggcauagcccugccuca

SEQ ID NO: 1810382 - RNA, 19 nt, Human
agacaauuguuggagagcc

SEQ ID NO: 1810383 - RNA, 22 nt, Human
auauacuugguucucuccacca

SEQ ID NO: 1810384 - RNA, 15 nt, Human
guccccagccugcuc

SEQ ID NO: 1810385 - RNA, 15 nt, Human
ugagccaccacaucc

SEQ ID NO: 1810386 - RNA, 16 nt, Human
uaacaauaaaagacaa

SEQ ID NO: 1810387 - RNA, 17 nt, Human
auaacguauaaaagccu

SEQ ID NO: 1810388 - RNA, 13 nt, Human
caccaugcugcug

SEQ ID NO: 1810389 - RNA, 13 nt, Human
augcuugaaaaga

SEQ ID NO: 1810390 - RNA, 20 nt, Human
ugcuucuccagccucagccu

SEQ ID NO: 1810391 - RNA, 12 nt, Human
gucugagacaga

SEQ ID NO: 1810392 - RNA, 16 nt, Human
auauccacuaaaauca

SEQ ID NO: 1810393 - RNA, 14 nt, Human
ccuggaaaaugaau

SEQ ID NO: 1810394 - RNA, 15 nt, Human
aacgauaaaagacag

SEQ ID NO: 1810395 - RNA, 20 nt, Human
acuaggcugagcaaucugac

SEQ ID NO: 1810396 - RNA, 19 nt, Human
uuuggaagaggacuccuua

SEQ ID NO: 1810397 - RNA, 18 nt, Human
uguauucuuuuaguuuuu

SEQ ID NO: 1810398 - RNA, 21 nt, Human
gaaauagcccuguaacaggcu

SEQ ID NO: 1810399 - RNA, 14 nt, Human
caucaucuucuggg

SEQ ID NO: 1810400 - RNA, 13 nt, Human
cagaaacuccugu

SEQ ID NO: 1810401 - RNA, 20 nt, Human
auucauauuuucuuucaaaa

SEQ ID NO: 1810402 - RNA, 22 nt, Human
aauuguaggugacuauuauauu

SEQ ID NO: 1810403 - RNA, 11 nt, Human
gagauggagga

SEQ ID NO: 1810404 - RNA, 13 nt, Human
auaauuuuagaca

SEQ ID NO: 1810405 - RNA, 21 nt, Human
cuacacagauguucacccaac

SEQ ID NO: 1810406 - RNA, 17 nt, Human
ccaguaccuagcuggcu

SEQ ID NO: 1810407 - RNA, 14 nt, Human
aaaauaaaaugaag

SEQ ID NO: 1810408 - RNA, 22 nt, Human
cucuuuuuauuuagauuggcag

SEQ ID NO: 1810409 - RNA, 17 nt, Human
gcccuuccccucugcag

SEQ ID NO: 1810410 - RNA, 20 nt, Human
auucccagccagcacagccu

SEQ ID NO: 1810411 - RNA, 15 nt, Human
aauaaauuucaccaa

SEQ ID NO: 1810412 - RNA, 15 nt, Human
cugucauuucaaaga

SEQ ID NO: 1810413 - RNA, 17 nt, Human
cagaugagaagucugcu

SEQ ID NO: 1810414 - RNA, 20 nt, Human
cccaagcccacuggggugug

SEQ ID NO: 1810415 - RNA, 15 nt, Human
aauaacauggugugc

SEQ ID NO: 1810416 - RNA, 17 nt, Human
cucagucucccucccuu

SEQ ID NO: 1810417 - RNA, 18 nt, Human
auuacauuuuaaacacau

SEQ ID NO: 1810418 - RNA, 14 nt, Human
agccaggcccagag

SEQ ID NO: 1810419 - RNA, 15 nt, Human
agggcucacagaauu

SEQ ID NO: 1810420 - RNA, 12 nt, Human
ccucaccagccc

SEQ ID NO: 1810421 - RNA, 14 nt, Human
cuaauauguaaaau

SEQ ID NO: 1810422 - RNA, 20 nt, Human
accccagauucaugcacugu

SEQ ID NO: 1810423 - RNA, 14 nt, Human
auggaacuugcugc

SEQ ID NO: 1810424 - RNA, 17 nt, Human
aucucaaacuucuauuu

SEQ ID NO: 1810425 - RNA, 15 nt, Human
cucguggaacaguua

SEQ ID NO: 1810426 - RNA, 17 nt, Human
cauauaauacaaaggcu

SEQ ID NO: 1810427 - RNA, 12 nt, Human
agacagaaaaaa

SEQ ID NO: 1810428 - RNA, 16 nt, Human
cucaagcugcaucuag

SEQ ID NO: 1810429 - RNA, 19 nt, Human
cuaccugcucagcccugca

SEQ ID NO: 1810430 - RNA, 17 nt, Human
aaauguucaucaaugaa

SEQ ID NO: 1810431 - RNA, 21 nt, Human
uaaaaagcgcuaauuucuauu

SEQ ID NO: 1810432 - RNA, 21 nt, Human
agagcaagaccccaucucaaa

SEQ ID NO: 1810433 - RNA, 12 nt, Human
ccuucacuccca

SEQ ID NO: 1810434 - RNA, 17 nt, Human
uuucauaagaauucugu

SEQ ID NO: 1810435 - RNA, 19 nt, Human
gaaaauguucccuucaagu

SEQ ID NO: 1810436 - RNA, 15 nt, Human
uaagcuuuucuuuuc

SEQ ID NO: 1810437 - RNA, 22 nt, Human
gagccucagucucccucccuug

SEQ ID NO: 1810438 - RNA, 14 nt, Human
uauucuagucuauu

SEQ ID NO: 1810439 - RNA, 23 nt, Human
acugucuuguuggacgagaaaac

SEQ ID NO: 1810440 - RNA, 14 nt, Human
gagacaagaaaaua

SEQ ID NO: 1810441 - RNA, 16 nt, Human
ccauuuuuagugaaau

SEQ ID NO: 1810442 - RNA, 19 nt, Human
cacagcuucagccaggagc

SEQ ID NO: 1810443 - RNA, 13 nt, Human
gacaaggaaaaaa

SEQ ID NO: 1810444 - RNA, 20 nt, Human
cugcugucccaaacaugcac

SEQ ID NO: 1810445 - RNA, 16 nt, Human
agaugucgcccuacuc

SEQ ID NO: 1810446 - RNA, 22 nt, Human
agacucgggauuaguacacacu

SEQ ID NO: 1810447 - RNA, 14 nt, Human
aaucucaauauuuc

SEQ ID NO: 1810448 - RNA, 13 nt, Human
ugcuuucuucucc

SEQ ID NO: 1810449 - RNA, 20 nt, Human
auauugucacugacacacac

SEQ ID NO: 1810450 - RNA, 20 nt, Human
ucccaugaagaaagggaacg

SEQ ID NO: 1810451 - RNA, 17 nt, Human
uaaaaugagaaaucuaa

SEQ ID NO: 1810452 - RNA, 12 nt, Human
ccucccuccaga

SEQ ID NO: 1810453 - RNA, 13 nt, Human
uauuauggaggca

SEQ ID NO: 1810454 - RNA, 20 nt, Human
cacccagguuggagugcagu

SEQ ID NO: 1810455 - RNA, 14 nt, Human
acaaauccaaugaa

SEQ ID NO: 1810456 - RNA, 22 nt, Human
ccacagcuguaugauucccagc

SEQ ID NO: 1810457 - RNA, 18 nt, Human
ggacuucuugaaaucaau

SEQ ID NO: 1810458 - RNA, 19 nt, Human
ucccuauuccuccuucccu

SEQ ID NO: 1810459 - RNA, 23 nt, Human
ucucaagcccugcagucacagcu

SEQ ID NO: 1810460 - RNA, 20 nt, Human
ucuaagaaagaacacgcucu

SEQ ID NO: 1810461 - RNA, 12 nt, Human
cugaggccaggg

SEQ ID NO: 1810462 - RNA, 23 nt, Human
ucaauaucuuuuuuuuaauaaac

SEQ ID NO: 1810463 - RNA, 18 nt, Human
cuagucucuacccaguag

SEQ ID NO: 1810464 - RNA, 15 nt, Human
uaaaaggaaagaaaa

SEQ ID NO: 1810465 - RNA, 14 nt, Human
aauugaauuuccau

SEQ ID NO: 1810466 - RNA, 23 nt, Human
auaagauauuuuucaugauuuug

SEQ ID NO: 1810467 - RNA, 20 nt, Human
gaacuggacccuguugcuaa

SEQ ID NO: 1810468 - RNA, 18 nt, Human
aaauauuuauuuuaauaa

SEQ ID NO: 1810469 - RNA, 14 nt, Human
agugucuugaauug

SEQ ID NO: 1810470 - RNA, 16 nt, Human
cugcucucaguucacu

SEQ ID NO: 1810471 - RNA, 15 nt, Human
ccucugagagcauca

SEQ ID NO: 1810472 - RNA, 15 nt, Human
uaguccccagccugc

SEQ ID NO: 1810473 - RNA, 19 nt, Human
gugcucaguagucagacug

SEQ ID NO: 1810474 - RNA, 14 nt, Human
cccugccucaagcu

SEQ ID NO: 1810475 - RNA, 17 nt, Human
gugggauacuauuuaau

SEQ ID NO: 1810476 - RNA, 23 nt, Human
cugagaaggcuguggauuuaaug

SEQ ID NO: 1810477 - RNA, 20 nt, Human
ugcagucacagcuacacaga

SEQ ID NO: 1810478 - RNA, 15 nt, Human
caucugaaaauugau

SEQ ID NO: 1810479 - RNA, 19 nt, Human
caacagcacccucuccaga

SEQ ID NO: 1810480 - RNA, 16 nt, Human
ucauuucucaucuuuu

SEQ ID NO: 1810481 - RNA, 20 nt, Human
ucgucuucuuggccauggga

SEQ ID NO: 1810482 - RNA, 13 nt, Human
uuucaccauguug

SEQ ID NO: 1810483 - RNA, 16 nt, Human
acacucuugaaaaaug

SEQ ID NO: 1810484 - RNA, 17 nt, Human
auacaauuaaagcuguu

SEQ ID NO: 1810485 - RNA, 15 nt, Human
agaauuauuuuguga

SEQ ID NO: 1810486 - RNA, 11 nt, Human
ucaugauuuug

SEQ ID NO: 1810487 - RNA, 23 nt, Human
ccuccacauuucccccuagccug

SEQ ID NO: 1810488 - RNA, 19 nt, Human
gaaggcaccucucuggguu

SEQ ID NO: 1810489 - RNA, 15 nt, Human
gcaagcucuaucacc

SEQ ID NO: 1810490 - RNA, 20 nt, Human
ugcacacccuccagagacaa

SEQ ID NO: 1810491 - RNA, 15 nt, Human
caaacaaaaaaaaaa

SEQ ID NO: 1810492 - RNA, 18 nt, Human
aaccuuuuauauuuagua

SEQ ID NO: 1810493 - RNA, 22 nt, Human
uggcugaaaggaagcugugcgu

SEQ ID NO: 1810494 - RNA, 17 nt, Human
uccucugagccuuggga

SEQ ID NO: 1810495 - RNA, 17 nt, Human
uaguuagccaauauuuu

SEQ ID NO: 1810496 - RNA, 14 nt, Human
uauuugcuguuauu

SEQ ID NO: 1810497 - RNA, 12 nt, Human
gcuuucuucucc

SEQ ID NO: 1810498 - RNA, 14 nt, Human
uuaaaauagccaua

SEQ ID NO: 1810499 - RNA, 15 nt, Human
aauauauuuccuuau

SEQ ID NO: 1810500 - RNA, 22 nt, Human
aguuuaauggugccuucauuug

SEQ ID NO: 1810501 - RNA, 16 nt, Human
gcuuuucuuuucuuug

SEQ ID NO: 1810502 - RNA, 16 nt, Human
auaaucuuacaaugaa

SEQ ID NO: 1810503 - RNA, 17 nt, Human
cuguagaaaugguugua

SEQ ID NO: 1810504 - RNA, 16 nt, Human
ggaggcucuggagccc

SEQ ID NO: 1810505 - RNA, 19 nt, Human
aaauauggggaaaaaacug

SEQ ID NO: 1810506 - RNA, 15 nt, Human
aacaaaucucaagca

SEQ ID NO: 1810507 - RNA, 19 nt, Human
auggugccuucauuuggga

SEQ ID NO: 1810508 - RNA, 15 nt, Human
gccugccuuucuccc

SEQ ID NO: 1810509 - RNA, 14 nt, Human
cuauuuuuaauguu

SEQ ID NO: 1810510 - RNA, 15 nt, Human
auaauuuugugaagc

SEQ ID NO: 1810511 - RNA, 12 nt, Human
agccagugaaaa

SEQ ID NO: 1810512 - RNA, 24 nt, Human
cucagggacucaucuuucccuccu

SEQ ID NO: 1810513 - RNA, 20 nt, Human
uaauaucuuaucuuccuaua

SEQ ID NO: 1810514 - RNA, 21 nt, Human
aggcuguucccaccaggcugc

SEQ ID NO: 1810515 - RNA, 15 nt, Human
auuuaauuauuucac

SEQ ID NO: 1810516 - RNA, 13 nt, Human
agacagcucugca

SEQ ID NO: 1810517 - RNA, 16 nt, Human
ucccaagcaguuggga

SEQ ID NO: 1810518 - RNA, 23 nt, Human
aagugcugggauuaacagguaug

SEQ ID NO: 1810519 - RNA, 21 nt, Human
ucccuuuggagauuuuuuaau

SEQ ID NO: 1810520 - RNA, 16 nt, Human
uaaacuuugauuuuau

SEQ ID NO: 1810521 - RNA, 20 nt, Human
ccagcagccuggcucuccca

SEQ ID NO: 1810522 - RNA, 11 nt, Human
acccucccacu

SEQ ID NO: 1810523 - RNA, 20 nt, Human
guguucauaaauaaaguuug

SEQ ID NO: 1810524 - RNA, 21 nt, Human
uagaauuauaacuggaaagaa

SEQ ID NO: 1810525 - RNA, 15 nt, Human
gauuccugagccagu

SEQ ID NO: 1810526 - RNA, 20 nt, Human
agacauacaccuaugucauu

SEQ ID NO: 1810527 - RNA, 20 nt, Human
ccugccuaagugcagccccg

SEQ ID NO: 1810528 - RNA, 15 nt, Human
agaugagaguacacc

SEQ ID NO: 1810529 - RNA, 13 nt, Human
ugccuucuggccu

SEQ ID NO: 1810530 - RNA, 15 nt, Human
acccucacuuaaacu

SEQ ID NO: 1810531 - RNA, 22 nt, Human
ucuggguuccuuccucugagcc

SEQ ID NO: 1810532 - RNA, 21 nt, Human
aaaaacuuaaguagauaagga

SEQ ID NO: 1810533 - RNA, 13 nt, Human
cauucuucccuug

SEQ ID NO: 1810534 - RNA, 14 nt, Human
cuaguccccagccu

SEQ ID NO: 1810535 - RNA, 21 nt, Human
aagacagagccccacccucag

SEQ ID NO: 1810536 - RNA, 13 nt, Human
ugccuuuaaaaau

SEQ ID NO: 1810537 - RNA, 21 nt, Human
cacuugaacccgggaggcaga

SEQ ID NO: 1810538 - RNA, 23 nt, Human
agcaugucgucaaagcugaaaug

SEQ ID NO: 1810539 - RNA, 16 nt, Human
uuugaucugauaucag

SEQ ID NO: 1810540 - RNA, 12 nt, Human
uauuauuuuuua

SEQ ID NO: 1810541 - RNA, 16 nt, Human
uaaaauaaaaugaagu

SEQ ID NO: 1810542 - RNA, 16 nt, Human
cuucucuguucauuuc

SEQ ID NO: 1810543 - RNA, 22 nt, Human
uaagcccuccgccauucucaag

SEQ ID NO: 1810544 - RNA, 14 nt, Human
ugagcugaagguga

SEQ ID NO: 1810545 - RNA, 15 nt, Human
augcauacacucuca

SEQ ID NO: 1810546 - RNA, 14 nt, Human
caaggcuagaacca

SEQ ID NO: 1810547 - RNA, 21 nt, Human
gacucaagcaagauuucagau

SEQ ID NO: 1810548 - RNA, 19 nt, Human
auuuauauugauaagaucu

SEQ ID NO: 1810549 - RNA, 20 nt, Human
cuacuuccccuuccuaauuc

SEQ ID NO: 1810550 - RNA, 19 nt, Human
ucuuuguucuucuaccacc

SEQ ID NO: 1810551 - RNA, 15 nt, Human
aauucugaaagcaac

SEQ ID NO: 1810552 - RNA, 17 nt, Human
aaauaacaauaaaagac

SEQ ID NO: 1810553 - RNA, 14 nt, Human
uaaauaguuuauga

SEQ ID NO: 1810554 - RNA, 22 nt, Human
agcucaggaugagggaaaagaa

SEQ ID NO: 1810555 - RNA, 12 nt, Human
ccuucagccuga

SEQ ID NO: 1810556 - RNA, 13 nt, Human
agauuugugugca

SEQ ID NO: 1810557 - RNA, 18 nt, Human
aaauauaaauaaaaauaa

SEQ ID NO: 1810558 - RNA, 19 nt, Human
gcuaauuucuauuugaucu

SEQ ID NO: 1810559 - RNA, 20 nt, Human
aucugguccaacaugaaaac

SEQ ID NO: 1810560 - RNA, 15 nt, Human
uuacccuucuuuucu

SEQ ID NO: 1810561 - RNA, 11 nt, Human
aguacacccca

SEQ ID NO: 1810562 - RNA, 21 nt, Human
uauuauuuuauagcuacuaau

SEQ ID NO: 1810563 - RNA, 20 nt, Human
cuaucgcaccacuguguauu

SEQ ID NO: 1810564 - RNA, 22 nt, Human
agggcuuggacucaagcaagau

SEQ ID NO: 1810565 - RNA, 22 nt, Human
cgaggcccgcaugcggcccagg

SEQ ID NO: 1810566 - RNA, 16 nt, Human
uacaccccaacagcac

SEQ ID NO: 1810567 - RNA, 13 nt, Human
uuuuccuaaguga

SEQ ID NO: 1810568 - RNA, 18 nt, Human
cugagacagaaucucagu

SEQ ID NO: 1810569 - RNA, 15 nt, Human
ucaauaaguuuauuu

SEQ ID NO: 1810570 - RNA, 19 nt, Human
gaaaauaacgauaaaagac

SEQ ID NO: 1810571 - RNA, 15 nt, Human
gcucagcccugcacc

SEQ ID NO: 1810572 - RNA, 18 nt, Human
cccacuagacccacugga

SEQ ID NO: 1810573 - RNA, 17 nt, Human
cuggauaguccgucucu

SEQ ID NO: 1810574 - RNA, 17 nt, Human
auauuaccaguuuuccu

SEQ ID NO: 1810575 - RNA, 20 nt, Human
aaauccuugaagauuuacca

SEQ ID NO: 1810576 - RNA, 13 nt, Human
acucaaagaggga

SEQ ID NO: 1810577 - RNA, 16 nt, Human
acuaaacaaagaguga

SEQ ID NO: 1810578 - RNA, 22 nt, Human
uucccucuugcucagugggggc

SEQ ID NO: 1810579 - RNA, 23 nt, Human
agcauaucugccuuuauuguguu

SEQ ID NO: 1810580 - RNA, 21 nt, Human
uaacaugauuuggggaaagga

SEQ ID NO: 1810581 - RNA, 13 nt, Human
ccuuugcaccucc

SEQ ID NO: 1810582 - RNA, 22 nt, Human
agaguuuaauuuuugaaaacug

SEQ ID NO: 1810583 - RNA, 15 nt, Human
gucccauucccccag

SEQ ID NO: 1810584 - RNA, 18 nt, Human
gcugccuggaagagcagc

SEQ ID NO: 1810585 - RNA, 19 nt, Human
cucagaaguuucuucuuua

SEQ ID NO: 1810586 - RNA, 22 nt, Human
uauaaaaugaauacaauuaaag

SEQ ID NO: 1810587 - RNA, 18 nt, Human
aguagagacaggguuuca

SEQ ID NO: 1810588 - RNA, 22 nt, Human
aagcccucccuaccuaccaaga

SEQ ID NO: 1810589 - RNA, 14 nt, Human
auaucaaauauauu

SEQ ID NO: 1810590 - RNA, 17 nt, Human
gccagaggcucuaaugu

SEQ ID NO: 1810591 - RNA, 17 nt, Human
uccuuccagucuaaaaa

SEQ ID NO: 1810592 - RNA, 15 nt, Human
gccaggcccagagca

SEQ ID NO: 1810593 - RNA, 16 nt, Human
aauaucuucacuuguc

SEQ ID NO: 1810594 - RNA, 14 nt, Human
uuuacaacaaacac

SEQ ID NO: 1810595 - RNA, 19 nt, Human
gcuggccuauguggucuaa

SEQ ID NO: 1810596 - RNA, 15 nt, Human
ugcauagaauaaaau

SEQ ID NO: 1810597 - RNA, 16 nt, Human
augauuucagcaggga

SEQ ID NO: 1810598 - RNA, 15 nt, Human
cuauuuuuuccccca

SEQ ID NO: 1810599 - RNA, 17 nt, Human
aaagacaaggaaaaaau

SEQ ID NO: 1810600 - RNA, 17 nt, Human
ccacauuggagauguuu

SEQ ID NO: 1810601 - RNA, 15 nt, Human
uuuaaauguuuuuuu

SEQ ID NO: 1810602 - RNA, 16 nt, Human
caaacuuuauuuugug

SEQ ID NO: 1810603 - RNA, 22 nt, Human
gcuaauuagcauggccacaucu

SEQ ID NO: 1810604 - RNA, 16 nt, Human
uugauccagaaagaaa

SEQ ID NO: 1810605 - RNA, 17 nt, Human
agcccugcaccaugcug

SEQ ID NO: 1810606 - RNA, 15 nt, Human
ucaggcugaccacuu

SEQ ID NO: 1810607 - RNA, 21 nt, Human
aacuggagccacgacguaaca

SEQ ID NO: 1810608 - RNA, 15 nt, Human
agcaagauuucagau

SEQ ID NO: 1810609 - RNA, 17 nt, Human
aacucagaggcagugac

SEQ ID NO: 1810610 - RNA, 14 nt, Human
aagagauuuuucau

SEQ ID NO: 1810611 - RNA, 19 nt, Human
aucaaaagacuuuuuccuu

SEQ ID NO: 1810612 - RNA, 18 nt, Human
uacccaguagaugccacu

SEQ ID NO: 1810613 - RNA, 20 nt, Human
uguuagccaggcuggucuca

SEQ ID NO: 1810614 - RNA, 17 nt, Human
uccuauuuuuggaagag

SEQ ID NO: 1810615 - RNA, 14 nt, Human
ugcuggagugcagu

SEQ ID NO: 1810616 - RNA, 14 nt, Human
aaacacucuugaaa

SEQ ID NO: 1810617 - RNA, 19 nt, Human
ccaucuugcccgcucaggc

SEQ ID NO: 1810618 - RNA, 15 nt, Human
aaagaaauuaugugc

SEQ ID NO: 1810619 - RNA, 12 nt, Human
caggagcccugg

SEQ ID NO: 1810620 - RNA, 15 nt, Human
uuucccagucuucag

SEQ ID NO: 1810621 - RNA, 14 nt, Human
cgcuaccuuuugcu

SEQ ID NO: 1810622 - RNA, 22 nt, Human
aauugacccacaagaaaugaaa

SEQ ID NO: 1810623 - RNA, 13 nt, Human
aaacuauuuguaa

SEQ ID NO: 1810624 - RNA, 11 nt, Human
uuauauuuauu

SEQ ID NO: 1810625 - RNA, 16 nt, Human
aaauaugucuuucuuu

SEQ ID NO: 1810626 - RNA, 14 nt, Human
ucggagcccugucu

SEQ ID NO: 1810627 - RNA, 16 nt, Human
cuuggacuucuugaaa

SEQ ID NO: 1810628 - RNA, 22 nt, Human
ugaaaaaguucugcagauaaac

SEQ ID NO: 1810629 - RNA, 11 nt, Human
gcuggcucugu

SEQ ID NO: 1810630 - RNA, 15 nt, Human
gcacuuggcugcaua

SEQ ID NO: 1810631 - RNA, 17 nt, Human
gauuaucaauuaccaca

SEQ ID NO: 1810632 - RNA, 22 nt, Human
uuccuucugagccugccuuucu

SEQ ID NO: 1810633 - RNA, 22 nt, Human
gaauaacauggugugcuucuua

SEQ ID NO: 1810634 - RNA, 15 nt, Human
ucuucuuacuggugc

SEQ ID NO: 1810635 - RNA, 15 nt, Human
cacucagauccuccu

SEQ ID NO: 1810636 - RNA, 21 nt, Human
ccccaacagcacccucuccag

SEQ ID NO: 1810637 - RNA, 20 nt, Human
augguuuagaaagcuugccc

SEQ ID NO: 1810638 - RNA, 14 nt, Human
cucaggagcccugg

SEQ ID NO: 1810639 - RNA, 19 nt, Human
acccugucucuacaaaaaa

SEQ ID NO: 1810640 - RNA, 19 nt, Human
ugggcagaaggccaagagg

SEQ ID NO: 1810641 - RNA, 19 nt, Human
ucacauuuucccuucccug

SEQ ID NO: 1810642 - RNA, 19 nt, Human
uugaauuuuuuuuaacauu

SEQ ID NO: 1810643 - RNA, 22 nt, Human
cauuuccucagacucuaagaaa

SEQ ID NO: 1810644 - RNA, 13 nt, Human
aggauuugaaauu

SEQ ID NO: 1810645 - RNA, 23 nt, Human
uaaaguaucaggauacuauauuu

SEQ ID NO: 1810646 - RNA, 13 nt, Human
cucuccaccaggu

SEQ ID NO: 1810647 - RNA, 13 nt, Human
cugcacuccagcc

SEQ ID NO: 1810648 - RNA, 23 nt, Human
cacagauuugagcucagcccugg

SEQ ID NO: 1810649 - RNA, 21 nt, Human
gaaaaguauguuagugcaaau

SEQ ID NO: 1810650 - RNA, 20 nt, Human
ugagagacacacugaagaag

SEQ ID NO: 1810651 - RNA, 17 nt, Human
gcaccaggacuagggcu

SEQ ID NO: 1810652 - RNA, 11 nt, Human
ccugagcccca

SEQ ID NO: 1810653 - RNA, 20 nt, Human
ugcucaggagcccugggagg

SEQ ID NO: 1810654 - RNA, 16 nt, Human
cucccacuucagccuc

SEQ ID NO: 1810655 - RNA, 22 nt, Human
cuuuuuccuuccagucuaaaaa

SEQ ID NO: 1810656 - RNA, 14 nt, Human
gcuuuggaagccau

SEQ ID NO: 1810657 - RNA, 22 nt, Human
aguggcaucaucucagcucacu

SEQ ID NO: 1810658 - RNA, 14 nt, Human
cacauagaugcuga

SEQ ID NO: 1810659 - RNA, 21 nt, Human
auauaugcuaagucuuauaua

SEQ ID NO: 1810660 - RNA, 21 nt, Human
gcagcucuccccuucucugua

SEQ ID NO: 1810661 - RNA, 13 nt, Human
ucguuuucaaaau

SEQ ID NO: 1810662 - RNA, 20 nt, Human
cagacuuuuuuuuuuuauaa

SEQ ID NO: 1810663 - RNA, 22 nt, Human
caaugcuguauuuuaaaagaau

SEQ ID NO: 1810664 - RNA, 14 nt, Human
augaugauuucagc

SEQ ID NO: 1810665 - RNA, 13 nt, Human
cucaccuccccca

SEQ ID NO: 1810666 - RNA, 23 nt, Human
augaauuaaguuuuuuuuuaaaa

SEQ ID NO: 1810667 - RNA, 19 nt, Human
uucccuguuucuuccacag

SEQ ID NO: 1810668 - RNA, 22 nt, Human
gagucccaggcugagccucagu

SEQ ID NO: 1810669 - RNA, 18 nt, Human
acaugauuuggggaaagg

SEQ ID NO: 1810670 - RNA, 16 nt, Human
gcaggauuugggcucu

SEQ ID NO: 1810671 - RNA, 16 nt, Human
caguguguggcuuuca

SEQ ID NO: 1810672 - RNA, 23 nt, Human
cuuugcccugcugcccucccccu

SEQ ID NO: 1810673 - RNA, 16 nt, Human
cagggacuugaaccca

SEQ ID NO: 1810674 - RNA, 17 nt, Human
uguuucaacaguuuuug

SEQ ID NO: 1810675 - RNA, 14 nt, Human
uaaggccaugauuu

SEQ ID NO: 1810676 - RNA, 15 nt, Human
agcaaugccugccca

SEQ ID NO: 1810677 - RNA, 14 nt, Human
cacaugucuuaaug

SEQ ID NO: 1810678 - RNA, 17 nt, Human
auuuaguuauaaaaaua

SEQ ID NO: 1810679 - RNA, 15 nt, Human
ugcuuuuaaaaucca

SEQ ID NO: 1810680 - RNA, 21 nt, Human
cuucucacauuuauauuuuug

SEQ ID NO: 1810681 - RNA, 18 nt, Human
ugagcucagcccuggugg

SEQ ID NO: 1810682 - RNA, 13 nt, Human
cuucucaacucca

SEQ ID NO: 1810683 - RNA, 18 nt, Human
cucacacucaugcauugu

SEQ ID NO: 1810684 - RNA, 14 nt, Human
uuuagaauaugccu

SEQ ID NO: 1810685 - RNA, 17 nt, Human
gugccuguaaucacagc

SEQ ID NO: 1810686 - RNA, 21 nt, Human
auuuccuaguucuguagaaau

SEQ ID NO: 1810687 - RNA, 14 nt, Human
ccugcucagcccug

SEQ ID NO: 1810688 - RNA, 14 nt, Human
aaucuaucaaaauu

SEQ ID NO: 1810689 - RNA, 20 nt, Human
agauaaugugauauuauaca

SEQ ID NO: 1810690 - RNA, 13 nt, Human
uaguuuauauaga

SEQ ID NO: 1810691 - RNA, 14 nt, Human
uguugaauuuugau

SEQ ID NO: 1810692 - RNA, 17 nt, Human
cuccaaagcccucccua

SEQ ID NO: 1810693 - RNA, 21 nt, Human
uccauaucucccucuucccua

SEQ ID NO: 1810694 - RNA, 21 nt, Human
ucugauaucaguccaguuugu

SEQ ID NO: 1810695 - RNA, 15 nt, Human
gagacaggguuucac

SEQ ID NO: 1810696 - RNA, 17 nt, Human
ccacauuucccccuagc

SEQ ID NO: 1810697 - RNA, 20 nt, Human
cuauguagaauauauuuccu

SEQ ID NO: 1810698 - RNA, 23 nt, Human
aacaucacauuccucugcccuuc

SEQ ID NO: 1810699 - RNA, 12 nt, Human
guaaaggcaaac

SEQ ID NO: 1810700 - RNA, 19 nt, Human
uuuucuacacauacaugua

SEQ ID NO: 1810701 - RNA, 17 nt, Human
caggagcaucuccucaa

SEQ ID NO: 1810702 - RNA, 19 nt, Human
agcuacuaauuuuaaaaug

SEQ ID NO: 1810703 - RNA, 20 nt, Human
caggaguucucccaccaccu

SEQ ID NO: 1810704 - RNA, 20 nt, Human
cucuccaaagcccucccuac

SEQ ID NO: 1810705 - RNA, 22 nt, Human
ccugcagacucacugugggaag

SEQ ID NO: 1810706 - RNA, 13 nt, Human
cuuaucaaaggac

SEQ ID NO: 1810707 - RNA, 20 nt, Human
ggagaggagugugaagcaag

SEQ ID NO: 1810708 - RNA, 20 nt, Human
guccccuauccuacuucccc

SEQ ID NO: 1810709 - RNA, 20 nt, Human
aaagacagugaaagaaaaua

SEQ ID NO: 1810710 - RNA, 12 nt, Human
ugccucuguauu

SEQ ID NO: 1810711 - RNA, 18 nt, Human
ugggauacuauuuaauua

SEQ ID NO: 1810712 - RNA, 24 nt, Human
uacaauaaagcaaugugguaguuc

SEQ ID NO: 1810713 - RNA, 16 nt, Human
uagccccucuccugga

SEQ ID NO: 1810714 - RNA, 20 nt, Human
augcaguuguugcccacagc

SEQ ID NO: 1810715 - RNA, 21 nt, Human
aggcaccugucccagaaaaag

SEQ ID NO: 1810716 - RNA, 16 nt, Human
aaauaguuuaugauuc

SEQ ID NO: 1810717 - RNA, 17 nt, Human
uaucaauuaccacacca

SEQ ID NO: 1810718 - RNA, 19 nt, Human
uugcauagaauaaaauuuu

SEQ ID NO: 1810719 - RNA, 21 nt, Human
ucuuuuaggacccuucccuug

SEQ ID NO: 1810720 - RNA, 15 nt, Human
cuucuauugccucug

SEQ ID NO: 1810721 - RNA, 12 nt, Human
cagaaaaagcau

SEQ ID NO: 1810722 - RNA, 23 nt, Human
aaugcuccuccagggagucucag

SEQ ID NO: 1810723 - RNA, 23 nt, Human
aggagcuguugagguaccuccaa

SEQ ID NO: 1810724 - RNA, 18 nt, Human
cagacacaaauaaaggaa

SEQ ID NO: 1810725 - RNA, 14 nt, Human
cgaauggaagaggc

SEQ ID NO: 1810726 - RNA, 20 nt, Human
agaacacgcucucuccaggc

SEQ ID NO: 1810727 - RNA, 17 nt, Human
aaugagcugaaggugaa

SEQ ID NO: 1810728 - RNA, 15 nt, Human
gcauaacguauaaaa

SEQ ID NO: 1810729 - RNA, 21 nt, Human
agggugauauuaaccaggggc

SEQ ID NO: 1810730 - RNA, 13 nt, Human
auuaaaauuuuuu

SEQ ID NO: 1810731 - RNA, 14 nt, Human
gccucagucucccu

SEQ ID NO: 1810732 - RNA, 17 nt, Human
ucugcaaacugccuucu

SEQ ID NO: 1810733 - RNA, 18 nt, Human
aucauaauauaaaacagg

SEQ ID NO: 1810734 - RNA, 17 nt, Human
cuucugaggagcuguug

SEQ ID NO: 1810735 - RNA, 17 nt, Human
ccauucugaggccaggg

SEQ ID NO: 1810736 - RNA, 20 nt, Human
aaagucucuggaauuugaaa

SEQ ID NO: 1810737 - RNA, 22 nt, Human
augaaggugucauacagauuug

SEQ ID NO: 1810738 - RNA, 18 nt, Human
uaagccuucugguuuuau

SEQ ID NO: 1810739 - RNA, 15 nt, Human
aauauauauuuuaga

SEQ ID NO: 1810740 - RNA, 23 nt, Human
uguacaauaaagcaaugugguag

SEQ ID NO: 1810741 - RNA, 23 nt, Human
uaaguuuuuuuuuaaaaaagaaa

SEQ ID NO: 1810742 - RNA, 23 nt, Human
ccucucugcaggcagccugccuu

SEQ ID NO: 1810743 - RNA, 16 nt, Human
gaacuccuugauuuua

SEQ ID NO: 1810744 - RNA, 14 nt, Human
gaacuucuccccug

SEQ ID NO: 1810745 - RNA, 22 nt, Human
gugcuaauuuugaaaaacugcu

SEQ ID NO: 1810746 - RNA, 14 nt, Human
aaaagagucuuaau

SEQ ID NO: 1810747 - RNA, 20 nt, Human
cucuuagcuaaaucccuccc

SEQ ID NO: 1810748 - RNA, 15 nt, Human
uuuaugguuguauua

SEQ ID NO: 1810749 - RNA, 13 nt, Human
cauagagacuugg

SEQ ID NO: 1810750 - RNA, 21 nt, Human
ccucagaugcacaugagcugg

SEQ ID NO: 1810751 - RNA, 21 nt, Human
caggaucguuuuuucccaggg

SEQ ID NO: 1810752 - RNA, 19 nt, Human
uggagccuacuaaaugcuc

SEQ ID NO: 1810753 - RNA, 15 nt, Human
acauucuuccugauu

SEQ ID NO: 1810754 - RNA, 16 nt, Human
cagaucacagcuucag

SEQ ID NO: 1810755 - RNA, 18 nt, Human
uaauauuucuucaaauaa

SEQ ID NO: 1810756 - RNA, 15 nt, Human
cccccagcccuccuu

SEQ ID NO: 1810757 - RNA, 14 nt, Human
acuuacauucuuaa

SEQ ID NO: 1810758 - RNA, 12 nt, Human
acagccacuugg

SEQ ID NO: 1810759 - RNA, 17 nt, Human
auuuaaauauuuauuua

SEQ ID NO: 1810760 - RNA, 19 nt, Human
acuauuauauuuccaagaa

SEQ ID NO: 1810761 - RNA, 16 nt, Human
acucuuguaauaaaau

SEQ ID NO: 1810762 - RNA, 17 nt, Human
agucccaggcugagccu

SEQ ID NO: 1810763 - RNA, 17 nt, Human
uguuccuuauauuuacu

SEQ ID NO: 1810764 - RNA, 19 nt, Human
caugcugcuggggaagaca

SEQ ID NO: 1810765 - RNA, 12 nt, Human
cuccaaggaccg

SEQ ID NO: 1810766 - RNA, 15 nt, Human
accuuuuauauuuag

SEQ ID NO: 1810767 - RNA, 23 nt, Human
ugcccggcuaauuuuuguauuuu

SEQ ID NO: 1810768 - RNA, 21 nt, Human
uuuuagccuucucuguucauu

SEQ ID NO: 1810769 - RNA, 12 nt, Human
agcuauaaaaug

SEQ ID NO: 1810770 - RNA, 19 nt, Human
aucaggccuagaggccuga

SEQ ID NO: 1810771 - RNA, 14 nt, Human
gcagauucucccuu

SEQ ID NO: 1810772 - RNA, 16 nt, Human
gaaagaacacgcucuc

SEQ ID NO: 1810773 - RNA, 22 nt, Human
acccuuauugcuguccuggagg

SEQ ID NO: 1810774 - RNA, 16 nt, Human
gagguucgcuuaucaa

SEQ ID NO: 1810775 - RNA, 15 nt, Human
ccacaucugagcccc

SEQ ID NO: 1810776 - RNA, 17 nt, Human
cacucagauccuccuca

SEQ ID NO: 1810777 - RNA, 15 nt, Human
uuccacuagggucca

SEQ ID NO: 1810778 - RNA, 15 nt, Human
cuguauguccuuggu

SEQ ID NO: 1810779 - RNA, 15 nt, Human
uacaauaaagcaaug

SEQ ID NO: 1810780 - RNA, 23 nt, Human
aauauuuauuuuaauaauguuuc

SEQ ID NO: 1810781 - RNA, 14 nt, Human
aaaggccuuuaaaa

SEQ ID NO: 1810782 - RNA, 17 nt, Human
uuaaucuguauuucccc

SEQ ID NO: 1810783 - RNA, 22 nt, Human
ugguacccacuugcuuuuaaaa

SEQ ID NO: 1810784 - RNA, 15 nt, Human
cuuacugauuuuuaa

SEQ ID NO: 1810785 - RNA, 23 nt, Human
uugauuuuauaugcuauuuauua

SEQ ID NO: 1810786 - RNA, 13 nt, Human
aguaaagaacauc

SEQ ID NO: 1810787 - RNA, 15 nt, Human
cuagaaaauuuaaaa

SEQ ID NO: 1810788 - RNA, 23 nt, Human
ugccccuacccuggacuugccuc

SEQ ID NO: 1810789 - RNA, 18 nt, Human
auauuuauuuaacuauuc

SEQ ID NO: 1810790 - RNA, 15 nt, Human
ccuuucuuuuuuuaa

SEQ ID NO: 1810791 - RNA, 20 nt, Human
uauguccuuggugccuggag

SEQ ID NO: 1810792 - RNA, 18 nt, Human
ugaauguuaaauaaauug

SEQ ID NO: 1810793 - RNA, 12 nt, Human
uauuuuaauguu

SEQ ID NO: 1810794 - RNA, 21 nt, Human
ucugcuacccucauuucucau

SEQ ID NO: 1810795 - RNA, 23 nt, Human
cccacagaagugcuuucuucucc

SEQ ID NO: 1810796 - RNA, 16 nt, Human
cuucuggguuccuucc

SEQ ID NO: 1810797 - RNA, 18 nt, Human
gucuuuuaggacccuucc

SEQ ID NO: 1810798 - RNA, 14 nt, Human
auccauucuucccu

SEQ ID NO: 1810799 - RNA, 11 nt, Human
cuguuuuauaa

SEQ ID NO: 1810800 - RNA, 16 nt, Human
cuaacaaguagcaccc

SEQ ID NO: 1810801 - RNA, 14 nt, Human
cacucuugaaaaau

SEQ ID NO: 1810802 - RNA, 17 nt, Human
ucuaaugagauauuaaa

SEQ ID NO: 1810803 - RNA, 18 nt, Human
cacauaaugcucauacuu

SEQ ID NO: 1810804 - RNA, 19 nt, Human
uuuugaaaacuggcuacug

SEQ ID NO: 1810805 - RNA, 14 nt, Human
agcuggggccaggc

SEQ ID NO: 1810806 - RNA, 20 nt, Human
auaauccuaaacauaugaau

SEQ ID NO: 1810807 - RNA, 12 nt, Human
cuucaagcucuc

SEQ ID NO: 1810808 - RNA, 17 nt, Human
ggaccuggggcacugug

SEQ ID NO: 1810809 - RNA, 19 nt, Human
cuguuauuuuaucugcuau

SEQ ID NO: 1810810 - RNA, 17 nt, Human
ucccuagccagaggcuc

SEQ ID NO: 1810811 - RNA, 15 nt, Human
acuccuguuucacuu

SEQ ID NO: 1810812 - RNA, 20 nt, Human
gaggccccugucucagggug

SEQ ID NO: 1810813 - RNA, 19 nt, Human
aacucaugacggaagaguu

SEQ ID NO: 1810814 - RNA, 15 nt, Human
cuuccaucaccuccc

SEQ ID NO: 1810815 - RNA, 21 nt, Human
uccaagcaggaagaaggaaaa

SEQ ID NO: 1810816 - RNA, 23 nt, Human
uuccucaugaauguaaauuugua

SEQ ID NO: 1810817 - RNA, 20 nt, Human
guggggcgggcuucauagag

SEQ ID NO: 1810818 - RNA, 23 nt, Human
cccucuccaggagaccuacccuc

SEQ ID NO: 1810819 - RNA, 12 nt, Human
cccucuccugga

SEQ ID NO: 1810820 - RNA, 15 nt, Human
uucggccuccauccu

SEQ ID NO: 1810821 - RNA, 21 nt, Human
agccaaaagauuggauacgca

SEQ ID NO: 1810822 - RNA, 16 nt, Human
uauucauauuuucuuu

SEQ ID NO: 1810823 - RNA, 16 nt, Human
gaaaucaugaagauau

SEQ ID NO: 1810824 - RNA, 18 nt, Human
uacaaccuccgccuccca

SEQ ID NO: 1810825 - RNA, 13 nt, Human
agcccagcuugaa

SEQ ID NO: 1810826 - RNA, 14 nt, Human
caaaguccugggau

SEQ ID NO: 1810827 - RNA, 14 nt, Human
aguccuucccuuuc

SEQ ID NO: 1810828 - RNA, 19 nt, Human
ccuuucucccccccaccca

SEQ ID NO: 1810829 - RNA, 22 nt, Human
aaugaaauggugaaaugcagag

SEQ ID NO: 1810830 - RNA, 17 nt, Human
guuauaaucauuuauca

SEQ ID NO: 1810831 - RNA, 14 nt, Human
uguaauaaaauguc

SEQ ID NO: 1810832 - RNA, 22 nt, Human
cugcucaauaaaguacaagagc

SEQ ID NO: 1810833 - RNA, 23 nt, Human
caaagcugaaauggacuuuugua

SEQ ID NO: 1810834 - RNA, 21 nt, Human
cuuccaggcuggcgugcagca

SEQ ID NO: 1810835 - RNA, 20 nt, Human
aaacacugggagaaaugaaa

SEQ ID NO: 1810836 - RNA, 11 nt, Human
ugugugcagca

SEQ ID NO: 1810837 - RNA, 17 nt, Human
cugcugcccucccccuc

SEQ ID NO: 1810838 - RNA, 19 nt, Human
ggagcaguagcuggaggga

SEQ ID NO: 1810839 - RNA, 23 nt, Human
gaggcggaauugcucucccagcc

SEQ ID NO: 1810840 - RNA, 20 nt, Human
acacugagccagcagccugg

SEQ ID NO: 1810841 - RNA, 15 nt, Human
aaauuuuagcaaaga

SEQ ID NO: 1810842 - RNA, 17 nt, Human
uuuaaaccauuuucuuu

SEQ ID NO: 1810843 - RNA, 22 nt, Human
augcauauacuuuaauaaaugu

SEQ ID NO: 1810844 - RNA, 19 nt, Human
uuuuuaucaugugaaauca

SEQ ID NO: 1810845 - RNA, 17 nt, Human
ucauuauuacuuuugcu

SEQ ID NO: 1810846 - RNA, 22 nt, Human
uccauuacggagaguuuccuau

SEQ ID NO: 1810847 - RNA, 23 nt, Human
gcuaccugcucagcccugcacca

SEQ ID NO: 1810848 - RNA, 22 nt, Human
uggagugcaguggcaucaucuc

SEQ ID NO: 1810849 - RNA, 13 nt, Human
uguaagacaaaua

SEQ ID NO: 1810850 - RNA, 22 nt, Human
uaaucccgauucacccugucca

SEQ ID NO: 1810851 - RNA, 20 nt, Human
uuccauaagaagucguuuuu

SEQ ID NO: 1810852 - RNA, 23 nt, Human
cuaucgcaccacuguguauuuaa

SEQ ID NO: 1810853 - RNA, 20 nt, Human
ucugggcugugggcaagccu

SEQ ID NO: 1810854 - RNA, 21 nt, Human
aaucauucuuauuucaugaaa

SEQ ID NO: 1810855 - RNA, 22 nt, Human
uuuauagcuacuaauuuuaaaa

SEQ ID NO: 1810856 - RNA, 23 nt, Human
uauuuuucagaaucucucuucuu

SEQ ID NO: 1810857 - RNA, 21 nt, Human
ugugagccaccacauccagcc

SEQ ID NO: 1810858 - RNA, 20 nt, Human
cccucacugcaggcuccccu

SEQ ID NO: 1810859 - RNA, 14 nt, Human
cuacaggacauuuu

SEQ ID NO: 1810860 - RNA, 17 nt, Human
agacagugaaagaaaau

SEQ ID NO: 1810861 - RNA, 23 nt, Human
gcuuuggucuaucuuugagcgcc

SEQ ID NO: 1810862 - RNA, 15 nt, Human
ugccucccagguuca

SEQ ID NO: 1810863 - RNA, 23 nt, Human
agagacagcccaggauacuggca

SEQ ID NO: 1810864 - RNA, 15 nt, Human
cccauggccacuugg

SEQ ID NO: 1810865 - RNA, 13 nt, Human
ugcugacuggcuu

SEQ ID NO: 1810866 - RNA, 18 nt, Human
cauuuacccuucuuuucu

SEQ ID NO: 1810867 - RNA, 17 nt, Human
gcuaccuguaacuugaa

SEQ ID NO: 1810868 - RNA, 13 nt, Human
acaccuuuuacuc

SEQ ID NO: 1810869 - RNA, 18 nt, Human
aauuagugcuuuuugugu

SEQ ID NO: 1810870 - RNA, 18 nt, Human
guuguaauauuucuucaa

SEQ ID NO: 1810871 - RNA, 20 nt, Human
aucauuuaguuauaaaaaua

SEQ ID NO: 1810872 - RNA, 21 nt, Human
acaugcacuuggcugcauaaa

SEQ ID NO: 1810873 - RNA, 11 nt, Human
gcaugguuuag

SEQ ID NO: 1810874 - RNA, 16 nt, Human
uuuuagugauuuuaau

SEQ ID NO: 1810875 - RNA, 22 nt, Human
gaggcacccaugccaucucaac

SEQ ID NO: 1810876 - RNA, 11 nt, Human
aauugcagagu

SEQ ID NO: 1810877 - RNA, 20 nt, Human
ucauuguuauauaaucauua

SEQ ID NO: 1810878 - RNA, 16 nt, Human
acagcuucucaauuuc

SEQ ID NO: 1810879 - RNA, 19 nt, Human
uaccccuggccaaggaaga

SEQ ID NO: 1810880 - RNA, 13 nt, Human
guuaauauggugu

SEQ ID NO: 1810881 - RNA, 15 nt, Human
cuucaaagcaaagcu

SEQ ID NO: 1810882 - RNA, 21 nt, Human
uuuccucaaaaagauuucccc

SEQ ID NO: 1810883 - RNA, 18 nt, Human
gacuaaguguaccagaga

SEQ ID NO: 1810884 - RNA, 16 nt, Human
ccuaugcagaggucca

SEQ ID NO: 1810885 - RNA, 13 nt, Human
gugguuagaaaag

SEQ ID NO: 1810886 - RNA, 16 nt, Human
uugccauaauuacuau

SEQ ID NO: 1810887 - RNA, 17 nt, Human
acucagaggcagugaca

SEQ ID NO: 1810888 - RNA, 21 nt, Human
auccaaaaauguguaagaaca

SEQ ID NO: 1810889 - RNA, 23 nt, Human
auuuuuuuucuuguauuuuucca

SEQ ID NO: 1810890 - RNA, 14 nt, Human
gaucucagcucacu

SEQ ID NO: 1810891 - RNA, 20 nt, Human
gaagugcuaauuuugaaaaa

SEQ ID NO: 1810892 - RNA, 16 nt, Human
auuuccuaauuuugag

SEQ ID NO: 1810893 - RNA, 15 nt, Human
ugugcuugagccagg

SEQ ID NO: 1810894 - RNA, 17 nt, Human
cacucacaacagcugcc

SEQ ID NO: 1810895 - RNA, 17 nt, Human
cugcaaacugccuucuu

SEQ ID NO: 1810896 - RNA, 16 nt, Human
cauagaaguaaaaaca

SEQ ID NO: 1810897 - RNA, 18 nt, Human
ugcccugcugcccucccc

SEQ ID NO: 1810898 - RNA, 18 nt, Human
cagaagugcuuucuucuc

SEQ ID NO: 1810899 - RNA, 14 nt, Human
gaaggugaucuggc

SEQ ID NO: 1810900 - RNA, 23 nt, Human
uaaagacaauuguuggagagccc

SEQ ID NO: 1810901 - RNA, 15 nt, Human
aucuaugcauuuucu

SEQ ID NO: 1810902 - RNA, 14 nt, Human
ucaaugcagccccc

SEQ ID NO: 1810903 - RNA, 21 nt, Human
uccagaugagaguacacccca

SEQ ID NO: 1810904 - RNA, 16 nt, Human
aagcaagauuucagau

SEQ ID NO: 1810905 - RNA, 17 nt, Human
ucaaaagacuuuuuccu

SEQ ID NO: 1810906 - RNA, 15 nt, Human
aacuacuagaaaauu

SEQ ID NO: 1810907 - RNA, 18 nt, Human
aauaaacuauuuguaaag

SEQ ID NO: 1810908 - RNA, 21 nt, Human
acgccuggcuaauuuuuguau

SEQ ID NO: 1810909 - RNA, 18 nt, Human
aaaccuuuguuugcaucu

SEQ ID NO: 1810910 - RNA, 14 nt, Human
uuagagaauuuccu

SEQ ID NO: 1810911 - RNA, 13 nt, Human
uuuauuuugccaa

SEQ ID NO: 1810912 - RNA, 23 nt, Human
gauggaaaagggagauucagacu

SEQ ID NO: 1810913 - RNA, 12 nt, Human
gucccaggcuga

SEQ ID NO: 1810914 - RNA, 18 nt, Human
accucuccaaagcccucc

SEQ ID NO: 1810915 - RNA, 21 nt, Human
uuaauaaacacucuugaaaaa

SEQ ID NO: 1810916 - RNA, 13 nt, Human
gaaggugugggcc

SEQ ID NO: 1810917 - RNA, 15 nt, Human
agcucacaggagcuu

SEQ ID NO: 1810918 - RNA, 23 nt, Human
uuuccuccacaccauucaggucu

SEQ ID NO: 1810919 - RNA, 23 nt, Human
cacccugcccagccgucaaaaga

SEQ ID NO: 1810920 - RNA, 14 nt, Human
ucauaagauauuuu

SEQ ID NO: 1810921 - RNA, 18 nt, Human
ucacagugggagccaggg

SEQ ID NO: 1810922 - RNA, 12 nt, Human
aaaugaaagcag

SEQ ID NO: 1810923 - RNA, 17 nt, Human
cucuggccuguacccag

SEQ ID NO: 1810924 - RNA, 22 nt, Human
cagguauaccucacuuuacaca

SEQ ID NO: 1810925 - RNA, 22 nt, Human
agauauuuuucaugauuuugaa

SEQ ID NO: 1810926 - RNA, 13 nt, Human
agacacaaauaaa

SEQ ID NO: 1810927 - RNA, 16 nt, Human
gguaaccucuuacuua

SEQ ID NO: 1810928 - RNA, 23 nt, Human
gcuucauguaacuagaauuucuu

SEQ ID NO: 1810929 - RNA, 18 nt, Human
cuucucacauuuauauuu

SEQ ID NO: 1810930 - RNA, 20 nt, Human
uuuaauuucugcaaauguaa

SEQ ID NO: 1810931 - RNA, 16 nt, Human
acuugcuuuuaaaauc

SEQ ID NO: 1810932 - RNA, 20 nt, Human
uuaacguuuucauuaaaauu

SEQ ID NO: 1810933 - RNA, 22 nt, Human
uguuucauauuuuucauagcua

SEQ ID NO: 1810934 - RNA, 12 nt, Human
ccuccucuccca

SEQ ID NO: 1810935 - RNA, 23 nt, Human
agagacagcuugaucaaaggcac

SEQ ID NO: 1810936 - RNA, 20 nt, Human
gaggcuguugucuuuuccuu

SEQ ID NO: 1810937 - RNA, 14 nt, Human
aauuaauuuuagaa

SEQ ID NO: 1810938 - RNA, 16 nt, Human
caagugauccucaggc

SEQ ID NO: 1810939 - RNA, 17 nt, Human
ugaaauggugaaaugca

SEQ ID NO: 1810940 - RNA, 21 nt, Human
caccucuccaaagcccucccu

SEQ ID NO: 1810941 - RNA, 19 nt, Human
ucuuacugauuuuuaaguu

SEQ ID NO: 1810942 - RNA, 12 nt, Human
cuuuuccuucug

SEQ ID NO: 1810943 - RNA, 17 nt, Human
cacagaucuuucugccu

SEQ ID NO: 1810944 - RNA, 15 nt, Human
ugauacuugaaaauu

SEQ ID NO: 1810945 - RNA, 23 nt, Human
aagagccuuuuuuugaaaaaaag

SEQ ID NO: 1810946 - RNA, 22 nt, Human
guuagccguggugauuuagcag

SEQ ID NO: 1810947 - RNA, 18 nt, Human
auuuuagacauucuuuau

SEQ ID NO: 1810948 - RNA, 13 nt, Human
aacacaacuauau

SEQ ID NO: 1810949 - RNA, 15 nt, Human
cuucagccucccaag

SEQ ID NO: 1810950 - RNA, 16 nt, Human
cagagggaucaagcag

SEQ ID NO: 1810951 - RNA, 16 nt, Human
acgagaaauagaaaug

SEQ ID NO: 1810952 - RNA, 14 nt, Human
uccacuuggucugu

SEQ ID NO: 1810953 - RNA, 13 nt, Human
cugccucuuaaau

SEQ ID NO: 1810954 - RNA, 12 nt, Human
ucccccucuggc

SEQ ID NO: 1810955 - RNA, 19 nt, Human
ccaugugauuccaucuugc

SEQ ID NO: 1810956 - RNA, 16 nt, Human
agguacuucaaauccu

SEQ ID NO: 1810957 - RNA, 20 nt, Human
ccuaguccccagccugcucc

SEQ ID NO: 1810958 - RNA, 22 nt, Human
accagggaugaugcaacauccu

SEQ ID NO: 1810959 - RNA, 12 nt, Human
gugccuuucuuc

SEQ ID NO: 1810960 - RNA, 14 nt, Human
uaauauaaaacagg

SEQ ID NO: 1810961 - RNA, 19 nt, Human
auggccagcuaauuuuugu

SEQ ID NO: 1810962 - RNA, 14 nt, Human
agggagguggcugg

SEQ ID NO: 1810963 - RNA, 19 nt, Human
aucugcuauucuccauacu

SEQ ID NO: 1810964 - RNA, 20 nt, Human
cucacugcaaccuccaccuc

SEQ ID NO: 1810965 - RNA, 14 nt, Human
auaagcuuuucuuu

SEQ ID NO: 1810966 - RNA, 17 nt, Human
agguucugacucuuggc

SEQ ID NO: 1810967 - RNA, 18 nt, Human
ggaaagaauaaccaacac

SEQ ID NO: 1810968 - RNA, 12 nt, Human
uccuugauuuua

SEQ ID NO: 1810969 - RNA, 18 nt, Human
ccaggacuagggcuggag

SEQ ID NO: 1810970 - RNA, 18 nt, Human
uggacuguuuuuaaaaaa

SEQ ID NO: 1810971 - RNA, 14 nt, Human
cccuggacuugccu

SEQ ID NO: 1810972 - RNA, 16 nt, Human
aagaccauuuuuccuc

SEQ ID NO: 1810973 - RNA, 16 nt, Human
auauaauacaaaggcu

SEQ ID NO: 1810974 - RNA, 23 nt, Human
cacugggguguguggcagagcca

SEQ ID NO: 1810975 - RNA, 18 nt, Human
acuguuaucuucacuuuu

SEQ ID NO: 1810976 - RNA, 18 nt, Human
ucuauaauauaagcugcc

SEQ ID NO: 1810977 - RNA, 14 nt, Human
acauuaauuaucua

SEQ ID NO: 1810978 - RNA, 15 nt, Human
aauuauuucacuuua

SEQ ID NO: 1810979 - RNA, 16 nt, Human
ccaucaccuuagacca

SEQ ID NO: 1810980 - RNA, 19 nt, Human
cauuaaucugccucccucu

SEQ ID NO: 1810981 - RNA, 22 nt, Human
uuugaaacgaggauugggaaaa

SEQ ID NO: 1810982 - RNA, 20 nt, Human
gaauugcucucccagcccuu

SEQ ID NO: 1810983 - RNA, 22 nt, Human
uccacaggcacagguccccaga

SEQ ID NO: 1810984 - RNA, 14 nt, Human
caacguggcccaga

SEQ ID NO: 1810985 - RNA, 16 nt, Human
cugggcugugggcaag

SEQ ID NO: 1810986 - RNA, 15 nt, Human
guacaauaaagcaau

SEQ ID NO: 1810987 - RNA, 12 nt, Human
gguuagaaaagu

SEQ ID NO: 1810988 - RNA, 17 nt, Human
ucucugcaaacugccuu

SEQ ID NO: 1810989 - RNA, 15 nt, Human
ugggagcugccaaga

SEQ ID NO: 1810990 - RNA, 13 nt, Human
uaagugcagcccc

SEQ ID NO: 1810991 - RNA, 21 nt, Human
cugcccucccccuccucucca

SEQ ID NO: 1810992 - RNA, 12 nt, Human
agcucagggcuc

SEQ ID NO: 1810993 - RNA, 17 nt, Human
ugucuucaggggccaca

SEQ ID NO: 1810994 - RNA, 19 nt, Human
aacacauaucgauuuuuaa

SEQ ID NO: 1810995 - RNA, 17 nt, Human
acauuuuuguauuuugu

SEQ ID NO: 1810996 - RNA, 18 nt, Human
caagccucauguccacug

SEQ ID NO: 1810997 - RNA, 14 nt, Human
gucucaaugcucau

SEQ ID NO: 1810998 - RNA, 19 nt, Human
agcaggguugguuucccuu

SEQ ID NO: 1810999 - RNA, 23 nt, Human
uauuuugugaugcaaauaaauau

SEQ ID NO: 1811000 - RNA, 20 nt, Human
cuccuuccaggggagguuca

SEQ ID NO: 1811001 - RNA, 21 nt, Human
agauaaagguucaugcaaacu

SEQ ID NO: 1811002 - RNA, 21 nt, Human
cacugggagaaaugaaaaaau

SEQ ID NO: 1811003 - RNA, 17 nt, Human
cuccuaagaaggcaccu

SEQ ID NO: 1811004 - RNA, 17 nt, Human
cauggagucacagccac

SEQ ID NO: 1811005 - RNA, 19 nt, Human
ucuggauuuuaaaaguuuu

SEQ ID NO: 1811006 - RNA, 20 nt, Human
auggucccuauuccuccuuc

SEQ ID NO: 1811007 - RNA, 19 nt, Human
ugcaaccucugccucccag

SEQ ID NO: 1811008 - RNA, 16 nt, Human
auucuggacuguuuuu

SEQ ID NO: 1811009 - RNA, 21 nt, Human
uauugauaagaucuuuuauuu

SEQ ID NO: 1811010 - RNA, 13 nt, Human
aguaucuuuuuau

SEQ ID NO: 1811011 - RNA, 17 nt, Human
gucacagccacuuggga

SEQ ID NO: 1811012 - RNA, 21 nt, Human
gucuaaaaaaggaauccucug

SEQ ID NO: 1811013 - RNA, 20 nt, Human
ggcuagacuagucucaaacu

SEQ ID NO: 1811014 - RNA, 14 nt, Human
auacacuuuuuaaa

SEQ ID NO: 1811015 - RNA, 15 nt, Human
cccugagguugugug

SEQ ID NO: 1811016 - RNA, 20 nt, Human
augcugaaaaaucauccaag

SEQ ID NO: 1811017 - RNA, 23 nt, Human
gggguauuucaauuaccuucuau

SEQ ID NO: 1811018 - RNA, 17 nt, Human
ucuuucacauuuaaaua

SEQ ID NO: 1811019 - RNA, 18 nt, Human
uagcaacguggcuuuuuu

SEQ ID NO: 1811020 - RNA, 15 nt, Human
cacuugcuuuuaaaa

SEQ ID NO: 1811021 - RNA, 14 nt, Human
guccgucucugcuu

SEQ ID NO: 1811022 - RNA, 19 nt, Human
uuccacuaggguccaccag

SEQ ID NO: 1811023 - RNA, 18 nt, Human
gucugugaagugagaccu

SEQ ID NO: 1811024 - RNA, 14 nt, Human
ucaaagugcuggca

SEQ ID NO: 1811025 - RNA, 20 nt, Human
gccgggcgugguggugagug

SEQ ID NO: 1811026 - RNA, 17 nt, Human
aaacaugcacuuccuug

SEQ ID NO: 1811027 - RNA, 18 nt, Human
cuauauacucacuuucua

SEQ ID NO: 1811028 - RNA, 17 nt, Human
guuuaauucugaaagca

SEQ ID NO: 1811029 - RNA, 22 nt, Human
aggcuguucccaccaggcugcu

SEQ ID NO: 1811030 - RNA, 14 nt, Human
ggacugugugcuca

SEQ ID NO: 1811031 - RNA, 21 nt, Human
ugaagguggaaauaaacuauu

SEQ ID NO: 1811032 - RNA, 22 nt, Human
acucaggcccuccuugucuuuu

SEQ ID NO: 1811033 - RNA, 15 nt, Human
caagcucacagaccu

SEQ ID NO: 1811034 - RNA, 17 nt, Human
cagggccuguaauccca

SEQ ID NO: 1811035 - RNA, 16 nt, Human
auuacugccuauuuua

SEQ ID NO: 1811036 - RNA, 19 nt, Human
cugccaggcacacugagcc

SEQ ID NO: 1811037 - RNA, 18 nt, Human
acaaaugcauuucuaaag

SEQ ID NO: 1811038 - RNA, 17 nt, Human
cucaugagggcuggaug

SEQ ID NO: 1811039 - RNA, 19 nt, Human
auacaaaggcuuauuaauu

SEQ ID NO: 1811040 - RNA, 13 nt, Human
aagacuuuuauga

SEQ ID NO: 1811041 - RNA, 17 nt, Human
cagacaucaacagauaa

SEQ ID NO: 1811042 - RNA, 16 nt, Human
aaauauuccuuaagau

SEQ ID NO: 1811043 - RNA, 15 nt, Human
gguuaguggaagcau

SEQ ID NO: 1811044 - RNA, 17 nt, Human
auacauguaaaauaugu

SEQ ID NO: 1811045 - RNA, 22 nt, Human
ucagcccugcaccaugcugcug

SEQ ID NO: 1811046 - RNA, 15 nt, Human
gaucaaaggcacaca

SEQ ID NO: 1811047 - RNA, 17 nt, Human
caacaccccacagaagu

SEQ ID NO: 1811048 - RNA, 16 nt, Human
ggucacagggccuggg

SEQ ID NO: 1811049 - RNA, 22 nt, Human
gcagcuuuagccaagugcaggg

SEQ ID NO: 1811050 - RNA, 17 nt, Human
aagacaaggaaaaaaua

SEQ ID NO: 1811051 - RNA, 19 nt, Human
uaagauaugggacauuuuu

SEQ ID NO: 1811052 - RNA, 19 nt, Human
cuaagcuucacuguaaaau

SEQ ID NO: 1811053 - RNA, 17 nt, Human
ucaaauuguucucuaau

SEQ ID NO: 1811054 - RNA, 14 nt, Human
acuuguuucagagu

SEQ ID NO: 1811055 - RNA, 14 nt, Human
gcaccaggacgccc

SEQ ID NO: 1811056 - RNA, 17 nt, Human
caccaggacgcccucga

SEQ ID NO: 1811057 - RNA, 13 nt, Human
cuccccuucucug

SEQ ID NO: 1811058 - RNA, 23 nt, Human
auguuaaaacugggacaggggag

SEQ ID NO: 1811059 - RNA, 17 nt, Human
caugaagacagagcccc

SEQ ID NO: 1811060 - RNA, 13 nt, Human
uaucuugaauaau

SEQ ID NO: 1811061 - RNA, 12 nt, Human
aaauaagcaggc

SEQ ID NO: 1811062 - RNA, 19 nt, Human
uacuccccuccuugaacua

SEQ ID NO: 1811063 - RNA, 15 nt, Human
caaccuuuucccaac

SEQ ID NO: 1811064 - RNA, 17 nt, Human
ucaauaagccucagcuu

SEQ ID NO: 1811065 - RNA, 13 nt, Human
cuucuuuuuuucu

SEQ ID NO: 1811066 - RNA, 22 nt, Human
uguuuuuccaguaguuagcuuu

SEQ ID NO: 1811067 - RNA, 14 nt, Human
aaucauuuaucaua

SEQ ID NO: 1811068 - RNA, 12 nt, Human
uauauuuccuua

SEQ ID NO: 1811069 - RNA, 21 nt, Human
aggaguacaccccaacagcac

SEQ ID NO: 1811070 - RNA, 21 nt, Human
acuugcugcaguaugaaaaua

SEQ ID NO: 1811071 - RNA, 19 nt, Human
cucaggcaaucugcccgcc

SEQ ID NO: 1811072 - RNA, 13 nt, Human
uauauuuuagaua

SEQ ID NO: 1811073 - RNA, 15 nt, Human
ggcaagcagaagaga

SEQ ID NO: 1811074 - RNA, 14 nt, Human
gguucucuccacca

SEQ ID NO: 1811075 - RNA, 23 nt, Human
ucaccccuaaaagaaacccugca

SEQ ID NO: 1811076 - RNA, 15 nt, Human
gaaaggauaaaguug

SEQ ID NO: 1811077 - RNA, 15 nt, Human
caaaagacuuuuucc

SEQ ID NO: 1811078 - RNA, 12 nt, Human
ucagcaccccag

SEQ ID NO: 1811079 - RNA, 13 nt, Human
acuucagccuccc

SEQ ID NO: 1811080 - RNA, 16 nt, Human
ccaguagaugccaccc

SEQ ID NO: 1811081 - RNA, 16 nt, Human
gcacacccuccagaga

SEQ ID NO: 1811082 - RNA, 14 nt, Human
gaagaaagugaagu

SEQ ID NO: 1811083 - RNA, 18 nt, Human
ucuuggcacagcauggag

SEQ ID NO: 1811084 - RNA, 16 nt, Human
cuugcccgcucaggcu

SEQ ID NO: 1811085 - RNA, 16 nt, Human
auuuucccuucccuga

SEQ ID NO: 1811086 - RNA, 15 nt, Human
gccuaagugcagccc

SEQ ID NO: 1811087 - RNA, 12 nt, Human
agcaaagcucuu

SEQ ID NO: 1811088 - RNA, 14 nt, Human
agccugccuuucuc

SEQ ID NO: 1811089 - RNA, 13 nt, Human
cuuccuuccucuc

SEQ ID NO: 1811090 - RNA, 21 nt, Human
ugccacuagcccuccucuccc

SEQ ID NO: 1811091 - RNA, 23 nt, Human
cacccauuagcagucccuccaca

SEQ ID NO: 1811092 - RNA, 23 nt, Human
aucucuucuggguuccuuccucu

SEQ ID NO: 1811093 - RNA, 15 nt, Human
uugugcuucuuucuu

SEQ ID NO: 1811094 - RNA, 19 nt, Human
gaaugggggcagcaccucc

SEQ ID NO: 1811095 - RNA, 13 nt, Human
aguggugacugug

SEQ ID NO: 1811096 - RNA, 16 nt, Human
aauauguucugacaua

SEQ ID NO: 1811097 - RNA, 12 nt, Human
agguuucugagu

SEQ ID NO: 1811098 - RNA, 17 nt, Human
cagccuggcucucccag

SEQ ID NO: 1811099 - RNA, 22 nt, Human
acucucaaagcaaauaauuuuu

SEQ ID NO: 1811100 - RNA, 18 nt, Human
aaagaaaaucaggcuggc

SEQ ID NO: 1811101 - RNA, 15 nt, Human
uggaaagcagccugg

SEQ ID NO: 1811102 - RNA, 15 nt, Human
ugaauguaaauuugu

SEQ ID NO: 1811103 - RNA, 21 nt, Human
ccaccaggauauccucccucc

SEQ ID NO: 1811104 - RNA, 23 nt, Human
ccagagggaauugcagaguacug

SEQ ID NO: 1811105 - RNA, 14 nt, Human
guaacugauuugua

SEQ ID NO: 1811106 - RNA, 16 nt, Human
uuuucauuaaaauuuu

SEQ ID NO: 1811107 - RNA, 13 nt, Human
ccgcuaucauucc

SEQ ID NO: 1811108 - RNA, 11 nt, Human
uuccccauggc

SEQ ID NO: 1811109 - RNA, 16 nt, Human
cucagugggggcagag

SEQ ID NO: 1811110 - RNA, 21 nt, Human
aaauaauuuuuauauuugaaa

SEQ ID NO: 1811111 - RNA, 17 nt, Human
ugacuauuauauuucca

SEQ ID NO: 1811112 - RNA, 21 nt, Human
gauaaaagacagugaaagaaa

SEQ ID NO: 1811113 - RNA, 19 nt, Human
cuuugacaaagguaaauca

SEQ ID NO: 1811114 - RNA, 14 nt, Human
ccugcagucacagc

SEQ ID NO: 1811115 - RNA, 20 nt, Human
agaguacaccccaacagcac

SEQ ID NO: 1811116 - RNA, 23 nt, Human
gaaauauuuucuuuguuaaaaua

SEQ ID NO: 1811117 - RNA, 15 nt, Human
cauaauacuugcuuu

SEQ ID NO: 1811118 - RNA, 19 nt, Human
uucugauaaugaaaauuau

SEQ ID NO: 1811119 - RNA, 15 nt, Human
aucaaccuugcuuug

SEQ ID NO: 1811120 - RNA, 21 nt, Human
caaggaaaaaauaacaaugaa

SEQ ID NO: 1811121 - RNA, 16 nt, Human
ugcuaagucuuauaua

SEQ ID NO: 1811122 - RNA, 20 nt, Human
accugauuucugagcauuua

SEQ ID NO: 1811123 - RNA, 14 nt, Human
cagacauacauuuc

SEQ ID NO: 1811124 - RNA, 16 nt, Human
ccacaagaacccccuu

SEQ ID NO: 1811125 - RNA, 23 nt, Human
ucuuuucauacauuuucuaagaa

SEQ ID NO: 1811126 - RNA, 15 nt, Human
caaacuccugaccuc

SEQ ID NO: 1811127 - RNA, 13 nt, Human
guugcuccccauc

SEQ ID NO: 1811128 - RNA, 17 nt, Human
uggugaaaugcagaguc

SEQ ID NO: 1811129 - RNA, 22 nt, Human
ccccagccugcucccuagccag

SEQ ID NO: 1811130 - RNA, 14 nt, Human
cauuauaaauaaau

SEQ ID NO: 1811131 - RNA, 13 nt, Human
agaauauauuucc

SEQ ID NO: 1811132 - RNA, 22 nt, Human
aaagggacugagaaauuuauaa

SEQ ID NO: 1811133 - RNA, 19 nt, Human
uccuaagcuggagugcagu

SEQ ID NO: 1811134 - RNA, 22 nt, Human
aaaugugguacaagcauucugu

SEQ ID NO: 1811135 - RNA, 16 nt, Human
aggcuugccugcaggc

SEQ ID NO: 1811136 - RNA, 22 nt, Human
ucugguagcuaaauauauauuu

SEQ ID NO: 1811137 - RNA, 16 nt, Human
uauuccuccuucccuu

SEQ ID NO: 1811138 - RNA, 18 nt, Human
ugugcuggccaccugcug

SEQ ID NO: 1811139 - RNA, 19 nt, Human
aggcaggucugaagcucaa

SEQ ID NO: 1811140 - RNA, 16 nt, Human
auuuuuagugaaauau

SEQ ID NO: 1811141 - RNA, 19 nt, Human
gagccugaucaccugcccu

SEQ ID NO: 1811142 - RNA, 20 nt, Human
uaaagcuguguggcagucug

SEQ ID NO: 1811143 - RNA, 16 nt, Human
gcucagcuucuccaac

SEQ ID NO: 1811144 - RNA, 17 nt, Human
aaggcauuucuuuucug

SEQ ID NO: 1811145 - RNA, 15 nt, Human
agcuaaauauauauu

SEQ ID NO: 1811146 - RNA, 14 nt, Human
uauguagaaaaaag

SEQ ID NO: 1811147 - RNA, 22 nt, Human
augaggcuguugucuuuuccuu

SEQ ID NO: 1811148 - RNA, 22 nt, Human
cuagcaugaagacagagcccca

SEQ ID NO: 1811149 - RNA, 22 nt, Human
uuuccucauauccaguauuguu

SEQ ID NO: 1811150 - RNA, 13 nt, Human
aacguggcccaga

SEQ ID NO: 1811151 - RNA, 19 nt, Human
uacuugguucucuccacca

SEQ ID NO: 1811152 - RNA, 13 nt, Human
agaagaaggaaau

SEQ ID NO: 1811153 - RNA, 23 nt, Human
uauguuaaaacugggacagggga

SEQ ID NO: 1811154 - RNA, 13 nt, Human
agagagcuggagg

SEQ ID NO: 1811155 - RNA, 22 nt, Human
cuucacuugucauuguuauaua

SEQ ID NO: 1811156 - RNA, 15 nt, Human
uagauaggccauggg

SEQ ID NO: 1811157 - RNA, 14 nt, Human
uugugauugauuau

SEQ ID NO: 1811158 - RNA, 20 nt, Human
uucaguucucuugauuuuca

SEQ ID NO: 1811159 - RNA, 15 nt, Human
uauuuauuuuaauaa

SEQ ID NO: 1811160 - RNA, 12 nt, Human
caugggaggccu

SEQ ID NO: 1811161 - RNA, 15 nt, Human
gugaacuugguuuua

SEQ ID NO: 1811162 - RNA, 21 nt, Human
agacggauuuauuuuuccauu

SEQ ID NO: 1811163 - RNA, 14 nt, Human
ggccuucggccucc

SEQ ID NO: 1811164 - RNA, 18 nt, Human
aaauucgcaaacuuucuu

SEQ ID NO: 1811165 - RNA, 15 nt, Human
auuuuuguauuuuua

SEQ ID NO: 1811166 - RNA, 14 nt, Human
cugccuaagcccuc

SEQ ID NO: 1811167 - RNA, 23 nt, Human
ccaacaugcacugauguuguguu

SEQ ID NO: 1811168 - RNA, 20 nt, Human
gacaggcacuaucuggguuu

SEQ ID NO: 1811169 - RNA, 17 nt, Human
cagggcugaagcugugu

SEQ ID NO: 1811170 - RNA, 15 nt, Human
gaaauggggaacuac

SEQ ID NO: 1811171 - RNA, 15 nt, Human
ucuccauacucugua

SEQ ID NO: 1811172 - RNA, 13 nt, Human
ugguggccugggg

SEQ ID NO: 1811173 - RNA, 14 nt, Human
caagaaggaaagau

SEQ ID NO: 1811174 - RNA, 18 nt, Human
aaacuagagacucaaaga

SEQ ID NO: 1811175 - RNA, 22 nt, Human
agcuuguauuccuuuuucucuc

SEQ ID NO: 1811176 - RNA, 13 nt, Human
aggaaaaaauaac

SEQ ID NO: 1811177 - RNA, 19 nt, Human
cccagccugcucccuagcc

SEQ ID NO: 1811178 - RNA, 19 nt, Human
uuucuucucuccagugcac

SEQ ID NO: 1811179 - RNA, 18 nt, Human
guucucauaacucuguga

SEQ ID NO: 1811180 - RNA, 19 nt, Human
caccaggauauccucccuc

SEQ ID NO: 1811181 - RNA, 14 nt, Human
cccagcucagggcu

SEQ ID NO: 1811182 - RNA, 12 nt, Human
acuccccuccuu

SEQ ID NO: 1811183 - RNA, 13 nt, Human
ucaaaaucaacuu

SEQ ID NO: 1811184 - RNA, 17 nt, Human
gccugccccuacccugg

SEQ ID NO: 1811185 - RNA, 17 nt, Human
aggaaaauacuauucug

SEQ ID NO: 1811186 - RNA, 21 nt, Human
gacugcuaguuuauauagaaa

SEQ ID NO: 1811187 - RNA, 15 nt, Human
gaaagaaaauaacga

SEQ ID NO: 1811188 - RNA, 22 nt, Human
cucuccaaccagauugucagcu

SEQ ID NO: 1811189 - RNA, 12 nt, Human
cuacaaaaaaaa

SEQ ID NO: 1811190 - RNA, 19 nt, Human
ggcccaggauggcuuugaa

SEQ ID NO: 1811191 - RNA, 19 nt, Human
uauacacuuuuuaaaaucu

SEQ ID NO: 1811192 - RNA, 14 nt, Human
aaagcaauguggua

SEQ ID NO: 1811193 - RNA, 18 nt, Human
uauagcuacuaauuuuaa

SEQ ID NO: 1811194 - RNA, 20 nt, Human
aaacuuuaugcuaagugaaa

SEQ ID NO: 1811195 - RNA, 13 nt, Human
cucugcagcuucc

SEQ ID NO: 1811196 - RNA, 17 nt, Human
cacuacaaccuccgccu

SEQ ID NO: 1811197 - RNA, 23 nt, Human
accucaagugaucugcccgccuc

SEQ ID NO: 1811198 - RNA, 17 nt, Human
cccaaggaugucugcca

SEQ ID NO: 1811199 - RNA, 16 nt, Human
gaauaaucuccuguua

SEQ ID NO: 1811200 - RNA, 14 nt, Human
aggggaccagagag

SEQ ID NO: 1811201 - RNA, 16 nt, Human
aagcucaacucucuua

SEQ ID NO: 1811202 - RNA, 16 nt, Human
aaauucucacagaaga

SEQ ID NO: 1811203 - RNA, 19 nt, Human
agucaaugaacuuuccaca

SEQ ID NO: 1811204 - RNA, 22 nt, Human
cuagccagaggcucuaauguac

SEQ ID NO: 1811205 - RNA, 13 nt, Human
uuuaaaugaagaa

SEQ ID NO: 1811206 - RNA, 22 nt, Human
uuccagccaggccccaagccca

SEQ ID NO: 1811207 - RNA, 20 nt, Human
gaaacgaggauugggaaaaa

SEQ ID NO: 1811208 - RNA, 15 nt, Human
uagucucuacccagu

SEQ ID NO: 1811209 - RNA, 16 nt, Human
agccaacuauggccug

SEQ ID NO: 1811210 - RNA, 18 nt, Human
ucccaggaguacacccca

SEQ ID NO: 1811211 - RNA, 19 nt, Human
agacagugaaagaaaauaa

SEQ ID NO: 1811212 - RNA, 13 nt, Human
uuccucugagccu

SEQ ID NO: 1811213 - RNA, 14 nt, Human
ucuauucuagccug

SEQ ID NO: 1811214 - RNA, 17 nt, Human
cagccagugaccaaccu

SEQ ID NO: 1811215 - RNA, 19 nt, Human
ugaagcaaggagcuuagau

SEQ ID NO: 1811216 - RNA, 23 nt, Human
auauuagaaacagcuucucaauu

SEQ ID NO: 1811217 - RNA, 22 nt, Human
uaaaaauguucuauuuuaauua

SEQ ID NO: 1811218 - RNA, 14 nt, Human
agaguacuggcuga

SEQ ID NO: 1811219 - RNA, 20 nt, Human
aucaaaagacuuuuuccuug

SEQ ID NO: 1811220 - RNA, 15 nt, Human
cucagaaguuucuuc

SEQ ID NO: 1811221 - RNA, 16 nt, Human
cuucuuacaauaauuc

SEQ ID NO: 1811222 - RNA, 19 nt, Human
ugaggcacaugucagcaag

SEQ ID NO: 1811223 - RNA, 16 nt, Human
cuuucuuuuuuuucuu

SEQ ID NO: 1811224 - RNA, 20 nt, Human
acaugagguacugagaguga

SEQ ID NO: 1811225 - RNA, 14 nt, Human
uuagaaaaguuaug

SEQ ID NO: 1811226 - RNA, 20 nt, Human
caaauauaaauaaaaauaau

SEQ ID NO: 1811227 - RNA, 19 nt, Human
auucuggacuguuuuuaaa

SEQ ID NO: 1811228 - RNA, 20 nt, Human
caggcugagccucagucucc

SEQ ID NO: 1811229 - RNA, 18 nt, Human
gcccuggugggcagagag

SEQ ID NO: 1811230 - RNA, 23 nt, Human
caacacccugagguugugugugg

SEQ ID NO: 1811231 - RNA, 15 nt, Human
cauuuaguuauaaaa

SEQ ID NO: 1811232 - RNA, 20 nt, Human
caucuagaggcuuccuucau

SEQ ID NO: 1811233 - RNA, 16 nt, Human
uggaaggcaagauugu

SEQ ID NO: 1811234 - RNA, 16 nt, Human
acguuuucauuaaaau

SEQ ID NO: 1811235 - RNA, 17 nt, Human
cagugcuugaaugaagu

SEQ ID NO: 1811236 - RNA, 21 nt, Human
caccagucugacuguuuccau

SEQ ID NO: 1811237 - RNA, 22 nt, Human
auuuacgcucauuguagaaaag

SEQ ID NO: 1811238 - RNA, 13 nt, Human
uccucucccagug

SEQ ID NO: 1811239 - RNA, 22 nt, Human
cauggugcucagagcaguguuu

SEQ ID NO: 1811240 - RNA, 22 nt, Human
ucuguauuuccccaacauguaa

SEQ ID NO: 1811241 - RNA, 22 nt, Human
ccccaggacgcccucacugcag

SEQ ID NO: 1811242 - RNA, 19 nt, Human
ucaacuccuuucucaucuu

SEQ ID NO: 1811243 - RNA, 21 nt, Human
acuauuaacaacuugucuauu

SEQ ID NO: 1811244 - RNA, 18 nt, Human
ugcauagaauaaaauuuu

SEQ ID NO: 1811245 - RNA, 16 nt, Human
aaacaaaaaaaaaacc

SEQ ID NO: 1811246 - RNA, 14 nt, Human
uccuaagcuggagu

SEQ ID NO: 1811247 - RNA, 21 nt, Human
ucauuagaacuucaagcucuc

SEQ ID NO: 1811248 - RNA, 17 nt, Human
cagcaucugccuccccu

SEQ ID NO: 1811249 - RNA, 14 nt, Human
cauaaagucuugcc

SEQ ID NO: 1811250 - RNA, 15 nt, Human
gcaagaccccaucuc

SEQ ID NO: 1811251 - RNA, 18 nt, Human
gccagcuccgcgccagga

SEQ ID NO: 1811252 - RNA, 19 nt, Human
cuccauaucucccucuucc

SEQ ID NO: 1811253 - RNA, 18 nt, Human
cuugagggcaagagccac

SEQ ID NO: 1811254 - RNA, 21 nt, Human
gcuuuucccuuuuuuuaagua

SEQ ID NO: 1811255 - RNA, 21 nt, Human
cagacacaugugcuggccacc

SEQ ID NO: 1811256 - RNA, 19 nt, Human
cucuccaccagguucuuuc

SEQ ID NO: 1811257 - RNA, 14 nt, Human
cuucaccuuaggaa

SEQ ID NO: 1811258 - RNA, 15 nt, Human
caggcagccugccuu

SEQ ID NO: 1811259 - RNA, 14 nt, Human
cauuuuacuuuaau

SEQ ID NO: 1811260 - RNA, 16 nt, Human
ccacuuauaggaauug

SEQ ID NO: 1811261 - RNA, 15 nt, Human
auuuuaaaaguuuuu

SEQ ID NO: 1811262 - RNA, 22 nt, Human
uuuaaauuaguuagccaauauu

SEQ ID NO: 1811263 - RNA, 19 nt, Human
uucauugcucagaaauguc

SEQ ID NO: 1811264 - RNA, 15 nt, Human
agaguacaccccaac

SEQ ID NO: 1811265 - RNA, 19 nt, Human
aaaagcuuugaacccuggg

SEQ ID NO: 1811266 - RNA, 21 nt, Human
gccuucucuguucauuuccuc

SEQ ID NO: 1811267 - RNA, 13 nt, Human
guuguguuuuuaa

SEQ ID NO: 1811268 - RNA, 15 nt, Human
ggagaaccccaggac

SEQ ID NO: 1811269 - RNA, 14 nt, Human
cugccccccagccc

SEQ ID NO: 1811270 - RNA, 16 nt, Human
aucauauauauacaua

SEQ ID NO: 1811271 - RNA, 23 nt, Human
cuuguccccaacaccccacagaa

SEQ ID NO: 1811272 - RNA, 15 nt, Human
ugggacagggaggac

SEQ ID NO: 1811273 - RNA, 12 nt, Human
auccuuccuuuu

SEQ ID NO: 1811274 - RNA, 15 nt, Human
acuuuuuuuuuuuau

SEQ ID NO: 1811275 - RNA, 14 nt, Human
ucuuuuuuuuaaua

SEQ ID NO: 1811276 - RNA, 17 nt, Human
ccugcagacucacugug

SEQ ID NO: 1811277 - RNA, 17 nt, Human
uauaaucaagccuaaaa

SEQ ID NO: 1811278 - RNA, 17 nt, Human
cuuuaaugaauaaacau

SEQ ID NO: 1811279 - RNA, 13 nt, Human
gcuggagcucugc

SEQ ID NO: 1811280 - RNA, 19 nt, Human
ggcagaguucuauaaugua

SEQ ID NO: 1811281 - RNA, 16 nt, Human
ucuccaaagcccuccc

SEQ ID NO: 1811282 - RNA, 17 nt, Human
gugaagguggaaauaaa

SEQ ID NO: 1811283 - RNA, 21 nt, Human
cacaugaacuuguaaaggaau

SEQ ID NO: 1811284 - RNA, 18 nt, Human
gaagcaccaaucaugaau

SEQ ID NO: 1811285 - RNA, 15 nt, Human
aucauugugaaauua

SEQ ID NO: 1811286 - RNA, 17 nt, Human
gguaccuaguccccagc

SEQ ID NO: 1811287 - RNA, 18 nt, Human
ucucuaggaaauauuuau

SEQ ID NO: 1811288 - RNA, 21 nt, Human
aacucucuuauugccucacuu

SEQ ID NO: 1811289 - RNA, 16 nt, Human
augcacuuccuugcuu

SEQ ID NO: 1811290 - RNA, 16 nt, Human
cuuuuaguuuuuaaag

SEQ ID NO: 1811291 - RNA, 15 nt, Human
uaacgauaaaagaca

SEQ ID NO: 1811292 - RNA, 14 nt, Human
auuuaaauauaugc

SEQ ID NO: 1811293 - RNA, 15 nt, Human
uccuaagugauugua

SEQ ID NO: 1811294 - RNA, 17 nt, Human
gcuucucauccugcagg

SEQ ID NO: 1811295 - RNA, 22 nt, Human
ucucugcaaacugccuucuucg

SEQ ID NO: 1811296 - RNA, 18 nt, Human
uaacguuuucauuaaaau

SEQ ID NO: 1811297 - RNA, 16 nt, Human
acaggccucacacaca

SEQ ID NO: 1811298 - RNA, 18 nt, Human
uacccaugucuacacaga

SEQ ID NO: 1811299 - RNA, 20 nt, Human
agaugacagggaaaacugca

SEQ ID NO: 1811300 - RNA, 15 nt, Human
ugcccuguugcugcc

SEQ ID NO: 1811301 - RNA, 19 nt, Human
uaaugaaguguuuagcaua

SEQ ID NO: 1811302 - RNA, 16 nt, Human
cuauucuugauguaaa

SEQ ID NO: 1811303 - RNA, 17 nt, Human
aaagcuccauuuuuagu

SEQ ID NO: 1811304 - RNA, 17 nt, Human
caagacccaaaaggcag

SEQ ID NO: 1811305 - RNA, 13 nt, Human
guagucagacugg

SEQ ID NO: 1811306 - RNA, 14 nt, Human
uugguuucuagcau

SEQ ID NO: 1811307 - RNA, 20 nt, Human
cgaggagguaaugaauuaaa

SEQ ID NO: 1811308 - RNA, 21 nt, Human
agaagcuagaaaacaggcaaa

SEQ ID NO: 1811309 - RNA, 14 nt, Human
agccaggacccagg

SEQ ID NO: 1811310 - RNA, 14 nt, Human
cccagagaagccaa

SEQ ID NO: 1811311 - RNA, 16 nt, Human
gaccaguaugcuugga

SEQ ID NO: 1811312 - RNA, 12 nt, Human
aauaaaccuuuu

SEQ ID NO: 1811313 - RNA, 14 nt, Human
ccaaugaaaugagu

SEQ ID NO: 1811314 - RNA, 19 nt, Human
caggauguuugcucagcuu

SEQ ID NO: 1811315 - RNA, 19 nt, Human
auauacuuuaauaaaugua

SEQ ID NO: 1811316 - RNA, 12 nt, Human
uaguacacacuu

SEQ ID NO: 1811317 - RNA, 14 nt, Human
cuuccaauuuuugg

SEQ ID NO: 1811318 - RNA, 20 nt, Human
cagagaagggcuuggacuca

SEQ ID NO: 1811319 - RNA, 20 nt, Human
ugcuucuuggacuucuugaa

SEQ ID NO: 1811320 - RNA, 16 nt, Human
aaaaauuccaagugau

SEQ ID NO: 1811321 - RNA, 22 nt, Human
accccaaguuauccaccugccu

SEQ ID NO: 1811322 - RNA, 16 nt, Human
aaauauaaauaaaaau

SEQ ID NO: 1811323 - RNA, 23 nt, Human
uucugagccugccuuucuccccc

SEQ ID NO: 1811324 - RNA, 15 nt, Human
acaaacccaagggca

SEQ ID NO: 1811325 - RNA, 20 nt, Human
aaucaagacugcaaacccuu

SEQ ID NO: 1811326 - RNA, 17 nt, Human
agcuacuaauuuuaaaa

SEQ ID NO: 1811327 - RNA, 18 nt, Human
cauuucucauaccuuccc

SEQ ID NO: 1811328 - RNA, 21 nt, Human
acagcccuucuuuccacagaa

SEQ ID NO: 1811329 - RNA, 15 nt, Human
agaggcucuaaugua

SEQ ID NO: 1811330 - RNA, 15 nt, Human
uaaucuccuguuaau

SEQ ID NO: 1811331 - RNA, 15 nt, Human
aaauaaaaaacacug

SEQ ID NO: 1811332 - RNA, 14 nt, Human
agcucuaucaccaa

SEQ ID NO: 1811333 - RNA, 16 nt, Human
ccguucacauuuuugu

SEQ ID NO: 1811334 - RNA, 13 nt, Human
ucauagcuaaaaa

SEQ ID NO: 1811335 - RNA, 19 nt, Human
cugcaaagcccagcuugaa

SEQ ID NO: 1811336 - RNA, 18 nt, Human
cauuuguagcauccucuu

SEQ ID NO: 1811337 - RNA, 17 nt, Human
uuauaaucuuucacagg

SEQ ID NO: 1811338 - RNA, 18 nt, Human
uccagccucagccuccca

SEQ ID NO: 1811339 - RNA, 13 nt, Human
gcuggaaauggac

SEQ ID NO: 1811340 - RNA, 19 nt, Human
ggagcccugggaggcucug

SEQ ID NO: 1811341 - RNA, 17 nt, Human
cucugcaaugaccuuca

SEQ ID NO: 1811342 - RNA, 16 nt, Human
ucucugcaggucccua

SEQ ID NO: 1811343 - RNA, 22 nt, Human
guuucaccauguuggccaggcu

SEQ ID NO: 1811344 - RNA, 23 nt, Human
caugaauauuuaguguucauaaa

SEQ ID NO: 1811345 - RNA, 23 nt, Human
uugccucacuucagguauaccuc

SEQ ID NO: 1811346 - RNA, 21 nt, Human
acacccagucuguuccccaug

SEQ ID NO: 1811347 - RNA, 23 nt, Human
aaacaggaugguggcaggaaaau

SEQ ID NO: 1811348 - RNA, 22 nt, Human
ugguuguauuauuuuuuaaaaa

SEQ ID NO: 1811349 - RNA, 18 nt, Human
uaagaucuuuuauuuugc

SEQ ID NO: 1811350 - RNA, 20 nt, Human
uuuaaaaagcgcuaauuucu

SEQ ID NO: 1811351 - RNA, 19 nt, Human
caggcagauguuccuaaua

SEQ ID NO: 1811352 - RNA, 15 nt, Human
uauuucacuuuagaa

SEQ ID NO: 1811353 - RNA, 22 nt, Human
cacuacaaccuccgccucccau

SEQ ID NO: 1811354 - RNA, 22 nt, Human
caauaccugaagcuaucguaaa

SEQ ID NO: 1811355 - RNA, 23 nt, Human
agucauaaccuuaccagauuuuu

SEQ ID NO: 1811356 - RNA, 24 nt, Human
uuguaaagacaauuguuggagagc

SEQ ID NO: 1811357 - RNA, 23 nt, Human
ugaauuacauuuguauaaaauaa

SEQ ID NO: 1811358 - RNA, 20 nt, Human
ugguuuuagugauuuuaaua

SEQ ID NO: 1811359 - RNA, 16 nt, Human
agccucugcaggaugu

SEQ ID NO: 1811360 - RNA, 15 nt, Human
aaauguauucuuuua

SEQ ID NO: 1811361 - RNA, 23 nt, Human
aauaaacauucuaucuauuccug

SEQ ID NO: 1811362 - RNA, 18 nt, Human
uaacguauaaaagccugu

SEQ ID NO: 1811363 - RNA, 19 nt, Human
aaaaacuauuaacaacuug

SEQ ID NO: 1811364 - RNA, 23 nt, Human
caggcaugagucagucugaugag

SEQ ID NO: 1811365 - RNA, 16 nt, Human
cagcagucagggacag

SEQ ID NO: 1811366 - RNA, 18 nt, Human
uuuauuuaacuauucaua

SEQ ID NO: 1811367 - RNA, 14 nt, Human
ucacuguguuggcc

SEQ ID NO: 1811368 - RNA, 21 nt, Human
uuuugaaaccaugaagagauu

SEQ ID NO: 1811369 - RNA, 14 nt, Human
cauuauaucaaauc

SEQ ID NO: 1811370 - RNA, 11 nt, Human
agcuccuccuu

SEQ ID NO: 1811371 - RNA, 16 nt, Human
ucaguagucagacugg

SEQ ID NO: 1811372 - RNA, 17 nt, Human
cugccaggcacacugag

SEQ ID NO: 1811373 - RNA, 22 nt, Human
ggcauuuaggccaugggacagg

SEQ ID NO: 1811374 - RNA, 19 nt, Human
cagagucaagggugugugc

SEQ ID NO: 1811375 - RNA, 23 nt, Human
ugauguuucauaagaauucuguu

SEQ ID NO: 1811376 - RNA, 13 nt, Human
ccagagccacagu

SEQ ID NO: 1811377 - RNA, 13 nt, Human
cccaggacgcccu

SEQ ID NO: 1811378 - RNA, 14 nt, Human
cuauuauauuucca

SEQ ID NO: 1811379 - RNA, 18 nt, Human
aaccuuaccagauuuuua

SEQ ID NO: 1811380 - RNA, 16 nt, Human
agacggguuucaccau

SEQ ID NO: 1811381 - RNA, 13 nt, Human
cuuuccaugaguu

SEQ ID NO: 1811382 - RNA, 12 nt, Human
uacuugcucuug

SEQ ID NO: 1811383 - RNA, 15 nt, Human
uauuauaauucaaag

SEQ ID NO: 1811384 - RNA, 20 nt, Human
cugacucucuuaaggaggcu

SEQ ID NO: 1811385 - RNA, 14 nt, Human
aaguuauguagaaa

SEQ ID NO: 1811386 - RNA, 13 nt, Human
uucuuuuuuuucu

SEQ ID NO: 1811387 - RNA, 23 nt, Human
ucacagggccuggggagauggag

SEQ ID NO: 1811388 - RNA, 22 nt, Human
gacagcuugaucaaaggcacac

SEQ ID NO: 1811389 - RNA, 19 nt, Human
ccaaagugcugggauuaac

SEQ ID NO: 1811390 - RNA, 17 nt, Human
uaccguguaccucaguu

SEQ ID NO: 1811391 - RNA, 22 nt, Human
cucucuuauugccucacuucag

SEQ ID NO: 1811392 - RNA, 12 nt, Human
guuucuuucuuu

SEQ ID NO: 1811393 - RNA, 17 nt, Human
accacuguguauuuaac

SEQ ID NO: 1811394 - RNA, 13 nt, Human
aauuauuucacuu

SEQ ID NO: 1811395 - RNA, 14 nt, Human
cuccuuucucaucu

SEQ ID NO: 1811396 - RNA, 17 nt, Human
auacauuucucauaccu

SEQ ID NO: 1811397 - RNA, 21 nt, Human
ccuggcggggugggguggggg

SEQ ID NO: 1811398 - RNA, 14 nt, Human
ccuuggcugacaug

SEQ ID NO: 1811399 - RNA, 22 nt, Human
cucaagcccugcagucacagcu

SEQ ID NO: 1811400 - RNA, 20 nt, Human
uccagccugagcgacaguga

SEQ ID NO: 1811401 - RNA, 20 nt, Human
ucaaaacuucagacauagaa

SEQ ID NO: 1811402 - RNA, 15 nt, Human
cccucaaacccauuc

SEQ ID NO: 1811403 - RNA, 14 nt, Human
ccagcagccagcca

SEQ ID NO: 1811404 - RNA, 12 nt, Human
caaccugccagc

SEQ ID NO: 1811405 - RNA, 23 nt, Human
cagccaggagcugggcagaaggc

SEQ ID NO: 1811406 - RNA, 19 nt, Human
uuuaagaauccaaacguua

SEQ ID NO: 1811407 - RNA, 18 nt, Human
ugccucucugcagguccc

SEQ ID NO: 1811408 - RNA, 12 nt, Human
uaauaauauauu

SEQ ID NO: 1811409 - RNA, 22 nt, Human
ccucagccucccaaagugcugg

SEQ ID NO: 1811410 - RNA, 21 nt, Human
gggagccugaucaccugcccu

SEQ ID NO: 1811411 - RNA, 17 nt, Human
cccuuucauuuuuucca

SEQ ID NO: 1811412 - RNA, 17 nt, Human
acacuaagagagaauga

SEQ ID NO: 1811413 - RNA, 13 nt, Human
acacacaugaagu

SEQ ID NO: 1811414 - RNA, 11 nt, Human
acuuugaagag

SEQ ID NO: 1811415 - RNA, 16 nt, Human
ugcauuguaggauguu

SEQ ID NO: 1811416 - RNA, 22 nt, Human
auucugucucuggauuauauua

SEQ ID NO: 1811417 - RNA, 19 nt, Human
gcacuaguauuucuaugaa

SEQ ID NO: 1811418 - RNA, 13 nt, Human
aagugcagccccg

SEQ ID NO: 1811419 - RNA, 18 nt, Human
cugggcagaaggccaaga

SEQ ID NO: 1811420 - RNA, 19 nt, Human
cccccucuggcuccagcug

SEQ ID NO: 1811421 - RNA, 20 nt, Human
cagcuucucaauuucuacaa

SEQ ID NO: 1811422 - RNA, 22 nt, Human
gauccacccgccucagccuccc

SEQ ID NO: 1811423 - RNA, 17 nt, Human
cuccugggaaugaagca

SEQ ID NO: 1811424 - RNA, 13 nt, Human
acccauucccucu

SEQ ID NO: 1811425 - RNA, 22 nt, Human
gugccucaccccuugccauaau

SEQ ID NO: 1811426 - RNA, 21 nt, Human
ugcucaauaaaguacaagagc

SEQ ID NO: 1811427 - RNA, 18 nt, Human
cuagaaaauuuaaaacau

SEQ ID NO: 1811428 - RNA, 17 nt, Human
aagugcuaauuuugaaa

SEQ ID NO: 1811429 - RNA, 19 nt, Human
aauauggggaaaaaacugu

SEQ ID NO: 1811430 - RNA, 15 nt, Human
cugagugcaccacuu

SEQ ID NO: 1811431 - RNA, 23 nt, Human
cauguacauagcuugauaaaggg

SEQ ID NO: 1811432 - RNA, 14 nt, Human
caaaaaaaaaaaca

SEQ ID NO: 1811433 - RNA, 14 nt, Human
agcuuaaacagcug

SEQ ID NO: 1811434 - RNA, 19 nt, Human
uuuaaguuauuuuuacauu

SEQ ID NO: 1811435 - RNA, 17 nt, Human
cuccaucucuugaccuc

SEQ ID NO: 1811436 - RNA, 21 nt, Human
auuuacccuucuuuucugacu

SEQ ID NO: 1811437 - RNA, 20 nt, Human
guuuggaggcucucuugugc

SEQ ID NO: 1811438 - RNA, 21 nt, Human
gcuuguccaacccgaggcccg

SEQ ID NO: 1811439 - RNA, 15 nt, Human
uguuaucuucacuuu

SEQ ID NO: 1811440 - RNA, 21 nt, Human
ugccuaggcauagcccugccu

SEQ ID NO: 1811441 - RNA, 19 nt, Human
uggaaucauauugugugua

SEQ ID NO: 1811442 - RNA, 19 nt, Human
cucugcauacucauuagga

SEQ ID NO: 1811443 - RNA, 14 nt, Human
uauaauguaaacaa

SEQ ID NO: 1811444 - RNA, 14 nt, Human
uuccucagacucua

SEQ ID NO: 1811445 - RNA, 15 nt, Human
cugcaggcuccccuc

SEQ ID NO: 1811446 - RNA, 16 nt, Human
gagugcccccaacagc

SEQ ID NO: 1811447 - RNA, 15 nt, Human
uuuuauuuugccaag

SEQ ID NO: 1811448 - RNA, 18 nt, Human
ucaaaagacuuuuuccuu

SEQ ID NO: 1811449 - RNA, 21 nt, Human
aacauagaacucaugacggaa

SEQ ID NO: 1811450 - RNA, 18 nt, Human
ccacucauaauucuucac

SEQ ID NO: 1811451 - RNA, 19 nt, Human
auuaugaguuucuuuuugc

SEQ ID NO: 1811452 - RNA, 15 nt, Human
auaucuuaucuuccu

SEQ ID NO: 1811453 - RNA, 13 nt, Human
acucuugaaaaau

SEQ ID NO: 1811454 - RNA, 15 nt, Human
cuggggcuucagucu

SEQ ID NO: 1811455 - RNA, 20 nt, Human
auggucagaggcgcaugaau

SEQ ID NO: 1811456 - RNA, 15 nt, Human
acucaacaaacauaa

SEQ ID NO: 1811457 - RNA, 22 nt, Human
cugcuggagacauugaggcagg

SEQ ID NO: 1811458 - RNA, 17 nt, Human
ugguucccuugaugaag

SEQ ID NO: 1811459 - RNA, 12 nt, Human
ucacaauaauuu

SEQ ID NO: 1811460 - RNA, 19 nt, Human
uccuucuuuuuuucuugaa

SEQ ID NO: 1811461 - RNA, 18 nt, Human
gaaauggugaaaugcaga

SEQ ID NO: 1811462 - RNA, 21 nt, Human
ccuggugccucaccccuugcc

SEQ ID NO: 1811463 - RNA, 14 nt, Human
agcuggagggaccu

SEQ ID NO: 1811464 - RNA, 17 nt, Human
cuggcaaggguucaccu

SEQ ID NO: 1811465 - RNA, 17 nt, Human
aggccccaagcccacug

SEQ ID NO: 1811466 - RNA, 20 nt, Human
aguuauugcaagaguuuaau

SEQ ID NO: 1811467 - RNA, 16 nt, Human
gaaacugacacaugcu

SEQ ID NO: 1811468 - RNA, 12 nt, Human
auccagaaagaa

SEQ ID NO: 1811469 - RNA, 15 nt, Human
uugacccacaagaaa

SEQ ID NO: 1811470 - RNA, 21 nt, Human
cccaggaucguuuuuucccag

SEQ ID NO: 1811471 - RNA, 17 nt, Human
caaauauaaauaaaaau

SEQ ID NO: 1811472 - RNA, 14 nt, Human
caucgcagauucuc

SEQ ID NO: 1811473 - RNA, 17 nt, Human
uuauaucaauuuaaaaa

SEQ ID NO: 1811474 - RNA, 12 nt, Human
cuuccucacacc

SEQ ID NO: 1811475 - RNA, 19 nt, Human
auuugugaagguggaaaua

SEQ ID NO: 1811476 - RNA, 16 nt, Human
uuuuuauuaugcauua

SEQ ID NO: 1811477 - RNA, 22 nt, Human
gauccucaggcagguaacccca

SEQ ID NO: 1811478 - RNA, 16 nt, Human
auuuuaauaauguuuc

SEQ ID NO: 1811479 - RNA, 18 nt, Human
cuuucauaaagucuugcc

SEQ ID NO: 1811480 - RNA, 16 nt, Human
ccugcugcccuccccc

SEQ ID NO: 1811481 - RNA, 23 nt, Human
uacacuuugaacuacuagaaaau

SEQ ID NO: 1811482 - RNA, 14 nt, Human
gacacauguauuug

SEQ ID NO: 1811483 - RNA, 21 nt, Human
agaauucuguugauggaaaua

SEQ ID NO: 1811484 - RNA, 17 nt, Human
cgaggagguaaugaauu

SEQ ID NO: 1811485 - RNA, 17 nt, Human
ccaacacaauucuucuu

SEQ ID NO: 1811486 - RNA, 18 nt, Human
caugaagacagagcccca

SEQ ID NO: 1811487 - RNA, 22 nt, Human
ccuucugagccugccuuucucc

SEQ ID NO: 1811488 - RNA, 22 nt, Human
agcuaaaucccuccccgugacu

SEQ ID NO: 1811489 - RNA, 19 nt, Human
cuguuauuuaauuagccag

SEQ ID NO: 1811490 - RNA, 17 nt, Human
acuauugcuugcacaaa

SEQ ID NO: 1811491 - RNA, 19 nt, Human
uauauuuuugugauuuugu

SEQ ID NO: 1811492 - RNA, 19 nt, Human
acaagcugcauuucagaaa

SEQ ID NO: 1811493 - RNA, 21 nt, Human
ucacaggagcuuaaacagcug

SEQ ID NO: 1811494 - RNA, 15 nt, Human
guguugcagugucug

SEQ ID NO: 1811495 - RNA, 22 nt, Human
acauauugucacugacacacac

SEQ ID NO: 1811496 - RNA, 13 nt, Human
caugaauguaaau

SEQ ID NO: 1811497 - RNA, 20 nt, Human
aagucuuucacauuuaaaua

SEQ ID NO: 1811498 - RNA, 21 nt, Human
aauuguguuuauaauuuuaaa

SEQ ID NO: 1811499 - RNA, 18 nt, Human
augauguuucauaagaau

SEQ ID NO: 1811500 - RNA, 15 nt, Human
gaacuucaagcucuc

SEQ ID NO: 1811501 - RNA, 21 nt, Human
aauuuuuauauuugaaauauu

SEQ ID NO: 1811502 - RNA, 15 nt, Human
ccacaucugagagau

SEQ ID NO: 1811503 - RNA, 14 nt, Human
cacuugguucagua

SEQ ID NO: 1811504 - RNA, 18 nt, Human
aggcauccccaggcccug

SEQ ID NO: 1811505 - RNA, 17 nt, Human
agcucaucuauuucuuu

SEQ ID NO: 1811506 - RNA, 23 nt, Human
ugagucagucugaugagaacucu

SEQ ID NO: 1811507 - RNA, 20 nt, Human
caccugccuuggcuucccaa

SEQ ID NO: 1811508 - RNA, 21 nt, Human
auuuuccugaaaacccuugcc

SEQ ID NO: 1811509 - RNA, 16 nt, Human
cuaucugggcuguggg

SEQ ID NO: 1811510 - RNA, 23 nt, Human
uguccaaacugccuaagcccucc

SEQ ID NO: 1811511 - RNA, 19 nt, Human
cagugggagccagggcugu

SEQ ID NO: 1811512 - RNA, 13 nt, Human
accugggauuaca

SEQ ID NO: 1811513 - RNA, 15 nt, Human
uaguucaaguccugc

SEQ ID NO: 1811514 - RNA, 16 nt, Human
uuaaauuguaauaggc

SEQ ID NO: 1811515 - RNA, 21 nt, Human
ucauucacucaacaaacauaa

SEQ ID NO: 1811516 - RNA, 17 nt, Human
agauucauucaugucau

SEQ ID NO: 1811517 - RNA, 18 nt, Human
gacccacuggacucaccu

SEQ ID NO: 1811518 - RNA, 16 nt, Human
cuauguggaagugggg

SEQ ID NO: 1811519 - RNA, 16 nt, Human
ccuccuuuuaaaguaa

SEQ ID NO: 1811520 - RNA, 22 nt, Human
uccccuggaacugucucucaug

SEQ ID NO: 1811521 - RNA, 17 nt, Human
uuaauauugauuuauua

SEQ ID NO: 1811522 - RNA, 13 nt, Human
cugccucucugca

SEQ ID NO: 1811523 - RNA, 13 nt, Human
agagguccacaac

SEQ ID NO: 1811524 - RNA, 18 nt, Human
aguuuuugcuaauuuuua

SEQ ID NO: 1811525 - RNA, 13 nt, Human
auucucuugccuc

SEQ ID NO: 1811526 - RNA, 16 nt, Human
caggcugagccucagu

SEQ ID NO: 1811527 - RNA, 16 nt, Human
caggagcccugggagg

SEQ ID NO: 1811528 - RNA, 19 nt, Human
aaagauacccaaaggucaa

SEQ ID NO: 1811529 - RNA, 16 nt, Human
uaauucaaaggcauuu

SEQ ID NO: 1811530 - RNA, 15 nt, Human
ccagccugcugccug

SEQ ID NO: 1811531 - RNA, 20 nt, Human
ucucacagugggagccaggg

SEQ ID NO: 1811532 - RNA, 17 nt, Human
acuauuuaauuauuuca

SEQ ID NO: 1811533 - RNA, 19 nt, Human
uauuuauucauauuuucuu

SEQ ID NO: 1811534 - RNA, 16 nt, Human
cugacugccaagccau

SEQ ID NO: 1811535 - RNA, 22 nt, Human
uuugaugcuacaggauuugaaa

SEQ ID NO: 1811536 - RNA, 20 nt, Human
aaauaauuuuuauauuugaa

SEQ ID NO: 1811537 - RNA, 20 nt, Human
uuacaaauccaaugaaauga

SEQ ID NO: 1811538 - RNA, 16 nt, Human
cacagcuucagccagg

SEQ ID NO: 1811539 - RNA, 13 nt, Human
ugcuguauaaaau

SEQ ID NO: 1811540 - RNA, 22 nt, Human
aguggcgcgaucucagcucacu

SEQ ID NO: 1811541 - RNA, 18 nt, Human
ccuccuuuuuccuuccag

SEQ ID NO: 1811542 - RNA, 13 nt, Human
acuguaaaauaau

SEQ ID NO: 1811543 - RNA, 16 nt, Human
caucuccucagcaccc

SEQ ID NO: 1811544 - RNA, 19 nt, Human
uggcaaacugccaucauuu

SEQ ID NO: 1811545 - RNA, 15 nt, Human
acuuuuucuuuaugu

SEQ ID NO: 1811546 - RNA, 15 nt, Human
uggaguaaaucgcua

SEQ ID NO: 1811547 - RNA, 17 nt, Human
acuggugcuauuuugua

SEQ ID NO: 1811548 - RNA, 16 nt, Human
guccccagccugcucc

SEQ ID NO: 1811549 - RNA, 18 nt, Human
agccuuggggauucuucc

SEQ ID NO: 1811550 - RNA, 13 nt, Human
ugcucagcccugc

SEQ ID NO: 1811551 - RNA, 14 nt, Human
cuuauugacucaua

SEQ ID NO: 1811552 - RNA, 13 nt, Human
uucuucuccuaaa

SEQ ID NO: 1811553 - RNA, 16 nt, Human
uuacauuuuaaacaca

SEQ ID NO: 1811554 - RNA, 20 nt, Human
auguaaacaauaucagacuu

SEQ ID NO: 1811555 - RNA, 16 nt, Human
uggcaauugacuauag

SEQ ID NO: 1811556 - RNA, 18 nt, Human
auaugcauuauaaauaaa

SEQ ID NO: 1811557 - RNA, 23 nt, Human
acaaaacccuuucugccccugcu

SEQ ID NO: 1811558 - RNA, 19 nt, Human
cucccaccaccucaccagu

SEQ ID NO: 1811559 - RNA, 21 nt, Human
cauguaaaauaugucuuucuu

SEQ ID NO: 1811560 - RNA, 19 nt, Human
ccucuguauacaaaacccu

SEQ ID NO: 1811561 - RNA, 22 nt, Human
cuguacagacagaaaaaacuga

SEQ ID NO: 1811562 - RNA, 17 nt, Human
uuuccaauuagcuccuc

SEQ ID NO: 1811563 - RNA, 22 nt, Human
ccuccauaucucccucuucccu

SEQ ID NO: 1811564 - RNA, 20 nt, Human
ccuuuuuggacacacaaauu

SEQ ID NO: 1811565 - RNA, 14 nt, Human
gucuucaucaaacg

SEQ ID NO: 1811566 - RNA, 15 nt, Human
guucaaguccugccu

SEQ ID NO: 1811567 - RNA, 16 nt, Human
uccaguauuguuccuu

SEQ ID NO: 1811568 - RNA, 14 nt, Human
cuccuugucuuuuu

SEQ ID NO: 1811569 - RNA, 19 nt, Human
uguuucaacaguuuuugcu

SEQ ID NO: 1811570 - RNA, 19 nt, Human
ugaucaccugcccugcuga

SEQ ID NO: 1811571 - RNA, 20 nt, Human
uaaaugugguacaagcauuc

SEQ ID NO: 1811572 - RNA, 11 nt, Human
ggggccaggcu

SEQ ID NO: 1811573 - RNA, 21 nt, Human
cuaugaaguuuuuuuuauaca

SEQ ID NO: 1811574 - RNA, 22 nt, Human
auauccacuaaaaucaaacaau

SEQ ID NO: 1811575 - RNA, 15 nt, Human
gcuucagucuuuucc

SEQ ID NO: 1811576 - RNA, 15 nt, Human
uuuuuaccagucuca

SEQ ID NO: 1811577 - RNA, 22 nt, Human
augugccagauuuaugcauauu

SEQ ID NO: 1811578 - RNA, 17 nt, Human
ucagcuccagcugcucu

SEQ ID NO: 1811579 - RNA, 16 nt, Human
auauguucugacauaa

SEQ ID NO: 1811580 - RNA, 16 nt, Human
ucuucucagaaggaaa

SEQ ID NO: 1811581 - RNA, 12 nt, Human
uaaucugccucc

SEQ ID NO: 1811582 - RNA, 12 nt, Human
aucauuuccauu

SEQ ID NO: 1811583 - RNA, 19 nt, Human
gaauaaaauuuuuaaucuu

SEQ ID NO: 1811584 - RNA, 16 nt, Human
cagucucccucccuug

SEQ ID NO: 1811585 - RNA, 23 nt, Human
aggugaucuggcucuggacaggc

SEQ ID NO: 1811586 - RNA, 14 nt, Human
accugacucuugca

SEQ ID NO: 1811587 - RNA, 15 nt, Human
acugaggaucagagu

SEQ ID NO: 1811588 - RNA, 16 nt, Human
cuugccugcaggcaug

SEQ ID NO: 1811589 - RNA, 15 nt, Human
cugggcugugggcaa

SEQ ID NO: 1811590 - RNA, 16 nt, Human
gcucagcccugcacca

SEQ ID NO: 1811591 - RNA, 18 nt, Human
uaucaaaagaaagaaaau

SEQ ID NO: 1811592 - RNA, 11 nt, Human
ccucuccagau

SEQ ID NO: 1811593 - RNA, 19 nt, Human
ugauaccugggauacugug

SEQ ID NO: 1811594 - RNA, 15 nt, Human
aauguguaagaacaa

SEQ ID NO: 1811595 - RNA, 17 nt, Human
uaaaauuuuuuuagaaa

SEQ ID NO: 1811596 - RNA, 19 nt, Human
auuagauguucucuaucau

SEQ ID NO: 1811597 - RNA, 13 nt, Human
ucuauaauuuaaa

SEQ ID NO: 1811598 - RNA, 16 nt, Human
ccccaagcccacuggg

SEQ ID NO: 1811599 - RNA, 17 nt, Human
auccauucuucccuuga

SEQ ID NO: 1811600 - RNA, 16 nt, Human
ccccuaagcccccacu

SEQ ID NO: 1811601 - RNA, 22 nt, Human
uuccuguggauguaaagugaua

SEQ ID NO: 1811602 - RNA, 13 nt, Human
uuuaacaccuuuu

SEQ ID NO: 1811603 - RNA, 21 nt, Human
uaauaauauauuuuaaauauu

SEQ ID NO: 1811604 - RNA, 18 nt, Human
ucugcuuucucgggaauu

SEQ ID NO: 1811605 - RNA, 21 nt, Human
ugugcaucaggcuuucuuuuu

SEQ ID NO: 1811606 - RNA, 22 nt, Human
uuuuauagcuacuaauuuuaaa

SEQ ID NO: 1811607 - RNA, 19 nt, Human
aaauggugaaaugcagagu

SEQ ID NO: 1811608 - RNA, 13 nt, Human
uuaaaaaagaaac

SEQ ID NO: 1811609 - RNA, 19 nt, Human
cuagaguuuagcuggaaaa

SEQ ID NO: 1811610 - RNA, 14 nt, Human
augcuccuccaggg

SEQ ID NO: 1811611 - RNA, 13 nt, Human
uaaauauauauuu

SEQ ID NO: 1811612 - RNA, 15 nt, Human
cugccacaccucucc

SEQ ID NO: 1811613 - RNA, 21 nt, Human
uauuuccccaugguuuuaauc

SEQ ID NO: 1811614 - RNA, 15 nt, Human
aguauccucuugcca

SEQ ID NO: 1811615 - RNA, 15 nt, Human
ugccugcaggcauga

SEQ ID NO: 1811616 - RNA, 17 nt, Human
uaauuuuuauauuugaa

SEQ ID NO: 1811617 - RNA, 11 nt, Human
agaauauauuu

SEQ ID NO: 1811618 - RNA, 18 nt, Human
acucagacacaaauaaag

SEQ ID NO: 1811619 - RNA, 19 nt, Human
auuucagaaaugcugucau

SEQ ID NO: 1811620 - RNA, 15 nt, Human
uucacuguaaaauaa

SEQ ID NO: 1811621 - RNA, 16 nt, Human
augcaaacuuuauuuu

SEQ ID NO: 1811622 - RNA, 14 nt, Human
guagcuaaauauau

SEQ ID NO: 1811623 - RNA, 18 nt, Human
gaaaaacuauuaacaacu

SEQ ID NO: 1811624 - RNA, 19 nt, Human
augaugauuucagcaggga

SEQ ID NO: 1811625 - RNA, 15 nt, Human
auguuccuuauauuu

SEQ ID NO: 1811626 - RNA, 17 nt, Human
cauucuggauuuuaaaa

SEQ ID NO: 1811627 - RNA, 21 nt, Human
uagaaaaguuauguagaaaaa

SEQ ID NO: 1811628 - RNA, 17 nt, Human
augcagugccuuucuuc

SEQ ID NO: 1811629 - RNA, 14 nt, Human
aaagagaacuucca

SEQ ID NO: 1811630 - RNA, 17 nt, Human
aaauguucuauuuuaau

SEQ ID NO: 1811631 - RNA, 16 nt, Human
aucucagcucacugca

SEQ ID NO: 1811632 - RNA, 17 nt, Human
aagcuuuuuuugaauca

SEQ ID NO: 1811633 - RNA, 16 nt, Human
uuuaugcauauuauuu

SEQ ID NO: 1811634 - RNA, 12 nt, Human
gccaggccuggc

SEQ ID NO: 1811635 - RNA, 18 nt, Human
cauuuuuuucuaauaguu

SEQ ID NO: 1811636 - RNA, 19 nt, Human
ucagugucaaugcagcccc

SEQ ID NO: 1811637 - RNA, 15 nt, Human
agaauagaaauuagu

SEQ ID NO: 1811638 - RNA, 23 nt, Human
aaauaaaccuuuuuggacacaca

SEQ ID NO: 1811639 - RNA, 19 nt, Human
cucauggaauuggagcucg

SEQ ID NO: 1811640 - RNA, 14 nt, Human
aaauuuauaaacuu

SEQ ID NO: 1811641 - RNA, 19 nt, Human
guccaggucuaccaaaaau

SEQ ID NO: 1811642 - RNA, 16 nt, Human
gcauggagucacagcc

SEQ ID NO: 1811643 - RNA, 17 nt, Human
ccacuggacucaccucc

SEQ ID NO: 1811644 - RNA, 17 nt, Human
ggaaauauuuauuuuaa

SEQ ID NO: 1811645 - RNA, 13 nt, Human
auugaggcaggca

SEQ ID NO: 1811646 - RNA, 12 nt, Human
ugacugucacau

SEQ ID NO: 1811647 - RNA, 17 nt, Human
uaccugcucagcccugc

SEQ ID NO: 1811648 - RNA, 16 nt, Human
ugagccacccugccca

SEQ ID NO: 1811649 - RNA, 15 nt, Human
uccuugucuuuuuac

SEQ ID NO: 1811650 - RNA, 13 nt, Human
cuucuccagccuc

SEQ ID NO: 1811651 - RNA, 23 nt, Human
aaauuuuuaaucuuuaauuuuac

SEQ ID NO: 1811652 - RNA, 19 nt, Human
ucacccaaccacaucccac

SEQ ID NO: 1811653 - RNA, 16 nt, Human
cuuuguaaugaaaacc

SEQ ID NO: 1811654 - RNA, 23 nt, Human
ggcccgcaugcggcccaggaugg

SEQ ID NO: 1811655 - RNA, 15 nt, Human
cagugaaagaaaaua

SEQ ID NO: 1811656 - RNA, 18 nt, Human
cagagaagggcuuggacu

SEQ ID NO: 1811657 - RNA, 17 nt, Human
gacuucuugaaaucaau

SEQ ID NO: 1811658 - RNA, 18 nt, Human
uuuuauaucaauuuaaaa

SEQ ID NO: 1811659 - RNA, 13 nt, Human
uucuuuuugcuau

SEQ ID NO: 1811660 - RNA, 22 nt, Human
accacaaugcagugccuuucuu

SEQ ID NO: 1811661 - RNA, 13 nt, Human
agaaaauaaaucu

SEQ ID NO: 1811662 - RNA, 22 nt, Human
ucuagcaugucgucaaagcuga

SEQ ID NO: 1811663 - RNA, 21 nt, Human
uacaugagguacugagaguga

SEQ ID NO: 1811664 - RNA, 18 nt, Human
uuucaauuaccuucuauu

SEQ ID NO: 1811665 - RNA, 17 nt, Human
ugcucaggagcccuggg

SEQ ID NO: 1811666 - RNA, 15 nt, Human
caggacuagggcugg

SEQ ID NO: 1811667 - RNA, 13 nt, Human
augauaaaagcac

SEQ ID NO: 1811668 - RNA, 19 nt, Human
gauaagaucuuuuauuuug

SEQ ID NO: 1811669 - RNA, 19 nt, Human
ggaauuuuauuuuuuucug

SEQ ID NO: 1811670 - RNA, 20 nt, Human
uaccugcucagcccugcacc

SEQ ID NO: 1811671 - RNA, 17 nt, Human
agaaggccaagaggcug

SEQ ID NO: 1811672 - RNA, 18 nt, Human
auuauccaucuuucacua

SEQ ID NO: 1811673 - RNA, 15 nt, Human
uugaacacuuuuuua

SEQ ID NO: 1811674 - RNA, 15 nt, Human
accuaguccccagcc

SEQ ID NO: 1811675 - RNA, 15 nt, Human
gucccuauuccuccu

SEQ ID NO: 1811676 - RNA, 17 nt, Human
aggcuagaaccaccugc

SEQ ID NO: 1811677 - RNA, 14 nt, Human
uuuacccuucuuuu

SEQ ID NO: 1811678 - RNA, 19 nt, Human
ucccgauucacccugucca

SEQ ID NO: 1811679 - RNA, 16 nt, Human
augagcacgcauggaa

SEQ ID NO: 1811680 - RNA, 13 nt, Human
ugggagaaaugaa

SEQ ID NO: 1811681 - RNA, 17 nt, Human
ugaucaccugcccugcu

SEQ ID NO: 1811682 - RNA, 18 nt, Human
gucacccacuucccacua

SEQ ID NO: 1811683 - RNA, 15 nt, Human
ugccuauuuuaauaa

SEQ ID NO: 1811684 - RNA, 13 nt, Human
agaaaugaaagca

SEQ ID NO: 1811685 - RNA, 16 nt, Human
cuacacuccagugaga

SEQ ID NO: 1811686 - RNA, 13 nt, Human
ccaaaagguauuu

SEQ ID NO: 1811687 - RNA, 12 nt, Human
aacaaagaaauu

SEQ ID NO: 1811688 - RNA, 15 nt, Human
ggauggcgcaggaac

SEQ ID NO: 1811689 - RNA, 19 nt, Human
accuccuaagaaggcaccu

SEQ ID NO: 1811690 - RNA, 19 nt, Human
agucccuccccaaaugcuu

SEQ ID NO: 1811691 - RNA, 22 nt, Human
uccuuuucccgaaggaaaaggg

SEQ ID NO: 1811692 - RNA, 18 nt, Human
uaccacaccaucucccau

SEQ ID NO: 1811693 - RNA, 23 nt, Human
ugcucagaaaugucauguggcua

SEQ ID NO: 1811694 - RNA, 15 nt, Human
acaacagguaaaaca

SEQ ID NO: 1811695 - RNA, 21 nt, Human
accacuggagaucaccagugu

SEQ ID NO: 1811696 - RNA, 23 nt, Human
acucagauccuccucauucacau

SEQ ID NO: 1811697 - RNA, 13 nt, Human
agucuaacaaauu

SEQ ID NO: 1811698 - RNA, 16 nt, Human
gcagagggaucaagca

SEQ ID NO: 1811699 - RNA, 21 nt, Human
cucaguccaugaagauguaga

SEQ ID NO: 1811700 - RNA, 13 nt, Human
cugggccccugcc

SEQ ID NO: 1811701 - RNA, 20 nt, Human
ugcuaauuuugaaaaacugc

SEQ ID NO: 1811702 - RNA, 20 nt, Human
cuuugcccugcugcccuccc

SEQ ID NO: 1811703 - RNA, 12 nt, Human
cuuguuuccuua

SEQ ID NO: 1811704 - RNA, 17 nt, Human
cagccaacuauggccug

SEQ ID NO: 1811705 - RNA, 17 nt, Human
aaauaacgauaaaagac

SEQ ID NO: 1811706 - RNA, 23 nt, Human
auguacaauaaagcaauguggua

SEQ ID NO: 1811707 - RNA, 18 nt, Human
uauguuagagaauuuccu

SEQ ID NO: 1811708 - RNA, 15 nt, Human
gguugguuucccuuc

SEQ ID NO: 1811709 - RNA, 22 nt, Human
uuucccaaauugaaucacugcu

SEQ ID NO: 1811710 - RNA, 11 nt, Human
uugugaaauua

SEQ ID NO: 1811711 - RNA, 14 nt, Human
gcuccagcugcucu

SEQ ID NO: 1811712 - RNA, 16 nt, Human
auucugaggccaggga

SEQ ID NO: 1811713 - RNA, 14 nt, Human
aagaagugaaaauc

SEQ ID NO: 1811714 - RNA, 20 nt, Human
gcccaugcuggagugcagug

SEQ ID NO: 1811715 - RNA, 13 nt, Human
uugauuuaaugua

SEQ ID NO: 1811716 - RNA, 21 nt, Human
aauuugugcccccaaccauuu

SEQ ID NO: 1811717 - RNA, 21 nt, Human
uagggugauauuaaccagggg

SEQ ID NO: 1811718 - RNA, 20 nt, Human
aaggguaggcucaaaacagg

SEQ ID NO: 1811719 - RNA, 19 nt, Human
cagaaagcagaacagugau

SEQ ID NO: 1811720 - RNA, 15 nt, Human
cuugcggcuccucag

SEQ ID NO: 1811721 - RNA, 12 nt, Human
uaacaucugaga

SEQ ID NO: 1811722 - RNA, 14 nt, Human
acaugcuuuuuaau

SEQ ID NO: 1811723 - RNA, 22 nt, Human
ugauaucccccagccucaaguc

SEQ ID NO: 1811724 - RNA, 18 nt, Human
uacacuggaugaaaaugu

SEQ ID NO: 1811725 - RNA, 18 nt, Human
uguaaaggaauuuaaaaa

SEQ ID NO: 1811726 - RNA, 14 nt, Human
cucccugcccccca

SEQ ID NO: 1811727 - RNA, 22 nt, Human
gcuuaacccuggaaaaugaauc

SEQ ID NO: 1811728 - RNA, 16 nt, Human
ccaugucuacacagau

SEQ ID NO: 1811729 - RNA, 23 nt, Human
auugaucggagccuccucucuca

SEQ ID NO: 1811730 - RNA, 13 nt, Human
ucccaccaggcug

SEQ ID NO: 1811731 - RNA, 21 nt, Human
cacaucgcagauucucccuug

SEQ ID NO: 1811732 - RNA, 21 nt, Human
accaaggagccaaacauccua

SEQ ID NO: 1811733 - RNA, 13 nt, Human
cugucggagcccu

SEQ ID NO: 1811734 - RNA, 16 nt, Human
ccccagccugcucccu

SEQ ID NO: 1811735 - RNA, 18 nt, Human
ugcugaacucccucucug

SEQ ID NO: 1811736 - RNA, 16 nt, Human
agcccugcaccaugcu

SEQ ID NO: 1811737 - RNA, 16 nt, Human
uguggcuuucagagcc

SEQ ID NO: 1811738 - RNA, 19 nt, Human
uuuuaaguuauuuuuacau

SEQ ID NO: 1811739 - RNA, 15 nt, Human
uucauuaaucugccu

SEQ ID NO: 1811740 - RNA, 18 nt, Human
uuuuagugaaauauuauu

SEQ ID NO: 1811741 - RNA, 20 nt, Human
caugcugcuggggaagacag

SEQ ID NO: 1811742 - RNA, 19 nt, Human
cugccugccccuacccugg

SEQ ID NO: 1811743 - RNA, 14 nt, Human
cagagguugcagug

SEQ ID NO: 1811744 - RNA, 21 nt, Human
cugcuggggaagacaguggcc

SEQ ID NO: 1811745 - RNA, 23 nt, Human
acccuccccaaaggcuuugcccu

SEQ ID NO: 1811746 - RNA, 20 nt, Human
gauucuuccaucugauugug

SEQ ID NO: 1811747 - RNA, 19 nt, Human
auguuuacagauccccaag

SEQ ID NO: 1811748 - RNA, 22 nt, Human
gauucuccugccucagccuccc

SEQ ID NO: 1811749 - RNA, 16 nt, Human
gacauuugcucaugga

SEQ ID NO: 1811750 - RNA, 19 nt, Human
ugacugccaagccaugggu

SEQ ID NO: 1811751 - RNA, 15 nt, Human
cugccucucugcagg

SEQ ID NO: 1811752 - RNA, 18 nt, Human
ucccauuagaccaagcuu

SEQ ID NO: 1811753 - RNA, 20 nt, Human
cauacucuguaacaguugca

SEQ ID NO: 1811754 - RNA, 17 nt, Human
aggguuggagcaggggu

SEQ ID NO: 1811755 - RNA, 16 nt, Human
gacauugaggcaggca

SEQ ID NO: 1811756 - RNA, 15 nt, Human
aggcagauguuccua

SEQ ID NO: 1811757 - RNA, 20 nt, Human
cccacuacaagugauccuca

SEQ ID NO: 1811758 - RNA, 14 nt, Human
acuaauuuuaaaau

SEQ ID NO: 1811759 - RNA, 14 nt, Human
cugcucugucuucu

SEQ ID NO: 1811760 - RNA, 22 nt, Human
uagcuccuccuuuuuccuucca

SEQ ID NO: 1811761 - RNA, 20 nt, Human
uaagaaacauuuauauugau

SEQ ID NO: 1811762 - RNA, 22 nt, Human
gucucuacuaaaaauacaaaaa

SEQ ID NO: 1811763 - RNA, 22 nt, Human
aaguuagaaaguugauuuuaag

SEQ ID NO: 1811764 - RNA, 19 nt, Human
augccaggccuggcaagug

SEQ ID NO: 1811765 - RNA, 18 nt, Human
cugucauaugcucugauu

SEQ ID NO: 1811766 - RNA, 13 nt, Human
cugaagcuguguc

SEQ ID NO: 1811767 - RNA, 23 nt, Human
caaaucaaaagacuuuuuccuug

SEQ ID NO: 1811768 - RNA, 15 nt, Human
ucuggcuccagcugg

SEQ ID NO: 1811769 - RNA, 17 nt, Human
gccuggcgggguggggu

SEQ ID NO: 1811770 - RNA, 13 nt, Human
cagaaggccaaga

SEQ ID NO: 1811771 - RNA, 15 nt, Human
ucucuaauauguaaa

SEQ ID NO: 1811772 - RNA, 14 nt, Human
uuuaucacuguugc

SEQ ID NO: 1811773 - RNA, 20 nt, Human
uuagcauaguaccucugcua

SEQ ID NO: 1811774 - RNA, 22 nt, Human
cuuuccacagaagcuccaggua

SEQ ID NO: 1811775 - RNA, 13 nt, Human
cuucuggccuugu

SEQ ID NO: 1811776 - RNA, 18 nt, Human
cuaauguugaauuuugau

SEQ ID NO: 1811777 - RNA, 19 nt, Human
uuuuaaugagauaauguga

SEQ ID NO: 1811778 - RNA, 13 nt, Human
cucagugggggca

SEQ ID NO: 1811779 - RNA, 17 nt, Human
ucucguaagauuuccuu

SEQ ID NO: 1811780 - RNA, 15 nt, Human
aagaaggaaagauuu

SEQ ID NO: 1811781 - RNA, 14 nt, Human
ccccaucagcucca

SEQ ID NO: 1811782 - RNA, 14 nt, Human
cucccucccuuggg

SEQ ID NO: 1811783 - RNA, 18 nt, Human
cagcuccagcugcucugu

SEQ ID NO: 1811784 - RNA, 22 nt, Human
auuaacucagacacaaauaaag

SEQ ID NO: 1811785 - RNA, 16 nt, Human
cgagugggggccagcc

SEQ ID NO: 1811786 - RNA, 13 nt, Human
ucuuauaauuuaa

SEQ ID NO: 1811787 - RNA, 13 nt, Human
ugagucaacuccu

SEQ ID NO: 1811788 - RNA, 19 nt, Human
uuuaaaucacucaaauugu

SEQ ID NO: 1811789 - RNA, 15 nt, Human
ucagcuucuccaaca

SEQ ID NO: 1811790 - RNA, 22 nt, Human
cuuaaaucuaguaauuuguaga

SEQ ID NO: 1811791 - RNA, 17 nt, Human
accugcugagccccaag

SEQ ID NO: 1811792 - RNA, 19 nt, Human
cucuuccucagcugugugg

SEQ ID NO: 1811793 - RNA, 23 nt, Human
gauagauaggucagugcaaauac

SEQ ID NO: 1811794 - RNA, 21 nt, Human
auuuaaauuauuuuuguucau

SEQ ID NO: 1811795 - RNA, 18 nt, Human
ugccuaggcauagcccug

SEQ ID NO: 1811796 - RNA, 13 nt, Human
uauuucuaugaaa

SEQ ID NO: 1811797 - RNA, 21 nt, Human
uccucccacuucagccuccca

SEQ ID NO: 1811798 - RNA, 21 nt, Human
ccaggccccaagcccacuggg

SEQ ID NO: 1811799 - RNA, 18 nt, Human
gugcaucaggcuuucuuu

SEQ ID NO: 1811800 - RNA, 19 nt, Human
ccccucuggcuccagcugg

SEQ ID NO: 1811801 - RNA, 15 nt, Human
uugguagauucuaau

SEQ ID NO: 1811802 - RNA, 17 nt, Human
auauuugaaauauugac

SEQ ID NO: 1811803 - RNA, 17 nt, Human
cucugcccuuccugcag

SEQ ID NO: 1811804 - RNA, 20 nt, Human
aggauuuuaagggaagggga

SEQ ID NO: 1811805 - RNA, 22 nt, Human
agugagcagucaggaaagagaa

SEQ ID NO: 1811806 - RNA, 19 nt, Human
ucuguuuucccuccuugga

SEQ ID NO: 1811807 - RNA, 17 nt, Human
caggacgcccucacugc

SEQ ID NO: 1811808 - RNA, 18 nt, Human
caggauggcgcaggaacu

SEQ ID NO: 1811809 - RNA, 13 nt, Human
cuguguauuuaac

SEQ ID NO: 1811810 - RNA, 15 nt, Human
ucuccuaaaguacug

SEQ ID NO: 1811811 - RNA, 16 nt, Human
cacuucagccucccaa

SEQ ID NO: 1811812 - RNA, 12 nt, Human
ugcaucuagagg

SEQ ID NO: 1811813 - RNA, 16 nt, Human
cagacgugugcaguug

SEQ ID NO: 1811814 - RNA, 15 nt, Human
uaucuucacuuuuau

SEQ ID NO: 1811815 - RNA, 23 nt, Human
uccagguagaggguguguaagua

SEQ ID NO: 1811816 - RNA, 17 nt, Human
ugggagccagggcuguc

SEQ ID NO: 1811817 - RNA, 18 nt, Human
ccuuagaccaccaagccu

SEQ ID NO: 1811818 - RNA, 13 nt, Human
caugaagacagag

SEQ ID NO: 1811819 - RNA, 18 nt, Human
caaguaaaaggaaaugcu

SEQ ID NO: 1811820 - RNA, 12 nt, Human
uaauaaauguac

SEQ ID NO: 1811821 - RNA, 18 nt, Human
ugccgacagcucuccaau

SEQ ID NO: 1811822 - RNA, 17 nt, Human
agugggagccagggcug

SEQ ID NO: 1811823 - RNA, 17 nt, Human
ucagggagguggcuggg

SEQ ID NO: 1811824 - RNA, 16 nt, Human
guaaaauugccauauu

SEQ ID NO: 1811825 - RNA, 13 nt, Human
ucucaauuucuac

SEQ ID NO: 1811826 - RNA, 23 nt, Human
aauaaguuuauuucuuaaaucua

SEQ ID NO: 1811827 - RNA, 23 nt, Human
cgcccucacugcaggcuccccuc

SEQ ID NO: 1811828 - RNA, 15 nt, Human
cucgugggacaguca

SEQ ID NO: 1811829 - RNA, 20 nt, Human
uauacuuuaauaaauguaua

SEQ ID NO: 1811830 - RNA, 18 nt, Human
ugagaaauuuauaaacuu

SEQ ID NO: 1811831 - RNA, 12 nt, Human
cugcaaauguaa

SEQ ID NO: 1811832 - RNA, 19 nt, Human
gugaacuugguuuuaauua

SEQ ID NO: 1811833 - RNA, 15 nt, Human
uggcuggggcaugga

SEQ ID NO: 1811834 - RNA, 17 nt, Human
acucuugaaaaaugcau

SEQ ID NO: 1811835 - RNA, 15 nt, Human
auccugccccugagc

SEQ ID NO: 1811836 - RNA, 22 nt, Human
cagcaucccuagucucuaccca

SEQ ID NO: 1811837 - RNA, 15 nt, Human
aaacaaagaaauuau

SEQ ID NO: 1811838 - RNA, 20 nt, Human
caaaucagaccuggcugcuu

SEQ ID NO: 1811839 - RNA, 16 nt, Human
cuagccuggaaccaag

SEQ ID NO: 1811840 - RNA, 16 nt, Human
acugcaaccucugccu

SEQ ID NO: 1811841 - RNA, 13 nt, Human
cacuguaaaauaa

SEQ ID NO: 1811842 - RNA, 17 nt, Human
ccaaacugccuaagccc

SEQ ID NO: 1811843 - RNA, 13 nt, Human
caccaaggagcca

SEQ ID NO: 1811844 - RNA, 16 nt, Human
auaaugugauauuaua

SEQ ID NO: 1811845 - RNA, 22 nt, Human
uaaauaaaaagcauuauuauuu

SEQ ID NO: 1811846 - RNA, 21 nt, Human
ugugcauucuggauuuuaaaa

SEQ ID NO: 1811847 - RNA, 11 nt, Human
gaugagaguac

SEQ ID NO: 1811848 - RNA, 19 nt, Human
uauacugugugcuaaaaca

SEQ ID NO: 1811849 - RNA, 16 nt, Human
aacaugaaaacaauuc

SEQ ID NO: 1811850 - RNA, 14 nt, Human
ccagccugcucccu

SEQ ID NO: 1811851 - RNA, 13 nt, Human
cccuucucuguau

SEQ ID NO: 1811852 - RNA, 14 nt, Human
uaauuuugaaaaac

SEQ ID NO: 1811853 - RNA, 23 nt, Human
caggaggugcuaucgcaccacug

SEQ ID NO: 1811854 - RNA, 17 nt, Human
uggacaucaaaaucaac

SEQ ID NO: 1811855 - RNA, 17 nt, Human
auaucugcuauucucca

SEQ ID NO: 1811856 - RNA, 22 nt, Human
uauuuaugccucuguauuuaaa

SEQ ID NO: 1811857 - RNA, 13 nt, Human
aucaaugaaugaa

SEQ ID NO: 1811858 - RNA, 22 nt, Human
uaagaauucuguugauggaaau

SEQ ID NO: 1811859 - RNA, 13 nt, Human
uguaguuuuuaua

SEQ ID NO: 1811860 - RNA, 20 nt, Human
gccccaucagcuccagcugc

SEQ ID NO: 1811861 - RNA, 17 nt, Human
cuggacucaccuccccc

SEQ ID NO: 1811862 - RNA, 20 nt, Human
uguauuuccccaacauguaa

SEQ ID NO: 1811863 - RNA, 16 nt, Human
uccagaccugaagaau

SEQ ID NO: 1811864 - RNA, 19 nt, Human
cauuuggauccugugugga

SEQ ID NO: 1811865 - RNA, 18 nt, Human
ucuucaacucccugcccc

SEQ ID NO: 1811866 - RNA, 15 nt, Human
auucuagucuauuug

SEQ ID NO: 1811867 - RNA, 23 nt, Human
gcuguggauuuaauguggaaaug

SEQ ID NO: 1811868 - RNA, 12 nt, Human
ucucucuucuuu

SEQ ID NO: 1811869 - RNA, 15 nt, Human
uggacucaccucccc

SEQ ID NO: 1811870 - RNA, 20 nt, Human
cuccuuccggggaaggauuu

SEQ ID NO: 1811871 - RNA, 15 nt, Human
accugcucagcccug

SEQ ID NO: 1811872 - RNA, 14 nt, Human
aucucuucucagaa

SEQ ID NO: 1811873 - RNA, 20 nt, Human
ugguuguauuauuuuuuaaa

SEQ ID NO: 1811874 - RNA, 17 nt, Human
guacaagcauucugucu

SEQ ID NO: 1811875 - RNA, 17 nt, Human
acucuguugccaggcug

SEQ ID NO: 1811876 - RNA, 13 nt, Human
ugaaaaucuuaua

SEQ ID NO: 1811877 - RNA, 20 nt, Human
aaaugauguuucauaagaau

SEQ ID NO: 1811878 - RNA, 13 nt, Human
gauuauuuucuac

SEQ ID NO: 1811879 - RNA, 16 nt, Human
caccaccacgccuggc

SEQ ID NO: 1811880 - RNA, 19 nt, Human
acaugggaucaaguccugc

SEQ ID NO: 1811881 - RNA, 18 nt, Human
caaggcuagaaccaccug

SEQ ID NO: 1811882 - RNA, 14 nt, Human
gccugccuuucucc

SEQ ID NO: 1811883 - RNA, 20 nt, Human
gagauggagucuugcucugu

SEQ ID NO: 1811884 - RNA, 16 nt, Human
guaccuaguccccagc

SEQ ID NO: 1811885 - RNA, 13 nt, Human
cauugacugucac

SEQ ID NO: 1811886 - RNA, 18 nt, Human
uuggcagaguucuauaau

SEQ ID NO: 1811887 - RNA, 18 nt, Human
agaaaauugugcuggaaa

SEQ ID NO: 1811888 - RNA, 19 nt, Human
uaagauaccaaaaccacag

SEQ ID NO: 1811889 - RNA, 20 nt, Human
auaaagguucaugcaaacuu

SEQ ID NO: 1811890 - RNA, 14 nt, Human
guguucauaaauaa

SEQ ID NO: 1811891 - RNA, 14 nt, Human
uugucuuuuccuuc

SEQ ID NO: 1811892 - RNA, 14 nt, Human
ugcuggggaagaca

SEQ ID NO: 1811893 - RNA, 23 nt, Human
aaagcccagcuugaaaccuucac

SEQ ID NO: 1811894 - RNA, 20 nt, Human
cacugugggaaggagacaaa

SEQ ID NO: 1811895 - RNA, 22 nt, Human
gagggacucaucauuuccauuu

SEQ ID NO: 1811896 - RNA, 14 nt, Human
auugucuuuguucu

SEQ ID NO: 1811897 - RNA, 18 nt, Human
uuucacugugcaaauaua

SEQ ID NO: 1811898 - RNA, 21 nt, Human
ugaauguuaaauaaauuguau

SEQ ID NO: 1811899 - RNA, 18 nt, Human
aaaagggacugagaaauu

SEQ ID NO: 1811900 - RNA, 15 nt, Human
cauaaugguuuuuaa

SEQ ID NO: 1811901 - RNA, 19 nt, Human
uccuauaauuuuagacauu

SEQ ID NO: 1811902 - RNA, 22 nt, Human
cuuuaacuuaauugcuauguuu

SEQ ID NO: 1811903 - RNA, 22 nt, Human
cguguccgacucuucugagcac

SEQ ID NO: 1811904 - RNA, 20 nt, Human
gcaggcaggaacaaacaggg

SEQ ID NO: 1811905 - RNA, 13 nt, Human
uggagugcagugg

SEQ ID NO: 1811906 - RNA, 18 nt, Human
ucacugcaaccucugccu

SEQ ID NO: 1811907 - RNA, 20 nt, Human
ccagaugagaguacacccca

SEQ ID NO: 1811908 - RNA, 20 nt, Human
ccaccugccuuggcuuccca

SEQ ID NO: 1811909 - RNA, 19 nt, Human
cagcuaccugcucagcccu

SEQ ID NO: 1811910 - RNA, 20 nt, Human
auaaaucuaucaaaauuacc

SEQ ID NO: 1811911 - RNA, 16 nt, Human
cauuauuccuguggau

SEQ ID NO: 1811912 - RNA, 19 nt, Human
caaguaaaaggaaaugcuc

SEQ ID NO: 1811913 - RNA, 16 nt, Human
cacuaguauuucuaug

SEQ ID NO: 1811914 - RNA, 15 nt, Human
cugaagacccccaac

SEQ ID NO: 1811915 - RNA, 14 nt, Human
uuaugauuaaguaa

SEQ ID NO: 1811916 - RNA, 13 nt, Human
cacugacacacac

SEQ ID NO: 1811917 - RNA, 19 nt, Human
cacccgccucagccuccca

SEQ ID NO: 1811918 - RNA, 22 nt, Human
auauuuacaaaugggaaacaaa

SEQ ID NO: 1811919 - RNA, 17 nt, Human
auuuagguuucugaguu

SEQ ID NO: 1811920 - RNA, 18 nt, Human
uuccaagaaauauuccuu

SEQ ID NO: 1811921 - RNA, 20 nt, Human
ugauuacugccuauuuuaau

SEQ ID NO: 1811922 - RNA, 14 nt, Human
ugccucaccagccc

SEQ ID NO: 1811923 - RNA, 16 nt, Human
auuugaugcuacagga

SEQ ID NO: 1811924 - RNA, 16 nt, Human
ugcaaacugccuucuu

SEQ ID NO: 1811925 - RNA, 23 nt, Human
ugucuucaggggccacaccaacc

SEQ ID NO: 1811926 - RNA, 16 nt, Human
uuuaacaucugagaaa

SEQ ID NO: 1811927 - RNA, 23 nt, Human
cucuugaggcacagaaacuccug

SEQ ID NO: 1811928 - RNA, 13 nt, Human
uuguauuuuucca

SEQ ID NO: 1811929 - RNA, 15 nt, Human
aagugaaaaucuaca

SEQ ID NO: 1811930 - RNA, 12 nt, Human
gauaaaagacag

SEQ ID NO: 1811931 - RNA, 13 nt, Human
uacagagacagaa

SEQ ID NO: 1811932 - RNA, 21 nt, Human
gauucucuugccucaaccucc

SEQ ID NO: 1811933 - RNA, 18 nt, Human
cauguuccccuugggggu

SEQ ID NO: 1811934 - RNA, 20 nt, Human
gaugccacuagcccuccucu

SEQ ID NO: 1811935 - RNA, 20 nt, Human
cuauguuuugacauuuuuag

SEQ ID NO: 1811936 - RNA, 20 nt, Human
ugccgugugugugcguccug

SEQ ID NO: 1811937 - RNA, 17 nt, Human
ucagaaaugucaugugg

SEQ ID NO: 1811938 - RNA, 12 nt, Human
gaggacuccuua

SEQ ID NO: 1811939 - RNA, 19 nt, Human
uccacaaguaaaaggaaau

SEQ ID NO: 1811940 - RNA, 19 nt, Human
cuuuaauuuuacauuuccu

SEQ ID NO: 1811941 - RNA, 15 nt, Human
ucaacuaaugauuua

SEQ ID NO: 1811942 - RNA, 14 nt, Human
cucauuucucaucu

SEQ ID NO: 1811943 - RNA, 19 nt, Human
ccacaucugagagaugaca

SEQ ID NO: 1811944 - RNA, 14 nt, Human
cuggagugcagugg

SEQ ID NO: 1811945 - RNA, 23 nt, Human
uguggaaggugaucuggcucugg

SEQ ID NO: 1811946 - RNA, 23 nt, Human
caacggggugaaacccugucucu

SEQ ID NO: 1811947 - RNA, 12 nt, Human
caccuccuaaga

SEQ ID NO: 1811948 - RNA, 15 nt, Human
augagcaaaaccaaa

SEQ ID NO: 1811949 - RNA, 10 nt, Human
gagacagagu

SEQ ID NO: 1811950 - RNA, 15 nt, Human
gauccugcaauucca

SEQ ID NO: 1811951 - RNA, 18 nt, Human
acaaauccaaugaaauga

SEQ ID NO: 1811952 - RNA, 21 nt, Human
cccuagaaagccaugugcagc

SEQ ID NO: 1811953 - RNA, 15 nt, Human
gugaagcaaggagcu

SEQ ID NO: 1811954 - RNA, 23 nt, Human
ggccagccacggggacucagccc

SEQ ID NO: 1811955 - RNA, 15 nt, Human
auugcauuuuacuuu

SEQ ID NO: 1811956 - RNA, 22 nt, Human
cuuuuccuucugagccugccuu

SEQ ID NO: 1811957 - RNA, 23 nt, Human
accaaagacuacauauugucacu

SEQ ID NO: 1811958 - RNA, 19 nt, Human
ccuccagggagucucagcu

SEQ ID NO: 1811959 - RNA, 23 nt, Human
uguuucuuuguaaugaaaaccac

SEQ ID NO: 1811960 - RNA, 18 nt, Human
aguucccucuugcucagu

SEQ ID NO: 1811961 - RNA, 14 nt, Human
cagacucacugugg

SEQ ID NO: 1811962 - RNA, 16 nt, Human
uguaauugauuuauuu

SEQ ID NO: 1811963 - RNA, 15 nt, Human
agccagggcugucuu

SEQ ID NO: 1811964 - RNA, 17 nt, Human
guauaauucacauugua

SEQ ID NO: 1811965 - RNA, 18 nt, Human
ugcccaguuagccucugc

SEQ ID NO: 1811966 - RNA, 20 nt, Human
uauuucuucaaauaaaucuc

SEQ ID NO: 1811967 - RNA, 17 nt, Human
uuuauuucuuaaaucua

SEQ ID NO: 1811968 - RNA, 12 nt, Human
ggcgcgaucuca

SEQ ID NO: 1811969 - RNA, 23 nt, Human
cuguaucuagccuggaaccaagg

SEQ ID NO: 1811970 - RNA, 16 nt, Human
guuccuuccucugagc

SEQ ID NO: 1811971 - RNA, 23 nt, Human
accauguacauagcuugauaaag

SEQ ID NO: 1811972 - RNA, 13 nt, Human
uugcuaauuuuua

SEQ ID NO: 1811973 - RNA, 23 nt, Human
aauguauucuuuuaguuuuuaaa

SEQ ID NO: 1811974 - RNA, 21 nt, Human
cccuugagcccucuauggugu

SEQ ID NO: 1811975 - RNA, 17 nt, Human
cccaaccacaucccacu

SEQ ID NO: 1811976 - RNA, 16 nt, Human
uucuauagcuuuuccc

SEQ ID NO: 1811977 - RNA, 22 nt, Human
augcagagguccacaacacaca

SEQ ID NO: 1811978 - RNA, 22 nt, Human
cuuguacucugaaaguuuugga

SEQ ID NO: 1811979 - RNA, 22 nt, Human
aaguuguagguaauauugcaag

SEQ ID NO: 1811980 - RNA, 16 nt, Human
ugaggcuucuggggcu

SEQ ID NO: 1811981 - RNA, 13 nt, Human
aauauguuauuau

SEQ ID NO: 1811982 - RNA, 14 nt, Human
gccuggcuaauuuu

SEQ ID NO: 1811983 - RNA, 17 nt, Human
uuucacauuuaaauaaa

SEQ ID NO: 1811984 - RNA, 14 nt, Human
ccuuuucccaacca

SEQ ID NO: 1811985 - RNA, 20 nt, Human
gcuugcaugcuugcauaaga

SEQ ID NO: 1811986 - RNA, 13 nt, Human
ccauuagaccaag

SEQ ID NO: 1811987 - RNA, 20 nt, Human
uauacugugugcuaaaacaa

SEQ ID NO: 1811988 - RNA, 14 nt, Human
cgccacccucccac

SEQ ID NO: 1811989 - RNA, 12 nt, Human
aauauauuuccu

SEQ ID NO: 1811990 - RNA, 22 nt, Human
gaaaaucuuauaauuuaaaaua

SEQ ID NO: 1811991 - RNA, 13 nt, Human
uaaaugugauuua

SEQ ID NO: 1811992 - RNA, 20 nt, Human
agagugaagggaagagacag

SEQ ID NO: 1811993 - RNA, 23 nt, Human
gcccuacugggagaggggccuca

SEQ ID NO: 1811994 - RNA, 17 nt, Human
ggaggcuaaagcccaga

SEQ ID NO: 1811995 - RNA, 17 nt, Human
aagcugccauauauuuu

SEQ ID NO: 1811996 - RNA, 13 nt, Human
cccugcaccaugc

SEQ ID NO: 1811997 - RNA, 16 nt, Human
agaccugacucucuua

SEQ ID NO: 1811998 - RNA, 13 nt, Human
ccugaguagaaag

SEQ ID NO: 1811999 - RNA, 15 nt, Human
uuaaauauuuauuua

SEQ ID NO: 1812000 - RNA, 13 nt, Human
gauuuagcaggaa

SEQ ID NO: 1812001 - RNA, 16 nt, Human
uuacaggugugagcca

SEQ ID NO: 1812002 - RNA, 14 nt, Human
gcucucggugcuuc

SEQ ID NO: 1812003 - RNA, 18 nt, Human
gaagaggguuaggagggu

SEQ ID NO: 1812004 - RNA, 13 nt, Human
caggaguacaccc

SEQ ID NO: 1812005 - RNA, 17 nt, Human
gauccagaaagaaaacu

SEQ ID NO: 1812006 - RNA, 13 nt, Human
gcuuucagagccu

SEQ ID NO: 1812007 - RNA, 18 nt, Human
cagaaagcagaacaguga

SEQ ID NO: 1812008 - RNA, 20 nt, Human
auuguguuuauaauuuuaaa

SEQ ID NO: 1812009 - RNA, 12 nt, Human
aauaauuuuuaa

SEQ ID NO: 1812010 - RNA, 19 nt, Human
auuaauauauauuaucuuu

SEQ ID NO: 1812011 - RNA, 18 nt, Human
ucccuagucucuacccag

SEQ ID NO: 1812012 - RNA, 12 nt, Human
uuaugugaaaca

SEQ ID NO: 1812013 - RNA, 19 nt, Human
acuucagcgguuuauauaa

SEQ ID NO: 1812014 - RNA, 13 nt, Human
uggaaagaaguug

SEQ ID NO: 1812015 - RNA, 21 nt, Human
uuuuaaauguuuuuuuuuaaa

SEQ ID NO: 1812016 - RNA, 18 nt, Human
cagggaggacgcucucug

SEQ ID NO: 1812017 - RNA, 16 nt, Human
uuguuucaacaguuuu

SEQ ID NO: 1812018 - RNA, 14 nt, Human
cagaagaaggaaau

SEQ ID NO: 1812019 - RNA, 15 nt, Human
gccaucucaaccucu

SEQ ID NO: 1812020 - RNA, 21 nt, Human
cagguucaagcaauccuccca

SEQ ID NO: 1812021 - RNA, 19 nt, Human
aauuuuguuauguauauuu

SEQ ID NO: 1812022 - RNA, 15 nt, Human
caccacauccagccu

SEQ ID NO: 1812023 - RNA, 22 nt, Human
aaacagggcugccuucuggccu

SEQ ID NO: 1812024 - RNA, 19 nt, Human
ugagcgcccacuagaccca

SEQ ID NO: 1812025 - RNA, 17 nt, Human
ucacagaagaaggaaau

SEQ ID NO: 1812026 - RNA, 22 nt, Human
uccacccgccucagccucccaa

SEQ ID NO: 1812027 - RNA, 14 nt, Human
aaagaaauuaugug

SEQ ID NO: 1812028 - RNA, 13 nt, Human
ccuggacuugccu

SEQ ID NO: 1812029 - RNA, 14 nt, Human
cccuauuccuccuu

SEQ ID NO: 1812030 - RNA, 14 nt, Human
uuucuaaugagaua

SEQ ID NO: 1812031 - RNA, 18 nt, Human
agaagccaaaagauugga

SEQ ID NO: 1812032 - RNA, 13 nt, Human
cauacauuucuca

SEQ ID NO: 1812033 - RNA, 20 nt, Human
uuccacagaagcuccaggua

SEQ ID NO: 1812034 - RNA, 18 nt, Human
cuacaggccucacacaca

SEQ ID NO: 1812035 - RNA, 19 nt, Human
aacacucuugaaaaaugca

SEQ ID NO: 1812036 - RNA, 16 nt, Human
aagaaaauaacaauaa

SEQ ID NO: 1812037 - RNA, 16 nt, Human
aauauuuuaauguuuc

SEQ ID NO: 1812038 - RNA, 20 nt, Human
uaacaucugagaaaagcuuu

SEQ ID NO: 1812039 - RNA, 17 nt, Human
uuccuaaauauauuuua

SEQ ID NO: 1812040 - RNA, 22 nt, Human
auccagccugcugccugcuuuu

SEQ ID NO: 1812041 - RNA, 17 nt, Human
agaucacagcuucagcc

SEQ ID NO: 1812042 - RNA, 23 nt, Human
auucucaugauuauuauuuuagu

SEQ ID NO: 1812043 - RNA, 17 nt, Human
guuugcaucugaaaauu

SEQ ID NO: 1812044 - RNA, 17 nt, Human
gcccugcaccaugcugc

SEQ ID NO: 1812045 - RNA, 23 nt, Human
uaauucacauuguauucagaguu

SEQ ID NO: 1812046 - RNA, 13 nt, Human
agaugccacccag

SEQ ID NO: 1812047 - RNA, 21 nt, Human
uuucccaaauugaaucacugc

SEQ ID NO: 1812048 - RNA, 19 nt, Human
uaccuaguccccagccugc

SEQ ID NO: 1812049 - RNA, 15 nt, Human
caucaucucagcuca

SEQ ID NO: 1812050 - RNA, 19 nt, Human
uuauuaauuugacuagaaa

SEQ ID NO: 1812051 - RNA, 19 nt, Human
agaugagagaacagggcug

SEQ ID NO: 1812052 - RNA, 13 nt, Human
caucaccuccccc

SEQ ID NO: 1812053 - RNA, 17 nt, Human
ccuaggagaggagugug

SEQ ID NO: 1812054 - RNA, 14 nt, Human
aaaugaaaaaauau

SEQ ID NO: 1812055 - RNA, 14 nt, Human
aaaaauaaaaaaga

SEQ ID NO: 1812056 - RNA, 22 nt, Human
uggaaaggggcaggccagagcu

SEQ ID NO: 1812057 - RNA, 12 nt, Human
uacuauuuaauu

SEQ ID NO: 1812058 - RNA, 22 nt, Human
uaauauugauuuauuaauauau

SEQ ID NO: 1812059 - RNA, 18 nt, Human
uguaauguuaauauugau

SEQ ID NO: 1812060 - RNA, 16 nt, Human
auccaccugccuuggc

SEQ ID NO: 1812061 - RNA, 17 nt, Human
agggagucucagcuuca

SEQ ID NO: 1812062 - RNA, 20 nt, Human
auacuugguucucuccacca

SEQ ID NO: 1812063 - RNA, 14 nt, Human
cuuuuccuuugaau

SEQ ID NO: 1812064 - RNA, 17 nt, Human
guccccagccugcuccc

SEQ ID NO: 1812065 - RNA, 12 nt, Human
uccuuuuuccuu

SEQ ID NO: 1812066 - RNA, 13 nt, Human
auuuauaaaaaua

SEQ ID NO: 1812067 - RNA, 18 nt, Human
auuuuagccuucucuguu

SEQ ID NO: 1812068 - RNA, 13 nt, Human
caaguauaauauu

SEQ ID NO: 1812069 - RNA, 13 nt, Human
acaauucuucuuc

SEQ ID NO: 1812070 - RNA, 23 nt, Human
ucacuacaaccuccgccucccau

SEQ ID NO: 1812071 - RNA, 21 nt, Human
ccaccucgcagguucaagcaa

SEQ ID NO: 1812072 - RNA, 17 nt, Human
caggcgugaccugccag

SEQ ID NO: 1812073 - RNA, 14 nt, Human
uccaacucauccac

SEQ ID NO: 1812074 - RNA, 14 nt, Human
aaauugaauuucca

SEQ ID NO: 1812075 - RNA, 14 nt, Human
auugaggcaggcac

SEQ ID NO: 1812076 - RNA, 22 nt, Human
aggauggcuuugaaugcggccc

SEQ ID NO: 1812077 - RNA, 14 nt, Human
uugaaauuguauua

SEQ ID NO: 1812078 - RNA, 23 nt, Human
uccaacuaucucauuuccaagca

SEQ ID NO: 1812079 - RNA, 20 nt, Human
gaagucugcuacccucauuu

SEQ ID NO: 1812080 - RNA, 17 nt, Human
uauuuaauucauguugc

SEQ ID NO: 1812081 - RNA, 17 nt, Human
caaagagaaagaggguu

SEQ ID NO: 1812082 - RNA, 20 nt, Human
aggcugagaugggagaauca

SEQ ID NO: 1812083 - RNA, 19 nt, Human
ugcuuuuuauggccuguga

SEQ ID NO: 1812084 - RNA, 14 nt, Human
acuucagccuccca

SEQ ID NO: 1812085 - RNA, 18 nt, Human
guuucaaacauauauaac

SEQ ID NO: 1812086 - RNA, 15 nt, Human
uacuauauuuuaggu

SEQ ID NO: 1812087 - RNA, 13 nt, Human
ccuggucucuccu

SEQ ID NO: 1812088 - RNA, 17 nt, Human
agcaugauuggugccca

SEQ ID NO: 1812089 - RNA, 21 nt, Human
auauugucacugacacacacg

SEQ ID NO: 1812090 - RNA, 16 nt, Human
ccaggcugcucagggc

SEQ ID NO: 1812091 - RNA, 17 nt, Human
ugauacuugaaaauuaa

SEQ ID NO: 1812092 - RNA, 20 nt, Human
cagccacggggacucagccc

SEQ ID NO: 1812093 - RNA, 13 nt, Human
agauuugcaaagu

SEQ ID NO: 1812094 - RNA, 21 nt, Human
cuguacagacagaaaaaacug

SEQ ID NO: 1812095 - RNA, 15 nt, Human
caauaaaguauuuaa

SEQ ID NO: 1812096 - RNA, 13 nt, Human
uuucccuucuuuu

SEQ ID NO: 1812097 - RNA, 13 nt, Human
aaaccuccuucca

SEQ ID NO: 1812098 - RNA, 14 nt, Human
uuucacugugcaaa

SEQ ID NO: 1812099 - RNA, 14 nt, Human
cccugccccccagc

SEQ ID NO: 1812100 - RNA, 17 nt, Human
gacgagaaaacaauaac

SEQ ID NO: 1812101 - RNA, 15 nt, Human
uuccucaaaaagauu

SEQ ID NO: 1812102 - RNA, 19 nt, Human
ccugaaggcauccccaggc

SEQ ID NO: 1812103 - RNA, 21 nt, Human
uuacauuuguauaaaauaauu

SEQ ID NO: 1812104 - RNA, 17 nt, Human
ccgguggagaucccacc

SEQ ID NO: 1812105 - RNA, 15 nt, Human
aucucucuucuuuuc

SEQ ID NO: 1812106 - RNA, 21 nt, Human
guacaauaaagcaauguggua

SEQ ID NO: 1812107 - RNA, 14 nt, Human
agucacagcuacac

SEQ ID NO: 1812108 - RNA, 13 nt, Human
cuuaguucaaguc

SEQ ID NO: 1812109 - RNA, 13 nt, Human
cucagauccuccu

SEQ ID NO: 1812110 - RNA, 13 nt, Human
gcagagggaucaa

SEQ ID NO: 1812111 - RNA, 13 nt, Human
aacaauucuuauu

SEQ ID NO: 1812112 - RNA, 18 nt, Human
cucugcaaacugccuucu

SEQ ID NO: 1812113 - RNA, 17 nt, Human
cccaagcaccugggauu

SEQ ID NO: 1812114 - RNA, 18 nt, Human
uaaacacucuugaaaaau

SEQ ID NO: 1812115 - RNA, 16 nt, Human
ugcccuguugcugccu

SEQ ID NO: 1812116 - RNA, 18 nt, Human
gagucaacuccuuucuca

SEQ ID NO: 1812117 - RNA, 16 nt, Human
cagaaucucucuucuu

SEQ ID NO: 1812118 - RNA, 18 nt, Human
aacuggagccccaucagc

SEQ ID NO: 1812119 - RNA, 18 nt, Human
cacuguacuugcucuuga

SEQ ID NO: 1812120 - RNA, 15 nt, Human
cauuccaagccucau

SEQ ID NO: 1812121 - RNA, 22 nt, Human
caauaaaagacaaggaaaaaau

SEQ ID NO: 1812122 - RNA, 12 nt, Human
caggagguguga

SEQ ID NO: 1812123 - RNA, 17 nt, Human
uauacuuuaauaaaugu

SEQ ID NO: 1812124 - RNA, 13 nt, Human
ccucuguauuuga

SEQ ID NO: 1812125 - RNA, 17 nt, Human
ugaacuugguuuuaauu

SEQ ID NO: 1812126 - RNA, 22 nt, Human
uaagacaaauauguucugacau

SEQ ID NO: 1812127 - RNA, 14 nt, Human
ucaaauaaaucucu

SEQ ID NO: 1812128 - RNA, 16 nt, Human
guaaugaauuaaagaa

SEQ ID NO: 1812129 - RNA, 18 nt, Human
cacuuaccuugcaucuca

SEQ ID NO: 1812130 - RNA, 16 nt, Human
aaaacauguuccuuau

SEQ ID NO: 1812131 - RNA, 16 nt, Human
cucuuauugccucacu

SEQ ID NO: 1812132 - RNA, 16 nt, Human
uuaauaccacagcuuu

SEQ ID NO: 1812133 - RNA, 12 nt, Human
aauccucugugu

SEQ ID NO: 1812134 - RNA, 20 nt, Human
uugaacccgggaggcagagg

SEQ ID NO: 1812135 - RNA, 23 nt, Human
gugaaaucauucauuuucugggu

SEQ ID NO: 1812136 - RNA, 23 nt, Human
uaucuauguagaauauauuuccu

SEQ ID NO: 1812137 - RNA, 15 nt, Human
uguuuauaauuuuaa

SEQ ID NO: 1812138 - RNA, 17 nt, Human
aauaauguaagacaaau

SEQ ID NO: 1812139 - RNA, 19 nt, Human
uuuauaucaauuuaaaaaa

SEQ ID NO: 1812140 - RNA, 17 nt, Human
cccaggcugagccucag

SEQ ID NO: 1812141 - RNA, 22 nt, Human
gagcaguuugguuucuagcaug

SEQ ID NO: 1812142 - RNA, 15 nt, Human
caaaaggaagcaggg

SEQ ID NO: 1812143 - RNA, 17 nt, Human
agggguugugaagaggu

SEQ ID NO: 1812144 - RNA, 14 nt, Human
gccuuguuucaaca

SEQ ID NO: 1812145 - RNA, 21 nt, Human
guccccuauccuacuuccccu

SEQ ID NO: 1812146 - RNA, 20 nt, Human
cuguuaugaguggcuuuaau

SEQ ID NO: 1812147 - RNA, 15 nt, Human
cuucucuucacaguc

SEQ ID NO: 1812148 - RNA, 23 nt, Human
uaacauuccucaugaauguaaau

SEQ ID NO: 1812149 - RNA, 18 nt, Human
agugcuucuccagccuca

SEQ ID NO: 1812150 - RNA, 14 nt, Human
auuauacauaacac

SEQ ID NO: 1812151 - RNA, 15 nt, Human
uuuccacaaugauga

SEQ ID NO: 1812152 - RNA, 16 nt, Human
aagaugaaugagcaaa

SEQ ID NO: 1812153 - RNA, 13 nt, Human
uaagacgaaacau

SEQ ID NO: 1812154 - RNA, 18 nt, Human
uaauaauuuuuuaauuga

SEQ ID NO: 1812155 - RNA, 18 nt, Human
caaggaugucugccacac

SEQ ID NO: 1812156 - RNA, 23 nt, Human
cacagaaacuccuguucaugccc

SEQ ID NO: 1812157 - RNA, 21 nt, Human
ccuccacauuucccccuagcc

SEQ ID NO: 1812158 - RNA, 20 nt, Human
cccaaacaugcacuuccuug

SEQ ID NO: 1812159 - RNA, 14 nt, Human
auaaaauuuuuaau

SEQ ID NO: 1812160 - RNA, 18 nt, Human
ugcaaccucugccuccca

SEQ ID NO: 1812161 - RNA, 22 nt, Human
ugaaaccaugaagagauuuuuc

SEQ ID NO: 1812162 - RNA, 12 nt, Human
cuugaacuagga

SEQ ID NO: 1812163 - RNA, 14 nt, Human
agucucccucccuu

SEQ ID NO: 1812164 - RNA, 23 nt, Human
uaugacaggauguuugcucagcu

SEQ ID NO: 1812165 - RNA, 12 nt, Human
uccccagaugag

SEQ ID NO: 1812166 - RNA, 19 nt, Human
ccuuucauaaagucuugcc

SEQ ID NO: 1812167 - RNA, 12 nt, Human
guguacauucuu

SEQ ID NO: 1812168 - RNA, 15 nt, Human
aguguagggaguugu

SEQ ID NO: 1812169 - RNA, 23 nt, Human
ggccacccaaggaugucugccac

SEQ ID NO: 1812170 - RNA, 12 nt, Human
cucccugccccc

SEQ ID NO: 1812171 - RNA, 18 nt, Human
cccucuggcuccagcugg

SEQ ID NO: 1812172 - RNA, 14 nt, Human
cugucacccagguu

SEQ ID NO: 1812173 - RNA, 14 nt, Human
uggaggaaagugau

SEQ ID NO: 1812174 - RNA, 18 nt, Human
acccagguuggagugcag

SEQ ID NO: 1812175 - RNA, 14 nt, Human
ucuguaucuagccu

SEQ ID NO: 1812176 - RNA, 18 nt, Human
cuccagccugagcgacag

SEQ ID NO: 1812177 - RNA, 21 nt, Human
agccuggguguaaaaccugga

SEQ ID NO: 1812178 - RNA, 16 nt, Human
auauguccuuuuuaau

SEQ ID NO: 1812179 - RNA, 11 nt, Human
ggcuaucugug

SEQ ID NO: 1812180 - RNA, 16 nt, Human
ccuuucucaucuuguc

SEQ ID NO: 1812181 - RNA, 15 nt, Human
auaggaaauauuuua

SEQ ID NO: 1812182 - RNA, 14 nt, Human
cuuacuuauuaucu

SEQ ID NO: 1812183 - RNA, 21 nt, Human
aaagcugaaauggacuuuugu

SEQ ID NO: 1812184 - RNA, 17 nt, Human
ucuucaaauaaaucucu

SEQ ID NO: 1812185 - RNA, 16 nt, Human
gcaaugaccuucaaca

SEQ ID NO: 1812186 - RNA, 17 nt, Human
cagcacccucuccagau

SEQ ID NO: 1812187 - RNA, 14 nt, Human
uuccuucugagccu

SEQ ID NO: 1812188 - RNA, 20 nt, Human
uuguuucaacaguuuuugcu

SEQ ID NO: 1812189 - RNA, 18 nt, Human
acaaaggcuuauuaauuu

SEQ ID NO: 1812190 - RNA, 11 nt, Human
ugauuuucauu

SEQ ID NO: 1812191 - RNA, 18 nt, Human
auugaaggaugcugucuu

SEQ ID NO: 1812192 - RNA, 21 nt, Human
caugcugagagagcuggaggc

SEQ ID NO: 1812193 - RNA, 20 nt, Human
caacagcacccucuccagau

SEQ ID NO: 1812194 - RNA, 17 nt, Human
auaaaguacaagagcuu

SEQ ID NO: 1812195 - RNA, 17 nt, Human
caggcuggagugcagug

SEQ ID NO: 1812196 - RNA, 16 nt, Human
augccccgucccccuc

SEQ ID NO: 1812197 - RNA, 14 nt, Human
uccacaacacacag

SEQ ID NO: 1812198 - RNA, 22 nt, Human
ugaguuuuucuuuucauuuacc

SEQ ID NO: 1812199 - RNA, 12 nt, Human
uucacauuuuug

SEQ ID NO: 1812200 - RNA, 13 nt, Human
gccuguacccagu

SEQ ID NO: 1812201 - RNA, 17 nt, Human
cagcugcccccagagcc

SEQ ID NO: 1812202 - RNA, 17 nt, Human
ccaugcugcuggggaag

SEQ ID NO: 1812203 - RNA, 19 nt, Human
uuuucauuaaaauuuuuuu

SEQ ID NO: 1812204 - RNA, 17 nt, Human
aauaugcucuaaacaug

SEQ ID NO: 1812205 - RNA, 22 nt, Human
aaauaguugcugucauccacuu

SEQ ID NO: 1812206 - RNA, 15 nt, Human
cugugaccucucccc

SEQ ID NO: 1812207 - RNA, 14 nt, Human
uauguuuaauuaaa

SEQ ID NO: 1812208 - RNA, 18 nt, Human
cacaaguaaaaggaaaug

SEQ ID NO: 1812209 - RNA, 9 nt, Human
auacccaaa

SEQ ID NO: 1812210 - RNA, 16 nt, Human
uguguguguaugugug

SEQ ID NO: 1812211 - RNA, 16 nt, Human
cccaggaguacacccc

SEQ ID NO: 1812212 - RNA, 22 nt, Human
aaagucucuggaauuugaaaca

SEQ ID NO: 1812213 - RNA, 23 nt, Human
uccacaaugaugaugauuucagc

SEQ ID NO: 1812214 - RNA, 14 nt, Human
aaaagacagugaaa

SEQ ID NO: 1812215 - RNA, 23 nt, Human
auuucugagcauuuaauauggau

SEQ ID NO: 1812216 - RNA, 21 nt, Human
aaauuuauaaacuuuuuucuu

SEQ ID NO: 1812217 - RNA, 13 nt, Human
uuucuucucucca

SEQ ID NO: 1812218 - RNA, 22 nt, Human
gcagaccugacucucuuaagga

SEQ ID NO: 1812219 - RNA, 21 nt, Human
cccccauuguggucacaggaa

SEQ ID NO: 1812220 - RNA, 21 nt, Human
ucccauuagaccaagcuuguc

SEQ ID NO: 1812221 - RNA, 23 nt, Human
ggcaaagacuauucccuucuaac

SEQ ID NO: 1812222 - RNA, 13 nt, Human
cuuaggccucuga

SEQ ID NO: 1812223 - RNA, 22 nt, Human
aauuuaaaaaaaaaccugagcc

SEQ ID NO: 1812224 - RNA, 19 nt, Human
uagaaaaaaguaaauguga

SEQ ID NO: 1812225 - RNA, 13 nt, Human
uagccagaggcuc

SEQ ID NO: 1812226 - RNA, 21 nt, Human
caugaagagauuuuucaugau

SEQ ID NO: 1812227 - RNA, 16 nt, Human
gaagcucaacucucuu

SEQ ID NO: 1812228 - RNA, 17 nt, Human
ucaagcaauccucccac

SEQ ID NO: 1812229 - RNA, 16 nt, Human
agaccaccaagccuug

SEQ ID NO: 1812230 - RNA, 21 nt, Human
uccuucagccugaaagaggaa

SEQ ID NO: 1812231 - RNA, 18 nt, Human
ugaagcuguguccucaug

SEQ ID NO: 1812232 - RNA, 16 nt, Human
agcuuggaaaggacca

SEQ ID NO: 1812233 - RNA, 15 nt, Human
guggguauaaaagau

SEQ ID NO: 1812234 - RNA, 14 nt, Human
uaaaggaaacccag

SEQ ID NO: 1812235 - RNA, 17 nt, Human
uauucauaagauuuaaa

SEQ ID NO: 1812236 - RNA, 22 nt, Human
gcacagcauggagucacagcca

SEQ ID NO: 1812237 - RNA, 17 nt, Human
uauauaucaaauauauu

SEQ ID NO: 1812238 - RNA, 19 nt, Human
uccagaugagaguacaccc

SEQ ID NO: 1812239 - RNA, 13 nt, Human
aucuucuuuugug

SEQ ID NO: 1812240 - RNA, 19 nt, Human
ccuuucuucucuccagugc

SEQ ID NO: 1812241 - RNA, 16 nt, Human
ccuucugagccugccu

SEQ ID NO: 1812242 - RNA, 21 nt, Human
ccuuuuuuugaaaaaaagcuu

SEQ ID NO: 1812243 - RNA, 18 nt, Human
ucaagacugcaaacccuu

SEQ ID NO: 1812244 - RNA, 11 nt, Human
agagcuggagg

SEQ ID NO: 1812245 - RNA, 23 nt, Human
gugaagggaagagacagcccagg

SEQ ID NO: 1812246 - RNA, 19 nt, Human
acaugcacugauguugugu

SEQ ID NO: 1812247 - RNA, 19 nt, Human
accugucccagaaaaagca

SEQ ID NO: 1812248 - RNA, 20 nt, Human
auuacauuuguauaaaauaa

SEQ ID NO: 1812249 - RNA, 14 nt, Human
augggccauaugaa

SEQ ID NO: 1812250 - RNA, 15 nt, Human
cuuggacucaagcaa

SEQ ID NO: 1812251 - RNA, 13 nt, Human
ccuaguccccagc

SEQ ID NO: 1812252 - RNA, 17 nt, Human
cacagugccgacagcuc

SEQ ID NO: 1812253 - RNA, 21 nt, Human
acuucugccagcauaauacuu

SEQ ID NO: 1812254 - RNA, 16 nt, Human
aagaagcuagaaaaca

SEQ ID NO: 1812255 - RNA, 20 nt, Human
cagccugcagacucacugug

SEQ ID NO: 1812256 - RNA, 13 nt, Human
cucucaaagugcu

SEQ ID NO: 1812257 - RNA, 17 nt, Human
uaucuuuuuuuuaauaa

SEQ ID NO: 1812258 - RNA, 22 nt, Human
auuaccuucuauuggucucccu

SEQ ID NO: 1812259 - RNA, 16 nt, Human
cauuuaguuauaaaaa

SEQ ID NO: 1812260 - RNA, 21 nt, Human
uuaguugcaacuuuguauaaa

SEQ ID NO: 1812261 - RNA, 13 nt, Human
caagcaccuggga

SEQ ID NO: 1812262 - RNA, 14 nt, Human
gaauugcucuccca

SEQ ID NO: 1812263 - RNA, 20 nt, Human
uugugcaguacuuugugcau

SEQ ID NO: 1812264 - RNA, 13 nt, Human
aacaauaaaagac

SEQ ID NO: 1812265 - RNA, 17 nt, Human
agagccugagugacaga

SEQ ID NO: 1812266 - RNA, 13 nt, Human
agucuuauuuccu

SEQ ID NO: 1812267 - RNA, 23 nt, Human
aagaaagcccuuaggaagaauuu

SEQ ID NO: 1812268 - RNA, 15 nt, Human
ucauaagauuuaaau

SEQ ID NO: 1812269 - RNA, 14 nt, Human
gauccacccgccuc

SEQ ID NO: 1812270 - RNA, 14 nt, Human
cuaagccuucuggu

SEQ ID NO: 1812271 - RNA, 19 nt, Human
guguuaaaaauguucuauu

SEQ ID NO: 1812272 - RNA, 16 nt, Human
auacaguuaaguuuug

SEQ ID NO: 1812273 - RNA, 11 nt, Human
ugacaggaugu

SEQ ID NO: 1812274 - RNA, 13 nt, Human
ucacuguaaaaua

SEQ ID NO: 1812275 - RNA, 21 nt, Human
cagagucaaugaacuuuccac

SEQ ID NO: 1812276 - RNA, 22 nt, Human
cagcuaccugcucagcccugca

SEQ ID NO: 1812277 - RNA, 16 nt, Human
cauccuuccucacacc

SEQ ID NO: 1812278 - RNA, 14 nt, Human
cuccagugagacag

SEQ ID NO: 1812279 - RNA, 22 nt, Human
auuacuguaagaaaauaucacu

SEQ ID NO: 1812280 - RNA, 22 nt, Human
gccacaccucuccaaagcccuc

SEQ ID NO: 1812281 - RNA, 21 nt, Human
ucagcccugcaccaugcugcu

SEQ ID NO: 1812282 - RNA, 18 nt, Human
cugcauguucuaaauaaa

SEQ ID NO: 1812283 - RNA, 19 nt, Human
gagguacugagagugaaca

SEQ ID NO: 1812284 - RNA, 16 nt, Human
caguagaugccaccca

SEQ ID NO: 1812285 - RNA, 15 nt, Human
auauugacuuuuuau

SEQ ID NO: 1812286 - RNA, 13 nt, Human
aaacacucuugaa

SEQ ID NO: 1812287 - RNA, 15 nt, Human
gcagcucuccccuuc

SEQ ID NO: 1812288 - RNA, 13 nt, Human
uauaaucauuauu

SEQ ID NO: 1812289 - RNA, 16 nt, Human
acauccuacaagacac

SEQ ID NO: 1812290 - RNA, 22 nt, Human
gaagugaaaaucuacacuccag

SEQ ID NO: 1812291 - RNA, 22 nt, Human
aaagggagauucagacuguuuu

SEQ ID NO: 1812292 - RNA, 13 nt, Human
gauuacugccuau

SEQ ID NO: 1812293 - RNA, 20 nt, Human
gaugauccccacgccacagc

SEQ ID NO: 1812294 - RNA, 21 nt, Human
auaagacggauuuauuuuucc

SEQ ID NO: 1812295 - RNA, 21 nt, Human
ucaauaagccucagcuuucua

SEQ ID NO: 1812296 - RNA, 15 nt, Human
caggauuugggcucu

SEQ ID NO: 1812297 - RNA, 15 nt, Human
gcucucuuuccucug

SEQ ID NO: 1812298 - RNA, 15 nt, Human
gcuguuaaucuuuca

SEQ ID NO: 1812299 - RNA, 11 nt, Human
ccccugccucu

SEQ ID NO: 1812300 - RNA, 16 nt, Human
aagcaaagcucuuuac

SEQ ID NO: 1812301 - RNA, 19 nt, Human
uccuucugagccugccuuu

SEQ ID NO: 1812302 - RNA, 21 nt, Human
caacucucuuauugccucacu

SEQ ID NO: 1812303 - RNA, 13 nt, Human
ugccuccccugcc

SEQ ID NO: 1812304 - RNA, 21 nt, Human
cccuccagauauacuugguuc

SEQ ID NO: 1812305 - RNA, 21 nt, Human
auuucauuuccuauuuuugga

SEQ ID NO: 1812306 - RNA, 17 nt, Human
ccggagaaccccaggac

SEQ ID NO: 1812307 - RNA, 18 nt, Human
uuaucuaguuuaauuaau

SEQ ID NO: 1812308 - RNA, 17 nt, Human
uaccuaccaagauauac

SEQ ID NO: 1812309 - RNA, 19 nt, Human
cacaggaaccacaagacug

SEQ ID NO: 1812310 - RNA, 13 nt, Human
cccugcacuccag

SEQ ID NO: 1812311 - RNA, 20 nt, Human
auauauuuuaaauauuuuuu

SEQ ID NO: 1812312 - RNA, 16 nt, Human
cuagccagaggcucua

SEQ ID NO: 1812313 - RNA, 18 nt, Human
acucuuaagaagacugca

SEQ ID NO: 1812314 - RNA, 16 nt, Human
ccauuuagguuucuga

SEQ ID NO: 1812315 - RNA, 13 nt, Human
ugaagcuguugug

SEQ ID NO: 1812316 - RNA, 18 nt, Human
acuaggugcauauuuaua

SEQ ID NO: 1812317 - RNA, 18 nt, Human
uuggauccuguguggaga

SEQ ID NO: 1812318 - RNA, 18 nt, Human
ucaggcagguaaccccag

SEQ ID NO: 1812319 - RNA, 20 nt, Human
uuuaauuagccagugaaaaa

SEQ ID NO: 1812320 - RNA, 23 nt, Human
cacuuuuauguuaaugcucugga

SEQ ID NO: 1812321 - RNA, 22 nt, Human
ccucucugcaggcagccugccu

SEQ ID NO: 1812322 - RNA, 17 nt, Human
agaaaauaagagcucag

SEQ ID NO: 1812323 - RNA, 22 nt, Human
aacucucuuauugccucacuuc

SEQ ID NO: 1812324 - RNA, 16 nt, Human
ccucagucucccuccc

SEQ ID NO: 1812325 - RNA, 22 nt, Human
uagaaaaguuauguagaaaaaa

SEQ ID NO: 1812326 - RNA, 18 nt, Human
uuucucaucuugucccca

SEQ ID NO: 1812327 - RNA, 15 nt, Human
uacaugauucauuuu

SEQ ID NO: 1812328 - RNA, 12 nt, Human
ccaguuuuccua

SEQ ID NO: 1812329 - RNA, 17 nt, Human
ccucugccucccagguu

SEQ ID NO: 1812330 - RNA, 14 nt, Human
gacaagaaggaaag

SEQ ID NO: 1812331 - RNA, 20 nt, Human
gggaauucagacaagcugca

SEQ ID NO: 1812332 - RNA, 18 nt, Human
cucuguaacaguugcauu

SEQ ID NO: 1812333 - RNA, 13 nt, Human
cgggaggcagagg

SEQ ID NO: 1812334 - RNA, 21 nt, Human
aauuuacagagacagaaagca

SEQ ID NO: 1812335 - RNA, 22 nt, Human
gaguuacacuggaugaaaaugu

SEQ ID NO: 1812336 - RNA, 18 nt, Human
ccuuugcaccuccaugga

SEQ ID NO: 1812337 - RNA, 22 nt, Human
uauuuuuuuuuuuuuuuuagcu

SEQ ID NO: 1812338 - RNA, 20 nt, Human
accaccacgccuggcuaauu

SEQ ID NO: 1812339 - RNA, 14 nt, Human
agagacagaaagca

SEQ ID NO: 1812340 - RNA, 15 nt, Human
gagaaaugaaaaaau

SEQ ID NO: 1812341 - RNA, 18 nt, Human
cccgauucacccugucca

SEQ ID NO: 1812342 - RNA, 20 nt, Human
uagccugccuccccugccuc

SEQ ID NO: 1812343 - RNA, 20 nt, Human
cuaauguugaguuauuaaua

SEQ ID NO: 1812344 - RNA, 19 nt, Human
caugcacuuggcugcauaa

SEQ ID NO: 1812345 - RNA, 23 nt, Human
uaccuaguccccagccugcuccc

SEQ ID NO: 1812346 - RNA, 17 nt, Human
ucucaaacuccugaccu

SEQ ID NO: 1812347 - RNA, 16 nt, Human
gcaugaagacagagcc

SEQ ID NO: 1812348 - RNA, 22 nt, Human
cucagcucacugcaaccucugc

SEQ ID NO: 1812349 - RNA, 20 nt, Human
agccugcucccuagccagag

SEQ ID NO: 1812350 - RNA, 17 nt, Human
agucauaaccuuaccag

SEQ ID NO: 1812351 - RNA, 20 nt, Human
aauaauuuuucacuucaaaa

SEQ ID NO: 1812352 - RNA, 15 nt, Human
uccuucccuugcuuc

SEQ ID NO: 1812353 - RNA, 15 nt, Human
auggugaaaugcaga

SEQ ID NO: 1812354 - RNA, 22 nt, Human
cugcacccauuagcagucccuc

SEQ ID NO: 1812355 - RNA, 15 nt, Human
aaaagacaaggaaaa

SEQ ID NO: 1812356 - RNA, 22 nt, Human
caaaugggaaacaaaaggauaa

SEQ ID NO: 1812357 - RNA, 14 nt, Human
uauuauauuuccaa

SEQ ID NO: 1812358 - RNA, 17 nt, Human
gcagugccuuucuucuc

SEQ ID NO: 1812359 - RNA, 18 nt, Human
ugccauaauuacuauguc

SEQ ID NO: 1812360 - RNA, 21 nt, Human
agcuccagcugcucugucuuc

SEQ ID NO: 1812361 - RNA, 11 nt, Human
ugaauuuugau

SEQ ID NO: 1812362 - RNA, 14 nt, Human
uagaaacugacaca

SEQ ID NO: 1812363 - RNA, 18 nt, Human
cccuauuccuccuucccu

SEQ ID NO: 1812364 - RNA, 17 nt, Human
gagcaggggugcuggga

SEQ ID NO: 1812365 - RNA, 23 nt, Human
ccugacucucuuaaggaggcuga

SEQ ID NO: 1812366 - RNA, 23 nt, Human
ccugggauuacaggugugagcca

SEQ ID NO: 1812367 - RNA, 15 nt, Human
cccuaagcccccacu

SEQ ID NO: 1812368 - RNA, 22 nt, Human
cagaaagcaguugagacaagaa

SEQ ID NO: 1812369 - RNA, 21 nt, Human
ugcauguugcccuguugcugc

SEQ ID NO: 1812370 - RNA, 16 nt, Human
cgugaucucagcucac

SEQ ID NO: 1812371 - RNA, 16 nt, Human
guacaccccaacagca

SEQ ID NO: 1812372 - RNA, 17 nt, Human
aguuuguccuuagucac

SEQ ID NO: 1812373 - RNA, 19 nt, Human
cugaagggguucucacagu

SEQ ID NO: 1812374 - RNA, 17 nt, Human
cuaauuuugaaaaacug

SEQ ID NO: 1812375 - RNA, 23 nt, Human
ugcauuuuguuugguauuguauu

SEQ ID NO: 1812376 - RNA, 20 nt, Human
cucaggaugagggaaaagaa

SEQ ID NO: 1812377 - RNA, 18 nt, Human
acccgccucagccuccca

SEQ ID NO: 1812378 - RNA, 12 nt, Human
ggagugcagugg

SEQ ID NO: 1812379 - RNA, 22 nt, Human
cuggauugaucggagccuccuc

SEQ ID NO: 1812380 - RNA, 14 nt, Human
uacauguaaaauau

SEQ ID NO: 1812381 - RNA, 16 nt, Human
ucaucaaugaaugaau

SEQ ID NO: 1812382 - RNA, 17 nt, Human
uauuaacaacuugucua

SEQ ID NO: 1812383 - RNA, 15 nt, Human
gugaucugcccgccu

SEQ ID NO: 1812384 - RNA, 18 nt, Human
ccucccauguucaagcga

SEQ ID NO: 1812385 - RNA, 10 nt, Human
caacucccug

SEQ ID NO: 1812386 - RNA, 14 nt, Human
cuaagcauuccaac

SEQ ID NO: 1812387 - RNA, 17 nt, Human
uuuuauaugcuauuuau

SEQ ID NO: 1812388 - RNA, 15 nt, Human
uuacaaauauuuugc

SEQ ID NO: 1812389 - RNA, 14 nt, Human
aagaggacaggcua

SEQ ID NO: 1812390 - RNA, 21 nt, Human
aaauagugauuuccacaguga

SEQ ID NO: 1812391 - RNA, 18 nt, Human
ucacagcuucagccagga

SEQ ID NO: 1812392 - RNA, 14 nt, Human
aacacauaucgauu

SEQ ID NO: 1812393 - RNA, 22 nt, Human
uauuucagauaaucacaauaca

SEQ ID NO: 1812394 - RNA, 12 nt, Human
guuggccaggcu

SEQ ID NO: 1812395 - RNA, 14 nt, Human
cugacgaacuccuu

SEQ ID NO: 1812396 - RNA, 19 nt, Human
cacccagguuggagugcag

SEQ ID NO: 1812397 - RNA, 18 nt, Human
auguguauuacaaauauu

SEQ ID NO: 1812398 - RNA, 18 nt, Human
auguuucauaagaauucu

SEQ ID NO: 1812399 - RNA, 15 nt, Human
agucuguuuucccuc

SEQ ID NO: 1812400 - RNA, 13 nt, Human
cgcaaauucgcaa

SEQ ID NO: 1812401 - RNA, 18 nt, Human
uguguuugacgggaaaca

SEQ ID NO: 1812402 - RNA, 22 nt, Human
cuccacucugagucccagagcc

SEQ ID NO: 1812403 - RNA, 15 nt, Human
uccucaacucugagu

SEQ ID NO: 1812404 - RNA, 22 nt, Human
cagcacgggggccaaggaugcc

SEQ ID NO: 1812405 - RNA, 22 nt, Human
guuaugccgcuagauacaugcu

SEQ ID NO: 1812406 - RNA, 21 nt, Human
aacaguuuuugcuaauuuuua

SEQ ID NO: 1812407 - RNA, 16 nt, Human
cccaaccacaucccac

SEQ ID NO: 1812408 - RNA, 19 nt, Human
cugcuggggaagacagugg

SEQ ID NO: 1812409 - RNA, 22 nt, Human
gugauccacccgccucagccuc

SEQ ID NO: 1812410 - RNA, 13 nt, Human
ugcugucauccac

SEQ ID NO: 1812411 - RNA, 23 nt, Human
uagacacacaugaaguccaagca

SEQ ID NO: 1812412 - RNA, 19 nt, Human
acuccuugauuuuagccuu

SEQ ID NO: 1812413 - RNA, 16 nt, Human
agaaugguaucaauaa

SEQ ID NO: 1812414 - RNA, 17 nt, Human
ucacauccauucuuccc

SEQ ID NO: 1812415 - RNA, 21 nt, Human
agccugcucccuagccagagg

SEQ ID NO: 1812416 - RNA, 14 nt, Human
cagcuccagcugcu

SEQ ID NO: 1812417 - RNA, 14 nt, Human
cgaucucagcucac

SEQ ID NO: 1812418 - RNA, 15 nt, Human
gcuugagccaggagg

SEQ ID NO: 1812419 - RNA, 14 nt, Human
aauguaaacaauau

SEQ ID NO: 1812420 - RNA, 21 nt, Human
uguauagaccuaaaauaaaau

SEQ ID NO: 1812421 - RNA, 21 nt, Human
gaaaauauggcaauacuugcu

SEQ ID NO: 1812422 - RNA, 21 nt, Human
ggauccuguguggagagggaa

SEQ ID NO: 1812423 - RNA, 18 nt, Human
cugcccucccccuccucu

SEQ ID NO: 1812424 - RNA, 14 nt, Human
ugucuaccuggucu

SEQ ID NO: 1812425 - RNA, 19 nt, Human
aucucacauuuucccuucc

SEQ ID NO: 1812426 - RNA, 13 nt, Human
ggaugauccccac

SEQ ID NO: 1812427 - RNA, 16 nt, Human
uuuugaugaacaaaau

SEQ ID NO: 1812428 - RNA, 22 nt, Human
cucauagacacugaucuggcug

SEQ ID NO: 1812429 - RNA, 19 nt, Human
gcagccuaacacggugcuc

SEQ ID NO: 1812430 - RNA, 13 nt, Human
ucucacacucaug

SEQ ID NO: 1812431 - RNA, 17 nt, Human
agcccuuccccucugca

SEQ ID NO: 1812432 - RNA, 17 nt, Human
gcuaauuuuuaggcuga

SEQ ID NO: 1812433 - RNA, 18 nt, Human
aggcucuaauguacaaua

SEQ ID NO: 1812434 - RNA, 21 nt, Human
cuuauuuauucauauuuucuu

SEQ ID NO: 1812435 - RNA, 14 nt, Human
agaauauauuuccu

SEQ ID NO: 1812436 - RNA, 16 nt, Human
uuucaugauuuugaaa

SEQ ID NO: 1812437 - RNA, 13 nt, Human
ucuccucucucug

SEQ ID NO: 1812438 - RNA, 17 nt, Human
caaccucugccucccag

SEQ ID NO: 1812439 - RNA, 19 nt, Human
ggccccugucucaggguga

SEQ ID NO: 1812440 - RNA, 23 nt, Human
auacuuaucuaauguugaguuau

SEQ ID NO: 1812441 - RNA, 14 nt, Human
uguuucacugugca

SEQ ID NO: 1812442 - RNA, 10 nt, Human
aaagcaggau

SEQ ID NO: 1812443 - RNA, 14 nt, Human
agggauccugccug

SEQ ID NO: 1812444 - RNA, 13 nt, Human
aaaguguuugaaa

SEQ ID NO: 1812445 - RNA, 20 nt, Human
caccauguuagccaggcugg

SEQ ID NO: 1812446 - RNA, 19 nt, Human
agacucacugugggaagga

SEQ ID NO: 1812447 - RNA, 18 nt, Human
aauuauuuugugaugcaa

SEQ ID NO: 1812448 - RNA, 18 nt, Human
uucauucaagucagcucu

SEQ ID NO: 1812449 - RNA, 22 nt, Human
ggccaugggaggccuuucccua

SEQ ID NO: 1812450 - RNA, 21 nt, Human
aauaauguuucaaacauauau

SEQ ID NO: 1812451 - RNA, 13 nt, Human
auuggagauguuu

SEQ ID NO: 1812452 - RNA, 15 nt, Human
cuaauauguaaaauu

SEQ ID NO: 1812453 - RNA, 14 nt, Human
uccuucauuuccuc

SEQ ID NO: 1812454 - RNA, 22 nt, Human
aaauguugacaugggacauuug

SEQ ID NO: 1812455 - RNA, 21 nt, Human
auucauauuuucuuucaaaau

SEQ ID NO: 1812456 - RNA, 21 nt, Human
uuaagaaccauugauuuaaug

SEQ ID NO: 1812457 - RNA, 11 nt, Human
guauggcaaac

SEQ ID NO: 1812458 - RNA, 19 nt, Human
gcuaauuuuuguauuuuua

SEQ ID NO: 1812459 - RNA, 13 nt, Human
cuauuauauuucc

SEQ ID NO: 1812460 - RNA, 21 nt, Human
ucaagcgauucuccugccuca

SEQ ID NO: 1812461 - RNA, 19 nt, Human
gauccacccgccucagccu

SEQ ID NO: 1812462 - RNA, 20 nt, Human
acuugucauuguuauauaau

SEQ ID NO: 1812463 - RNA, 20 nt, Human
auucaaguccaggcuuuuuu

SEQ ID NO: 1812464 - RNA, 16 nt, Human
cauuaaauuuuagcaa

SEQ ID NO: 1812465 - RNA, 20 nt, Human
cacuuugaacuacuagaaaa

SEQ ID NO: 1812466 - RNA, 23 nt, Human
acuuuacacaauagaauuauaac

SEQ ID NO: 1812467 - RNA, 19 nt, Human
auaugcauuauaaauaaau

SEQ ID NO: 1812468 - RNA, 17 nt, Human
gacaauuguuggagagc

SEQ ID NO: 1812469 - RNA, 16 nt, Human
ugaauuaguuuuauau

SEQ ID NO: 1812470 - RNA, 18 nt, Human
gacauuuucugccaccca

SEQ ID NO: 1812471 - RNA, 12 nt, Human
cacccucccacu

SEQ ID NO: 1812472 - RNA, 21 nt, Human
ugcagaguacuggcugaugga

SEQ ID NO: 1812473 - RNA, 21 nt, Human
guuuuuaacaugucaaucugu

SEQ ID NO: 1812474 - RNA, 12 nt, Human
uccugcaggcag

SEQ ID NO: 1812475 - RNA, 13 nt, Human
uaaguuauuuuua

SEQ ID NO: 1812476 - RNA, 12 nt, Human
cuucuauuuuua

SEQ ID NO: 1812477 - RNA, 16 nt, Human
agaacucucuggaagc

SEQ ID NO: 1812478 - RNA, 21 nt, Human
auacuauuuaauuauuucacu

SEQ ID NO: 1812479 - RNA, 21 nt, Human
cagauuuaugcauauuauuuu

SEQ ID NO: 1812480 - RNA, 14 nt, Human
agagcgcacaggga

SEQ ID NO: 1812481 - RNA, 14 nt, Human
ggccugacugccaa

SEQ ID NO: 1812482 - RNA, 16 nt, Human
auaagcuuuucuuuuc

SEQ ID NO: 1812483 - RNA, 16 nt, Human
aagcuuuuaugugaaa

SEQ ID NO: 1812484 - RNA, 20 nt, Human
gauauccucccuccagauau

SEQ ID NO: 1812485 - RNA, 16 nt, Human
aaaagcaucacaugaa

SEQ ID NO: 1812486 - RNA, 20 nt, Human
cuggccaccugcugagcccc

SEQ ID NO: 1812487 - RNA, 23 nt, Human
ccaggacccuguccaaucuuuga

SEQ ID NO: 1812488 - RNA, 15 nt, Human
acauucuaucuauuc

SEQ ID NO: 1812489 - RNA, 20 nt, Human
cgucuuaucuaaucaugaaa

SEQ ID NO: 1812490 - RNA, 22 nt, Human
auaucuuuuuuuuaauaaacca

SEQ ID NO: 1812491 - RNA, 15 nt, Human
gaaugaagcaaugcu

SEQ ID NO: 1812492 - RNA, 16 nt, Human
ggccaucaaccucugu

SEQ ID NO: 1812493 - RNA, 21 nt, Human
aauccuuuuuuauuccauaag

SEQ ID NO: 1812494 - RNA, 16 nt, Human
ggccuagacucugucu

SEQ ID NO: 1812495 - RNA, 23 nt, Human
uaacgauaaaagacagugaaaga

SEQ ID NO: 1812496 - RNA, 21 nt, Human
uaguuagccaauauuuuucuu

SEQ ID NO: 1812497 - RNA, 13 nt, Human
uggacaucaaaau

SEQ ID NO: 1812498 - RNA, 22 nt, Human
uauauugauaagaucuuuuauu

SEQ ID NO: 1812499 - RNA, 19 nt, Human
auuuguagcauccucuuua

SEQ ID NO: 1812500 - RNA, 21 nt, Human
ucuaacaaauuccaaauucuc

SEQ ID NO: 1812501 - RNA, 21 nt, Human
cagagucuuccucugucuccu

SEQ ID NO: 1812502 - RNA, 12 nt, Human
cuguuaucuuca

SEQ ID NO: 1812503 - RNA, 19 nt, Human
agguagacaguauauaacu

SEQ ID NO: 1812504 - RNA, 22 nt, Human
acauguggcccaacacaauucu

SEQ ID NO: 1812505 - RNA, 20 nt, Human
acucacauccauucuucccu

SEQ ID NO: 1812506 - RNA, 22 nt, Human
agacagagccccacccucagau

SEQ ID NO: 1812507 - RNA, 22 nt, Human
uuuuaauguguauuacaaauau

SEQ ID NO: 1812508 - RNA, 12 nt, Human
caugaauucugu

SEQ ID NO: 1812509 - RNA, 19 nt, Human
cccuucucuacacucuugu

SEQ ID NO: 1812510 - RNA, 17 nt, Human
uccugcaagcagaggug

SEQ ID NO: 1812511 - RNA, 18 nt, Human
ggaagagacagcccagga

SEQ ID NO: 1812512 - RNA, 14 nt, Human
aaagaggaaugaag

SEQ ID NO: 1812513 - RNA, 16 nt, Human
uggagacaaaaucuua

SEQ ID NO: 1812514 - RNA, 24 nt, Human
uuggauacgcaucagacagaugga

SEQ ID NO: 1812515 - RNA, 22 nt, Human
ccccuaaaagaaacccugcacc

SEQ ID NO: 1812516 - RNA, 15 nt, Human
uuccuagguauaauu

SEQ ID NO: 1812517 - RNA, 14 nt, Human
cugagagaaaauaa

SEQ ID NO: 1812518 - RNA, 18 nt, Human
ccaccaggauauccuccc

SEQ ID NO: 1812519 - RNA, 18 nt, Human
aaugaaaaaauauauauc

SEQ ID NO: 1812520 - RNA, 14 nt, Human
ggugaaagauggaa

SEQ ID NO: 1812521 - RNA, 12 nt, Human
cucauaccuucc

SEQ ID NO: 1812522 - RNA, 15 nt, Human
auguuuuuuuuuaaa

SEQ ID NO: 1812523 - RNA, 19 nt, Human
uaaggcccucuugaaucuc

SEQ ID NO: 1812524 - RNA, 21 nt, Human
ugaugcuacaggauuugaaau

SEQ ID NO: 1812525 - RNA, 19 nt, Human
uuuauggagauauaauucu

SEQ ID NO: 1812526 - RNA, 18 nt, Human
accugccaggcacacuga

SEQ ID NO: 1812527 - RNA, 19 nt, Human
cuaucucuccaaccagauu

SEQ ID NO: 1812528 - RNA, 21 nt, Human
ccacaaacccaagggcagggg

SEQ ID NO: 1812529 - RNA, 20 nt, Human
guguggaaggugaucuggcu

SEQ ID NO: 1812530 - RNA, 13 nt, Human
uuucucaauaagc

SEQ ID NO: 1812531 - RNA, 17 nt, Human
ccuaguuccuucaugua

SEQ ID NO: 1812532 - RNA, 21 nt, Human
caacacacagauuugagcuca

SEQ ID NO: 1812533 - RNA, 20 nt, Human
uucucuaucauuuaauaaua

SEQ ID NO: 1812534 - RNA, 17 nt, Human
ccuuaggccucugagaa

SEQ ID NO: 1812535 - RNA, 15 nt, Human
ccagucuuccucccu

SEQ ID NO: 1812536 - RNA, 18 nt, Human
auuccucaugaauguaaa

SEQ ID NO: 1812537 - RNA, 15 nt, Human
cagcaagucaggguu

SEQ ID NO: 1812538 - RNA, 12 nt, Human
ugugaggagcug

SEQ ID NO: 1812539 - RNA, 20 nt, Human
gccccugccuucccaggagu

SEQ ID NO: 1812540 - RNA, 23 nt, Human
aaagauuggauacgcaucagaca

SEQ ID NO: 1812541 - RNA, 13 nt, Human
ggaaggcuuccac

SEQ ID NO: 1812542 - RNA, 23 nt, Human
uaagaauucuguugauggaaaua

SEQ ID NO: 1812543 - RNA, 13 nt, Human
ccuccuuuuaaag

SEQ ID NO: 1812544 - RNA, 23 nt, Human
ggauguggggaaguuaggaacug

SEQ ID NO: 1812545 - RNA, 15 nt, Human
cugcaaacccuuuca

SEQ ID NO: 1812546 - RNA, 23 nt, Human
acuaggguggugcauuuuuguaa

SEQ ID NO: 1812547 - RNA, 22 nt, Human
uaguucuguagaaaugguugua

SEQ ID NO: 1812548 - RNA, 16 nt, Human
cugcaaacugccuucu

SEQ ID NO: 1812549 - RNA, 23 nt, Human
accgcaggauuugggcucuugga

SEQ ID NO: 1812550 - RNA, 20 nt, Human
aaacucauagacacugaucu

SEQ ID NO: 1812551 - RNA, 12 nt, Human
uuucagcccuca

SEQ ID NO: 1812552 - RNA, 20 nt, Human
agggaagacaagaaggaaag

SEQ ID NO: 1812553 - RNA, 15 nt, Human
ucuuucuuuuuuaaa

SEQ ID NO: 1812554 - RNA, 16 nt, Human
agccucagucucccuc

SEQ ID NO: 1812555 - RNA, 21 nt, Human
cucaguagucagacuggauag

SEQ ID NO: 1812556 - RNA, 18 nt, Human
uuggggcuagacaguucu

SEQ ID NO: 1812557 - RNA, 16 nt, Human
cagggcucacagaauu

SEQ ID NO: 1812558 - RNA, 20 nt, Human
ucagcccugcaccaugcugc

SEQ ID NO: 1812559 - RNA, 20 nt, Human
auauaaguguguguuuuuca

SEQ ID NO: 1812560 - RNA, 15 nt, Human
aagggccagaaauau

SEQ ID NO: 1812561 - RNA, 12 nt, Human
acauuuuuguau

SEQ ID NO: 1812562 - RNA, 22 nt, Human
ugcucacacugcugaugauuua

SEQ ID NO: 1812563 - RNA, 16 nt, Human
uaauccuuuuuuauuc

SEQ ID NO: 1812564 - RNA, 13 nt, Human
gaaauuuauaaac

SEQ ID NO: 1812565 - RNA, 18 nt, Human
gggaccuugucucccagc

SEQ ID NO: 1812566 - RNA, 14 nt, Human
acaauaaagcaaug

SEQ ID NO: 1812567 - RNA, 17 nt, Human
uuaacguuuucauuaaa

SEQ ID NO: 1812568 - RNA, 13 nt, Human
ugacauaaguauu

SEQ ID NO: 1812569 - RNA, 20 nt, Human
uugccaggcuggagugcagu

SEQ ID NO: 1812570 - RNA, 14 nt, Human
ugagguugugugug

SEQ ID NO: 1812571 - RNA, 16 nt, Human
ucucuaggaaauauuu

SEQ ID NO: 1812572 - RNA, 20 nt, Human
ucacuugguucaguaccaca

SEQ ID NO: 1812573 - RNA, 14 nt, Human
cagccucagccucc

SEQ ID NO: 1812574 - RNA, 18 nt, Human
ucaagggugugugcagca

SEQ ID NO: 1812575 - RNA, 21 nt, Human
aaaauuugccaagagccugag

SEQ ID NO: 1812576 - RNA, 16 nt, Human
agccugcagacucacu

SEQ ID NO: 1812577 - RNA, 14 nt, Human
aaguaaaaacaaag

SEQ ID NO: 1812578 - RNA, 14 nt, Human
aguccccagccugc

SEQ ID NO: 1812579 - RNA, 17 nt, Human
aauaaaaugucuauuuu

SEQ ID NO: 1812580 - RNA, 22 nt, Human
cucuccagaugagaguacaccc

SEQ ID NO: 1812581 - RNA, 18 nt, Human
gcaauccucccacuucag

SEQ ID NO: 1812582 - RNA, 17 nt, Human
augggacauuuuugacu

SEQ ID NO: 1812583 - RNA, 19 nt, Human
cggccacggugccuccaga

SEQ ID NO: 1812584 - RNA, 17 nt, Human
uuguauuuuguuuaaau

SEQ ID NO: 1812585 - RNA, 21 nt, Human
caucucagguguguugcagug

SEQ ID NO: 1812586 - RNA, 17 nt, Human
cuuugcuucauucaagu

SEQ ID NO: 1812587 - RNA, 15 nt, Human
accugaagaaucaca

SEQ ID NO: 1812588 - RNA, 21 nt, Human
cuugucucgaacuccugaccc

SEQ ID NO: 1812589 - RNA, 13 nt, Human
agcgacagugaga

SEQ ID NO: 1812590 - RNA, 21 nt, Human
uggauuuuacauguggcccaa

SEQ ID NO: 1812591 - RNA, 23 nt, Human
aagcuaucguaaaauuaagaaag

SEQ ID NO: 1812592 - RNA, 13 nt, Human
cuaccugagcuaa

SEQ ID NO: 1812593 - RNA, 18 nt, Human
agccugaucaccugcccu

SEQ ID NO: 1812594 - RNA, 23 nt, Human
cuagcagauacagggaugaggca

SEQ ID NO: 1812595 - RNA, 21 nt, Human
ugaacaaauuuacagagacag

SEQ ID NO: 1812596 - RNA, 22 nt, Human
cccaugauguuuagaaacacaa

SEQ ID NO: 1812597 - RNA, 11 nt, Human
cccuguugcua

SEQ ID NO: 1812598 - RNA, 20 nt, Human
cuguuauaauaaauguaccu

SEQ ID NO: 1812599 - RNA, 13 nt, Human
auaauauuuuuaa

SEQ ID NO: 1812600 - RNA, 15 nt, Human
acaaaugggaaacaa

SEQ ID NO: 1812601 - RNA, 21 nt, Human
ugccuccccuucacucccacc

SEQ ID NO: 1812602 - RNA, 20 nt, Human
cuuuucugcauguucuaaau

SEQ ID NO: 1812603 - RNA, 16 nt, Human
aagaaauauuccuuaa

SEQ ID NO: 1812604 - RNA, 22 nt, Human
cccugaggccuagacucugucu

SEQ ID NO: 1812605 - RNA, 18 nt, Human
auuuccuaaauauauuuu

SEQ ID NO: 1812606 - RNA, 21 nt, Human
aguggauuuuacauguggccc

SEQ ID NO: 1812607 - RNA, 21 nt, Human
cacccaguugugacaauuaaa

SEQ ID NO: 1812608 - RNA, 14 nt, Human
auuuuuaguagaga

SEQ ID NO: 1812609 - RNA, 22 nt, Human
cuaaaguaaaaacaaagaaauu

SEQ ID NO: 1812610 - RNA, 13 nt, Human
aaaauaacgauaa

SEQ ID NO: 1812611 - RNA, 23 nt, Human
gaaauaugauuuguguauuauaa

SEQ ID NO: 1812612 - RNA, 19 nt, Human
auauuuucuuucaaaauua

SEQ ID NO: 1812613 - RNA, 23 nt, Human
caucucuucuggguuccuuccuc

SEQ ID NO: 1812614 - RNA, 19 nt, Human
gugacuuaaugccacuaaa

SEQ ID NO: 1812615 - RNA, 14 nt, Human
gaaaacaauaacga

SEQ ID NO: 1812616 - RNA, 21 nt, Human
caagaccccaucucaaaaaaa

SEQ ID NO: 1812617 - RNA, 17 nt, Human
uauaguccagcuuuguu

SEQ ID NO: 1812618 - RNA, 14 nt, Human
cugcucagcccugc

SEQ ID NO: 1812619 - RNA, 16 nt, Human
aaagcccuuaggaaga

SEQ ID NO: 1812620 - RNA, 14 nt, Human
aucucaucucuucu

SEQ ID NO: 1812621 - RNA, 21 nt, Human
augagaguacaccccaacagc

SEQ ID NO: 1812622 - RNA, 23 nt, Human
ucuggacccguucaacuuuuccu

SEQ ID NO: 1812623 - RNA, 21 nt, Human
cuccaucucuugaccucguga

SEQ ID NO: 1812624 - RNA, 12 nt, Human
uauaauguaaac

SEQ ID NO: 1812625 - RNA, 13 nt, Human
ugaaauuguauua

SEQ ID NO: 1812626 - RNA, 22 nt, Human
auuuucuucucacauuuauauu

SEQ ID NO: 1812627 - RNA, 20 nt, Human
ggcagugggaaaaauguagg

SEQ ID NO: 1812628 - RNA, 20 nt, Human
caguguguggcuuucagagc

SEQ ID NO: 1812629 - RNA, 15 nt, Human
aaggauagggugaug

SEQ ID NO: 1812630 - RNA, 19 nt, Human
aguauuccagaccugaaga

SEQ ID NO: 1812631 - RNA, 17 nt, Human
uaaggaaauaagaacca

SEQ ID NO: 1812632 - RNA, 21 nt, Human
ccccagcuggggccaggcugg

SEQ ID NO: 1812633 - RNA, 15 nt, Human
uuucauugcucagaa

SEQ ID NO: 1812634 - RNA, 17 nt, Human
cccagcuggggccaggc

SEQ ID NO: 1812635 - RNA, 13 nt, Human
aguucucagaauc

SEQ ID NO: 1812636 - RNA, 11 nt, Human
auuccucugcc

SEQ ID NO: 1812637 - RNA, 22 nt, Human
ccaaacauccuacaagacacag

SEQ ID NO: 1812638 - RNA, 20 nt, Human
aaggagccaaacauccuaca

SEQ ID NO: 1812639 - RNA, 19 nt, Human
agggacucaucuuucccuc

SEQ ID NO: 1812640 - RNA, 18 nt, Human
agcacccucuccagaugg

SEQ ID NO: 1812641 - RNA, 21 nt, Human
auuucuuaaaucuaguaauuu

SEQ ID NO: 1812642 - RNA, 19 nt, Human
caucccuagucucuaccca

SEQ ID NO: 1812643 - RNA, 21 nt, Human
accaccugccuauauuuuuug

SEQ ID NO: 1812644 - RNA, 17 nt, Human
aaaugaaguggugagcu

SEQ ID NO: 1812645 - RNA, 13 nt, Human
aguuuaauuuuug

SEQ ID NO: 1812646 - RNA, 13 nt, Human
cagccugcucccu

SEQ ID NO: 1812647 - RNA, 18 nt, Human
uacaccccaacagcaccc

SEQ ID NO: 1812648 - RNA, 16 nt, Human
gcaucccuagaaagcc

SEQ ID NO: 1812649 - RNA, 12 nt, Human
uacuaaaugcuc

SEQ ID NO: 1812650 - RNA, 16 nt, Human
agucagaauagaaauu

SEQ ID NO: 1812651 - RNA, 22 nt, Human
uuagaacuucaagcucuccaaa

SEQ ID NO: 1812652 - RNA, 15 nt, Human
ccccagagccacagu

SEQ ID NO: 1812653 - RNA, 13 nt, Human
gaacauagaacuc

SEQ ID NO: 1812654 - RNA, 21 nt, Human
ucagaaucucucuucuuuuca

SEQ ID NO: 1812655 - RNA, 23 nt, Human
gagucuuacucuguugccaggcu

SEQ ID NO: 1812656 - RNA, 19 nt, Human
uuagcuccuccuuuuuccu

SEQ ID NO: 1812657 - RNA, 19 nt, Human
uccagccaggccccaagcc

SEQ ID NO: 1812658 - RNA, 16 nt, Human
ccccaucucuucuggg

SEQ ID NO: 1812659 - RNA, 15 nt, Human
auuugggcucuugga

SEQ ID NO: 1812660 - RNA, 14 nt, Human
uuuuaguuuaaaaa

SEQ ID NO: 1812661 - RNA, 13 nt, Human
ccaacguggccca

SEQ ID NO: 1812662 - RNA, 15 nt, Human
ucagucuuuuccaug

SEQ ID NO: 1812663 - RNA, 14 nt, Human
uucuaugaaauauu

SEQ ID NO: 1812664 - RNA, 19 nt, Human
cccagcuggggccaggcug

SEQ ID NO: 1812665 - RNA, 22 nt, Human
agccaugggagacacugaugua

SEQ ID NO: 1812666 - RNA, 23 nt, Human
ucuagcaugucgucaaagcugaa

SEQ ID NO: 1812667 - RNA, 20 nt, Human
uccuccuuuuuccuuccagu

SEQ ID NO: 1812668 - RNA, 22 nt, Human
agaaauaggaaauauuuuaaug

SEQ ID NO: 1812669 - RNA, 19 nt, Human
aaccaggacccuguccaau

SEQ ID NO: 1812670 - RNA, 21 nt, Human
cugagacaaauggaggccugu

SEQ ID NO: 1812671 - RNA, 15 nt, Human
agucugaugagaacu

SEQ ID NO: 1812672 - RNA, 18 nt, Human
gaaaauaacaauaaaaga

SEQ ID NO: 1812673 - RNA, 17 nt, Human
gacuuacaugauucauu

SEQ ID NO: 1812674 - RNA, 23 nt, Human
ugaucgacuugccaaauuuagau

SEQ ID NO: 1812675 - RNA, 13 nt, Human
ugcaaccucugcc

SEQ ID NO: 1812676 - RNA, 14 nt, Human
cacuggccacccaa

SEQ ID NO: 1812677 - RNA, 11 nt, Human
uagagaaguuc

SEQ ID NO: 1812678 - RNA, 11 nt, Human
agugucugcug

SEQ ID NO: 1812679 - RNA, 23 nt, Human
uuuuuucuuaccuuauugcacug

SEQ ID NO: 1812680 - RNA, 15 nt, Human
uugcucauggaauug

SEQ ID NO: 1812681 - RNA, 16 nt, Human
aauugcauuuuacuuu

SEQ ID NO: 1812682 - RNA, 16 nt, Human
aacaauaaaagacaag

SEQ ID NO: 1812683 - RNA, 14 nt, Human
uugauggaaauaca

SEQ ID NO: 1812684 - RNA, 17 nt, Human
cugcaggcagccugccu

SEQ ID NO: 1812685 - RNA, 23 nt, Human
ccucuguauuugaaucagccuac

SEQ ID NO: 1812686 - RNA, 12 nt, Human
gguauuuuaauc

SEQ ID NO: 1812687 - RNA, 17 nt, Human
ucccccuagccugccuc

SEQ ID NO: 1812688 - RNA, 14 nt, Human
caucucccaugaag

SEQ ID NO: 1812689 - RNA, 16 nt, Human
cugaucaccugcccug

SEQ ID NO: 1812690 - RNA, 16 nt, Human
gccaugugcuaguaau

SEQ ID NO: 1812691 - RNA, 23 nt, Human
uuucuuuuuuugugguuagaaaa

SEQ ID NO: 1812692 - RNA, 13 nt, Human
cccaacagcaccc

SEQ ID NO: 1812693 - RNA, 18 nt, Human
gcugucuucguauuccca

SEQ ID NO: 1812694 - RNA, 14 nt, Human
gauaaaagacagug

SEQ ID NO: 1812695 - RNA, 22 nt, Human
ucuucuauugccucugagagca

SEQ ID NO: 1812696 - RNA, 13 nt, Human
accuuuuuucuua

SEQ ID NO: 1812697 - RNA, 13 nt, Human
ucaagcugcaucu

SEQ ID NO: 1812698 - RNA, 14 nt, Human
agagagcuggaggc

SEQ ID NO: 1812699 - RNA, 22 nt, Human
uuggaaaacccagauaaagguu

SEQ ID NO: 1812700 - RNA, 16 nt, Human
cacgggggccaaggau

SEQ ID NO: 1812701 - RNA, 13 nt, Human
gcuccagcugcuc

SEQ ID NO: 1812702 - RNA, 21 nt, Human
gaaagcagggacuugaaccca

SEQ ID NO: 1812703 - RNA, 22 nt, Human
gaguaaagaauuauuuugugau

SEQ ID NO: 1812704 - RNA, 21 nt, Human
cauuuuuauaaugucccuuca

SEQ ID NO: 1812705 - RNA, 21 nt, Human
aagaugacggaugccuagagu

SEQ ID NO: 1812706 - RNA, 22 nt, Human
auccacccgccucagccuccca

SEQ ID NO: 1812707 - RNA, 23 nt, Human
ucccuauuccuccuucccuugcu

SEQ ID NO: 1812708 - RNA, 13 nt, Human
acggggugaaacc

SEQ ID NO: 1812709 - RNA, 11 nt, Human
ccccagccuca

SEQ ID NO: 1812710 - RNA, 22 nt, Human
augcucuggacuugccuccaga

SEQ ID NO: 1812711 - RNA, 14 nt, Human
cccugaggugagca

SEQ ID NO: 1812712 - RNA, 13 nt, Human
ccuaagcccuccg

SEQ ID NO: 1812713 - RNA, 17 nt, Human
gaguacaccccaacagc

SEQ ID NO: 1812714 - RNA, 16 nt, Human
caauaaauagaccauu

SEQ ID NO: 1812715 - RNA, 19 nt, Human
caagucuuauuuccucaac

SEQ ID NO: 1812716 - RNA, 20 nt, Human
ugauuucugagcauuuaaua

SEQ ID NO: 1812717 - RNA, 14 nt, Human
agagcuuaagaacc

SEQ ID NO: 1812718 - RNA, 20 nt, Human
ccaggcacacugagccagca

SEQ ID NO: 1812719 - RNA, 18 nt, Human
uuacaaaugggaaacaaa

SEQ ID NO: 1812720 - RNA, 14 nt, Human
caaaugcauuucua

SEQ ID NO: 1812721 - RNA, 13 nt, Human
auuaauauauauu

SEQ ID NO: 1812722 - RNA, 15 nt, Human
ccugccucucugcag

SEQ ID NO: 1812723 - RNA, 22 nt, Human
cuucucuguucauuuccucaaa

SEQ ID NO: 1812724 - RNA, 13 nt, Human
ccacuggacugac

SEQ ID NO: 1812725 - RNA, 14 nt, Human
cagccaccagucca

SEQ ID NO: 1812726 - RNA, 14 nt, Human
uugugguuagaaaa

SEQ ID NO: 1812727 - RNA, 20 nt, Human
ccaccuugcagcucuccccu

SEQ ID NO: 1812728 - RNA, 14 nt, Human
agguuaucuuggaa

SEQ ID NO: 1812729 - RNA, 16 nt, Human
agcaguugagacaaga

SEQ ID NO: 1812730 - RNA, 21 nt, Human
cuuguccccaacaccccacag

SEQ ID NO: 1812731 - RNA, 16 nt, Human
uagccagugaaaaacu

SEQ ID NO: 1812732 - RNA, 14 nt, Human
gaaaauuuaaaaca

SEQ ID NO: 1812733 - RNA, 15 nt, Human
ccucccacuucagcc

SEQ ID NO: 1812734 - RNA, 15 nt, Human
cugccugcuuuuuau

SEQ ID NO: 1812735 - RNA, 20 nt, Human
gagcuuaacccuggaaaaug

SEQ ID NO: 1812736 - RNA, 14 nt, Human
gcuggcgugcagca

SEQ ID NO: 1812737 - RNA, 18 nt, Human
aauuaaagcuguuauuua

SEQ ID NO: 1812738 - RNA, 16 nt, Human
cuguaugaguggaaau

SEQ ID NO: 1812739 - RNA, 16 nt, Human
aaaagcuauaaaauga

SEQ ID NO: 1812740 - RNA, 16 nt, Human
uuuucccccacaaacc

SEQ ID NO: 1812741 - RNA, 18 nt, Human
ccuuucuucucuccagug

SEQ ID NO: 1812742 - RNA, 22 nt, Human
cccuggauugaucggagccucc

SEQ ID NO: 1812743 - RNA, 16 nt, Human
acugcuugaacuaggc

SEQ ID NO: 1812744 - RNA, 13 nt, Human
caacaucuaguga

SEQ ID NO: 1812745 - RNA, 15 nt, Human
agucagcucuucucc

SEQ ID NO: 1812746 - RNA, 21 nt, Human
cagauacagggaugaggcaga

SEQ ID NO: 1812747 - RNA, 16 nt, Human
auuauacccccugcaa

SEQ ID NO: 1812748 - RNA, 15 nt, Human
uauagaccuaaaaua

SEQ ID NO: 1812749 - RNA, 15 nt, Human
uuauuagaaguuuca

SEQ ID NO: 1812750 - RNA, 20 nt, Human
gaaaauaacgauaaaagaca

SEQ ID NO: 1812751 - RNA, 19 nt, Human
ugcacacagcacgggggcc

SEQ ID NO: 1812752 - RNA, 16 nt, Human
auuaucuaguuuaauu

SEQ ID NO: 1812753 - RNA, 23 nt, Human
caagcugcaucuagaggcuuccu

SEQ ID NO: 1812754 - RNA, 12 nt, Human
uuauucacugua

SEQ ID NO: 1812755 - RNA, 19 nt, Human
cagcuucucauccugcagg

SEQ ID NO: 1812756 - RNA, 22 nt, Human
ugauaguuguaccgcaauguga

SEQ ID NO: 1812757 - RNA, 16 nt, Human
aauucauccucacuca

SEQ ID NO: 1812758 - RNA, 16 nt, Human
ccaggaguacacccca

SEQ ID NO: 1812759 - RNA, 13 nt, Human
uccuacuuccccu

SEQ ID NO: 1812760 - RNA, 15 nt, Human
aguuucuucuuuagg

SEQ ID NO: 1812761 - RNA, 12 nt, Human
uugguuucccuu

SEQ ID NO: 1812762 - RNA, 14 nt, Human
cuuauuaauuugac

SEQ ID NO: 1812763 - RNA, 22 nt, Human
cagugacagcagucagggacag

SEQ ID NO: 1812764 - RNA, 16 nt, Human
aaaguguuugaaagcu

SEQ ID NO: 1812765 - RNA, 21 nt, Human
ggaaagaauaaccaacacccu

SEQ ID NO: 1812766 - RNA, 16 nt, Human
uauguuuugacauuuu

SEQ ID NO: 1812767 - RNA, 22 nt, Human
aauuuuagacauucuuuaucuu

SEQ ID NO: 1812768 - RNA, 22 nt, Human
agagaguggcuggggcauggaa

SEQ ID NO: 1812769 - RNA, 21 nt, Human
agaaagcaguugagacaagaa

SEQ ID NO: 1812770 - RNA, 19 nt, Human
aguccuucccuuucauuuu

SEQ ID NO: 1812771 - RNA, 18 nt, Human
aaguuugaauguuaaaua

SEQ ID NO: 1812772 - RNA, 14 nt, Human
gagaguacacccca

SEQ ID NO: 1812773 - RNA, 13 nt, Human
cugccuucucaac

SEQ ID NO: 1812774 - RNA, 20 nt, Human
uucccaggaguacaccccaa

SEQ ID NO: 1812775 - RNA, 20 nt, Human
cagugccgacagcucuccaa

SEQ ID NO: 1812776 - RNA, 15 nt, Human
uaaugaauuaaagaa

SEQ ID NO: 1812777 - RNA, 20 nt, Human
ggguaccuaguccccagccu

SEQ ID NO: 1812778 - RNA, 17 nt, Human
ggccuggggagauggag

SEQ ID NO: 1812779 - RNA, 16 nt, Human
aacccauucccucucc

SEQ ID NO: 1812780 - RNA, 20 nt, Human
auacauuuucuaagaaacau

SEQ ID NO: 1812781 - RNA, 19 nt, Human
gccuggcgggguggggugg

SEQ ID NO: 1812782 - RNA, 17 nt, Human
ccuauuccuccuucccu

SEQ ID NO: 1812783 - RNA, 18 nt, Human
ccuucggccuccauccug

SEQ ID NO: 1812784 - RNA, 18 nt, Human
caguuguugcccacagcu

SEQ ID NO: 1812785 - RNA, 15 nt, Human
ccgucaccucagaga

SEQ ID NO: 1812786 - RNA, 20 nt, Human
uaauauauauuaucuuuuca

SEQ ID NO: 1812787 - RNA, 13 nt, Human
cuaaacucagagg

SEQ ID NO: 1812788 - RNA, 21 nt, Human
auuuuaguaagagauuccuga

SEQ ID NO: 1812789 - RNA, 19 nt, Human
uaaaguaaaaacaaagaaa

SEQ ID NO: 1812790 - RNA, 15 nt, Human
uaaaaggaaaugcuc

SEQ ID NO: 1812791 - RNA, 14 nt, Human
ccacccgccucagc

SEQ ID NO: 1812792 - RNA, 20 nt, Human
gcccugcaccaugcugcugg

SEQ ID NO: 1812793 - RNA, 14 nt, Human
cuacaaaaaaaaaa

SEQ ID NO: 1812794 - RNA, 15 nt, Human
gucacugacacacac

SEQ ID NO: 1812795 - RNA, 16 nt, Human
uaacaggcaaaaggaa

SEQ ID NO: 1812796 - RNA, 16 nt, Human
ccuccuguccagccug

SEQ ID NO: 1812797 - RNA, 15 nt, Human
aguuugaauguuaaa

SEQ ID NO: 1812798 - RNA, 14 nt, Human
aaccagauugucag

SEQ ID NO: 1812799 - RNA, 16 nt, Human
cauguuucaggagaga

SEQ ID NO: 1812800 - RNA, 18 nt, Human
augaugauuucagcaggg

SEQ ID NO: 1812801 - RNA, 20 nt, Human
cagcgauuaauaacaggcaa

SEQ ID NO: 1812802 - RNA, 16 nt, Human
ugaccaaccuuuuccc

SEQ ID NO: 1812803 - RNA, 20 nt, Human
accacaagggucacaauacu

SEQ ID NO: 1812804 - RNA, 12 nt, Human
aagauuuaaauu

SEQ ID NO: 1812805 - RNA, 12 nt, Human
cuaguccccagc

SEQ ID NO: 1812806 - RNA, 18 nt, Human
gcaccaugcugcugggga

SEQ ID NO: 1812807 - RNA, 15 nt, Human
ugauuauuauuuuag

SEQ ID NO: 1812808 - RNA, 22 nt, Human
aucuauguagaauauauuuccu

SEQ ID NO: 1812809 - RNA, 12 nt, Human
ggaauuuuauuu

SEQ ID NO: 1812810 - RNA, 14 nt, Human
uucaggucuuucuu

SEQ ID NO: 1812811 - RNA, 18 nt, Human
ucagcccccuaagccccc

SEQ ID NO: 1812812 - RNA, 15 nt, Human
ucuaugaaauauuau

SEQ ID NO: 1812813 - RNA, 16 nt, Human
ggcugcucagggcugg

SEQ ID NO: 1812814 - RNA, 14 nt, Human
ugccagauuuaugc

SEQ ID NO: 1812815 - RNA, 21 nt, Human
uugacuagaaaauuuaaaaca

SEQ ID NO: 1812816 - RNA, 13 nt, Human
uuccgacugccau

SEQ ID NO: 1812817 - RNA, 20 nt, Human
aucuauguagaauauauuuc

SEQ ID NO: 1812818 - RNA, 13 nt, Human
gggcuauuuuuuc

SEQ ID NO: 1812819 - RNA, 19 nt, Human
accagauuuuuacacaugu

SEQ ID NO: 1812820 - RNA, 16 nt, Human
agcuugaaaccuucac

SEQ ID NO: 1812821 - RNA, 16 nt, Human
uaaauaaaaagcauua

SEQ ID NO: 1812822 - RNA, 12 nt, Human
ugcucagcccug

SEQ ID NO: 1812823 - RNA, 14 nt, Human
uauguauauuuuau

SEQ ID NO: 1812824 - RNA, 22 nt, Human
uaacacccagucuguuccccau

SEQ ID NO: 1812825 - RNA, 18 nt, Human
auuugcuggagcucugcc

SEQ ID NO: 1812826 - RNA, 22 nt, Human
aauuguauuuuaguaagagauu

SEQ ID NO: 1812827 - RNA, 16 nt, Human
acugaugacuuuuuau

SEQ ID NO: 1812828 - RNA, 17 nt, Human
ccucugucuccuaagcu

SEQ ID NO: 1812829 - RNA, 19 nt, Human
uuaucuuuucauacauuuu

SEQ ID NO: 1812830 - RNA, 16 nt, Human
aucaauuuaaaaaaaa

SEQ ID NO: 1812831 - RNA, 20 nt, Human
gauuacaggugugagccacc

SEQ ID NO: 1812832 - RNA, 18 nt, Human
uuaaauagagaaauauga

SEQ ID NO: 1812833 - RNA, 15 nt, Human
agacucugucuaccu

SEQ ID NO: 1812834 - RNA, 14 nt, Human
caucucaggugugu

SEQ ID NO: 1812835 - RNA, 13 nt, Human
uguggcagagcca

SEQ ID NO: 1812836 - RNA, 17 nt, Human
uaacugauuuguaacaa

SEQ ID NO: 1812837 - RNA, 15 nt, Human
auccccuucuccccu

SEQ ID NO: 1812838 - RNA, 21 nt, Human
uauuguugcauuaaaaaugca

SEQ ID NO: 1812839 - RNA, 20 nt, Human
agccccaucuccucagcacc

SEQ ID NO: 1812840 - RNA, 20 nt, Human
gcaaauaucuugaaaggggu

SEQ ID NO: 1812841 - RNA, 14 nt, Human
aaaagcuauaaaau

SEQ ID NO: 1812842 - RNA, 18 nt, Human
agucgguuaguggaagca

SEQ ID NO: 1812843 - RNA, 13 nt, Human
ggcuccucaggga

SEQ ID NO: 1812844 - RNA, 20 nt, Human
aaucuuucuuucuuagaaau

SEQ ID NO: 1812845 - RNA, 16 nt, Human
auuucuuuuuuaaaug

SEQ ID NO: 1812846 - RNA, 15 nt, Human
uguuugcucagcuuc

SEQ ID NO: 1812847 - RNA, 22 nt, Human
gucccugcagcucucuuuccuc

SEQ ID NO: 1812848 - RNA, 18 nt, Human
cacccaaacggaggcagc

SEQ ID NO: 1812849 - RNA, 15 nt, Human
auuuauucauauuuu

SEQ ID NO: 1812850 - RNA, 22 nt, Human
ggcuggggcauggaaggcaaga

SEQ ID NO: 1812851 - RNA, 21 nt, Human
gauggcuuugaaugcggccca

SEQ ID NO: 1812852 - RNA, 17 nt, Human
gccuccuuuuaaaguaa

SEQ ID NO: 1812853 - RNA, 13 nt, Human
auuaggaaaaguu

SEQ ID NO: 1812854 - RNA, 23 nt, Human
gcaaugccugcccauuggagaga

SEQ ID NO: 1812855 - RNA, 14 nt, Human
ggcucagauuauaa

SEQ ID NO: 1812856 - RNA, 23 nt, Human
cccccuagccugccuccccugcc

SEQ ID NO: 1812857 - RNA, 20 nt, Human
gcugcuggggaagacagugg

SEQ ID NO: 1812858 - RNA, 13 nt, Human
uuaucuauuuaaa

SEQ ID NO: 1812859 - RNA, 23 nt, Human
uggaggcggaauugcucucccag

SEQ ID NO: 1812860 - RNA, 22 nt, Human
gcucuucauguuucaggagaga

SEQ ID NO: 1812861 - RNA, 11 nt, Human
ucaccuccccc

SEQ ID NO: 1812862 - RNA, 11 nt, Human
aucugaaaauu

SEQ ID NO: 1812863 - RNA, 17 nt, Human
uaaacacauuaggaaaa

SEQ ID NO: 1812864 - RNA, 20 nt, Human
agcugcucugucuucuuugc

SEQ ID NO: 1812865 - RNA, 15 nt, Human
uccuccuuuuuccuu

SEQ ID NO: 1812866 - RNA, 16 nt, Human
ugcuauugaaguuuug

SEQ ID NO: 1812867 - RNA, 16 nt, Human
uuguacauauaaguga

SEQ ID NO: 1812868 - RNA, 22 nt, Human
acguuaagaauuguuaaaggcu

SEQ ID NO: 1812869 - RNA, 16 nt, Human
cgcauggaaaaguuuc

SEQ ID NO: 1812870 - RNA, 20 nt, Human
uaauaccacagcuuuuuacc

SEQ ID NO: 1812871 - RNA, 20 nt, Human
ugaguuacacuggaugaaaa

SEQ ID NO: 1812872 - RNA, 13 nt, Human
ucucccucccuug

SEQ ID NO: 1812873 - RNA, 21 nt, Human
cugcccugcugagucccaggc

SEQ ID NO: 1812874 - RNA, 19 nt, Human
uaaaaaaggaauccucugu

SEQ ID NO: 1812875 - RNA, 16 nt, Human
uaucucaucucuucuu

SEQ ID NO: 1812876 - RNA, 17 nt, Human
ugaagguggaaauaaac

SEQ ID NO: 1812877 - RNA, 20 nt, Human
uaaaccuuuuuggacacaca

SEQ ID NO: 1812878 - RNA, 21 nt, Human
aacuuguaaaggaauuuaaaa

SEQ ID NO: 1812879 - RNA, 13 nt, Human
ucuuucuuagaaa

SEQ ID NO: 1812880 - RNA, 14 nt, Human
uauuaugcauuaua

SEQ ID NO: 1812881 - RNA, 22 nt, Human
ucuauaauguaaacaauaucag

SEQ ID NO: 1812882 - RNA, 19 nt, Human
acuugaaaauuaacaugaa

SEQ ID NO: 1812883 - RNA, 14 nt, Human
cugagcaaucugac

SEQ ID NO: 1812884 - RNA, 14 nt, Human
auauauauacauac

SEQ ID NO: 1812885 - RNA, 14 nt, Human
cauauacagcucag

SEQ ID NO: 1812886 - RNA, 21 nt, Human
cgacagugagacucugucuca

SEQ ID NO: 1812887 - RNA, 20 nt, Human
gaaagggauuuucagcccuc

SEQ ID NO: 1812888 - RNA, 14 nt, Human
cuaaaauuguauag

SEQ ID NO: 1812889 - RNA, 15 nt, Human
uuguauaucuuguuu

SEQ ID NO: 1812890 - RNA, 22 nt, Human
acauccuaagcucaucuauuuc

SEQ ID NO: 1812891 - RNA, 19 nt, Human
cuucuggguuccuuccucu

SEQ ID NO: 1812892 - RNA, 22 nt, Human
ccucuccaccaucgucuucuug

SEQ ID NO: 1812893 - RNA, 23 nt, Human
gggaaacaaaaggauaaugaaua

SEQ ID NO: 1812894 - RNA, 16 nt, Human
cuacuagaaaauugug

SEQ ID NO: 1812895 - RNA, 16 nt, Human
uuuauauuugaaauau

SEQ ID NO: 1812896 - RNA, 13 nt, Human
ugcauuucuaaag

SEQ ID NO: 1812897 - RNA, 23 nt, Human
cucaaagagggagugcauuuaug

SEQ ID NO: 1812898 - RNA, 20 nt, Human
gaacaaacagggcugccuuc

SEQ ID NO: 1812899 - RNA, 22 nt, Human
cuccuccagggagucucagcuu

SEQ ID NO: 1812900 - RNA, 14 nt, Human
caugagucagucug

SEQ ID NO: 1812901 - RNA, 14 nt, Human
auuuuaucugcuau

SEQ ID NO: 1812902 - RNA, 17 nt, Human
ugcuuaaggccaugauu

SEQ ID NO: 1812903 - RNA, 20 nt, Human
uaugaguggcuuuaaugaau

SEQ ID NO: 1812904 - RNA, 16 nt, Human
cugauuauuuucuaca

SEQ ID NO: 1812905 - RNA, 21 nt, Human
agccgucaaaagagucuuaau

SEQ ID NO: 1812906 - RNA, 15 nt, Human
ucuucacuugucauu

SEQ ID NO: 1812907 - RNA, 15 nt, Human
gcaaucauggugcuc

SEQ ID NO: 1812908 - RNA, 15 nt, Human
gccuugggaccccug

SEQ ID NO: 1812909 - RNA, 10 nt, Human
aauagggcaa

SEQ ID NO: 1812910 - RNA, 17 nt, Human
ccagguuggagugcagu

SEQ ID NO: 1812911 - RNA, 14 nt, Human
ggaaaagaaaaaga

SEQ ID NO: 1812912 - RNA, 15 nt, Human
guaaggggaauugag

SEQ ID NO: 1812913 - RNA, 17 nt, Human
acucaccucccccaucu

SEQ ID NO: 1812914 - RNA, 19 nt, Human
aagggagauucagacuguu

SEQ ID NO: 1812915 - RNA, 20 nt, Human
acacagucuaacaaauucca

SEQ ID NO: 1812916 - RNA, 22 nt, Human
auucaaaggcauuucuuuucug

SEQ ID NO: 1812917 - RNA, 16 nt, Human
acaaugcuuugccccu

SEQ ID NO: 1812918 - RNA, 16 nt, Human
uuucuuuguuaaaaua

SEQ ID NO: 1812919 - RNA, 19 nt, Human
cugugugcucaggagcccu

SEQ ID NO: 1812920 - RNA, 15 nt, Human
guuuuagugauuuua

SEQ ID NO: 1812921 - RNA, 17 nt, Human
uacgcucauuguagaaa

SEQ ID NO: 1812922 - RNA, 17 nt, Human
guuagccaauauuuuuc

SEQ ID NO: 1812923 - RNA, 19 nt, Human
uuccucagacucuaagaaa

SEQ ID NO: 1812924 - RNA, 22 nt, Human
cuccugaggaugugucccaucu

SEQ ID NO: 1812925 - RNA, 15 nt, Human
aacucaucuagguaa

SEQ ID NO: 1812926 - RNA, 17 nt, Human
uuuuaauuucugcaaau

SEQ ID NO: 1812927 - RNA, 13 nt, Human
ugauuacauuuua

SEQ ID NO: 1812928 - RNA, 15 nt, Human
acaaagggggaggcu

SEQ ID NO: 1812929 - RNA, 19 nt, Human
ccuuagcccuuccccucug

SEQ ID NO: 1812930 - RNA, 16 nt, Human
auacuuuaauaaaugu

SEQ ID NO: 1812931 - RNA, 22 nt, Human
ggacaguaaaauccacagacca

SEQ ID NO: 1812932 - RNA, 21 nt, Human
caaagugagcuccuaagccau

SEQ ID NO: 1812933 - RNA, 13 nt, Human
cacuggggugugu

SEQ ID NO: 1812934 - RNA, 22 nt, Human
uuuugagauggagucuugcucu

SEQ ID NO: 1812935 - RNA, 15 nt, Human
caacguggcccagag

SEQ ID NO: 1812936 - RNA, 15 nt, Human
aaucucaauauuuca

SEQ ID NO: 1812937 - RNA, 14 nt, Human
guuuuacaaagggg

SEQ ID NO: 1812938 - RNA, 13 nt, Human
ucauuguagaaaa

SEQ ID NO: 1812939 - RNA, 21 nt, Human
uaacuccuaggaaaauacuau

SEQ ID NO: 1812940 - RNA, 22 nt, Human
cugagcagugcuugaaugaagu

SEQ ID NO: 1812941 - RNA, 15 nt, Human
uuaaacuaaggcccu

SEQ ID NO: 1812942 - RNA, 16 nt, Human
ugacaagcucacagac

SEQ ID NO: 1812943 - RNA, 19 nt, Human
gagucacucacauccauuc

SEQ ID NO: 1812944 - RNA, 13 nt, Human
auaccauauacag

SEQ ID NO: 1812945 - RNA, 13 nt, Human
gccaaaccaggac

SEQ ID NO: 1812946 - RNA, 16 nt, Human
uacauuuguauaaaau

SEQ ID NO: 1812947 - RNA, 17 nt, Human
auaagagcuuaagaacc

SEQ ID NO: 1812948 - RNA, 16 nt, Human
ugauuccaucuugccc

SEQ ID NO: 1812949 - RNA, 18 nt, Human
cuccccuucacucccacc

SEQ ID NO: 1812950 - RNA, 16 nt, Human
uccacauuucccccua

SEQ ID NO: 1812951 - RNA, 20 nt, Human
uucauacauuuucuaagaaa

SEQ ID NO: 1812952 - RNA, 19 nt, Human
aaccuuaccagauuuuuac

SEQ ID NO: 1812953 - RNA, 17 nt, Human
cccuagccugccucccc

SEQ ID NO: 1812954 - RNA, 20 nt, Human
auccagaaagaaaacuugua

SEQ ID NO: 1812955 - RNA, 22 nt, Human
ucugcuaugcuauugaaguuuu

SEQ ID NO: 1812956 - RNA, 16 nt, Human
aaacaauaucagacuu

SEQ ID NO: 1812957 - RNA, 22 nt, Human
gcaguuugguuucuagcaugaa

SEQ ID NO: 1812958 - RNA, 16 nt, Human
ucccaggaguacaccc

SEQ ID NO: 1812959 - RNA, 21 nt, Human
ugaaaaaauauauaucaaaua

SEQ ID NO: 1812960 - RNA, 14 nt, Human
uuucauacauuuuc

SEQ ID NO: 1812961 - RNA, 20 nt, Human
auucagggcuauuuuuuccc

SEQ ID NO: 1812962 - RNA, 22 nt, Human
cccaagggcaggggccacucuu

SEQ ID NO: 1812963 - RNA, 16 nt, Human
uccccaugguuuuaau

SEQ ID NO: 1812964 - RNA, 21 nt, Human
guaaaucagacuaugaaguuu

SEQ ID NO: 1812965 - RNA, 17 nt, Human
uccuccauaucucccuc

SEQ ID NO: 1812966 - RNA, 19 nt, Human
agcuggggccaggcugggu

SEQ ID NO: 1812967 - RNA, 15 nt, Human
acucaucauuuccau

SEQ ID NO: 1812968 - RNA, 19 nt, Human
cagacucuaagaaagaaca

SEQ ID NO: 1812969 - RNA, 18 nt, Human
gguccuuaggccucugag

SEQ ID NO: 1812970 - RNA, 12 nt, Human
agcuguugugug

SEQ ID NO: 1812971 - RNA, 22 nt, Human
uaugauguacauguacugauua

SEQ ID NO: 1812972 - RNA, 12 nt, Human
uugucuuuuccu

SEQ ID NO: 1812973 - RNA, 17 nt, Human
gcuaauuauauaauauu

SEQ ID NO: 1812974 - RNA, 17 nt, Human
auguuucauaagaauuc

SEQ ID NO: 1812975 - RNA, 15 nt, Human
cuccucaacucugag

SEQ ID NO: 1812976 - RNA, 19 nt, Human
aagcuuguauuccuuuuuc

SEQ ID NO: 1812977 - RNA, 17 nt, Human
caaacuggggccucccu

SEQ ID NO: 1812978 - RNA, 18 nt, Human
cucucuggaagccccugg

SEQ ID NO: 1812979 - RNA, 13 nt, Human
gcuuaguucaagu

SEQ ID NO: 1812980 - RNA, 22 nt, Human
cucugagccuugggaccccuga

SEQ ID NO: 1812981 - RNA, 19 nt, Human
aaguugcauagguuuaaua

SEQ ID NO: 1812982 - RNA, 17 nt, Human
uugagacaagaaaauaa

SEQ ID NO: 1812983 - RNA, 12 nt, Human
aguguuugaaag

SEQ ID NO: 1812984 - RNA, 21 nt, Human
cuguguauuuaacugccuugu

SEQ ID NO: 1812985 - RNA, 15 nt, Human
gcucagguggugagu

SEQ ID NO: 1812986 - RNA, 18 nt, Human
uacgcaucagacagaugg

SEQ ID NO: 1812987 - RNA, 23 nt, Human
aacguggcuuuuuuuuuuucccu

SEQ ID NO: 1812988 - RNA, 13 nt, Human
ucucuccaaccag

SEQ ID NO: 1812989 - RNA, 18 nt, Human
caaggcugauuaaaccaa

SEQ ID NO: 1812990 - RNA, 22 nt, Human
ugccucugcacacccuccagag

SEQ ID NO: 1812991 - RNA, 19 nt, Human
agccaccacauccagccua

SEQ ID NO: 1812992 - RNA, 20 nt, Human
ugagucccaggcugagccuc

SEQ ID NO: 1812993 - RNA, 13 nt, Human
ucuggacuugccu

SEQ ID NO: 1812994 - RNA, 16 nt, Human
cucaggcaaucugccc

SEQ ID NO: 1812995 - RNA, 21 nt, Human
agaaagucuuauuuauucaua

SEQ ID NO: 1812996 - RNA, 15 nt, Human
cuucccaaaguccug

SEQ ID NO: 1812997 - RNA, 15 nt, Human
uuaauucugaaagca

SEQ ID NO: 1812998 - RNA, 22 nt, Human
aggcuccccuccucggcuuccu

SEQ ID NO: 1812999 - RNA, 13 nt, Human
cacuuugaagagu

SEQ ID NO: 1813000 - RNA, 21 nt, Human
uaaacacucuugaaaaaugca

SEQ ID NO: 1813001 - RNA, 22 nt, Human
auuuagcaggaagcugugagag

SEQ ID NO: 1813002 - RNA, 13 nt, Human
uacuuuauuuucu

SEQ ID NO: 1813003 - RNA, 14 nt, Human
cauagaaguaaaaa

SEQ ID NO: 1813004 - RNA, 22 nt, Human
aaaaguuuuuuauuaugcauua

SEQ ID NO: 1813005 - RNA, 18 nt, Human
agcuauaaaaugaauaca

SEQ ID NO: 1813006 - RNA, 19 nt, Human
uggagagccccucacacag

SEQ ID NO: 1813007 - RNA, 17 nt, Human
agcuuggaaaggaccag

SEQ ID NO: 1813008 - RNA, 17 nt, Human
aagacagugaaagaaaa

SEQ ID NO: 1813009 - RNA, 19 nt, Human
agucaaauugugugaaagg

SEQ ID NO: 1813010 - RNA, 14 nt, Human
gugcuucuuucuuu

SEQ ID NO: 1813011 - RNA, 14 nt, Human
uauuauccccauuu

SEQ ID NO: 1813012 - RNA, 16 nt, Human
uagaaaguugauuuua

SEQ ID NO: 1813013 - RNA, 15 nt, Human
ucauaauaaguugca

SEQ ID NO: 1813014 - RNA, 17 nt, Human
ucaccuguuauaauaaa

SEQ ID NO: 1813015 - RNA, 19 nt, Human
augcgccaccauggccagc

SEQ ID NO: 1813016 - RNA, 16 nt, Human
acacaccaccacgccu

SEQ ID NO: 1813017 - RNA, 17 nt, Human
cuaaagcccagagacag

SEQ ID NO: 1813018 - RNA, 16 nt, Human
uggauaggcacaggaa

SEQ ID NO: 1813019 - RNA, 15 nt, Human
ugcugaacucccucu

SEQ ID NO: 1813020 - RNA, 13 nt, Human
cucucucaaacug

SEQ ID NO: 1813021 - RNA, 20 nt, Human
ugcuaggguuaggagguccu

SEQ ID NO: 1813022 - RNA, 19 nt, Human
auuguauuuuaguaagaga

SEQ ID NO: 1813023 - RNA, 15 nt, Human
cuacuaauuuuaaaa

SEQ ID NO: 1813024 - RNA, 17 nt, Human
aaagaccauuuuuccuc

SEQ ID NO: 1813025 - RNA, 13 nt, Human
cacaccaggcuug

SEQ ID NO: 1813026 - RNA, 22 nt, Human
cacagcccuuuugucucugcaa

SEQ ID NO: 1813027 - RNA, 15 nt, Human
caggaguauccucuu

SEQ ID NO: 1813028 - RNA, 17 nt, Human
gcuuucuuuuuuuucuu

SEQ ID NO: 1813029 - RNA, 17 nt, Human
ccaccugcugagcccca

SEQ ID NO: 1813030 - RNA, 16 nt, Human
cuggccuucggccucc

SEQ ID NO: 1813031 - RNA, 12 nt, Human
gaugagagaaca

SEQ ID NO: 1813032 - RNA, 15 nt, Human
uauuccuagaaacug

SEQ ID NO: 1813033 - RNA, 22 nt, Human
gugaacaaauuuacagagacag

SEQ ID NO: 1813034 - RNA, 18 nt, Human
caggaucguuuuuuccca

SEQ ID NO: 1813035 - RNA, 23 nt, Human
aucacagcuacuugggaggcuga

SEQ ID NO: 1813036 - RNA, 21 nt, Human
cccuggacugugugcucagga

SEQ ID NO: 1813037 - RNA, 22 nt, Human
agguucuuucuuuaaagcagga

SEQ ID NO: 1813038 - RNA, 14 nt, Human
ccucccaagcaguu

SEQ ID NO: 1813039 - RNA, 14 nt, Human
cauacucuguaaca

SEQ ID NO: 1813040 - RNA, 18 nt, Human
aauguacaauaaagcaau

SEQ ID NO: 1813041 - RNA, 16 nt, Human
caugugucuucugccc

SEQ ID NO: 1813042 - RNA, 21 nt, Human
ucaaaaagauuuccccauuua

SEQ ID NO: 1813043 - RNA, 12 nt, Human
cuccauuuuuag

SEQ ID NO: 1813044 - RNA, 16 nt, Human
aauuuugaaaaacugc

SEQ ID NO: 1813045 - RNA, 16 nt, Human
ugcauauacuuuaaua

SEQ ID NO: 1813046 - RNA, 20 nt, Human
ccacaggcacagguccccag

SEQ ID NO: 1813047 - RNA, 21 nt, Human
aaaagguauuuuaaucaccaa

SEQ ID NO: 1813048 - RNA, 17 nt, Human
uaaauuuaucauuuagu

SEQ ID NO: 1813049 - RNA, 20 nt, Human
gagaguacaccccaacagca

SEQ ID NO: 1813050 - RNA, 18 nt, Human
ucaccuuaggaauaaucu

SEQ ID NO: 1813051 - RNA, 20 nt, Human
aacaguuuuugcuaauuuuu

SEQ ID NO: 1813052 - RNA, 13 nt, Human
ccacauccagccu

SEQ ID NO: 1813053 - RNA, 20 nt, Human
ccggagaaccccaggacgcc

SEQ ID NO: 1813054 - RNA, 23 nt, Human
agaggcaccugucccagaaaaag

SEQ ID NO: 1813055 - RNA, 13 nt, Human
cugccacccaaac

SEQ ID NO: 1813056 - RNA, 22 nt, Human
caccagucugacuguuuccauc

SEQ ID NO: 1813057 - RNA, 22 nt, Human
guacacugccuucucaacucca

SEQ ID NO: 1813058 - RNA, 22 nt, Human
acacauguaucuaugcauuuuc

SEQ ID NO: 1813059 - RNA, 20 nt, Human
gcugcccccagagccacagu

SEQ ID NO: 1813060 - RNA, 13 nt, Human
caucugagaaaag

SEQ ID NO: 1813061 - RNA, 17 nt, Human
ugauugcugguuuuagu

SEQ ID NO: 1813062 - RNA, 23 nt, Human
ccaggaguacaccccaacagcac

SEQ ID NO: 1813063 - RNA, 17 nt, Human
auaucaauuuaaaaaaa

SEQ ID NO: 1813064 - RNA, 16 nt, Human
uggcuuuuuuuuuuuc

SEQ ID NO: 1813065 - RNA, 23 nt, Human
aauaaaccuuuuuggacacacaa

SEQ ID NO: 1813066 - RNA, 22 nt, Human
ccucgugauccacccgccucag

SEQ ID NO: 1813067 - RNA, 22 nt, Human
aguacuucuugauaccugggau

SEQ ID NO: 1813068 - RNA, 13 nt, Human
gggcugaagcugu

SEQ ID NO: 1813069 - RNA, 17 nt, Human
cuugccuugcugaacuc

SEQ ID NO: 1813070 - RNA, 14 nt, Human
gaacgagacaagca

SEQ ID NO: 1813071 - RNA, 18 nt, Human
uccuaguucuguagaaau

SEQ ID NO: 1813072 - RNA, 20 nt, Human
uguaaguuagguaacuguau

SEQ ID NO: 1813073 - RNA, 20 nt, Human
gaacuagccaaaccaggacc

SEQ ID NO: 1813074 - RNA, 22 nt, Human
cuacaggcgugagccaccaugc

SEQ ID NO: 1813075 - RNA, 20 nt, Human
accacucauaauucuucacc

SEQ ID NO: 1813076 - RNA, 17 nt, Human
augucauuucauuuccu

SEQ ID NO: 1813077 - RNA, 13 nt, Human
caacucccugccc

SEQ ID NO: 1813078 - RNA, 23 nt, Human
acccuuucauaaagucuugccuu

SEQ ID NO: 1813079 - RNA, 15 nt, Human
aagucuuauuuauuc

SEQ ID NO: 1813080 - RNA, 16 nt, Human
uacugugcccagagcc

SEQ ID NO: 1813081 - RNA, 23 nt, Human
caugcugucuacacuaagagaga

SEQ ID NO: 1813082 - RNA, 17 nt, Human
gauaucucaucucuucu

SEQ ID NO: 1813083 - RNA, 11 nt, Human
gucuucugccc

SEQ ID NO: 1813084 - RNA, 18 nt, Human
auuuugaaaaacugcuca

SEQ ID NO: 1813085 - RNA, 22 nt, Human
auuucuuuuuuaaaugaagaaa

SEQ ID NO: 1813086 - RNA, 15 nt, Human
ugauccagaaagaaa

SEQ ID NO: 1813087 - RNA, 12 nt, Human
gcugaugcaguu

SEQ ID NO: 1813088 - RNA, 16 nt, Human
gaucauuugagcccag

SEQ ID NO: 1813089 - RNA, 20 nt, Human
acaccccaacagcacccucu

SEQ ID NO: 1813090 - RNA, 16 nt, Human
ucuagcaugaagacag

SEQ ID NO: 1813091 - RNA, 19 nt, Human
uggggcuuuaacuccugcu

SEQ ID NO: 1813092 - RNA, 14 nt, Human
auugucuagugaaa

SEQ ID NO: 1813093 - RNA, 20 nt, Human
gaccugccaggcacacugag

SEQ ID NO: 1813094 - RNA, 13 nt, Human
auugucuagugaa

SEQ ID NO: 1813095 - RNA, 16 nt, Human
aggaguacaccccaac

SEQ ID NO: 1813096 - RNA, 21 nt, Human
aauuugacuagaaaauuuaaa

SEQ ID NO: 1813097 - RNA, 13 nt, Human
cuccgccucccau

SEQ ID NO: 1813098 - RNA, 22 nt, Human
aacuuguauuuuuuuucuugua

SEQ ID NO: 1813099 - RNA, 16 nt, Human
acucaucuuucccucc

SEQ ID NO: 1813100 - RNA, 19 nt, Human
ggaauuucuucaacucccu

SEQ ID NO: 1813101 - RNA, 15 nt, Human
acagugaaagaaaau

SEQ ID NO: 1813102 - RNA, 23 nt, Human
ucuucuuccaacguggcccagag

SEQ ID NO: 1813103 - RNA, 21 nt, Human
cagagaaacaauggcuaagau

SEQ ID NO: 1813104 - RNA, 23 nt, Human
ugcucagcccugcaccaugcugc

SEQ ID NO: 1813105 - RNA, 14 nt, Human
gagagugaacaaau

SEQ ID NO: 1813106 - RNA, 22 nt, Human
caucgcaauguaagacucggga

SEQ ID NO: 1813107 - RNA, 21 nt, Human
cugugcaaauauaucugcuau

SEQ ID NO: 1813108 - RNA, 13 nt, Human
auucuaucuauuc

SEQ ID NO: 1813109 - RNA, 23 nt, Human
uagugauuuuaauaauauauuuu

SEQ ID NO: 1813110 - RNA, 19 nt, Human
acccagguuggagugcagu

SEQ ID NO: 1813111 - RNA, 12 nt, Human
cucauuucuagc

SEQ ID NO: 1813112 - RNA, 19 nt, Human
cuagcagauacagggauga

SEQ ID NO: 1813113 - RNA, 15 nt, Human
agccucagccuccca

SEQ ID NO: 1813114 - RNA, 12 nt, Human
agacucuaagaa

SEQ ID NO: 1813115 - RNA, 19 nt, Human
cuggcucuggacaggcacu

SEQ ID NO: 1813116 - RNA, 12 nt, Human
cugugagggugc

SEQ ID NO: 1813117 - RNA, 14 nt, Human
cugagucccaggcu

SEQ ID NO: 1813118 - RNA, 17 nt, Human
uauucuguguuaaaaau

SEQ ID NO: 1813119 - RNA, 13 nt, Human
ucaucauuuccau

SEQ ID NO: 1813120 - RNA, 15 nt, Human
ucugccuccccuuca

SEQ ID NO: 1813121 - RNA, 18 nt, Human
cagagucaagggugugug

SEQ ID NO: 1813122 - RNA, 14 nt, Human
cuugcucucggugc

SEQ ID NO: 1813123 - RNA, 13 nt, Human
ugccaggccuggc

SEQ ID NO: 1813124 - RNA, 13 nt, Human
auauaauucuuau

SEQ ID NO: 1813125 - RNA, 18 nt, Human
ccuauguuucacugugca

SEQ ID NO: 1813126 - RNA, 17 nt, Human
auuuucuaagaaacauu

SEQ ID NO: 1813127 - RNA, 23 nt, Human
aauuuuuaggcugaaagaugacg

SEQ ID NO: 1813128 - RNA, 16 nt, Human
ugcuuugaaaaugcug

SEQ ID NO: 1813129 - RNA, 18 nt, Human
cacuggaugaaaauguuc

SEQ ID NO: 1813130 - RNA, 16 nt, Human
aaauauuauguuaaaa

SEQ ID NO: 1813131 - RNA, 16 nt, Human
aaaaguuauguagaaa

SEQ ID NO: 1813132 - RNA, 18 nt, Human
ccccaaccauuuccucag

SEQ ID NO: 1813133 - RNA, 12 nt, Human
aacuggcuacug

SEQ ID NO: 1813134 - RNA, 20 nt, Human
aauucugguagcuaaauaua

SEQ ID NO: 1813135 - RNA, 20 nt, Human
ucaaagcaaagcucuuuacu

SEQ ID NO: 1813136 - RNA, 21 nt, Human
aaauugugcuggaaauggaca

SEQ ID NO: 1813137 - RNA, 24 nt, Human
ccccugagcuugcagagaugaggc

SEQ ID NO: 1813138 - RNA, 14 nt, Human
ugaaaaacuauuaa

SEQ ID NO: 1813139 - RNA, 11 nt, Human
aauuccacagc

SEQ ID NO: 1813140 - RNA, 16 nt, Human
augaauacuuuauaaa

SEQ ID NO: 1813141 - RNA, 22 nt, Human
uaaacuaaggcccucuugaauc

SEQ ID NO: 1813142 - RNA, 14 nt, Human
cagcucuccccuuc

SEQ ID NO: 1813143 - RNA, 14 nt, Human
acgugguaaaacac

SEQ ID NO: 1813144 - RNA, 18 nt, Human
cagauuuuuacacaugua

SEQ ID NO: 1813145 - RNA, 23 nt, Human
cugcccucccccuccucuccacc

SEQ ID NO: 1813146 - RNA, 21 nt, Human
ugcccccaacagcacccucuc

SEQ ID NO: 1813147 - RNA, 20 nt, Human
auuuucuaccuggucucucc

SEQ ID NO: 1813148 - RNA, 12 nt, Human
guaauaaaaugu

SEQ ID NO: 1813149 - RNA, 20 nt, Human
gccuauuuuaauaaacacuc

SEQ ID NO: 1813150 - RNA, 20 nt, Human
uauugauccagaaagaaaac

SEQ ID NO: 1813151 - RNA, 19 nt, Human
cauuccucaugaauguaaa

SEQ ID NO: 1813152 - RNA, 23 nt, Human
ccaugcugcuggggaagacagug

SEQ ID NO: 1813153 - RNA, 17 nt, Human
gcaucuccucaacucug

SEQ ID NO: 1813154 - RNA, 12 nt, Human
ccccacagcccc

SEQ ID NO: 1813155 - RNA, 18 nt, Human
aucagcccugggauagug

SEQ ID NO: 1813156 - RNA, 17 nt, Human
gcucuugaugccuggcg

SEQ ID NO: 1813157 - RNA, 13 nt, Human
uucuaccacccac

SEQ ID NO: 1813158 - RNA, 17 nt, Human
acuuuccccuugguucu

SEQ ID NO: 1813159 - RNA, 23 nt, Human
ugggcccaguaccuagcuggcuc

SEQ ID NO: 1813160 - RNA, 21 nt, Human
ucagaaguuucuucuuuaggc

SEQ ID NO: 1813161 - RNA, 19 nt, Human
gaccggccuuugcaccucc

SEQ ID NO: 1813162 - RNA, 19 nt, Human
ggaacaaguacuucuugau

SEQ ID NO: 1813163 - RNA, 13 nt, Human
cagccugccuuua

SEQ ID NO: 1813164 - RNA, 17 nt, Human
cuauuugaacuuuuuau

SEQ ID NO: 1813165 - RNA, 18 nt, Human
agugacagcagucaggga

SEQ ID NO: 1813166 - RNA, 19 nt, Human
ucaaaggcauuucuuuucu

SEQ ID NO: 1813167 - RNA, 20 nt, Human
gauugugccccugcacucca

SEQ ID NO: 1813168 - RNA, 20 nt, Human
uuguugcauuaaaaaugcau

SEQ ID NO: 1813169 - RNA, 22 nt, Human
acauccuacaagacacagugac

SEQ ID NO: 1813170 - RNA, 16 nt, Human
ggaugagggaaaagaa

SEQ ID NO: 1813171 - RNA, 20 nt, Human
ggagccugaucaccugcccu

SEQ ID NO: 1813172 - RNA, 22 nt, Human
aaaguaaaaacaaagaaauuau

SEQ ID NO: 1813173 - RNA, 15 nt, Human
uugagcaucagugag

SEQ ID NO: 1813174 - RNA, 16 nt, Human
ccacuugcuuuuaaaa

SEQ ID NO: 1813175 - RNA, 15 nt, Human
cuuccaacguggccc

SEQ ID NO: 1813176 - RNA, 22 nt, Human
caaugcagugccuuucuucucu

SEQ ID NO: 1813177 - RNA, 10 nt, Human
gccagaggcu

SEQ ID NO: 1813178 - RNA, 20 nt, Human
cagccugcucccuagccaga

SEQ ID NO: 1813179 - RNA, 16 nt, Human
ucaaguauaauauuaa

SEQ ID NO: 1813180 - RNA, 16 nt, Human
uuucuauaauuuaaau

SEQ ID NO: 1813181 - RNA, 22 nt, Human
aaagagugaaggauuuauguuu

SEQ ID NO: 1813182 - RNA, 16 nt, Human
gccucacacacaaugu

SEQ ID NO: 1813183 - RNA, 12 nt, Human
ggaaagaaguug

SEQ ID NO: 1813184 - RNA, 21 nt, Human
aaucaccaaggcugauuaaac

SEQ ID NO: 1813185 - RNA, 13 nt, Human
aucacugcucaca

SEQ ID NO: 1813186 - RNA, 15 nt, Human
agacaaggccuugga

SEQ ID NO: 1813187 - RNA, 23 nt, Human
caggaaucacuggcuguuaaucu

SEQ ID NO: 1813188 - RNA, 13 nt, Human
auuccucacuuug

SEQ ID NO: 1813189 - RNA, 16 nt, Human
uguguguuuuaaaaug

SEQ ID NO: 1813190 - RNA, 20 nt, Human
aaaucauaagauauuuuuca

SEQ ID NO: 1813191 - RNA, 20 nt, Human
cacagcccuuuugucucugc

SEQ ID NO: 1813192 - RNA, 14 nt, Human
cuucucuucacagu

SEQ ID NO: 1813193 - RNA, 16 nt, Human
cuauaauguaaacaau

SEQ ID NO: 1813194 - RNA, 15 nt, Human
gauuuccacagugac

SEQ ID NO: 1813195 - RNA, 13 nt, Human
accuggucucucc

SEQ ID NO: 1813196 - RNA, 16 nt, Human
ccuuuucccaaccaua

SEQ ID NO: 1813197 - RNA, 15 nt, Human
uguaauguuaauauu

SEQ ID NO: 1813198 - RNA, 14 nt, Human
ggcuccccuccucg

SEQ ID NO: 1813199 - RNA, 18 nt, Human
ucuuuuuucuaaaguaaa

SEQ ID NO: 1813200 - RNA, 11 nt, Human
uuuaaaugaag

SEQ ID NO: 1813201 - RNA, 21 nt, Human
cucaccaagcugcuguggcca

SEQ ID NO: 1813202 - RNA, 16 nt, Human
cagcuucucauccugc

SEQ ID NO: 1813203 - RNA, 15 nt, Human
cuucaacucccugcc

SEQ ID NO: 1813204 - RNA, 14 nt, Human
cagcuaauuuuugu

SEQ ID NO: 1813205 - RNA, 15 nt, Human
ucccccaucucuucu

SEQ ID NO: 1813206 - RNA, 23 nt, Human
ggagauauuuacaugaauugcau

SEQ ID NO: 1813207 - RNA, 19 nt, Human
aauuucgucuguuuauaaa

SEQ ID NO: 1813208 - RNA, 21 nt, Human
ggacugugugcucaggagccc

SEQ ID NO: 1813209 - RNA, 16 nt, Human
ccugccccccagcccu

SEQ ID NO: 1813210 - RNA, 12 nt, Human
aauaaaguacaa

SEQ ID NO: 1813211 - RNA, 22 nt, Human
aacccugcacccauuagcaguc

SEQ ID NO: 1813212 - RNA, 14 nt, Human
uucacuaucuguaa

SEQ ID NO: 1813213 - RNA, 15 nt, Human
auuucauucaauauc

SEQ ID NO: 1813214 - RNA, 22 nt, Human
ucugauaaugaaaauuaugaua

SEQ ID NO: 1813215 - RNA, 15 nt, Human
acaccccaacagcac

SEQ ID NO: 1813216 - RNA, 18 nt, Human
ugcccucccccuccucuc

SEQ ID NO: 1813217 - RNA, 18 nt, Human
uucccuguuucuuccaca

SEQ ID NO: 1813218 - RNA, 17 nt, Human
uuuucccagggcaagca

SEQ ID NO: 1813219 - RNA, 14 nt, Human
accauuuccucaga

SEQ ID NO: 1813220 - RNA, 14 nt, Human
ccuucauuuccucc

SEQ ID NO: 1813221 - RNA, 22 nt, Human
acccucuccagaugcagcccca

SEQ ID NO: 1813222 - RNA, 20 nt, Human
ccaggugguaagcaccagga

SEQ ID NO: 1813223 - RNA, 12 nt, Human
ccacccucccac

SEQ ID NO: 1813224 - RNA, 23 nt, Human
uaggauggcuaguaucaaaagaa

SEQ ID NO: 1813225 - RNA, 13 nt, Human
agagaaacaaugg

SEQ ID NO: 1813226 - RNA, 12 nt, Human
cuccugaccuca

SEQ ID NO: 1813227 - RNA, 12 nt, Human
aaugagauauua

SEQ ID NO: 1813228 - RNA, 20 nt, Human
gcauguugcccuguugcugc

SEQ ID NO: 1813229 - RNA, 19 nt, Human
cuggccuuguaagacccuu

SEQ ID NO: 1813230 - RNA, 12 nt, Human
cuaauuuuuagg

SEQ ID NO: 1813231 - RNA, 17 nt, Human
caugcugaacaucacag

SEQ ID NO: 1813232 - RNA, 18 nt, Human
uauuaagaaaaucuauuu

SEQ ID NO: 1813233 - RNA, 21 nt, Human
ugcagcugagagaaaauaauc

SEQ ID NO: 1813234 - RNA, 21 nt, Human
ccagccacggggacucagccc

SEQ ID NO: 1813235 - RNA, 14 nt, Human
uuucuugaaaguac

SEQ ID NO: 1813236 - RNA, 18 nt, Human
uuuuaccagucucacaug

SEQ ID NO: 1813237 - RNA, 20 nt, Human
gacaugaagcuguuguguga

SEQ ID NO: 1813238 - RNA, 15 nt, Human
cucauuucucaucuu

SEQ ID NO: 1813239 - RNA, 14 nt, Human
ugccuucuggccuu

SEQ ID NO: 1813240 - RNA, 14 nt, Human
ucauaaauaaaguu

SEQ ID NO: 1813241 - RNA, 21 nt, Human
aauucauguugccuugcauaa

SEQ ID NO: 1813242 - RNA, 12 nt, Human
ccaggcugagcc

SEQ ID NO: 1813243 - RNA, 16 nt, Human
acauucagggcuauuu

SEQ ID NO: 1813244 - RNA, 16 nt, Human
cauaucucccucuucc

SEQ ID NO: 1813245 - RNA, 15 nt, Human
augagggaaaagaaa

SEQ ID NO: 1813246 - RNA, 22 nt, Human
cccagcucacaggagcuuaaac

SEQ ID NO: 1813247 - RNA, 21 nt, Human
caggauggcaaccagaccauu

SEQ ID NO: 1813248 - RNA, 18 nt, Human
uguugccaggcuggagug

SEQ ID NO: 1813249 - RNA, 16 nt, Human
cuagucucuacccagu

SEQ ID NO: 1813250 - RNA, 16 nt, Human
aaaaauguaggagacu

SEQ ID NO: 1813251 - RNA, 12 nt, Human
cccucugcagcu

SEQ ID NO: 1813252 - RNA, 15 nt, Human
agcauuugaaugcau

SEQ ID NO: 1813253 - RNA, 14 nt, Human
uggcucugugugcu

SEQ ID NO: 1813254 - RNA, 23 nt, Human
ugccucagccucccgaguagcug

SEQ ID NO: 1813255 - RNA, 14 nt, Human
uaaucauucuuauu

SEQ ID NO: 1813256 - RNA, 12 nt, Human
uuggccauggga

SEQ ID NO: 1813257 - RNA, 18 nt, Human
ucaugcauuguccucuuu

SEQ ID NO: 1813258 - RNA, 17 nt, Human
agauuacuuuuucuuua

SEQ ID NO: 1813259 - RNA, 12 nt, Human
aacccagauaaa

SEQ ID NO: 1813260 - RNA, 14 nt, Human
acauagugaggagc

SEQ ID NO: 1813261 - RNA, 11 nt, Human
ugcucucccag

SEQ ID NO: 1813262 - RNA, 17 nt, Human
guccgggauugggaauc

SEQ ID NO: 1813263 - RNA, 20 nt, Human
uuucauaagaauucuguuga

SEQ ID NO: 1813264 - RNA, 20 nt, Human
accacaugggugaacacuca

SEQ ID NO: 1813265 - RNA, 18 nt, Human
auccauucuucccuugau

SEQ ID NO: 1813266 - RNA, 19 nt, Human
uauuuuaauaauguuucaa

SEQ ID NO: 1813267 - RNA, 19 nt, Human
agaccuaaaauaaaaugaa

SEQ ID NO: 1813268 - RNA, 14 nt, Human
ugcucucccagccc

SEQ ID NO: 1813269 - RNA, 21 nt, Human
caguucauccauucuauuguu

SEQ ID NO: 1813270 - RNA, 16 nt, Human
auauaaguguguguuu

SEQ ID NO: 1813271 - RNA, 21 nt, Human
aguccccagccugcucccuag

SEQ ID NO: 1813272 - RNA, 21 nt, Human
gcugagucccaggcugagccu

SEQ ID NO: 1813273 - RNA, 21 nt, Human
acugccaaaacaucaaccugc

SEQ ID NO: 1813274 - RNA, 13 nt, Human
uuuguguauuaua

SEQ ID NO: 1813275 - RNA, 16 nt, Human
accuaguccccagccu

SEQ ID NO: 1813276 - RNA, 22 nt, Human
uggaugauccccacgccacagc

SEQ ID NO: 1813277 - RNA, 17 nt, Human
ucuauuuuuauguuuaa

SEQ ID NO: 1813278 - RNA, 20 nt, Human
ugcucucggugcuuccaacu

SEQ ID NO: 1813279 - RNA, 22 nt, Human
aauuagcuccuccuuuuuccuu

SEQ ID NO: 1813280 - RNA, 19 nt, Human
ccaaacugccuaagcccuc

SEQ ID NO: 1813281 - RNA, 17 nt, Human
ucucuccuuguucugau

SEQ ID NO: 1813282 - RNA, 21 nt, Human
cccuguaugauuccuugaugg

SEQ ID NO: 1813283 - RNA, 19 nt, Human
uuuccauuuacccuucuuu

SEQ ID NO: 1813284 - RNA, 18 nt, Human
uacuguagcaaccugaaa

SEQ ID NO: 1813285 - RNA, 22 nt, Human
ugucauaugcucugauuuaucu

SEQ ID NO: 1813286 - RNA, 14 nt, Human
augaauuugugaag

SEQ ID NO: 1813287 - RNA, 19 nt, Human
acauuccucugcccuuccu

SEQ ID NO: 1813288 - RNA, 20 nt, Human
ucauucacucaacaaacaua

SEQ ID NO: 1813289 - RNA, 17 nt, Human
gcaagcagaagagaaaa

SEQ ID NO: 1813290 - RNA, 19 nt, Human
cauggccacaucugagccc

SEQ ID NO: 1813291 - RNA, 19 nt, Human
uguggaacuagguuuuaau

SEQ ID NO: 1813292 - RNA, 17 nt, Human
caggauacuggcacaga

SEQ ID NO: 1813293 - RNA, 15 nt, Human
uucagggcuauuuuu

SEQ ID NO: 1813294 - RNA, 17 nt, Human
ccaaggaugccccgucc

SEQ ID NO: 1813295 - RNA, 15 nt, Human
cauguccacugguuc

SEQ ID NO: 1813296 - RNA, 18 nt, Human
gcccugcagucacagcua

SEQ ID NO: 1813297 - RNA, 14 nt, Human
guuggagugcagug

SEQ ID NO: 1813298 - RNA, 14 nt, Human
uugccuugcauaau

SEQ ID NO: 1813299 - RNA, 17 nt, Human
uaaagacuuuuaugaua

SEQ ID NO: 1813300 - RNA, 23 nt, Human
caugaguuacacuggaugaaaau

SEQ ID NO: 1813301 - RNA, 20 nt, Human
ucuugcagggguagccugag

SEQ ID NO: 1813302 - RNA, 19 nt, Human
ggagcgagugggggccagc

SEQ ID NO: 1813303 - RNA, 18 nt, Human
uuagcaaccccaauacag

SEQ ID NO: 1813304 - RNA, 16 nt, Human
acagagacagaaagca

SEQ ID NO: 1813305 - RNA, 16 nt, Human
auuuuuaaguuauuuu

SEQ ID NO: 1813306 - RNA, 23 nt, Human
ggcuaagcuucacuguaaaauaa

SEQ ID NO: 1813307 - RNA, 23 nt, Human
gaggcauuuaggccaugggacag

SEQ ID NO: 1813308 - RNA, 19 nt, Human
uucccuugaugaagaaguu

SEQ ID NO: 1813309 - RNA, 19 nt, Human
caauccucccacuucagcc

SEQ ID NO: 1813310 - RNA, 21 nt, Human
cacuaaagaaggugugggcca

SEQ ID NO: 1813311 - RNA, 17 nt, Human
cagcccugcaccaugcu

SEQ ID NO: 1813312 - RNA, 18 nt, Human
gaaauggacacagucuaa

SEQ ID NO: 1813313 - RNA, 22 nt, Human
aauaauccuaaacauaugaauu

SEQ ID NO: 1813314 - RNA, 21 nt, Human
acuguagggugcugcgcagca

SEQ ID NO: 1813315 - RNA, 13 nt, Human
cucccuagccaga

SEQ ID NO: 1813316 - RNA, 19 nt, Human
gacaaguauggcuccucca

SEQ ID NO: 1813317 - RNA, 21 nt, Human
auuucuuuuuuaaaugaagaa

SEQ ID NO: 1813318 - RNA, 12 nt, Human
auaaaaauaaaa

SEQ ID NO: 1813319 - RNA, 19 nt, Human
acagugauuaccagggacu

SEQ ID NO: 1813320 - RNA, 15 nt, Human
aauauuuucuuuguu

SEQ ID NO: 1813321 - RNA, 22 nt, Human
uccagaugagaguacaccccaa

SEQ ID NO: 1813322 - RNA, 18 nt, Human
uucagcagagaaguuuuc

SEQ ID NO: 1813323 - RNA, 18 nt, Human
cacuaggguccaccagga

SEQ ID NO: 1813324 - RNA, 13 nt, Human
uuaaauuguaaua

SEQ ID NO: 1813325 - RNA, 18 nt, Human
uggucaauuuuguuaugu

SEQ ID NO: 1813326 - RNA, 22 nt, Human
aauugagcuggaccucaccaag

SEQ ID NO: 1813327 - RNA, 22 nt, Human
uuaucuaaucaugaaacucccu

SEQ ID NO: 1813328 - RNA, 22 nt, Human
aguguuuuaggagcaugagugc

SEQ ID NO: 1813329 - RNA, 17 nt, Human
aacaguuaccucugccu

SEQ ID NO: 1813330 - RNA, 19 nt, Human
aagagacagccaacuaugg

SEQ ID NO: 1813331 - RNA, 14 nt, Human
cacccugcccagcc

SEQ ID NO: 1813332 - RNA, 14 nt, Human
aauuguauuacaaa

SEQ ID NO: 1813333 - RNA, 15 nt, Human
ucugagaaaagcuuu

SEQ ID NO: 1813334 - RNA, 19 nt, Human
auaauacuugcuuuggaaa

SEQ ID NO: 1813335 - RNA, 13 nt, Human
acucucuuaagga

SEQ ID NO: 1813336 - RNA, 18 nt, Human
cuaccugcucagcccugc

SEQ ID NO: 1813337 - RNA, 22 nt, Human
acacaaauuaucuuaaaacucc

SEQ ID NO: 1813338 - RNA, 22 nt, Human
uuuauggcacuaguauuucuau

SEQ ID NO: 1813339 - RNA, 13 nt, Human
cacaacacacaga

SEQ ID NO: 1813340 - RNA, 11 nt, Human
caauaaaagac

SEQ ID NO: 1813341 - RNA, 18 nt, Human
aauaaacucauuucuagc

SEQ ID NO: 1813342 - RNA, 11 nt, Human
agccagggcug

SEQ ID NO: 1813343 - RNA, 18 nt, Human
aacuccuguuucacuugg

SEQ ID NO: 1813344 - RNA, 17 nt, Human
guuuaccagaaagcagu

SEQ ID NO: 1813345 - RNA, 15 nt, Human
uacaggauuugaaau

SEQ ID NO: 1813346 - RNA, 21 nt, Human
gcuggccaccugcugagcccc

SEQ ID NO: 1813347 - RNA, 15 nt, Human
gagccugccuuucuc

SEQ ID NO: 1813348 - RNA, 17 nt, Human
ugcucuaugugcuugua

SEQ ID NO: 1813349 - RNA, 12 nt, Human
aaagguaaauca

SEQ ID NO: 1813350 - RNA, 20 nt, Human
aaagauaucucaucucuucu

SEQ ID NO: 1813351 - RNA, 17 nt, Human
cuaagccagcugccccc

SEQ ID NO: 1813352 - RNA, 23 nt, Human
aacauguuucuuuguaaugaaaa

SEQ ID NO: 1813353 - RNA, 15 nt, Human
gagauuccugagcca

SEQ ID NO: 1813354 - RNA, 15 nt, Human
accaaggcugauuaa

SEQ ID NO: 1813355 - RNA, 14 nt, Human
acccugaggugagc

SEQ ID NO: 1813356 - RNA, 19 nt, Human
cagacucacugugggaagg

SEQ ID NO: 1813357 - RNA, 15 nt, Human
aaaauacaaaaaaaa

SEQ ID NO: 1813358 - RNA, 19 nt, Human
gcccugcaccaugcugcug

SEQ ID NO: 1813359 - RNA, 14 nt, Human
caugugugguacau

SEQ ID NO: 1813360 - RNA, 19 nt, Human
cuccccugcacuguaaaau

SEQ ID NO: 1813361 - RNA, 13 nt, Human
cauauaaucuuac

SEQ ID NO: 1813362 - RNA, 19 nt, Human
auggagccagcucugcauu

SEQ ID NO: 1813363 - RNA, 21 nt, Human
gaaaggggcaggccagagcua

SEQ ID NO: 1813364 - RNA, 18 nt, Human
uuacuguaagaaaauauc

SEQ ID NO: 1813365 - RNA, 13 nt, Human
auacacuuuuuaa

SEQ ID NO: 1813366 - RNA, 14 nt, Human
aacccagauaaagg

SEQ ID NO: 1813367 - RNA, 12 nt, Human
ugugagccacca

SEQ ID NO: 1813368 - RNA, 17 nt, Human
cucccaccaccucacca

SEQ ID NO: 1813369 - RNA, 17 nt, Human
agaaucacuugaacccg

SEQ ID NO: 1813370 - RNA, 17 nt, Human
uauccuaucucuccaac

SEQ ID NO: 1813371 - RNA, 15 nt, Human
ucaguuuuugugaaa

SEQ ID NO: 1813372 - RNA, 22 nt, Human
cacuuccaagagccuuuuuuug

SEQ ID NO: 1813373 - RNA, 18 nt, Human
ccacacaugggaucaagu

SEQ ID NO: 1813374 - RNA, 21 nt, Human
aagauggggucuguaaaaucu

SEQ ID NO: 1813375 - RNA, 20 nt, Human
aguuagaaaguugauuuuaa

SEQ ID NO: 1813376 - RNA, 22 nt, Human
aucuagaggcuuccuucauuuc

SEQ ID NO: 1813377 - RNA, 20 nt, Human
ccucuccaaagcccucccua

SEQ ID NO: 1813378 - RNA, 16 nt, Human
acaaggaugaauuaag

SEQ ID NO: 1813379 - RNA, 18 nt, Human
uauuaugcauuauaucaa

SEQ ID NO: 1813380 - RNA, 23 nt, Human
agaaaccuuuguuugcaucugaa

SEQ ID NO: 1813381 - RNA, 21 nt, Human
uugaggcacagaaacuccugu

SEQ ID NO: 1813382 - RNA, 15 nt, Human
caucagcuccagcug

SEQ ID NO: 1813383 - RNA, 22 nt, Human
accuucaacaaccggccaccag

SEQ ID NO: 1813384 - RNA, 12 nt, Human
cuucuuaaaaua

SEQ ID NO: 1813385 - RNA, 15 nt, Human
auagaauuauaacug

SEQ ID NO: 1813386 - RNA, 21 nt, Human
acaccuaugucauuucauuuc

SEQ ID NO: 1813387 - RNA, 19 nt, Human
ucauguaagcugaaaauau

SEQ ID NO: 1813388 - RNA, 21 nt, Human
aguuagcuuucuuccuggauu

SEQ ID NO: 1813389 - RNA, 21 nt, Human
auuauauggcuugaguuuaaa

SEQ ID NO: 1813390 - RNA, 21 nt, Human
cugcuuauccguuagccgugg

SEQ ID NO: 1813391 - RNA, 17 nt, Human
uaauaaauguauauugu

SEQ ID NO: 1813392 - RNA, 15 nt, Human
ucuccagaugagagu

SEQ ID NO: 1813393 - RNA, 13 nt, Human
gacugugggcucc

SEQ ID NO: 1813394 - RNA, 13 nt, Human
ggcaggaaaaugg

SEQ ID NO: 1813395 - RNA, 17 nt, Human
aggcaugagucagucug

SEQ ID NO: 1813396 - RNA, 15 nt, Human
cuugaaaacuuuaug

SEQ ID NO: 1813397 - RNA, 11 nt, Human
uaguccccagc

SEQ ID NO: 1813398 - RNA, 23 nt, Human
ggagugcccccaacagcacccuc

SEQ ID NO: 1813399 - RNA, 20 nt, Human
cauaaugcucauacuuaucu

SEQ ID NO: 1813400 - RNA, 13 nt, Human
uuuguauuuuguu

SEQ ID NO: 1813401 - RNA, 23 nt, Human
caguaguggugacugugggcucc

SEQ ID NO: 1813402 - RNA, 15 nt, Human
acaucaacagauaaa

SEQ ID NO: 1813403 - RNA, 19 nt, Human
gaugauuucagcagggaug

SEQ ID NO: 1813404 - RNA, 16 nt, Human
gacaaggaaaaaauaa

SEQ ID NO: 1813405 - RNA, 12 nt, Human
acaugagguacu

SEQ ID NO: 1813406 - RNA, 13 nt, Human
uuuaaaaaauaua

SEQ ID NO: 1813407 - RNA, 16 nt, Human
cauucaggucuuucuu

SEQ ID NO: 1813408 - RNA, 14 nt, Human
uuuuauaagaaaua

SEQ ID NO: 1813409 - RNA, 18 nt, Human
uugaacuuuuuauugauu

SEQ ID NO: 1813410 - RNA, 22 nt, Human
cauccccaggcccugcucuucc

SEQ ID NO: 1813411 - RNA, 23 nt, Human
auguaggaaagaccauuuuuccu

SEQ ID NO: 1813412 - RNA, 19 nt, Human
ucaguuauuauauuuacaa

SEQ ID NO: 1813413 - RNA, 15 nt, Human
guuucugaguuuuac

SEQ ID NO: 1813414 - RNA, 23 nt, Human
uuauagcuacuaauuuuaaaaug

SEQ ID NO: 1813415 - RNA, 11 nt, Human
uuugcucagcu

SEQ ID NO: 1813416 - RNA, 14 nt, Human
caagcaguuugaaa

SEQ ID NO: 1813417 - RNA, 15 nt, Human
aaaaucauccaagac

SEQ ID NO: 1813418 - RNA, 15 nt, Human
augcugcuggggaag

SEQ ID NO: 1813419 - RNA, 18 nt, Human
caucaggccuagaggccu

SEQ ID NO: 1813420 - RNA, 19 nt, Human
cccugcaaagcccagcuug

SEQ ID NO: 1813421 - RNA, 14 nt, Human
gcucugauuuaucu

SEQ ID NO: 1813422 - RNA, 19 nt, Human
aggugcuaucgcaccacug

SEQ ID NO: 1813423 - RNA, 14 nt, Human
cucuugaggcacag

SEQ ID NO: 1813424 - RNA, 16 nt, Human
cuuuaaugaauaaaca

SEQ ID NO: 1813425 - RNA, 19 nt, Human
cacagcccuggccucugcu

SEQ ID NO: 1813426 - RNA, 17 nt, Human
aacuaggugcauauuua

SEQ ID NO: 1813427 - RNA, 21 nt, Human
auuuacaaaugggaaacaaaa

SEQ ID NO: 1813428 - RNA, 17 nt, Human
cugccuccccugccuca

SEQ ID NO: 1813429 - RNA, 23 nt, Human
ucacagcuacacagaucacagcu

SEQ ID NO: 1813430 - RNA, 23 nt, Human
guauuuauucaauaaaguauuua

SEQ ID NO: 1813431 - RNA, 18 nt, Human
gugauaucccccagccuc

SEQ ID NO: 1813432 - RNA, 19 nt, Human
uacuucuuaggguuaugau

SEQ ID NO: 1813433 - RNA, 16 nt, Human
uauccucccuccagau

SEQ ID NO: 1813434 - RNA, 15 nt, Human
cucaacaaacauaau

SEQ ID NO: 1813435 - RNA, 19 nt, Human
caccucgcagguucaagca

SEQ ID NO: 1813436 - RNA, 11 nt, Human
gcuuaguucaa

SEQ ID NO: 1813437 - RNA, 15 nt, Human
cauucucaugauuau

SEQ ID NO: 1813438 - RNA, 19 nt, Human
auuaucuuuucauacauuu

SEQ ID NO: 1813439 - RNA, 22 nt, Human
cuuaggaauaaucuccuguuaa

SEQ ID NO: 1813440 - RNA, 15 nt, Human
uuuacaugaauugca

SEQ ID NO: 1813441 - RNA, 17 nt, Human
uaguaaacucaauaagu

SEQ ID NO: 1813442 - RNA, 21 nt, Human
gcuuuucuuuucuuuguuucu

SEQ ID NO: 1813443 - RNA, 16 nt, Human
uuuuaaaaaauauaca

SEQ ID NO: 1813444 - RNA, 15 nt, Human
ugucaauaaaaucca

SEQ ID NO: 1813445 - RNA, 20 nt, Human
aucuuucuuucuuagaaauu

SEQ ID NO: 1813446 - RNA, 21 nt, Human
uaaaccuuuuuggacacacaa

SEQ ID NO: 1813447 - RNA, 23 nt, Human
acuuaaguggcuuccaauuuuug

SEQ ID NO: 1813448 - RNA, 14 nt, Human
ugcucagggcuggu

SEQ ID NO: 1813449 - RNA, 17 nt, Human
cauguacugauuacugc

SEQ ID NO: 1813450 - RNA, 19 nt, Human
ccagccugcucccuagcca

SEQ ID NO: 1813451 - RNA, 16 nt, Human
uaacaucugagaaaag

SEQ ID NO: 1813452 - RNA, 19 nt, Human
uaugauaaggaugauaaaa

SEQ ID NO: 1813453 - RNA, 15 nt, Human
aaauuguaagcaugc

SEQ ID NO: 1813454 - RNA, 15 nt, Human
gcaggaagcugugag

SEQ ID NO: 1813455 - RNA, 19 nt, Human
cugggauacugugcccaga

SEQ ID NO: 1813456 - RNA, 17 nt, Human
ccacuaaaaucaaacaa

SEQ ID NO: 1813457 - RNA, 21 nt, Human
ggaagacaagaaggaaagauu

SEQ ID NO: 1813458 - RNA, 17 nt, Human
ugccauauaauucaccu

SEQ ID NO: 1813459 - RNA, 16 nt, Human
ucacaggagcuuaaac

SEQ ID NO: 1813460 - RNA, 21 nt, Human
cuaaauugacacuuaaaaaug

SEQ ID NO: 1813461 - RNA, 17 nt, Human
ugcucuggacuugccuc

SEQ ID NO: 1813462 - RNA, 16 nt, Human
uaucuaugcauuuucu

SEQ ID NO: 1813463 - RNA, 20 nt, Human
auuuuaacaucugagaaaag

SEQ ID NO: 1813464 - RNA, 13 nt, Human
ggaggccuguccu

SEQ ID NO: 1813465 - RNA, 14 nt, Human
agcucguggaacag

SEQ ID NO: 1813466 - RNA, 21 nt, Human
cugacuauucuugauguaaaa

SEQ ID NO: 1813467 - RNA, 15 nt, Human
uaauuuugaaaaacu

SEQ ID NO: 1813468 - RNA, 23 nt, Human
uaaaagacagugaaagaaaauaa

SEQ ID NO: 1813469 - RNA, 23 nt, Human
uguugcauagaauaaaauuuuua

SEQ ID NO: 1813470 - RNA, 16 nt, Human
agugagacagcucugc

SEQ ID NO: 1813471 - RNA, 22 nt, Human
auuccaccaggauauccucccu

SEQ ID NO: 1813472 - RNA, 15 nt, Human
ugagagaguggcugg

SEQ ID NO: 1813473 - RNA, 15 nt, Human
uccagauccuggaaa

SEQ ID NO: 1813474 - RNA, 20 nt, Human
aggauguggaaaccuccuuc

SEQ ID NO: 1813475 - RNA, 15 nt, Human
ucccaccaccucacc

SEQ ID NO: 1813476 - RNA, 20 nt, Human
uuuuccuuugaauccucucu

SEQ ID NO: 1813477 - RNA, 10 nt, Human
auguuuucag

SEQ ID NO: 1813478 - RNA, 18 nt, Human
ccccuuugcugacccucc

SEQ ID NO: 1813479 - RNA, 17 nt, Human
auuauuguacauuuaua

SEQ ID NO: 1813480 - RNA, 20 nt, Human
uuucgucuguuuauaaacau

SEQ ID NO: 1813481 - RNA, 16 nt, Human
ucuucaacucccugcc

SEQ ID NO: 1813482 - RNA, 18 nt, Human
acauuugcucauggaauu

SEQ ID NO: 1813483 - RNA, 15 nt, Human
auguuagagaauuuc

SEQ ID NO: 1813484 - RNA, 17 nt, Human
uucacuuuuauaagaaa

SEQ ID NO: 1813485 - RNA, 22 nt, Human
ccuccuaacaaguagcacccug

SEQ ID NO: 1813486 - RNA, 20 nt, Human
uuccaccaggauauccuccc

SEQ ID NO: 1813487 - RNA, 17 nt, Human
acaggccucacacacaa

SEQ ID NO: 1813488 - RNA, 19 nt, Human
cuuucauaaagucuugccu

SEQ ID NO: 1813489 - RNA, 14 nt, Human
ccugcaagcagagg

SEQ ID NO: 1813490 - RNA, 22 nt, Human
gaguaauccaagcaaaugugaa

SEQ ID NO: 1813491 - RNA, 18 nt, Human
cagacauacauuucucau

SEQ ID NO: 1813492 - RNA, 13 nt, Human
gagacagcucugc

SEQ ID NO: 1813493 - RNA, 15 nt, Human
cagucucccucccuu

SEQ ID NO: 1813494 - RNA, 18 nt, Human
cugagccuugggaccccu

SEQ ID NO: 1813495 - RNA, 22 nt, Human
aaagaugacggaugccuagagu

SEQ ID NO: 1813496 - RNA, 14 nt, Human
cugagauccuuccu

SEQ ID NO: 1813497 - RNA, 23 nt, Human
aauaauccucaguuuuugugaaa

SEQ ID NO: 1813498 - RNA, 15 nt, Human
auaauccuaaacaua

SEQ ID NO: 1813499 - RNA, 15 nt, Human
cuaagugcagccccg

SEQ ID NO: 1813500 - RNA, 19 nt, Human
aagcucugaagaacucucu

SEQ ID NO: 1813501 - RNA, 13 nt, Human
aauaucucuucuc

SEQ ID NO: 1813502 - RNA, 15 nt, Human
ccaccauggccagcu

SEQ ID NO: 1813503 - RNA, 12 nt, Human
auuuaucauuua

SEQ ID NO: 1813504 - RNA, 18 nt, Human
aaagcauuauuauuugcu

SEQ ID NO: 1813505 - RNA, 13 nt, Human
ccauucuucccuu

SEQ ID NO: 1813506 - RNA, 18 nt, Human
agggauuuucagcccuca

SEQ ID NO: 1813507 - RNA, 15 nt, Human
agcgauuaauaacag

SEQ ID NO: 1813508 - RNA, 15 nt, Human
agugauuuccacagu

SEQ ID NO: 1813509 - RNA, 14 nt, Human
gcuuuguucuucuu

SEQ ID NO: 1813510 - RNA, 21 nt, Human
uccuaaaacuuuaaaacuuga

SEQ ID NO: 1813511 - RNA, 18 nt, Human
cauuacggagaguuuccu

SEQ ID NO: 1813512 - RNA, 18 nt, Human
aucacucaaauuguucuc

SEQ ID NO: 1813513 - RNA, 18 nt, Human
cccccaacagcacccucu

SEQ ID NO: 1813514 - RNA, 19 nt, Human
auuuaucuauuuaaauauu

SEQ ID NO: 1813515 - RNA, 12 nt, Human
gaagaaggaaaa

SEQ ID NO: 1813516 - RNA, 20 nt, Human
gagcaucaucuucuggguua

SEQ ID NO: 1813517 - RNA, 11 nt, Human
accugaagaau

SEQ ID NO: 1813518 - RNA, 22 nt, Human
uauuccuuuuucucuccucucc

SEQ ID NO: 1813519 - RNA, 11 nt, Human
cagucuuuucc

SEQ ID NO: 1813520 - RNA, 16 nt, Human
uccauuuuuuucuaau

SEQ ID NO: 1813521 - RNA, 15 nt, Human
gccuuaacuggagcc

SEQ ID NO: 1813522 - RNA, 20 nt, Human
caagccuccuuuuaaaguaa

SEQ ID NO: 1813523 - RNA, 15 nt, Human
cugccuccccugccu

SEQ ID NO: 1813524 - RNA, 19 nt, Human
acuccugaccucaagugau

SEQ ID NO: 1813525 - RNA, 19 nt, Human
aaaccuuuuuggacacaca

SEQ ID NO: 1813526 - RNA, 16 nt, Human
auucuguguuaaaaau

SEQ ID NO: 1813527 - RNA, 17 nt, Human
aucagcuccagcugcuc

SEQ ID NO: 1813528 - RNA, 15 nt, Human
ucaucucagcucacu

SEQ ID NO: 1813529 - RNA, 19 nt, Human
cauauuuauaaaaauaaaa

SEQ ID NO: 1813530 - RNA, 17 nt, Human
ucucuguaauaaacuca

SEQ ID NO: 1813531 - RNA, 17 nt, Human
uaauuccacagcugcuc

SEQ ID NO: 1813532 - RNA, 17 nt, Human
aguuggggacacaugua

SEQ ID NO: 1813533 - RNA, 19 nt, Human
caagcagcccuuagcccuu

SEQ ID NO: 1813534 - RNA, 19 nt, Human
uauacuugguucucuccac

SEQ ID NO: 1813535 - RNA, 14 nt, Human
aucaugcugagaga

SEQ ID NO: 1813536 - RNA, 19 nt, Human
aggucuaccaaaaaucuca

SEQ ID NO: 1813537 - RNA, 13 nt, Human
ccaaggaugcccc

SEQ ID NO: 1813538 - RNA, 18 nt, Human
cuaggcauagcccugccu

SEQ ID NO: 1813539 - RNA, 15 nt, Human
acagugggagccagg

SEQ ID NO: 1813540 - RNA, 19 nt, Human
uacaaaaaaaaaaaaaaau

SEQ ID NO: 1813541 - RNA, 19 nt, Human
uguuucacugugcaaauau

SEQ ID NO: 1813542 - RNA, 15 nt, Human
uugauaaagggccaa

SEQ ID NO: 1813543 - RNA, 15 nt, Human
cccugcaaagcccag

SEQ ID NO: 1813544 - RNA, 20 nt, Human
uaaaagacaaggaaaaaaua

SEQ ID NO: 1813545 - RNA, 17 nt, Human
auuauguguguuuuaaa

SEQ ID NO: 1813546 - RNA, 20 nt, Human
augcuucuguuuuauaauuu

SEQ ID NO: 1813547 - RNA, 15 nt, Human
caugcuaauuauaua

SEQ ID NO: 1813548 - RNA, 20 nt, Human
uauuauuguugcauuaaaaa

SEQ ID NO: 1813549 - RNA, 19 nt, Human
gccucccaaguagcugaga

SEQ ID NO: 1813550 - RNA, 18 nt, Human
gccacggggacucagccc

SEQ ID NO: 1813551 - RNA, 20 nt, Human
gauguuguguuuuuaacaug

SEQ ID NO: 1813552 - RNA, 16 nt, Human
auccccacgccacagc

SEQ ID NO: 1813553 - RNA, 14 nt, Human
uugccugcaggcau

SEQ ID NO: 1813554 - RNA, 16 nt, Human
agcgcuaauuucuauu

SEQ ID NO: 1813555 - RNA, 16 nt, Human
agacauugaggcaggc

SEQ ID NO: 1813556 - RNA, 21 nt, Human
acuauuauauuuccaagaaau

SEQ ID NO: 1813557 - RNA, 20 nt, Human
acaguggaaagacagcuucu

SEQ ID NO: 1813558 - RNA, 12 nt, Human
cugacccucccc

SEQ ID NO: 1813559 - RNA, 13 nt, Human
aaauaaaggaaac

SEQ ID NO: 1813560 - RNA, 21 nt, Human
acagacauccucuaugccagc

SEQ ID NO: 1813561 - RNA, 18 nt, Human
uguuuugacauuuuuagu

SEQ ID NO: 1813562 - RNA, 19 nt, Human
aucuauguagaauauauuu

SEQ ID NO: 1813563 - RNA, 18 nt, Human
ccuaucucuccaaccaga

SEQ ID NO: 1813564 - RNA, 20 nt, Human
uuuaaaucacucaaauuguu

SEQ ID NO: 1813565 - RNA, 17 nt, Human
gagaaccccaggacgcc

SEQ ID NO: 1813566 - RNA, 16 nt, Human
caugcuggagugcagu

SEQ ID NO: 1813567 - RNA, 23 nt, Human
uuaaaaauaguugcugucaucca

SEQ ID NO: 1813568 - RNA, 22 nt, Human
auuuuaauaauauauuuuaaau

SEQ ID NO: 1813569 - RNA, 16 nt, Human
uagaauaaggaacaac

SEQ ID NO: 1813570 - RNA, 21 nt, Human
auuuuuuucuaauaguuuuau

SEQ ID NO: 1813571 - RNA, 13 nt, Human
cagacaagcugca

SEQ ID NO: 1813572 - RNA, 22 nt, Human
uguauacugugugcuaaaacaa

SEQ ID NO: 1813573 - RNA, 20 nt, Human
aauuaaguuuuuuuuuaaaa

SEQ ID NO: 1813574 - RNA, 20 nt, Human
aaagagucacucacauccau

SEQ ID NO: 1813575 - RNA, 22 nt, Human
cuuccacuaggguccaccagga

SEQ ID NO: 1813576 - RNA, 19 nt, Human
gccccaucagcuccagcug

SEQ ID NO: 1813577 - RNA, 18 nt, Human
gaagaacucucuggaagc

SEQ ID NO: 1813578 - RNA, 13 nt, Human
aggcuagauguau

SEQ ID NO: 1813579 - RNA, 17 nt, Human
ggcaucaggcuuucuua

SEQ ID NO: 1813580 - RNA, 18 nt, Human
ccuccauaucucccucuu

SEQ ID NO: 1813581 - RNA, 14 nt, Human
aaaucauaagauau

SEQ ID NO: 1813582 - RNA, 17 nt, Human
uguuccccuuugcuuca

SEQ ID NO: 1813583 - RNA, 12 nt, Human
ugucucagagca

SEQ ID NO: 1813584 - RNA, 19 nt, Human
gagcucaccagucccuccc

SEQ ID NO: 1813585 - RNA, 20 nt, Human
ggaaacaaaacuagguaaaa

SEQ ID NO: 1813586 - RNA, 12 nt, Human
ccagcucagggc

SEQ ID NO: 1813587 - RNA, 20 nt, Human
uacccaguagaugccaccca

SEQ ID NO: 1813588 - RNA, 19 nt, Human
ugcaucuuauuucugucaa

SEQ ID NO: 1813589 - RNA, 13 nt, Human
aagaauuguuaaa

SEQ ID NO: 1813590 - RNA, 14 nt, Human
ucagacaagcugca

SEQ ID NO: 1813591 - RNA, 22 nt, Human
cauggauacagccaggcccaga

SEQ ID NO: 1813592 - RNA, 20 nt, Human
gcuccagcugcucugucuuc

SEQ ID NO: 1813593 - RNA, 18 nt, Human
auuuuaacucuauaaugu

SEQ ID NO: 1813594 - RNA, 16 nt, Human
ccucagccucccaaag

SEQ ID NO: 1813595 - RNA, 22 nt, Human
ccuuagaccaccaagccuugau

SEQ ID NO: 1813596 - RNA, 17 nt, Human
gaaugagagacacacug

SEQ ID NO: 1813597 - RNA, 15 nt, Human
uguaugauuccuuga

SEQ ID NO: 1813598 - RNA, 20 nt, Human
caggcaggaacaaacagggc

SEQ ID NO: 1813599 - RNA, 15 nt, Human
cugcaaacugccuuc

SEQ ID NO: 1813600 - RNA, 15 nt, Human
auuaagacuuuaugu

SEQ ID NO: 1813601 - RNA, 21 nt, Human
ccccaaguuauccaccugccu

SEQ ID NO: 1813602 - RNA, 14 nt, Human
caccaaccuucuga

SEQ ID NO: 1813603 - RNA, 10 nt, Human
uggccugugg

SEQ ID NO: 1813604 - RNA, 14 nt, Human
gccuccagagacug

SEQ ID NO: 1813605 - RNA, 21 nt, Human
ucacucuguucauuccuccag

SEQ ID NO: 1813606 - RNA, 11 nt, Human
gucacaauacu

SEQ ID NO: 1813607 - RNA, 23 nt, Human
auauuuccccaugguuuuaaucu

SEQ ID NO: 1813608 - RNA, 13 nt, Human
ccuugagcccucu

SEQ ID NO: 1813609 - RNA, 17 nt, Human
cccacuagacccacugg

SEQ ID NO: 1813610 - RNA, 14 nt, Human
cugggaucacugau

SEQ ID NO: 1813611 - RNA, 21 nt, Human
gcuuaacccuggaaaaugaau

SEQ ID NO: 1813612 - RNA, 23 nt, Human
uaccuagcuggcucugugagggu

SEQ ID NO: 1813613 - RNA, 20 nt, Human
cacucaugcauuguccucuu

SEQ ID NO: 1813614 - RNA, 12 nt, Human
auuauuuucucu

SEQ ID NO: 1813615 - RNA, 19 nt, Human
uguugcauagaauaaaauu

SEQ ID NO: 1813616 - RNA, 17 nt, Human
aggguguguaaguagau

SEQ ID NO: 1813617 - RNA, 13 nt, Human
uuuaauaaaugua

SEQ ID NO: 1813618 - RNA, 17 nt, Human
cccuggauugaucggag

SEQ ID NO: 1813619 - RNA, 15 nt, Human
gcauuacugcaugca

SEQ ID NO: 1813620 - RNA, 19 nt, Human
aguguguguuuuucauaaa

SEQ ID NO: 1813621 - RNA, 17 nt, Human
ucugguugggcagccag

SEQ ID NO: 1813622 - RNA, 16 nt, Human
cuucggccuccauccu

SEQ ID NO: 1813623 - RNA, 22 nt, Human
agauaucucaucucuucuuuua

SEQ ID NO: 1813624 - RNA, 23 nt, Human
gaaugagagacacacugaagaag

SEQ ID NO: 1813625 - RNA, 18 nt, Human
auccccaagccuggcaag

SEQ ID NO: 1813626 - RNA, 18 nt, Human
aagaaaaucucugugaaa

SEQ ID NO: 1813627 - RNA, 14 nt, Human
uauuuauucaauaa

SEQ ID NO: 1813628 - RNA, 23 nt, Human
gcaugagucacuacgccuggcug

SEQ ID NO: 1813629 - RNA, 23 nt, Human
auuaguacuccccuccuugaacu

SEQ ID NO: 1813630 - RNA, 13 nt, Human
cccugcucuuccu

SEQ ID NO: 1813631 - RNA, 13 nt, Human
aauccaagcagga

SEQ ID NO: 1813632 - RNA, 22 nt, Human
uuuuuccaauuagcuccuccuu

SEQ ID NO: 1813633 - RNA, 17 nt, Human
uccucacuuugaagagu

SEQ ID NO: 1813634 - RNA, 18 nt, Human
cuuuuaugauacuugaaa

SEQ ID NO: 1813635 - RNA, 22 nt, Human
acagauuugagcucagcccugg

SEQ ID NO: 1813636 - RNA, 14 nt, Human
ccaaauauaaauaa

SEQ ID NO: 1813637 - RNA, 23 nt, Human
caucaggcuuucuuuuuuuucuu

SEQ ID NO: 1813638 - RNA, 18 nt, Human
uuuuuaacaccuuuuacu

SEQ ID NO: 1813639 - RNA, 12 nt, Human
ugagagacacac

SEQ ID NO: 1813640 - RNA, 16 nt, Human
ccucaaaacuucagac

SEQ ID NO: 1813641 - RNA, 17 nt, Human
ccuucugagccugccuu

SEQ ID NO: 1813642 - RNA, 14 nt, Human
caguuguccuccuu

SEQ ID NO: 1813643 - RNA, 14 nt, Human
aaaagaaacauuug

SEQ ID NO: 1813644 - RNA, 18 nt, Human
cacugggagaaaugaaaa

SEQ ID NO: 1813645 - RNA, 21 nt, Human
caggaccccauggcaguggga

SEQ ID NO: 1813646 - RNA, 18 nt, Human
uucuaauuggcaugaagg

SEQ ID NO: 1813647 - RNA, 20 nt, Human
ucccuauuccuccuucccuu

SEQ ID NO: 1813648 - RNA, 16 nt, Human
cucagcccugcaccau

SEQ ID NO: 1813649 - RNA, 16 nt, Human
ugggguuucaccaugu

SEQ ID NO: 1813650 - RNA, 22 nt, Human
ggguuccuuccucugagccuug

SEQ ID NO: 1813651 - RNA, 19 nt, Human
uauaaguguguguuuuuca

SEQ ID NO: 1813652 - RNA, 17 nt, Human
uuaauaauuuuuaauua

SEQ ID NO: 1813653 - RNA, 22 nt, Human
aaacauguuuaucguauuugau

SEQ ID NO: 1813654 - RNA, 23 nt, Human
ucugucuaccuggucugguuggg

SEQ ID NO: 1813655 - RNA, 13 nt, Human
cucuguucauuuc

SEQ ID NO: 1813656 - RNA, 23 nt, Human
caccaaggagccaaacauccuac

SEQ ID NO: 1813657 - RNA, 21 nt, Human
augcuaauuauauaauauuuu

SEQ ID NO: 1813658 - RNA, 22 nt, Human
agggaguuguggguagugggga

SEQ ID NO: 1813659 - RNA, 15 nt, Human
aaauccacuuuaucu

SEQ ID NO: 1813660 - RNA, 12 nt, Human
ucugcacacagc

SEQ ID NO: 1813661 - RNA, 13 nt, Human
auuuugugaugca

SEQ ID NO: 1813662 - RNA, 15 nt, Human
aaaauaaaaugaagu

SEQ ID NO: 1813663 - RNA, 19 nt, Human
uauuaauauauauuaucuu

SEQ ID NO: 1813664 - RNA, 23 nt, Human
agacagagucuuccucugucucc

SEQ ID NO: 1813665 - RNA, 16 nt, Human
ucaaaagaaagaaaau

SEQ ID NO: 1813666 - RNA, 15 nt, Human
cacgcacacugucug

SEQ ID NO: 1813667 - RNA, 14 nt, Human
cuuuuaaaauccac

SEQ ID NO: 1813668 - RNA, 20 nt, Human
uguauuacaaauauuuugcu

SEQ ID NO: 1813669 - RNA, 19 nt, Human
ucucagcucacugcaaccu

SEQ ID NO: 1813670 - RNA, 17 nt, Human
cuggagggaagccuugg

SEQ ID NO: 1813671 - RNA, 17 nt, Human
agaacucccuuucaaca

SEQ ID NO: 1813672 - RNA, 23 nt, Human
accuccauggaaacgaagcacca

SEQ ID NO: 1813673 - RNA, 23 nt, Human
uauccaccugccuuggcuuccca

SEQ ID NO: 1813674 - RNA, 16 nt, Human
ggucuccuaaaguacu

SEQ ID NO: 1813675 - RNA, 14 nt, Human
cuggccgggagccu

SEQ ID NO: 1813676 - RNA, 18 nt, Human
guauuauuuuuuaaaaaa

SEQ ID NO: 1813677 - RNA, 16 nt, Human
uugucaauaaaaucca

SEQ ID NO: 1813678 - RNA, 21 nt, Human
accucaguucccucuugcuca

SEQ ID NO: 1813679 - RNA, 21 nt, Human
ucaagucuuucacauuuaaau

SEQ ID NO: 1813680 - RNA, 15 nt, Human
cacuguguuggccag

SEQ ID NO: 1813681 - RNA, 19 nt, Human
uguucccaccaggcugcuc

SEQ ID NO: 1813682 - RNA, 19 nt, Human
uuuacauuuccuaaauaua

SEQ ID NO: 1813683 - RNA, 16 nt, Human
uguuguaugucuuguu

SEQ ID NO: 1813684 - RNA, 20 nt, Human
cucaauaagccucagcuuuc

SEQ ID NO: 1813685 - RNA, 17 nt, Human
ucuccauacucuguaac

SEQ ID NO: 1813686 - RNA, 16 nt, Human
cccaaaguccugggau

SEQ ID NO: 1813687 - RNA, 14 nt, Human
uaauguguauuaca

SEQ ID NO: 1813688 - RNA, 21 nt, Human
cuaccuuuugcuguggcaaau

SEQ ID NO: 1813689 - RNA, 15 nt, Human
cagcuggccuuguga

SEQ ID NO: 1813690 - RNA, 18 nt, Human
uaccacaugggugaacac

SEQ ID NO: 1813691 - RNA, 21 nt, Human
gcaaaauuuuuucucuaggaa

SEQ ID NO: 1813692 - RNA, 16 nt, Human
uagaauauauuuccuu

SEQ ID NO: 1813693 - RNA, 18 nt, Human
aucuggcucuggacaggc

SEQ ID NO: 1813694 - RNA, 16 nt, Human
gcaaauaauuuuucac

SEQ ID NO: 1813695 - RNA, 22 nt, Human
ccuuccccucugcagcuuccag

SEQ ID NO: 1813696 - RNA, 23 nt, Human
auauauuuuaagacgaaacauuu

SEQ ID NO: 1813697 - RNA, 20 nt, Human
ucauguaucgcuucauguaa

SEQ ID NO: 1813698 - RNA, 23 nt, Human
gcuugaucaaaggcacacagcaa

SEQ ID NO: 1813699 - RNA, 18 nt, Human
auacaaaacccuuucugc

SEQ ID NO: 1813700 - RNA, 21 nt, Human
caagaggcuguucccaccagg

SEQ ID NO: 1813701 - RNA, 21 nt, Human
gagacuugggaaugagcugaa

SEQ ID NO: 1813702 - RNA, 18 nt, Human
acaggagcuuaaacagcu

SEQ ID NO: 1813703 - RNA, 10 nt, Human
gcagcucucc

SEQ ID NO: 1813704 - RNA, 14 nt, Human
ccagagacaacagg

SEQ ID NO: 1813705 - RNA, 19 nt, Human
ucagguguguugcaguguc

SEQ ID NO: 1813706 - RNA, 13 nt, Human
aaaacuaacaccc

SEQ ID NO: 1813707 - RNA, 13 nt, Human
aaaugggaaacaa

SEQ ID NO: 1813708 - RNA, 15 nt, Human
aaggccaugauuuua

SEQ ID NO: 1813709 - RNA, 15 nt, Human
aacuagguaaaaucu

SEQ ID NO: 1813710 - RNA, 13 nt, Human
ugggaggcugaga

SEQ ID NO: 1813711 - RNA, 22 nt, Human
ucguaaaauuaagaaaggauaa

SEQ ID NO: 1813712 - RNA, 13 nt, Human
aagugcugggauu

SEQ ID NO: 1813713 - RNA, 16 nt, Human
cuccauccugaggcuc

SEQ ID NO: 1813714 - RNA, 23 nt, Human
ugcucauuuuuucuucuccuaaa

SEQ ID NO: 1813715 - RNA, 21 nt, Human
gaaggugaaacauuuucuccc

SEQ ID NO: 1813716 - RNA, 21 nt, Human
gucucagugucaaugcagccc

SEQ ID NO: 1813717 - RNA, 18 nt, Human
aguguguggcuuucagag

SEQ ID NO: 1813718 - RNA, 11 nt, Human
cuauuuuguag

SEQ ID NO: 1813719 - RNA, 20 nt, Human
caaacugccaucauuuacuu

SEQ ID NO: 1813720 - RNA, 17 nt, Human
augauuaaguaaugaua

SEQ ID NO: 1813721 - RNA, 20 nt, Human
cagacacaaauaaaggaaac

SEQ ID NO: 1813722 - RNA, 21 nt, Human
gccccuuugcugacccucccc

SEQ ID NO: 1813723 - RNA, 18 nt, Human
acaauuaaagcuguuauu

SEQ ID NO: 1813724 - RNA, 17 nt, Human
cucaagucuuauuuccu

SEQ ID NO: 1813725 - RNA, 13 nt, Human
ugagauccuuccu

SEQ ID NO: 1813726 - RNA, 18 nt, Human
cagcugcucaauaaagua

SEQ ID NO: 1813727 - RNA, 13 nt, Human
ucucuccaggcag

SEQ ID NO: 1813728 - RNA, 16 nt, Human
uauuuauucauauuuu

SEQ ID NO: 1813729 - RNA, 21 nt, Human
uucuuuaacuuaauugcuaug

SEQ ID NO: 1813730 - RNA, 23 nt, Human
gggcugccuucuggccuuguaag

SEQ ID NO: 1813731 - RNA, 15 nt, Human
aucaauuuaaaaaaa

SEQ ID NO: 1813732 - RNA, 12 nt, Human
cuuucucccccc

SEQ ID NO: 1813733 - RNA, 12 nt, Human
aucauuuacuuu

SEQ ID NO: 1813734 - RNA, 16 nt, Human
guugauggaaauacac

SEQ ID NO: 1813735 - RNA, 22 nt, Human
ccucuggggagcucaggaaggg

SEQ ID NO: 1813736 - RNA, 22 nt, Human
cacuaguauuucuaugaaauau

SEQ ID NO: 1813737 - RNA, 21 nt, Human
gauccuuccuuuugagggagc

SEQ ID NO: 1813738 - RNA, 17 nt, Human
cgcaucagacagaugga

SEQ ID NO: 1813739 - RNA, 12 nt, Human
guacaccccaac

SEQ ID NO: 1813740 - RNA, 17 nt, Human
uacaggccucacacaca

SEQ ID NO: 1813741 - RNA, 20 nt, Human
cacagcacgggggccaagga

SEQ ID NO: 1813742 - RNA, 13 nt, Human
ccuguacccagua

SEQ ID NO: 1813743 - RNA, 16 nt, Human
agugcuucuccagccu

SEQ ID NO: 1813744 - RNA, 22 nt, Human
aaguggaacgagacaagcagcc

SEQ ID NO: 1813745 - RNA, 17 nt, Human
cacauccauucuucccu

SEQ ID NO: 1813746 - RNA, 14 nt, Human
uuuuauauccacua

SEQ ID NO: 1813747 - RNA, 16 nt, Human
acagauggaaaaggga

SEQ ID NO: 1813748 - RNA, 14 nt, Human
cauggccacaucug

SEQ ID NO: 1813749 - RNA, 16 nt, Human
gaauggcuaagcaaaa

SEQ ID NO: 1813750 - RNA, 21 nt, Human
uagaguuuaccuuauguuuaa

SEQ ID NO: 1813751 - RNA, 21 nt, Human
ucccuauuccuccuucccuug

SEQ ID NO: 1813752 - RNA, 22 nt, Human
aucucagucugucacccagguu

SEQ ID NO: 1813753 - RNA, 14 nt, Human
aagagugaaggauu

SEQ ID NO: 1813754 - RNA, 15 nt, Human
ucagucucccucccu

SEQ ID NO: 1813755 - RNA, 14 nt, Human
accaggcugcucag

SEQ ID NO: 1813756 - RNA, 19 nt, Human
cccugccccccagcccucc

SEQ ID NO: 1813757 - RNA, 17 nt, Human
ucuaugugcuuguaaaa

SEQ ID NO: 1813758 - RNA, 15 nt, Human
cucacugcaggcucc

SEQ ID NO: 1813759 - RNA, 23 nt, Human
aagauaucucaucucuucuuuua

SEQ ID NO: 1813760 - RNA, 16 nt, Human
uaaaauaugucuuucu

SEQ ID NO: 1813761 - RNA, 21 nt, Human
aauuaaguuuuuuuuuaaaaa

SEQ ID NO: 1813762 - RNA, 21 nt, Human
cuagucuguuuucccuccuug

SEQ ID NO: 1813763 - RNA, 18 nt, Human
gagccaggaggccugcua

SEQ ID NO: 1813764 - RNA, 20 nt, Human
ggaaacccagcucacaggag

SEQ ID NO: 1813765 - RNA, 13 nt, Human
aaauauuuauuua

SEQ ID NO: 1813766 - RNA, 20 nt, Human
aauaaacacucuugaaaaau

SEQ ID NO: 1813767 - RNA, 18 nt, Human
cagucagggacagacaua

SEQ ID NO: 1813768 - RNA, 18 nt, Human
uuguuacaaauuguagaa

SEQ ID NO: 1813769 - RNA, 15 nt, Human
aaguccugcaagcag

SEQ ID NO: 1813770 - RNA, 16 nt, Human
aagcuucacuguaaaa

SEQ ID NO: 1813771 - RNA, 18 nt, Human
gcagccagccaacccuuu

SEQ ID NO: 1813772 - RNA, 20 nt, Human
uaaaagacagugaaagaaaa

SEQ ID NO: 1813773 - RNA, 16 nt, Human
gcgggguggggugggg

SEQ ID NO: 1813774 - RNA, 17 nt, Human
ccugcaggcaugaguca

SEQ ID NO: 1813775 - RNA, 20 nt, Human
gcaaacuuuauuuuguguuu

SEQ ID NO: 1813776 - RNA, 17 nt, Human
cccuggauuuuuaccag

SEQ ID NO: 1813777 - RNA, 14 nt, Human
uaaauuuaucauuu

SEQ ID NO: 1813778 - RNA, 18 nt, Human
agcuucucauccugcagg

SEQ ID NO: 1813779 - RNA, 18 nt, Human
ccucaaccucccaagcag

SEQ ID NO: 1813780 - RNA, 15 nt, Human
ugauuuuaauaauau

SEQ ID NO: 1813781 - RNA, 15 nt, Human
ccacccgccucagcc

SEQ ID NO: 1813782 - RNA, 15 nt, Human
cugauguaugaggaa

SEQ ID NO: 1813783 - RNA, 14 nt, Human
ccucagucucccuc

SEQ ID NO: 1813784 - RNA, 14 nt, Human
cucuggggagcuca

SEQ ID NO: 1813785 - RNA, 15 nt, Human
agacaaggaaaaaau

SEQ ID NO: 1813786 - RNA, 16 nt, Human
accuccuaagaaggca

SEQ ID NO: 1813787 - RNA, 18 nt, Human
auggccacaucugagccc

SEQ ID NO: 1813788 - RNA, 20 nt, Human
caucccuagaaagccaugug

SEQ ID NO: 1813789 - RNA, 23 nt, Human
aaguucaauauaagcuuuucuuu

SEQ ID NO: 1813790 - RNA, 19 nt, Human
cugcuagagugacucacua

SEQ ID NO: 1813791 - RNA, 22 nt, Human
cuuuuuuaucaugugaaaucau

SEQ ID NO: 1813792 - RNA, 18 nt, Human
ugacacagacauccucua

SEQ ID NO: 1813793 - RNA, 18 nt, Human
caugaagagauuuuucau

SEQ ID NO: 1813794 - RNA, 18 nt, Human
caagcaggaagaaggaaa

SEQ ID NO: 1813795 - RNA, 12 nt, Human
aaaucaugaaga

SEQ ID NO: 1813796 - RNA, 15 nt, Human
ugaucucagcucacu

SEQ ID NO: 1813797 - RNA, 15 nt, Human
cucuaugguguggca

SEQ ID NO: 1813798 - RNA, 13 nt, Human
agcuucuguuccg

SEQ ID NO: 1813799 - RNA, 21 nt, Human
agaaaagcuauaaaaugaaua

SEQ ID NO: 1813800 - RNA, 15 nt, Human
cucuaauguacaaua

SEQ ID NO: 1813801 - RNA, 20 nt, Human
cacugggagaaaugaaaaaa

SEQ ID NO: 1813802 - RNA, 12 nt, Human
ugcuuuuuaugg

SEQ ID NO: 1813803 - RNA, 15 nt, Human
caccugggauuacaa

SEQ ID NO: 1813804 - RNA, 14 nt, Human
uauccccauuucuu

SEQ ID NO: 1813805 - RNA, 21 nt, Human
gaaaaaaagcuuuuuuugaau

SEQ ID NO: 1813806 - RNA, 20 nt, Human
uacauuuccuaaauauauuu

SEQ ID NO: 1813807 - RNA, 17 nt, Human
ccucaaaugcaccaugu

SEQ ID NO: 1813808 - RNA, 20 nt, Human
caguucuuuggcugaaagga

SEQ ID NO: 1813809 - RNA, 17 nt, Human
ucucaaaaaaaaaaaca

SEQ ID NO: 1813810 - RNA, 14 nt, Human
agcagaagagaaaa

SEQ ID NO: 1813811 - RNA, 19 nt, Human
aacacucaaugguuaacua

SEQ ID NO: 1813812 - RNA, 16 nt, Human
ugaaaaggacuuuaua

SEQ ID NO: 1813813 - RNA, 17 nt, Human
ccaaaagguauuuuaau

SEQ ID NO: 1813814 - RNA, 14 nt, Human
uaaauaaaaauaau

SEQ ID NO: 1813815 - RNA, 13 nt, Human
agaccuaaaauaa

SEQ ID NO: 1813816 - RNA, 17 nt, Human
uguaacaguugcauuga

SEQ ID NO: 1813817 - RNA, 11 nt, Human
ugcauuaaaaa

SEQ ID NO: 1813818 - RNA, 20 nt, Human
cucccacuucagccucccaa

SEQ ID NO: 1813819 - RNA, 21 nt, Human
uuuuacccggcacauuccccu

SEQ ID NO: 1813820 - RNA, 20 nt, Human
ccuaaauauauuuuaagacg

SEQ ID NO: 1813821 - RNA, 16 nt, Human
acugcuaguuuauaua

SEQ ID NO: 1813822 - RNA, 21 nt, Human
acauacauguaaaauaugucu

SEQ ID NO: 1813823 - RNA, 16 nt, Human
uaugaaguuuuuuuua

SEQ ID NO: 1813824 - RNA, 18 nt, Human
ccugaaagaggaaugaag

SEQ ID NO: 1813825 - RNA, 15 nt, Human
ucuaugcauuuucug

SEQ ID NO: 1813826 - RNA, 21 nt, Human
ugaacugauggguuucuccag

SEQ ID NO: 1813827 - RNA, 15 nt, Human
gacucaccuccccca

SEQ ID NO: 1813828 - RNA, 19 nt, Human
aaauuaacaugaauauuua

SEQ ID NO: 1813829 - RNA, 21 nt, Human
aagagauuuuucaugauuuug

SEQ ID NO: 1813830 - RNA, 20 nt, Human
uucaucaccccuaaaagaaa

SEQ ID NO: 1813831 - RNA, 14 nt, Human
aauuuugaaaaacu

SEQ ID NO: 1813832 - RNA, 16 nt, Human
agggguugugaagagg

SEQ ID NO: 1813833 - RNA, 16 nt, Human
uggacuugccucugca

SEQ ID NO: 1813834 - RNA, 20 nt, Human
ccuuugcugacccuccccaa

SEQ ID NO: 1813835 - RNA, 14 nt, Human
ugaucucagcucac

SEQ ID NO: 1813836 - RNA, 20 nt, Human
cugcaauagaacccucuggg

SEQ ID NO: 1813837 - RNA, 13 nt, Human
gagaggaguguga

SEQ ID NO: 1813838 - RNA, 21 nt, Human
aguuguugcccacagcuguau

SEQ ID NO: 1813839 - RNA, 22 nt, Human
auuuggucaacacuaacaugau

SEQ ID NO: 1813840 - RNA, 23 nt, Human
ugcagagguccacaacacacaga

SEQ ID NO: 1813841 - RNA, 13 nt, Human
cguugagccacca

SEQ ID NO: 1813842 - RNA, 23 nt, Human
auuuuguuugguauuguauuuau

SEQ ID NO: 1813843 - RNA, 21 nt, Human
cagcuggucagcccccuaagc

SEQ ID NO: 1813844 - RNA, 22 nt, Human
ccacagaagugcuuucuucucc

SEQ ID NO: 1813845 - RNA, 15 nt, Human
uauuacaaauauuuu

SEQ ID NO: 1813846 - RNA, 22 nt, Human
ugcacgcacacugucugccccc

SEQ ID NO: 1813847 - RNA, 14 nt, Human
gggaagacaagaag

SEQ ID NO: 1813848 - RNA, 16 nt, Human
ugcaaauauaucugcu

SEQ ID NO: 1813849 - RNA, 21 nt, Human
caagacugcacaucaaaauau

SEQ ID NO: 1813850 - RNA, 15 nt, Human
gcuggagugcagugg

SEQ ID NO: 1813851 - RNA, 13 nt, Human
uuuuuuuuaaaga

SEQ ID NO: 1813852 - RNA, 20 nt, Human
cagcuuuagccaagugcagg

SEQ ID NO: 1813853 - RNA, 20 nt, Human
uaucucuaaagaaaaucucu

SEQ ID NO: 1813854 - RNA, 21 nt, Human
aggcuaaagcccagagacagc

SEQ ID NO: 1813855 - RNA, 13 nt, Human
uccaacaauaaga

SEQ ID NO: 1813856 - RNA, 21 nt, Human
augggguaccuaguccccagc

SEQ ID NO: 1813857 - RNA, 19 nt, Human
agugcuaguggauuuuaca

SEQ ID NO: 1813858 - RNA, 16 nt, Human
ucgugagcucuuguga

SEQ ID NO: 1813859 - RNA, 16 nt, Human
uuacaggcgugagcca

SEQ ID NO: 1813860 - RNA, 19 nt, Human
agaguacucuuguuuccuu

SEQ ID NO: 1813861 - RNA, 23 nt, Human
ccaauugcuuuaccuuuuuucuu

SEQ ID NO: 1813862 - RNA, 14 nt, Human
ccuguaacaggcuu

SEQ ID NO: 1813863 - RNA, 16 nt, Human
uaccccuggccaagga

SEQ ID NO: 1813864 - RNA, 20 nt, Human
agcucacugcaaccucugcc

SEQ ID NO: 1813865 - RNA, 22 nt, Human
uguucugauauuggacaguaaa

SEQ ID NO: 1813866 - RNA, 17 nt, Human
uccauucuucccuugau

SEQ ID NO: 1813867 - RNA, 21 nt, Human
gccagccacggggacucagcc

SEQ ID NO: 1813868 - RNA, 23 nt, Human
aauuuccaugaguuacacuggau

SEQ ID NO: 1813869 - RNA, 21 nt, Human
uuagaaaaguuauguagaaaa

SEQ ID NO: 1813870 - RNA, 15 nt, Human
gcuaauaucuuaucu

SEQ ID NO: 1813871 - RNA, 19 nt, Human
uaccuccaaggaccggccu

SEQ ID NO: 1813872 - RNA, 18 nt, Human
uggacuugccuccagaga

SEQ ID NO: 1813873 - RNA, 14 nt, Human
acaugauucauuuu

SEQ ID NO: 1813874 - RNA, 21 nt, Human
aaggcauuucuuuucugcaug

SEQ ID NO: 1813875 - RNA, 21 nt, Human
aacacagugauuuuauuagaa

SEQ ID NO: 1813876 - RNA, 21 nt, Human
cuguguccucaugagggcugg

SEQ ID NO: 1813877 - RNA, 17 nt, Human
gcucacaggagcuuaaa

SEQ ID NO: 1813878 - RNA, 18 nt, Human
agccuggguguaaaaccu

SEQ ID NO: 1813879 - RNA, 15 nt, Human
ucccuccagauauac

SEQ ID NO: 1813880 - RNA, 21 nt, Human
ugagaguacaccccaacagca

SEQ ID NO: 1813881 - RNA, 20 nt, Human
uuuaugugcaucuuauuucu

SEQ ID NO: 1813882 - RNA, 23 nt, Human
caagguuaggguuggagcagggg

SEQ ID NO: 1813883 - RNA, 16 nt, Human
uauaauuuuaaauguu

SEQ ID NO: 1813884 - RNA, 22 nt, Human
ccuugauuuuagccuucucugu

SEQ ID NO: 1813885 - RNA, 21 nt, Human
cccuccacauuucccccuagc

SEQ ID NO: 1813886 - RNA, 20 nt, Human
auaugauuuguguauuauaa

SEQ ID NO: 1813887 - RNA, 15 nt, Human
gaccucucucaaagu

SEQ ID NO: 1813888 - RNA, 14 nt, Human
aaauugaaucacug

SEQ ID NO: 1813889 - RNA, 18 nt, Human
gauuacugccuauuuuaa

SEQ ID NO: 1813890 - RNA, 14 nt, Human
guacugauuacugc

SEQ ID NO: 1813891 - RNA, 13 nt, Human
guuccugcaugcc

SEQ ID NO: 1813892 - RNA, 18 nt, Human
ccaggcuggagugcagug

SEQ ID NO: 1813893 - RNA, 22 nt, Human
uaaagguucaugcaaacuuuau

SEQ ID NO: 1813894 - RNA, 17 nt, Human
uuuugaugaacaaaauu

SEQ ID NO: 1813895 - RNA, 17 nt, Human
cuccccugccucaccag

SEQ ID NO: 1813896 - RNA, 16 nt, Human
ucagcuccagcugcuc

SEQ ID NO: 1813897 - RNA, 12 nt, Human
aacuccugaccu

SEQ ID NO: 1813898 - RNA, 17 nt, Human
aaucuuauaauuuaaaa

SEQ ID NO: 1813899 - RNA, 23 nt, Human
cccucauuucucaucuuuuuacu

SEQ ID NO: 1813900 - RNA, 14 nt, Human
ugugggucauaccg

SEQ ID NO: 1813901 - RNA, 12 nt, Human
uccgccucccau

SEQ ID NO: 1813902 - RNA, 16 nt, Human
ccaauuagcuccuccu

SEQ ID NO: 1813903 - RNA, 21 nt, Human
cgugauccacccgccucagcc

SEQ ID NO: 1813904 - RNA, 16 nt, Human
agucaagauuuccaua

SEQ ID NO: 1813905 - RNA, 18 nt, Human
caguucccucuugcucag

SEQ ID NO: 1813906 - RNA, 15 nt, Human
cgggagccugaucac

SEQ ID NO: 1813907 - RNA, 15 nt, Human
ccccaggacgcccuc

SEQ ID NO: 1813908 - RNA, 16 nt, Human
uaauccaagcaaaugu

SEQ ID NO: 1813909 - RNA, 21 nt, Human
aaauaagaaccacucauaauu

SEQ ID NO: 1813910 - RNA, 17 nt, Human
cuuugaauccucucucu

SEQ ID NO: 1813911 - RNA, 12 nt, Human
ucuuaagaagac

SEQ ID NO: 1813912 - RNA, 20 nt, Human
agcagcccuuagcccuuccc

SEQ ID NO: 1813913 - RNA, 13 nt, Human
uguugccaggcug

SEQ ID NO: 1813914 - RNA, 18 nt, Human
gcuccauuuuuagugaaa

SEQ ID NO: 1813915 - RNA, 19 nt, Human
aaagcaguugagacaagaa

SEQ ID NO: 1813916 - RNA, 16 nt, Human
aggccaugggacaggg

SEQ ID NO: 1813917 - RNA, 18 nt, Human
gaaaauaucacuugucaa

SEQ ID NO: 1813918 - RNA, 12 nt, Human
cuuaagcuuuca

SEQ ID NO: 1813919 - RNA, 19 nt, Human
cucacaugauuccagccau

SEQ ID NO: 1813920 - RNA, 18 nt, Human
uuuaguuauaaaaauaua

SEQ ID NO: 1813921 - RNA, 21 nt, Human
acaugcacugauguuguguuu

SEQ ID NO: 1813922 - RNA, 14 nt, Human
augcauuacugcau

SEQ ID NO: 1813923 - RNA, 16 nt, Human
agauagaugaagaagc

SEQ ID NO: 1813924 - RNA, 22 nt, Human
agaaagugacaagcucacagac

SEQ ID NO: 1813925 - RNA, 22 nt, Human
ccuggacugugugcucaggagc

SEQ ID NO: 1813926 - RNA, 20 nt, Human
cguucccggguagccacugg

SEQ ID NO: 1813927 - RNA, 14 nt, Human
cauuuaguuauaaa

SEQ ID NO: 1813928 - RNA, 21 nt, Human
gauacuugaaggucuaggugc

SEQ ID NO: 1813929 - RNA, 15 nt, Human
ucucuaucauuuaau

SEQ ID NO: 1813930 - RNA, 19 nt, Human
aaagcauuauuauuugcug

SEQ ID NO: 1813931 - RNA, 23 nt, Human
aggcaugagucagucugaugaga

SEQ ID NO: 1813932 - RNA, 13 nt, Human
uuuuauuaugcau

SEQ ID NO: 1813933 - RNA, 14 nt, Human
auaaaauaauuuuu

SEQ ID NO: 1813934 - RNA, 19 nt, Human
gucucugcaaacugccuuc

SEQ ID NO: 1813935 - RNA, 20 nt, Human
auuaaaaaugcauauacuuu

SEQ ID NO: 1813936 - RNA, 19 nt, Human
aucugagagaugacaggga

SEQ ID NO: 1813937 - RNA, 15 nt, Human
ggggcauggaaggca

SEQ ID NO: 1813938 - RNA, 15 nt, Human
aggcuguucccacca

SEQ ID NO: 1813939 - RNA, 14 nt, Human
acaagcagcccuua

SEQ ID NO: 1813940 - RNA, 17 nt, Human
cugcccucccccuccuc

SEQ ID NO: 1813941 - RNA, 14 nt, Human
uucagcccucagaa

SEQ ID NO: 1813942 - RNA, 21 nt, Human
gacagaaaaaacugagaugua

SEQ ID NO: 1813943 - RNA, 14 nt, Human
cagauuugagcuca

SEQ ID NO: 1813944 - RNA, 19 nt, Human
cccagguuggagugcagug

SEQ ID NO: 1813945 - RNA, 18 nt, Human
ccaaacugccuaagcccu

SEQ ID NO: 1813946 - RNA, 14 nt, Human
cagccgucaaaaga

SEQ ID NO: 1813947 - RNA, 23 nt, Human
ucaagccuaaaauuguauagacc

SEQ ID NO: 1813948 - RNA, 12 nt, Human
ucucaugaaccu

SEQ ID NO: 1813949 - RNA, 21 nt, Human
cucacugcaaccucugccucc

SEQ ID NO: 1813950 - RNA, 23 nt, Human
guagaugccacuagcccuccucu

SEQ ID NO: 1813951 - RNA, 18 nt, Human
uaaaagauggggucugua

SEQ ID NO: 1813952 - RNA, 20 nt, Human
cuuuauguuacuacaugcac

SEQ ID NO: 1813953 - RNA, 23 nt, Human
ucacaccaggcuugccugcaggc

SEQ ID NO: 1813954 - RNA, 22 nt, Human
augcacuuggcugcauaaaugu

SEQ ID NO: 1813955 - RNA, 13 nt, Human
ucacuuucccaaa

SEQ ID NO: 1813956 - RNA, 20 nt, Human
cugagagcccaaacugcugu

SEQ ID NO: 1813957 - RNA, 14 nt, Human
cucaguucccucuu

SEQ ID NO: 1813958 - RNA, 20 nt, Human
uagccaccgagauccuuauc

SEQ ID NO: 1813959 - RNA, 21 nt, Human
uaaaagauggggucuguaaaa

SEQ ID NO: 1813960 - RNA, 17 nt, Human
cuauguggaaguggggc

SEQ ID NO: 1813961 - RNA, 20 nt, Human
caacaugcacugauguugug

SEQ ID NO: 1813962 - RNA, 16 nt, Human
auuccuccuucccuug

SEQ ID NO: 1813963 - RNA, 17 nt, Human
cuggggaagacaguggc

SEQ ID NO: 1813964 - RNA, 21 nt, Human
guaacaggcuugaaucaaaga

SEQ ID NO: 1813965 - RNA, 12 nt, Human
auuagaccaagc

SEQ ID NO: 1813966 - RNA, 23 nt, Human
gggagccugaucaccugcccugc

SEQ ID NO: 1813967 - RNA, 14 nt, Human
aauugcagaguacu

SEQ ID NO: 1813968 - RNA, 23 nt, Human
acauauccaggcaccaggacuag

SEQ ID NO: 1813969 - RNA, 14 nt, Human
ucuugaaaaaugca

SEQ ID NO: 1813970 - RNA, 15 nt, Human
cuuauuauuuuugag

SEQ ID NO: 1813971 - RNA, 19 nt, Human
cacagcaagucaggguugg

SEQ ID NO: 1813972 - RNA, 22 nt, Human
gaaauaagccagacaucaacag

SEQ ID NO: 1813973 - RNA, 14 nt, Human
gccaucuuggacuu

SEQ ID NO: 1813974 - RNA, 22 nt, Human
uggcccaacacaauucuucuuc

SEQ ID NO: 1813975 - RNA, 21 nt, Human
acagcacccucuccagaugag

SEQ ID NO: 1813976 - RNA, 20 nt, Human
auaaacugauuuaucuauuu

SEQ ID NO: 1813977 - RNA, 19 nt, Human
acagcacccucuccagaug

SEQ ID NO: 1813978 - RNA, 12 nt, Human
guggaagugggg

SEQ ID NO: 1813979 - RNA, 22 nt, Human
cauuuaaauaaaguguuugaaa

SEQ ID NO: 1813980 - RNA, 14 nt, Human
ucccuccacauuuc

SEQ ID NO: 1813981 - RNA, 15 nt, Human
ccauguuggccaggc

SEQ ID NO: 1813982 - RNA, 14 nt, Human
uggucuccaucucu

SEQ ID NO: 1813983 - RNA, 21 nt, Human
uggugcccaguuagccucugc

SEQ ID NO: 1813984 - RNA, 21 nt, Human
cuuacugauuuuuaaguuauu

SEQ ID NO: 1813985 - RNA, 16 nt, Human
auuuccucauuuuuau

SEQ ID NO: 1813986 - RNA, 19 nt, Human
cuaauuuuuaggcugaaag

SEQ ID NO: 1813987 - RNA, 16 nt, Human
agauauuuuucaugau

SEQ ID NO: 1813988 - RNA, 20 nt, Human
gaacguaaucguguccccua

SEQ ID NO: 1813989 - RNA, 23 nt, Human
uuuuuacauucugaauauguccu

SEQ ID NO: 1813990 - RNA, 15 nt, Human
gugccuuucuucucu

SEQ ID NO: 1813991 - RNA, 18 nt, Human
gccugcucccuagccaga

SEQ ID NO: 1813992 - RNA, 19 nt, Human
uccagccuggcaaggguuc

SEQ ID NO: 1813993 - RNA, 15 nt, Human
agcaucucuggccug

SEQ ID NO: 1813994 - RNA, 18 nt, Human
caggacuagggcuggagu

SEQ ID NO: 1813995 - RNA, 11 nt, Human
aggaugaugac

SEQ ID NO: 1813996 - RNA, 22 nt, Human
auauaccugauauauuccacca

SEQ ID NO: 1813997 - RNA, 14 nt, Human
gagcaaguccuucc

SEQ ID NO: 1813998 - RNA, 15 nt, Human
gaaagcagccuggcc

SEQ ID NO: 1813999 - RNA, 19 nt, Human
gcaguggcgcgaucucagc

SEQ ID NO: 1814000 - RNA, 17 nt, Human
ggagcucguggaacagu

SEQ ID NO: 1814001 - RNA, 22 nt, Human
agacaauuguuggagagccccu

SEQ ID NO: 1814002 - RNA, 14 nt, Human
cuuucauaauaagu

SEQ ID NO: 1814003 - RNA, 13 nt, Human
ucucaaaaaaaaa

SEQ ID NO: 1814004 - RNA, 14 nt, Human
ccccuagccugccu

SEQ ID NO: 1814005 - RNA, 20 nt, Human
cugagauccuuccuuuugag

SEQ ID NO: 1814006 - RNA, 23 nt, Human
augcugcuggggaagacaguggc

SEQ ID NO: 1814007 - RNA, 13 nt, Human
aaaguaaaaacaa

SEQ ID NO: 1814008 - RNA, 20 nt, Human
ggaguucucccaccaccuca

SEQ ID NO: 1814009 - RNA, 15 nt, Human
cucccagcucagggc

SEQ ID NO: 1814010 - RNA, 13 nt, Human
acauucuaucuau

SEQ ID NO: 1814011 - RNA, 13 nt, Human
cucuucuccaucc

SEQ ID NO: 1814012 - RNA, 15 nt, Human
cuccuuguucugaua

SEQ ID NO: 1814013 - RNA, 19 nt, Human
ccgggcgugguggugagug

SEQ ID NO: 1814014 - RNA, 22 nt, Human
ccccuuugcugacccuccccaa

SEQ ID NO: 1814015 - RNA, 22 nt, Human
auuuaugcauauuauuuuaugu

SEQ ID NO: 1814016 - RNA, 21 nt, Human
uuauuuugugaugcaaauaaa

SEQ ID NO: 1814017 - RNA, 14 nt, Human
ucucugaauuugag

SEQ ID NO: 1814018 - RNA, 14 nt, Human
uuucauauuuuuca

SEQ ID NO: 1814019 - RNA, 15 nt, Human
aguugagacaagaaa

SEQ ID NO: 1814020 - RNA, 18 nt, Human
uuuauggcacuaguauuu

SEQ ID NO: 1814021 - RNA, 20 nt, Human
gccccuuugcugacccuccc

SEQ ID NO: 1814022 - RNA, 13 nt, Human
ccauccuaccaca

SEQ ID NO: 1814023 - RNA, 12 nt, Human
ccccuugccaua

SEQ ID NO: 1814024 - RNA, 12 nt, Human
uguuugaaagcu

SEQ ID NO: 1814025 - RNA, 15 nt, Human
agauucaugcacugu

SEQ ID NO: 1814026 - RNA, 13 nt, Human
ugagcgacaguga

SEQ ID NO: 1814027 - RNA, 22 nt, Human
cucuccaggagaccuacccucc

SEQ ID NO: 1814028 - RNA, 18 nt, Human
gaaggugaucuggcucug

SEQ ID NO: 1814029 - RNA, 16 nt, Human
uuccugggucuaccac

SEQ ID NO: 1814030 - RNA, 14 nt, Human
ucacuaucuguaau

SEQ ID NO: 1814031 - RNA, 16 nt, Human
ucuuauaauuuaaaau

SEQ ID NO: 1814032 - RNA, 13 nt, Human
ucucuugauuuuc

SEQ ID NO: 1814033 - RNA, 13 nt, Human
aagauugagagaa

SEQ ID NO: 1814034 - RNA, 21 nt, Human
uuuggcauuuuacuguacaga

SEQ ID NO: 1814035 - RNA, 15 nt, Human
aaauuauucauaauu

SEQ ID NO: 1814036 - RNA, 15 nt, Human
uguaucuaugcauuu

SEQ ID NO: 1814037 - RNA, 14 nt, Human
cuaauguugaauuu

SEQ ID NO: 1814038 - RNA, 21 nt, Human
agcauuugucaacaaagucac

SEQ ID NO: 1814039 - RNA, 23 nt, Human
uuuauuaugcauuauaucaaauc

SEQ ID NO: 1814040 - RNA, 22 nt, Human
ugugagcucaccagucccuccc

SEQ ID NO: 1814041 - RNA, 19 nt, Human
guaauuugaaauauuuucu

SEQ ID NO: 1814042 - RNA, 14 nt, Human
cucugucuucuuug

SEQ ID NO: 1814043 - RNA, 22 nt, Human
caucaucuucuggguuaggccu

SEQ ID NO: 1814044 - RNA, 10 nt, Human
uuacuuuuuc

SEQ ID NO: 1814045 - RNA, 13 nt, Human
uaggacccuuccc

SEQ ID NO: 1814046 - RNA, 13 nt, Human
auuuuacuguaca

SEQ ID NO: 1814047 - RNA, 23 nt, Human
accaggcugcucagggcuggucu

SEQ ID NO: 1814048 - RNA, 17 nt, Human
ucucauccugcaggcag

SEQ ID NO: 1814049 - RNA, 15 nt, Human
auaauauauuuuaaa

SEQ ID NO: 1814050 - RNA, 21 nt, Human
auuccuuuuucucuccucucc

SEQ ID NO: 1814051 - RNA, 14 nt, Human
acacagacauccuc

SEQ ID NO: 1814052 - RNA, 12 nt, Human
ccagcucugcau

SEQ ID NO: 1814053 - RNA, 22 nt, Human
acuugcucuugaugccuggcgg

SEQ ID NO: 1814054 - RNA, 13 nt, Human
ucauugugaaauu

SEQ ID NO: 1814055 - RNA, 12 nt, Human
gaauuggagcuc

SEQ ID NO: 1814056 - RNA, 14 nt, Human
accucccccccccc

SEQ ID NO: 1814057 - RNA, 15 nt, Human
uaacaauaaaagaca

SEQ ID NO: 1814058 - RNA, 13 nt, Human
uagcaugaagaca

SEQ ID NO: 1814059 - RNA, 17 nt, Human
ccagccucagccuccca

SEQ ID NO: 1814060 - RNA, 20 nt, Human
ugaauauuuaguguucauaa

SEQ ID NO: 1814061 - RNA, 19 nt, Human
ccuauuccuccuucccuug

SEQ ID NO: 1814062 - RNA, 22 nt, Human
guaaagaacaucccuccuggga

SEQ ID NO: 1814063 - RNA, 17 nt, Human
uuuccacauucagagcu

SEQ ID NO: 1814064 - RNA, 16 nt, Human
ugcugggccccugccu

SEQ ID NO: 1814065 - RNA, 13 nt, Human
auggaggaaagug

SEQ ID NO: 1814066 - RNA, 21 nt, Human
ugucugccacaccucuccaaa

SEQ ID NO: 1814067 - RNA, 19 nt, Human
caugauuuggggaaaggag

SEQ ID NO: 1814068 - RNA, 16 nt, Human
uugccucugagagcau

SEQ ID NO: 1814069 - RNA, 13 nt, Human
uugacaaagguaa

SEQ ID NO: 1814070 - RNA, 13 nt, Human
auaaaaauaaaaa

SEQ ID NO: 1814071 - RNA, 20 nt, Human
uguaaaaccuggagauggug

SEQ ID NO: 1814072 - RNA, 18 nt, Human
cuacccuggacuugccuc

SEQ ID NO: 1814073 - RNA, 15 nt, Human
aaauaauuuuuauau

SEQ ID NO: 1814074 - RNA, 22 nt, Human
gaaauuguaacuaaaguuagaa

SEQ ID NO: 1814075 - RNA, 19 nt, Human
ggagagccccucacacagc

SEQ ID NO: 1814076 - RNA, 19 nt, Human
aaaagauugagagaauuug

SEQ ID NO: 1814077 - RNA, 16 nt, Human
caugcugagagagcug

SEQ ID NO: 1814078 - RNA, 17 nt, Human
cccuagucucuacccag

SEQ ID NO: 1814079 - RNA, 13 nt, Human
uccaacucaucca

SEQ ID NO: 1814080 - RNA, 19 nt, Human
cauggaauuggagcucgug

SEQ ID NO: 1814081 - RNA, 14 nt, Human
aacuuugauuuuau

SEQ ID NO: 1814082 - RNA, 23 nt, Human
ggcuccuccauaucucccucuuc

SEQ ID NO: 1814083 - RNA, 23 nt, Human
cagucuuccucccuguguauuca

SEQ ID NO: 1814084 - RNA, 19 nt, Human
augcccggcuaauuuuugu

SEQ ID NO: 1814085 - RNA, 18 nt, Human
cccacuggacucaccucc

SEQ ID NO: 1814086 - RNA, 22 nt, Human
caagauuucagauuugugacca

SEQ ID NO: 1814087 - RNA, 12 nt, Human
cagauuuuccug

SEQ ID NO: 1814088 - RNA, 14 nt, Human
agaaaugaaaaaau

SEQ ID NO: 1814089 - RNA, 18 nt, Human
caaaacuagagacucaaa

SEQ ID NO: 1814090 - RNA, 18 nt, Human
cauacauuuucuaagaaa

SEQ ID NO: 1814091 - RNA, 21 nt, Human
augucauuugcuggagcucug

SEQ ID NO: 1814092 - RNA, 13 nt, Human
uuuugaaucauca

SEQ ID NO: 1814093 - RNA, 13 nt, Human
ugcucucccagcc

SEQ ID NO: 1814094 - RNA, 22 nt, Human
gaugguucccuugaugaagaag

SEQ ID NO: 1814095 - RNA, 22 nt, Human
gacgcccucacugcaggcuccc

SEQ ID NO: 1814096 - RNA, 16 nt, Human
uauuuuaaauauuuuu

SEQ ID NO: 1814097 - RNA, 15 nt, Human
cauaauuauuauuug

SEQ ID NO: 1814098 - RNA, 23 nt, Human
auauuuacaugaauugcauuuua

SEQ ID NO: 1814099 - RNA, 15 nt, Human
guacaguuauuuaug

SEQ ID NO: 1814100 - RNA, 22 nt, Human
gcuuggacugaagggguucuca

SEQ ID NO: 1814101 - RNA, 16 nt, Human
acacucagauccuccu

SEQ ID NO: 1814102 - RNA, 19 nt, Human
aaaagggcuuucucaauaa

SEQ ID NO: 1814103 - RNA, 16 nt, Human
auagagaaauaugauu

SEQ ID NO: 1814104 - RNA, 20 nt, Human
agcugcccccagagccacag

SEQ ID NO: 1814105 - RNA, 13 nt, Human
agguauucguuau

SEQ ID NO: 1814106 - RNA, 11 nt, Human
ccacaucugag

SEQ ID NO: 1814107 - RNA, 14 nt, Human
accacaagacugca

SEQ ID NO: 1814108 - RNA, 18 nt, Human
aucacauucagggcuauu

SEQ ID NO: 1814109 - RNA, 19 nt, Human
auuaaguuuuuuuuuaaaa

SEQ ID NO: 1814110 - RNA, 16 nt, Human
guaaagaauuauuuug

SEQ ID NO: 1814111 - RNA, 18 nt, Human
aacacauaucgauuuuua

SEQ ID NO: 1814112 - RNA, 21 nt, Human
ucaagugcuucuccagccuca

SEQ ID NO: 1814113 - RNA, 12 nt, Human
uacccuucuuuu

SEQ ID NO: 1814114 - RNA, 15 nt, Human
agagucacucacauc

SEQ ID NO: 1814115 - RNA, 22 nt, Human
acaguucuuuguuuggaggcuc

SEQ ID NO: 1814116 - RNA, 18 nt, Human
cguccugucggagcccug

SEQ ID NO: 1814117 - RNA, 14 nt, Human
cacacaugggauca

SEQ ID NO: 1814118 - RNA, 16 nt, Human
guauuuuuaguagaga

SEQ ID NO: 1814119 - RNA, 23 nt, Human
auuccaccaggauauccucccuc

SEQ ID NO: 1814120 - RNA, 13 nt, Human
gaugauccccacg

SEQ ID NO: 1814121 - RNA, 11 nt, Human
auguguaucuc

SEQ ID NO: 1814122 - RNA, 21 nt, Human
ucauauaaucuuacaaugaaa

SEQ ID NO: 1814123 - RNA, 17 nt, Human
cacugaugacuuuuuau

SEQ ID NO: 1814124 - RNA, 21 nt, Human
ucaaacccauucccucuccag

SEQ ID NO: 1814125 - RNA, 17 nt, Human
cucuggauuauauuaug

SEQ ID NO: 1814126 - RNA, 22 nt, Human
gaaauuuauaaacuuuuuucuu

SEQ ID NO: 1814127 - RNA, 22 nt, Human
cauuuaguuauaaaaauauaua

SEQ ID NO: 1814128 - RNA, 19 nt, Human
gaaagaaaauaacaauaaa

SEQ ID NO: 1814129 - RNA, 16 nt, Human
uaaaagacaaggaaaa

SEQ ID NO: 1814130 - RNA, 16 nt, Human
ucuuucuuagaaauuu

SEQ ID NO: 1814131 - RNA, 16 nt, Human
agacauacauuucuca

SEQ ID NO: 1814132 - RNA, 16 nt, Human
auuuuuguaguuuuag

SEQ ID NO: 1814133 - RNA, 20 nt, Human
cacauguaucuaugcauuuu

SEQ ID NO: 1814134 - RNA, 21 nt, Human
aaacgaggauugggaaaaagu

SEQ ID NO: 1814135 - RNA, 16 nt, Human
ccucuaugguguggca

SEQ ID NO: 1814136 - RNA, 20 nt, Human
uuguaggugacuauuauauu

SEQ ID NO: 1814137 - RNA, 14 nt, Human
gcauuacugcaugc

SEQ ID NO: 1814138 - RNA, 14 nt, Human
aauucauguugccu

SEQ ID NO: 1814139 - RNA, 18 nt, Human
acacuguuaucuucacuu

SEQ ID NO: 1814140 - RNA, 13 nt, Human
auucccucuccag

SEQ ID NO: 1814141 - RNA, 16 nt, Human
uaaaauuuuuaaucuu

SEQ ID NO: 1814142 - RNA, 19 nt, Human
uauuauaauucaaaggcau

SEQ ID NO: 1814143 - RNA, 20 nt, Human
cuaggguggugcauuuuugu

SEQ ID NO: 1814144 - RNA, 23 nt, Human
ucuuucuaaugagauauuaaacc

SEQ ID NO: 1814145 - RNA, 19 nt, Human
acuagacaaguccagccug

SEQ ID NO: 1814146 - RNA, 23 nt, Human
auguagccccucuccuggaagug

SEQ ID NO: 1814147 - RNA, 16 nt, Human
cccacuugcuuuuaaa

SEQ ID NO: 1814148 - RNA, 22 nt, Human
cuaggauuguagucccaaagag

SEQ ID NO: 1814149 - RNA, 19 nt, Human
ugguucucauaacucugug

SEQ ID NO: 1814150 - RNA, 16 nt, Human
acuguauguccuuggu

SEQ ID NO: 1814151 - RNA, 16 nt, Human
caauauaagcuuuucu

SEQ ID NO: 1814152 - RNA, 12 nt, Human
gccucacacaca

SEQ ID NO: 1814153 - RNA, 16 nt, Human
aagacugcacaucaaa

SEQ ID NO: 1814154 - RNA, 23 nt, Human
cuccccaaaggcuuugcccugcu

SEQ ID NO: 1814155 - RNA, 15 nt, Human
caccaccacgccugg

SEQ ID NO: 1814156 - RNA, 20 nt, Human
auacaauuaaagcuguuauu

SEQ ID NO: 1814157 - RNA, 17 nt, Human
cugcacgaauggaagag

SEQ ID NO: 1814158 - RNA, 14 nt, Human
uuuucauuauuccu

SEQ ID NO: 1814159 - RNA, 17 nt, Human
ccuuucugccccugcug

SEQ ID NO: 1814160 - RNA, 19 nt, Human
ccacucuuagcuaaauccc

SEQ ID NO: 1814161 - RNA, 16 nt, Human
ggcuaagcacgggcca

SEQ ID NO: 1814162 - RNA, 17 nt, Human
caguggcgugaucucag

SEQ ID NO: 1814163 - RNA, 14 nt, Human
aauuaccacaccau

SEQ ID NO: 1814164 - RNA, 16 nt, Human
aaguaaaugugauuua

SEQ ID NO: 1814165 - RNA, 17 nt, Human
gucaaagcugaaaugga

SEQ ID NO: 1814166 - RNA, 21 nt, Human
ucagccuacaggccucacaca

SEQ ID NO: 1814167 - RNA, 16 nt, Human
uugucauuguuauaua

SEQ ID NO: 1814168 - RNA, 13 nt, Human
ucauccugcaggc

SEQ ID NO: 1814169 - RNA, 17 nt, Human
cagacaagcugcauuuc

SEQ ID NO: 1814170 - RNA, 15 nt, Human
cccaguuagccucug

SEQ ID NO: 1814171 - RNA, 18 nt, Human
ugggugaaagauggaacu

SEQ ID NO: 1814172 - RNA, 14 nt, Human
gcuggagugcagug

SEQ ID NO: 1814173 - RNA, 19 nt, Human
cuugcagcucuccccuucu

SEQ ID NO: 1814174 - RNA, 10 nt, Human
aaaguuuuuu

SEQ ID NO: 1814175 - RNA, 15 nt, Human
ugggcagaaggccaa

SEQ ID NO: 1814176 - RNA, 20 nt, Human
gacuggauaguccgucucug

SEQ ID NO: 1814177 - RNA, 18 nt, Human
auauugauaagaucuuuu

SEQ ID NO: 1814178 - RNA, 21 nt, Human
gcuuuaaugaauaaacauuug

SEQ ID NO: 1814179 - RNA, 12 nt, Human
ccaggacgcccu

SEQ ID NO: 1814180 - RNA, 14 nt, Human
ggccuauguggucu

SEQ ID NO: 1814181 - RNA, 19 nt, Human
cccccgccacccucccacu

SEQ ID NO: 1814182 - RNA, 19 nt, Human
cauuacggagaguuuccua

SEQ ID NO: 1814183 - RNA, 19 nt, Human
gcugcucagggcuggucuu

SEQ ID NO: 1814184 - RNA, 21 nt, Human
uucauacauuuucuaagaaac

SEQ ID NO: 1814185 - RNA, 17 nt, Human
uccugccccugagccca

SEQ ID NO: 1814186 - RNA, 14 nt, Human
cauaugaauaacau

SEQ ID NO: 1814187 - RNA, 19 nt, Human
uguggauuuaauguggaaa

SEQ ID NO: 1814188 - RNA, 14 nt, Human
guucccaccaggcu

SEQ ID NO: 1814189 - RNA, 16 nt, Human
cuuguauuuuuccaau

SEQ ID NO: 1814190 - RNA, 23 nt, Human
agguccuuaggccucugagaagc

SEQ ID NO: 1814191 - RNA, 20 nt, Human
cugaauuugagauacaaaca

SEQ ID NO: 1814192 - RNA, 15 nt, Human
cguucacauuuuugu

SEQ ID NO: 1814193 - RNA, 19 nt, Human
ucuguggccagaauuuaaa

SEQ ID NO: 1814194 - RNA, 16 nt, Human
ccuguccugaccuguc

SEQ ID NO: 1814195 - RNA, 15 nt, Human
uacuuuagggaagua

SEQ ID NO: 1814196 - RNA, 23 nt, Human
gucucccucccuuggggccuaug

SEQ ID NO: 1814197 - RNA, 21 nt, Human
uauguguuugacgggaaacaa

SEQ ID NO: 1814198 - RNA, 15 nt, Human
gaaucucucuucuuu

SEQ ID NO: 1814199 - RNA, 16 nt, Human
acuccuaggaaaauac

SEQ ID NO: 1814200 - RNA, 19 nt, Human
agagguggccaagccaacc

SEQ ID NO: 1814201 - RNA, 19 nt, Human
ucuccagccucagccuccc

SEQ ID NO: 1814202 - RNA, 23 nt, Human
ucuccauguacuggcaagaccug

SEQ ID NO: 1814203 - RNA, 18 nt, Human
gaaaauaacgauaaaaga

SEQ ID NO: 1814204 - RNA, 18 nt, Human
cucaugcauuguccucuu

SEQ ID NO: 1814205 - RNA, 22 nt, Human
ggagggguuaaagcugccggca

SEQ ID NO: 1814206 - RNA, 15 nt, Human
gaaagugaaguaggc

SEQ ID NO: 1814207 - RNA, 22 nt, Human
cuagacuagucucaaacuccug

SEQ ID NO: 1814208 - RNA, 20 nt, Human
auuuucaguuauuauauuua

SEQ ID NO: 1814209 - RNA, 18 nt, Human
aguaucuuuuuauucagc

SEQ ID NO: 1814210 - RNA, 13 nt, Human
ggaaguagaggag

SEQ ID NO: 1814211 - RNA, 18 nt, Human
ucaacuuuuccuuugaau

SEQ ID NO: 1814212 - RNA, 21 nt, Human
ggagcgagugggggccagcca

SEQ ID NO: 1814213 - RNA, 20 nt, Human
ugaaaauuaacaugaauauu

SEQ ID NO: 1814214 - RNA, 22 nt, Human
uuuugcccaucccaaaaucaua

SEQ ID NO: 1814215 - RNA, 22 nt, Human
auucauguugccuugcauaaug

SEQ ID NO: 1814216 - RNA, 14 nt, Human
gccaggacccagga

SEQ ID NO: 1814217 - RNA, 13 nt, Human
ccucccacugcca

SEQ ID NO: 1814218 - RNA, 15 nt, Human
uuaauuuguaguguu

SEQ ID NO: 1814219 - RNA, 16 nt, Human
aauagaaauggggaac

SEQ ID NO: 1814220 - RNA, 20 nt, Human
uaucuuuucauacauuuucu

SEQ ID NO: 1814221 - RNA, 23 nt, Human
augugaauuguuaguuucugagu

SEQ ID NO: 1814222 - RNA, 12 nt, Human
auauuuuucuua

SEQ ID NO: 1814223 - RNA, 15 nt, Human
aggaguauccucuug

SEQ ID NO: 1814224 - RNA, 22 nt, Human
ugcuucuccagccucagccucc

SEQ ID NO: 1814225 - RNA, 13 nt, Human
uuuaaaaauccua

SEQ ID NO: 1814226 - RNA, 21 nt, Human
cuagagugacucacuaauuca

SEQ ID NO: 1814227 - RNA, 13 nt, Human
aaauaaaaauaau

SEQ ID NO: 1814228 - RNA, 20 nt, Human
aguggauuuuacauguggcc

SEQ ID NO: 1814229 - RNA, 15 nt, Human
uguacaauaaagcaa

SEQ ID NO: 1814230 - RNA, 24 nt, Human
uagauauuaccaguuuuccuaagu

SEQ ID NO: 1814231 - RNA, 17 nt, Human
cacauguuccccuuggg

SEQ ID NO: 1814232 - RNA, 22 nt, Human
gcaaguccuucccuuucauuuu

SEQ ID NO: 1814233 - RNA, 17 nt, Human
ucuuuacuuuccccuug

SEQ ID NO: 1814234 - RNA, 19 nt, Human
cacuaggguccaccaggag

SEQ ID NO: 1814235 - RNA, 23 nt, Human
auaauguguucauucuggaauaa

SEQ ID NO: 1814236 - RNA, 15 nt, Human
agucuguuccccaug

SEQ ID NO: 1814237 - RNA, 16 nt, Human
cacuguguauuuaacu

SEQ ID NO: 1814238 - RNA, 19 nt, Human
gucagcucuucuccauccu

SEQ ID NO: 1814239 - RNA, 13 nt, Human
ugacaaccaaaag

SEQ ID NO: 1814240 - RNA, 23 nt, Human
agcaggguugguuucccuucuuu

SEQ ID NO: 1814241 - RNA, 15 nt, Human
uaaguuaacaccuuu

SEQ ID NO: 1814242 - RNA, 16 nt, Human
cagaggcucuaaugua

SEQ ID NO: 1814243 - RNA, 14 nt, Human
gcagacucacugug

SEQ ID NO: 1814244 - RNA, 20 nt, Human
gcuuuuuuuuuuucccuucc

SEQ ID NO: 1814245 - RNA, 16 nt, Human
uaaaggaauuuaaaaa

SEQ ID NO: 1814246 - RNA, 13 nt, Human
cuuaaauaaaccu

SEQ ID NO: 1814247 - RNA, 14 nt, Human
cgugagccaccaug

SEQ ID NO: 1814248 - RNA, 18 nt, Human
uuucacuguguuggccag

SEQ ID NO: 1814249 - RNA, 16 nt, Human
ccuguguauucauucu

SEQ ID NO: 1814250 - RNA, 12 nt, Human
aauuuugaaaaa

SEQ ID NO: 1814251 - RNA, 20 nt, Human
cgauucacccuguccaaacu

SEQ ID NO: 1814252 - RNA, 16 nt, Human
guucauaaauaaaguu

SEQ ID NO: 1814253 - RNA, 17 nt, Human
ucugugagaugcuagaa

SEQ ID NO: 1814254 - RNA, 17 nt, Human
aauaacaauaaaagaca

SEQ ID NO: 1814255 - RNA, 15 nt, Human
aaggaauuuaaaaau

SEQ ID NO: 1814256 - RNA, 22 nt, Human
gucucagcuucacccugaggug

SEQ ID NO: 1814257 - RNA, 13 nt, Human
acaaugaaaagga

SEQ ID NO: 1814258 - RNA, 19 nt, Human
ugaggccagggagcgagug

SEQ ID NO: 1814259 - RNA, 15 nt, Human
cuuuuuccuuccagu

SEQ ID NO: 1814260 - RNA, 15 nt, Human
uuguacauauaagug

SEQ ID NO: 1814261 - RNA, 20 nt, Human
acaugcauuacugcaugcac

SEQ ID NO: 1814262 - RNA, 14 nt, Human
aggaugagggaaaa

SEQ ID NO: 1814263 - RNA, 18 nt, Human
caggcacagguccccaga

SEQ ID NO: 1814264 - RNA, 19 nt, Human
ccuccauccugaggcucca

SEQ ID NO: 1814265 - RNA, 13 nt, Human
cucagaugcacau

SEQ ID NO: 1814266 - RNA, 11 nt, Human
uggagugcagu

SEQ ID NO: 1814267 - RNA, 19 nt, Human
ucaaaaaaaaaaacaaaca

SEQ ID NO: 1814268 - RNA, 18 nt, Human
cugcauccauucuccuga

SEQ ID NO: 1814269 - RNA, 20 nt, Human
cuuagaccaccaagccuuga

SEQ ID NO: 1814270 - RNA, 20 nt, Human
ggcaagugggugaaagaugg

SEQ ID NO: 1814271 - RNA, 22 nt, Human
ucuuauuauuuuugagacagag

SEQ ID NO: 1814272 - RNA, 20 nt, Human
gaaaaguuauguagaaaaaa

SEQ ID NO: 1814273 - RNA, 23 nt, Human
cagagucaagggugugugcagca

SEQ ID NO: 1814274 - RNA, 14 nt, Human
cuguuucuuccaca

SEQ ID NO: 1814275 - RNA, 18 nt, Human
ggccacucuuagcuaaau

SEQ ID NO: 1814276 - RNA, 15 nt, Human
ccucauguccacugg

SEQ ID NO: 1814277 - RNA, 14 nt, Human
ggcgugaucucagc

SEQ ID NO: 1814278 - RNA, 16 nt, Human
cagauucaugcacugu

SEQ ID NO: 1814279 - RNA, 13 nt, Human
gucccagaaaaag

SEQ ID NO: 1814280 - RNA, 23 nt, Human
uuccaggugguaagcaccaggac

SEQ ID NO: 1814281 - RNA, 20 nt, Human
cuugccauaauuacuauguc

SEQ ID NO: 1814282 - RNA, 16 nt, Human
uccugggaacaucaca

SEQ ID NO: 1814283 - RNA, 19 nt, Human
uaauaauuuuuuaauugau

SEQ ID NO: 1814284 - RNA, 18 nt, Human
cagaaaugcugucauaau

SEQ ID NO: 1814285 - RNA, 22 nt, Human
aagugcuaauuuugaaaaacug

SEQ ID NO: 1814286 - RNA, 13 nt, Human
uaugucuuuuacc

SEQ ID NO: 1814287 - RNA, 23 nt, Human
cagccagugaccaaccuuuuccc

SEQ ID NO: 1814288 - RNA, 13 nt, Human
ugaaagaaaauaa

SEQ ID NO: 1814289 - RNA, 20 nt, Human
auguuucuuggggaauaugu

SEQ ID NO: 1814290 - RNA, 21 nt, Human
cuauguuuugacauuuuuagu

SEQ ID NO: 1814291 - RNA, 20 nt, Human
auaacaaugcuguauuuuaa

SEQ ID NO: 1814292 - RNA, 22 nt, Human
uacauauugucacugacacaca

SEQ ID NO: 1814293 - RNA, 23 nt, Human
acaaugcagugccuuucuucucu

SEQ ID NO: 1814294 - RNA, 12 nt, Human
auucugaaagca

SEQ ID NO: 1814295 - RNA, 15 nt, Human
gcacagguccccaga

SEQ ID NO: 1814296 - RNA, 13 nt, Human
ugaaaaaauauau

SEQ ID NO: 1814297 - RNA, 15 nt, Human
accuaccaagauaua

SEQ ID NO: 1814298 - RNA, 22 nt, Human
cauguuucuuuguaaugaaaac

SEQ ID NO: 1814299 - RNA, 19 nt, Human
caaaaaaaaaauuugccaa

SEQ ID NO: 1814300 - RNA, 17 nt, Human
cauuucccccuagccug

SEQ ID NO: 1814301 - RNA, 18 nt, Human
aacugccaucauuuacuu

SEQ ID NO: 1814302 - RNA, 14 nt, Human
ugcuguauaaaauc

SEQ ID NO: 1814303 - RNA, 18 nt, Human
aagcccaucauaauauaa

SEQ ID NO: 1814304 - RNA, 19 nt, Human
cugcucccuagccagaggc

SEQ ID NO: 1814305 - RNA, 20 nt, Human
auuuccauuuacccuucuuu

SEQ ID NO: 1814306 - RNA, 18 nt, Human
ucaccagcccuggcaacu

SEQ ID NO: 1814307 - RNA, 23 nt, Human
agcagcccuuagcccuuccccuc

SEQ ID NO: 1814308 - RNA, 21 nt, Human
ccugcauugagcuugcaugcu

SEQ ID NO: 1814309 - RNA, 13 nt, Human
auccaagcaaaug

SEQ ID NO: 1814310 - RNA, 14 nt, Human
agaaauaggaaaua

SEQ ID NO: 1814311 - RNA, 18 nt, Human
cuccccaaaugcuuucca

SEQ ID NO: 1814312 - RNA, 18 nt, Human
aauauugauuuauuaaua

SEQ ID NO: 1814313 - RNA, 14 nt, Human
auacaaaaaaaaaa

SEQ ID NO: 1814314 - RNA, 21 nt, Human
auuaacucagacacaaauaaa

SEQ ID NO: 1814315 - RNA, 14 nt, Human
uauaauuuaaauau

SEQ ID NO: 1814316 - RNA, 13 nt, Human
cugccauauauuu

SEQ ID NO: 1814317 - RNA, 17 nt, Human
auuaaagaagagaacug

SEQ ID NO: 1814318 - RNA, 16 nt, Human
accugcucagcccugc

SEQ ID NO: 1814319 - RNA, 18 nt, Human
uaaaaaaggaauccucug

SEQ ID NO: 1814320 - RNA, 20 nt, Human
ccaaguuauccaccugccuu

SEQ ID NO: 1814321 - RNA, 22 nt, Human
acccuuucugccccugcugaca

SEQ ID NO: 1814322 - RNA, 20 nt, Human
gcuaucugggcugugggcaa

SEQ ID NO: 1814323 - RNA, 16 nt, Human
aaucucucuucuuuuc

SEQ ID NO: 1814324 - RNA, 20 nt, Human
uaagugaaauaagccagaca

SEQ ID NO: 1814325 - RNA, 18 nt, Human
uccuucugagccugccuu

SEQ ID NO: 1814326 - RNA, 19 nt, Human
cuuuucuucuauugccucu

SEQ ID NO: 1814327 - RNA, 12 nt, Human
augacaggaugu

SEQ ID NO: 1814328 - RNA, 21 nt, Human
aaguuuaugguuguauuauuu

SEQ ID NO: 1814329 - RNA, 16 nt, Human
ucccuguuucuuccac

SEQ ID NO: 1814330 - RNA, 17 nt, Human
auucuccugccucagcc

SEQ ID NO: 1814331 - RNA, 19 nt, Human
uguucugugauauaagugu

SEQ ID NO: 1814332 - RNA, 21 nt, Human
aauaauccucaguuuuuguga

SEQ ID NO: 1814333 - RNA, 18 nt, Human
cuuuucccaacuccagaa

SEQ ID NO: 1814334 - RNA, 16 nt, Human
ugggaaagauuacuuu

SEQ ID NO: 1814335 - RNA, 14 nt, Human
cuauugccucugag

SEQ ID NO: 1814336 - RNA, 23 nt, Human
aacugccuucuucggaaagaaga

SEQ ID NO: 1814337 - RNA, 14 nt, Human
ugagaugcuagaac

SEQ ID NO: 1814338 - RNA, 13 nt, Human
aacucauuucuag

SEQ ID NO: 1814339 - RNA, 19 nt, Human
gaacucccucucugcaggc

SEQ ID NO: 1814340 - RNA, 13 nt, Human
aacgucacaucuu

SEQ ID NO: 1814341 - RNA, 17 nt, Human
ucuauaauguguucauu

SEQ ID NO: 1814342 - RNA, 17 nt, Human
uuccaagugauugaaac

SEQ ID NO: 1814343 - RNA, 12 nt, Human
guucaagugcuu

SEQ ID NO: 1814344 - RNA, 22 nt, Human
cccagcccuccuuaucaaagga

SEQ ID NO: 1814345 - RNA, 14 nt, Human
auauuuauuuuaau

SEQ ID NO: 1814346 - RNA, 14 nt, Human
uauucuugauguaa

SEQ ID NO: 1814347 - RNA, 13 nt, Human
cucuaagaaagaa

SEQ ID NO: 1814348 - RNA, 15 nt, Human
uccauucuucccuug

SEQ ID NO: 1814349 - RNA, 17 nt, Human
auauccaguauuguucc

SEQ ID NO: 1814350 - RNA, 20 nt, Human
uuaauuaaaaucaguauuug

SEQ ID NO: 1814351 - RNA, 20 nt, Human
uuaucuucaggacacucacu

SEQ ID NO: 1814352 - RNA, 23 nt, Human
acugcucacacugcugaugauuu

SEQ ID NO: 1814353 - RNA, 16 nt, Human
uggguagccugggugu

SEQ ID NO: 1814354 - RNA, 21 nt, Human
gagcaagucagaauagaaauu

SEQ ID NO: 1814355 - RNA, 20 nt, Human
ucaggagagaguugaaccua

SEQ ID NO: 1814356 - RNA, 19 nt, Human
uccagauauacuugguucu

SEQ ID NO: 1814357 - RNA, 15 nt, Human
cuauuccuccuuccc

SEQ ID NO: 1814358 - RNA, 20 nt, Human
uuuccuucuuuuuuucuuga

SEQ ID NO: 1814359 - RNA, 16 nt, Human
cguuagugcuagugga

SEQ ID NO: 1814360 - RNA, 19 nt, Human
cuuuaaugaauaaacauuu

SEQ ID NO: 1814361 - RNA, 20 nt, Human
cagcuuccaggcuggcgugc

SEQ ID NO: 1814362 - RNA, 14 nt, Human
ccugcucccuagcc

SEQ ID NO: 1814363 - RNA, 16 nt, Human
ccuggcuaauuuuugu

SEQ ID NO: 1814364 - RNA, 15 nt, Human
agugccuuucuucuc

SEQ ID NO: 1814365 - RNA, 19 nt, Human
aacacggugcucauuuuuu

SEQ ID NO: 1814366 - RNA, 21 nt, Human
aucugagucaacuccuuucuc

SEQ ID NO: 1814367 - RNA, 20 nt, Human
aaaacaagcacuaaacaaag

SEQ ID NO: 1814368 - RNA, 18 nt, Human
ccagguuggagugcagug

SEQ ID NO: 1814369 - RNA, 16 nt, Human
gccucccaaagugcug

SEQ ID NO: 1814370 - RNA, 16 nt, Human
cuuuaugcuaagugaa

SEQ ID NO: 1814371 - RNA, 20 nt, Human
gagaaaaaacuuaaguagau

SEQ ID NO: 1814372 - RNA, 13 nt, Human
auugauuauaugu

SEQ ID NO: 1814373 - RNA, 17 nt, Human
acaccuaugucauuuca

SEQ ID NO: 1814374 - RNA, 14 nt, Human
gaccuugucuccca

SEQ ID NO: 1814375 - RNA, 16 nt, Human
gcccuccucucccagu

SEQ ID NO: 1814376 - RNA, 16 nt, Human
gaaaaaaguaaaugug

SEQ ID NO: 1814377 - RNA, 16 nt, Human
cccacuggacucaccu

SEQ ID NO: 1814378 - RNA, 15 nt, Human
auaaagcaauguggu

SEQ ID NO: 1814379 - RNA, 22 nt, Human
caccucccccaucucuucuggg

SEQ ID NO: 1814380 - RNA, 14 nt, Human
uaucuuguuuuggu

SEQ ID NO: 1814381 - RNA, 13 nt, Human
ggaguacacccca

SEQ ID NO: 1814382 - RNA, 23 nt, Human
gccugcucccuagccagaggcuc

SEQ ID NO: 1814383 - RNA, 22 nt, Human
aaaucaugaagauauuuuucca

SEQ ID NO: 1814384 - RNA, 23 nt, Human
auuagcuccuccuuuuuccuucc

SEQ ID NO: 1814385 - RNA, 14 nt, Human
ugugcucaggagcc

SEQ ID NO: 1814386 - RNA, 18 nt, Human
agugucaaugcagccccc

SEQ ID NO: 1814387 - RNA, 23 nt, Human
uguugggguggguauaaaagaug

SEQ ID NO: 1814388 - RNA, 18 nt, Human
gagcgacagugagacucu

SEQ ID NO: 1814389 - RNA, 14 nt, Human
uuuguauaaaauaa

SEQ ID NO: 1814390 - RNA, 18 nt, Human
cccuggacuugccucugc

SEQ ID NO: 1814391 - RNA, 15 nt, Human
aauauguuauuauua

SEQ ID NO: 1814392 - RNA, 14 nt, Human
agaauuuaaaccua

SEQ ID NO: 1814393 - RNA, 17 nt, Human
ugcaaauauaucugcua

SEQ ID NO: 1814394 - RNA, 22 nt, Human
cccuauccuacuuccccuuccu

SEQ ID NO: 1814395 - RNA, 19 nt, Human
uauaagugcuguauaaaau

SEQ ID NO: 1814396 - RNA, 18 nt, Human
uauaacaaugcuguauuu

SEQ ID NO: 1814397 - RNA, 13 nt, Human
accuacuuacaug

SEQ ID NO: 1814398 - RNA, 21 nt, Human
uaguauuucuaugaaauauua

SEQ ID NO: 1814399 - RNA, 18 nt, Human
gauauaagugcuguauaa

SEQ ID NO: 1814400 - RNA, 21 nt, Human
uacacucucaaagcaaauaau

SEQ ID NO: 1814401 - RNA, 23 nt, Human
guaauuccguagguuauuuucag

SEQ ID NO: 1814402 - RNA, 14 nt, Human
gauuuccccauuua

SEQ ID NO: 1814403 - RNA, 19 nt, Human
ggagggguuaaagcugccg

SEQ ID NO: 1814404 - RNA, 22 nt, Human
cuggggaacauagaacucauga

SEQ ID NO: 1814405 - RNA, 21 nt, Human
caucaucucagcucacugcaa

SEQ ID NO: 1814406 - RNA, 14 nt, Human
ugguauguuuucag

SEQ ID NO: 1814407 - RNA, 15 nt, Human
uugcaacuuuguaua

SEQ ID NO: 1814408 - RNA, 14 nt, Human
aaacauuuguucua

SEQ ID NO: 1814409 - RNA, 20 nt, Human
ccuucccaggaguacacccc

SEQ ID NO: 1814410 - RNA, 13 nt, Human
gcucucuggccuu

SEQ ID NO: 1814411 - RNA, 12 nt, Human
cccccagcccuc

SEQ ID NO: 1814412 - RNA, 15 nt, Human
acucaucuuucccuc

SEQ ID NO: 1814413 - RNA, 21 nt, Human
gauguggggaaguuaggaacu

SEQ ID NO: 1814414 - RNA, 15 nt, Human
uagagaauuuccuua

SEQ ID NO: 1814415 - RNA, 15 nt, Human
uccauacucuguaac

SEQ ID NO: 1814416 - RNA, 13 nt, Human
aauucacauugua

SEQ ID NO: 1814417 - RNA, 20 nt, Human
gggacucaucuuucccuccu

SEQ ID NO: 1814418 - RNA, 24 nt, Human
uaacaguugcauugacugucacau

SEQ ID NO: 1814419 - RNA, 14 nt, Human
gaaagcagaacagu

SEQ ID NO: 1814420 - RNA, 13 nt, Human
auuauaucaauuu

SEQ ID NO: 1814421 - RNA, 19 nt, Human
uguaguguuggagaagaac

SEQ ID NO: 1814422 - RNA, 16 nt, Human
agggcaguguucccug

SEQ ID NO: 1814423 - RNA, 16 nt, Human
uguucuaagaagugaa

SEQ ID NO: 1814424 - RNA, 18 nt, Human
aaacugagauccuuccuu

SEQ ID NO: 1814425 - RNA, 14 nt, Human
auuuguauaaaaua

SEQ ID NO: 1814426 - RNA, 14 nt, Human
acugagaaauuuau

SEQ ID NO: 1814427 - RNA, 17 nt, Human
cuggcuacugcucugug

SEQ ID NO: 1814428 - RNA, 16 nt, Human
uauaugucacuuugcu

SEQ ID NO: 1814429 - RNA, 22 nt, Human
uaugaaccaccgcgcccagccu

SEQ ID NO: 1814430 - RNA, 15 nt, Human
auuucauuuccuauu

SEQ ID NO: 1814431 - RNA, 21 nt, Human
aauuccugacugcuaguuuau

SEQ ID NO: 1814432 - RNA, 22 nt, Human
gggguaccuaguccccagccug

SEQ ID NO: 1814433 - RNA, 19 nt, Human
agcaguugagacaagaaaa

SEQ ID NO: 1814434 - RNA, 15 nt, Human
acacaucucccgcuc

SEQ ID NO: 1814435 - RNA, 21 nt, Human
cugucauaaugguuuuuaaca

SEQ ID NO: 1814436 - RNA, 15 nt, Human
cuugucuuuuuacug

SEQ ID NO: 1814437 - RNA, 16 nt, Human
cuaagcucaucuauuu

SEQ ID NO: 1814438 - RNA, 16 nt, Human
cuguaucuagccugga

SEQ ID NO: 1814439 - RNA, 17 nt, Human
cauuuguauaaaauaau

SEQ ID NO: 1814440 - RNA, 18 nt, Human
uaauuuuaacucuauaau

SEQ ID NO: 1814441 - RNA, 13 nt, Human
caaccuccgccuc

SEQ ID NO: 1814442 - RNA, 13 nt, Human
accuuuuauauuu

SEQ ID NO: 1814443 - RNA, 22 nt, Human
aauaagacggauuuauuuuucc

SEQ ID NO: 1814444 - RNA, 23 nt, Human
ggagcaucuccucaacucugagu

SEQ ID NO: 1814445 - RNA, 14 nt, Human
augagaguacaccc

SEQ ID NO: 1814446 - RNA, 14 nt, Human
acagcuaugaaggc

SEQ ID NO: 1814447 - RNA, 10 nt, Human
acauuuuuag

SEQ ID NO: 1814448 - RNA, 14 nt, Human
ucauuuccuauuuu

SEQ ID NO: 1814449 - RNA, 18 nt, Human
auuacugccuauuuuaau

SEQ ID NO: 1814450 - RNA, 23 nt, Human
caggcuccccuccucggcuuccu

SEQ ID NO: 1814451 - RNA, 16 nt, Human
auuuucuuuguuaaaa

SEQ ID NO: 1814452 - RNA, 17 nt, Human
uacaaccuccgccuccc

SEQ ID NO: 1814453 - RNA, 13 nt, Human
gcccuggacugug

SEQ ID NO: 1814454 - RNA, 16 nt, Human
aguaaaggcaaacuua

SEQ ID NO: 1814455 - RNA, 14 nt, Human
ucagucucccuccc

SEQ ID NO: 1814456 - RNA, 17 nt, Human
cucgugggacagucacc

SEQ ID NO: 1814457 - RNA, 15 nt, Human
ugaauaauguaagac

SEQ ID NO: 1814458 - RNA, 16 nt, Human
gcuucuccagccucag

SEQ ID NO: 1814459 - RNA, 14 nt, Human
ucacugacacacac

SEQ ID NO: 1814460 - RNA, 20 nt, Human
uauuuuuuucugaauuauuu

SEQ ID NO: 1814461 - RNA, 13 nt, Human
aucuacacuccag

SEQ ID NO: 1814462 - RNA, 18 nt, Human
gaguacaccccaacagca

SEQ ID NO: 1814463 - RNA, 15 nt, Human
cguggguugcacugg

SEQ ID NO: 1814464 - RNA, 14 nt, Human
gacucuaagaaaga

SEQ ID NO: 1814465 - RNA, 16 nt, Human
ccagagaagccaaaag

SEQ ID NO: 1814466 - RNA, 13 nt, Human
ccucagccuccca

SEQ ID NO: 1814467 - RNA, 12 nt, Human
aauuauguuaaa

SEQ ID NO: 1814468 - RNA, 15 nt, Human
cucagcucacuacaa

SEQ ID NO: 1814469 - RNA, 21 nt, Human
uucauucaagucagcucuucu

SEQ ID NO: 1814470 - RNA, 16 nt, Human
cacaugcugaacauca

SEQ ID NO: 1814471 - RNA, 19 nt, Human
auuucuucaacucccugcc

SEQ ID NO: 1814472 - RNA, 19 nt, Human
auaaaagacagugaaagaa

SEQ ID NO: 1814473 - RNA, 20 nt, Human
cucugucgcccaugcuggag

SEQ ID NO: 1814474 - RNA, 13 nt, Human
acaagaaggaaag

SEQ ID NO: 1814475 - RNA, 18 nt, Human
cuugauugguguugccag

SEQ ID NO: 1814476 - RNA, 21 nt, Human
ccucuccaccaucgucuucuu

SEQ ID NO: 1814477 - RNA, 18 nt, Human
ccuauuccuccuucccuu

SEQ ID NO: 1814478 - RNA, 13 nt, Human
uucucaagcccug

SEQ ID NO: 1814479 - RNA, 18 nt, Human
ccuugggaccccugagcu

SEQ ID NO: 1814480 - RNA, 15 nt, Human
agauuuccauauaaa

SEQ ID NO: 1814481 - RNA, 15 nt, Human
ccagugaaaaacuau

SEQ ID NO: 1814482 - RNA, 14 nt, Human
uauuuauuuuaaua

SEQ ID NO: 1814483 - RNA, 17 nt, Human
gcccugggaggcucugg

SEQ ID NO: 1814484 - RNA, 16 nt, Human
augguguggcaaagcc

SEQ ID NO: 1814485 - RNA, 16 nt, Human
cgcaaauucgcaaacu

SEQ ID NO: 1814486 - RNA, 18 nt, Human
caugaagauguagaggag

SEQ ID NO: 1814487 - RNA, 19 nt, Human
ccugcaccaugcugcuggg

SEQ ID NO: 1814488 - RNA, 19 nt, Human
aaaauuguauagaccuaaa

SEQ ID NO: 1814489 - RNA, 13 nt, Human
agggaaggcugga

SEQ ID NO: 1814490 - RNA, 23 nt, Human
uggugagccaagcaguuugaaau

SEQ ID NO: 1814491 - RNA, 14 nt, Human
cggggugggaaaga

SEQ ID NO: 1814492 - RNA, 20 nt, Human
auguguauuacaaauauuuu

SEQ ID NO: 1814493 - RNA, 22 nt, Human
gauaaaagacagugaaagaaaa

SEQ ID NO: 1814494 - RNA, 17 nt, Human
cccaggaguauccucuu

SEQ ID NO: 1814495 - RNA, 18 nt, Human
cuucacuguaaaauaaua

SEQ ID NO: 1814496 - RNA, 23 nt, Human
uccaauuuuuggccaugaggaag

SEQ ID NO: 1814497 - RNA, 15 nt, Human
uaaauauuuuuucuu

SEQ ID NO: 1814498 - RNA, 18 nt, Human
uucccaaccauacaaaaa

SEQ ID NO: 1814499 - RNA, 18 nt, Human
cagcuuauugucuaguga

SEQ ID NO: 1814500 - RNA, 15 nt, Human
cugggcagaaggcca

SEQ ID NO: 1814501 - RNA, 21 nt, Human
uuuguauaaaauaauuuuuau

SEQ ID NO: 1814502 - RNA, 18 nt, Human
cugucucuacaaaaaaaa

SEQ ID NO: 1814503 - RNA, 15 nt, Human
ucaauuaccuucuau

SEQ ID NO: 1814504 - RNA, 22 nt, Human
ucugagaaaagcuuugaacccu

SEQ ID NO: 1814505 - RNA, 14 nt, Human
uacuaaacucagag

SEQ ID NO: 1814506 - RNA, 20 nt, Human
gccagcaucugccuccccuu

SEQ ID NO: 1814507 - RNA, 18 nt, Human
cuuccuuccucucugcaa

SEQ ID NO: 1814508 - RNA, 16 nt, Human
auacuauuuaauuauu

SEQ ID NO: 1814509 - RNA, 14 nt, Human
caucaucucagcuc

SEQ ID NO: 1814510 - RNA, 15 nt, Human
uucuccuaaaacuuu

SEQ ID NO: 1814511 - RNA, 21 nt, Human
acugugcaaauauaucugcua

SEQ ID NO: 1814512 - RNA, 18 nt, Human
uguugcagugucugcugg

SEQ ID NO: 1814513 - RNA, 13 nt, Human
cccuccucuccca

SEQ ID NO: 1814514 - RNA, 16 nt, Human
cugcaugcacuucuua

SEQ ID NO: 1814515 - RNA, 16 nt, Human
acuauucauaagauuu

SEQ ID NO: 1814516 - RNA, 17 nt, Human
cugagcagugcuugaau

SEQ ID NO: 1814517 - RNA, 23 nt, Human
cccuguuucuggcaccaggaauc

SEQ ID NO: 1814518 - RNA, 18 nt, Human
acuuuauguaguuuuuau

SEQ ID NO: 1814519 - RNA, 23 nt, Human
aagguggcuacaaagaugacugu

SEQ ID NO: 1814520 - RNA, 16 nt, Human
gcuucuguuccgugcu

SEQ ID NO: 1814521 - RNA, 15 nt, Human
aguaaggaauuuuau

SEQ ID NO: 1814522 - RNA, 18 nt, Human
gaugccccgucccccucu

SEQ ID NO: 1814523 - RNA, 13 nt, Human
uacugauuuuuaa

SEQ ID NO: 1814524 - RNA, 13 nt, Human
ucuaccacccacc

SEQ ID NO: 1814525 - RNA, 17 nt, Human
gcacuucuuacaauaau

SEQ ID NO: 1814526 - RNA, 21 nt, Human
aaaauccacuuuaucuugaau

SEQ ID NO: 1814527 - RNA, 12 nt, Human
cugcaaacccuu

SEQ ID NO: 1814528 - RNA, 16 nt, Human
ucuccagccucagccu

SEQ ID NO: 1814529 - RNA, 17 nt, Human
ccugccccccagcccuc

SEQ ID NO: 1814530 - RNA, 23 nt, Human
ugggaacaucacauuccucugcc

SEQ ID NO: 1814531 - RNA, 15 nt, Human
uacaugcuuuuuaau

SEQ ID NO: 1814532 - RNA, 23 nt, Human
accaguaugcuuggacugaaggg

SEQ ID NO: 1814533 - RNA, 21 nt, Human
ugccaaaucaaaagacuuuuu

SEQ ID NO: 1814534 - RNA, 14 nt, Human
agguggaaauaaac

SEQ ID NO: 1814535 - RNA, 14 nt, Human
agagaugacaggga

SEQ ID NO: 1814536 - RNA, 22 nt, Human
ccaggcaccaggacuagggcug

SEQ ID NO: 1814537 - RNA, 16 nt, Human
guucacccaaccacau

SEQ ID NO: 1814538 - RNA, 19 nt, Human
cuuaccuugcaucucacag

SEQ ID NO: 1814539 - RNA, 12 nt, Human
uauucacaagac

SEQ ID NO: 1814540 - RNA, 12 nt, Human
uuguuuuggaug

SEQ ID NO: 1814541 - RNA, 14 nt, Human
uaguuucccuugca

SEQ ID NO: 1814542 - RNA, 16 nt, Human
caccuccccccccccg

SEQ ID NO: 1814543 - RNA, 21 nt, Human
aauggggaacuacugcuggca

SEQ ID NO: 1814544 - RNA, 15 nt, Human
agugacaagcucaca

SEQ ID NO: 1814545 - RNA, 19 nt, Human
guugaacacuuuuuuauau

SEQ ID NO: 1814546 - RNA, 12 nt, Human
aaauaaaaaaca

SEQ ID NO: 1814547 - RNA, 15 nt, Human
ucacagcuacacaga

SEQ ID NO: 1814548 - RNA, 23 nt, Human
auaccuuccccacaucugagaga

SEQ ID NO: 1814549 - RNA, 19 nt, Human
ugagaagucugcuacccuc

SEQ ID NO: 1814550 - RNA, 14 nt, Human
cucaacaaacauaa

SEQ ID NO: 1814551 - RNA, 19 nt, Human
uuguuucucuuccuuucuu

SEQ ID NO: 1814552 - RNA, 18 nt, Human
cuagccagaggcucuaau

SEQ ID NO: 1814553 - RNA, 16 nt, Human
ugaaacucauagacac

SEQ ID NO: 1814554 - RNA, 14 nt, Human
ugagcuugcagaga

SEQ ID NO: 1814555 - RNA, 21 nt, Human
auaaguauucuguguuaaaaa

SEQ ID NO: 1814556 - RNA, 22 nt, Human
ggcagcuuuccucaaaacuuca

SEQ ID NO: 1814557 - RNA, 18 nt, Human
agagaaugagagacacac

SEQ ID NO: 1814558 - RNA, 12 nt, Human
aaaagaaagaaa

SEQ ID NO: 1814559 - RNA, 23 nt, Human
ugguggcaggaaaauggacauca

SEQ ID NO: 1814560 - RNA, 13 nt, Human
ugauuauauguca

SEQ ID NO: 1814561 - RNA, 21 nt, Human
auguacauagcuugauaaagg

SEQ ID NO: 1814562 - RNA, 17 nt, Human
uugugaugcaaauaaau

SEQ ID NO: 1814563 - RNA, 19 nt, Human
uucuuuaucuuuuuaguau

SEQ ID NO: 1814564 - RNA, 14 nt, Human
gcagucccuccaca

SEQ ID NO: 1814565 - RNA, 23 nt, Human
cauuuccuaaauauauuuuaaga

SEQ ID NO: 1814566 - RNA, 14 nt, Human
cgccucagccuccc

SEQ ID NO: 1814567 - RNA, 19 nt, Human
aagguaaaucagacuauga

SEQ ID NO: 1814568 - RNA, 16 nt, Human
cucagacucuaagaaa

SEQ ID NO: 1814569 - RNA, 12 nt, Human
auuuuagcaaag

SEQ ID NO: 1814570 - RNA, 14 nt, Human
aaaauuuaaaacau

SEQ ID NO: 1814571 - RNA, 18 nt, Human
aagagggagugcauuuau

SEQ ID NO: 1814572 - RNA, 15 nt, Human
uggaaacgaagcacc

SEQ ID NO: 1814573 - RNA, 13 nt, Human
cccuagccugccu

SEQ ID NO: 1814574 - RNA, 23 nt, Human
uuuuaaaaugagaaaucuaaaaa

SEQ ID NO: 1814575 - RNA, 19 nt, Human
guaaaauuaagaaaggaua

SEQ ID NO: 1814576 - RNA, 18 nt, Human
aagaccucauuuugaagg

SEQ ID NO: 1814577 - RNA, 15 nt, Human
uccacauuucccccu

SEQ ID NO: 1814578 - RNA, 11 nt, Human
auuauucuuau

SEQ ID NO: 1814579 - RNA, 21 nt, Human
ugaaacgaggauugggaaaaa

SEQ ID NO: 1814580 - RNA, 20 nt, Human
acaggcuugaaucaaagaac

SEQ ID NO: 1814581 - RNA, 16 nt, Human
acaccccaacagcacc

SEQ ID NO: 1814582 - RNA, 16 nt, Human
aaggcuuugcccugcu

SEQ ID NO: 1814583 - RNA, 14 nt, Human
auuuguguauuaua

SEQ ID NO: 1814584 - RNA, 19 nt, Human
cacccaaggaugucugcca

SEQ ID NO: 1814585 - RNA, 14 nt, Human
agaaauuuauaaac

SEQ ID NO: 1814586 - RNA, 16 nt, Human
auguuccgaaggugag

SEQ ID NO: 1814587 - RNA, 20 nt, Human
gaacaucacagcuuauuucc

SEQ ID NO: 1814588 - RNA, 16 nt, Human
acauuuauauuuuugu

SEQ ID NO: 1814589 - RNA, 15 nt, Human
cugacgaacuccuug

SEQ ID NO: 1814590 - RNA, 22 nt, Human
gcucuggacuugccuccagaga

SEQ ID NO: 1814591 - RNA, 15 nt, Human
ucuucuaccacccac

SEQ ID NO: 1814592 - RNA, 18 nt, Human
ugcggcccaggauggcuu

SEQ ID NO: 1814593 - RNA, 16 nt, Human
agagcuggaggcaccc

SEQ ID NO: 1814594 - RNA, 21 nt, Human
cagaggcucuaauguacaaua

SEQ ID NO: 1814595 - RNA, 17 nt, Human
agcuucacuguaaaaua

SEQ ID NO: 1814596 - RNA, 22 nt, Human
aagacccaaaaggcagaagcaa

SEQ ID NO: 1814597 - RNA, 20 nt, Human
ugauccacccgccucagccu

SEQ ID NO: 1814598 - RNA, 12 nt, Human
gcaauaauagua

SEQ ID NO: 1814599 - RNA, 19 nt, Human
agacuugggaaugagcuga

SEQ ID NO: 1814600 - RNA, 12 nt, Human
ucccuucuuuuu

SEQ ID NO: 1814601 - RNA, 13 nt, Human
uuuauaaacuuuu

SEQ ID NO: 1814602 - RNA, 15 nt, Human
aaauuuauaaacuuu

SEQ ID NO: 1814603 - RNA, 16 nt, Human
ugagccccgaaucuga

SEQ ID NO: 1814604 - RNA, 14 nt, Human
caaacaaacaaaaa

SEQ ID NO: 1814605 - RNA, 17 nt, Human
uuauuacuguaagaaaa

SEQ ID NO: 1814606 - RNA, 22 nt, Human
ccacacaugggaucaaguccug

SEQ ID NO: 1814607 - RNA, 17 nt, Human
auuuuaauaauguuuca

SEQ ID NO: 1814608 - RNA, 14 nt, Human
cugaggcuucuggg

SEQ ID NO: 1814609 - RNA, 23 nt, Human
agacuggauaguccgucucugcu

SEQ ID NO: 1814610 - RNA, 23 nt, Human
uggagggaccuugucucccagcu

SEQ ID NO: 1814611 - RNA, 21 nt, Human
uucuuuuuaauuucugcaaau

SEQ ID NO: 1814612 - RNA, 18 nt, Human
cagauuugagcucagccc

SEQ ID NO: 1814613 - RNA, 17 nt, Human
ccaguaguuagcuuucu

SEQ ID NO: 1814614 - RNA, 19 nt, Human
uucuuuggcugaaaggaag

SEQ ID NO: 1814615 - RNA, 15 nt, Human
uuccacagugacucc

SEQ ID NO: 1814616 - RNA, 16 nt, Human
uuggcugcauaaaugu

SEQ ID NO: 1814617 - RNA, 14 nt, Human
aggauuugggcucu

SEQ ID NO: 1814618 - RNA, 15 nt, Human
guugcauuaaaaaug

SEQ ID NO: 1814619 - RNA, 16 nt, Human
caguuugguuucuagc

SEQ ID NO: 1814620 - RNA, 17 nt, Human
cacugcaaccucugccu

SEQ ID NO: 1814621 - RNA, 17 nt, Human
acgcaucagacagaugg

SEQ ID NO: 1814622 - RNA, 17 nt, Human
ccacugccaaagaacuu

SEQ ID NO: 1814623 - RNA, 18 nt, Human
cuccauccugaggcucca

SEQ ID NO: 1814624 - RNA, 20 nt, Human
agcucacuacaaccuccgcc

SEQ ID NO: 1814625 - RNA, 17 nt, Human
uuguauuuuuuuucuug

SEQ ID NO: 1814626 - RNA, 18 nt, Human
ccagcaucugccuccccu

SEQ ID NO: 1814627 - RNA, 14 nt, Human
cuuuuuaaugagau

SEQ ID NO: 1814628 - RNA, 23 nt, Human
gagcaaaaccaaauauuccagag

SEQ ID NO: 1814629 - RNA, 18 nt, Human
ccugaaggcauccccagg

SEQ ID NO: 1814630 - RNA, 14 nt, Human
uaacuaauuuuaac

SEQ ID NO: 1814631 - RNA, 15 nt, Human
uuguuacaaauugua

SEQ ID NO: 1814632 - RNA, 21 nt, Human
ggcaccaggacuagggcugga

SEQ ID NO: 1814633 - RNA, 21 nt, Human
gccauggguagccugggugua

SEQ ID NO: 1814634 - RNA, 16 nt, Human
uuauaauuuaaaauau

SEQ ID NO: 1814635 - RNA, 21 nt, Human
uccauccugaggcuccacuug

SEQ ID NO: 1814636 - RNA, 21 nt, Human
ucccuggggcuuuaacuccug

SEQ ID NO: 1814637 - RNA, 19 nt, Human
uccugaaggcauccccagg

SEQ ID NO: 1814638 - RNA, 20 nt, Human
aauuuugaugaacaaaauuu

SEQ ID NO: 1814639 - RNA, 14 nt, Human
aagacaguggcccc

SEQ ID NO: 1814640 - RNA, 15 nt, Human
cacugcuugaacuag

SEQ ID NO: 1814641 - RNA, 19 nt, Human
caggccuagaggccugacu

SEQ ID NO: 1814642 - RNA, 16 nt, Human
uaggaaauauuuuaau

SEQ ID NO: 1814643 - RNA, 19 nt, Human
ccucaacguugcuccccau

SEQ ID NO: 1814644 - RNA, 21 nt, Human
cugccuccccuucacucccac

SEQ ID NO: 1814645 - RNA, 16 nt, Human
acugaggaucagagua

SEQ ID NO: 1814646 - RNA, 21 nt, Human
acagugauuaccagggacuga

SEQ ID NO: 1814647 - RNA, 12 nt, Human
uguacacaacaa

SEQ ID NO: 1814648 - RNA, 13 nt, Human
gcuggagugcagu

SEQ ID NO: 1814649 - RNA, 16 nt, Human
auuuguguauuauaau

SEQ ID NO: 1814650 - RNA, 16 nt, Human
cugaacucccucucug

SEQ ID NO: 1814651 - RNA, 21 nt, Human
gaaagggauuuucagcccuca

SEQ ID NO: 1814652 - RNA, 21 nt, Human
ccacuagcccuccucucccag

SEQ ID NO: 1814653 - RNA, 18 nt, Human
ccacaucugagccccgaa

SEQ ID NO: 1814654 - RNA, 17 nt, Human
auucagacuguuuuuca

SEQ ID NO: 1814655 - RNA, 16 nt, Human
gcaggcagauguuccu

SEQ ID NO: 1814656 - RNA, 22 nt, Human
uagaauugugcaaccaucacca

SEQ ID NO: 1814657 - RNA, 17 nt, Human
aagccauggguagccug

SEQ ID NO: 1814658 - RNA, 14 nt, Human
uucagccugaaaga

SEQ ID NO: 1814659 - RNA, 15 nt, Human
gcugcccucccccuc

SEQ ID NO: 1814660 - RNA, 22 nt, Human
augaaacucccuaguuccuuca

SEQ ID NO: 1814661 - RNA, 23 nt, Human
uucuugauaccugggauacugug

SEQ ID NO: 1814662 - RNA, 19 nt, Human
ggaaaaaauaacaaugaaa

SEQ ID NO: 1814663 - RNA, 21 nt, Human
uauuugaucugauaucagucc

SEQ ID NO: 1814664 - RNA, 21 nt, Human
gagucaacuccuuucucaucu

SEQ ID NO: 1814665 - RNA, 19 nt, Human
ucuggcaccaggaaucccc

SEQ ID NO: 1814666 - RNA, 12 nt, Human
ccaugcugcugg

SEQ ID NO: 1814667 - RNA, 22 nt, Human
uaugaagcuuuuaugugaaaca

SEQ ID NO: 1814668 - RNA, 20 nt, Human
caggcaaaaggaagcagggu

SEQ ID NO: 1814669 - RNA, 16 nt, Human
aggguugguuucccuu

SEQ ID NO: 1814670 - RNA, 14 nt, Human
uguguuggccagga

SEQ ID NO: 1814671 - RNA, 13 nt, Human
uuuuuuuucccuu

SEQ ID NO: 1814672 - RNA, 18 nt, Human
cuauuuuguaacuuucuc

SEQ ID NO: 1814673 - RNA, 17 nt, Human
uuaacagguaugaacca

SEQ ID NO: 1814674 - RNA, 23 nt, Human
ugcuuauccguuagccgugguga

SEQ ID NO: 1814675 - RNA, 21 nt, Human
gaaaugaguuuuucuuuucau

SEQ ID NO: 1814676 - RNA, 14 nt, Human
agacagaaaaaacu

SEQ ID NO: 1814677 - RNA, 18 nt, Human
cuuucacauuuaaauaaa

SEQ ID NO: 1814678 - RNA, 15 nt, Human
agcucuccccuucuc

SEQ ID NO: 1814679 - RNA, 18 nt, Human
cugagggcauagaaguaa

SEQ ID NO: 1814680 - RNA, 16 nt, Human
gagcucgugggacagu

SEQ ID NO: 1814681 - RNA, 13 nt, Human
cugagccugccuu

SEQ ID NO: 1814682 - RNA, 21 nt, Human
uuccuaauuccacagcugcuc

SEQ ID NO: 1814683 - RNA, 19 nt, Human
uauguagaauauauuuccu

SEQ ID NO: 1814684 - RNA, 22 nt, Human
guuucaccauguuagccaggcu

SEQ ID NO: 1814685 - RNA, 22 nt, Human
acucuuagcuaaaucccucccc

SEQ ID NO: 1814686 - RNA, 21 nt, Human
agauuuccuucuuuuuuucuu

SEQ ID NO: 1814687 - RNA, 21 nt, Human
caucccuagucucuacccagu

SEQ ID NO: 1814688 - RNA, 23 nt, Human
gaucucggcucacugcaaccucc

SEQ ID NO: 1814689 - RNA, 20 nt, Human
gcagacucacugugggaagg

SEQ ID NO: 1814690 - RNA, 21 nt, Human
cacagagguagucucacugcu

SEQ ID NO: 1814691 - RNA, 23 nt, Human
guccaccaggaguucucccacca

SEQ ID NO: 1814692 - RNA, 23 nt, Human
auuccuguggauguaaagugaua

SEQ ID NO: 1814693 - RNA, 12 nt, Human
cuccuguuucac

SEQ ID NO: 1814694 - RNA, 23 nt, Human
aauaagacggauuuauuuuucca

SEQ ID NO: 1814695 - RNA, 21 nt, Human
ucagggcuggucuuuuaggac

SEQ ID NO: 1814696 - RNA, 22 nt, Human
uaaauuauuguuuuucuuuuuu

SEQ ID NO: 1814697 - RNA, 18 nt, Human
ggcacagaaacuccuguu

SEQ ID NO: 1814698 - RNA, 15 nt, Human
ugcuuuuccccaagu

SEQ ID NO: 1814699 - RNA, 14 nt, Human
uuuuaaaaaagaaa

SEQ ID NO: 1814700 - RNA, 14 nt, Human
uagccagugaaaaa

SEQ ID NO: 1814701 - RNA, 13 nt, Human
aucuauuuuguaa

SEQ ID NO: 1814702 - RNA, 19 nt, Human
accuaaacauagaaauugc

SEQ ID NO: 1814703 - RNA, 14 nt, Human
cugugugcucagga

SEQ ID NO: 1814704 - RNA, 12 nt, Human
caacccaaaugu

SEQ ID NO: 1814705 - RNA, 14 nt, Human
cugucggagcccug

SEQ ID NO: 1814706 - RNA, 16 nt, Human
cggauuuauuuuucca

SEQ ID NO: 1814707 - RNA, 18 nt, Human
cucccuuggggccuaugc

SEQ ID NO: 1814708 - RNA, 14 nt, Human
aacgauaaaagaca

SEQ ID NO: 1814709 - RNA, 18 nt, Human
acuggggccucccugguc

SEQ ID NO: 1814710 - RNA, 20 nt, Human
ucuugaaaaaugcauguugc

SEQ ID NO: 1814711 - RNA, 20 nt, Human
agcuacuaauuuuaaaaugu

SEQ ID NO: 1814712 - RNA, 19 nt, Human
uacacauacauguaaaaua

SEQ ID NO: 1814713 - RNA, 22 nt, Human
aauaugccccauucaacaucua

SEQ ID NO: 1814714 - RNA, 17 nt, Human
ugugaagguggaaauaa

SEQ ID NO: 1814715 - RNA, 16 nt, Human
auuuaguuauaaaaau

SEQ ID NO: 1814716 - RNA, 14 nt, Human
ugcuugagccagga

SEQ ID NO: 1814717 - RNA, 11 nt, Human
auauauauaca

SEQ ID NO: 1814718 - RNA, 12 nt, Human
uaucaugugaaa

SEQ ID NO: 1814719 - RNA, 21 nt, Human
cacauguaucuaugcauuuuc

SEQ ID NO: 1814720 - RNA, 14 nt, Human
cuuuaauaaaugua

SEQ ID NO: 1814721 - RNA, 14 nt, Human
gaaagaagaugaau

SEQ ID NO: 1814722 - RNA, 16 nt, Human
acuuguuuuggaugcc

SEQ ID NO: 1814723 - RNA, 18 nt, Human
cucagaaguuucuucuuu

SEQ ID NO: 1814724 - RNA, 11 nt, Human
auuuaaaaauc

SEQ ID NO: 1814725 - RNA, 16 nt, Human
ucuaucucuaaagaaa

SEQ ID NO: 1814726 - RNA, 23 nt, Human
aacccuuucauaaagucuugccu

SEQ ID NO: 1814727 - RNA, 18 nt, Human
uaaaagggacugagaaau

SEQ ID NO: 1814728 - RNA, 22 nt, Human
cuuuaauaaauguauauuguau

SEQ ID NO: 1814729 - RNA, 22 nt, Human
augccacuagcccuccucuccc

SEQ ID NO: 1814730 - RNA, 21 nt, Human
caggcugggucgcccuggacu

SEQ ID NO: 1814731 - RNA, 22 nt, Human
cagugggagccagggcugucuu

SEQ ID NO: 1814732 - RNA, 11 nt, Human
uguacccagua

SEQ ID NO: 1814733 - RNA, 14 nt, Human
cuagccugccuccc

SEQ ID NO: 1814734 - RNA, 15 nt, Human
ggccaagaggcuguu

SEQ ID NO: 1814735 - RNA, 15 nt, Human
ucuccagccucagcc

SEQ ID NO: 1814736 - RNA, 18 nt, Human
caucacauuccucugccc

SEQ ID NO: 1814737 - RNA, 21 nt, Human
ccuuauguuuaauuaaaauca

SEQ ID NO: 1814738 - RNA, 17 nt, Human
cgcaugaauuugugaag

SEQ ID NO: 1814739 - RNA, 21 nt, Human
cuuucauaaagucuugccuug

SEQ ID NO: 1814740 - RNA, 11 nt, Human
auaaggaacaa

SEQ ID NO: 1814741 - RNA, 14 nt, Human
ugcauuguccucuu

SEQ ID NO: 1814742 - RNA, 14 nt, Human
agauguagaggaga

SEQ ID NO: 1814743 - RNA, 23 nt, Human
caagcugcuguggccaucaaccu

SEQ ID NO: 1814744 - RNA, 16 nt, Human
cguccaucucuuguuu

SEQ ID NO: 1814745 - RNA, 15 nt, Human
cucaucuuucccucc

SEQ ID NO: 1814746 - RNA, 14 nt, Human
cugguggcucugug

SEQ ID NO: 1814747 - RNA, 14 nt, Human
uuccccucugcagc

SEQ ID NO: 1814748 - RNA, 22 nt, Human
cacagauuugagcucagcccug

SEQ ID NO: 1814749 - RNA, 20 nt, Human
ucccaggaguacaccccaac

SEQ ID NO: 1814750 - RNA, 21 nt, Human
uaggugacuauuauauuucca

SEQ ID NO: 1814751 - RNA, 13 nt, Human
ugccuuguuucau

SEQ ID NO: 1814752 - RNA, 15 nt, Human
uauauuuuaaauauu

SEQ ID NO: 1814753 - RNA, 20 nt, Human
gcuggagacauugaggcagg

SEQ ID NO: 1814754 - RNA, 16 nt, Human
gaaaaugaaucccucu

SEQ ID NO: 1814755 - RNA, 16 nt, Human
gcaccaugucaagggu

SEQ ID NO: 1814756 - RNA, 14 nt, Human
ucucuaaagaaaau

SEQ ID NO: 1814757 - RNA, 20 nt, Human
ccagagacagcuugaucaaa

SEQ ID NO: 1814758 - RNA, 13 nt, Human
ccccucugcagcu

SEQ ID NO: 1814759 - RNA, 16 nt, Human
uucauaauuauuauuu

SEQ ID NO: 1814760 - RNA, 16 nt, Human
agcucagggcucuuuc

SEQ ID NO: 1814761 - RNA, 22 nt, Human
ugaagcaaaauuuuuucucuag

SEQ ID NO: 1814762 - RNA, 14 nt, Human
cugggccccugccu

SEQ ID NO: 1814763 - RNA, 12 nt, Human
agucuucaucaa

SEQ ID NO: 1814764 - RNA, 19 nt, Human
auuguaggugacuauuaua

SEQ ID NO: 1814765 - RNA, 15 nt, Human
uuuucauuaaaauuu

SEQ ID NO: 1814766 - RNA, 18 nt, Human
ugaacuacuagaaaauug

SEQ ID NO: 1814767 - RNA, 12 nt, Human
cauucccucucc

SEQ ID NO: 1814768 - RNA, 19 nt, Human
ugugccagauuuaugcaua

SEQ ID NO: 1814769 - RNA, 17 nt, Human
agcuucaagaaauuacu

SEQ ID NO: 1814770 - RNA, 22 nt, Human
agcauuguuggcuguuccugca

SEQ ID NO: 1814771 - RNA, 16 nt, Human
aggcuaaagcccagag

SEQ ID NO: 1814772 - RNA, 21 nt, Human
cauuuuaaacacauuaggaaa

SEQ ID NO: 1814773 - RNA, 16 nt, Human
ucaguuuuugugaaaa

SEQ ID NO: 1814774 - RNA, 13 nt, Human
ccucccccaucuc

SEQ ID NO: 1814775 - RNA, 19 nt, Human
gaaauaaacuauuuguaaa

SEQ ID NO: 1814776 - RNA, 21 nt, Human
acgcucucuggccuucggccu

SEQ ID NO: 1814777 - RNA, 18 nt, Human
cuaccccuuuacaaauag

SEQ ID NO: 1814778 - RNA, 23 nt, Human
cuccagaugggagugcccccaac

SEQ ID NO: 1814779 - RNA, 16 nt, Human
ugcuguauuuuaaaag

SEQ ID NO: 1814780 - RNA, 18 nt, Human
uuaauccccaguaaaauu

SEQ ID NO: 1814781 - RNA, 14 nt, Human
ugcaaccuccaccu

SEQ ID NO: 1814782 - RNA, 21 nt, Human
cagacuguuuuucagggaggu

SEQ ID NO: 1814783 - RNA, 19 nt, Human
cucagaaucaugcugagag

SEQ ID NO: 1814784 - RNA, 17 nt, Human
gaaaagcuauaaaauga

SEQ ID NO: 1814785 - RNA, 13 nt, Human
auugcaaggcaaa

SEQ ID NO: 1814786 - RNA, 16 nt, Human
uggcaguggaacuaag

SEQ ID NO: 1814787 - RNA, 22 nt, Human
ucagcccugggauagugcuguc

SEQ ID NO: 1814788 - RNA, 18 nt, Human
cagagacagaaagcagaa

SEQ ID NO: 1814789 - RNA, 13 nt, Human
caucaggcuuucu

SEQ ID NO: 1814790 - RNA, 18 nt, Human
gccuuggggcugaugcag

SEQ ID NO: 1814791 - RNA, 23 nt, Human
gaaccggagaaccccaggacgcc

SEQ ID NO: 1814792 - RNA, 20 nt, Human
gcuaccugcucagcccugca

SEQ ID NO: 1814793 - RNA, 21 nt, Human
aacacugggagaaaugaaaaa

SEQ ID NO: 1814794 - RNA, 18 nt, Human
uagucuuacgauguuuag

SEQ ID NO: 1814795 - RNA, 18 nt, Human
gaagcaaaauuuuuucuc

SEQ ID NO: 1814796 - RNA, 17 nt, Human
uucauccgcaaauuuuc

SEQ ID NO: 1814797 - RNA, 16 nt, Human
auccaaugaaaugagu

SEQ ID NO: 1814798 - RNA, 14 nt, Human
aauacuguggaacu

SEQ ID NO: 1814799 - RNA, 13 nt, Human
agaaaauuuaaaa

SEQ ID NO: 1814800 - RNA, 14 nt, Human
uguguguuuuucau

SEQ ID NO: 1814801 - RNA, 21 nt, Human
ccugcucagcccugcaccaug

SEQ ID NO: 1814802 - RNA, 14 nt, Human
gcguugagccacca

SEQ ID NO: 1814803 - RNA, 22 nt, Human
auguucacccaaccacauccca

SEQ ID NO: 1814804 - RNA, 18 nt, Human
uuauggagauauaauucu

SEQ ID NO: 1814805 - RNA, 22 nt, Human
aacauuacucugaaauuguaac

SEQ ID NO: 1814806 - RNA, 12 nt, Human
aauuuaaauaua

SEQ ID NO: 1814807 - RNA, 14 nt, Human
gcugcucagggcug

SEQ ID NO: 1814808 - RNA, 13 nt, Human
aaaucuaucaaaa

SEQ ID NO: 1814809 - RNA, 17 nt, Human
aaaaucauaagauauuu

SEQ ID NO: 1814810 - RNA, 19 nt, Human
cacggccuaaaagccucuu

SEQ ID NO: 1814811 - RNA, 14 nt, Human
ucccugaagaucua

SEQ ID NO: 1814812 - RNA, 20 nt, Human
auuuuuuucugaauuauuuu

SEQ ID NO: 1814813 - RNA, 22 nt, Human
gaacuuuccacauucagagcuu

SEQ ID NO: 1814814 - RNA, 20 nt, Human
agcccuggugggcagagagg

SEQ ID NO: 1814815 - RNA, 18 nt, Human
aguccauugggcaggcag

SEQ ID NO: 1814816 - RNA, 16 nt, Human
acaaugaaaaggacuu

SEQ ID NO: 1814817 - RNA, 20 nt, Human
uauuuuaaauauuuuuucuu

SEQ ID NO: 1814818 - RNA, 13 nt, Human
uauucuccauacu

SEQ ID NO: 1814819 - RNA, 22 nt, Human
accccugagcuugcagagauga

SEQ ID NO: 1814820 - RNA, 21 nt, Human
cuaauuauauaauauuuuuaa

SEQ ID NO: 1814821 - RNA, 15 nt, Human
ucucuacaaaaaaaa

SEQ ID NO: 1814822 - RNA, 18 nt, Human
uggcuguuaaucuuucaa

SEQ ID NO: 1814823 - RNA, 20 nt, Human
ucuuucacuaucuguaaugc

SEQ ID NO: 1814824 - RNA, 16 nt, Human
cuaggcauagcccugc

SEQ ID NO: 1814825 - RNA, 21 nt, Human
caggaguacaccccaacagca

SEQ ID NO: 1814826 - RNA, 13 nt, Human
ugaauauaaauuu

SEQ ID NO: 1814827 - RNA, 23 nt, Human
ccaggagcugggcagaaggccaa

SEQ ID NO: 1814828 - RNA, 16 nt, Human
cuggagccccaucagc

SEQ ID NO: 1814829 - RNA, 15 nt, Human
uaguaauuuguagau

SEQ ID NO: 1814830 - RNA, 22 nt, Human
ugggaauauuugaaucuugucu

SEQ ID NO: 1814831 - RNA, 24 nt, Human
cuggcuaauuagcauggccacauc

SEQ ID NO: 1814832 - RNA, 15 nt, Human
ugccacuagcccucc

SEQ ID NO: 1814833 - RNA, 19 nt, Human
ccaccucaccaguuuccag

SEQ ID NO: 1814834 - RNA, 22 nt, Human
ucucuccaccagguucuuucuu

SEQ ID NO: 1814835 - RNA, 16 nt, Human
aacaaagaaauuaugu

SEQ ID NO: 1814836 - RNA, 21 nt, Human
gcacacugucugcccccguuc

SEQ ID NO: 1814837 - RNA, 15 nt, Human
aggccuuucccuaag

SEQ ID NO: 1814838 - RNA, 21 nt, Human
uaccugcucagcccugcacca

SEQ ID NO: 1814839 - RNA, 18 nt, Human
cccugucucagggugagg

SEQ ID NO: 1814840 - RNA, 19 nt, Human
caucaaggguacacugccu

SEQ ID NO: 1814841 - RNA, 19 nt, Human
acuuuuuauugauuuuugg

SEQ ID NO: 1814842 - RNA, 17 nt, Human
auauuaugaagcuuuua

SEQ ID NO: 1814843 - RNA, 22 nt, Human
aauaaguuuauuucuuaaaucu

SEQ ID NO: 1814844 - RNA, 13 nt, Human
cugagagugaaca

SEQ ID NO: 1814845 - RNA, 20 nt, Human
caagcgauucuccugccuca

SEQ ID NO: 1814846 - RNA, 20 nt, Human
uaggaauugacccacaagaa

SEQ ID NO: 1814847 - RNA, 19 nt, Human
cagagaugaggccgccaug

SEQ ID NO: 1814848 - RNA, 18 nt, Human
ccaaaguccugggauuac

SEQ ID NO: 1814849 - RNA, 22 nt, Human
aauuuccaugaguuacacugga

SEQ ID NO: 1814850 - RNA, 16 nt, Human
uaaucugccucccucu

SEQ ID NO: 1814851 - RNA, 16 nt, Human
cugcacuccagccuga

SEQ ID NO: 1814852 - RNA, 21 nt, Human
uaagucugugagauucauuca

SEQ ID NO: 1814853 - RNA, 18 nt, Human
aucagcaucccuagaaag

SEQ ID NO: 1814854 - RNA, 17 nt, Human
ugucauaaugguuuuua

SEQ ID NO: 1814855 - RNA, 13 nt, Human
cucaccaguuucc

SEQ ID NO: 1814856 - RNA, 23 nt, Human
aggaugguucccuugaugaagaa

SEQ ID NO: 1814857 - RNA, 13 nt, Human
auauuuuuucuuu

SEQ ID NO: 1814858 - RNA, 15 nt, Human
cauacauuucucaua

SEQ ID NO: 1814859 - RNA, 15 nt, Human
uaaaucccuccccgu

SEQ ID NO: 1814860 - RNA, 13 nt, Human
gccagcuaauuuu

SEQ ID NO: 1814861 - RNA, 14 nt, Human
uauuuucuacacau

SEQ ID NO: 1814862 - RNA, 15 nt, Human
ccagaccagcaggcu

SEQ ID NO: 1814863 - RNA, 20 nt, Human
aagcauuugaaugcauuuug

SEQ ID NO: 1814864 - RNA, 17 nt, Human
aaaaagauugagagaau

SEQ ID NO: 1814865 - RNA, 14 nt, Human
uguuggccaggcuu

SEQ ID NO: 1814866 - RNA, 19 nt, Human
aagcauuccaacuaucuca

SEQ ID NO: 1814867 - RNA, 15 nt, Human
auacauguaaaauau

SEQ ID NO: 1814868 - RNA, 19 nt, Human
guacacugcacgaauggaa

SEQ ID NO: 1814869 - RNA, 21 nt, Human
auaauuuuuauauuugaaaua

SEQ ID NO: 1814870 - RNA, 14 nt, Human
uauaauauuuuuaa

SEQ ID NO: 1814871 - RNA, 14 nt, Human
acugugugcucagg

SEQ ID NO: 1814872 - RNA, 16 nt, Human
cagauccccaagccug

SEQ ID NO: 1814873 - RNA, 14 nt, Human
cugcugccugcuuu

SEQ ID NO: 1814874 - RNA, 17 nt, Human
ccucugcacacccucca

SEQ ID NO: 1814875 - RNA, 20 nt, Human
auuuugugauugauuauaug

SEQ ID NO: 1814876 - RNA, 10 nt, Human
accugagccc

SEQ ID NO: 1814877 - RNA, 20 nt, Human
cagucccuccccaaaugcuu

SEQ ID NO: 1814878 - RNA, 15 nt, Human
gccaggagcugggca

SEQ ID NO: 1814879 - RNA, 16 nt, Human
ccagucccuccccaaa

SEQ ID NO: 1814880 - RNA, 13 nt, Human
gccacaagaaccc

SEQ ID NO: 1814881 - RNA, 23 nt, Human
cccuagccagaggcucuaaugua

SEQ ID NO: 1814882 - RNA, 19 nt, Human
cuuuccccuugguucucau

SEQ ID NO: 1814883 - RNA, 20 nt, Human
auuauaccgcuaucauucca

SEQ ID NO: 1814884 - RNA, 12 nt, Human
acugaaaucaua

SEQ ID NO: 1814885 - RNA, 17 nt, Human
accaggaguucucccac

SEQ ID NO: 1814886 - RNA, 21 nt, Human
uaaauuauuuuuguucauaua

SEQ ID NO: 1814887 - RNA, 19 nt, Human
cagugggugguagcagagg

SEQ ID NO: 1814888 - RNA, 14 nt, Human
gucaacuccuuucu

SEQ ID NO: 1814889 - RNA, 16 nt, Human
uuagagaauuuccuua

SEQ ID NO: 1814890 - RNA, 18 nt, Human
auaugcauagucauguaa

SEQ ID NO: 1814891 - RNA, 17 nt, Human
aaauccuacuuucauaa

SEQ ID NO: 1814892 - RNA, 16 nt, Human
aucaaaagaaagaaaa

SEQ ID NO: 1814893 - RNA, 23 nt, Human
caagcaugagucacuacgccugg

SEQ ID NO: 1814894 - RNA, 15 nt, Human
cuggacucaccuccc

SEQ ID NO: 1814895 - RNA, 20 nt, Human
augaauucugucauuucaaa

SEQ ID NO: 1814896 - RNA, 14 nt, Human
cucccuagccagag

SEQ ID NO: 1814897 - RNA, 18 nt, Human
ugccuauuuuaauaaaca

SEQ ID NO: 1814898 - RNA, 23 nt, Human
cacuacgccuggcugauuuuugu

SEQ ID NO: 1814899 - RNA, 23 nt, Human
agccuugggaccccugagcuugc

SEQ ID NO: 1814900 - RNA, 16 nt, Human
cugccuuggcuuccca

SEQ ID NO: 1814901 - RNA, 20 nt, Human
cuagaggcuuccuucauuuc

SEQ ID NO: 1814902 - RNA, 18 nt, Human
ugugaccacugcagaaga

SEQ ID NO: 1814903 - RNA, 15 nt, Human
cuguucuuccaucac

SEQ ID NO: 1814904 - RNA, 21 nt, Human
guuuguuuauuuguuuuucca

SEQ ID NO: 1814905 - RNA, 22 nt, Human
acuuugauuuuauaugcuauuu

SEQ ID NO: 1814906 - RNA, 21 nt, Human
ggcaagugggugaaagaugga

SEQ ID NO: 1814907 - RNA, 18 nt, Human
uaauuuuagacauucuuu

SEQ ID NO: 1814908 - RNA, 15 nt, Human
ugcugacccucccca

SEQ ID NO: 1814909 - RNA, 17 nt, Human
ugaauauaaauuuauca

SEQ ID NO: 1814910 - RNA, 12 nt, Human
caauccuucuau

SEQ ID NO: 1814911 - RNA, 13 nt, Human
acguugcucccca

SEQ ID NO: 1814912 - RNA, 12 nt, Human
gucuuuuuucua

SEQ ID NO: 1814913 - RNA, 19 nt, Human
cauaagauuuaaauuauuu

SEQ ID NO: 1814914 - RNA, 17 nt, Human
agauucaugcacuguag

SEQ ID NO: 1814915 - RNA, 22 nt, Human
uuggacugaagggguucucaca

SEQ ID NO: 1814916 - RNA, 17 nt, Human
auuuuuucuuuucuauu

SEQ ID NO: 1814917 - RNA, 13 nt, Human
ugccugcaggcau

SEQ ID NO: 1814918 - RNA, 18 nt, Human
cugauaaugaaaauuaug

SEQ ID NO: 1814919 - RNA, 18 nt, Human
uauuuucuauaauuuaaa

SEQ ID NO: 1814920 - RNA, 21 nt, Human
aauuguggggaugaugaaaua

SEQ ID NO: 1814921 - RNA, 23 nt, Human
ugaaagaugacggaugccuagag

SEQ ID NO: 1814922 - RNA, 21 nt, Human
aucccucuaucucuaaagaaa

SEQ ID NO: 1814923 - RNA, 14 nt, Human
uaucuuuuuauuca

SEQ ID NO: 1814924 - RNA, 18 nt, Human
ugugauacaauaaagaau

SEQ ID NO: 1814925 - RNA, 23 nt, Human
uccuugggcuuuagccuuaaaga

SEQ ID NO: 1814926 - RNA, 14 nt, Human
ucucaucuuuuuac

SEQ ID NO: 1814927 - RNA, 13 nt, Human
uuauaaaaauaua

SEQ ID NO: 1814928 - RNA, 17 nt, Human
cccugggaggcucugga

SEQ ID NO: 1814929 - RNA, 17 nt, Human
cacauaucgauuuuuaa

SEQ ID NO: 1814930 - RNA, 20 nt, Human
ccuccucucccagugacaac

SEQ ID NO: 1814931 - RNA, 12 nt, Human
cuggaggggcug

SEQ ID NO: 1814932 - RNA, 14 nt, Human
ccagugaccaaccu

SEQ ID NO: 1814933 - RNA, 15 nt, Human
gccaauauuuuucuu

SEQ ID NO: 1814934 - RNA, 18 nt, Human
acaauuguuggagagccc

SEQ ID NO: 1814935 - RNA, 21 nt, Human
ccaugucaaggguucaagauu

SEQ ID NO: 1814936 - RNA, 21 nt, Human
gcaaauuuucuuccauuucau

SEQ ID NO: 1814937 - RNA, 16 nt, Human
guucaagugcuucucc

SEQ ID NO: 1814938 - RNA, 22 nt, Human
agcagccuggcucucccagcca

SEQ ID NO: 1814939 - RNA, 16 nt, Human
uuguaaaggaauuuaa

SEQ ID NO: 1814940 - RNA, 16 nt, Human
gaccuugucucccagc

SEQ ID NO: 1814941 - RNA, 13 nt, Human
gcacauuccccuu

SEQ ID NO: 1814942 - RNA, 13 nt, Human
cuccuuuuuccuu

SEQ ID NO: 1814943 - RNA, 15 nt, Human
ugaauccucucucug

SEQ ID NO: 1814944 - RNA, 19 nt, Human
cuggccuucggccuccauc

SEQ ID NO: 1814945 - RNA, 13 nt, Human
guguuggccagga

SEQ ID NO: 1814946 - RNA, 18 nt, Human
auacccaugucuacacag

SEQ ID NO: 1814947 - RNA, 15 nt, Human
aaauaugauguuaug

SEQ ID NO: 1814948 - RNA, 14 nt, Human
cucaacucugagug

SEQ ID NO: 1814949 - RNA, 12 nt, Human
augcugcugggg

SEQ ID NO: 1814950 - RNA, 12 nt, Human
ucaccccuugcc

SEQ ID NO: 1814951 - RNA, 19 nt, Human
uguuuuuuuuuuuuuugag

SEQ ID NO: 1814952 - RNA, 22 nt, Human
uggacgagaaaacaauaacgau

SEQ ID NO: 1814953 - RNA, 22 nt, Human
cccucacugcaggcuccccucc

SEQ ID NO: 1814954 - RNA, 20 nt, Human
ccaaaucaaaagacuuuuuc

SEQ ID NO: 1814955 - RNA, 16 nt, Human
ccugucuguuuccucu

SEQ ID NO: 1814956 - RNA, 15 nt, Human
cgccucagccuccca

SEQ ID NO: 1814957 - RNA, 18 nt, Human
aucacauuccucugcccu

SEQ ID NO: 1814958 - RNA, 13 nt, Human
uacugccuauuuu

SEQ ID NO: 1814959 - RNA, 16 nt, Human
cuguagcaaccugaaa

SEQ ID NO: 1814960 - RNA, 23 nt, Human
agugcaguggcgugaucucagcu

SEQ ID NO: 1814961 - RNA, 16 nt, Human
cauacaugcauacacu

SEQ ID NO: 1814962 - RNA, 15 nt, Human
ucuccucucucugua

SEQ ID NO: 1814963 - RNA, 17 nt, Human
uccuggaggggcugggg

SEQ ID NO: 1814964 - RNA, 16 nt, Human
uacacauacauguaaa

SEQ ID NO: 1814965 - RNA, 20 nt, Human
cuguagaaaugguuguauua

SEQ ID NO: 1814966 - RNA, 20 nt, Human
uuguaauauuucuucaaaua

SEQ ID NO: 1814967 - RNA, 22 nt, Human
ugaaaauaagacggauuuauuu

SEQ ID NO: 1814968 - RNA, 18 nt, Human
auaccccuggccaaggaa

SEQ ID NO: 1814969 - RNA, 18 nt, Human
gugauuccgcagugagag

SEQ ID NO: 1814970 - RNA, 13 nt, Human
caaaaaaaaaacc

SEQ ID NO: 1814971 - RNA, 19 nt, Human
aauauauuuuaaauauuuu

SEQ ID NO: 1814972 - RNA, 15 nt, Human
gucuuccucugucuc

SEQ ID NO: 1814973 - RNA, 14 nt, Human
uuuuaauaaacacu

SEQ ID NO: 1814974 - RNA, 22 nt, Human
auaguuggaaucauauugugug

SEQ ID NO: 1814975 - RNA, 17 nt, Human
cacuguguuggccagga

SEQ ID NO: 1814976 - RNA, 18 nt, Human
ggauuugccuucucuaaa

SEQ ID NO: 1814977 - RNA, 16 nt, Human
cugcagacucacugug

SEQ ID NO: 1814978 - RNA, 20 nt, Human
uucucucgugaguauauuga

SEQ ID NO: 1814979 - RNA, 18 nt, Human
aguauauuucccuguuuc

SEQ ID NO: 1814980 - RNA, 21 nt, Human
ccagcuggggccaggcugggu

SEQ ID NO: 1814981 - RNA, 18 nt, Human
gaggucacagggccuggg

SEQ ID NO: 1814982 - RNA, 18 nt, Human
cucuggggagcucaggaa

SEQ ID NO: 1814983 - RNA, 16 nt, Human
uccucuaugccagcag

SEQ ID NO: 1814984 - RNA, 16 nt, Human
gccaguuguccuccuu

SEQ ID NO: 1814985 - RNA, 15 nt, Human
acauaucgauuuuua

SEQ ID NO: 1814986 - RNA, 18 nt, Human
gugagccacggugcccgg

SEQ ID NO: 1814987 - RNA, 20 nt, Human
aauuuugugaagcaaaauuu

SEQ ID NO: 1814988 - RNA, 22 nt, Human
uaggugagaacccuugcacuag

SEQ ID NO: 1814989 - RNA, 22 nt, Human
gacuuuucuccucucagugggu

SEQ ID NO: 1814990 - RNA, 13 nt, Human
ugugcuggccacc

SEQ ID NO: 1814991 - RNA, 12 nt, Human
uguccucuuuuu

SEQ ID NO: 1814992 - RNA, 14 nt, Human
ggcuggggacuugu

SEQ ID NO: 1814993 - RNA, 15 nt, Human
cuugugaggagcugg

SEQ ID NO: 1814994 - RNA, 20 nt, Human
aaugauuuagugaucaaauu

SEQ ID NO: 1814995 - RNA, 20 nt, Human
ggaucguuuuuucccagggc

SEQ ID NO: 1814996 - RNA, 22 nt, Human
cuggagugcaguggcaucaucu

SEQ ID NO: 1814997 - RNA, 22 nt, Human
uggagacauugaggcaggcacu

SEQ ID NO: 1814998 - RNA, 21 nt, Human
aggcugagagcccaaacugcu

SEQ ID NO: 1814999 - RNA, 22 nt, Human
caaacaauuugaauauaaauuu

SEQ ID NO: 1815000 - RNA, 11 nt, Human
uguugcauuaa

SEQ ID NO: 1815001 - RNA, 15 nt, Human
ucuuuacuuuccccu

SEQ ID NO: 1815002 - RNA, 13 nt, Human
agaaguaaaaaca

SEQ ID NO: 1815003 - RNA, 19 nt, Human
caccaggcugcucagggcu

SEQ ID NO: 1815004 - RNA, 16 nt, Human
guuggcuguuccugca

SEQ ID NO: 1815005 - RNA, 16 nt, Human
ccacuucagccuccca

SEQ ID NO: 1815006 - RNA, 17 nt, Human
caugcgccaccauggcc

SEQ ID NO: 1815007 - RNA, 12 nt, Human
agcccugucucc

SEQ ID NO: 1815008 - RNA, 15 nt, Human
aggagaccuacccuc

SEQ ID NO: 1815009 - RNA, 15 nt, Human
aacuaggcugagcaa

SEQ ID NO: 1815010 - RNA, 14 nt, Human
ccucaccagcccug

SEQ ID NO: 1815011 - RNA, 12 nt, Human
caagaaggaaag

SEQ ID NO: 1815012 - RNA, 13 nt, Human
uaaaaguuuaagu

SEQ ID NO: 1815013 - RNA, 18 nt, Human
auauauacauacaugcau

SEQ ID NO: 1815014 - RNA, 13 nt, Human
gugcauucuggau

SEQ ID NO: 1815015 - RNA, 19 nt, Human
cggccuccauccugaggcu

SEQ ID NO: 1815016 - RNA, 14 nt, Human
gcacuggccaccca

SEQ ID NO: 1815017 - RNA, 16 nt, Human
cugagacagaaucuca

SEQ ID NO: 1815018 - RNA, 14 nt, Human
aggaagaaggaaaa

SEQ ID NO: 1815019 - RNA, 22 nt, Human
gucuuccucccuguguauucau

SEQ ID NO: 1815020 - RNA, 18 nt, Human
cauuucucaucuuuuuac

SEQ ID NO: 1815021 - RNA, 18 nt, Human
cauuugaaugcauuuugu

SEQ ID NO: 1815022 - RNA, 16 nt, Human
cgugauccacccgccu

SEQ ID NO: 1815023 - RNA, 20 nt, Human
ucaugcuuaaggccaugauu

SEQ ID NO: 1815024 - RNA, 19 nt, Human
cuuauguuuaauuaaaauc

SEQ ID NO: 1815025 - RNA, 22 nt, Human
ggugagaacccuugcacuagag

SEQ ID NO: 1815026 - RNA, 20 nt, Human
uguaauaaacucauuucuag

SEQ ID NO: 1815027 - RNA, 11 nt, Human
cuccaccaucg

SEQ ID NO: 1815028 - RNA, 15 nt, Human
auaauauaaaacagg

SEQ ID NO: 1815029 - RNA, 18 nt, Human
aaagagugaaggauuuau

SEQ ID NO: 1815030 - RNA, 21 nt, Human
ccuccccaaaugcuuuccaug

SEQ ID NO: 1815031 - RNA, 12 nt, Human
acucuugaaaaa

SEQ ID NO: 1815032 - RNA, 16 nt, Human
agcagaagagaaaaug

SEQ ID NO: 1815033 - RNA, 16 nt, Human
gcagugucugcuggag

SEQ ID NO: 1815034 - RNA, 19 nt, Human
gcuaccuuuugcuguggca

SEQ ID NO: 1815035 - RNA, 13 nt, Human
cugcucccuagcc

SEQ ID NO: 1815036 - RNA, 16 nt, Human
cucagauccuccucau

SEQ ID NO: 1815037 - RNA, 16 nt, Human
agccccacccucagau

SEQ ID NO: 1815038 - RNA, 14 nt, Human
auuuauuuuaauaa

SEQ ID NO: 1815039 - RNA, 14 nt, Human
uggcaucaucucag

SEQ ID NO: 1815040 - RNA, 16 nt, Human
auacgcaucagacaga

SEQ ID NO: 1815041 - RNA, 17 nt, Human
cacccaaccacauccca

SEQ ID NO: 1815042 - RNA, 16 nt, Human
cagacucuaagaaaga

SEQ ID NO: 1815043 - RNA, 19 nt, Human
uguaaagugauauuucccc

SEQ ID NO: 1815044 - RNA, 22 nt, Human
uguacacaacaauccuucuauu

SEQ ID NO: 1815045 - RNA, 19 nt, Human
ggccccuuugcugacccuc

SEQ ID NO: 1815046 - RNA, 21 nt, Human
cagguaaaacagggccacaua

SEQ ID NO: 1815047 - RNA, 22 nt, Human
cccugaagaucuagugaacauu

SEQ ID NO: 1815048 - RNA, 22 nt, Human
uucuuccacagugccuaauaau

SEQ ID NO: 1815049 - RNA, 24 nt, Human
aaagacagcuucucauccugcagg

SEQ ID NO: 1815050 - RNA, 13 nt, Human
uaucucacacuca

SEQ ID NO: 1815051 - RNA, 18 nt, Human
cugcucagcccugcacca

SEQ ID NO: 1815052 - RNA, 21 nt, Human
cucaccugagcgcucagcuuc

SEQ ID NO: 1815053 - RNA, 16 nt, Human
cacccucccacugcca

SEQ ID NO: 1815054 - RNA, 22 nt, Human
agacccuuauugcuguccugga

SEQ ID NO: 1815055 - RNA, 20 nt, Human
uaauaaguugcauagguuua

SEQ ID NO: 1815056 - RNA, 19 nt, Human
ccucuauggccccugccuu

SEQ ID NO: 1815057 - RNA, 14 nt, Human
gauauccucccucc

SEQ ID NO: 1815058 - RNA, 15 nt, Human
agcagguaggaggca

SEQ ID NO: 1815059 - RNA, 22 nt, Human
aaaaaacacugggagaaaugaa

SEQ ID NO: 1815060 - RNA, 19 nt, Human
uggccacaucugagccccg

SEQ ID NO: 1815061 - RNA, 13 nt, Human
gaagauauuuuuc

SEQ ID NO: 1815062 - RNA, 20 nt, Human
augcauauacuuuaauaaau

SEQ ID NO: 1815063 - RNA, 16 nt, Human
uacuggaaggcuucca

SEQ ID NO: 1815064 - RNA, 23 nt, Human
aauuagcuccuccuuuuuccuuc

SEQ ID NO: 1815065 - RNA, 16 nt, Human
gccugacugccaagcc

SEQ ID NO: 1815066 - RNA, 19 nt, Human
acaaacccaagggcagggg

SEQ ID NO: 1815067 - RNA, 15 nt, Human
uuuagccuuaaagau

SEQ ID NO: 1815068 - RNA, 20 nt, Human
acagaucacagcuucagcca

SEQ ID NO: 1815069 - RNA, 16 nt, Human
cuccauaucucccucu

SEQ ID NO: 1815070 - RNA, 17 nt, Human
uguuggcuguuccugca

SEQ ID NO: 1815071 - RNA, 13 nt, Human
guuauuauuaaau

SEQ ID NO: 1815072 - RNA, 19 nt, Human
cuucuuccaacguggccca

SEQ ID NO: 1815073 - RNA, 18 nt, Human
cuuuccaugaguugcagu

SEQ ID NO: 1815074 - RNA, 15 nt, Human
ccugcaccaugcugc

SEQ ID NO: 1815075 - RNA, 17 nt, Human
ccugagcuugcagagau

SEQ ID NO: 1815076 - RNA, 12 nt, Human
gaccuuccuuuu

SEQ ID NO: 1815077 - RNA, 22 nt, Human
gacugugggcuccauucaaagu

SEQ ID NO: 1815078 - RNA, 20 nt, Human
uuuaguaagagauuccugag

SEQ ID NO: 1815079 - RNA, 19 nt, Human
cauguuucaggagagaguu

SEQ ID NO: 1815080 - RNA, 19 nt, Human
uaaagucaagauuuccaua

SEQ ID NO: 1815081 - RNA, 20 nt, Human
cagcauggagucacagccac

SEQ ID NO: 1815082 - RNA, 17 nt, Human
aggccaugggacaggga

SEQ ID NO: 1815083 - RNA, 21 nt, Human
uaacaaauauggggaaaaaac

SEQ ID NO: 1815084 - RNA, 19 nt, Human
caagccauggguagccugg

SEQ ID NO: 1815085 - RNA, 16 nt, Human
aaagacaaggaaaaaa

SEQ ID NO: 1815086 - RNA, 20 nt, Human
agaauucuguugauggaaau

SEQ ID NO: 1815087 - RNA, 21 nt, Human
acuuguggacuaaaagauaua

SEQ ID NO: 1815088 - RNA, 14 nt, Human
ugagacucugucuc

SEQ ID NO: 1815089 - RNA, 11 nt, Human
cccccagccuc

SEQ ID NO: 1815090 - RNA, 22 nt, Human
ucugccuccccuucacucccac

SEQ ID NO: 1815091 - RNA, 18 nt, Human
ucaaauuguaagcaugca

SEQ ID NO: 1815092 - RNA, 18 nt, Human
gagugagggggggguauu

SEQ ID NO: 1815093 - RNA, 16 nt, Human
auuuuuacacauguau

SEQ ID NO: 1815094 - RNA, 18 nt, Human
ugagcaaaaccaaauauu

SEQ ID NO: 1815095 - RNA, 22 nt, Human
auaauauuuuuaauauauacua

SEQ ID NO: 1815096 - RNA, 22 nt, Human
uuuccucaacguugcuccccau

SEQ ID NO: 1815097 - RNA, 14 nt, Human
cagagaaguuuucu

SEQ ID NO: 1815098 - RNA, 20 nt, Human
uucacaucgcagauucuccc

SEQ ID NO: 1815099 - RNA, 17 nt, Human
acaaaugggaaacaaaa

SEQ ID NO: 1815100 - RNA, 21 nt, Human
cuacccuggacuugccucugc

SEQ ID NO: 1815101 - RNA, 18 nt, Human
ccugccuaagugcagccc

SEQ ID NO: 1815102 - RNA, 18 nt, Human
cugcucaauaaaguacaa

SEQ ID NO: 1815103 - RNA, 18 nt, Human
cucucagugggugguagc

SEQ ID NO: 1815104 - RNA, 15 nt, Human
cuuuucccaacucca

SEQ ID NO: 1815105 - RNA, 20 nt, Human
cgcuccaccuugcagcucuc

SEQ ID NO: 1815106 - RNA, 19 nt, Human
aaccaccgcgcccagccuu

SEQ ID NO: 1815107 - RNA, 22 nt, Human
gugugaccacugcagaagacag

SEQ ID NO: 1815108 - RNA, 18 nt, Human
uuucaccauguuggccag

SEQ ID NO: 1815109 - RNA, 19 nt, Human
gccagagcuacccgcagag

SEQ ID NO: 1815110 - RNA, 17 nt, Human
acccacuggacucaccu

SEQ ID NO: 1815111 - RNA, 12 nt, Human
cagccucagccu

SEQ ID NO: 1815112 - RNA, 18 nt, Human
gcagcccuuagcccuucc

SEQ ID NO: 1815113 - RNA, 23 nt, Human
aguaaagaauuauuuugugaugc

SEQ ID NO: 1815114 - RNA, 12 nt, Human
ugcucagcuucu

SEQ ID NO: 1815115 - RNA, 19 nt, Human
aaguccuucccuuucauuu

SEQ ID NO: 1815116 - RNA, 12 nt, Human
aaccucugccuc

SEQ ID NO: 1815117 - RNA, 13 nt, Human
gcuucagccagga

SEQ ID NO: 1815118 - RNA, 22 nt, Human
guaugauggguguuuuuagcag

SEQ ID NO: 1815119 - RNA, 19 nt, Human
accuccuggguucaagcga

SEQ ID NO: 1815120 - RNA, 15 nt, Human
agggaagagguggcc

SEQ ID NO: 1815121 - RNA, 20 nt, Human
aagaugguaccaccagucug

SEQ ID NO: 1815122 - RNA, 22 nt, Human
auagaccuaaaauaaaaugaag

SEQ ID NO: 1815123 - RNA, 15 nt, Human
aucccucuaucucua

SEQ ID NO: 1815124 - RNA, 18 nt, Human
accugcucagcccugcac

SEQ ID NO: 1815125 - RNA, 16 nt, Human
caggguuucaccaugu

SEQ ID NO: 1815126 - RNA, 12 nt, Human
acugcuccagag

SEQ ID NO: 1815127 - RNA, 21 nt, Human
cccuauccuacuuccccuucc

SEQ ID NO: 1815128 - RNA, 16 nt, Human
acaguugcauugacug

SEQ ID NO: 1815129 - RNA, 20 nt, Human
agugaaaaacuauuaacaac

SEQ ID NO: 1815130 - RNA, 14 nt, Human
ucccuuucauuuuu

SEQ ID NO: 1815131 - RNA, 17 nt, Human
uaagccuucugguuuua

SEQ ID NO: 1815132 - RNA, 17 nt, Human
guguauguguaucucac

SEQ ID NO: 1815133 - RNA, 22 nt, Human
ugguagcuaaauauauauuuua

SEQ ID NO: 1815134 - RNA, 15 nt, Human
accgcgcccagccuu

SEQ ID NO: 1815135 - RNA, 15 nt, Human
agccagguucugacu

SEQ ID NO: 1815136 - RNA, 13 nt, Human
aauaaaccuuuuu

SEQ ID NO: 1815137 - RNA, 15 nt, Human
aagccaugugcagcc

SEQ ID NO: 1815138 - RNA, 16 nt, Human
ccugcucagcccugca

SEQ ID NO: 1815139 - RNA, 14 nt, Human
agguaaaacagggc

SEQ ID NO: 1815140 - RNA, 17 nt, Human
ugauuuuauuagaaguu

SEQ ID NO: 1815141 - RNA, 13 nt, Human
cugacccucccca

SEQ ID NO: 1815142 - RNA, 17 nt, Human
agcccuguaacaggcuu

SEQ ID NO: 1815143 - RNA, 15 nt, Human
uaggguccaccagga

SEQ ID NO: 1815144 - RNA, 14 nt, Human
cccuggacugugug

SEQ ID NO: 1815145 - RNA, 15 nt, Human
agaacuucaagcucu

SEQ ID NO: 1815146 - RNA, 14 nt, Human
agcccucccuaccu

SEQ ID NO: 1815147 - RNA, 21 nt, Human
gaacuuuccacauucagagcu

SEQ ID NO: 1815148 - RNA, 13 nt, Human
cucugagccuugg

SEQ ID NO: 1815149 - RNA, 17 nt, Human
cugcaaccucugccucc

SEQ ID NO: 1815150 - RNA, 14 nt, Human
aggccuuuaaaauu

SEQ ID NO: 1815151 - RNA, 23 nt, Human
caauauuuuucuuacugauuuuu

SEQ ID NO: 1815152 - RNA, 16 nt, Human
cuuagcccuuccccuc

SEQ ID NO: 1815153 - RNA, 19 nt, Human
uaauacuugcuuuggaaaa

SEQ ID NO: 1815154 - RNA, 16 nt, Human
cuuauaauuuaaaaua

SEQ ID NO: 1815155 - RNA, 13 nt, Human
auaauaaauguac

SEQ ID NO: 1815156 - RNA, 15 nt, Human
uaucaauuuaaaaaa

SEQ ID NO: 1815157 - RNA, 18 nt, Human
uacuuuauuuucuauaau

SEQ ID NO: 1815158 - RNA, 19 nt, Human
cuaguccccagccugcucc

SEQ ID NO: 1815159 - RNA, 18 nt, Human
ccuggcugcugcugugca

SEQ ID NO: 1815160 - RNA, 20 nt, Human
auucaaaggcauuucuuuuc

SEQ ID NO: 1815161 - RNA, 22 nt, Human
uuuccuuauucagaauuucuaa

SEQ ID NO: 1815162 - RNA, 12 nt, Human
cagccugccuuu

SEQ ID NO: 1815163 - RNA, 17 nt, Human
uuucucaucuuuuuacu

SEQ ID NO: 1815164 - RNA, 20 nt, Human
ugcguccugucggagcccug

SEQ ID NO: 1815165 - RNA, 16 nt, Human
gaaaaacuauuaacaa

SEQ ID NO: 1815166 - RNA, 14 nt, Human
ugccuuucuucucu

SEQ ID NO: 1815167 - RNA, 16 nt, Human
gaagccagaucuaugc

SEQ ID NO: 1815168 - RNA, 14 nt, Human
ucaccauguuggcu

SEQ ID NO: 1815169 - RNA, 23 nt, Human
uggcuugaguuuaaauuguaaua

SEQ ID NO: 1815170 - RNA, 11 nt, Human
caacucccugc

SEQ ID NO: 1815171 - RNA, 17 nt, Human
agugcucgcuguugcug

SEQ ID NO: 1815172 - RNA, 14 nt, Human
acaggccucacaca

SEQ ID NO: 1815173 - RNA, 15 nt, Human
ucuaucauuuaauaa

SEQ ID NO: 1815174 - RNA, 21 nt, Human
cacagcauggagucacagcca

SEQ ID NO: 1815175 - RNA, 19 nt, Human
cagcuacuugggaggcuga

SEQ ID NO: 1815176 - RNA, 19 nt, Human
ugugaugcaaauaaauauc

SEQ ID NO: 1815177 - RNA, 18 nt, Human
uagugaaauauuauuuua

SEQ ID NO: 1815178 - RNA, 21 nt, Human
cccuucuuuuuguucuucauc

SEQ ID NO: 1815179 - RNA, 23 nt, Human
auauaacaaugcuguauuuuaaa

SEQ ID NO: 1815180 - RNA, 17 nt, Human
aggaucguuuuuuccca

SEQ ID NO: 1815181 - RNA, 19 nt, Human
uuauauugauaagaucuuu

SEQ ID NO: 1815182 - RNA, 18 nt, Human
ucuaauaguuuuauuaau

SEQ ID NO: 1815183 - RNA, 14 nt, Human
uuuugcuaauuuuu

SEQ ID NO: 1815184 - RNA, 14 nt, Human
gaggcacagaaacu

SEQ ID NO: 1815185 - RNA, 18 nt, Human
acaaacagggcugccuuc

SEQ ID NO: 1815186 - RNA, 16 nt, Human
ucauaaagucuugccu

SEQ ID NO: 1815187 - RNA, 18 nt, Human
cauggaauuggagcucgu

SEQ ID NO: 1815188 - RNA, 17 nt, Human
ccagccugcucccuagc

SEQ ID NO: 1815189 - RNA, 18 nt, Human
cacuaucuuaauuauugu

SEQ ID NO: 1815190 - RNA, 14 nt, Human
gucgcccuggacug

SEQ ID NO: 1815191 - RNA, 13 nt, Human
ccugccccccagc

SEQ ID NO: 1815192 - RNA, 18 nt, Human
aaucaaaagacuuuuucc

SEQ ID NO: 1815193 - RNA, 11 nt, Human
ugcugauuguu

SEQ ID NO: 1815194 - RNA, 17 nt, Human
agccaggagcugggcag

SEQ ID NO: 1815195 - RNA, 16 nt, Human
gucccuauuccuccuu

SEQ ID NO: 1815196 - RNA, 22 nt, Human
guaacaggcuugaaucaaagaa

SEQ ID NO: 1815197 - RNA, 19 nt, Human
uaggugacuauuauauuuc

SEQ ID NO: 1815198 - RNA, 15 nt, Human
gcccccuaagccccc

SEQ ID NO: 1815199 - RNA, 20 nt, Human
aaggaugccccgucccccuc

SEQ ID NO: 1815200 - RNA, 20 nt, Human
uauaccugauauauuccacc

SEQ ID NO: 1815201 - RNA, 23 nt, Human
caaagugagcuccuaagccaugg

SEQ ID NO: 1815202 - RNA, 12 nt, Human
guuuucuuucua

SEQ ID NO: 1815203 - RNA, 13 nt, Human
uuuuaaauauuuu

SEQ ID NO: 1815204 - RNA, 21 nt, Human
cugcuggcaguggaacuaaga

SEQ ID NO: 1815205 - RNA, 12 nt, Human
augcagccccau

SEQ ID NO: 1815206 - RNA, 12 nt, Human
uggcugaaagga

SEQ ID NO: 1815207 - RNA, 14 nt, Human
cagaggcucuaaug

SEQ ID NO: 1815208 - RNA, 22 nt, Salmonella typhimurium LT2
uuuuucuugcucucaggcagua

SEQ ID NO: 1815209 - RNA, 19 nt, Salmonella typhimurium LT2
uuuugaguuugucauccag

SEQ ID NO: 1815210 - RNA, 17 nt, Salmonella typhimurium LT2
uuuucuucuucggcuuc

SEQ ID NO: 1815211 - RNA, 15 nt, Salmonella typhimurium LT2
uuuuauuaagcaggc

SEQ ID NO: 1815212 - RNA, 14 nt, Salmonella typhimurium LT2
uuuuacaggccgga

SEQ ID NO: 1815213 - RNA, 19 nt, Salmonella typhimurium LT2
uuuguaaccaacaaacgcg

SEQ ID NO: 1815214 - RNA, 21 nt, Salmonella typhimurium LT2
uuuguaacgaacgcugcaucg

SEQ ID NO: 1815215 - RNA, 15 nt, Salmonella typhimurium LT2
uuugcgaaaagccgg

SEQ ID NO: 1815216 - RNA, 19 nt, Salmonella typhimurium LT2
uuugcgacggaacagacga

SEQ ID NO: 1815217 - RNA, 17 nt, Salmonella typhimurium LT2
uuugccugagcgcgaac

SEQ ID NO: 1815218 - RNA, 22 nt, Salmonella typhimurium LT2
uuugccgcgcucuuuaaacgcc

SEQ ID NO: 1815219 - RNA, 15 nt, Salmonella typhimurium LT2
uuugccgcaaacgcc

SEQ ID NO: 1815220 - RNA, 22 nt, Salmonella typhimurium LT2
uuugcccagcgcuggcagaucg

SEQ ID NO: 1815221 - RNA, 13 nt, Salmonella typhimurium LT2
uuugcagcagcgu

SEQ ID NO: 1815222 - RNA, 22 nt, Salmonella typhimurium LT2
uuugcagccagauaucgcguac

SEQ ID NO: 1815223 - RNA, 12 nt, Salmonella typhimurium LT2
uuucguaccgaa

SEQ ID NO: 1815224 - RNA, 17 nt, Salmonella typhimurium LT2
uuucguacauguccaga

SEQ ID NO: 1815225 - RNA, 14 nt, Salmonella typhimurium LT2
uuucguaagccgcg

SEQ ID NO: 1815226 - RNA, 18 nt, Salmonella typhimurium LT2
uuucgccagcaacgccca

SEQ ID NO: 1815227 - RNA, 22 nt, Salmonella typhimurium LT2
uuucgcccgguucauuaccgac

SEQ ID NO: 1815228 - RNA, 20 nt, Salmonella typhimurium LT2
uuucgccagguacaucgcgc

SEQ ID NO: 1815229 - RNA, 17 nt, Salmonella typhimurium LT2
uuucgccgcgcggaucg

SEQ ID NO: 1815230 - RNA, 23 nt, Salmonella typhimurium LT2
uuucgccguguaagagcuggucg

SEQ ID NO: 1815231 - RNA, 13 nt, Salmonella typhimurium LT2
uuuccggcaccag

SEQ ID NO: 1815232 - RNA, 15 nt, Salmonella typhimurium LT2
uuuccggucgcgcaa

SEQ ID NO: 1815233 - RNA, 22 nt, Salmonella typhimurium LT2
uuucgaacgccgacaucacgca

SEQ ID NO: 1815234 - RNA, 14 nt, Salmonella typhimurium LT2
uuucgauaaccgcc

SEQ ID NO: 1815235 - RNA, 15 nt, Salmonella typhimurium LT2
uuucaucaucgccga

SEQ ID NO: 1815236 - RNA, 13 nt, Salmonella typhimurium LT2
uuucaaucgccac

SEQ ID NO: 1815237 - RNA, 16 nt, Salmonella typhimurium LT2
uuucaauaagcgguaa

SEQ ID NO: 1815238 - RNA, 18 nt, Salmonella typhimurium LT2
uuuaacgcuuccggaucg

SEQ ID NO: 1815239 - RNA, 15 nt, Salmonella typhimurium LT2
uugucacaaacggca

SEQ ID NO: 1815240 - RNA, 20 nt, Salmonella typhimurium LT2
uuguauuggucuaucgcuuc

SEQ ID NO: 1815241 - RNA, 18 nt, Salmonella typhimurium LT2
uuguccagcagcagcaca

SEQ ID NO: 1815242 - RNA, 19 nt, Salmonella typhimurium LT2
uugucguucacguaaucgc

SEQ ID NO: 1815243 - RNA, 13 nt, Salmonella typhimurium LT2
uugugauaauacu

SEQ ID NO: 1815244 - RNA, 21 nt, Salmonella typhimurium LT2
uuuaaaaagcugcauaaugcg

SEQ ID NO: 1815245 - RNA, 20 nt, Salmonella typhimurium LT2
uugcgccaccuuaaucgacu

SEQ ID NO: 1815246 - RNA, 14 nt, Salmonella typhimurium LT2
uugcgccauugccg

SEQ ID NO: 1815247 - RNA, 13 nt, Salmonella typhimurium LT2
uugcgguccagua

SEQ ID NO: 1815248 - RNA, 20 nt, Salmonella typhimurium LT2
uugccggagagaugccgcca

SEQ ID NO: 1815249 - RNA, 20 nt, Salmonella typhimurium LT2
uugcgauacagcguaucggc

SEQ ID NO: 1815250 - RNA, 13 nt, Salmonella typhimurium LT2
uugccuuauucac

SEQ ID NO: 1815251 - RNA, 16 nt, Salmonella typhimurium LT2
uugcuuuuucggcaau

SEQ ID NO: 1815252 - RNA, 20 nt, Salmonella typhimurium LT2
uugcuggcgugaaccgguaa

SEQ ID NO: 1815253 - RNA, 20 nt, Salmonella typhimurium LT2
uugcugcguaaaagcguuac

SEQ ID NO: 1815254 - RNA, 18 nt, Salmonella typhimurium LT2
uugcugaaucugcggcug

SEQ ID NO: 1815255 - RNA, 22 nt, Salmonella typhimurium LT2
uugcucccagaaaccgccccug

SEQ ID NO: 1815256 - RNA, 21 nt, Salmonella typhimurium LT2
uuggcagggcugaaucggcac

SEQ ID NO: 1815257 - RNA, 13 nt, Salmonella typhimurium LT2
uuggcauccagca

SEQ ID NO: 1815258 - RNA, 14 nt, Salmonella typhimurium LT2
uuggaggccggaua

SEQ ID NO: 1815259 - RNA, 13 nt, Salmonella typhimurium LT2
uuggaucggcaaa

SEQ ID NO: 1815260 - RNA, 18 nt, Salmonella typhimurium LT2
uugccagcgcauccaccg

SEQ ID NO: 1815261 - RNA, 16 nt, Salmonella typhimurium LT2
uugccauacgcccacg

SEQ ID NO: 1815262 - RNA, 17 nt, Salmonella typhimurium LT2
uugcccgguggcgcugc

SEQ ID NO: 1815263 - RNA, 19 nt, Salmonella typhimurium LT2
uugccaaaaaaucagcaau

SEQ ID NO: 1815264 - RNA, 11 nt, Salmonella typhimurium LT2
uugcagcgcca

SEQ ID NO: 1815265 - RNA, 19 nt, Salmonella typhimurium LT2
uugcagcgcuguccagaua

SEQ ID NO: 1815266 - RNA, 23 nt, Salmonella typhimurium LT2
uugaugcuggggauuuuuucugc

SEQ ID NO: 1815267 - RNA, 20 nt, Salmonella typhimurium LT2
uugaugaaccgcuguagcgu

SEQ ID NO: 1815268 - RNA, 17 nt, Salmonella typhimurium LT2
uugacuuuuacgccacg

SEQ ID NO: 1815269 - RNA, 18 nt, Salmonella typhimurium LT2
uugacgugcucaaucgcc

SEQ ID NO: 1815270 - RNA, 22 nt, Salmonella typhimurium LT2
uugacgucacugucagcaucag

SEQ ID NO: 1815271 - RNA, 16 nt, Salmonella typhimurium LT2
uugaccgucauccacg

SEQ ID NO: 1815272 - RNA, 18 nt, Salmonella typhimurium LT2
uugaccgucauccacgcc

SEQ ID NO: 1815273 - RNA, 21 nt, Salmonella typhimurium LT2
uugacgauuuuuaagcugcgc

SEQ ID NO: 1815274 - RNA, 22 nt, Salmonella typhimurium LT2
uugagacguuauuagccggaua

SEQ ID NO: 1815275 - RNA, 15 nt, Salmonella typhimurium LT2
uugaacauauccgcg

SEQ ID NO: 1815276 - RNA, 15 nt, Salmonella typhimurium LT2
uuccuccgccgauaa

SEQ ID NO: 1815277 - RNA, 14 nt, Salmonella typhimurium LT2
uuccucagaauccg

SEQ ID NO: 1815278 - RNA, 14 nt, Salmonella typhimurium LT2
uugacacuauauug

SEQ ID NO: 1815279 - RNA, 13 nt, Salmonella typhimurium LT2
uugaauuugacga

SEQ ID NO: 1815280 - RNA, 21 nt, Salmonella typhimurium LT2
uugaauaaugcccguugacga

SEQ ID NO: 1815281 - RNA, 16 nt, Salmonella typhimurium LT2
uggguuaacgcgccau

SEQ ID NO: 1815282 - RNA, 15 nt, Salmonella typhimurium LT2
ugggauaaugucgac

SEQ ID NO: 1815283 - RNA, 20 nt, Salmonella typhimurium LT2
ugggacguuuggcuuauccg

SEQ ID NO: 1815284 - RNA, 14 nt, Salmonella typhimurium LT2
uggcuuugcgccac

SEQ ID NO: 1815285 - RNA, 16 nt, Salmonella typhimurium LT2
uggcuuugcgccacuu

SEQ ID NO: 1815286 - RNA, 20 nt, Salmonella typhimurium LT2
uggcuuucuaccugcaaugu

SEQ ID NO: 1815287 - RNA, 12 nt, Salmonella typhimurium LT2
uggcugcgccug

SEQ ID NO: 1815288 - RNA, 19 nt, Salmonella typhimurium LT2
uggcguuaacggcgccacg

SEQ ID NO: 1815289 - RNA, 18 nt, Salmonella typhimurium LT2
uggcgucagaccggcaau

SEQ ID NO: 1815290 - RNA, 24 nt, Salmonella typhimurium LT2
uggcgugaaaagugccgcucacug

SEQ ID NO: 1815291 - RNA, 13 nt, Salmonella typhimurium LT2
uggcgucucagcg

SEQ ID NO: 1815292 - RNA, 20 nt, Salmonella typhimurium LT2
uggcguacgguuggaucggc

SEQ ID NO: 1815293 - RNA, 23 nt, Salmonella typhimurium LT2
uggcgcagcuucugauacugcuc

SEQ ID NO: 1815294 - RNA, 18 nt, Salmonella typhimurium LT2
uggcgaagugcagcguuu

SEQ ID NO: 1815295 - RNA, 23 nt, Salmonella typhimurium LT2
uggcgaacguuacccggccagcc

SEQ ID NO: 1815296 - RNA, 22 nt, Salmonella typhimurium LT2
uggcggaauugguagacgcgcu

SEQ ID NO: 1815297 - RNA, 19 nt, Salmonella typhimurium LT2
uggcgcugucgcuuaccgg

SEQ ID NO: 1815298 - RNA, 17 nt, Salmonella typhimurium LT2
uggcgcuuaauacgcga

SEQ ID NO: 1815299 - RNA, 18 nt, Salmonella typhimurium LT2
uggcgcuucgcuuaucag

SEQ ID NO: 1815300 - RNA, 16 nt, Salmonella typhimurium LT2
uggcgcuugcuuaucg

SEQ ID NO: 1815301 - RNA, 17 nt, Salmonella typhimurium LT2
uggcgcuugcuuaucgg

SEQ ID NO: 1815302 - RNA, 18 nt, Salmonella typhimurium LT2
uggcgcgacgcuuaucag

SEQ ID NO: 1815303 - RNA, 14 nt, Salmonella typhimurium LT2
uggcgaaacgccug

SEQ ID NO: 1815304 - RNA, 14 nt, Salmonella typhimurium LT2
uggccuucaaucag

SEQ ID NO: 1815305 - RNA, 21 nt, Salmonella typhimurium LT2
uggccuguaccgcuucccgcg

SEQ ID NO: 1815306 - RNA, 17 nt, Salmonella typhimurium LT2
uggaacugaucguggcc

SEQ ID NO: 1815307 - RNA, 19 nt, Salmonella typhimurium LT2
uggaaguacgccucgcgca

SEQ ID NO: 1815308 - RNA, 16 nt, Salmonella typhimurium LT2
uggaaucuaccgccau

SEQ ID NO: 1815309 - RNA, 20 nt, Salmonella typhimurium LT2
uggaacaucucccaggcgau

SEQ ID NO: 1815310 - RNA, 22 nt, Salmonella typhimurium LT2
uggaacaggccaaacccugcgc

SEQ ID NO: 1815311 - RNA, 17 nt, Salmonella typhimurium LT2
uggacaaggaucguuac

SEQ ID NO: 1815312 - RNA, 20 nt, Salmonella typhimurium LT2
uggacgugccuuccaucggc

SEQ ID NO: 1815313 - RNA, 16 nt, Salmonella typhimurium LT2
uggacggcgucaccac

SEQ ID NO: 1815314 - RNA, 13 nt, Salmonella typhimurium LT2
uggacggcaucag

SEQ ID NO: 1815315 - RNA, 21 nt, Salmonella typhimurium LT2
uggagacacuucagccggaua

SEQ ID NO: 1815316 - RNA, 19 nt, Salmonella typhimurium LT2
uggagagcgauaaacucag

SEQ ID NO: 1815317 - RNA, 15 nt, Salmonella typhimurium LT2
uggauauccagcaua

SEQ ID NO: 1815318 - RNA, 23 nt, Salmonella typhimurium LT2
uggauaacgcggguuagcgccgg

SEQ ID NO: 1815319 - RNA, 15 nt, Salmonella typhimurium LT2
uggauaacggcguua

SEQ ID NO: 1815320 - RNA, 17 nt, Salmonella typhimurium LT2
uggauagucaggcgaug

SEQ ID NO: 1815321 - RNA, 20 nt, Salmonella typhimurium LT2
uggauacuggucgcgucaau

SEQ ID NO: 1815322 - RNA, 13 nt, Salmonella typhimurium LT2
uggauaaggcgug

SEQ ID NO: 1815323 - RNA, 18 nt, Salmonella typhimurium LT2
uggauaaggcgugagcca

SEQ ID NO: 1815324 - RNA, 19 nt, Salmonella typhimurium LT2
uggagguuucuucaucaaa

SEQ ID NO: 1815325 - RNA, 20 nt, Salmonella typhimurium LT2
uggauggcuuccguuagcgu

SEQ ID NO: 1815326 - RNA, 18 nt, Salmonella typhimurium LT2
uggcaaaucccguaccgg

SEQ ID NO: 1815327 - RNA, 15 nt, Salmonella typhimurium LT2
uggcaaccuuaccgg

SEQ ID NO: 1815328 - RNA, 22 nt, Salmonella typhimurium LT2
uggcagcgugaacgccuuaucc

SEQ ID NO: 1815329 - RNA, 16 nt, Salmonella typhimurium LT2
uggcagaguccagcgg

SEQ ID NO: 1815330 - RNA, 18 nt, Salmonella typhimurium LT2
uggcagggcugaaucggc

SEQ ID NO: 1815331 - RNA, 12 nt, Salmonella typhimurium LT2
uggcauccagca

SEQ ID NO: 1815332 - RNA, 15 nt, Salmonella typhimurium LT2
uggccaccuuuacgg

SEQ ID NO: 1815333 - RNA, 17 nt, Salmonella typhimurium LT2
uggccagcuccgcauaa

SEQ ID NO: 1815334 - RNA, 14 nt, Salmonella typhimurium LT2
uggccagcacaaua

SEQ ID NO: 1815335 - RNA, 13 nt, Salmonella typhimurium LT2
uggccagcauggc

SEQ ID NO: 1815336 - RNA, 18 nt, Salmonella typhimurium LT2
uggccaucuuccagcauc

SEQ ID NO: 1815337 - RNA, 17 nt, Salmonella typhimurium LT2
uggcccguuucgggcgc

SEQ ID NO: 1815338 - RNA, 19 nt, Salmonella typhimurium LT2
ugugaggucgggaacugaa

SEQ ID NO: 1815339 - RNA, 14 nt, Salmonella typhimurium LT2
ugucgauaauaucc

SEQ ID NO: 1815340 - RNA, 18 nt, Salmonella typhimurium LT2
ugucgauaauauccagca

SEQ ID NO: 1815341 - RNA, 11 nt, Salmonella typhimurium LT2
ugucgcguaac

SEQ ID NO: 1815342 - RNA, 18 nt, Salmonella typhimurium LT2
uguggucgucugaguaua

SEQ ID NO: 1815343 - RNA, 12 nt, Salmonella typhimurium LT2
uguguauagcuu

SEQ ID NO: 1815344 - RNA, 21 nt, Salmonella typhimurium LT2
uguguaucgcccugccagcuc

SEQ ID NO: 1815345 - RNA, 12 nt, Salmonella typhimurium LT2
ugugcaggagca

SEQ ID NO: 1815346 - RNA, 21 nt, Salmonella typhimurium LT2
uguggcguguuguaaaacgcg

SEQ ID NO: 1815347 - RNA, 15 nt, Salmonella typhimurium LT2
uguucacauccagcc

SEQ ID NO: 1815348 - RNA, 16 nt, Salmonella typhimurium LT2
uguucaagcugguuaa

SEQ ID NO: 1815349 - RNA, 18 nt, Salmonella typhimurium LT2
uguucaacgucagcugga

SEQ ID NO: 1815350 - RNA, 22 nt, Salmonella typhimurium LT2
uguuauagccuaaucucgccgg

SEQ ID NO: 1815351 - RNA, 16 nt, Salmonella typhimurium LT2
uguuagcgaaacugcc

SEQ ID NO: 1815352 - RNA, 21 nt, Salmonella typhimurium LT2
uguuaccagcaacugaccauc

SEQ ID NO: 1815353 - RNA, 14 nt, Salmonella typhimurium LT2
uguuaaaaccggcu

SEQ ID NO: 1815354 - RNA, 13 nt, Salmonella typhimurium LT2
uguguuugagcag

SEQ ID NO: 1815355 - RNA, 19 nt, Salmonella typhimurium LT2
uguugcgcaaucacgcguu

SEQ ID NO: 1815356 - RNA, 15 nt, Salmonella typhimurium LT2
uguugcacgcauggc

SEQ ID NO: 1815357 - RNA, 14 nt, Salmonella typhimurium LT2
uguucgauccggcg

SEQ ID NO: 1815358 - RNA, 20 nt, Salmonella typhimurium LT2
uguugaagauuagccguuga

SEQ ID NO: 1815359 - RNA, 18 nt, Salmonella typhimurium LT2
uguccacggggcggcaau

SEQ ID NO: 1815360 - RNA, 18 nt, Salmonella typhimurium LT2
uguccagaucuucccagu

SEQ ID NO: 1815361 - RNA, 10 nt, Salmonella typhimurium LT2
ugucauggcu

SEQ ID NO: 1815362 - RNA, 18 nt, Salmonella typhimurium LT2
uguccggguucgcggcaa

SEQ ID NO: 1815363 - RNA, 16 nt, Salmonella typhimurium LT2
uguccggcgcuucggc

SEQ ID NO: 1815364 - RNA, 21 nt, Salmonella typhimurium LT2
uguaggcccgguaagcgcagc

SEQ ID NO: 1815365 - RNA, 21 nt, Salmonella typhimurium LT2
uguaggccgaauaagcgacag

SEQ ID NO: 1815366 - RNA, 20 nt, Salmonella typhimurium LT2
uguaggccggauaagcguaa

SEQ ID NO: 1815367 - RNA, 19 nt, Salmonella typhimurium LT2
uguaggccggauaaggcag

SEQ ID NO: 1815368 - RNA, 19 nt, Salmonella typhimurium LT2
uguaggccggauaaggcgc

SEQ ID NO: 1815369 - RNA, 21 nt, Salmonella typhimurium LT2
uguaggccggauaaggcgcag

SEQ ID NO: 1815370 - RNA, 21 nt, Salmonella typhimurium LT2
uguaggccggaugaggcgcag

SEQ ID NO: 1815371 - RNA, 15 nt, Salmonella typhimurium LT2
uguacguauuuacaa

SEQ ID NO: 1815372 - RNA, 12 nt, Salmonella typhimurium LT2
uguacggcguca

SEQ ID NO: 1815373 - RNA, 16 nt, Salmonella typhimurium LT2
uguaauaaacagcguu

SEQ ID NO: 1815374 - RNA, 12 nt, Salmonella typhimurium LT2
uguacauccagg

SEQ ID NO: 1815375 - RNA, 17 nt, Salmonella typhimurium LT2
uguaccugauccagcuc

SEQ ID NO: 1815376 - RNA, 23 nt, Salmonella typhimurium LT2
ugguuugccgcauacaucgcaga

SEQ ID NO: 1815377 - RNA, 12 nt, Salmonella typhimurium LT2
ugguuugucgau

SEQ ID NO: 1815378 - RNA, 13 nt, Salmonella typhimurium LT2
ugguuucggcgua

SEQ ID NO: 1815379 - RNA, 17 nt, Salmonella typhimurium LT2
ugguuguccugguacau

SEQ ID NO: 1815380 - RNA, 14 nt, Salmonella typhimurium LT2
uggguuuccggauc

SEQ ID NO: 1815381 - RNA, 15 nt, Salmonella typhimurium LT2
ugguaaaggcguaga

SEQ ID NO: 1815382 - RNA, 17 nt, Salmonella typhimurium LT2
ugguaaauacgcugcgg

SEQ ID NO: 1815383 - RNA, 16 nt, Salmonella typhimurium LT2
ugguggauauccagca

SEQ ID NO: 1815384 - RNA, 16 nt, Salmonella typhimurium LT2
uuacagauauccaccg

SEQ ID NO: 1815385 - RNA, 19 nt, Salmonella typhimurium LT2
uuacagcauacgccgcugg

SEQ ID NO: 1815386 - RNA, 20 nt, Salmonella typhimurium LT2
uuacccggcguauugguaca

SEQ ID NO: 1815387 - RNA, 18 nt, Salmonella typhimurium LT2
uuacccuucaugcagccc

SEQ ID NO: 1815388 - RNA, 18 nt, Salmonella typhimurium LT2
uuaccgaccuguaccgcg

SEQ ID NO: 1815389 - RNA, 15 nt, Salmonella typhimurium LT2
uuaccagcaucaaua

SEQ ID NO: 1815390 - RNA, 14 nt, Salmonella typhimurium LT2
uuacugugccgccg

SEQ ID NO: 1815391 - RNA, 16 nt, Salmonella typhimurium LT2
uuaccggacagcacga

SEQ ID NO: 1815392 - RNA, 17 nt, Salmonella typhimurium LT2
uuaccgcaggucggaca

SEQ ID NO: 1815393 - RNA, 15 nt, Salmonella typhimurium LT2
uuagggcgcggcugg

SEQ ID NO: 1815394 - RNA, 23 nt, Salmonella typhimurium LT2
uuaggggcucuuuuuuuauagca

SEQ ID NO: 1815395 - RNA, 17 nt, Salmonella typhimurium LT2
uuagggggcuaccggag

SEQ ID NO: 1815396 - RNA, 14 nt, Salmonella typhimurium LT2
uuaggcacaucaau

SEQ ID NO: 1815397 - RNA, 17 nt, Salmonella typhimurium LT2
uuaguaauaaagcguag

SEQ ID NO: 1815398 - RNA, 20 nt, Salmonella typhimurium LT2
uuaucugugggucugcggcg

SEQ ID NO: 1815399 - RNA, 14 nt, Salmonella typhimurium LT2
uuaucaauccugcc

SEQ ID NO: 1815400 - RNA, 12 nt, Salmonella typhimurium LT2
uuaucuggucug

SEQ ID NO: 1815401 - RNA, 20 nt, Salmonella typhimurium LT2
uuaucuggucugcaugccgc

SEQ ID NO: 1815402 - RNA, 22 nt, Salmonella typhimurium LT2
uuaucacuauuacgauugcgcc

SEQ ID NO: 1815403 - RNA, 12 nt, Salmonella typhimurium LT2
uuauauuccgca

SEQ ID NO: 1815404 - RNA, 15 nt, Salmonella typhimurium LT2
uuaucaauaaccgcc

SEQ ID NO: 1815405 - RNA, 15 nt, Salmonella typhimurium LT2
uguuuuccagcguaa

SEQ ID NO: 1815406 - RNA, 14 nt, Salmonella typhimurium LT2
uguuuuaaauucaa

SEQ ID NO: 1815407 - RNA, 19 nt, Salmonella typhimurium LT2
uuaacagcgcgaccaggaa

SEQ ID NO: 1815408 - RNA, 21 nt, Salmonella typhimurium LT2
uuaacaaacgccaggcgcugc

SEQ ID NO: 1815409 - RNA, 11 nt, Salmonella typhimurium LT2
uguuucaccaa

SEQ ID NO: 1815410 - RNA, 22 nt, Salmonella typhimurium LT2
uuaagcgccuccacaaagcgcg

SEQ ID NO: 1815411 - RNA, 14 nt, Salmonella typhimurium LT2
uuaagauguugcgu

SEQ ID NO: 1815412 - RNA, 21 nt, Salmonella typhimurium LT2
uuaagacgcuucauaucgccc

SEQ ID NO: 1815413 - RNA, 21 nt, Salmonella typhimurium LT2
uuaacgcuuccggaucgcggc

SEQ ID NO: 1815414 - RNA, 17 nt, Salmonella typhimurium LT2
uuaacugcacuuucugc

SEQ ID NO: 1815415 - RNA, 11 nt, Salmonella typhimurium LT2
uuaauccagga

SEQ ID NO: 1815416 - RNA, 17 nt, Salmonella typhimurium LT2
uuaaugcuuuaaaugcc

SEQ ID NO: 1815417 - RNA, 16 nt, Salmonella typhimurium LT2
uuacacugauacggcg

SEQ ID NO: 1815418 - RNA, 21 nt, Salmonella typhimurium LT2
uucccgacuuuacaccccacu

SEQ ID NO: 1815419 - RNA, 23 nt, Salmonella typhimurium LT2
uuccggcagacgaaaaugcgccu

SEQ ID NO: 1815420 - RNA, 23 nt, Salmonella typhimurium LT2
uuccgguaaaucaacaaccggcu

SEQ ID NO: 1815421 - RNA, 14 nt, Salmonella typhimurium LT2
uuccgcucagcguc

SEQ ID NO: 1815422 - RNA, 16 nt, Salmonella typhimurium LT2
uuccgccguuaaccgu

SEQ ID NO: 1815423 - RNA, 20 nt, Salmonella typhimurium LT2
uuccacugcggcauuacgcg

SEQ ID NO: 1815424 - RNA, 23 nt, Salmonella typhimurium LT2
uuccacgccgucgaugauggcgg

SEQ ID NO: 1815425 - RNA, 13 nt, Salmonella typhimurium LT2
uuccacgauauua

SEQ ID NO: 1815426 - RNA, 14 nt, Salmonella typhimurium LT2
uucauaacgccgau

SEQ ID NO: 1815427 - RNA, 15 nt, Salmonella typhimurium LT2
uucauaagucaucca

SEQ ID NO: 1815428 - RNA, 13 nt, Salmonella typhimurium LT2
uucauaauaagcg

SEQ ID NO: 1815429 - RNA, 19 nt, Salmonella typhimurium LT2
uucauaguuugcauaaccg

SEQ ID NO: 1815430 - RNA, 15 nt, Salmonella typhimurium LT2
uucauauuaaauucc

SEQ ID NO: 1815431 - RNA, 14 nt, Salmonella typhimurium LT2
uucauauuguaggu

SEQ ID NO: 1815432 - RNA, 12 nt, Salmonella typhimurium LT2
uucaucauaucu

SEQ ID NO: 1815433 - RNA, 20 nt, Salmonella typhimurium LT2
uucaucagcacaaaauccca

SEQ ID NO: 1815434 - RNA, 11 nt, Salmonella typhimurium LT2
uucauccagcg

SEQ ID NO: 1815435 - RNA, 12 nt, Salmonella typhimurium LT2
uucauccagcgc

SEQ ID NO: 1815436 - RNA, 18 nt, Salmonella typhimurium LT2
uuccacacggcauucacg

SEQ ID NO: 1815437 - RNA, 23 nt, Salmonella typhimurium LT2
uucaacaucagcgcuaccagcgc

SEQ ID NO: 1815438 - RNA, 15 nt, Salmonella typhimurium LT2
uucaaccugauauug

SEQ ID NO: 1815439 - RNA, 16 nt, Salmonella typhimurium LT2
uucacaaccuccacgc

SEQ ID NO: 1815440 - RNA, 22 nt, Salmonella typhimurium LT2
uucacaaacaauuucccccacu

SEQ ID NO: 1815441 - RNA, 17 nt, Salmonella typhimurium LT2
uuauguaccgucaucgc

SEQ ID NO: 1815442 - RNA, 23 nt, Salmonella typhimurium LT2
uucacgggaacggcguaccagaa

SEQ ID NO: 1815443 - RNA, 21 nt, Salmonella typhimurium LT2
uucagguuuuuaagcugccca

SEQ ID NO: 1815444 - RNA, 19 nt, Salmonella typhimurium LT2
uucagucgggaucgccaga

SEQ ID NO: 1815445 - RNA, 24 nt, Salmonella typhimurium LT2
uucaguggcgcgccgcugucucgu

SEQ ID NO: 1815446 - RNA, 22 nt, Salmonella typhimurium LT2
uucaguucguagagcuccacgc

SEQ ID NO: 1815447 - RNA, 18 nt, Salmonella typhimurium LT2
uucagggcgacgaaucag

SEQ ID NO: 1815448 - RNA, 21 nt, Salmonella typhimurium LT2
uucaggcgggguuaacugcuu

SEQ ID NO: 1815449 - RNA, 23 nt, Salmonella typhimurium LT2
ucggcuuuggcaaacggcgccag

SEQ ID NO: 1815450 - RNA, 14 nt, Salmonella typhimurium LT2
ucggcuuuaucgcc

SEQ ID NO: 1815451 - RNA, 20 nt, Salmonella typhimurium LT2
ucggcuguacuuuaaccgga

SEQ ID NO: 1815452 - RNA, 16 nt, Salmonella typhimurium LT2
ucgggauuccagugac

SEQ ID NO: 1815453 - RNA, 19 nt, Salmonella typhimurium LT2
ucgggaugguuaaauucau

SEQ ID NO: 1815454 - RNA, 20 nt, Salmonella typhimurium LT2
ucgggaugguuaaauucaua

SEQ ID NO: 1815455 - RNA, 14 nt, Salmonella typhimurium LT2
ucgggacggcgguc

SEQ ID NO: 1815456 - RNA, 14 nt, Salmonella typhimurium LT2
ucggcuccggcaaa

SEQ ID NO: 1815457 - RNA, 12 nt, Salmonella typhimurium LT2
ucggcgcgcugg

SEQ ID NO: 1815458 - RNA, 20 nt, Salmonella typhimurium LT2
ucggcgacuggaacaggcca

SEQ ID NO: 1815459 - RNA, 22 nt, Salmonella typhimurium LT2
ucggcgacguccguuagcuggc

SEQ ID NO: 1815460 - RNA, 15 nt, Salmonella typhimurium LT2
ucggccugcguuaac

SEQ ID NO: 1815461 - RNA, 16 nt, Salmonella typhimurium LT2
ucgcucaucucaagcc

SEQ ID NO: 1815462 - RNA, 13 nt, Salmonella typhimurium LT2
ucgcuauccagca

SEQ ID NO: 1815463 - RNA, 14 nt, Salmonella typhimurium LT2
ucgcuauccagcag

SEQ ID NO: 1815464 - RNA, 23 nt, Salmonella typhimurium LT2
ucgcuaucugacagccaaacugc

SEQ ID NO: 1815465 - RNA, 20 nt, Salmonella typhimurium LT2
ucgcucagguuguccagcag

SEQ ID NO: 1815466 - RNA, 20 nt, Salmonella typhimurium LT2
ucgcgcuguucgcuuaaccg

SEQ ID NO: 1815467 - RNA, 22 nt, Salmonella typhimurium LT2
ucgcuaccacagaaaucgccgg

SEQ ID NO: 1815468 - RNA, 17 nt, Salmonella typhimurium LT2
ucgcuggccuccagcac

SEQ ID NO: 1815469 - RNA, 21 nt, Salmonella typhimurium LT2
ucggcauacaccgccagcguc

SEQ ID NO: 1815470 - RNA, 15 nt, Salmonella typhimurium LT2
ucggccagcgccagc

SEQ ID NO: 1815471 - RNA, 18 nt, Salmonella typhimurium LT2
ucggccaucuggcguugc

SEQ ID NO: 1815472 - RNA, 23 nt, Salmonella typhimurium LT2
ucgucaccuguagggucgccgcg

SEQ ID NO: 1815473 - RNA, 16 nt, Salmonella typhimurium LT2
ucgucagccgccaguu

SEQ ID NO: 1815474 - RNA, 14 nt, Salmonella typhimurium LT2
ucgucagcaccguc

SEQ ID NO: 1815475 - RNA, 14 nt, Salmonella typhimurium LT2
ucgguucgccgcag

SEQ ID NO: 1815476 - RNA, 18 nt, Salmonella typhimurium LT2
ucguagccgaccaccauc

SEQ ID NO: 1815477 - RNA, 14 nt, Salmonella typhimurium LT2
ucguaggccagcgc

SEQ ID NO: 1815478 - RNA, 13 nt, Salmonella typhimurium LT2
ucguagguucgac

SEQ ID NO: 1815479 - RNA, 22 nt, Salmonella typhimurium LT2
ucggucaucagggcguaagcgc

SEQ ID NO: 1815480 - RNA, 18 nt, Salmonella typhimurium LT2
ucggucccaucgcgccau

SEQ ID NO: 1815481 - RNA, 20 nt, Salmonella typhimurium LT2
ucgguaagucugauaacggc

SEQ ID NO: 1815482 - RNA, 17 nt, Salmonella typhimurium LT2
ucgguaguguuaucgcc

SEQ ID NO: 1815483 - RNA, 21 nt, Salmonella typhimurium LT2
ucggguucacuuuaccaggca

SEQ ID NO: 1815484 - RNA, 15 nt, Salmonella typhimurium LT2
ucguccugcgcgacg

SEQ ID NO: 1815485 - RNA, 19 nt, Salmonella typhimurium LT2
ucgugauaacgaugcggau

SEQ ID NO: 1815486 - RNA, 21 nt, Salmonella typhimurium LT2
ucgucuaccguuucgaccgug

SEQ ID NO: 1815487 - RNA, 14 nt, Salmonella typhimurium LT2
ucgucuguacggaa

SEQ ID NO: 1815488 - RNA, 20 nt, Salmonella typhimurium LT2
ucgugauugauucgcgccag

SEQ ID NO: 1815489 - RNA, 19 nt, Salmonella typhimurium LT2
ucuaucagguaucccgcca

SEQ ID NO: 1815490 - RNA, 22 nt, Salmonella typhimurium LT2
ucuaacgaaaccggcggcgacu

SEQ ID NO: 1815491 - RNA, 12 nt, Salmonella typhimurium LT2
ucucauccagcu

SEQ ID NO: 1815492 - RNA, 18 nt, Salmonella typhimurium LT2
ucgccuguccggccugua

SEQ ID NO: 1815493 - RNA, 22 nt, Salmonella typhimurium LT2
ucgcgccggaacagggccgcau

SEQ ID NO: 1815494 - RNA, 20 nt, Salmonella typhimurium LT2
ucgcgccgccgccaacgccg

SEQ ID NO: 1815495 - RNA, 18 nt, Salmonella typhimurium LT2
ucgcgccgccgggcuuca

SEQ ID NO: 1815496 - RNA, 20 nt, Salmonella typhimurium LT2
ucgccggcagacgauagcgg

SEQ ID NO: 1815497 - RNA, 17 nt, Salmonella typhimurium LT2
ucgccgccgccagguua

SEQ ID NO: 1815498 - RNA, 16 nt, Salmonella typhimurium LT2
ucgccgguagccagcc

SEQ ID NO: 1815499 - RNA, 13 nt, Salmonella typhimurium LT2
ucgccccagcaua

SEQ ID NO: 1815500 - RNA, 17 nt, Salmonella typhimurium LT2
ucgccccgaccaggaug

SEQ ID NO: 1815501 - RNA, 21 nt, Salmonella typhimurium LT2
ucgccaguuuacgcguacucg

SEQ ID NO: 1815502 - RNA, 15 nt, Salmonella typhimurium LT2
ucgccagcccgacua

SEQ ID NO: 1815503 - RNA, 19 nt, Salmonella typhimurium LT2
ucgccagccgcagcucaua

SEQ ID NO: 1815504 - RNA, 21 nt, Salmonella typhimurium LT2
ucgccaggccaucgccgccau

SEQ ID NO: 1815505 - RNA, 16 nt, Salmonella typhimurium LT2
ucgccagcagcgcgau

SEQ ID NO: 1815506 - RNA, 21 nt, Salmonella typhimurium LT2
ucgccagcuuaucgaccagcg

SEQ ID NO: 1815507 - RNA, 13 nt, Salmonella typhimurium LT2
ucgccgcaucggc

SEQ ID NO: 1815508 - RNA, 17 nt, Salmonella typhimurium LT2
ucgcauuuaaucgccug

SEQ ID NO: 1815509 - RNA, 16 nt, Salmonella typhimurium LT2
ucgcauuuuuaucggc

SEQ ID NO: 1815510 - RNA, 20 nt, Salmonella typhimurium LT2
ucgcaucagggcgacgucag

SEQ ID NO: 1815511 - RNA, 19 nt, Salmonella typhimurium LT2
ucgcagcgaucagggguca

SEQ ID NO: 1815512 - RNA, 14 nt, Salmonella typhimurium LT2
ucgccaccagcgau

SEQ ID NO: 1815513 - RNA, 14 nt, Salmonella typhimurium LT2
ucgccaacaccgau

SEQ ID NO: 1815514 - RNA, 19 nt, Salmonella typhimurium LT2
ucgccaacgccaaccggcu

SEQ ID NO: 1815515 - RNA, 22 nt, Salmonella typhimurium LT2
ucgccagaugucggcggcaggu

SEQ ID NO: 1815516 - RNA, 16 nt, Salmonella typhimurium LT2
ucgccagcaacgccca

SEQ ID NO: 1815517 - RNA, 19 nt, Salmonella typhimurium LT2
ucgccaccgcuacaaucca

SEQ ID NO: 1815518 - RNA, 14 nt, Salmonella typhimurium LT2
ucgccaccggcaca

SEQ ID NO: 1815519 - RNA, 12 nt, Salmonella typhimurium LT2
ucgccacggcca

SEQ ID NO: 1815520 - RNA, 19 nt, Salmonella typhimurium LT2
ucgagauuuuucugcgcca

SEQ ID NO: 1815521 - RNA, 16 nt, Salmonella typhimurium LT2
ucgagauuuaccggga

SEQ ID NO: 1815522 - RNA, 19 nt, Salmonella typhimurium LT2
ucgacuucauucggcagau

SEQ ID NO: 1815523 - RNA, 17 nt, Salmonella typhimurium LT2
ucgacugcggaacgccc

SEQ ID NO: 1815524 - RNA, 18 nt, Salmonella typhimurium LT2
ucgacgucaccaucagcg

SEQ ID NO: 1815525 - RNA, 19 nt, Salmonella typhimurium LT2
ucgacgucaccaucagcgu

SEQ ID NO: 1815526 - RNA, 23 nt, Salmonella typhimurium LT2
ucgacguucagcauauccagcgc

SEQ ID NO: 1815527 - RNA, 21 nt, Salmonella typhimurium LT2
uccgguaaaucaacaaccggc

SEQ ID NO: 1815528 - RNA, 16 nt, Salmonella typhimurium LT2
uccggguucgcggcaa

SEQ ID NO: 1815529 - RNA, 12 nt, Salmonella typhimurium LT2
ucgagcagcagg

SEQ ID NO: 1815530 - RNA, 15 nt, Salmonella typhimurium LT2
ucgagcagcaggacg

SEQ ID NO: 1815531 - RNA, 19 nt, Salmonella typhimurium LT2
ucgaucacccacaucagcg

SEQ ID NO: 1815532 - RNA, 21 nt, Salmonella typhimurium LT2
ucgauagcgacggcgcgccaa

SEQ ID NO: 1815533 - RNA, 14 nt, Salmonella typhimurium LT2
ucgagugaaccgga

SEQ ID NO: 1815534 - RNA, 16 nt, Salmonella typhimurium LT2
ucgagucaggcgccag

SEQ ID NO: 1815535 - RNA, 16 nt, Salmonella typhimurium LT2
ucgauaagccagcgau

SEQ ID NO: 1815536 - RNA, 17 nt, Salmonella typhimurium LT2
ucgauaauauccagcac

SEQ ID NO: 1815537 - RNA, 14 nt, Salmonella typhimurium LT2
ucgauaaccuggau

SEQ ID NO: 1815538 - RNA, 16 nt, Salmonella typhimurium LT2
ucgauaaccaccagcg

SEQ ID NO: 1815539 - RNA, 21 nt, Salmonella typhimurium LT2
ucgauaaagcgauuaccggca

SEQ ID NO: 1815540 - RNA, 21 nt, Salmonella typhimurium LT2
ucgauaaaagcucgcggaucg

SEQ ID NO: 1815541 - RNA, 20 nt, Salmonella typhimurium LT2
ucgaugaccgcuuucgccug

SEQ ID NO: 1815542 - RNA, 19 nt, Salmonella typhimurium LT2
ucgauccaguuaauucguc

SEQ ID NO: 1815543 - RNA, 15 nt, Salmonella typhimurium LT2
ucgaucccgccgcau

SEQ ID NO: 1815544 - RNA, 20 nt, Salmonella typhimurium LT2
ucgcaaacccacccgguaau

SEQ ID NO: 1815545 - RNA, 13 nt, Salmonella typhimurium LT2
ucgauuuacggau

SEQ ID NO: 1815546 - RNA, 22 nt, Salmonella typhimurium LT2
ucgauucccagauguugagcaa

SEQ ID NO: 1815547 - RNA, 16 nt, Salmonella typhimurium LT2
ucgcaacagcauacgc

SEQ ID NO: 1815548 - RNA, 19 nt, Salmonella typhimurium LT2
ugccggacggcggcugcga

SEQ ID NO: 1815549 - RNA, 15 nt, Salmonella typhimurium LT2
ugccggacugauacc

SEQ ID NO: 1815550 - RNA, 13 nt, Salmonella typhimurium LT2
ugccggaccugcg

SEQ ID NO: 1815551 - RNA, 13 nt, Salmonella typhimurium LT2
ugccggaacgcga

SEQ ID NO: 1815552 - RNA, 18 nt, Salmonella typhimurium LT2
ugccggaaaccuguuccc

SEQ ID NO: 1815553 - RNA, 22 nt, Salmonella typhimurium LT2
ugccgccuccagcauacugaug

SEQ ID NO: 1815554 - RNA, 15 nt, Salmonella typhimurium LT2
ugccgcccguacaga

SEQ ID NO: 1815555 - RNA, 22 nt, Salmonella typhimurium LT2
ugccgcccguacagacaucauc

SEQ ID NO: 1815556 - RNA, 20 nt, Salmonella typhimurium LT2
ugccgcccguuuuuuccagu

SEQ ID NO: 1815557 - RNA, 20 nt, Salmonella typhimurium LT2
ugccgauuccaugcccaguu

SEQ ID NO: 1815558 - RNA, 19 nt, Salmonella typhimurium LT2
ugccgcaaaugaccagauc

SEQ ID NO: 1815559 - RNA, 18 nt, Salmonella typhimurium LT2
ugccgaucaccagcgcau

SEQ ID NO: 1815560 - RNA, 19 nt, Salmonella typhimurium LT2
ugccgauaauacgcgcgau

SEQ ID NO: 1815561 - RNA, 18 nt, Salmonella typhimurium LT2
ugccgagguuaaccgacu

SEQ ID NO: 1815562 - RNA, 13 nt, Salmonella typhimurium LT2
ugcccggccuccg

SEQ ID NO: 1815563 - RNA, 13 nt, Salmonella typhimurium LT2
ugccaccagccua

SEQ ID NO: 1815564 - RNA, 20 nt, Salmonella typhimurium LT2
ugcauacguuucaccagcac

SEQ ID NO: 1815565 - RNA, 12 nt, Salmonella typhimurium LT2
ugcauauauccu

SEQ ID NO: 1815566 - RNA, 22 nt, Salmonella typhimurium LT2
ugcauauucauaucgaagccca

SEQ ID NO: 1815567 - RNA, 19 nt, Salmonella typhimurium LT2
ugcaucgugagcgcgucau

SEQ ID NO: 1815568 - RNA, 21 nt, Salmonella typhimurium LT2
ugcauccgggguucgaauccc

SEQ ID NO: 1815569 - RNA, 16 nt, Salmonella typhimurium LT2
ugcauagccccagcgc

SEQ ID NO: 1815570 - RNA, 22 nt, Salmonella typhimurium LT2
ugcauaaaacugaguucgccau

SEQ ID NO: 1815571 - RNA, 23 nt, Salmonella typhimurium LT2
ugcauaaaggaguaacagauagu

SEQ ID NO: 1815572 - RNA, 20 nt, Salmonella typhimurium LT2
ugcaccuuuuuuuccagcgu

SEQ ID NO: 1815573 - RNA, 15 nt, Salmonella typhimurium LT2
ugccccauccggcaa

SEQ ID NO: 1815574 - RNA, 18 nt, Salmonella typhimurium LT2
ugcccacccgggccggaa

SEQ ID NO: 1815575 - RNA, 16 nt, Salmonella typhimurium LT2
ugcccagcgcaaucac

SEQ ID NO: 1815576 - RNA, 15 nt, Salmonella typhimurium LT2
ugcccacggcguagc

SEQ ID NO: 1815577 - RNA, 22 nt, Salmonella typhimurium LT2
ugccagcaacccaccugccagu

SEQ ID NO: 1815578 - RNA, 18 nt, Salmonella typhimurium LT2
ugccauuguuccggcgac

SEQ ID NO: 1815579 - RNA, 21 nt, Salmonella typhimurium LT2
ugcggauuaucguccggcauc

SEQ ID NO: 1815580 - RNA, 14 nt, Salmonella typhimurium LT2
ugcggaugcgccau

SEQ ID NO: 1815581 - RNA, 22 nt, Salmonella typhimurium LT2
ugcggcaauggccgcagcgcca

SEQ ID NO: 1815582 - RNA, 23 nt, Salmonella typhimurium LT2
ugcggcaauggccgcagcgccau

SEQ ID NO: 1815583 - RNA, 13 nt, Salmonella typhimurium LT2
ugcggcauccggc

SEQ ID NO: 1815584 - RNA, 17 nt, Salmonella typhimurium LT2
ugcggcauuacgcgccu

SEQ ID NO: 1815585 - RNA, 18 nt, Salmonella typhimurium LT2
ugcggcauuagcaugggc

SEQ ID NO: 1815586 - RNA, 17 nt, Salmonella typhimurium LT2
ugcggccaugaucgccg

SEQ ID NO: 1815587 - RNA, 22 nt, Salmonella typhimurium LT2
ugcggcguacugcaacgcgcau

SEQ ID NO: 1815588 - RNA, 18 nt, Salmonella typhimurium LT2
ugcgccgccauccggcga

SEQ ID NO: 1815589 - RNA, 15 nt, Salmonella typhimurium LT2
ugcgccgcagcgccu

SEQ ID NO: 1815590 - RNA, 19 nt, Salmonella typhimurium LT2
ugcgccaguacguuaugcc

SEQ ID NO: 1815591 - RNA, 21 nt, Salmonella typhimurium LT2
ugcgccaguucauccagcagc

SEQ ID NO: 1815592 - RNA, 23 nt, Salmonella typhimurium LT2
ugcgccgugaaaauaaaauaucc

SEQ ID NO: 1815593 - RNA, 20 nt, Salmonella typhimurium LT2
ugcgccgcuccguacgcguc

SEQ ID NO: 1815594 - RNA, 13 nt, Salmonella typhimurium LT2
ugcgccucagcca

SEQ ID NO: 1815595 - RNA, 20 nt, Salmonella typhimurium LT2
ugcgccuuauccggccugua

SEQ ID NO: 1815596 - RNA, 17 nt, Salmonella typhimurium LT2
ugcgcgcgagugauccc

SEQ ID NO: 1815597 - RNA, 19 nt, Salmonella typhimurium LT2
ugcgcggcaauuuccgcug

SEQ ID NO: 1815598 - RNA, 17 nt, Salmonella typhimurium LT2
ugcgcgcuauguucaug

SEQ ID NO: 1815599 - RNA, 19 nt, Salmonella typhimurium LT2
ugcgcgucgccugaaugca

SEQ ID NO: 1815600 - RNA, 22 nt, Salmonella typhimurium LT2
ugccugaaaauagcgccauugc

SEQ ID NO: 1815601 - RNA, 15 nt, Salmonella typhimurium LT2
ugccucgcugaguuc

SEQ ID NO: 1815602 - RNA, 14 nt, Salmonella typhimurium LT2
ugccugacgccacc

SEQ ID NO: 1815603 - RNA, 22 nt, Salmonella typhimurium LT2
ugccugcgcuuacggccauggg

SEQ ID NO: 1815604 - RNA, 18 nt, Salmonella typhimurium LT2
ugccguccugaucaaggc

SEQ ID NO: 1815605 - RNA, 18 nt, Salmonella typhimurium LT2
ugccgucgaucucaggcu

SEQ ID NO: 1815606 - RNA, 22 nt, Salmonella typhimurium LT2
ugccggcguuccgcacauaauc

SEQ ID NO: 1815607 - RNA, 21 nt, Salmonella typhimurium LT2
ugccgggcauaaacuaauccc

SEQ ID NO: 1815608 - RNA, 11 nt, Salmonella typhimurium LT2
ugccggguuaa

SEQ ID NO: 1815609 - RNA, 20 nt, Salmonella typhimurium LT2
ugcgccagccagucgccagg

SEQ ID NO: 1815610 - RNA, 13 nt, Salmonella typhimurium LT2
ugcgccagcgcca

SEQ ID NO: 1815611 - RNA, 18 nt, Salmonella typhimurium LT2
ugcgcauccucuuuccgu

SEQ ID NO: 1815612 - RNA, 15 nt, Salmonella typhimurium LT2
ugcgaucgccggcaa

SEQ ID NO: 1815613 - RNA, 21 nt, Salmonella typhimurium LT2
ugcgcaacagcuugcgcccau

SEQ ID NO: 1815614 - RNA, 23 nt, Salmonella typhimurium LT2
ugcgacgguaaaaauaucugaau

SEQ ID NO: 1815615 - RNA, 14 nt, Salmonella typhimurium LT2
ugccuggcgaacga

SEQ ID NO: 1815616 - RNA, 17 nt, Salmonella typhimurium LT2
ugcgacacgcugcauau

SEQ ID NO: 1815617 - RNA, 23 nt, Salmonella typhimurium LT2
ugcgacagguucgaaucuuccau

SEQ ID NO: 1815618 - RNA, 17 nt, Salmonella typhimurium LT2
ugagcugacugacguga

SEQ ID NO: 1815619 - RNA, 20 nt, Salmonella typhimurium LT2
ugagcugguggucuacggcg

SEQ ID NO: 1815620 - RNA, 18 nt, Salmonella typhimurium LT2
ugagcgcuugcugcguaa

SEQ ID NO: 1815621 - RNA, 17 nt, Salmonella typhimurium LT2
ugagcgccaucaggaua

SEQ ID NO: 1815622 - RNA, 18 nt, Salmonella typhimurium LT2
ugagcggagucgucaaau

SEQ ID NO: 1815623 - RNA, 20 nt, Salmonella typhimurium LT2
ugagcguggaaaacagcgcc

SEQ ID NO: 1815624 - RNA, 23 nt, Salmonella typhimurium LT2
ugagcguugggcacccauacgcg

SEQ ID NO: 1815625 - RNA, 18 nt, Salmonella typhimurium LT2
ugacucagcggccauuga

SEQ ID NO: 1815626 - RNA, 19 nt, Salmonella typhimurium LT2
ugacguccaggccguagcg

SEQ ID NO: 1815627 - RNA, 16 nt, Salmonella typhimurium LT2
ugacucgcugcgcucg

SEQ ID NO: 1815628 - RNA, 16 nt, Salmonella typhimurium LT2
ugagccauuccagcgu

SEQ ID NO: 1815629 - RNA, 20 nt, Salmonella typhimurium LT2
ugacuucgcagcccaucgcg

SEQ ID NO: 1815630 - RNA, 19 nt, Salmonella typhimurium LT2
ugacgccggguaaacgcag

SEQ ID NO: 1815631 - RNA, 14 nt, Salmonella typhimurium LT2
ugacgcgaucgccg

SEQ ID NO: 1815632 - RNA, 18 nt, Salmonella typhimurium LT2
ugacgaucguggcgauag

SEQ ID NO: 1815633 - RNA, 14 nt, Salmonella typhimurium LT2
ugacgcagacguca

SEQ ID NO: 1815634 - RNA, 16 nt, Salmonella typhimurium LT2
ugacgcguuaauaucc

SEQ ID NO: 1815635 - RNA, 18 nt, Salmonella typhimurium LT2
ugacgcuucgcuuauccg

SEQ ID NO: 1815636 - RNA, 16 nt, Salmonella typhimurium LT2
ugacguaaaucugaaa

SEQ ID NO: 1815637 - RNA, 21 nt, Salmonella typhimurium LT2
ugacgguagccguuuugcugu

SEQ ID NO: 1815638 - RNA, 18 nt, Salmonella typhimurium LT2
ugacgggcggcuuccguu

SEQ ID NO: 1815639 - RNA, 15 nt, Salmonella typhimurium LT2
ugcaaauaccacauc

SEQ ID NO: 1815640 - RNA, 15 nt, Salmonella typhimurium LT2
ugcaaauacugcuuu

SEQ ID NO: 1815641 - RNA, 18 nt, Salmonella typhimurium LT2
ugaugcguauccagcgcg

SEQ ID NO: 1815642 - RNA, 19 nt, Salmonella typhimurium LT2
ugcaacuguugcgccagca

SEQ ID NO: 1815643 - RNA, 18 nt, Salmonella typhimurium LT2
ugcaauaucgaugccagu

SEQ ID NO: 1815644 - RNA, 14 nt, Salmonella typhimurium LT2
ugcaauuccggcga

SEQ ID NO: 1815645 - RNA, 14 nt, Salmonella typhimurium LT2
ugcaauuccgccau

SEQ ID NO: 1815646 - RNA, 16 nt, Salmonella typhimurium LT2
ugcaaugugcaggcuu

SEQ ID NO: 1815647 - RNA, 22 nt, Salmonella typhimurium LT2
ugaucccgccgaccagauaucc

SEQ ID NO: 1815648 - RNA, 16 nt, Salmonella typhimurium LT2
ugaucaugcugcaccg

SEQ ID NO: 1815649 - RNA, 21 nt, Salmonella typhimurium LT2
ugaucauaaauucgcagcguu

SEQ ID NO: 1815650 - RNA, 22 nt, Salmonella typhimurium LT2
ugaucauaaauucgcagcguuc

SEQ ID NO: 1815651 - RNA, 15 nt, Salmonella typhimurium LT2
ugaucgagaucgcca

SEQ ID NO: 1815652 - RNA, 18 nt, Salmonella typhimurium LT2
ugaucggcggcccacuca

SEQ ID NO: 1815653 - RNA, 17 nt, Salmonella typhimurium LT2
ugaucgccaaagcguaa

SEQ ID NO: 1815654 - RNA, 17 nt, Salmonella typhimurium LT2
ugaucgccgccaucggc

SEQ ID NO: 1815655 - RNA, 21 nt, Salmonella typhimurium LT2
ugaucuccgcgcaaucgccga

SEQ ID NO: 1815656 - RNA, 22 nt, Salmonella typhimurium LT2
ugaucguuuccagcaucgacca

SEQ ID NO: 1815657 - RNA, 15 nt, Salmonella typhimurium LT2
ugaucguaugcagcc

SEQ ID NO: 1815658 - RNA, 21 nt, Salmonella typhimurium LT2
ugacgagcgacgaggcauggc

SEQ ID NO: 1815659 - RNA, 21 nt, Salmonella typhimurium LT2
ugacgaaaacccgccaccauc

SEQ ID NO: 1815660 - RNA, 12 nt, Salmonella typhimurium LT2
ugaccugaacgc

SEQ ID NO: 1815661 - RNA, 13 nt, Salmonella typhimurium LT2
ugaccugaacgcc

SEQ ID NO: 1815662 - RNA, 13 nt, Salmonella typhimurium LT2
ugaccucaucacc

SEQ ID NO: 1815663 - RNA, 12 nt, Salmonella typhimurium LT2
ugaccguugcca

SEQ ID NO: 1815664 - RNA, 19 nt, Salmonella typhimurium LT2
ugacauucccauugagcag

SEQ ID NO: 1815665 - RNA, 16 nt, Salmonella typhimurium LT2
ugacaucgcuuaaugu

SEQ ID NO: 1815666 - RNA, 20 nt, Salmonella typhimurium LT2
ugacauugucauaaggacua

SEQ ID NO: 1815667 - RNA, 17 nt, Salmonella typhimurium LT2
ugacaauacugaacgcc

SEQ ID NO: 1815668 - RNA, 15 nt, Salmonella typhimurium LT2
ugacagccaccagcg

SEQ ID NO: 1815669 - RNA, 13 nt, Salmonella typhimurium LT2
ugacagaggaaug

SEQ ID NO: 1815670 - RNA, 15 nt, Salmonella typhimurium LT2
ugacacuuuauucuc

SEQ ID NO: 1815671 - RNA, 15 nt, Salmonella typhimurium LT2
ugacagcgcgcgaau

SEQ ID NO: 1815672 - RNA, 14 nt, Salmonella typhimurium LT2
ugaccccauacgcg

SEQ ID NO: 1815673 - RNA, 13 nt, Salmonella typhimurium LT2
ugacccgccgcac

SEQ ID NO: 1815674 - RNA, 16 nt, Salmonella typhimurium LT2
ugaccagcaucgccgg

SEQ ID NO: 1815675 - RNA, 12 nt, Salmonella typhimurium LT2
ugaccagcgccg

SEQ ID NO: 1815676 - RNA, 14 nt, Salmonella typhimurium LT2
ugaccaucgccagc

SEQ ID NO: 1815677 - RNA, 21 nt, Salmonella typhimurium LT2
ugaccauaauuuccggcgcau

SEQ ID NO: 1815678 - RNA, 20 nt, Salmonella typhimurium LT2
ugaccaggaaacccucggcg

SEQ ID NO: 1815679 - RNA, 14 nt, Salmonella typhimurium LT2
ugaaaucgguaauc

SEQ ID NO: 1815680 - RNA, 20 nt, Salmonella typhimurium LT2
ugaaaucacccagaugcgaa

SEQ ID NO: 1815681 - RNA, 20 nt, Salmonella typhimurium LT2
ugaaauuuccuccgccgaua

SEQ ID NO: 1815682 - RNA, 19 nt, Salmonella typhimurium LT2
ugaaccuguuaucaggaua

SEQ ID NO: 1815683 - RNA, 20 nt, Salmonella typhimurium LT2
ugaaccgucgccuccagcga

SEQ ID NO: 1815684 - RNA, 17 nt, Salmonella typhimurium LT2
ugaacugcgcguauccg

SEQ ID NO: 1815685 - RNA, 17 nt, Salmonella typhimurium LT2
ucuuucaauaauggcgc

SEQ ID NO: 1815686 - RNA, 15 nt, Salmonella typhimurium LT2
ucuccaguaucagcg

SEQ ID NO: 1815687 - RNA, 18 nt, Salmonella typhimurium LT2
ugaaagaguacgccgaua

SEQ ID NO: 1815688 - RNA, 17 nt, Salmonella typhimurium LT2
ugaaauaaacguaccga

SEQ ID NO: 1815689 - RNA, 17 nt, Salmonella typhimurium LT2
ugaaugaguaaccagac

SEQ ID NO: 1815690 - RNA, 16 nt, Salmonella typhimurium LT2
ugaaucgccucaacgc

SEQ ID NO: 1815691 - RNA, 16 nt, Salmonella typhimurium LT2
ugacaaaaaucugaau

SEQ ID NO: 1815692 - RNA, 16 nt, Salmonella typhimurium LT2
ugacaagcagcggaaa

SEQ ID NO: 1815693 - RNA, 20 nt, Salmonella typhimurium LT2
ugaaugcucucauauuccag

SEQ ID NO: 1815694 - RNA, 18 nt, Salmonella typhimurium LT2
ugaauugauuagcuuuaa

SEQ ID NO: 1815695 - RNA, 22 nt, Salmonella typhimurium LT2
ugaagguaaaggcggaaaucag

SEQ ID NO: 1815696 - RNA, 19 nt, Salmonella typhimurium LT2
ugaagacguucuaucaggu

SEQ ID NO: 1815697 - RNA, 21 nt, Salmonella typhimurium LT2
uaugcauauucauaucgaagc

SEQ ID NO: 1815698 - RNA, 21 nt, Salmonella typhimurium LT2
uaugccggauaguuacccggc

SEQ ID NO: 1815699 - RNA, 15 nt, Salmonella typhimurium LT2
uaugcacaaccagcg

SEQ ID NO: 1815700 - RNA, 16 nt, Salmonella typhimurium LT2
uaugauuucacccaga

SEQ ID NO: 1815701 - RNA, 14 nt, Salmonella typhimurium LT2
uaugcagccgauag

SEQ ID NO: 1815702 - RNA, 13 nt, Salmonella typhimurium LT2
uaugcacuucgcc

SEQ ID NO: 1815703 - RNA, 12 nt, Salmonella typhimurium LT2
uaucuugcuuua

SEQ ID NO: 1815704 - RNA, 24 nt, Salmonella typhimurium LT2
uaucuuucagaccuuuuacuucac

SEQ ID NO: 1815705 - RNA, 14 nt, Salmonella typhimurium LT2
uaucuuccagcgcg

SEQ ID NO: 1815706 - RNA, 18 nt, Salmonella typhimurium LT2
uaucuggccuacagcauc

SEQ ID NO: 1815707 - RNA, 16 nt, Salmonella typhimurium LT2
uaucugcgccgccaaa

SEQ ID NO: 1815708 - RNA, 21 nt, Salmonella typhimurium LT2
uaucugaugccugaaggcgcu

SEQ ID NO: 1815709 - RNA, 18 nt, Salmonella typhimurium LT2
uaucggaagaaaacgcaa

SEQ ID NO: 1815710 - RNA, 15 nt, Salmonella typhimurium LT2
uaucggauagucggc

SEQ ID NO: 1815711 - RNA, 16 nt, Salmonella typhimurium LT2
uaucgccaucaacgcc

SEQ ID NO: 1815712 - RNA, 20 nt, Salmonella typhimurium LT2
uaucgccagcagggucagga

SEQ ID NO: 1815713 - RNA, 18 nt, Salmonella typhimurium LT2
uaucgaacucauagcgcc

SEQ ID NO: 1815714 - RNA, 22 nt, Salmonella typhimurium LT2
uaucgccgaaagcgaucacauu

SEQ ID NO: 1815715 - RNA, 19 nt, Salmonella typhimurium LT2
uaucgcgccgccaauaucc

SEQ ID NO: 1815716 - RNA, 23 nt, Salmonella typhimurium LT2
uaucgcgcucuuccgccagcgcc

SEQ ID NO: 1815717 - RNA, 18 nt, Salmonella typhimurium LT2
uaucgccguucgcauugg

SEQ ID NO: 1815718 - RNA, 13 nt, Salmonella typhimurium LT2
uaucgcaauauac

SEQ ID NO: 1815719 - RNA, 14 nt, Salmonella typhimurium LT2
uagcgccacgcgau

SEQ ID NO: 1815720 - RNA, 15 nt, Salmonella typhimurium LT2
uauccugaugcgccu

SEQ ID NO: 1815721 - RNA, 21 nt, Salmonella typhimurium LT2
uagcgggcuguuuuccagcgg

SEQ ID NO: 1815722 - RNA, 16 nt, Salmonella typhimurium LT2
uauugccacaauauca

SEQ ID NO: 1815723 - RNA, 20 nt, Salmonella typhimurium LT2
uauugagaaaauuacgccca

SEQ ID NO: 1815724 - RNA, 18 nt, Salmonella typhimurium LT2
uauuagccaaagcgguaa

SEQ ID NO: 1815725 - RNA, 22 nt, Salmonella typhimurium LT2
uaugcugaucaucuggccuacg

SEQ ID NO: 1815726 - RNA, 11 nt, Salmonella typhimurium LT2
ucaaaacaggu

SEQ ID NO: 1815727 - RNA, 15 nt, Salmonella typhimurium LT2
uauuuuuuuaucgaa

SEQ ID NO: 1815728 - RNA, 14 nt, Salmonella typhimurium LT2
uauuuuucaccuca

SEQ ID NO: 1815729 - RNA, 16 nt, Salmonella typhimurium LT2
uauugccuaaaguggc

SEQ ID NO: 1815730 - RNA, 21 nt, Salmonella typhimurium LT2
uauugccuuauucacagcgua

SEQ ID NO: 1815731 - RNA, 20 nt, Salmonella typhimurium LT2
uauuucacuucgauaacauc

SEQ ID NO: 1815732 - RNA, 22 nt, Salmonella typhimurium LT2
ucaaccgcgcggcguucugcgc

SEQ ID NO: 1815733 - RNA, 18 nt, Salmonella typhimurium LT2
ucaacacuuagaacgcgg

SEQ ID NO: 1815734 - RNA, 13 nt, Salmonella typhimurium LT2
ucaacacgcgcac

SEQ ID NO: 1815735 - RNA, 14 nt, Salmonella typhimurium LT2
ucaacaucagcgcu

SEQ ID NO: 1815736 - RNA, 17 nt, Salmonella typhimurium LT2
ucaacagcggcggcagu

SEQ ID NO: 1815737 - RNA, 14 nt, Salmonella typhimurium LT2
ucaacaaucguuaa

SEQ ID NO: 1815738 - RNA, 17 nt, Salmonella typhimurium LT2
ucaaacagauccagcgc

SEQ ID NO: 1815739 - RNA, 13 nt, Salmonella typhimurium LT2
ucaaaccacgcug

SEQ ID NO: 1815740 - RNA, 22 nt, Salmonella typhimurium LT2
ucaaacgcgccgcugcguaccg

SEQ ID NO: 1815741 - RNA, 16 nt, Salmonella typhimurium LT2
ucaaacacgaccagcg

SEQ ID NO: 1815742 - RNA, 16 nt, Salmonella typhimurium LT2
ucaaacuccgcgcugg

SEQ ID NO: 1815743 - RNA, 18 nt, Salmonella typhimurium LT2
ucaacgcggcuaccgaag

SEQ ID NO: 1815744 - RNA, 19 nt, Salmonella typhimurium LT2
ucaacgcguucauccagcg

SEQ ID NO: 1815745 - RNA, 18 nt, Salmonella typhimurium LT2
ucaacgcccugcucccac

SEQ ID NO: 1815746 - RNA, 20 nt, Salmonella typhimurium LT2
ucaagauaaaaagacagaua

SEQ ID NO: 1815747 - RNA, 16 nt, Salmonella typhimurium LT2
ucaagaguaggccgga

SEQ ID NO: 1815748 - RNA, 14 nt, Salmonella typhimurium LT2
ucaacuuccgcguu

SEQ ID NO: 1815749 - RNA, 23 nt, Salmonella typhimurium LT2
ucaaguuuuaggcuaaaggcuac

SEQ ID NO: 1815750 - RNA, 17 nt, Salmonella typhimurium LT2
ucaauaccguccagcgc

SEQ ID NO: 1815751 - RNA, 13 nt, Salmonella typhimurium LT2
ucaauaauauccu

SEQ ID NO: 1815752 - RNA, 19 nt, Salmonella typhimurium LT2
ucaaggcaggaaucguccg

SEQ ID NO: 1815753 - RNA, 16 nt, Salmonella typhimurium LT2
ucaauauuaucguaau

SEQ ID NO: 1815754 - RNA, 20 nt, Salmonella typhimurium LT2
ucaaucaacgguucgacgga

SEQ ID NO: 1815755 - RNA, 12 nt, Salmonella typhimurium LT2
ucaauagcgauu

SEQ ID NO: 1815756 - RNA, 19 nt, Salmonella typhimurium LT2
ucaauagguguaucccuau

SEQ ID NO: 1815757 - RNA, 17 nt, Salmonella typhimurium LT2
ucaaucuggauagcgau

SEQ ID NO: 1815758 - RNA, 18 nt, Salmonella typhimurium LT2
ucaaucgucagacggaca

SEQ ID NO: 1815759 - RNA, 15 nt, Salmonella typhimurium LT2
ucaaucgguacgcca

SEQ ID NO: 1815760 - RNA, 16 nt, Salmonella typhimurium LT2
ucagacaacgccgccu

SEQ ID NO: 1815761 - RNA, 16 nt, Salmonella typhimurium LT2
ucagauaggcgcgaaa

SEQ ID NO: 1815762 - RNA, 16 nt, Salmonella typhimurium LT2
ucagauacggcuccag

SEQ ID NO: 1815763 - RNA, 16 nt, Salmonella typhimurium LT2
ucagaugguuugccgc

SEQ ID NO: 1815764 - RNA, 17 nt, Salmonella typhimurium LT2
ucagcagaggaaaacgu

SEQ ID NO: 1815765 - RNA, 17 nt, Salmonella typhimurium LT2
ucagcaucgcauuaacg

SEQ ID NO: 1815766 - RNA, 16 nt, Salmonella typhimurium LT2
ucagcauauccagcgc

SEQ ID NO: 1815767 - RNA, 20 nt, Salmonella typhimurium LT2
ucagccaggguuuaaucgcc

SEQ ID NO: 1815768 - RNA, 16 nt, Salmonella typhimurium LT2
ucagcauuucggcgug

SEQ ID NO: 1815769 - RNA, 16 nt, Salmonella typhimurium LT2
ucagcccaaaacgcgc

SEQ ID NO: 1815770 - RNA, 18 nt, Salmonella typhimurium LT2
ucagccguauggcguacg

SEQ ID NO: 1815771 - RNA, 22 nt, Salmonella typhimurium LT2
ucacguuuuuuacgucagcaau

SEQ ID NO: 1815772 - RNA, 19 nt, Salmonella typhimurium LT2
ucacguugacgcaaacugc

SEQ ID NO: 1815773 - RNA, 14 nt, Salmonella typhimurium LT2
ucacguucagcgcg

SEQ ID NO: 1815774 - RNA, 14 nt, Salmonella typhimurium LT2
ucacgggaacggcg

SEQ ID NO: 1815775 - RNA, 17 nt, Salmonella typhimurium LT2
ucacuuuucuuuccugc

SEQ ID NO: 1815776 - RNA, 20 nt, Salmonella typhimurium LT2
ucagaauacagaauccggcg

SEQ ID NO: 1815777 - RNA, 21 nt, Salmonella typhimurium LT2
ucaccgugguuaccgccagau

SEQ ID NO: 1815778 - RNA, 21 nt, Salmonella typhimurium LT2
ucacgccgaugguugccagac

SEQ ID NO: 1815779 - RNA, 14 nt, Salmonella typhimurium LT2
ucacgcgcgcgaaa

SEQ ID NO: 1815780 - RNA, 17 nt, Salmonella typhimurium LT2
ucacgcguucaauauuc

SEQ ID NO: 1815781 - RNA, 22 nt, Salmonella typhimurium LT2
ucacgcgcuguaacuucacgcc

SEQ ID NO: 1815782 - RNA, 21 nt, Salmonella typhimurium LT2
ucacacugcgccgccagcgac

SEQ ID NO: 1815783 - RNA, 14 nt, Salmonella typhimurium LT2
ucacagcaccaugu

SEQ ID NO: 1815784 - RNA, 19 nt, Salmonella typhimurium LT2
ucacaggcuucgacaaaca

SEQ ID NO: 1815785 - RNA, 13 nt, Salmonella typhimurium LT2
ucacauggcgaau

SEQ ID NO: 1815786 - RNA, 18 nt, Salmonella typhimurium LT2
ucacauuacuuccggcga

SEQ ID NO: 1815787 - RNA, 15 nt, Salmonella typhimurium LT2
ucaccaccacccgau

SEQ ID NO: 1815788 - RNA, 16 nt, Salmonella typhimurium LT2
ucaauuugcaauucga

SEQ ID NO: 1815789 - RNA, 14 nt, Salmonella typhimurium LT2
ucaauuugccggaa

SEQ ID NO: 1815790 - RNA, 13 nt, Salmonella typhimurium LT2
ucaauuucguauu

SEQ ID NO: 1815791 - RNA, 21 nt, Salmonella typhimurium LT2
ucacaauaucgagaugaccgu

SEQ ID NO: 1815792 - RNA, 14 nt, Salmonella typhimurium LT2
ucaauuccacaggc

SEQ ID NO: 1815793 - RNA, 17 nt, Salmonella typhimurium LT2
ucaauuccuggaacugg

SEQ ID NO: 1815794 - RNA, 12 nt, Salmonella typhimurium LT2
ucaauugagcgg

SEQ ID NO: 1815795 - RNA, 20 nt, Salmonella typhimurium LT2
ucaauggcgucaaacagcuu

SEQ ID NO: 1815796 - RNA, 17 nt, Salmonella typhimurium LT2
ucaaugccgucggcaau

SEQ ID NO: 1815797 - RNA, 19 nt, Salmonella typhimurium LT2
ucaauggugaauuugcugc

SEQ ID NO: 1815798 - RNA, 14 nt, Salmonella typhimurium LT2
ucaccagccgaucg

SEQ ID NO: 1815799 - RNA, 14 nt, Salmonella typhimurium LT2
ucaccauucauguu

SEQ ID NO: 1815800 - RNA, 16 nt, Salmonella typhimurium LT2
ucaccauucccagcgc

SEQ ID NO: 1815801 - RNA, 14 nt, Salmonella typhimurium LT2
ucacccgccggcag

SEQ ID NO: 1815802 - RNA, 16 nt, Salmonella typhimurium LT2
ucauaucgauaccgaa

SEQ ID NO: 1815803 - RNA, 14 nt, Salmonella typhimurium LT2
ucauagucggcgcc

SEQ ID NO: 1815804 - RNA, 16 nt, Salmonella typhimurium LT2
ucauacauagcaggcc

SEQ ID NO: 1815805 - RNA, 19 nt, Salmonella typhimurium LT2
ucauaccggauauggcaaa

SEQ ID NO: 1815806 - RNA, 21 nt, Salmonella typhimurium LT2
ucauaccagguuagcgugaau

SEQ ID NO: 1815807 - RNA, 22 nt, Salmonella typhimurium LT2
ucauagacugcgcuuaacgcuu

SEQ ID NO: 1815808 - RNA, 22 nt, Salmonella typhimurium LT2
ucagguuucguccgccgcuacg

SEQ ID NO: 1815809 - RNA, 17 nt, Salmonella typhimurium LT2
ucaguaaaucccgcauc

SEQ ID NO: 1815810 - RNA, 19 nt, Salmonella typhimurium LT2
ucagguuccacgucugggu

SEQ ID NO: 1815811 - RNA, 21 nt, Salmonella typhimurium LT2
ucaguacgcgcgcggcgucaa

SEQ ID NO: 1815812 - RNA, 19 nt, Salmonella typhimurium LT2
ucaguaccucgcauacuuc

SEQ ID NO: 1815813 - RNA, 16 nt, Salmonella typhimurium LT2
ucaguaccgccuucag

SEQ ID NO: 1815814 - RNA, 16 nt, Salmonella typhimurium LT2
ucagccugaaucagca

SEQ ID NO: 1815815 - RNA, 14 nt, Salmonella typhimurium LT2
ucagggugacagaa

SEQ ID NO: 1815816 - RNA, 18 nt, Salmonella typhimurium LT2
ucagggcguagacgacca

SEQ ID NO: 1815817 - RNA, 15 nt, Salmonella typhimurium LT2
ucagggcuaacgccg

SEQ ID NO: 1815818 - RNA, 19 nt, Salmonella typhimurium LT2
ucagggcuaacgccgguag

SEQ ID NO: 1815819 - RNA, 14 nt, Salmonella typhimurium LT2
ucagggccaucuca

SEQ ID NO: 1815820 - RNA, 21 nt, Salmonella typhimurium LT2
ucaggcugguauaaaaacugc

SEQ ID NO: 1815821 - RNA, 13 nt, Salmonella typhimurium LT2
ucaugcggcggug

SEQ ID NO: 1815822 - RNA, 21 nt, Salmonella typhimurium LT2
ucaugaaaaacaguaccggca

SEQ ID NO: 1815823 - RNA, 16 nt, Salmonella typhimurium LT2
ucaucugaugauuaau

SEQ ID NO: 1815824 - RNA, 19 nt, Salmonella typhimurium LT2
ucaucugguuuugcguaau

SEQ ID NO: 1815825 - RNA, 20 nt, Salmonella typhimurium LT2
ucaugcugcguacaaucgcg

SEQ ID NO: 1815826 - RNA, 16 nt, Salmonella typhimurium LT2
ucaugcugcaccgcau

SEQ ID NO: 1815827 - RNA, 19 nt, Salmonella typhimurium LT2
ucauggaacuuauccacaa

SEQ ID NO: 1815828 - RNA, 21 nt, Salmonella typhimurium LT2
ucauggcgcgacauggcgaaa

SEQ ID NO: 1815829 - RNA, 20 nt, Salmonella typhimurium LT2
ucauuacgcuuccugccgug

SEQ ID NO: 1815830 - RNA, 19 nt, Salmonella typhimurium LT2
ucauuacgccugucgcgcc

SEQ ID NO: 1815831 - RNA, 22 nt, Salmonella typhimurium LT2
ucauuacgccugucgcgccaug

SEQ ID NO: 1815832 - RNA, 23 nt, Salmonella typhimurium LT2
ucauguugccggauagcucgcug

SEQ ID NO: 1815833 - RNA, 21 nt, Salmonella typhimurium LT2
ucauccgguucauaauccgga

SEQ ID NO: 1815834 - RNA, 14 nt, Salmonella typhimurium LT2
ucauccgucuggcg

SEQ ID NO: 1815835 - RNA, 23 nt, Salmonella typhimurium LT2
uccagaccggcaugauggcgaac

SEQ ID NO: 1815836 - RNA, 13 nt, Salmonella typhimurium LT2
uccagaaggcgag

SEQ ID NO: 1815837 - RNA, 23 nt, Salmonella typhimurium LT2
uccagacuguggccgguauauuu

SEQ ID NO: 1815838 - RNA, 15 nt, Salmonella typhimurium LT2
uccacgcacgccggc

SEQ ID NO: 1815839 - RNA, 20 nt, Salmonella typhimurium LT2
ucauuuuuaggcguacauua

SEQ ID NO: 1815840 - RNA, 17 nt, Salmonella typhimurium LT2
ucauugucguaccggca

SEQ ID NO: 1815841 - RNA, 19 nt, Salmonella typhimurium LT2
uccacccaguucauuaaca

SEQ ID NO: 1815842 - RNA, 19 nt, Salmonella typhimurium LT2
uccaccagccccaaaauuc

SEQ ID NO: 1815843 - RNA, 17 nt, Salmonella typhimurium LT2
uccagcagcucaucaau

SEQ ID NO: 1815844 - RNA, 22 nt, Salmonella typhimurium LT2
uccagcagaaucuguuucaguu

SEQ ID NO: 1815845 - RNA, 22 nt, Salmonella typhimurium LT2
uccagcgaauccgugcgcagaa

SEQ ID NO: 1815846 - RNA, 19 nt, Salmonella typhimurium LT2
uccagcgcgucggccggca

SEQ ID NO: 1815847 - RNA, 12 nt, Salmonella typhimurium LT2
uccagcgcgaaa

SEQ ID NO: 1815848 - RNA, 13 nt, Salmonella typhimurium LT2
uccagcggcagga

SEQ ID NO: 1815849 - RNA, 13 nt, Salmonella typhimurium LT2
uccagcggcaggc

SEQ ID NO: 1815850 - RNA, 17 nt, Salmonella typhimurium LT2
uccaggacguccugcaa

SEQ ID NO: 1815851 - RNA, 22 nt, Salmonella typhimurium LT2
uccaggaggcaaaaugccagcc

SEQ ID NO: 1815852 - RNA, 14 nt, Salmonella typhimurium LT2
uccaguaacgcguc

SEQ ID NO: 1815853 - RNA, 16 nt, Salmonella typhimurium LT2
uccaguucgagccgga

SEQ ID NO: 1815854 - RNA, 17 nt, Salmonella typhimurium LT2
uccaguuguuccagcag

SEQ ID NO: 1815855 - RNA, 18 nt, Salmonella typhimurium LT2
uccgacaugacgccgcag

SEQ ID NO: 1815856 - RNA, 19 nt, Salmonella typhimurium LT2
uccgcaaagcccaucagcg

SEQ ID NO: 1815857 - RNA, 22 nt, Salmonella typhimurium LT2
uccgcaagacacgcuuccagau

SEQ ID NO: 1815858 - RNA, 13 nt, Salmonella typhimurium LT2
uccgcaaacgccg

SEQ ID NO: 1815859 - RNA, 20 nt, Salmonella typhimurium LT2
uccgccaauuccugccagag

SEQ ID NO: 1815860 - RNA, 13 nt, Salmonella typhimurium LT2
uccgcauuucgcc

SEQ ID NO: 1815861 - RNA, 13 nt, Salmonella typhimurium LT2
uccgccaugugcu

SEQ ID NO: 1815862 - RNA, 15 nt, Salmonella typhimurium LT2
uccggcgcagacggc

SEQ ID NO: 1815863 - RNA, 22 nt, Salmonella typhimurium LT2
uccggcguguaaaccgccagau

SEQ ID NO: 1815864 - RNA, 16 nt, Salmonella typhimurium LT2
uccggaugacgccgcu

SEQ ID NO: 1815865 - RNA, 20 nt, Salmonella typhimurium LT2
uccggaugcgacuccaggaa

SEQ ID NO: 1815866 - RNA, 19 nt, Salmonella typhimurium LT2
uccggccuacagcugauug

SEQ ID NO: 1815867 - RNA, 22 nt, Salmonella typhimurium LT2
uccggccuacguuccaugcgau

SEQ ID NO: 1815868 - RNA, 15 nt, Salmonella typhimurium LT2
uccggccuacucuug

SEQ ID NO: 1815869 - RNA, 23 nt, Salmonella typhimurium LT2
uccggccuacucuugagccagau

SEQ ID NO: 1815870 - RNA, 14 nt, Salmonella typhimurium LT2
uccgcuauuugcgc

SEQ ID NO: 1815871 - RNA, 14 nt, Salmonella typhimurium LT2
uccgcguuuaucgc

SEQ ID NO: 1815872 - RNA, 22 nt, Salmonella typhimurium LT2
uccgcgugaugggcgaucgccg

SEQ ID NO: 1815873 - RNA, 16 nt, Salmonella typhimurium LT2
uccgcguggacgcguu

SEQ ID NO: 1815874 - RNA, 23 nt, Salmonella typhimurium LT2
uccgcgcgcuuuuuuggcguaga

SEQ ID NO: 1815875 - RNA, 19 nt, Salmonella typhimurium LT2
uccgcgcuuucuggcgcag

SEQ ID NO: 1815876 - RNA, 21 nt, Salmonella typhimurium LT2
uccgcguaaugguguccacaa

SEQ ID NO: 1815877 - RNA, 13 nt, Salmonella typhimurium LT2
uccccagccgcuu

SEQ ID NO: 1815878 - RNA, 23 nt, Salmonella typhimurium LT2
uccccaggcuggcgcagccgcuu

SEQ ID NO: 1815879 - RNA, 19 nt, Salmonella typhimurium LT2
uccccaucccaaucagguu

SEQ ID NO: 1815880 - RNA, 23 nt, Salmonella typhimurium LT2
uccccauuugaacucuuccagau

SEQ ID NO: 1815881 - RNA, 18 nt, Salmonella typhimurium LT2
uccccacaaucccgccag

SEQ ID NO: 1815882 - RNA, 14 nt, Salmonella typhimurium LT2
uccccaacaucaug

SEQ ID NO: 1815883 - RNA, 19 nt, Salmonella typhimurium LT2
ucccaucaauaagcgaauu

SEQ ID NO: 1815884 - RNA, 12 nt, Salmonella typhimurium LT2
ucccauccgccg

SEQ ID NO: 1815885 - RNA, 22 nt, Salmonella typhimurium LT2
ucccauacugcccagccgccag

SEQ ID NO: 1815886 - RNA, 18 nt, Salmonella typhimurium LT2
ucccacaguuaacgccaa

SEQ ID NO: 1815887 - RNA, 18 nt, Salmonella typhimurium LT2
ucccaauacggcuaagca

SEQ ID NO: 1815888 - RNA, 13 nt, Salmonella typhimurium LT2
uccauauccagca

SEQ ID NO: 1815889 - RNA, 19 nt, Salmonella typhimurium LT2
uccaucaauaauccggcaa

SEQ ID NO: 1815890 - RNA, 16 nt, Salmonella typhimurium LT2
ucccacugcacgccag

SEQ ID NO: 1815891 - RNA, 21 nt, Salmonella typhimurium LT2
ucccacgucgccuuuaacgcc

SEQ ID NO: 1815892 - RNA, 15 nt, Salmonella typhimurium LT2
ucccagaugcgccag

SEQ ID NO: 1815893 - RNA, 13 nt, Salmonella typhimurium LT2
ucccgacgaauaa

SEQ ID NO: 1815894 - RNA, 14 nt, Salmonella typhimurium LT2
ucccggcaccgauc

SEQ ID NO: 1815895 - RNA, 22 nt, Salmonella typhimurium LT2
ucccggaacagcggagcgaaga

SEQ ID NO: 1815896 - RNA, 15 nt, Salmonella typhimurium LT2
ucccgcugguugccu

SEQ ID NO: 1815897 - RNA, 19 nt, Salmonella typhimurium LT2
ucccgaucuucaucguuac

SEQ ID NO: 1815898 - RNA, 18 nt, Salmonella typhimurium LT2
ucccgcgcugcgccgcaa

SEQ ID NO: 1815899 - RNA, 20 nt, Salmonella typhimurium LT2
guuggcuugaucaacgccgc

SEQ ID NO: 1815900 - RNA, 18 nt, Salmonella typhimurium LT2
guugggauuaucgcggau

SEQ ID NO: 1815901 - RNA, 18 nt, Salmonella typhimurium LT2
guuggcuauacgcggcgu

SEQ ID NO: 1815902 - RNA, 17 nt, Salmonella typhimurium LT2
guugcuccuguaaguca

SEQ ID NO: 1815903 - RNA, 16 nt, Salmonella typhimurium LT2
guuuaaucgcccugcg

SEQ ID NO: 1815904 - RNA, 13 nt, Salmonella typhimurium LT2
guugccuucgaug

SEQ ID NO: 1815905 - RNA, 22 nt, Salmonella typhimurium LT2
guugcgcaucauucugucagca

SEQ ID NO: 1815906 - RNA, 13 nt, Salmonella typhimurium LT2
guugcccaguacg

SEQ ID NO: 1815907 - RNA, 20 nt, Salmonella typhimurium LT2
guugcccaguacggcgcgaa

SEQ ID NO: 1815908 - RNA, 23 nt, Salmonella typhimurium LT2
guucgcuuucauacgacgacggu

SEQ ID NO: 1815909 - RNA, 18 nt, Salmonella typhimurium LT2
guucgcgccgcggucgca

SEQ ID NO: 1815910 - RNA, 14 nt, Salmonella typhimurium LT2
guucuuucugccau

SEQ ID NO: 1815911 - RNA, 23 nt, Salmonella typhimurium LT2
guucuuccacuucagcagcagca

SEQ ID NO: 1815912 - RNA, 16 nt, Salmonella typhimurium LT2
guucugcgucgcgcau

SEQ ID NO: 1815913 - RNA, 20 nt, Salmonella typhimurium LT2
guucgacaauguccgccaga

SEQ ID NO: 1815914 - RNA, 18 nt, Salmonella typhimurium LT2
guuccuucuuccagaccg

SEQ ID NO: 1815915 - RNA, 14 nt, Salmonella typhimurium LT2
guucccugcgccag

SEQ ID NO: 1815916 - RNA, 20 nt, Salmonella typhimurium LT2
guuccccauacugacggcgc

SEQ ID NO: 1815917 - RNA, 22 nt, Salmonella typhimurium LT2
guuccauuccagaaucuggccg

SEQ ID NO: 1815918 - RNA, 15 nt, Salmonella typhimurium LT2
guucccgagcggcca

SEQ ID NO: 1815919 - RNA, 19 nt, Salmonella typhimurium LT2
guuccuggcaaagcgucau

SEQ ID NO: 1815920 - RNA, 20 nt, Salmonella typhimurium LT2
guuccgcuauuugcgcauca

SEQ ID NO: 1815921 - RNA, 15 nt, Salmonella typhimurium LT2
guucaauauccagcc

SEQ ID NO: 1815922 - RNA, 15 nt, Salmonella typhimurium LT2
guucaaacaucagcg

SEQ ID NO: 1815923 - RNA, 12 nt, Salmonella typhimurium LT2
guucaacggcaa

SEQ ID NO: 1815924 - RNA, 18 nt, Salmonella typhimurium LT2
guuauacgcauucucgcc

SEQ ID NO: 1815925 - RNA, 20 nt, Salmonella typhimurium LT2
guuaucuggcgcaaccggcg

SEQ ID NO: 1815926 - RNA, 17 nt, Salmonella typhimurium LT2
guuaugcacaaccagcg

SEQ ID NO: 1815927 - RNA, 14 nt, Salmonella typhimurium LT2
guuacguccggcau

SEQ ID NO: 1815928 - RNA, 20 nt, Salmonella typhimurium LT2
guuagccggaagauccuguu

SEQ ID NO: 1815929 - RNA, 17 nt, Salmonella typhimurium LT2
guuacgcacuacaucau

SEQ ID NO: 1815930 - RNA, 19 nt, Salmonella typhimurium LT2
guuaauccagagcggauaa

SEQ ID NO: 1815931 - RNA, 18 nt, Salmonella typhimurium LT2
guucagauaggcgcgaaa

SEQ ID NO: 1815932 - RNA, 21 nt, Salmonella typhimurium LT2
guucacggccaaagcgcgacu

SEQ ID NO: 1815933 - RNA, 23 nt, Salmonella typhimurium LT2
guucagcugacaaugugccggau

SEQ ID NO: 1815934 - RNA, 17 nt, Salmonella typhimurium LT2
guucagguuggcgacau

SEQ ID NO: 1815935 - RNA, 18 nt, Salmonella typhimurium LT2
guucaggugcauuccgcg

SEQ ID NO: 1815936 - RNA, 13 nt, Salmonella typhimurium LT2
guucauagcgcac

SEQ ID NO: 1815937 - RNA, 21 nt, Salmonella typhimurium LT2
guucaucaggccugcaaaccu

SEQ ID NO: 1815938 - RNA, 19 nt, Salmonella typhimurium LT2
guucaugcacucgcgacau

SEQ ID NO: 1815939 - RNA, 14 nt, Salmonella typhimurium LT2
gugcguucggauaa

SEQ ID NO: 1815940 - RNA, 16 nt, Salmonella typhimurium LT2
guggugcggcuuaucg

SEQ ID NO: 1815941 - RNA, 24 nt, Salmonella typhimurium LT2
gugguguuaacgaaguauucgaug

SEQ ID NO: 1815942 - RNA, 21 nt, Salmonella typhimurium LT2
guguagcgagccaucggcaaa

SEQ ID NO: 1815943 - RNA, 19 nt, Salmonella typhimurium LT2
guguccggguucagcgaca

SEQ ID NO: 1815944 - RNA, 23 nt, Salmonella typhimurium LT2
gugucaucaaauuaucuguugau

SEQ ID NO: 1815945 - RNA, 13 nt, Salmonella typhimurium LT2
gugucaaagcgcc

SEQ ID NO: 1815946 - RNA, 17 nt, Salmonella typhimurium LT2
guguauccauagucagc

SEQ ID NO: 1815947 - RNA, 19 nt, Salmonella typhimurium LT2
gugucguuucauccugaca

SEQ ID NO: 1815948 - RNA, 22 nt, Salmonella typhimurium LT2
guguuaucgcuaucaagcugau

SEQ ID NO: 1815949 - RNA, 20 nt, Salmonella typhimurium LT2
guuaagcgcccgcgcgccag

SEQ ID NO: 1815950 - RNA, 18 nt, Salmonella typhimurium LT2
guuaacagaaugcugaac

SEQ ID NO: 1815951 - RNA, 15 nt, Salmonella typhimurium LT2
guuaaccuugcgccu

SEQ ID NO: 1815952 - RNA, 18 nt, Salmonella typhimurium LT2
uacccaguaccauaccgg

SEQ ID NO: 1815953 - RNA, 21 nt, Salmonella typhimurium LT2
uacccagcgggugaugcgcca

SEQ ID NO: 1815954 - RNA, 19 nt, Salmonella typhimurium LT2
uaccaucggcgcuacggcg

SEQ ID NO: 1815955 - RNA, 18 nt, Salmonella typhimurium LT2
uacccuccgccauagccu

SEQ ID NO: 1815956 - RNA, 14 nt, Salmonella typhimurium LT2
uacccuucaugcag

SEQ ID NO: 1815957 - RNA, 20 nt, Salmonella typhimurium LT2
uacccuucacggucaaacgc

SEQ ID NO: 1815958 - RNA, 17 nt, Salmonella typhimurium LT2
uaccgaaaucgguacgc

SEQ ID NO: 1815959 - RNA, 20 nt, Salmonella typhimurium LT2
uaccgaaaucgguacgcguc

SEQ ID NO: 1815960 - RNA, 21 nt, Salmonella typhimurium LT2
uacccggcgcaaacaguacgc

SEQ ID NO: 1815961 - RNA, 17 nt, Salmonella typhimurium LT2
uacccgcucggcauaca

SEQ ID NO: 1815962 - RNA, 18 nt, Salmonella typhimurium LT2
uacccggccuacaucguc

SEQ ID NO: 1815963 - RNA, 19 nt, Salmonella typhimurium LT2
uaccacaaaaccguugucg

SEQ ID NO: 1815964 - RNA, 23 nt, Salmonella typhimurium LT2
uaccacuaacagugcgcguagcg

SEQ ID NO: 1815965 - RNA, 22 nt, Salmonella typhimurium LT2
uaccagccgagugcuuauguag

SEQ ID NO: 1815966 - RNA, 16 nt, Salmonella typhimurium LT2
uaccagcgaaaugcga

SEQ ID NO: 1815967 - RNA, 21 nt, Salmonella typhimurium LT2
uaccaggcgguaugauacagu

SEQ ID NO: 1815968 - RNA, 17 nt, Salmonella typhimurium LT2
uacaguuugucaucagu

SEQ ID NO: 1815969 - RNA, 20 nt, Salmonella typhimurium LT2
uaccgcgcaguucaauauuc

SEQ ID NO: 1815970 - RNA, 18 nt, Salmonella typhimurium LT2
uaccgcucacaaugccgc

SEQ ID NO: 1815971 - RNA, 22 nt, Salmonella typhimurium LT2
uaccgcucguuaacccaaaucc

SEQ ID NO: 1815972 - RNA, 21 nt, Salmonella typhimurium LT2
uaccgcuucccgcgucgccgg

SEQ ID NO: 1815973 - RNA, 20 nt, Salmonella typhimurium LT2
uaccgcagauaacaggcaau

SEQ ID NO: 1815974 - RNA, 18 nt, Salmonella typhimurium LT2
uaccgauaaaucaaacgc

SEQ ID NO: 1815975 - RNA, 16 nt, Salmonella typhimurium LT2
uaccgccauccggcau

SEQ ID NO: 1815976 - RNA, 18 nt, Salmonella typhimurium LT2
uaccgccaaucaacgccg

SEQ ID NO: 1815977 - RNA, 14 nt, Salmonella typhimurium LT2
uaccgucacgcggc

SEQ ID NO: 1815978 - RNA, 19 nt, Salmonella typhimurium LT2
uaccguauggucggcgugc

SEQ ID NO: 1815979 - RNA, 16 nt, Salmonella typhimurium LT2
uaccgggcuuacagcg

SEQ ID NO: 1815980 - RNA, 17 nt, Salmonella typhimurium LT2
uaccgggcuuacagcgu

SEQ ID NO: 1815981 - RNA, 15 nt, Salmonella typhimurium LT2
uaccgguaaggcagg

SEQ ID NO: 1815982 - RNA, 23 nt, Salmonella typhimurium LT2
uaccgguuuuauaggccgguaug

SEQ ID NO: 1815983 - RNA, 20 nt, Salmonella typhimurium LT2
uaccgugcaaaaucacgcgg

SEQ ID NO: 1815984 - RNA, 21 nt, Salmonella typhimurium LT2
uaccgugcaaaaucacgcggc

SEQ ID NO: 1815985 - RNA, 22 nt, Salmonella typhimurium LT2
uaccgucguuaaagcggauacu

SEQ ID NO: 1815986 - RNA, 21 nt, Salmonella typhimurium LT2
uaccguccggaucgacggcaa

SEQ ID NO: 1815987 - RNA, 21 nt, Salmonella typhimurium LT2
uaccguccaaaucaugccgcc

SEQ ID NO: 1815988 - RNA, 15 nt, Salmonella typhimurium LT2
uacgauccucgccau

SEQ ID NO: 1815989 - RNA, 17 nt, Salmonella typhimurium LT2
uacgaucgccaccgcau

SEQ ID NO: 1815990 - RNA, 15 nt, Salmonella typhimurium LT2
uacgaucgcgcacau

SEQ ID NO: 1815991 - RNA, 15 nt, Salmonella typhimurium LT2
uacgaucguuugccc

SEQ ID NO: 1815992 - RNA, 18 nt, Salmonella typhimurium LT2
uacgcccucaucggcaaa

SEQ ID NO: 1815993 - RNA, 17 nt, Salmonella typhimurium LT2
uacgcauuucaagcaga

SEQ ID NO: 1815994 - RNA, 15 nt, Salmonella typhimurium LT2
uacgccacggcuuaa

SEQ ID NO: 1815995 - RNA, 20 nt, Salmonella typhimurium LT2
uacgccaucagggacgauag

SEQ ID NO: 1815996 - RNA, 21 nt, Salmonella typhimurium LT2
uacgcagaaccgccgcgauag

SEQ ID NO: 1815997 - RNA, 23 nt, Salmonella typhimurium LT2
uacgcaacgcuucugagaauuug

SEQ ID NO: 1815998 - RNA, 17 nt, Salmonella typhimurium LT2
uacugcuuuaauaccgg

SEQ ID NO: 1815999 - RNA, 19 nt, Salmonella typhimurium LT2
uacugcgaucgccggcaau

SEQ ID NO: 1816000 - RNA, 16 nt, Salmonella typhimurium LT2
uacugcaacgccagau

SEQ ID NO: 1816001 - RNA, 19 nt, Salmonella typhimurium LT2
uacugccaaccaucaacuc

SEQ ID NO: 1816002 - RNA, 13 nt, Salmonella typhimurium LT2
uacucagcgucau

SEQ ID NO: 1816003 - RNA, 15 nt, Salmonella typhimurium LT2
uacgccguuccguua

SEQ ID NO: 1816004 - RNA, 15 nt, Salmonella typhimurium LT2
uacgccgucacgcau

SEQ ID NO: 1816005 - RNA, 15 nt, Salmonella typhimurium LT2
uacgccgccagcaau

SEQ ID NO: 1816006 - RNA, 21 nt, Salmonella typhimurium LT2
uacucaaaccugcgccgcgau

SEQ ID NO: 1816007 - RNA, 14 nt, Salmonella typhimurium LT2
uacucaacaucauu

SEQ ID NO: 1816008 - RNA, 13 nt, Salmonella typhimurium LT2
uacuuguugcugg

SEQ ID NO: 1816009 - RNA, 16 nt, Salmonella typhimurium LT2
uacuuguugagugaau

SEQ ID NO: 1816010 - RNA, 14 nt, Salmonella typhimurium LT2
uagagaaccaacgu

SEQ ID NO: 1816011 - RNA, 19 nt, Salmonella typhimurium LT2
uagagaugcuggccggaua

SEQ ID NO: 1816012 - RNA, 21 nt, Salmonella typhimurium LT2
uagcacccuucgcuauccauc

SEQ ID NO: 1816013 - RNA, 17 nt, Salmonella typhimurium LT2
uagcaccuggcggagcu

SEQ ID NO: 1816014 - RNA, 14 nt, Salmonella typhimurium LT2
uagauaccuacuuu

SEQ ID NO: 1816015 - RNA, 20 nt, Salmonella typhimurium LT2
uagccagagcgcgcuggcaa

SEQ ID NO: 1816016 - RNA, 18 nt, Salmonella typhimurium LT2
uagccacagauuaugcag

SEQ ID NO: 1816017 - RNA, 22 nt, Salmonella typhimurium LT2
uagccaguucgccuucuucauc

SEQ ID NO: 1816018 - RNA, 15 nt, Salmonella typhimurium LT2
uagcauagacgauca

SEQ ID NO: 1816019 - RNA, 11 nt, Salmonella typhimurium LT2
uagcauucgcg

SEQ ID NO: 1816020 - RNA, 22 nt, Salmonella typhimurium LT2
uagcaugacaauaacggccuca

SEQ ID NO: 1816021 - RNA, 17 nt, Salmonella typhimurium LT2
uagcccgcuuuaccgaa

SEQ ID NO: 1816022 - RNA, 20 nt, Salmonella typhimurium LT2
uagcccagcgccgcaucgcg

SEQ ID NO: 1816023 - RNA, 14 nt, Salmonella typhimurium LT2
uagccgcgccagac

SEQ ID NO: 1816024 - RNA, 15 nt, Salmonella typhimurium LT2
uagcgaucagcgcca

SEQ ID NO: 1816025 - RNA, 17 nt, Salmonella typhimurium LT2
uagcgcaguacgcgcca

SEQ ID NO: 1816026 - RNA, 21 nt, Salmonella typhimurium LT2
uaaugaguacggguauuccag

SEQ ID NO: 1816027 - RNA, 20 nt, Salmonella typhimurium LT2
uaaugacccagucgggaaac

SEQ ID NO: 1816028 - RNA, 21 nt, Salmonella typhimurium LT2
uaaucgcccugcgguagcgcc

SEQ ID NO: 1816029 - RNA, 14 nt, Salmonella typhimurium LT2
uaaucgcacggcuu

SEQ ID NO: 1816030 - RNA, 22 nt, Salmonella typhimurium LT2
uaagcgcccguccaugaguagc

SEQ ID NO: 1816031 - RNA, 16 nt, Salmonella typhimurium LT2
uaaguauacggaagcg

SEQ ID NO: 1816032 - RNA, 20 nt, Salmonella typhimurium LT2
uaacugcgguaaauaaugcg

SEQ ID NO: 1816033 - RNA, 15 nt, Salmonella typhimurium LT2
uaacugcaaacgcgg

SEQ ID NO: 1816034 - RNA, 13 nt, Salmonella typhimurium LT2
uaacugacagacu

SEQ ID NO: 1816035 - RNA, 19 nt, Salmonella typhimurium LT2
uaacucggcagcgcgacau

SEQ ID NO: 1816036 - RNA, 13 nt, Salmonella typhimurium LT2
uacaauuucuggc

SEQ ID NO: 1816037 - RNA, 22 nt, Salmonella typhimurium LT2
uacaauggcaggcauagacauc

SEQ ID NO: 1816038 - RNA, 22 nt, Salmonella typhimurium LT2
uacacauuuuauccggcgucac

SEQ ID NO: 1816039 - RNA, 16 nt, Salmonella typhimurium LT2
uaauuuugccaucgcg

SEQ ID NO: 1816040 - RNA, 20 nt, Salmonella typhimurium LT2
uaauuuucgcaaacuggucg

SEQ ID NO: 1816041 - RNA, 14 nt, Salmonella typhimurium LT2
uacagcacuucccg

SEQ ID NO: 1816042 - RNA, 22 nt, Salmonella typhimurium LT2
uacagaugccuuguaagccgga

SEQ ID NO: 1816043 - RNA, 14 nt, Salmonella typhimurium LT2
uacagccagcacaa

SEQ ID NO: 1816044 - RNA, 13 nt, Salmonella typhimurium LT2
uaauuagagacau

SEQ ID NO: 1816045 - RNA, 22 nt, Salmonella typhimurium LT2
uaauucgggcgguugccacucu

SEQ ID NO: 1816046 - RNA, 21 nt, Salmonella typhimurium LT2
uaaugugaugcagacgggcgu

SEQ ID NO: 1816047 - RNA, 20 nt, Salmonella typhimurium LT2
uaaugucaccaucaucgaua

SEQ ID NO: 1816048 - RNA, 14 nt, Salmonella typhimurium LT2
uaauguuuacgcca

SEQ ID NO: 1816049 - RNA, 13 nt, Salmonella typhimurium LT2
uaauuaaccgcgc

SEQ ID NO: 1816050 - RNA, 13 nt, Salmonella typhimurium LT2
uaacgcaucgcgg

SEQ ID NO: 1816051 - RNA, 14 nt, Salmonella typhimurium LT2
uaacgccgccgccu

SEQ ID NO: 1816052 - RNA, 15 nt, Salmonella typhimurium LT2
uaacgcaggcgauag

SEQ ID NO: 1816053 - RNA, 19 nt, Salmonella typhimurium LT2
uaacgcgaauccgccauag

SEQ ID NO: 1816054 - RNA, 15 nt, Salmonella typhimurium LT2
uaaccaccuguucgc

SEQ ID NO: 1816055 - RNA, 19 nt, Salmonella typhimurium LT2
uaacccaaagaugauuucu

SEQ ID NO: 1816056 - RNA, 22 nt, Salmonella typhimurium LT2
uaacaccacgaaggaaacgcca

SEQ ID NO: 1816057 - RNA, 11 nt, Salmonella typhimurium LT2
uaaccaacuga

SEQ ID NO: 1816058 - RNA, 14 nt, Salmonella typhimurium LT2
uaaccaaagcacca

SEQ ID NO: 1816059 - RNA, 20 nt, Salmonella typhimurium LT2
uaaaugcugaugacguccag

SEQ ID NO: 1816060 - RNA, 14 nt, Salmonella typhimurium LT2
uaaaucugccauca

SEQ ID NO: 1816061 - RNA, 13 nt, Salmonella typhimurium LT2
uaaaucugccguc

SEQ ID NO: 1816062 - RNA, 18 nt, Salmonella typhimurium LT2
uaaaugaggacgcacucu

SEQ ID NO: 1816063 - RNA, 13 nt, Salmonella typhimurium LT2
uaaaguuauucac

SEQ ID NO: 1816064 - RNA, 13 nt, Salmonella typhimurium LT2
uaaauaacgccag

SEQ ID NO: 1816065 - RNA, 22 nt, Salmonella typhimurium LT2
uaaaaagcugcauaaugcgcga

SEQ ID NO: 1816066 - RNA, 20 nt, Salmonella typhimurium LT2
uaaaacagccugucgccguc

SEQ ID NO: 1816067 - RNA, 19 nt, Salmonella typhimurium LT2
guuuauccggcacgguaaa

SEQ ID NO: 1816068 - RNA, 22 nt, Salmonella typhimurium LT2
guuuauccggcacgguaaaccu

SEQ ID NO: 1816069 - RNA, 22 nt, Salmonella typhimurium LT2
guuuauuuaacguguuacguuu

SEQ ID NO: 1816070 - RNA, 19 nt, Salmonella typhimurium LT2
guuucaagcaguuccagca

SEQ ID NO: 1816071 - RNA, 22 nt, Salmonella typhimurium LT2
uaaaaucggguggccuaacgcc

SEQ ID NO: 1816072 - RNA, 15 nt, Salmonella typhimurium LT2
uaaaguaaggcugau

SEQ ID NO: 1816073 - RNA, 22 nt, Salmonella typhimurium LT2
uaaaguagccaaugccugacgc

SEQ ID NO: 1816074 - RNA, 21 nt, Salmonella typhimurium LT2
uaaaccgaaaggguauacaaa

SEQ ID NO: 1816075 - RNA, 16 nt, Salmonella typhimurium LT2
uaaacuaaugccuggc

SEQ ID NO: 1816076 - RNA, 13 nt, Salmonella typhimurium LT2
uaaacugcgccau

SEQ ID NO: 1816077 - RNA, 15 nt, Salmonella typhimurium LT2
gggauuaugcagacg

SEQ ID NO: 1816078 - RNA, 12 nt, Salmonella typhimurium LT2
gggacuggauga

SEQ ID NO: 1816079 - RNA, 14 nt, Salmonella typhimurium LT2
ggcuuuguaucagc

SEQ ID NO: 1816080 - RNA, 16 nt, Salmonella typhimurium LT2
ggcuuucuaccugcaa

SEQ ID NO: 1816081 - RNA, 19 nt, Salmonella typhimurium LT2
ggcuuuacgaccgcagaaa

SEQ ID NO: 1816082 - RNA, 17 nt, Salmonella typhimurium LT2
ggcuugagcaccacgcg

SEQ ID NO: 1816083 - RNA, 22 nt, Salmonella typhimurium LT2
ggcuucugauaagcgcagcguc

SEQ ID NO: 1816084 - RNA, 23 nt, Salmonella typhimurium LT2
ggcuucugauaagcgcagcgucg

SEQ ID NO: 1816085 - RNA, 19 nt, Salmonella typhimurium LT2
ggcuggguucauccagcaa

SEQ ID NO: 1816086 - RNA, 13 nt, Salmonella typhimurium LT2
gggcgaucagcag

SEQ ID NO: 1816087 - RNA, 14 nt, Salmonella typhimurium LT2
gggcggucuuauca

SEQ ID NO: 1816088 - RNA, 18 nt, Salmonella typhimurium LT2
ggcuagcgccuuauccgg

SEQ ID NO: 1816089 - RNA, 17 nt, Salmonella typhimurium LT2
ggcguuugugcgcgcca

SEQ ID NO: 1816090 - RNA, 23 nt, Salmonella typhimurium LT2
ggcguuugcgccgcuauccggca

SEQ ID NO: 1816091 - RNA, 20 nt, Salmonella typhimurium LT2
ggcuauucuucgaucgccug

SEQ ID NO: 1816092 - RNA, 21 nt, Salmonella typhimurium LT2
ggcuauuagcguuuuuaccgg

SEQ ID NO: 1816093 - RNA, 14 nt, Salmonella typhimurium LT2
ggcuaucaauaugg

SEQ ID NO: 1816094 - RNA, 13 nt, Salmonella typhimurium LT2
ggcucaauaugcc

SEQ ID NO: 1816095 - RNA, 12 nt, Salmonella typhimurium LT2
ggcguucucccg

SEQ ID NO: 1816096 - RNA, 18 nt, Salmonella typhimurium LT2
ggcguucgcccugcgcca

SEQ ID NO: 1816097 - RNA, 12 nt, Salmonella typhimurium LT2
ggcgugacggau

SEQ ID NO: 1816098 - RNA, 20 nt, Salmonella typhimurium LT2
ggcggucgacaugcgcaugu

SEQ ID NO: 1816099 - RNA, 14 nt, Salmonella typhimurium LT2
ggcugaaugaagcc

SEQ ID NO: 1816100 - RNA, 17 nt, Salmonella typhimurium LT2
ggcucccacucuuccag

SEQ ID NO: 1816101 - RNA, 22 nt, Salmonella typhimurium LT2
ggcugacugaauuuucagccau

SEQ ID NO: 1816102 - RNA, 18 nt, Salmonella typhimurium LT2
ggcugagaaggucagucc

SEQ ID NO: 1816103 - RNA, 15 nt, Salmonella typhimurium LT2
ggcugccaucaggcg

SEQ ID NO: 1816104 - RNA, 22 nt, Salmonella typhimurium LT2
ggcugcgacaaugaagcauaaa

SEQ ID NO: 1816105 - RNA, 12 nt, Salmonella typhimurium LT2
ggcugccgauga

SEQ ID NO: 1816106 - RNA, 15 nt, Salmonella typhimurium LT2
ggcugcggcacgcua

SEQ ID NO: 1816107 - RNA, 20 nt, Salmonella typhimurium LT2
ggcugcgccuuaucaagccu

SEQ ID NO: 1816108 - RNA, 20 nt, Salmonella typhimurium LT2
ggcugcgccuuauccggccu

SEQ ID NO: 1816109 - RNA, 14 nt, Salmonella typhimurium LT2
ggcuggaucaggcg

SEQ ID NO: 1816110 - RNA, 23 nt, Salmonella typhimurium LT2
ggcgcacgcguucacaacggcga

SEQ ID NO: 1816111 - RNA, 11 nt, Salmonella typhimurium LT2
ggcgcaaaucg

SEQ ID NO: 1816112 - RNA, 18 nt, Salmonella typhimurium LT2
ggcgauucauaugcgcca

SEQ ID NO: 1816113 - RNA, 22 nt, Salmonella typhimurium LT2
ggcgcaaccgacgggcgcuggu

SEQ ID NO: 1816114 - RNA, 17 nt, Salmonella typhimurium LT2
ggcgacaaacagcgccc

SEQ ID NO: 1816115 - RNA, 21 nt, Salmonella typhimurium LT2
ggcgaugcgcgagccguaaac

SEQ ID NO: 1816116 - RNA, 20 nt, Salmonella typhimurium LT2
ggcgcaguuuacgcagcgcc

SEQ ID NO: 1816117 - RNA, 23 nt, Salmonella typhimurium LT2
ggcgcaggggcauuuuccggcga

SEQ ID NO: 1816118 - RNA, 20 nt, Salmonella typhimurium LT2
ggcgccaaucaccgccagca

SEQ ID NO: 1816119 - RNA, 18 nt, Salmonella typhimurium LT2
ggcgcauuuucggcagcg

SEQ ID NO: 1816120 - RNA, 15 nt, Salmonella typhimurium LT2
ggcgccaucaccauc

SEQ ID NO: 1816121 - RNA, 15 nt, Salmonella typhimurium LT2
ggcgccuccagccau

SEQ ID NO: 1816122 - RNA, 16 nt, Salmonella typhimurium LT2
ggcgccuuauccggcc

SEQ ID NO: 1816123 - RNA, 20 nt, Salmonella typhimurium LT2
ggcggcugcgccuuauccgg

SEQ ID NO: 1816124 - RNA, 20 nt, Salmonella typhimurium LT2
ggcggcuucgccuuacccgg

SEQ ID NO: 1816125 - RNA, 17 nt, Salmonella typhimurium LT2
ggcggcugcgccuuauc

SEQ ID NO: 1816126 - RNA, 20 nt, Salmonella typhimurium LT2
ggcggcggaaaggacuuauc

SEQ ID NO: 1816127 - RNA, 21 nt, Salmonella typhimurium LT2
ggcggguuugaguguuuccgg

SEQ ID NO: 1816128 - RNA, 14 nt, Salmonella typhimurium LT2
ggcgguauuauccg

SEQ ID NO: 1816129 - RNA, 15 nt, Salmonella typhimurium LT2
ggcgguauuauccgc

SEQ ID NO: 1816130 - RNA, 22 nt, Salmonella typhimurium LT2
ggcggaugaaacaguccggcga

SEQ ID NO: 1816131 - RNA, 14 nt, Salmonella typhimurium LT2
ggcggcaaaaacgc

SEQ ID NO: 1816132 - RNA, 18 nt, Salmonella typhimurium LT2
ggcggcaaaaacgccggu

SEQ ID NO: 1816133 - RNA, 14 nt, Salmonella typhimurium LT2
ggcggccugcgcca

SEQ ID NO: 1816134 - RNA, 14 nt, Salmonella typhimurium LT2
ggcgcuccagccgu

SEQ ID NO: 1816135 - RNA, 18 nt, Salmonella typhimurium LT2
ggcgcugcuggcagcgcu

SEQ ID NO: 1816136 - RNA, 19 nt, Salmonella typhimurium LT2
ggcgcugcgcuuaucaggc

SEQ ID NO: 1816137 - RNA, 20 nt, Salmonella typhimurium LT2
ggcgcugcgcuuaucaggcc

SEQ ID NO: 1816138 - RNA, 18 nt, Salmonella typhimurium LT2
ggcgcugcgcuuaucagg

SEQ ID NO: 1816139 - RNA, 18 nt, Salmonella typhimurium LT2
ggcgcugcgcuuauccgg

SEQ ID NO: 1816140 - RNA, 20 nt, Salmonella typhimurium LT2
ggcgcugcgcuuaccaggcc

SEQ ID NO: 1816141 - RNA, 19 nt, Salmonella typhimurium LT2
ggcgcuucgcuuaucaggc

SEQ ID NO: 1816142 - RNA, 22 nt, Salmonella typhimurium LT2
ggcgcuuacacauuuuauccgg

SEQ ID NO: 1816143 - RNA, 17 nt, Salmonella typhimurium LT2
ggcgcuugcgccgccau

SEQ ID NO: 1816144 - RNA, 20 nt, Salmonella typhimurium LT2
ggcgcgacgcuuaucagccc

SEQ ID NO: 1816145 - RNA, 17 nt, Salmonella typhimurium LT2
ggcgcgaaagcgccuug

SEQ ID NO: 1816146 - RNA, 18 nt, Salmonella typhimurium LT2
ggcgccuuucgcgcugca

SEQ ID NO: 1816147 - RNA, 15 nt, Salmonella typhimurium LT2
ggcgcggauuuccgg

SEQ ID NO: 1816148 - RNA, 12 nt, Salmonella typhimurium LT2
ggcgcguccagc

SEQ ID NO: 1816149 - RNA, 11 nt, Salmonella typhimurium LT2
ggccagcacaa

SEQ ID NO: 1816150 - RNA, 11 nt, Salmonella typhimurium LT2
ggccagcguua

SEQ ID NO: 1816151 - RNA, 21 nt, Salmonella typhimurium LT2
ggccaggaauaaaggucacau

SEQ ID NO: 1816152 - RNA, 20 nt, Salmonella typhimurium LT2
ggcaucgcccguuuuaccgg

SEQ ID NO: 1816153 - RNA, 15 nt, Salmonella typhimurium LT2
ggcagguauuaaucc

SEQ ID NO: 1816154 - RNA, 17 nt, Salmonella typhimurium LT2
ggcaguccuugcagcca

SEQ ID NO: 1816155 - RNA, 23 nt, Salmonella typhimurium LT2
ggcagucgcaucauggcgaaucc

SEQ ID NO: 1816156 - RNA, 17 nt, Salmonella typhimurium LT2
ggcaucugucaucgccg

SEQ ID NO: 1816157 - RNA, 20 nt, Salmonella typhimurium LT2
ggcaugauggcgaacagccc

SEQ ID NO: 1816158 - RNA, 17 nt, Salmonella typhimurium LT2
ggcauuggcguuaccgg

SEQ ID NO: 1816159 - RNA, 18 nt, Salmonella typhimurium LT2
ggcaucugaacacgccga

SEQ ID NO: 1816160 - RNA, 18 nt, Salmonella typhimurium LT2
ggcaucggcagcgucagg

SEQ ID NO: 1816161 - RNA, 16 nt, Salmonella typhimurium LT2
ggcagcgggugagcgc

SEQ ID NO: 1816162 - RNA, 20 nt, Salmonella typhimurium LT2
ggcaggccugauucagguca

SEQ ID NO: 1816163 - RNA, 20 nt, Salmonella typhimurium LT2
ggcagacagccgcggcgcuu

SEQ ID NO: 1816164 - RNA, 21 nt, Salmonella typhimurium LT2
ggcacuucgauaaacgccucg

SEQ ID NO: 1816165 - RNA, 15 nt, Salmonella typhimurium LT2
ggcagacaugaccgc

SEQ ID NO: 1816166 - RNA, 16 nt, Salmonella typhimurium LT2
ggcacgccggcaaucc

SEQ ID NO: 1816167 - RNA, 12 nt, Salmonella typhimurium LT2
ggcacaguauua

SEQ ID NO: 1816168 - RNA, 20 nt, Salmonella typhimurium LT2
ggcacauugucagcugaaca

SEQ ID NO: 1816169 - RNA, 19 nt, Salmonella typhimurium LT2
ggcaaugccaccagcgcca

SEQ ID NO: 1816170 - RNA, 22 nt, Salmonella typhimurium LT2
ggcaaugccucaccccauggcg

SEQ ID NO: 1816171 - RNA, 23 nt, Salmonella typhimurium LT2
ggcaaucccuuucgacgucacca

SEQ ID NO: 1816172 - RNA, 19 nt, Salmonella typhimurium LT2
ggcaauaauguuuacgcca

SEQ ID NO: 1816173 - RNA, 12 nt, Salmonella typhimurium LT2
ggcaaucaucag

SEQ ID NO: 1816174 - RNA, 16 nt, Salmonella typhimurium LT2
ggcaauuccgcaucag

SEQ ID NO: 1816175 - RNA, 13 nt, Salmonella typhimurium LT2
ggcacacagcacu

SEQ ID NO: 1816176 - RNA, 21 nt, Salmonella typhimurium LT2
ggcacacagccaaaauaugcu

SEQ ID NO: 1816177 - RNA, 22 nt, Salmonella typhimurium LT2
ggcacaaaauauuacgccauca

SEQ ID NO: 1816178 - RNA, 15 nt, Salmonella typhimurium LT2
ggcaauuuccggcga

SEQ ID NO: 1816179 - RNA, 20 nt, Salmonella typhimurium LT2
ggcaagaaucacgccgauga

SEQ ID NO: 1816180 - RNA, 12 nt, Salmonella typhimurium LT2
ggcaagacccga

SEQ ID NO: 1816181 - RNA, 13 nt, Salmonella typhimurium LT2
ggcaagggaguga

SEQ ID NO: 1816182 - RNA, 17 nt, Salmonella typhimurium LT2
ggcaauauaauccggcg

SEQ ID NO: 1816183 - RNA, 22 nt, Salmonella typhimurium LT2
ggcaauauaccgucagcaccag

SEQ ID NO: 1816184 - RNA, 19 nt, Salmonella typhimurium LT2
ggcaaguucguuugcugac

SEQ ID NO: 1816185 - RNA, 13 nt, Salmonella typhimurium LT2
ggcaaccuuaccg

SEQ ID NO: 1816186 - RNA, 13 nt, Salmonella typhimurium LT2
ggcaacgccuucc

SEQ ID NO: 1816187 - RNA, 16 nt, Salmonella typhimurium LT2
ggcaaccagcccauga

SEQ ID NO: 1816188 - RNA, 19 nt, Salmonella typhimurium LT2
ggcaaauaauaccacgaug

SEQ ID NO: 1816189 - RNA, 23 nt, Salmonella typhimurium LT2
ggcaacaaacauaagcaaauccu

SEQ ID NO: 1816190 - RNA, 17 nt, Salmonella typhimurium LT2
ggcaaaaacgccgguca

SEQ ID NO: 1816191 - RNA, 23 nt, Salmonella typhimurium LT2
ggcaaaaagcauaugcgguccgu

SEQ ID NO: 1816192 - RNA, 13 nt, Salmonella typhimurium LT2
ggcaaaaugccag

SEQ ID NO: 1816193 - RNA, 15 nt, Salmonella typhimurium LT2
ggcaaaaugccagcc

SEQ ID NO: 1816194 - RNA, 20 nt, Salmonella typhimurium LT2
ggcaaaaugcgucggcacca

SEQ ID NO: 1816195 - RNA, 22 nt, Salmonella typhimurium LT2
ggcaaaaugcgucggcaccauu

SEQ ID NO: 1816196 - RNA, 20 nt, Salmonella typhimurium LT2
ggauugggcagacuuucuga

SEQ ID NO: 1816197 - RNA, 15 nt, Salmonella typhimurium LT2
ggauuguggccccau

SEQ ID NO: 1816198 - RNA, 21 nt, Salmonella typhimurium LT2
ggauugagcgaauccagcgcc

SEQ ID NO: 1816199 - RNA, 15 nt, Salmonella typhimurium LT2
ggauucgcucaccgc

SEQ ID NO: 1816200 - RNA, 14 nt, Salmonella typhimurium LT2
ggauucggcaacac

SEQ ID NO: 1816201 - RNA, 16 nt, Salmonella typhimurium LT2
ggagagaugccgccag

SEQ ID NO: 1816202 - RNA, 12 nt, Salmonella typhimurium LT2
ggccgcaucggg

SEQ ID NO: 1816203 - RNA, 12 nt, Salmonella typhimurium LT2
ggccgcagcgcc

SEQ ID NO: 1816204 - RNA, 16 nt, Salmonella typhimurium LT2
ggcccaggcaucgacg

SEQ ID NO: 1816205 - RNA, 16 nt, Salmonella typhimurium LT2
ggcccaugaucaggcg

SEQ ID NO: 1816206 - RNA, 19 nt, Salmonella typhimurium LT2
ggcccauaccccacgccau

SEQ ID NO: 1816207 - RNA, 15 nt, Salmonella typhimurium LT2
ggcccgauaagcgcc

SEQ ID NO: 1816208 - RNA, 21 nt, Salmonella typhimurium LT2
ggccgcuuugcgaacagcgca

SEQ ID NO: 1816209 - RNA, 19 nt, Salmonella typhimurium LT2
ggccgcuuugcgaacagcg

SEQ ID NO: 1816210 - RNA, 24 nt, Salmonella typhimurium LT2
ggccggcauaaugauuguccagcc

SEQ ID NO: 1816211 - RNA, 21 nt, Salmonella typhimurium LT2
ggccgguuuuaaaaauaacgc

SEQ ID NO: 1816212 - RNA, 21 nt, Salmonella typhimurium LT2
ggccguagugcuucucuucaa

SEQ ID NO: 1816213 - RNA, 15 nt, Salmonella typhimurium LT2
ggcgaacuccagcgc

SEQ ID NO: 1816214 - RNA, 13 nt, Salmonella typhimurium LT2
ggcgaauauagcu

SEQ ID NO: 1816215 - RNA, 13 nt, Salmonella typhimurium LT2
ggcgaauagcgcc

SEQ ID NO: 1816216 - RNA, 15 nt, Salmonella typhimurium LT2
ggccuuucggcagcg

SEQ ID NO: 1816217 - RNA, 18 nt, Salmonella typhimurium LT2
ggcgaaccggcaucggca

SEQ ID NO: 1816218 - RNA, 24 nt, Salmonella typhimurium LT2
ggcgaaccggcaucggcagcguca

SEQ ID NO: 1816219 - RNA, 15 nt, Salmonella typhimurium LT2
ggcgaaaaucggcag

SEQ ID NO: 1816220 - RNA, 14 nt, Salmonella typhimurium LT2
ggcgaaagcacuuc

SEQ ID NO: 1816221 - RNA, 18 nt, Salmonella typhimurium LT2
ggcgaaagcgaccggcac

SEQ ID NO: 1816222 - RNA, 12 nt, Salmonella typhimurium LT2
ggccuccagcac

SEQ ID NO: 1816223 - RNA, 17 nt, Salmonella typhimurium LT2
ggccgucggcgccagcc

SEQ ID NO: 1816224 - RNA, 15 nt, Salmonella typhimurium LT2
ggccucgccccuucg

SEQ ID NO: 1816225 - RNA, 18 nt, Salmonella typhimurium LT2
ggccugcgaaugcaggcc

SEQ ID NO: 1816226 - RNA, 18 nt, Salmonella typhimurium LT2
ggucaucaccuccagcac

SEQ ID NO: 1816227 - RNA, 16 nt, Salmonella typhimurium LT2
ggugauuaacagcgcc

SEQ ID NO: 1816228 - RNA, 21 nt, Salmonella typhimurium LT2
ggucugguacauacuguugac

SEQ ID NO: 1816229 - RNA, 18 nt, Salmonella typhimurium LT2
ggucuucuuucagguucc

SEQ ID NO: 1816230 - RNA, 17 nt, Salmonella typhimurium LT2
ggucguccugauagccg

SEQ ID NO: 1816231 - RNA, 15 nt, Salmonella typhimurium LT2
ggucggguguucuca

SEQ ID NO: 1816232 - RNA, 23 nt, Salmonella typhimurium LT2
gguaucaucaauacgcgacagcg

SEQ ID NO: 1816233 - RNA, 16 nt, Salmonella typhimurium LT2
gguaggacauagccgc

SEQ ID NO: 1816234 - RNA, 15 nt, Salmonella typhimurium LT2
gguacuggagaccgg

SEQ ID NO: 1816235 - RNA, 21 nt, Salmonella typhimurium LT2
gguagagcaucgcagcaucau

SEQ ID NO: 1816236 - RNA, 17 nt, Salmonella typhimurium LT2
ggucaacgcgccgccaa

SEQ ID NO: 1816237 - RNA, 19 nt, Salmonella typhimurium LT2
ggucaacccuauugccaca

SEQ ID NO: 1816238 - RNA, 19 nt, Salmonella typhimurium LT2
ggucaaaaaagcgacgcug

SEQ ID NO: 1816239 - RNA, 17 nt, Salmonella typhimurium LT2
gguauuuucuaucgcau

SEQ ID NO: 1816240 - RNA, 23 nt, Salmonella typhimurium LT2
gguauccucgaugaaaucaccca

SEQ ID NO: 1816241 - RNA, 21 nt, Salmonella typhimurium LT2
gguaucccgccagcggcgcca

SEQ ID NO: 1816242 - RNA, 13 nt, Salmonella typhimurium LT2
gguaucgccuucg

SEQ ID NO: 1816243 - RNA, 13 nt, Salmonella typhimurium LT2
gguaucucgucgc

SEQ ID NO: 1816244 - RNA, 15 nt, Salmonella typhimurium LT2
ggucacgacguauua

SEQ ID NO: 1816245 - RNA, 17 nt, Salmonella typhimurium LT2
ggguuagcgccggugca

SEQ ID NO: 1816246 - RNA, 20 nt, Salmonella typhimurium LT2
gguaaaaagcugaugcccag

SEQ ID NO: 1816247 - RNA, 18 nt, Salmonella typhimurium LT2
gguaaaaauauggcgggc

SEQ ID NO: 1816248 - RNA, 16 nt, Salmonella typhimurium LT2
gguaaaaacagccaua

SEQ ID NO: 1816249 - RNA, 20 nt, Salmonella typhimurium LT2
ggguuuucucuuuccagcga

SEQ ID NO: 1816250 - RNA, 22 nt, Salmonella typhimurium LT2
gguaaacggugcgauuauccca

SEQ ID NO: 1816251 - RNA, 16 nt, Salmonella typhimurium LT2
gguaaacacgacgcug

SEQ ID NO: 1816252 - RNA, 14 nt, Salmonella typhimurium LT2
gguaaacagaucga

SEQ ID NO: 1816253 - RNA, 17 nt, Salmonella typhimurium LT2
gguacaggccgccgccu

SEQ ID NO: 1816254 - RNA, 13 nt, Salmonella typhimurium LT2
gguaaaucgcauu

SEQ ID NO: 1816255 - RNA, 17 nt, Salmonella typhimurium LT2
gguaacguaaauaccca

SEQ ID NO: 1816256 - RNA, 23 nt, Salmonella typhimurium LT2
gguaaaggcggaaaucagcacaa

SEQ ID NO: 1816257 - RNA, 22 nt, Salmonella typhimurium LT2
gguaacaguccguggcacggua

SEQ ID NO: 1816258 - RNA, 22 nt, Salmonella typhimurium LT2
gguaagguacggcuuuaacagu

SEQ ID NO: 1816259 - RNA, 22 nt, Salmonella typhimurium LT2
gggugcaaacccaucucaggcc

SEQ ID NO: 1816260 - RNA, 14 nt, Salmonella typhimurium LT2
guaccgaacagcca

SEQ ID NO: 1816261 - RNA, 17 nt, Salmonella typhimurium LT2
guaccgaaaccagaaua

SEQ ID NO: 1816262 - RNA, 14 nt, Salmonella typhimurium LT2
guaccagcaacgcc

SEQ ID NO: 1816263 - RNA, 17 nt, Salmonella typhimurium LT2
guaccggcgcucagcca

SEQ ID NO: 1816264 - RNA, 19 nt, Salmonella typhimurium LT2
guaccguuuuccagaccga

SEQ ID NO: 1816265 - RNA, 20 nt, Salmonella typhimurium LT2
guaccgccuuguccggccua

SEQ ID NO: 1816266 - RNA, 14 nt, Salmonella typhimurium LT2
guacgcaagcguaa

SEQ ID NO: 1816267 - RNA, 18 nt, Salmonella typhimurium LT2
guagcauuuccgcaucgu

SEQ ID NO: 1816268 - RNA, 14 nt, Salmonella typhimurium LT2
guacuuuugccagg

SEQ ID NO: 1816269 - RNA, 12 nt, Salmonella typhimurium LT2
guacuuucuaca

SEQ ID NO: 1816270 - RNA, 21 nt, Salmonella typhimurium LT2
guagcgcauugcgucccagca

SEQ ID NO: 1816271 - RNA, 21 nt, Salmonella typhimurium LT2
guagcggaaucaauuucuaca

SEQ ID NO: 1816272 - RNA, 14 nt, Salmonella typhimurium LT2
guagcgccauccgg

SEQ ID NO: 1816273 - RNA, 13 nt, Salmonella typhimurium LT2
guagcgccaucag

SEQ ID NO: 1816274 - RNA, 20 nt, Salmonella typhimurium LT2
guagcgcugaagcccgcgau

SEQ ID NO: 1816275 - RNA, 18 nt, Salmonella typhimurium LT2
guagcuggucgccagcgc

SEQ ID NO: 1816276 - RNA, 16 nt, Salmonella typhimurium LT2
guagcugcgccugaaa

SEQ ID NO: 1816277 - RNA, 24 nt, Salmonella typhimurium LT2
guagcugcgccugaaaggcacgcu

SEQ ID NO: 1816278 - RNA, 22 nt, Salmonella typhimurium LT2
guaggagauauccugaaacgcg

SEQ ID NO: 1816279 - RNA, 17 nt, Salmonella typhimurium LT2
guaguggcgaucagcgg

SEQ ID NO: 1816280 - RNA, 13 nt, Salmonella typhimurium LT2
guaguuagcgccc

SEQ ID NO: 1816281 - RNA, 17 nt, Salmonella typhimurium LT2
guaugacguggccagca

SEQ ID NO: 1816282 - RNA, 14 nt, Salmonella typhimurium LT2
guauccgccaccau

SEQ ID NO: 1816283 - RNA, 15 nt, Salmonella typhimurium LT2
guauaauaauauccu

SEQ ID NO: 1816284 - RNA, 15 nt, Salmonella typhimurium LT2
guauagaaauagccu

SEQ ID NO: 1816285 - RNA, 12 nt, Salmonella typhimurium LT2
guauaaaucacg

SEQ ID NO: 1816286 - RNA, 13 nt, Salmonella typhimurium LT2
guauaacucagcg

SEQ ID NO: 1816287 - RNA, 16 nt, Salmonella typhimurium LT2
guaucacaaucagcca

SEQ ID NO: 1816288 - RNA, 23 nt, Salmonella typhimurium LT2
guaucacuguaaaagggauacgg

SEQ ID NO: 1816289 - RNA, 21 nt, Salmonella typhimurium LT2
guaucagcauuuacaucauuc

SEQ ID NO: 1816290 - RNA, 12 nt, Salmonella typhimurium LT2
guauagcgcuug

SEQ ID NO: 1816291 - RNA, 22 nt, Salmonella typhimurium LT2
guauagcgcuugucgcgcuaua

SEQ ID NO: 1816292 - RNA, 23 nt, Salmonella typhimurium LT2
gucaaauuccagcaacgagccgu

SEQ ID NO: 1816293 - RNA, 22 nt, Salmonella typhimurium LT2
gucaaagcauugugcagccaug

SEQ ID NO: 1816294 - RNA, 17 nt, Salmonella typhimurium LT2
guauguuaacgccgauu

SEQ ID NO: 1816295 - RNA, 17 nt, Salmonella typhimurium LT2
gucacagauccagacau

SEQ ID NO: 1816296 - RNA, 15 nt, Salmonella typhimurium LT2
gucacagaauacccu

SEQ ID NO: 1816297 - RNA, 21 nt, Salmonella typhimurium LT2
gucacauggcgaauaucacua

SEQ ID NO: 1816298 - RNA, 16 nt, Salmonella typhimurium LT2
gucaccagcagcacaa

SEQ ID NO: 1816299 - RNA, 17 nt, Salmonella typhimurium LT2
gucacccgccggcagua

SEQ ID NO: 1816300 - RNA, 15 nt, Salmonella typhimurium LT2
gucacgcaggggguc

SEQ ID NO: 1816301 - RNA, 18 nt, Salmonella typhimurium LT2
gucacgauguucaacguc

SEQ ID NO: 1816302 - RNA, 21 nt, Salmonella typhimurium LT2
ggugcuauacaguaaaacgcc

SEQ ID NO: 1816303 - RNA, 14 nt, Salmonella typhimurium LT2
gguuacucuuccac

SEQ ID NO: 1816304 - RNA, 19 nt, Salmonella typhimurium LT2
gguuagccagugggcguca

SEQ ID NO: 1816305 - RNA, 13 nt, Salmonella typhimurium LT2
gguggugcaggcu

SEQ ID NO: 1816306 - RNA, 19 nt, Salmonella typhimurium LT2
guaaaggcguagaucucua

SEQ ID NO: 1816307 - RNA, 20 nt, Salmonella typhimurium LT2
guaaagcgccauauccgcag

SEQ ID NO: 1816308 - RNA, 19 nt, Salmonella typhimurium LT2
gguuguucuuccagcguca

SEQ ID NO: 1816309 - RNA, 15 nt, Salmonella typhimurium LT2
gguuugcauugccau

SEQ ID NO: 1816310 - RNA, 20 nt, Salmonella typhimurium LT2
guaacggcugacgcccauca

SEQ ID NO: 1816311 - RNA, 22 nt, Salmonella typhimurium LT2
guaacgaguugcggcaacguga

SEQ ID NO: 1816312 - RNA, 17 nt, Salmonella typhimurium LT2
guaaauaaucgacgaua

SEQ ID NO: 1816313 - RNA, 16 nt, Salmonella typhimurium LT2
guaaaggucgccgcau

SEQ ID NO: 1816314 - RNA, 15 nt, Salmonella typhimurium LT2
gguuccguaagcgcc

SEQ ID NO: 1816315 - RNA, 16 nt, Salmonella typhimurium LT2
gguucccgagcggcca

SEQ ID NO: 1816316 - RNA, 16 nt, Salmonella typhimurium LT2
guaacuaucuguucuu

SEQ ID NO: 1816317 - RNA, 16 nt, Salmonella typhimurium LT2
guaacggucauucggc

SEQ ID NO: 1816318 - RNA, 19 nt, Salmonella typhimurium LT2
guaacgucauugcgaucuc

SEQ ID NO: 1816319 - RNA, 17 nt, Salmonella typhimurium LT2
guaacuggauuccuggc

SEQ ID NO: 1816320 - RNA, 23 nt, Salmonella typhimurium LT2
guaagacguuuacgccgccaucc

SEQ ID NO: 1816321 - RNA, 17 nt, Salmonella typhimurium LT2
guaaugcgccaggcagc

SEQ ID NO: 1816322 - RNA, 18 nt, Salmonella typhimurium LT2
guaaugucuggugcagca

SEQ ID NO: 1816323 - RNA, 17 nt, Salmonella typhimurium LT2
guaauguuuacuccauu

SEQ ID NO: 1816324 - RNA, 12 nt, Salmonella typhimurium LT2
guaauugacgcg

SEQ ID NO: 1816325 - RNA, 19 nt, Salmonella typhimurium LT2
guaauguucaggguuagcg

SEQ ID NO: 1816326 - RNA, 12 nt, Salmonella typhimurium LT2
guacaaacgcac

SEQ ID NO: 1816327 - RNA, 15 nt, Salmonella typhimurium LT2
guacacgaaauagcg

SEQ ID NO: 1816328 - RNA, 22 nt, Salmonella typhimurium LT2
guacacaaucgcauaaccggcg

SEQ ID NO: 1816329 - RNA, 21 nt, Salmonella typhimurium LT2
guacacaauugccaugguuca

SEQ ID NO: 1816330 - RNA, 14 nt, Salmonella typhimurium LT2
guacacuucagcca

SEQ ID NO: 1816331 - RNA, 14 nt, Salmonella typhimurium LT2
guacacgcaucggg

SEQ ID NO: 1816332 - RNA, 20 nt, Salmonella typhimurium LT2
guacagcuugcuggccgcgu

SEQ ID NO: 1816333 - RNA, 21 nt, Salmonella typhimurium LT2
guaccagaacucguugccaga

SEQ ID NO: 1816334 - RNA, 14 nt, Salmonella typhimurium LT2
guacauguccagau

SEQ ID NO: 1816335 - RNA, 21 nt, Salmonella typhimurium LT2
guacaucaaaucagacgcuuc

SEQ ID NO: 1816336 - RNA, 22 nt, Salmonella typhimurium LT2
gugccacgcuuuuuaccggcga

SEQ ID NO: 1816337 - RNA, 11 nt, Salmonella typhimurium LT2
gugccgccaga

SEQ ID NO: 1816338 - RNA, 21 nt, Salmonella typhimurium LT2
gugccgaugacgcuccugaau

SEQ ID NO: 1816339 - RNA, 21 nt, Salmonella typhimurium LT2
gugcgaguucaagucucgccu

SEQ ID NO: 1816340 - RNA, 14 nt, Salmonella typhimurium LT2
gugcgcagccccag

SEQ ID NO: 1816341 - RNA, 21 nt, Salmonella typhimurium LT2
gugcgcggaucgugauaacgc

SEQ ID NO: 1816342 - RNA, 18 nt, Salmonella typhimurium LT2
gugagcuuccgucgccag

SEQ ID NO: 1816343 - RNA, 20 nt, Salmonella typhimurium LT2
gugagaagggcagaucgagg

SEQ ID NO: 1816344 - RNA, 15 nt, Salmonella typhimurium LT2
gugauuaacgcgaaa

SEQ ID NO: 1816345 - RNA, 23 nt, Salmonella typhimurium LT2
gucguauaccguuucuccgcgau

SEQ ID NO: 1816346 - RNA, 17 nt, Salmonella typhimurium LT2
gucgguaauguccgcca

SEQ ID NO: 1816347 - RNA, 15 nt, Salmonella typhimurium LT2
gugaauaucgagcgg

SEQ ID NO: 1816348 - RNA, 16 nt, Salmonella typhimurium LT2
gugaauguccccugac

SEQ ID NO: 1816349 - RNA, 14 nt, Salmonella typhimurium LT2
gugaccccggccuc

SEQ ID NO: 1816350 - RNA, 21 nt, Salmonella typhimurium LT2
gugaagauuauucucgcacuu

SEQ ID NO: 1816351 - RNA, 15 nt, Salmonella typhimurium LT2
gucgugugcggaugc

SEQ ID NO: 1816352 - RNA, 19 nt, Salmonella typhimurium LT2
gucgaaggcgcuuugcgag

SEQ ID NO: 1816353 - RNA, 19 nt, Salmonella typhimurium LT2
guccuccagcgugcagaug

SEQ ID NO: 1816354 - RNA, 14 nt, Salmonella typhimurium LT2
guccugauccggcu

SEQ ID NO: 1816355 - RNA, 15 nt, Salmonella typhimurium LT2
guccggcugaagcgg

SEQ ID NO: 1816356 - RNA, 20 nt, Salmonella typhimurium LT2
guccgggcugcacgccaucg

SEQ ID NO: 1816357 - RNA, 16 nt, Salmonella typhimurium LT2
guccgucagauccgca

SEQ ID NO: 1816358 - RNA, 18 nt, Salmonella typhimurium LT2
guccgcuggcguccagcc

SEQ ID NO: 1816359 - RNA, 16 nt, Salmonella typhimurium LT2
guccgccuuugacgcc

SEQ ID NO: 1816360 - RNA, 17 nt, Salmonella typhimurium LT2
gucccuuccgccaccag

SEQ ID NO: 1816361 - RNA, 22 nt, Salmonella typhimurium LT2
guccccuggacgcgagccacag

SEQ ID NO: 1816362 - RNA, 17 nt, Salmonella typhimurium LT2
gucagauccuucauuca

SEQ ID NO: 1816363 - RNA, 19 nt, Salmonella typhimurium LT2
gucagaucguaugcgccug

SEQ ID NO: 1816364 - RNA, 15 nt, Salmonella typhimurium LT2
gucggacguaugcuu

SEQ ID NO: 1816365 - RNA, 17 nt, Salmonella typhimurium LT2
gucgcuaaucagcaacu

SEQ ID NO: 1816366 - RNA, 21 nt, Salmonella typhimurium LT2
gucgcucagguuguccagcag

SEQ ID NO: 1816367 - RNA, 16 nt, Salmonella typhimurium LT2
gucgcgacguccgcca

SEQ ID NO: 1816368 - RNA, 15 nt, Salmonella typhimurium LT2
gucgcgaucgcgcca

SEQ ID NO: 1816369 - RNA, 16 nt, Salmonella typhimurium LT2
gucgcgaucgcgccag

SEQ ID NO: 1816370 - RNA, 14 nt, Salmonella typhimurium LT2
gucgccuuccagcg

SEQ ID NO: 1816371 - RNA, 12 nt, Salmonella typhimurium LT2
gucgccggccug

SEQ ID NO: 1816372 - RNA, 17 nt, Salmonella typhimurium LT2
gucgccagaaggcaggu

SEQ ID NO: 1816373 - RNA, 22 nt, Salmonella typhimurium LT2
gucgccgcaggcccggcaggca

SEQ ID NO: 1816374 - RNA, 20 nt, Salmonella typhimurium LT2
gucgaugugaauccaggcca

SEQ ID NO: 1816375 - RNA, 22 nt, Salmonella typhimurium LT2
gucgauaauauccagcacgccu

SEQ ID NO: 1816376 - RNA, 20 nt, Salmonella typhimurium LT2
gucgauaaucauacagcgca

SEQ ID NO: 1816377 - RNA, 16 nt, Salmonella typhimurium LT2
gucgauaaaucgccac

SEQ ID NO: 1816378 - RNA, 18 nt, Salmonella typhimurium LT2
gucgauaaaugcccgaau

SEQ ID NO: 1816379 - RNA, 21 nt, Salmonella typhimurium LT2
gucgauaaccuggaugacaca

SEQ ID NO: 1816380 - RNA, 20 nt, Salmonella typhimurium LT2
gucgacaaagccaacgccgc

SEQ ID NO: 1816381 - RNA, 18 nt, Salmonella typhimurium LT2
gucgacaaagccgcagcg

SEQ ID NO: 1816382 - RNA, 17 nt, Salmonella typhimurium LT2
gucgaccgguccacuug

SEQ ID NO: 1816383 - RNA, 16 nt, Salmonella typhimurium LT2
gcgccgcuacucagcc

SEQ ID NO: 1816384 - RNA, 16 nt, Salmonella typhimurium LT2
gcgccgcugcguaccg

SEQ ID NO: 1816385 - RNA, 14 nt, Salmonella typhimurium LT2
gcgccgcuuccagg

SEQ ID NO: 1816386 - RNA, 15 nt, Salmonella typhimurium LT2
gcgccgcgggcuggu

SEQ ID NO: 1816387 - RNA, 14 nt, Salmonella typhimurium LT2
gcgccgcggguauu

SEQ ID NO: 1816388 - RNA, 14 nt, Salmonella typhimurium LT2
gcgccgcgccaccg

SEQ ID NO: 1816389 - RNA, 16 nt, Salmonella typhimurium LT2
gcgccgcgccuaccag

SEQ ID NO: 1816390 - RNA, 21 nt, Salmonella typhimurium LT2
gcgccgccaacgauacagcac

SEQ ID NO: 1816391 - RNA, 18 nt, Salmonella typhimurium LT2
gcgccgccaauauccauu

SEQ ID NO: 1816392 - RNA, 22 nt, Salmonella typhimurium LT2
gcgcccaaugcuuagucagccu

SEQ ID NO: 1816393 - RNA, 20 nt, Salmonella typhimurium LT2
gcgccauuaacgccaugacg

SEQ ID NO: 1816394 - RNA, 14 nt, Salmonella typhimurium LT2
gcgccaguucagcg

SEQ ID NO: 1816395 - RNA, 16 nt, Salmonella typhimurium LT2
gcgccaguucagcguc

SEQ ID NO: 1816396 - RNA, 19 nt, Salmonella typhimurium LT2
gcgccaguucauccagcag

SEQ ID NO: 1816397 - RNA, 19 nt, Salmonella typhimurium LT2
gcgcccaguccuuccggcg

SEQ ID NO: 1816398 - RNA, 21 nt, Salmonella typhimurium LT2
gcgcccaucaucaucggcaca

SEQ ID NO: 1816399 - RNA, 15 nt, Salmonella typhimurium LT2
gcgcccauuccgccu

SEQ ID NO: 1816400 - RNA, 19 nt, Salmonella typhimurium LT2
gcgccagcgacaacgcuuc

SEQ ID NO: 1816401 - RNA, 21 nt, Salmonella typhimurium LT2
gcgccagcgacaucccagaca

SEQ ID NO: 1816402 - RNA, 23 nt, Salmonella typhimurium LT2
gcgccagcggauugccauacacg

SEQ ID NO: 1816403 - RNA, 16 nt, Salmonella typhimurium LT2
gcgccagcgcgcguac

SEQ ID NO: 1816404 - RNA, 13 nt, Salmonella typhimurium LT2
gcgccagcaccag

SEQ ID NO: 1816405 - RNA, 19 nt, Salmonella typhimurium LT2
gcgccagaauagcgcaguc

SEQ ID NO: 1816406 - RNA, 13 nt, Salmonella typhimurium LT2
gcgcaccaguuca

SEQ ID NO: 1816407 - RNA, 16 nt, Salmonella typhimurium LT2
gcgauauuuccacggu

SEQ ID NO: 1816408 - RNA, 18 nt, Salmonella typhimurium LT2
gcgauaucugccgcgcca

SEQ ID NO: 1816409 - RNA, 15 nt, Salmonella typhimurium LT2
gcgauauccggacaa

SEQ ID NO: 1816410 - RNA, 13 nt, Salmonella typhimurium LT2
gcgauauagcgca

SEQ ID NO: 1816411 - RNA, 16 nt, Salmonella typhimurium LT2
gcgauauccagcgcca

SEQ ID NO: 1816412 - RNA, 22 nt, Salmonella typhimurium LT2
gcgcaccuucaacagcucgcca

SEQ ID NO: 1816413 - RNA, 21 nt, Salmonella typhimurium LT2
gcgcagaaucacuucauccgg

SEQ ID NO: 1816414 - RNA, 18 nt, Salmonella typhimurium LT2
gcgcagacuugaaucugu

SEQ ID NO: 1816415 - RNA, 16 nt, Salmonella typhimurium LT2
gcgcagagauagccag

SEQ ID NO: 1816416 - RNA, 24 nt, Salmonella typhimurium LT2
gcgcacgucgguaaagcgcaccag

SEQ ID NO: 1816417 - RNA, 15 nt, Salmonella typhimurium LT2
gcgcacggcgcgucc

SEQ ID NO: 1816418 - RNA, 22 nt, Salmonella typhimurium LT2
gcgcagccacggcgcacacgcc

SEQ ID NO: 1816419 - RNA, 16 nt, Salmonella typhimurium LT2
gcgcagcgcaucaggc

SEQ ID NO: 1816420 - RNA, 11 nt, Salmonella typhimurium LT2
gcgcagcgcca

SEQ ID NO: 1816421 - RNA, 17 nt, Salmonella typhimurium LT2
gcgcagcgccaucaggc

SEQ ID NO: 1816422 - RNA, 19 nt, Salmonella typhimurium LT2
gcgcagcgccaucaggccc

SEQ ID NO: 1816423 - RNA, 13 nt, Salmonella typhimurium LT2
gcgcaggccguca

SEQ ID NO: 1816424 - RNA, 16 nt, Salmonella typhimurium LT2
gcgcagcgcgcggaug

SEQ ID NO: 1816425 - RNA, 21 nt, Salmonella typhimurium LT2
gcgcagcguggccuuauccag

SEQ ID NO: 1816426 - RNA, 19 nt, Salmonella typhimurium LT2
gcgcaggggcauuuuccgg

SEQ ID NO: 1816427 - RNA, 16 nt, Salmonella typhimurium LT2
gcgcauauuccggcga

SEQ ID NO: 1816428 - RNA, 17 nt, Salmonella typhimurium LT2
gcgcauacgucaugccu

SEQ ID NO: 1816429 - RNA, 18 nt, Salmonella typhimurium LT2
gcgcauacucauuaccgg

SEQ ID NO: 1816430 - RNA, 23 nt, Salmonella typhimurium LT2
gcgcauacucauuaccggcugcc

SEQ ID NO: 1816431 - RNA, 23 nt, Salmonella typhimurium LT2
gcgcauaauccggaauaagaaua

SEQ ID NO: 1816432 - RNA, 20 nt, Salmonella typhimurium LT2
gcgcggcugcgggaggcggu

SEQ ID NO: 1816433 - RNA, 13 nt, Salmonella typhimurium LT2
gcgcggacagcag

SEQ ID NO: 1816434 - RNA, 14 nt, Salmonella typhimurium LT2
gcgcggaucgccau

SEQ ID NO: 1816435 - RNA, 20 nt, Salmonella typhimurium LT2
gcgcggcacacuuucaucag

SEQ ID NO: 1816436 - RNA, 23 nt, Salmonella typhimurium LT2
gcgcgguggcuuuuuccugccau

SEQ ID NO: 1816437 - RNA, 23 nt, Salmonella typhimurium LT2
gcgcucaccuccgccaccagcgc

SEQ ID NO: 1816438 - RNA, 15 nt, Salmonella typhimurium LT2
gcgcuaaaucguccg

SEQ ID NO: 1816439 - RNA, 16 nt, Salmonella typhimurium LT2
gcgcguuuagcgccag

SEQ ID NO: 1816440 - RNA, 20 nt, Salmonella typhimurium LT2
gcgcguagguuggcugaggc

SEQ ID NO: 1816441 - RNA, 20 nt, Salmonella typhimurium LT2
gcgcuucgcuuaucaggccu

SEQ ID NO: 1816442 - RNA, 17 nt, Salmonella typhimurium LT2
gcgcuucgcuuaucagg

SEQ ID NO: 1816443 - RNA, 16 nt, Salmonella typhimurium LT2
gcgcuucgcuuaucgg

SEQ ID NO: 1816444 - RNA, 18 nt, Salmonella typhimurium LT2
gcgcuucucccagccguc

SEQ ID NO: 1816445 - RNA, 17 nt, Salmonella typhimurium LT2
gcgcuuucaaucgucag

SEQ ID NO: 1816446 - RNA, 18 nt, Salmonella typhimurium LT2
gcgcugucgcuaauccgg

SEQ ID NO: 1816447 - RNA, 20 nt, Salmonella typhimurium LT2
gcgcugucgcuaauccggcc

SEQ ID NO: 1816448 - RNA, 16 nt, Salmonella typhimurium LT2
gcgcugucgcuuaccg

SEQ ID NO: 1816449 - RNA, 16 nt, Salmonella typhimurium LT2
gcgcuguauucgucca

SEQ ID NO: 1816450 - RNA, 17 nt, Salmonella typhimurium LT2
gcgcuggucagcagaaa

SEQ ID NO: 1816451 - RNA, 19 nt, Salmonella typhimurium LT2
gcgcuuaccgggccuacag

SEQ ID NO: 1816452 - RNA, 23 nt, Salmonella typhimurium LT2
gcgcuuagcggcaccuuguccgg

SEQ ID NO: 1816453 - RNA, 12 nt, Salmonella typhimurium LT2
gcgcugcgccau

SEQ ID NO: 1816454 - RNA, 15 nt, Salmonella typhimurium LT2
gcgcugcgcgcaucg

SEQ ID NO: 1816455 - RNA, 12 nt, Salmonella typhimurium LT2
gcgcugcgccag

SEQ ID NO: 1816456 - RNA, 22 nt, Salmonella typhimurium LT2
gcgcuccgacugaaccuucacg

SEQ ID NO: 1816457 - RNA, 21 nt, Salmonella typhimurium LT2
gcgcuccagcuucaucaucag

SEQ ID NO: 1816458 - RNA, 20 nt, Salmonella typhimurium LT2
gcgcugaguuucucccgcca

SEQ ID NO: 1816459 - RNA, 14 nt, Salmonella typhimurium LT2
gcgcugaucgccac

SEQ ID NO: 1816460 - RNA, 17 nt, Salmonella typhimurium LT2
gcgcugaugugcggccu

SEQ ID NO: 1816461 - RNA, 22 nt, Salmonella typhimurium LT2
gcgcgcuuucaccgccucaucg

SEQ ID NO: 1816462 - RNA, 19 nt, Salmonella typhimurium LT2
gcgcgcgucaguucgucca

SEQ ID NO: 1816463 - RNA, 15 nt, Salmonella typhimurium LT2
gcgcgcggaugacga

SEQ ID NO: 1816464 - RNA, 15 nt, Salmonella typhimurium LT2
gcgcgcgccagucau

SEQ ID NO: 1816465 - RNA, 16 nt, Salmonella typhimurium LT2
gcgcgccuaccgccau

SEQ ID NO: 1816466 - RNA, 16 nt, Salmonella typhimurium LT2
gcgcgccugccgccag

SEQ ID NO: 1816467 - RNA, 13 nt, Salmonella typhimurium LT2
gcgcgccgcagcg

SEQ ID NO: 1816468 - RNA, 14 nt, Salmonella typhimurium LT2
gcgccuuccggcca

SEQ ID NO: 1816469 - RNA, 14 nt, Salmonella typhimurium LT2
gcgccuugccccag

SEQ ID NO: 1816470 - RNA, 19 nt, Salmonella typhimurium LT2
gcgcgaccacgccagccag

SEQ ID NO: 1816471 - RNA, 14 nt, Salmonella typhimurium LT2
gcgccuaccgccau

SEQ ID NO: 1816472 - RNA, 18 nt, Salmonella typhimurium LT2
gcgccuccacaaagcgcg

SEQ ID NO: 1816473 - RNA, 14 nt, Salmonella typhimurium LT2
gcgccggacagcag

SEQ ID NO: 1816474 - RNA, 23 nt, Salmonella typhimurium LT2
gcgccggacuccagcaacgccgc

SEQ ID NO: 1816475 - RNA, 23 nt, Salmonella typhimurium LT2
gcgccgugucaucauuacaggcg

SEQ ID NO: 1816476 - RNA, 22 nt, Salmonella typhimurium LT2
gcgccugugcuuucgccaccag

SEQ ID NO: 1816477 - RNA, 13 nt, Salmonella typhimurium LT2
gcgccuuauccgg

SEQ ID NO: 1816478 - RNA, 16 nt, Salmonella typhimurium LT2
gcgccuuacguaccgg

SEQ ID NO: 1816479 - RNA, 14 nt, Salmonella typhimurium LT2
gcgccuuccagcaa

SEQ ID NO: 1816480 - RNA, 17 nt, Salmonella typhimurium LT2
gcgccuucaggcaucag

SEQ ID NO: 1816481 - RNA, 15 nt, Salmonella typhimurium LT2
gcgccuccgcguagc

SEQ ID NO: 1816482 - RNA, 20 nt, Salmonella typhimurium LT2
gccgggcaacacgaugaugu

SEQ ID NO: 1816483 - RNA, 22 nt, Salmonella typhimurium LT2
gccggguaggacauagccgcca

SEQ ID NO: 1816484 - RNA, 14 nt, Salmonella typhimurium LT2
gccggguacugaau

SEQ ID NO: 1816485 - RNA, 19 nt, Salmonella typhimurium LT2
gccgguacgggcagcggcu

SEQ ID NO: 1816486 - RNA, 21 nt, Salmonella typhimurium LT2
gccgguacgggcagcggcuuc

SEQ ID NO: 1816487 - RNA, 15 nt, Salmonella typhimurium LT2
gccggucaugccauc

SEQ ID NO: 1816488 - RNA, 22 nt, Salmonella typhimurium LT2
gccggucaggauacagccgacu

SEQ ID NO: 1816489 - RNA, 21 nt, Salmonella typhimurium LT2
gccggucuuaugcugccagcg

SEQ ID NO: 1816490 - RNA, 19 nt, Salmonella typhimurium LT2
gccguauaccagcgucagc

SEQ ID NO: 1816491 - RNA, 20 nt, Salmonella typhimurium LT2
gccguaucagcaagcgccag

SEQ ID NO: 1816492 - RNA, 21 nt, Salmonella typhimurium LT2
gccgguguuuagccugauaca

SEQ ID NO: 1816493 - RNA, 19 nt, Salmonella typhimurium LT2
gccgucacaaagcccaccg

SEQ ID NO: 1816494 - RNA, 19 nt, Salmonella typhimurium LT2
gccgucacucccugcguca

SEQ ID NO: 1816495 - RNA, 12 nt, Salmonella typhimurium LT2
gccguccggcau

SEQ ID NO: 1816496 - RNA, 18 nt, Salmonella typhimurium LT2
gccgucucaaccagcaau

SEQ ID NO: 1816497 - RNA, 23 nt, Salmonella typhimurium LT2
gccgucuuuggcucuuagcagca

SEQ ID NO: 1816498 - RNA, 14 nt, Salmonella typhimurium LT2
gccgugaacgccaa

SEQ ID NO: 1816499 - RNA, 21 nt, Salmonella typhimurium LT2
gccgucgauuuaaugccuauc

SEQ ID NO: 1816500 - RNA, 13 nt, Salmonella typhimurium LT2
gccgucggcagcc

SEQ ID NO: 1816501 - RNA, 16 nt, Salmonella typhimurium LT2
gccuaguucugcgcca

SEQ ID NO: 1816502 - RNA, 22 nt, Salmonella typhimurium LT2
gccguugcuguuccagccgcca

SEQ ID NO: 1816503 - RNA, 23 nt, Salmonella typhimurium LT2
gccguugaguuugacugccagac

SEQ ID NO: 1816504 - RNA, 19 nt, Salmonella typhimurium LT2
gccguugaccauaucgucg

SEQ ID NO: 1816505 - RNA, 21 nt, Salmonella typhimurium LT2
gccucacccugaaauccggcu

SEQ ID NO: 1816506 - RNA, 15 nt, Salmonella typhimurium LT2
gccuccugccgaugc

SEQ ID NO: 1816507 - RNA, 19 nt, Salmonella typhimurium LT2
gccugcggauuuuucgcca

SEQ ID NO: 1816508 - RNA, 22 nt, Salmonella typhimurium LT2
gccugcugcagacugccggcaa

SEQ ID NO: 1816509 - RNA, 16 nt, Salmonella typhimurium LT2
gccugcgccagcgccg

SEQ ID NO: 1816510 - RNA, 15 nt, Salmonella typhimurium LT2
gccugcgccagcgcc

SEQ ID NO: 1816511 - RNA, 13 nt, Salmonella typhimurium LT2
gccugcgcggcaa

SEQ ID NO: 1816512 - RNA, 17 nt, Salmonella typhimurium LT2
gccugcgccuugacgau

SEQ ID NO: 1816513 - RNA, 15 nt, Salmonella typhimurium LT2
gccucgcugacgcca

SEQ ID NO: 1816514 - RNA, 19 nt, Salmonella typhimurium LT2
gccugccguaacgccgucg

SEQ ID NO: 1816515 - RNA, 14 nt, Salmonella typhimurium LT2
gccuguucaucagg

SEQ ID NO: 1816516 - RNA, 16 nt, Salmonella typhimurium LT2
gccuucaauuccugga

SEQ ID NO: 1816517 - RNA, 22 nt, Salmonella typhimurium LT2
gccuucagccugaaucagcauc

SEQ ID NO: 1816518 - RNA, 17 nt, Salmonella typhimurium LT2
gccuuauccggccugca

SEQ ID NO: 1816519 - RNA, 21 nt, Salmonella typhimurium LT2
gccuuauccggccugcaggca

SEQ ID NO: 1816520 - RNA, 14 nt, Salmonella typhimurium LT2
gccuuauucacagc

SEQ ID NO: 1816521 - RNA, 20 nt, Salmonella typhimurium LT2
gccuugauccuguaacgcau

SEQ ID NO: 1816522 - RNA, 13 nt, Salmonella typhimurium LT2
gccuguccggccu

SEQ ID NO: 1816523 - RNA, 18 nt, Salmonella typhimurium LT2
gccuguaaugccgccugu

SEQ ID NO: 1816524 - RNA, 12 nt, Salmonella typhimurium LT2
gccugucaggau

SEQ ID NO: 1816525 - RNA, 16 nt, Salmonella typhimurium LT2
gccugucaggaugaaa

SEQ ID NO: 1816526 - RNA, 17 nt, Salmonella typhimurium LT2
gccuggccuucaaucag

SEQ ID NO: 1816527 - RNA, 21 nt, Salmonella typhimurium LT2
gccuggcgguaugaaagccau

SEQ ID NO: 1816528 - RNA, 18 nt, Salmonella typhimurium LT2
gcgaacguuugaccugca

SEQ ID NO: 1816529 - RNA, 20 nt, Salmonella typhimurium LT2
gcgaagauuaauccggucau

SEQ ID NO: 1816530 - RNA, 12 nt, Salmonella typhimurium LT2
gcgaagccacuu

SEQ ID NO: 1816531 - RNA, 13 nt, Salmonella typhimurium LT2
gcgaacuugccgg

SEQ ID NO: 1816532 - RNA, 17 nt, Salmonella typhimurium LT2
gcgaaccaccagccgau

SEQ ID NO: 1816533 - RNA, 19 nt, Salmonella typhimurium LT2
gcgaacaggcucagcgcca

SEQ ID NO: 1816534 - RNA, 14 nt, Salmonella typhimurium LT2
gcgaacaggcguaa

SEQ ID NO: 1816535 - RNA, 18 nt, Salmonella typhimurium LT2
gccuuucggcagcgggau

SEQ ID NO: 1816536 - RNA, 21 nt, Salmonella typhimurium LT2
gccuuuaugggcuuugcaagc

SEQ ID NO: 1816537 - RNA, 17 nt, Salmonella typhimurium LT2
gccuuucaccagcgccu

SEQ ID NO: 1816538 - RNA, 18 nt, Salmonella typhimurium LT2
gccuuucaccaucagcau

SEQ ID NO: 1816539 - RNA, 14 nt, Salmonella typhimurium LT2
gccuuuauccagcg

SEQ ID NO: 1816540 - RNA, 21 nt, Salmonella typhimurium LT2
gccuugcccguauugaagcga

SEQ ID NO: 1816541 - RNA, 18 nt, Salmonella typhimurium LT2
gcgaaaagcgugcgccuu

SEQ ID NO: 1816542 - RNA, 12 nt, Salmonella typhimurium LT2
gccuuuggccug

SEQ ID NO: 1816543 - RNA, 23 nt, Salmonella typhimurium LT2
gccuuugucauccaccaggauaa

SEQ ID NO: 1816544 - RNA, 18 nt, Salmonella typhimurium LT2
gccuuuucccccagcauc

SEQ ID NO: 1816545 - RNA, 14 nt, Salmonella typhimurium LT2
gccuuuuggcagca

SEQ ID NO: 1816546 - RNA, 19 nt, Salmonella typhimurium LT2
gccuuuuucgcucuuauca

SEQ ID NO: 1816547 - RNA, 17 nt, Salmonella typhimurium LT2
gcgaaacuccagcgaua

SEQ ID NO: 1816548 - RNA, 23 nt, Salmonella typhimurium LT2
gcgaaagcacuucucgcgcauca

SEQ ID NO: 1816549 - RNA, 19 nt, Salmonella typhimurium LT2
gcgaaagagaauguaggcc

SEQ ID NO: 1816550 - RNA, 14 nt, Salmonella typhimurium LT2
gcgaaacggcagcg

SEQ ID NO: 1816551 - RNA, 15 nt, Salmonella typhimurium LT2
gcgaaaucaccgaca

SEQ ID NO: 1816552 - RNA, 17 nt, Salmonella typhimurium LT2
gcgacgcgcacccggcu

SEQ ID NO: 1816553 - RNA, 14 nt, Salmonella typhimurium LT2
gcgacgacgcuggu

SEQ ID NO: 1816554 - RNA, 16 nt, Salmonella typhimurium LT2
gcgacgacacggcgca

SEQ ID NO: 1816555 - RNA, 14 nt, Salmonella typhimurium LT2
gcgaccgccaccau

SEQ ID NO: 1816556 - RNA, 13 nt, Salmonella typhimurium LT2
gcgacccagcgca

SEQ ID NO: 1816557 - RNA, 15 nt, Salmonella typhimurium LT2
gcgacaguaguauca

SEQ ID NO: 1816558 - RNA, 12 nt, Salmonella typhimurium LT2
gcgacagcgcca

SEQ ID NO: 1816559 - RNA, 15 nt, Salmonella typhimurium LT2
gcgacagcgcgccaa

SEQ ID NO: 1816560 - RNA, 22 nt, Salmonella typhimurium LT2
gcgaggaaaaucgcugcgcccg

SEQ ID NO: 1816561 - RNA, 19 nt, Salmonella typhimurium LT2
gcgagcuucucgccggaaa

SEQ ID NO: 1816562 - RNA, 20 nt, Salmonella typhimurium LT2
gcgagucccuaauagcgcca

SEQ ID NO: 1816563 - RNA, 19 nt, Salmonella typhimurium LT2
gcgauacucucgcagcgaa

SEQ ID NO: 1816564 - RNA, 19 nt, Salmonella typhimurium LT2
gcgauacugccgcccaucg

SEQ ID NO: 1816565 - RNA, 22 nt, Salmonella typhimurium LT2
gcgauacugccgcccaucgcca

SEQ ID NO: 1816566 - RNA, 23 nt, Salmonella typhimurium LT2
gcgauacugccgcccaucgccac

SEQ ID NO: 1816567 - RNA, 18 nt, Salmonella typhimurium LT2
gcgauacggauagcguca

SEQ ID NO: 1816568 - RNA, 14 nt, Salmonella typhimurium LT2
gcgauaagcgucuu

SEQ ID NO: 1816569 - RNA, 16 nt, Salmonella typhimurium LT2
gcgauaauagaaccca

SEQ ID NO: 1816570 - RNA, 18 nt, Salmonella typhimurium LT2
gcgauaaaaauauccgcc

SEQ ID NO: 1816571 - RNA, 18 nt, Salmonella typhimurium LT2
gcgauaaaaaacgcccag

SEQ ID NO: 1816572 - RNA, 16 nt, Salmonella typhimurium LT2
gcgauaacccgcgcau

SEQ ID NO: 1816573 - RNA, 13 nt, Salmonella typhimurium LT2
gcgauaaacgauc

SEQ ID NO: 1816574 - RNA, 22 nt, Salmonella typhimurium LT2
gcgacggcgcgccaaacggcag

SEQ ID NO: 1816575 - RNA, 20 nt, Salmonella typhimurium LT2
gcgacuuugcgccggcaguc

SEQ ID NO: 1816576 - RNA, 16 nt, Salmonella typhimurium LT2
gcgacuucagauaccg

SEQ ID NO: 1816577 - RNA, 21 nt, Salmonella typhimurium LT2
gcggcccacucauccagcaaa

SEQ ID NO: 1816578 - RNA, 20 nt, Salmonella typhimurium LT2
gcggccaugaucgccgccau

SEQ ID NO: 1816579 - RNA, 21 nt, Salmonella typhimurium LT2
gcggcauuggcguuaccggca

SEQ ID NO: 1816580 - RNA, 15 nt, Salmonella typhimurium LT2
gcggcaguuccggcg

SEQ ID NO: 1816581 - RNA, 14 nt, Salmonella typhimurium LT2
gcggcauaaacgcc

SEQ ID NO: 1816582 - RNA, 12 nt, Salmonella typhimurium LT2
gcggcauccggc

SEQ ID NO: 1816583 - RNA, 22 nt, Salmonella typhimurium LT2
gcggcaucgcccguuuuaccgg

SEQ ID NO: 1816584 - RNA, 20 nt, Salmonella typhimurium LT2
gcgcuuuggguuaaugccag

SEQ ID NO: 1816585 - RNA, 17 nt, Salmonella typhimurium LT2
gcgcuuugcuuauccgg

SEQ ID NO: 1816586 - RNA, 16 nt, Salmonella typhimurium LT2
gcggccuaucaggccu

SEQ ID NO: 1816587 - RNA, 19 nt, Salmonella typhimurium LT2
gcggccuccuggcuuaccu

SEQ ID NO: 1816588 - RNA, 22 nt, Salmonella typhimurium LT2
gcgggccguaaaguucccagcg

SEQ ID NO: 1816589 - RNA, 17 nt, Salmonella typhimurium LT2
gcgggccgcggcgcgca

SEQ ID NO: 1816590 - RNA, 21 nt, Salmonella typhimurium LT2
gcgggccgacaaaaauuucga

SEQ ID NO: 1816591 - RNA, 11 nt, Salmonella typhimurium LT2
gcgggagcugu

SEQ ID NO: 1816592 - RNA, 14 nt, Salmonella typhimurium LT2
gcgggaagcgcgca

SEQ ID NO: 1816593 - RNA, 21 nt, Salmonella typhimurium LT2
gcggcuugaguuuuccgccau

SEQ ID NO: 1816594 - RNA, 14 nt, Salmonella typhimurium LT2
gcggcguugcccag

SEQ ID NO: 1816595 - RNA, 18 nt, Salmonella typhimurium LT2
gcggcgaaacgccuuauc

SEQ ID NO: 1816596 - RNA, 16 nt, Salmonella typhimurium LT2
gcggcguucaaaacgc

SEQ ID NO: 1816597 - RNA, 17 nt, Salmonella typhimurium LT2
gcggcguucugcgccau

SEQ ID NO: 1816598 - RNA, 15 nt, Salmonella typhimurium LT2
gcggcggguuaaugg

SEQ ID NO: 1816599 - RNA, 15 nt, Salmonella typhimurium LT2
gcggcguccgccagc

SEQ ID NO: 1816600 - RNA, 19 nt, Salmonella typhimurium LT2
gcguucgccaaagcaguga

SEQ ID NO: 1816601 - RNA, 20 nt, Salmonella typhimurium LT2
gcguucugguugaccggaaa

SEQ ID NO: 1816602 - RNA, 21 nt, Salmonella typhimurium LT2
gcguucuuccacuucagcagc

SEQ ID NO: 1816603 - RNA, 19 nt, Salmonella typhimurium LT2
gcguuauugaccaucgcca

SEQ ID NO: 1816604 - RNA, 23 nt, Salmonella typhimurium LT2
gcguucacgccgccauccggcaa

SEQ ID NO: 1816605 - RNA, 19 nt, Salmonella typhimurium LT2
gcguucgaccguuuccgcc

SEQ ID NO: 1816606 - RNA, 22 nt, Salmonella typhimurium LT2
gcguucgaccguuuccgccagu

SEQ ID NO: 1816607 - RNA, 21 nt, Salmonella typhimurium LT2
gcgugucgccggggcgcuggc

SEQ ID NO: 1816608 - RNA, 20 nt, Salmonella typhimurium LT2
gcguuagugcccagcgcgac

SEQ ID NO: 1816609 - RNA, 20 nt, Salmonella typhimurium LT2
gcguggcaucuuaucaggcc

SEQ ID NO: 1816610 - RNA, 15 nt, Salmonella typhimurium LT2
gcguuuuuaccggcu

SEQ ID NO: 1816611 - RNA, 16 nt, Salmonella typhimurium LT2
gcuaaaccggcggaau

SEQ ID NO: 1816612 - RNA, 17 nt, Salmonella typhimurium LT2
gcuaaaacagauaacga

SEQ ID NO: 1816613 - RNA, 16 nt, Salmonella typhimurium LT2
gcguuugcgccgccau

SEQ ID NO: 1816614 - RNA, 23 nt, Salmonella typhimurium LT2
gcuaaagcgacuuauccggccua

SEQ ID NO: 1816615 - RNA, 20 nt, Salmonella typhimurium LT2
gcuaaaucguccgccgucgg

SEQ ID NO: 1816616 - RNA, 13 nt, Salmonella typhimurium LT2
gcuaaccaggcca

SEQ ID NO: 1816617 - RNA, 13 nt, Salmonella typhimurium LT2
gcuaacgcgucuu

SEQ ID NO: 1816618 - RNA, 12 nt, Salmonella typhimurium LT2
gcuaacgcgcac

SEQ ID NO: 1816619 - RNA, 20 nt, Salmonella typhimurium LT2
gcuaacgcgcacccggcuua

SEQ ID NO: 1816620 - RNA, 18 nt, Salmonella typhimurium LT2
gcguugggugcagcguca

SEQ ID NO: 1816621 - RNA, 15 nt, Salmonella typhimurium LT2
gcguuguuccugagu

SEQ ID NO: 1816622 - RNA, 20 nt, Salmonella typhimurium LT2
gcguuucguaauggccuaca

SEQ ID NO: 1816623 - RNA, 23 nt, Salmonella typhimurium LT2
gcguuucccgcgcggaaggcgcc

SEQ ID NO: 1816624 - RNA, 14 nt, Salmonella typhimurium LT2
gcguuuccacgaca

SEQ ID NO: 1816625 - RNA, 13 nt, Salmonella typhimurium LT2
gcgucgccgccgu

SEQ ID NO: 1816626 - RNA, 18 nt, Salmonella typhimurium LT2
gcgucgguuauagacgcc

SEQ ID NO: 1816627 - RNA, 23 nt, Salmonella typhimurium LT2
gcgucgucauagcguugauaugc

SEQ ID NO: 1816628 - RNA, 19 nt, Salmonella typhimurium LT2
gcgucuggguuugcagcag

SEQ ID NO: 1816629 - RNA, 16 nt, Salmonella typhimurium LT2
gcgucuuauccggccu

SEQ ID NO: 1816630 - RNA, 21 nt, Salmonella typhimurium LT2
gcgugaacgccuuauccggcc

SEQ ID NO: 1816631 - RNA, 23 nt, Salmonella typhimurium LT2
gcgugccugccgcagaagcgaca

SEQ ID NO: 1816632 - RNA, 16 nt, Salmonella typhimurium LT2
gcgugaccaucgcguu

SEQ ID NO: 1816633 - RNA, 14 nt, Salmonella typhimurium LT2
gcgucaaaacuuau

SEQ ID NO: 1816634 - RNA, 22 nt, Salmonella typhimurium LT2
gcguauuuaaaacgcacgacaa

SEQ ID NO: 1816635 - RNA, 20 nt, Salmonella typhimurium LT2
gcguauucucaaccagccga

SEQ ID NO: 1816636 - RNA, 14 nt, Salmonella typhimurium LT2
gcguauagcgcuug

SEQ ID NO: 1816637 - RNA, 12 nt, Salmonella typhimurium LT2
gcguauccagca

SEQ ID NO: 1816638 - RNA, 17 nt, Salmonella typhimurium LT2
gcguaccgucucggccu

SEQ ID NO: 1816639 - RNA, 13 nt, Salmonella typhimurium LT2
gcguacgggcaaa

SEQ ID NO: 1816640 - RNA, 21 nt, Salmonella typhimurium LT2
gcguacagaagguuauucgcc

SEQ ID NO: 1816641 - RNA, 14 nt, Salmonella typhimurium LT2
gcguaccagcguca

SEQ ID NO: 1816642 - RNA, 16 nt, Salmonella typhimurium LT2
gcguacaggcggauga

SEQ ID NO: 1816643 - RNA, 17 nt, Salmonella typhimurium LT2
gcguagccaaaagcgcc

SEQ ID NO: 1816644 - RNA, 14 nt, Salmonella typhimurium LT2
gcgucauccggcgu

SEQ ID NO: 1816645 - RNA, 21 nt, Salmonella typhimurium LT2
gcgucaucccgguuucccgcg

SEQ ID NO: 1816646 - RNA, 19 nt, Salmonella typhimurium LT2
gcgucauaguuuuccagcc

SEQ ID NO: 1816647 - RNA, 12 nt, Salmonella typhimurium LT2
gcgucauccggc

SEQ ID NO: 1816648 - RNA, 12 nt, Salmonella typhimurium LT2
gcgucagcgccu

SEQ ID NO: 1816649 - RNA, 16 nt, Salmonella typhimurium LT2
gcgucacgaccggcga

SEQ ID NO: 1816650 - RNA, 19 nt, Salmonella typhimurium LT2
gcgguccggcauccaaccg

SEQ ID NO: 1816651 - RNA, 21 nt, Salmonella typhimurium LT2
gcggucgguuuucuucggccu

SEQ ID NO: 1816652 - RNA, 22 nt, Salmonella typhimurium LT2
gcggucagggugaauaccagcg

SEQ ID NO: 1816653 - RNA, 21 nt, Salmonella typhimurium LT2
gcggggaacacaauuaaagcc

SEQ ID NO: 1816654 - RNA, 22 nt, Salmonella typhimurium LT2
gcggucagccagcguaccagcg

SEQ ID NO: 1816655 - RNA, 18 nt, Salmonella typhimurium LT2
gcgguguaaaagccagca

SEQ ID NO: 1816656 - RNA, 15 nt, Salmonella typhimurium LT2
gcguaagucguaccg

SEQ ID NO: 1816657 - RNA, 12 nt, Salmonella typhimurium LT2
gcguaagcgcgu

SEQ ID NO: 1816658 - RNA, 14 nt, Salmonella typhimurium LT2
gcguaacggcugac

SEQ ID NO: 1816659 - RNA, 14 nt, Salmonella typhimurium LT2
gcguaauuugcgac

SEQ ID NO: 1816660 - RNA, 19 nt, Salmonella typhimurium LT2
gcguaauggccaccagcac

SEQ ID NO: 1816661 - RNA, 20 nt, Salmonella typhimurium LT2
gcggugcuuggcauagccag

SEQ ID NO: 1816662 - RNA, 14 nt, Salmonella typhimurium LT2
gcuccguacgcguc

SEQ ID NO: 1816663 - RNA, 12 nt, Salmonella typhimurium LT2
gcuccuucgaug

SEQ ID NO: 1816664 - RNA, 14 nt, Salmonella typhimurium LT2
gcucgaaucgccau

SEQ ID NO: 1816665 - RNA, 17 nt, Salmonella typhimurium LT2
gcucgacgcgcugcggu

SEQ ID NO: 1816666 - RNA, 23 nt, Salmonella typhimurium LT2
gcuaaucaccaccucaaacgaug

SEQ ID NO: 1816667 - RNA, 20 nt, Salmonella typhimurium LT2
gcuaaugcuuauccggccua

SEQ ID NO: 1816668 - RNA, 15 nt, Salmonella typhimurium LT2
gcucccguuccaggc

SEQ ID NO: 1816669 - RNA, 15 nt, Salmonella typhimurium LT2
gcucccucgaaugcu

SEQ ID NO: 1816670 - RNA, 20 nt, Salmonella typhimurium LT2
gcuccgcaguaaucaccguc

SEQ ID NO: 1816671 - RNA, 11 nt, Salmonella typhimurium LT2
gcuccgccaga

SEQ ID NO: 1816672 - RNA, 22 nt, Salmonella typhimurium LT2
gcucgcacugauagccgccagu

SEQ ID NO: 1816673 - RNA, 21 nt, Salmonella typhimurium LT2
gcucgagggugguauccucga

SEQ ID NO: 1816674 - RNA, 16 nt, Salmonella typhimurium LT2
gcucgcccaucacuac

SEQ ID NO: 1816675 - RNA, 15 nt, Salmonella typhimurium LT2
gcucgcgccacgcag

SEQ ID NO: 1816676 - RNA, 16 nt, Salmonella typhimurium LT2
gcucgcuguucgccag

SEQ ID NO: 1816677 - RNA, 23 nt, Salmonella typhimurium LT2
gcucgcuuaaugaggccaccagu

SEQ ID NO: 1816678 - RNA, 21 nt, Salmonella typhimurium LT2
gcucgcuguaccgccauccgg

SEQ ID NO: 1816679 - RNA, 11 nt, Salmonella typhimurium LT2
gcucgcguaac

SEQ ID NO: 1816680 - RNA, 17 nt, Salmonella typhimurium LT2
gcucgugauugauucgc

SEQ ID NO: 1816681 - RNA, 15 nt, Salmonella typhimurium LT2
gcucuauuugcauag

SEQ ID NO: 1816682 - RNA, 22 nt, Salmonella typhimurium LT2
gcugacaucauccacggcauca

SEQ ID NO: 1816683 - RNA, 18 nt, Salmonella typhimurium LT2
gcugacaaucugcuggaa

SEQ ID NO: 1816684 - RNA, 14 nt, Salmonella typhimurium LT2
gcugacaaggcgau

SEQ ID NO: 1816685 - RNA, 23 nt, Salmonella typhimurium LT2
gcugaacauacguuuaaagcgcu

SEQ ID NO: 1816686 - RNA, 15 nt, Salmonella typhimurium LT2
gcugaaccacccuga

SEQ ID NO: 1816687 - RNA, 15 nt, Salmonella typhimurium LT2
gcugaacggacuuga

SEQ ID NO: 1816688 - RNA, 19 nt, Salmonella typhimurium LT2
gcugauguccgcagccgca

SEQ ID NO: 1816689 - RNA, 13 nt, Salmonella typhimurium LT2
gcugcaacgucgc

SEQ ID NO: 1816690 - RNA, 18 nt, Salmonella typhimurium LT2
gcugcaacuucaccuucg

SEQ ID NO: 1816691 - RNA, 19 nt, Salmonella typhimurium LT2
gcugcacaaaauacuguuu

SEQ ID NO: 1816692 - RNA, 22 nt, Salmonella typhimurium LT2
gcugauacuuauuacgguauca

SEQ ID NO: 1816693 - RNA, 17 nt, Salmonella typhimurium LT2
gcugagcagccagccca

SEQ ID NO: 1816694 - RNA, 21 nt, Salmonella typhimurium LT2
gcugacgauacucagccccag

SEQ ID NO: 1816695 - RNA, 13 nt, Salmonella typhimurium LT2
gcugcgcaaaucc

SEQ ID NO: 1816696 - RNA, 15 nt, Salmonella typhimurium LT2
gcugccgucccagcg

SEQ ID NO: 1816697 - RNA, 18 nt, Salmonella typhimurium LT2
gcugccauuaucaccauu

SEQ ID NO: 1816698 - RNA, 20 nt, Salmonella typhimurium LT2
gcugcgccuuacccggccua

SEQ ID NO: 1816699 - RNA, 13 nt, Salmonella typhimurium LT2
gcugcgccaucag

SEQ ID NO: 1816700 - RNA, 16 nt, Salmonella typhimurium LT2
gcugcgcccgacgcca

SEQ ID NO: 1816701 - RNA, 13 nt, Salmonella typhimurium LT2
gcugcgcacggca

SEQ ID NO: 1816702 - RNA, 18 nt, Salmonella typhimurium LT2
gcugcguaacguaucggc

SEQ ID NO: 1816703 - RNA, 20 nt, Salmonella typhimurium LT2
gcugcguuugccgccuuguc

SEQ ID NO: 1816704 - RNA, 18 nt, Salmonella typhimurium LT2
ggacugauacagccaaau

SEQ ID NO: 1816705 - RNA, 17 nt, Salmonella typhimurium LT2
ggacgucaugccgccac

SEQ ID NO: 1816706 - RNA, 17 nt, Salmonella typhimurium LT2
ggacgguaccugaagcc

SEQ ID NO: 1816707 - RNA, 20 nt, Salmonella typhimurium LT2
ggacgggaucucgcacauca

SEQ ID NO: 1816708 - RNA, 14 nt, Salmonella typhimurium LT2
ggaauaucccgcaa

SEQ ID NO: 1816709 - RNA, 19 nt, Salmonella typhimurium LT2
ggacgcaagagcguccagu

SEQ ID NO: 1816710 - RNA, 22 nt, Salmonella typhimurium LT2
ggaauacguaauaccugaagcc

SEQ ID NO: 1816711 - RNA, 14 nt, Salmonella typhimurium LT2
ggaauaaacgguaa

SEQ ID NO: 1816712 - RNA, 15 nt, Salmonella typhimurium LT2
ggaagugauaauggu

SEQ ID NO: 1816713 - RNA, 20 nt, Salmonella typhimurium LT2
ggaagcgacgacacggcgca

SEQ ID NO: 1816714 - RNA, 24 nt, Salmonella typhimurium LT2
ggaaaucaauuccgguugcccauu

SEQ ID NO: 1816715 - RNA, 13 nt, Salmonella typhimurium LT2
ggaacagacgccu

SEQ ID NO: 1816716 - RNA, 20 nt, Salmonella typhimurium LT2
ggaacaucagccagcagcuc

SEQ ID NO: 1816717 - RNA, 12 nt, Salmonella typhimurium LT2
ggaacaucagca

SEQ ID NO: 1816718 - RNA, 18 nt, Salmonella typhimurium LT2
gcuuucgccaccagcgau

SEQ ID NO: 1816719 - RNA, 23 nt, Salmonella typhimurium LT2
gcuuuacgaccgcagaaacagau

SEQ ID NO: 1816720 - RNA, 13 nt, Salmonella typhimurium LT2
gcuuuaagcgcug

SEQ ID NO: 1816721 - RNA, 18 nt, Salmonella typhimurium LT2
gcuucuucaacguuuuca

SEQ ID NO: 1816722 - RNA, 14 nt, Salmonella typhimurium LT2
ggaaagggacgaug

SEQ ID NO: 1816723 - RNA, 14 nt, Salmonella typhimurium LT2
ggaaacgcugcgcc

SEQ ID NO: 1816724 - RNA, 16 nt, Salmonella typhimurium LT2
ggaaacuccagcggca

SEQ ID NO: 1816725 - RNA, 12 nt, Salmonella typhimurium LT2
ggaaaaucuggu

SEQ ID NO: 1816726 - RNA, 18 nt, Salmonella typhimurium LT2
gcuuugcuuauccggccu

SEQ ID NO: 1816727 - RNA, 22 nt, Salmonella typhimurium LT2
gcuuugcguaaugugauccgcc

SEQ ID NO: 1816728 - RNA, 18 nt, Salmonella typhimurium LT2
gcuuuggcaaacggcgcc

SEQ ID NO: 1816729 - RNA, 20 nt, Salmonella typhimurium LT2
gcuuugggaacuagcgaauc

SEQ ID NO: 1816730 - RNA, 13 nt, Salmonella typhimurium LT2
ggaaaauagcgca

SEQ ID NO: 1816731 - RNA, 16 nt, Salmonella typhimurium LT2
gcuguuccagccgcca

SEQ ID NO: 1816732 - RNA, 14 nt, Salmonella typhimurium LT2
gcuguuaaaaccgg

SEQ ID NO: 1816733 - RNA, 15 nt, Salmonella typhimurium LT2
gcuguuaaaaccggc

SEQ ID NO: 1816734 - RNA, 21 nt, Salmonella typhimurium LT2
gcuguuaauuugcaucaggcc

SEQ ID NO: 1816735 - RNA, 20 nt, Salmonella typhimurium LT2
gcuguuaguaaacagcauca

SEQ ID NO: 1816736 - RNA, 15 nt, Salmonella typhimurium LT2
gcuguaaaccggccc

SEQ ID NO: 1816737 - RNA, 16 nt, Salmonella typhimurium LT2
gcuggucagcgcgcca

SEQ ID NO: 1816738 - RNA, 19 nt, Salmonella typhimurium LT2
gcuggucagcguaccagcg

SEQ ID NO: 1816739 - RNA, 13 nt, Salmonella typhimurium LT2
gcugguuccccgu

SEQ ID NO: 1816740 - RNA, 21 nt, Salmonella typhimurium LT2
gcugcugcgcuuuccaggcca

SEQ ID NO: 1816741 - RNA, 14 nt, Salmonella typhimurium LT2
gcuggguucaucca

SEQ ID NO: 1816742 - RNA, 15 nt, Salmonella typhimurium LT2
gcuggucagcgcaau

SEQ ID NO: 1816743 - RNA, 23 nt, Salmonella typhimurium LT2
gcuggucagcaacgccuccagcg

SEQ ID NO: 1816744 - RNA, 14 nt, Salmonella typhimurium LT2
gcuuaccagaccgg

SEQ ID NO: 1816745 - RNA, 14 nt, Salmonella typhimurium LT2
gcuuaccaggccua

SEQ ID NO: 1816746 - RNA, 19 nt, Salmonella typhimurium LT2
gcuuaccaggccuacacgu

SEQ ID NO: 1816747 - RNA, 21 nt, Salmonella typhimurium LT2
gcuuacagagcaguuacguuu

SEQ ID NO: 1816748 - RNA, 20 nt, Salmonella typhimurium LT2
gcuuacucagccagauaccg

SEQ ID NO: 1816749 - RNA, 17 nt, Salmonella typhimurium LT2
gcuuaaucuugagucgg

SEQ ID NO: 1816750 - RNA, 19 nt, Salmonella typhimurium LT2
gcuuaacggcccaggcauc

SEQ ID NO: 1816751 - RNA, 21 nt, Salmonella typhimurium LT2
gcuguuuugcuucuucagccu

SEQ ID NO: 1816752 - RNA, 16 nt, Salmonella typhimurium LT2
gcuguuuuucaucauc

SEQ ID NO: 1816753 - RNA, 14 nt, Salmonella typhimurium LT2
gcuuaucaggccua

SEQ ID NO: 1816754 - RNA, 21 nt, Salmonella typhimurium LT2
gcuuagggucagugauaacgc

SEQ ID NO: 1816755 - RNA, 20 nt, Salmonella typhimurium LT2
gcuuaucuggccuacagcau

SEQ ID NO: 1816756 - RNA, 15 nt, Salmonella typhimurium LT2
gcuuaugaagcgcgu

SEQ ID NO: 1816757 - RNA, 18 nt, Salmonella typhimurium LT2
gcuuauucagucuggcaa

SEQ ID NO: 1816758 - RNA, 17 nt, Salmonella typhimurium LT2
gcuuauccggccuacag

SEQ ID NO: 1816759 - RNA, 16 nt, Salmonella typhimurium LT2
gcuucaaaaagcgcgc

SEQ ID NO: 1816760 - RNA, 23 nt, Salmonella typhimurium LT2
gcuucaaaaagcgcgcggcugcg

SEQ ID NO: 1816761 - RNA, 13 nt, Salmonella typhimurium LT2
gcuuccagcgccg

SEQ ID NO: 1816762 - RNA, 19 nt, Salmonella typhimurium LT2
gcuucaugugccgcgacaa

SEQ ID NO: 1816763 - RNA, 15 nt, Salmonella typhimurium LT2
gcuuccacugcaucu

SEQ ID NO: 1816764 - RNA, 21 nt, Salmonella typhimurium LT2
gcuucaguaaaucccgcauca

SEQ ID NO: 1816765 - RNA, 18 nt, Salmonella typhimurium LT2
gcuucggcuccagcgccu

SEQ ID NO: 1816766 - RNA, 16 nt, Salmonella typhimurium LT2
gcuucguucuguauca

SEQ ID NO: 1816767 - RNA, 13 nt, Salmonella typhimurium LT2
gcuucuauccacu

SEQ ID NO: 1816768 - RNA, 13 nt, Salmonella typhimurium LT2
gcuuccgccuucu

SEQ ID NO: 1816769 - RNA, 23 nt, Salmonella typhimurium LT2
gcuuccguuuuguugccgcccgu

SEQ ID NO: 1816770 - RNA, 11 nt, Salmonella typhimurium LT2
gcuuccggcag

SEQ ID NO: 1816771 - RNA, 23 nt, Salmonella typhimurium LT2
uggucucucgugcaggccggaua

SEQ ID NO: 1816772 - RNA, 15 nt, Salmonella typhimurium LT2
uggugacaucgccgg

SEQ ID NO: 1816773 - RNA, 21 nt, Salmonella typhimurium LT2
uggugaacauggcgcggcgua

SEQ ID NO: 1816774 - RNA, 15 nt, Salmonella typhimurium LT2
ugguauugcgaaacg

SEQ ID NO: 1816775 - RNA, 15 nt, Salmonella typhimurium LT2
uggugcguccgguag

SEQ ID NO: 1816776 - RNA, 14 nt, Salmonella typhimurium LT2
uggugcucaaucag

SEQ ID NO: 1816777 - RNA, 13 nt, Salmonella typhimurium LT2
uggugcuuagcug

SEQ ID NO: 1816778 - RNA, 19 nt, Salmonella typhimurium LT2
ugguuucccugaccaguug

SEQ ID NO: 1816779 - RNA, 21 nt, Salmonella typhimurium LT2
ugguuucccugccucaacauc

SEQ ID NO: 1816780 - RNA, 21 nt, Salmonella typhimurium LT2
uguaauguuuucugccagcag

SEQ ID NO: 1816781 - RNA, 12 nt, Salmonella typhimurium LT2
uguaaucgccgu

SEQ ID NO: 1816782 - RNA, 19 nt, Salmonella typhimurium LT2
uguagcgcuuuuuccagcg

SEQ ID NO: 1816783 - RNA, 16 nt, Salmonella typhimurium LT2
uguaggcacuuuccag

SEQ ID NO: 1816784 - RNA, 20 nt, Salmonella typhimurium LT2
uguaggcccgguaagcgcag

SEQ ID NO: 1816785 - RNA, 20 nt, Salmonella typhimurium LT2
uguagagcggauaagcgcag

SEQ ID NO: 1816786 - RNA, 17 nt, Salmonella typhimurium LT2
uguagcgagccaucggc

SEQ ID NO: 1816787 - RNA, 11 nt, Salmonella typhimurium LT2
aaucacgcaga

SEQ ID NO: 1816788 - RNA, 20 nt, Salmonella typhimurium LT2
uguaggccugguaagcguag

SEQ ID NO: 1816789 - RNA, 21 nt, Salmonella typhimurium LT2
uguaggucagguaagcgcuag

SEQ ID NO: 1816790 - RNA, 18 nt, Salmonella typhimurium LT2
uguaggccggauaagcaa

SEQ ID NO: 1816791 - RNA, 20 nt, Salmonella typhimurium LT2
uguaggccggauaagcauua

SEQ ID NO: 1816792 - RNA, 21 nt, Salmonella typhimurium LT2
uguaggccggauaagcgucag

SEQ ID NO: 1816793 - RNA, 20 nt, Salmonella typhimurium LT2
uguaggccggauaagcguua

SEQ ID NO: 1816794 - RNA, 21 nt, Salmonella typhimurium LT2
uguaggccggauaagcguuag

SEQ ID NO: 1816795 - RNA, 20 nt, Salmonella typhimurium LT2
uguaggccggauaaggcagc

SEQ ID NO: 1816796 - RNA, 19 nt, Salmonella typhimurium LT2
aaucaccuuaucguuaccg

SEQ ID NO: 1816797 - RNA, 21 nt, Salmonella typhimurium LT2
aauauuguuuaacguuucaug

SEQ ID NO: 1816798 - RNA, 15 nt, Salmonella typhimurium LT2
aauaugcgucagcgc

SEQ ID NO: 1816799 - RNA, 17 nt, Salmonella typhimurium LT2
aauauggcacagcacua

SEQ ID NO: 1816800 - RNA, 15 nt, Salmonella typhimurium LT2
aauaucuauaucgcu

SEQ ID NO: 1816801 - RNA, 15 nt, Salmonella typhimurium LT2
uggcuaacgggcuga

SEQ ID NO: 1816802 - RNA, 16 nt, Salmonella typhimurium LT2
aauaugcaacaugucg

SEQ ID NO: 1816803 - RNA, 15 nt, Salmonella typhimurium LT2
ugggcugaccaugcg

SEQ ID NO: 1816804 - RNA, 19 nt, Salmonella typhimurium LT2
uggggccgauaccggcaac

SEQ ID NO: 1816805 - RNA, 19 nt, Salmonella typhimurium LT2
ugggguugcccggcgccau

SEQ ID NO: 1816806 - RNA, 13 nt, Salmonella typhimurium LT2
uggcguccggaug

SEQ ID NO: 1816807 - RNA, 23 nt, Salmonella typhimurium LT2
uggcgguauaacugccuuauccg

SEQ ID NO: 1816808 - RNA, 15 nt, Salmonella typhimurium LT2
uggcggucaacgcgg

SEQ ID NO: 1816809 - RNA, 14 nt, Salmonella typhimurium LT2
uggcgguacagcga

SEQ ID NO: 1816810 - RNA, 17 nt, Salmonella typhimurium LT2
uggcgucagaccggcaa

SEQ ID NO: 1816811 - RNA, 16 nt, Salmonella typhimurium LT2
uggcggcuucgccauc

SEQ ID NO: 1816812 - RNA, 20 nt, Salmonella typhimurium LT2
uggcggcuaccucuuauccg

SEQ ID NO: 1816813 - RNA, 22 nt, Salmonella typhimurium LT2
uggcggcuaccucuuauccggc

SEQ ID NO: 1816814 - RNA, 23 nt, Salmonella typhimurium LT2
uggcggcgugaacgucuuauccg

SEQ ID NO: 1816815 - RNA, 23 nt, Salmonella typhimurium LT2
uggcggcggaaaggacuuaucag

SEQ ID NO: 1816816 - RNA, 14 nt, Salmonella typhimurium LT2
uggcggcugaugcc

SEQ ID NO: 1816817 - RNA, 18 nt, Salmonella typhimurium LT2
uggcgguaaauacgcggc

SEQ ID NO: 1816818 - RNA, 20 nt, Salmonella typhimurium LT2
uggcgcuuuaagugcaucgc

SEQ ID NO: 1816819 - RNA, 17 nt, Salmonella typhimurium LT2
uggcgcuucgcuuaucg

SEQ ID NO: 1816820 - RNA, 23 nt, Salmonella typhimurium LT2
uggcggcgcgaacgccuuauccg

SEQ ID NO: 1816821 - RNA, 19 nt, Salmonella typhimurium LT2
uggcgcuggcgcuuaccgg

SEQ ID NO: 1816822 - RNA, 18 nt, Salmonella typhimurium LT2
uggcgcugcgcuuaucag

SEQ ID NO: 1816823 - RNA, 18 nt, Salmonella typhimurium LT2
uggcgcgucaaucagcgu

SEQ ID NO: 1816824 - RNA, 18 nt, Salmonella typhimurium LT2
uggcgcuacgcuuauccg

SEQ ID NO: 1816825 - RNA, 18 nt, Salmonella typhimurium LT2
uggcgcuacgcuuaucag

SEQ ID NO: 1816826 - RNA, 21 nt, Salmonella typhimurium LT2
uggcgccuuuuggcagcagcg

SEQ ID NO: 1816827 - RNA, 21 nt, Salmonella typhimurium LT2
uggcgcgacgcuuaucagccc

SEQ ID NO: 1816828 - RNA, 19 nt, Salmonella typhimurium LT2
uggcgaacgacucacgcgc

SEQ ID NO: 1816829 - RNA, 12 nt, Salmonella typhimurium LT2
uggcgacagacg

SEQ ID NO: 1816830 - RNA, 23 nt, Salmonella typhimurium LT2
uggcgacagacgcuuaucgccgu

SEQ ID NO: 1816831 - RNA, 14 nt, Salmonella typhimurium LT2
uggcgacaaucaau

SEQ ID NO: 1816832 - RNA, 22 nt, Salmonella typhimurium LT2
uggcgaauccuaaacucaacug

SEQ ID NO: 1816833 - RNA, 22 nt, Salmonella typhimurium LT2
uggcgaauacuguuccaggcga

SEQ ID NO: 1816834 - RNA, 23 nt, Salmonella typhimurium LT2
uggcgauauccgugccgccgcga

SEQ ID NO: 1816835 - RNA, 17 nt, Salmonella typhimurium LT2
uggcgauaauagaaccg

SEQ ID NO: 1816836 - RNA, 22 nt, Salmonella typhimurium LT2
uggcgauaauagaaccgaacaa

SEQ ID NO: 1816837 - RNA, 14 nt, Salmonella typhimurium LT2
uggcgaucagcggc

SEQ ID NO: 1816838 - RNA, 18 nt, Salmonella typhimurium LT2
uggcccaggcccggguaa

SEQ ID NO: 1816839 - RNA, 14 nt, Salmonella typhimurium LT2
uggccgaugcgccc

SEQ ID NO: 1816840 - RNA, 14 nt, Salmonella typhimurium LT2
uggccaucuuccag

SEQ ID NO: 1816841 - RNA, 17 nt, Salmonella typhimurium LT2
uggccaguuucaaugcc

SEQ ID NO: 1816842 - RNA, 17 nt, Salmonella typhimurium LT2
uggccagcaugcccgcc

SEQ ID NO: 1816843 - RNA, 15 nt, Salmonella typhimurium LT2
uggccacaucguuac

SEQ ID NO: 1816844 - RNA, 15 nt, Salmonella typhimurium LT2
uggacaauccgcgaa

SEQ ID NO: 1816845 - RNA, 13 nt, Salmonella typhimurium LT2
uggccaaccagau

SEQ ID NO: 1816846 - RNA, 15 nt, Salmonella typhimurium LT2
uggcauugugagcga

SEQ ID NO: 1816847 - RNA, 12 nt, Salmonella typhimurium LT2
aauagccagcgu

SEQ ID NO: 1816848 - RNA, 21 nt, Salmonella typhimurium LT2
ugccggccugauauccacguu

SEQ ID NO: 1816849 - RNA, 12 nt, Salmonella typhimurium LT2
ugccggcguucc

SEQ ID NO: 1816850 - RNA, 22 nt, Salmonella typhimurium LT2
ugccggaaagacggcagcgcca

SEQ ID NO: 1816851 - RNA, 19 nt, Salmonella typhimurium LT2
ugccggauggcggcgucgc

SEQ ID NO: 1816852 - RNA, 16 nt, Salmonella typhimurium LT2
ugccgcugucgccaga

SEQ ID NO: 1816853 - RNA, 13 nt, Salmonella typhimurium LT2
ugcgaaaagccgg

SEQ ID NO: 1816854 - RNA, 15 nt, Salmonella typhimurium LT2
ugccuuuggccugga

SEQ ID NO: 1816855 - RNA, 14 nt, Salmonella typhimurium LT2
ugccuuuacuguug

SEQ ID NO: 1816856 - RNA, 15 nt, Salmonella typhimurium LT2
ugcgaagaccgcauc

SEQ ID NO: 1816857 - RNA, 22 nt, Salmonella typhimurium LT2
ugcgaacagcgcuccacgcguc

SEQ ID NO: 1816858 - RNA, 17 nt, Salmonella typhimurium LT2
ugcgaacauuucagcgc

SEQ ID NO: 1816859 - RNA, 21 nt, Salmonella typhimurium LT2
ugccuguucgugcguugucag

SEQ ID NO: 1816860 - RNA, 18 nt, Salmonella typhimurium LT2
ugccuucacccagacugu

SEQ ID NO: 1816861 - RNA, 21 nt, Salmonella typhimurium LT2
aauagcgccacgcgaugcaac

SEQ ID NO: 1816862 - RNA, 18 nt, Salmonella typhimurium LT2
ugccugugcgaagcgccc

SEQ ID NO: 1816863 - RNA, 22 nt, Salmonella typhimurium LT2
ugcgcaacguuucuuucaucag

SEQ ID NO: 1816864 - RNA, 20 nt, Salmonella typhimurium LT2
ugcgaucgggauuccaguga

SEQ ID NO: 1816865 - RNA, 18 nt, Salmonella typhimurium LT2
ugcgacuuugcgccggca

SEQ ID NO: 1816866 - RNA, 14 nt, Salmonella typhimurium LT2
ugcgccaagcgccu

SEQ ID NO: 1816867 - RNA, 13 nt, Salmonella typhimurium LT2
ugcgccagcgccg

SEQ ID NO: 1816868 - RNA, 15 nt, Salmonella typhimurium LT2
ugcgccagccagcuc

SEQ ID NO: 1816869 - RNA, 12 nt, Salmonella typhimurium LT2
ugcgccagcgca

SEQ ID NO: 1816870 - RNA, 20 nt, Salmonella typhimurium LT2
ugcgccagcgcauuaccgcc

SEQ ID NO: 1816871 - RNA, 15 nt, Salmonella typhimurium LT2
ugcgccagcagcggc

SEQ ID NO: 1816872 - RNA, 13 nt, Salmonella typhimurium LT2
ugcgcccgguaau

SEQ ID NO: 1816873 - RNA, 16 nt, Salmonella typhimurium LT2
ugcgccgcaaacucag

SEQ ID NO: 1816874 - RNA, 19 nt, Salmonella typhimurium LT2
ugcgccccggcggcguaca

SEQ ID NO: 1816875 - RNA, 15 nt, Salmonella typhimurium LT2
ugcgccauuuccagc

SEQ ID NO: 1816876 - RNA, 17 nt, Salmonella typhimurium LT2
ugcgccaguucagcguc

SEQ ID NO: 1816877 - RNA, 19 nt, Salmonella typhimurium LT2
ugcgucgccccaaucgcca

SEQ ID NO: 1816878 - RNA, 21 nt, Salmonella typhimurium LT2
ugcggucuucaacaccgacau

SEQ ID NO: 1816879 - RNA, 13 nt, Salmonella typhimurium LT2
ugcgggcuccgga

SEQ ID NO: 1816880 - RNA, 18 nt, Salmonella typhimurium LT2
ugcgguauaucacgccau

SEQ ID NO: 1816881 - RNA, 17 nt, Salmonella typhimurium LT2
ugcgguaauaugccagc

SEQ ID NO: 1816882 - RNA, 19 nt, Salmonella typhimurium LT2
ugcgguaauaugccagcuc

SEQ ID NO: 1816883 - RNA, 15 nt, Salmonella typhimurium LT2
ugcgcuuccagcaug

SEQ ID NO: 1816884 - RNA, 20 nt, Salmonella typhimurium LT2
ugcgcuuaucaggccuacgg

SEQ ID NO: 1816885 - RNA, 20 nt, Salmonella typhimurium LT2
ugcgcuuaucaggccuacgu

SEQ ID NO: 1816886 - RNA, 19 nt, Salmonella typhimurium LT2
ugcgcuuaucaggccugua

SEQ ID NO: 1816887 - RNA, 21 nt, Salmonella typhimurium LT2
ugcgcuuaucgggcagacugu

SEQ ID NO: 1816888 - RNA, 18 nt, Salmonella typhimurium LT2
ugcgcuucgaugcguuca

SEQ ID NO: 1816889 - RNA, 14 nt, Salmonella typhimurium LT2
ugcgccucaagcgc

SEQ ID NO: 1816890 - RNA, 15 nt, Salmonella typhimurium LT2
ugcgccuaccgccau

SEQ ID NO: 1816891 - RNA, 21 nt, Salmonella typhimurium LT2
ugcgccguaaggcgugccgcc

SEQ ID NO: 1816892 - RNA, 15 nt, Salmonella typhimurium LT2
ugcggauguuaauga

SEQ ID NO: 1816893 - RNA, 21 nt, Salmonella typhimurium LT2
ugcggaucuucaccacgccau

SEQ ID NO: 1816894 - RNA, 15 nt, Salmonella typhimurium LT2
ugcgcuuucagcgca

SEQ ID NO: 1816895 - RNA, 21 nt, Salmonella typhimurium LT2
ugcggauuuuucgccaguaag

SEQ ID NO: 1816896 - RNA, 13 nt, Salmonella typhimurium LT2
ugcggcguacugc

SEQ ID NO: 1816897 - RNA, 12 nt, Salmonella typhimurium LT2
ugcggcuuaucg

SEQ ID NO: 1816898 - RNA, 16 nt, Salmonella typhimurium LT2
ugcggcuucagcgaca

SEQ ID NO: 1816899 - RNA, 22 nt, Salmonella typhimurium LT2
ugcggcuugaguuuuccgccau

SEQ ID NO: 1816900 - RNA, 21 nt, Salmonella typhimurium LT2
ugcuuaauccccgauaucgcu

SEQ ID NO: 1816901 - RNA, 14 nt, Salmonella typhimurium LT2
ugcuguuaccggac

SEQ ID NO: 1816902 - RNA, 22 nt, Salmonella typhimurium LT2
ugcuucaugcacaaaacccgca

SEQ ID NO: 1816903 - RNA, 12 nt, Salmonella typhimurium LT2
ugcuuccagcuc

SEQ ID NO: 1816904 - RNA, 14 nt, Salmonella typhimurium LT2
ugcuuccagcucca

SEQ ID NO: 1816905 - RNA, 14 nt, Salmonella typhimurium LT2
ugcuucaugcacaa

SEQ ID NO: 1816906 - RNA, 12 nt, Salmonella typhimurium LT2
ugcuuccgccuu

SEQ ID NO: 1816907 - RNA, 13 nt, Salmonella typhimurium LT2
ugcuuucgccagc

SEQ ID NO: 1816908 - RNA, 14 nt, Salmonella typhimurium LT2
uggaaaagcgacau

SEQ ID NO: 1816909 - RNA, 15 nt, Salmonella typhimurium LT2
uggaaaaaagcgccc

SEQ ID NO: 1816910 - RNA, 20 nt, Salmonella typhimurium LT2
uggaaaaauuccgcagagcu

SEQ ID NO: 1816911 - RNA, 19 nt, Salmonella typhimurium LT2
uggaacaggccaaacccug

SEQ ID NO: 1816912 - RNA, 18 nt, Salmonella typhimurium LT2
uggaaagggaaugcgccg

SEQ ID NO: 1816913 - RNA, 13 nt, Salmonella typhimurium LT2
ugcuccgccagag

SEQ ID NO: 1816914 - RNA, 14 nt, Salmonella typhimurium LT2
ugcuccgccagcaa

SEQ ID NO: 1816915 - RNA, 20 nt, Salmonella typhimurium LT2
ugcucauccaacugcgccug

SEQ ID NO: 1816916 - RNA, 19 nt, Salmonella typhimurium LT2
aauauaccgucagcaccag

SEQ ID NO: 1816917 - RNA, 15 nt, Salmonella typhimurium LT2
aauauauucucugug

SEQ ID NO: 1816918 - RNA, 19 nt, Salmonella typhimurium LT2
ugcugaucuggcugcguaa

SEQ ID NO: 1816919 - RNA, 16 nt, Salmonella typhimurium LT2
ugcugacucgcgcaau

SEQ ID NO: 1816920 - RNA, 16 nt, Salmonella typhimurium LT2
ugucuaacuuaccagu

SEQ ID NO: 1816921 - RNA, 16 nt, Salmonella typhimurium LT2
ugucuccgucacuucc

SEQ ID NO: 1816922 - RNA, 15 nt, Salmonella typhimurium LT2
ugucuucugccagca

SEQ ID NO: 1816923 - RNA, 14 nt, Salmonella typhimurium LT2
ugugaugccguuag

SEQ ID NO: 1816924 - RNA, 22 nt, Salmonella typhimurium LT2
ugugacguuaacgcagcaucgc

SEQ ID NO: 1816925 - RNA, 18 nt, Salmonella typhimurium LT2
ugucagaauuuccccagu

SEQ ID NO: 1816926 - RNA, 19 nt, Salmonella typhimurium LT2
ugucagaauuuccccaguu

SEQ ID NO: 1816927 - RNA, 17 nt, Salmonella typhimurium LT2
ugucggcucauccagca

SEQ ID NO: 1816928 - RNA, 14 nt, Salmonella typhimurium LT2
ugucaauccggcga

SEQ ID NO: 1816929 - RNA, 15 nt, Salmonella typhimurium LT2
ugucacaaacggcac

SEQ ID NO: 1816930 - RNA, 13 nt, Salmonella typhimurium LT2
ugucaaagcgcca

SEQ ID NO: 1816931 - RNA, 18 nt, Salmonella typhimurium LT2
ugucggucugauaagcgc

SEQ ID NO: 1816932 - RNA, 16 nt, Salmonella typhimurium LT2
ugugccgccggguuua

SEQ ID NO: 1816933 - RNA, 13 nt, Salmonella typhimurium LT2
ugugccgcgacaa

SEQ ID NO: 1816934 - RNA, 23 nt, Salmonella typhimurium LT2
ugugccgcggcuucaucaccauc

SEQ ID NO: 1816935 - RNA, 18 nt, Salmonella typhimurium LT2
ugugcgccagccuuaucc

SEQ ID NO: 1816936 - RNA, 15 nt, Salmonella typhimurium LT2
uguggacccgcuuaa

SEQ ID NO: 1816937 - RNA, 20 nt, Salmonella typhimurium LT2
uguuaauggccgcucgccug

SEQ ID NO: 1816938 - RNA, 22 nt, Salmonella typhimurium LT2
uguucaaauacgguuagccagu

SEQ ID NO: 1816939 - RNA, 18 nt, Salmonella typhimurium LT2
uguucaauagagcgcagc

SEQ ID NO: 1816940 - RNA, 19 nt, Salmonella typhimurium LT2
uguucggcgcgauagcgau

SEQ ID NO: 1816941 - RNA, 18 nt, Salmonella typhimurium LT2
uuacgcgacgugcugugg

SEQ ID NO: 1816942 - RNA, 18 nt, Salmonella typhimurium LT2
uuacgaucgccaccgcau

SEQ ID NO: 1816943 - RNA, 18 nt, Salmonella typhimurium LT2
uuacccaccagccgcaua

SEQ ID NO: 1816944 - RNA, 17 nt, Salmonella typhimurium LT2
uuacgaguggcgaucag

SEQ ID NO: 1816945 - RNA, 16 nt, Salmonella typhimurium LT2
uuacgguuggccagca

SEQ ID NO: 1816946 - RNA, 21 nt, Salmonella typhimurium LT2
uuacguucggcaaaacgccgc

SEQ ID NO: 1816947 - RNA, 18 nt, Salmonella typhimurium LT2
uuagcgcucacuaccgcg

SEQ ID NO: 1816948 - RNA, 20 nt, Salmonella typhimurium LT2
uuagcgauuuaaugucgaca

SEQ ID NO: 1816949 - RNA, 16 nt, Salmonella typhimurium LT2
uuaguaccgucuggcu

SEQ ID NO: 1816950 - RNA, 20 nt, Salmonella typhimurium LT2
uuagggucagugauaacgcg

SEQ ID NO: 1816951 - RNA, 18 nt, Salmonella typhimurium LT2
uuaguguccuuacggacg

SEQ ID NO: 1816952 - RNA, 18 nt, Salmonella typhimurium LT2
uuaguguucuuacggacg

SEQ ID NO: 1816953 - RNA, 21 nt, Salmonella typhimurium LT2
uuagcuuguguaggccggaua

SEQ ID NO: 1816954 - RNA, 18 nt, Salmonella typhimurium LT2
uuagcuggcauaaccgca

SEQ ID NO: 1816955 - RNA, 19 nt, Salmonella typhimurium LT2
uuagcuggcauaaccgcag

SEQ ID NO: 1816956 - RNA, 10 nt, Salmonella typhimurium LT2
uuaggcagau

SEQ ID NO: 1816957 - RNA, 21 nt, Salmonella typhimurium LT2
uuaucaggcgacccauaacgg

SEQ ID NO: 1816958 - RNA, 15 nt, Salmonella typhimurium LT2
uuaucagauaacccg

SEQ ID NO: 1816959 - RNA, 12 nt, Salmonella typhimurium LT2
uuaucaggccua

SEQ ID NO: 1816960 - RNA, 14 nt, Salmonella typhimurium LT2
uuaucaggccugua

SEQ ID NO: 1816961 - RNA, 11 nt, Salmonella typhimurium LT2
uuauccagcag

SEQ ID NO: 1816962 - RNA, 18 nt, Salmonella typhimurium LT2
uuauccccacuaccgcca

SEQ ID NO: 1816963 - RNA, 19 nt, Salmonella typhimurium LT2
uuaucaauaaccgccagca

SEQ ID NO: 1816964 - RNA, 16 nt, Salmonella typhimurium LT2
uuaucaagagaaccgu

SEQ ID NO: 1816965 - RNA, 23 nt, Salmonella typhimurium LT2
uuaaugcgccccugcaggcgauc

SEQ ID NO: 1816966 - RNA, 22 nt, Salmonella typhimurium LT2
uuaaucgcuucaaucagcgugg

SEQ ID NO: 1816967 - RNA, 13 nt, Salmonella typhimurium LT2
uuaccaaucgcgg

SEQ ID NO: 1816968 - RNA, 17 nt, Salmonella typhimurium LT2
uuaccacaauaaucgcg

SEQ ID NO: 1816969 - RNA, 19 nt, Salmonella typhimurium LT2
uuacagcucauaaacgcga

SEQ ID NO: 1816970 - RNA, 22 nt, Salmonella typhimurium LT2
uuaauacaucagaaaacagcau

SEQ ID NO: 1816971 - RNA, 17 nt, Salmonella typhimurium LT2
uuaaccugauccaggaa

SEQ ID NO: 1816972 - RNA, 15 nt, Salmonella typhimurium LT2
uuaauauuuuaucac

SEQ ID NO: 1816973 - RNA, 17 nt, Salmonella typhimurium LT2
uuaauaugcgcaaucac

SEQ ID NO: 1816974 - RNA, 16 nt, Salmonella typhimurium LT2
uuaaauguuugcuuua

SEQ ID NO: 1816975 - RNA, 13 nt, Salmonella typhimurium LT2
uuaacacccggau

SEQ ID NO: 1816976 - RNA, 20 nt, Salmonella typhimurium LT2
uguucuguccggaagacagc

SEQ ID NO: 1816977 - RNA, 14 nt, Salmonella typhimurium LT2
uguugaccagguug

SEQ ID NO: 1816978 - RNA, 22 nt, Salmonella typhimurium LT2
uuaaacgccggauuccagaaua

SEQ ID NO: 1816979 - RNA, 13 nt, Salmonella typhimurium LT2
uuaaaugcgccca

SEQ ID NO: 1816980 - RNA, 14 nt, Salmonella typhimurium LT2
uucguucaaaucgc

SEQ ID NO: 1816981 - RNA, 22 nt, Salmonella typhimurium LT2
uucgucggcaaaacgcgccacg

SEQ ID NO: 1816982 - RNA, 19 nt, Salmonella typhimurium LT2
uucuccugcaucugcgcau

SEQ ID NO: 1816983 - RNA, 17 nt, Salmonella typhimurium LT2
uucucgcgcagccagua

SEQ ID NO: 1816984 - RNA, 23 nt, Salmonella typhimurium LT2
uucucgccggaaagaaacgccgc

SEQ ID NO: 1816985 - RNA, 19 nt, Salmonella typhimurium LT2
uucuccugggauaccggaa

SEQ ID NO: 1816986 - RNA, 19 nt, Salmonella typhimurium LT2
uucugccccccgacuucac

SEQ ID NO: 1816987 - RNA, 18 nt, Salmonella typhimurium LT2
aaucagccacggcaacgc

SEQ ID NO: 1816988 - RNA, 11 nt, Salmonella typhimurium LT2
aaucagcaauc

SEQ ID NO: 1816989 - RNA, 20 nt, Salmonella typhimurium LT2
aaucacguuuugcagcgcca

SEQ ID NO: 1816990 - RNA, 15 nt, Salmonella typhimurium LT2
aaucacgccgaugac

SEQ ID NO: 1816991 - RNA, 23 nt, Salmonella typhimurium LT2
uucgcgcgucaacggcgcggcgu

SEQ ID NO: 1816992 - RNA, 18 nt, Salmonella typhimurium LT2
uucggcagauuaccggca

SEQ ID NO: 1816993 - RNA, 19 nt, Salmonella typhimurium LT2
uucggauuauuggucagca

SEQ ID NO: 1816994 - RNA, 20 nt, Salmonella typhimurium LT2
uucgcuugcccggccguuac

SEQ ID NO: 1816995 - RNA, 23 nt, Salmonella typhimurium LT2
uucgcuugcccggccguuaccgu

SEQ ID NO: 1816996 - RNA, 22 nt, Salmonella typhimurium LT2
uuccgcuaucucuuccagcguc

SEQ ID NO: 1816997 - RNA, 16 nt, Salmonella typhimurium LT2
uuccuuacuguagcgc

SEQ ID NO: 1816998 - RNA, 19 nt, Salmonella typhimurium LT2
uucgaaacguucgcauccc

SEQ ID NO: 1816999 - RNA, 15 nt, Salmonella typhimurium LT2
uucgcccacggcaug

SEQ ID NO: 1817000 - RNA, 21 nt, Salmonella typhimurium LT2
uucgccagcgcgacaauagcc

SEQ ID NO: 1817001 - RNA, 17 nt, Salmonella typhimurium LT2
uucgaaucagcugcugc

SEQ ID NO: 1817002 - RNA, 14 nt, Salmonella typhimurium LT2
uuccgccaccacgc

SEQ ID NO: 1817003 - RNA, 22 nt, Salmonella typhimurium LT2
uuccgcaaacgccgugaacgcc

SEQ ID NO: 1817004 - RNA, 21 nt, Salmonella typhimurium LT2
uuccgacaauaaaaaugccgc

SEQ ID NO: 1817005 - RNA, 18 nt, Salmonella typhimurium LT2
uuccaguagucgcgccau

SEQ ID NO: 1817006 - RNA, 17 nt, Salmonella typhimurium LT2
uucauucaacaucgccc

SEQ ID NO: 1817007 - RNA, 22 nt, Salmonella typhimurium LT2
uucauucggcagauuaccggca

SEQ ID NO: 1817008 - RNA, 16 nt, Salmonella typhimurium LT2
uucaugcgacugccca

SEQ ID NO: 1817009 - RNA, 20 nt, Salmonella typhimurium LT2
uucauugucuuuuucucaau

SEQ ID NO: 1817010 - RNA, 17 nt, Salmonella typhimurium LT2
uucauuucuuccagcac

SEQ ID NO: 1817011 - RNA, 20 nt, Salmonella typhimurium LT2
uuccagagcgaacggauaaa

SEQ ID NO: 1817012 - RNA, 11 nt, Salmonella typhimurium LT2
uuccagcgcca

SEQ ID NO: 1817013 - RNA, 17 nt, Salmonella typhimurium LT2
uuccacucuucgggaau

SEQ ID NO: 1817014 - RNA, 16 nt, Salmonella typhimurium LT2
uucacuggcaugcgcc

SEQ ID NO: 1817015 - RNA, 22 nt, Salmonella typhimurium LT2
uucaggacgagagacugauaau

SEQ ID NO: 1817016 - RNA, 19 nt, Salmonella typhimurium LT2
uucagcucuuuuagcgccc

SEQ ID NO: 1817017 - RNA, 20 nt, Salmonella typhimurium LT2
uucagcucuuuuagcgcccg

SEQ ID NO: 1817018 - RNA, 12 nt, Salmonella typhimurium LT2
uucacgcugcag

SEQ ID NO: 1817019 - RNA, 14 nt, Salmonella typhimurium LT2
uucacgaucgaacg

SEQ ID NO: 1817020 - RNA, 21 nt, Salmonella typhimurium LT2
uuauccgccagcgcaacgcgc

SEQ ID NO: 1817021 - RNA, 23 nt, Salmonella typhimurium LT2
uuauccgccagcgcaacgcgcau

SEQ ID NO: 1817022 - RNA, 16 nt, Salmonella typhimurium LT2
uucaccuuacccggcg

SEQ ID NO: 1817023 - RNA, 21 nt, Salmonella typhimurium LT2
uucaccuuacccggcguauug

SEQ ID NO: 1817024 - RNA, 18 nt, Salmonella typhimurium LT2
uucaugaaucaucacaau

SEQ ID NO: 1817025 - RNA, 20 nt, Salmonella typhimurium LT2
uucauccaugccaagcggca

SEQ ID NO: 1817026 - RNA, 14 nt, Salmonella typhimurium LT2
uucaucgccgcgac

SEQ ID NO: 1817027 - RNA, 14 nt, Salmonella typhimurium LT2
uucaggggucccca

SEQ ID NO: 1817028 - RNA, 23 nt, Salmonella typhimurium LT2
uucaucaaagaaauacccuucac

SEQ ID NO: 1817029 - RNA, 20 nt, Salmonella typhimurium LT2
uucauauucaaaauccgcca

SEQ ID NO: 1817030 - RNA, 18 nt, Salmonella typhimurium LT2
uuugcugcuguuaccgga

SEQ ID NO: 1817031 - RNA, 19 nt, Salmonella typhimurium LT2
uuugcuuuguaaagcgcca

SEQ ID NO: 1817032 - RNA, 21 nt, Salmonella typhimurium LT2
uuuggcggcaagaucauccgg

SEQ ID NO: 1817033 - RNA, 23 nt, Salmonella typhimurium LT2
uuugcugcaacgacgcgggaucg

SEQ ID NO: 1817034 - RNA, 22 nt, Salmonella typhimurium LT2
uuuguauuaacggcgcugcgcu

SEQ ID NO: 1817035 - RNA, 18 nt, Salmonella typhimurium LT2
uuugguuccuucagcuuc

SEQ ID NO: 1817036 - RNA, 14 nt, Salmonella typhimurium LT2
uuugaaaucgaaca

SEQ ID NO: 1817037 - RNA, 11 nt, Salmonella typhimurium LT2
uuugaauuuga

SEQ ID NO: 1817038 - RNA, 13 nt, Salmonella typhimurium LT2
uuugcaucacgcg

SEQ ID NO: 1817039 - RNA, 14 nt, Salmonella typhimurium LT2
uuugaucagcacgc

SEQ ID NO: 1817040 - RNA, 15 nt, Salmonella typhimurium LT2
uuugcccagcgcugg

SEQ ID NO: 1817041 - RNA, 21 nt, Salmonella typhimurium LT2
uuugccuuuugacagcacaua

SEQ ID NO: 1817042 - RNA, 15 nt, Salmonella typhimurium LT2
uuugcgauaagcgcg

SEQ ID NO: 1817043 - RNA, 16 nt, Salmonella typhimurium LT2
uuugccugaaacgugc

SEQ ID NO: 1817044 - RNA, 23 nt, Salmonella typhimurium LT2
uuugcccgagcgcuggcauuccc

SEQ ID NO: 1817045 - RNA, 16 nt, Salmonella typhimurium LT2
uuuccccugacgggaa

SEQ ID NO: 1817046 - RNA, 16 nt, Salmonella typhimurium LT2
uuuccgccauagaaca

SEQ ID NO: 1817047 - RNA, 12 nt, Salmonella typhimurium LT2
uuuccgaaucag

SEQ ID NO: 1817048 - RNA, 14 nt, Salmonella typhimurium LT2
uuuaccgucacgcg

SEQ ID NO: 1817049 - RNA, 16 nt, Salmonella typhimurium LT2
uuuccaguucaaucag

SEQ ID NO: 1817050 - RNA, 22 nt, Salmonella typhimurium LT2
uuuccaucaccauuaacgggcg

SEQ ID NO: 1817051 - RNA, 16 nt, Salmonella typhimurium LT2
uuuaaaaucagauuga

SEQ ID NO: 1817052 - RNA, 22 nt, Salmonella typhimurium LT2
uuucuggccccugagcaaucag

SEQ ID NO: 1817053 - RNA, 22 nt, Salmonella typhimurium LT2
uuucuugcgccagcgcgcguac

SEQ ID NO: 1817054 - RNA, 14 nt, Salmonella typhimurium LT2
uuucgcuaucgccc

SEQ ID NO: 1817055 - RNA, 14 nt, Salmonella typhimurium LT2
uuucggcgcgcugg

SEQ ID NO: 1817056 - RNA, 14 nt, Salmonella typhimurium LT2
uuucgguucgccgc

SEQ ID NO: 1817057 - RNA, 22 nt, Salmonella typhimurium LT2
aaugucagaucguaugcgccug

SEQ ID NO: 1817058 - RNA, 20 nt, Salmonella typhimurium LT2
aauggcgacgaucagcgcca

SEQ ID NO: 1817059 - RNA, 19 nt, Salmonella typhimurium LT2
aauggcggagaucuccaga

SEQ ID NO: 1817060 - RNA, 11 nt, Salmonella typhimurium LT2
aauggccuaca

SEQ ID NO: 1817061 - RNA, 15 nt, Salmonella typhimurium LT2
aauggcgccagguuu

SEQ ID NO: 1817062 - RNA, 14 nt, Salmonella typhimurium LT2
aauggcgugaauca

SEQ ID NO: 1817063 - RNA, 20 nt, Salmonella typhimurium LT2
aauggcgggaaaagguuccg

SEQ ID NO: 1817064 - RNA, 14 nt, Salmonella typhimurium LT2
aauggucagcgccg

SEQ ID NO: 1817065 - RNA, 16 nt, Salmonella typhimurium LT2
aaugcgccagcggcca

SEQ ID NO: 1817066 - RNA, 15 nt, Salmonella typhimurium LT2
aaugcgacagcggca

SEQ ID NO: 1817067 - RNA, 17 nt, Salmonella typhimurium LT2
aaugccguuaccguuca

SEQ ID NO: 1817068 - RNA, 21 nt, Salmonella typhimurium LT2
aaugccugacgccaccacgcc

SEQ ID NO: 1817069 - RNA, 14 nt, Salmonella typhimurium LT2
aaugcgaauccggc

SEQ ID NO: 1817070 - RNA, 19 nt, Salmonella typhimurium LT2
aaugcguccagaggaucug

SEQ ID NO: 1817071 - RNA, 15 nt, Salmonella typhimurium LT2
aaugcggcauccggc

SEQ ID NO: 1817072 - RNA, 21 nt, Salmonella typhimurium LT2
aaugauguagucaucaacgcg

SEQ ID NO: 1817073 - RNA, 14 nt, Salmonella typhimurium LT2
aaugauaaugccgc

SEQ ID NO: 1817074 - RNA, 17 nt, Salmonella typhimurium LT2
aaugaucacuuccgcca

SEQ ID NO: 1817075 - RNA, 16 nt, Salmonella typhimurium LT2
aaugacuguccacgac

SEQ ID NO: 1817076 - RNA, 18 nt, Salmonella typhimurium LT2
aaugaccuccaaagcgcu

SEQ ID NO: 1817077 - RNA, 17 nt, Salmonella typhimurium LT2
aaugagcgucgccagac

SEQ ID NO: 1817078 - RNA, 16 nt, Salmonella typhimurium LT2
aaugacuucaucgcca

SEQ ID NO: 1817079 - RNA, 15 nt, Salmonella typhimurium LT2
aaucggcaugcguuc

SEQ ID NO: 1817080 - RNA, 22 nt, Salmonella typhimurium LT2
aaucgcuuuuaucugggucagg

SEQ ID NO: 1817081 - RNA, 13 nt, Salmonella typhimurium LT2
aaucgcugcgcca

SEQ ID NO: 1817082 - RNA, 12 nt, Salmonella typhimurium LT2
aaucggcgugac

SEQ ID NO: 1817083 - RNA, 17 nt, Salmonella typhimurium LT2
aaucgcgaauaaaugag

SEQ ID NO: 1817084 - RNA, 21 nt, Salmonella typhimurium LT2
uuuuucacgaccagccaacag

SEQ ID NO: 1817085 - RNA, 19 nt, Salmonella typhimurium LT2
aaucgccuggcuugcuggc

SEQ ID NO: 1817086 - RNA, 17 nt, Salmonella typhimurium LT2
uuuuagcguuucaucgg

SEQ ID NO: 1817087 - RNA, 13 nt, Salmonella typhimurium LT2
uuuuuaaugucca

SEQ ID NO: 1817088 - RNA, 14 nt, Salmonella typhimurium LT2
aaucgguacgccaa

SEQ ID NO: 1817089 - RNA, 19 nt, Salmonella typhimurium LT2
aaucguauucauugccgua

SEQ ID NO: 1817090 - RNA, 21 nt, Salmonella typhimurium LT2
aaucgucgugccuuccgcaau

SEQ ID NO: 1817091 - RNA, 18 nt, Salmonella typhimurium LT2
aaugacgcgcgagaacug

SEQ ID NO: 1817092 - RNA, 15 nt, Salmonella typhimurium LT2
aaugaauagcggcag

SEQ ID NO: 1817093 - RNA, 13 nt, Salmonella typhimurium LT2
aaucuuugccgca

SEQ ID NO: 1817094 - RNA, 13 nt, Salmonella typhimurium LT2
uugaugaaccgcu

SEQ ID NO: 1817095 - RNA, 21 nt, Salmonella typhimurium LT2
uugaugaaccgagauacauuc

SEQ ID NO: 1817096 - RNA, 12 nt, Salmonella typhimurium LT2
uucuggcgcuga

SEQ ID NO: 1817097 - RNA, 16 nt, Salmonella typhimurium LT2
uucuggcguuacggaa

SEQ ID NO: 1817098 - RNA, 19 nt, Salmonella typhimurium LT2
uucuguuuguuuuuauuac

SEQ ID NO: 1817099 - RNA, 16 nt, Salmonella typhimurium LT2
uucuuaucuguggguc

SEQ ID NO: 1817100 - RNA, 13 nt, Salmonella typhimurium LT2
uucuuaauaccca

SEQ ID NO: 1817101 - RNA, 16 nt, Salmonella typhimurium LT2
aaucaggauauucgcc

SEQ ID NO: 1817102 - RNA, 16 nt, Salmonella typhimurium LT2
uugccaagaaacgcag

SEQ ID NO: 1817103 - RNA, 13 nt, Salmonella typhimurium LT2
aaucagggugcca

SEQ ID NO: 1817104 - RNA, 20 nt, Salmonella typhimurium LT2
aaucaguacgcgcgcggcgu

SEQ ID NO: 1817105 - RNA, 15 nt, Salmonella typhimurium LT2
uugcgccacggaugg

SEQ ID NO: 1817106 - RNA, 14 nt, Salmonella typhimurium LT2
uugccgucgccgga

SEQ ID NO: 1817107 - RNA, 19 nt, Salmonella typhimurium LT2
uugcgcaggguaucaucgc

SEQ ID NO: 1817108 - RNA, 14 nt, Salmonella typhimurium LT2
uugccauauugccg

SEQ ID NO: 1817109 - RNA, 15 nt, Salmonella typhimurium LT2
uugcccgaugcgccc

SEQ ID NO: 1817110 - RNA, 18 nt, Salmonella typhimurium LT2
uugcccuucgcgcgauaa

SEQ ID NO: 1817111 - RNA, 18 nt, Salmonella typhimurium LT2
uugccagaaacgcguagc

SEQ ID NO: 1817112 - RNA, 13 nt, Salmonella typhimurium LT2
aaucauaccagcg

SEQ ID NO: 1817113 - RNA, 13 nt, Salmonella typhimurium LT2
aaucaucaugucg

SEQ ID NO: 1817114 - RNA, 19 nt, Salmonella typhimurium LT2
uugucaucaguaugagcga

SEQ ID NO: 1817115 - RNA, 16 nt, Salmonella typhimurium LT2
uugucgaaauugccgc

SEQ ID NO: 1817116 - RNA, 22 nt, Salmonella typhimurium LT2
uuguccgcuggucagcgcgcca

SEQ ID NO: 1817117 - RNA, 24 nt, Salmonella typhimurium LT2
uugucuauaccguagaucgccagc

SEQ ID NO: 1817118 - RNA, 18 nt, Salmonella typhimurium LT2
uugucgugacaugcgcau

SEQ ID NO: 1817119 - RNA, 17 nt, Salmonella typhimurium LT2
uugucggccaggugccg

SEQ ID NO: 1817120 - RNA, 23 nt, Salmonella typhimurium LT2
uuggugauuaacagcgccaucag

SEQ ID NO: 1817121 - RNA, 14 nt, Salmonella typhimurium LT2
uugguugccgcaua

SEQ ID NO: 1817122 - RNA, 15 nt, Salmonella typhimurium LT2
aaucgauggugccga

SEQ ID NO: 1817123 - RNA, 16 nt, Salmonella typhimurium LT2
aaucccuggcgaauaa

SEQ ID NO: 1817124 - RNA, 16 nt, Salmonella typhimurium LT2
uugggcggucuuauca

SEQ ID NO: 1817125 - RNA, 13 nt, Salmonella typhimurium LT2
uuggggucgucac

SEQ ID NO: 1817126 - RNA, 20 nt, Salmonella typhimurium LT2
uuggcaucauaaaaggcauc

SEQ ID NO: 1817127 - RNA, 12 nt, Salmonella typhimurium LT2
aaucccguaccg

SEQ ID NO: 1817128 - RNA, 22 nt, Salmonella typhimurium LT2
aaucccgacgcgcgauaucagc

SEQ ID NO: 1817129 - RNA, 17 nt, Salmonella typhimurium LT2
aauccccgccgccauca

SEQ ID NO: 1817130 - RNA, 22 nt, Salmonella typhimurium LT2
uuggcaacccguaccuccagcg

SEQ ID NO: 1817131 - RNA, 12 nt, Salmonella typhimurium LT2
aauccagcgccg

SEQ ID NO: 1817132 - RNA, 22 nt, Salmonella typhimurium LT2
aauccaggccagauauugccga

SEQ ID NO: 1817133 - RNA, 17 nt, Salmonella typhimurium LT2
aauccacucggcgcugu

SEQ ID NO: 1817134 - RNA, 19 nt, Salmonella typhimurium LT2
acgcuuaucaggccuacca

SEQ ID NO: 1817135 - RNA, 19 nt, Salmonella typhimurium LT2
acgcuuaucagcccuacaa

SEQ ID NO: 1817136 - RNA, 18 nt, Salmonella typhimurium LT2
acgcuuaucaggccuaca

SEQ ID NO: 1817137 - RNA, 19 nt, Salmonella typhimurium LT2
acgcuuaucccagccgcga

SEQ ID NO: 1817138 - RNA, 22 nt, Salmonella typhimurium LT2
acggauaccguccaccagcaca

SEQ ID NO: 1817139 - RNA, 16 nt, Salmonella typhimurium LT2
acggauagcgucaacg

SEQ ID NO: 1817140 - RNA, 13 nt, Salmonella typhimurium LT2
acgcuuucugggg

SEQ ID NO: 1817141 - RNA, 23 nt, Salmonella typhimurium LT2
acgcuuugcgauagcccggcaug

SEQ ID NO: 1817142 - RNA, 19 nt, Salmonella typhimurium LT2
acgcuuuagugccgccauu

SEQ ID NO: 1817143 - RNA, 21 nt, Salmonella typhimurium LT2
acgcuuuccaguugcggcauc

SEQ ID NO: 1817144 - RNA, 14 nt, Salmonella typhimurium LT2
acgcuugagcaggc

SEQ ID NO: 1817145 - RNA, 16 nt, Salmonella typhimurium LT2
acgcuuguacuugaua

SEQ ID NO: 1817146 - RNA, 14 nt, Salmonella typhimurium LT2
acggaugcgccauc

SEQ ID NO: 1817147 - RNA, 15 nt, Salmonella typhimurium LT2
acgcgcuaaaugcau

SEQ ID NO: 1817148 - RNA, 21 nt, Salmonella typhimurium LT2
acgcgcucaccuccgccacca

SEQ ID NO: 1817149 - RNA, 23 nt, Salmonella typhimurium LT2
acgcggauugccgcccguacaga

SEQ ID NO: 1817150 - RNA, 21 nt, Salmonella typhimurium LT2
acgcgcuaucguugcgcgcaa

SEQ ID NO: 1817151 - RNA, 20 nt, Salmonella typhimurium LT2
acgcggccaucacgcugcgg

SEQ ID NO: 1817152 - RNA, 21 nt, Salmonella typhimurium LT2
acgcuggcggcaggccuaaca

SEQ ID NO: 1817153 - RNA, 19 nt, Salmonella typhimurium LT2
acgcugcgcuuauccggcc

SEQ ID NO: 1817154 - RNA, 15 nt, Salmonella typhimurium LT2
acgcugcgucaggcg

SEQ ID NO: 1817155 - RNA, 20 nt, Salmonella typhimurium LT2
acggcagcguauacgccgga

SEQ ID NO: 1817156 - RNA, 16 nt, Salmonella typhimurium LT2
acggcagccacgccga

SEQ ID NO: 1817157 - RNA, 15 nt, Salmonella typhimurium LT2
acggcagcaccgcug

SEQ ID NO: 1817158 - RNA, 20 nt, Salmonella typhimurium LT2
acggcauagcuguuccgcaa

SEQ ID NO: 1817159 - RNA, 13 nt, Salmonella typhimurium LT2
acggcaucaggaa

SEQ ID NO: 1817160 - RNA, 15 nt, Salmonella typhimurium LT2
acggcgauaccagua

SEQ ID NO: 1817161 - RNA, 17 nt, Salmonella typhimurium LT2
acggcgccaugauccag

SEQ ID NO: 1817162 - RNA, 16 nt, Salmonella typhimurium LT2
acggcgagaccaccgu

SEQ ID NO: 1817163 - RNA, 22 nt, Salmonella typhimurium LT2
acggccugcaaacgaaucaccu

SEQ ID NO: 1817164 - RNA, 19 nt, Salmonella typhimurium LT2
acgggcauuguuaauccag

SEQ ID NO: 1817165 - RNA, 22 nt, Salmonella typhimurium LT2
acgggcaguccggcggcagccg

SEQ ID NO: 1817166 - RNA, 15 nt, Salmonella typhimurium LT2
acgggaaguaaggca

SEQ ID NO: 1817167 - RNA, 15 nt, Salmonella typhimurium LT2
acggcggucgccgca

SEQ ID NO: 1817168 - RNA, 17 nt, Salmonella typhimurium LT2
acgggcgcgcgcguuaa

SEQ ID NO: 1817169 - RNA, 16 nt, Salmonella typhimurium LT2
acgggcuaucaauaug

SEQ ID NO: 1817170 - RNA, 13 nt, Salmonella typhimurium LT2
acgggcgcugucg

SEQ ID NO: 1817171 - RNA, 13 nt, Salmonella typhimurium LT2
acguccaccguua

SEQ ID NO: 1817172 - RNA, 19 nt, Salmonella typhimurium LT2
acgucaucaugcugcugau

SEQ ID NO: 1817173 - RNA, 15 nt, Salmonella typhimurium LT2
acggucaaucaucag

SEQ ID NO: 1817174 - RNA, 21 nt, Salmonella typhimurium LT2
acggucaaacagauccagcgc

SEQ ID NO: 1817175 - RNA, 20 nt, Salmonella typhimurium LT2
acguucaauucauagagcgc

SEQ ID NO: 1817176 - RNA, 17 nt, Salmonella typhimurium LT2
acgugcucaaucgccug

SEQ ID NO: 1817177 - RNA, 15 nt, Salmonella typhimurium LT2
acguuccagcagcgc

SEQ ID NO: 1817178 - RNA, 17 nt, Salmonella typhimurium LT2
acguucagcauauccag

SEQ ID NO: 1817179 - RNA, 20 nt, Salmonella typhimurium LT2
acguucagcauauccagcgc

SEQ ID NO: 1817180 - RNA, 13 nt, Salmonella typhimurium LT2
acguucagcgcgg

SEQ ID NO: 1817181 - RNA, 19 nt, Salmonella typhimurium LT2
acguucggcaaaacgccgc

SEQ ID NO: 1817182 - RNA, 12 nt, Salmonella typhimurium LT2
acguucgcgcau

SEQ ID NO: 1817183 - RNA, 15 nt, Salmonella typhimurium LT2
acgucgucaccacgg

SEQ ID NO: 1817184 - RNA, 16 nt, Salmonella typhimurium LT2
acguugucccaggcca

SEQ ID NO: 1817185 - RNA, 22 nt, Salmonella typhimurium LT2
acguuucucaugcguaaaucgc

SEQ ID NO: 1817186 - RNA, 13 nt, Salmonella typhimurium LT2
acguucuucgaua

SEQ ID NO: 1817187 - RNA, 21 nt, Salmonella typhimurium LT2
acguucuaucagguaucccgc

SEQ ID NO: 1817188 - RNA, 20 nt, Salmonella typhimurium LT2
acguugggauuaucgcggau

SEQ ID NO: 1817189 - RNA, 17 nt, Salmonella typhimurium LT2
acguuuuucagccgcgc

SEQ ID NO: 1817190 - RNA, 22 nt, Salmonella typhimurium LT2
acuacuucuucaguuccgccag

SEQ ID NO: 1817191 - RNA, 22 nt, Salmonella typhimurium LT2
acucuuucuugaauauggcggu

SEQ ID NO: 1817192 - RNA, 17 nt, Salmonella typhimurium LT2
acucuuuggacggcauc

SEQ ID NO: 1817193 - RNA, 21 nt, Salmonella typhimurium LT2
acugaagauaaacagcagcgc

SEQ ID NO: 1817194 - RNA, 21 nt, Salmonella typhimurium LT2
acugaucgccgcugcuggcga

SEQ ID NO: 1817195 - RNA, 18 nt, Salmonella typhimurium LT2
acucgcuucacgcggauu

SEQ ID NO: 1817196 - RNA, 21 nt, Salmonella typhimurium LT2
acucgcuaaagccauugccga

SEQ ID NO: 1817197 - RNA, 21 nt, Salmonella typhimurium LT2
acucgcgcagaaucagcgugc

SEQ ID NO: 1817198 - RNA, 18 nt, Salmonella typhimurium LT2
acugcgccgccagcgaca

SEQ ID NO: 1817199 - RNA, 15 nt, Salmonella typhimurium LT2
acugcgccacaucau

SEQ ID NO: 1817200 - RNA, 13 nt, Salmonella typhimurium LT2
acugcccggcaua

SEQ ID NO: 1817201 - RNA, 17 nt, Salmonella typhimurium LT2
acugauuaaucugccga

SEQ ID NO: 1817202 - RNA, 14 nt, Salmonella typhimurium LT2
acugaugaucauug

SEQ ID NO: 1817203 - RNA, 16 nt, Salmonella typhimurium LT2
acucccgcguagcguu

SEQ ID NO: 1817204 - RNA, 15 nt, Salmonella typhimurium LT2
acuccugcgccggac

SEQ ID NO: 1817205 - RNA, 12 nt, Salmonella typhimurium LT2
acuccagcacgu

SEQ ID NO: 1817206 - RNA, 12 nt, Salmonella typhimurium LT2
acuccagacgau

SEQ ID NO: 1817207 - RNA, 14 nt, Salmonella typhimurium LT2
acuccaggaacagg

SEQ ID NO: 1817208 - RNA, 19 nt, Salmonella typhimurium LT2
acuccauaauuugaaucgc

SEQ ID NO: 1817209 - RNA, 15 nt, Salmonella typhimurium LT2
acuccauugucggca

SEQ ID NO: 1817210 - RNA, 19 nt, Salmonella typhimurium LT2
acuagcgaaucacauccgc

SEQ ID NO: 1817211 - RNA, 12 nt, Salmonella typhimurium LT2
acucaugcgccu

SEQ ID NO: 1817212 - RNA, 21 nt, Salmonella typhimurium LT2
acucauuaccggcugccgaua

SEQ ID NO: 1817213 - RNA, 18 nt, Salmonella typhimurium LT2
accugaggaagaagcgca

SEQ ID NO: 1817214 - RNA, 21 nt, Salmonella typhimurium LT2
accugauccagcucuucuucg

SEQ ID NO: 1817215 - RNA, 17 nt, Salmonella typhimurium LT2
accugcgcaaucaugac

SEQ ID NO: 1817216 - RNA, 23 nt, Salmonella typhimurium LT2
accugcgcccgcguugcgccaag

SEQ ID NO: 1817217 - RNA, 17 nt, Salmonella typhimurium LT2
accugccugaucgccac

SEQ ID NO: 1817218 - RNA, 13 nt, Salmonella typhimurium LT2
accugccgccaua

SEQ ID NO: 1817219 - RNA, 15 nt, Salmonella typhimurium LT2
accugcccuuucaga

SEQ ID NO: 1817220 - RNA, 22 nt, Salmonella typhimurium LT2
accucuugcuggguuaacgcgc

SEQ ID NO: 1817221 - RNA, 17 nt, Salmonella typhimurium LT2
accucauccaucagcgc

SEQ ID NO: 1817222 - RNA, 20 nt, Salmonella typhimurium LT2
accucacuccagaccugaag

SEQ ID NO: 1817223 - RNA, 17 nt, Salmonella typhimurium LT2
accuccacgcccagcgc

SEQ ID NO: 1817224 - RNA, 15 nt, Salmonella typhimurium LT2
accucaugcuuaucg

SEQ ID NO: 1817225 - RNA, 14 nt, Salmonella typhimurium LT2
accuaucaggauca

SEQ ID NO: 1817226 - RNA, 15 nt, Salmonella typhimurium LT2
accggucaggcagca

SEQ ID NO: 1817227 - RNA, 18 nt, Salmonella typhimurium LT2
accgguaaaggcgaccgg

SEQ ID NO: 1817228 - RNA, 21 nt, Salmonella typhimurium LT2
accuacaaucgucuucagcaa

SEQ ID NO: 1817229 - RNA, 13 nt, Salmonella typhimurium LT2
accuaccggcaua

SEQ ID NO: 1817230 - RNA, 11 nt, Salmonella typhimurium LT2
accuccgccac

SEQ ID NO: 1817231 - RNA, 17 nt, Salmonella typhimurium LT2
accuuauccggccuaca

SEQ ID NO: 1817232 - RNA, 17 nt, Salmonella typhimurium LT2
accuucacccccaucgc

SEQ ID NO: 1817233 - RNA, 18 nt, Salmonella typhimurium LT2
accuguucaugccagauu

SEQ ID NO: 1817234 - RNA, 19 nt, Salmonella typhimurium LT2
accugggucagcgucaucg

SEQ ID NO: 1817235 - RNA, 21 nt, Salmonella typhimurium LT2
acgaccugguggcgaacaaua

SEQ ID NO: 1817236 - RNA, 19 nt, Salmonella typhimurium LT2
acgaauuuacucgccaaua

SEQ ID NO: 1817237 - RNA, 20 nt, Salmonella typhimurium LT2
acgaaugucuuaaugcgguu

SEQ ID NO: 1817238 - RNA, 15 nt, Salmonella typhimurium LT2
acgaccauaaauagc

SEQ ID NO: 1817239 - RNA, 23 nt, Salmonella typhimurium LT2
acgacccuuuuuugguuauccag

SEQ ID NO: 1817240 - RNA, 12 nt, Salmonella typhimurium LT2
acgaaucaggau

SEQ ID NO: 1817241 - RNA, 17 nt, Salmonella typhimurium LT2
acgaaucucgcugccgg

SEQ ID NO: 1817242 - RNA, 18 nt, Salmonella typhimurium LT2
accuuucgccgccagaua

SEQ ID NO: 1817243 - RNA, 19 nt, Salmonella typhimurium LT2
acgcgccaucgucaccgga

SEQ ID NO: 1817244 - RNA, 15 nt, Salmonella typhimurium LT2
acgcgccacgcgcca

SEQ ID NO: 1817245 - RNA, 14 nt, Salmonella typhimurium LT2
acgcgccacgccau

SEQ ID NO: 1817246 - RNA, 17 nt, Salmonella typhimurium LT2
acgcgcaguacggcgca

SEQ ID NO: 1817247 - RNA, 17 nt, Salmonella typhimurium LT2
acgcgcagacgcgugau

SEQ ID NO: 1817248 - RNA, 19 nt, Salmonella typhimurium LT2
acgccuuauccugccuaca

SEQ ID NO: 1817249 - RNA, 21 nt, Salmonella typhimurium LT2
acgccuuauccugccuacagg

SEQ ID NO: 1817250 - RNA, 15 nt, Salmonella typhimurium LT2
acgccuuauccggcc

SEQ ID NO: 1817251 - RNA, 22 nt, Salmonella typhimurium LT2
acgccuuacccggccuacaucg

SEQ ID NO: 1817252 - RNA, 20 nt, Salmonella typhimurium LT2
acgcgaugcaaccccugacg

SEQ ID NO: 1817253 - RNA, 13 nt, Salmonella typhimurium LT2
acgcgaucgcgau

SEQ ID NO: 1817254 - RNA, 19 nt, Salmonella typhimurium LT2
acgcgauauguuugcgcgu

SEQ ID NO: 1817255 - RNA, 15 nt, Salmonella typhimurium LT2
acgccuguucaucag

SEQ ID NO: 1817256 - RNA, 17 nt, Salmonella typhimurium LT2
acgccggagaccggcga

SEQ ID NO: 1817257 - RNA, 18 nt, Salmonella typhimurium LT2
acgccggaugacgccguu

SEQ ID NO: 1817258 - RNA, 14 nt, Salmonella typhimurium LT2
acgccggaugcgag

SEQ ID NO: 1817259 - RNA, 17 nt, Salmonella typhimurium LT2
acgccggaccagacgac

SEQ ID NO: 1817260 - RNA, 16 nt, Salmonella typhimurium LT2
acgccgccgcaggcca

SEQ ID NO: 1817261 - RNA, 12 nt, Salmonella typhimurium LT2
acgccgccgcau

SEQ ID NO: 1817262 - RNA, 19 nt, Salmonella typhimurium LT2
acgccgcccagcgaacugg

SEQ ID NO: 1817263 - RNA, 19 nt, Salmonella typhimurium LT2
acgccgcuaucgaccagca

SEQ ID NO: 1817264 - RNA, 14 nt, Salmonella typhimurium LT2
acgccgauagcggc

SEQ ID NO: 1817265 - RNA, 17 nt, Salmonella typhimurium LT2
acgccgccauccggcac

SEQ ID NO: 1817266 - RNA, 19 nt, Salmonella typhimurium LT2
acgccgacucacgcagcgc

SEQ ID NO: 1817267 - RNA, 21 nt, Salmonella typhimurium LT2
acgccgacgacaggcagcguc

SEQ ID NO: 1817268 - RNA, 19 nt, Salmonella typhimurium LT2
acgacuggauacaggcgca

SEQ ID NO: 1817269 - RNA, 19 nt, Salmonella typhimurium LT2
acgauggucucaaucgcaa

SEQ ID NO: 1817270 - RNA, 23 nt, Salmonella typhimurium LT2
acgcaaucucuuccgcccagaua

SEQ ID NO: 1817271 - RNA, 13 nt, Salmonella typhimurium LT2
acgcacacggcgu

SEQ ID NO: 1817272 - RNA, 21 nt, Salmonella typhimurium LT2
acgcagacgauaccagggcga

SEQ ID NO: 1817273 - RNA, 15 nt, Salmonella typhimurium LT2
acgcaccaccugcau

SEQ ID NO: 1817274 - RNA, 15 nt, Salmonella typhimurium LT2
acgcagcaucgccau

SEQ ID NO: 1817275 - RNA, 18 nt, Salmonella typhimurium LT2
acgcagcaucucaauauc

SEQ ID NO: 1817276 - RNA, 16 nt, Salmonella typhimurium LT2
acgcagcauuucgucg

SEQ ID NO: 1817277 - RNA, 18 nt, Salmonella typhimurium LT2
acgcagcgccuuauccag

SEQ ID NO: 1817278 - RNA, 15 nt, Salmonella typhimurium LT2
acgcccgacaaucgc

SEQ ID NO: 1817279 - RNA, 18 nt, Salmonella typhimurium LT2
acgccaugcaucaauggc

SEQ ID NO: 1817280 - RNA, 20 nt, Salmonella typhimurium LT2
acgccauuccuuuaaauauc

SEQ ID NO: 1817281 - RNA, 15 nt, Salmonella typhimurium LT2
acgcccaauccggcu

SEQ ID NO: 1817282 - RNA, 13 nt, Salmonella typhimurium LT2
acgcccgccgaag

SEQ ID NO: 1817283 - RNA, 15 nt, Salmonella typhimurium LT2
acgccgaacaggcca

SEQ ID NO: 1817284 - RNA, 19 nt, Salmonella typhimurium LT2
acgccaggcacgccggcaa

SEQ ID NO: 1817285 - RNA, 21 nt, Salmonella typhimurium LT2
acgccaggcacgccggcaauc

SEQ ID NO: 1817286 - RNA, 14 nt, Salmonella typhimurium LT2
acgccaccgcuacc

SEQ ID NO: 1817287 - RNA, 20 nt, Salmonella typhimurium LT2
acgccacaaacugcgcuagc

SEQ ID NO: 1817288 - RNA, 21 nt, Salmonella typhimurium LT2
acgcauaguccugccgacagg

SEQ ID NO: 1817289 - RNA, 14 nt, Salmonella typhimurium LT2
acgcaguagcgcuu

SEQ ID NO: 1817290 - RNA, 19 nt, Salmonella typhimurium LT2
acgcagucaaaacgacaua

SEQ ID NO: 1817291 - RNA, 18 nt, Salmonella typhimurium LT2
acagcagacaaccgacgc

SEQ ID NO: 1817292 - RNA, 19 nt, Salmonella typhimurium LT2
acacuuaccgacgcguggu

SEQ ID NO: 1817293 - RNA, 21 nt, Salmonella typhimurium LT2
acacggcgccaugauccagcg

SEQ ID NO: 1817294 - RNA, 16 nt, Salmonella typhimurium LT2
acagcgcggcaggccg

SEQ ID NO: 1817295 - RNA, 17 nt, Salmonella typhimurium LT2
acagccugucgccguca

SEQ ID NO: 1817296 - RNA, 16 nt, Salmonella typhimurium LT2
acagcccauaccagcg

SEQ ID NO: 1817297 - RNA, 16 nt, Salmonella typhimurium LT2
acacacuuucugcuuu

SEQ ID NO: 1817298 - RNA, 13 nt, Salmonella typhimurium LT2
acacaccagcagg

SEQ ID NO: 1817299 - RNA, 13 nt, Salmonella typhimurium LT2
acaccgccagcgu

SEQ ID NO: 1817300 - RNA, 22 nt, Salmonella typhimurium LT2
acaccgccgcgcugaucgccac

SEQ ID NO: 1817301 - RNA, 18 nt, Salmonella typhimurium LT2
acacgcggcgcuacggcg

SEQ ID NO: 1817302 - RNA, 21 nt, Salmonella typhimurium LT2
acacgcuuccagaugaagcgc

SEQ ID NO: 1817303 - RNA, 17 nt, Salmonella typhimurium LT2
acacggaacaacggcac

SEQ ID NO: 1817304 - RNA, 15 nt, Salmonella typhimurium LT2
acacggacagcgcgc

SEQ ID NO: 1817305 - RNA, 22 nt, Salmonella typhimurium LT2
acaaagagcuccccacgaaagu

SEQ ID NO: 1817306 - RNA, 17 nt, Salmonella typhimurium LT2
aauguuaggaguaaaua

SEQ ID NO: 1817307 - RNA, 21 nt, Salmonella typhimurium LT2
aaugugcagcaggacgcgcac

SEQ ID NO: 1817308 - RNA, 12 nt, Salmonella typhimurium LT2
aauuuuuccagc

SEQ ID NO: 1817309 - RNA, 12 nt, Salmonella typhimurium LT2
aauuuuuccagu

SEQ ID NO: 1817310 - RNA, 20 nt, Salmonella typhimurium LT2
aauguugaaucccacgccgc

SEQ ID NO: 1817311 - RNA, 13 nt, Salmonella typhimurium LT2
aauguugauaagg

SEQ ID NO: 1817312 - RNA, 16 nt, Salmonella typhimurium LT2
acaaacaccgagccag

SEQ ID NO: 1817313 - RNA, 15 nt, Salmonella typhimurium LT2
aauuuuugaucugcu

SEQ ID NO: 1817314 - RNA, 16 nt, Salmonella typhimurium LT2
acaagaauuuaucgca

SEQ ID NO: 1817315 - RNA, 17 nt, Salmonella typhimurium LT2
acaagaauuuaucgcaa

SEQ ID NO: 1817316 - RNA, 12 nt, Salmonella typhimurium LT2
acaagaucgcaa

SEQ ID NO: 1817317 - RNA, 16 nt, Salmonella typhimurium LT2
acaacgccugccgcgc

SEQ ID NO: 1817318 - RNA, 22 nt, Salmonella typhimurium LT2
acaacgccugccgcgcccaguu

SEQ ID NO: 1817319 - RNA, 15 nt, Salmonella typhimurium LT2
acacaauagcaaucu

SEQ ID NO: 1817320 - RNA, 17 nt, Salmonella typhimurium LT2
acacaacacggcggcua

SEQ ID NO: 1817321 - RNA, 15 nt, Salmonella typhimurium LT2
acaauuuaucagaca

SEQ ID NO: 1817322 - RNA, 22 nt, Salmonella typhimurium LT2
acaauuucccccacuucugaca

SEQ ID NO: 1817323 - RNA, 15 nt, Salmonella typhimurium LT2
acaauuagucgggaa

SEQ ID NO: 1817324 - RNA, 16 nt, Salmonella typhimurium LT2
acaaugucaucaagau

SEQ ID NO: 1817325 - RNA, 14 nt, Salmonella typhimurium LT2
acaauccgcggcaa

SEQ ID NO: 1817326 - RNA, 21 nt, Salmonella typhimurium LT2
accaaguuuggcaaucaaauc

SEQ ID NO: 1817327 - RNA, 14 nt, Salmonella typhimurium LT2
accaauaucgccgu

SEQ ID NO: 1817328 - RNA, 16 nt, Salmonella typhimurium LT2
accaacgcccaacugu

SEQ ID NO: 1817329 - RNA, 22 nt, Salmonella typhimurium LT2
acauugagcgucaggccaucgc

SEQ ID NO: 1817330 - RNA, 14 nt, Salmonella typhimurium LT2
acauugaccagugc

SEQ ID NO: 1817331 - RNA, 20 nt, Salmonella typhimurium LT2
acauugcgccgcacuucacg

SEQ ID NO: 1817332 - RNA, 17 nt, Salmonella typhimurium LT2
acauugcgcggcgaacu

SEQ ID NO: 1817333 - RNA, 16 nt, Salmonella typhimurium LT2
acauuucgugcagucc

SEQ ID NO: 1817334 - RNA, 18 nt, Salmonella typhimurium LT2
acauuugcgcacggcgcg

SEQ ID NO: 1817335 - RNA, 19 nt, Salmonella typhimurium LT2
acaugauaagcguggcgca

SEQ ID NO: 1817336 - RNA, 12 nt, Salmonella typhimurium LT2
acauacgcgcuc

SEQ ID NO: 1817337 - RNA, 17 nt, Salmonella typhimurium LT2
acauacaccggcgccag

SEQ ID NO: 1817338 - RNA, 20 nt, Salmonella typhimurium LT2
acauaccgccgguaaggcca

SEQ ID NO: 1817339 - RNA, 19 nt, Salmonella typhimurium LT2
acauccgggccaacggcau

SEQ ID NO: 1817340 - RNA, 22 nt, Salmonella typhimurium LT2
acaucccgauaauggcgccgau

SEQ ID NO: 1817341 - RNA, 19 nt, Salmonella typhimurium LT2
acaucguguccuggguaac

SEQ ID NO: 1817342 - RNA, 16 nt, Salmonella typhimurium LT2
acaucguuggccgcca

SEQ ID NO: 1817343 - RNA, 15 nt, Salmonella typhimurium LT2
acauaaaaacgcgcu

SEQ ID NO: 1817344 - RNA, 15 nt, Salmonella typhimurium LT2
acauaaucaccgcaa

SEQ ID NO: 1817345 - RNA, 13 nt, Salmonella typhimurium LT2
acagugcgccaua

SEQ ID NO: 1817346 - RNA, 16 nt, Salmonella typhimurium LT2
acaguucacgacugau

SEQ ID NO: 1817347 - RNA, 16 nt, Salmonella typhimurium LT2
acagucaucgcgccaa

SEQ ID NO: 1817348 - RNA, 12 nt, Salmonella typhimurium LT2
acagugacagcg

SEQ ID NO: 1817349 - RNA, 15 nt, Salmonella typhimurium LT2
acagcggcgcgccaa

SEQ ID NO: 1817350 - RNA, 17 nt, Salmonella typhimurium LT2
acagcguaaugcgccag

SEQ ID NO: 1817351 - RNA, 12 nt, Salmonella typhimurium LT2
acaguacgcccg

SEQ ID NO: 1817352 - RNA, 14 nt, Salmonella typhimurium LT2
accacuucacuauc

SEQ ID NO: 1817353 - RNA, 14 nt, Salmonella typhimurium LT2
accacuuugcgguu

SEQ ID NO: 1817354 - RNA, 23 nt, Salmonella typhimurium LT2
accacucuuuggacggcaucagg

SEQ ID NO: 1817355 - RNA, 18 nt, Salmonella typhimurium LT2
accacucggcgagcagua

SEQ ID NO: 1817356 - RNA, 18 nt, Salmonella typhimurium LT2
accagcggcgucccggca

SEQ ID NO: 1817357 - RNA, 22 nt, Salmonella typhimurium LT2
accagccgauaacucuucaucg

SEQ ID NO: 1817358 - RNA, 16 nt, Salmonella typhimurium LT2
accagccgaucaucac

SEQ ID NO: 1817359 - RNA, 19 nt, Salmonella typhimurium LT2
accagcguuggugccgcca

SEQ ID NO: 1817360 - RNA, 22 nt, Salmonella typhimurium LT2
accagcguuggugccgccagau

SEQ ID NO: 1817361 - RNA, 19 nt, Salmonella typhimurium LT2
accaaugacgcuauccgca

SEQ ID NO: 1817362 - RNA, 13 nt, Salmonella typhimurium LT2
accacgugacgcc

SEQ ID NO: 1817363 - RNA, 16 nt, Salmonella typhimurium LT2
accacguuaccgcgca

SEQ ID NO: 1817364 - RNA, 16 nt, Salmonella typhimurium LT2
accacggauaagccag

SEQ ID NO: 1817365 - RNA, 22 nt, Salmonella typhimurium LT2
accggauucacauaggcguagc

SEQ ID NO: 1817366 - RNA, 15 nt, Salmonella typhimurium LT2
accggcaaauaccgu

SEQ ID NO: 1817367 - RNA, 16 nt, Salmonella typhimurium LT2
accgcuuuaugcgcuu

SEQ ID NO: 1817368 - RNA, 19 nt, Salmonella typhimurium LT2
accggaaaacagccgccau

SEQ ID NO: 1817369 - RNA, 19 nt, Salmonella typhimurium LT2
accgcuucgcgcgccaguu

SEQ ID NO: 1817370 - RNA, 15 nt, Salmonella typhimurium LT2
accgcguuuccacgc

SEQ ID NO: 1817371 - RNA, 14 nt, Salmonella typhimurium LT2
accgcuacgcaggc

SEQ ID NO: 1817372 - RNA, 14 nt, Salmonella typhimurium LT2
accgcuaucgccaa

SEQ ID NO: 1817373 - RNA, 15 nt, Salmonella typhimurium LT2
accgcgcggcguucu

SEQ ID NO: 1817374 - RNA, 17 nt, Salmonella typhimurium LT2
accggcaccagcaauga

SEQ ID NO: 1817375 - RNA, 12 nt, Salmonella typhimurium LT2
accggcgacgua

SEQ ID NO: 1817376 - RNA, 19 nt, Salmonella typhimurium LT2
accggcuaucagccgccag

SEQ ID NO: 1817377 - RNA, 20 nt, Salmonella typhimurium LT2
accgggcugcagcccuuacg

SEQ ID NO: 1817378 - RNA, 17 nt, Salmonella typhimurium LT2
accggcucgucguugaa

SEQ ID NO: 1817379 - RNA, 21 nt, Salmonella typhimurium LT2
accgccgcugcaaaucaccac

SEQ ID NO: 1817380 - RNA, 15 nt, Salmonella typhimurium LT2
accgccagccauggc

SEQ ID NO: 1817381 - RNA, 19 nt, Salmonella typhimurium LT2
accgccagcaacgcgcuaa

SEQ ID NO: 1817382 - RNA, 20 nt, Salmonella typhimurium LT2
accgccagagcacgaaaagu

SEQ ID NO: 1817383 - RNA, 16 nt, Salmonella typhimurium LT2
accgccaaacgccgca

SEQ ID NO: 1817384 - RNA, 21 nt, Salmonella typhimurium LT2
accgccagaaaagaaccgacu

SEQ ID NO: 1817385 - RNA, 18 nt, Salmonella typhimurium LT2
accgcagaaacagauagu

SEQ ID NO: 1817386 - RNA, 12 nt, Salmonella typhimurium LT2
accgacgaacaa

SEQ ID NO: 1817387 - RNA, 21 nt, Salmonella typhimurium LT2
accgcaucaaugcccagcgca

SEQ ID NO: 1817388 - RNA, 13 nt, Salmonella typhimurium LT2
accgcauacccga

SEQ ID NO: 1817389 - RNA, 18 nt, Salmonella typhimurium LT2
accgcgcaguucaauauu

SEQ ID NO: 1817390 - RNA, 16 nt, Salmonella typhimurium LT2
accgcgcaguucaaua

SEQ ID NO: 1817391 - RNA, 16 nt, Salmonella typhimurium LT2
accgccugcguuugcg

SEQ ID NO: 1817392 - RNA, 15 nt, Salmonella typhimurium LT2
accgccugcggcaua

SEQ ID NO: 1817393 - RNA, 21 nt, Salmonella typhimurium LT2
accgccucaucggcguugccc

SEQ ID NO: 1817394 - RNA, 18 nt, Salmonella typhimurium LT2
accgccguuucguugcca

SEQ ID NO: 1817395 - RNA, 17 nt, Salmonella typhimurium LT2
accgccuuguccggccu

SEQ ID NO: 1817396 - RNA, 19 nt, Salmonella typhimurium LT2
accgccuuguccggccuaa

SEQ ID NO: 1817397 - RNA, 23 nt, Salmonella typhimurium LT2
accgcgaagaucguuauccagca

SEQ ID NO: 1817398 - RNA, 16 nt, Salmonella typhimurium LT2
acccuuuaucgcgcag

SEQ ID NO: 1817399 - RNA, 19 nt, Salmonella typhimurium LT2
accgaaacagucacgcuug

SEQ ID NO: 1817400 - RNA, 19 nt, Salmonella typhimurium LT2
accgacagauagcccugau

SEQ ID NO: 1817401 - RNA, 20 nt, Salmonella typhimurium LT2
accgaaaucgguacgcgucu

SEQ ID NO: 1817402 - RNA, 15 nt, Salmonella typhimurium LT2
acccguccggcaguc

SEQ ID NO: 1817403 - RNA, 13 nt, Salmonella typhimurium LT2
accccugacgggc

SEQ ID NO: 1817404 - RNA, 16 nt, Salmonella typhimurium LT2
accccuuuagcggcau

SEQ ID NO: 1817405 - RNA, 21 nt, Salmonella typhimurium LT2
acccgcguacaggaagccggu

SEQ ID NO: 1817406 - RNA, 13 nt, Salmonella typhimurium LT2
acccggauauccg

SEQ ID NO: 1817407 - RNA, 17 nt, Salmonella typhimurium LT2
acccagcgcgacauggc

SEQ ID NO: 1817408 - RNA, 15 nt, Salmonella typhimurium LT2
acccagcgcaugagc

SEQ ID NO: 1817409 - RNA, 14 nt, Salmonella typhimurium LT2
acccaggauggcgg

SEQ ID NO: 1817410 - RNA, 12 nt, Salmonella typhimurium LT2
acccagcccaau

SEQ ID NO: 1817411 - RNA, 19 nt, Salmonella typhimurium LT2
acccagacugugauggcgg

SEQ ID NO: 1817412 - RNA, 22 nt, Salmonella typhimurium LT2
acccagccccccuaaagcucau

SEQ ID NO: 1817413 - RNA, 20 nt, Salmonella typhimurium LT2
acccacuaacugccgcugac

SEQ ID NO: 1817414 - RNA, 17 nt, Salmonella typhimurium LT2
accaggaaauaaucgag

SEQ ID NO: 1817415 - RNA, 16 nt, Salmonella typhimurium LT2
acccacgccggaaauc

SEQ ID NO: 1817416 - RNA, 16 nt, Salmonella typhimurium LT2
accccgccaaaccggc

SEQ ID NO: 1817417 - RNA, 23 nt, Salmonella typhimurium LT2
accccacccgcugauaaaauucc

SEQ ID NO: 1817418 - RNA, 20 nt, Salmonella typhimurium LT2
accccagguaaauccgccag

SEQ ID NO: 1817419 - RNA, 21 nt, Salmonella typhimurium LT2
accccagguuauucaggugga

SEQ ID NO: 1817420 - RNA, 15 nt, Salmonella typhimurium LT2
accccaucccggcaa

SEQ ID NO: 1817421 - RNA, 16 nt, Salmonella typhimurium LT2
ucggccauauccagcc

SEQ ID NO: 1817422 - RNA, 18 nt, Salmonella typhimurium LT2
ucggcagcaauacgcccg

SEQ ID NO: 1817423 - RNA, 19 nt, Salmonella typhimurium LT2
ucggcagauuaccggcaau

SEQ ID NO: 1817424 - RNA, 12 nt, Salmonella typhimurium LT2
ucggcacgcgau

SEQ ID NO: 1817425 - RNA, 18 nt, Salmonella typhimurium LT2
ucggcaauuuccggcgac

SEQ ID NO: 1817426 - RNA, 17 nt, Salmonella typhimurium LT2
ucggcaauuuccggcga

SEQ ID NO: 1817427 - RNA, 20 nt, Salmonella typhimurium LT2
ucggcacacuacgcagcggu

SEQ ID NO: 1817428 - RNA, 15 nt, Salmonella typhimurium LT2
ucggagaaauagacg

SEQ ID NO: 1817429 - RNA, 18 nt, Salmonella typhimurium LT2
aauacccuucacggucaa

SEQ ID NO: 1817430 - RNA, 17 nt, Salmonella typhimurium LT2
aauacccagcgccaacg

SEQ ID NO: 1817431 - RNA, 18 nt, Salmonella typhimurium LT2
aauaccaaagaacgcggu

SEQ ID NO: 1817432 - RNA, 16 nt, Salmonella typhimurium LT2
aauaccuuuaagcgcu

SEQ ID NO: 1817433 - RNA, 23 nt, Salmonella typhimurium LT2
ucgcgggucgguuucaguucgua

SEQ ID NO: 1817434 - RNA, 19 nt, Salmonella typhimurium LT2
ucgcgcccuccuccagcgu

SEQ ID NO: 1817435 - RNA, 24 nt, Salmonella typhimurium LT2
ucgcguacaggauguccaggcgac

SEQ ID NO: 1817436 - RNA, 17 nt, Salmonella typhimurium LT2
ucgcgguggguagcggc

SEQ ID NO: 1817437 - RNA, 15 nt, Salmonella typhimurium LT2
ucgcguacuuucgcc

SEQ ID NO: 1817438 - RNA, 24 nt, Salmonella typhimurium LT2
ucgcuaucagacugaucgccgcug

SEQ ID NO: 1817439 - RNA, 19 nt, Salmonella typhimurium LT2
ucgcucaucucaagcccca

SEQ ID NO: 1817440 - RNA, 21 nt, Salmonella typhimurium LT2
ucgcucucgugccaguaacgu

SEQ ID NO: 1817441 - RNA, 17 nt, Salmonella typhimurium LT2
ucgcgucuacgucagga

SEQ ID NO: 1817442 - RNA, 13 nt, Salmonella typhimurium LT2
ucgcguucagcgc

SEQ ID NO: 1817443 - RNA, 19 nt, Salmonella typhimurium LT2
ucgcuugcccggccuacgu

SEQ ID NO: 1817444 - RNA, 23 nt, Salmonella typhimurium LT2
ucgcuuuccauuacgcuuaucgg

SEQ ID NO: 1817445 - RNA, 21 nt, Salmonella typhimurium LT2
ucgcuugcggcugccagugac

SEQ ID NO: 1817446 - RNA, 19 nt, Salmonella typhimurium LT2
ucgcuuagcuucccgcauu

SEQ ID NO: 1817447 - RNA, 18 nt, Salmonella typhimurium LT2
ucgcuuaucgggccuaca

SEQ ID NO: 1817448 - RNA, 15 nt, Salmonella typhimurium LT2
ucgcuuaucugcugc

SEQ ID NO: 1817449 - RNA, 20 nt, Salmonella typhimurium LT2
ucgcuuaacaacuccagcaa

SEQ ID NO: 1817450 - RNA, 16 nt, Salmonella typhimurium LT2
ucgcugcguuugccgc

SEQ ID NO: 1817451 - RNA, 19 nt, Salmonella typhimurium LT2
ucgcugcguuugccgccuu

SEQ ID NO: 1817452 - RNA, 16 nt, Salmonella typhimurium LT2
ucgccaauaaugccgc

SEQ ID NO: 1817453 - RNA, 21 nt, Salmonella typhimurium LT2
ucgccaagcgguaaggcaccg

SEQ ID NO: 1817454 - RNA, 18 nt, Salmonella typhimurium LT2
ucgccaccgcgcgcuuaa

SEQ ID NO: 1817455 - RNA, 17 nt, Salmonella typhimurium LT2
ucgcauauuguaccugc

SEQ ID NO: 1817456 - RNA, 16 nt, Salmonella typhimurium LT2
ucgccaaagcguaaac

SEQ ID NO: 1817457 - RNA, 22 nt, Salmonella typhimurium LT2
ucgcauuuuuaagcuggcgaac

SEQ ID NO: 1817458 - RNA, 15 nt, Salmonella typhimurium LT2
ucgcauuuaaucgcc

SEQ ID NO: 1817459 - RNA, 21 nt, Salmonella typhimurium LT2
ucgccaaagaaacgcugaucu

SEQ ID NO: 1817460 - RNA, 20 nt, Salmonella typhimurium LT2
ucgccaaaacccagaaucag

SEQ ID NO: 1817461 - RNA, 21 nt, Salmonella typhimurium LT2
ucgcaggcccgauaagcgccg

SEQ ID NO: 1817462 - RNA, 15 nt, Salmonella typhimurium LT2
ucgccgacugccacc

SEQ ID NO: 1817463 - RNA, 14 nt, Salmonella typhimurium LT2
ucgccagaccgaaa

SEQ ID NO: 1817464 - RNA, 22 nt, Salmonella typhimurium LT2
ucgcccaccgcauagacgugcg

SEQ ID NO: 1817465 - RNA, 17 nt, Salmonella typhimurium LT2
ucgcccaaauaguccag

SEQ ID NO: 1817466 - RNA, 19 nt, Salmonella typhimurium LT2
ucgccauugcaauaccggc

SEQ ID NO: 1817467 - RNA, 13 nt, Salmonella typhimurium LT2
ucgccucccgcac

SEQ ID NO: 1817468 - RNA, 14 nt, Salmonella typhimurium LT2
ucgccuccagcgau

SEQ ID NO: 1817469 - RNA, 16 nt, Salmonella typhimurium LT2
ucgccuccagcgauag

SEQ ID NO: 1817470 - RNA, 17 nt, Salmonella typhimurium LT2
ucgccguuccauuccag

SEQ ID NO: 1817471 - RNA, 18 nt, Salmonella typhimurium LT2
ucgcgauccucauacagc

SEQ ID NO: 1817472 - RNA, 20 nt, Salmonella typhimurium LT2
ucgcgccauuugccagauag

SEQ ID NO: 1817473 - RNA, 13 nt, Salmonella typhimurium LT2
ucgcgccagcgac

SEQ ID NO: 1817474 - RNA, 19 nt, Salmonella typhimurium LT2
ucgccuuccgcaccgccag

SEQ ID NO: 1817475 - RNA, 19 nt, Salmonella typhimurium LT2
ucgccuuuuagcgcguuac

SEQ ID NO: 1817476 - RNA, 15 nt, Salmonella typhimurium LT2
ucgccuuucacgcgu

SEQ ID NO: 1817477 - RNA, 16 nt, Salmonella typhimurium LT2
ucgccuuucacgcguu

SEQ ID NO: 1817478 - RNA, 19 nt, Salmonella typhimurium LT2
ucgccuucauccgcauaac

SEQ ID NO: 1817479 - RNA, 13 nt, Salmonella typhimurium LT2
ucgccuucauccg

SEQ ID NO: 1817480 - RNA, 14 nt, Salmonella typhimurium LT2
ucgccuucacgcau

SEQ ID NO: 1817481 - RNA, 19 nt, Salmonella typhimurium LT2
ucgccuucgcccauaucca

SEQ ID NO: 1817482 - RNA, 18 nt, Salmonella typhimurium LT2
ucgccuucgccggcaaca

SEQ ID NO: 1817483 - RNA, 15 nt, Salmonella typhimurium LT2
ucgccuuccagcgac

SEQ ID NO: 1817484 - RNA, 20 nt, Salmonella typhimurium LT2
ucgagauuuuucugcgccac

SEQ ID NO: 1817485 - RNA, 21 nt, Salmonella typhimurium LT2
ucgagaugcguuggcucgcug

SEQ ID NO: 1817486 - RNA, 22 nt, Salmonella typhimurium LT2
ucgaggucagcauuucauccau

SEQ ID NO: 1817487 - RNA, 17 nt, Salmonella typhimurium LT2
ucgauccccucuuccau

SEQ ID NO: 1817488 - RNA, 14 nt, Salmonella typhimurium LT2
ucgauaaacucaug

SEQ ID NO: 1817489 - RNA, 15 nt, Salmonella typhimurium LT2
ucgacguugccaggc

SEQ ID NO: 1817490 - RNA, 18 nt, Salmonella typhimurium LT2
ucgacguugccaggcgac

SEQ ID NO: 1817491 - RNA, 13 nt, Salmonella typhimurium LT2
ucgacucgagcga

SEQ ID NO: 1817492 - RNA, 18 nt, Salmonella typhimurium LT2
ucgagaacguaaaagacg

SEQ ID NO: 1817493 - RNA, 17 nt, Salmonella typhimurium LT2
ucgacugcguuaucgcu

SEQ ID NO: 1817494 - RNA, 23 nt, Salmonella typhimurium LT2
uccgguagcaaaggcuaccggac

SEQ ID NO: 1817495 - RNA, 16 nt, Salmonella typhimurium LT2
uccggugaucggcuug

SEQ ID NO: 1817496 - RNA, 23 nt, Salmonella typhimurium LT2
uccguaggcggcuaccgccguau

SEQ ID NO: 1817497 - RNA, 17 nt, Salmonella typhimurium LT2
uccugcgcagauaccgg

SEQ ID NO: 1817498 - RNA, 20 nt, Salmonella typhimurium LT2
uccugcgggcuuagggucag

SEQ ID NO: 1817499 - RNA, 20 nt, Salmonella typhimurium LT2
uccuggauacguuccagcag

SEQ ID NO: 1817500 - RNA, 22 nt, Salmonella typhimurium LT2
uccugcacaauuuuagccgcau

SEQ ID NO: 1817501 - RNA, 17 nt, Salmonella typhimurium LT2
uccugcacuuccagcca

SEQ ID NO: 1817502 - RNA, 15 nt, Salmonella typhimurium LT2
uccucuuuuaucacc

SEQ ID NO: 1817503 - RNA, 22 nt, Salmonella typhimurium LT2
uccugaaagaguacgccgauag

SEQ ID NO: 1817504 - RNA, 16 nt, Salmonella typhimurium LT2
uccugauaauccagaa

SEQ ID NO: 1817505 - RNA, 12 nt, Salmonella typhimurium LT2
ucgaaccugcga

SEQ ID NO: 1817506 - RNA, 23 nt, Salmonella typhimurium LT2
ucgacaugggcgggauccugcaa

SEQ ID NO: 1817507 - RNA, 22 nt, Salmonella typhimurium LT2
ucgacauuaacgaugccuuaug

SEQ ID NO: 1817508 - RNA, 15 nt, Salmonella typhimurium LT2
uccuggcuugccaga

SEQ ID NO: 1817509 - RNA, 23 nt, Salmonella typhimurium LT2
uccuggugcgacaccacgcaggc

SEQ ID NO: 1817510 - RNA, 18 nt, Salmonella typhimurium LT2
uccuguagguucgguaug

SEQ ID NO: 1817511 - RNA, 15 nt, Salmonella typhimurium LT2
ucccugcaacgccug

SEQ ID NO: 1817512 - RNA, 19 nt, Salmonella typhimurium LT2
ucccugaucggccagauag

SEQ ID NO: 1817513 - RNA, 17 nt, Salmonella typhimurium LT2
ucccucaucaauacguu

SEQ ID NO: 1817514 - RNA, 21 nt, Salmonella typhimurium LT2
ucccuaagccggcaggcagcg

SEQ ID NO: 1817515 - RNA, 11 nt, Salmonella typhimurium LT2
uccccggcaac

SEQ ID NO: 1817516 - RNA, 17 nt, Salmonella typhimurium LT2
uccccgccaucuucacg

SEQ ID NO: 1817517 - RNA, 17 nt, Salmonella typhimurium LT2
ucccgccucggucagua

SEQ ID NO: 1817518 - RNA, 22 nt, Salmonella typhimurium LT2
ucccgcgacgucaauaaagccg

SEQ ID NO: 1817519 - RNA, 20 nt, Salmonella typhimurium LT2
uccccagcuaaaaacgccaa

SEQ ID NO: 1817520 - RNA, 17 nt, Salmonella typhimurium LT2
ucccccagauucugaug

SEQ ID NO: 1817521 - RNA, 22 nt, Salmonella typhimurium LT2
ucccccugauagcgagcgauag

SEQ ID NO: 1817522 - RNA, 14 nt, Salmonella typhimurium LT2
uccccaacaucauu

SEQ ID NO: 1817523 - RNA, 18 nt, Salmonella typhimurium LT2
ucccauguugcgccgaau

SEQ ID NO: 1817524 - RNA, 16 nt, Salmonella typhimurium LT2
ucccaucguaacgccg

SEQ ID NO: 1817525 - RNA, 14 nt, Salmonella typhimurium LT2
ucccaguggcgucg

SEQ ID NO: 1817526 - RNA, 15 nt, Salmonella typhimurium LT2
ucccagccgcgauga

SEQ ID NO: 1817527 - RNA, 15 nt, Salmonella typhimurium LT2
ucccagcgucgccag

SEQ ID NO: 1817528 - RNA, 11 nt, Salmonella typhimurium LT2
ucccagcgccc

SEQ ID NO: 1817529 - RNA, 13 nt, Salmonella typhimurium LT2
uccagguauugau

SEQ ID NO: 1817530 - RNA, 23 nt, Salmonella typhimurium LT2
uccagguaguguuuaagcgucag

SEQ ID NO: 1817531 - RNA, 21 nt, Salmonella typhimurium LT2
uccaggguuuaaucacgccau

SEQ ID NO: 1817532 - RNA, 21 nt, Salmonella typhimurium LT2
uccggcaagucagaccagucg

SEQ ID NO: 1817533 - RNA, 19 nt, Salmonella typhimurium LT2
uccggcaccucguccagau

SEQ ID NO: 1817534 - RNA, 21 nt, Salmonella typhimurium LT2
uccggcacggucaaucaucag

SEQ ID NO: 1817535 - RNA, 17 nt, Salmonella typhimurium LT2
uccggcacuacagcguu

SEQ ID NO: 1817536 - RNA, 18 nt, Salmonella typhimurium LT2
uccggcacuggcgcuggc

SEQ ID NO: 1817537 - RNA, 20 nt, Salmonella typhimurium LT2
uccggaugcgccucaucugc

SEQ ID NO: 1817538 - RNA, 14 nt, Salmonella typhimurium LT2
uccgcuacuaccgg

SEQ ID NO: 1817539 - RNA, 11 nt, Salmonella typhimurium LT2
uccgcguuagg

SEQ ID NO: 1817540 - RNA, 15 nt, Salmonella typhimurium LT2
uccggccuggcgcag

SEQ ID NO: 1817541 - RNA, 15 nt, Salmonella typhimurium LT2
uccggccugucagga

SEQ ID NO: 1817542 - RNA, 14 nt, Salmonella typhimurium LT2
uccggcgcgaacgg

SEQ ID NO: 1817543 - RNA, 22 nt, Salmonella typhimurium LT2
uccggcgcugugcggcgugcag

SEQ ID NO: 1817544 - RNA, 13 nt, Salmonella typhimurium LT2
ucccuugccagcg

SEQ ID NO: 1817545 - RNA, 19 nt, Salmonella typhimurium LT2
uccgaaaugaccaccgcau

SEQ ID NO: 1817546 - RNA, 15 nt, Salmonella typhimurium LT2
uccgccgccagccau

SEQ ID NO: 1817547 - RNA, 13 nt, Salmonella typhimurium LT2
uccgccgccgcaa

SEQ ID NO: 1817548 - RNA, 18 nt, Salmonella typhimurium LT2
uccgcguaaucgcgaaua

SEQ ID NO: 1817549 - RNA, 23 nt, Salmonella typhimurium LT2
uccgcgcugaugguuucggcaug

SEQ ID NO: 1817550 - RNA, 16 nt, Salmonella typhimurium LT2
uccgccuggaacccag

SEQ ID NO: 1817551 - RNA, 14 nt, Salmonella typhimurium LT2
ucggcuucaccgau

SEQ ID NO: 1817552 - RNA, 14 nt, Salmonella typhimurium LT2
ucggcuucaucaca

SEQ ID NO: 1817553 - RNA, 14 nt, Salmonella typhimurium LT2
ucgggaacgcuguc

SEQ ID NO: 1817554 - RNA, 13 nt, Salmonella typhimurium LT2
ucggcgcgcuggc

SEQ ID NO: 1817555 - RNA, 16 nt, Salmonella typhimurium LT2
ucgggcuuccagcguu

SEQ ID NO: 1817556 - RNA, 23 nt, Salmonella typhimurium LT2
ucgggcguauuuuccugccagaa

SEQ ID NO: 1817557 - RNA, 15 nt, Salmonella typhimurium LT2
ucgucgaaaccguau

SEQ ID NO: 1817558 - RNA, 21 nt, Salmonella typhimurium LT2
ucgucgaaaccguauagccgc

SEQ ID NO: 1817559 - RNA, 21 nt, Salmonella typhimurium LT2
ucgucaaaaccaaacagcgac

SEQ ID NO: 1817560 - RNA, 16 nt, Salmonella typhimurium LT2
ucgucaaacaguucag

SEQ ID NO: 1817561 - RNA, 15 nt, Salmonella typhimurium LT2
ucgucaaauuacgcc

SEQ ID NO: 1817562 - RNA, 18 nt, Salmonella typhimurium LT2
ucguagucaggcagcagg

SEQ ID NO: 1817563 - RNA, 24 nt, Salmonella typhimurium LT2
ucgguuaacaccaguuuauccgcc

SEQ ID NO: 1817564 - RNA, 18 nt, Salmonella typhimurium LT2
ucgguucgccgcgcgcau

SEQ ID NO: 1817565 - RNA, 15 nt, Salmonella typhimurium LT2
ucguagcucauggcg

SEQ ID NO: 1817566 - RNA, 15 nt, Salmonella typhimurium LT2
ucgguguaaacaggc

SEQ ID NO: 1817567 - RNA, 17 nt, Salmonella typhimurium LT2
ucgugauaaagcugacg

SEQ ID NO: 1817568 - RNA, 15 nt, Salmonella typhimurium LT2
ucgugagcgcgucau

SEQ ID NO: 1817569 - RNA, 13 nt, Salmonella typhimurium LT2
ucgugauaacgcg

SEQ ID NO: 1817570 - RNA, 14 nt, Salmonella typhimurium LT2
ucgugauagacggc

SEQ ID NO: 1817571 - RNA, 18 nt, Salmonella typhimurium LT2
ucgucuucgaccgccaua

SEQ ID NO: 1817572 - RNA, 16 nt, Salmonella typhimurium LT2
ucgugacccacacaua

SEQ ID NO: 1817573 - RNA, 14 nt, Salmonella typhimurium LT2
ucugccauuucugc

SEQ ID NO: 1817574 - RNA, 19 nt, Salmonella typhimurium LT2
ucugccaguuaucgguaau

SEQ ID NO: 1817575 - RNA, 14 nt, Salmonella typhimurium LT2
ucugcaggucacga

SEQ ID NO: 1817576 - RNA, 22 nt, Salmonella typhimurium LT2
ucugcaaugguaaaacgcuggc

SEQ ID NO: 1817577 - RNA, 18 nt, Salmonella typhimurium LT2
ucugaugagcgcagcgac

SEQ ID NO: 1817578 - RNA, 21 nt, Salmonella typhimurium LT2
ucucuucaugcauaaccgcgc

SEQ ID NO: 1817579 - RNA, 15 nt, Salmonella typhimurium LT2
ucucuucccagcgaa

SEQ ID NO: 1817580 - RNA, 13 nt, Salmonella typhimurium LT2
ucucuuuugcggc

SEQ ID NO: 1817581 - RNA, 18 nt, Salmonella typhimurium LT2
ucugacaacuauugcugc

SEQ ID NO: 1817582 - RNA, 17 nt, Salmonella typhimurium LT2
ucugauaagcgcagcgu

SEQ ID NO: 1817583 - RNA, 16 nt, Salmonella typhimurium LT2
ucugagcgcaaacauc

SEQ ID NO: 1817584 - RNA, 13 nt, Salmonella typhimurium LT2
ucucuccaguuug

SEQ ID NO: 1817585 - RNA, 20 nt, Salmonella typhimurium LT2
ucucauuguguacauccagg

SEQ ID NO: 1817586 - RNA, 14 nt, Salmonella typhimurium LT2
ucucaugcguaaau

SEQ ID NO: 1817587 - RNA, 16 nt, Salmonella typhimurium LT2
ucucaggcgagcccug

SEQ ID NO: 1817588 - RNA, 13 nt, Salmonella typhimurium LT2
ucucccgaacugu

SEQ ID NO: 1817589 - RNA, 12 nt, Salmonella typhimurium LT2
ucucgcaggcca

SEQ ID NO: 1817590 - RNA, 21 nt, Salmonella typhimurium LT2
ucuccgggaaaaacguaucca

SEQ ID NO: 1817591 - RNA, 15 nt, Salmonella typhimurium LT2
ucucgcccgccagau

SEQ ID NO: 1817592 - RNA, 16 nt, Salmonella typhimurium LT2
ugaaauccggcuuuga

SEQ ID NO: 1817593 - RNA, 14 nt, Salmonella typhimurium LT2
ugaaaucgucgcca

SEQ ID NO: 1817594 - RNA, 12 nt, Salmonella typhimurium LT2
ugaacaggcgug

SEQ ID NO: 1817595 - RNA, 15 nt, Salmonella typhimurium LT2
ugaaccaagauaaga

SEQ ID NO: 1817596 - RNA, 16 nt, Salmonella typhimurium LT2
ugaacgccaggccguu

SEQ ID NO: 1817597 - RNA, 13 nt, Salmonella typhimurium LT2
ugaaaggccauca

SEQ ID NO: 1817598 - RNA, 13 nt, Salmonella typhimurium LT2
ugaaaggcgucag

SEQ ID NO: 1817599 - RNA, 15 nt, Salmonella typhimurium LT2
ucuuugaccagcgac

SEQ ID NO: 1817600 - RNA, 22 nt, Salmonella typhimurium LT2
ucuuucccggcaauuaccgcca

SEQ ID NO: 1817601 - RNA, 22 nt, Salmonella typhimurium LT2
ucuuucccggcguaauccagcu

SEQ ID NO: 1817602 - RNA, 16 nt, Salmonella typhimurium LT2
ucuuucugccaucgcu

SEQ ID NO: 1817603 - RNA, 14 nt, Salmonella typhimurium LT2
ucuuucaacuuccg

SEQ ID NO: 1817604 - RNA, 14 nt, Salmonella typhimurium LT2
ucuucgaucgccug

SEQ ID NO: 1817605 - RNA, 24 nt, Salmonella typhimurium LT2
ucuucaucccacucaaucauuguc

SEQ ID NO: 1817606 - RNA, 15 nt, Salmonella typhimurium LT2
ucuucaaggcucaau

SEQ ID NO: 1817607 - RNA, 13 nt, Salmonella typhimurium LT2
ucuugcccggugg

SEQ ID NO: 1817608 - RNA, 21 nt, Salmonella typhimurium LT2
ucuuacccgcuuuuaaacggc

SEQ ID NO: 1817609 - RNA, 20 nt, Salmonella typhimurium LT2
ucuggcagcggcaguaaauu

SEQ ID NO: 1817610 - RNA, 15 nt, Salmonella typhimurium LT2
ucugcugauaauacu

SEQ ID NO: 1817611 - RNA, 15 nt, Salmonella typhimurium LT2
ucuggauuuggcugc

SEQ ID NO: 1817612 - RNA, 17 nt, Salmonella typhimurium LT2
ucuggcaauaaggcgau

SEQ ID NO: 1817613 - RNA, 15 nt, Salmonella typhimurium LT2
ucugcugcgggaaaa

SEQ ID NO: 1817614 - RNA, 17 nt, Salmonella typhimurium LT2
ugcauaaacgcggccau

SEQ ID NO: 1817615 - RNA, 22 nt, Salmonella typhimurium LT2
ugcauacggucaaacagaucca

SEQ ID NO: 1817616 - RNA, 18 nt, Salmonella typhimurium LT2
ugcauagaacggccuguu

SEQ ID NO: 1817617 - RNA, 22 nt, Salmonella typhimurium LT2
ugccagacgggccaggcgaccg

SEQ ID NO: 1817618 - RNA, 22 nt, Salmonella typhimurium LT2
ugcccagcgcgaccugcauccc

SEQ ID NO: 1817619 - RNA, 19 nt, Salmonella typhimurium LT2
ugcccagcucaucgaaccu

SEQ ID NO: 1817620 - RNA, 16 nt, Salmonella typhimurium LT2
ugcccacggcguagcg

SEQ ID NO: 1817621 - RNA, 12 nt, Salmonella typhimurium LT2
ugccauccucau

SEQ ID NO: 1817622 - RNA, 20 nt, Salmonella typhimurium LT2
ugccaucgcuuugagcagcg

SEQ ID NO: 1817623 - RNA, 12 nt, Salmonella typhimurium LT2
ugcccggcugua

SEQ ID NO: 1817624 - RNA, 21 nt, Salmonella typhimurium LT2
ugcccuuaaauccggccucca

SEQ ID NO: 1817625 - RNA, 14 nt, Salmonella typhimurium LT2
ugcccggccguuac

SEQ ID NO: 1817626 - RNA, 16 nt, Salmonella typhimurium LT2
ugcccggcgccauccg

SEQ ID NO: 1817627 - RNA, 19 nt, Salmonella typhimurium LT2
ugcccggcaugucgccagc

SEQ ID NO: 1817628 - RNA, 20 nt, Salmonella typhimurium LT2
ugcccggcaugucgccagcc

SEQ ID NO: 1817629 - RNA, 17 nt, Salmonella typhimurium LT2
ugcccgcgaucgagcgc

SEQ ID NO: 1817630 - RNA, 21 nt, Salmonella typhimurium LT2
ugcccgccaggguaucaucaa

SEQ ID NO: 1817631 - RNA, 20 nt, Salmonella typhimurium LT2
ugauggcguaauuaaccgcg

SEQ ID NO: 1817632 - RNA, 20 nt, Salmonella typhimurium LT2
ugcaccaaauccuccagcgg

SEQ ID NO: 1817633 - RNA, 23 nt, Salmonella typhimurium LT2
ugauguccacacugacgcgccag

SEQ ID NO: 1817634 - RNA, 14 nt, Salmonella typhimurium LT2
ugauguaccugcgu

SEQ ID NO: 1817635 - RNA, 18 nt, Salmonella typhimurium LT2
ugauguagucaucaacgc

SEQ ID NO: 1817636 - RNA, 15 nt, Salmonella typhimurium LT2
ugcacuugucgggga

SEQ ID NO: 1817637 - RNA, 17 nt, Salmonella typhimurium LT2
ugcagauuauuucacuu

SEQ ID NO: 1817638 - RNA, 19 nt, Salmonella typhimurium LT2
ugcagaugguauaaaucac

SEQ ID NO: 1817639 - RNA, 17 nt, Salmonella typhimurium LT2
ugcagcaccucgguaug

SEQ ID NO: 1817640 - RNA, 20 nt, Salmonella typhimurium LT2
ugcagauccgcgauaucaau

SEQ ID NO: 1817641 - RNA, 19 nt, Salmonella typhimurium LT2
ugcagauccuuaacgucaa

SEQ ID NO: 1817642 - RNA, 18 nt, Salmonella typhimurium LT2
ugcagccccggcggcguu

SEQ ID NO: 1817643 - RNA, 21 nt, Salmonella typhimurium LT2
ugcagcggcaguuccggcguu

SEQ ID NO: 1817644 - RNA, 14 nt, Salmonella typhimurium LT2
ugcagcgccaucca

SEQ ID NO: 1817645 - RNA, 14 nt, Salmonella typhimurium LT2
ugcagcucaagcgc

SEQ ID NO: 1817646 - RNA, 11 nt, Salmonella typhimurium LT2
ugacggcgcuc

SEQ ID NO: 1817647 - RNA, 15 nt, Salmonella typhimurium LT2
ugacgcgaucgccgu

SEQ ID NO: 1817648 - RNA, 13 nt, Salmonella typhimurium LT2
ugacgcuaacgcg

SEQ ID NO: 1817649 - RNA, 23 nt, Salmonella typhimurium LT2
ugacgauaugcugccgauugccg

SEQ ID NO: 1817650 - RNA, 17 nt, Salmonella typhimurium LT2
ugacgacuaccgccgau

SEQ ID NO: 1817651 - RNA, 20 nt, Salmonella typhimurium LT2
ugacgcagcaucucaauauc

SEQ ID NO: 1817652 - RNA, 22 nt, Salmonella typhimurium LT2
ugaccguugauucagcgucuga

SEQ ID NO: 1817653 - RNA, 14 nt, Salmonella typhimurium LT2
ugacgaaaaucauc

SEQ ID NO: 1817654 - RNA, 20 nt, Salmonella typhimurium LT2
ugacgaagccuuucaguugu

SEQ ID NO: 1817655 - RNA, 16 nt, Salmonella typhimurium LT2
ugaccuuaauccagcc

SEQ ID NO: 1817656 - RNA, 19 nt, Salmonella typhimurium LT2
ugaccgauuuguggcguua

SEQ ID NO: 1817657 - RNA, 15 nt, Salmonella typhimurium LT2
ugaccgaagcaggcg

SEQ ID NO: 1817658 - RNA, 17 nt, Salmonella typhimurium LT2
ugaccggaaaaggcgac

SEQ ID NO: 1817659 - RNA, 12 nt, Salmonella typhimurium LT2
ugaucuugcuca

SEQ ID NO: 1817660 - RNA, 20 nt, Salmonella typhimurium LT2
ugaucuggccaauuuuucac

SEQ ID NO: 1817661 - RNA, 17 nt, Salmonella typhimurium LT2
ugaucgucgcgaucgcg

SEQ ID NO: 1817662 - RNA, 15 nt, Salmonella typhimurium LT2
ugaucucaucgauca

SEQ ID NO: 1817663 - RNA, 21 nt, Salmonella typhimurium LT2
ugaucgggauuggaucgacgc

SEQ ID NO: 1817664 - RNA, 19 nt, Salmonella typhimurium LT2
ugaucgcugagcgccauca

SEQ ID NO: 1817665 - RNA, 22 nt, Salmonella typhimurium LT2
ugaugaaaaguauauaucccgc

SEQ ID NO: 1817666 - RNA, 18 nt, Salmonella typhimurium LT2
ugaugacaaagccggaua

SEQ ID NO: 1817667 - RNA, 15 nt, Salmonella typhimurium LT2
ugaugccgucgacgc

SEQ ID NO: 1817668 - RNA, 16 nt, Salmonella typhimurium LT2
ugaugaggcguaagcg

SEQ ID NO: 1817669 - RNA, 15 nt, Salmonella typhimurium LT2
ugaugacggcuggua

SEQ ID NO: 1817670 - RNA, 13 nt, Salmonella typhimurium LT2
ugaugacgcgcag

SEQ ID NO: 1817671 - RNA, 23 nt, Salmonella typhimurium LT2
ugaucagacgcacaaucgccgug

SEQ ID NO: 1817672 - RNA, 22 nt, Salmonella typhimurium LT2
ugaucagacgcacaaucgccgu

SEQ ID NO: 1817673 - RNA, 18 nt, Salmonella typhimurium LT2
ugaucgaacuugaccagc

SEQ ID NO: 1817674 - RNA, 20 nt, Salmonella typhimurium LT2
ugaucaacgccgcgccauca

SEQ ID NO: 1817675 - RNA, 16 nt, Salmonella typhimurium LT2
ugauauuuucaccucc

SEQ ID NO: 1817676 - RNA, 18 nt, Salmonella typhimurium LT2
ugaucgauagcgacggcg

SEQ ID NO: 1817677 - RNA, 16 nt, Salmonella typhimurium LT2
ugaucgcuugccacua

SEQ ID NO: 1817678 - RNA, 16 nt, Salmonella typhimurium LT2
ugaggaagaagcgcac

SEQ ID NO: 1817679 - RNA, 15 nt, Salmonella typhimurium LT2
ugagcgccauaucgg

SEQ ID NO: 1817680 - RNA, 12 nt, Salmonella typhimurium LT2
ugacuaaaucag

SEQ ID NO: 1817681 - RNA, 20 nt, Salmonella typhimurium LT2
ugacucauuucaacauaucc

SEQ ID NO: 1817682 - RNA, 18 nt, Salmonella typhimurium LT2
ugagcgaaacuccagcga

SEQ ID NO: 1817683 - RNA, 18 nt, Salmonella typhimurium LT2
ugacguuaacgcagcauc

SEQ ID NO: 1817684 - RNA, 23 nt, Salmonella typhimurium LT2
ugacguugccgaccugucgauca

SEQ ID NO: 1817685 - RNA, 22 nt, Salmonella typhimurium LT2
ugaguucaauaugugcaucggc

SEQ ID NO: 1817686 - RNA, 15 nt, Salmonella typhimurium LT2
ugauaccccagcgau

SEQ ID NO: 1817687 - RNA, 13 nt, Salmonella typhimurium LT2
ugauacccugaau

SEQ ID NO: 1817688 - RNA, 21 nt, Salmonella typhimurium LT2
ugauaacgauaagugaagcgu

SEQ ID NO: 1817689 - RNA, 16 nt, Salmonella typhimurium LT2
ugauaaaucgucggca

SEQ ID NO: 1817690 - RNA, 20 nt, Salmonella typhimurium LT2
ugauaagcgcagcgccauca

SEQ ID NO: 1817691 - RNA, 22 nt, Salmonella typhimurium LT2
ugauaauaugcucaacuuccag

SEQ ID NO: 1817692 - RNA, 17 nt, Salmonella typhimurium LT2
uaucggagguauacauc

SEQ ID NO: 1817693 - RNA, 19 nt, Salmonella typhimurium LT2
uaugcgccuucuucgcaau

SEQ ID NO: 1817694 - RNA, 17 nt, Salmonella typhimurium LT2
uaugcgccaacugcauu

SEQ ID NO: 1817695 - RNA, 21 nt, Salmonella typhimurium LT2
uaucgacucucccggcgccca

SEQ ID NO: 1817696 - RNA, 23 nt, Salmonella typhimurium LT2
uaucgaugcgccaguucagcguc

SEQ ID NO: 1817697 - RNA, 17 nt, Salmonella typhimurium LT2
uaucgccaagcgguaag

SEQ ID NO: 1817698 - RNA, 20 nt, Salmonella typhimurium LT2
uaucgcuaucaagcugauug

SEQ ID NO: 1817699 - RNA, 11 nt, Salmonella typhimurium LT2
uaucgcggcag

SEQ ID NO: 1817700 - RNA, 23 nt, Salmonella typhimurium LT2
uaucgcgacggaccggcagcguc

SEQ ID NO: 1817701 - RNA, 17 nt, Salmonella typhimurium LT2
uaucgcgagcaauuucc

SEQ ID NO: 1817702 - RNA, 15 nt, Salmonella typhimurium LT2
uaucgccgaucacaa

SEQ ID NO: 1817703 - RNA, 18 nt, Salmonella typhimurium LT2
uaucgccguaacgaacgc

SEQ ID NO: 1817704 - RNA, 21 nt, Salmonella typhimurium LT2
uaucgccguuaaauagcccca

SEQ ID NO: 1817705 - RNA, 13 nt, Salmonella typhimurium LT2
uauucucgccgua

SEQ ID NO: 1817706 - RNA, 20 nt, Salmonella typhimurium LT2
uauucugucgccaccacucg

SEQ ID NO: 1817707 - RNA, 17 nt, Salmonella typhimurium LT2
uauucuguuagcgcccu

SEQ ID NO: 1817708 - RNA, 23 nt, Salmonella typhimurium LT2
uauuccguuuuuaucggcgucgc

SEQ ID NO: 1817709 - RNA, 15 nt, Salmonella typhimurium LT2
uauucaucggcacau

SEQ ID NO: 1817710 - RNA, 13 nt, Salmonella typhimurium LT2
uauuccauacaga

SEQ ID NO: 1817711 - RNA, 18 nt, Salmonella typhimurium LT2
uauuccgaauacggacau

SEQ ID NO: 1817712 - RNA, 20 nt, Salmonella typhimurium LT2
uauuccgcucagauaacaua

SEQ ID NO: 1817713 - RNA, 16 nt, Salmonella typhimurium LT2
uauuccggcgacgcuu

SEQ ID NO: 1817714 - RNA, 14 nt, Salmonella typhimurium LT2
uauggaugaggauc

SEQ ID NO: 1817715 - RNA, 17 nt, Salmonella typhimurium LT2
uauguaccgucaucgcc

SEQ ID NO: 1817716 - RNA, 19 nt, Salmonella typhimurium LT2
uauguaccgucaucgccca

SEQ ID NO: 1817717 - RNA, 19 nt, Salmonella typhimurium LT2
uauucacuuuccgaaucag

SEQ ID NO: 1817718 - RNA, 14 nt, Salmonella typhimurium LT2
uauucaccuggaaa

SEQ ID NO: 1817719 - RNA, 14 nt, Salmonella typhimurium LT2
uauuuuccaucacg

SEQ ID NO: 1817720 - RNA, 23 nt, Salmonella typhimurium LT2
uauuucaggccaugcuuuugcag

SEQ ID NO: 1817721 - RNA, 17 nt, Salmonella typhimurium LT2
uauugagcgaaacaggu

SEQ ID NO: 1817722 - RNA, 23 nt, Salmonella typhimurium LT2
ucaacagcgcggcaggccggcag

SEQ ID NO: 1817723 - RNA, 22 nt, Salmonella typhimurium LT2
ucaacaucuuugccgcgucgau

SEQ ID NO: 1817724 - RNA, 22 nt, Salmonella typhimurium LT2
ucaacaucagcgcuaccagcgc

SEQ ID NO: 1817725 - RNA, 19 nt, Salmonella typhimurium LT2
ucaacaucauuaagccggg

SEQ ID NO: 1817726 - RNA, 14 nt, Salmonella typhimurium LT2
ucaaauuugcccag

SEQ ID NO: 1817727 - RNA, 17 nt, Salmonella typhimurium LT2
ucaaaugcguggcguau

SEQ ID NO: 1817728 - RNA, 22 nt, Salmonella typhimurium LT2
uagucaggaucgcuggcgcguu

SEQ ID NO: 1817729 - RNA, 15 nt, Salmonella typhimurium LT2
uaguccgguaucggc

SEQ ID NO: 1817730 - RNA, 24 nt, Salmonella typhimurium LT2
uaguuuaaauccagcgcgcugagc

SEQ ID NO: 1817731 - RNA, 19 nt, Salmonella typhimurium LT2
uaguuucccgguaaaucau

SEQ ID NO: 1817732 - RNA, 14 nt, Salmonella typhimurium LT2
uagugccgccaggc

SEQ ID NO: 1817733 - RNA, 18 nt, Salmonella typhimurium LT2
uaguggauggcccacugu

SEQ ID NO: 1817734 - RNA, 15 nt, Salmonella typhimurium LT2
uaguguauccagaua

SEQ ID NO: 1817735 - RNA, 20 nt, Salmonella typhimurium LT2
uagcugugagaauucugcgc

SEQ ID NO: 1817736 - RNA, 22 nt, Salmonella typhimurium LT2
uagcuuguguaggccggauaag

SEQ ID NO: 1817737 - RNA, 16 nt, Salmonella typhimurium LT2
uagcuuugccacuggc

SEQ ID NO: 1817738 - RNA, 16 nt, Salmonella typhimurium LT2
uagcuuugcgccagau

SEQ ID NO: 1817739 - RNA, 21 nt, Salmonella typhimurium LT2
uaguagcggaauaucuucccg

SEQ ID NO: 1817740 - RNA, 17 nt, Salmonella typhimurium LT2
uaguaauaaagcguagc

SEQ ID NO: 1817741 - RNA, 18 nt, Salmonella typhimurium LT2
uaguaauaaagcguagcc

SEQ ID NO: 1817742 - RNA, 18 nt, Salmonella typhimurium LT2
uauccacgcagacgccgc

SEQ ID NO: 1817743 - RNA, 20 nt, Salmonella typhimurium LT2
uaucaugaaugccccagcgc

SEQ ID NO: 1817744 - RNA, 15 nt, Salmonella typhimurium LT2
uaucaugcugauaac

SEQ ID NO: 1817745 - RNA, 18 nt, Salmonella typhimurium LT2
uauccagccacguugucg

SEQ ID NO: 1817746 - RNA, 15 nt, Salmonella typhimurium LT2
uauccugguagcgcc

SEQ ID NO: 1817747 - RNA, 21 nt, Salmonella typhimurium LT2
uauccagaucuucagaggccu

SEQ ID NO: 1817748 - RNA, 18 nt, Salmonella typhimurium LT2
uaucaaaaaaaaccagau

SEQ ID NO: 1817749 - RNA, 17 nt, Salmonella typhimurium LT2
uaucaaucauauaaucu

SEQ ID NO: 1817750 - RNA, 18 nt, Salmonella typhimurium LT2
uaucaaugccgcgagaaa

SEQ ID NO: 1817751 - RNA, 15 nt, Salmonella typhimurium LT2
uaucaaugcgcguaa

SEQ ID NO: 1817752 - RNA, 19 nt, Salmonella typhimurium LT2
uaucaucagcacgaauugu

SEQ ID NO: 1817753 - RNA, 22 nt, Salmonella typhimurium LT2
uauaaccgucgcccguccgcua

SEQ ID NO: 1817754 - RNA, 13 nt, Salmonella typhimurium LT2
uauaaaccugauu

SEQ ID NO: 1817755 - RNA, 22 nt, Salmonella typhimurium LT2
uauagcaaucauaaagcgcccg

SEQ ID NO: 1817756 - RNA, 17 nt, Salmonella typhimurium LT2
uauaaucccgcggcgga

SEQ ID NO: 1817757 - RNA, 20 nt, Salmonella typhimurium LT2
uauagccgcguuugaguagc

SEQ ID NO: 1817758 - RNA, 19 nt, Salmonella typhimurium LT2
uacuuaacacccguagccc

SEQ ID NO: 1817759 - RNA, 14 nt, Salmonella typhimurium LT2
uacucgccaauauc

SEQ ID NO: 1817760 - RNA, 23 nt, Salmonella typhimurium LT2
uacggacguggggguucaagucc

SEQ ID NO: 1817761 - RNA, 23 nt, Salmonella typhimurium LT2
uacggagcaaaaaacgagaacac

SEQ ID NO: 1817762 - RNA, 16 nt, Salmonella typhimurium LT2
uacggauguacucauc

SEQ ID NO: 1817763 - RNA, 14 nt, Salmonella typhimurium LT2
uacgcuucauaucc

SEQ ID NO: 1817764 - RNA, 16 nt, Salmonella typhimurium LT2
uacgcuuccugccgug

SEQ ID NO: 1817765 - RNA, 18 nt, Salmonella typhimurium LT2
uacgcuuaauggcgucaa

SEQ ID NO: 1817766 - RNA, 19 nt, Salmonella typhimurium LT2
uacgcuuaucaggccuaca

SEQ ID NO: 1817767 - RNA, 21 nt, Salmonella typhimurium LT2
uacgcuuaucccagccgcgau

SEQ ID NO: 1817768 - RNA, 18 nt, Salmonella typhimurium LT2
uagacgucgcguacaauu

SEQ ID NO: 1817769 - RNA, 15 nt, Salmonella typhimurium LT2
uagccgggguaauau

SEQ ID NO: 1817770 - RNA, 20 nt, Salmonella typhimurium LT2
uagcgcagucaagcuugccg

SEQ ID NO: 1817771 - RNA, 21 nt, Salmonella typhimurium LT2
uagcgccuuauccggccuacg

SEQ ID NO: 1817772 - RNA, 17 nt, Salmonella typhimurium LT2
uagccagagcgcgcugg

SEQ ID NO: 1817773 - RNA, 17 nt, Salmonella typhimurium LT2
uagccaguucgccuucu

SEQ ID NO: 1817774 - RNA, 13 nt, Salmonella typhimurium LT2
uagccaucggcau

SEQ ID NO: 1817775 - RNA, 21 nt, Salmonella typhimurium LT2
uagccccuuaucaaaggcguc

SEQ ID NO: 1817776 - RNA, 14 nt, Salmonella typhimurium LT2
uagcccauccagca

SEQ ID NO: 1817777 - RNA, 15 nt, Salmonella typhimurium LT2
uagccaaaagcgcca

SEQ ID NO: 1817778 - RNA, 21 nt, Salmonella typhimurium LT2
uagccaaaagcgccacgcguc

SEQ ID NO: 1817779 - RNA, 20 nt, Salmonella typhimurium LT2
uagccacagauuaugcagcu

SEQ ID NO: 1817780 - RNA, 15 nt, Salmonella typhimurium LT2
uagccaauaacgucu

SEQ ID NO: 1817781 - RNA, 15 nt, Salmonella typhimurium LT2
uagauguaagcaauu

SEQ ID NO: 1817782 - RNA, 23 nt, Salmonella typhimurium LT2
uaccugauccagcucuucuucgc

SEQ ID NO: 1817783 - RNA, 19 nt, Salmonella typhimurium LT2
uaccugccugucacgcagg

SEQ ID NO: 1817784 - RNA, 17 nt, Salmonella typhimurium LT2
uaccguuggaauaaauc

SEQ ID NO: 1817785 - RNA, 16 nt, Salmonella typhimurium LT2
uacgcuuaucaggccu

SEQ ID NO: 1817786 - RNA, 21 nt, Salmonella typhimurium LT2
uacgcugcaacccgccgccau

SEQ ID NO: 1817787 - RNA, 20 nt, Salmonella typhimurium LT2
uacgccuuacccggccuaca

SEQ ID NO: 1817788 - RNA, 15 nt, Salmonella typhimurium LT2
uacgccgauagcggc

SEQ ID NO: 1817789 - RNA, 11 nt, Salmonella typhimurium LT2
uacgccggaua

SEQ ID NO: 1817790 - RNA, 14 nt, Salmonella typhimurium LT2
uacgcccacgcggc

SEQ ID NO: 1817791 - RNA, 15 nt, Salmonella typhimurium LT2
uaccggcaucacgcc

SEQ ID NO: 1817792 - RNA, 22 nt, Salmonella typhimurium LT2
uaccgcgguauuuaccgaacgg

SEQ ID NO: 1817793 - RNA, 20 nt, Salmonella typhimurium LT2
uaccgcuucccacagucggc

SEQ ID NO: 1817794 - RNA, 13 nt, Salmonella typhimurium LT2
uaccgccaaucaa

SEQ ID NO: 1817795 - RNA, 20 nt, Salmonella typhimurium LT2
uaccgccuuguccggccuaa

SEQ ID NO: 1817796 - RNA, 17 nt, Salmonella typhimurium LT2
uaccgggcgcaaucauc

SEQ ID NO: 1817797 - RNA, 19 nt, Salmonella typhimurium LT2
uaccgggcgcaaucaucac

SEQ ID NO: 1817798 - RNA, 21 nt, Salmonella typhimurium LT2
uaccgguuaacucgaccagaa

SEQ ID NO: 1817799 - RNA, 15 nt, Salmonella typhimurium LT2
uaccgucgagaaacc

SEQ ID NO: 1817800 - RNA, 19 nt, Salmonella typhimurium LT2
uacaaaaaagacagcaucu

SEQ ID NO: 1817801 - RNA, 14 nt, Salmonella typhimurium LT2
uaccauaccaggcg

SEQ ID NO: 1817802 - RNA, 22 nt, Salmonella typhimurium LT2
uaccaguuggucgcguuuaccu

SEQ ID NO: 1817803 - RNA, 23 nt, Salmonella typhimurium LT2
uaccaggcggcuuuuucaucauc

SEQ ID NO: 1817804 - RNA, 23 nt, Salmonella typhimurium LT2
uacaaacgcaccgccaaacgcgg

SEQ ID NO: 1817805 - RNA, 19 nt, Salmonella typhimurium LT2
uacccacuucuuccagcgu

SEQ ID NO: 1817806 - RNA, 20 nt, Salmonella typhimurium LT2
uaccauugcccauucguaau

SEQ ID NO: 1817807 - RNA, 23 nt, Salmonella typhimurium LT2
uaccccgccugacgaaaaucauc

SEQ ID NO: 1817808 - RNA, 19 nt, Salmonella typhimurium LT2
uacccgccgauaaacgcgu

SEQ ID NO: 1817809 - RNA, 14 nt, Salmonella typhimurium LT2
uacccggcucccau

SEQ ID NO: 1817810 - RNA, 17 nt, Salmonella typhimurium LT2
uacccggccuacacauc

SEQ ID NO: 1817811 - RNA, 18 nt, Salmonella typhimurium LT2
uaccgaaaauagccugaa

SEQ ID NO: 1817812 - RNA, 15 nt, Salmonella typhimurium LT2
uaccgccaaacgccg

SEQ ID NO: 1817813 - RNA, 14 nt, Salmonella typhimurium LT2
uaccgauagcgcgg

SEQ ID NO: 1817814 - RNA, 19 nt, Salmonella typhimurium LT2
uaccgauaauuaagccggu

SEQ ID NO: 1817815 - RNA, 15 nt, Salmonella typhimurium LT2
ucaggcuaaggcguc

SEQ ID NO: 1817816 - RNA, 21 nt, Salmonella typhimurium LT2
ucagggcgacgaaucagcgau

SEQ ID NO: 1817817 - RNA, 22 nt, Salmonella typhimurium LT2
ucagguaaguguaaguucauuu

SEQ ID NO: 1817818 - RNA, 18 nt, Salmonella typhimurium LT2
ucagguuaugcgcgccaa

SEQ ID NO: 1817819 - RNA, 17 nt, Salmonella typhimurium LT2
ucaggcgaccaauaucc

SEQ ID NO: 1817820 - RNA, 15 nt, Salmonella typhimurium LT2
ucaggcugcggauga

SEQ ID NO: 1817821 - RNA, 17 nt, Salmonella typhimurium LT2
ucaggcgcacgaccuga

SEQ ID NO: 1817822 - RNA, 14 nt, Salmonella typhimurium LT2
ucaggcgcaucuga

SEQ ID NO: 1817823 - RNA, 13 nt, Salmonella typhimurium LT2
ucagucauaaucc

SEQ ID NO: 1817824 - RNA, 20 nt, Salmonella typhimurium LT2
ucagugauggauuucacaau

SEQ ID NO: 1817825 - RNA, 20 nt, Salmonella typhimurium LT2
ucaguggcguagcguacugc

SEQ ID NO: 1817826 - RNA, 14 nt, Salmonella typhimurium LT2
ucaguucacgcgcc

SEQ ID NO: 1817827 - RNA, 13 nt, Salmonella typhimurium LT2
ucauauuaucgcg

SEQ ID NO: 1817828 - RNA, 17 nt, Salmonella typhimurium LT2
ucauauugcccaucgcg

SEQ ID NO: 1817829 - RNA, 13 nt, Salmonella typhimurium LT2
ucaucaaguaccg

SEQ ID NO: 1817830 - RNA, 14 nt, Salmonella typhimurium LT2
ucaucacaucgcgc

SEQ ID NO: 1817831 - RNA, 20 nt, Salmonella typhimurium LT2
ucaucaauaccguccagcgc

SEQ ID NO: 1817832 - RNA, 18 nt, Salmonella typhimurium LT2
ucauccacggcaucaaua

SEQ ID NO: 1817833 - RNA, 16 nt, Salmonella typhimurium LT2
ucaucaccuccagcac

SEQ ID NO: 1817834 - RNA, 22 nt, Salmonella typhimurium LT2
ucauccagcaauaacacaggcg

SEQ ID NO: 1817835 - RNA, 11 nt, Salmonella typhimurium LT2
ucauccagcag

SEQ ID NO: 1817836 - RNA, 14 nt, Salmonella typhimurium LT2
ucauccaucagcgc

SEQ ID NO: 1817837 - RNA, 22 nt, Salmonella typhimurium LT2
ucaucccgguuugggcgcgaaa

SEQ ID NO: 1817838 - RNA, 13 nt, Salmonella typhimurium LT2
ucauccgcguaau

SEQ ID NO: 1817839 - RNA, 22 nt, Salmonella typhimurium LT2
ucaucgccacaugcggcaggcu

SEQ ID NO: 1817840 - RNA, 18 nt, Salmonella typhimurium LT2
ucaucgcucaucagcuuc

SEQ ID NO: 1817841 - RNA, 17 nt, Salmonella typhimurium LT2
ucaucgcuugcccagca

SEQ ID NO: 1817842 - RNA, 16 nt, Salmonella typhimurium LT2
uccaacugucgccauc

SEQ ID NO: 1817843 - RNA, 18 nt, Salmonella typhimurium LT2
ucauggcguucgccgcau

SEQ ID NO: 1817844 - RNA, 16 nt, Salmonella typhimurium LT2
ucaugauaucgccugc

SEQ ID NO: 1817845 - RNA, 15 nt, Salmonella typhimurium LT2
ucaugcccggcaaac

SEQ ID NO: 1817846 - RNA, 20 nt, Salmonella typhimurium LT2
ucaugcguagcaugaucggc

SEQ ID NO: 1817847 - RNA, 23 nt, Salmonella typhimurium LT2
ucaugcugcaccgcaucaaacuc

SEQ ID NO: 1817848 - RNA, 21 nt, Salmonella typhimurium LT2
uccaccagcccaucuuucgcc

SEQ ID NO: 1817849 - RNA, 22 nt, Salmonella typhimurium LT2
uccaccacgacgagacguuggg

SEQ ID NO: 1817850 - RNA, 14 nt, Salmonella typhimurium LT2
uccaccccagcauu

SEQ ID NO: 1817851 - RNA, 13 nt, Salmonella typhimurium LT2
uccaccauucgcg

SEQ ID NO: 1817852 - RNA, 15 nt, Salmonella typhimurium LT2
uccacccuggcgcag

SEQ ID NO: 1817853 - RNA, 20 nt, Salmonella typhimurium LT2
uccagcuguuuaagcgccuc

SEQ ID NO: 1817854 - RNA, 19 nt, Salmonella typhimurium LT2
uccaggccgucggcgccag

SEQ ID NO: 1817855 - RNA, 19 nt, Salmonella typhimurium LT2
uccaggccagauauugccg

SEQ ID NO: 1817856 - RNA, 22 nt, Salmonella typhimurium LT2
uccaggaacaggcccgccagac

SEQ ID NO: 1817857 - RNA, 22 nt, Salmonella typhimurium LT2
uccaggaugaccaguuaagcaa

SEQ ID NO: 1817858 - RNA, 22 nt, Salmonella typhimurium LT2
uccacgguacuggugcccgcaa

SEQ ID NO: 1817859 - RNA, 19 nt, Salmonella typhimurium LT2
uccacgccgcuaucgacca

SEQ ID NO: 1817860 - RNA, 20 nt, Salmonella typhimurium LT2
uccacgcccagcgccgggaa

SEQ ID NO: 1817861 - RNA, 23 nt, Salmonella typhimurium LT2
ucacaucaucgccaagcggcaau

SEQ ID NO: 1817862 - RNA, 11 nt, Salmonella typhimurium LT2
ucaacgggcga

SEQ ID NO: 1817863 - RNA, 16 nt, Salmonella typhimurium LT2
ucaacgucuugccaug

SEQ ID NO: 1817864 - RNA, 13 nt, Salmonella typhimurium LT2
ucaacgcguaccg

SEQ ID NO: 1817865 - RNA, 20 nt, Salmonella typhimurium LT2
ucaacgcguucauccagcgc

SEQ ID NO: 1817866 - RNA, 14 nt, Salmonella typhimurium LT2
ucaacgcguugccu

SEQ ID NO: 1817867 - RNA, 17 nt, Salmonella typhimurium LT2
ucaacgccgccaggaua

SEQ ID NO: 1817868 - RNA, 16 nt, Salmonella typhimurium LT2
ucaacgccgcgcguaa

SEQ ID NO: 1817869 - RNA, 16 nt, Salmonella typhimurium LT2
ucaacgccaggcagaa

SEQ ID NO: 1817870 - RNA, 21 nt, Salmonella typhimurium LT2
ucaacgccacaccgagacaga

SEQ ID NO: 1817871 - RNA, 17 nt, Salmonella typhimurium LT2
ucaccauucccagcgcc

SEQ ID NO: 1817872 - RNA, 19 nt, Salmonella typhimurium LT2
ucaccacgcgcacgcccau

SEQ ID NO: 1817873 - RNA, 18 nt, Salmonella typhimurium LT2
ucaccacuguauuccguu

SEQ ID NO: 1817874 - RNA, 21 nt, Salmonella typhimurium LT2
ucaccacuuugcgguuacguu

SEQ ID NO: 1817875 - RNA, 16 nt, Salmonella typhimurium LT2
ucaccagagcaucaau

SEQ ID NO: 1817876 - RNA, 23 nt, Salmonella typhimurium LT2
ucaccagagcaucaauggugaau

SEQ ID NO: 1817877 - RNA, 18 nt, Salmonella typhimurium LT2
ucaccuccagcacgcgcu

SEQ ID NO: 1817878 - RNA, 12 nt, Salmonella typhimurium LT2
ucacccagacuu

SEQ ID NO: 1817879 - RNA, 16 nt, Salmonella typhimurium LT2
ucacccggauacgcgg

SEQ ID NO: 1817880 - RNA, 19 nt, Salmonella typhimurium LT2
ucagcaggcuacgguacug

SEQ ID NO: 1817881 - RNA, 19 nt, Salmonella typhimurium LT2
ucagcaccuuugaacgucg

SEQ ID NO: 1817882 - RNA, 16 nt, Salmonella typhimurium LT2
ucagcgauugcgccag

SEQ ID NO: 1817883 - RNA, 17 nt, Salmonella typhimurium LT2
ucagcgcggcagccgga

SEQ ID NO: 1817884 - RNA, 23 nt, Salmonella typhimurium LT2
ucagcggcgcgccgcucgacaug

SEQ ID NO: 1817885 - RNA, 15 nt, Salmonella typhimurium LT2
ucagcggcgccgcaa

SEQ ID NO: 1817886 - RNA, 22 nt, Salmonella typhimurium LT2
ucacugucgccaggccaucgcc

SEQ ID NO: 1817887 - RNA, 22 nt, Salmonella typhimurium LT2
ucagaccauaguccaugcccaa

SEQ ID NO: 1817888 - RNA, 17 nt, Salmonella typhimurium LT2
ucagaaucagauccgcg

SEQ ID NO: 1817889 - RNA, 18 nt, Salmonella typhimurium LT2
ucagaccgagacccagcg

SEQ ID NO: 1817890 - RNA, 23 nt, Salmonella typhimurium LT2
ucagaccgagacccagcgcgaau

SEQ ID NO: 1817891 - RNA, 15 nt, Salmonella typhimurium LT2
ucagcaaaaucacgc

SEQ ID NO: 1817892 - RNA, 17 nt, Salmonella typhimurium LT2
ucagcaauuucucgccc

SEQ ID NO: 1817893 - RNA, 18 nt, Salmonella typhimurium LT2
ucacgcggauugccgccc

SEQ ID NO: 1817894 - RNA, 15 nt, Salmonella typhimurium LT2
ucacgcgaagcgccg

SEQ ID NO: 1817895 - RNA, 20 nt, Salmonella typhimurium LT2
ucacuccuuagauuaaucac

SEQ ID NO: 1817896 - RNA, 22 nt, Salmonella typhimurium LT2
gugaugcggacgcugacgccag

SEQ ID NO: 1817897 - RNA, 16 nt, Salmonella typhimurium LT2
gugauuaacagcgcca

SEQ ID NO: 1817898 - RNA, 22 nt, Salmonella typhimurium LT2
gugauuccuuugaaaucgaaca

SEQ ID NO: 1817899 - RNA, 18 nt, Salmonella typhimurium LT2
aagugccagcacuaacga

SEQ ID NO: 1817900 - RNA, 14 nt, Salmonella typhimurium LT2
aagugcaucgccag

SEQ ID NO: 1817901 - RNA, 16 nt, Salmonella typhimurium LT2
gugccggcgauaaccc

SEQ ID NO: 1817902 - RNA, 13 nt, Salmonella typhimurium LT2
gugcgcgccaccg

SEQ ID NO: 1817903 - RNA, 18 nt, Salmonella typhimurium LT2
gugcgcuaaaaccaaugc

SEQ ID NO: 1817904 - RNA, 21 nt, Salmonella typhimurium LT2
gugcucacggcacgcccuucg

SEQ ID NO: 1817905 - RNA, 23 nt, Salmonella typhimurium LT2
guggcgcaguuuacgcagcgccu

SEQ ID NO: 1817906 - RNA, 18 nt, Salmonella typhimurium LT2
guggcgccaugcuuuccg

SEQ ID NO: 1817907 - RNA, 19 nt, Salmonella typhimurium LT2
guggcgcugucgcuuaccg

SEQ ID NO: 1817908 - RNA, 18 nt, Salmonella typhimurium LT2
guggcgcugcgcuuaccg

SEQ ID NO: 1817909 - RNA, 19 nt, Salmonella typhimurium LT2
guggcgcggacgcuuaccg

SEQ ID NO: 1817910 - RNA, 19 nt, Salmonella typhimurium LT2
guggcuaacgggcugaccg

SEQ ID NO: 1817911 - RNA, 17 nt, Salmonella typhimurium LT2
guggcugaagagcgacu

SEQ ID NO: 1817912 - RNA, 23 nt, Salmonella typhimurium LT2
gugggauugcagcagaucgacau

SEQ ID NO: 1817913 - RNA, 21 nt, Salmonella typhimurium LT2
guggcgaaauugguagacgca

SEQ ID NO: 1817914 - RNA, 20 nt, Salmonella typhimurium LT2
guggcgacaaaagccagaua

SEQ ID NO: 1817915 - RNA, 21 nt, Salmonella typhimurium LT2
guggccagcaugcccgccagc

SEQ ID NO: 1817916 - RNA, 18 nt, Salmonella typhimurium LT2
guggccaucuuccagcau

SEQ ID NO: 1817917 - RNA, 22 nt, Salmonella typhimurium LT2
gugucuucccugaccagcgacg

SEQ ID NO: 1817918 - RNA, 21 nt, Salmonella typhimurium LT2
guguuccuuacuguagcgccg

SEQ ID NO: 1817919 - RNA, 21 nt, Salmonella typhimurium LT2
gugugacagcaacaucuauca

SEQ ID NO: 1817920 - RNA, 21 nt, Salmonella typhimurium LT2
guggugauucaaauccuggaa

SEQ ID NO: 1817921 - RNA, 24 nt, Salmonella typhimurium LT2
guuacgcgcugcaaauacugcuuu

SEQ ID NO: 1817922 - RNA, 19 nt, Salmonella typhimurium LT2
guuacccuauuuugcgccu

SEQ ID NO: 1817923 - RNA, 15 nt, Salmonella typhimurium LT2
aaguucauauggcgu

SEQ ID NO: 1817924 - RNA, 20 nt, Salmonella typhimurium LT2
guucaaaaugcccgcauugc

SEQ ID NO: 1817925 - RNA, 15 nt, Salmonella typhimurium LT2
guuaaucucacgcuc

SEQ ID NO: 1817926 - RNA, 15 nt, Salmonella typhimurium LT2
guuaauucuggcaau

SEQ ID NO: 1817927 - RNA, 13 nt, Salmonella typhimurium LT2
guuaagacgcuuc

SEQ ID NO: 1817928 - RNA, 19 nt, Salmonella typhimurium LT2
guuaaggggcaggcgucaa

SEQ ID NO: 1817929 - RNA, 17 nt, Salmonella typhimurium LT2
guuaagcauuucgccag

SEQ ID NO: 1817930 - RNA, 12 nt, Salmonella typhimurium LT2
guuaauacgccg

SEQ ID NO: 1817931 - RNA, 17 nt, Salmonella typhimurium LT2
guuaaagccgaccaucg

SEQ ID NO: 1817932 - RNA, 20 nt, Salmonella typhimurium LT2
guucugaacuguaaccggcg

SEQ ID NO: 1817933 - RNA, 17 nt, Salmonella typhimurium LT2
guugacaccacggcaau

SEQ ID NO: 1817934 - RNA, 15 nt, Salmonella typhimurium LT2
guugaauuacccguc

SEQ ID NO: 1817935 - RNA, 18 nt, Salmonella typhimurium LT2
guugacaucgcacgccuu

SEQ ID NO: 1817936 - RNA, 19 nt, Salmonella typhimurium LT2
guugaccagguugccagcg

SEQ ID NO: 1817937 - RNA, 17 nt, Salmonella typhimurium LT2
guugacuuaaaaagcgg

SEQ ID NO: 1817938 - RNA, 17 nt, Salmonella typhimurium LT2
guucguuaacccggcau

SEQ ID NO: 1817939 - RNA, 21 nt, Salmonella typhimurium LT2
guucgcugcauuguuccugcu

SEQ ID NO: 1817940 - RNA, 23 nt, Salmonella typhimurium LT2
guucgcgcgugguaucgcggcag

SEQ ID NO: 1817941 - RNA, 16 nt, Salmonella typhimurium LT2
guucgcggaacggcga

SEQ ID NO: 1817942 - RNA, 15 nt, Salmonella typhimurium LT2
guucgccgcgcgcau

SEQ ID NO: 1817943 - RNA, 23 nt, Salmonella typhimurium LT2
guucgcauugguaucggcaggca

SEQ ID NO: 1817944 - RNA, 12 nt, Salmonella typhimurium LT2
guucgccacggu

SEQ ID NO: 1817945 - RNA, 13 nt, Salmonella typhimurium LT2
guucgcaacauuc

SEQ ID NO: 1817946 - RNA, 23 nt, Salmonella typhimurium LT2
guucaauauucgcgccuagcgcg

SEQ ID NO: 1817947 - RNA, 20 nt, Salmonella typhimurium LT2
guucaacgucagcuggaaug

SEQ ID NO: 1817948 - RNA, 14 nt, Salmonella typhimurium LT2
guuauugaccaucg

SEQ ID NO: 1817949 - RNA, 20 nt, Salmonella typhimurium LT2
guuauugagaaaauuacgcc

SEQ ID NO: 1817950 - RNA, 21 nt, Salmonella typhimurium LT2
guugcgcaagcacugaaugcu

SEQ ID NO: 1817951 - RNA, 17 nt, Salmonella typhimurium LT2
guugagcagcgcgauau

SEQ ID NO: 1817952 - RNA, 13 nt, Salmonella typhimurium LT2
guugcgccaccau

SEQ ID NO: 1817953 - RNA, 14 nt, Salmonella typhimurium LT2
guuggcauccugug

SEQ ID NO: 1817954 - RNA, 23 nt, Salmonella typhimurium LT2
guuggcaacccguaccuccagcg

SEQ ID NO: 1817955 - RNA, 14 nt, Salmonella typhimurium LT2
guuggauugcaucc

SEQ ID NO: 1817956 - RNA, 12 nt, Salmonella typhimurium LT2
guuggccgccag

SEQ ID NO: 1817957 - RNA, 19 nt, Salmonella typhimurium LT2
guuggcugucgauuuccgg

SEQ ID NO: 1817958 - RNA, 19 nt, Salmonella typhimurium LT2
guugucggcucauccagca

SEQ ID NO: 1817959 - RNA, 17 nt, Salmonella typhimurium LT2
guuguuccagcagcuca

SEQ ID NO: 1817960 - RNA, 15 nt, Salmonella typhimurium LT2
guuguugacaccacg

SEQ ID NO: 1817961 - RNA, 14 nt, Salmonella typhimurium LT2
guuuaaauccagcg

SEQ ID NO: 1817962 - RNA, 21 nt, Salmonella typhimurium LT2
guuuacccacuucuuccagcg

SEQ ID NO: 1817963 - RNA, 17 nt, Salmonella typhimurium LT2
guuuacguagcagcgcg

SEQ ID NO: 1817964 - RNA, 18 nt, Salmonella typhimurium LT2
uaagcaacugauuaaucu

SEQ ID NO: 1817965 - RNA, 19 nt, Salmonella typhimurium LT2
uaagcaauuacggacagaa

SEQ ID NO: 1817966 - RNA, 18 nt, Salmonella typhimurium LT2
uaagcaccugcgacgcau

SEQ ID NO: 1817967 - RNA, 17 nt, Salmonella typhimurium LT2
uaagacguuuacgccgc

SEQ ID NO: 1817968 - RNA, 16 nt, Salmonella typhimurium LT2
uaagacgcuacgcguc

SEQ ID NO: 1817969 - RNA, 20 nt, Salmonella typhimurium LT2
uaagaaugcgcgucaggcca

SEQ ID NO: 1817970 - RNA, 13 nt, Salmonella typhimurium LT2
uaaccuugcccau

SEQ ID NO: 1817971 - RNA, 18 nt, Salmonella typhimurium LT2
uaauacacaauacgccga

SEQ ID NO: 1817972 - RNA, 21 nt, Salmonella typhimurium LT2
uaauaccgugcaggacagaca

SEQ ID NO: 1817973 - RNA, 15 nt, Salmonella typhimurium LT2
uaaggacauucagca

SEQ ID NO: 1817974 - RNA, 23 nt, Salmonella typhimurium LT2
uaagcuggcgaacguuacccggc

SEQ ID NO: 1817975 - RNA, 14 nt, Salmonella typhimurium LT2
uaauuugaaucgcc

SEQ ID NO: 1817976 - RNA, 14 nt, Salmonella typhimurium LT2
uaauucaaccggcg

SEQ ID NO: 1817977 - RNA, 21 nt, Salmonella typhimurium LT2
uaauuauuccauuuuaaccuu

SEQ ID NO: 1817978 - RNA, 12 nt, Salmonella typhimurium LT2
uaauggcgucaa

SEQ ID NO: 1817979 - RNA, 16 nt, Salmonella typhimurium LT2
uaaugcuuaauucaua

SEQ ID NO: 1817980 - RNA, 22 nt, Salmonella typhimurium LT2
uaaugaucguaugcagccaggc

SEQ ID NO: 1817981 - RNA, 16 nt, Salmonella typhimurium LT2
uaaugauuguccagcc

SEQ ID NO: 1817982 - RNA, 13 nt, Salmonella typhimurium LT2
uaaugaucagcgc

SEQ ID NO: 1817983 - RNA, 14 nt, Salmonella typhimurium LT2
uaaugaucagcgcu

SEQ ID NO: 1817984 - RNA, 22 nt, Salmonella typhimurium LT2
uaauccggcgaggcgauaaucu

SEQ ID NO: 1817985 - RNA, 21 nt, Salmonella typhimurium LT2
uaaucgccauugcaauaccgg
